United States Patent 7,323,308 (METHODS OF GENETIC ANALYSIS OF E. COLI) - sequence listing, part 5

SEQ ID NO: 164317 - DNA, 25 bp, E. coli
tcgccggaacatctccacgttgagt

SEQ ID NO: 164318 - DNA, 25 bp, E. coli
tcgccggaacatgtccacgttgagt

SEQ ID NO: 164319 - DNA, 25 bp, E. coli
gaagcaacgggacagattaacggca

SEQ ID NO: 164320 - DNA, 25 bp, E. coli
gaagcaacgggagagattaacggca

SEQ ID NO: 164321 - DNA, 25 bp, E. coli
gcactagaagcatcgggagagatta

SEQ ID NO: 164322 - DNA, 25 bp, E. coli
gcactagaagcaacgggagagatta

SEQ ID NO: 164323 - DNA, 25 bp, E. coli
gaacatgtccacgttgagtttcacg

SEQ ID NO: 164324 - DNA, 25 bp, E. coli
gactgagatgaatcagctgctcggc

SEQ ID NO: 164325 - DNA, 25 bp, E. coli
gactgagatgaaacagctgctcggc

SEQ ID NO: 164326 - DNA, 25 bp, E. coli
gaacatgtccaccttgagtttcacg

SEQ ID NO: 164327 - DNA, 25 bp, E. coli
gtgtcgccggaagatgtccacgttg

SEQ ID NO: 164328 - DNA, 25 bp, E. coli
gtgtcgccggaacatgtccacgttg

SEQ ID NO: 164329 - DNA, 25 bp, E. coli
tggtatctgactgagatgaaacagc

SEQ ID NO: 164330 - DNA, 25 bp, E. coli
tggtatctgactcagatgaaacagc

SEQ ID NO: 164331 - DNA, 25 bp, E. coli
cactacgatgtggtcagggcggcat

SEQ ID NO: 164332 - DNA, 25 bp, E. coli
cacacctgttgtggtgaagctgaca

SEQ ID NO: 164333 - DNA, 25 bp, E. coli
cactacgatgtgctcagggcggcat

SEQ ID NO: 164334 - DNA, 25 bp, E. coli
cacacctgttgtcgtgaagctgaca

SEQ ID NO: 164335 - DNA, 25 bp, E. coli
cagaccttgctgttgcacttgcgca

SEQ ID NO: 164336 - DNA, 25 bp, E. coli
cagaccttgctgatgcacttgcgca

SEQ ID NO: 164337 - DNA, 25 bp, E. coli
catgtcgtatggtgaaggtcttccg

SEQ ID NO: 164338 - DNA, 25 bp, E. coli
catgtcgtatggagaaggtcttccg

SEQ ID NO: 164339 - DNA, 25 bp, E. coli
tactttgttgtggttctggcagggc

SEQ ID NO: 164340 - DNA, 25 bp, E. coli
tactttgttgtgcttctggcagggc

SEQ ID NO: 164341 - DNA, 25 bp, E. coli
tcgcagaaggtgttgtgagcacacc

SEQ ID NO: 164342 - DNA, 25 bp, E. coli
tcgcagaaggtgatgtgagcacacc

SEQ ID NO: 164343 - DNA, 25 bp, E. coli
gcagggcagtcaaacggcatgtcgt

SEQ ID NO: 164344 - DNA, 25 bp, E. coli
gcagggcagtcatacggcatgtcgt

SEQ ID NO: 164345 - DNA, 25 bp, E. coli
tggagaaggtgctgtaatcagcgcc

SEQ ID NO: 164346 - DNA, 25 bp, E. coli
ggcggtgtcgccagtaaatataacg

SEQ ID NO: 164347 - DNA, 25 bp, E. coli
tggagaaggtgcagtaatcagcgcc

SEQ ID NO: 164348 - DNA, 25 bp, E. coli
ggcggtgtcgcctgtaaatataacg

SEQ ID NO: 164349 - DNA, 25 bp, E. coli
gatgatggcgcagcacttattcagg

SEQ ID NO: 164350 - DNA, 25 bp, E. coli
gatgatggcgcaccacttattcagg

SEQ ID NO: 164351 - DNA, 25 bp, E. coli
gatggcaaccatacggtgggccgtt

SEQ ID NO: 164352 - DNA, 25 bp, E. coli
gatggcaaccattcggtgggccgtt

SEQ ID NO: 164353 - DNA, 25 bp, E. coli
cacaaactgggtcaattcgcaccga

SEQ ID NO: 164354 - DNA, 25 bp, E. coli
cacaaactgggtgaattcgcaccga

SEQ ID NO: 164355 - DNA, 25 bp, E. coli
gcacttggtcccgtcgttcaacgat

SEQ ID NO: 164356 - DNA, 25 bp, E. coli
gcacttggtcccctcgttcaacgat

SEQ ID NO: 164357 - DNA, 25 bp, E. coli
acaagaagcccctgcgcacttggtc

SEQ ID NO: 164358 - DNA, 25 bp, E. coli
acaagaagccccagcgcacttggtc

SEQ ID NO: 164359 - DNA, 25 bp, E. coli
tattgacctgcacttgctgaagaag

SEQ ID NO: 164360 - DNA, 25 bp, E. coli
tattgacctgcagttgctgaagaag

SEQ ID NO: 164361 - DNA, 25 bp, E. coli
ttcgcaccgactcgtacttatcgcg

SEQ ID NO: 164362 - DNA, 25 bp, E. coli
ttcgcaccgactggtacttatcgcg

SEQ ID NO: 164363 - DNA, 25 bp, E. coli
tccggtatttgttaccgacgaaatg

SEQ ID NO: 164364 - DNA, 25 bp, E. coli
tccggtatttgtaaccgacgaaatg

SEQ ID NO: 164365 - DNA, 25 bp, E. coli
tcggtttgaccatcgctgtccataa

SEQ ID NO: 164366 - DNA, 25 bp, E. coli
tctttcctaacaagatcggtttgac

SEQ ID NO: 164367 - DNA, 25 bp, E. coli
tcggtttgaccaacgctgtccataa

SEQ ID NO: 164368 - DNA, 25 bp, E. coli
tctttcctaacatgatcggtttgac

SEQ ID NO: 164369 - DNA, 25 bp, E. coli
gccacgttctctcaagaaaggtcct

SEQ ID NO: 164370 - DNA, 25 bp, E. coli
gccacgttctctgaagaaaggtcct

SEQ ID NO: 164371 - DNA, 25 bp, E. coli
gtggaaagcggagacaagaagcccc

SEQ ID NO: 164372 - DNA, 25 bp, E. coli
gtggaaagcggacacaagaagcccc

SEQ ID NO: 164373 - DNA, 25 bp, E. coli
taatggtcgtcaccacgttccggta

SEQ ID NO: 164374 - DNA, 25 bp, E. coli
taatggtcgtcagcacgttccggta

SEQ ID NO: 164375 - DNA, 25 bp, E. coli
caaagcaaccgaacgtttgagtcat

SEQ ID NO: 164376 - DNA, 25 bp, E. coli
caaagcaaccgatcgtttgagtcat

SEQ ID NO: 164377 - DNA, 25 bp, E. coli
agcaaccgatcgtttgagtcattat

SEQ ID NO: 164378 - DNA, 25 bp, E. coli
atggcgcagcggcaaagcaaccgat

SEQ ID NO: 164379 - DNA, 25 bp, E. coli
atggcgcagcgggaaagcaaccgat

SEQ ID NO: 164380 - DNA, 25 bp, E. coli
agcaaccgatcgattgagtcattat

SEQ ID NO: 164381 - DNA, 25 bp, E. coli
ttagttcgccatccgttaatgccgg

SEQ ID NO: 164382 - DNA, 25 bp, E. coli
ttagttcgccatgcgttaatgccgg

SEQ ID NO: 164383 - DNA, 25 bp, E. coli
ttgctgctggcgtcggcggtatttt

SEQ ID NO: 164384 - DNA, 25 bp, E. coli
ttgctgctggcgacggcggtatttt

SEQ ID NO: 164385 - DNA, 25 bp, E. coli
tgttagttcgccttccgttaatgcc

SEQ ID NO: 164386 - DNA, 25 bp, E. coli
tgttagttcgccatccgttaatgcc

SEQ ID NO: 164387 - DNA, 25 bp, E. coli
gcgacggcggtaattttgtgggttg

SEQ ID NO: 164388 - DNA, 25 bp, E. coli
gcggcaaagcaagcgatcgtttgag

SEQ ID NO: 164389 - DNA, 25 bp, E. coli
gcggcaaagcaaccgatcgtttgag

SEQ ID NO: 164390 - DNA, 25 bp, E. coli
gcagcggcaaagcaaccgatcgttt

SEQ ID NO: 164391 - DNA, 25 bp, E. coli
gcagcggcaaaggaaccgatcgttt

SEQ ID NO: 164392 - DNA, 25 bp, E. coli
gcgacggcggtatttttgtgggttg

SEQ ID NO: 164393 - DNA, 25 bp, E. coli
gttcgccatccgttaatgccggtgt

SEQ ID NO: 164394 - DNA, 25 bp, E. coli
gttcgccatccgataatgccggtgt

SEQ ID NO: 164395 - DNA, 25 bp, E. coli
gtggtgttagttggccatccgttaa

SEQ ID NO: 164396 - DNA, 25 bp, E. coli
gtggtgttagttcgccatccgttaa

SEQ ID NO: 164397 - DNA, 25 bp, E. coli
caacatgaaggagcacagatacgat

SEQ ID NO: 164398 - DNA, 25 bp, E. coli
caacatgaaggaccacagatacgat

SEQ ID NO: 164399 - DNA, 25 bp, E. coli
catggctgatgaagaatgtgcgcaa

SEQ ID NO: 164400 - DNA, 25 bp, E. coli
catggctgatgatgaatgtgcgcaa

SEQ ID NO: 164401 - DNA, 25 bp, E. coli
tacggagcataatcacacggtcagc

SEQ ID NO: 164402 - DNA, 25 bp, E. coli
tacggagcataaacacacggtcagc

SEQ ID NO: 164403 - DNA, 25 bp, E. coli
tttgccatccgccagtcggcgtcat

SEQ ID NO: 164404 - DNA, 25 bp, E. coli
tttgccatccgcgagtcggcgtcat

SEQ ID NO: 164405 - DNA, 25 bp, E. coli
tcggcagaaggaatctatggtcaac

SEQ ID NO: 164406 - DNA, 25 bp, E. coli
tcggcagaaggattctatggtcaac

SEQ ID NO: 164407 - DNA, 25 bp, E. coli
tcatcagggcaaaacgtggcgttaa

SEQ ID NO: 164408 - DNA, 25 bp, E. coli
tcatcagggcaatacgtggcgttaa

SEQ ID NO: 164409 - DNA, 25 bp, E. coli
gcaggttattgcaacaatcatccgg

SEQ ID NO: 164410 - DNA, 25 bp, E. coli
gcaggttattgctacaatcatccgg

SEQ ID NO: 164411 - DNA, 25 bp, E. coli
gacattttgtagttcctttcaccga

SEQ ID NO: 164412 - DNA, 25 bp, E. coli
gacattttgtagatcctttcaccga

SEQ ID NO: 164413 - DNA, 25 bp, E. coli
cggctgttcagtcctttatgtcgca

SEQ ID NO: 164414 - DNA, 25 bp, E. coli
cggctgttcagtgctttatgtcgca

SEQ ID NO: 164415 - DNA, 25 bp, E. coli
tcaccgacgggtacacgaacgtatt

SEQ ID NO: 164416 - DNA, 25 bp, E. coli
tcacttcacgctctattcggcagaa

SEQ ID NO: 164417 - DNA, 25 bp, E. coli
tcacttcacgctgtattcggcagaa

SEQ ID NO: 164418 - DNA, 25 bp, E. coli
tcaccgacgggttcacgaacgtatt

SEQ ID NO: 164419 - DNA, 25 bp, E. coli
ctttatgccgccattttgtccgcag

SEQ ID NO: 164420 - DNA, 25 bp, E. coli
ctttatgccgcctttttgtccgcag

SEQ ID NO: 164421 - DNA, 25 bp, E. coli
taaactttatgcggccattttgtcc

SEQ ID NO: 164422 - DNA, 25 bp, E. coli
taaactttatgccgccattttgtcc

SEQ ID NO: 164423 - DNA, 25 bp, E. coli
atgcgtaaacttaatgccgccattt

SEQ ID NO: 164424 - DNA, 25 bp, E. coli
atgcgtaaactttatgccgccattt

SEQ ID NO: 164425 - DNA, 25 bp, E. coli
aactttatgccgccattttgtccgc

SEQ ID NO: 164426 - DNA, 25 bp, E. coli
actttatgccgccattttgtccgca

SEQ ID NO: 164427 - DNA, 25 bp, E. coli
actttatgccgcgattttgtccgca

SEQ ID NO: 164428 - DNA, 25 bp, E. coli
aactttatgccggcattttgtccgc

SEQ ID NO: 164429 - DNA, 25 bp, E. coli
tttatgccgccattttgtccgcagc

SEQ ID NO: 164430 - DNA, 25 bp, E. coli
tttatgccgccaatttgtccgcagc

SEQ ID NO: 164431 - DNA, 25 bp, E. coli
ttatgccgccattttgtccgcagcc

SEQ ID NO: 164432 - DNA, 25 bp, E. coli
ttatgccgccatattgtccgcagcc

SEQ ID NO: 164433 - DNA, 25 bp, E. coli
tgcgtaaactttttgccgccatttt

SEQ ID NO: 164434 - DNA, 25 bp, E. coli
tgcgtaaactttatgccgccatttt

SEQ ID NO: 164435 - DNA, 25 bp, E. coli
gcgtaaactttatgccgccattttg

SEQ ID NO: 164436 - DNA, 25 bp, E. coli
gcgtaaactttaagccgccattttg

SEQ ID NO: 164437 - DNA, 25 bp, E. coli
gtaaactttatggcgccattttgtc

SEQ ID NO: 164438 - DNA, 25 bp, E. coli
gtaaactttatgccgccattttgtc

SEQ ID NO: 164439 - DNA, 25 bp, E. coli
cgtaaactttatcccgccattttgt

SEQ ID NO: 164440 - DNA, 25 bp, E. coli
cgtaaactttatgccgccattttgt

SEQ ID NO: 164441 - DNA, 25 bp, E. coli
cagatgtttcatgatttaccgggag

SEQ ID NO: 164442 - DNA, 25 bp, E. coli
cagatgtttcatcatttaccgggag

SEQ ID NO: 164443 - DNA, 25 bp, E. coli
acgacgcagagaggatgcacagagt

SEQ ID NO: 164444 - DNA, 25 bp, E. coli
acgacgcagagacgatgcacagagt

SEQ ID NO: 164445 - DNA, 25 bp, E. coli
ttacctgaagtgtggacgacgcaga

SEQ ID NO: 164446 - DNA, 25 bp, E. coli
ttacctgaagtgaggacgacgcaga

SEQ ID NO: 164447 - DNA, 25 bp, E. coli
tgtcacaaccagtagtcaaaaatcc

SEQ ID NO: 164448 - DNA, 25 bp, E. coli
tgtcacaaccagaagtcaaaaatcc

SEQ ID NO: 164449 - DNA, 25 bp, E. coli
tgagtattcacagccttacctgaag

SEQ ID NO: 164450 - DNA, 25 bp, E. coli
tgagtattcacacccttacctgaag

SEQ ID NO: 164451 - DNA, 25 bp, E. coli
gcacagagtgctgcgccgttcaggt

SEQ ID NO: 164452 - DNA, 25 bp, E. coli
gcacagagtgctccgccgttcaggt

SEQ ID NO: 164453 - DNA, 25 bp, E. coli
cgtaatacaggactaagcgcagatg

SEQ ID NO: 164454 - DNA, 25 bp, E. coli
cgtaatacaggagtaagcgcagatg

SEQ ID NO: 164455 - DNA, 25 bp, E. coli
ccgggagttaaatagagcattggct

SEQ ID NO: 164456 - DNA, 25 bp, E. coli
cgatgccgcccctgttagtgcgtaa

SEQ ID NO: 164457 - DNA, 25 bp, E. coli
ccgggagttaaaaagagcattggct

SEQ ID NO: 164458 - DNA, 25 bp, E. coli
cgatgccgccccagttagtgcgtaa

SEQ ID NO: 164459 - DNA, 25 bp, E. coli
ctttaagggtggctgaatacatgag

SEQ ID NO: 164460 - DNA, 25 bp, E. coli
ctttaagggtgggtgaatacatgag

SEQ ID NO: 164461 - DNA, 25 bp, E. coli
gggtgacacaataaaacaggaagac

SEQ ID NO: 164462 - DNA, 25 bp, E. coli
gggtgacacaattaaacaggaagac

SEQ ID NO: 164463 - DNA, 25 bp, E. coli
cactggcggactggattgagttgaa

SEQ ID NO: 164464 - DNA, 25 bp, E. coli
cactggcggactcgattgagttgaa

SEQ ID NO: 164465 - DNA, 25 bp, E. coli
agatgcttgcgcagtcgttacaggc

SEQ ID NO: 164466 - DNA, 25 bp, E. coli
atcgctttagcgacctgcggcgcaa

SEQ ID NO: 164467 - DNA, 25 bp, E. coli
agatgcttgcgctgtcgttacaggc

SEQ ID NO: 164468 - DNA, 25 bp, E. coli
atcgctttagcgtcctgcggcgcaa

SEQ ID NO: 164469 - DNA, 25 bp, E. coli
tagcctgtcgcaacaactgaaagag

SEQ ID NO: 164470 - DNA, 25 bp, E. coli
tagaacaggatgcttttcttaaccg

SEQ ID NO: 164471 - DNA, 25 bp, E. coli
tagcctgtcgcatcaactgaaagag

SEQ ID NO: 164472 - DNA, 25 bp, E. coli
tagaacaggatggttttcttaaccg

SEQ ID NO: 164473 - DNA, 25 bp, E. coli
ttgaaacacgtctccagccgttggg

SEQ ID NO: 164474 - DNA, 25 bp, E. coli
ttgagttgaatttgcccgaggtgtt

SEQ ID NO: 164475 - DNA, 25 bp, E. coli
ttgaaacacgtcaccagccgttggg

SEQ ID NO: 164476 - DNA, 25 bp, E. coli
ttgagttgaattagcccgaggtgtt

SEQ ID NO: 164477 - DNA, 25 bp, E. coli
tgttgattctggtggcgctacgcga

SEQ ID NO: 164478 - DNA, 25 bp, E. coli
tgttgattctggaggcgctacgcga

SEQ ID NO: 164479 - DNA, 25 bp, E. coli
tctctttgcggatcagtgcccgtcg

SEQ ID NO: 164480 - DNA, 25 bp, E. coli
tctctttgcggaacagtgcccgtcg

SEQ ID NO: 164481 - DNA, 25 bp, E. coli
cgaaaaggttgctgcactggcggac

SEQ ID NO: 164482 - DNA, 25 bp, E. coli
cgaaaaggttgcagcactggcggac

SEQ ID NO: 164483 - DNA, 25 bp, E. coli
taaccgtatcgcgtatccggtggtg

SEQ ID NO: 164484 - DNA, 25 bp, E. coli
taaccgtatcgcctatccggtggtg

SEQ ID NO: 164485 - DNA, 25 bp, E. coli
cacaactatttggagaacaccttcc

SEQ ID NO: 164486 - DNA, 25 bp, E. coli
cacaactatttgcagaacaccttcc

SEQ ID NO: 164487 - DNA, 25 bp, E. coli
cagggagccgttatcttatgccact

SEQ ID NO: 164488 - DNA, 25 bp, E. coli
cagggagccgttttcttatgccact

SEQ ID NO: 164489 - DNA, 25 bp, E. coli
cagttaaggattagttgaccgatcc

SEQ ID NO: 164490 - DNA, 25 bp, E. coli
cagttaaggatttgttgaccgatcc

SEQ ID NO: 164491 - DNA, 25 bp, E. coli
taaacggcccctactgggcaatgcc

SEQ ID NO: 164492 - DNA, 25 bp, E. coli
taaactgaggcactataacggcttc

SEQ ID NO: 164493 - DNA, 25 bp, E. coli
taaactgaggcagtataacggcttc

SEQ ID NO: 164494 - DNA, 25 bp, E. coli
taaacggccccttctgggcaatgcc

SEQ ID NO: 164495 - DNA, 25 bp, E. coli
tagttgaccgatccttaaactgagg

SEQ ID NO: 164496 - DNA, 25 bp, E. coli
tagttgaccgatgcttaaactgagg

SEQ ID NO: 164497 - DNA, 25 bp, E. coli
tgccacttctcattgatctgctcga

SEQ ID NO: 164498 - DNA, 25 bp, E. coli
tgccacttctcaatgatctgctcga

SEQ ID NO: 164499 - DNA, 25 bp, E. coli
gctgtctggcaagataaacggcccc

SEQ ID NO: 164500 - DNA, 25 bp, E. coli
gctgtctggcaacataaacggcccc

SEQ ID NO: 164501 - DNA, 25 bp, E. coli
tgggcaatgccgatcagttaaggat

SEQ ID NO: 164502 - DNA, 25 bp, E. coli
tgggcaatgccgttcagttaaggat

SEQ ID NO: 164503 - DNA, 25 bp, E. coli
taacggcttccacaacagggagccg

SEQ ID NO: 164504 - DNA, 25 bp, E. coli
taacggcttccagaacagggagccg

SEQ ID NO: 164505 - DNA, 25 bp, E. coli
gatctgctcgatatcagtgaccatc

SEQ ID NO: 164506 - DNA, 25 bp, E. coli
gatctgctcgatttcagtgaccatc

SEQ ID NO: 164507 - DNA, 25 bp, E. coli
taacggcgtggattacctgttgatg

SEQ ID NO: 164508 - DNA, 25 bp, E. coli
tacgccgatgtctaacggcgtggaa

SEQ ID NO: 164509 - DNA, 25 bp, E. coli
acggcgtggaattcctgttgatgct

SEQ ID NO: 164510 - DNA, 25 bp, E. coli
acggcgtggaatacctgttgatgct

SEQ ID NO: 164511 - DNA, 25 bp, E. coli
tacgccgatgtcaaacggcgtggaa

SEQ ID NO: 164512 - DNA, 25 bp, E. coli
ttacggtctgttgcgtttctccttg

SEQ ID NO: 164513 - DNA, 25 bp, E. coli
ttacggtctgttccgtttctccttg

SEQ ID NO: 164514 - DNA, 25 bp, E. coli
tctaacggcgtgcaatacctgttga

SEQ ID NO: 164515 - DNA, 25 bp, E. coli
tctaacggcgtggaatacctgttga

SEQ ID NO: 164516 - DNA, 25 bp, E. coli
gccgatgtctaagggcgtggaatac

SEQ ID NO: 164517 - DNA, 25 bp, E. coli
gccgatgtctaacggcgtggaatac

SEQ ID NO: 164518 - DNA, 25 bp, E. coli
gaatacgccgatgtctaacggcgtg

SEQ ID NO: 164519 - DNA, 25 bp, E. coli
gaatacgccgatctctaacggcgtg

SEQ ID NO: 164520 - DNA, 25 bp, E. coli
ctgaatacgccgttgtctaacggcg

SEQ ID NO: 164521 - DNA, 25 bp, E. coli
ctgttgcgtttcaccttgccgctgt

SEQ ID NO: 164522 - DNA, 25 bp, E. coli
ctgttgcgtttctccttgccgctgt

SEQ ID NO: 164523 - DNA, 25 bp, E. coli
ctgaatacgccgatgtctaacggcg

SEQ ID NO: 164524 - DNA, 25 bp, E. coli
ggtctgttgcgtatctccttgccgc

SEQ ID NO: 164525 - DNA, 25 bp, E. coli
ggtctgttgcgtttctccttgccgc

SEQ ID NO: 164526 - DNA, 25 bp, E. coli
tgtctaacggcgtggaatacctgtt

SEQ ID NO: 164527 - DNA, 25 bp, E. coli
tgtctaacggcgaggaatacctgtt

SEQ ID NO: 164528 - DNA, 25 bp, E. coli
taacggcgtggaatacctgttgatg

SEQ ID NO: 164529 - DNA, 25 bp, E. coli
caggaaatctgtgcatgatgccgga

SEQ ID NO: 164530 - DNA, 25 bp, E. coli
caggaaatctgtccatgatgccgga

SEQ ID NO: 164531 - DNA, 25 bp, E. coli
tatatggttcttaatcaggatgtcg

SEQ ID NO: 164532 - DNA, 25 bp, E. coli
tatttgcggttagaggaaatctgtc

SEQ ID NO: 164533 - DNA, 25 bp, E. coli
tatttgcggttacaggaaatctgtc

SEQ ID NO: 164534 - DNA, 25 bp, E. coli
tatatggttctttatcaggatgtcg

SEQ ID NO: 164535 - DNA, 25 bp, E. coli
ttcgcaattatccttcctgtgtggg

SEQ ID NO: 164536 - DNA, 25 bp, E. coli
ttcgcaattatcgttcctgtgtggg

SEQ ID NO: 164537 - DNA, 25 bp, E. coli
tccgtattactgcaaaacataaatg

SEQ ID NO: 164538 - DNA, 25 bp, E. coli
tcgacatatatatccgtattactgg

SEQ ID NO: 164539 - DNA, 25 bp, E. coli
tccatgatgccggatatatggttct

SEQ ID NO: 164540 - DNA, 25 bp, E. coli
tccatgatgccgcatatatggttct

SEQ ID NO: 164541 - DNA, 25 bp, E. coli
tcgacatatataaccgtattactgg

SEQ ID NO: 164542 - DNA, 25 bp, E. coli
tccgtattactggaaaacataaatg

SEQ ID NO: 164543 - DNA, 25 bp, E. coli
gaatcttcttatggacatatatatc

SEQ ID NO: 164544 - DNA, 25 bp, E. coli
gaatcttcttatcgacatatatatc

SEQ ID NO: 164545 - DNA, 25 bp, E. coli
gataaggagactagtttttttcgca

SEQ ID NO: 164546 - DNA, 25 bp, E. coli
tggttttatatttgcggttacagga

SEQ ID NO: 164547 - DNA, 25 bp, E. coli
tggttttatattagcggttacagga

SEQ ID NO: 164548 - DNA, 25 bp, E. coli
gatgtcgctcttgctgtttattatg

SEQ ID NO: 164549 - DNA, 25 bp, E. coli
gatgtcgctcttcctgtttattatg

SEQ ID NO: 164550 - DNA, 25 bp, E. coli
gataaggagacttgtttttttcgca

SEQ ID NO: 164551 - DNA, 25 bp, E. coli
aataccggtggcgaaaacagcaagc

SEQ ID NO: 164552 - DNA, 25 bp, E. coli
aagtggattccgactcgttaggcga

SEQ ID NO: 164553 - DNA, 25 bp, E. coli
aataccggtggccaaaacagcaagc

SEQ ID NO: 164554 - DNA, 25 bp, E. coli
cagcaagcacggtatctggtacacc

SEQ ID NO: 164555 - DNA, 25 bp, E. coli
cagcaagcacggaatctggtacacc

SEQ ID NO: 164556 - DNA, 25 bp, E. coli
cagatgttatcgatcaggcgacgct

SEQ ID NO: 164557 - DNA, 25 bp, E. coli
cagatgttatcgttcaggcgacgct

SEQ ID NO: 164558 - DNA, 25 bp, E. coli
aagtggattccgtctcgttaggcga

SEQ ID NO: 164559 - DNA, 25 bp, E. coli
tattcgtcggcagattgcagcgctg

SEQ ID NO: 164560 - DNA, 25 bp, E. coli
tattatggtctgtggaatgccgcgc

SEQ ID NO: 164561 - DNA, 25 bp, E. coli
tattatggtctgaggaatgccgcgc

SEQ ID NO: 164562 - DNA, 25 bp, E. coli
tttgcgcttaatccgtgagcagggc

SEQ ID NO: 164563 - DNA, 25 bp, E. coli
tattcgtcggcacattgcagcgctg

SEQ ID NO: 164564 - DNA, 25 bp, E. coli
tttgcgcttaatgcgtgagcagggc

SEQ ID NO: 164565 - DNA, 25 bp, E. coli
tgaaactggaaaatgaaccgggtcg

SEQ ID NO: 164566 - DNA, 25 bp, E. coli
tgaaactggaaattgaaccgggtcg

SEQ ID NO: 164567 - DNA, 25 bp, E. coli
cggtgtgggtctacgatgcgcaaat

SEQ ID NO: 164568 - DNA, 25 bp, E. coli
cggtgtgggtcttcgatgcgcaaat

SEQ ID NO: 164569 - DNA, 25 bp, E. coli
gatttacaggctttttctgcgggcg

SEQ ID NO: 164570 - DNA, 25 bp, E. coli
gatttacaggctatttctgcgggcg

SEQ ID NO: 164571 - DNA, 25 bp, E. coli
ggcgatgtctttacccagcaggaag

SEQ ID NO: 164572 - DNA, 25 bp, E. coli
ggcgatgtcttttcccagcaggaag

SEQ ID NO: 164573 - DNA, 25 bp, E. coli
caaactggcgatttccagtctggta

SEQ ID NO: 164574 - DNA, 25 bp, E. coli
caaactggcgatatccagtctggta

SEQ ID NO: 164575 - DNA, 25 bp, E. coli
taactatcctcccaaactggcgata

SEQ ID NO: 164576 - DNA, 25 bp, E. coli
taactatcctccgaaactggcgata

SEQ ID NO: 164577 - DNA, 25 bp, E. coli
agtctggtaaactgcctcaaaggcg

SEQ ID NO: 164578 - DNA, 25 bp, E. coli
agtctggtaaacagcctcaaaggcg

SEQ ID NO: 164579 - DNA, 25 bp, E. coli
agcctcaaaggcctatcgggtaggt

SEQ ID NO: 164580 - DNA, 25 bp, E. coli
agcctcaaaggcgtatcgggtaggt

SEQ ID NO: 164581 - DNA, 25 bp, E. coli
tgattttgaagcagaactggttgaa

SEQ ID NO: 164582 - DNA, 25 bp, E. coli
tgattttgaagctgaactggttgaa

SEQ ID NO: 164583 - DNA, 25 bp, E. coli
tgacgcgacagaaaaactacgcact

SEQ ID NO: 164584 - DNA, 25 bp, E. coli
tgacgcgacagataaactacgcact

SEQ ID NO: 164585 - DNA, 25 bp, E. coli
gttgaaatggatggcgaaccagatc

SEQ ID NO: 164586 - DNA, 25 bp, E. coli
gttgaaatggatcgcgaaccagatc

SEQ ID NO: 164587 - DNA, 25 bp, E. coli
gaaggcattgtgttttcctgatgca

SEQ ID NO: 164588 - DNA, 25 bp, E. coli
gaaggcattgtgatttcctgatgca

SEQ ID NO: 164589 - DNA, 25 bp, E. coli
gacagaaaaactacgcacttacttt

SEQ ID NO: 164590 - DNA, 25 bp, E. coli
gacagaaaaacttcgcacttacttt

SEQ ID NO: 164591 - DNA, 25 bp, E. coli
gtatgtgctgattttgaagctgaac

SEQ ID NO: 164592 - DNA, 25 bp, E. coli
gtatgtgctgatattgaagctgaac

SEQ ID NO: 164593 - DNA, 25 bp, E. coli
ggcgaaccagatcacgtccatttgt

SEQ ID NO: 164594 - DNA, 25 bp, E. coli
ggcgaaccagatgacgtccatttgt

SEQ ID NO: 164595 - DNA, 25 bp, E. coli
aagagatcgctctcatcctgcagcg

SEQ ID NO: 164596 - DNA, 25 bp, E. coli
aagagatcgctcacatcctgcagcg

SEQ ID NO: 164597 - DNA, 25 bp, E. coli
cagcgcgtagcgcaggaaatgcaaa

SEQ ID NO: 164598 - DNA, 25 bp, E. coli
cagcgcgtagcggaggaaatgcaaa

SEQ ID NO: 164599 - DNA, 25 bp, E. coli
tatcgtgccggaactgaccttcttc

SEQ ID NO: 164600 - DNA, 25 bp, E. coli
tatcgtgccggatctgaccttcttc

SEQ ID NO: 164601 - DNA, 25 bp, E. coli
ttaaagcgggcatcaaagcgttgca

SEQ ID NO: 164602 - DNA, 25 bp, E. coli
ttaaagcgggcaacaaagcgttgca

SEQ ID NO: 164603 - DNA, 25 bp, E. coli
tgtcgaaatgtcacgcgacctggcg

SEQ ID NO: 164604 - DNA, 25 bp, E. coli
tgtcgaaatgtctcgcgacctggcg

SEQ ID NO: 164605 - DNA, 25 bp, E. coli
tcctgcagcgtgtaattaaagatcc

SEQ ID NO: 164606 - DNA, 25 bp, E. coli
tcctgcagcgtgaaattaaagatcc

SEQ ID NO: 164607 - DNA, 25 bp, E. coli
gcgaaagaatttcgtcgcccgcagc

SEQ ID NO: 164608 - DNA, 25 bp, E. coli
gcgaaagaatttggtcgcccgcagc

SEQ ID NO: 164609 - DNA, 25 bp, E. coli
gaagcttctggtttcatccgcagcc

SEQ ID NO: 164610 - DNA, 25 bp, E. coli
gaagcttctggtatcatccgcagcc

SEQ ID NO: 164611 - DNA, 25 bp, E. coli
ctcaacgacaaacatgaagacgcgg

SEQ ID NO: 164612 - DNA, 25 bp, E. coli
ctcaacgacaaagatgaagacgcgg

SEQ ID NO: 164613 - DNA, 25 bp, E. coli
gtgttaacccggacgacagcaagga

SEQ ID NO: 164614 - DNA, 25 bp, E. coli
gtgttaacccggtcgacagcaagga

SEQ ID NO: 164615 - DNA, 25 bp, E. coli
gaccagcgtggtcaaacatgacgaa

SEQ ID NO: 164616 - DNA, 25 bp, E. coli
gaccagcgtggtgaaacatgacgaa

SEQ ID NO: 164617 - DNA, 25 bp, E. coli
catatgttgatgaaggcaccatggt

SEQ ID NO: 164618 - DNA, 25 bp, E. coli
catatgttgatgtaggcaccatggt

SEQ ID NO: 164619 - DNA, 25 bp, E. coli
taaatcaggtgaacgccctgctgga

SEQ ID NO: 164620 - DNA, 25 bp, E. coli
taaatcaggtgatcgccctgctgga

SEQ ID NO: 164621 - DNA, 25 bp, E. coli
tgtgcgcagattcgtaaaaacgtcc

SEQ ID NO: 164622 - DNA, 25 bp, E. coli
tgtgcgcagattggtaaaaacgtcc

SEQ ID NO: 164623 - DNA, 25 bp, E. coli
tgaaaccgcttttgaacgccgtgcc

SEQ ID NO: 164624 - DNA, 25 bp, E. coli
tgaaaccgctttagaacgccgtgcc

SEQ ID NO: 164625 - DNA, 25 bp, E. coli
gcgtatacattggtcagagcacccg

SEQ ID NO: 164626 - DNA, 25 bp, E. coli
gcgtatacattgctcagagcacccg

SEQ ID NO: 164627 - DNA, 25 bp, E. coli
gaaagccgctacatcgacaaagtgc

SEQ ID NO: 164628 - DNA, 25 bp, E. coli
gaaagccgctacttcgacaaagtgc

SEQ ID NO: 164629 - DNA, 25 bp, E. coli
cgaactgctgcgaaccatcgactaa

SEQ ID NO: 164630 - DNA, 25 bp, E. coli
cgaactgctgcgtaccatcgactaa

SEQ ID NO: 164631 - DNA, 25 bp, E. coli
gtaacaccgtgctgatgccgtctta

SEQ ID NO: 164632 - DNA, 25 bp, E. coli
gtaacaccgtgcagatgccgtctta

SEQ ID NO: 164633 - DNA, 25 bp, E. coli
ggcgcactgcgtctagcggaaaaaa

SEQ ID NO: 164634 - DNA, 25 bp, E. coli
tggttgaaaaaaccggtgctgctct

SEQ ID NO: 164635 - DNA, 25 bp, E. coli
ggcgcactgcgtgtagcggaaaaaa

SEQ ID NO: 164636 - DNA, 25 bp, E. coli
tggttgaaaaaagcggtgctgctct

SEQ ID NO: 164637 - DNA, 25 bp, E. coli
taagaaagttgacgcgaaaactcgc

SEQ ID NO: 164638 - DNA, 25 bp, E. coli
taagaaagttgaggcgaaaactcgc

SEQ ID NO: 164639 - DNA, 25 bp, E. coli
aatgcagcgcaggatctgaaatggg

SEQ ID NO: 164640 - DNA, 25 bp, E. coli
aatgcagcgcagcatctgaaatggg

SEQ ID NO: 164641 - DNA, 25 bp, E. coli
cagaaaattaatccagcgcaggatc

SEQ ID NO: 164642 - DNA, 25 bp, E. coli
cagaaaattaatgcagcgcaggatc

SEQ ID NO: 164643 - DNA, 25 bp, E. coli
atgcagcgcaggttctgaaatgggc

SEQ ID NO: 164644 - DNA, 25 bp, E. coli
atgcagcgcaggatctgaaatgggc

SEQ ID NO: 164645 - DNA, 25 bp, E. coli
attaatgcagcgcaggatctgaaat

SEQ ID NO: 164646 - DNA, 25 bp, E. coli
agaaaattaatggagcgcaggatct

SEQ ID NO: 164647 - DNA, 25 bp, E. coli
agaaaattaatgcagcgcaggatct

SEQ ID NO: 164648 - DNA, 25 bp, E. coli
attaatgcagcggaggatctgaaat

SEQ ID NO: 164649 - DNA, 25 bp, E. coli
aaaattaatgcagcgcaggatctga

SEQ ID NO: 164650 - DNA, 25 bp, E. coli
aaaattaatgcaccgcaggatctga

SEQ ID NO: 164651 - DNA, 25 bp, E. coli
aaattaatgcagggcaggatctgaa

SEQ ID NO: 164652 - DNA, 25 bp, E. coli
aaattaatgcagcgcaggatctgaa

SEQ ID NO: 164653 - DNA, 25 bp, E. coli
ttaatgcagcgctggatctgaaatg

SEQ ID NO: 164654 - DNA, 25 bp, E. coli
ttaatgcagcgcaggatctgaaatg

SEQ ID NO: 164655 - DNA, 25 bp, E. coli
ccagaaaattaatgcagcgcaggat

SEQ ID NO: 164656 - DNA, 25 bp, E. coli
ccagaaaattaaagcagcgcaggat

SEQ ID NO: 164657 - DNA, 25 bp, E. coli
gaaaattaatgcagcgcaggatctg

SEQ ID NO: 164658 - DNA, 25 bp, E. coli
gaaaattaatgctgcgcaggatctg

SEQ ID NO: 164659 - DNA, 25 bp, E. coli
taatgcagcgcaggatctgaaatgg

SEQ ID NO: 164660 - DNA, 25 bp, E. coli
taatgcagcgcacgatctgaaatgg

SEQ ID NO: 164661 - DNA, 25 bp, E. coli
catggataaggccaaaaccggcgag

SEQ ID NO: 164662 - DNA, 25 bp, E. coli
catggataaggcgaaaaccggcgag

SEQ ID NO: 164663 - DNA, 25 bp, E. coli
taaactgctctaccgtccacaggga

SEQ ID NO: 164664 - DNA, 25 bp, E. coli
taaactgctctagcgtccacaggga

SEQ ID NO: 164665 - DNA, 25 bp, E. coli
tatccctggaggatacaccggagga

SEQ ID NO: 164666 - DNA, 25 bp, E. coli
tatccctggaggttacaccggagga

SEQ ID NO: 164667 - DNA, 25 bp, E. coli
ttgatgccacaaacggacagatgcc

SEQ ID NO: 164668 - DNA, 25 bp, E. coli
ttatattccgcagagctatgccggg

SEQ ID NO: 164669 - DNA, 25 bp, E. coli
ttgatgccacaatcggacagatgcc

SEQ ID NO: 164670 - DNA, 25 bp, E. coli
ttatattccgcacagctatgccggg

SEQ ID NO: 164671 - DNA, 25 bp, E. coli
tgaagcacatgcgtatatgggccgt

SEQ ID NO: 164672 - DNA, 25 bp, E. coli
tgaagcacatgcctatatgggccgt

SEQ ID NO: 164673 - DNA, 25 bp, E. coli
tgacagtgactgtcttaaaggccgg

SEQ ID NO: 164674 - DNA, 25 bp, E. coli
tgacagtgactgacttaaaggccgg

SEQ ID NO: 164675 - DNA, 25 bp, E. coli
tccacagggactggttattccgcca

SEQ ID NO: 164676 - DNA, 25 bp, E. coli
tccacagggactcgttattccgcca

SEQ ID NO: 164677 - DNA, 25 bp, E. coli
tctgggtgaatgtcaaggccatccc

SEQ ID NO: 164678 - DNA, 25 bp, E. coli
tctgggtgaatgacaaggccatccc

SEQ ID NO: 164679 - DNA, 25 bp, E. coli
ccgtgtgatttaccctgaagggcaa

SEQ ID NO: 164680 - DNA, 25 bp, E. coli
ccgtgtgatttagcctgaagggcaa

SEQ ID NO: 164681 - DNA, 25 bp, E. coli
gagggctgactcagtttaatccgac

SEQ ID NO: 164682 - DNA, 25 bp, E. coli
gagggctgactctgtttaatccgac

SEQ ID NO: 164683 - DNA, 25 bp, E. coli
caagtgcaattggttagggtatgga

SEQ ID NO: 164684 - DNA, 25 bp, E. coli
caagtgcaattgcttagggtatgga

SEQ ID NO: 164685 - DNA, 25 bp, E. coli
aataaaattccaatagtcagactac

SEQ ID NO: 164686 - DNA, 25 bp, E. coli
aataaaattccattagtcagactac

SEQ ID NO: 164687 - DNA, 25 bp, E. coli
tacaaccattgtacattaggtcgcc

SEQ ID NO: 164688 - DNA, 25 bp, E. coli
tacaaccattgttcattaggtcgcc

SEQ ID NO: 164689 - DNA, 25 bp, E. coli
tgacacaaatagcagaaacaaatgt

SEQ ID NO: 164690 - DNA, 25 bp, E. coli
tgacacaaataggagaaacaaatgt

SEQ ID NO: 164691 - DNA, 25 bp, E. coli
tgcactttagaaccttttgaacaaa

SEQ ID NO: 164692 - DNA, 25 bp, E. coli
tgcactttagaagcttttgaacaaa

SEQ ID NO: 164693 - DNA, 25 bp, E. coli
tccgcaaagagaagtttaaactaaa

SEQ ID NO: 164694 - DNA, 25 bp, E. coli
tccgcaaagagatgtttaaactaaa

SEQ ID NO: 164695 - DNA, 25 bp, E. coli
tcgtaattaaggaaagagatgagat

SEQ ID NO: 164696 - DNA, 25 bp, E. coli
tcgtaattaaggtaagagatgagat

SEQ ID NO: 164697 - DNA, 25 bp, E. coli
tcagactacatgattgaagaatgac

SEQ ID NO: 164698 - DNA, 25 bp, E. coli
tcagactacatgtttgaagaatgac

SEQ ID NO: 164699 - DNA, 25 bp, E. coli
gaagttatattaattccgcaaagag

SEQ ID NO: 164700 - DNA, 25 bp, E. coli
gaagaatgactattcatgacacaaa

SEQ ID NO: 164701 - DNA, 25 bp, E. coli
gaagaatgactaatcatgacacaaa

SEQ ID NO: 164702 - DNA, 25 bp, E. coli
gaagttatattatttccgcaaagag

SEQ ID NO: 164703 - DNA, 25 bp, E. coli
ggtcgcctattgagcactttagaag

SEQ ID NO: 164704 - DNA, 25 bp, E. coli
ggtcgcctattgtgcactttagaag

SEQ ID NO: 164705 - DNA, 25 bp, E. coli
caatgatgttactgcacaacgttgg

SEQ ID NO: 164706 - DNA, 25 bp, E. coli
caatgatgttacagcacaacgttgg

SEQ ID NO: 164707 - DNA, 25 bp, E. coli
cacaacgttgggtattgactgagca

SEQ ID NO: 164708 - DNA, 25 bp, E. coli
cacaacgttgggaattgactgagca

SEQ ID NO: 164709 - DNA, 25 bp, E. coli
tactcaacatatcgaaaagcaaagg

SEQ ID NO: 164710 - DNA, 25 bp, E. coli
tactcaacatatggaaaagcaaagg

SEQ ID NO: 164711 - DNA, 25 bp, E. coli
tgactgagcaagttgaacgacaagg

SEQ ID NO: 164712 - DNA, 25 bp, E. coli
tgactgagcaagatgaacgacaagg

SEQ ID NO: 164713 - DNA, 25 bp, E. coli
tccatgaagcccaacacaatgatgt

SEQ ID NO: 164714 - DNA, 25 bp, E. coli
tccatgaagccctacacaatgatgt

SEQ ID NO: 164715 - DNA, 25 bp, E. coli
tctgctaataatcccaatgtgcgcg

SEQ ID NO: 164716 - DNA, 25 bp, E. coli
tctgctaataatgccaatgtgcgcg

SEQ ID NO: 164717 - DNA, 25 bp, E. coli
tcatacggtccgcattctggaaagt

SEQ ID NO: 164718 - DNA, 25 bp, E. coli
tcatacggtccggattctggaaagt

SEQ ID NO: 164719 - DNA, 25 bp, E. coli
gacaacgacatcagcctcatgagga

SEQ ID NO: 164720 - DNA, 25 bp, E. coli
gacaacgacatctgcctcatgagga

SEQ ID NO: 164721 - DNA, 25 bp, E. coli
ggaatgttaataggctcaatcagaa

SEQ ID NO: 164722 - DNA, 25 bp, E. coli
ggaatgttaatacgctcaatcagaa

SEQ ID NO: 164723 - DNA, 25 bp, E. coli
ggaccgcaggcccattcattagaca

SEQ ID NO: 164724 - DNA, 25 bp, E. coli
ggaccgcaggccgattcattagaca

SEQ ID NO: 164725 - DNA, 25 bp, E. coli
gagacaaaataaatggaccgcaggc

SEQ ID NO: 164726 - DNA, 25 bp, E. coli
gagacaaaataattggaccgcaggc

SEQ ID NO: 164727 - DNA, 25 bp, E. coli
tattgcctatcgaaaacgggaagcg

SEQ ID NO: 164728 - DNA, 25 bp, E. coli
tattgcctatcgtaaacgggaagcg

SEQ ID NO: 164729 - DNA, 25 bp, E. coli
tttacacgctacgacttcggctggg

SEQ ID NO: 164730 - DNA, 25 bp, E. coli
tttacacgctaccacttcggctggg

SEQ ID NO: 164731 - DNA, 25 bp, E. coli
tgttctttcagttgggaagcccgtt

SEQ ID NO: 164732 - DNA, 25 bp, E. coli
tgttctttcagtagggaagcccgtt

SEQ ID NO: 164733 - DNA, 25 bp, E. coli
tctcaattagcctcgaagaagccgt

SEQ ID NO: 164734 - DNA, 25 bp, E. coli
tcggtttccacgaggccattaaagg

SEQ ID NO: 164735 - DNA, 25 bp, E. coli
tcggtttccacgtggccattaaagg

SEQ ID NO: 164736 - DNA, 25 bp, E. coli
tctcaattagccacgaagaagccgt

SEQ ID NO: 164737 - DNA, 25 bp, E. coli
tctctccgtggttttcgacagcgcc

SEQ ID NO: 164738 - DNA, 25 bp, E. coli
tctctccgtggtattcgacagcgcc

SEQ ID NO: 164739 - DNA, 25 bp, E. coli
gcgcctcgtacctgaaaaccttcgg

SEQ ID NO: 164740 - DNA, 25 bp, E. coli
gcgcctcgtaccagaaaaccttcgg

SEQ ID NO: 164741 - DNA, 25 bp, E. coli
gaagccgtttctccctttgaacaaa

SEQ ID NO: 164742 - DNA, 25 bp, E. coli
gaagccgtttctgcctttgaacaaa

SEQ ID NO: 164743 - DNA, 25 bp, E. coli
ggataaagtactcgcaacccggctc

SEQ ID NO: 164744 - DNA, 25 bp, E. coli
ggataaagtactggcaacccggctc

SEQ ID NO: 164745 - DNA, 25 bp, E. coli
ggaaccgtgctgttgccagtacaaa

SEQ ID NO: 164746 - DNA, 25 bp, E. coli
ggaaccgtgctgatgccagtacaaa

SEQ ID NO: 164747 - DNA, 25 bp, E. coli
gatgatcccgcactggaatttcgcc

SEQ ID NO: 164748 - DNA, 25 bp, E. coli
gatgatcccgcagtggaatttcgcc

SEQ ID NO: 164749 - DNA, 25 bp, E. coli
cacattaatgatggcccgcgtgcag

SEQ ID NO: 164750 - DNA, 25 bp, E. coli
cactgccaccctagttgcggaagaa

SEQ ID NO: 164751 - DNA, 25 bp, E. coli
cacattaatgatcgcccgcgtgcag

SEQ ID NO: 164752 - DNA, 25 bp, E. coli
cactgccacccttgttgcggaagaa

SEQ ID NO: 164753 - DNA, 25 bp, E. coli
catggttgcaaactcaggcggctca

SEQ ID NO: 164754 - DNA, 25 bp, E. coli
catggttgcaaagtcaggcggctca

SEQ ID NO: 164755 - DNA, 25 bp, E. coli
tatggcaaccaccaaatttgacgcg

SEQ ID NO: 164756 - DNA, 25 bp, E. coli
tatggcaaccacgaaatttgacgcg

SEQ ID NO: 164757 - DNA, 25 bp, E. coli
tgtaacgccggattgatgcatgcct

SEQ ID NO: 164758 - DNA, 25 bp, E. coli
tgtaacgccggaatgatgcatgcct

SEQ ID NO: 164759 - DNA, 25 bp, E. coli
tcagcctgcagacgaaggtacgcgt

SEQ ID NO: 164760 - DNA, 25 bp, E. coli
tctcagtgaagaccaggatgtcagc

SEQ ID NO: 164761 - DNA, 25 bp, E. coli
tctcagtgaagagcaggatgtcagc

SEQ ID NO: 164762 - DNA, 25 bp, E. coli
tcagcctgcagaggaaggtacgcgt

SEQ ID NO: 164763 - DNA, 25 bp, E. coli
tcagggcgcagcaaccatgtatggt

SEQ ID NO: 164764 - DNA, 25 bp, E. coli
tcagggcgcagctaccatgtatggt

SEQ ID NO: 164765 - DNA, 25 bp, E. coli
gcgggttccgaacatgccacattaa

SEQ ID NO: 164766 - DNA, 25 bp, E. coli
gcgggttccgaagatgccacattaa

SEQ ID NO: 164767 - DNA, 25 bp, E. coli
gaaactcgtctgatgggtgcagcta

SEQ ID NO: 164768 - DNA, 25 bp, E. coli
gaaactcgtctgttgggtgcagcta

SEQ ID NO: 164769 - DNA, 25 bp, E. coli
cattgaacgtgtagaagcgcctgcg

SEQ ID NO: 164770 - DNA, 25 bp, E. coli
cattgaacgtgttgaagcgcctgcg

SEQ ID NO: 164771 - DNA, 25 bp, E. coli
aagcgtggaagatctcgtcagaacc

SEQ ID NO: 164772 - DNA, 25 bp, E. coli
aagcgtggaagaactcgtcagaacc

SEQ ID NO: 164773 - DNA, 25 bp, E. coli
aggtaagcgtggaagatctcgtcag

SEQ ID NO: 164774 - DNA, 25 bp, E. coli
aggtaagcgtggtagatctcgtcag

SEQ ID NO: 164775 - DNA, 25 bp, E. coli
aacggcgtgcagtacaggcagaatc

SEQ ID NO: 164776 - DNA, 25 bp, E. coli
aacggcgtgcagaacaggcagaatc

SEQ ID NO: 164777 - DNA, 25 bp, E. coli
tgcagaacaggctgaatccagcggc

SEQ ID NO: 164778 - DNA, 25 bp, E. coli
tgcagaacaggcagaatccagcggc

SEQ ID NO: 164779 - DNA, 25 bp, E. coli
cctgaaacggcgagcagaacaggca

SEQ ID NO: 164780 - DNA, 25 bp, E. coli
cctgaaacggcgtgcagaacaggca

SEQ ID NO: 164781 - DNA, 25 bp, E. coli
gcgtgcagaacaggcagaatccagc

SEQ ID NO: 164782 - DNA, 25 bp, E. coli
gcgtgcagaacacgcagaatccagc

SEQ ID NO: 164783 - DNA, 25 bp, E. coli
gaaacggcgtgcagaacaggcagaa

SEQ ID NO: 164784 - DNA, 25 bp, E. coli
gaaacggcgtgctgaacaggcagaa

SEQ ID NO: 164785 - DNA, 25 bp, E. coli
cggcgtgcagaagaggcagaatcca

SEQ ID NO: 164786 - DNA, 25 bp, E. coli
ctgaaacggcgtgcagaacaggcag

SEQ ID NO: 164787 - DNA, 25 bp, E. coli
ctgaaacggcgtccagaacaggcag

SEQ ID NO: 164788 - DNA, 25 bp, E. coli
cggcgtgcagaacaggcagaatcca

SEQ ID NO: 164789 - DNA, 25 bp, E. coli
ggtaagcgtggatgatctcgtcaga

SEQ ID NO: 164790 - DNA, 25 bp, E. coli
ggtaagcgtggaagatctcgtcaga

SEQ ID NO: 164791 - DNA, 25 bp, E. coli
taagcgtggaagttctcgtcagaac

SEQ ID NO: 164792 - DNA, 25 bp, E. coli
taagcgtggaagatctcgtcagaac

SEQ ID NO: 164793 - DNA, 25 bp, E. coli
aaagctcgtatcactgccagtggca

SEQ ID NO: 164794 - DNA, 25 bp, E. coli
aaagggtgccagctctcgcgtcatt

SEQ ID NO: 164795 - DNA, 25 bp, E. coli
aaagctcgtatctctgccagtggca

SEQ ID NO: 164796 - DNA, 25 bp, E. coli
aaagggtgccaggtctcgcgtcatt

SEQ ID NO: 164797 - DNA, 25 bp, E. coli
ttggctggcgtaacacgagacaacc

SEQ ID NO: 164798 - DNA, 25 bp, E. coli
ttggctggcgtatcacgagacaacc

SEQ ID NO: 164799 - DNA, 25 bp, E. coli
ccttaacggcaatgctcgtatctct

SEQ ID NO: 164800 - DNA, 25 bp, E. coli
ccttaacggcaaagctcgtatctct

SEQ ID NO: 164801 - DNA, 25 bp, E. coli
gcagaagttattgccgggctaacag

SEQ ID NO: 164802 - DNA, 25 bp, E. coli
gcagaagttattcccgggctaacag

SEQ ID NO: 164803 - DNA, 25 bp, E. coli
gccagtcgtcccggtttgggccatt

SEQ ID NO: 164804 - DNA, 25 bp, E. coli
gccagtcgtccccgtttgggccatt

SEQ ID NO: 164805 - DNA, 25 bp, E. coli
gtcagcatccggcagaagttattgc

SEQ ID NO: 164806 - DNA, 25 bp, E. coli
gtcagcatccgggagaagttattgc

SEQ ID NO: 164807 - DNA, 25 bp, E. coli
gatccgtttttattacctttggctg

SEQ ID NO: 164808 - DNA, 25 bp, E. coli
ggtgccaggtctcgcgtcattgaat

SEQ ID NO: 164809 - DNA, 25 bp, E. coli
ggtgccaggtctggcgtcattgaat

SEQ ID NO: 164810 - DNA, 25 bp, E. coli
taatttctgccgatcatgtgctggg

SEQ ID NO: 164811 - DNA, 25 bp, E. coli
taatacctttgggtggcgtaacacg

SEQ ID NO: 164812 - DNA, 25 bp, E. coli
taatacctttggctggcgtaacacg

SEQ ID NO: 164813 - DNA, 25 bp, E. coli
taatttctgccgttcatgtgctggg

SEQ ID NO: 164814 - DNA, 25 bp, E. coli
gatccgtttttaatacctttggctg

SEQ ID NO: 164815 - DNA, 25 bp, E. coli
cacttcactgtggaaaatgaggaaa

SEQ ID NO: 164816 - DNA, 25 bp, E. coli
cacttcactgtgcaaaatgaggaaa

SEQ ID NO: 164817 - DNA, 25 bp, E. coli
aattaatggttataaggtcggccag

SEQ ID NO: 164818 - DNA, 25 bp, E. coli
aattaatggttaaaaggtcggccag

SEQ ID NO: 164819 - DNA, 25 bp, E. coli
actagctttaagaggttgagatcac

SEQ ID NO: 164820 - DNA, 25 bp, E. coli
actagctttaagtggttgagatcac

SEQ ID NO: 164821 - DNA, 25 bp, E. coli
tatagagttaccttccgctttttga

SEQ ID NO: 164822 - DNA, 25 bp, E. coli
tatagagttaccatccgctttttga

SEQ ID NO: 164823 - DNA, 25 bp, E. coli
tgctaatcctgtcgtttgcactagc

SEQ ID NO: 164824 - DNA, 25 bp, E. coli
tgctaatcctgtggtttgcactagc

SEQ ID NO: 164825 - DNA, 25 bp, E. coli
gcctggcaaactagcgataacgttg

SEQ ID NO: 164826 - DNA, 25 bp, E. coli
gcctggcaaacttgcgataacgttg

SEQ ID NO: 164827 - DNA, 25 bp, E. coli
gctttttgaaaatacgcaacggcca

SEQ ID NO: 164828 - DNA, 25 bp, E. coli
gctttttgaaaaaacgcaacggcca

SEQ ID NO: 164829 - DNA, 25 bp, E. coli
gaaggtcaacatggagcctggcaaa

SEQ ID NO: 164830 - DNA, 25 bp, E. coli
gaaggtcaacatcgagcctggcaaa

SEQ ID NO: 164831 - DNA, 25 bp, E. coli
gaaacctttctaatgcaagcgatga

SEQ ID NO: 164832 - DNA, 25 bp, E. coli
gaaacctttctattgcaagcgatga

SEQ ID NO: 164833 - DNA, 25 bp, E. coli
ccccgcaggatgaggaaggtcaaca

SEQ ID NO: 164834 - DNA, 25 bp, E. coli
ccccgcaggatgtggaaggtcaaca

SEQ ID NO: 164835 - DNA, 25 bp, E. coli
cggccattttttgcacttagataca

SEQ ID NO: 164836 - DNA, 25 bp, E. coli
cggccattttttccacttagataca

SEQ ID NO: 164837 - DNA, 25 bp, E. coli
tgatattgcgcacctgaagcaggaa

SEQ ID NO: 164838 - DNA, 25 bp, E. coli
tgatattgcgcagctgaagcaggaa

SEQ ID NO: 164839 - DNA, 25 bp, E. coli
tgaagcaggaaaaccgcctgctgcg

SEQ ID NO: 164840 - DNA, 25 bp, E. coli
tgcataccggcatctctgaagagga

SEQ ID NO: 164841 - DNA, 25 bp, E. coli
tgaagcaggaaatccgcctgctgcg

SEQ ID NO: 164842 - DNA, 25 bp, E. coli
tgcataccggcaactctgaagagga

SEQ ID NO: 164843 - DNA, 25 bp, E. coli
tgcgccagcggcattcccggtttgt

SEQ ID NO: 164844 - DNA, 25 bp, E. coli
tgcgccagcggctttcccggtttgt

SEQ ID NO: 164845 - DNA, 25 bp, E. coli
ttaccgaattttgcctgcataccgg

SEQ ID NO: 164846 - DNA, 25 bp, E. coli
ttaccgaattttccctgcataccgg

SEQ ID NO: 164847 - DNA, 25 bp, E. coli
tcatgaactggcactggactggccg

SEQ ID NO: 164848 - DNA, 25 bp, E. coli
tcatgaactggctctggactggccg

SEQ ID NO: 164849 - DNA, 25 bp, E. coli
cgcctgcgtcatcaactggctctgg

SEQ ID NO: 164850 - DNA, 25 bp, E. coli
cgcctgcgtcatgaactggctctgg

SEQ ID NO: 164851 - DNA, 25 bp, E. coli
tggctaatgttacggtgacttttac

SEQ ID NO: 164852 - DNA, 25 bp, E. coli
gggtatttgacgaccatgccgccat

SEQ ID NO: 164853 - DNA, 25 bp, E. coli
gggtatttgacgtccatgccgccat

SEQ ID NO: 164854 - DNA, 25 bp, E. coli
tggctaatgttagggtgacttttac

SEQ ID NO: 164855 - DNA, 25 bp, E. coli
tggcgctgacgtaaatggatgatat

SEQ ID NO: 164856 - DNA, 25 bp, E. coli
tggcgctgacgttaatggatgatat

SEQ ID NO: 164857 - DNA, 25 bp, E. coli
taatggatgataatgcgcacctgaa

SEQ ID NO: 164858 - DNA, 25 bp, E. coli
taatggatgatattgcgcacctgaa

SEQ ID NO: 164859 - DNA, 25 bp, E. coli
cacacatcgggaacctttctatata

SEQ ID NO: 164860 - DNA, 25 bp, E. coli
caatcataacagtcaggtattatga

SEQ ID NO: 164861 - DNA, 25 bp, E. coli
caatcataacagacaggtattatga

SEQ ID NO: 164862 - DNA, 25 bp, E. coli
catcgggaacctatctatataaaca

SEQ ID NO: 164863 - DNA, 25 bp, E. coli
cacacatcgggatcctttctatata

SEQ ID NO: 164864 - DNA, 25 bp, E. coli
catcgggaacctttctatataaaca

SEQ ID NO: 164865 - DNA, 25 bp, E. coli
cattattgtcaatcataacagtcag

SEQ ID NO: 164866 - DNA, 25 bp, E. coli
aacacacatcgggaacctttctata

SEQ ID NO: 164867 - DNA, 25 bp, E. coli
aacacacatcggcaacctttctata

SEQ ID NO: 164868 - DNA, 25 bp, E. coli
tatgtaacacacttcgggaaccttt

SEQ ID NO: 164869 - DNA, 25 bp, E. coli
tatgtaacacacatcgggaaccttt

SEQ ID NO: 164870 - DNA, 25 bp, E. coli
tattgtcaatcataacagtcaggta

SEQ ID NO: 164871 - DNA, 25 bp, E. coli
tattgtcaatcaaaacagtcaggta

SEQ ID NO: 164872 - DNA, 25 bp, E. coli
tgtcaatcataagagtcaggtatta

SEQ ID NO: 164873 - DNA, 25 bp, E. coli
tgatatgtaacagacatcgggaacc

SEQ ID NO: 164874 - DNA, 25 bp, E. coli
tgtcaatcataacagtcaggtatta

SEQ ID NO: 164875 - DNA, 25 bp, E. coli
tgatatgtaacacacatcgggaacc

SEQ ID NO: 164876 - DNA, 25 bp, E. coli
cattattgtcaaacataacagtcag

SEQ ID NO: 164877 - DNA, 25 bp, E. coli
ggaacctttctatataaacattatc

SEQ ID NO: 164878 - DNA, 25 bp, E. coli
gatatgtaacacacatcgggaacct

SEQ ID NO: 164879 - DNA, 25 bp, E. coli
ggaacctttctaaataaacattatc

SEQ ID NO: 164880 - DNA, 25 bp, E. coli
gatatgtaacactcatcgggaacct

SEQ ID NO: 164881 - DNA, 25 bp, E. coli
aacgctggttcggtactgacgccaa

SEQ ID NO: 164882 - DNA, 25 bp, E. coli
tacccggatcgctggcaaatttgat

SEQ ID NO: 164883 - DNA, 25 bp, E. coli
gacgccaattggcaacccgcaaaat

SEQ ID NO: 164884 - DNA, 25 bp, E. coli
gacgccaattgggaacccgcaaaat

SEQ ID NO: 164885 - DNA, 25 bp, E. coli
aacgctggttcgctactgacgccaa

SEQ ID NO: 164886 - DNA, 25 bp, E. coli
tacccggatcgcaggcaaatttgat

SEQ ID NO: 164887 - DNA, 25 bp, E. coli
tatatcgtctttctgacggcgctgg

SEQ ID NO: 164888 - DNA, 25 bp, E. coli
tatcgcaggtgatcagtaacgtgcc

SEQ ID NO: 164889 - DNA, 25 bp, E. coli
tatatcgtctttgtgacggcgctgg

SEQ ID NO: 164890 - DNA, 25 bp, E. coli
tatcgcaggtgaacagtaacgtgcc

SEQ ID NO: 164891 - DNA, 25 bp, E. coli
ttattgcccaaaaggcaccgctggc

SEQ ID NO: 164892 - DNA, 25 bp, E. coli
ttttacgcacgcagcaaggcgatcg

SEQ ID NO: 164893 - DNA, 25 bp, E. coli
ttttacgcacgctgcaaggcgatcg

SEQ ID NO: 164894 - DNA, 25 bp, E. coli
ttattgcccaaatggcaccgctggc

SEQ ID NO: 164895 - DNA, 25 bp, E. coli
gcctgatgctgcagaccaaaggtgt

SEQ ID NO: 164896 - DNA, 25 bp, E. coli
gcctgatgctgctgaccaaaggtgt

SEQ ID NO: 164897 - DNA, 25 bp, E. coli
gctgattatttttgaggcgctggca

SEQ ID NO: 164898 - DNA, 25 bp, E. coli
gctgattattttagaggcgctggca

SEQ ID NO: 164899 - DNA, 25 bp, E. coli
gaaatcctggccagctgctatcgac

SEQ ID NO: 164900 - DNA, 25 bp, E. coli
gacgttctggtcattcgtttgccgg

SEQ ID NO: 164901 - DNA, 25 bp, E. coli
gacgttctggtctttcgtttgccgg

SEQ ID NO: 164902 - DNA, 25 bp, E. coli
gaaatcctggcctgctgctatcgac

SEQ ID NO: 164903 - DNA, 25 bp, E. coli
cagagcgccaggaaaaaattagcac

SEQ ID NO: 164904 - DNA, 25 bp, E. coli
cagagcgccaggtaaaaattagcac

SEQ ID NO: 164905 - DNA, 25 bp, E. coli
agttattgggtattagctctgctgc

SEQ ID NO: 164906 - DNA, 25 bp, E. coli
agcagcgtgaacaggcagagcgcca

SEQ ID NO: 164907 - DNA, 25 bp, E. coli
agttattgggtaatagctctgctgc

SEQ ID NO: 164908 - DNA, 25 bp, E. coli
agcagcgtgaactggcagagcgcca

SEQ ID NO: 164909 - DNA, 25 bp, E. coli
tagcacctggctggagctgatgaaa

SEQ ID NO: 164910 - DNA, 25 bp, E. coli
tagcacctggctcgagctgatgaaa

SEQ ID NO: 164911 - DNA, 25 bp, E. coli
ttaaataacattcgcaccctccgtg

SEQ ID NO: 164912 - DNA, 25 bp, E. coli
ttaaataacattggcaccctccgtg

SEQ ID NO: 164913 - DNA, 25 bp, E. coli
gccgcgtccggccaaatataaattc

SEQ ID NO: 164914 - DNA, 25 bp, E. coli
gccgcgtccggcgaaatataaattc

SEQ ID NO: 164915 - DNA, 25 bp, E. coli
gctgacggaatttacccggaagagt

SEQ ID NO: 164916 - DNA, 25 bp, E. coli
gctgacggaattaacccggaagagt

SEQ ID NO: 164917 - DNA, 25 bp, E. coli
gaattctccattgacgttcttgaag

SEQ ID NO: 164918 - DNA, 25 bp, E. coli
gaattctccattcacgttcttgaag

SEQ ID NO: 164919 - DNA, 25 bp, E. coli
gaaaaattcagggttgtcactaaag

SEQ ID NO: 164920 - DNA, 25 bp, E. coli
gaaaaattcaggcttgtcactaaag

SEQ ID NO: 164921 - DNA, 25 bp, E. coli
cgtgcgatggctcgcgaattctcca

SEQ ID NO: 164922 - DNA, 25 bp, E. coli
cgtgcgatggctggcgaattctcca

SEQ ID NO: 164923 - DNA, 25 bp, E. coli
ggcgctggcagaaggtaaatctctc

SEQ ID NO: 164924 - DNA, 25 bp, E. coli
ggcgctggcagatggtaaatctctc

SEQ ID NO: 164925 - DNA, 25 bp, E. coli
caatctgaaacattatgaaacggca

SEQ ID NO: 164926 - DNA, 25 bp, E. coli
caacgtgaaacaagctggaacaagg

SEQ ID NO: 164927 - DNA, 25 bp, E. coli
caagctggaacaaggaaaatcacaa

SEQ ID NO: 164928 - DNA, 25 bp, E. coli
caatctgaaacaatatgaaacggca

SEQ ID NO: 164929 - DNA, 25 bp, E. coli
caacgtgaaacatgctggaacaagg

SEQ ID NO: 164930 - DNA, 25 bp, E. coli
caaaaacatagtgaacaatctgaaa

SEQ ID NO: 164931 - DNA, 25 bp, E. coli
caaaaacatagtcaacaatctgaaa

SEQ ID NO: 164932 - DNA, 25 bp, E. coli
caaagggctacaacgtgaaacaagc

SEQ ID NO: 164933 - DNA, 25 bp, E. coli
caaagggctacatcgtgaaacaagc

SEQ ID NO: 164934 - DNA, 25 bp, E. coli
caagctggaacatggaaaatcacaa

SEQ ID NO: 164935 - DNA, 25 bp, E. coli
actacaccattaactacaccgatcg

SEQ ID NO: 164936 - DNA, 25 bp, E. coli
actacaccgatcgttgcacaaaggg

SEQ ID NO: 164937 - DNA, 25 bp, E. coli
actacaccattatctacaccgatcg

SEQ ID NO: 164938 - DNA, 25 bp, E. coli
actacaccgatccttgcacaaaggg

SEQ ID NO: 164939 - DNA, 25 bp, E. coli
ccgatcgttgcagaaagggctacaa

SEQ ID NO: 164940 - DNA, 25 bp, E. coli
ccgatcgttgcacaaagggctacaa

SEQ ID NO: 164941 - DNA, 25 bp, E. coli
ggtcatcacaataaactacaccatt

SEQ ID NO: 164942 - DNA, 25 bp, E. coli
ggtcatcacaattaactacaccatt

SEQ ID NO: 164943 - DNA, 25 bp, E. coli
tggaacaaggaaaatcacaaatctg

SEQ ID NO: 164944 - DNA, 25 bp, E. coli
tggaacaaggaatatcacaaatctg

SEQ ID NO: 164945 - DNA, 25 bp, E. coli
tcacaaatctgtttataatcaaaaa

SEQ ID NO: 164946 - DNA, 25 bp, E. coli
tcacaaatctgtatataatcaaaaa

SEQ ID NO: 164947 - DNA, 25 bp, E. coli
caaccgtcatctgcgcagtatggaa

SEQ ID NO: 164948 - DNA, 25 bp, E. coli
caaccgtcatctccgcagtatggaa

SEQ ID NO: 164949 - DNA, 25 bp, E. coli
accacgtacaagctaagcccgtgat

SEQ ID NO: 164950 - DNA, 25 bp, E. coli
ataaagaattgcagggcggaggccc

SEQ ID NO: 164951 - DNA, 25 bp, E. coli
ataaagaattgctgggcggaggccc

SEQ ID NO: 164952 - DNA, 25 bp, E. coli
accacgtacaaggtaagcccgtgat

SEQ ID NO: 164953 - DNA, 25 bp, E. coli
ttactaataaagaattgcagggcgg

SEQ ID NO: 164954 - DNA, 25 bp, E. coli
ttactaataaagtattgcagggcgg

SEQ ID NO: 164955 - DNA, 25 bp, E. coli
tcatctgcgcagaatggaagccttt

SEQ ID NO: 164956 - DNA, 25 bp, E. coli
tcatctgcgcagtatggaagccttt

SEQ ID NO: 164957 - DNA, 25 bp, E. coli
gcctttatcaacgacgtacaaggta

SEQ ID NO: 164958 - DNA, 25 bp, E. coli
gcctttatcaaccacgtacaaggta

SEQ ID NO: 164959 - DNA, 25 bp, E. coli
gcaactggtggccacgctttatcaa

SEQ ID NO: 164960 - DNA, 25 bp, E. coli
gcaactggtggcgacgctttatcaa

SEQ ID NO: 164961 - DNA, 25 bp, E. coli
gacgacaaccgtcatctgcgcagta

SEQ ID NO: 164962 - DNA, 25 bp, E. coli
ggcgacgctttatcaatccgcagaa

SEQ ID NO: 164963 - DNA, 25 bp, E. coli
ggcgacgctttaacaatccgcagaa

SEQ ID NO: 164964 - DNA, 25 bp, E. coli
tcaaccacgtactaggtaagcccgt

SEQ ID NO: 164965 - DNA, 25 bp, E. coli
tcaaccacgtacaaggtaagcccgt

SEQ ID NO: 164966 - DNA, 25 bp, E. coli
gagtcgcgatcataggcgcgggcca

SEQ ID NO: 164967 - DNA, 25 bp, E. coli
gacgacaaccgtgatctgcgcagta

SEQ ID NO: 164968 - DNA, 25 bp, E. coli
gagtcgcgatcaaaggcgcgggcca

SEQ ID NO: 164969 - DNA, 25 bp, E. coli
ctttcgctatacttcctaaggagta

SEQ ID NO: 164970 - DNA, 25 bp, E. coli
ctttcgctatacatcctaaggagta

SEQ ID NO: 164971 - DNA, 25 bp, E. coli
tgtaattacgaattgactcgcaggt

SEQ ID NO: 164972 - DNA, 25 bp, E. coli
tgtaattacgaaatgactcgcaggt

SEQ ID NO: 164973 - DNA, 25 bp, E. coli
tgaataaaatttcccacgatcataa

SEQ ID NO: 164974 - DNA, 25 bp, E. coli
tgaataaaatttgccacgatcataa

SEQ ID NO: 164975 - DNA, 25 bp, E. coli
gccacgatcataattaatatctatg

SEQ ID NO: 164976 - DNA, 25 bp, E. coli
gccacgatcatatttaatatctatg

SEQ ID NO: 164977 - DNA, 25 bp, E. coli
gactcgcaggtttaagtgatttaat

SEQ ID NO: 164978 - DNA, 25 bp, E. coli
gactcgcaggttaaagtgatttaat

SEQ ID NO: 164979 - DNA, 25 bp, E. coli
cgaaatgactcggaggtttaagtga

SEQ ID NO: 164980 - DNA, 25 bp, E. coli
cgaaatgactcgcaggtttaagtga

SEQ ID NO: 164981 - DNA, 25 bp, E. coli
gatttaatgaataaaatttgccacg

SEQ ID NO: 164982 - DNA, 25 bp, E. coli
gatttatttcacttagagttagtgg

SEQ ID NO: 164983 - DNA, 25 bp, E. coli
gatttaatgaattaaatttgccacg

SEQ ID NO: 164984 - DNA, 25 bp, E. coli
gatttatttcacatagagttagtgg

SEQ ID NO: 164985 - DNA, 25 bp, E. coli
ggtatatctttttctcctttcgcta

SEQ ID NO: 164986 - DNA, 25 bp, E. coli
ggtatatcttttactcctttcgcta

SEQ ID NO: 164987 - DNA, 25 bp, E. coli
ggtgatcgaggtttatctttttctc

SEQ ID NO: 164988 - DNA, 25 bp, E. coli
ggtgatcgaggtatatctttttctc

SEQ ID NO: 164989 - DNA, 25 bp, E. coli
tacatcctaaggtgtatttcggcgt

SEQ ID NO: 164990 - DNA, 25 bp, E. coli
tacatcctaaggagtatttcggcgt

SEQ ID NO: 164991 - DNA, 25 bp, E. coli
cagcctgaaggccagtctttccagt

SEQ ID NO: 164992 - DNA, 25 bp, E. coli
cagcctgaaggcgagtctttccagt

SEQ ID NO: 164993 - DNA, 25 bp, E. coli
tattgcggctgaagtcctgagacta

SEQ ID NO: 164994 - DNA, 25 bp, E. coli
tattgcggctgatgtcctgagacta

SEQ ID NO: 164995 - DNA, 25 bp, E. coli
tgagactaagacagagcggaatgcc

SEQ ID NO: 164996 - DNA, 25 bp, E. coli
tgagactaagactgagcggaatgcc

SEQ ID NO: 164997 - DNA, 25 bp, E. coli
tcctgagactaacacagagcggaat

SEQ ID NO: 164998 - DNA, 25 bp, E. coli
tgcggctgatgtcctgagactaaga

SEQ ID NO: 164999 - DNA, 25 bp, E. coli
tgcggctgatgtgctgagactaaga

SEQ ID NO: 165000 - DNA, 25 bp, E. coli
tcctgagactaagacagagcggaat

SEQ ID NO: 165001 - DNA, 25 bp, E. coli
gcctgaaggccactctttccagtgt

SEQ ID NO: 165002 - DNA, 25 bp, E. coli
gcctgaaggccagtctttccagtgt

SEQ ID NO: 165003 - DNA, 25 bp, E. coli
gctgatgtcctgagactaagacaga

SEQ ID NO: 165004 - DNA, 25 bp, E. coli
gctgatgtcctgtgactaagacaga

SEQ ID NO: 165005 - DNA, 25 bp, E. coli
gaaggccagtctttccagtgtgccg

SEQ ID NO: 165006 - DNA, 25 bp, E. coli
gaaggccagtctatccagtgtgccg

SEQ ID NO: 165007 - DNA, 25 bp, E. coli
gactaagacagaccggaatgccggt

SEQ ID NO: 165008 - DNA, 25 bp, E. coli
gactaagacagagcggaatgccggt

SEQ ID NO: 165009 - DNA, 25 bp, E. coli
ggccagtctttccagtgtgccggat

SEQ ID NO: 165010 - DNA, 25 bp, E. coli
ggccagtctttcgagtgtgccggat

SEQ ID NO: 165011 - DNA, 25 bp, E. coli
gatgtcctgagagtaagacagagcg

SEQ ID NO: 165012 - DNA, 25 bp, E. coli
gatgtcctgagactaagacagagcg

SEQ ID NO: 165013 - DNA, 25 bp, E. coli
caattaaatacctgacaggcccgga

SEQ ID NO: 165014 - DNA, 25 bp, E. coli
caattaaataccagacaggcccgga

SEQ ID NO: 165015 - DNA, 25 bp, E. coli
aaattgaccgtcaggctgcgctgag

SEQ ID NO: 165016 - DNA, 25 bp, E. coli
aaattgaccgtctggctgcgctgag

SEQ ID NO: 165017 - DNA, 25 bp, E. coli
tatcatctcgttaatccgggccagt

SEQ ID NO: 165018 - DNA, 25 bp, E. coli
tatcatctcgtttatccgggccagt

SEQ ID NO: 165019 - DNA, 25 bp, E. coli
tgagtgactcgagccgaagtgaagc

SEQ ID NO: 165020 - DNA, 25 bp, E. coli
tgctctgagccgacattaacccggg

SEQ ID NO: 165021 - DNA, 25 bp, E. coli
tgaagcgctcgcacagaatgctgaa

SEQ ID NO: 165022 - DNA, 25 bp, E. coli
tgaagcgctcgctcagaatgctgaa

SEQ ID NO: 165023 - DNA, 25 bp, E. coli
tgctctgagccgtcattaacccggg

SEQ ID NO: 165024 - DNA, 25 bp, E. coli
tgagtgactcgacccgaagtgaagc

SEQ ID NO: 165025 - DNA, 25 bp, E. coli
tccacagggaaggtcgtactcgata

SEQ ID NO: 165026 - DNA, 25 bp, E. coli
tgccaacttactgggcaccggcaag

SEQ ID NO: 165027 - DNA, 25 bp, E. coli
tccacagggaagctcgtactcgata

SEQ ID NO: 165028 - DNA, 25 bp, E. coli
tgccaacttactcggcaccggcaag

SEQ ID NO: 165029 - DNA, 25 bp, E. coli
gaagctggctctgcactccgttgat

SEQ ID NO: 165030 - DNA, 25 bp, E. coli
gaagctggctctccactccgttgat

SEQ ID NO: 165031 - DNA, 25 bp, E. coli
gaatgctgaactgaaaaccggtgag

SEQ ID NO: 165032 - DNA, 25 bp, E. coli
gaatgctgaactcaaaaccggtgag

SEQ ID NO: 165033 - DNA, 25 bp, E. coli
tggataaaaagaccctccgccggat

SEQ ID NO: 165034 - DNA, 25 bp, E. coli
tggataaaaagagcctccgccggat

SEQ ID NO: 165035 - DNA, 25 bp, E. coli
caaacaggtgatgggcgatattccc

SEQ ID NO: 165036 - DNA, 25 bp, E. coli
caaacaggtgatcggcgatattccc

SEQ ID NO: 165037 - DNA, 25 bp, E. coli
taaagaggctaatcccagggtcgct

SEQ ID NO: 165038 - DNA, 25 bp, E. coli
taaagaggctaaacccagggtcgct

SEQ ID NO: 165039 - DNA, 25 bp, E. coli
taccgttatgtgttaaccggcttgt

SEQ ID NO: 165040 - DNA, 25 bp, E. coli
atagcgcggcgctacaggaaatctc

SEQ ID NO: 165041 - DNA, 25 bp, E. coli
atagcgcggcgcaacaggaaatctc

SEQ ID NO: 165042 - DNA, 25 bp, E. coli
taccgttatgtgataaccggcttgt

SEQ ID NO: 165043 - DNA, 25 bp, E. coli
gcgcccattgttgctttgcgtgatt

SEQ ID NO: 165044 - DNA, 25 bp, E. coli
gcgcccattgttcctttgcgtgatt

SEQ ID NO: 165045 - DNA, 25 bp, E. coli
cctcgctggagatggcgaaaaaaga

SEQ ID NO: 165046 - DNA, 25 bp, E. coli
cctcgctggagaaggcgaaaaaaga

SEQ ID NO: 165047 - DNA, 25 bp, E. coli
gctattacccttctggcattgcctg

SEQ ID NO: 165048 - DNA, 25 bp, E. coli
gctattacccttgtggcattgcctg

SEQ ID NO: 165049 - DNA, 25 bp, E. coli
gaaatctccagcaattacccttgtg

SEQ ID NO: 165050 - DNA, 25 bp, E. coli
gaaatctccagctattacccttgtg

SEQ ID NO: 165051 - DNA, 25 bp, E. coli
gatttacatctgctgacaacagcgg

SEQ ID NO: 165052 - DNA, 25 bp, E. coli
gatttacatctggtgacaacagcgg

SEQ ID NO: 165053 - DNA, 25 bp, E. coli
gtgttccgctctatgcgcccattgt

SEQ ID NO: 165054 - DNA, 25 bp, E. coli
ggagaaatttaccacctcgctggag

SEQ ID NO: 165055 - DNA, 25 bp, E. coli
gtgttccgctctttgcgcccattgt

SEQ ID NO: 165056 - DNA, 25 bp, E. coli
ggagaaatttacgacctcgctggag

SEQ ID NO: 165057 - DNA, 25 bp, E. coli
catttgttatcaggtattggcgctt

SEQ ID NO: 165058 - DNA, 25 bp, E. coli
catttgttatcacgtattggcgctt

SEQ ID NO: 165059 - DNA, 25 bp, E. coli
tatggctgccatttgttatcacgta

SEQ ID NO: 165060 - DNA, 25 bp, E. coli
tatggctgccatatgttatcacgta

SEQ ID NO: 165061 - DNA, 25 bp, E. coli
tatactgcagattaatatggctgcc

SEQ ID NO: 165062 - DNA, 25 bp, E. coli
tatactgcagataaatatggctgcc

SEQ ID NO: 165063 - DNA, 25 bp, E. coli
tgatgctgattttctcgtcgctttt

SEQ ID NO: 165064 - DNA, 25 bp, E. coli
tggtgtggttatgctgtccattgct

SEQ ID NO: 165065 - DNA, 25 bp, E. coli
tgatgctgatttactcgtcgctttt

SEQ ID NO: 165066 - DNA, 25 bp, E. coli
tcctgtccattgcttatactgcaga

SEQ ID NO: 165067 - DNA, 25 bp, E. coli
tcctgtccattggttatactgcaga

SEQ ID NO: 165068 - DNA, 25 bp, E. coli
cgtattggcgcttattgctcgttga

SEQ ID NO: 165069 - DNA, 25 bp, E. coli
cgtattggcgctaattgctcgttga

SEQ ID NO: 165070 - DNA, 25 bp, E. coli
ctgacggtttctggtgtggttatcc

SEQ ID NO: 165071 - DNA, 25 bp, E. coli
ctgacggtttctcgtgtggttatcc

SEQ ID NO: 165072 - DNA, 25 bp, E. coli
ggtttctggtgtcgttatcctgtcc

SEQ ID NO: 165073 - DNA, 25 bp, E. coli
ggtttctggtgtggttatcctgtcc

SEQ ID NO: 165074 - DNA, 25 bp, E. coli
tggattttatgctgacggtttctgg

SEQ ID NO: 165075 - DNA, 25 bp, E. coli
tggattttatgcagacggtttctgg

SEQ ID NO: 165076 - DNA, 25 bp, E. coli
tggtgtggttatcctgtccattgct

SEQ ID NO: 165077 - DNA, 25 bp, E. coli
ggcgcttattgcacgttgatgctga

SEQ ID NO: 165078 - DNA, 25 bp, E. coli
ggcgcttattgctcgttgatgctga

SEQ ID NO: 165079 - DNA, 25 bp, E. coli
aatagcggcccagatgttttcccgg

SEQ ID NO: 165080 - DNA, 25 bp, E. coli
aatagcggcccacatgttttcccgg

SEQ ID NO: 165081 - DNA, 25 bp, E. coli
caaagttgcgtctacaaatagcggc

SEQ ID NO: 165082 - DNA, 25 bp, E. coli
caaagttgcgtcaacaaatagcggc

SEQ ID NO: 165083 - DNA, 25 bp, E. coli
cacgccgctggctgtattaacaaag

SEQ ID NO: 165084 - DNA, 25 bp, E. coli
cacgccgctggcagtattaacaaag

SEQ ID NO: 165085 - DNA, 25 bp, E. coli
caggaatccagatcggcaatgccgg

SEQ ID NO: 165086 - DNA, 25 bp, E. coli
caggaatccagaacggcaatgccgg

SEQ ID NO: 165087 - DNA, 25 bp, E. coli
tataactggctgtgggaggcgatcc

SEQ ID NO: 165088 - DNA, 25 bp, E. coli
tataactggctgagggaggcgatcc

SEQ ID NO: 165089 - DNA, 25 bp, E. coli
tccctgttgtggagatcgctgagtc

SEQ ID NO: 165090 - DNA, 25 bp, E. coli
tccctgttgtggtgatcgctgagtc

SEQ ID NO: 165091 - DNA, 25 bp, E. coli
tccacgtcttggtgcggtaatacag

SEQ ID NO: 165092 - DNA, 25 bp, E. coli
tccacgtcttggagcggtaatacag

SEQ ID NO: 165093 - DNA, 25 bp, E. coli
gaatatcgggaaagggtcagacagc

SEQ ID NO: 165094 - DNA, 25 bp, E. coli
gaatatcgggaatgggtcagacagc

SEQ ID NO: 165095 - DNA, 25 bp, E. coli
ttacgcccgggaaatgtggtcctgc

SEQ ID NO: 165096 - DNA, 25 bp, E. coli
ttacgcccgggatatgtggtcctgc

SEQ ID NO: 165097 - DNA, 25 bp, E. coli
gaggcgatcccgtttttacaacagg

SEQ ID NO: 165098 - DNA, 25 bp, E. coli
gatgcttaacgcaccacaaggaacg

SEQ ID NO: 165099 - DNA, 25 bp, E. coli
gaggcgatcccgattttacaacagg

SEQ ID NO: 165100 - DNA, 25 bp, E. coli
gatgcttaacgctccacaaggaacg

SEQ ID NO: 165101 - DNA, 25 bp, E. coli
caaagatcgggtcaattgattaaaa

SEQ ID NO: 165102 - DNA, 25 bp, E. coli
caaataaatataataggcgcttccg

SEQ ID NO: 165103 - DNA, 25 bp, E. coli
caaagatcgggtgaattgattaaaa

SEQ ID NO: 165104 - DNA, 25 bp, E. coli
caaataaatatattaggcgcttccg

SEQ ID NO: 165105 - DNA, 25 bp, E. coli
cagatggacgtatgggcaaggatta

SEQ ID NO: 165106 - DNA, 25 bp, E. coli
cagatggacgtaagggcaaggatta

SEQ ID NO: 165107 - DNA, 25 bp, E. coli
attcttcgcctgtaccacgggtcgg

SEQ ID NO: 165108 - DNA, 25 bp, E. coli
attcttcgcctgaaccacgggtcgg

SEQ ID NO: 165109 - DNA, 25 bp, E. coli
taccgttgatgagatcaaagatcgg

SEQ ID NO: 165110 - DNA, 25 bp, E. coli
taccgttgatgacatcaaagatcgg

SEQ ID NO: 165111 - DNA, 25 bp, E. coli
tatacgctggtttattttgataccg

SEQ ID NO: 165112 - DNA, 25 bp, E. coli
tatacgctggttaattttgataccg

SEQ ID NO: 165113 - DNA, 25 bp, E. coli
tgattaaaaatatgccagatggacg

SEQ ID NO: 165114 - DNA, 25 bp, E. coli
tgattaaaaataagccagatggacg

SEQ ID NO: 165115 - DNA, 25 bp, E. coli
cctccatggtttttcgaatcttatg

SEQ ID NO: 165116 - DNA, 25 bp, E. coli
cctccatggtttatcgaatcttatg

SEQ ID NO: 165117 - DNA, 25 bp, E. coli
gttcgatttgaaggttatacgctgg

SEQ ID NO: 165118 - DNA, 25 bp, E. coli
gttcgatttgaacgttatacgctgg

SEQ ID NO: 165119 - DNA, 25 bp, E. coli
taataggcgcttccgatgtagaccc

SEQ ID NO: 165120 - DNA, 25 bp, E. coli
taataggcgcttgcgatgtagaccc

SEQ ID NO: 165121 - DNA, 25 bp, E. coli
gatgtagacccgtattcttcgcctg

SEQ ID NO: 165122 - DNA, 25 bp, E. coli
gatgtagacccgaattcttcgcctg

SEQ ID NO: 165123 - DNA, 25 bp, E. coli
cattttcgggatgcacaacatgccg

SEQ ID NO: 165124 - DNA, 25 bp, E. coli
cggttacgactttaacgatgcaagc

SEQ ID NO: 165125 - DNA, 25 bp, E. coli
cggttacgacttaaacgatgcaagc

SEQ ID NO: 165126 - DNA, 25 bp, E. coli
cattttcgggatccacaacatgccg

SEQ ID NO: 165127 - DNA, 25 bp, E. coli
agtgctggttgcagcacatatcacc

SEQ ID NO: 165128 - DNA, 25 bp, E. coli
agtgctggttgctgcacatatcacc

SEQ ID NO: 165129 - DNA, 25 bp, E. coli
aacatgccgggtttgccggtcggca

SEQ ID NO: 165130 - DNA, 25 bp, E. coli
aacatgccgggtatgccggtcggca

SEQ ID NO: 165131 - DNA, 25 bp, E. coli
tgaggttgagcatgggctggcgaca

SEQ ID NO: 165132 - DNA, 25 bp, E. coli
tgaggttgagcaagggctggcgaca

SEQ ID NO: 165133 - DNA, 25 bp, E. coli
tgccggtcggcaagtttttcttcca

SEQ ID NO: 165134 - DNA, 25 bp, E. coli
tgccggtcggcatgtttttcttcca

SEQ ID NO: 165135 - DNA, 25 bp, E. coli
gccatcgatccactgctggttgctg

SEQ ID NO: 165136 - DNA, 25 bp, E. coli
gccatcgatccagtgctggttgctg

SEQ ID NO: 165137 - DNA, 25 bp, E. coli
gacaaccggcgtggtagccacgtta

SEQ ID NO: 165138 - DNA, 25 bp, E. coli
gacaaccggcgtcgtagccacgtta

SEQ ID NO: 165139 - DNA, 25 bp, E. coli
cggcaagtttttgttccagcctggg

SEQ ID NO: 165140 - DNA, 25 bp, E. coli
cggcaagtttttcttccagcctggg

SEQ ID NO: 165141 - DNA, 25 bp, E. coli
gatccagtgctggttgctgcacata

SEQ ID NO: 165142 - DNA, 25 bp, E. coli
gatgcacaacatgccgggtttgccg

SEQ ID NO: 165143 - DNA, 25 bp, E. coli
gatccagtgctgcttgctgcacata

SEQ ID NO: 165144 - DNA, 25 bp, E. coli
gatgcacaacatcccgggtttgccg

SEQ ID NO: 165145 - DNA, 25 bp, E. coli
caagtataccctggcttaagtaccg

SEQ ID NO: 165146 - DNA, 25 bp, E. coli
caagtataccctcgcttaagtaccg

SEQ ID NO: 165147 - DNA, 25 bp, E. coli
tttatcagttttcccgcactttgcg

SEQ ID NO: 165148 - DNA, 25 bp, E. coli
tttatcagttttgccgcactttgcg

SEQ ID NO: 165149 - DNA, 25 bp, E. coli
tgtaaagagactcacgggtaatgac

SEQ ID NO: 165150 - DNA, 25 bp, E. coli
tgtaaagagactgacgggtaatgac

SEQ ID NO: 165151 - DNA, 25 bp, E. coli
taatcgcacgggaggataagcgttt

SEQ ID NO: 165152 - DNA, 25 bp, E. coli
taatcgcacgggtggataagcgttt

SEQ ID NO: 165153 - DNA, 25 bp, E. coli
tcgcaagctcgttaaagcagtacag

SEQ ID NO: 165154 - DNA, 25 bp, E. coli
tcgcaagctcgtaaaagcagtacag

SEQ ID NO: 165155 - DNA, 25 bp, E. coli
gcttttcccgtattcgcacgggtgg

SEQ ID NO: 165156 - DNA, 25 bp, E. coli
gcttttcccgtaatcgcacgggtgg

SEQ ID NO: 165157 - DNA, 25 bp, E. coli
gcagtacagtgcaccgtaagaaaat

SEQ ID NO: 165158 - DNA, 25 bp, E. coli
gcactttgcgcgcttttcccgtaat

SEQ ID NO: 165159 - DNA, 25 bp, E. coli
gcagtacagtgctccgtaagaaaat

SEQ ID NO: 165160 - DNA, 25 bp, E. coli
gcactttgcgcggttttcccgtaat

SEQ ID NO: 165161 - DNA, 25 bp, E. coli
gggtaatgacgaattccgcactgaa

SEQ ID NO: 165162 - DNA, 25 bp, E. coli
gggtaatgacgatttccgcactgaa

SEQ ID NO: 165163 - DNA, 25 bp, E. coli
taagaaaattacaagtataccctgg

SEQ ID NO: 165164 - DNA, 25 bp, E. coli
taagcgtttacagttttcgcaagct

SEQ ID NO: 165165 - DNA, 25 bp, E. coli
taagcgtttacacttttcgcaagct

SEQ ID NO: 165166 - DNA, 25 bp, E. coli
taagaaaattactagtataccctgg

SEQ ID NO: 165167 - DNA, 25 bp, E. coli
tacgtttcccgcatgaaagaagggc

SEQ ID NO: 165168 - DNA, 25 bp, E. coli
tacgtttcccgcttgaaagaagggc

SEQ ID NO: 165169 - DNA, 25 bp, E. coli
tattcgtcgtatcaaccagctgctg

SEQ ID NO: 165170 - DNA, 25 bp, E. coli
tattcgtcgtatgaaccagctgctg

SEQ ID NO: 165171 - DNA, 25 bp, E. coli
tgtggaaccgcgttcataaacacgg

SEQ ID NO: 165172 - DNA, 25 bp, E. coli
tgtggaaccgcgatcataaacacgg

SEQ ID NO: 165173 - DNA, 25 bp, E. coli
tctgactgagttcgacggtaaaccg

SEQ ID NO: 165174 - DNA, 25 bp, E. coli
tcatcatggacgtcgcagaacagtt

SEQ ID NO: 165175 - DNA, 25 bp, E. coli
tctgactgagttggacggtaaaccg

SEQ ID NO: 165176 - DNA, 25 bp, E. coli
tcatcatggacgacgcagaacagtt

SEQ ID NO: 165177 - DNA, 25 bp, E. coli
cctgcatctgcgagaaggcgaagac

SEQ ID NO: 165178 - DNA, 25 bp, E. coli
cctgcatctgcgtgaaggcgaagac

SEQ ID NO: 165179 - DNA, 25 bp, E. coli
gcgaaaccgttaactcctgggagaa

SEQ ID NO: 165180 - DNA, 25 bp, E. coli
gctgccggtagagatcgaaaaacgc

SEQ ID NO: 165181 - DNA, 25 bp, E. coli
gcgaaaccgttatctcctgggagaa

SEQ ID NO: 165182 - DNA, 25 bp, E. coli
gctgccggtagacatcgaaaaacgc

SEQ ID NO: 165183 - DNA, 25 bp, E. coli
gaaagatgtccgtctgactcaccgt

SEQ ID NO: 165184 - DNA, 25 bp, E. coli
gaaagatgtccgactgactcaccgt

SEQ ID NO: 165185 - DNA, 25 bp, E. coli
gatacgccagcgatcgtttcgaccg

SEQ ID NO: 165186 - DNA, 25 bp, E. coli
gatacgccagcgttcgtttcgaccg

SEQ ID NO: 165187 - DNA, 25 bp, E. coli
gatgacccgcgacgaagtgattgac

SEQ ID NO: 165188 - DNA, 25 bp, E. coli
gatgacccgcgaggaagtgattgac

SEQ ID NO: 165189 - DNA, 25 bp, E. coli
aatgatgacgctgattggtaaaccc

SEQ ID NO: 165190 - DNA, 25 bp, E. coli
aatgatgacgctcattggtaaaccc

SEQ ID NO: 165191 - DNA, 25 bp, E. coli
catcgcctggttacaagaagcactg

SEQ ID NO: 165192 - DNA, 25 bp, E. coli
catgccaatcatcgtgttgccggta

SEQ ID NO: 165193 - DNA, 25 bp, E. coli
catgccaatcatggtgttgccggta

SEQ ID NO: 165194 - DNA, 25 bp, E. coli
catcgcctggtttcaagaagcactg

SEQ ID NO: 165195 - DNA, 25 bp, E. coli
tgaaggagtcataccgatcgccgcg

SEQ ID NO: 165196 - DNA, 25 bp, E. coli
tgctttcactctcgaagaaaccggt

SEQ ID NO: 165197 - DNA, 25 bp, E. coli
tgctttcactctggaagaaaccggt

SEQ ID NO: 165198 - DNA, 25 bp, E. coli
tgaaggagtcattccgatcgccgcg

SEQ ID NO: 165199 - DNA, 25 bp, E. coli
tgacctgctgcgagtagtgggatct

SEQ ID NO: 165200 - DNA, 25 bp, E. coli
tgacctgctgcgtgtagtgggatct

SEQ ID NO: 165201 - DNA, 25 bp, E. coli
gccataaatacacccgtgcggagcg

SEQ ID NO: 165202 - DNA, 25 bp, E. coli
gccataaatacagccgtgcggagcg

SEQ ID NO: 165203 - DNA, 25 bp, E. coli
cttgctggtcagtggcgtctacgga

SEQ ID NO: 165204 - DNA, 25 bp, E. coli
cttgctggtcagaggcgtctacgga

SEQ ID NO: 165205 - DNA, 25 bp, E. coli
gataccccttatagtggccgccggg

SEQ ID NO: 165206 - DNA, 25 bp, E. coli
gataccccttattgtggccgccggg

SEQ ID NO: 165207 - DNA, 25 bp, E. coli
ggtggtccggtcaacaaaaccatgt

SEQ ID NO: 165208 - DNA, 25 bp, E. coli
gattgtcggctttctctgcgggcaa

SEQ ID NO: 165209 - DNA, 25 bp, E. coli
gattgtcggcttactctgcgggcaa

SEQ ID NO: 165210 - DNA, 25 bp, E. coli
ggtggtccggtctacaaaaccatgt

SEQ ID NO: 165211 - DNA, 25 bp, E. coli
caacgatggtgttagccagtgcgcc

SEQ ID NO: 165212 - DNA, 25 bp, E. coli
caacgatggtgtaagccagtgcgcc

SEQ ID NO: 165213 - DNA, 25 bp, E. coli
tacgtgttgcatcgtcaaggtcgga

SEQ ID NO: 165214 - DNA, 25 bp, E. coli
tacccggcagggtgatcatttcacc

SEQ ID NO: 165215 - DNA, 25 bp, E. coli
tacccggcagggagatcatttcacc

SEQ ID NO: 165216 - DNA, 25 bp, E. coli
tacgtgttgcatggtcaaggtcgga

SEQ ID NO: 165217 - DNA, 25 bp, E. coli
tgatcacggtcgacgtaagccagca

SEQ ID NO: 165218 - DNA, 25 bp, E. coli
tgatcacggtcgtcgtaagccagca

SEQ ID NO: 165219 - DNA, 25 bp, E. coli
gaacttccaggaaacggccagtaca

SEQ ID NO: 165220 - DNA, 25 bp, E. coli
gaacttccaggatacggccagtaca

SEQ ID NO: 165221 - DNA, 25 bp, E. coli
gatacatttgataccggaatcgcgc

SEQ ID NO: 165222 - DNA, 25 bp, E. coli
gatctgacggtatgcaacagcctgt

SEQ ID NO: 165223 - DNA, 25 bp, E. coli
gttaaccgcaggtcgaataccggcg

SEQ ID NO: 165224 - DNA, 25 bp, E. coli
gatctcttgcatgaacggagcgtga

SEQ ID NO: 165225 - DNA, 25 bp, E. coli
gatctgacggtaagcaacagcctgt

SEQ ID NO: 165226 - DNA, 25 bp, E. coli
gttaaccgcaggacgaataccggcg

SEQ ID NO: 165227 - DNA, 25 bp, E. coli
gatacatttgattccggaatcgcgc

SEQ ID NO: 165228 - DNA, 25 bp, E. coli
tcgatttcgtcgttgtagccaccgg

SEQ ID NO: 165229 - DNA, 25 bp, E. coli
tcgatttcgtcgatgtagccaccgg

SEQ ID NO: 165230 - DNA, 25 bp, E. coli
gatctcttgcatcaacggagcgtga

SEQ ID NO: 165231 - DNA, 25 bp, E. coli
gatgcaaactgagagaacgctgcca

SEQ ID NO: 165232 - DNA, 25 bp, E. coli
gatgcaaactgacagaacgctgcca

SEQ ID NO: 165233 - DNA, 25 bp, E. coli
cacgccaggcttacttaactttcca

SEQ ID NO: 165234 - DNA, 25 bp, E. coli
cacgccaggctttcttaactttcca

SEQ ID NO: 165235 - DNA, 25 bp, E. coli
catagcttaaaatatacccttgtca

SEQ ID NO: 165236 - DNA, 25 bp, E. coli
catagcttaaaaaatacccttgtca

SEQ ID NO: 165237 - DNA, 25 bp, E. coli
taaagaacagattcccgttatctta

SEQ ID NO: 165238 - DNA, 25 bp, E. coli
aacccattgccgtcgtacttttgat

SEQ ID NO: 165239 - DNA, 25 bp, E. coli
aacccattgccgacgtacttttgat

SEQ ID NO: 165240 - DNA, 25 bp, E. coli
ttccgcaccctattcgtgacagcat

SEQ ID NO: 165241 - DNA, 25 bp, E. coli
ttccgcaccctaatcgtgacagcat

SEQ ID NO: 165242 - DNA, 25 bp, E. coli
tcctttttccgctccctaatcgtga

SEQ ID NO: 165243 - DNA, 25 bp, E. coli
tcctttttccgcaccctaatcgtga

SEQ ID NO: 165244 - DNA, 25 bp, E. coli
gccgtcgtacttttgattgttctta

SEQ ID NO: 165245 - DNA, 25 bp, E. coli
gccgtcgtacttatgattgttctta

SEQ ID NO: 165246 - DNA, 25 bp, E. coli
gcatcattaaagaacagatacccgt

SEQ ID NO: 165247 - DNA, 25 bp, E. coli
gcatcattaaagtacagatacccgt

SEQ ID NO: 165248 - DNA, 25 bp, E. coli
cttgtcaatcaacccattgccgtcg

SEQ ID NO: 165249 - DNA, 25 bp, E. coli
cttgtcaatcaagccattgccgtcg

SEQ ID NO: 165250 - DNA, 25 bp, E. coli
gattgttcttatatacgcttccttt

SEQ ID NO: 165251 - DNA, 25 bp, E. coli
gattgttcttatttacgcttccttt

SEQ ID NO: 165252 - DNA, 25 bp, E. coli
tggcgctgattcatagcttaaaaaa

SEQ ID NO: 165253 - DNA, 25 bp, E. coli
tggcgctgattcttagcttaaaaaa

SEQ ID NO: 165254 - DNA, 25 bp, E. coli
taaagaacagatacccgttatctta

SEQ ID NO: 165255 - DNA, 25 bp, E. coli
aacctgatttacagattgctcgcca

SEQ ID NO: 165256 - DNA, 25 bp, E. coli
aacctgatttactgattgctcgcca

SEQ ID NO: 165257 - DNA, 25 bp, E. coli
caaatggaaagagaactggtgctgg

SEQ ID NO: 165258 - DNA, 25 bp, E. coli
caccgcgcgtaatacctgggatgaa

SEQ ID NO: 165259 - DNA, 25 bp, E. coli
caaatggaaagacaactggtgctgg

SEQ ID NO: 165260 - DNA, 25 bp, E. coli
caccgcgcgtaaaacctgggatgaa

SEQ ID NO: 165261 - DNA, 25 bp, E. coli
cagtttgtgattacgccggcagaag

SEQ ID NO: 165262 - DNA, 25 bp, E. coli
cagtttgtgatttcgccggcagaag

SEQ ID NO: 165263 - DNA, 25 bp, E. coli
aaatccgtcggcctggaacgcacga

SEQ ID NO: 165264 - DNA, 25 bp, E. coli
aaatccgtcggcgtggaacgcacga

SEQ ID NO: 165265 - DNA, 25 bp, E. coli
tatgccgacagggatggcgctcaaa

SEQ ID NO: 165266 - DNA, 25 bp, E. coli
tatgccgacaggcatggcgctcaaa

SEQ ID NO: 165267 - DNA, 25 bp, E. coli
tccctattgctattggcggcagccg

SEQ ID NO: 165268 - DNA, 25 bp, E. coli
tccctattgctaatggcggcagccg

SEQ ID NO: 165269 - DNA, 25 bp, E. coli
tctggccgcggctgaataaagctga

SEQ ID NO: 165270 - DNA, 25 bp, E. coli
tctggccgcggcagaataaagctga

SEQ ID NO: 165271 - DNA, 25 bp, E. coli
gccgtctggcaaaggtaaaacctga

SEQ ID NO: 165272 - DNA, 25 bp, E. coli
gccgtctggcaatggtaaaacctga

SEQ ID NO: 165273 - DNA, 25 bp, E. coli
gatagcgtccattgccacggttctg

SEQ ID NO: 165274 - DNA, 25 bp, E. coli
gatagcgtccatagccacggttctg

SEQ ID NO: 165275 - DNA, 25 bp, E. coli
taaacgctttggcaaatttggccgc

SEQ ID NO: 165276 - DNA, 25 bp, E. coli
taaacgctttgggaaatttggccgc

SEQ ID NO: 165277 - DNA, 25 bp, E. coli
aattccggcgattgtgaagcccttt

SEQ ID NO: 165278 - DNA, 25 bp, E. coli
aattccggcgatagtgaagcccttt

SEQ ID NO: 165279 - DNA, 25 bp, E. coli
tgtggcgacagtagtgatggcattc

SEQ ID NO: 165280 - DNA, 25 bp, E. coli
tgtggcgacagttgtgatggcattc

SEQ ID NO: 165281 - DNA, 25 bp, E. coli
gaagccctttatcgatcggctgaat

SEQ ID NO: 165282 - DNA, 25 bp, E. coli
gaagccctttatggatcggctgaat

SEQ ID NO: 165283 - DNA, 25 bp, E. coli
gacagtagtgatcgcattcgtcgcc

SEQ ID NO: 165284 - DNA, 25 bp, E. coli
gacagtagtgatggcattcgtcgcc

SEQ ID NO: 165285 - DNA, 25 bp, E. coli
cgccatcattgccttaattaacggt

SEQ ID NO: 165286 - DNA, 25 bp, E. coli
cgccatcattgcgttaattaacggt

SEQ ID NO: 165287 - DNA, 25 bp, E. coli
cattgtaggttaactgctggcccca

SEQ ID NO: 165288 - DNA, 25 bp, E. coli
cattgtaggttatctgctggcccca

SEQ ID NO: 165289 - DNA, 25 bp, E. coli
gattgtgaagccctttatcgatcgg

SEQ ID NO: 165290 - DNA, 25 bp, E. coli
gattgtgaagccgtttatcgatcgg

SEQ ID NO: 165291 - DNA, 25 bp, E. coli
gtaggttatctgctggccccactgg

SEQ ID NO: 165292 - DNA, 25 bp, E. coli
gtaggttatctggtggccccactgg

SEQ ID NO: 165293 - DNA, 25 bp, E. coli
ggcgacactttcaaacctgatgagt

SEQ ID NO: 165294 - DNA, 25 bp, E. coli
ggcgacactttctaacctgatgagt

SEQ ID NO: 165295 - DNA, 25 bp, E. coli
ggcattcgtcgccatcattgcgtta

SEQ ID NO: 165296 - DNA, 25 bp, E. coli
ggcattcgtcgcgatcattgcgtta

SEQ ID NO: 165297 - DNA, 25 bp, E. coli
taacctgatgagagccaccattgcc

SEQ ID NO: 165298 - DNA, 25 bp, E. coli
taacctgatgagtgccaccattgcc

SEQ ID NO: 165299 - DNA, 25 bp, E. coli
caactggcggcagacggctttaaca

SEQ ID NO: 165300 - DNA, 25 bp, E. coli
cagcgctgccaatgccggaattatc

SEQ ID NO: 165301 - DNA, 25 bp, E. coli
cagcgctgccaaagccggaattatc

SEQ ID NO: 165302 - DNA, 25 bp, E. coli
caactggcggcacacggctttaaca

SEQ ID NO: 165303 - DNA, 25 bp, E. coli
aaagaggcaatgtcgatgatcccca

SEQ ID NO: 165304 - DNA, 25 bp, E. coli
aaagaggcaatgacgatgatcccca

SEQ ID NO: 165305 - DNA, 25 bp, E. coli
ttaacattggcgatcactatcaccg

SEQ ID NO: 165306 - DNA, 25 bp, E. coli
ttaacattggcgttcactatcaccg

SEQ ID NO: 165307 - DNA, 25 bp, E. coli
tcgcaaaccgcgaacagtgtcggga

SEQ ID NO: 165308 - DNA, 25 bp, E. coli
tcggtttccggcgtaatgggcaatc

SEQ ID NO: 165309 - DNA, 25 bp, E. coli
tcggtttccggcctaatgggcaatc

SEQ ID NO: 165310 - DNA, 25 bp, E. coli
tcgcaaaccgcgtacagtgtcggga

SEQ ID NO: 165311 - DNA, 25 bp, E. coli
ccagcaaaggcaatggtcgcgccat

SEQ ID NO: 165312 - DNA, 25 bp, E. coli
ccagcaaaggcattggtcgcgccat

SEQ ID NO: 165313 - DNA, 25 bp, E. coli
gacgactgggatccggtgatccaca

SEQ ID NO: 165314 - DNA, 25 bp, E. coli
gacgactgggatgcggtgatccaca

SEQ ID NO: 165315 - DNA, 25 bp, E. coli
gtttctacaacgtcattcagccgtg

SEQ ID NO: 165316 - DNA, 25 bp, E. coli
gtttctacaacgacattcagccgtg

SEQ ID NO: 165317 - DNA, 25 bp, E. coli
tggctatcgaactcgcgaagcgcaa

SEQ ID NO: 165318 - DNA, 25 bp, E. coli
tggctatcgaacacgcgaagcgcaa

SEQ ID NO: 165319 - DNA, 25 bp, E. coli
taacgggcgtttgctcagtttcgac

SEQ ID NO: 165320 - DNA, 25 bp, E. coli
taacgggcgtttcctcagtttcgac

SEQ ID NO: 165321 - DNA, 25 bp, E. coli
aattcggataacactgccgcccctg

SEQ ID NO: 165322 - DNA, 25 bp, E. coli
aattcggataactctgccgcccctg

SEQ ID NO: 165323 - DNA, 25 bp, E. coli
tacaattcggataactctgccgccc

SEQ ID NO: 165324 - DNA, 25 bp, E. coli
tacaattcggattactctgccgccc

SEQ ID NO: 165325 - DNA, 25 bp, E. coli
acccctgcaccgaagaacaggctga

SEQ ID NO: 165326 - DNA, 25 bp, E. coli
aaatctgactggaatcagcacgacc

SEQ ID NO: 165327 - DNA, 25 bp, E. coli
acccctgcaccgtagaacaggctga

SEQ ID NO: 165328 - DNA, 25 bp, E. coli
aaatctgactggtatcagcacgacc

SEQ ID NO: 165329 - DNA, 25 bp, E. coli
ttttacaattcgcataactctgccg

SEQ ID NO: 165330 - DNA, 25 bp, E. coli
ttttacaattcggataactctgccg

SEQ ID NO: 165331 - DNA, 25 bp, E. coli
tctgactggtatgagcacgacccct

SEQ ID NO: 165332 - DNA, 25 bp, E. coli
tctgactggtatcagcacgacccct

SEQ ID NO: 165333 - DNA, 25 bp, E. coli
gactggtatcagcacgacccctgca

SEQ ID NO: 165334 - DNA, 25 bp, E. coli
ccctgcaccgaacaacaggctgaat

SEQ ID NO: 165335 - DNA, 25 bp, E. coli
ccctgcaccgaagaacaggctgaat

SEQ ID NO: 165336 - DNA, 25 bp, E. coli
ctgactggtatctgcacgacccctg

SEQ ID NO: 165337 - DNA, 25 bp, E. coli
ctgactggtatcagcacgacccctg

SEQ ID NO: 165338 - DNA, 25 bp, E. coli
ctgcaccgaagaacaggctgaatgg

SEQ ID NO: 165339 - DNA, 25 bp, E. coli
ctgcaccgaagatcaggctgaatgg

SEQ ID NO: 165340 - DNA, 25 bp, E. coli
gataccaaatttaacaattcggata

SEQ ID NO: 165341 - DNA, 25 bp, E. coli
gataccaaattttacaattcggata

SEQ ID NO: 165342 - DNA, 25 bp, E. coli
gactggtatcaggacgacccctgca

SEQ ID NO: 165343 - DNA, 25 bp, E. coli
aatttgaagataaggcgcaacagcg

SEQ ID NO: 165344 - DNA, 25 bp, E. coli
aataacgggccaccgtcgtgatgac

SEQ ID NO: 165345 - DNA, 25 bp, E. coli
aataacgggccagcgtcgtgatgac

SEQ ID NO: 165346 - DNA, 25 bp, E. coli
aatatgtgcatttctttgtaggccg

SEQ ID NO: 165347 - DNA, 25 bp, E. coli
aatttgaagatatggcgcaacagcg

SEQ ID NO: 165348 - DNA, 25 bp, E. coli
aatatgtgcattactttgtaggccg

SEQ ID NO: 165349 - DNA, 25 bp, E. coli
caacagcgagatctggaaacggcga

SEQ ID NO: 165350 - DNA, 25 bp, E. coli
caacagcgagatgtggaaacggcga

SEQ ID NO: 165351 - DNA, 25 bp, E. coli
caggcctacattaccttgcaatatg

SEQ ID NO: 165352 - DNA, 25 bp, E. coli
caggcctacatttccttgcaatatg

SEQ ID NO: 165353 - DNA, 25 bp, E. coli
tttcacccaacaaataacgggccag

SEQ ID NO: 165354 - DNA, 25 bp, E. coli
tttcacccaacatataacgggccag

SEQ ID NO: 165355 - DNA, 25 bp, E. coli
tcttttttgatatacgttcgacgca

SEQ ID NO: 165356 - DNA, 25 bp, E. coli
tcgtgatgacgaggcctttcttttt

SEQ ID NO: 165357 - DNA, 25 bp, E. coli
tcttttttgataaacgttcgacgca

SEQ ID NO: 165358 - DNA, 25 bp, E. coli
tcgtgatgacgacgcctttcttttt

SEQ ID NO: 165359 - DNA, 25 bp, E. coli
gaacaaagcgcaatttgccagcaat

SEQ ID NO: 165360 - DNA, 25 bp, E. coli
gaaacggcgaggcacttcacatttt

SEQ ID NO: 165361 - DNA, 25 bp, E. coli
gaacaaagcgcattttgccagcaat

SEQ ID NO: 165362 - DNA, 25 bp, E. coli
gaaacggcgagggacttcacatttt

SEQ ID NO: 165363 - DNA, 25 bp, E. coli
gggtttccccgtatcagagtgatga

SEQ ID NO: 165364 - DNA, 25 bp, E. coli
gggtttccccgtttcagagtgatga

SEQ ID NO: 165365 - DNA, 25 bp, E. coli
aatggcgctttactacgacgacaga

SEQ ID NO: 165366 - DNA, 25 bp, E. coli
aatggcgctttagtacgacgacaga

SEQ ID NO: 165367 - DNA, 25 bp, E. coli
aaagtgacctgtgaaagctatgacg

SEQ ID NO: 165368 - DNA, 25 bp, E. coli
aaagtgacctgtcaaagctatgacg

SEQ ID NO: 165369 - DNA, 25 bp, E. coli
tataaatcaagaaccccaaagaggg

SEQ ID NO: 165370 - DNA, 25 bp, E. coli
tataaatcaagatccccaaagaggg

SEQ ID NO: 165371 - DNA, 25 bp, E. coli
tgctgcttgtttcggcgagttaacc

SEQ ID NO: 165372 - DNA, 25 bp, E. coli
tgctgcttgtttgggcgagttaacc

SEQ ID NO: 165373 - DNA, 25 bp, E. coli
tctggtatcgctaaaacagtgttgc

SEQ ID NO: 165374 - DNA, 25 bp, E. coli
tctggtatcgcttaaacagtgttgc

SEQ ID NO: 165375 - DNA, 25 bp, E. coli
cctttctggcactagagatgctcag

SEQ ID NO: 165376 - DNA, 25 bp, E. coli
ccttatagctggagatagacaatct

SEQ ID NO: 165377 - DNA, 25 bp, E. coli
ccttatagctggtgatagacaatct

SEQ ID NO: 165378 - DNA, 25 bp, E. coli
cctttctggcacaagagatgctcag

SEQ ID NO: 165379 - DNA, 25 bp, E. coli
gctattccagaagaaaaatggcgct

SEQ ID NO: 165380 - DNA, 25 bp, E. coli
gctattccagaacaaaaatggcgct

SEQ ID NO: 165381 - DNA, 25 bp, E. coli
gcaatccgggatgtttcctctgaaa

SEQ ID NO: 165382 - DNA, 25 bp, E. coli
gaataattacaaaaaggcactagcc

SEQ ID NO: 165383 - DNA, 25 bp, E. coli
gaatgtaatttccagagtgtgtccc

SEQ ID NO: 165384 - DNA, 25 bp, E. coli
gcaatccgggatctttcctctgaaa

SEQ ID NO: 165385 - DNA, 25 bp, E. coli
gaatgtaatttcgagagtgtgtccc

SEQ ID NO: 165386 - DNA, 25 bp, E. coli
gaataattacaataaggcactagcc

SEQ ID NO: 165387 - DNA, 25 bp, E. coli
aattctttctgaaattcctagcgag

SEQ ID NO: 165388 - DNA, 25 bp, E. coli
aattctttctgatattcctagcgag

SEQ ID NO: 165389 - DNA, 25 bp, E. coli
taaagatatcgaacatgctcaaggt

SEQ ID NO: 165390 - DNA, 25 bp, E. coli
taaagatatcgatcatgctcaaggt

SEQ ID NO: 165391 - DNA, 25 bp, E. coli
tccttttaactcagagagatgatac

SEQ ID NO: 165392 - DNA, 25 bp, E. coli
tcctagcgaggagacaaaaagaaag

SEQ ID NO: 165393 - DNA, 25 bp, E. coli
tccttttaactctgagagatgatac

SEQ ID NO: 165394 - DNA, 25 bp, E. coli
tcctagcgaggacacaaaaagaaag

SEQ ID NO: 165395 - DNA, 25 bp, E. coli
ccaaaagtgcttcgtctaaaaagag

SEQ ID NO: 165396 - DNA, 25 bp, E. coli
ccaaaagtgcttggtctaaaaagag

SEQ ID NO: 165397 - DNA, 25 bp, E. coli
gactattttataaggtggttctgac

SEQ ID NO: 165398 - DNA, 25 bp, E. coli
gactattttatatggtggttctgac

SEQ ID NO: 165399 - DNA, 25 bp, E. coli
gatagcgcccattacagattatatg

SEQ ID NO: 165400 - DNA, 25 bp, E. coli
gatagcgcccataacagattatatg

SEQ ID NO: 165401 - DNA, 25 bp, E. coli
ggttctgactctggaaaaacataca

SEQ ID NO: 165402 - DNA, 25 bp, E. coli
ggttctgactctcgaaaaacataca

SEQ ID NO: 165403 - DNA, 25 bp, E. coli
taattttcaaggaagggtaatgaca

SEQ ID NO: 165404 - DNA, 25 bp, E. coli
taattttcaaggtagggtaatgaca

SEQ ID NO: 165405 - DNA, 25 bp, E. coli
gagatgatactaactccttagcaga

SEQ ID NO: 165406 - DNA, 25 bp, E. coli
gagaggtctcttcaggatagcgccc

SEQ ID NO: 165407 - DNA, 25 bp, E. coli
gagaggtctcttgaggatagcgccc

SEQ ID NO: 165408 - DNA, 25 bp, E. coli
gagatgatactatctccttagcaga

SEQ ID NO: 165409 - DNA, 25 bp, E. coli
tacttgccatgttcaaaaaacgcga

SEQ ID NO: 165410 - DNA, 25 bp, E. coli
tacttgccatgtacaaaaaacgcga

SEQ ID NO: 165411 - DNA, 25 bp, E. coli
taaagattattaaggtgtcacgcca

SEQ ID NO: 165412 - DNA, 25 bp, E. coli
taaagattattatggtgtcacgcca

SEQ ID NO: 165413 - DNA, 25 bp, E. coli
tagaagggagtttccagtatgcccc

SEQ ID NO: 165414 - DNA, 25 bp, E. coli
tagcagactcacactccctttggtt

SEQ ID NO: 165415 - DNA, 25 bp, E. coli
tagaagggagttaccagtatgcccc

SEQ ID NO: 165416 - DNA, 25 bp, E. coli
tagcagactcactctccctttggtt

SEQ ID NO: 165417 - DNA, 25 bp, E. coli
tatcgacgtgaaaaatgagctgcct

SEQ ID NO: 165418 - DNA, 25 bp, E. coli
tattctatcaatgtcgtagcccaga

SEQ ID NO: 165419 - DNA, 25 bp, E. coli
tatcgacgtgaataatgagctgcct

SEQ ID NO: 165420 - DNA, 25 bp, E. coli
tattctatcaatctcgtagcccaga

SEQ ID NO: 165421 - DNA, 25 bp, E. coli
tcggcgtcacagttggaataaacaa

SEQ ID NO: 165422 - DNA, 25 bp, E. coli
tcggcgtcacagatggaataaacaa

SEQ ID NO: 165423 - DNA, 25 bp, E. coli
gcccagaaatgtggctataacagta

SEQ ID NO: 165424 - DNA, 25 bp, E. coli
gcccagaaatgtcgctataacagta

SEQ ID NO: 165425 - DNA, 25 bp, E. coli
gctatattgctgaagaggaacctcc

SEQ ID NO: 165426 - DNA, 25 bp, E. coli
gctatattgctgtagaggaacctcc

SEQ ID NO: 165427 - DNA, 25 bp, E. coli
gtatgcccctctaaactaagaattg

SEQ ID NO: 165428 - DNA, 25 bp, E. coli
gtatgcccctcttaactaagaattg

SEQ ID NO: 165429 - DNA, 25 bp, E. coli
gagctgcctggcaaatttactcttg

SEQ ID NO: 165430 - DNA, 25 bp, E. coli
gagctgcctggctaatttactcttg

SEQ ID NO: 165431 - DNA, 25 bp, E. coli
cactgaagattaatctggtggatta

SEQ ID NO: 165432 - DNA, 25 bp, E. coli
cactgaagattattctggtggatta

SEQ ID NO: 165433 - DNA, 25 bp, E. coli
atgttcttctcaccgctggtggcga

SEQ ID NO: 165434 - DNA, 25 bp, E. coli
acgcaaccgccggagcgttaatctt

SEQ ID NO: 165435 - DNA, 25 bp, E. coli
atgttcttctcagcgctggtggcga

SEQ ID NO: 165436 - DNA, 25 bp, E. coli
acctgtgtgtggtggtggtcgcagc

SEQ ID NO: 165437 - DNA, 25 bp, E. coli
acgcaaccgccgcagcgttaatctt

SEQ ID NO: 165438 - DNA, 25 bp, E. coli
acctgtgtgtggaggtggtcgcagc

SEQ ID NO: 165439 - DNA, 25 bp, E. coli
ttctcgatcaccgaagggattgcac

SEQ ID NO: 165440 - DNA, 25 bp, E. coli
ttctcgatcacccaagggattgcac

SEQ ID NO: 165441 - DNA, 25 bp, E. coli
tggtcgcagctcagtttgcactgaa

SEQ ID NO: 165442 - DNA, 25 bp, E. coli
tggtcgcagctctgtttgcactgaa

SEQ ID NO: 165443 - DNA, 25 bp, E. coli
gcagctctgtttgcactgaagatta

SEQ ID NO: 165444 - DNA, 25 bp, E. coli
gcagctctgtttccactgaagatta

SEQ ID NO: 165445 - DNA, 25 bp, E. coli
cgcgttaactgggatgattttaccg

SEQ ID NO: 165446 - DNA, 25 bp, E. coli
cgcgttaactggcatgattttaccg

SEQ ID NO: 165447 - DNA, 25 bp, E. coli
gttatgttcttctcaccgctggtgg

SEQ ID NO: 165448 - DNA, 25 bp, E. coli
gattttaccgaatcggtgcctgcgt

SEQ ID NO: 165449 - DNA, 25 bp, E. coli
gttatgttcttcacaccgctggtgg

SEQ ID NO: 165450 - DNA, 25 bp, E. coli
gattttaccgaaacggtgcctgcgt

SEQ ID NO: 165451 - DNA, 25 bp, E. coli
ggctttatgtcgtactgcatcatga

SEQ ID NO: 165452 - DNA, 25 bp, E. coli
ggctttatgtcgaactgcatcatga

SEQ ID NO: 165453 - DNA, 25 bp, E. coli
aatgcccagcaggacgactttgacc

SEQ ID NO: 165454 - DNA, 25 bp, E. coli
aatgcccagcagcacgactttgacc

SEQ ID NO: 165455 - DNA, 25 bp, E. coli
tatgcgttctgatcagctgccgacg

SEQ ID NO: 165456 - DNA, 25 bp, E. coli
tatgcgttctgaacagctgccgacg

SEQ ID NO: 165457 - DNA, 25 bp, E. coli
ttaccggcaaaccaagtgttgtggc

SEQ ID NO: 165458 - DNA, 25 bp, E. coli
ttaccggcaaacgaagtgttgtggc

SEQ ID NO: 165459 - DNA, 25 bp, E. coli
tgtttattcgcaccggcgacgtaga

SEQ ID NO: 165460 - DNA, 25 bp, E. coli
tgtttattcgcagcggcgacgtaga

SEQ ID NO: 165461 - DNA, 25 bp, E. coli
tgacggtttacgatccgcaggatgt

SEQ ID NO: 165462 - DNA, 25 bp, E. coli
tgacggtttacgttccgcaggatgt

SEQ ID NO: 165463 - DNA, 25 bp, E. coli
tcggcaatggttacgtggtgatcac

SEQ ID NO: 165464 - DNA, 25 bp, E. coli
tcggcaatggtttcgtggtgatcac

SEQ ID NO: 165465 - DNA, 25 bp, E. coli
gaacgttgcgcccatgcgctgaaaa

SEQ ID NO: 165466 - DNA, 25 bp, E. coli
gaacgttgcgccgatgcgctgaaaa

SEQ ID NO: 165467 - DNA, 25 bp, E. coli
gaaattccagaaaatgccgacctga

SEQ ID NO: 165468 - DNA, 25 bp, E. coli
gaaattccagaatatgccgacctga

SEQ ID NO: 165469 - DNA, 25 bp, E. coli
cgctgaaaacgctgcctgatgaaga

SEQ ID NO: 165470 - DNA, 25 bp, E. coli
cgctgaaaacgcagcctgatgaaga

SEQ ID NO: 165471 - DNA, 25 bp, E. coli
gtaatgcctgcgcaaaatgcccagc

SEQ ID NO: 165472 - DNA, 25 bp, E. coli
gtaatgcctgcggaaaatgcccagc

SEQ ID NO: 165473 - DNA, 25 bp, E. coli
tggagttcaaatccacctgctcgcg

SEQ ID NO: 165474 - DNA, 25 bp, E. coli
tggagttcaaatgcacctgctcgcg

SEQ ID NO: 165475 - DNA, 25 bp, E. coli
aatcagcgtaatcgaaagcgagcac

SEQ ID NO: 165476 - DNA, 25 bp, E. coli
caacctttaggtgaactggcgctct

SEQ ID NO: 165477 - DNA, 25 bp, E. coli
caacctttaggtcaactggcgctct

SEQ ID NO: 165478 - DNA, 25 bp, E. coli
aatcagcgtaatggaaagcgagcac

SEQ ID NO: 165479 - DNA, 25 bp, E. coli
cacctggaaagcgatgtataacggc

SEQ ID NO: 165480 - DNA, 25 bp, E. coli
cacctggaaagccatgtataacggc

SEQ ID NO: 165481 - DNA, 25 bp, E. coli
ttgagaaagactggcgtagcgcccc

SEQ ID NO: 165482 - DNA, 25 bp, E. coli
ttgagaaagactcgcgtagcgcccc

SEQ ID NO: 165483 - DNA, 25 bp, E. coli
tgaacaaccgatagagaaagactgg

SEQ ID NO: 165484 - DNA, 25 bp, E. coli
tgaacaaccgattgagaaagactgg

SEQ ID NO: 165485 - DNA, 25 bp, E. coli
tgccaaaagggcagacaaaatacct

SEQ ID NO: 165486 - DNA, 25 bp, E. coli
tgccaaaagggctgacaaaatacct

SEQ ID NO: 165487 - DNA, 25 bp, E. coli
gaagagctttcctgccacatgatga

SEQ ID NO: 165488 - DNA, 25 bp, E. coli
gaactggcgctctctattcctcgcg

SEQ ID NO: 165489 - DNA, 25 bp, E. coli
gaactggcgctcactattcctcgcg

SEQ ID NO: 165490 - DNA, 25 bp, E. coli
gaagagctttccagccacatgatga

SEQ ID NO: 165491 - DNA, 25 bp, E. coli
cgactaaagtcgtgcgcgttcacgc

SEQ ID NO: 165492 - DNA, 25 bp, E. coli
cgactaaagtcgagcgcgttcacgc

SEQ ID NO: 165493 - DNA, 25 bp, E. coli
cggcggcacgtaaagaactggatgt

SEQ ID NO: 165494 - DNA, 25 bp, E. coli
cggcggcacgtatagaactggatgt

SEQ ID NO: 165495 - DNA, 25 bp, E. coli
tggcttatcgcgaccaacctttagg

SEQ ID NO: 165496 - DNA, 25 bp, E. coli
tggcttatcgcgtccaacctttagg

SEQ ID NO: 165497 - DNA, 25 bp, E. coli
caaagtgttacgacaggcggttgtc

SEQ ID NO: 165498 - DNA, 25 bp, E. coli
caaagtgttacgtcaggcggttgtc

SEQ ID NO: 165499 - DNA, 25 bp, E. coli
taccagttcaaagtggcgatggccg

SEQ ID NO: 165500 - DNA, 25 bp, E. coli
tagaccggatgcagaaagagtttcg

SEQ ID NO: 165501 - DNA, 25 bp, E. coli
tagaccggatgctgaaagagtttcg

SEQ ID NO: 165502 - DNA, 25 bp, E. coli
taccagttcaaactggcgatggccg

SEQ ID NO: 165503 - DNA, 25 bp, E. coli
ttcctgaaagtatgcgcgtagaccg

SEQ ID NO: 165504 - DNA, 25 bp, E. coli
ttcctgaaagtaagcgcgtagaccg

SEQ ID NO: 165505 - DNA, 25 bp, E. coli
tgatggacatcggagaccaacgcgt

SEQ ID NO: 165506 - DNA, 25 bp, E. coli
tgaagccttcaggatggacaaagtg

SEQ ID NO: 165507 - DNA, 25 bp, E. coli
tgatggacatcgcagaccaacgcgt

SEQ ID NO: 165508 - DNA, 25 bp, E. coli
tgaagccttcagcatggacaaagtg

SEQ ID NO: 165509 - DNA, 25 bp, E. coli
gctctcagcgtttccacatggcgat

SEQ ID NO: 165510 - DNA, 25 bp, E. coli
gctctcagcgttaccacatggcgat

SEQ ID NO: 165511 - DNA, 25 bp, E. coli
cgaaaaaccgtgtcgaactgctggc

SEQ ID NO: 165512 - DNA, 25 bp, E. coli
cgaaaaaccgtgacgaactgctggc

SEQ ID NO: 165513 - DNA, 25 bp, E. coli
gattccgggcagtacgaccttatcg

SEQ ID NO: 165514 - DNA, 25 bp, E. coli
gattccgggcagaacgaccttatcg

SEQ ID NO: 165515 - DNA, 25 bp, E. coli
gatgattaccctcaaacgcaaccag

SEQ ID NO: 165516 - DNA, 25 bp, E. coli
gatgatatcgacttccgtcagctga

SEQ ID NO: 165517 - DNA, 25 bp, E. coli
gatgattaccctgaaacgcaaccag

SEQ ID NO: 165518 - DNA, 25 bp, E. coli
gatgatatcgacatccgtcagctga

SEQ ID NO: 165519 - DNA, 25 bp, E. coli
caggtcaggtcaatttcggaaaaat

SEQ ID NO: 165520 - DNA, 25 bp, E. coli
caggtcaggtcattttcggaaaaat

SEQ ID NO: 165521 - DNA, 25 bp, E. coli
ttttcaggaaaactcaggtcaggtc

SEQ ID NO: 165522 - DNA, 25 bp, E. coli
ttttcaggaaaagtcaggtcaggtc

SEQ ID NO: 165523 - DNA, 25 bp, E. coli
tgacaaaaaagaaattgcccgttcg

SEQ ID NO: 165524 - DNA, 25 bp, E. coli
tgacaaaaaagatattgcccgttcg

SEQ ID NO: 165525 - DNA, 25 bp, E. coli
tcgttttacgggtcagcactttact

SEQ ID NO: 165526 - DNA, 25 bp, E. coli
tcgttttacgggacagcactttact

SEQ ID NO: 165527 - DNA, 25 bp, E. coli
tctgggaggttcgattgtccttcaa

SEQ ID NO: 165528 - DNA, 25 bp, E. coli
tctgatgcccgatatgttcaagttg

SEQ ID NO: 165529 - DNA, 25 bp, E. coli
tctgatgcccgaaatgttcaagttg

SEQ ID NO: 165530 - DNA, 25 bp, E. coli
tctgggaggttccattgtccttcaa

SEQ ID NO: 165531 - DNA, 25 bp, E. coli
gccaactgtcaaatcagccctgtta

SEQ ID NO: 165532 - DNA, 25 bp, E. coli
gccaactgtcaattcagccctgtta

SEQ ID NO: 165533 - DNA, 25 bp, E. coli
cctgaaagtttcttgccaccgccaa

SEQ ID NO: 165534 - DNA, 25 bp, E. coli
cctgaaagtttcatgccaccgccaa

SEQ ID NO: 165535 - DNA, 25 bp, E. coli
gctattgaaaaccacacagctttgg

SEQ ID NO: 165536 - DNA, 25 bp, E. coli
gctattgaaaacgacacagctttgg

SEQ ID NO: 165537 - DNA, 25 bp, E. coli
gaaatgctggaacttgtccctgaaa

SEQ ID NO: 165538 - DNA, 25 bp, E. coli
gaaatgctggaagttgtccctgaaa

SEQ ID NO: 165539 - DNA, 25 bp, E. coli
gaaacttgtctatgaggtaggtcct

SEQ ID NO: 165540 - DNA, 25 bp, E. coli
gaaacttgtctaagaggtaggtcct

SEQ ID NO: 165541 - DNA, 25 bp, E. coli
caatatgatcaaacgcggtggcgag

SEQ ID NO: 165542 - DNA, 25 bp, E. coli
caatatgatcaatcgcggtggcgag

SEQ ID NO: 165543 - DNA, 25 bp, E. coli
atctgtattaaaggcgtaccaggga

SEQ ID NO: 165544 - DNA, 25 bp, E. coli
atcaaacgcggtggcgagaatgtct

SEQ ID NO: 165545 - DNA, 25 bp, E. coli
atctgtattaaacgcgtaccaggga

SEQ ID NO: 165546 - DNA, 25 bp, E. coli
atcaaacgcggtcgcgagaatgtct

SEQ ID NO: 165547 - DNA, 25 bp, E. coli
aaatctgtattataggcgtaccagg

SEQ ID NO: 165548 - DNA, 25 bp, E. coli
aaatctgtattaaaggcgtaccagg

SEQ ID NO: 165549 - DNA, 25 bp, E. coli
tgatcaaacgcggtggcgagaatgt

SEQ ID NO: 165550 - DNA, 25 bp, E. coli
tgatcaaacgcgctggcgagaatgt

SEQ ID NO: 165551 - DNA, 25 bp, E. coli
tgcaatatgatctaacgcggtggcg

SEQ ID NO: 165552 - DNA, 25 bp, E. coli
tgcaatatgatcaaacgcggtggcg

SEQ ID NO: 165553 - DNA, 25 bp, E. coli
tgaaatctgtataaaaggcgtacca

SEQ ID NO: 165554 - DNA, 25 bp, E. coli
tgaaatctgtattaaaggcgtacca

SEQ ID NO: 165555 - DNA, 25 bp, E. coli
tcaaagagtattatctcaacccgaa

SEQ ID NO: 165556 - DNA, 25 bp, E. coli
tcaaagagtattttctcaacccgaa

SEQ ID NO: 165557 - DNA, 25 bp, E. coli
gctgcaatatgaacaaacgcggtgg

SEQ ID NO: 165558 - DNA, 25 bp, E. coli
gctgcaatatgatcaaacgcggtgg

SEQ ID NO: 165559 - DNA, 25 bp, E. coli
gtattttctcaagccgaaagccact

SEQ ID NO: 165560 - DNA, 25 bp, E. coli
gtattttctcaacccgaaagccact

SEQ ID NO: 165561 - DNA, 25 bp, E. coli
gagtattttctctacccgaaagcca

SEQ ID NO: 165562 - DNA, 25 bp, E. coli
gagtattttctcaacccgaaagcca

SEQ ID NO: 165563 - DNA, 25 bp, E. coli
taaagttctcggcaatcgcatggcg

SEQ ID NO: 165564 - DNA, 25 bp, E. coli
taaagttctcgggaatcgcatggcg

SEQ ID NO: 165565 - DNA, 25 bp, E. coli
aaatttgctcttcgccttggcctga

SEQ ID NO: 165566 - DNA, 25 bp, E. coli
aaatttgctcttggccttggcctga

SEQ ID NO: 165567 - DNA, 25 bp, E. coli
tatgtcgttgcggtgcaaatctggg

SEQ ID NO: 165568 - DNA, 25 bp, E. coli
tatgtcacgccattcctcggtggct

SEQ ID NO: 165569 - DNA, 25 bp, E. coli
tatgtcacgccaatcctcggtggct

SEQ ID NO: 165570 - DNA, 25 bp, E. coli
tatgtcgttgcgctgcaaatctggg

SEQ ID NO: 165571 - DNA, 25 bp, E. coli
tgatgagcgccggattctgcattct

SEQ ID NO: 165572 - DNA, 25 bp, E. coli
tgatgagcgccgcattctgcattct

SEQ ID NO: 165573 - DNA, 25 bp, E. coli
tgctcggcgagctgtatgagccaac

SEQ ID NO: 165574 - DNA, 25 bp, E. coli
tgctcggcgagcagtatgagccaac

SEQ ID NO: 165575 - DNA, 25 bp, E. coli
tctgcattctgaccttaagcgcccg

SEQ ID NO: 165576 - DNA, 25 bp, E. coli
tctgcattctgagcttaagcgcccg

SEQ ID NO: 165577 - DNA, 25 bp, E. coli
gcaggcttcgtttgatgcttccggg

SEQ ID NO: 165578 - DNA, 25 bp, E. coli
gcaggcttcgttagatgcttccggg

SEQ ID NO: 165579 - DNA, 25 bp, E. coli
cccgctggtccggaatgtatggtca

SEQ ID NO: 165580 - DNA, 25 bp, E. coli
cccgctggtccgcaatgtatggtca

SEQ ID NO: 165581 - DNA, 25 bp, E. coli
ggtaatcgtaccgtgcgcatctggg

SEQ ID NO: 165582 - DNA, 25 bp, E. coli
ggtaatcgtaccctgcgcatctggg

SEQ ID NO: 165583 - DNA, 25 bp, E. coli
taatgccttcgctgttatgctgtgc

SEQ ID NO: 165584 - DNA, 25 bp, E. coli
taatgccttcgcagttatgctgtgc

SEQ ID NO: 165585 - DNA, 25 bp, E. coli
caacgcctggctgatggaaatcgtc

SEQ ID NO: 165586 - DNA, 25 bp, E. coli
caacgcctggctcatggaaatcgtc

SEQ ID NO: 165587 - DNA, 25 bp, E. coli
tactgggtttatccctgcatcgggc

SEQ ID NO: 165588 - DNA, 25 bp, E. coli
tactgggtttatgcctgcatcgggc

SEQ ID NO: 165589 - DNA, 25 bp, E. coli
tactggctggtctggctgcgattct

SEQ ID NO: 165590 - DNA, 25 bp, E. coli
tactggctggtcaggctgcgattct

SEQ ID NO: 165591 - DNA, 25 bp, E. coli
tgttaggtttcgtcagccgtcaccg

SEQ ID NO: 165592 - DNA, 25 bp, E. coli
tgacctttgtggttaccggcccgat

SEQ ID NO: 165593 - DNA, 25 bp, E. coli
tgacctttgtggataccggcccgat

SEQ ID NO: 165594 - DNA, 25 bp, E. coli
tgttaggtttcgacagccgtcaccg

SEQ ID NO: 165595 - DNA, 25 bp, E. coli
tctcctgatggtgctggcggttgcc

SEQ ID NO: 165596 - DNA, 25 bp, E. coli
tctcctgatggtcctggcggttgcc

SEQ ID NO: 165597 - DNA, 25 bp, E. coli
tcagcggcatcagcatgtcgattgg

SEQ ID NO: 165598 - DNA, 25 bp, E. coli
tcagcggcatcaccatgtcgattgg

SEQ ID NO: 165599 - DNA, 25 bp, E. coli
gtttgatgttcacccacagcctggc

SEQ ID NO: 165600 - DNA, 25 bp, E. coli
gtttgatgttcagccacagcctggc

SEQ ID NO: 165601 - DNA, 25 bp, E. coli
ggttcacagcagtccaaagtaccgt

SEQ ID NO: 165602 - DNA, 25 bp, E. coli
ggttcacagcagaccaaagtaccgt

SEQ ID NO: 165603 - DNA, 25 bp, E. coli
ggatgattttcccaatgatcgccgc

SEQ ID NO: 165604 - DNA, 25 bp, E. coli
ggatgattttccgaatgatcgccgc

SEQ ID NO: 165605 - DNA, 25 bp, E. coli
gaccttcggctgagagttcccggcg

SEQ ID NO: 165606 - DNA, 25 bp, E. coli
gaccttcggctgtgagttcccggcg

SEQ ID NO: 165607 - DNA, 25 bp, E. coli
aataacctcgaagcactagcaccag

SEQ ID NO: 165608 - DNA, 25 bp, E. coli
caacgatcggacaatacttgtgaac

SEQ ID NO: 165609 - DNA, 25 bp, E. coli
aataacctcgaaccactagcaccag

SEQ ID NO: 165610 - DNA, 25 bp, E. coli
caacgatcggactatacttgtgaac

SEQ ID NO: 165611 - DNA, 25 bp, E. coli
catagaagactctagctcagaagag

SEQ ID NO: 165612 - DNA, 25 bp, E. coli
catagaagactcaagctcagaagag

SEQ ID NO: 165613 - DNA, 25 bp, E. coli
aagacgaaaattgtccggacaatgg

SEQ ID NO: 165614 - DNA, 25 bp, E. coli
aagacgaaaattctccggacaatgg

SEQ ID NO: 165615 - DNA, 25 bp, E. coli
tatcgttgatctatcctctctggac

SEQ ID NO: 165616 - DNA, 25 bp, E. coli
tatcgttgatctttcctctctggac

SEQ ID NO: 165617 - DNA, 25 bp, E. coli
tttactaatgccaacatgtttcagg

SEQ ID NO: 165618 - DNA, 25 bp, E. coli
ttagtccgtcgataaatgaatgacc

SEQ ID NO: 165619 - DNA, 25 bp, E. coli
ttagtccgtcgaaaaatgaatgacc

SEQ ID NO: 165620 - DNA, 25 bp, E. coli
tttactaatgcctacatgtttcagg

SEQ ID NO: 165621 - DNA, 25 bp, E. coli
gaaagcccaacaggaaataacctcg

SEQ ID NO: 165622 - DNA, 25 bp, E. coli
gaaagcccaacacgaaataacctcg

SEQ ID NO: 165623 - DNA, 25 bp, E. coli
gaaatggtcactatacttaacacgt

SEQ ID NO: 165624 - DNA, 25 bp, E. coli
gaaatggtcactttacttaacacgt

SEQ ID NO: 165625 - DNA, 25 bp, E. coli
gatttcacagataaacatatggcta

SEQ ID NO: 165626 - DNA, 25 bp, E. coli
tgtgaacttaccattaatgaaccgt

SEQ ID NO: 165627 - DNA, 25 bp, E. coli
tgtgaacttacctttaatgaaccgt

SEQ ID NO: 165628 - DNA, 25 bp, E. coli
gatttcacagattaacatatggcta

SEQ ID NO: 165629 - DNA, 25 bp, E. coli
tcgatagtttttcccgttggttact

SEQ ID NO: 165630 - DNA, 25 bp, E. coli
tcgatagtttttgccgttggttact

SEQ ID NO: 165631 - DNA, 25 bp, E. coli
attgccaccacgaagtccggttgat

SEQ ID NO: 165632 - DNA, 25 bp, E. coli
attgccaccacgtagtccggttgat

SEQ ID NO: 165633 - DNA, 25 bp, E. coli
acttacaccaccactctttgatctt

SEQ ID NO: 165634 - DNA, 25 bp, E. coli
acttacaccacctctctttgatctt

SEQ ID NO: 165635 - DNA, 25 bp, E. coli
taatcttttcgaaagtttttgccgt

SEQ ID NO: 165636 - DNA, 25 bp, E. coli
tccattgccaccacgtagtccggtt

SEQ ID NO: 165637 - DNA, 25 bp, E. coli
tccattgccacctcgtagtccggtt

SEQ ID NO: 165638 - DNA, 25 bp, E. coli
taatcttttcgatagtttttgccgt

SEQ ID NO: 165639 - DNA, 25 bp, E. coli
tcttcgggattgcttgggactgaca

SEQ ID NO: 165640 - DNA, 25 bp, E. coli
tcttcgggattggttgggactgaca

SEQ ID NO: 165641 - DNA, 25 bp, E. coli
cgttggttactgagtggtcgccgaa

SEQ ID NO: 165642 - DNA, 25 bp, E. coli
cgttggttactgtgtggtcgccgaa

SEQ ID NO: 165643 - DNA, 25 bp, E. coli
gattggttgggactgacagatccaa

SEQ ID NO: 165644 - DNA, 25 bp, E. coli
gattggttgggagtgacagatccaa

SEQ ID NO: 165645 - DNA, 25 bp, E. coli
ggactgacagatgcaaattcggctg

SEQ ID NO: 165646 - DNA, 25 bp, E. coli
ggactgacagatccaaattcggctg

SEQ ID NO: 165647 - DNA, 25 bp, E. coli
tcctccgtacatttttcttcgggat

SEQ ID NO: 165648 - DNA, 25 bp, E. coli
tcctccgtacatatttcttcgggat

SEQ ID NO: 165649 - DNA, 25 bp, E. coli
tggttactgtgtcgtcgccgaagta

SEQ ID NO: 165650 - DNA, 25 bp, E. coli
tggttactgtgtggtcgccgaagta

SEQ ID NO: 165651 - DNA, 25 bp, E. coli
caacgtttctcaaagtgagatggca

SEQ ID NO: 165652 - DNA, 25 bp, E. coli
caacgtttctcatagtgagatggca

SEQ ID NO: 165653 - DNA, 25 bp, E. coli
taaagctattcgtgagcaactcaac

SEQ ID NO: 165654 - DNA, 25 bp, E. coli
taaagctattcgagagcaactcaac

SEQ ID NO: 165655 - DNA, 25 bp, E. coli
taaaagaacctggacgggtgacccg

SEQ ID NO: 165656 - DNA, 25 bp, E. coli
taccattaaaagctgggaatcgaag

SEQ ID NO: 165657 - DNA, 25 bp, E. coli
aatcctacgggaatggctgcaaaag

SEQ ID NO: 165658 - DNA, 25 bp, E. coli
aatcctacgggattggctgcaaaag

SEQ ID NO: 165659 - DNA, 25 bp, E. coli
taccattaaaaggtgggaatcgaag

SEQ ID NO: 165660 - DNA, 25 bp, E. coli
tgagttgaaaacctctctggaagag

SEQ ID NO: 165661 - DNA, 25 bp, E. coli
tgagttgaaaacgtctctggaagag

SEQ ID NO: 165662 - DNA, 25 bp, E. coli
tgagatggcaaaagctctgggaacc

SEQ ID NO: 165663 - DNA, 25 bp, E. coli
tgagatggcaaatgctctgggaacc

SEQ ID NO: 165664 - DNA, 25 bp, E. coli
tctgggaaccagtgtggataccatt

SEQ ID NO: 165665 - DNA, 25 bp, E. coli
tctgggaaccagagtggataccatt

SEQ ID NO: 165666 - DNA, 25 bp, E. coli
gaatcgaagcgatgaaatcctacgg

SEQ ID NO: 165667 - DNA, 25 bp, E. coli
gaatcgaagcgaagaaatcctacgg

SEQ ID NO: 165668 - DNA, 25 bp, E. coli
ctggaagaggctctcgagattaaac

SEQ ID NO: 165669 - DNA, 25 bp, E. coli
ctggaagaggctgtcgagattaaac

SEQ ID NO: 165670 - DNA, 25 bp, E. coli
gggtgacccgcttcgaaattgcgga

SEQ ID NO: 165671 - DNA, 25 bp, E. coli
gggtgacccgctacgaaattgcgga

SEQ ID NO: 165672 - DNA, 25 bp, E. coli
taaaagaacctgcacgggtgacccg

SEQ ID NO: 165673 - DNA, 25 bp, E. coli
aatagaacgtctggcaaagcgtggg

SEQ ID NO: 165674 - DNA, 25 bp, E. coli
aatagaacgtctcgcaaagcgtggg

SEQ ID NO: 165675 - DNA, 25 bp, E. coli
cacaagcgtgtatatattcgaaggc

SEQ ID NO: 165676 - DNA, 25 bp, E. coli
cacggtaatgtctgaatatcaatag

SEQ ID NO: 165677 - DNA, 25 bp, E. coli
cacggtaatgtcagaatatcaatag

SEQ ID NO: 165678 - DNA, 25 bp, E. coli
cacaagcgtgtaaatattcgaaggc

SEQ ID NO: 165679 - DNA, 25 bp, E. coli
tagccctaacaatttcacaagcgtg

SEQ ID NO: 165680 - DNA, 25 bp, E. coli
tagccctaacaaattcacaagcgtg

SEQ ID NO: 165681 - DNA, 25 bp, E. coli
tatatattcgaaggcgaacaaggta

SEQ ID NO: 165682 - DNA, 25 bp, E. coli
tatatattcgaacgcgaacaaggta

SEQ ID NO: 165683 - DNA, 25 bp, E. coli
tatcaatagaacctctggcaaagcg

SEQ ID NO: 165684 - DNA, 25 bp, E. coli
tatcaatagaacgtctggcaaagcg

SEQ ID NO: 165685 - DNA, 25 bp, E. coli
tgaaaataaacatacaattagccct

SEQ ID NO: 165686 - DNA, 25 bp, E. coli
tgaaaataaacaaacaattagccct

SEQ ID NO: 165687 - DNA, 25 bp, E. coli
ccttcaatgcaataagttgaaaata

SEQ ID NO: 165688 - DNA, 25 bp, E. coli
ccttcaatgcaaaaagttgaaaata

SEQ ID NO: 165689 - DNA, 25 bp, E. coli
gggtgattcaacttccttcaatgca

SEQ ID NO: 165690 - DNA, 25 bp, E. coli
ggtgggaagccatcacggtaatgtc

SEQ ID NO: 165691 - DNA, 25 bp, E. coli
gggtgattcaacatccttcaatgca

SEQ ID NO: 165692 - DNA, 25 bp, E. coli
ggtgggaagccaacacggtaatgtc

SEQ ID NO: 165693 - DNA, 25 bp, E. coli
taagcgaggcagcattattgtcgtc

SEQ ID NO: 165694 - DNA, 25 bp, E. coli
taagcgaggcaggattattgtcgtc

SEQ ID NO: 165695 - DNA, 25 bp, E. coli
caatataacctttcaagagctggga

SEQ ID NO: 165696 - DNA, 25 bp, E. coli
caatataaccttacaagagctggga

SEQ ID NO: 165697 - DNA, 25 bp, E. coli
cactgaagaagaaataataccgctg

SEQ ID NO: 165698 - DNA, 25 bp, E. coli
cactgaagaagatataataccgctg

SEQ ID NO: 165699 - DNA, 25 bp, E. coli
catcgaaaggtgtttactaccgcaa

SEQ ID NO: 165700 - DNA, 25 bp, E. coli
catcgaaaggtgattactaccgcaa

SEQ ID NO: 165701 - DNA, 25 bp, E. coli
taccgcaatgaacaagggcagacct

SEQ ID NO: 165702 - DNA, 25 bp, E. coli
taccgcaatgaagaagggcagacct

SEQ ID NO: 165703 - DNA, 25 bp, E. coli
tgtgcctgatgaaggactcgctcgc

SEQ ID NO: 165704 - DNA, 25 bp, E. coli
tgtgcctgatgatggactcgctcgc

SEQ ID NO: 165705 - DNA, 25 bp, E. coli
tcgctcgccggatctcatcgaaagg

SEQ ID NO: 165706 - DNA, 25 bp, E. coli
tcgctcgccggaactcatcgaaagg

SEQ ID NO: 165707 - DNA, 25 bp, E. coli
tctacagcaggatgcaaagcgactg

SEQ ID NO: 165708 - DNA, 25 bp, E. coli
tctacagcaggaagcaaagcgactg

SEQ ID NO: 165709 - DNA, 25 bp, E. coli
gccacgctggctaaaagaagcactg

SEQ ID NO: 165710 - DNA, 25 bp, E. coli
gccacgctggcttaaagaagcactg

SEQ ID NO: 165711 - DNA, 25 bp, E. coli
cgactgcgagaggaggaagttcaaa

SEQ ID NO: 165712 - DNA, 25 bp, E. coli
cgactgcgagagcaggaagttcaaa

SEQ ID NO: 165713 - DNA, 25 bp, E. coli
gagcaaattgcagttctacagcagg

SEQ ID NO: 165714 - DNA, 25 bp, E. coli
gagctgggatattctaatgtgcctg

SEQ ID NO: 165715 - DNA, 25 bp, E. coli
gagctgggatatactaatgtgcctg

SEQ ID NO: 165716 - DNA, 25 bp, E. coli
gagcaaattgcacttctacagcagg

SEQ ID NO: 165717 - DNA, 25 bp, E. coli
caacgttcgatacccaatggtggat

SEQ ID NO: 165718 - DNA, 25 bp, E. coli
caaaatagttcgcattggcaaccgc

SEQ ID NO: 165719 - DNA, 25 bp, E. coli
caacgttcgatagccaatggtggat

SEQ ID NO: 165720 - DNA, 25 bp, E. coli
caaaatagttcggattggcaaccgc

SEQ ID NO: 165721 - DNA, 25 bp, E. coli
catcggcattttcggcgcaggcgta

SEQ ID NO: 165722 - DNA, 25 bp, E. coli
catcggcattttgggcgcaggcgta

SEQ ID NO: 165723 - DNA, 25 bp, E. coli
taaatcgtggcctggcgtgcaaagc

SEQ ID NO: 165724 - DNA, 25 bp, E. coli
taaatcgtggccaggcgtgcaaagc

SEQ ID NO: 165725 - DNA, 25 bp, E. coli
tatctcctcaacctggcgcgtggtg

SEQ ID NO: 165726 - DNA, 25 bp, E. coli
tatctcctcaacgtggcgcgtggtg

SEQ ID NO: 165727 - DNA, 25 bp, E. coli
tattcctcaggcaagagtcagagca

SEQ ID NO: 165728 - DNA, 25 bp, E. coli
tattttgagcaagctacaggcacac

SEQ ID NO: 165729 - DNA, 25 bp, E. coli
tattttgagcaacctacaggcacac

SEQ ID NO: 165730 - DNA, 25 bp, E. coli
tattcctcaggctagagtcagagca

SEQ ID NO: 165731 - DNA, 25 bp, E. coli
tttcgcctggaagataccggtatgg

SEQ ID NO: 165732 - DNA, 25 bp, E. coli
tttcgcctggaacataccggtatgg

SEQ ID NO: 165733 - DNA, 25 bp, E. coli
tcttaaagcggtgttcgcactcggg

SEQ ID NO: 165734 - DNA, 25 bp, E. coli
tcttaaagcggtcttcgcactcggg

SEQ ID NO: 165735 - DNA, 25 bp, E. coli
gcgttgctggagtcgaacccgtaaa

SEQ ID NO: 165736 - DNA, 25 bp, E. coli
gcgttgctggagacgaacccgtaaa

SEQ ID NO: 165737 - DNA, 25 bp, E. coli
gaaaaattaccgcatggcgcgtatc

SEQ ID NO: 165738 - DNA, 25 bp, E. coli
gaaaaattaccggatggcgcgtatc

SEQ ID NO: 165739 - DNA, 25 bp, E. coli
agcgcctttatctcgtattgcatcg

SEQ ID NO: 165740 - DNA, 25 bp, E. coli
atgcctcaacgctgggcggcctgat

SEQ ID NO: 165741 - DNA, 25 bp, E. coli
agcgcctttatcacgtattgcatcg

SEQ ID NO: 165742 - DNA, 25 bp, E. coli
atgcctcaacgcagggcggcctgat

SEQ ID NO: 165743 - DNA, 25 bp, E. coli
tattgcatcgccctcgtgctggcct

SEQ ID NO: 165744 - DNA, 25 bp, E. coli
tattgcatcgccgtcgtgctggcct

SEQ ID NO: 165745 - DNA, 25 bp, E. coli
tgtccatcaaggttgcctcaacgct

SEQ ID NO: 165746 - DNA, 25 bp, E. coli
tgtccatcaaggatgcctcaacgct

SEQ ID NO: 165747 - DNA, 25 bp, E. coli
tgacgcttgagcgaatcagcgcctt

SEQ ID NO: 165748 - DNA, 25 bp, E. coli
tgacgcttgagccaatcagcgcctt

SEQ ID NO: 165749 - DNA, 25 bp, E. coli
tctcgcgggaggactatgaatccat

SEQ ID NO: 165750 - DNA, 25 bp, E. coli
tctcgcgggaggtctatgaatccat

SEQ ID NO: 165751 - DNA, 25 bp, E. coli
cctgatgattggtgtgctgatgctg

SEQ ID NO: 165752 - DNA, 25 bp, E. coli
cctgatgattggagtgctgatgctg

SEQ ID NO: 165753 - DNA, 25 bp, E. coli
cctggctgggcgttttgtccatcaa

SEQ ID NO: 165754 - DNA, 25 bp, E. coli
cctggctgggcgatttgtccatcaa

SEQ ID NO: 165755 - DNA, 25 bp, E. coli
cggcttctgcgcgacgggcagatct

SEQ ID NO: 165756 - DNA, 25 bp, E. coli
cggcttctgcgccacgggcagatct

SEQ ID NO: 165757 - DNA, 25 bp, E. coli
gtactacaaacagaaagcctaccgg

SEQ ID NO: 165758 - DNA, 25 bp, E. coli
gtactacaaacacaaagcctaccgg

SEQ ID NO: 165759 - DNA, 25 bp, E. coli
gatgctggctatgaactggtactac

SEQ ID NO: 165760 - DNA, 25 bp, E. coli
gatgctggctatcaactggtactac

SEQ ID NO: 165761 - DNA, 25 bp, E. coli
caggtttgttacacttatcgtgcca

SEQ ID NO: 165762 - DNA, 25 bp, E. coli
caactgacagtcattttatagggaa

SEQ ID NO: 165763 - DNA, 25 bp, E. coli
caggtttgttactcttatcgtgcca

SEQ ID NO: 165764 - DNA, 25 bp, E. coli
tatcccgccccgatagacgtattat

SEQ ID NO: 165765 - DNA, 25 bp, E. coli
caactgacagtctttttatagggaa

SEQ ID NO: 165766 - DNA, 25 bp, E. coli
tatcccgccccgttagacgtattat

SEQ ID NO: 165767 - DNA, 25 bp, E. coli
tatagggaatatatacaggtttgtt

SEQ ID NO: 165768 - DNA, 25 bp, E. coli
tatagggaatatttacaggtttgtt

SEQ ID NO: 165769 - DNA, 25 bp, E. coli
tgaccatcaaggcaaaatatcccgc

SEQ ID NO: 165770 - DNA, 25 bp, E. coli
tgaccatcaagggaaaatatcccgc

SEQ ID NO: 165771 - DNA, 25 bp, E. coli
tgcatttcaatggaccacgatagtg

SEQ ID NO: 165772 - DNA, 25 bp, E. coli
tgcatttcaatgcaccacgatagtg

SEQ ID NO: 165773 - DNA, 25 bp, E. coli
tcgtgccataaaattgaccatcaag

SEQ ID NO: 165774 - DNA, 25 bp, E. coli
tcgtgccataaatttgaccatcaag

SEQ ID NO: 165775 - DNA, 25 bp, E. coli
tcaggtacagcttcccagcgacgta

SEQ ID NO: 165776 - DNA, 25 bp, E. coli
tcaggtacagctacccagcgacgta

SEQ ID NO: 165777 - DNA, 25 bp, E. coli
cctggcgtgcacgatgatgatcatt

SEQ ID NO: 165778 - DNA, 25 bp, E. coli
cctggcgtgcaccatgatgatcatt

SEQ ID NO: 165779 - DNA, 25 bp, E. coli
cgatagtgcaactaacctggcgtgc

SEQ ID NO: 165780 - DNA, 25 bp, E. coli
cgatagtgcaacaaacctggcgtgc

SEQ ID NO: 165781 - DNA, 25 bp, E. coli
gatgatcattccatcaggtacagct

SEQ ID NO: 165782 - DNA, 25 bp, E. coli
gatgatcattccttcaggtacagct

SEQ ID NO: 165783 - DNA, 25 bp, E. coli
aattgctattggagaagatggcccg

SEQ ID NO: 165784 - DNA, 25 bp, E. coli
aattgctattggtgaagatggcccg

SEQ ID NO: 165785 - DNA, 25 bp, E. coli
cagcggctctgataaaatactacgg

SEQ ID NO: 165786 - DNA, 25 bp, E. coli
cagcggctctgaaaaaatactacgg

SEQ ID NO: 165787 - DNA, 25 bp, E. coli
taaaagagtttcactcagctcaggg

SEQ ID NO: 165788 - DNA, 25 bp, E. coli
taaaagagtttctctcagctcaggg

SEQ ID NO: 165789 - DNA, 25 bp, E. coli
tattgcgagtaatgcagcccatggt

SEQ ID NO: 165790 - DNA, 25 bp, E. coli
tattgcgagtaaagcagcccatggt

SEQ ID NO: 165791 - DNA, 25 bp, E. coli
tgcaactcaagctgctacagcggct

SEQ ID NO: 165792 - DNA, 25 bp, E. coli
tgcaactcaagcagctacagcggct

SEQ ID NO: 165793 - DNA, 25 bp, E. coli
tcgaagaactagtgaccaatgctgg

SEQ ID NO: 165794 - DNA, 25 bp, E. coli
tcgaagaactagagaccaatgctgg

SEQ ID NO: 165795 - DNA, 25 bp, E. coli
tctctatcgggaaaaaggagcttgc

SEQ ID NO: 165796 - DNA, 25 bp, E. coli
tcttaactcaggacaggtcacggct

SEQ ID NO: 165797 - DNA, 25 bp, E. coli
tctctatcgggataaaggagcttgc

SEQ ID NO: 165798 - DNA, 25 bp, E. coli
tcttaactcaggtcaggtcacggct

SEQ ID NO: 165799 - DNA, 25 bp, E. coli
gcagatctgaataacggcgttcgcc

SEQ ID NO: 165800 - DNA, 25 bp, E. coli
gcagatctgaattacggcgttcgcc

SEQ ID NO: 165801 - DNA, 25 bp, E. coli
gataaaggctatcagttaacacgct

SEQ ID NO: 165802 - DNA, 25 bp, E. coli
gataaaggctatgagttaacacgct

SEQ ID NO: 165803 - DNA, 25 bp, E. coli
gatggcccgatagctaacaaacgtg

SEQ ID NO: 165804 - DNA, 25 bp, E. coli
gatggcccgatacctaacaaacgtg

SEQ ID NO: 165805 - DNA, 25 bp, E. coli
aatttttcttgaccgtgatggcacc

SEQ ID NO: 165806 - DNA, 25 bp, E. coli
aatttttcttgagcgtgatggcacc

SEQ ID NO: 165807 - DNA, 25 bp, E. coli
catccgcagggtagtgttgaagagt

SEQ ID NO: 165808 - DNA, 25 bp, E. coli
cagtctggcattcctcgcggtaaat

SEQ ID NO: 165809 - DNA, 25 bp, E. coli
catccgcagggttgtgttgaagagt

SEQ ID NO: 165810 - DNA, 25 bp, E. coli
cagtctggcattgctcgcggtaaat

SEQ ID NO: 165811 - DNA, 25 bp, E. coli
taaattagaagatatgcaggcagcg

SEQ ID NO: 165812 - DNA, 25 bp, E. coli
taaattagaagaaatgcaggcagcg

SEQ ID NO: 165813 - DNA, 25 bp, E. coli
aaaaatgggctttgcgctggtggta

SEQ ID NO: 165814 - DNA, 25 bp, E. coli
aaaaatgggcttagcgctggtggta

SEQ ID NO: 165815 - DNA, 25 bp, E. coli
tattattgcccggatcatccgcagg

SEQ ID NO: 165816 - DNA, 25 bp, E. coli
tattattgcccgcatcatccgcagg

SEQ ID NO: 165817 - DNA, 25 bp, E. coli
tttgaaacgctgaccgagtggatgg

SEQ ID NO: 165818 - DNA, 25 bp, E. coli
tttgaaacgctgtccgagtggatgg

SEQ ID NO: 165819 - DNA, 25 bp, E. coli
ccgcttcttataaggtgggcgataa

SEQ ID NO: 165820 - DNA, 25 bp, E. coli
ccgcttcttatatggtgggcgataa

SEQ ID NO: 165821 - DNA, 25 bp, E. coli
tggcgaagagcgtacccgcaatttt

SEQ ID NO: 165822 - DNA, 25 bp, E. coli
tggcgaagagcgaacccgcaatttt

SEQ ID NO: 165823 - DNA, 25 bp, E. coli
tcacggctatgtccatgagatcgac

SEQ ID NO: 165824 - DNA, 25 bp, E. coli
tcacggctatgtgcatgagatcgac

SEQ ID NO: 165825 - DNA, 25 bp, E. coli
gacggtgttattcacgccatgcgcg

SEQ ID NO: 165826 - DNA, 25 bp, E. coli
gacggtgttattgacgccatgcgcg

SEQ ID NO: 165827 - DNA, 25 bp, E. coli
actttacagccactatccggtagcg

SEQ ID NO: 165828 - DNA, 25 bp, E. coli
actttacagccagtatccggtagcg

SEQ ID NO: 165829 - DNA, 25 bp, E. coli
tttacagccagtatccggtagcgaa

SEQ ID NO: 165830 - DNA, 25 bp, E. coli
tttacagccagtttccggtagcgaa

SEQ ID NO: 165831 - DNA, 25 bp, E. coli
ttacagccagtaaccggtagcgaaa

SEQ ID NO: 165832 - DNA, 25 bp, E. coli
ttacagccagtatccggtagcgaaa

SEQ ID NO: 165833 - DNA, 25 bp, E. coli
gtactttacagcgagtatccggtag

SEQ ID NO: 165834 - DNA, 25 bp, E. coli
gtactttacagccagtatccggtag

SEQ ID NO: 165835 - DNA, 25 bp, E. coli
cccgctggtgatccgtgggcctggc

SEQ ID NO: 165836 - DNA, 25 bp, E. coli
cgacctctccggcaaagacgtaatg

SEQ ID NO: 165837 - DNA, 25 bp, E. coli
cgacctctccgggaaagacgtaatg

SEQ ID NO: 165838 - DNA, 25 bp, E. coli
cccgctggtgatgcgtgggcctggc

SEQ ID NO: 165839 - DNA, 25 bp, E. coli
ccgtactttacagccagtatccggt

SEQ ID NO: 165840 - DNA, 25 bp, E. coli
ctttacagccagaatccggtagcga

SEQ ID NO: 165841 - DNA, 25 bp, E. coli
ccgtactttacacccagtatccggt

SEQ ID NO: 165842 - DNA, 25 bp, E. coli
ctttacagccagtatccggtagcga

SEQ ID NO: 165843 - DNA, 25 bp, E. coli
ctggtgatccgtgggcctggcgcgg

SEQ ID NO: 165844 - DNA, 25 bp, E. coli
ctggtgatccgtcggcctggcgcgg

SEQ ID NO: 165845 - DNA, 25 bp, E. coli
tactttacagccagtatccggtagc

SEQ ID NO: 165846 - DNA, 25 bp, E. coli
tactttacagcctgtatccggtagc

SEQ ID NO: 165847 - DNA, 25 bp, E. coli
gagcctgatccgggtgacgacctct

SEQ ID NO: 165848 - DNA, 25 bp, E. coli
gagcctgatccgcgtgacgacctct

SEQ ID NO: 165849 - DNA, 25 bp, E. coli
caaagctaaacggtatcgctatgcc

SEQ ID NO: 165850 - DNA, 25 bp, E. coli
caaagctaaacgctatcgctatgcc

SEQ ID NO: 165851 - DNA, 25 bp, E. coli
cattgttgccgcgtccatcaaagta

SEQ ID NO: 165852 - DNA, 25 bp, E. coli
cattgttgccgcctccatcaaagta

SEQ ID NO: 165853 - DNA, 25 bp, E. coli
ttatcaccggtaggcttggtaaagc

SEQ ID NO: 165854 - DNA, 25 bp, E. coli
accggtacgcttcgtaaagcgctgg

SEQ ID NO: 165855 - DNA, 25 bp, E. coli
accggtacgcttggtaaagcgctgg

SEQ ID NO: 165856 - DNA, 25 bp, E. coli
tcgatattatcagcggtacgcttgg

SEQ ID NO: 165857 - DNA, 25 bp, E. coli
tgccgcgtccatcaaagtactggag

SEQ ID NO: 165858 - DNA, 25 bp, E. coli
tgccgcgtccatgaaagtactggag

SEQ ID NO: 165859 - DNA, 25 bp, E. coli
tcgatattatcaccggtacgcttgg

SEQ ID NO: 165860 - DNA, 25 bp, E. coli
tctgtgcaaagcaaaacgctatcgc

SEQ ID NO: 165861 - DNA, 25 bp, E. coli
tctgtgcaaagctaaacgctatcgc

SEQ ID NO: 165862 - DNA, 25 bp, E. coli
ctggcaccggccattgttgccgcgt

SEQ ID NO: 165863 - DNA, 25 bp, E. coli
ctgggtgcggaacacgccattatct

SEQ ID NO: 165864 - DNA, 25 bp, E. coli
ctgggtgcggaagacgccattatct

SEQ ID NO: 165865 - DNA, 25 bp, E. coli
ctggcaccggcctttgttgccgcgt

SEQ ID NO: 165866 - DNA, 25 bp, E. coli
gggtgcggaagaggccattatctcc

SEQ ID NO: 165867 - DNA, 25 bp, E. coli
gggtgcggaagacgccattatctcc

SEQ ID NO: 165868 - DNA, 25 bp, E. coli
ttatcaccggtacgcttggtaaagc

SEQ ID NO: 165869 - DNA, 25 bp, E. coli
gatgggccgggtcgatattatcacc

SEQ ID NO: 165870 - DNA, 25 bp, E. coli
gatgggccgggtggatattatcacc

SEQ ID NO: 165871 - DNA, 25 bp, E. coli
tacgttagcgttcccgacttcgacg

SEQ ID NO: 165872 - DNA, 25 bp, E. coli
tacgttagcgttgccgacttcgacg

SEQ ID NO: 165873 - DNA, 25 bp, E. coli
aacaggttgcggctattcttcacga

SEQ ID NO: 165874 - DNA, 25 bp, E. coli
aacaggttgcgggtattcttcacga

SEQ ID NO: 165875 - DNA, 25 bp, E. coli
tattacgatgaactgccgacggaag

SEQ ID NO: 165876 - DNA, 25 bp, E. coli
tattacgatgaagtgccgacggaag

SEQ ID NO: 165877 - DNA, 25 bp, E. coli
ttctacctcggtagcatcggcggtc

SEQ ID NO: 165878 - DNA, 25 bp, E. coli
ttctacctcggttgcatcggcggtc

SEQ ID NO: 165879 - DNA, 25 bp, E. coli
tgcacacgccaacctgaaagagctg

SEQ ID NO: 165880 - DNA, 25 bp, E. coli
tgcacacgccaagctgaaagagctg

SEQ ID NO: 165881 - DNA, 25 bp, E. coli
tcctgaaagtggtaccagaagccct

SEQ ID NO: 165882 - DNA, 25 bp, E. coli
tcgacggcgaaagcatcctgaaagt

SEQ ID NO: 165883 - DNA, 25 bp, E. coli
tcgacggcgaaaccatcctgaaagt

SEQ ID NO: 165884 - DNA, 25 bp, E. coli
tcctgaaagtggaaccagaagccct

SEQ ID NO: 165885 - DNA, 25 bp, E. coli
tcttaagaaactgcgaaatcgccgc

SEQ ID NO: 165886 - DNA, 25 bp, E. coli
tcttaagaaactccgaaatcgccgc

SEQ ID NO: 165887 - DNA, 25 bp, E. coli
ccggcgtttatcgtggtcgatgaca

SEQ ID NO: 165888 - DNA, 25 bp, E. coli
ccggcgtttatcctggtcgatgaca

SEQ ID NO: 165889 - DNA, 25 bp, E. coli
gaaagagctgattgacgccggtaaa

SEQ ID NO: 165890 - DNA, 25 bp, E. coli
gaaagagctgatagacgccggtaaa

SEQ ID NO: 165891 - DNA, 25 bp, E. coli
cgcaaatcgacctgtacgcggtaga

SEQ ID NO: 165892 - DNA, 25 bp, E. coli
cgcaaatcgaccagtacgcggtaga

SEQ ID NO: 165893 - DNA, 25 bp, E. coli
aattctgcgtaaagtctctcaggcc

SEQ ID NO: 165894 - DNA, 25 bp, E. coli
aattctgcgtaatgtctctcaggcc

SEQ ID NO: 165895 - DNA, 25 bp, E. coli
tactgacgaaataacttaaccgccg

SEQ ID NO: 165896 - DNA, 25 bp, E. coli
tacaaatccagcataccgtcgcgga

SEQ ID NO: 165897 - DNA, 25 bp, E. coli
tacaaatccagcttaccgtcgcgga

SEQ ID NO: 165898 - DNA, 25 bp, E. coli
taaagccgcggatattgccgttgcg

SEQ ID NO: 165899 - DNA, 25 bp, E. coli
taaagccgcggaaattgccgttgcg

SEQ ID NO: 165900 - DNA, 25 bp, E. coli
tgtttgaagaagtatcgcgccacga

SEQ ID NO: 165901 - DNA, 25 bp, E. coli
tgtttgaagaagaatcgcgccacga

SEQ ID NO: 165902 - DNA, 25 bp, E. coli
tgcatgcccgcaaaggaattccggt

SEQ ID NO: 165903 - DNA, 25 bp, E. coli
tgcatgcccgcataggaattccggt

SEQ ID NO: 165904 - DNA, 25 bp, E. coli
tctgcccaggttcacgatgtcgaaa

SEQ ID NO: 165905 - DNA, 25 bp, E. coli
tctgcccaggttgacgatgtcgaaa

SEQ ID NO: 165906 - DNA, 25 bp, E. coli
gactgaagcttctgaaaacgaaacg

SEQ ID NO: 165907 - DNA, 25 bp, E. coli
gacaacgtccgcagtagtgattatg

SEQ ID NO: 165908 - DNA, 25 bp, E. coli
gacaacgtccgctgtagtgattatg

SEQ ID NO: 165909 - DNA, 25 bp, E. coli
gactgaagcttcagaaaacgaaacg

SEQ ID NO: 165910 - DNA, 25 bp, E. coli
tactgacgaaattacttaaccgccg

SEQ ID NO: 165911 - DNA, 25 bp, E. coli
gacccgcatgccgaagaattcttga

SEQ ID NO: 165912 - DNA, 25 bp, E. coli
gacccgcatgcccaagaattcttga

SEQ ID NO: 165913 - DNA, 25 bp, E. coli
gatccgcccattcgtgctaaagccg

SEQ ID NO: 165914 - DNA, 25 bp, E. coli
gatccgcccattggtgctaaagccg

SEQ ID NO: 165915 - DNA, 25 bp, E. coli
caaatttgatatggccggtagcccg

SEQ ID NO: 165916 - DNA, 25 bp, E. coli
caaatttgatatcgccggtagcccg

SEQ ID NO: 165917 - DNA, 25 bp, E. coli
tgacctttggtttccgggcggctga

SEQ ID NO: 165918 - DNA, 25 bp, E. coli
tgacctttggttaccgggcggctga

SEQ ID NO: 165919 - DNA, 25 bp, E. coli
tgacggtcagcagggatacttcctg

SEQ ID NO: 165920 - DNA, 25 bp, E. coli
tgacggtcagcacggatacttcctg

SEQ ID NO: 165921 - DNA, 25 bp, E. coli
tgcgtactacgacaaaaaccggact

SEQ ID NO: 165922 - DNA, 25 bp, E. coli
tgcgtactacgagaaaaaccggact

SEQ ID NO: 165923 - DNA, 25 bp, E. coli
tcaggcggaaggctatatcgatcaa

SEQ ID NO: 165924 - DNA, 25 bp, E. coli
tcaggcggaagggtatatcgatcaa

SEQ ID NO: 165925 - DNA, 25 bp, E. coli
cctggcagagcattccggatgcgta

SEQ ID NO: 165926 - DNA, 25 bp, E. coli
gcgccaaaggcacgatgttcaaact

SEQ ID NO: 165927 - DNA, 25 bp, E. coli
gcgccaaaggcaggatgttcaaact

SEQ ID NO: 165928 - DNA, 25 bp, E. coli
gaatcttccaggcttcgccatcggc

SEQ ID NO: 165929 - DNA, 25 bp, E. coli
gaatcttccagggttcgccatcggc

SEQ ID NO: 165930 - DNA, 25 bp, E. coli
gacgtagtggatatgcgcctcgaag

SEQ ID NO: 165931 - DNA, 25 bp, E. coli
gaaaaagcggtcttcttcggtgcga

SEQ ID NO: 165932 - DNA, 25 bp, E. coli
gacgtagtggatttgcgcctcgaag

SEQ ID NO: 165933 - DNA, 25 bp, E. coli
gaaaaagcggtcatcttcggtgcga

SEQ ID NO: 165934 - DNA, 25 bp, E. coli
cctggcagagcaatccggatgcgta

SEQ ID NO: 165935 - DNA, 25 bp, E. coli
tcaaacgctgtttgcgccgcactgg

SEQ ID NO: 165936 - DNA, 25 bp, E. coli
tcaaacgctgttagcgccgcactgg

SEQ ID NO: 165937 - DNA, 25 bp, E. coli
caattttacgggttatatacgctaa

SEQ ID NO: 165938 - DNA, 25 bp, E. coli
caattttacgggatatatacgctaa

SEQ ID NO: 165939 - DNA, 25 bp, E. coli
cactcttcacttgagacgtggcgta

SEQ ID NO: 165940 - DNA, 25 bp, E. coli
cactcttcacttcagacgtggcgta

SEQ ID NO: 165941 - DNA, 25 bp, E. coli
tatgacatcatggataacaaaatca

SEQ ID NO: 165942 - DNA, 25 bp, E. coli
tatgacatcatgcataacaaaatca

SEQ ID NO: 165943 - DNA, 25 bp, E. coli
tttgcctgacaaagagggcgtgctt

SEQ ID NO: 165944 - DNA, 25 bp, E. coli
tatacgctaataccttcccgtggtg

SEQ ID NO: 165945 - DNA, 25 bp, E. coli
tatacgctaatagcttcccgtggtg

SEQ ID NO: 165946 - DNA, 25 bp, E. coli
tttgcctgacaatgagggcgtgctt

SEQ ID NO: 165947 - DNA, 25 bp, E. coli
tcttttgtaagggaaaacgcacagc

SEQ ID NO: 165948 - DNA, 25 bp, E. coli
tcttttgtaaggcaaaacgcacagc

SEQ ID NO: 165949 - DNA, 25 bp, E. coli
gaaatattcggcaattttacgggat

SEQ ID NO: 165950 - DNA, 25 bp, E. coli
gaaatattcggctattttacgggat

SEQ ID NO: 165951 - DNA, 25 bp, E. coli
gggaaaacgcacagcactcttcact

SEQ ID NO: 165952 - DNA, 25 bp, E. coli
gggaaaacgcactgcactcttcact

SEQ ID NO: 165953 - DNA, 25 bp, E. coli
gacgtggcgtacaactttgcctgac

SEQ ID NO: 165954 - DNA, 25 bp, E. coli
gagggcgtgcttatgctgaattatc

SEQ ID NO: 165955 - DNA, 25 bp, E. coli
gagtttaacaaaatatgacatcatg

SEQ ID NO: 165956 - DNA, 25 bp, E. coli
gagtttaacaaattatgacatcatg

SEQ ID NO: 165957 - DNA, 25 bp, E. coli
gagggcgtgcttttgctgaattatc

SEQ ID NO: 165958 - DNA, 25 bp, E. coli
gacgtggcgtactactttgcctgac

SEQ ID NO: 165959 - DNA, 25 bp, E. coli
aactggtcagcgttgcataaggcgg

SEQ ID NO: 165960 - DNA, 25 bp, E. coli
catgtctatggcatgatgcgcggtc

SEQ ID NO: 165961 - DNA, 25 bp, E. coli
catgtctatggcttgatgcgcggtc

SEQ ID NO: 165962 - DNA, 25 bp, E. coli
aactggtcagcgatgcataaggcgg

SEQ ID NO: 165963 - DNA, 25 bp, E. coli
tattttgtacgatcctgatggcgga

SEQ ID NO: 165964 - DNA, 25 bp, E. coli
tattttgtacgaacctgatggcgga

SEQ ID NO: 165965 - DNA, 25 bp, E. coli
tgattgttacaagccacgttagcgc

SEQ ID NO: 165966 - DNA, 25 bp, E. coli
tggtgaccgggaaacgcaaatattt

SEQ ID NO: 165967 - DNA, 25 bp, E. coli
tggtgaccgggatacgcaaatattt

SEQ ID NO: 165968 - DNA, 25 bp, E. coli
tgtccatcgcagctgaatactggct

SEQ ID NO: 165969 - DNA, 25 bp, E. coli
tgattgttacaacccacgttagcgc

SEQ ID NO: 165970 - DNA, 25 bp, E. coli
tgtccatcgcaggtgaatactggct

SEQ ID NO: 165971 - DNA, 25 bp, E. coli
gcagttagtcgataacgctttgacc

SEQ ID NO: 165972 - DNA, 25 bp, E. coli
gcagttagtcgaaaacgctttgacc

SEQ ID NO: 165973 - DNA, 25 bp, E. coli
gaacctaaggttatccatcaggcgc

SEQ ID NO: 165974 - DNA, 25 bp, E. coli
gaacctaaggttttccatcaggcgc

SEQ ID NO: 165975 - DNA, 25 bp, E. coli
cgtaagtggctgcaaagatgcgcaa

SEQ ID NO: 165976 - DNA, 25 bp, E. coli
cgtaagtggctggaaagatgcgcaa

SEQ ID NO: 165977 - DNA, 25 bp, E. coli
gttgtactcaacgtcagtgcactgg

SEQ ID NO: 165978 - DNA, 25 bp, E. coli
gttgtactcaacctcagtgcactgg

SEQ ID NO: 165979 - DNA, 25 bp, E. coli
ggcgctggaagacaaaatcgctcag

SEQ ID NO: 165980 - DNA, 25 bp, E. coli
ggcgctggaagagaaaatcgctcag

SEQ ID NO: 165981 - DNA, 25 bp, E. coli
caaggatgaaatagtgctttttact

SEQ ID NO: 165982 - DNA, 25 bp, E. coli
caaggatgaaattgtgctttttact

SEQ ID NO: 165983 - DNA, 25 bp, E. coli
cacgccacggtaataggcatatcct

SEQ ID NO: 165984 - DNA, 25 bp, E. coli
cagcaacaaggaagaaatagtgctt

SEQ ID NO: 165985 - DNA, 25 bp, E. coli
cagcaacaaggatgaaatagtgctt

SEQ ID NO: 165986 - DNA, 25 bp, E. coli
cacgccacggtattaggcatatcct

SEQ ID NO: 165987 - DNA, 25 bp, E. coli
gctttttactaacagttctactcca

SEQ ID NO: 165988 - DNA, 25 bp, E. coli
gctttttactaagagttctactcca

SEQ ID NO: 165989 - DNA, 25 bp, E. coli
taggcatatcctttatagcccctgg

SEQ ID NO: 165990 - DNA, 25 bp, E. coli
taggcatatcctatatagcccctgg

SEQ ID NO: 165991 - DNA, 25 bp, E. coli
tatatagcccctggtgagagtcacc

SEQ ID NO: 165992 - DNA, 25 bp, E. coli
tatatagcccctcgtgagagtcacc

SEQ ID NO: 165993 - DNA, 25 bp, E. coli
ttctactccagttccggactgctca

SEQ ID NO: 165994 - DNA, 25 bp, E. coli
ttctactccagtaccggactgctca

SEQ ID NO: 165995 - DNA, 25 bp, E. coli
taagagttctacaccagttccggac

SEQ ID NO: 165996 - DNA, 25 bp, E. coli
taagagttctactccagttccggac

SEQ ID NO: 165997 - DNA, 25 bp, E. coli
gactgctcacgccacggtattaggc

SEQ ID NO: 165998 - DNA, 25 bp, E. coli
gactgctcacgcgacggtattaggc

SEQ ID NO: 165999 - DNA, 25 bp, E. coli
ggtgagagtcacgagttccttgatt

SEQ ID NO: 166000 - DNA, 25 bp, E. coli
ggtgagagtcaccagttccttgatt

SEQ ID NO: 166001 - DNA, 25 bp, E. coli
gagtcaccagttgcttgattaaata

SEQ ID NO: 166002 - DNA, 25 bp, E. coli
gagtcaccagttccttgattaaata

SEQ ID NO: 166003 - DNA, 25 bp, E. coli
caagttctatcggtgcacagatggg

SEQ ID NO: 166004 - DNA, 25 bp, E. coli
caagttctatcgctgcacagatggg

SEQ ID NO: 166005 - DNA, 25 bp, E. coli
tatgtttacggtcataccgcgacgc

SEQ ID NO: 166006 - DNA, 25 bp, E. coli
tatgtttacggtgataccgcgacgc

SEQ ID NO: 166007 - DNA, 25 bp, E. coli
ttatcattgcggaggtggcggcatc

SEQ ID NO: 166008 - DNA, 25 bp, E. coli
ttatcattgcggtggtggcggcatc

SEQ ID NO: 166009 - DNA, 25 bp, E. coli
tgcaaattgccgagaagctgctgcg

SEQ ID NO: 166010 - DNA, 25 bp, E. coli
tgcaaattgccgtgaagctgctgcg

SEQ ID NO: 166011 - DNA, 25 bp, E. coli
gaaatatgtctctattgtcgcgccg

SEQ ID NO: 166012 - DNA, 25 bp, E. coli
gaaatatgtctcaattgtcgcgccg

SEQ ID NO: 166013 - DNA, 25 bp, E. coli
gaaagagtatccctgggcctatgcc

SEQ ID NO: 166014 - DNA, 25 bp, E. coli
gaaagagtatccgtgggcctatgcc

SEQ ID NO: 166015 - DNA, 25 bp, E. coli
cgacttatccgagcgatctggcagc

SEQ ID NO: 166016 - DNA, 25 bp, E. coli
cgcgacgctgctcgataaaaaactg

SEQ ID NO: 166017 - DNA, 25 bp, E. coli
cgcgacgctgctggataaaaaactg

SEQ ID NO: 166018 - DNA, 25 bp, E. coli
cgacttatccgaccgatctggcagc

SEQ ID NO: 166019 - DNA, 25 bp, E. coli
gtttgtaaactcacaggctgcggcg

SEQ ID NO: 166020 - DNA, 25 bp, E. coli
gtttgtaaactctcaggctgcggcg

SEQ ID NO: 166021 - DNA, 25 bp, E. coli
gattatcgccagaccggtgtcggtt

SEQ ID NO: 166022 - DNA, 25 bp, E. coli
gattatcgccagtccggtgtcggtt

SEQ ID NO: 166023 - DNA, 25 bp, E. coli
gatccggcatacttcgtggcttcag

SEQ ID NO: 166024 - DNA, 25 bp, E. coli
gatccggcatacatcgtggcttcag

SEQ ID NO: 166025 - DNA, 25 bp, E. coli
caacagtacgcacgttgtcggcacg

SEQ ID NO: 166026 - DNA, 25 bp, E. coli
caacagtacgcaggttgtcggcacg

SEQ ID NO: 166027 - DNA, 25 bp, E. coli
taccgataatgatctgttagtgaat

SEQ ID NO: 166028 - DNA, 25 bp, E. coli
taccgataatgaactgttagtgaat

SEQ ID NO: 166029 - DNA, 25 bp, E. coli
tattgcgctactcgcgtgtgcaggc

SEQ ID NO: 166030 - DNA, 25 bp, E. coli
tattgcgctactggcgtgtgcaggc

SEQ ID NO: 166031 - DNA, 25 bp, E. coli
ttgaaatggcggatgaattgctggc

SEQ ID NO: 166032 - DNA, 25 bp, E. coli
ttgaaatggcggttgaattgctggc

SEQ ID NO: 166033 - DNA, 25 bp, E. coli
tgttagtgaatgaaatttctgacag

SEQ ID NO: 166034 - DNA, 25 bp, E. coli
tgttagtgaatgtaatttctgacag

SEQ ID NO: 166035 - DNA, 25 bp, E. coli
tgcctgctgttgatgaaatggcgga

SEQ ID NO: 166036 - DNA, 25 bp, E. coli
tgcctgctgttgttgaaatggcgga

SEQ ID NO: 166037 - DNA, 25 bp, E. coli
cctgacgcaggtacaaaagctgctg

SEQ ID NO: 166038 - DNA, 25 bp, E. coli
cctgacgcaggttcaaaagctgctg

SEQ ID NO: 166039 - DNA, 25 bp, E. coli
cgctactggcgtctgcaggcccgat

SEQ ID NO: 166040 - DNA, 25 bp, E. coli
cgctactggcgtgtgcaggcccgat

SEQ ID NO: 166041 - DNA, 25 bp, E. coli
gttgtcggcacgaccggcggttcca

SEQ ID NO: 166042 - DNA, 25 bp, E. coli
gttgtcggcacgtccggcggttcca

SEQ ID NO: 166043 - DNA, 25 bp, E. coli
ggcggtaacgcctcctatatgatta

SEQ ID NO: 166044 - DNA, 25 bp, E. coli
gtgagcgatccgctccagacgctgc

SEQ ID NO: 166045 - DNA, 25 bp, E. coli
gtgagcgatccggtccagacgctgc

SEQ ID NO: 166046 - DNA, 25 bp, E. coli
ggcggtaacgccacctatatgatta

SEQ ID NO: 166047 - DNA, 25 bp, E. coli
aattaagaagccttgccaacagcgc

SEQ ID NO: 166048 - DNA, 25 bp, E. coli
aattaagaagccatgccaacagcgc

SEQ ID NO: 166049 - DNA, 25 bp, E. coli
tagttcaaccagcaaaatagagagc

SEQ ID NO: 166050 - DNA, 25 bp, E. coli
tagttcaaccaggaaaatagagagc

SEQ ID NO: 166051 - DNA, 25 bp, E. coli
tatctttaaacatcgcagcaaacga

SEQ ID NO: 166052 - DNA, 25 bp, E. coli
tatctttaaacaacgcagcaaacga

SEQ ID NO: 166053 - DNA, 25 bp, E. coli
tgaaaaataataaactggcgaccag

SEQ ID NO: 166054 - DNA, 25 bp, E. coli
tgaaaaataatatactggcgaccag

SEQ ID NO: 166055 - DNA, 25 bp, E. coli
tcagtcgctggtgaataatgaacgc

SEQ ID NO: 166056 - DNA, 25 bp, E. coli
gaatatgtggcttcagtcgctggtg

SEQ ID NO: 166057 - DNA, 25 bp, E. coli
gaatatgtggctacagtcgctggtg

SEQ ID NO: 166058 - DNA, 25 bp, E. coli
gattaacggcttatcaggtcacgct

SEQ ID NO: 166059 - DNA, 25 bp, E. coli
gattaacggcttttcaggtcacgct

SEQ ID NO: 166060 - DNA, 25 bp, E. coli
tggcgaccagtgaattaagaagcct

SEQ ID NO: 166061 - DNA, 25 bp, E. coli
tggcgaccagtgtattaagaagcct

SEQ ID NO: 166062 - DNA, 25 bp, E. coli
tcagtcgctggtcaataatgaacgc

SEQ ID NO: 166063 - DNA, 25 bp, E. coli
tcaactgcaagattaatattagccg

SEQ ID NO: 166064 - DNA, 25 bp, E. coli
taatgaacgcgaagaatcaactgca

SEQ ID NO: 166065 - DNA, 25 bp, E. coli
taatgaacgcgatgaatcaactgca

SEQ ID NO: 166066 - DNA, 25 bp, E. coli
tcaactgcaagaataatattagccg

SEQ ID NO: 166067 - DNA, 25 bp, E. coli
gagcatatcagagaagattaacggc

SEQ ID NO: 166068 - DNA, 25 bp, E. coli
gagcatatcagacaagattaacggc

SEQ ID NO: 166069 - DNA, 25 bp, E. coli
caaccattgcatatctcgggctggg

SEQ ID NO: 166070 - DNA, 25 bp, E. coli
caaccattgcatttctcgggctggg

SEQ ID NO: 166071 - DNA, 25 bp, E. coli
tacggcagcagggaaaggacatttt

SEQ ID NO: 166072 - DNA, 25 bp, E. coli
tacggcagcaggcaaaggacatttt

SEQ ID NO: 166073 - DNA, 25 bp, E. coli
tattacgccgcagcaagtcaagacg

SEQ ID NO: 166074 - DNA, 25 bp, E. coli
tattgcagttgacgtcgctcggaaa

SEQ ID NO: 166075 - DNA, 25 bp, E. coli
tattgcagttgaggtcgctcggaaa

SEQ ID NO: 166076 - DNA, 25 bp, E. coli
tattacgccgcaccaagtcaagacg

SEQ ID NO: 166077 - DNA, 25 bp, E. coli
tgatgtcaatactcaggccgtcgat

SEQ ID NO: 166078 - DNA, 25 bp, E. coli
tgatgtcaatacacaggccgtcgat

SEQ ID NO: 166079 - DNA, 25 bp, E. coli
gctaaatcaggttcgccagcaggct

SEQ ID NO: 166080 - DNA, 25 bp, E. coli
gctaaatcaggtacgccagcaggct

SEQ ID NO: 166081 - DNA, 25 bp, E. coli
gacaggagagtattcatggcaacca

SEQ ID NO: 166082 - DNA, 25 bp, E. coli
gacattttacgagcacctggcctgg

SEQ ID NO: 166083 - DNA, 25 bp, E. coli
gacattttacgaccacctggcctgg

SEQ ID NO: 166084 - DNA, 25 bp, E. coli
gacaggagagtaatcatggcaacca

SEQ ID NO: 166085 - DNA, 25 bp, E. coli
cgaagccgctgtcttatgtgagtca

SEQ ID NO: 166086 - DNA, 25 bp, E. coli
cgaagccgctgtgttatgtgagtca

SEQ ID NO: 166087 - DNA, 25 bp, E. coli
ccccgtgggcagtacgtcagtgaat

SEQ ID NO: 166088 - DNA, 25 bp, E. coli
ccccgtgggcagaacgtcagtgaat

SEQ ID NO: 166089 - DNA, 25 bp, E. coli
gatgagcagattgcgcgtgcacgcc

SEQ ID NO: 166090 - DNA, 25 bp, E. coli
gatgagcagattccgcgtgcacgcc

SEQ ID NO: 166091 - DNA, 25 bp, E. coli
cacgcgtttatgcagatgtcagcag

SEQ ID NO: 166092 - DNA, 25 bp, E. coli
cagcacggtgtacagccttatacgc

SEQ ID NO: 166093 - DNA, 25 bp, E. coli
cagcacggtgtagagccttatacgc

SEQ ID NO: 166094 - DNA, 25 bp, E. coli
cacgcgtttatggagatgtcagcag

SEQ ID NO: 166095 - DNA, 25 bp, E. coli
aaaatgatttctgtgctggtggcgc

SEQ ID NO: 166096 - DNA, 25 bp, E. coli
aaaatgatttctctgctggtggcgc

SEQ ID NO: 166097 - DNA, 25 bp, E. coli
taccgtgctggaggcgttacagtta

SEQ ID NO: 166098 - DNA, 25 bp, E. coli
taccgtgctggacgcgttacagtta

SEQ ID NO: 166099 - DNA, 25 bp, E. coli
tgaagcggttatcgccagtcaggac

SEQ ID NO: 166100 - DNA, 25 bp, E. coli
tgaagcggttatggccagtcaggac

SEQ ID NO: 166101 - DNA, 25 bp, E. coli
tgcagaacagtgtaggcgcacaatt

SEQ ID NO: 166102 - DNA, 25 bp, E. coli
tgcagaacagtgaaggcgcacaatt

SEQ ID NO: 166103 - DNA, 25 bp, E. coli
gcagcggtgttccataaaggcgaaa

SEQ ID NO: 166104 - DNA, 25 bp, E. coli
gcaacgctatattcgctggcagact

SEQ ID NO: 166105 - DNA, 25 bp, E. coli
gcagcggtgttcgataaaggcgaaa

SEQ ID NO: 166106 - DNA, 25 bp, E. coli
gcaacgctatatacgctggcagact

SEQ ID NO: 166107 - DNA, 25 bp, E. coli
cttttttgataacggccgtcggcag

SEQ ID NO: 166108 - DNA, 25 bp, E. coli
tcctttagttgacagttacagtgcc

SEQ ID NO: 166109 - DNA, 25 bp, E. coli
cttttttgataagggccgtcggcag

SEQ ID NO: 166110 - DNA, 25 bp, E. coli
tcctttagttgagagttacagtgcc

SEQ ID NO: 166111 - DNA, 25 bp, E. coli
tggatgtcgctatccgcctgattga

SEQ ID NO: 166112 - DNA, 25 bp, E. coli
tggatgtcgctaaccgcctgattga

SEQ ID NO: 166113 - DNA, 25 bp, E. coli
caattttacttgtggttggcgcctg

SEQ ID NO: 166114 - DNA, 25 bp, E. coli
caattttacttgaggttggcgcctg

SEQ ID NO: 166115 - DNA, 25 bp, E. coli
cagcgtgcgctggtggacacttata

SEQ ID NO: 166116 - DNA, 25 bp, E. coli
cagcgtgcgctgctggacacttata

SEQ ID NO: 166117 - DNA, 25 bp, E. coli
atcagaatgtgggagcggcgacaac

SEQ ID NO: 166118 - DNA, 25 bp, E. coli
atcagaatgtggcagcggcgacaac

SEQ ID NO: 166119 - DNA, 25 bp, E. coli
taccattctcatggccatgttgctg

SEQ ID NO: 166120 - DNA, 25 bp, E. coli
taccattctcatcgccatgttgctg

SEQ ID NO: 166121 - DNA, 25 bp, E. coli
ttttgtcttcgcgagtatcagcgga

SEQ ID NO: 166122 - DNA, 25 bp, E. coli
tatcagcggataacagaatgtggga

SEQ ID NO: 166123 - DNA, 25 bp, E. coli
tatcagcggatatcagaatgtggga

SEQ ID NO: 166124 - DNA, 25 bp, E. coli
ttttgtcttcgccagtatcagcgga

SEQ ID NO: 166125 - DNA, 25 bp, E. coli
ccatgttgctgatctcactggtggg

SEQ ID NO: 166126 - DNA, 25 bp, E. coli
ccatgttgctgaactcactggtggg

SEQ ID NO: 166127 - DNA, 25 bp, E. coli
gctgggatcgttatttgtcttcgcc

SEQ ID NO: 166128 - DNA, 25 bp, E. coli
gctgggatcgttttttgtcttcgcc

SEQ ID NO: 166129 - DNA, 25 bp, E. coli
gacacttataccaggcttgctggga

SEQ ID NO: 166130 - DNA, 25 bp, E. coli
gacacttatacctggcttgctggga

SEQ ID NO: 166131 - DNA, 25 bp, E. coli
cggcccaatttgaggcgcaatttta

SEQ ID NO: 166132 - DNA, 25 bp, E. coli
ctgatggtgcgcatcacccagacct

SEQ ID NO: 166133 - DNA, 25 bp, E. coli
cggcccaatttgtggcgcaatttta

SEQ ID NO: 166134 - DNA, 25 bp, E. coli
ctgatggtgcgcttcacccagacct

SEQ ID NO: 166135 - DNA, 25 bp, E. coli
caaagttcgacggagtataagcagc

SEQ ID NO: 166136 - DNA, 25 bp, E. coli
caaagttcgacgcagtataagcagc

SEQ ID NO: 166137 - DNA, 25 bp, E. coli
tactgatgagtaggtacaggccgca

SEQ ID NO: 166138 - DNA, 25 bp, E. coli
taaaaaggtggaggaactgctggct

SEQ ID NO: 166139 - DNA, 25 bp, E. coli
tactgatgagtacgtacaggccgca

SEQ ID NO: 166140 - DNA, 25 bp, E. coli
taaaaaggtggacgaactgctggct

SEQ ID NO: 166141 - DNA, 25 bp, E. coli
tattgtgagtctaacgccgatagca

SEQ ID NO: 166142 - DNA, 25 bp, E. coli
tattgtgagtcttacgccgatagca

SEQ ID NO: 166143 - DNA, 25 bp, E. coli
tgtcgttacaatctgcgcggtgagt

SEQ ID NO: 166144 - DNA, 25 bp, E. coli
tgtcgttacaatgtgcgcggtgagt

SEQ ID NO: 166145 - DNA, 25 bp, E. coli
tatttcccggaagcagagttgtatc

SEQ ID NO: 166146 - DNA, 25 bp, E. coli
tatttcccggaaccagagttgtatc

SEQ ID NO: 166147 - DNA, 25 bp, E. coli
gcacgcgagctgattgttcccgaaa

SEQ ID NO: 166148 - DNA, 25 bp, E. coli
gcacgcgagctgtttgttcccgaaa

SEQ ID NO: 166149 - DNA, 25 bp, E. coli
cttgaacaacaagcgcatctggcgg

SEQ ID NO: 166150 - DNA, 25 bp, E. coli
cttgaacaacaaccgcatctggcgg

SEQ ID NO: 166151 - DNA, 25 bp, E. coli
taaacggcatttccccaagggcgaa

SEQ ID NO: 166152 - DNA, 25 bp, E. coli
taaacggcatttgcccaagggcgaa

SEQ ID NO: 166153 - DNA, 25 bp, E. coli
gaggtttactatcagttccgcgaag

SEQ ID NO: 166154 - DNA, 25 bp, E. coli
gagttcaacaaatgccaggatccgt

SEQ ID NO: 166155 - DNA, 25 bp, E. coli
gaggtttactatgagttccgcgaag

SEQ ID NO: 166156 - DNA, 25 bp, E. coli
gagttcaacaaaagccaggatccgt

SEQ ID NO: 166157 - DNA, 25 bp, E. coli
caaatatgatgaaggctaatgctgt

SEQ ID NO: 166158 - DNA, 25 bp, E. coli
caaatatgatgatggctaatgctgt

SEQ ID NO: 166159 - DNA, 25 bp, E. coli
tacgcacttcttccgggctatatac

SEQ ID NO: 166160 - DNA, 25 bp, E. coli
tacgcacttcttgcgggctatatac

SEQ ID NO: 166161 - DNA, 25 bp, E. coli
aatacggccccacaagggcaatgcc

SEQ ID NO: 166162 - DNA, 25 bp, E. coli
aatacggccccagaagggcaatgcc

SEQ ID NO: 166163 - DNA, 25 bp, E. coli
tatcctgtcagttcgttttacgcac

SEQ ID NO: 166164 - DNA, 25 bp, E. coli
tatcctgtcagtacgttttacgcac

SEQ ID NO: 166165 - DNA, 25 bp, E. coli
tttttaacgccgctatacgcctcac

SEQ ID NO: 166166 - DNA, 25 bp, E. coli
tttttaacgccggtatacgcctcac

SEQ ID NO: 166167 - DNA, 25 bp, E. coli
tttactgacaggctgagcagggcac

SEQ ID NO: 166168 - DNA, 25 bp, E. coli
tttactgacagggtgagcagggcac

SEQ ID NO: 166169 - DNA, 25 bp, E. coli
gcaccgacgttgtcttgtgacctgt

SEQ ID NO: 166170 - DNA, 25 bp, E. coli
gcaccgacgttgacttgtgacctgt

SEQ ID NO: 166171 - DNA, 25 bp, E. coli
ggctatatacccatctcggcagttt

SEQ ID NO: 166172 - DNA, 25 bp, E. coli
ggctatatacccttctcggcagttt

SEQ ID NO: 166173 - DNA, 25 bp, E. coli
ggctaatgctgtgggtttatggaaa

SEQ ID NO: 166174 - DNA, 25 bp, E. coli
ggctaatgctgtcggtttatggaaa

SEQ ID NO: 166175 - DNA, 25 bp, E. coli
tcacagggctcttaagcaccgacgt

SEQ ID NO: 166176 - DNA, 25 bp, E. coli
tcacagggctctaaagcaccgacgt

SEQ ID NO: 166177 - DNA, 25 bp, E. coli
gagcagggcacttttatcctgtcag

SEQ ID NO: 166178 - DNA, 25 bp, E. coli
gagcagggcactattatcctgtcag

SEQ ID NO: 166179 - DNA, 25 bp, E. coli
aagtgggtctatgaactgtttccgc

SEQ ID NO: 166180 - DNA, 25 bp, E. coli
aagtgggtctatcaactgtttccgc

SEQ ID NO: 166181 - DNA, 25 bp, E. coli
catcgctcgggcaggcaccgattat

SEQ ID NO: 166182 - DNA, 25 bp, E. coli
catcgctcgggctggcaccgattat

SEQ ID NO: 166183 - DNA, 25 bp, E. coli
agcgggcactatctctggcggtgaa

SEQ ID NO: 166184 - DNA, 25 bp, E. coli
agcgggcactatgtctggcggtgaa

SEQ ID NO: 166185 - DNA, 25 bp, E. coli
tcatgtagtgctgtccgataccggc

SEQ ID NO: 166186 - DNA, 25 bp, E. coli
tctatgaactgtttccgcgtctgca

SEQ ID NO: 166187 - DNA, 25 bp, E. coli
tctatgaactgtatccgcgtctgca

SEQ ID NO: 166188 - DNA, 25 bp, E. coli
tcatgtagtgctctccgataccggc

SEQ ID NO: 166189 - DNA, 25 bp, E. coli
gctttgatgagttacccgcgtttgc

SEQ ID NO: 166190 - DNA, 25 bp, E. coli
gctttgatgagtaacccgcgtttgc

SEQ ID NO: 166191 - DNA, 25 bp, E. coli
cgattggtcgcgctttgatgagtaa

SEQ ID NO: 166192 - DNA, 25 bp, E. coli
cgattggtcgcggtttgatgagtaa

SEQ ID NO: 166193 - DNA, 25 bp, E. coli
cgggctggcaccgattatcatccag

SEQ ID NO: 166194 - DNA, 25 bp, E. coli
cgtgttcagcgagcgggcactatgt

SEQ ID NO: 166195 - DNA, 25 bp, E. coli
cgtgttcagcgaccgggcactatgt

SEQ ID NO: 166196 - DNA, 25 bp, E. coli
cgggctggcacccattatcatccag

SEQ ID NO: 166197 - DNA, 25 bp, E. coli
gtagtgctctccgataccggcgacg

SEQ ID NO: 166198 - DNA, 25 bp, E. coli
gtagtgctctcccataccggcgacg

SEQ ID NO: 166199 - DNA, 25 bp, E. coli
tggtcgcgctttgatgagtaacccg

SEQ ID NO: 166200 - DNA, 25 bp, E. coli
tggtcgcgctttcatgagtaacccg

SEQ ID NO: 166201 - DNA, 25 bp, E. coli
caatattggtgtaatgagatttgtg

SEQ ID NO: 166202 - DNA, 25 bp, E. coli
aatgttgcaatgtatggtttatacc

SEQ ID NO: 166203 - DNA, 25 bp, E. coli
aatgttgcaatgaatggtttatacc

SEQ ID NO: 166204 - DNA, 25 bp, E. coli
caatattggtgttatgagatttgtg

SEQ ID NO: 166205 - DNA, 25 bp, E. coli
caaaatcaatataggtgtaatgaga

SEQ ID NO: 166206 - DNA, 25 bp, E. coli
caaaatcaatattggtgtaatgaga

SEQ ID NO: 166207 - DNA, 25 bp, E. coli
tgttgcaatgaatggtttataccaa

SEQ ID NO: 166208 - DNA, 25 bp, E. coli
tgtaatgagatttgtggaaccaaga

SEQ ID NO: 166209 - DNA, 25 bp, E. coli
tgttgcaatgaaaggtttataccaa

SEQ ID NO: 166210 - DNA, 25 bp, E. coli
tgtaatgagattagtggaaccaaga

SEQ ID NO: 166211 - DNA, 25 bp, E. coli
gcaatgaatggtatataccaaaata

SEQ ID NO: 166212 - DNA, 25 bp, E. coli
gaaatgtaaatgttgcaatgaatgg

SEQ ID NO: 166213 - DNA, 25 bp, E. coli
gcaatgaatggtttataccaaaata

SEQ ID NO: 166214 - DNA, 25 bp, E. coli
gaaatgtaaatgatgcaatgaatgg

SEQ ID NO: 166215 - DNA, 25 bp, E. coli
gaaggaaatgtaaatgttgcaatga

SEQ ID NO: 166216 - DNA, 25 bp, E. coli
gaaggaaatgtatatgttgcaatga

SEQ ID NO: 166217 - DNA, 25 bp, E. coli
ggtgtaatgagatttgtggaaccaa

SEQ ID NO: 166218 - DNA, 25 bp, E. coli
ggtttataccaatatatcaaaatca

SEQ ID NO: 166219 - DNA, 25 bp, E. coli
ggtttataccaaaatatcaaaatca

SEQ ID NO: 166220 - DNA, 25 bp, E. coli
ggtgtaatgagaattgtggaaccaa

SEQ ID NO: 166221 - DNA, 25 bp, E. coli
taatgagatttgaggaaccaagata

SEQ ID NO: 166222 - DNA, 25 bp, E. coli
taatgagatttgtggaaccaagata

SEQ ID NO: 166223 - DNA, 25 bp, E. coli
tacaccgtggatgccaaaaattgag

SEQ ID NO: 166224 - DNA, 25 bp, E. coli
tacaccgtggatcccaaaaattgag

SEQ ID NO: 166225 - DNA, 25 bp, E. coli
tattgactggcacgcactggtggct

SEQ ID NO: 166226 - DNA, 25 bp, E. coli
tattgactggcaggcactggtggct

SEQ ID NO: 166227 - DNA, 25 bp, E. coli
ttactgcattaatcagcacgccgcg

SEQ ID NO: 166228 - DNA, 25 bp, E. coli
ttagcggccccaagctggtagcaaa

SEQ ID NO: 166229 - DNA, 25 bp, E. coli
ttagcggccccatgctggtagcaaa

SEQ ID NO: 166230 - DNA, 25 bp, E. coli
ttactgcattaaacagcacgccgcg

SEQ ID NO: 166231 - DNA, 25 bp, E. coli
gctggaagatattaacgagcaccct

SEQ ID NO: 166232 - DNA, 25 bp, E. coli
gctggaagatataaacgagcaccct

SEQ ID NO: 166233 - DNA, 25 bp, E. coli
gcaatgtcatcagctttagcggccc

SEQ ID NO: 166234 - DNA, 25 bp, E. coli
gcaatgtcatcacctttagcggccc

SEQ ID NO: 166235 - DNA, 25 bp, E. coli
gtagcaaactttcgcgcggatgaac

SEQ ID NO: 166236 - DNA, 25 bp, E. coli
gattttggtcatgaacaacgcacgg

SEQ ID NO: 166237 - DNA, 25 bp, E. coli
gattattctcggtagctttagcggc

SEQ ID NO: 166238 - DNA, 25 bp, E. coli
gtagcaaactttggcgcggatgaac

SEQ ID NO: 166239 - DNA, 25 bp, E. coli
gattattctcggaagctttagcggc

SEQ ID NO: 166240 - DNA, 25 bp, E. coli
gattttggtcatcaacaacgcacgg

SEQ ID NO: 166241 - DNA, 25 bp, E. coli
ggaattttgccaggtcagaaggcga

SEQ ID NO: 166242 - DNA, 25 bp, E. coli
ggaattttgccacgtcagaaggcga

SEQ ID NO: 166243 - DNA, 25 bp, E. coli
taacgtcgaggttattgcccgtcgt

SEQ ID NO: 166244 - DNA, 25 bp, E. coli
taacgtcgaggtaattgcccgtcgt

SEQ ID NO: 166245 - DNA, 25 bp, E. coli
caccgctgctttttctcggctacgg

SEQ ID NO: 166246 - DNA, 25 bp, E. coli
caccgctgctttatctcggctacgg

SEQ ID NO: 166247 - DNA, 25 bp, E. coli
tttgccgcggggatcgtggtttcca

SEQ ID NO: 166248 - DNA, 25 bp, E. coli
tttgccgcggggttcgtggtttcca

SEQ ID NO: 166249 - DNA, 25 bp, E. coli
tttgctggcgttgggcactacctgg

SEQ ID NO: 166250 - DNA, 25 bp, E. coli
tttgctggcgttcggcactacctgg

SEQ ID NO: 166251 - DNA, 25 bp, E. coli
ttatctcggctagggcggtttgatg

SEQ ID NO: 166252 - DNA, 25 bp, E. coli
ttgggcactacctggctggagcgca

SEQ ID NO: 166253 - DNA, 25 bp, E. coli
ttatctcggctacggcggtttgatg

SEQ ID NO: 166254 - DNA, 25 bp, E. coli
ttgggcactaccaggctggagcgca

SEQ ID NO: 166255 - DNA, 25 bp, E. coli
tcggctacggcggtttgatggtggc

SEQ ID NO: 166256 - DNA, 25 bp, E. coli
tcggctacggcgctttgatggtggc

SEQ ID NO: 166257 - DNA, 25 bp, E. coli
gctttatctcggctacggcggtttg

SEQ ID NO: 166258 - DNA, 25 bp, E. coli
gctgctttatctcggctacggcggt

SEQ ID NO: 166259 - DNA, 25 bp, E. coli
gctttatctcgggtacggcggtttg

SEQ ID NO: 166260 - DNA, 25 bp, E. coli
gctgctttatctgggctacggcggt

SEQ ID NO: 166261 - DNA, 25 bp, E. coli
gaatttgctggccttgggcactacc

SEQ ID NO: 166262 - DNA, 25 bp, E. coli
gaatttgctggcgttgggcactacc

SEQ ID NO: 166263 - DNA, 25 bp, E. coli
gcactacctggcaggagcgcattaa

SEQ ID NO: 166264 - DNA, 25 bp, E. coli
gcactacctggctggagcgcattaa

SEQ ID NO: 166265 - DNA, 25 bp, E. coli
taagtctcggggacaacgtgttgac

SEQ ID NO: 166266 - DNA, 25 bp, E. coli
taagtctcggggtcaacgtgttgac

SEQ ID NO: 166267 - DNA, 25 bp, E. coli
aagtgtcaaaatccggtgctccggc

SEQ ID NO: 166268 - DNA, 25 bp, E. coli
aagtgtcaaaatgcggtgctccggc

SEQ ID NO: 166269 - DNA, 25 bp, E. coli
tatgatttacgttgcaggtcggcag

SEQ ID NO: 166270 - DNA, 25 bp, E. coli
tatgatttacgtagcaggtcggcag

SEQ ID NO: 166271 - DNA, 25 bp, E. coli
tatttccatgcttggcgtgccggaa

SEQ ID NO: 166272 - DNA, 25 bp, E. coli
tatttccatgctaggcgtgccggaa

SEQ ID NO: 166273 - DNA, 25 bp, E. coli
tgtacaactttgtgatggagcgcct

SEQ ID NO: 166274 - DNA, 25 bp, E. coli
tgtggtgggtcgactccagtaagcc

SEQ ID NO: 166275 - DNA, 25 bp, E. coli
tgtggtgggtcgtctccagtaagcc

SEQ ID NO: 166276 - DNA, 25 bp, E. coli
tgtacaactttgagatggagcgcct

SEQ ID NO: 166277 - DNA, 25 bp, E. coli
tgaagaacaagaactgctgctggcc

SEQ ID NO: 166278 - DNA, 25 bp, E. coli
tgaagaacaagatctgctgctggcc

SEQ ID NO: 166279 - DNA, 25 bp, E. coli
gcagagcagctacgtaaaacggcag

SEQ ID NO: 166280 - DNA, 25 bp, E. coli
gcacctgcgatctaaacgggacata

SEQ ID NO: 166281 - DNA, 25 bp, E. coli
gcacctgcgatcaaaacgggacata

SEQ ID NO: 166282 - DNA, 25 bp, E. coli
gcagagcagctaggtaaaacggcag

SEQ ID NO: 166283 - DNA, 25 bp, E. coli
gattcaaatcatcggcggtctgggc

SEQ ID NO: 166284 - DNA, 25 bp, E. coli
gtattcacagtaagcgccgtttcgg

SEQ ID NO: 166285 - DNA, 25 bp, E. coli
gattacgtcaccgaaatgctggcgc

SEQ ID NO: 166286 - DNA, 25 bp, E. coli
gattcaaatcatgggcggtctgggc

SEQ ID NO: 166287 - DNA, 25 bp, E. coli
gattacgtcacccaaatgctggcgc

SEQ ID NO: 166288 - DNA, 25 bp, E. coli
gtattcacagtatgcgccgtttcgg

SEQ ID NO: 166289 - DNA, 25 bp, E. coli
acaaaaatggcgtgactggctggcg

SEQ ID NO: 166290 - DNA, 25 bp, E. coli
acaaaaatggcgagactggctggcg

SEQ ID NO: 166291 - DNA, 25 bp, E. coli
taccggtggtttcgccgtatcggca

SEQ ID NO: 166292 - DNA, 25 bp, E. coli
taccggtggtttggccgtatcggca

SEQ ID NO: 166293 - DNA, 25 bp, E. coli
tatctgaaagggtttgcctgtcgcg

SEQ ID NO: 166294 - DNA, 25 bp, E. coli
tattgcacggcacaacgttgagctg

SEQ ID NO: 166295 - DNA, 25 bp, E. coli
tatctgaaagggattgcctgtcgcg

SEQ ID NO: 166296 - DNA, 25 bp, E. coli
tattgcacggcagaacgttgagctg

SEQ ID NO: 166297 - DNA, 25 bp, E. coli
ttattcgccagcttcgcaaatccgg

SEQ ID NO: 166298 - DNA, 25 bp, E. coli
ttattcgccagcatcgcaaatccgg

SEQ ID NO: 166299 - DNA, 25 bp, E. coli
tgaacaaactggatctgagcaaggc

SEQ ID NO: 166300 - DNA, 25 bp, E. coli
tgaacaaactggttctgagcaaggc

SEQ ID NO: 166301 - DNA, 25 bp, E. coli
gaaggtaaagcctgcctcggtgaaa

SEQ ID NO: 166302 - DNA, 25 bp, E. coli
gaaggtaaagccagcctcggtgaaa

SEQ ID NO: 166303 - DNA, 25 bp, E. coli
gacagctatcgtataatcgccggag

SEQ ID NO: 166304 - DNA, 25 bp, E. coli
gacagctatcgtttaatcgccggag

SEQ ID NO: 166305 - DNA, 25 bp, E. coli
cctgcaaacgctctacccggaatgt

SEQ ID NO: 166306 - DNA, 25 bp, E. coli
cctgcaaacgctgtacccggaatgt

SEQ ID NO: 166307 - DNA, 25 bp, E. coli
tggctggcgcaataagatggcctcg

SEQ ID NO: 166308 - DNA, 25 bp, E. coli
tggctggcgcaaaaagatggcctcg

SEQ ID NO: 166309 - DNA, 25 bp, E. coli
tggacccgccgatgtttgttgagaa

SEQ ID NO: 166310 - DNA, 25 bp, E. coli
tggacccgccgaagtttgttgagaa

SEQ ID NO: 166311 - DNA, 25 bp, E. coli
catcgctggtcgttcctggtctgga

SEQ ID NO: 166312 - DNA, 25 bp, E. coli
cagtttgcatggttcgtgcgtcaga

SEQ ID NO: 166313 - DNA, 25 bp, E. coli
catcgctggtcgatcctggtctgga

SEQ ID NO: 166314 - DNA, 25 bp, E. coli
cagtttgcatggatcgtgcgtcaga

SEQ ID NO: 166315 - DNA, 25 bp, E. coli
cagtctttatccgttatgcagggcg

SEQ ID NO: 166316 - DNA, 25 bp, E. coli
cagtctttatcccttatgcagggcg

SEQ ID NO: 166317 - DNA, 25 bp, E. coli
agtccgaccttcagccgtattgccg

SEQ ID NO: 166318 - DNA, 25 bp, E. coli
agtccgaccttctgccgtattgccg

SEQ ID NO: 166319 - DNA, 25 bp, E. coli
tatgcagggcgttacctatgagcag

SEQ ID NO: 166320 - DNA, 25 bp, E. coli
tatgcagggcgtaacctatgagcag

SEQ ID NO: 166321 - DNA, 25 bp, E. coli
tgcgtcagagcgaagagcagatttc

SEQ ID NO: 166322 - DNA, 25 bp, E. coli
tgcgtcagagcgtagagcagatttc

SEQ ID NO: 166323 - DNA, 25 bp, E. coli
ccatatgcagaatttcgacggtgtc

SEQ ID NO: 166324 - DNA, 25 bp, E. coli
ccatatgcagaaattcgacggtgtc

SEQ ID NO: 166325 - DNA, 25 bp, E. coli
ggatgataatctgccaaagctggtg

SEQ ID NO: 166326 - DNA, 25 bp, E. coli
ggatgataatctcccaaagctggtg

SEQ ID NO: 166327 - DNA, 25 bp, E. coli
tcaatgccagttggctgaccgtgaa

SEQ ID NO: 166328 - DNA, 25 bp, E. coli
tcaatgccagttcgctgaccgtgaa

SEQ ID NO: 166329 - DNA, 25 bp, E. coli
taatgcccatcaactgctgttaccg

SEQ ID NO: 166330 - DNA, 25 bp, E. coli
taatgcccatcatctgctgttaccg

SEQ ID NO: 166331 - DNA, 25 bp, E. coli
gatcctgttttctgccatggcggaa

SEQ ID NO: 166332 - DNA, 25 bp, E. coli
gatcctgttttcagccatggcggaa

SEQ ID NO: 166333 - DNA, 25 bp, E. coli
cagtgacgtactggatatttccgca

SEQ ID NO: 166334 - DNA, 25 bp, E. coli
cagtgacgtactcgatatttccgca

SEQ ID NO: 166335 - DNA, 25 bp, E. coli
tacttgtccgaagactattgatggc

SEQ ID NO: 166336 - DNA, 25 bp, E. coli
tacttgtccgaacactattgatggc

SEQ ID NO: 166337 - DNA, 25 bp, E. coli
tatgatggcgcgcttggtgtaacca

SEQ ID NO: 166338 - DNA, 25 bp, E. coli
tatgatggcgcggttggtgtaacca

SEQ ID NO: 166339 - DNA, 25 bp, E. coli
tatttgggagattgcagtgacgtac

SEQ ID NO: 166340 - DNA, 25 bp, E. coli
tatttgggagatagcagtgacgtac

SEQ ID NO: 166341 - DNA, 25 bp, E. coli
ttttcgctgctgaagtagataccgg

SEQ ID NO: 166342 - DNA, 25 bp, E. coli
ttttcgctgctgtagtagataccgg

SEQ ID NO: 166343 - DNA, 25 bp, E. coli
tgtcgctggcggagattcagtcagt

SEQ ID NO: 166344 - DNA, 25 bp, E. coli
tgtcgctggcggtgattcagtcagt

SEQ ID NO: 166345 - DNA, 25 bp, E. coli
gaatcaccatgttcatttgtcgctg

SEQ ID NO: 166346 - DNA, 25 bp, E. coli
gcaatatccagtagtaatgacacag

SEQ ID NO: 166347 - DNA, 25 bp, E. coli
gaatcaccatgtacatttgtcgctg

SEQ ID NO: 166348 - DNA, 25 bp, E. coli
gcaatatccagttgtaatgacacag

SEQ ID NO: 166349 - DNA, 25 bp, E. coli
gactgtacccacgactgtatttgat

SEQ ID NO: 166350 - DNA, 25 bp, E. coli
gacagtggtgttccatctggtacag

SEQ ID NO: 166351 - DNA, 25 bp, E. coli
gactgtacccaccactgtatttgat

SEQ ID NO: 166352 - DNA, 25 bp, E. coli
gacagtggtgttgcatctggtacag

SEQ ID NO: 166353 - DNA, 25 bp, E. coli
cattggttatgcctgttgcccagga

SEQ ID NO: 166354 - DNA, 25 bp, E. coli
cattggttatgcgtgttgcccagga

SEQ ID NO: 166355 - DNA, 25 bp, E. coli
catcgggatcttgagttacgtacag

SEQ ID NO: 166356 - DNA, 25 bp, E. coli
catcgggatcttcagttacgtacag

SEQ ID NO: 166357 - DNA, 25 bp, E. coli
tacgtacagttacgcgttgaaccca

SEQ ID NO: 166358 - DNA, 25 bp, E. coli
tacgtacagttaggcgttgaaccca

SEQ ID NO: 166359 - DNA, 25 bp, E. coli
tactgggatgatttcgctccggcgc

SEQ ID NO: 166360 - DNA, 25 bp, E. coli
tactgggatgatatcgctccggcgc

SEQ ID NO: 166361 - DNA, 25 bp, E. coli
tatcggctgggaaaaacgcttcttc

SEQ ID NO: 166362 - DNA, 25 bp, E. coli
tatcggctgggataaacgcttcttc

SEQ ID NO: 166363 - DNA, 25 bp, E. coli
tgttcggcgtccttgctgaagagtg

SEQ ID NO: 166364 - DNA, 25 bp, E. coli
tgttcggcgtccatgctgaagagtg

SEQ ID NO: 166365 - DNA, 25 bp, E. coli
ccaaaatcatgtcggcgggaccaaa

SEQ ID NO: 166366 - DNA, 25 bp, E. coli
ccaaaatcatgtgggcgggaccaaa

SEQ ID NO: 166367 - DNA, 25 bp, E. coli
cgcgatatgtggatcaccggacgta

SEQ ID NO: 166368 - DNA, 25 bp, E. coli
cgcgatatgtggttcaccggacgta

SEQ ID NO: 166369 - DNA, 25 bp, E. coli
cattggttcatggtttggcgcgcgc

SEQ ID NO: 166370 - DNA, 25 bp, E. coli
cattggttcatgctttggcgcgcgc

SEQ ID NO: 166371 - DNA, 25 bp, E. coli
ggaaggatcgcctttaacccgcatc

SEQ ID NO: 166372 - DNA, 25 bp, E. coli
tggcagcaattctaacacgcctggt

SEQ ID NO: 166373 - DNA, 25 bp, E. coli
ggaaggatcgccattaacccgcatc

SEQ ID NO: 166374 - DNA, 25 bp, E. coli
tggcagcaattcaaacacgcctggt

SEQ ID NO: 166375 - DNA, 25 bp, E. coli
gatgatcctcggaatgtttggcggc

SEQ ID NO: 166376 - DNA, 25 bp, E. coli
gatgatcctcggtatgtttggcggc

SEQ ID NO: 166377 - DNA, 25 bp, E. coli
tacacggctaaacaactggtgagcg

SEQ ID NO: 166378 - DNA, 25 bp, E. coli
tactggaagaactgcagcaactgga

SEQ ID NO: 166379 - DNA, 25 bp, E. coli
tacacggctaaagaactggtgagcg

SEQ ID NO: 166380 - DNA, 25 bp, E. coli
tactggaagaacagcagcaactgga

SEQ ID NO: 166381 - DNA, 25 bp, E. coli
aaatttgacgaggatcacctgggcg

SEQ ID NO: 166382 - DNA, 25 bp, E. coli
aaatttgacgagcatcacctgggcg

SEQ ID NO: 166383 - DNA, 25 bp, E. coli
tttgtcagcaaacaaaccgatggtg

SEQ ID NO: 166384 - DNA, 25 bp, E. coli
tattgccaaagtggcatccggtggt

SEQ ID NO: 166385 - DNA, 25 bp, E. coli
tttgtcagcaaagaaaccgatggtg

SEQ ID NO: 166386 - DNA, 25 bp, E. coli
tattgccaaagtcgcatccggtggt

SEQ ID NO: 166387 - DNA, 25 bp, E. coli
tttctctgaaagttacgccagcggc

SEQ ID NO: 166388 - DNA, 25 bp, E. coli
tttctctgaaagatacgccagcggc

SEQ ID NO: 166389 - DNA, 25 bp, E. coli
gaaaaccagcttcaagacgggcatg

SEQ ID NO: 166390 - DNA, 25 bp, E. coli
gagtacaaacgtctggcgaacagcg

SEQ ID NO: 166391 - DNA, 25 bp, E. coli
gaaaccccggcactgatttttgatg

SEQ ID NO: 166392 - DNA, 25 bp, E. coli
gaaaaccagcttgaagacgggcatg

SEQ ID NO: 166393 - DNA, 25 bp, E. coli
gaaaccccggcagtgatttttgatg

SEQ ID NO: 166394 - DNA, 25 bp, E. coli
gagtacaaacgtgtggcgaacagcg

SEQ ID NO: 166395 - DNA, 25 bp, E. coli
gattcagatccaaggtcagcacgct

SEQ ID NO: 166396 - DNA, 25 bp, E. coli
gattcagatccatggtcagcacgct

SEQ ID NO: 166397 - DNA, 25 bp, E. coli
ggtaacgaaacaacatcagcaggca

SEQ ID NO: 166398 - DNA, 25 bp, E. coli
ggtaacgaaacatcatcagcaggca

SEQ ID NO: 166399 - DNA, 25 bp, E. coli
catttaatcggcttataaagcggga

SEQ ID NO: 166400 - DNA, 25 bp, E. coli
tgaaacatcactcttcagagtcgct

SEQ ID NO: 166401 - DNA, 25 bp, E. coli
tgaaacatcactgttcagagtcgct

SEQ ID NO: 166402 - DNA, 25 bp, E. coli
tcagagtcgctagccgtcacgatag

SEQ ID NO: 166403 - DNA, 25 bp, E. coli
tcagagtcgctacccgtcacgatag

SEQ ID NO: 166404 - DNA, 25 bp, E. coli
gcaatgcctgggtctacggtgagaa

SEQ ID NO: 166405 - DNA, 25 bp, E. coli
gcaatgcctgggactacggtgagaa

SEQ ID NO: 166406 - DNA, 25 bp, E. coli
gaaatcatgaagtttcacggcgcgc

SEQ ID NO: 166407 - DNA, 25 bp, E. coli
gaaatcatgaagattcacggcgcgc

SEQ ID NO: 166408 - DNA, 25 bp, E. coli
catttaatcggcatataaagcggga

SEQ ID NO: 166409 - DNA, 25 bp, E. coli
gatttcactagcacggtaaacatgg

SEQ ID NO: 166410 - DNA, 25 bp, E. coli
gatttcactagctcggtaaacatgg

SEQ ID NO: 166411 - DNA, 25 bp, E. coli
gggattgtcaaagcaaaacatcgat

SEQ ID NO: 166412 - DNA, 25 bp, E. coli
gggattgtcaaaccaaaacatcgat

SEQ ID NO: 166413 - DNA, 25 bp, E. coli
tggcagctatcgtcatcacgaatgg

SEQ ID NO: 166414 - DNA, 25 bp, E. coli
tggcagctatcgacatcacgaatgg

SEQ ID NO: 166415 - DNA, 25 bp, E. coli
taatgacgggagtatttgacctgct

SEQ ID NO: 166416 - DNA, 25 bp, E. coli
taagtagcagaggtgataatgacgg

SEQ ID NO: 166417 - DNA, 25 bp, E. coli
taatgacgggagaatttgacctgct

SEQ ID NO: 166418 - DNA, 25 bp, E. coli
taagtagcagagctgataatgacgg

SEQ ID NO: 166419 - DNA, 25 bp, E. coli
gagaagaccgttcccttgtggcagc

SEQ ID NO: 166420 - DNA, 25 bp, E. coli
gagaagaccgttgccttgtggcagc

SEQ ID NO: 166421 - DNA, 25 bp, E. coli
aaaacgagcgggtcagctggcccgc

SEQ ID NO: 166422 - DNA, 25 bp, E. coli
aaaacgagcgggacagctggcccgc

SEQ ID NO: 166423 - DNA, 25 bp, E. coli
ttatgcgttatttttgctgaagtgc

SEQ ID NO: 166424 - DNA, 25 bp, E. coli
ttatgcgttattattgctgaagtgc

SEQ ID NO: 166425 - DNA, 25 bp, E. coli
tgtaatcagtctcgagcgggtcagt

SEQ ID NO: 166426 - DNA, 25 bp, E. coli
tgtaatcagtctggagcgggtcagt

SEQ ID NO: 166427 - DNA, 25 bp, E. coli
tgcgtttgtaatcagtctcgagcgg

SEQ ID NO: 166428 - DNA, 25 bp, E. coli
tgcgtttgtaatgagtctcgagcgg

SEQ ID NO: 166429 - DNA, 25 bp, E. coli
tcgtacgcaccaaaacgagcgggtc

SEQ ID NO: 166430 - DNA, 25 bp, E. coli
tcgtacgcaccataacgagcgggtc

SEQ ID NO: 166431 - DNA, 25 bp, E. coli
tcagattgtgacatagtgcgctttg

SEQ ID NO: 166432 - DNA, 25 bp, E. coli
tcagattgtgacttagtgcgctttg

SEQ ID NO: 166433 - DNA, 25 bp, E. coli
tctcgagcgggtgagtttactggcc

SEQ ID NO: 166434 - DNA, 25 bp, E. coli
tctcgagcgggtcagtttactggcc

SEQ ID NO: 166435 - DNA, 25 bp, E. coli
gcgggtcagttttctggcccgcttt

SEQ ID NO: 166436 - DNA, 25 bp, E. coli
gcgggtcagtttactggcccgcttt

SEQ ID NO: 166437 - DNA, 25 bp, E. coli
cgcaccaaaacgagcgggtcagctg

SEQ ID NO: 166438 - DNA, 25 bp, E. coli
cgcaccaaaacgtgcgggtcagctg

SEQ ID NO: 166439 - DNA, 25 bp, E. coli
tggcccgcttcagattgtgacatag

SEQ ID NO: 166440 - DNA, 25 bp, E. coli
tggcccgcttcacattgtgacatag

SEQ ID NO: 166441 - DNA, 25 bp, E. coli
tcagctggcccgcttcagattgtga

SEQ ID NO: 166442 - DNA, 25 bp, E. coli
tcagctggcccggttcagattgtga

SEQ ID NO: 166443 - DNA, 25 bp, E. coli
aatcgtcatgttgctgtgtgcgggc

SEQ ID NO: 166444 - DNA, 25 bp, E. coli
caacgcacggatttcatcagagtac

SEQ ID NO: 166445 - DNA, 25 bp, E. coli
aatcgtcatgttcctgtgtgcgggc

SEQ ID NO: 166446 - DNA, 25 bp, E. coli
caacgcacggatatcatcagagtac

SEQ ID NO: 166447 - DNA, 25 bp, E. coli
cagctgtgcatcagttgagttgggc

SEQ ID NO: 166448 - DNA, 25 bp, E. coli
cagctgtgcatctgttgagttgggc

SEQ ID NO: 166449 - DNA, 25 bp, E. coli
ttagctcagccagaacgcacggatt

SEQ ID NO: 166450 - DNA, 25 bp, E. coli
ttagctcagccacaacgcacggatt

SEQ ID NO: 166451 - DNA, 25 bp, E. coli
tcactggctgttttcgacccggcag

SEQ ID NO: 166452 - DNA, 25 bp, E. coli
tcactggctgttatcgacccggcag

SEQ ID NO: 166453 - DNA, 25 bp, E. coli
gctgctgctgatctattgcgcggta

SEQ ID NO: 166454 - DNA, 25 bp, E. coli
gctgctgctgatgtattgcgcggta

SEQ ID NO: 166455 - DNA, 25 bp, E. coli
cggatttcatcacagtacccgcgtg

SEQ ID NO: 166456 - DNA, 25 bp, E. coli
cggatttcatcagagtacccgcgtg

SEQ ID NO: 166457 - DNA, 25 bp, E. coli
gttaaatatcgtgctggcgctgctg

SEQ ID NO: 166458 - DNA, 25 bp, E. coli
gttaaatatcgtcctggcgctgctg

SEQ ID NO: 166459 - DNA, 25 bp, E. coli
ggcatttcgtttacactggctgtta

SEQ ID NO: 166460 - DNA, 25 bp, E. coli
ggcatttcgttttcactggctgtta

SEQ ID NO: 166461 - DNA, 25 bp, E. coli
gacccggcagctgtgcatctgttga

SEQ ID NO: 166462 - DNA, 25 bp, E. coli
gacccggcagctctgcatctgttga

SEQ ID NO: 166463 - DNA, 25 bp, E. coli
gagtctgggatttttaatcgtcatg

SEQ ID NO: 166464 - DNA, 25 bp, E. coli
gagtctgggattattaatcgtcatg

SEQ ID NO: 166465 - DNA, 25 bp, E. coli
caagcgcggtgaacgcattgccgta

SEQ ID NO: 166466 - DNA, 25 bp, E. coli
caaaaacgtgtttatgggcaagctc

SEQ ID NO: 166467 - DNA, 25 bp, E. coli
caagcgcggtgatcgcattgccgta

SEQ ID NO: 166468 - DNA, 25 bp, E. coli
caaaagcaggagttcgtaaccgacc

SEQ ID NO: 166469 - DNA, 25 bp, E. coli
caaaagcaggagatcgtaaccgacc

SEQ ID NO: 166470 - DNA, 25 bp, E. coli
caaaaacgtgttaatgggcaagctc

SEQ ID NO: 166471 - DNA, 25 bp, E. coli
catagatcccaagggtgagaacgac

SEQ ID NO: 166472 - DNA, 25 bp, E. coli
catagatcccaacggtgagaacgac

SEQ ID NO: 166473 - DNA, 25 bp, E. coli
aaaatggcaccggttattcagcgtc

SEQ ID NO: 166474 - DNA, 25 bp, E. coli
aaaatggcaccgcttattcagcgtc

SEQ ID NO: 166475 - DNA, 25 bp, E. coli
tatcgcgccaatttgcaatcagagc

SEQ ID NO: 166476 - DNA, 25 bp, E. coli
tatcgcgccaatatgcaatcagagc

SEQ ID NO: 166477 - DNA, 25 bp, E. coli
tatctcaatgggtgcctgtgccaac

SEQ ID NO: 166478 - DNA, 25 bp, E. coli
ttgatgtgtatatcccgggctgccc

SEQ ID NO: 166479 - DNA, 25 bp, E. coli
tatttattccgtagtgcagggcgtc

SEQ ID NO: 166480 - DNA, 25 bp, E. coli
tatctcaatgggagcctgtgccaac

SEQ ID NO: 166481 - DNA, 25 bp, E. coli
ttgatgtgtataacccgggctgccc

SEQ ID NO: 166482 - DNA, 25 bp, E. coli
tatttattccgttgtgcagggcgtc

SEQ ID NO: 166483 - DNA, 25 bp, E. coli
tggattatacgctcacccgcataga

SEQ ID NO: 166484 - DNA, 25 bp, E. coli
tggattatacgcacacccgcataga

SEQ ID NO: 166485 - DNA, 25 bp, E. coli
taaccgaccctctggagcaagaagt

SEQ ID NO: 166486 - DNA, 25 bp, E. coli
taaccgaccctcaggagcaagaagt

SEQ ID NO: 166487 - DNA, 25 bp, E. coli
aacgttgctcggtagcttctgctcg

SEQ ID NO: 166488 - DNA, 25 bp, E. coli
caccggctgtaattaacaacaaagg

SEQ ID NO: 166489 - DNA, 25 bp, E. coli
caccggctgtaaataacaacaaagg

SEQ ID NO: 166490 - DNA, 25 bp, E. coli
catacaccagcgaaaggccgggtgg

SEQ ID NO: 166491 - DNA, 25 bp, E. coli
catacaccagcgtaaggccgggtgg

SEQ ID NO: 166492 - DNA, 25 bp, E. coli
aaaaacgtgatgtctgtgtcgctcg

SEQ ID NO: 166493 - DNA, 25 bp, E. coli
aaaaacgtgatgactgtgtcgctcg

SEQ ID NO: 166494 - DNA, 25 bp, E. coli
aacgttgctcggaagcttctgctcg

SEQ ID NO: 166495 - DNA, 25 bp, E. coli
tatgatatttgcgtggcgtcaccag

SEQ ID NO: 166496 - DNA, 25 bp, E. coli
tatgatatttgcctggcgtcaccag

SEQ ID NO: 166497 - DNA, 25 bp, E. coli
tgtcgctcgtgagtcgaaacgttgc

SEQ ID NO: 166498 - DNA, 25 bp, E. coli
tggttcagatacaggcaccggctgt

SEQ ID NO: 166499 - DNA, 25 bp, E. coli
tgtcgctcgtgactcgaaacgttgc

SEQ ID NO: 166500 - DNA, 25 bp, E. coli
tcttgccgctgaacgttacgtgggt

SEQ ID NO: 166501 - DNA, 25 bp, E. coli
tcttgccgctgatcgttacgtgggt

SEQ ID NO: 166502 - DNA, 25 bp, E. coli
ccgggtggcctgcacattcgcattt

SEQ ID NO: 166503 - DNA, 25 bp, E. coli
ccgggtggcctggacattcgcattt

SEQ ID NO: 166504 - DNA, 25 bp, E. coli
gcaagtggattggtgttcagcctca

SEQ ID NO: 166505 - DNA, 25 bp, E. coli
gcaagtggattgctgttcagcctca

SEQ ID NO: 166506 - DNA, 25 bp, E. coli
gttcagcctcaatgaccccttctgg

SEQ ID NO: 166507 - DNA, 25 bp, E. coli
gttcagcctcaaagaccccttctgg

SEQ ID NO: 166508 - DNA, 25 bp, E. coli
tggttcagatactggcaccggctgt

SEQ ID NO: 166509 - DNA, 25 bp, E. coli
caaacctgcgcgttgctcgattacg

SEQ ID NO: 166510 - DNA, 25 bp, E. coli
caaacctgcgcgatgctcgattacg

SEQ ID NO: 166511 - DNA, 25 bp, E. coli
caccgaaaacgagcaaaaaatcgct

SEQ ID NO: 166512 - DNA, 25 bp, E. coli
agtgatcgcgcggaaactgaatcgc

SEQ ID NO: 166513 - DNA, 25 bp, E. coli
agctgcaatccgattcttcacggca

SEQ ID NO: 166514 - DNA, 25 bp, E. coli
caccgaaaacgaccaaaaaatcgct

SEQ ID NO: 166515 - DNA, 25 bp, E. coli
agtgatcgcgcgcaaactgaatcgc

SEQ ID NO: 166516 - DNA, 25 bp, E. coli
agctgcaatccgtttcttcacggca

SEQ ID NO: 166517 - DNA, 25 bp, E. coli
actcggcgcgcaaggatttactgaa

SEQ ID NO: 166518 - DNA, 25 bp, E. coli
actcggcgcgcatggatttactgaa

SEQ ID NO: 166519 - DNA, 25 bp, E. coli
tcgcgcgcaaactgaatcgcgaaaa

SEQ ID NO: 166520 - DNA, 25 bp, E. coli
tcgcgcgcaaacagaatcgcgaaaa

SEQ ID NO: 166521 - DNA, 25 bp, E. coli
ccagtcgagcattgtgaaatttgcc

SEQ ID NO: 166522 - DNA, 25 bp, E. coli
ccagtcgagcatagtgaaatttgcc

SEQ ID NO: 166523 - DNA, 25 bp, E. coli
gaaatttgcccataaactcggcgcg

SEQ ID NO: 166524 - DNA, 25 bp, E. coli
gaaatttgcccaaaaactcggcgcg

SEQ ID NO: 166525 - DNA, 25 bp, E. coli
cgcgttgctcgaatacgcgcggctg

SEQ ID NO: 166526 - DNA, 25 bp, E. coli
cgcgttgctcgattacgcgcggctg

SEQ ID NO: 166527 - DNA, 25 bp, E. coli
ggagtgaattcaccgaaaacgagca

SEQ ID NO: 166528 - DNA, 25 bp, E. coli
ggagtgaattcagcgaaaacgagca

SEQ ID NO: 166529 - DNA, 25 bp, E. coli
gagtgagctgcaatccgtttcttca

SEQ ID NO: 166530 - DNA, 25 bp, E. coli
gagtgagctgcattccgtttcttca

SEQ ID NO: 166531 - DNA, 25 bp, E. coli
caaaagagaaggcttacaagttggc

SEQ ID NO: 166532 - DNA, 25 bp, E. coli
cactaggtgtgtttcctgaggtcac

SEQ ID NO: 166533 - DNA, 25 bp, E. coli
cactaggtgtgtatcctgaggtcac

SEQ ID NO: 166534 - DNA, 25 bp, E. coli
caaaagagaagggttacaagttggc

SEQ ID NO: 166535 - DNA, 25 bp, E. coli
ttcaaagatattgcccttgagtggc

SEQ ID NO: 166536 - DNA, 25 bp, E. coli
ttcaaagatattccccttgagtggc

SEQ ID NO: 166537 - DNA, 25 bp, E. coli
tgtacctcctggtaaaacctggtgg

SEQ ID NO: 166538 - DNA, 25 bp, E. coli
tgtacctcctggaaaaacctggtgg

SEQ ID NO: 166539 - DNA, 25 bp, E. coli
tgaagcgagaggtaaagattgcccg

SEQ ID NO: 166540 - DNA, 25 bp, E. coli
tgaagcgagaggaaaagattgcccg

SEQ ID NO: 166541 - DNA, 25 bp, E. coli
gctgatggtggtcgtctgtacctcc

SEQ ID NO: 166542 - DNA, 25 bp, E. coli
gctgatggtggtggtctgtacctcc

SEQ ID NO: 166543 - DNA, 25 bp, E. coli
cgtcaaatagactctgccaagccaa

SEQ ID NO: 166544 - DNA, 25 bp, E. coli
cgtcaaatagacactgccaagccaa

SEQ ID NO: 166545 - DNA, 25 bp, E. coli
tggcgtctcaagtatcgtgtagctg

SEQ ID NO: 166546 - DNA, 25 bp, E. coli
tggcgtctcaagaatcgtgtagctg

SEQ ID NO: 166547 - DNA, 25 bp, E. coli
gatgctcctgcaaaacttgaagaag

SEQ ID NO: 166548 - DNA, 25 bp, E. coli
gtgaaactcaatgcccgtcaaatag

SEQ ID NO: 166549 - DNA, 25 bp, E. coli
gaggtcaccttacctgatgctcctg

SEQ ID NO: 166550 - DNA, 25 bp, E. coli
gtgaaactcaatccccgtcaaatag

SEQ ID NO: 166551 - DNA, 25 bp, E. coli
gaggtcaccttagctgatgctcctg

SEQ ID NO: 166552 - DNA, 25 bp, E. coli
gatgctcctgcataacttgaagaag

SEQ ID NO: 166553 - DNA, 25 bp, E. coli
tacaaacgcaattcgcgttgcggcg

SEQ ID NO: 166554 - DNA, 25 bp, E. coli
tacaaacgcaatacgcgttgcggcg

SEQ ID NO: 166555 - DNA, 25 bp, E. coli
tacccaacgtcacgaatcagaggcc

SEQ ID NO: 166556 - DNA, 25 bp, E. coli
tacccaacgtcaggaatcagaggcc

SEQ ID NO: 166557 - DNA, 25 bp, E. coli
ttaggcgataacatcaacggtcagc

SEQ ID NO: 166558 - DNA, 25 bp, E. coli
ttaggcgataacttcaacggtcagc

SEQ ID NO: 166559 - DNA, 25 bp, E. coli
tcagaggccgatgattactcctacg

SEQ ID NO: 166560 - DNA, 25 bp, E. coli
gcaggtagcactaggtacaaacgca

SEQ ID NO: 166561 - DNA, 25 bp, E. coli
gcaggtagcacttggtacaaacgca

SEQ ID NO: 166562 - DNA, 25 bp, E. coli
gaaatctctggaacatgctcgcatg

SEQ ID NO: 166563 - DNA, 25 bp, E. coli
gaaatctctggatcatgctcgcatg

SEQ ID NO: 166564 - DNA, 25 bp, E. coli
gacgacaatttcacgcgcgttaggc

SEQ ID NO: 166565 - DNA, 25 bp, E. coli
gacgacaatttctcgcgcgttaggc

SEQ ID NO: 166566 - DNA, 25 bp, E. coli
cgaatatgctagtcgtctgacgaca

SEQ ID NO: 166567 - DNA, 25 bp, E. coli
cgaatatgctagacgtctgacgaca

SEQ ID NO: 166568 - DNA, 25 bp, E. coli
gatttgctgcgcgaacgcggtatca

SEQ ID NO: 166569 - DNA, 25 bp, E. coli
gatttgctgcgccaacgcggtatca

SEQ ID NO: 166570 - DNA, 25 bp, E. coli
tcagaggccgatcattactcctacg

SEQ ID NO: 166571 - DNA, 25 bp, E. coli
tcacaatcacaagtgggagacctgg

SEQ ID NO: 166572 - DNA, 25 bp, E. coli
tcacaatcacaactgggagacctgg

SEQ ID NO: 166573 - DNA, 25 bp, E. coli
gagacctgggcgaaaagctagtcaa

SEQ ID NO: 166574 - DNA, 25 bp, E. coli
gagacctgggcgtaaagctagtcaa

SEQ ID NO: 166575 - DNA, 25 bp, E. coli
aagcgacaactacccgggctaatca

SEQ ID NO: 166576 - DNA, 25 bp, E. coli
acccgcagcgcgcatctgaagcagg

SEQ ID NO: 166577 - DNA, 25 bp, E. coli
agcgacaactagccgggctaatcaa

SEQ ID NO: 166578 - DNA, 25 bp, E. coli
agcgacaactaggcgggctaatcaa

SEQ ID NO: 166579 - DNA, 25 bp, E. coli
aaagcgacaactagccgggctaatc

SEQ ID NO: 166580 - DNA, 25 bp, E. coli
aaaagcgacaacaagccgggctaat

SEQ ID NO: 166581 - DNA, 25 bp, E. coli
aaaaggtggacaccacagcgggggt

SEQ ID NO: 166582 - DNA, 25 bp, E. coli
aagcgacaactagccgggctaatca

SEQ ID NO: 166583 - DNA, 25 bp, E. coli
acccgcagcgcggatctgaagcagg

SEQ ID NO: 166584 - DNA, 25 bp, E. coli
aaagcgacaacttgccgggctaatc

SEQ ID NO: 166585 - DNA, 25 bp, E. coli
aaaagcgacaactagccgggctaat

SEQ ID NO: 166586 - DNA, 25 bp, E. coli
aaaaggtggacagcacagcgggggt

SEQ ID NO: 166587 - DNA, 25 bp, E. coli
gacaactagccgggctaatcaatga

SEQ ID NO: 166588 - DNA, 25 bp, E. coli
gacagcacagcgggggtaatttcaa

SEQ ID NO: 166589 - DNA, 25 bp, E. coli
gacagcacagcgcgggtaatttcaa

SEQ ID NO: 166590 - DNA, 25 bp, E. coli
gacaactagccgcgctaatcaatga

SEQ ID NO: 166591 - DNA, 25 bp, E. coli
cccgcagcgcgcttctgaagcaggt

SEQ ID NO: 166592 - DNA, 25 bp, E. coli
cgacaactagcccggctaatcaatg

SEQ ID NO: 166593 - DNA, 25 bp, E. coli
cccgcagcgcgcatctgaagcaggt

SEQ ID NO: 166594 - DNA, 25 bp, E. coli
cgacaactagccgggctaatcaatg

SEQ ID NO: 166595 - DNA, 25 bp, E. coli
ggtggacagcacagcgggggtaatt

SEQ ID NO: 166596 - DNA, 25 bp, E. coli
ggtggacagcactgcgggggtaatt

SEQ ID NO: 166597 - DNA, 25 bp, E. coli
caggcaagcttaatcaggtgttaca

SEQ ID NO: 166598 - DNA, 25 bp, E. coli
caggcaagcttattcaggtgttaca

SEQ ID NO: 166599 - DNA, 25 bp, E. coli
catgccctccggcaatattcggtta

SEQ ID NO: 166600 - DNA, 25 bp, E. coli
catgccctccgggaatattcggtta

SEQ ID NO: 166601 - DNA, 25 bp, E. coli
aacatgccgcgccaagtctggtctg

SEQ ID NO: 166602 - DNA, 25 bp, E. coli
aacatgccgcgcgaagtctggtctg

SEQ ID NO: 166603 - DNA, 25 bp, E. coli
tattcaattgaagggcatgccctcc

SEQ ID NO: 166604 - DNA, 25 bp, E. coli
tattcaattgaacggcatgccctcc

SEQ ID NO: 166605 - DNA, 25 bp, E. coli
tggtctggccgatgctaaaaccttt

SEQ ID NO: 166606 - DNA, 25 bp, E. coli
tggtctggccgaagctaaaaccttt

SEQ ID NO: 166607 - DNA, 25 bp, E. coli
tgacgtgtagtcgattgccagaaag

SEQ ID NO: 166608 - DNA, 25 bp, E. coli
tgacgtgtagtccattgccagaaag

SEQ ID NO: 166609 - DNA, 25 bp, E. coli
tgccagaaagaaatgatgccgcgtt

SEQ ID NO: 166610 - DNA, 25 bp, E. coli
tgccgggatacgactgggtgaaaat

SEQ ID NO: 166611 - DNA, 25 bp, E. coli
tgccagaaagaattgatgccgcgtt

SEQ ID NO: 166612 - DNA, 25 bp, E. coli
tgccgggatacgtctgggtgaaaat

SEQ ID NO: 166613 - DNA, 25 bp, E. coli
gaatcattgcctgccttgaaccgcg

SEQ ID NO: 166614 - DNA, 25 bp, E. coli
gaatcattgcctcccttgaaccgcg

SEQ ID NO: 166615 - DNA, 25 bp, E. coli
gatcgatgcgctacgctacaccgaa

SEQ ID NO: 166616 - DNA, 25 bp, E. coli
tcaacatgcgtttgccaactgccgg

SEQ ID NO: 166617 - DNA, 25 bp, E. coli
tcaacatgcgttagccaactgccgg

SEQ ID NO: 166618 - DNA, 25 bp, E. coli
gatcgatgcgcttcgctacaccgaa

SEQ ID NO: 166619 - DNA, 25 bp, E. coli
cagaaatacggcctggaaaccgcta

SEQ ID NO: 166620 - DNA, 25 bp, E. coli
cagaaatacggcgtggaaaccgcta

SEQ ID NO: 166621 - DNA, 25 bp, E. coli
taaaaggtgcggtgcttgagctgct

SEQ ID NO: 166622 - DNA, 25 bp, E. coli
taaaaggtgcggagcttgagctgct

SEQ ID NO: 166623 - DNA, 25 bp, E. coli
acgacatcgtcgttgcgctgctgca

SEQ ID NO: 166624 - DNA, 25 bp, E. coli
acggaagagctgcatccgcgtaccc

SEQ ID NO: 166625 - DNA, 25 bp, E. coli
acgacatcgtcgatgcgctgctgca

SEQ ID NO: 166626 - DNA, 25 bp, E. coli
acggaagagctggatccgcgtaccc

SEQ ID NO: 166627 - DNA, 25 bp, E. coli
tatccgacgctgcatggcgtgaacg

SEQ ID NO: 166628 - DNA, 25 bp, E. coli
tatgtgatcggtgagaaatacggcc

SEQ ID NO: 166629 - DNA, 25 bp, E. coli
tatccgacgctggatggcgtgaacg

SEQ ID NO: 166630 - DNA, 25 bp, E. coli
tatgtgatcggtcagaaatacggcc

SEQ ID NO: 166631 - DNA, 25 bp, E. coli
tatctgccgggcacttatccgacgc

SEQ ID NO: 166632 - DNA, 25 bp, E. coli
tatctgccgggctcttatccgacgc

SEQ ID NO: 166633 - DNA, 25 bp, E. coli
cctcggcgatcacgttaccctggat

SEQ ID NO: 166634 - DNA, 25 bp, E. coli
ccacggtctgcccatcgagctgaaa

SEQ ID NO: 166635 - DNA, 25 bp, E. coli
cctcggcgatcaggttaccctggat

SEQ ID NO: 166636 - DNA, 25 bp, E. coli
ccacggtctgccgatcgagctgaaa

SEQ ID NO: 166637 - DNA, 25 bp, E. coli
gatttcgactatgcgctggtgcaga

SEQ ID NO: 166638 - DNA, 25 bp, E. coli
gatttcgactatccgctggtgcaga

SEQ ID NO: 166639 - DNA, 25 bp, E. coli
gaccgattacaccattctcggcacg

SEQ ID NO: 166640 - DNA, 25 bp, E. coli
gaccgattacacgattctcggcacg

SEQ ID NO: 166641 - DNA, 25 bp, E. coli
aattccgcgttgagctacgaactgg

SEQ ID NO: 166642 - DNA, 25 bp, E. coli
caatatggtggtatcctcagtggaa

SEQ ID NO: 166643 - DNA, 25 bp, E. coli
caatatggtggtttcctcagtggaa

SEQ ID NO: 166644 - DNA, 25 bp, E. coli
aattccgcgttgtgctacgaactgg

SEQ ID NO: 166645 - DNA, 25 bp, E. coli
taaatggtggcttgacggctatagc

SEQ ID NO: 166646 - DNA, 25 bp, E. coli
taaatggtggctagacggctatagc

SEQ ID NO: 166647 - DNA, 25 bp, E. coli
taccgcctatggtatgacttatgtg

SEQ ID NO: 166648 - DNA, 25 bp, E. coli
taccgcctatggaatgacttatgtg

SEQ ID NO: 166649 - DNA, 25 bp, E. coli
tatatagtgacccatggtatgccca

SEQ ID NO: 166650 - DNA, 25 bp, E. coli
tatatagtgaccgatggtatgccca

SEQ ID NO: 166651 - DNA, 25 bp, E. coli
tattccgggcaaccgaattccgcgt

SEQ ID NO: 166652 - DNA, 25 bp, E. coli
tattccgggcaagcgaattccgcgt

SEQ ID NO: 166653 - DNA, 25 bp, E. coli
tctttatgattagagccgtgctggc

SEQ ID NO: 166654 - DNA, 25 bp, E. coli
tctttatgattacagccgtgctggc

SEQ ID NO: 166655 - DNA, 25 bp, E. coli
gaactggatgcttttgccgcggctg

SEQ ID NO: 166656 - DNA, 25 bp, E. coli
gaactggatgctattgccgcggctg

SEQ ID NO: 166657 - DNA, 25 bp, E. coli
ggtgatcggcgcattaaccatcggc

SEQ ID NO: 166658 - DNA, 25 bp, E. coli
ggtgatcggcgctttaaccatcggc

SEQ ID NO: 166659 - DNA, 25 bp, E. coli
tcactggtggtattaaagaagcggc

SEQ ID NO: 166660 - DNA, 25 bp, E. coli
tcactggtggtaataaagaagcggc

SEQ ID NO: 166661 - DNA, 25 bp, E. coli
gagaaaactcttcccagtccgaaac

SEQ ID NO: 166662 - DNA, 25 bp, E. coli
gagaaaactcttgccagtccgaaac

SEQ ID NO: 166663 - DNA, 25 bp, E. coli
cacgtttgtcttatgcaatccgatg

SEQ ID NO: 166664 - DNA, 25 bp, E. coli
cacgtttgtcttttgcaatccgatg

SEQ ID NO: 166665 - DNA, 25 bp, E. coli
tacctactgttagcgtgcattggca

SEQ ID NO: 166666 - DNA, 25 bp, E. coli
tacctactgttaccgtgcattggca

SEQ ID NO: 166667 - DNA, 25 bp, E. coli
ttatcgggctgtaccaaaagggcgg

SEQ ID NO: 166668 - DNA, 25 bp, E. coli
ttatcgggctgttccaaaagggcgg

SEQ ID NO: 166669 - DNA, 25 bp, E. coli
tttatcgggctgttccaaaagggcg

SEQ ID NO: 166670 - DNA, 25 bp, E. coli
tttatcgggctgatccaaaagggcg

SEQ ID NO: 166671 - DNA, 25 bp, E. coli
tactgttaccgtgcattggcacgtt

SEQ ID NO: 166672 - DNA, 25 bp, E. coli
tactgttaccgtccattggcacgtt

SEQ ID NO: 166673 - DNA, 25 bp, E. coli
cctactgttaccctgcattggcacg

SEQ ID NO: 166674 - DNA, 25 bp, E. coli
cctactgttaccgtgcattggcacg

SEQ ID NO: 166675 - DNA, 25 bp, E. coli
cattggcacgtttgtcttttgcaat

SEQ ID NO: 166676 - DNA, 25 bp, E. coli
cgttacctactgttaccgtgcattg

SEQ ID NO: 166677 - DNA, 25 bp, E. coli
cattggcacgttagtcttttgcaat

SEQ ID NO: 166678 - DNA, 25 bp, E. coli
cgttacctactgataccgtgcattg

SEQ ID NO: 166679 - DNA, 25 bp, E. coli
gttacctactgtaaccgtgcattgg

SEQ ID NO: 166680 - DNA, 25 bp, E. coli
gttacctactgttaccgtgcattgg

SEQ ID NO: 166681 - DNA, 25 bp, E. coli
ggcacgtttgtcatttgcaatccga

SEQ ID NO: 166682 - DNA, 25 bp, E. coli
ggcacgtttgtcttttgcaatccga

SEQ ID NO: 166683 - DNA, 25 bp, E. coli
tcccgttacctactgttaccgtgca

SEQ ID NO: 166684 - DNA, 25 bp, E. coli
tcccgttacctagtgttaccgtgca

SEQ ID NO: 166685 - DNA, 25 bp, E. coli
aaggatatggtagtcatgccgcatc

SEQ ID NO: 166686 - DNA, 25 bp, E. coli
aaggatatggtactcatgccgcatc

SEQ ID NO: 166687 - DNA, 25 bp, E. coli
taccactcgcctgattatttttagc

SEQ ID NO: 166688 - DNA, 25 bp, E. coli
taccactcgcctcattatttttagc

SEQ ID NO: 166689 - DNA, 25 bp, E. coli
atcgcatccgctttaaaggtaaggg

SEQ ID NO: 166690 - DNA, 25 bp, E. coli
atcgcatccgctataaaggtaaggg

SEQ ID NO: 166691 - DNA, 25 bp, E. coli
tatgcgatataattcgcatccgctt

SEQ ID NO: 166692 - DNA, 25 bp, E. coli
tatgcgatataaatcgcatccgctt

SEQ ID NO: 166693 - DNA, 25 bp, E. coli
ttagctatgttgcattttgccacgg

SEQ ID NO: 166694 - DNA, 25 bp, E. coli
ttagctatgttggattttgccacgg

SEQ ID NO: 166695 - DNA, 25 bp, E. coli
tcaggaaggataaggtactcatgcc

SEQ ID NO: 166696 - DNA, 25 bp, E. coli
tcaggaaggatatggtactcatgcc

SEQ ID NO: 166697 - DNA, 25 bp, E. coli
gaatttgcgcgaatttcaggaagga

SEQ ID NO: 166698 - DNA, 25 bp, E. coli
gaatttgcgcgattttcaggaagga

SEQ ID NO: 166699 - DNA, 25 bp, E. coli
ccgcatccggcaagagtactgcact

SEQ ID NO: 166700 - DNA, 25 bp, E. coli
ccgcatccggcatgagtactgcact

SEQ ID NO: 166701 - DNA, 25 bp, E. coli
ctgcaatatatagaatttgcgcgat

SEQ ID NO: 166702 - DNA, 25 bp, E. coli
ctgcaatatatacaatttgcgcgat

SEQ ID NO: 166703 - DNA, 25 bp, E. coli
tggattttgccacggtttataccgt

SEQ ID NO: 166704 - DNA, 25 bp, E. coli
tggattttgccagggtttataccgt

SEQ ID NO: 166705 - DNA, 25 bp, E. coli
gagtactgcactgttatgcgatata

SEQ ID NO: 166706 - DNA, 25 bp, E. coli
gagtactgcactcttatgcgatata

SEQ ID NO: 166707 - DNA, 25 bp, E. coli
aaaattcgctggttgccattgccga

SEQ ID NO: 166708 - DNA, 25 bp, E. coli
aaaattcgctggatgccattgccga

SEQ ID NO: 166709 - DNA, 25 bp, E. coli
ttttgcacttcacggcgtttacgcc

SEQ ID NO: 166710 - DNA, 25 bp, E. coli
ttttgcacttcagggcgtttacgcc

SEQ ID NO: 166711 - DNA, 25 bp, E. coli
tgtttgcatttttgacccgcgtggc

SEQ ID NO: 166712 - DNA, 25 bp, E. coli
tgtttgcattttagacccgcgtggc

SEQ ID NO: 166713 - DNA, 25 bp, E. coli
tctcatggatcgtagcggtaggcac

SEQ ID NO: 166714 - DNA, 25 bp, E. coli
tctcatggatcgaagcggtaggcac

SEQ ID NO: 166715 - DNA, 25 bp, E. coli
tcagattcagctctatgccagcctg

SEQ ID NO: 166716 - DNA, 25 bp, E. coli
tcatgcaagcattaggattacaggt

SEQ ID NO: 166717 - DNA, 25 bp, E. coli
tcatgcaagcataaggattacaggt

SEQ ID NO: 166718 - DNA, 25 bp, E. coli
tcagattcagctgtatgccagcctg

SEQ ID NO: 166719 - DNA, 25 bp, E. coli
gcaggcggttatgatctctcatgga

SEQ ID NO: 166720 - DNA, 25 bp, E. coli
gcaggcggttatcatctctcatgga

SEQ ID NO: 166721 - DNA, 25 bp, E. coli
gacaaaccagtcagaacgaggcgga

SEQ ID NO: 166722 - DNA, 25 bp, E. coli
gacaaaccagtctgaacgaggcgga

SEQ ID NO: 166723 - DNA, 25 bp, E. coli
gggttgctgtgttttggccttgcca

SEQ ID NO: 166724 - DNA, 25 bp, E. coli
gggttgctgtgtattggccttgcca

SEQ ID NO: 166725 - DNA, 25 bp, E. coli
tggtatgcgtggacgcgacaaacca

SEQ ID NO: 166726 - DNA, 25 bp, E. coli
tggtatgcgtggtcgcgacaaacca

SEQ ID NO: 166727 - DNA, 25 bp, E. coli
tacttctttggcgtgatcaacgtca

SEQ ID NO: 166728 - DNA, 25 bp, E. coli
tacttctttggcctgatcaacgtca

SEQ ID NO: 166729 - DNA, 25 bp, E. coli
cacggatttgctgaccaggtgacac

SEQ ID NO: 166730 - DNA, 25 bp, E. coli
cacggatttgctcaccaggtgacac

SEQ ID NO: 166731 - DNA, 25 bp, E. coli
cagcctatgcgctgaaaaccggaaa

SEQ ID NO: 166732 - DNA, 25 bp, E. coli
cagcctatgcgcagaaaaccggaaa

SEQ ID NO: 166733 - DNA, 25 bp, E. coli
taccgtgtatgtggatggcgttgcc

SEQ ID NO: 166734 - DNA, 25 bp, E. coli
tatggctgagcagaaagcccgcatg

SEQ ID NO: 166735 - DNA, 25 bp, E. coli
taccgtgtatgtcgatggcgttgcc

SEQ ID NO: 166736 - DNA, 25 bp, E. coli
tatggctgagcacaaagcccgcatg

SEQ ID NO: 166737 - DNA, 25 bp, E. coli
tatcagacgcttcaggcacagtgcg

SEQ ID NO: 166738 - DNA, 25 bp, E. coli
tatcagacgcttgaggcacagtgcg

SEQ ID NO: 166739 - DNA, 25 bp, E. coli
tgaatgaaatggctgaaccgccccg

SEQ ID NO: 166740 - DNA, 25 bp, E. coli
tgaatgaaatgggtgaaccgccccg

SEQ ID NO: 166741 - DNA, 25 bp, E. coli
ccggcagtgtctcatgaggcgacca

SEQ ID NO: 166742 - DNA, 25 bp, E. coli
ccggcagtgtctgatgaggcgacca

SEQ ID NO: 166743 - DNA, 25 bp, E. coli
gaatcggtactgatgccagcctatg

SEQ ID NO: 166744 - DNA, 25 bp, E. coli
gaatcggtactgttgccagcctatg

SEQ ID NO: 166745 - DNA, 25 bp, E. coli
gacacccgctgttgaggcaatggca

SEQ ID NO: 166746 - DNA, 25 bp, E. coli
gacacccgctgtagaggcaatggca

SEQ ID NO: 166747 - DNA, 25 bp, E. coli
gtaacagaaccatcaccggtaccgg

SEQ ID NO: 166748 - DNA, 25 bp, E. coli
gtaacagaaccaacaccggtaccgg

SEQ ID NO: 166749 - DNA, 25 bp, E. coli
tggaaatggcccgtgaacgtctgct

SEQ ID NO: 166750 - DNA, 25 bp, E. coli
tggaaatggcccctgaacgtctgct

SEQ ID NO: 166751 - DNA, 25 bp, E. coli
acagaaaagaatgggacgcgcttga

SEQ ID NO: 166752 - DNA, 25 bp, E. coli
acagaaaagaatcggacgcgcttga

SEQ ID NO: 166753 - DNA, 25 bp, E. coli
tgtctatggctttgactcagacaga

SEQ ID NO: 166754 - DNA, 25 bp, E. coli
tgtctatggcttagactcagacaga

SEQ ID NO: 166755 - DNA, 25 bp, E. coli
tggtcaggcggaccggatcctgttt

SEQ ID NO: 166756 - DNA, 25 bp, E. coli
tgggacgcgcttgatatgagtttac

SEQ ID NO: 166757 - DNA, 25 bp, E. coli
tgggacgcgcttcatatgagtttac

SEQ ID NO: 166758 - DNA, 25 bp, E. coli
tgaatagtgatgctcaggcggagcg

SEQ ID NO: 166759 - DNA, 25 bp, E. coli
tgactcagacagtaaagaatgggac

SEQ ID NO: 166760 - DNA, 25 bp, E. coli
tgaatagtgatggtcaggcggagcg

SEQ ID NO: 166761 - DNA, 25 bp, E. coli
tgactcagacagaaaagaatgggac

SEQ ID NO: 166762 - DNA, 25 bp, E. coli
tcagacagaaaagaatgggacgcgc

SEQ ID NO: 166763 - DNA, 25 bp, E. coli
tcagacagaaaacaatgggacgcgc

SEQ ID NO: 166764 - DNA, 25 bp, E. coli
cgcgcttgatatgagtttacttccg

SEQ ID NO: 166765 - DNA, 25 bp, E. coli
cgcgcttgatatcagtttacttccg

SEQ ID NO: 166766 - DNA, 25 bp, E. coli
gtttgcttttaatgatgacagagtc

SEQ ID NO: 166767 - DNA, 25 bp, E. coli
gatatgagtttagttccgaacgaaa

SEQ ID NO: 166768 - DNA, 25 bp, E. coli
gtttgcttttaaagatgacagagtc

SEQ ID NO: 166769 - DNA, 25 bp, E. coli
tggtcaggcggagcggatcctgttt

SEQ ID NO: 166770 - DNA, 25 bp, E. coli
gatatgagtttacttccgaacgaaa

SEQ ID NO: 166771 - DNA, 25 bp, E. coli
gatgacagagtctttgtctatggct

SEQ ID NO: 166772 - DNA, 25 bp, E. coli
gatgacagagtcattgtctatggct

SEQ ID NO: 166773 - DNA, 25 bp, E. coli
tacgtcaggatgtcagcggcttctc

SEQ ID NO: 166774 - DNA, 25 bp, E. coli
tacgtcaggatgacagcggcttctc

SEQ ID NO: 166775 - DNA, 25 bp, E. coli
tctgggatcgcgtaccggtaaaaga

SEQ ID NO: 166776 - DNA, 25 bp, E. coli
tctgggatcgcgaaccggtaaaaga

SEQ ID NO: 166777 - DNA, 25 bp, E. coli
tcattgtgcagtcggatgcgaacag

SEQ ID NO: 166778 - DNA, 25 bp, E. coli
tctgcctgcgtttcagcgtgaaagt

SEQ ID NO: 166779 - DNA, 25 bp, E. coli
tctgcctgcgttacagcgtgaaagt

SEQ ID NO: 166780 - DNA, 25 bp, E. coli
tcattgtgcagtgggatgcgaacag

SEQ ID NO: 166781 - DNA, 25 bp, E. coli
gcttctcgccggagttgacggttaa

SEQ ID NO: 166782 - DNA, 25 bp, E. coli
gctacgcggtgcgacatcctgtgaa

SEQ ID NO: 166783 - DNA, 25 bp, E. coli
gcttctcgccggtgttgacggttaa

SEQ ID NO: 166784 - DNA, 25 bp, E. coli
gctacgcggtgccacatcctgtgaa

SEQ ID NO: 166785 - DNA, 25 bp, E. coli
gaagcatctccagagggcgggttat

SEQ ID NO: 166786 - DNA, 25 bp, E. coli
gaagcatctccacagggcgggttat

SEQ ID NO: 166787 - DNA, 25 bp, E. coli
gacacttttcagctcgtacgtcagg

SEQ ID NO: 166788 - DNA, 25 bp, E. coli
gacacttttcaggtcgtacgtcagg

SEQ ID NO: 166789 - DNA, 25 bp, E. coli
cggtaaaagagtgcgaccagattgg

SEQ ID NO: 166790 - DNA, 25 bp, E. coli
cggtaaaagagtccgaccagattgg

SEQ ID NO: 166791 - DNA, 25 bp, E. coli
gataaagtcacttatccggatgcca

SEQ ID NO: 166792 - DNA, 25 bp, E. coli
gataaagtcactaatccggatgcca

SEQ ID NO: 166793 - DNA, 25 bp, E. coli
ggtatttaccgtcgcgaagcatctc

SEQ ID NO: 166794 - DNA, 25 bp, E. coli
ggtatttaccgtggcgaagcatctc

SEQ ID NO: 166795 - DNA, 25 bp, E. coli
cacgttagggttctacagaggcatc

SEQ ID NO: 166796 - DNA, 25 bp, E. coli
cacgttagggttgtacagaggcatc

SEQ ID NO: 166797 - DNA, 25 bp, E. coli
aaaatatgcccggtttatgacgcca

SEQ ID NO: 166798 - DNA, 25 bp, E. coli
aaaatatgcccgctttatgacgcca

SEQ ID NO: 166799 - DNA, 25 bp, E. coli
tatgccacgggcgataatttacagg

SEQ ID NO: 166800 - DNA, 25 bp, E. coli
tatgccacgggccataatttacagg

SEQ ID NO: 166801 - DNA, 25 bp, E. coli
tatttaagtgtggaaacgctgacca

SEQ ID NO: 166802 - DNA, 25 bp, E. coli
tatttaagtgtgcaaacgctgacca

SEQ ID NO: 166803 - DNA, 25 bp, E. coli
tttacagggcgctcgtcaactgggc

SEQ ID NO: 166804 - DNA, 25 bp, E. coli
tttacagggcgcacgtcaactgggc

SEQ ID NO: 166805 - DNA, 25 bp, E. coli
tgggcgcgacgctggtaatgcttac

SEQ ID NO: 166806 - DNA, 25 bp, E. coli
tgggcgcgacgcaggtaatgcttac

SEQ ID NO: 166807 - DNA, 25 bp, E. coli
tgaaatcacggcactgctggcggtg

SEQ ID NO: 166808 - DNA, 25 bp, E. coli
tgaaatcacggctctgctggcggtg

SEQ ID NO: 166809 - DNA, 25 bp, E. coli
tcctggtcgcgtggctaaagatccc

SEQ ID NO: 166810 - DNA, 25 bp, E. coli
tcctggtcgcgtcgctaaagatccc

SEQ ID NO: 166811 - DNA, 25 bp, E. coli
gatttttcaacggtgtcctggtcgc

SEQ ID NO: 166812 - DNA, 25 bp, E. coli
gatttttcaacgctgtcctggtcgc

SEQ ID NO: 166813 - DNA, 25 bp, E. coli
ggtactcggcgcttggttcctgacg

SEQ ID NO: 166814 - DNA, 25 bp, E. coli
ggtactcggcgcatggttcctgacg

SEQ ID NO: 166815 - DNA, 25 bp, E. coli
gaccatggtttatagcagcgcgcaa

SEQ ID NO: 166816 - DNA, 25 bp, E. coli
gaccatggtttaaagcagcgcgcaa

SEQ ID NO: 166817 - DNA, 25 bp, E. coli
taaagcttacatgaacaatgcgggt

SEQ ID NO: 166818 - DNA, 25 bp, E. coli
taaagcttacatcaacaatgcgggt

SEQ ID NO: 166819 - DNA, 25 bp, E. coli
tatgacggcatctgggacaacaaca

SEQ ID NO: 166820 - DNA, 25 bp, E. coli
tatgacggcatcagggacaacaaca

SEQ ID NO: 166821 - DNA, 25 bp, E. coli
tattggctgatattgtcggaacaca

SEQ ID NO: 166822 - DNA, 25 bp, E. coli
tattggctgataatgtcggaacaca

SEQ ID NO: 166823 - DNA, 25 bp, E. coli
tgtaggctatacaggaacgaacgcg

SEQ ID NO: 166824 - DNA, 25 bp, E. coli
tgtaggctatactggaacgaacgcg

SEQ ID NO: 166825 - DNA, 25 bp, E. coli
tgttaaagcgttcaggaacagcgcc

SEQ ID NO: 166826 - DNA, 25 bp, E. coli
tgttaaagcgttgaggaacagcgcc

SEQ ID NO: 166827 - DNA, 25 bp, E. coli
tccaacaatcaatgtagcgatccgg

SEQ ID NO: 166828 - DNA, 25 bp, E. coli
tccaacaatcaaagtagcgatccgg

SEQ ID NO: 166829 - DNA, 25 bp, E. coli
tctgagtgtgggtggaacatctacc

SEQ ID NO: 166830 - DNA, 25 bp, E. coli
tctgagtgtgggaggaacatctacc

SEQ ID NO: 166831 - DNA, 25 bp, E. coli
gaaacaccaagaaagcgtccggcta

SEQ ID NO: 166832 - DNA, 25 bp, E. coli
gaaacaccaagatagcgtccggcta

SEQ ID NO: 166833 - DNA, 25 bp, E. coli
gtatcgcgacgaatggacttaatcc

SEQ ID NO: 166834 - DNA, 25 bp, E. coli
gtatcgcgacgattggacttaatcc

SEQ ID NO: 166835 - DNA, 25 bp, E. coli
taatccaaacgaactgcctgctggg

SEQ ID NO: 166836 - DNA, 25 bp, E. coli
tcaacaggcagaatcaaagcaggtg

SEQ ID NO: 166837 - DNA, 25 bp, E. coli
taatccaaacgatctgcctgctggg

SEQ ID NO: 166838 - DNA, 25 bp, E. coli
tcaacaggcagattcaaagcaggtg

SEQ ID NO: 166839 - DNA, 25 bp, E. coli
caactacttttcgttgtcttatgtg

SEQ ID NO: 166840 - DNA, 25 bp, E. coli
caactacttttccttgtcttatgtg

SEQ ID NO: 166841 - DNA, 25 bp, E. coli
tacagcacacaagtacttttcgttg

SEQ ID NO: 166842 - DNA, 25 bp, E. coli
tacttcgagtataggtagggttgta

SEQ ID NO: 166843 - DNA, 25 bp, E. coli
tacagcacacaactacttttcgttg

SEQ ID NO: 166844 - DNA, 25 bp, E. coli
tacttcgagtattggtagggttgta

SEQ ID NO: 166845 - DNA, 25 bp, E. coli
tatgtgttgaacctacttcgagtat

SEQ ID NO: 166846 - DNA, 25 bp, E. coli
tatgtgttgaacgtacttcgagtat

SEQ ID NO: 166847 - DNA, 25 bp, E. coli
tatttaaattttacagcacacaact

SEQ ID NO: 166848 - DNA, 25 bp, E. coli
tatttaaatttttcagcacacaact

SEQ ID NO: 166849 - DNA, 25 bp, E. coli
ttttacagcacacaactacttttcg

SEQ ID NO: 166850 - DNA, 25 bp, E. coli
ttttacagcacagaactacttttcg

SEQ ID NO: 166851 - DNA, 25 bp, E. coli
tgaacgtacttcgagtataggtagg

SEQ ID NO: 166852 - DNA, 25 bp, E. coli
tgaacgtacttccagtataggtagg

SEQ ID NO: 166853 - DNA, 25 bp, E. coli
tcttatgtgttgtacgtacttcgag

SEQ ID NO: 166854 - DNA, 25 bp, E. coli
tcttatgtgttgaacgtacttcgag

SEQ ID NO: 166855 - DNA, 25 bp, E. coli
cgagtataggtagggttgtatatat

SEQ ID NO: 166856 - DNA, 25 bp, E. coli
cgagtataggtacggttgtatatat

SEQ ID NO: 166857 - DNA, 25 bp, E. coli
cgttgtcttatgagttgaacgtact

SEQ ID NO: 166858 - DNA, 25 bp, E. coli
cgttgtcttatgtgttgaacgtact

SEQ ID NO: 166859 - DNA, 25 bp, E. coli
cgtacttcgagtttaggtagggttg

SEQ ID NO: 166860 - DNA, 25 bp, E. coli
cgtacttcgagtataggtagggttg

SEQ ID NO: 166861 - DNA, 25 bp, E. coli
aatccgaagccgcatccaaaaccag

SEQ ID NO: 166862 - DNA, 25 bp, E. coli
caatggcgttgatacgacgcttgcc

SEQ ID NO: 166863 - DNA, 25 bp, E. coli
caatggcgttgaaacgacgcttgcc

SEQ ID NO: 166864 - DNA, 25 bp, E. coli
aatccgaagccggatccaaaaccag

SEQ ID NO: 166865 - DNA, 25 bp, E. coli
taacgacggtaatgtttatttatca

SEQ ID NO: 166866 - DNA, 25 bp, E. coli
taacgacggtaaagtttatttatca

SEQ ID NO: 166867 - DNA, 25 bp, E. coli
tcagatctattcaggtggtacgcaa

SEQ ID NO: 166868 - DNA, 25 bp, E. coli
tctccaggttgctggcgggacagca

SEQ ID NO: 166869 - DNA, 25 bp, E. coli
tcagatctattctggtggtacgcaa

SEQ ID NO: 166870 - DNA, 25 bp, E. coli
tctccaggttgcaggcgggacagca

SEQ ID NO: 166871 - DNA, 25 bp, E. coli
ccaacgagtagatgaacgaggtaca

SEQ ID NO: 166872 - DNA, 25 bp, E. coli
ccaacgagtagaagaacgaggtaca

SEQ ID NO: 166873 - DNA, 25 bp, E. coli
gactgtagatgggagccaacgagta

SEQ ID NO: 166874 - DNA, 25 bp, E. coli
gacattaactatcggcaatggcgtt

SEQ ID NO: 166875 - DNA, 25 bp, E. coli
gactgtagatggcagccaacgagta

SEQ ID NO: 166876 - DNA, 25 bp, E. coli
gacattaactatgggcaatggcgtt

SEQ ID NO: 166877 - DNA, 25 bp, E. coli
gatagcgcgacaataactatcggca

SEQ ID NO: 166878 - DNA, 25 bp, E. coli
gatagcgcgacattaactatcggca

SEQ ID NO: 166879 - DNA, 25 bp, E. coli
gatgtaggaagggataacaattatg

SEQ ID NO: 166880 - DNA, 25 bp, E. coli
gatggcagccaacgagtagatgaac

SEQ ID NO: 166881 - DNA, 25 bp, E. coli
gatggcagccaaggagtagatgaac

SEQ ID NO: 166882 - DNA, 25 bp, E. coli
gatgtaggaaggcataacaattatg

SEQ ID NO: 166883 - DNA, 25 bp, E. coli
actgtgattatctggtcgccctgcg

SEQ ID NO: 166884 - DNA, 25 bp, E. coli
actgtgattatcaggtcgccctgcg

SEQ ID NO: 166885 - DNA, 25 bp, E. coli
tgcgcggcgaaagcctcgaaatgat

SEQ ID NO: 166886 - DNA, 25 bp, E. coli
tgcgcggcgaaaccctcgaaatgat

SEQ ID NO: 166887 - DNA, 25 bp, E. coli
cctgcgcggcggtgaaatgattgct

SEQ ID NO: 166888 - DNA, 25 bp, E. coli
cctgcgcggcggagaaatgattgct

SEQ ID NO: 166889 - DNA, 25 bp, E. coli
gctatctcgctgcttggcttaaaac

SEQ ID NO: 166890 - DNA, 25 bp, E. coli
gctatctcgctggttggcttaaaac

SEQ ID NO: 166891 - DNA, 25 bp, E. coli
gaaatgattgctgagggaacgcctg

SEQ ID NO: 166892 - DNA, 25 bp, E. coli
gaaatgattgctcagggaacgcctg

SEQ ID NO: 166893 - DNA, 25 bp, E. coli
gaaatgatttatcgcatcccgatgg

SEQ ID NO: 166894 - DNA, 25 bp, E. coli
gaaatgatttatggcatcccgatgg

SEQ ID NO: 166895 - DNA, 25 bp, E. coli
gaacgcctgcggaaattatgcgcgg

SEQ ID NO: 166896 - DNA, 25 bp, E. coli
gaacgcctgcggtaattatgcgcgg

SEQ ID NO: 166897 - DNA, 25 bp, E. coli
cgattggtcgttacccgtggcatgg

SEQ ID NO: 166898 - DNA, 25 bp, E. coli
cgattggtcgtttcccgtggcatgg

SEQ ID NO: 166899 - DNA, 25 bp, E. coli
ggcttaaaaccgctggcgcatcggc

SEQ ID NO: 166900 - DNA, 25 bp, E. coli
tggatatcgccctccaggttgatgt

SEQ ID NO: 166901 - DNA, 25 bp, E. coli
tggatatcgcccaccaggttgatgt

SEQ ID NO: 166902 - DNA, 25 bp, E. coli
ggcttaaaaccggtggcgcatcggc

SEQ ID NO: 166903 - DNA, 25 bp, E. coli
taatatctccttacgtgtgcccggg

SEQ ID NO: 166904 - DNA, 25 bp, E. coli
taatatctcctttcgtgtgcccggg

SEQ ID NO: 166905 - DNA, 25 bp, E. coli
aaggctttagccctcagcacgcggt

SEQ ID NO: 166906 - DNA, 25 bp, E. coli
caatcagccctggaataagcgcctg

SEQ ID NO: 166907 - DNA, 25 bp, E. coli
caatcagccctgcaataagcgcctg

SEQ ID NO: 166908 - DNA, 25 bp, E. coli
aaggctttagccgtcagcacgcggt

SEQ ID NO: 166909 - DNA, 25 bp, E. coli
catccgagcgatatggcggtcgcaa

SEQ ID NO: 166910 - DNA, 25 bp, E. coli
catccgagcgatttggcggtcgcaa

SEQ ID NO: 166911 - DNA, 25 bp, E. coli
taaactcctgttggcgaagcgaacg

SEQ ID NO: 166912 - DNA, 25 bp, E. coli
taaactcctgttcgcgaagcgaacg

SEQ ID NO: 166913 - DNA, 25 bp, E. coli
tatctaccgtaacgtgcgcgatcgc

SEQ ID NO: 166914 - DNA, 25 bp, E. coli
tatctaccgtaaggtgcgcgatcgc

SEQ ID NO: 166915 - DNA, 25 bp, E. coli
gcgcaaaatttatcgcgggcgggac

SEQ ID NO: 166916 - DNA, 25 bp, E. coli
gcgcaaaatttaacgcgggcgggac

SEQ ID NO: 166917 - DNA, 25 bp, E. coli
gaaagactcgcactatcacactggc

SEQ ID NO: 166918 - DNA, 25 bp, E. coli
gaacgcttgcctgcgtactggctga

SEQ ID NO: 166919 - DNA, 25 bp, E. coli
gaaagactcgcagtatcacactggc

SEQ ID NO: 166920 - DNA, 25 bp, E. coli
gaacgcttgcctccgtactggctga

SEQ ID NO: 166921 - DNA, 25 bp, E. coli
ggaccaatctgctggacctgatgaa

SEQ ID NO: 166922 - DNA, 25 bp, E. coli
ggaccaatctgcaggacctgatgaa

SEQ ID NO: 166923 - DNA, 25 bp, E. coli
gatgcggtggtgcaaaccatcacgc

SEQ ID NO: 166924 - DNA, 25 bp, E. coli
gagtagcacataagccctggcgcat

SEQ ID NO: 166925 - DNA, 25 bp, E. coli
gatgcggtggtggaaaccatcacgc

SEQ ID NO: 166926 - DNA, 25 bp, E. coli
gagtagcacatatgccctggcgcat

SEQ ID NO: 166927 - DNA, 25 bp, E. coli
cacttttctgggtggttgtcgcact

SEQ ID NO: 166928 - DNA, 25 bp, E. coli
cacttttctgggaggttgtcgcact

SEQ ID NO: 166929 - DNA, 25 bp, E. coli
atgaggttagcattgccttctggaa

SEQ ID NO: 166930 - DNA, 25 bp, E. coli
atgaggttagcaatgccttctggaa

SEQ ID NO: 166931 - DNA, 25 bp, E. coli
attaaaacgtaaagcctggctggcg

SEQ ID NO: 166932 - DNA, 25 bp, E. coli
attaaaacgtaatgcctggctggcg

SEQ ID NO: 166933 - DNA, 25 bp, E. coli
tagcaatgccttgtggaaatcagga

SEQ ID NO: 166934 - DNA, 25 bp, E. coli
tagcaatgccttctggaaatcagga

SEQ ID NO: 166935 - DNA, 25 bp, E. coli
ttttctgggtggatgtcgcactgct

SEQ ID NO: 166936 - DNA, 25 bp, E. coli
ttttctgggtggttgtcgcactgct

SEQ ID NO: 166937 - DNA, 25 bp, E. coli
tgccttctggaattcaggaaccccg

SEQ ID NO: 166938 - DNA, 25 bp, E. coli
tcctgaattaaaacgtaaagcctgg

SEQ ID NO: 166939 - DNA, 25 bp, E. coli
tgccttctggaaatcaggaaccccg

SEQ ID NO: 166940 - DNA, 25 bp, E. coli
tcctgaattaaatcgtaaagcctgg

SEQ ID NO: 166941 - DNA, 25 bp, E. coli
cttggttctgcagttttctgggtgg

SEQ ID NO: 166942 - DNA, 25 bp, E. coli
ctggcggtttttcttggttctgcac

SEQ ID NO: 166943 - DNA, 25 bp, E. coli
ctggctggcggtttttcttggttct

SEQ ID NO: 166944 - DNA, 25 bp, E. coli
ctggcggtttttgttggttctgcac

SEQ ID NO: 166945 - DNA, 25 bp, E. coli
cttctggaaatctggaaccccgccg

SEQ ID NO: 166946 - DNA, 25 bp, E. coli
cttggttctgcacttttctgggtgg

SEQ ID NO: 166947 - DNA, 25 bp, E. coli
cttctggaaatcaggaaccccgccg

SEQ ID NO: 166948 - DNA, 25 bp, E. coli
ctggctggcggtatttcttggttct

SEQ ID NO: 166949 - DNA, 25 bp, E. coli
aagtactggctaaacgtgctgagaa

SEQ ID NO: 166950 - DNA, 25 bp, E. coli
aagtactggctatacgtgctgagaa

SEQ ID NO: 166951 - DNA, 25 bp, E. coli
taaacgtgctgagaagaaaaaagct

SEQ ID NO: 166952 - DNA, 25 bp, E. coli
taaacgtgctgacaagaaaaaagct

SEQ ID NO: 166953 - DNA, 25 bp, E. coli
tactggctaaacgtgctgagaagaa

SEQ ID NO: 166954 - DNA, 25 bp, E. coli
tactggctaaacctgctgagaagaa

SEQ ID NO: 166955 - DNA, 25 bp, E. coli
tgctgctgggtatagtaggccgcta

SEQ ID NO: 166956 - DNA, 25 bp, E. coli
tgctgctgggtaaagtaggccgcta

SEQ ID NO: 166957 - DNA, 25 bp, E. coli
tgctgggtaaagtaggccgctatat

SEQ ID NO: 166958 - DNA, 25 bp, E. coli
tgctgggtaaagaaggccgctatat

SEQ ID NO: 166959 - DNA, 25 bp, E. coli
tctgctgctgggaaaagtaggccgc

SEQ ID NO: 166960 - DNA, 25 bp, E. coli
tctgctgctgggtaaagtaggccgc

SEQ ID NO: 166961 - DNA, 25 bp, E. coli
ccatctgctgctcggtaaagtaggc

SEQ ID NO: 166962 - DNA, 25 bp, E. coli
ccatctgctgctgggtaaagtaggc

SEQ ID NO: 166963 - DNA, 25 bp, E. coli
gaagaaagtactggctaaacgtgct

SEQ ID NO: 166964 - DNA, 25 bp, E. coli
gaagaaagtactcgctaaacgtgct

SEQ ID NO: 166965 - DNA, 25 bp, E. coli
gaaagtactggctaaacgtgctgag

SEQ ID NO: 166966 - DNA, 25 bp, E. coli
gaaagtactggcaaaacgtgctgag

SEQ ID NO: 166967 - DNA, 25 bp, E. coli
ctggctaaacgtcctgagaagaaaa

SEQ ID NO: 166968 - DNA, 25 bp, E. coli
ctggctaaacgtgctgagaagaaaa

SEQ ID NO: 166969 - DNA, 25 bp, E. coli
taaagtaggccgctatattgaagag

SEQ ID NO: 166970 - DNA, 25 bp, E. coli
taaagtaggccggtatattgaagag

SEQ ID NO: 166971 - DNA, 25 bp, E. coli
caatctgaatatgagtgtgtcggca

SEQ ID NO: 166972 - DNA, 25 bp, E. coli
caatctgaatatcagtgtgtcggca

SEQ ID NO: 166973 - DNA, 25 bp, E. coli
cacttacaggcgctcgccttatggg

SEQ ID NO: 166974 - DNA, 25 bp, E. coli
cacttacaggcggtcgccttatggg

SEQ ID NO: 166975 - DNA, 25 bp, E. coli
agatcatcagttatgccgattttag

SEQ ID NO: 166976 - DNA, 25 bp, E. coli
agatcatcagttttgccgattttag

SEQ ID NO: 166977 - DNA, 25 bp, E. coli
tagcaaatatcacacttacaggcgc

SEQ ID NO: 166978 - DNA, 25 bp, E. coli
tagcaaatatcagacttacaggcgc

SEQ ID NO: 166979 - DNA, 25 bp, E. coli
tttgtctacgtgaaaagatcatcag

SEQ ID NO: 166980 - DNA, 25 bp, E. coli
tttgtctacgtgtaaagatcatcag

SEQ ID NO: 166981 - DNA, 25 bp, E. coli
tgtgtcggcagatatggacattatc

SEQ ID NO: 166982 - DNA, 25 bp, E. coli
tgtgtcggcagaaatggacattatc

SEQ ID NO: 166983 - DNA, 25 bp, E. coli
tgcgcatttgaaacgcctgcaacgg

SEQ ID NO: 166984 - DNA, 25 bp, E. coli
tgcgcatttgaatcgcctgcaacgg

SEQ ID NO: 166985 - DNA, 25 bp, E. coli
cctgcaacggtgaatagtaagagat

SEQ ID NO: 166986 - DNA, 25 bp, E. coli
cctgcaacggtgtatagtaagagat

SEQ ID NO: 166987 - DNA, 25 bp, E. coli
gacgttgtgtagataactatttgtc

SEQ ID NO: 166988 - DNA, 25 bp, E. coli
ccgattttagtcatttacagatagc

SEQ ID NO: 166989 - DNA, 25 bp, E. coli
ccgattttagtcttttacagatagc

SEQ ID NO: 166990 - DNA, 25 bp, E. coli
gtaagagatttaagccccagggagt

SEQ ID NO: 166991 - DNA, 25 bp, E. coli
gtaagagatttatgccccagggagt

SEQ ID NO: 166992 - DNA, 25 bp, E. coli
gacgttgtgtagttaactatttgtc

SEQ ID NO: 166993 - DNA, 25 bp, E. coli
ctttattattccttgtacggacata

SEQ ID NO: 166994 - DNA, 25 bp, E. coli
ctttattattccatgtacggacata

SEQ ID NO: 166995 - DNA, 25 bp, E. coli
attccatgtacgcacatattgaaac

SEQ ID NO: 166996 - DNA, 25 bp, E. coli
attccatgtacggacatattgaaac

SEQ ID NO: 166997 - DNA, 25 bp, E. coli
agttctggtgctttattattccatg

SEQ ID NO: 166998 - DNA, 25 bp, E. coli
agttctggtgctatattattccatg

SEQ ID NO: 166999 - DNA, 25 bp, E. coli
aaagttctggtggtttattattcca

SEQ ID NO: 167000 - DNA, 25 bp, E. coli
aaagttctggtgctttattattcca

SEQ ID NO: 167001 - DNA, 25 bp, E. coli
tattattccatgaacggacatattg

SEQ ID NO: 167002 - DNA, 25 bp, E. coli
tattattccatgtacggacatattg

SEQ ID NO: 167003 - DNA, 25 bp, E. coli
ttattccatgtagggacatattgaa

SEQ ID NO: 167004 - DNA, 25 bp, E. coli
ttattccatgtacggacatattgaa

SEQ ID NO: 167005 - DNA, 25 bp, E. coli
tgctttattattccatgtacggaca

SEQ ID NO: 167006 - DNA, 25 bp, E. coli
tgctttattattgcatgtacggaca

SEQ ID NO: 167007 - DNA, 25 bp, E. coli
gctttattattccatgtacggacat

SEQ ID NO: 167008 - DNA, 25 bp, E. coli
gctttattattcgatgtacggacat

SEQ ID NO: 167009 - DNA, 25 bp, E. coli
gtgctttattattccatgtacggac

SEQ ID NO: 167010 - DNA, 25 bp, E. coli
ggtgctttattattccatgtacgga

SEQ ID NO: 167011 - DNA, 25 bp, E. coli
gtgctttattataccatgtacggac

SEQ ID NO: 167012 - DNA, 25 bp, E. coli
ggtgctttattaatccatgtacgga

SEQ ID NO: 167013 - DNA, 25 bp, E. coli
tggctaaagttcaggtgctttatta

SEQ ID NO: 167014 - DNA, 25 bp, E. coli
tggctaaagttctggtgctttatta

SEQ ID NO: 167015 - DNA, 25 bp, E. coli
tactccctgcgtcagattccaatta

SEQ ID NO: 167016 - DNA, 25 bp, E. coli
tactccctgcgtgagattccaatta

SEQ ID NO: 167017 - DNA, 25 bp, E. coli
atcaggcgattttgctatttacaca

SEQ ID NO: 167018 - DNA, 25 bp, E. coli
atcaggcgatttagctatttacaca

SEQ ID NO: 167019 - DNA, 25 bp, E. coli
tgagattccaataatcgcgtccagc

SEQ ID NO: 167020 - DNA, 25 bp, E. coli
tgcgtgagattcgaattatcgcgtc

SEQ ID NO: 167021 - DNA, 25 bp, E. coli
tgagattccaattatcgcgtccagc

SEQ ID NO: 167022 - DNA, 25 bp, E. coli
tgcgtgagattccaattatcgcgtc

SEQ ID NO: 167023 - DNA, 25 bp, E. coli
tccctgcgtgagtttccaattatcg

SEQ ID NO: 167024 - DNA, 25 bp, E. coli
tccctgcgtgagattccaattatcg

SEQ ID NO: 167025 - DNA, 25 bp, E. coli
cctgcgtgagattccaattatcgcg

SEQ ID NO: 167026 - DNA, 25 bp, E. coli
cctgcgtgagataccaattatcgcg

SEQ ID NO: 167027 - DNA, 25 bp, E. coli
gcgtgagattccaattatcgcgtcc

SEQ ID NO: 167028 - DNA, 25 bp, E. coli
gcgtgagattcctattatcgcgtcc

SEQ ID NO: 167029 - DNA, 25 bp, E. coli
cgtgagattccaattatcgcgtcca

SEQ ID NO: 167030 - DNA, 25 bp, E. coli
cgtgagattccatttatcgcgtcca

SEQ ID NO: 167031 - DNA, 25 bp, E. coli
gattccaattatggcgtccagcatg

SEQ ID NO: 167032 - DNA, 25 bp, E. coli
gattccaattatcgcgtccagcatg

SEQ ID NO: 167033 - DNA, 25 bp, E. coli
gtgagattccaaatatcgcgtccag

SEQ ID NO: 167034 - DNA, 25 bp, E. coli
gtgagattccaattatcgcgtccag

SEQ ID NO: 167035 - DNA, 25 bp, E. coli
gagattccaattttcgcgtccagca

SEQ ID NO: 167036 - DNA, 25 bp, E. coli
gagattccaattatcgcgtccagca

SEQ ID NO: 167037 - DNA, 25 bp, E. coli
tccgccagctgaagaaatcgctaat

SEQ ID NO: 167038 - DNA, 25 bp, E. coli
tccgccagctgatgaaatcgctaat

SEQ ID NO: 167039 - DNA, 25 bp, E. coli
tccggattcggacaaggcttaatat

SEQ ID NO: 167040 - DNA, 25 bp, E. coli
tccggattcggagaaggcttaatat

SEQ ID NO: 167041 - DNA, 25 bp, E. coli
ccagagcatcagataacggcaccac

SEQ ID NO: 167042 - DNA, 25 bp, E. coli
ccagagcatcagttaacggcaccac

SEQ ID NO: 167043 - DNA, 25 bp, E. coli
gcttcgaagagagacactacctgca

SEQ ID NO: 167044 - DNA, 25 bp, E. coli
gcttcgaagagacacactacctgca

SEQ ID NO: 167045 - DNA, 25 bp, E. coli
gaaagcgtttatgcgcattgccaga

SEQ ID NO: 167046 - DNA, 25 bp, E. coli
gaaagcgtttatccgcattgccaga

SEQ ID NO: 167047 - DNA, 25 bp, E. coli
cattgccagagtgaaaatgcctcag

SEQ ID NO: 167048 - DNA, 25 bp, E. coli
cattgccagagtcaaaatgcctcag

SEQ ID NO: 167049 - DNA, 25 bp, E. coli
gatatataccgaagtgctccctccg

SEQ ID NO: 167050 - DNA, 25 bp, E. coli
gatatataccgatgtgctccctccg

SEQ ID NO: 167051 - DNA, 25 bp, E. coli
ggttataaaaccagcacgtccttgc

SEQ ID NO: 167052 - DNA, 25 bp, E. coli
ggttataaaacctgcacgtccttgc

SEQ ID NO: 167053 - DNA, 25 bp, E. coli
ggcttaatatgaggatgacccagtg

SEQ ID NO: 167054 - DNA, 25 bp, E. coli
ggcttaatatgacgatgacccagtg

SEQ ID NO: 167055 - DNA, 25 bp, E. coli
taattcttgcaatgttagccactgg

SEQ ID NO: 167056 - DNA, 25 bp, E. coli
taattcttgcaaagttagccactgg

SEQ ID NO: 167057 - DNA, 25 bp, E. coli
gatggctatctcactccagtcagag

SEQ ID NO: 167058 - DNA, 25 bp, E. coli
gatggctatctctctccagtcagag

SEQ ID NO: 167059 - DNA, 25 bp, E. coli
agcgtcaccgcgttctgctgggcgc

SEQ ID NO: 167060 - DNA, 25 bp, E. coli
agcgtcaccgcgatctgctgggcgc

SEQ ID NO: 167061 - DNA, 25 bp, E. coli
aaaatgctgcacctgaccgttgaac

SEQ ID NO: 167062 - DNA, 25 bp, E. coli
aaaatgctgcacgtgaccgttgaac

SEQ ID NO: 167063 - DNA, 25 bp, E. coli
tatgctgaacacgatggaaaaccgt

SEQ ID NO: 167064 - DNA, 25 bp, E. coli
tatgctgaacaccatggaaaaccgt

SEQ ID NO: 167065 - DNA, 25 bp, E. coli
tatctttgcgcggtttgaagctgca

SEQ ID NO: 167066 - DNA, 25 bp, E. coli
tatctttgcgcgctttgaagctgca

SEQ ID NO: 167067 - DNA, 25 bp, E. coli
tgattacgctgagagcctgaccgaa

SEQ ID NO: 167068 - DNA, 25 bp, E. coli
tgattacgctgacagcctgaccgaa

SEQ ID NO: 167069 - DNA, 25 bp, E. coli
tgctgggcgcgaccaatccggcaaa

SEQ ID NO: 167070 - DNA, 25 bp, E. coli
tgctgggcgcgagcaatccggcaaa

SEQ ID NO: 167071 - DNA, 25 bp, E. coli
tctgccgctcgccaaatcgcttatt

SEQ ID NO: 167072 - DNA, 25 bp, E. coli
tctgccgctcgcgaaatcgcttatt

SEQ ID NO: 167073 - DNA, 25 bp, E. coli
gaaggcgaagtgtgcccgcgcaccc

SEQ ID NO: 167074 - DNA, 25 bp, E. coli
gaaggcgaagtgagcccgcgcaccc

SEQ ID NO: 167075 - DNA, 25 bp, E. coli
cgcgctttgaagctgcagggttcaa

SEQ ID NO: 167076 - DNA, 25 bp, E. coli
cgcgctttgaaggtgcagggttcaa

SEQ ID NO: 167077 - DNA, 25 bp, E. coli
ggtacccacggtactgattccgtcg

SEQ ID NO: 167078 - DNA, 25 bp, E. coli
ggtacccacggttctgattccgtcg

SEQ ID NO: 167079 - DNA, 25 bp, E. coli
ggaaaaccgttctttgatggtctgg

SEQ ID NO: 167080 - DNA, 25 bp, E. coli
ggaaaaccgttcattgatggtctgg

SEQ ID NO: 167081 - DNA, 25 bp, E. coli
agccacggagtgttatatgtcccga

SEQ ID NO: 167082 - DNA, 25 bp, E. coli
agccacggagtgatatatgtcccga

SEQ ID NO: 167083 - DNA, 25 bp, E. coli
tatcgggagtcgctactgccttcaa

SEQ ID NO: 167084 - DNA, 25 bp, E. coli
tatcgggagtcggtactgccttcaa

SEQ ID NO: 167085 - DNA, 25 bp, E. coli
ttctgcccgcgtcgcagtagaagcg

SEQ ID NO: 167086 - DNA, 25 bp, E. coli
ttcaaatgtttctgcccgcgtggca

SEQ ID NO: 167087 - DNA, 25 bp, E. coli
ttcaaatgtttcagcccgcgtggca

SEQ ID NO: 167088 - DNA, 25 bp, E. coli
ttctgcccgcgtggcagtagaagcg

SEQ ID NO: 167089 - DNA, 25 bp, E. coli
tctggcacaggttgaacgaacaccg

SEQ ID NO: 167090 - DNA, 25 bp, E. coli
tctggcacaggtagaacgaacaccg

SEQ ID NO: 167091 - DNA, 25 bp, E. coli
gccaaactataaaccagccacggag

SEQ ID NO: 167092 - DNA, 25 bp, E. coli
gccaaactataatccagccacggag

SEQ ID NO: 167093 - DNA, 25 bp, E. coli
gcagaatctggcacaggtagaacga

SEQ ID NO: 167094 - DNA, 25 bp, E. coli
gcagaatctggctcaggtagaacga

SEQ ID NO: 167095 - DNA, 25 bp, E. coli
cgctggcggcgcaatttaatcagcc

SEQ ID NO: 167096 - DNA, 25 bp, E. coli
cgctggcggcgctatttaatcagcc

SEQ ID NO: 167097 - DNA, 25 bp, E. coli
ggtagaacgaactccggatcaggtt

SEQ ID NO: 167098 - DNA, 25 bp, E. coli
ggtagaacgaacaccggatcaggtt

SEQ ID NO: 167099 - DNA, 25 bp, E. coli
ggagtgttatatctcccgaaaagac

SEQ ID NO: 167100 - DNA, 25 bp, E. coli
ggagtgttatatgtcccgaaaagac

SEQ ID NO: 167101 - DNA, 25 bp, E. coli
ggagtcggtactgccttcaaatgtt

SEQ ID NO: 167102 - DNA, 25 bp, E. coli
ggagtcggtactcccttcaaatgtt

SEQ ID NO: 167103 - DNA, 25 bp, E. coli
aatcaggatgaggtccttttgacca

SEQ ID NO: 167104 - DNA, 25 bp, E. coli
aatcaggatgagctccttttgacca

SEQ ID NO: 167105 - DNA, 25 bp, E. coli
caatggacagtttggatatgttcga

SEQ ID NO: 167106 - DNA, 25 bp, E. coli
caatggacagttaggatatgttcga

SEQ ID NO: 167107 - DNA, 25 bp, E. coli
tatgttcgaaaaaacagcaaaaagc

SEQ ID NO: 167108 - DNA, 25 bp, E. coli
tatgttcgaaaatacagcaaaaagc

SEQ ID NO: 167109 - DNA, 25 bp, E. coli
ttttaccgggtaattgcgcaatgga

SEQ ID NO: 167110 - DNA, 25 bp, E. coli
ttttaccgggtatttgcgcaatgga

SEQ ID NO: 167111 - DNA, 25 bp, E. coli
tgcacttgcactagaggtaatcggc

SEQ ID NO: 167112 - DNA, 25 bp, E. coli
tgaccaatcccaggaaaattctgcg

SEQ ID NO: 167113 - DNA, 25 bp, E. coli
tgaccaatcccacgaaaattctgcg

SEQ ID NO: 167114 - DNA, 25 bp, E. coli
tgcacttgcacttgaggtaatcggc

SEQ ID NO: 167115 - DNA, 25 bp, E. coli
tcatctatctttctgctgtgaaagt

SEQ ID NO: 167116 - DNA, 25 bp, E. coli
tcatctatctttgtgctgtgaaagt

SEQ ID NO: 167117 - DNA, 25 bp, E. coli
gcaaaaagcacgttttcatctatct

SEQ ID NO: 167118 - DNA, 25 bp, E. coli
gcaaaaagcacgatttcatctatct

SEQ ID NO: 167119 - DNA, 25 bp, E. coli
ctgtgaaagttattagtgcacttgc

SEQ ID NO: 167120 - DNA, 25 bp, E. coli
ctgtgaaagttaatagtgcacttgc

SEQ ID NO: 167121 - DNA, 25 bp, E. coli
ggtaatcggcaattactcttagtga

SEQ ID NO: 167122 - DNA, 25 bp, E. coli
ggtaatcggcaaatactcttagtga

SEQ ID NO: 167123 - DNA, 25 bp, E. coli
tgagctccttttgaccaatcccagg

SEQ ID NO: 167124 - DNA, 25 bp, E. coli
tgagctccttttcaccaatcccagg

SEQ ID NO: 167125 - DNA, 25 bp, E. coli
tattcaaccttctgcatcctcaacg

SEQ ID NO: 167126 - DNA, 25 bp, E. coli
tattcaaccttcagcatcctcaacg

SEQ ID NO: 167127 - DNA, 25 bp, E. coli
ttttactggtatcacgccagagggc

SEQ ID NO: 167128 - DNA, 25 bp, E. coli
ttttactggtatgacgccagagggc

SEQ ID NO: 167129 - DNA, 25 bp, E. coli
ttccggtgaatgttgagcaatcgct

SEQ ID NO: 167130 - DNA, 25 bp, E. coli
ttccggtgaatgatgagcaatcgct

SEQ ID NO: 167131 - DNA, 25 bp, E. coli
tgtcgttcacatgcggaaattccgg

SEQ ID NO: 167132 - DNA, 25 bp, E. coli
tgtcgttcacatccggaaattccgg

SEQ ID NO: 167133 - DNA, 25 bp, E. coli
tgcgggcatcagagcagaaaagccc

SEQ ID NO: 167134 - DNA, 25 bp, E. coli
tgcgggcatcagtgcagaaaagccc

SEQ ID NO: 167135 - DNA, 25 bp, E. coli
gcaatcgctggtgatggagtcatct

SEQ ID NO: 167136 - DNA, 25 bp, E. coli
gcaatcgctggtcatggagtcatct

SEQ ID NO: 167137 - DNA, 25 bp, E. coli
cgctgtacggcagcgccaattttct

SEQ ID NO: 167138 - DNA, 25 bp, E. coli
cgccagagggctggagatgcatcct

SEQ ID NO: 167139 - DNA, 25 bp, E. coli
cgccagagggctcgagatgcatcct

SEQ ID NO: 167140 - DNA, 25 bp, E. coli
cgctgtacggcaccgccaattttct

SEQ ID NO: 167141 - DNA, 25 bp, E. coli
tcaacgctttattacgaaaggcaag

SEQ ID NO: 167142 - DNA, 25 bp, E. coli
tcaacgctttataacgaaaggcaag

SEQ ID NO: 167143 - DNA, 25 bp, E. coli
ttaccattcccgcacattcggcggt

SEQ ID NO: 167144 - DNA, 25 bp, E. coli
gatgcatcctctcgaaaggccacgc

SEQ ID NO: 167145 - DNA, 25 bp, E. coli
gatgcatcctctggaaaggccacgc

SEQ ID NO: 167146 - DNA, 25 bp, E. coli
ttaccattcccggacattcggcggt

SEQ ID NO: 167147 - DNA, 25 bp, E. coli
aatggaaatatgttcactggcggcg

SEQ ID NO: 167148 - DNA, 25 bp, E. coli
aatggaaatatgatcactggcggcg

SEQ ID NO: 167149 - DNA, 25 bp, E. coli
cacaggaatgccacaagtttattta

SEQ ID NO: 167150 - DNA, 25 bp, E. coli
cacaggaatgcctcaagtttattta

SEQ ID NO: 167151 - DNA, 25 bp, E. coli
tacattgccatgtaagaggaaatga

SEQ ID NO: 167152 - DNA, 25 bp, E. coli
tacattgccatgaaagaggaaatga

SEQ ID NO: 167153 - DNA, 25 bp, E. coli
tagttattaaaatcacaggaatgcc

SEQ ID NO: 167154 - DNA, 25 bp, E. coli
tagttattaaaaacacaggaatgcc

SEQ ID NO: 167155 - DNA, 25 bp, E. coli
tattagcaatgaagactcctgtggg

SEQ ID NO: 167156 - DNA, 25 bp, E. coli
tattagcaatgatgactcctgtggg

SEQ ID NO: 167157 - DNA, 25 bp, E. coli
tataattacgaatttccctcggtgc

SEQ ID NO: 167158 - DNA, 25 bp, E. coli
tataattacgaaattccctcggtgc

SEQ ID NO: 167159 - DNA, 25 bp, E. coli
tagttatccctataaaagtactgag

SEQ ID NO: 167160 - DNA, 25 bp, E. coli
tagttatccctaaaaaagtactgag

SEQ ID NO: 167161 - DNA, 25 bp, E. coli
cctctctgaagaagaggacatcata

SEQ ID NO: 167162 - DNA, 25 bp, E. coli
cctctctgaagatgaggacatcata

SEQ ID NO: 167163 - DNA, 25 bp, E. coli
gaaggatggcatctatagcattata

SEQ ID NO: 167164 - DNA, 25 bp, E. coli
gaaggatggcatgtatagcattata

SEQ ID NO: 167165 - DNA, 25 bp, E. coli
ccctcggtgctaaacattgaacaag

SEQ ID NO: 167166 - DNA, 25 bp, E. coli
ccctcggtgctatacattgaacaag

SEQ ID NO: 167167 - DNA, 25 bp, E. coli
tcactggcggcgttattgcttctgt

SEQ ID NO: 167168 - DNA, 25 bp, E. coli
tcactggcggcgatattgcttctgt

SEQ ID NO: 167169 - DNA, 25 bp, E. coli
catcatggacactaatcagccgagt

SEQ ID NO: 167170 - DNA, 25 bp, E. coli
catcatggacacaaatcagccgagt

SEQ ID NO: 167171 - DNA, 25 bp, E. coli
tatcgccccggctaaagatgacgtt

SEQ ID NO: 167172 - DNA, 25 bp, E. coli
tatcgccccggcaaaagatgacgtt

SEQ ID NO: 167173 - DNA, 25 bp, E. coli
tattgataactgcatccctgtacgc

SEQ ID NO: 167174 - DNA, 25 bp, E. coli
tattgcgccgcatagtcctcttgaa

SEQ ID NO: 167175 - DNA, 25 bp, E. coli
tattgataactggatccctgtacgc

SEQ ID NO: 167176 - DNA, 25 bp, E. coli
tattgcgccgcaaagtcctcttgaa

SEQ ID NO: 167177 - DNA, 25 bp, E. coli
tttacagttaatcggctatggcccc

SEQ ID NO: 167178 - DNA, 25 bp, E. coli
tttacagttaatgggctatggcccc

SEQ ID NO: 167179 - DNA, 25 bp, E. coli
ccaggcgaatcacgcaccaggtttt

SEQ ID NO: 167180 - DNA, 25 bp, E. coli
ccaggcgaatcaggcaccaggtttt

SEQ ID NO: 167181 - DNA, 25 bp, E. coli
gaactggccgctttagcactgctgg

SEQ ID NO: 167182 - DNA, 25 bp, E. coli
gaactggccgctatagcactgctgg

SEQ ID NO: 167183 - DNA, 25 bp, E. coli
gtttcaacaactcatcgcgccgtgg

SEQ ID NO: 167184 - DNA, 25 bp, E. coli
gtttcaacaactgatcgcgccgtgg

SEQ ID NO: 167185 - DNA, 25 bp, E. coli
gttaaaaccgcatggagggccatca

SEQ ID NO: 167186 - DNA, 25 bp, E. coli
gttaaaaccgcaaggagggccatca

SEQ ID NO: 167187 - DNA, 25 bp, E. coli
taagcggcgcgaggaattgtgcatt

SEQ ID NO: 167188 - DNA, 25 bp, E. coli
taataagcacataagcgcttgcccg

SEQ ID NO: 167189 - DNA, 25 bp, E. coli
taataagcacattagcgcttgcccg

SEQ ID NO: 167190 - DNA, 25 bp, E. coli
taagcggcgcgacgaattgtgcatt

SEQ ID NO: 167191 - DNA, 25 bp, E. coli
cagtattgcgcgtattacccgtggc

SEQ ID NO: 167192 - DNA, 25 bp, E. coli
cagtattgcgcgaattacccgtggc

SEQ ID NO: 167193 - DNA, 25 bp, E. coli
taaaacctgctcagttacccgtgct

SEQ ID NO: 167194 - DNA, 25 bp, E. coli
taaaacctgctctgttacccgtgct

SEQ ID NO: 167195 - DNA, 25 bp, E. coli
aaagggttacctttgcggcggatca

SEQ ID NO: 167196 - DNA, 25 bp, E. coli
aaagggttacctatgcggcggatca

SEQ ID NO: 167197 - DNA, 25 bp, E. coli
tttattcgtactccccgggcgaaag

SEQ ID NO: 167198 - DNA, 25 bp, E. coli
tattctacgtcggtgtctggaagcg

SEQ ID NO: 167199 - DNA, 25 bp, E. coli
tttattcgtactgcccgggcgaaag

SEQ ID NO: 167200 - DNA, 25 bp, E. coli
tattctacgtcgctgtctggaagcg

SEQ ID NO: 167201 - DNA, 25 bp, E. coli
tgctatatgcggatatcgacccgaa

SEQ ID NO: 167202 - DNA, 25 bp, E. coli
tgctatatgcggttatcgacccgaa

SEQ ID NO: 167203 - DNA, 25 bp, E. coli
ccaaatgggactttaccgtgatggg

SEQ ID NO: 167204 - DNA, 25 bp, E. coli
ccaaatgggactataccgtgatggg

SEQ ID NO: 167205 - DNA, 25 bp, E. coli
cgtttctgccaaactgggagccgca

SEQ ID NO: 167206 - DNA, 25 bp, E. coli
cgtttctgccaatctgggagccgca

SEQ ID NO: 167207 - DNA, 25 bp, E. coli
gttctttatgatgcgcctcgcgccg

SEQ ID NO: 167208 - DNA, 25 bp, E. coli
gatcattttgcaatggctgccgggc

SEQ ID NO: 167209 - DNA, 25 bp, E. coli
gttctttatgatccgcctcgcgccg

SEQ ID NO: 167210 - DNA, 25 bp, E. coli
gatcattttgcattggctgccgggc

SEQ ID NO: 167211 - DNA, 25 bp, E. coli
taatggcgcattgaaccgtgactat

SEQ ID NO: 167212 - DNA, 25 bp, E. coli
taatggcgcattcaaccgtgactat

SEQ ID NO: 167213 - DNA, 25 bp, E. coli
cagattgacttaacctcactaaagg

SEQ ID NO: 167214 - DNA, 25 bp, E. coli
cagattgacttatcctcactaaagg

SEQ ID NO: 167215 - DNA, 25 bp, E. coli
tatcgcagcgttaatcccgtagagc

SEQ ID NO: 167216 - DNA, 25 bp, E. coli
tatcgcagcgtttatcccgtagagc

SEQ ID NO: 167217 - DNA, 25 bp, E. coli
tgtcgagatggcttgcggcttaata

SEQ ID NO: 167218 - DNA, 25 bp, E. coli
tgtcgagatggcatgcggcttaata

SEQ ID NO: 167219 - DNA, 25 bp, E. coli
tcctcctttttaaccgcgatcgcgg

SEQ ID NO: 167220 - DNA, 25 bp, E. coli
tccccttaagcggataaacttgctg

SEQ ID NO: 167221 - DNA, 25 bp, E. coli
tcctcctttttatccgcgatcgcgg

SEQ ID NO: 167222 - DNA, 25 bp, E. coli
tccccttaagcgcataaacttgctg

SEQ ID NO: 167223 - DNA, 25 bp, E. coli
ccgtataagccggatgtcgagatgg

SEQ ID NO: 167224 - DNA, 25 bp, E. coli
ccgtataagccgcatgtcgagatgg

SEQ ID NO: 167225 - DNA, 25 bp, E. coli
gcgatcgcggatttcgcagcgttta

SEQ ID NO: 167226 - DNA, 25 bp, E. coli
gcgcatcaacgccttatttaaatcc

SEQ ID NO: 167227 - DNA, 25 bp, E. coli
gcgcatcaacgcgttatttaaatcc

SEQ ID NO: 167228 - DNA, 25 bp, E. coli
gcggataaacttgctgtggacgtat

SEQ ID NO: 167229 - DNA, 25 bp, E. coli
gcggataaacttcctgtggacgtat

SEQ ID NO: 167230 - DNA, 25 bp, E. coli
gcgatcgcggatatcgcagcgttta

SEQ ID NO: 167231 - DNA, 25 bp, E. coli
cccgtagagcggataagatgtgttt

SEQ ID NO: 167232 - DNA, 25 bp, E. coli
cccgtagagcggttaagatgtgttt

SEQ ID NO: 167233 - DNA, 25 bp, E. coli
taatattgccgagttcaaacggcgc

SEQ ID NO: 167234 - DNA, 25 bp, E. coli
taatattgccgacttcaaacggcgc

SEQ ID NO: 167235 - DNA, 25 bp, E. coli
caattacgtaaacctgccacagcaa

SEQ ID NO: 167236 - DNA, 25 bp, E. coli
caattacgtaaagctgccacagcaa

SEQ ID NO: 167237 - DNA, 25 bp, E. coli
aacgccattgttcaagcagtgaaaa

SEQ ID NO: 167238 - DNA, 25 bp, E. coli
aacgccattgttgaagcagtgaaaa

SEQ ID NO: 167239 - DNA, 25 bp, E. coli
aaacaggcggctatctctgacacta

SEQ ID NO: 167240 - DNA, 25 bp, E. coli
aaacaggcggctttctctgacacta

SEQ ID NO: 167241 - DNA, 25 bp, E. coli
tattttcgtggtgggtacgcgcctg

SEQ ID NO: 167242 - DNA, 25 bp, E. coli
tattttcgtggtcggtacgcgcctg

SEQ ID NO: 167243 - DNA, 25 bp, E. coli
tgcagacctccggtgaagcggaaaa

SEQ ID NO: 167244 - DNA, 25 bp, E. coli
tgcagacctccgctgaagcggaaaa

SEQ ID NO: 167245 - DNA, 25 bp, E. coli
tccgccgaaaaagctgaacatgaat

SEQ ID NO: 167246 - DNA, 25 bp, E. coli
tccgccgaaaaacctgaacatgaat

SEQ ID NO: 167247 - DNA, 25 bp, E. coli
tcgcaggattactccaacgccattg

SEQ ID NO: 167248 - DNA, 25 bp, E. coli
tcgcaggattacaccaacgccattg

SEQ ID NO: 167249 - DNA, 25 bp, E. coli
gaaagcggtcgtcccgttgccttta

SEQ ID NO: 167250 - DNA, 25 bp, E. coli
gaaagcggtcgtgccgttgccttta

SEQ ID NO: 167251 - DNA, 25 bp, E. coli
gaacgtgcgaaaccgaagaaaccag

SEQ ID NO: 167252 - DNA, 25 bp, E. coli
gaacgtgcgaaagcgaagaaaccag

SEQ ID NO: 167253 - DNA, 25 bp, E. coli
gatccgcagttctaaaagctgatgg

SEQ ID NO: 167254 - DNA, 25 bp, E. coli
tcagcgccaaagttcacggtgactc

SEQ ID NO: 167255 - DNA, 25 bp, E. coli
tcagcgccaaagatcacggtgactc

SEQ ID NO: 167256 - DNA, 25 bp, E. coli
gatccgcagttcaaaaagctgatgg

SEQ ID NO: 167257 - DNA, 25 bp, E. coli
taaagagtcattgggtggattattg

SEQ ID NO: 167258 - DNA, 25 bp, E. coli
taaagagtcattcggtggattattg

SEQ ID NO: 167259 - DNA, 25 bp, E. coli
gtgcttaacacatttccccctttgt

SEQ ID NO: 167260 - DNA, 25 bp, E. coli
cctttgttgtttgttaaagagtcat

SEQ ID NO: 167261 - DNA, 25 bp, E. coli
gtgcttaacacaattccccctttgt

SEQ ID NO: 167262 - DNA, 25 bp, E. coli
cctttgttgtttcttaaagagtcat

SEQ ID NO: 167263 - DNA, 25 bp, E. coli
ttgtgtcggattgtgtcagggtgtt

SEQ ID NO: 167264 - DNA, 25 bp, E. coli
ttgtgtcggattctgtcagggtgtt

SEQ ID NO: 167265 - DNA, 25 bp, E. coli
tcttaaagagtctttgggtggatta

SEQ ID NO: 167266 - DNA, 25 bp, E. coli
tcttaaagagtcattgggtggatta

SEQ ID NO: 167267 - DNA, 25 bp, E. coli
tcagggtgtttgaggaatggcaaac

SEQ ID NO: 167268 - DNA, 25 bp, E. coli
tcagggtgtttgtggaatggcaaac

SEQ ID NO: 167269 - DNA, 25 bp, E. coli
cgttttacagaaccaggggaaatga

SEQ ID NO: 167270 - DNA, 25 bp, E. coli
cgttttacagaagcaggggaaatga

SEQ ID NO: 167271 - DNA, 25 bp, E. coli
tgtttcttaaagtgtcattgggtgg

SEQ ID NO: 167272 - DNA, 25 bp, E. coli
gattattgggttgggttgtgtcgga

SEQ ID NO: 167273 - DNA, 25 bp, E. coli
tgtttcttaaagagtcattgggtgg

SEQ ID NO: 167274 - DNA, 25 bp, E. coli
gattattgggttcggttgtgtcgga

SEQ ID NO: 167275 - DNA, 25 bp, E. coli
gtgtttgtggaatggcaaacactgg

SEQ ID NO: 167276 - DNA, 25 bp, E. coli
gtgtttgtggaaaggcaaacactgg

SEQ ID NO: 167277 - DNA, 25 bp, E. coli
ggcggcggtcgtattacagaagcag

SEQ ID NO: 167278 - DNA, 25 bp, E. coli
ggcggcggtcgttttacagaagcag

SEQ ID NO: 167279 - DNA, 25 bp, E. coli
taacatggcccgctttatcagaagc

SEQ ID NO: 167280 - DNA, 25 bp, E. coli
taacatggcccggtttatcagaagc

SEQ ID NO: 167281 - DNA, 25 bp, E. coli
aggcagacatctctgaatcgcttca

SEQ ID NO: 167282 - DNA, 25 bp, E. coli
aggcagacatctgtgaatcgcttca

SEQ ID NO: 167283 - DNA, 25 bp, E. coli
tttatcagaagccagacattaacgc

SEQ ID NO: 167284 - DNA, 25 bp, E. coli
tttatcagaagcgagacattaacgc

SEQ ID NO: 167285 - DNA, 25 bp, E. coli
tgagctttaccggagctgcctcgcg

SEQ ID NO: 167286 - DNA, 25 bp, E. coli
tgagctttaccgcagctgcctcgcg

SEQ ID NO: 167287 - DNA, 25 bp, E. coli
gaatcgcttcaccaccacgctgatg

SEQ ID NO: 167288 - DNA, 25 bp, E. coli
gaatcgcttcacgaccacgctgatg

SEQ ID NO: 167289 - DNA, 25 bp, E. coli
gacattaacgcttctggagaaactc

SEQ ID NO: 167290 - DNA, 25 bp, E. coli
gacattaacgctactggagaaactc

SEQ ID NO: 167291 - DNA, 25 bp, E. coli
cggtgatgacggagaaaacctctga

SEQ ID NO: 167292 - DNA, 25 bp, E. coli
ctgcctcgcgcgtttcggtgatgac

SEQ ID NO: 167293 - DNA, 25 bp, E. coli
cggtgatgacggtgaaaacctctga

SEQ ID NO: 167294 - DNA, 25 bp, E. coli
ctgcctcgcgcgattcggtgatgac

SEQ ID NO: 167295 - DNA, 25 bp, E. coli
tggacgcggatgaacaggcagacat

SEQ ID NO: 167296 - DNA, 25 bp, E. coli
tggacgcggatgtacaggcagacat

SEQ ID NO: 167297 - DNA, 25 bp, E. coli
gagaaactcaacgagctggacgcgg

SEQ ID NO: 167298 - DNA, 25 bp, E. coli
gaccacgctgatcagctttaccgca

SEQ ID NO: 167299 - DNA, 25 bp, E. coli
gaccacgctgatgagctttaccgca

SEQ ID NO: 167300 - DNA, 25 bp, E. coli
gagaaactcaaccagctggacgcgg

SEQ ID NO: 167301 - DNA, 25 bp, E. coli
cactgaaagaatctaagcgtttacc

SEQ ID NO: 167302 - DNA, 25 bp, E. coli
cactgaaagaatgtaagcgtttacc

SEQ ID NO: 167303 - DNA, 25 bp, E. coli
acgatgaaaacaggccaccccttga

SEQ ID NO: 167304 - DNA, 25 bp, E. coli
gttttccgtaactctgaaagaatgt

SEQ ID NO: 167305 - DNA, 25 bp, E. coli
acgatgaaaacacgccaccccttga

SEQ ID NO: 167306 - DNA, 25 bp, E. coli
gttttccgtaacactgaaagaatgt

SEQ ID NO: 167307 - DNA, 25 bp, E. coli
acattcccacgatgaaaacacgcca

SEQ ID NO: 167308 - DNA, 25 bp, E. coli
acattcccacgaagaaaacacgcca

SEQ ID NO: 167309 - DNA, 25 bp, E. coli
tgaaaacacgccaccccttgaacca

SEQ ID NO: 167310 - DNA, 25 bp, E. coli
tgaaaacacgcctccccttgaacca

SEQ ID NO: 167311 - DNA, 25 bp, E. coli
tccgtaacactgaaagaatgtaagc

SEQ ID NO: 167312 - DNA, 25 bp, E. coli
tccgtaacactgtaagaatgtaagc

SEQ ID NO: 167313 - DNA, 25 bp, E. coli
gaaagaatgtaagcgtttacccact

SEQ ID NO: 167314 - DNA, 25 bp, E. coli
gaaagaatgtaaccgtttacccact

SEQ ID NO: 167315 - DNA, 25 bp, E. coli
gaatgtaagcgtttacccactaagg

SEQ ID NO: 167316 - DNA, 25 bp, E. coli
gaatgtaagcgtatacccactaagg

SEQ ID NO: 167317 - DNA, 25 bp, E. coli
cgtaacactgaaagaatgtaagcgt

SEQ ID NO: 167318 - DNA, 25 bp, E. coli
gcgttttccgtatcactgaaagaat

SEQ ID NO: 167319 - DNA, 25 bp, E. coli
gcgttttccgtaacactgaaagaat

SEQ ID NO: 167320 - DNA, 25 bp, E. coli
cgtaacactgaatgaatgtaagcgt

SEQ ID NO: 167321 - DNA, 25 bp, E. coli
tgtaagcgtttacccactaaggtat

SEQ ID NO: 167322 - DNA, 25 bp, E. coli
tgtaagcgtttagccactaaggtat

SEQ ID NO: 167323 - DNA, 25 bp, E. coli
caaaggacagacgagattgaagtgg

SEQ ID NO: 167324 - DNA, 25 bp, E. coli
caaaggacagaccagattgaagtgg

SEQ ID NO: 167325 - DNA, 25 bp, E. coli
acagcgtttgtagcggagctggtcc

SEQ ID NO: 167326 - DNA, 25 bp, E. coli
acagcgtttgtaccggagctggtcc

SEQ ID NO: 167327 - DNA, 25 bp, E. coli
tatcccgcccctaagacagaatgtt

SEQ ID NO: 167328 - DNA, 25 bp, E. coli
tatcccgccccttagacagaatgtt

SEQ ID NO: 167329 - DNA, 25 bp, E. coli
tggtccgttgcaaaatgctcaccgg

SEQ ID NO: 167330 - DNA, 25 bp, E. coli
tgctcaccgggagaattcagatatt

SEQ ID NO: 167331 - DNA, 25 bp, E. coli
tgtacatatcacagccaaaggacag

SEQ ID NO: 167332 - DNA, 25 bp, E. coli
tgctcaccgggacaattcagatatt

SEQ ID NO: 167333 - DNA, 25 bp, E. coli
tggtccgttgcataatgctcaccgg

SEQ ID NO: 167334 - DNA, 25 bp, E. coli
tgtacatatcactgccaaaggacag

SEQ ID NO: 167335 - DNA, 25 bp, E. coli
gaagtggtaaaaccgatcgtgcaca

SEQ ID NO: 167336 - DNA, 25 bp, E. coli
gcagtctcacaactaacaagaggtt

SEQ ID NO: 167337 - DNA, 25 bp, E. coli
gaagtggtaaaagcgatcgtgcaca

SEQ ID NO: 167338 - DNA, 25 bp, E. coli
gcagtctcacaagtaacaagaggtt

SEQ ID NO: 167339 - DNA, 25 bp, E. coli
gatattccctctttcacactctgta

SEQ ID NO: 167340 - DNA, 25 bp, E. coli
gatcgtgcacacaacgcagtctcac

SEQ ID NO: 167341 - DNA, 25 bp, E. coli
gatattccctctatcacactctgta

SEQ ID NO: 167342 - DNA, 25 bp, E. coli
gatcgtgcacactacgcagtctcac

SEQ ID NO: 167343 - DNA, 25 bp, E. coli
taatctgaacccacaacagcgtttg

SEQ ID NO: 167344 - DNA, 25 bp, E. coli
taatctgaaccctcaacagcgtttg

SEQ ID NO: 167345 - DNA, 25 bp, E. coli
cacttttgcgccaattatggagaaa

SEQ ID NO: 167346 - DNA, 25 bp, E. coli
cacttttgcgcctattatggagaaa

SEQ ID NO: 167347 - DNA, 25 bp, E. coli
cacgatgattttgcagagattatga

SEQ ID NO: 167348 - DNA, 25 bp, E. coli
cacgatgattttccagagattatga

SEQ ID NO: 167349 - DNA, 25 bp, E. coli
tacggctttctttagtagcgtgccg

SEQ ID NO: 167350 - DNA, 25 bp, E. coli
tacggctttcttaagtagcgtgccg

SEQ ID NO: 167351 - DNA, 25 bp, E. coli
agcgtgccgtgttgacgagattaac

SEQ ID NO: 167352 - DNA, 25 bp, E. coli
agcgtgccgtgtagacgagattaac

SEQ ID NO: 167353 - DNA, 25 bp, E. coli
tatgaagaactataccggatgactg

SEQ ID NO: 167354 - DNA, 25 bp, E. coli
tatgaagaactaaaccggatgactg

SEQ ID NO: 167355 - DNA, 25 bp, E. coli
tagcgtcaattattcagagcaacgg

SEQ ID NO: 167356 - DNA, 25 bp, E. coli
tagcgtcaattaatcagagcaacgg

SEQ ID NO: 167357 - DNA, 25 bp, E. coli
gaaagcaacttattacccgcagaat

SEQ ID NO: 167358 - DNA, 25 bp, E. coli
gaaagcaacttaatacccgcagaat

SEQ ID NO: 167359 - DNA, 25 bp, E. coli
gtgataaataaagcaaataaccagg

SEQ ID NO: 167360 - DNA, 25 bp, E. coli
gtgataaataaaccaaataaccagg

SEQ ID NO: 167361 - DNA, 25 bp, E. coli
gagattaacttttctgactttagcg

SEQ ID NO: 167362 - DNA, 25 bp, E. coli
gatgagagaatattacaacacgatg

SEQ ID NO: 167363 - DNA, 25 bp, E. coli
gagcaacggtaaaacaatgaaagtg

SEQ ID NO: 167364 - DNA, 25 bp, E. coli
gagcaacggtaatacaatgaaagtg

SEQ ID NO: 167365 - DNA, 25 bp, E. coli
gagattaactttactgactttagcg

SEQ ID NO: 167366 - DNA, 25 bp, E. coli
gatgagagaataatacaacacgatg

SEQ ID NO: 167367 - DNA, 25 bp, E. coli
caattgcagaaccagggagcgtaga

SEQ ID NO: 167368 - DNA, 25 bp, E. coli
caattgcagaacgagggagcgtaga

SEQ ID NO: 167369 - DNA, 25 bp, E. coli
caaaggatggcaaacaggcacagac

SEQ ID NO: 167370 - DNA, 25 bp, E. coli
caaaggatggcatacaggcacagac

SEQ ID NO: 167371 - DNA, 25 bp, E. coli
tacagaaatttctgatggcgaccct

SEQ ID NO: 167372 - DNA, 25 bp, E. coli
tacagaaatttcagatggcgaccct

SEQ ID NO: 167373 - DNA, 25 bp, E. coli
taggcattctggctcacgttgacgc

SEQ ID NO: 167374 - DNA, 25 bp, E. coli
taggcattctgggtcacgttgacgc

SEQ ID NO: 167375 - DNA, 25 bp, E. coli
tattcatccgatacagcctgctctg

SEQ ID NO: 167376 - DNA, 25 bp, E. coli
tatttcacaaatgggcagggagtct

SEQ ID NO: 167377 - DNA, 25 bp, E. coli
tatttcacaaatcggcagggagtct

SEQ ID NO: 167378 - DNA, 25 bp, E. coli
tattcatccgattcagcctgctctg

SEQ ID NO: 167379 - DNA, 25 bp, E. coli
gccgcccgaatacccgtatagataa

SEQ ID NO: 167380 - DNA, 25 bp, E. coli
gccgcccgaatagccgtatagataa

SEQ ID NO: 167381 - DNA, 25 bp, E. coli
gaagcaaaaggttgggcagcatccc

SEQ ID NO: 167382 - DNA, 25 bp, E. coli
gcaggaatatctctcacgggcgtat

SEQ ID NO: 167383 - DNA, 25 bp, E. coli
gaagcaaaaggtagggcagcatccc

SEQ ID NO: 167384 - DNA, 25 bp, E. coli
gaaggtcaatctgaactatgcgggc

SEQ ID NO: 167385 - DNA, 25 bp, E. coli
gcaggaatatctgtcacgggcgtat

SEQ ID NO: 167386 - DNA, 25 bp, E. coli
gaaggtcaatctcaactatgcgggc

SEQ ID NO: 167387 - DNA, 25 bp, E. coli
gaacgaaatgctgttgccgcagaga

SEQ ID NO: 167388 - DNA, 25 bp, E. coli
gaacgaaatgctcttgccgcagaga

SEQ ID NO: 167389 - DNA, 25 bp, E. coli
taggctccggtgacatcatcaacgc

SEQ ID NO: 167390 - DNA, 25 bp, E. coli
taggctccggtgtcatcatcaacgc

SEQ ID NO: 167391 - DNA, 25 bp, E. coli
tattcagctcaatgatgggcgcgag

SEQ ID NO: 167392 - DNA, 25 bp, E. coli
tattcagctcaaagatgggcgcgag

SEQ ID NO: 167393 - DNA, 25 bp, E. coli
tgttaggcatcaaaggcaccgagat

SEQ ID NO: 167394 - DNA, 25 bp, E. coli
tgttaggcatcataggcaccgagat

SEQ ID NO: 167395 - DNA, 25 bp, E. coli
tgaagcttggcctgctgcgtaacgg

SEQ ID NO: 167396 - DNA, 25 bp, E. coli
tgaagcttggccagctgcgtaacgg

SEQ ID NO: 167397 - DNA, 25 bp, E. coli
tgcgtaacggcataccactggaagt

SEQ ID NO: 167398 - DNA, 25 bp, E. coli
tgcgtaacggcaaaccactggaagt

SEQ ID NO: 167399 - DNA, 25 bp, E. coli
ccagcgctggaaggtgcaacgttga

SEQ ID NO: 167400 - DNA, 25 bp, E. coli
ccagcgctggaacgtgcaacgttga

SEQ ID NO: 167401 - DNA, 25 bp, E. coli
gatattattacctgcctcaacggca

SEQ ID NO: 167402 - DNA, 25 bp, E. coli
gatattattaccagcctcaacggca

SEQ ID NO: 167403 - DNA, 25 bp, E. coli
taatatggcgcgtacactggcgcag

SEQ ID NO: 167404 - DNA, 25 bp, E. coli
taagtgtcgggttaactctctcggc

SEQ ID NO: 167405 - DNA, 25 bp, E. coli
taatatggcgcgaacactggcgcag

SEQ ID NO: 167406 - DNA, 25 bp, E. coli
taagtgtcgggtaaactctctcggc

SEQ ID NO: 167407 - DNA, 25 bp, E. coli
gatgtgatcattggcgtcaaccgcg

SEQ ID NO: 167408 - DNA, 25 bp, E. coli
gatgtgatcattcgcgtcaaccgcg

SEQ ID NO: 167409 - DNA, 25 bp, E. coli
gatgagtgccgaaatcgccaaagcc

SEQ ID NO: 167410 - DNA, 25 bp, E. coli
gatgagtgccgatatcgccaaagcc

SEQ ID NO: 167411 - DNA, 25 bp, E. coli
aattgtagagcttatcgactacgcc

SEQ ID NO: 167412 - DNA, 25 bp, E. coli
caacgtcggtgaacattatggatac

SEQ ID NO: 167413 - DNA, 25 bp, E. coli
caacgtcggtgatcattatggatac

SEQ ID NO: 167414 - DNA, 25 bp, E. coli
gaattgcagattgtcctgaaaacgg

SEQ ID NO: 167415 - DNA, 25 bp, E. coli
aattgtagagctaatcgactacgcc

SEQ ID NO: 167416 - DNA, 25 bp, E. coli
caagctggtgctaacggttttgtca

SEQ ID NO: 167417 - DNA, 25 bp, E. coli
gaattgcagattctcctgaaaacgg

SEQ ID NO: 167418 - DNA, 25 bp, E. coli
caaatccagagcacagtgaaagtgt

SEQ ID NO: 167419 - DNA, 25 bp, E. coli
caagctggtgcttacggttttgtca

SEQ ID NO: 167420 - DNA, 25 bp, E. coli
caaatccagagctcagtgaaagtgt

SEQ ID NO: 167421 - DNA, 25 bp, E. coli
tacgaatagttcaacggtcactgtg

SEQ ID NO: 167422 - DNA, 25 bp, E. coli
tacgaatagttctacggtcactgtg

SEQ ID NO: 167423 - DNA, 25 bp, E. coli
tatgctggcagagcgatacaagctg

SEQ ID NO: 167424 - DNA, 25 bp, E. coli
tatgctggcagaccgatacaagctg

SEQ ID NO: 167425 - DNA, 25 bp, E. coli
gccgttcagatgttcctctccggat

SEQ ID NO: 167426 - DNA, 25 bp, E. coli
gccgttcagatgatcctctccggat

SEQ ID NO: 167427 - DNA, 25 bp, E. coli
cattatggatatagacttgcccgga

SEQ ID NO: 167428 - DNA, 25 bp, E. coli
cattatggatattgacttgcccgga

SEQ ID NO: 167429 - DNA, 25 bp, E. coli
gattatctccgatcccgtcctgttg

SEQ ID NO: 167430 - DNA, 25 bp, E. coli
gattatctccgaacccgtcctgttg

SEQ ID NO: 167431 - DNA, 25 bp, E. coli
tgtgctatctaatcgtgaagtgacc

SEQ ID NO: 167432 - DNA, 25 bp, E. coli
tgtgctatctaaacgtgaagtgacc

SEQ ID NO: 167433 - DNA, 25 bp, E. coli
cactaaagcctattttttgtgcaaa

SEQ ID NO: 167434 - DNA, 25 bp, E. coli
cactaaagcctaatttttgtgcaaa

SEQ ID NO: 167435 - DNA, 25 bp, E. coli
aggctgctcatttcattaaacgcgg

SEQ ID NO: 167436 - DNA, 25 bp, E. coli
aggctgctcattacattaaacgcgg

SEQ ID NO: 167437 - DNA, 25 bp, E. coli
aaaatttgcgtcagggagaggctgc

SEQ ID NO: 167438 - DNA, 25 bp, E. coli
aaaatttgcgtctgggagaggctgc

SEQ ID NO: 167439 - DNA, 25 bp, E. coli
tttgcgtcagggagaggctgctcat

SEQ ID NO: 167440 - DNA, 25 bp, E. coli
tttgcgtcagggtgaggctgctcat

SEQ ID NO: 167441 - DNA, 25 bp, E. coli
tgcaaaatttgcctcagggagaggc

SEQ ID NO: 167442 - DNA, 25 bp, E. coli
tgcaaaatttgcgtcagggagaggc

SEQ ID NO: 167443 - DNA, 25 bp, E. coli
tgcgccttattttttaacctgaaga

SEQ ID NO: 167444 - DNA, 25 bp, E. coli
tgcgccttatttattaacctgaaga

SEQ ID NO: 167445 - DNA, 25 bp, E. coli
gctcgcgttttcatgcaaccttttt

SEQ ID NO: 167446 - DNA, 25 bp, E. coli
gctcgcgttttcttgcaaccttttt

SEQ ID NO: 167447 - DNA, 25 bp, E. coli
gaacaaaaacaaatcactaaagcct

SEQ ID NO: 167448 - DNA, 25 bp, E. coli
gaacaaaaacaattcactaaagcct

SEQ ID NO: 167449 - DNA, 25 bp, E. coli
ggtttgttatcttcgttgcgcctta

SEQ ID NO: 167450 - DNA, 25 bp, E. coli
ggtttgttatctacgttgcgcctta

SEQ ID NO: 167451 - DNA, 25 bp, E. coli
ggcatgattttgaacaaaaacaaat

SEQ ID NO: 167452 - DNA, 25 bp, E. coli
ggcatgattttgtacaaaaacaaat

SEQ ID NO: 167453 - DNA, 25 bp, E. coli
gagaggctgctcatttcattaaacg

SEQ ID NO: 167454 - DNA, 25 bp, E. coli
gagaggctgctcttttcattaaacg

SEQ ID NO: 167455 - DNA, 25 bp, E. coli
caatgctggctcgtctggacctgct

SEQ ID NO: 167456 - DNA, 25 bp, E. coli
caatgctggctcctctggacctgct

SEQ ID NO: 167457 - DNA, 25 bp, E. coli
cagcacgtctgaacttcgtttcgaa

SEQ ID NO: 167458 - DNA, 25 bp, E. coli
cagcacgtctgatcttcgtttcgaa

SEQ ID NO: 167459 - DNA, 25 bp, E. coli
caggacctgttatatgaagtatgca

SEQ ID NO: 167460 - DNA, 25 bp, E. coli
caggacctgttaaatgaagtatgca

SEQ ID NO: 167461 - DNA, 25 bp, E. coli
aaagttatcatgaaatgccagcacg

SEQ ID NO: 167462 - DNA, 25 bp, E. coli
aaagttatcatgtaatgccagcacg

SEQ ID NO: 167463 - DNA, 25 bp, E. coli
gaagtatgcattccttcaatgctgg

SEQ ID NO: 167464 - DNA, 25 bp, E. coli
gaagtatgcattgcttcaatgctgg

SEQ ID NO: 167465 - DNA, 25 bp, E. coli
gacaaaacattttttgaagacgcca

SEQ ID NO: 167466 - DNA, 25 bp, E. coli
gacaaaacatttattgaagacgcca

SEQ ID NO: 167467 - DNA, 25 bp, E. coli
cgaaattggcgtaatcactggagac

SEQ ID NO: 167468 - DNA, 25 bp, E. coli
cgaaattggcgttatcactggagac

SEQ ID NO: 167469 - DNA, 25 bp, E. coli
ggacctgctgcaaaaaggatataaa

SEQ ID NO: 167470 - DNA, 25 bp, E. coli
ggcgttatcactggagacaaaacat

SEQ ID NO: 167471 - DNA, 25 bp, E. coli
ggcgttatcactcgagacaaaacat

SEQ ID NO: 167472 - DNA, 25 bp, E. coli
ggacctgctgcataaaggatataaa

SEQ ID NO: 167473 - DNA, 25 bp, E. coli
gacgccattaaggagagaaaactcg

SEQ ID NO: 167474 - DNA, 25 bp, E. coli
gagaaaactcgaccaggacctgtta

SEQ ID NO: 167475 - DNA, 25 bp, E. coli
gacgccattaagcagagaaaactcg

SEQ ID NO: 167476 - DNA, 25 bp, E. coli
gagaaaactcgagcaggacctgtta

SEQ ID NO: 167477 - DNA, 25 bp, E. coli
tcgtcattcaacaccgagcgcgtgg

SEQ ID NO: 167478 - DNA, 25 bp, E. coli
tcgtcattcaactccgagcgcgtgg

SEQ ID NO: 167479 - DNA, 25 bp, E. coli
gctaatgacctcgaagcggcgaaaa

SEQ ID NO: 167480 - DNA, 25 bp, E. coli
gcattgtggtttccgtcaccgggca

SEQ ID NO: 167481 - DNA, 25 bp, E. coli
gcattgtggtttgcgtcaccgggca

SEQ ID NO: 167482 - DNA, 25 bp, E. coli
gctaatgacctccaagcggcgaaaa

SEQ ID NO: 167483 - DNA, 25 bp, E. coli
gaagatttcgttatcgcgaccggcg

SEQ ID NO: 167484 - DNA, 25 bp, E. coli
gcacgaaaaactcggctggaaaccg

SEQ ID NO: 167485 - DNA, 25 bp, E. coli
gcacgaaaaactgggctggaaaccg

SEQ ID NO: 167486 - DNA, 25 bp, E. coli
gaagatttcgttttcgcgaccggcg

SEQ ID NO: 167487 - DNA, 25 bp, E. coli
gaagttgaaacgctgctcggcgacc

SEQ ID NO: 167488 - DNA, 25 bp, E. coli
gaagttgaaacggtgctcggcgacc

SEQ ID NO: 167489 - DNA, 25 bp, E. coli
gaaattccgcagaaagagaccacgc

SEQ ID NO: 167490 - DNA, 25 bp, E. coli
gacaagacggttcttacctggcaga

SEQ ID NO: 167491 - DNA, 25 bp, E. coli
gaaattccgcagtaagagaccacgc

SEQ ID NO: 167492 - DNA, 25 bp, E. coli
gacaagacggttgttacctggcaga

SEQ ID NO: 167493 - DNA, 25 bp, E. coli
tggaaaccggaaatcaccctcagag

SEQ ID NO: 167494 - DNA, 25 bp, E. coli
tggaaaccggaattcaccctcagag

SEQ ID NO: 167495 - DNA, 25 bp, E. coli
tcaaaagtcgctctcatcaccggtg

SEQ ID NO: 167496 - DNA, 25 bp, E. coli
tcaaaagtcgctgtcatcaccggtg

SEQ ID NO: 167497 - DNA, 25 bp, E. coli
gatgaagtgtacaacctgggcgcaa

SEQ ID NO: 167498 - DNA, 25 bp, E. coli
gatgaagtgtactacctgggcgcaa

SEQ ID NO: 167499 - DNA, 25 bp, E. coli
tactatttccataatctgacgcccg

SEQ ID NO: 167500 - DNA, 25 bp, E. coli
tactatttccattatctgacgcccg

SEQ ID NO: 167501 - DNA, 25 bp, E. coli
accggagattgcgatcgttccccag

SEQ ID NO: 167502 - DNA, 25 bp, E. coli
accggagattgccatcgttccccag

SEQ ID NO: 167503 - DNA, 25 bp, E. coli
tcatccgaatatgtactatttccat

SEQ ID NO: 167504 - DNA, 25 bp, E. coli
tcatccgaatatctactatttccat

SEQ ID NO: 167505 - DNA, 25 bp, E. coli
ccggctgatttatggtccggacaaa

SEQ ID NO: 167506 - DNA, 25 bp, E. coli
ccggctgatttaaggtccggacaaa

SEQ ID NO: 167507 - DNA, 25 bp, E. coli
ctgatttatggtccggacaaactat

SEQ ID NO: 167508 - DNA, 25 bp, E. coli
ctgatttatggtgcggacaaactat

SEQ ID NO: 167509 - DNA, 25 bp, E. coli
gatttatggtcccgacaaactatga

SEQ ID NO: 167510 - DNA, 25 bp, E. coli
gatttatggtccggacaaactatga

SEQ ID NO: 167511 - DNA, 25 bp, E. coli
gtgaggaatatgtaaatgaaacaac

SEQ ID NO: 167512 - DNA, 25 bp, E. coli
gtgaggaatatgaaaatgaaacaac

SEQ ID NO: 167513 - DNA, 25 bp, E. coli
ggagattgccatggttccccagagt

SEQ ID NO: 167514 - DNA, 25 bp, E. coli
ggagattgccatcgttccccagagt

SEQ ID NO: 167515 - DNA, 25 bp, E. coli
ggctgatttatggtccggacaaact

SEQ ID NO: 167516 - DNA, 25 bp, E. coli
ggaatatgaaaatgaaacaacagta

SEQ ID NO: 167517 - DNA, 25 bp, E. coli
ggctgatttatgctccggacaaact

SEQ ID NO: 167518 - DNA, 25 bp, E. coli
ggaatatgaaaaagaaacaacagta

SEQ ID NO: 167519 - DNA, 25 bp, E. coli
gagattgccatccttccccagagtc

SEQ ID NO: 167520 - DNA, 25 bp, E. coli
gagattgccatcgttccccagagtc

SEQ ID NO: 167521 - DNA, 25 bp, E. coli
caatatcgtagaagtgggtgagcag

SEQ ID NO: 167522 - DNA, 25 bp, E. coli
caatatcgtagatgtgggtgagcag

SEQ ID NO: 167523 - DNA, 25 bp, E. coli
cacgaggaatcaccatggctaacta

SEQ ID NO: 167524 - DNA, 25 bp, E. coli
cacgaggaatcagcatggctaacta

SEQ ID NO: 167525 - DNA, 25 bp, E. coli
taaaagcaggcgatgagttggcgtt

SEQ ID NO: 167526 - DNA, 25 bp, E. coli
taaaagcaggcgttgagttggcgtt

SEQ ID NO: 167527 - DNA, 25 bp, E. coli
aacgcgaaccgaacaataagaagca

SEQ ID NO: 167528 - DNA, 25 bp, E. coli
aacgcgaaccgatcaataagaagca

SEQ ID NO: 167529 - DNA, 25 bp, E. coli
tagtgaattcaatctcgcaaacgcg

SEQ ID NO: 167530 - DNA, 25 bp, E. coli
tagtgaattcaaactcgcaaacgcg

SEQ ID NO: 167531 - DNA, 25 bp, E. coli
gcttacgcgcttactgagcaactga

SEQ ID NO: 167532 - DNA, 25 bp, E. coli
gcttacgcgctttctgagcaactga

SEQ ID NO: 167533 - DNA, 25 bp, E. coli
gaagagactggcaaaaccgcattcg

SEQ ID NO: 167534 - DNA, 25 bp, E. coli
gaagagactggctaaaccgcattcg

SEQ ID NO: 167535 - DNA, 25 bp, E. coli
cgcagctgcgtgatgtaaatgaagc

SEQ ID NO: 167536 - DNA, 25 bp, E. coli
cgcagctgcgtgttgtaaatgaagc

SEQ ID NO: 167537 - DNA, 25 bp, E. coli
tggttatctccgttactgccgagta

SEQ ID NO: 167538 - DNA, 25 bp, E. coli
ggctactctcatggtttcaatatcg

SEQ ID NO: 167539 - DNA, 25 bp, E. coli
ggctactctcatcgtttcaatatcg

SEQ ID NO: 167540 - DNA, 25 bp, E. coli
tggttatctccgatactgccgagta

SEQ ID NO: 167541 - DNA, 25 bp, E. coli
taagaagcacaagatcacgaggaat

SEQ ID NO: 167542 - DNA, 25 bp, E. coli
taagaagcacaacatcacgaggaat

SEQ ID NO: 167543 - DNA, 25 bp, E. coli
cagcggtgtaccgaatgcgtacgca

SEQ ID NO: 167544 - DNA, 25 bp, E. coli
cagcctgcggtcaacatcaatagta

SEQ ID NO: 167545 - DNA, 25 bp, E. coli
cagcctgcggtctacatcaatagta

SEQ ID NO: 167546 - DNA, 25 bp, E. coli
cagcggtgtacccaatgcgtacgca

SEQ ID NO: 167547 - DNA, 25 bp, E. coli
cagatagttcccgtggttgatgtca

SEQ ID NO: 167548 - DNA, 25 bp, E. coli
cagatagttcccctggttgatgtca

SEQ ID NO: 167549 - DNA, 25 bp, E. coli
catcaatagtacagctgctgcagca

SEQ ID NO: 167550 - DNA, 25 bp, E. coli
catcaatagtactgctgctgcagca

SEQ ID NO: 167551 - DNA, 25 bp, E. coli
tattttggatacgtcgttagcggtc

SEQ ID NO: 167552 - DNA, 25 bp, E. coli
tattttggatacctcgttagcggtc

SEQ ID NO: 167553 - DNA, 25 bp, E. coli
gcgtcatgccaacacgtattttgga

SEQ ID NO: 167554 - DNA, 25 bp, E. coli
gctccagagtggtacagcctgcggt

SEQ ID NO: 167555 - DNA, 25 bp, E. coli
gctccagagtggaacagcctgcggt

SEQ ID NO: 167556 - DNA, 25 bp, E. coli
gcgtcatgccaagacgtattttgga

SEQ ID NO: 167557 - DNA, 25 bp, E. coli
gcagcagtcagcgttttacagcgca

SEQ ID NO: 167558 - DNA, 25 bp, E. coli
gcagcagtcagccttttacagcgca

SEQ ID NO: 167559 - DNA, 25 bp, E. coli
gttgatgtcaggacggtaaaccact

SEQ ID NO: 167560 - DNA, 25 bp, E. coli
gttgatgtcaggtcggtaaaccact

SEQ ID NO: 167561 - DNA, 25 bp, E. coli
tcgttagcggtctgatagttcccct

SEQ ID NO: 167562 - DNA, 25 bp, E. coli
tcgttagcggtcagatagttcccct

SEQ ID NO: 167563 - DNA, 25 bp, E. coli
gacggtaaaccactcgctccagagt

SEQ ID NO: 167564 - DNA, 25 bp, E. coli
gacggtaaaccagtcgctccagagt

SEQ ID NO: 167565 - DNA, 25 bp, E. coli
taaacctcaggatgagctggcagca

SEQ ID NO: 167566 - DNA, 25 bp, E. coli
taaacctcaggaagagctggcagca

SEQ ID NO: 167567 - DNA, 25 bp, E. coli
agcgtttacctgtactggatgccga

SEQ ID NO: 167568 - DNA, 25 bp, E. coli
agcgtttacctgaactggatgccga

SEQ ID NO: 167569 - DNA, 25 bp, E. coli
aaattgcgcccagggtgagcattga

SEQ ID NO: 167570 - DNA, 25 bp, E. coli
aaattgcgcccacggtgagcattga

SEQ ID NO: 167571 - DNA, 25 bp, E. coli
gccgctgattgagagcattcctgaa

SEQ ID NO: 167572 - DNA, 25 bp, E. coli
gccgctgattgacagcattcctgaa

SEQ ID NO: 167573 - DNA, 25 bp, E. coli
gctatcaggcacaaatcaatgcgct

SEQ ID NO: 167574 - DNA, 25 bp, E. coli
gctatcaggcactaatcaatgcgct

SEQ ID NO: 167575 - DNA, 25 bp, E. coli
gaaatctatcgctagctggcagaac

SEQ ID NO: 167576 - DNA, 25 bp, E. coli
gaaatctatcgcaagctggcagaac

SEQ ID NO: 167577 - DNA, 25 bp, E. coli
gatttagggcgcaaagtcactgttc

SEQ ID NO: 167578 - DNA, 25 bp, E. coli
gattgtggcggcaaagcctgacctg

SEQ ID NO: 167579 - DNA, 25 bp, E. coli
gattttgtttttccaacctggcgcg

SEQ ID NO: 167580 - DNA, 25 bp, E. coli
gattgtggcggctaagcctgacctg

SEQ ID NO: 167581 - DNA, 25 bp, E. coli
gattttgtttttgcaacctggcgcg

SEQ ID NO: 167582 - DNA, 25 bp, E. coli
gatttagggcgctaagtcactgttc

SEQ ID NO: 167583 - DNA, 25 bp, E. coli
tcaatgcgctgaaggcgacgctgga

SEQ ID NO: 167584 - DNA, 25 bp, E. coli
taacggtatcggagattcaggcaaa

SEQ ID NO: 167585 - DNA, 25 bp, E. coli
tcaatgcgctgatggcgacgctgga

SEQ ID NO: 167586 - DNA, 25 bp, E. coli
taacggtatcggtgattcaggcaaa

SEQ ID NO: 167587 - DNA, 25 bp, E. coli
aatacgggtctacatcggaagcgcc

SEQ ID NO: 167588 - DNA, 25 bp, E. coli
aatacgggtctagatcggaagcgcc

SEQ ID NO: 167589 - DNA, 25 bp, E. coli
aaccagcgtataacgttcaaatcga

SEQ ID NO: 167590 - DNA, 25 bp, E. coli
aaccagcgtatatcgttcaaatcga

SEQ ID NO: 167591 - DNA, 25 bp, E. coli
cataagattcgaaaaaccatggagg

SEQ ID NO: 167592 - DNA, 25 bp, E. coli
cataagattcgataaaccatggagg

SEQ ID NO: 167593 - DNA, 25 bp, E. coli
catcggaagcgcgtattatatttat

SEQ ID NO: 167594 - DNA, 25 bp, E. coli
catcggaagcgcctattatatttat

SEQ ID NO: 167595 - DNA, 25 bp, E. coli
taaaaccataatgcttgcccatacg

SEQ ID NO: 167596 - DNA, 25 bp, E. coli
tacaggcgaagaatacgggtctaca

SEQ ID NO: 167597 - DNA, 25 bp, E. coli
taaaaccataatccttgcccatacg

SEQ ID NO: 167598 - DNA, 25 bp, E. coli
tacaggcgaagattacgggtctaca

SEQ ID NO: 167599 - DNA, 25 bp, E. coli
tgcccatacgtcgatctggcttatt

SEQ ID NO: 167600 - DNA, 25 bp, E. coli
tgcccatacgtccatctggcttatt

SEQ ID NO: 167601 - DNA, 25 bp, E. coli
ccgatctttgatgtcatcaacggta

SEQ ID NO: 167602 - DNA, 25 bp, E. coli
ccgatctttgatctcatcaacggta

SEQ ID NO: 167603 - DNA, 25 bp, E. coli
cgacccgtggtagaggcgaagaata

SEQ ID NO: 167604 - DNA, 25 bp, E. coli
cgacccgtggtacaggcgaagaata

SEQ ID NO: 167605 - DNA, 25 bp, E. coli
gatatttaaagaaaacgcctgtact

SEQ ID NO: 167606 - DNA, 25 bp, E. coli
gatatttaaagataacgcctgtact

SEQ ID NO: 167607 - DNA, 25 bp, E. coli
tcaacggtatcaaaataaaccagcg

SEQ ID NO: 167608 - DNA, 25 bp, E. coli
tcaacggtatcataataaaccagcg

SEQ ID NO: 167609 - DNA, 25 bp, E. coli
aatatcgagcgtcagcgtcagcgtc

SEQ ID NO: 167610 - DNA, 25 bp, E. coli
caagatgagatccaaaagcagctgc

SEQ ID NO: 167611 - DNA, 25 bp, E. coli
aatatcgagcgtgagcgtcagcgtc

SEQ ID NO: 167612 - DNA, 25 bp, E. coli
caagatgagatcgaaaagcagctgc

SEQ ID NO: 167613 - DNA, 25 bp, E. coli
aagacaaagtcatgcgcttcgccga

SEQ ID NO: 167614 - DNA, 25 bp, E. coli
aagacaaagtcaagcgcttcgccga

SEQ ID NO: 167615 - DNA, 25 bp, E. coli
taaaagaagtggttgcactcggcgg

SEQ ID NO: 167616 - DNA, 25 bp, E. coli
tacgaaggttatatcgcgcgccagc

SEQ ID NO: 167617 - DNA, 25 bp, E. coli
taaaagaagtggatgcactcggcgg

SEQ ID NO: 167618 - DNA, 25 bp, E. coli
taccggttacgatgaagccgctgcg

SEQ ID NO: 167619 - DNA, 25 bp, E. coli
tacgaaggttatttcgcgcgccagc

SEQ ID NO: 167620 - DNA, 25 bp, E. coli
taccggttacgaagaagccgctgcg

SEQ ID NO: 167621 - DNA, 25 bp, E. coli
tgggcgcgcttttacgagaaacttg

SEQ ID NO: 167622 - DNA, 25 bp, E. coli
tctgaaatcgacgtgggtaaccccg

SEQ ID NO: 167623 - DNA, 25 bp, E. coli
tctgaaatcgacctgggtaaccccg

SEQ ID NO: 167624 - DNA, 25 bp, E. coli
gaagatcgtgcgaccgggttatgcc

SEQ ID NO: 167625 - DNA, 25 bp, E. coli
gaagatcgtgcgtccgggttatgcc

SEQ ID NO: 167626 - DNA, 25 bp, E. coli
gaaaacccatgaagtgatccgcagt

SEQ ID NO: 167627 - DNA, 25 bp, E. coli
gaaaacccatgatgtgatccgcagt

SEQ ID NO: 167628 - DNA, 25 bp, E. coli
ctggagaaccaaccgaacctgatga

SEQ ID NO: 167629 - DNA, 25 bp, E. coli
ctggagaaccaagcgaacctgatga

SEQ ID NO: 167630 - DNA, 25 bp, E. coli
tgggcgcgctttaacgagaaacttg

SEQ ID NO: 167631 - DNA, 25 bp, E. coli
caagcagccccgcttgggtagttat

SEQ ID NO: 167632 - DNA, 25 bp, E. coli
caagcagccccggttgggtagttat

SEQ ID NO: 167633 - DNA, 25 bp, E. coli
catcagaaaaagaggcgagtgccgc

SEQ ID NO: 167634 - DNA, 25 bp, E. coli
catcagaaaaagtggcgagtgccgc

SEQ ID NO: 167635 - DNA, 25 bp, E. coli
taaaaaatcccgacaacagcggcca

SEQ ID NO: 167636 - DNA, 25 bp, E. coli
taaaaaatcccgtcaacagcggcca

SEQ ID NO: 167637 - DNA, 25 bp, E. coli
agcaaacgcacatgcagccccggtt

SEQ ID NO: 167638 - DNA, 25 bp, E. coli
accgaccctgaattgggcctgtttg

SEQ ID NO: 167639 - DNA, 25 bp, E. coli
accgaccctgaaatgggcctgtttg

SEQ ID NO: 167640 - DNA, 25 bp, E. coli
agcaaacgcacaagcagccccggtt

SEQ ID NO: 167641 - DNA, 25 bp, E. coli
acatcaggatatggctgagggttac

SEQ ID NO: 167642 - DNA, 25 bp, E. coli
acatcaggatatcgctgagggttac

SEQ ID NO: 167643 - DNA, 25 bp, E. coli
tatccgctgacatcagaaaaagtgg

SEQ ID NO: 167644 - DNA, 25 bp, E. coli
tatccgctgacaacagaaaaagtgg

SEQ ID NO: 167645 - DNA, 25 bp, E. coli
gaaggaaagcagcttccggcgcaaa

SEQ ID NO: 167646 - DNA, 25 bp, E. coli
gaaggaaagcaggttccggcgcaaa

SEQ ID NO: 167647 - DNA, 25 bp, E. coli
cctgtttgaaactggctaaactggg

SEQ ID NO: 167648 - DNA, 25 bp, E. coli
cgcaaacaccgaccctgaaatgggc

SEQ ID NO: 167649 - DNA, 25 bp, E. coli
cgcaaacaccgagcctgaaatgggc

SEQ ID NO: 167650 - DNA, 25 bp, E. coli
cctgtttgaaacaggctaaactggg

SEQ ID NO: 167651 - DNA, 25 bp, E. coli
gacggagcctgcaggtatccgctga

SEQ ID NO: 167652 - DNA, 25 bp, E. coli
gacggagcctgctggtatccgctga

SEQ ID NO: 167653 - DNA, 25 bp, E. coli
tacttttaatgtggctttccggcga

SEQ ID NO: 167654 - DNA, 25 bp, E. coli
tacttttaatgtcgctttccggcga

SEQ ID NO: 167655 - DNA, 25 bp, E. coli
tattttggcaacctggtcggcgcac

SEQ ID NO: 167656 - DNA, 25 bp, E. coli
tatatcacagcaaccactggcacag

SEQ ID NO: 167657 - DNA, 25 bp, E. coli
tatatcacagcatccactggcacag

SEQ ID NO: 167658 - DNA, 25 bp, E. coli
tattttggcaacgtggtcggcgcac

SEQ ID NO: 167659 - DNA, 25 bp, E. coli
ttcctgctgcaaaggccaaagtggc

SEQ ID NO: 167660 - DNA, 25 bp, E. coli
ttcctgctgcaatggccaaagtggc

SEQ ID NO: 167661 - DNA, 25 bp, E. coli
tggtatcctggctaacctgatggta

SEQ ID NO: 167662 - DNA, 25 bp, E. coli
tggtatcctggcaaacctgatggta

SEQ ID NO: 167663 - DNA, 25 bp, E. coli
gccagcggttttgagcacagtatcg

SEQ ID NO: 167664 - DNA, 25 bp, E. coli
gccagcggttttcagcacagtatcg

SEQ ID NO: 167665 - DNA, 25 bp, E. coli
cttcggcatggcaaaactggttggc

SEQ ID NO: 167666 - DNA, 25 bp, E. coli
cttcggcatggctaaactggttggc

SEQ ID NO: 167667 - DNA, 25 bp, E. coli
gattctttgtgtagtctgcggagcc

SEQ ID NO: 167668 - DNA, 25 bp, E. coli
gattctttgtgttgtctgcggagcc

SEQ ID NO: 167669 - DNA, 25 bp, E. coli
gggtattgtaatgcgcgacttcgca

SEQ ID NO: 167670 - DNA, 25 bp, E. coli
gggtattgtaatccgcgacttcgca

SEQ ID NO: 167671 - DNA, 25 bp, E. coli
ggaaaatttttctcacctgaccgtg

SEQ ID NO: 167672 - DNA, 25 bp, E. coli
tggatgagttatactggccgcagcc

SEQ ID NO: 167673 - DNA, 25 bp, E. coli
ggaaaatttttcacacctgaccgtg

SEQ ID NO: 167674 - DNA, 25 bp, E. coli
tggatgagttattctggccgcagcc

SEQ ID NO: 167675 - DNA, 25 bp, E. coli
caatgctgggaatgttctggcgtcc

SEQ ID NO: 167676 - DNA, 25 bp, E. coli
caatgctgggaaagttctggcgtcc

SEQ ID NO: 167677 - DNA, 25 bp, E. coli
caggatattcgcatgccgagagtca

SEQ ID NO: 167678 - DNA, 25 bp, E. coli
caggatattcgcttgccgagagtca

SEQ ID NO: 167679 - DNA, 25 bp, E. coli
tatttatgaccactgcagatgttcg

SEQ ID NO: 167680 - DNA, 25 bp, E. coli
tatttatgaccagtgcagatgttcg

SEQ ID NO: 167681 - DNA, 25 bp, E. coli
ttttattctacgtggcgggcagacg

SEQ ID NO: 167682 - DNA, 25 bp, E. coli
ttttattctacgaggcgggcagacg

SEQ ID NO: 167683 - DNA, 25 bp, E. coli
tgtggttatcggcaagcctgcatgc

SEQ ID NO: 167684 - DNA, 25 bp, E. coli
tgtggttatcgggaagcctgcatgc

SEQ ID NO: 167685 - DNA, 25 bp, E. coli
tgagtcggataaagaacgtcgggct

SEQ ID NO: 167686 - DNA, 25 bp, E. coli
tgagtcggataatgaacgtcgggct

SEQ ID NO: 167687 - DNA, 25 bp, E. coli
gcttggtcatcaggttgcaaccggg

SEQ ID NO: 167688 - DNA, 25 bp, E. coli
gcttggtcatcacgttgcaaccggg

SEQ ID NO: 167689 - DNA, 25 bp, E. coli
gttttgtcggatagatagcacccca

SEQ ID NO: 167690 - DNA, 25 bp, E. coli
gttttgtcggattgatagcacccca

SEQ ID NO: 167691 - DNA, 25 bp, E. coli
ggtacgccctaaaaatctggtgttg

SEQ ID NO: 167692 - DNA, 25 bp, E. coli
ggtacgccctaataatctggtgttg

SEQ ID NO: 167693 - DNA, 25 bp, E. coli
tcagcctgttggttgttgccagccg

SEQ ID NO: 167694 - DNA, 25 bp, E. coli
taagttttcgacactggtacgccct

SEQ ID NO: 167695 - DNA, 25 bp, E. coli
tcagcctgttggatgttgccagccg

SEQ ID NO: 167696 - DNA, 25 bp, E. coli
taagttttcgactctggtacgccct

SEQ ID NO: 167697 - DNA, 25 bp, E. coli
caacaagtgataatctcaaagctga

SEQ ID NO: 167698 - DNA, 25 bp, E. coli
caacaagtgatattctcaaagctga

SEQ ID NO: 167699 - DNA, 25 bp, E. coli
cactggaaatcgagttgcgatacac

SEQ ID NO: 167700 - DNA, 25 bp, E. coli
cactggaaatcgtgttgcgatacac

SEQ ID NO: 167701 - DNA, 25 bp, E. coli
caggcgataatgttaataataaaaa

SEQ ID NO: 167702 - DNA, 25 bp, E. coli
caggcgataatgataataataaaaa

SEQ ID NO: 167703 - DNA, 25 bp, E. coli
accaatttaatggtttcaggcgata

SEQ ID NO: 167704 - DNA, 25 bp, E. coli
accaatttaatgctttcaggcgata

SEQ ID NO: 167705 - DNA, 25 bp, E. coli
tattatcttaagtctgatacactcc

SEQ ID NO: 167706 - DNA, 25 bp, E. coli
tattatcttaagactgatacactcc

SEQ ID NO: 167707 - DNA, 25 bp, E. coli
tgctttcaggcgataatgttaataa

SEQ ID NO: 167708 - DNA, 25 bp, E. coli
tgctttcaggcgttaatgttaataa

SEQ ID NO: 167709 - DNA, 25 bp, E. coli
tcgtgttgcgatacacagctgatga

SEQ ID NO: 167710 - DNA, 25 bp, E. coli
tcgtgttgcgattcacagctgatga

SEQ ID NO: 167711 - DNA, 25 bp, E. coli
gcgatacacagctgatgatatgtaa

SEQ ID NO: 167712 - DNA, 25 bp, E. coli
gctgatgtgatttgaaaaacactgg

SEQ ID NO: 167713 - DNA, 25 bp, E. coli
gcgatacacagcagatgatatgtaa

SEQ ID NO: 167714 - DNA, 25 bp, E. coli
gctgatgtgattagaaaaacactgg

SEQ ID NO: 167715 - DNA, 25 bp, E. coli
gattagaaaaactctggaaatcgtg

SEQ ID NO: 167716 - DNA, 25 bp, E. coli
gattagaaaaacactggaaatcgtg

SEQ ID NO: 167717 - DNA, 25 bp, E. coli
gatattctcaaagctgatgtgatta

SEQ ID NO: 167718 - DNA, 25 bp, E. coli
gatattctcaaacctgatgtgatta

SEQ ID NO: 167719 - DNA, 25 bp, E. coli
aatgatggactaggagttccccgcg

SEQ ID NO: 167720 - DNA, 25 bp, E. coli
aatgatggactacgagttccccgcg

SEQ ID NO: 167721 - DNA, 25 bp, E. coli
cagccgaagccaaaggtgatgccga

SEQ ID NO: 167722 - DNA, 25 bp, E. coli
cagccgaagccataggtgatgccga

SEQ ID NO: 167723 - DNA, 25 bp, E. coli
tgataatgttgagagttccccgcgc

SEQ ID NO: 167724 - DNA, 25 bp, E. coli
tatacttttagacagttccccgcgc

SEQ ID NO: 167725 - DNA, 25 bp, E. coli
tgataatgttgacagttccccgcgc

SEQ ID NO: 167726 - DNA, 25 bp, E. coli
tatacttttagagagttccccgcgc

SEQ ID NO: 167727 - DNA, 25 bp, E. coli
gaaagagattgccagccagcttgag

SEQ ID NO: 167728 - DNA, 25 bp, E. coli
gaaagagattgcgagccagcttgag

SEQ ID NO: 167729 - DNA, 25 bp, E. coli
gtctggaatttcagagcggtcgcga

SEQ ID NO: 167730 - DNA, 25 bp, E. coli
gtctggaatttctgagcggtcgcga

SEQ ID NO: 167731 - DNA, 25 bp, E. coli
gtttgcaacgcctgaaccgagagtt

SEQ ID NO: 167732 - DNA, 25 bp, E. coli
gtttgcaacgccagaaccgagagtt

SEQ ID NO: 167733 - DNA, 25 bp, E. coli
gataaaccgggacttcagacatagg

SEQ ID NO: 167734 - DNA, 25 bp, E. coli
gataaaccgggagttcagacatagg

SEQ ID NO: 167735 - DNA, 25 bp, E. coli
ggataaaccgctttcgcagacgcgc

SEQ ID NO: 167736 - DNA, 25 bp, E. coli
ggataaaccgctgctggagctggct

SEQ ID NO: 167737 - DNA, 25 bp, E. coli
ggataaaccgctatcgcagacgcgc

SEQ ID NO: 167738 - DNA, 25 bp, E. coli
ggataaaccgctcctggagctggct

SEQ ID NO: 167739 - DNA, 25 bp, E. coli
gagatttcacgcctgacgctggtgt

SEQ ID NO: 167740 - DNA, 25 bp, E. coli
gagatttcacgcgtgacgctggtgt

SEQ ID NO: 167741 - DNA, 25 bp, E. coli
cacgagatagctatcccggcgatca

SEQ ID NO: 167742 - DNA, 25 bp, E. coli
cacgagatagctttcccggcgatca

SEQ ID NO: 167743 - DNA, 25 bp, E. coli
tattaaccgcgtcagcgaactgctc

SEQ ID NO: 167744 - DNA, 25 bp, E. coli
tattaaccgcgtgagcgaactgctc

SEQ ID NO: 167745 - DNA, 25 bp, E. coli
tgttgctgacgccattaagtgatcg

SEQ ID NO: 167746 - DNA, 25 bp, E. coli
tgttgctgacgcgattaagtgatcg

SEQ ID NO: 167747 - DNA, 25 bp, E. coli
tgttgaatattgacggcctcgcgct

SEQ ID NO: 167748 - DNA, 25 bp, E. coli
tgttgaatattgtcggcctcgcgct

SEQ ID NO: 167749 - DNA, 25 bp, E. coli
cccacgaaagatccctcacgagata

SEQ ID NO: 167750 - DNA, 25 bp, E. coli
cccacgaaagatgcctcacgagata

SEQ ID NO: 167751 - DNA, 25 bp, E. coli
cattaattcctgaaaaacgggccag

SEQ ID NO: 167752 - DNA, 25 bp, E. coli
cattcatgtggccttatttcggcaa

SEQ ID NO: 167753 - DNA, 25 bp, E. coli
cattaattcctgtaaaacgggccag

SEQ ID NO: 167754 - DNA, 25 bp, E. coli
cattcatgtggcgttatttcggcaa

SEQ ID NO: 167755 - DNA, 25 bp, E. coli
tgattggcgcacactggtttactga

SEQ ID NO: 167756 - DNA, 25 bp, E. coli
gatattgatcggtttgccctgggtg

SEQ ID NO: 167757 - DNA, 25 bp, E. coli
tgattggcgcactctggtttactga

SEQ ID NO: 167758 - DNA, 25 bp, E. coli
gatattgatcggattgccctgggtg

SEQ ID NO: 167759 - DNA, 25 bp, E. coli
ggtattaaaccacctgggtcaggca

SEQ ID NO: 167760 - DNA, 25 bp, E. coli
ggtattaaaccagctgggtcaggca

SEQ ID NO: 167761 - DNA, 25 bp, E. coli
tcagaaactggtcgaaagtaaggcc

SEQ ID NO: 167762 - DNA, 25 bp, E. coli
tcagaaactggtggaaagtaaggcc

SEQ ID NO: 167763 - DNA, 25 bp, E. coli
cactatgtcggtaaattcgagacgc

SEQ ID NO: 167764 - DNA, 25 bp, E. coli
cactatgtcggttaattcgagacgc

SEQ ID NO: 167765 - DNA, 25 bp, E. coli
tattgggaaatgtccggcgctgcga

SEQ ID NO: 167766 - DNA, 25 bp, E. coli
tattgggaaatgaccggcgctgcga

SEQ ID NO: 167767 - DNA, 25 bp, E. coli
ttcgagacgctgctgcctgaaagcg

SEQ ID NO: 167768 - DNA, 25 bp, E. coli
ttggaacatgcagtgatatattggg

SEQ ID NO: 167769 - DNA, 25 bp, E. coli
ttcgagacgctggtgcctgaaagcg

SEQ ID NO: 167770 - DNA, 25 bp, E. coli
ttggaacatgcactgatatattggg

SEQ ID NO: 167771 - DNA, 25 bp, E. coli
tgatatattgggtaatgtccggcgc

SEQ ID NO: 167772 - DNA, 25 bp, E. coli
tgatatattgggaaatgtccggcgc

SEQ ID NO: 167773 - DNA, 25 bp, E. coli
cctgaaagcggcaaacagaatacct

SEQ ID NO: 167774 - DNA, 25 bp, E. coli
cctgaaagcggctaacagaatacct

SEQ ID NO: 167775 - DNA, 25 bp, E. coli
gcggcaaacagaatacctctgatcg

SEQ ID NO: 167776 - DNA, 25 bp, E. coli
gcggcaaacagattacctctgatcg

SEQ ID NO: 167777 - DNA, 25 bp, E. coli
gaatacctctgatcgtctgtactaa

SEQ ID NO: 167778 - DNA, 25 bp, E. coli
gaatacctctgaacgtctgtactaa

SEQ ID NO: 167779 - DNA, 25 bp, E. coli
cggtaaattcgagacgctggtgcct

SEQ ID NO: 167780 - DNA, 25 bp, E. coli
cggtaaattcgacacgctggtgcct

SEQ ID NO: 167781 - DNA, 25 bp, E. coli
ggcgctgcgatccacattcactgcg

SEQ ID NO: 167782 - DNA, 25 bp, E. coli
ggcgctgcgatcgacattcactgcg

SEQ ID NO: 167783 - DNA, 25 bp, E. coli
tcactgcgcgcagtatgtcggtaaa

SEQ ID NO: 167784 - DNA, 25 bp, E. coli
tcactgcgcgcactatgtcggtaaa

SEQ ID NO: 167785 - DNA, 25 bp, E. coli
aatggcagtaaaaattcgttcaagg

SEQ ID NO: 167786 - DNA, 25 bp, E. coli
aatggcagtaaatattcgttcaagg

SEQ ID NO: 167787 - DNA, 25 bp, E. coli
caatgttttgtatgtcagataaggc

SEQ ID NO: 167788 - DNA, 25 bp, E. coli
caatgttttgtaagtcagataaggc

SEQ ID NO: 167789 - DNA, 25 bp, E. coli
tagctaattatcagaggcacctcgt

SEQ ID NO: 167790 - DNA, 25 bp, E. coli
tagctaattatctgaggcacctcgt

SEQ ID NO: 167791 - DNA, 25 bp, E. coli
tgatgacaagcggaaaatcgccaga

SEQ ID NO: 167792 - DNA, 25 bp, E. coli
tgatgacaagcgcaaaatcgccaga

SEQ ID NO: 167793 - DNA, 25 bp, E. coli
tgccacatccgacatgaacaacatg

SEQ ID NO: 167794 - DNA, 25 bp, E. coli
tcgttcaaggaaataataaagtgcc

SEQ ID NO: 167795 - DNA, 25 bp, E. coli
tcgttcaaggaattaataaagtgcc

SEQ ID NO: 167796 - DNA, 25 bp, E. coli
tgccacatccgagatgaacaacatg

SEQ ID NO: 167797 - DNA, 25 bp, E. coli
tctgcgcgggttttgcaatctattg

SEQ ID NO: 167798 - DNA, 25 bp, E. coli
tctgcgcgggttatgcaatctattg

SEQ ID NO: 167799 - DNA, 25 bp, E. coli
gctacgcttatctggtctgcgcggg

SEQ ID NO: 167800 - DNA, 25 bp, E. coli
gctacgcttatcaggtctgcgcggg

SEQ ID NO: 167801 - DNA, 25 bp, E. coli
gaaggcgcgctatgactgatgacaa

SEQ ID NO: 167802 - DNA, 25 bp, E. coli
gaaggcgcgctaagactgatgacaa

SEQ ID NO: 167803 - DNA, 25 bp, E. coli
taagaatagacgtgaatgaaatggc

SEQ ID NO: 167804 - DNA, 25 bp, E. coli
taataaagtgccctgaaggcgcgct

SEQ ID NO: 167805 - DNA, 25 bp, E. coli
taagaatagacgagaatgaaatggc

SEQ ID NO: 167806 - DNA, 25 bp, E. coli
taataaagtgccgtgaaggcgcgct

SEQ ID NO: 167807 - DNA, 25 bp, E. coli
caaaccaataagcactaacatgact

SEQ ID NO: 167808 - DNA, 25 bp, E. coli
caaaccaataaggactaacatgact

SEQ ID NO: 167809 - DNA, 25 bp, E. coli
taaaaagggcggacatcagccgaac

SEQ ID NO: 167810 - DNA, 25 bp, E. coli
taaatttaacagtcaagaccgactc

SEQ ID NO: 167811 - DNA, 25 bp, E. coli
tacacacagcaaagtcgttatttac

SEQ ID NO: 167812 - DNA, 25 bp, E. coli
tacacacagcaatgtcgttatttac

SEQ ID NO: 167813 - DNA, 25 bp, E. coli
taaatttaacagacaagaccgactc

SEQ ID NO: 167814 - DNA, 25 bp, E. coli
taaaaagggcggtcatcagccgaac

SEQ ID NO: 167815 - DNA, 25 bp, E. coli
atgacttttaacagtgccacgtgcg

SEQ ID NO: 167816 - DNA, 25 bp, E. coli
atgacttttaactgtgccacgtgcg

SEQ ID NO: 167817 - DNA, 25 bp, E. coli
tgttgatgcggtgtctggtgcctcc

SEQ ID NO: 167818 - DNA, 25 bp, E. coli
tgttgatgcggtctctggtgcctcc

SEQ ID NO: 167819 - DNA, 25 bp, E. coli
gacatcagccgatcttcaagaaaaa

SEQ ID NO: 167820 - DNA, 25 bp, E. coli
gacatcagccgaacttcaagaaaaa

SEQ ID NO: 167821 - DNA, 25 bp, E. coli
cgttatttacaagcggaggcgcact

SEQ ID NO: 167822 - DNA, 25 bp, E. coli
cgttatttacaaccggaggcgcact

SEQ ID NO: 167823 - DNA, 25 bp, E. coli
gtgcctccaggtcactgcaaccagt

SEQ ID NO: 167824 - DNA, 25 bp, E. coli
gtgcctccaggtgactgcaaccagt

SEQ ID NO: 167825 - DNA, 25 bp, E. coli
gaccgactctttatggatatcggaa

SEQ ID NO: 167826 - DNA, 25 bp, E. coli
gaggcgcactcccaccatttaaatt

SEQ ID NO: 167827 - DNA, 25 bp, E. coli
gaccgactctttttggatatcggaa

SEQ ID NO: 167828 - DNA, 25 bp, E. coli
gaggcgcactccgaccatttaaatt

SEQ ID NO: 167829 - DNA, 25 bp, E. coli
caaggcgcaaacctacagatggtag

SEQ ID NO: 167830 - DNA, 25 bp, E. coli
caaggcgcaaacgtacagatggtag

SEQ ID NO: 167831 - DNA, 25 bp, E. coli
cacggtggcgatcgacaatatgaag

SEQ ID NO: 167832 - DNA, 25 bp, E. coli
cacggtggcgatggacaatatgaag

SEQ ID NO: 167833 - DNA, 25 bp, E. coli
acaaggcgcaaaggtacagatggta

SEQ ID NO: 167834 - DNA, 25 bp, E. coli
aaacgtacagatcgtagatattcac

SEQ ID NO: 167835 - DNA, 25 bp, E. coli
aaacgtacagatggtagatattcac

SEQ ID NO: 167836 - DNA, 25 bp, E. coli
aaccgggctacggacgccggaatat

SEQ ID NO: 167837 - DNA, 25 bp, E. coli
acaaggcgcaaacgtacagatggta

SEQ ID NO: 167838 - DNA, 25 bp, E. coli
aaccgggctacgcacgccggaatat

SEQ ID NO: 167839 - DNA, 25 bp, E. coli
tatgaaggtcattaaggctatcagt

SEQ ID NO: 167840 - DNA, 25 bp, E. coli
tatgaaggtcataaaggctatcagt

SEQ ID NO: 167841 - DNA, 25 bp, E. coli
tcataaaggctaacagttttggccg

SEQ ID NO: 167842 - DNA, 25 bp, E. coli
tcataaaggctatcagttttggccg

SEQ ID NO: 167843 - DNA, 25 bp, E. coli
gaaggtcataaacgctatcagtttt

SEQ ID NO: 167844 - DNA, 25 bp, E. coli
gaaggtcataaaggctatcagtttt

SEQ ID NO: 167845 - DNA, 25 bp, E. coli
tggcgatggacattatgaaggtcat

SEQ ID NO: 167846 - DNA, 25 bp, E. coli
ggcgcaaacgtacagatggtagata

SEQ ID NO: 167847 - DNA, 25 bp, E. coli
ggcgcaaacgtagagatggtagata

SEQ ID NO: 167848 - DNA, 25 bp, E. coli
tggacaatatgaaggtcataaaggc

SEQ ID NO: 167849 - DNA, 25 bp, E. coli
tggacaatatgatggtcataaaggc

SEQ ID NO: 167850 - DNA, 25 bp, E. coli
tggcgatggacaatatgaaggtcat

SEQ ID NO: 167851 - DNA, 25 bp, E. coli
gagttggttacggtcattaccccgc

SEQ ID NO: 167852 - DNA, 25 bp, E. coli
tacggtagtgataccccagaggatt

SEQ ID NO: 167853 - DNA, 25 bp, E. coli
tacggtagtgattccccagaggatt

SEQ ID NO: 167854 - DNA, 25 bp, E. coli
gagttggttacgctcattaccccgc

SEQ ID NO: 167855 - DNA, 25 bp, E. coli
tatctcaccgctgccttatacgttg

SEQ ID NO: 167856 - DNA, 25 bp, E. coli
tatctcaccgctcccttatacgttg

SEQ ID NO: 167857 - DNA, 25 bp, E. coli
tatcttgccggtacaaattacggta

SEQ ID NO: 167858 - DNA, 25 bp, E. coli
tatacgttgcgcatttggtgcggct

SEQ ID NO: 167859 - DNA, 25 bp, E. coli
tatcttgccggttcaaattacggta

SEQ ID NO: 167860 - DNA, 25 bp, E. coli
tatacgttgcgcttttggtgcggct

SEQ ID NO: 167861 - DNA, 25 bp, E. coli
ttttcgcgtcagctaacgcccatcg

SEQ ID NO: 167862 - DNA, 25 bp, E. coli
ttttcgcgtcaggtaacgcccatcg

SEQ ID NO: 167863 - DNA, 25 bp, E. coli
ccagagtgttattattgcggtcgca

SEQ ID NO: 167864 - DNA, 25 bp, E. coli
ccagagtgttataattgcggtcgca

SEQ ID NO: 167865 - DNA, 25 bp, E. coli
gcttagccgtgtcttttcggagtaa

SEQ ID NO: 167866 - DNA, 25 bp, E. coli
gcttagccgtgtgttttcggagtaa

SEQ ID NO: 167867 - DNA, 25 bp, E. coli
gttttcggcacaattctccccagag

SEQ ID NO: 167868 - DNA, 25 bp, E. coli
gttttcggcacatttctccccagag

SEQ ID NO: 167869 - DNA, 25 bp, E. coli
taccccgctgccgataaggaatttt

SEQ ID NO: 167870 - DNA, 25 bp, E. coli
taccccgctgcccataaggaatttt

SEQ ID NO: 167871 - DNA, 25 bp, E. coli
taatgtgccgaagctgtttgttgcg

SEQ ID NO: 167872 - DNA, 25 bp, E. coli
taatgtgccgaacctgtttgttgcg

SEQ ID NO: 167873 - DNA, 25 bp, E. coli
aattaactgtttaagcggaggatgc

SEQ ID NO: 167874 - DNA, 25 bp, E. coli
aattaactgttttagcggaggatgc

SEQ ID NO: 167875 - DNA, 25 bp, E. coli
tacgggcctataagccaggcgagat

SEQ ID NO: 167876 - DNA, 25 bp, E. coli
aaaccatgcgagatacgggcctata

SEQ ID NO: 167877 - DNA, 25 bp, E. coli
aaaccatgcgagttacgggcctata

SEQ ID NO: 167878 - DNA, 25 bp, E. coli
tacgggcctatatgccaggcgagat

SEQ ID NO: 167879 - DNA, 25 bp, E. coli
ttagcggaggatccggaaaaaattc

SEQ ID NO: 167880 - DNA, 25 bp, E. coli
ttagcggaggatgcggaaaaaattc

SEQ ID NO: 167881 - DNA, 25 bp, E. coli
tgcggaaaaaattcaactcatttgt

SEQ ID NO: 167882 - DNA, 25 bp, E. coli
tcgtcgccgacttaataaagagaga

SEQ ID NO: 167883 - DNA, 25 bp, E. coli
tcgtcgccgactaaataaagagaga

SEQ ID NO: 167884 - DNA, 25 bp, E. coli
tgcggaaaaaatacaactcatttgt

SEQ ID NO: 167885 - DNA, 25 bp, E. coli
gccaggcgagatttgatctatatca

SEQ ID NO: 167886 - DNA, 25 bp, E. coli
gccaggcgagatatgatctatatca

SEQ ID NO: 167887 - DNA, 25 bp, E. coli
gctttgttagtaactcgtcgccgac

SEQ ID NO: 167888 - DNA, 25 bp, E. coli
gctttgttagtatctcgtcgccgac

SEQ ID NO: 167889 - DNA, 25 bp, E. coli
ccgacttaataatgagagagttagt

SEQ ID NO: 167890 - DNA, 25 bp, E. coli
cgtatttgcatataaaccatgcgag

SEQ ID NO: 167891 - DNA, 25 bp, E. coli
cgtatttgcataaaaaccatgcgag

SEQ ID NO: 167892 - DNA, 25 bp, E. coli
ccgacttaataaagagagagttagt

SEQ ID NO: 167893 - DNA, 25 bp, E. coli
gatcgatattgtaactttattcgcc

SEQ ID NO: 167894 - DNA, 25 bp, E. coli
gatcgatattgttactttattcgcc

SEQ ID NO: 167895 - DNA, 25 bp, E. coli
catgaagaagtgtttacagacctga

SEQ ID NO: 167896 - DNA, 25 bp, E. coli
catgaagaagtgattacagacctga

SEQ ID NO: 167897 - DNA, 25 bp, E. coli
ctgaccgtggtgaccgtccgttcgt

SEQ ID NO: 167898 - DNA, 25 bp, E. coli
ctgaccgtggtgtccgtccgttcgt

SEQ ID NO: 167899 - DNA, 25 bp, E. coli
tatggcccggaattgctgcgtattg

SEQ ID NO: 167900 - DNA, 25 bp, E. coli
tatggcccggaaatgctgcgtattg

SEQ ID NO: 167901 - DNA, 25 bp, E. coli
ccatctgaactgtggcaagagagtg

SEQ ID NO: 167902 - DNA, 25 bp, E. coli
ccatctgaactgaggcaagagagtg

SEQ ID NO: 167903 - DNA, 25 bp, E. coli
gctgcgtattgcagaccgtggtgac

SEQ ID NO: 167904 - DNA, 25 bp, E. coli
gctgcgtattgctgaccgtggtgac

SEQ ID NO: 167905 - DNA, 25 bp, E. coli
gaaattgctgatttccgcaacgtgg

SEQ ID NO: 167906 - DNA, 25 bp, E. coli
gaaattgctgatatccgcaacgtgg

SEQ ID NO: 167907 - DNA, 25 bp, E. coli
cgttgggaacagaatggcccggaat

SEQ ID NO: 167908 - DNA, 25 bp, E. coli
cgttgggaacagtatggcccggaat

SEQ ID NO: 167909 - DNA, 25 bp, E. coli
gatacttctgactacgcagcgaaca

SEQ ID NO: 167910 - DNA, 25 bp, E. coli
gatacttctgacaacgcagcgaaca

SEQ ID NO: 167911 - DNA, 25 bp, E. coli
ggtggttcagccatctgaactgtgg

SEQ ID NO: 167912 - DNA, 25 bp, E. coli
ggaaccgtaacaacatgcgtactag

SEQ ID NO: 167913 - DNA, 25 bp, E. coli
ggtggttcagccttctgaactgtgg

SEQ ID NO: 167914 - DNA, 25 bp, E. coli
ggaaccgtaacatcatgcgtactag

SEQ ID NO: 167915 - DNA, 25 bp, E. coli
gatgtcgctactgcggaaattgctg

SEQ ID NO: 167916 - DNA, 25 bp, E. coli
gatgtcgctactccggaaattgctg

SEQ ID NO: 167917 - DNA, 25 bp, E. coli
cagcatggatacacttgatcttggc

SEQ ID NO: 167918 - DNA, 25 bp, E. coli
cagcatggatactcttgatcttggc

SEQ ID NO: 167919 - DNA, 25 bp, E. coli
tatgaggtcagcatggatactcttg

SEQ ID NO: 167920 - DNA, 25 bp, E. coli
tatgaggtcagcttggatactcttg

SEQ ID NO: 167921 - DNA, 25 bp, E. coli
tgaggtcagcatggatactcttgat

SEQ ID NO: 167922 - DNA, 25 bp, E. coli
tgaggtcagcatcgatactcttgat

SEQ ID NO: 167923 - DNA, 25 bp, E. coli
tcagcatggatagtcttgatcttgg

SEQ ID NO: 167924 - DNA, 25 bp, E. coli
tcagcatggatactcttgatcttgg

SEQ ID NO: 167925 - DNA, 25 bp, E. coli
gctggttagcaagaaactctgacta

SEQ ID NO: 167926 - DNA, 25 bp, E. coli
gctggttagcaacaaactctgacta

SEQ ID NO: 167927 - DNA, 25 bp, E. coli
gcatggatactcttgatcttggcaa

SEQ ID NO: 167928 - DNA, 25 bp, E. coli
gcatggatactcatgatcttggcaa

SEQ ID NO: 167929 - DNA, 25 bp, E. coli
cgtttaaaaccgaatctggcgcgcg

SEQ ID NO: 167930 - DNA, 25 bp, E. coli
cgtttaaaaccgtatctggcgcgcg

SEQ ID NO: 167931 - DNA, 25 bp, E. coli
ggatatgaggtctgcatggatactc

SEQ ID NO: 167932 - DNA, 25 bp, E. coli
ggtcagcatggaaactcttgatctt

SEQ ID NO: 167933 - DNA, 25 bp, E. coli
ggtcagcatggatactcttgatctt

SEQ ID NO: 167934 - DNA, 25 bp, E. coli
ggatatgaggtcagcatggatactc

SEQ ID NO: 167935 - DNA, 25 bp, E. coli
gatatgaggtcagcatggatactct

SEQ ID NO: 167936 - DNA, 25 bp, E. coli
gatatgaggtcaccatggatactct

SEQ ID NO: 167937 - DNA, 25 bp, E. coli
gaggtcagcatggatactcttgatc

SEQ ID NO: 167938 - DNA, 25 bp, E. coli
gaggtcagcatgcatactcttgatc

SEQ ID NO: 167939 - DNA, 25 bp, E. coli
catagcgtctgtgctcatcactggt

SEQ ID NO: 167940 - DNA, 25 bp, E. coli
catcactggtcccagtggtgacgat

SEQ ID NO: 167941 - DNA, 25 bp, E. coli
catcactggtccgagtggtgacgat

SEQ ID NO: 167942 - DNA, 25 bp, E. coli
cataccatacgaagatatcgttggc

SEQ ID NO: 167943 - DNA, 25 bp, E. coli
catagcgtctgtcctcatcactggt

SEQ ID NO: 167944 - DNA, 25 bp, E. coli
cataccatacgatgatatcgttggc

SEQ ID NO: 167945 - DNA, 25 bp, E. coli
agggctgatgacacgccgcgagatt

SEQ ID NO: 167946 - DNA, 25 bp, E. coli
atggaaagggctcatgactcgccgc

SEQ ID NO: 167947 - DNA, 25 bp, E. coli
atggaaagggctgatgactcgccgc

SEQ ID NO: 167948 - DNA, 25 bp, E. coli
agggctgatgactcgccgcgagatt

SEQ ID NO: 167949 - DNA, 25 bp, E. coli
tgtcgccatcataacgcaaggctgt

SEQ ID NO: 167950 - DNA, 25 bp, E. coli
tgtgctcatcacaggtccgagtggt

SEQ ID NO: 167951 - DNA, 25 bp, E. coli
tgtcgccatcattacgcaaggctgt

SEQ ID NO: 167952 - DNA, 25 bp, E. coli
ccatcattacgcaaggctgttgctg

SEQ ID NO: 167953 - DNA, 25 bp, E. coli
ccatcattacgctaggctgttgctg

SEQ ID NO: 167954 - DNA, 25 bp, E. coli
ccgagtggtgaccatggcctggaag

SEQ ID NO: 167955 - DNA, 25 bp, E. coli
gaagatatcgttggcgtatggactg

SEQ ID NO: 167956 - DNA, 25 bp, E. coli
gaagatatcgttcgcgtatggactg

SEQ ID NO: 167957 - DNA, 25 bp, E. coli
ccgagtggtgacgatggcctggaag

SEQ ID NO: 167958 - DNA, 25 bp, E. coli
gggctgctgccatagcgtctgtgct

SEQ ID NO: 167959 - DNA, 25 bp, E. coli
gggctgctgccaaagcgtctgtgct

SEQ ID NO: 167960 - DNA, 25 bp, E. coli
tgtgctcatcactggtccgagtggt

SEQ ID NO: 167961 - DNA, 25 bp, E. coli
cagtagacagggtagccggtttgcc

SEQ ID NO: 167962 - DNA, 25 bp, E. coli
cagtagacagggaagccggtttgcc

SEQ ID NO: 167963 - DNA, 25 bp, E. coli
tttccagttcaacgaagttcggcgg

SEQ ID NO: 167964 - DNA, 25 bp, E. coli
tttccagttcaaggaagttcggcgg

SEQ ID NO: 167965 - DNA, 25 bp, E. coli
tttctacgcgagaaccggtcagcag

SEQ ID NO: 167966 - DNA, 25 bp, E. coli
tttctacgcgagtaccggtcagcag

SEQ ID NO: 167967 - DNA, 25 bp, E. coli
gcgccttcagcggaatcagtagatt

SEQ ID NO: 167968 - DNA, 25 bp, E. coli
gcttcaaccgcgtaaggttcgccgt

SEQ ID NO: 167969 - DNA, 25 bp, E. coli
gcgccttcagcgcaatcagtagatt

SEQ ID NO: 167970 - DNA, 25 bp, E. coli
gcggtatcacctttcaggcccggat

SEQ ID NO: 167971 - DNA, 25 bp, E. coli
gcggtatcacctatcaggcccggat

SEQ ID NO: 167972 - DNA, 25 bp, E. coli
gcttcaaccgcgaaaggttcgccgt

SEQ ID NO: 167973 - DNA, 25 bp, E. coli
gaagtgccagaagtcaccgtcgttg

SEQ ID NO: 167974 - DNA, 25 bp, E. coli
gaagtgccagaactcaccgtcgttg

SEQ ID NO: 167975 - DNA, 25 bp, E. coli
cgagagacgtatacaccagagcggg

SEQ ID NO: 167976 - DNA, 25 bp, E. coli
cgagagacgtattcaccagagcggg

SEQ ID NO: 167977 - DNA, 25 bp, E. coli
gtttaacgcgaggaaatgcctggcc

SEQ ID NO: 167978 - DNA, 25 bp, E. coli
gtttaacgcgagcaaatgcctggcc

SEQ ID NO: 167979 - DNA, 25 bp, E. coli
ggttcatatcgagaacatcagcgcc

SEQ ID NO: 167980 - DNA, 25 bp, E. coli
ggttcatatcgacaacatcagcgcc

SEQ ID NO: 167981 - DNA, 25 bp, E. coli
gagatcggctgaccattccacagag

SEQ ID NO: 167982 - DNA, 25 bp, E. coli
gagatcggctgagcattccacagag

SEQ ID NO: 167983 - DNA, 25 bp, E. coli
tactgtacggttgacaggcaattgg

SEQ ID NO: 167984 - DNA, 25 bp, E. coli
tactgtacggttcacaggcaattgg

SEQ ID NO: 167985 - DNA, 25 bp, E. coli
aaaggtccatattccgtactgtacg

SEQ ID NO: 167986 - DNA, 25 bp, E. coli
aaaggtccatataccgtactgtacg

SEQ ID NO: 167987 - DNA, 25 bp, E. coli
ttgatagatgagtctgcgctggagc

SEQ ID NO: 167988 - DNA, 25 bp, E. coli
ttgatagatgagactgcgctggagc

SEQ ID NO: 167989 - DNA, 25 bp, E. coli
tcaggaggtaacttatcagcgcgcc

SEQ ID NO: 167990 - DNA, 25 bp, E. coli
tctcattgatggtcaggaggtaact

SEQ ID NO: 167991 - DNA, 25 bp, E. coli
tcaggaggtaacatatcagcgcgcc

SEQ ID NO: 167992 - DNA, 25 bp, E. coli
tctcattgatggacaggaggtaact

SEQ ID NO: 167993 - DNA, 25 bp, E. coli
cccgtgttttaaatctcattgatgg

SEQ ID NO: 167994 - DNA, 25 bp, E. coli
cccgtgttttaattctcattgatgg

SEQ ID NO: 167995 - DNA, 25 bp, E. coli
cggttcacaggctattggcggtatt

SEQ ID NO: 167996 - DNA, 25 bp, E. coli
cgtgttgaggtagtgaaaggtccat

SEQ ID NO: 167997 - DNA, 25 bp, E. coli
cgtgttgaggtactgaaaggtccat

SEQ ID NO: 167998 - DNA, 25 bp, E. coli
cggttcacaggcaattggcggtatt

SEQ ID NO: 167999 - DNA, 25 bp, E. coli
ggcgaagcatccacccgtgttttaa

SEQ ID NO: 168000 - DNA, 25 bp, E. coli
ggcgaagcatcctcccgtgttttaa

SEQ ID NO: 168001 - DNA, 25 bp, E. coli
taattatggtgtcggactgttgata

SEQ ID NO: 168002 - DNA, 25 bp, E. coli
tcagcgcgccggtgataattatggt

SEQ ID NO: 168003 - DNA, 25 bp, E. coli
tcagcgcgccggagataattatggt

SEQ ID NO: 168004 - DNA, 25 bp, E. coli
taattatggtgtgggactgttgata

SEQ ID NO: 168005 - DNA, 25 bp, E. coli
aatttgtaaggtagtgaagatagcg

SEQ ID NO: 168006 - DNA, 25 bp, E. coli
caagcatcgggcagaaattaatcgc

SEQ ID NO: 168007 - DNA, 25 bp, E. coli
aatttgtaaggttgtgaagatagcg

SEQ ID NO: 168008 - DNA, 25 bp, E. coli
caagcatcgggctgaaattaatcgc

SEQ ID NO: 168009 - DNA, 25 bp, E. coli
atctgagcctgacgcaagcatcggg

SEQ ID NO: 168010 - DNA, 25 bp, E. coli
atctgagcctgaggcaagcatcggg

SEQ ID NO: 168011 - DNA, 25 bp, E. coli
aaatcagcgctctctctgttgctga

SEQ ID NO: 168012 - DNA, 25 bp, E. coli
aaatcagcgctcactctgttgctga

SEQ ID NO: 168013 - DNA, 25 bp, E. coli
tatacgcaaatctgagcctgacgca

SEQ ID NO: 168014 - DNA, 25 bp, E. coli
tatacgcaaatcagagcctgacgca

SEQ ID NO: 168015 - DNA, 25 bp, E. coli
gcccgcgcattatacgcaaatctga

SEQ ID NO: 168016 - DNA, 25 bp, E. coli
gcccgcgcattaaacgcaaatctga

SEQ ID NO: 168017 - DNA, 25 bp, E. coli
gcaacgcgcagaatgcgagctgcat

SEQ ID NO: 168018 - DNA, 25 bp, E. coli
gcaacgcgcagattgcgagctgcat

SEQ ID NO: 168019 - DNA, 25 bp, E. coli
cgagctgcattcgacgaaatttgta

SEQ ID NO: 168020 - DNA, 25 bp, E. coli
cgagctgcattccacgaaatttgta

SEQ ID NO: 168021 - DNA, 25 bp, E. coli
gatagcgtttttcaccggaatcagg

SEQ ID NO: 168022 - DNA, 25 bp, E. coli
gatagcgtttttgaccggaatcagg

SEQ ID NO: 168023 - DNA, 25 bp, E. coli
ggaatcaggttatcaaatcagcgct

SEQ ID NO: 168024 - DNA, 25 bp, E. coli
ggaatcaggttaacaaatcagcgct

SEQ ID NO: 168025 - DNA, 25 bp, E. coli
ggcagaaattaaacgcaacgcgcag

SEQ ID NO: 168026 - DNA, 25 bp, E. coli
ggcagaaattaatcgcaacgcgcag

SEQ ID NO: 168027 - DNA, 25 bp, E. coli
tactaaacgcgtaattatgctcggc

SEQ ID NO: 168028 - DNA, 25 bp, E. coli
tactaaacgcgttattatgctcggc

SEQ ID NO: 168029 - DNA, 25 bp, E. coli
tatcttcggtaaagaagccttcgcg

SEQ ID NO: 168030 - DNA, 25 bp, E. coli
tatcgtgtctgtaagctggctggtc

SEQ ID NO: 168031 - DNA, 25 bp, E. coli
tatggcggctatagcggtcggtaac

SEQ ID NO: 168032 - DNA, 25 bp, E. coli
tatggcggctattgcggtcggtaac

SEQ ID NO: 168033 - DNA, 25 bp, E. coli
tatcgtgtctgttagctggctggtc

SEQ ID NO: 168034 - DNA, 25 bp, E. coli
tatcttcggtaatgaagccttcgcg

SEQ ID NO: 168035 - DNA, 25 bp, E. coli
tttatggtctggtcgctatcggcgg

SEQ ID NO: 168036 - DNA, 25 bp, E. coli
tttatggtctggacgctatcggcgg

SEQ ID NO: 168037 - DNA, 25 bp, E. coli
tgctatgagaaaaacgacccgcgtc

SEQ ID NO: 168038 - DNA, 25 bp, E. coli
tgctgcgcgtcgtaaaatgatcgtt

SEQ ID NO: 168039 - DNA, 25 bp, E. coli
tgctatgagaaatacgacccgcgtc

SEQ ID NO: 168040 - DNA, 25 bp, E. coli
tgctgcgcgtcgaaaaatgatcgtt

SEQ ID NO: 168041 - DNA, 25 bp, E. coli
tctgccgctgggtgcgaaattcgcg

SEQ ID NO: 168042 - DNA, 25 bp, E. coli
tctgccgctgggagcgaaattcgcg

SEQ ID NO: 168043 - DNA, 25 bp, E. coli
tctataacaagaagggcgataccct

SEQ ID NO: 168044 - DNA, 25 bp, E. coli
tctataacaagatgggcgataccct

SEQ ID NO: 168045 - DNA, 25 bp, E. coli
cattatgggtagctggttcctgacc

SEQ ID NO: 168046 - DNA, 25 bp, E. coli
ctatcggcggctggttaggtgacaa

SEQ ID NO: 168047 - DNA, 25 bp, E. coli
ctatcggcggctcgttaggtgacaa

SEQ ID NO: 168048 - DNA, 25 bp, E. coli
cattatgggtaggtggttcctgacc

SEQ ID NO: 168049 - DNA, 25 bp, E. coli
catcatggcggccaaaaacttgctg

SEQ ID NO: 168050 - DNA, 25 bp, E. coli
catcatggcggcgaaaaacttgctg

SEQ ID NO: 168051 - DNA, 25 bp, E. coli
taaagcgcaggctctgaaaaatgtt

SEQ ID NO: 168052 - DNA, 25 bp, E. coli
taaagcgcaggcactgaaaaatgtt

SEQ ID NO: 168053 - DNA, 25 bp, E. coli
taccgcgagcatcatcagaaactgg

SEQ ID NO: 168054 - DNA, 25 bp, E. coli
taccgcgagcatgatcagaaactgg

SEQ ID NO: 168055 - DNA, 25 bp, E. coli
tgcctgacagctacgtgacgatggg

SEQ ID NO: 168056 - DNA, 25 bp, E. coli
tgcctgacagcttcgtgacgatggg

SEQ ID NO: 168057 - DNA, 25 bp, E. coli
ccttcgctgatggtaatcgctgata

SEQ ID NO: 168058 - DNA, 25 bp, E. coli
ccttcgctgatgctaatcgctgata

SEQ ID NO: 168059 - DNA, 25 bp, E. coli
gcaaaccgtggacttcccgatccag

SEQ ID NO: 168060 - DNA, 25 bp, E. coli
gcaaaccgtggagttcccgatccag

SEQ ID NO: 168061 - DNA, 25 bp, E. coli
cccgatccagggagagatggttgat

SEQ ID NO: 168062 - DNA, 25 bp, E. coli
cccgatccagggtgagatggttgat

SEQ ID NO: 168063 - DNA, 25 bp, E. coli
ggtaagccctggtacgataactgct

SEQ ID NO: 168064 - DNA, 25 bp, E. coli
ggtaagccctggaacgataactgct

SEQ ID NO: 168065 - DNA, 25 bp, E. coli
ggcgtaacgattaccaatctgcgta

SEQ ID NO: 168066 - DNA, 25 bp, E. coli
ggcgtaacgatttccaatctgcgta

SEQ ID NO: 168067 - DNA, 25 bp, E. coli
tcactattgatatctaccgcgagca

SEQ ID NO: 168068 - DNA, 25 bp, E. coli
tcactattgataactaccgcgagca

SEQ ID NO: 168069 - DNA, 25 bp, E. coli
gacccatttccatgagcaaaccgtg

SEQ ID NO: 168070 - DNA, 25 bp, E. coli
gacccatttccaagagcaaaccgtg

SEQ ID NO: 168071 - DNA, 25 bp, E. coli
cagccagtaaggagggatacaggca

SEQ ID NO: 168072 - DNA, 25 bp, E. coli
cagccagtaaggtgggatacaggca

SEQ ID NO: 168073 - DNA, 25 bp, E. coli
aaaaatgttgccgttctgccaacag

SEQ ID NO: 168074 - DNA, 25 bp, E. coli
aaaaatgttgcccttctgccaacag

SEQ ID NO: 168075 - DNA, 25 bp, E. coli
tagcctctccttaagtaatcaccgg

SEQ ID NO: 168076 - DNA, 25 bp, E. coli
tagcctctcctttagtaatcaccgg

SEQ ID NO: 168077 - DNA, 25 bp, E. coli
tgagggatttacagaccagcggcat

SEQ ID NO: 168078 - DNA, 25 bp, E. coli
tgagggatttactgaccagcggcat

SEQ ID NO: 168079 - DNA, 25 bp, E. coli
tgccaacagttcctgccagcattcg

SEQ ID NO: 168080 - DNA, 25 bp, E. coli
tgccaacagttcgtgccagcattcg

SEQ ID NO: 168081 - DNA, 25 bp, E. coli
tcgacatggtgaggtcaacgacaaa

SEQ ID NO: 168082 - DNA, 25 bp, E. coli
tcgacatggtgacgtcaacgacaaa

SEQ ID NO: 168083 - DNA, 25 bp, E. coli
tcatgccagccaacaatttcagttg

SEQ ID NO: 168084 - DNA, 25 bp, E. coli
tcatgccagccatcaatttcagttg

SEQ ID NO: 168085 - DNA, 25 bp, E. coli
gcattcgggcaacgaagggttctac

SEQ ID NO: 168086 - DNA, 25 bp, E. coli
gcattcgggcaaggaagggttctac

SEQ ID NO: 168087 - DNA, 25 bp, E. coli
gaagggttctacaggtggatacaca

SEQ ID NO: 168088 - DNA, 25 bp, E. coli
gaataaagtcgtattagcctctcct

SEQ ID NO: 168089 - DNA, 25 bp, E. coli
gaataaagtcgttttagcctctcct

SEQ ID NO: 168090 - DNA, 25 bp, E. coli
gaagggttctactggtggatacaca

SEQ ID NO: 168091 - DNA, 25 bp, E. coli
gggtaatgaaatcagcatctgcatc

SEQ ID NO: 168092 - DNA, 25 bp, E. coli
gggtaatgaaatgagcatctgcatc

SEQ ID NO: 168093 - DNA, 25 bp, E. coli
aatgctgaacgtccagaaggtcagg

SEQ ID NO: 168094 - DNA, 25 bp, E. coli
caacgcttagggtttcgcgatagca

SEQ ID NO: 168095 - DNA, 25 bp, E. coli
aatgctgaacgtgcagaaggtcagg

SEQ ID NO: 168096 - DNA, 25 bp, E. coli
caacgcttagggattcgcgatagca

SEQ ID NO: 168097 - DNA, 25 bp, E. coli
tacatccttgcttctgcgggaaggg

SEQ ID NO: 168098 - DNA, 25 bp, E. coli
tacatccttgctactgcgggaaggg

SEQ ID NO: 168099 - DNA, 25 bp, E. coli
aaggaaggctggtcaacgtcaccaa

SEQ ID NO: 168100 - DNA, 25 bp, E. coli
aaggaaggctggacaacgtcaccaa

SEQ ID NO: 168101 - DNA, 25 bp, E. coli
taataaatgggtacgcaaggaaggc

SEQ ID NO: 168102 - DNA, 25 bp, E. coli
taataaatgggttcgcaaggaaggc

SEQ ID NO: 168103 - DNA, 25 bp, E. coli
cgaaagagatgaggccagttgaaca

SEQ ID NO: 168104 - DNA, 25 bp, E. coli
ccctttctggtgttgcgccgcttga

SEQ ID NO: 168105 - DNA, 25 bp, E. coli
ccctttctggtgatgcgccgcttga

SEQ ID NO: 168106 - DNA, 25 bp, E. coli
cgaaagagatgacgccagttgaaca

SEQ ID NO: 168107 - DNA, 25 bp, E. coli
gggattatcggaatgttacaacgct

SEQ ID NO: 168108 - DNA, 25 bp, E. coli
gggattatcggattgttacaacgct

SEQ ID NO: 168109 - DNA, 25 bp, E. coli
ggctatagccgccagaccattaata

SEQ ID NO: 168110 - DNA, 25 bp, E. coli
ggctatagccgcgagaccattaata

SEQ ID NO: 168111 - DNA, 25 bp, E. coli
tggttcacgtcattgaacaggttcg

SEQ ID NO: 168112 - DNA, 25 bp, E. coli
tggttcacgtcaatgaacaggttcg

SEQ ID NO: 168113 - DNA, 25 bp, E. coli
gatgaacttgccagactgaccggct

SEQ ID NO: 168114 - DNA, 25 bp, E. coli
gatgaacttgcctgactgaccggct

SEQ ID NO: 168115 - DNA, 25 bp, E. coli
caggaagtctgtaacatctgttcga

SEQ ID NO: 168116 - DNA, 25 bp, E. coli
caggaagtctgttacatctgttcga

SEQ ID NO: 168117 - DNA, 25 bp, E. coli
agtcggcgcagcctatggcgttcac

SEQ ID NO: 168118 - DNA, 25 bp, E. coli
agtcggcgcagcgtatggcgttcac

SEQ ID NO: 168119 - DNA, 25 bp, E. coli
ttatggaagcactgcgctgtctgcc

SEQ ID NO: 168120 - DNA, 25 bp, E. coli
ttatggaagcacagcgctgtctgcc

SEQ ID NO: 168121 - DNA, 25 bp, E. coli
tgaaggtgaagctaccgctaactac

SEQ ID NO: 168122 - DNA, 25 bp, E. coli
tgaaggtgaagcaaccgctaactac

SEQ ID NO: 168123 - DNA, 25 bp, E. coli
gcgtctggcagaggaaaaaatcact

SEQ ID NO: 168124 - DNA, 25 bp, E. coli
gcgtctggcagacgaaaaaatcact

SEQ ID NO: 168125 - DNA, 25 bp, E. coli
gcgcaatatgacctggaagccagcc

SEQ ID NO: 168126 - DNA, 25 bp, E. coli
gcgcaatatgacgtggaagccagcc

SEQ ID NO: 168127 - DNA, 25 bp, E. coli
gaagccagccgaatcgctcatggcg

SEQ ID NO: 168128 - DNA, 25 bp, E. coli
gaagccagccgattcgctcatggcg

SEQ ID NO: 168129 - DNA, 25 bp, E. coli
cgtcgtcaggaatacggtcaaatct

SEQ ID NO: 168130 - DNA, 25 bp, E. coli
cttgccgggcgtgataagattcgtt

SEQ ID NO: 168131 - DNA, 25 bp, E. coli
cttgccgggcgtcataagattcgtt

SEQ ID NO: 168132 - DNA, 25 bp, E. coli
cgtcgtcaggaaaacggtcaaatct

SEQ ID NO: 168133 - DNA, 25 bp, E. coli
tcaaatctgcgtcgtggagagtccg

SEQ ID NO: 168134 - DNA, 25 bp, E. coli
tcaaatctgcgtggtggagagtccg

SEQ ID NO: 168135 - DNA, 25 bp, E. coli
tcacccgggcgatgtcggaaatcgg

SEQ ID NO: 168136 - DNA, 25 bp, E. coli
tcacccgggcgaagtcggaaatcgg

SEQ ID NO: 168137 - DNA, 25 bp, E. coli
agcttaatgcgtggctcgccagtgg

SEQ ID NO: 168138 - DNA, 25 bp, E. coli
agcttaatgcgtcgctcgccagtgg

SEQ ID NO: 168139 - DNA, 25 bp, E. coli
aactctgaagctcatgccggaaaac

SEQ ID NO: 168140 - DNA, 25 bp, E. coli
aaacagcttaatgcgtggctcgcca

SEQ ID NO: 168141 - DNA, 25 bp, E. coli
aaacagcttaatccgtggctcgcca

SEQ ID NO: 168142 - DNA, 25 bp, E. coli
aaaacagcttaatgcgtggctcgcc

SEQ ID NO: 168143 - DNA, 25 bp, E. coli
aactctgaagctgatgccggaaaac

SEQ ID NO: 168144 - DNA, 25 bp, E. coli
aaaacagcttaaagcgtggctcgcc

SEQ ID NO: 168145 - DNA, 25 bp, E. coli
gccggaaaacagcttaatgcgtggc

SEQ ID NO: 168146 - DNA, 25 bp, E. coli
gccggaaaacaggttaatgcgtggc

SEQ ID NO: 168147 - DNA, 25 bp, E. coli
gcgtggctcgccagtggagggcttc

SEQ ID NO: 168148 - DNA, 25 bp, E. coli
gcgtggctcgcctgtggagggcttc

SEQ ID NO: 168149 - DNA, 25 bp, E. coli
gaactctgaagcagatgccggaaaa

SEQ ID NO: 168150 - DNA, 25 bp, E. coli
gaactctgaagctgatgccggaaaa

SEQ ID NO: 168151 - DNA, 25 bp, E. coli
gaaaacagcttaatgcgtggctcgc

SEQ ID NO: 168152 - DNA, 25 bp, E. coli
gaaaacagcttattgcgtggctcgc

SEQ ID NO: 168153 - DNA, 25 bp, E. coli
cggaaaacagctaaatgcgtggctc

SEQ ID NO: 168154 - DNA, 25 bp, E. coli
cggaaaacagcttaatgcgtggctc

SEQ ID NO: 168155 - DNA, 25 bp, E. coli
ggaactctgaaggtgatgccggaaa

SEQ ID NO: 168156 - DNA, 25 bp, E. coli
ggaactctgaagctgatgccggaaa

SEQ ID NO: 168157 - DNA, 25 bp, E. coli
taatgcgtggctggccagtggaggg

SEQ ID NO: 168158 - DNA, 25 bp, E. coli
taatgcgtggctcgccagtggaggg

SEQ ID NO: 168159 - DNA, 25 bp, E. coli
aacgctggcagtcagttcattaagc

SEQ ID NO: 168160 - DNA, 25 bp, E. coli
aacgctggcagtgagttcattaagc

SEQ ID NO: 168161 - DNA, 25 bp, E. coli
ttcaggcgataagtggcatccgggt

SEQ ID NO: 168162 - DNA, 25 bp, E. coli
ttcaggcgataactggcatccgggt

SEQ ID NO: 168163 - DNA, 25 bp, E. coli
tgaagtcggttctggcgataactgg

SEQ ID NO: 168164 - DNA, 25 bp, E. coli
tgaagtcggttcaggcgataactgg

SEQ ID NO: 168165 - DNA, 25 bp, E. coli
tagttaccgctgccgtcatggcctc

SEQ ID NO: 168166 - DNA, 25 bp, E. coli
tccgggtgaagatcttacgcagcgc

SEQ ID NO: 168167 - DNA, 25 bp, E. coli
tccgggtgaagaacttacgcagcgc

SEQ ID NO: 168168 - DNA, 25 bp, E. coli
tagttaccgctggcgtcatggcctc

SEQ ID NO: 168169 - DNA, 25 bp, E. coli
tcatggcctcaaggctggcagtcag

SEQ ID NO: 168170 - DNA, 25 bp, E. coli
tcatggcctcaacgctggcagtcag

SEQ ID NO: 168171 - DNA, 25 bp, E. coli
gcgataactggcatccgggtgaaga

SEQ ID NO: 168172 - DNA, 25 bp, E. coli
gcagagccatatgttcgacggcata

SEQ ID NO: 168173 - DNA, 25 bp, E. coli
gcgataactggcttccgggtgaaga

SEQ ID NO: 168174 - DNA, 25 bp, E. coli
gcagagccatatcttcgacggcata

SEQ ID NO: 168175 - DNA, 25 bp, E. coli
gtcagttcattatgccacgctgctg

SEQ ID NO: 168176 - DNA, 25 bp, E. coli
gtcagttcattaagccacgctgctg

SEQ ID NO: 168177 - DNA, 25 bp, E. coli
tggcatccgggtcaagaacttacgc

SEQ ID NO: 168178 - DNA, 25 bp, E. coli
tggcatccgggtgaagaacttacgc

SEQ ID NO: 168179 - DNA, 25 bp, E. coli
taagccacgctggtgaagtcggttc

SEQ ID NO: 168180 - DNA, 25 bp, E. coli
taagccacgctgctgaagtcggttc

SEQ ID NO: 168181 - DNA, 25 bp, E. coli
aagggttttcatgccttgcaggcct

SEQ ID NO: 168182 - DNA, 25 bp, E. coli
aagggttttcatcccttgcaggcct

SEQ ID NO: 168183 - DNA, 25 bp, E. coli
cagacagcgataagccatcaatgga

SEQ ID NO: 168184 - DNA, 25 bp, E. coli
ccaggtttctgtcacgttccaggtc

SEQ ID NO: 168185 - DNA, 25 bp, E. coli
ccaggtttctgtgacgttccaggtc

SEQ ID NO: 168186 - DNA, 25 bp, E. coli
cggtaaaccagagagcgataagcca

SEQ ID NO: 168187 - DNA, 25 bp, E. coli
cagacagcgatatgccatcaatgga

SEQ ID NO: 168188 - DNA, 25 bp, E. coli
cggtaaaccagacagcgataagcca

SEQ ID NO: 168189 - DNA, 25 bp, E. coli
tattaaccatacatttgagtatggg

SEQ ID NO: 168190 - DNA, 25 bp, E. coli
tattaaccatacttttgagtatggg

SEQ ID NO: 168191 - DNA, 25 bp, E. coli
gccatcaatggaaatggaccagcat

SEQ ID NO: 168192 - DNA, 25 bp, E. coli
gccatcaatggatatggaccagcat

SEQ ID NO: 168193 - DNA, 25 bp, E. coli
gcgttccggctcgtattgtcggtaa

SEQ ID NO: 168194 - DNA, 25 bp, E. coli
gcgttccggctcctattgtcggtaa

SEQ ID NO: 168195 - DNA, 25 bp, E. coli
gcaaaaccaggtatctgtgacgttc

SEQ ID NO: 168196 - DNA, 25 bp, E. coli
gcaaaaccaggtttctgtgacgttc

SEQ ID NO: 168197 - DNA, 25 bp, E. coli
cggctcgtattgtcggtaaaccaga

SEQ ID NO: 168198 - DNA, 25 bp, E. coli
cggctcgtattgacggtaaaccaga

SEQ ID NO: 168199 - DNA, 25 bp, E. coli
tggcaatctttctgcaaaaccaggt

SEQ ID NO: 168200 - DNA, 25 bp, E. coli
tggcaatctttcagcaaaaccaggt

SEQ ID NO: 168201 - DNA, 25 bp, E. coli
tcaaccccgttgttatacctgaagg

SEQ ID NO: 168202 - DNA, 25 bp, E. coli
tcaaccccgttgatatacctgaagg

SEQ ID NO: 168203 - DNA, 25 bp, E. coli
tacagaaattgagacatcagatgcc

SEQ ID NO: 168204 - DNA, 25 bp, E. coli
tacagaaattgacacatcagatgcc

SEQ ID NO: 168205 - DNA, 25 bp, E. coli
tatagcaaatgctctaccggcaggc

SEQ ID NO: 168206 - DNA, 25 bp, E. coli
tatagcaaatgcactaccggcaggc

SEQ ID NO: 168207 - DNA, 25 bp, E. coli
tgttaacgtcatatacagaaattga

SEQ ID NO: 168208 - DNA, 25 bp, E. coli
tgttaacgtcatttacagaaattga

SEQ ID NO: 168209 - DNA, 25 bp, E. coli
tgcactaccggctggcatctgactt

SEQ ID NO: 168210 - DNA, 25 bp, E. coli
tgcactaccggcaggcatctgactt

SEQ ID NO: 168211 - DNA, 25 bp, E. coli
tgacacatcagatgcctgctttacg

SEQ ID NO: 168212 - DNA, 25 bp, E. coli
tgacacatcagaagcctgctttacg

SEQ ID NO: 168213 - DNA, 25 bp, E. coli
gactttccgcgtgactttgttaacg

SEQ ID NO: 168214 - DNA, 25 bp, E. coli
gactttccgcgtcactttgttaacg

SEQ ID NO: 168215 - DNA, 25 bp, E. coli
gcatctgactttccgcgtgactttg

SEQ ID NO: 168216 - DNA, 25 bp, E. coli
gcatctgactttgcgcgtgactttg

SEQ ID NO: 168217 - DNA, 25 bp, E. coli
gaaattgacacatcagatgcctgct

SEQ ID NO: 168218 - DNA, 25 bp, E. coli
gaaattgacacaacagatgcctgct

SEQ ID NO: 168219 - DNA, 25 bp, E. coli
cgcgtgactttgataacgtcattta

SEQ ID NO: 168220 - DNA, 25 bp, E. coli
cgcgtgactttgttaacgtcattta

SEQ ID NO: 168221 - DNA, 25 bp, E. coli
gtgccctactattgcaaatgcacta

SEQ ID NO: 168222 - DNA, 25 bp, E. coli
gtgccctactatagcaaatgcacta

SEQ ID NO: 168223 - DNA, 25 bp, E. coli
ggcaggcatctgtctttccgcgtga

SEQ ID NO: 168224 - DNA, 25 bp, E. coli
ggcaggcatctgactttccgcgtga

SEQ ID NO: 168225 - DNA, 25 bp, E. coli
aatcccacgacctccgggcataaag

SEQ ID NO: 168226 - DNA, 25 bp, E. coli
aatcccacgaccaccgggcataaag

SEQ ID NO: 168227 - DNA, 25 bp, E. coli
tagcggcaagtggtcgtcctggacc

SEQ ID NO: 168228 - DNA, 25 bp, E. coli
tagcggcaagtgctcgtcctggacc

SEQ ID NO: 168229 - DNA, 25 bp, E. coli
tgactaatggggtcgcttacgtgac

SEQ ID NO: 168230 - DNA, 25 bp, E. coli
tgactaatggggacgcttacgtgac

SEQ ID NO: 168231 - DNA, 25 bp, E. coli
tctttggcggttgactaatggggac

SEQ ID NO: 168232 - DNA, 25 bp, E. coli
tctttggcggttcactaatggggac

SEQ ID NO: 168233 - DNA, 25 bp, E. coli
tcctggacccgtggtcgttgattta

SEQ ID NO: 168234 - DNA, 25 bp, E. coli
tcctggacccgtcgtcgttgattta

SEQ ID NO: 168235 - DNA, 25 bp, E. coli
ctggatcaactcaggcggcctcggc

SEQ ID NO: 168236 - DNA, 25 bp, E. coli
ctggctagcggctagtggtcgtcct

SEQ ID NO: 168237 - DNA, 25 bp, E. coli
cgtcgctggatctactctggcggcc

SEQ ID NO: 168238 - DNA, 25 bp, E. coli
ctggatcaactctggcggcctcggc

SEQ ID NO: 168239 - DNA, 25 bp, E. coli
ctggctagcggcaagtggtcgtcct

SEQ ID NO: 168240 - DNA, 25 bp, E. coli
cgtcgctggatcaactctggcggcc

SEQ ID NO: 168241 - DNA, 25 bp, E. coli
tggtcgtcctggtcccgtggtcgtt

SEQ ID NO: 168242 - DNA, 25 bp, E. coli
tggtcgtcctggacccgtggtcgtt

SEQ ID NO: 168243 - DNA, 25 bp, E. coli
gatccaacctcattttctaaaaccg

SEQ ID NO: 168244 - DNA, 25 bp, E. coli
gacctccgggcataaagggcaaatt

SEQ ID NO: 168245 - DNA, 25 bp, E. coli
gatccaacctcaatttctaaaaccg

SEQ ID NO: 168246 - DNA, 25 bp, E. coli
gacctccgggcaaaaagggcaaatt

SEQ ID NO: 168247 - DNA, 25 bp, E. coli
atctgacaccgtggaatgggatgac

SEQ ID NO: 168248 - DNA, 25 bp, E. coli
atctgacaccgtcgaatgggatgac

SEQ ID NO: 168249 - DNA, 25 bp, E. coli
aaaattatcctcgtggagccacggc

SEQ ID NO: 168250 - DNA, 25 bp, E. coli
aaaattatcctcctggagccacggc

SEQ ID NO: 168251 - DNA, 25 bp, E. coli
tatggccggtgttcattcactacgc

SEQ ID NO: 168252 - DNA, 25 bp, E. coli
tatggccggtgtacattcactacgc

SEQ ID NO: 168253 - DNA, 25 bp, E. coli
ttatcctcctggagccacggcgtct

SEQ ID NO: 168254 - DNA, 25 bp, E. coli
ttatcctcctggtgccacggcgtct

SEQ ID NO: 168255 - DNA, 25 bp, E. coli
tgatgccgacgacgcgctaagtcgc

SEQ ID NO: 168256 - DNA, 25 bp, E. coli
tgctgccacataaggccggtgtaca

SEQ ID NO: 168257 - DNA, 25 bp, E. coli
tgatgccgacgaggcgctaagtcgc

SEQ ID NO: 168258 - DNA, 25 bp, E. coli
tgctgccacatatggccggtgtaca

SEQ ID NO: 168259 - DNA, 25 bp, E. coli
tgcagcaatctgtcaccgtggaatg

SEQ ID NO: 168260 - DNA, 25 bp, E. coli
tgcagcaatctgacaccgtggaatg

SEQ ID NO: 168261 - DNA, 25 bp, E. coli
tcagcgaatcagtcaggcgtcgatg

SEQ ID NO: 168262 - DNA, 25 bp, E. coli
gcggttgattacacagcgaatcagt

SEQ ID NO: 168263 - DNA, 25 bp, E. coli
gcggttgattactcagcgaatcagt

SEQ ID NO: 168264 - DNA, 25 bp, E. coli
gctgtccgcagcaggtgcagcaatc

SEQ ID NO: 168265 - DNA, 25 bp, E. coli
gctgtccgcagctggtgcagcaatc

SEQ ID NO: 168266 - DNA, 25 bp, E. coli
ggcgtatcgtgaggtgcaaaaggag

SEQ ID NO: 168267 - DNA, 25 bp, E. coli
ggcgtatcgtgacgtgcaaaaggag

SEQ ID NO: 168268 - DNA, 25 bp, E. coli
tcagcgaatcagacaggcgtcgatg

SEQ ID NO: 168269 - DNA, 25 bp, E. coli
cagcggagagtcattgtctgtcacc

SEQ ID NO: 168270 - DNA, 25 bp, E. coli
cagcggagagtctttgtctgtcacc

SEQ ID NO: 168271 - DNA, 25 bp, E. coli
taaaaaattactcgcgcatcttgat

SEQ ID NO: 168272 - DNA, 25 bp, E. coli
taaaaaattactggcgcatcttgat

SEQ ID NO: 168273 - DNA, 25 bp, E. coli
aaaaaatcagtcagacatctgaagg

SEQ ID NO: 168274 - DNA, 25 bp, E. coli
aaaaaatcagtctgacatctgaagg

SEQ ID NO: 168275 - DNA, 25 bp, E. coli
tatgttttttatacagaggctcact

SEQ ID NO: 168276 - DNA, 25 bp, E. coli
tagcagggaggaacgccgtgctaaa

SEQ ID NO: 168277 - DNA, 25 bp, E. coli
tagcagggaggatcgccgtgctaaa

SEQ ID NO: 168278 - DNA, 25 bp, E. coli
tatgttttttattcagaggctcact

SEQ ID NO: 168279 - DNA, 25 bp, E. coli
tatctgacccatcatgaacaggaac

SEQ ID NO: 168280 - DNA, 25 bp, E. coli
tatctgacccatgatgaacaggaac

SEQ ID NO: 168281 - DNA, 25 bp, E. coli
tgtcaccttcagtgataagccagaa

SEQ ID NO: 168282 - DNA, 25 bp, E. coli
tgtcaccttcagagataagccagaa

SEQ ID NO: 168283 - DNA, 25 bp, E. coli
tgcgcgcttgtagacagacagtgtg

SEQ ID NO: 168284 - DNA, 25 bp, E. coli
tgcgcgcttgtacacagacagtgtg

SEQ ID NO: 168285 - DNA, 25 bp, E. coli
gaactaatattagccgcattacaga

SEQ ID NO: 168286 - DNA, 25 bp, E. coli
gaactaatattacccgcattacaga

SEQ ID NO: 168287 - DNA, 25 bp, E. coli
gacagtgtgtttgagtaatatggag

SEQ ID NO: 168288 - DNA, 25 bp, E. coli
gacagtgtgtttcagtaatatggag

SEQ ID NO: 168289 - DNA, 25 bp, E. coli
gaggctcactctagcacaaagcatg

SEQ ID NO: 168290 - DNA, 25 bp, E. coli
gaggctcactcttgcacaaagcatg

SEQ ID NO: 168291 - DNA, 25 bp, E. coli
caacgttgttgtcagcgtgctcacc

SEQ ID NO: 168292 - DNA, 25 bp, E. coli
caacagccaggtgagcgatggtagc

SEQ ID NO: 168293 - DNA, 25 bp, E. coli
caacgttgttgtgagcgtgctcacc

SEQ ID NO: 168294 - DNA, 25 bp, E. coli
caacagccaggtcagcgatggtagc

SEQ ID NO: 168295 - DNA, 25 bp, E. coli
tagaattcagaacctgcgcagtcca

SEQ ID NO: 168296 - DNA, 25 bp, E. coli
tagaattcagaagctgcgcagtcca

SEQ ID NO: 168297 - DNA, 25 bp, E. coli
ttcacgggaaccagtagaagcacct

SEQ ID NO: 168298 - DNA, 25 bp, E. coli
ttcacgggaacctgtagaagcacct

SEQ ID NO: 168299 - DNA, 25 bp, E. coli
gcgcagttccagtgcttcacgggaa

SEQ ID NO: 168300 - DNA, 25 bp, E. coli
gcgcagttccagagcttcacgggaa

SEQ ID NO: 168301 - DNA, 25 bp, E. coli
gaaaacttcagatcccatgcggatg

SEQ ID NO: 168302 - DNA, 25 bp, E. coli
gaaaacttcagaacccatgcggatg

SEQ ID NO: 168303 - DNA, 25 bp, E. coli
gataacagccagagcttcagcgttg

SEQ ID NO: 168304 - DNA, 25 bp, E. coli
gatacagccaggattgcgttcgcgc

SEQ ID NO: 168305 - DNA, 25 bp, E. coli
gatacagccaggtttgcgttcgcgc

SEQ ID NO: 168306 - DNA, 25 bp, E. coli
gataacagccagtgcttcagcgttg

SEQ ID NO: 168307 - DNA, 25 bp, E. coli
ggcatacctttagcagctgcagcag

SEQ ID NO: 168308 - DNA, 25 bp, E. coli
ggaaacgggattagtcgccatcgcg

SEQ ID NO: 168309 - DNA, 25 bp, E. coli
ggaaacgggatttgtcgccatcgcg

SEQ ID NO: 168310 - DNA, 25 bp, E. coli
ggcatacctttaccagctgcagcag

SEQ ID NO: 168311 - DNA, 25 bp, E. coli
tcagcgatgtgctcgtacagcggca

SEQ ID NO: 168312 - DNA, 25 bp, E. coli
tcagcgatgtgcacgtacagcggca

SEQ ID NO: 168313 - DNA, 25 bp, E. coli
agttcattgcgaaaccatctagcca

SEQ ID NO: 168314 - DNA, 25 bp, E. coli
agttcattgcgataccatctagcca

SEQ ID NO: 168315 - DNA, 25 bp, E. coli
tagtgagtacacgagcaaaacgctt

SEQ ID NO: 168316 - DNA, 25 bp, E. coli
tagtgagtacaccagcaaaacgctt

SEQ ID NO: 168317 - DNA, 25 bp, E. coli
tatccttatttgcagtggtgaccca

SEQ ID NO: 168318 - DNA, 25 bp, E. coli
tatccttatttggagtggtgaccca

SEQ ID NO: 168319 - DNA, 25 bp, E. coli
tgaatccagcaaagttcgttgcgtg

SEQ ID NO: 168320 - DNA, 25 bp, E. coli
tgaatccagcaatgttcgttgcgtg

SEQ ID NO: 168321 - DNA, 25 bp, E. coli
tccacccggttgtgcgatgttaaca

SEQ ID NO: 168322 - DNA, 25 bp, E. coli
tccacccggttgagcgatgttaaca

SEQ ID NO: 168323 - DNA, 25 bp, E. coli
tctgaaaggttttctgcgagcggat

SEQ ID NO: 168324 - DNA, 25 bp, E. coli
tctgaaaggtttactgcgagcggat

SEQ ID NO: 168325 - DNA, 25 bp, E. coli
gcgagcggatttacagcagcataaa

SEQ ID NO: 168326 - DNA, 25 bp, E. coli
gcgagcggattttcagcagcataaa

SEQ ID NO: 168327 - DNA, 25 bp, E. coli
cgtgcacatttccttctggcgataa

SEQ ID NO: 168328 - DNA, 25 bp, E. coli
cgtgcacatttcgttctggcgataa

SEQ ID NO: 168329 - DNA, 25 bp, E. coli
ggagattgtacctttccgtttcaca

SEQ ID NO: 168330 - DNA, 25 bp, E. coli
ggagattgtaccattccgtttcaca

SEQ ID NO: 168331 - DNA, 25 bp, E. coli
tggttcgcaatcaggtacacaaatg

SEQ ID NO: 168332 - DNA, 25 bp, E. coli
tggttcgcaatctggtacacaaatg

SEQ ID NO: 168333 - DNA, 25 bp, E. coli
taacatcacggtgcgtctgaaaggt

SEQ ID NO: 168334 - DNA, 25 bp, E. coli
taacatcacggtccgtctgaaaggt

SEQ ID NO: 168335 - DNA, 25 bp, E. coli
caactaggtttcgaatgccatccaa

SEQ ID NO: 168336 - DNA, 25 bp, E. coli
caactaggtttccaatgccatccaa

SEQ ID NO: 168337 - DNA, 25 bp, E. coli
tagtgcttactctttgcttgggaaa

SEQ ID NO: 168338 - DNA, 25 bp, E. coli
tagtgcttactcattgcttgggaaa

SEQ ID NO: 168339 - DNA, 25 bp, E. coli
tatatcacacagtgcttagagacgc

SEQ ID NO: 168340 - DNA, 25 bp, E. coli
tatatcacacagagcttagagacgc

SEQ ID NO: 168341 - DNA, 25 bp, E. coli
tttagttagtgacagatgcgatgcc

SEQ ID NO: 168342 - DNA, 25 bp, E. coli
tttagttagtgagagatgcgatgcc

SEQ ID NO: 168343 - DNA, 25 bp, E. coli
tgcttgggcaactgaaaaggatgtc

SEQ ID NO: 168344 - DNA, 25 bp, E. coli
tgcttgggcaacagaaaaggatgtc

SEQ ID NO: 168345 - DNA, 25 bp, E. coli
gaaggcgcagaagtcaatgctcgag

SEQ ID NO: 168346 - DNA, 25 bp, E. coli
gaaggcgcagaactcaatgctcgag

SEQ ID NO: 168347 - DNA, 25 bp, E. coli
gacaattactgcttaaagaaggcgc

SEQ ID NO: 168348 - DNA, 25 bp, E. coli
gacttgggttaacagacttgcagca

SEQ ID NO: 168349 - DNA, 25 bp, E. coli
gacaattactgcataaagaaggcgc

SEQ ID NO: 168350 - DNA, 25 bp, E. coli
gacttgggttaagagacttgcagca

SEQ ID NO: 168351 - DNA, 25 bp, E. coli
cgtgaaacacggaggaagctggaat

SEQ ID NO: 168352 - DNA, 25 bp, E. coli
cgtgaaacacggtggaagctggaat

SEQ ID NO: 168353 - DNA, 25 bp, E. coli
tcacttactgtgttgatggagagca

SEQ ID NO: 168354 - DNA, 25 bp, E. coli
tcacttactgtgatgatggagagca

SEQ ID NO: 168355 - DNA, 25 bp, E. coli
gagggatctcgcataccaaaaaacg

SEQ ID NO: 168356 - DNA, 25 bp, E. coli
gagggatctcgcttaccaaaaaacg

SEQ ID NO: 168357 - DNA, 25 bp, E. coli
caacgcgtactgattgtgggcgcca

SEQ ID NO: 168358 - DNA, 25 bp, E. coli
caacgcgtactgtttgtgggcgcca

SEQ ID NO: 168359 - DNA, 25 bp, E. coli
cagggctgctgcaattgggtaaaca

SEQ ID NO: 168360 - DNA, 25 bp, E. coli
cagggctgctgctattgggtaaaca

SEQ ID NO: 168361 - DNA, 25 bp, E. coli
cagttccttacatacgctggcgcag

SEQ ID NO: 168362 - DNA, 25 bp, E. coli
cagttccttacaaacgctggcgcag

SEQ ID NO: 168363 - DNA, 25 bp, E. coli
tttgtcgcagaccatcaggagaacg

SEQ ID NO: 168364 - DNA, 25 bp, E. coli
tttgtcgcagacgatcaggagaacg

SEQ ID NO: 168365 - DNA, 25 bp, E. coli
tcgccggaacagataaccaggatgc

SEQ ID NO: 168366 - DNA, 25 bp, E. coli
tcgccggaacagttaaccaggatgc

SEQ ID NO: 168367 - DNA, 25 bp, E. coli
gcggcgtacacgacattcaggagca

SEQ ID NO: 168368 - DNA, 25 bp, E. coli
gcgttatcacgtttatggcagcaga

SEQ ID NO: 168369 - DNA, 25 bp, E. coli
gcgttatcacgtatatggcagcaga

SEQ ID NO: 168370 - DNA, 25 bp, E. coli
gcggcgtacacgtcattcaggagca

SEQ ID NO: 168371 - DNA, 25 bp, E. coli
gaaggtcatcttacgctggaggcga

SEQ ID NO: 168372 - DNA, 25 bp, E. coli
gaaggtcatctttcgctggaggcga

SEQ ID NO: 168373 - DNA, 25 bp, E. coli
gacagttgctcttctccactctgga

SEQ ID NO: 168374 - DNA, 25 bp, E. coli
gacagttgctctactccactctgga

SEQ ID NO: 168375 - DNA, 25 bp, E. coli
gattttacgtaacaccggcaatgcg

SEQ ID NO: 168376 - DNA, 25 bp, E. coli
gattttacgtaagaccggcaatgcg

SEQ ID NO: 168377 - DNA, 25 bp, E. coli
gacgatccagatatgcatagcctta

SEQ ID NO: 168378 - DNA, 25 bp, E. coli
gacgatccagatttgcatagcctta

SEQ ID NO: 168379 - DNA, 25 bp, E. coli
caaagctggtggcaattgtgactca

SEQ ID NO: 168380 - DNA, 25 bp, E. coli
caaagctggtgggaattgtgactca

SEQ ID NO: 168381 - DNA, 25 bp, E. coli
cagtttgctggctgcgtgtcgacaa

SEQ ID NO: 168382 - DNA, 25 bp, E. coli
cagtttgctggcagcgtgtcgacaa

SEQ ID NO: 168383 - DNA, 25 bp, E. coli
acgctggcaacggaagactgtggac

SEQ ID NO: 168384 - DNA, 25 bp, E. coli
acgctggcaacgcaagactgtggac

SEQ ID NO: 168385 - DNA, 25 bp, E. coli
tgtccatatcaatacggatgcgggt

SEQ ID NO: 168386 - DNA, 25 bp, E. coli
tgtcgacaatcaccgaaggcgcagt

SEQ ID NO: 168387 - DNA, 25 bp, E. coli
tgtccatatcaaaacggatgcgggt

SEQ ID NO: 168388 - DNA, 25 bp, E. coli
tgtcgacaatcagcgaaggcgcagt

SEQ ID NO: 168389 - DNA, 25 bp, E. coli
tctggcgaaaggcaaagaagcgatt

SEQ ID NO: 168390 - DNA, 25 bp, E. coli
tctggcgaaagggaaagaagcgatt

SEQ ID NO: 168391 - DNA, 25 bp, E. coli
ccggaacagttaccgcagtagcaat

SEQ ID NO: 168392 - DNA, 25 bp, E. coli
ccggaacagttagcgcagtagcaat

SEQ ID NO: 168393 - DNA, 25 bp, E. coli
gaaatgaaactctccactggctcgc

SEQ ID NO: 168394 - DNA, 25 bp, E. coli
gaaatgaaactcaccactggctcgc

SEQ ID NO: 168395 - DNA, 25 bp, E. coli
gactgaaattctctgctcgcaacca

SEQ ID NO: 168396 - DNA, 25 bp, E. coli
gactgaaattctgtgctcgcaacca

SEQ ID NO: 168397 - DNA, 25 bp, E. coli
gattgccctgattaaagccccgtgg

SEQ ID NO: 168398 - DNA, 25 bp, E. coli
gattgccctgataaaagccccgtgg

SEQ ID NO: 168399 - DNA, 25 bp, E. coli
ggctcgcgcgtttttgcattgatca

SEQ ID NO: 168400 - DNA, 25 bp, E. coli
ggctcgcgcgttattgcattgatca

SEQ ID NO: 168401 - DNA, 25 bp, E. coli
cacgcttgcgtcatgcagttgcaga

SEQ ID NO: 168402 - DNA, 25 bp, E. coli
cacgcttgcgtcttgcagttgcaga

SEQ ID NO: 168403 - DNA, 25 bp, E. coli
cagtcaccggtgtatgtggcgatct

SEQ ID NO: 168404 - DNA, 25 bp, E. coli
cagactggcatcagattatggcggc

SEQ ID NO: 168405 - DNA, 25 bp, E. coli
cagttgcagatacgttcgcgatggt

SEQ ID NO: 168406 - DNA, 25 bp, E. coli
catcttaattgcttggccatacggt

SEQ ID NO: 168407 - DNA, 25 bp, E. coli
cagactggcatctgattatggcggc

SEQ ID NO: 168408 - DNA, 25 bp, E. coli
cagtcaccggtgaatgtggcgatct

SEQ ID NO: 168409 - DNA, 25 bp, E. coli
cagttgcagataggttcgcgatggt

SEQ ID NO: 168410 - DNA, 25 bp, E. coli
catcttaattgcatggccatacggt

SEQ ID NO: 168411 - DNA, 25 bp, E. coli
taaagtcagccgataccagcaggta

SEQ ID NO: 168412 - DNA, 25 bp, E. coli
taaagtcagccgttaccagcaggta

SEQ ID NO: 168413 - DNA, 25 bp, E. coli
aaaatctggcggttatcctggctta

SEQ ID NO: 168414 - DNA, 25 bp, E. coli
aaaatctggcggatatcctggctta

SEQ ID NO: 168415 - DNA, 25 bp, E. coli
tatgcgcgcggctcgcaaagttagc

SEQ ID NO: 168416 - DNA, 25 bp, E. coli
tatgcgcgcggcacgcaaagttagc

SEQ ID NO: 168417 - DNA, 25 bp, E. coli
tctccggaatgagcttcgaacagtc

SEQ ID NO: 168418 - DNA, 25 bp, E. coli
tctccggaatgaccttcgaacagtc

SEQ ID NO: 168419 - DNA, 25 bp, E. coli
gcccgtcgggctcgataaaaaatct

SEQ ID NO: 168420 - DNA, 25 bp, E. coli
gcccgtcgggctggataaaaaatct

SEQ ID NO: 168421 - DNA, 25 bp, E. coli
gctacttcctcgattattgccgccg

SEQ ID NO: 168422 - DNA, 25 bp, E. coli
gctacttcctcgtttattgccgccg

SEQ ID NO: 168423 - DNA, 25 bp, E. coli
agcgggttaacgatcaaactggcga

SEQ ID NO: 168424 - DNA, 25 bp, E. coli
acgatgttcgttgtggttgccttga

SEQ ID NO: 168425 - DNA, 25 bp, E. coli
accgcgccgacttcctcaaattgag

SEQ ID NO: 168426 - DNA, 25 bp, E. coli
agcgggttaacgttcaaactggcga

SEQ ID NO: 168427 - DNA, 25 bp, E. coli
accgcgccgactacctcaaattgag

SEQ ID NO: 168428 - DNA, 25 bp, E. coli
acgatgttcgttctggttgccttga

SEQ ID NO: 168429 - DNA, 25 bp, E. coli
tatgattatcgttatacctttcccc

SEQ ID NO: 168430 - DNA, 25 bp, E. coli
tatgattatcgtaatacctttcccc

SEQ ID NO: 168431 - DNA, 25 bp, E. coli
tattcgttgtttttctgtgccccga

SEQ ID NO: 168432 - DNA, 25 bp, E. coli
tattcgttgtttatctgtgccccga

SEQ ID NO: 168433 - DNA, 25 bp, E. coli
tgatggtctgcgtggtcattatgac

SEQ ID NO: 168434 - DNA, 25 bp, E. coli
tgaccattcccataaacaacatatt

SEQ ID NO: 168435 - DNA, 25 bp, E. coli
tgatggtctgcgaggtcattatgac

SEQ ID NO: 168436 - DNA, 25 bp, E. coli
tgaccattcccaaaaacaacatatt

SEQ ID NO: 168437 - DNA, 25 bp, E. coli
tcccgaaaatatcagcgggttaacg

SEQ ID NO: 168438 - DNA, 25 bp, E. coli
tcccgaaaatatgagcgggttaacg

SEQ ID NO: 168439 - DNA, 25 bp, E. coli
ggtaaaagctcctaccgtaacgatg

SEQ ID NO: 168440 - DNA, 25 bp, E. coli
ggtaaaagctccaaccgtaacgatg

SEQ ID NO: 168441 - DNA, 25 bp, E. coli
tcaaattgaggacgtcgaaagtatc

SEQ ID NO: 168442 - DNA, 25 bp, E. coli
tcaaattgaggaggtcgaaagtatc

SEQ ID NO: 168443 - DNA, 25 bp, E. coli
tgtgccccgaccacctcaaattgag

SEQ ID NO: 168444 - DNA, 25 bp, E. coli
tgtgccccgacctcctcaaattgag

SEQ ID NO: 168445 - DNA, 25 bp, E. coli
aacggccgagggtaaagccagtgca

SEQ ID NO: 168446 - DNA, 25 bp, E. coli
aacggccgagggaaaagccagtgca

SEQ ID NO: 168447 - DNA, 25 bp, E. coli
gcgccaccgaccagggaacgtattt

SEQ ID NO: 168448 - DNA, 25 bp, E. coli
ccattgcggagtttctggaagatcg

SEQ ID NO: 168449 - DNA, 25 bp, E. coli
ccattgcggagtatctggaagatcg

SEQ ID NO: 168450 - DNA, 25 bp, E. coli
gcgccaccgacctgggaacgtattt

SEQ ID NO: 168451 - DNA, 25 bp, E. coli
gcaaggttacggacagacacgccgt

SEQ ID NO: 168452 - DNA, 25 bp, E. coli
gcaaggttacggtcagacacgccgt

SEQ ID NO: 168453 - DNA, 25 bp, E. coli
cattgctgatacagatctggcgcta

SEQ ID NO: 168454 - DNA, 25 bp, E. coli
cattgctgatactgatctggcgcta

SEQ ID NO: 168455 - DNA, 25 bp, E. coli
cattccagtggctgcgagcgtctgt

SEQ ID NO: 168456 - DNA, 25 bp, E. coli
cattccagtggcagcgagcgtctgt

SEQ ID NO: 168457 - DNA, 25 bp, E. coli
gattaaccgcctcgtactacatggc

SEQ ID NO: 168458 - DNA, 25 bp, E. coli
gatttagaaaatggtgcgcgtgcac

SEQ ID NO: 168459 - DNA, 25 bp, E. coli
gattaaccgcctggtactacatggc

SEQ ID NO: 168460 - DNA, 25 bp, E. coli
gatttagaaaatcgtgcgcgtgcac

SEQ ID NO: 168461 - DNA, 25 bp, E. coli
tggaagatcgatatgcgccaccgac

SEQ ID NO: 168462 - DNA, 25 bp, E. coli
tggaagatcgatttgcgccaccgac

SEQ ID NO: 168463 - DNA, 25 bp, E. coli
gaccatcgacctcgacagcggtgaa

SEQ ID NO: 168464 - DNA, 25 bp, E. coli
gagtaaacccgctatcacgctttgg

SEQ ID NO: 168465 - DNA, 25 bp, E. coli
gagtaaacccgcaatcacgctttgg

SEQ ID NO: 168466 - DNA, 25 bp, E. coli
gaccatcgacctggacagcggtgaa

SEQ ID NO: 168467 - DNA, 25 bp, E. coli
actgtcggtgccatcgttgggatga

SEQ ID NO: 168468 - DNA, 25 bp, E. coli
actgtcggtgccttcgttgggatga

SEQ ID NO: 168469 - DNA, 25 bp, E. coli
aaatggcggcgctgtcgatttgtat

SEQ ID NO: 168470 - DNA, 25 bp, E. coli
aactactccggtccgcaaatggcgg

SEQ ID NO: 168471 - DNA, 25 bp, E. coli
aaaacctggaccatgatggaaacca

SEQ ID NO: 168472 - DNA, 25 bp, E. coli
aaatggcggcgcagtcgatttgtat

SEQ ID NO: 168473 - DNA, 25 bp, E. coli
aaaacctggaccttgatggaaacca

SEQ ID NO: 168474 - DNA, 25 bp, E. coli
aactactccggtgcgcaaatggcgg

SEQ ID NO: 168475 - DNA, 25 bp, E. coli
ttgttgtcagcctcgttaacgacgc

SEQ ID NO: 168476 - DNA, 25 bp, E. coli
ttgttgtcagccacgttaacgacgc

SEQ ID NO: 168477 - DNA, 25 bp, E. coli
tgaacaactgaactactccggtgcg

SEQ ID NO: 168478 - DNA, 25 bp, E. coli
tgcagtgcgcatcattcagggttct

SEQ ID NO: 168479 - DNA, 25 bp, E. coli
tgcagtgcgcatgattcagggttct

SEQ ID NO: 168480 - DNA, 25 bp, E. coli
tgaacaactgaagtactccggtgcg

SEQ ID NO: 168481 - DNA, 25 bp, E. coli
ccatcgttgggaagattgcgttcca

SEQ ID NO: 168482 - DNA, 25 bp, E. coli
ccatcgttgggatgattgcgttcca

SEQ ID NO: 168483 - DNA, 25 bp, E. coli
gattgcgttccacctgttgagttaa

SEQ ID NO: 168484 - DNA, 25 bp, E. coli
gattgcgttccagctgttgagttaa

SEQ ID NO: 168485 - DNA, 25 bp, E. coli
ggttcgattgttgtcagccacgtta

SEQ ID NO: 168486 - DNA, 25 bp, E. coli
ggttcgattgttctcagccacgtta

SEQ ID NO: 168487 - DNA, 25 bp, E. coli
ggaaaccatcctcggcactgtcggt

SEQ ID NO: 168488 - DNA, 25 bp, E. coli
ggaaaccatcctgggcactgtcggt

SEQ ID NO: 168489 - DNA, 25 bp, E. coli
tacacgtagcgcagcgtccggaaaa

SEQ ID NO: 168490 - DNA, 25 bp, E. coli
tacacgtagcgctgcgtccggaaaa

SEQ ID NO: 168491 - DNA, 25 bp, E. coli
agtcgatgcggatgcttcagtggtc

SEQ ID NO: 168492 - DNA, 25 bp, E. coli
atgcggatgcttgagtggtcgataa

SEQ ID NO: 168493 - DNA, 25 bp, E. coli
agtcgatgcggaagcttcagtggtc

SEQ ID NO: 168494 - DNA, 25 bp, E. coli
atgcggatgcttcagtggtcgataa

SEQ ID NO: 168495 - DNA, 25 bp, E. coli
acacgtagcgctgcgtccggaaaaa

SEQ ID NO: 168496 - DNA, 25 bp, E. coli
acgtagcgctgcgtccggaaaaaat

SEQ ID NO: 168497 - DNA, 25 bp, E. coli
acgtagcgctgcctccggaaaaaat

SEQ ID NO: 168498 - DNA, 25 bp, E. coli
aaagtcgatgcgcatgcttcagtgg

SEQ ID NO: 168499 - DNA, 25 bp, E. coli
acacgtagcgctccgtccggaaaaa

SEQ ID NO: 168500 - DNA, 25 bp, E. coli
aaagtcgatgcggatgcttcagtgg

SEQ ID NO: 168501 - DNA, 25 bp, E. coli
gccggtacacgttgcgctgcgtccg

SEQ ID NO: 168502 - DNA, 25 bp, E. coli
gccggtacacgtagcgctgcgtccg

SEQ ID NO: 168503 - DNA, 25 bp, E. coli
cgatgcggatgcatcagtggtcgat

SEQ ID NO: 168504 - DNA, 25 bp, E. coli
cgatgcggatgcttcagtggtcgat

SEQ ID NO: 168505 - DNA, 25 bp, E. coli
gtacacgtagcgctgcgtccggaaa

SEQ ID NO: 168506 - DNA, 25 bp, E. coli
gtgccggtacacgtagcgctgcgtc

SEQ ID NO: 168507 - DNA, 25 bp, E. coli
gtacacgtagcggtgcgtccggaaa

SEQ ID NO: 168508 - DNA, 25 bp, E. coli
gtgccggtacacctagcgctgcgtc

SEQ ID NO: 168509 - DNA, 25 bp, E. coli
gatgcggatgctacagtggtcgata

SEQ ID NO: 168510 - DNA, 25 bp, E. coli
gatgcggatgcttcagtggtcgata

SEQ ID NO: 168511 - DNA, 25 bp, E. coli
aataccttgcattggaaacgctcag

SEQ ID NO: 168512 - DNA, 25 bp, E. coli
aattctttggcgacggcagtcacta

SEQ ID NO: 168513 - DNA, 25 bp, E. coli
aataccttgcataggaaacgctcag

SEQ ID NO: 168514 - DNA, 25 bp, E. coli
aattctttggcgtcggcagtcacta

SEQ ID NO: 168515 - DNA, 25 bp, E. coli
ttggcccaagacagactaacgacct

SEQ ID NO: 168516 - DNA, 25 bp, E. coli
tatgggtgacaagcagtcatcccgg

SEQ ID NO: 168517 - DNA, 25 bp, E. coli
ttggcccaagactgactaacgacct

SEQ ID NO: 168518 - DNA, 25 bp, E. coli
tatgggtgacaaccagtcatcccgg

SEQ ID NO: 168519 - DNA, 25 bp, E. coli
tatcagtggcaatactatggtgccg

SEQ ID NO: 168520 - DNA, 25 bp, E. coli
tatcagtggcaaaactatggtgccg

SEQ ID NO: 168521 - DNA, 25 bp, E. coli
tcgacacgggtctaccaattaagct

SEQ ID NO: 168522 - DNA, 25 bp, E. coli
tcgacacgggtcaaccaattaagct

SEQ ID NO: 168523 - DNA, 25 bp, E. coli
gaaggttaacttgggagatggtcca

SEQ ID NO: 168524 - DNA, 25 bp, E. coli
gaaggttaacttcggagatggtcca

SEQ ID NO: 168525 - DNA, 25 bp, E. coli
gtcatcccggcaaagtacatggtat

SEQ ID NO: 168526 - DNA, 25 bp, E. coli
gtcatcccggcatagtacatggtat

SEQ ID NO: 168527 - DNA, 25 bp, E. coli
ggcttggtacagatatcgacacggg

SEQ ID NO: 168528 - DNA, 25 bp, E. coli
ggcttggtacagttatcgacacggg

SEQ ID NO: 168529 - DNA, 25 bp, E. coli
tcacaacggtggtcaatggaatgcg

SEQ ID NO: 168530 - DNA, 25 bp, E. coli
tcacaacggtggacaatggaatgcg

SEQ ID NO: 168531 - DNA, 25 bp, E. coli
gagggctcaccagtatttacggaaa

SEQ ID NO: 168532 - DNA, 25 bp, E. coli
gagggctcaccactatttacggaaa

SEQ ID NO: 168533 - DNA, 25 bp, E. coli
cactggttgcagactggactgacga

SEQ ID NO: 168534 - DNA, 25 bp, E. coli
cactggttgcagtctggactgacga

SEQ ID NO: 168535 - DNA, 25 bp, E. coli
agataaagttaagccgcgtctggcg

SEQ ID NO: 168536 - DNA, 25 bp, E. coli
agataaagttaacccgcgtctggcg

SEQ ID NO: 168537 - DNA, 25 bp, E. coli
aactggctaaacgtggcgaaatcga

SEQ ID NO: 168538 - DNA, 25 bp, E. coli
aactggctaaacctggcgaaatcga

SEQ ID NO: 168539 - DNA, 25 bp, E. coli
tatccgctggaacgccatcatgacg

SEQ ID NO: 168540 - DNA, 25 bp, E. coli
tatccgctggaaggccatcatgacg

SEQ ID NO: 168541 - DNA, 25 bp, E. coli
tcaggaagttcagggcaatggcctc

SEQ ID NO: 168542 - DNA, 25 bp, E. coli
tcaggaagttcacggcaatggcctc

SEQ ID NO: 168543 - DNA, 25 bp, E. coli
gaattctggcagttcccgaccgtat

SEQ ID NO: 168544 - DNA, 25 bp, E. coli
gaattctggcagatcccgaccgtat

SEQ ID NO: 168545 - DNA, 25 bp, E. coli
gaactgtatctcatacgacccggct

SEQ ID NO: 168546 - DNA, 25 bp, E. coli
gaactgtatctcttacgacccggct

SEQ ID NO: 168547 - DNA, 25 bp, E. coli
gaaactgttcgctgagcaggtccgt

SEQ ID NO: 168548 - DNA, 25 bp, E. coli
gaaatatctggatcaccgtggcctg

SEQ ID NO: 168549 - DNA, 25 bp, E. coli
gaaatatctggaacaccgtggcctg

SEQ ID NO: 168550 - DNA, 25 bp, E. coli
gaaactgttcgcagagcaggtccgt

SEQ ID NO: 168551 - DNA, 25 bp, E. coli
gattgtgaacgcaggaacatgctgc

SEQ ID NO: 168552 - DNA, 25 bp, E. coli
gattgtgaacgctggaacatgctgc

SEQ ID NO: 168553 - DNA, 25 bp, E. coli
gatccagctgatcaacgaaaccgtt

SEQ ID NO: 168554 - DNA, 25 bp, E. coli
gatccagctgatgaacgaaaccgtt

SEQ ID NO: 168555 - DNA, 25 bp, E. coli
taccagctggcgtcgattaaaaccg

SEQ ID NO: 168556 - DNA, 25 bp, E. coli
tatggtgtcctcaacatgctgcgca

SEQ ID NO: 168557 - DNA, 25 bp, E. coli
taccagctggcgacgattaaaaccg

SEQ ID NO: 168558 - DNA, 25 bp, E. coli
tatggtgtcctctacatgctgcgca

SEQ ID NO: 168559 - DNA, 25 bp, E. coli
tttgataccgaatccgacagccttg

SEQ ID NO: 168560 - DNA, 25 bp, E. coli
tttgataccgaaaccgacagccttg

SEQ ID NO: 168561 - DNA, 25 bp, E. coli
tgataacattccaggcgtaccgggc

SEQ ID NO: 168562 - DNA, 25 bp, E. coli
tgataacattcctggcgtaccgggc

SEQ ID NO: 168563 - DNA, 25 bp, E. coli
tccgtggcgcgataacaatggcagc

SEQ ID NO: 168564 - DNA, 25 bp, E. coli
tccgtggcgcgaaaacaatggcagc

SEQ ID NO: 168565 - DNA, 25 bp, E. coli
tctgcaaaaacagaaagggccgttg

SEQ ID NO: 168566 - DNA, 25 bp, E. coli
tctgcaaaaacacaaagggccgttg

SEQ ID NO: 168567 - DNA, 25 bp, E. coli
gaagaactggcgctggactatccgt

SEQ ID NO: 168568 - DNA, 25 bp, E. coli
gaagaactggcggtggactatccgt

SEQ ID NO: 168569 - DNA, 25 bp, E. coli
gaactggagctgtcctgtgaacaac

SEQ ID NO: 168570 - DNA, 25 bp, E. coli
gaactggagctgacctgtgaacaac

SEQ ID NO: 168571 - DNA, 25 bp, E. coli
gatacgctgtatgccgagccagaaa

SEQ ID NO: 168572 - DNA, 25 bp, E. coli
gatacgctgtatcccgagccagaaa

SEQ ID NO: 168573 - DNA, 25 bp, E. coli
tggagtatatggtacgcacccgtgc

SEQ ID NO: 168574 - DNA, 25 bp, E. coli
tggagtatatggaacgcacccgtgc

SEQ ID NO: 168575 - DNA, 25 bp, E. coli
gatggaaaactgaacccgtctggat

SEQ ID NO: 168576 - DNA, 25 bp, E. coli
gatggaaaactgtacccgtctggat

SEQ ID NO: 168577 - DNA, 25 bp, E. coli
catattgagcgccacgtatcggtgc

SEQ ID NO: 168578 - DNA, 25 bp, E. coli
catattgagcgcgacgtatcggtgc

SEQ ID NO: 168579 - DNA, 25 bp, E. coli
attgagcgccacgtatcggtgcagg

SEQ ID NO: 168580 - DNA, 25 bp, E. coli
agcgccacgtatgggtgcaggcttc

SEQ ID NO: 168581 - DNA, 25 bp, E. coli
agcgccacgtatcggtgcaggcttc

SEQ ID NO: 168582 - DNA, 25 bp, E. coli
attgagcgccacctatcggtgcagg

SEQ ID NO: 168583 - DNA, 25 bp, E. coli
tatccgcatattgagcgccacgtat

SEQ ID NO: 168584 - DNA, 25 bp, E. coli
tattgagcgccacgtatcggtgcag

SEQ ID NO: 168585 - DNA, 25 bp, E. coli
tattgagcgccaggtatcggtgcag

SEQ ID NO: 168586 - DNA, 25 bp, E. coli
tatccgcatattcagcgccacgtat

SEQ ID NO: 168587 - DNA, 25 bp, E. coli
tgagcgccacgtttcggtgcaggct

SEQ ID NO: 168588 - DNA, 25 bp, E. coli
tgagcgccacgtatcggtgcaggct

SEQ ID NO: 168589 - DNA, 25 bp, E. coli
tccgcatattgagcgccacgtatcg

SEQ ID NO: 168590 - DNA, 25 bp, E. coli
tccgcatattgaccgccacgtatcg

SEQ ID NO: 168591 - DNA, 25 bp, E. coli
ccacgtatcggtgcaggcttcggcg

SEQ ID NO: 168592 - DNA, 25 bp, E. coli
ccacgtatcggtccaggcttcggcg

SEQ ID NO: 168593 - DNA, 25 bp, E. coli
gcgttatccgcatattgagcgccac

SEQ ID NO: 168594 - DNA, 25 bp, E. coli
gcgttatccgcaaattgagcgccac

SEQ ID NO: 168595 - DNA, 25 bp, E. coli
cgccacgtatcgctgcaggcttcgg

SEQ ID NO: 168596 - DNA, 25 bp, E. coli
cgccacgtatcggtgcaggcttcgg

SEQ ID NO: 168597 - DNA, 25 bp, E. coli
gttatccgcatattgagcgccacgt

SEQ ID NO: 168598 - DNA, 25 bp, E. coli
gttatccgcataatgagcgccacgt

SEQ ID NO: 168599 - DNA, 25 bp, E. coli
caaaaatattacaacaaacagcggt

SEQ ID NO: 168600 - DNA, 25 bp, E. coli
caaaaatattactacaaacagcggt

SEQ ID NO: 168601 - DNA, 25 bp, E. coli
tatcgagttattccctaagttgtcg

SEQ ID NO: 168602 - DNA, 25 bp, E. coli
tatcgagttattgcctaagttgtcg

SEQ ID NO: 168603 - DNA, 25 bp, E. coli
tatcactgctaatgagatatccggc

SEQ ID NO: 168604 - DNA, 25 bp, E. coli
tatcactgctaaagagatatccggc

SEQ ID NO: 168605 - DNA, 25 bp, E. coli
tcatcttgccagcatattggagcgt

SEQ ID NO: 168606 - DNA, 25 bp, E. coli
tcgtggttcactttaggcaataagc

SEQ ID NO: 168607 - DNA, 25 bp, E. coli
tcgtggttcactataggcaataagc

SEQ ID NO: 168608 - DNA, 25 bp, E. coli
tcatcttgccaggatattggagcgt

SEQ ID NO: 168609 - DNA, 25 bp, E. coli
gactcggtgaaaagaaaaatccacg

SEQ ID NO: 168610 - DNA, 25 bp, E. coli
gactcggtgaaatgaaaaatccacg

SEQ ID NO: 168611 - DNA, 25 bp, E. coli
gagaataattctctattaccgggca

SEQ ID NO: 168612 - DNA, 25 bp, E. coli
gagaataattctgtattaccgggca

SEQ ID NO: 168613 - DNA, 25 bp, E. coli
gatatccggcatctgaacacttatg

SEQ ID NO: 168614 - DNA, 25 bp, E. coli
gatatccggcatgtgaacacttatg

SEQ ID NO: 168615 - DNA, 25 bp, E. coli
gatttagcgaaagctcatgagacaa

SEQ ID NO: 168616 - DNA, 25 bp, E. coli
gatttagcgaaacctcatgagacaa

SEQ ID NO: 168617 - DNA, 25 bp, E. coli
gggaatttcgcttgatgtatctgca

SEQ ID NO: 168618 - DNA, 25 bp, E. coli
gggaatttcgctagatgtatctgca

SEQ ID NO: 168619 - DNA, 25 bp, E. coli
tgttacaagaatgattaggactcgg

SEQ ID NO: 168620 - DNA, 25 bp, E. coli
tgttacaagaatcattaggactcgg

SEQ ID NO: 168621 - DNA, 25 bp, E. coli
tttaacactaacctcgaagctgccg

SEQ ID NO: 168622 - DNA, 25 bp, E. coli
tttaacactaacgtcgaagctgccg

SEQ ID NO: 168623 - DNA, 25 bp, E. coli
tgttaatcaacgcaactcagcagga

SEQ ID NO: 168624 - DNA, 25 bp, E. coli
tgttaatcaacggaactcagcagga

SEQ ID NO: 168625 - DNA, 25 bp, E. coli
tgggaagccatctaaaaagccgctg

SEQ ID NO: 168626 - DNA, 25 bp, E. coli
tgggaagccatcaaaaaagccgctg

SEQ ID NO: 168627 - DNA, 25 bp, E. coli
tgattacggcgctgaacgtcacggt

SEQ ID NO: 168628 - DNA, 25 bp, E. coli
tgattacggcgcagaacgtcacggt

SEQ ID NO: 168629 - DNA, 25 bp, E. coli
tctgatgttgccctagcccaggaag

SEQ ID NO: 168630 - DNA, 25 bp, E. coli
tctgatgttgccgtagcccaggaag

SEQ ID NO: 168631 - DNA, 25 bp, E. coli
gcaaaatcaaactgtacaccggcga

SEQ ID NO: 168632 - DNA, 25 bp, E. coli
gcaaaatcaaacagtacaccggcga

SEQ ID NO: 168633 - DNA, 25 bp, E. coli
gataacccgaaagtgctcgaactgg

SEQ ID NO: 168634 - DNA, 25 bp, E. coli
gataacccgaaactgctcgaactgg

SEQ ID NO: 168635 - DNA, 25 bp, E. coli
tcagatcgataatgaagagcgcggc

SEQ ID NO: 168636 - DNA, 25 bp, E. coli
taaccacctttatcagtctggcggg

SEQ ID NO: 168637 - DNA, 25 bp, E. coli
taagcttccgtcagaaacactggga

SEQ ID NO: 168638 - DNA, 25 bp, E. coli
tcagatcgataaagaagagcgcggc

SEQ ID NO: 168639 - DNA, 25 bp, E. coli
taactacagtgcacatggtcgtccc

SEQ ID NO: 168640 - DNA, 25 bp, E. coli
taaccacctttaacagtctggcggg

SEQ ID NO: 168641 - DNA, 25 bp, E. coli
taagcttccgtctgaaacactggga

SEQ ID NO: 168642 - DNA, 25 bp, E. coli
taactacagtgctcatggtcgtccc

SEQ ID NO: 168643 - DNA, 25 bp, E. coli
tgatgccccgaataaccagttccgt

SEQ ID NO: 168644 - DNA, 25 bp, E. coli
tgattgccgacatacagagcgttgg

SEQ ID NO: 168645 - DNA, 25 bp, E. coli
tgattgccgacaaacagagcgttgg

SEQ ID NO: 168646 - DNA, 25 bp, E. coli
tgatgccccgaaaaaccagttccgt

SEQ ID NO: 168647 - DNA, 25 bp, E. coli
tgaatcgcccgcagcaaattgttgc

SEQ ID NO: 168648 - DNA, 25 bp, E. coli
tgaatcgcccgctgcaaattgttgc

SEQ ID NO: 168649 - DNA, 25 bp, E. coli
tcggcctgcctgtaagcgtggtgat

SEQ ID NO: 168650 - DNA, 25 bp, E. coli
tcggcctgcctgaaagcgtggtgat

SEQ ID NO: 168651 - DNA, 25 bp, E. coli
ccagtgcggtagtgaaaaccctgca

SEQ ID NO: 168652 - DNA, 25 bp, E. coli
ccagtgcggtagagaaaaccctgca

SEQ ID NO: 168653 - DNA, 25 bp, E. coli
gctgaccgaagcatgggccaaaaat

SEQ ID NO: 168654 - DNA, 25 bp, E. coli
gcgtagagtggtatccccgttggca

SEQ ID NO: 168655 - DNA, 25 bp, E. coli
gcgtagagtggtttccccgttggca

SEQ ID NO: 168656 - DNA, 25 bp, E. coli
gctgaccgaagcttgggccaaaaat

SEQ ID NO: 168657 - DNA, 25 bp, E. coli
gaacgctaaccatcgcctgaaaggg

SEQ ID NO: 168658 - DNA, 25 bp, E. coli
gaacgctaaccaacgcctgaaaggg

SEQ ID NO: 168659 - DNA, 25 bp, E. coli
gtttgccgaaaacccgaacgcgatg

SEQ ID NO: 168660 - DNA, 25 bp, E. coli
gatttatcggtcaggaagcaggcca

SEQ ID NO: 168661 - DNA, 25 bp, E. coli
gtttgccgaaaagccgaacgcgatg

SEQ ID NO: 168662 - DNA, 25 bp, E. coli
gatttatcggtctggaagcaggcca

SEQ ID NO: 168663 - DNA, 25 bp, E. coli
gagattacccgtatgtgccacgcgc

SEQ ID NO: 168664 - DNA, 25 bp, E. coli
gagattacccgtttgtgccacgcgc

SEQ ID NO: 168665 - DNA, 25 bp, E. coli
aatcctggagactaaactccctgag

SEQ ID NO: 168666 - DNA, 25 bp, E. coli
aatcctggagacaaaactccctgag

SEQ ID NO: 168667 - DNA, 25 bp, E. coli
attctggctgtgagaaccgccccgg

SEQ ID NO: 168668 - DNA, 25 bp, E. coli
agcgattctggcagtgtgaaccgcc

SEQ ID NO: 168669 - DNA, 25 bp, E. coli
agcgattctggctgtgtgaaccgcc

SEQ ID NO: 168670 - DNA, 25 bp, E. coli
attctggctgtgtgaaccgccccgg

SEQ ID NO: 168671 - DNA, 25 bp, E. coli
tcctggagactatactccctgagaa

SEQ ID NO: 168672 - DNA, 25 bp, E. coli
tcctggagactaaactccctgagaa

SEQ ID NO: 168673 - DNA, 25 bp, E. coli
tctggctgtgtgaaccgccccggaa

SEQ ID NO: 168674 - DNA, 25 bp, E. coli
tctggctgtgtgtaccgccccggaa

SEQ ID NO: 168675 - DNA, 25 bp, E. coli
cctggagactaaactccctgagaaa

SEQ ID NO: 168676 - DNA, 25 bp, E. coli
cctggagactaatctccctgagaaa

SEQ ID NO: 168677 - DNA, 25 bp, E. coli
gcgattctggctctgtgaaccgccc

SEQ ID NO: 168678 - DNA, 25 bp, E. coli
gcgattctggctgtgtgaaccgccc

SEQ ID NO: 168679 - DNA, 25 bp, E. coli
gactaaactcccagagaaagaggta

SEQ ID NO: 168680 - DNA, 25 bp, E. coli
gactaaactccctgagaaagaggta

SEQ ID NO: 168681 - DNA, 25 bp, E. coli
cgattctggctgtgtgaaccgcccc

SEQ ID NO: 168682 - DNA, 25 bp, E. coli
cgattctggctgagtgaaccgcccc

SEQ ID NO: 168683 - DNA, 25 bp, E. coli
ggagactaaactccctgagaaagag

SEQ ID NO: 168684 - DNA, 25 bp, E. coli
tggagactaaacaccctgagaaaga

SEQ ID NO: 168685 - DNA, 25 bp, E. coli
ggagactaaactgcctgagaaagag

SEQ ID NO: 168686 - DNA, 25 bp, E. coli
tggagactaaactccctgagaaaga

SEQ ID NO: 168687 - DNA, 25 bp, E. coli
cagcggcgtggatgcattagttgcc

SEQ ID NO: 168688 - DNA, 25 bp, E. coli
cagcggcgtggaagcattagttgcc

SEQ ID NO: 168689 - DNA, 25 bp, E. coli
attagttgcccaccgtgcggcggtc

SEQ ID NO: 168690 - DNA, 25 bp, E. coli
attagttgcccagcgtgcggcggtc

SEQ ID NO: 168691 - DNA, 25 bp, E. coli
aacaggccacagttacattacgccg

SEQ ID NO: 168692 - DNA, 25 bp, E. coli
acagatacattaggccgcaccgagc

SEQ ID NO: 168693 - DNA, 25 bp, E. coli
aaagaaggttttctctcagcggaag

SEQ ID NO: 168694 - DNA, 25 bp, E. coli
aaagaaggttttgtctcagcggaag

SEQ ID NO: 168695 - DNA, 25 bp, E. coli
acagatacattacgccgcaccgagc

SEQ ID NO: 168696 - DNA, 25 bp, E. coli
aacaggccacagatacattacgccg

SEQ ID NO: 168697 - DNA, 25 bp, E. coli
tgccatgcgccctatttttacccta

SEQ ID NO: 168698 - DNA, 25 bp, E. coli
tgccatgcgcccaatttttacccta

SEQ ID NO: 168699 - DNA, 25 bp, E. coli
tccgtcgggcaaattgcttctgcca

SEQ ID NO: 168700 - DNA, 25 bp, E. coli
tccgtcgggcaatttgcttctgcca

SEQ ID NO: 168701 - DNA, 25 bp, E. coli
gccgcaccgagccattactgaaaga

SEQ ID NO: 168702 - DNA, 25 bp, E. coli
gccgcaccgagcgattactgaaaga

SEQ ID NO: 168703 - DNA, 25 bp, E. coli
gcaatttgcttcagccatgcgccct

SEQ ID NO: 168704 - DNA, 25 bp, E. coli
gcaatttgcttctgccatgcgccct

SEQ ID NO: 168705 - DNA, 25 bp, E. coli
ccgagccattactgaaagaaggttt

SEQ ID NO: 168706 - DNA, 25 bp, E. coli
ccgagccattacagaaagaaggttt

SEQ ID NO: 168707 - DNA, 25 bp, E. coli
gatgcattagttgcccagcgtgcgg

SEQ ID NO: 168708 - DNA, 25 bp, E. coli
gatgcattagttccccagcgtgcgg

SEQ ID NO: 168709 - DNA, 25 bp, E. coli
aatatgccgtaaccgcttatgccag

SEQ ID NO: 168710 - DNA, 25 bp, E. coli
aatatgccgtaagcgcttatgccag

SEQ ID NO: 168711 - DNA, 25 bp, E. coli
caaaagatgaatcgctggttgccag

SEQ ID NO: 168712 - DNA, 25 bp, E. coli
caaaagatgaatggctggttgccag

SEQ ID NO: 168713 - DNA, 25 bp, E. coli
tacatcaacgacatgctggacagaa

SEQ ID NO: 168714 - DNA, 25 bp, E. coli
tacatcaacgacttgctggacagaa

SEQ ID NO: 168715 - DNA, 25 bp, E. coli
tgtttgcgccagacaaaagtgtgca

SEQ ID NO: 168716 - DNA, 25 bp, E. coli
tgtttgcgccagtcaaaagtgtgca

SEQ ID NO: 168717 - DNA, 25 bp, E. coli
tctggtggctatcttccgtaaacgg

SEQ ID NO: 168718 - DNA, 25 bp, E. coli
tctggtggctatgttccgtaaacgg

SEQ ID NO: 168719 - DNA, 25 bp, E. coli
ccagccagcgctatcttgagaaaca

SEQ ID NO: 168720 - DNA, 25 bp, E. coli
ccagccagcgctttcttgagaaaca

SEQ ID NO: 168721 - DNA, 25 bp, E. coli
gaaattcgccaccagcttgctcagt

SEQ ID NO: 168722 - DNA, 25 bp, E. coli
gaaattcgccacgagcttgctcagt

SEQ ID NO: 168723 - DNA, 25 bp, E. coli
ctggagctggcacgaaatcacctgg

SEQ ID NO: 168724 - DNA, 25 bp, E. coli
ctggagctggcaggaaatcacctgg

SEQ ID NO: 168725 - DNA, 25 bp, E. coli
gtaaacgggaataccagccctggcg

SEQ ID NO: 168726 - DNA, 25 bp, E. coli
gtaaacgggaattccagccctggcg

SEQ ID NO: 168727 - DNA, 25 bp, E. coli
taagcatgagaatcgtggtcgggtc

SEQ ID NO: 168728 - DNA, 25 bp, E. coli
taagcatgagaaacgtggtcgggtc

SEQ ID NO: 168729 - DNA, 25 bp, E. coli
gacgcgaatatcaggcgcttcaacg

SEQ ID NO: 168730 - DNA, 25 bp, E. coli
gacgcgaatatctggcgcttcaacg

SEQ ID NO: 168731 - DNA, 25 bp, E. coli
catctctgactcatacgacccgtgg

SEQ ID NO: 168732 - DNA, 25 bp, E. coli
catctctgactcttacgacccgtgg

SEQ ID NO: 168733 - DNA, 25 bp, E. coli
tttctctggcgcaatgccgacacgg

SEQ ID NO: 168734 - DNA, 25 bp, E. coli
tttctctggcgctatgccgacacgg

SEQ ID NO: 168735 - DNA, 25 bp, E. coli
ttgaaaaaggccttatcacccgcgc

SEQ ID NO: 168736 - DNA, 25 bp, E. coli
ttgaaaaaggccatatcacccgcgc

SEQ ID NO: 168737 - DNA, 25 bp, E. coli
gcgcccaggtgtttaccgacagcct

SEQ ID NO: 168738 - DNA, 25 bp, E. coli
gcgcccaggtgtataccgacagcct

SEQ ID NO: 168739 - DNA, 25 bp, E. coli
gctggcaagccgcagtacgataaaa

SEQ ID NO: 168740 - DNA, 25 bp, E. coli
gctggcaagccggagtacgataaaa

SEQ ID NO: 168741 - DNA, 25 bp, E. coli
gaaagagtgtaaaacccggcggatg

SEQ ID NO: 168742 - DNA, 25 bp, E. coli
gaaagagtgtaatacccggcggatg

SEQ ID NO: 168743 - DNA, 25 bp, E. coli
gacgtaacgatctggtggtgaaaac

SEQ ID NO: 168744 - DNA, 25 bp, E. coli
cccattatggcgagcgcgtggaagc

SEQ ID NO: 168745 - DNA, 25 bp, E. coli
cccattatggcgtgcgcgtggaagc

SEQ ID NO: 168746 - DNA, 25 bp, E. coli
cgtggaagcggatatcatctccccg

SEQ ID NO: 168747 - DNA, 25 bp, E. coli
cgtggaagcggaaatcatctccccg

SEQ ID NO: 168748 - DNA, 25 bp, E. coli
cgtggaactgcaattcgacgttgaa

SEQ ID NO: 168749 - DNA, 25 bp, E. coli
cgtggaactgcatttcgacgttgaa

SEQ ID NO: 168750 - DNA, 25 bp, E. coli
tggaagaagatatcgtccgcctggc

SEQ ID NO: 168751 - DNA, 25 bp, E. coli
tggaagaagataacgtccgcctggc

SEQ ID NO: 168752 - DNA, 25 bp, E. coli
gacgtaacgatcaggtggtgaaaac

SEQ ID NO: 168753 - DNA, 25 bp, E. coli
caataatgcgtaaggtagaaacccg

SEQ ID NO: 168754 - DNA, 25 bp, E. coli
caataatgcgtatggtagaaacccg

SEQ ID NO: 168755 - DNA, 25 bp, E. coli
tatcgcccacttaatttttccagga

SEQ ID NO: 168756 - DNA, 25 bp, E. coli
tatcgcccactttatttttccagga

SEQ ID NO: 168757 - DNA, 25 bp, E. coli
ttttccaggattagccggttgtcgg

SEQ ID NO: 168758 - DNA, 25 bp, E. coli
ttttccaggatttgccggttgtcgg

SEQ ID NO: 168759 - DNA, 25 bp, E. coli
tgttgcgcaattagtcaacgaaaac

SEQ ID NO: 168760 - DNA, 25 bp, E. coli
tgttgcgcaatttgtcaacgaaaac

SEQ ID NO: 168761 - DNA, 25 bp, E. coli
gcgggagtgatacaatatcgcccac

SEQ ID NO: 168762 - DNA, 25 bp, E. coli
gcgggagtgatagaatatcgcccac

SEQ ID NO: 168763 - DNA, 25 bp, E. coli
gcaagatgatcgcaaaacagaccgt

SEQ ID NO: 168764 - DNA, 25 bp, E. coli
gcaagatgatcggaaaacagaccgt

SEQ ID NO: 168765 - DNA, 25 bp, E. coli
ccgaactacattgaggaatcaggcg

SEQ ID NO: 168766 - DNA, 25 bp, E. coli
ccgaactacattcaggaatcaggcg

SEQ ID NO: 168767 - DNA, 25 bp, E. coli
cgttcgtcgtaaatttaagcaagat

SEQ ID NO: 168768 - DNA, 25 bp, E. coli
cgttcgtcgtaattttaagcaagat

SEQ ID NO: 168769 - DNA, 25 bp, E. coli
tgtcggcatcttactaaacgtaagg

SEQ ID NO: 168770 - DNA, 25 bp, E. coli
gagtcgcattattgggagagttcaa

SEQ ID NO: 168771 - DNA, 25 bp, E. coli
tgtcggcatctttctaaacgtaagg

SEQ ID NO: 168772 - DNA, 25 bp, E. coli
gagagttcaaaatgagtcaacgcat

SEQ ID NO: 168773 - DNA, 25 bp, E. coli
gagtcgcattatagggagagttcaa

SEQ ID NO: 168774 - DNA, 25 bp, E. coli
gagagttcaaaaagagtcaacgcat

SEQ ID NO: 168775 - DNA, 25 bp, E. coli
tactgctggtactgtcgatgatcgt

SEQ ID NO: 168776 - DNA, 25 bp, E. coli
tactgctggtacagtcgatgatcgt

SEQ ID NO: 168777 - DNA, 25 bp, E. coli
actgtcgatgatcgtttacggttgc

SEQ ID NO: 168778 - DNA, 25 bp, E. coli
actgtcgatgatggtttacggttgc

SEQ ID NO: 168779 - DNA, 25 bp, E. coli
actgtactgctggtactgtcgatga

SEQ ID NO: 168780 - DNA, 25 bp, E. coli
actgtactgctgctactgtcgatga

SEQ ID NO: 168781 - DNA, 25 bp, E. coli
tgctggtactgtcgatgatcgttta

SEQ ID NO: 168782 - DNA, 25 bp, E. coli
tgctggtactgtggatgatcgttta

SEQ ID NO: 168783 - DNA, 25 bp, E. coli
tcgtttacggttgcgcattcgactt

SEQ ID NO: 168784 - DNA, 25 bp, E. coli
tcgtttacggttccgcattcgactt

SEQ ID NO: 168785 - DNA, 25 bp, E. coli
tccgttcggtacagtactgctggta

SEQ ID NO: 168786 - DNA, 25 bp, E. coli
tccgttcggtactgtactgctggta

SEQ ID NO: 168787 - DNA, 25 bp, E. coli
cgttcggtactgaactgctggtact

SEQ ID NO: 168788 - DNA, 25 bp, E. coli
cgttcggtactgtactgctggtact

SEQ ID NO: 168789 - DNA, 25 bp, E. coli
cggttgcgcattcgacttcttcaac

SEQ ID NO: 168790 - DNA, 25 bp, E. coli
cggttgcgcattggacttcttcaac

SEQ ID NO: 168791 - DNA, 25 bp, E. coli
ggtactgtactgctggtactgtcga

SEQ ID NO: 168792 - DNA, 25 bp, E. coli
ggtactgtactggtggtactgtcga

SEQ ID NO: 168793 - DNA, 25 bp, E. coli
tggtactgtcgatgatcgtttacgg

SEQ ID NO: 168794 - DNA, 25 bp, E. coli
tggtactgtcgaagatcgtttacgg

SEQ ID NO: 168795 - DNA, 25 bp, E. coli
gatcgtttacggttgcgcattcgac

SEQ ID NO: 168796 - DNA, 25 bp, E. coli
gatcgtttacggatgcgcattcgac

SEQ ID NO: 168797 - DNA, 25 bp, E. coli
cgtgacccctttgctccagaaatga

SEQ ID NO: 168798 - DNA, 25 bp, E. coli
cgtgacccctttcctccagaaatga

SEQ ID NO: 168799 - DNA, 25 bp, E. coli
tattgccggaaaatgagctggaggc

SEQ ID NO: 168800 - DNA, 25 bp, E. coli
tatctggagcagtggcaagctgccc

SEQ ID NO: 168801 - DNA, 25 bp, E. coli
tatctggagcagaggcaagctgccc

SEQ ID NO: 168802 - DNA, 25 bp, E. coli
tattgccggaaattgagctggaggc

SEQ ID NO: 168803 - DNA, 25 bp, E. coli
tgcaggagagcgtcataaaaacact

SEQ ID NO: 168804 - DNA, 25 bp, E. coli
tgcaggagagcgacataaaaacact

SEQ ID NO: 168805 - DNA, 25 bp, E. coli
gcctattcttggtggactttgggac

SEQ ID NO: 168806 - DNA, 25 bp, E. coli
gcctattcttggaggactttgggac

SEQ ID NO: 168807 - DNA, 25 bp, E. coli
gacactattactttaggaggccgta

SEQ ID NO: 168808 - DNA, 25 bp, E. coli
gacactattactataggaggccgta

SEQ ID NO: 168809 - DNA, 25 bp, E. coli
taacgctacataatcctgagacagg

SEQ ID NO: 168810 - DNA, 25 bp, E. coli
taacgctacatattcctgagacagg

SEQ ID NO: 168811 - DNA, 25 bp, E. coli
gagaggctcatcatctcgcagaccg

SEQ ID NO: 168812 - DNA, 25 bp, E. coli
gaccgcctgacatgacaacttaacg

SEQ ID NO: 168813 - DNA, 25 bp, E. coli
gaccgcctgacaagacaacttaacg

SEQ ID NO: 168814 - DNA, 25 bp, E. coli
gaggtaacacttatctgcaggcata

SEQ ID NO: 168815 - DNA, 25 bp, E. coli
gagctggaggctatacgacatatag

SEQ ID NO: 168816 - DNA, 25 bp, E. coli
gagaggctcatcttctcgcagaccg

SEQ ID NO: 168817 - DNA, 25 bp, E. coli
gagctggaggctttacgacatatag

SEQ ID NO: 168818 - DNA, 25 bp, E. coli
gaggtaacacttttctgcaggcata

SEQ ID NO: 168819 - DNA, 25 bp, E. coli
caatggcgatgcttacatactggat

SEQ ID NO: 168820 - DNA, 25 bp, E. coli
caatggcgatgcatacatactggat

SEQ ID NO: 168821 - DNA, 25 bp, E. coli
caccgactcgctgtgattgatgcag

SEQ ID NO: 168822 - DNA, 25 bp, E. coli
caccgactcgctctgattgatgcag

SEQ ID NO: 168823 - DNA, 25 bp, E. coli
tactggattacgaggactatcactg

SEQ ID NO: 168824 - DNA, 25 bp, E. coli
tacatccgttaagcggcgatcgcga

SEQ ID NO: 168825 - DNA, 25 bp, E. coli
tactggattacgtggactatcactg

SEQ ID NO: 168826 - DNA, 25 bp, E. coli
tacatccgttaaccggcgatcgcga

SEQ ID NO: 168827 - DNA, 25 bp, E. coli
tttcttctcggcaaaacctccggcg

SEQ ID NO: 168828 - DNA, 25 bp, E. coli
tttcttctcggctaaacctccggcg

SEQ ID NO: 168829 - DNA, 25 bp, E. coli
tgatatcgatatccccggttaccga

SEQ ID NO: 168830 - DNA, 25 bp, E. coli
tgatatcgatatgcccggttaccga

SEQ ID NO: 168831 - DNA, 25 bp, E. coli
tgaatttcagacacaagggattgcg

SEQ ID NO: 168832 - DNA, 25 bp, E. coli
tgaatttcagactcaagggattgcg

SEQ ID NO: 168833 - DNA, 25 bp, E. coli
tccggcgttataccgacgcaagtca

SEQ ID NO: 168834 - DNA, 25 bp, E. coli
tccggcgttatagcgacgcaagtca

SEQ ID NO: 168835 - DNA, 25 bp, E. coli
tctcgggtaactcgcgaatcacatt

SEQ ID NO: 168836 - DNA, 25 bp, E. coli
tctcgggtaactggcgaatcacatt

SEQ ID NO: 168837 - DNA, 25 bp, E. coli
gaatttgggcgatatctgtctcggg

SEQ ID NO: 168838 - DNA, 25 bp, E. coli
gaatttgggcgaaatctgtctcggg

SEQ ID NO: 168839 - DNA, 25 bp, E. coli
gcaagtcaaacgattacgccaccga

SEQ ID NO: 168840 - DNA, 25 bp, E. coli
gcaagtcaaacgtttacgccaccga

SEQ ID NO: 168841 - DNA, 25 bp, E. coli
cagatagggccggaggcggcaggca

SEQ ID NO: 168842 - DNA, 25 bp, E. coli
caggcagtcttgagcagctgattga

SEQ ID NO: 168843 - DNA, 25 bp, E. coli
cagatagggccgcaggcggcaggca

SEQ ID NO: 168844 - DNA, 25 bp, E. coli
caggcagtcttgtgcagctgattga

SEQ ID NO: 168845 - DNA, 25 bp, E. coli
accagcgggtgctggcggtgatgct

SEQ ID NO: 168846 - DNA, 25 bp, E. coli
accagcgggtgcaggcggtgatgct

SEQ ID NO: 168847 - DNA, 25 bp, E. coli
tgtccatgcgacctgacggaggaat

SEQ ID NO: 168848 - DNA, 25 bp, E. coli
tgtccatgcgacgtgacggaggaat

SEQ ID NO: 168849 - DNA, 25 bp, E. coli
tgcagctgattgaccagcgggtgca

SEQ ID NO: 168850 - DNA, 25 bp, E. coli
tgcagctgattgtccagcgggtgca

SEQ ID NO: 168851 - DNA, 25 bp, E. coli
ccatgcgacgtgacggaggaatgct

SEQ ID NO: 168852 - DNA, 25 bp, E. coli
ccatgcgacgtgtcggaggaatgct

SEQ ID NO: 168853 - DNA, 25 bp, E. coli
cgtgacggaggaatgctgagtggct

SEQ ID NO: 168854 - DNA, 25 bp, E. coli
cggcaggcagtcttgtgcagctgat

SEQ ID NO: 168855 - DNA, 25 bp, E. coli
cggcaggcagtcatgtgcagctgat

SEQ ID NO: 168856 - DNA, 25 bp, E. coli
cgtgacggaggattgctgagtggct

SEQ ID NO: 168857 - DNA, 25 bp, E. coli
gtctggtgtattccccggtctacca

SEQ ID NO: 168858 - DNA, 25 bp, E. coli
gtctggtgtattgcccggtctacca

SEQ ID NO: 168859 - DNA, 25 bp, E. coli
gtgatgctgtccttgcgacgtgacg

SEQ ID NO: 168860 - DNA, 25 bp, E. coli
gtgatgctgtccatgcgacgtgacg

SEQ ID NO: 168861 - DNA, 25 bp, E. coli
gatgctgtccatgcgacgtgacgga

SEQ ID NO: 168862 - DNA, 25 bp, E. coli
gatgctgtccatccgacgtgacgga

SEQ ID NO: 168863 - DNA, 25 bp, E. coli
aagagatgtttgtggcgattgccgc

SEQ ID NO: 168864 - DNA, 25 bp, E. coli
aagagatgtttgaggcgattgccgc

SEQ ID NO: 168865 - DNA, 25 bp, E. coli
caacagcgtgaaagccgttatgccg

SEQ ID NO: 168866 - DNA, 25 bp, E. coli
caacagcgtgaatgccgttatgccg

SEQ ID NO: 168867 - DNA, 25 bp, E. coli
caggcgcagtacagcgaactgttcg

SEQ ID NO: 168868 - DNA, 25 bp, E. coli
caggcgcagtactgcgaactgttcg

SEQ ID NO: 168869 - DNA, 25 bp, E. coli
tgtatctggagttcctggcgcagct

SEQ ID NO: 168870 - DNA, 25 bp, E. coli
tgtatctggagtacctggcgcagct

SEQ ID NO: 168871 - DNA, 25 bp, E. coli
tgaatatcaccagcggaggacagca

SEQ ID NO: 168872 - DNA, 25 bp, E. coli
tgaatatcaccaccggaggacagca

SEQ ID NO: 168873 - DNA, 25 bp, E. coli
tctgccaaaagacgatgcccatgcg

SEQ ID NO: 168874 - DNA, 25 bp, E. coli
tctgccaaaagaggatgcccatgcg

SEQ ID NO: 168875 - DNA, 25 bp, E. coli
gaatatccggatcctgccttatggc

SEQ ID NO: 168876 - DNA, 25 bp, E. coli
gcagcacggcttccagttaaacagc

SEQ ID NO: 168877 - DNA, 25 bp, E. coli
gaatatccggatgctgccttatggc

SEQ ID NO: 168878 - DNA, 25 bp, E. coli
gcagcacggcttgcagttaaacagc

SEQ ID NO: 168879 - DNA, 25 bp, E. coli
cgtcgcgccgcattatctgaatatc

SEQ ID NO: 168880 - DNA, 25 bp, E. coli
cgtcgcgccgcaatatctgaatatc

SEQ ID NO: 168881 - DNA, 25 bp, E. coli
gattgccgcgtcgaaaaatctgcca

SEQ ID NO: 168882 - DNA, 25 bp, E. coli
gattgccgcgtccaaaaatctgcca

SEQ ID NO: 168883 - DNA, 25 bp, E. coli
gatttaacgacgttggatccgctcg

SEQ ID NO: 168884 - DNA, 25 bp, E. coli
gatttaacgacgatggatccgctcg

SEQ ID NO: 168885 - DNA, 25 bp, E. coli
cacctgggtattgccaacgaaataa

SEQ ID NO: 168886 - DNA, 25 bp, E. coli
cacctgggtattcccaacgaaataa

SEQ ID NO: 168887 - DNA, 25 bp, E. coli
tgacctatccggaaaaagctgtacg

SEQ ID NO: 168888 - DNA, 25 bp, E. coli
tgacctatccggtaaaagctgtacg

SEQ ID NO: 168889 - DNA, 25 bp, E. coli
tctggctgagcgtaaaattttcaac

SEQ ID NO: 168890 - DNA, 25 bp, E. coli
tctggccatggaacgtcacctgggt

SEQ ID NO: 168891 - DNA, 25 bp, E. coli
tctggccatggatcgtcacctgggt

SEQ ID NO: 168892 - DNA, 25 bp, E. coli
tctggctgagcgaaaaattttcaac

SEQ ID NO: 168893 - DNA, 25 bp, E. coli
gcgtagagctcaatgatatgccgat

SEQ ID NO: 168894 - DNA, 25 bp, E. coli
gcttatcgagtaagtcgagggcgta

SEQ ID NO: 168895 - DNA, 25 bp, E. coli
gcttatcgagtatgtcgagggcgta

SEQ ID NO: 168896 - DNA, 25 bp, E. coli
gcgtagagctcattgatatgccgat

SEQ ID NO: 168897 - DNA, 25 bp, E. coli
gaaaccgatcgtctcagaagtgcag

SEQ ID NO: 168898 - DNA, 25 bp, E. coli
gaaagcccgtgatcgtctggccatg

SEQ ID NO: 168899 - DNA, 25 bp, E. coli
gaaaccgatcgtgtcagaagtgcag

SEQ ID NO: 168900 - DNA, 25 bp, E. coli
gaaagcccgtgaacgtctggccatg

SEQ ID NO: 168901 - DNA, 25 bp, E. coli
ctgtacggcagaccggaaagcccgt

SEQ ID NO: 168902 - DNA, 25 bp, E. coli
cttaaatatgctttcgggcgaccca

SEQ ID NO: 168903 - DNA, 25 bp, E. coli
ctgtacggcagagcggaaagcccgt

SEQ ID NO: 168904 - DNA, 25 bp, E. coli
cttaaatatgctatcgggcgaccca

SEQ ID NO: 168905 - DNA, 25 bp, E. coli
gattacaagtatacgctatcgcggc

SEQ ID NO: 168906 - DNA, 25 bp, E. coli
gattacaagtattcgctatcgcggc

SEQ ID NO: 168907 - DNA, 25 bp, E. coli
aattggaggtcatgccacatcggga

SEQ ID NO: 168908 - DNA, 25 bp, E. coli
caatatccccgcagaatggacgagt

SEQ ID NO: 168909 - DNA, 25 bp, E. coli
aattggaggtcaagccacatcggga

SEQ ID NO: 168910 - DNA, 25 bp, E. coli
caagtgaagacggagccagagagta

SEQ ID NO: 168911 - DNA, 25 bp, E. coli
caatatccccgctgaatggacgagt

SEQ ID NO: 168912 - DNA, 25 bp, E. coli
caagtgaagacgcagccagagagta

SEQ ID NO: 168913 - DNA, 25 bp, E. coli
cagggtggatttactatgaggcaac

SEQ ID NO: 168914 - DNA, 25 bp, E. coli
cagagagtatgcaagccaggctgcg

SEQ ID NO: 168915 - DNA, 25 bp, E. coli
cagagagtatgctagccaggctgcg

SEQ ID NO: 168916 - DNA, 25 bp, E. coli
cagggtggattttctatgaggcaac

SEQ ID NO: 168917 - DNA, 25 bp, E. coli
aaacaagttttgcagccgcttcccg

SEQ ID NO: 168918 - DNA, 25 bp, E. coli
aaacaagttttggagccgcttcccg

SEQ ID NO: 168919 - DNA, 25 bp, E. coli
tataatagaccgcttacgtgcctgg

SEQ ID NO: 168920 - DNA, 25 bp, E. coli
tataatagaccggttacgtgcctgg

SEQ ID NO: 168921 - DNA, 25 bp, E. coli
tattgattgaaggacagcgcactaa

SEQ ID NO: 168922 - DNA, 25 bp, E. coli
tattgattgaagcacagcgcactaa

SEQ ID NO: 168923 - DNA, 25 bp, E. coli
tcagtatgcgcccaaaaaaggtggt

SEQ ID NO: 168924 - DNA, 25 bp, E. coli
tcagtatgcgccgaaaaaaggtggt

SEQ ID NO: 168925 - DNA, 25 bp, E. coli
gctgcggagccgaataaacaagttt

SEQ ID NO: 168926 - DNA, 25 bp, E. coli
gctgcggagccgtataaacaagttt

SEQ ID NO: 168927 - DNA, 25 bp, E. coli
gcagctactgcatctaaagatccgg

SEQ ID NO: 168928 - DNA, 25 bp, E. coli
gcagctactgcaactaaagatccgg

SEQ ID NO: 168929 - DNA, 25 bp, E. coli
aattaacgaccgagatattttgata

SEQ ID NO: 168930 - DNA, 25 bp, E. coli
aattaacgaccgtgatattttgata

SEQ ID NO: 168931 - DNA, 25 bp, E. coli
caactacccggaagaccaggcagtg

SEQ ID NO: 168932 - DNA, 25 bp, E. coli
caactacccggatgaccaggcagtg

SEQ ID NO: 168933 - DNA, 25 bp, E. coli
tatgataacaacaacccggaagacc

SEQ ID NO: 168934 - DNA, 25 bp, E. coli
tatgataacaactacccggaagacc

SEQ ID NO: 168935 - DNA, 25 bp, E. coli
tgatattttgatttctgaccatgtc

SEQ ID NO: 168936 - DNA, 25 bp, E. coli
tgatattttgatatctgaccatgtc

SEQ ID NO: 168937 - DNA, 25 bp, E. coli
tgcgggaagcacttatgataacaac

SEQ ID NO: 168938 - DNA, 25 bp, E. coli
tgcgggaagcacatatgataacaac

SEQ ID NO: 168939 - DNA, 25 bp, E. coli
gcgcaaagacgtacgtggtgttttt

SEQ ID NO: 168940 - DNA, 25 bp, E. coli
gcgcaaagacgttcgtggtgttttt

SEQ ID NO: 168941 - DNA, 25 bp, E. coli
gacgttcgtggtctttttatggcga

SEQ ID NO: 168942 - DNA, 25 bp, E. coli
gaaagcgggcattgataacgcgaca

SEQ ID NO: 168943 - DNA, 25 bp, E. coli
gaaagcgggcatagataacgcgaca

SEQ ID NO: 168944 - DNA, 25 bp, E. coli
gacgttcgtggtgtttttatggcga

SEQ ID NO: 168945 - DNA, 25 bp, E. coli
ctatgagcggctttggcccggtgac

SEQ ID NO: 168946 - DNA, 25 bp, E. coli
ctatgagcggctatggcccggtgac

SEQ ID NO: 168947 - DNA, 25 bp, E. coli
ggctgactatgaccggctttggccc

SEQ ID NO: 168948 - DNA, 25 bp, E. coli
gggcattgataaggcgacagtcgct

SEQ ID NO: 168949 - DNA, 25 bp, E. coli
ggctgactatgagcggctttggccc

SEQ ID NO: 168950 - DNA, 25 bp, E. coli
gggcattgataacgcgacagtcgct

SEQ ID NO: 168951 - DNA, 25 bp, E. coli
cccgtactgggtccaacttctgaca

SEQ ID NO: 168952 - DNA, 25 bp, E. coli
cccgtactgggtgcaacttctgaca

SEQ ID NO: 168953 - DNA, 25 bp, E. coli
tagcccgctctgattgcaattagtg

SEQ ID NO: 168954 - DNA, 25 bp, E. coli
tagcccgctctgtttgcaattagtg

SEQ ID NO: 168955 - DNA, 25 bp, E. coli
tgctgttacgcatcccgattatggg

SEQ ID NO: 168956 - DNA, 25 bp, E. coli
tgaactgaccggaaagctggatgaa

SEQ ID NO: 168957 - DNA, 25 bp, E. coli
tgctgttacgcaacccgattatggg

SEQ ID NO: 168958 - DNA, 25 bp, E. coli
tgaactgaccggtaagctggatgaa

SEQ ID NO: 168959 - DNA, 25 bp, E. coli
tctatcaggcgatgatccgcacggg

SEQ ID NO: 168960 - DNA, 25 bp, E. coli
tcagagaaacaatgcgctgcccgta

SEQ ID NO: 168961 - DNA, 25 bp, E. coli
tctatcaggcgaagatccgcacggg

SEQ ID NO: 168962 - DNA, 25 bp, E. coli
cctggtcagaggaatttccgccgct

SEQ ID NO: 168963 - DNA, 25 bp, E. coli
cctggtcagaggtatttccgccgct

SEQ ID NO: 168964 - DNA, 25 bp, E. coli
gatggttacccctctaagcctgaag

SEQ ID NO: 168965 - DNA, 25 bp, E. coli
gatggttaccccactaagcctgaag

SEQ ID NO: 168966 - DNA, 25 bp, E. coli
gtaagcaactctggcgctggcatgg

SEQ ID NO: 168967 - DNA, 25 bp, E. coli
gtaagcaactctcgcgctggcatgg

SEQ ID NO: 168968 - DNA, 25 bp, E. coli
tggcggaacagcatcccagtaagca

SEQ ID NO: 168969 - DNA, 25 bp, E. coli
tggcggaacagcttcccagtaagca

SEQ ID NO: 168970 - DNA, 25 bp, E. coli
tcagagaaacaaagcgctgcccgta

SEQ ID NO: 168971 - DNA, 25 bp, E. coli
gatgaatgctgcattgaactggcgc

SEQ ID NO: 168972 - DNA, 25 bp, E. coli
gatgaatgctgctttgaactggcgc

SEQ ID NO: 168973 - DNA, 25 bp, E. coli
cgtcggtcagatcgcgcaaaccatt

SEQ ID NO: 168974 - DNA, 25 bp, E. coli
cgtcggtcagatggcgcaaaccatt

SEQ ID NO: 168975 - DNA, 25 bp, E. coli
aaaacattggttccggcgtgctggc

SEQ ID NO: 168976 - DNA, 25 bp, E. coli
aaaacattggttgcggcgtgctggc

SEQ ID NO: 168977 - DNA, 25 bp, E. coli
tttgaagcctgctccggcgtgctga

SEQ ID NO: 168978 - DNA, 25 bp, E. coli
tatatgaacggagacagttgcgcca

SEQ ID NO: 168979 - DNA, 25 bp, E. coli
tattccagctatagccgatatggcg

SEQ ID NO: 168980 - DNA, 25 bp, E. coli
tatatgaacggacacagttgcgcca

SEQ ID NO: 168981 - DNA, 25 bp, E. coli
tattccagctattgccgatatggcg

SEQ ID NO: 168982 - DNA, 25 bp, E. coli
tttgaagcctgcaccggcgtgctga

SEQ ID NO: 168983 - DNA, 25 bp, E. coli
gcgctgttctttttcggtgccggga

SEQ ID NO: 168984 - DNA, 25 bp, E. coli
gcgctgttctttatcggtgccggga

SEQ ID NO: 168985 - DNA, 25 bp, E. coli
gcacgcgcctgcataccagttataa

SEQ ID NO: 168986 - DNA, 25 bp, E. coli
gcacgcgcctgcttaccagttataa

SEQ ID NO: 168987 - DNA, 25 bp, E. coli
ccccgactggttaggcgtgatgaat

SEQ ID NO: 168988 - DNA, 25 bp, E. coli
ccccgactggtttggcgtgatgaat

SEQ ID NO: 168989 - DNA, 25 bp, E. coli
cggtctgctggatacgatgtggaac

SEQ ID NO: 168990 - DNA, 25 bp, E. coli
cggtctgctggaaacgatgtggaac

SEQ ID NO: 168991 - DNA, 25 bp, E. coli
ggtattactcgtggccgtcggtcag

SEQ ID NO: 168992 - DNA, 25 bp, E. coli
gtctcacagctgatttatggcccga

SEQ ID NO: 168993 - DNA, 25 bp, E. coli
ggtattactcgtcgccgtcggtcag

SEQ ID NO: 168994 - DNA, 25 bp, E. coli
gtctcacagctgttttatggcccga

SEQ ID NO: 168995 - DNA, 25 bp, E. coli
aaggcgatgagttgctgtgtgaaaa

SEQ ID NO: 168996 - DNA, 25 bp, E. coli
aaggcgatgagtagctgtgtgaaaa

SEQ ID NO: 168997 - DNA, 25 bp, E. coli
cagcttattgatcaagccaaacgta

SEQ ID NO: 168998 - DNA, 25 bp, E. coli
cagtggtggcagagctgataagaaa

SEQ ID NO: 168999 - DNA, 25 bp, E. coli
cagcttattgatgaagccaaacgta

SEQ ID NO: 169000 - DNA, 25 bp, E. coli
cagtggtggcagtgctgataagaaa

SEQ ID NO: 169001 - DNA, 25 bp, E. coli
tttcgcggcattgtggctccgggca

SEQ ID NO: 169002 - DNA, 25 bp, E. coli
ttccaacagtgagtttgtaccgctg

SEQ ID NO: 169003 - DNA, 25 bp, E. coli
tttcgcggcattctggctccgggca

SEQ ID NO: 169004 - DNA, 25 bp, E. coli
ttccaacagtgactttgtaccgctg

SEQ ID NO: 169005 - DNA, 25 bp, E. coli
tgataagaaaaaggctgcaccgcgt

SEQ ID NO: 169006 - DNA, 25 bp, E. coli
tgataagaaaaacgctgcaccgcgt

SEQ ID NO: 169007 - DNA, 25 bp, E. coli
tgcaccgcgtaaacgtagtgcgaaa

SEQ ID NO: 169008 - DNA, 25 bp, E. coli
tgcaccgcgtaatcgtagtgcgaaa

SEQ ID NO: 169009 - DNA, 25 bp, E. coli
tgcgaaaaaaagtccgccagcagat

SEQ ID NO: 169010 - DNA, 25 bp, E. coli
tgcgaaaaaaagaccgccagcagat

SEQ ID NO: 169011 - DNA, 25 bp, E. coli
gaactgttgttcaagcgtggtttcc

SEQ ID NO: 169012 - DNA, 25 bp, E. coli
gaactgttgttctagcgtggtttcc

SEQ ID NO: 169013 - DNA, 25 bp, E. coli
gatcgaccgtctacgttccaacagt

SEQ ID NO: 169014 - DNA, 25 bp, E. coli
gatcgaccgtcttcgttccaacagt

SEQ ID NO: 169015 - DNA, 25 bp, E. coli
gggacgctatatgagcttattgatc

SEQ ID NO: 169016 - DNA, 25 bp, E. coli
gggacgctatatcagcttattgatc

SEQ ID NO: 169017 - DNA, 25 bp, E. coli
aaatgaaagccgtcgtggtggtcgc

SEQ ID NO: 169018 - DNA, 25 bp, E. coli
aaatgaaagccgacgtggtggtcgc

SEQ ID NO: 169019 - DNA, 25 bp, E. coli
ttcaggatacccacgatacgccagt

SEQ ID NO: 169020 - DNA, 25 bp, E. coli
ttcaggataccctcgatacgccagt

SEQ ID NO: 169021 - DNA, 25 bp, E. coli
ttctggaaaaccttccgctgctcgg

SEQ ID NO: 169022 - DNA, 25 bp, E. coli
ttctggaaaaccatccgctgctcgg

SEQ ID NO: 169023 - DNA, 25 bp, E. coli
tggtggtcgctatcatccttgcagg

SEQ ID NO: 169024 - DNA, 25 bp, E. coli
tggtggtcgctaacatccttgcagg

SEQ ID NO: 169025 - DNA, 25 bp, E. coli
tgatgtgccggacgaaaacgccgtc

SEQ ID NO: 169026 - DNA, 25 bp, E. coli
tgatgtgccggaggaaaacgccgtc

SEQ ID NO: 169027 - DNA, 25 bp, E. coli
tgaaactgggtgcagcaaaagccat

SEQ ID NO: 169028 - DNA, 25 bp, E. coli
tgaaactgggtggagcaaaagccat

SEQ ID NO: 169029 - DNA, 25 bp, E. coli
tctgttcgacgctgaaaccgatatg

SEQ ID NO: 169030 - DNA, 25 bp, E. coli
tctgttcgacgcagaaaccgatatg

SEQ ID NO: 169031 - DNA, 25 bp, E. coli
ccttggatccaagtgaaactgaaca

SEQ ID NO: 169032 - DNA, 25 bp, E. coli
ccttggatccaactgaaactgaaca

SEQ ID NO: 169033 - DNA, 25 bp, E. coli
gaagataaagactgggagcgcgaat

SEQ ID NO: 169034 - DNA, 25 bp, E. coli
gaagataaagacagggagcgcgaat

SEQ ID NO: 169035 - DNA, 25 bp, E. coli
cgacgtggtggccattctggaaaac

SEQ ID NO: 169036 - DNA, 25 bp, E. coli
cgacgtggtggcgattctggaaaac

SEQ ID NO: 169037 - DNA, 25 bp, E. coli
ggataatttccagccgatgcgcttt

SEQ ID NO: 169038 - DNA, 25 bp, E. coli
ggataatttccacccgatgcgcttt

SEQ ID NO: 169039 - DNA, 25 bp, E. coli
aatacaacgctgattcgatggccgg

SEQ ID NO: 169040 - DNA, 25 bp, E. coli
aatacaacgctgtttcgatggccgg

SEQ ID NO: 169041 - DNA, 25 bp, E. coli
cactcaaaatgatgcctcgtgcgct

SEQ ID NO: 169042 - DNA, 25 bp, E. coli
cactcaaaatgaagcctcgtgcgct

SEQ ID NO: 169043 - DNA, 25 bp, E. coli
tttttatgaaagagcacgcacagag

SEQ ID NO: 169044 - DNA, 25 bp, E. coli
tttttatgaaagtgcacgcacagag

SEQ ID NO: 169045 - DNA, 25 bp, E. coli
tgtggtgtaccaggccagttacgtc

SEQ ID NO: 169046 - DNA, 25 bp, E. coli
tgtggtgtaccacgccagttacgtc

SEQ ID NO: 169047 - DNA, 25 bp, E. coli
tctactatgaagataccgatgccgg

SEQ ID NO: 169048 - DNA, 25 bp, E. coli
tctactatgaagttaccgatgccgg

SEQ ID NO: 169049 - DNA, 25 bp, E. coli
gaacgcgttgccattgtggtacgta

SEQ ID NO: 169050 - DNA, 25 bp, E. coli
gcaacgtattgtcaacgccgagaat

SEQ ID NO: 169051 - DNA, 25 bp, E. coli
gaacgcgttgcctttgtggtacgta

SEQ ID NO: 169052 - DNA, 25 bp, E. coli
gcaacgtattgtgaacgccgagaat

SEQ ID NO: 169053 - DNA, 25 bp, E. coli
gacgatatgctcgaaatacagactg

SEQ ID NO: 169054 - DNA, 25 bp, E. coli
gaaataacatcattgcgtggcacct

SEQ ID NO: 169055 - DNA, 25 bp, E. coli
gaaataacatcaatgcgtggcacct

SEQ ID NO: 169056 - DNA, 25 bp, E. coli
gacgatatgctccaaatacagactg

SEQ ID NO: 169057 - DNA, 25 bp, E. coli
ccaagtctattgacgcggagtttaa

SEQ ID NO: 169058 - DNA, 25 bp, E. coli
ccaagtctattgtcgcggagtttaa

SEQ ID NO: 169059 - DNA, 25 bp, E. coli
tggaatattacggacctgcgcggct

SEQ ID NO: 169060 - DNA, 25 bp, E. coli
tggaatattacgcacctgcgcggct

SEQ ID NO: 169061 - DNA, 25 bp, E. coli
tacggttgtcgctacgttactggcg

SEQ ID NO: 169062 - DNA, 25 bp, E. coli
tacggttgtcgcaacgttactggcg

SEQ ID NO: 169063 - DNA, 25 bp, E. coli
tataagcccctacctgacgatggcc

SEQ ID NO: 169064 - DNA, 25 bp, E. coli
tataagcccctagctgacgatggcc

SEQ ID NO: 169065 - DNA, 25 bp, E. coli
tattgctggagaaaacgccgctcgg

SEQ ID NO: 169066 - DNA, 25 bp, E. coli
tattctggtgactggtggtagcgcc

SEQ ID NO: 169067 - DNA, 25 bp, E. coli
tattctggtgacaggtggtagcgcc

SEQ ID NO: 169068 - DNA, 25 bp, E. coli
tattgctggagataacgccgctcgg

SEQ ID NO: 169069 - DNA, 25 bp, E. coli
tggtgtcaatccacgcggcagtact

SEQ ID NO: 169070 - DNA, 25 bp, E. coli
tcgaaactcaactcggctaaggcct

SEQ ID NO: 169071 - DNA, 25 bp, E. coli
tcgaaactcaacacggctaaggcct

SEQ ID NO: 169072 - DNA, 25 bp, E. coli
cctgattgggtctaacgaacgagca

SEQ ID NO: 169073 - DNA, 25 bp, E. coli
cctgattgggtcaaacgaacgagca

SEQ ID NO: 169074 - DNA, 25 bp, E. coli
gaaagcggcttctatattctcggta

SEQ ID NO: 169075 - DNA, 25 bp, E. coli
gaaagcggcttcaatattctcggta

SEQ ID NO: 169076 - DNA, 25 bp, E. coli
gataagtaatttgcagtccgtcgct

SEQ ID NO: 169077 - DNA, 25 bp, E. coli
gataagtaatttccagtccgtcgct

SEQ ID NO: 169078 - DNA, 25 bp, E. coli
tggtgtcaatcctcgcggcagtact

SEQ ID NO: 169079 - DNA, 25 bp, E. coli
ggcgactcagtaaccaccgggtatt

SEQ ID NO: 169080 - DNA, 25 bp, E. coli
ggcgactcagtatccaccgggtatt

SEQ ID NO: 169081 - DNA, 25 bp, E. coli
gagttttacttgatcggcctgctgg

SEQ ID NO: 169082 - DNA, 25 bp, E. coli
gagttttacttgttcggcctgctgg

SEQ ID NO: 169083 - DNA, 25 bp, E. coli
cagttgaataaatccggcatcgtgg

SEQ ID NO: 169084 - DNA, 25 bp, E. coli
catccggagaatgtagtcggcgtcc

SEQ ID NO: 169085 - DNA, 25 bp, E. coli
cagttgaataaaaccggcatcgtgg

SEQ ID NO: 169086 - DNA, 25 bp, E. coli
catccggagaatctagtcggcgtcc

SEQ ID NO: 169087 - DNA, 25 bp, E. coli
taaatgccgacacatgatcgaagcg

SEQ ID NO: 169088 - DNA, 25 bp, E. coli
taaatgccgacagatgatcgaagcg

SEQ ID NO: 169089 - DNA, 25 bp, E. coli
aactggcgtcgctcataacatggcg

SEQ ID NO: 169090 - DNA, 25 bp, E. coli
aactggcgtcgcacataacatggcg

SEQ ID NO: 169091 - DNA, 25 bp, E. coli
tatcgctatcaacagacgtacgccg

SEQ ID NO: 169092 - DNA, 25 bp, E. coli
tatgaacccggtaccgctgatgcac

SEQ ID NO: 169093 - DNA, 25 bp, E. coli
tatgaacccggttccgctgatgcac

SEQ ID NO: 169094 - DNA, 25 bp, E. coli
tatcgctatcaagagacgtacgccg

SEQ ID NO: 169095 - DNA, 25 bp, E. coli
tttatggtgcagcagcagatcgccc

SEQ ID NO: 169096 - DNA, 25 bp, E. coli
tttatggtgcaggagcagatcgccc

SEQ ID NO: 169097 - DNA, 25 bp, E. coli
tccgtggtgtacatactgcagagcg

SEQ ID NO: 169098 - DNA, 25 bp, E. coli
tccgtggtgtacttactgcagagcg

SEQ ID NO: 169099 - DNA, 25 bp, E. coli
gtttaaaacctgcttcgggcacaag

SEQ ID NO: 169100 - DNA, 25 bp, E. coli
gtttaaaacctggttcgggcacaag

SEQ ID NO: 169101 - DNA, 25 bp, E. coli
ggatgaatacgatctgcggcgcgtc

SEQ ID NO: 169102 - DNA, 25 bp, E. coli
ggatgaatacgaactgcggcgcgtc

SEQ ID NO: 169103 - DNA, 25 bp, E. coli
taatgatgataactatcgccccagc

SEQ ID NO: 169104 - DNA, 25 bp, E. coli
taatgatgataagtatcgccccagc

SEQ ID NO: 169105 - DNA, 25 bp, E. coli
accatgtttggcattggcggctcca

SEQ ID NO: 169106 - DNA, 25 bp, E. coli
atagtcggtgcgctggtcggcggct

SEQ ID NO: 169107 - DNA, 25 bp, E. coli
atgtttggcattcgcggctccatca

SEQ ID NO: 169108 - DNA, 25 bp, E. coli
atgggaattattccctggattattt

SEQ ID NO: 169109 - DNA, 25 bp, E. coli
atgggaattattgcctggattattt

SEQ ID NO: 169110 - DNA, 25 bp, E. coli
atagtcggtgcggtggtcggcggct

SEQ ID NO: 169111 - DNA, 25 bp, E. coli
accatgtttggctttggcggctcca

SEQ ID NO: 169112 - DNA, 25 bp, E. coli
atgtttggcattggcggctccatca

SEQ ID NO: 169113 - DNA, 25 bp, E. coli
tattccgcctccagcgaagagaata

SEQ ID NO: 169114 - DNA, 25 bp, E. coli
tattccgcctcctgcgaagagaata

SEQ ID NO: 169115 - DNA, 25 bp, E. coli
ttatcgccaagcaaatcatgccggg

SEQ ID NO: 169116 - DNA, 25 bp, E. coli
ttatcgccaagctaatcatgccggg

SEQ ID NO: 169117 - DNA, 25 bp, E. coli
tgatggtggtggttttttcctgacc

SEQ ID NO: 169118 - DNA, 25 bp, E. coli
tgatggtggtggatttttcctgacc

SEQ ID NO: 169119 - DNA, 25 bp, E. coli
tgcacagcttcctggtggcggtggt

SEQ ID NO: 169120 - DNA, 25 bp, E. coli
tgcacagcttccaggtggcggtggt

SEQ ID NO: 169121 - DNA, 25 bp, E. coli
ccaagctaatcatgccggggcgtga

SEQ ID NO: 169122 - DNA, 25 bp, E. coli
ccaagctaatcaagccggggcgtga

SEQ ID NO: 169123 - DNA, 25 bp, E. coli
ctggctggcgaccatgtttggcatt

SEQ ID NO: 169124 - DNA, 25 bp, E. coli
ctggctggcgacgatgtttggcatt

SEQ ID NO: 169125 - DNA, 25 bp, E. coli
ggtggatttttcctgacctgtattc

SEQ ID NO: 169126 - DNA, 25 bp, E. coli
ggtggatttttcgtgacctgtattc

SEQ ID NO: 169127 - DNA, 25 bp, E. coli
aacggataacacgtcgctcgctgag

SEQ ID NO: 169128 - DNA, 25 bp, E. coli
aacgatttttcggaagcgctggcaa

SEQ ID NO: 169129 - DNA, 25 bp, E. coli
cacggcactgttcaaactggcggtt

SEQ ID NO: 169130 - DNA, 25 bp, E. coli
cacggcactgttgaaactggcggtt

SEQ ID NO: 169131 - DNA, 25 bp, E. coli
tacggcggtcgtgacaagttagcgc

SEQ ID NO: 169132 - DNA, 25 bp, E. coli
tacggcggtcgtcacaagttagcgc

SEQ ID NO: 169133 - DNA, 25 bp, E. coli
aacattgtcgagatctacctgggca

SEQ ID NO: 169134 - DNA, 25 bp, E. coli
aacgatttttcgcaagcgctggcaa

SEQ ID NO: 169135 - DNA, 25 bp, E. coli
caaacgttaatggaaaggctcaagg

SEQ ID NO: 169136 - DNA, 25 bp, E. coli
caaacgttaatgcaaaggctcaagg

SEQ ID NO: 169137 - DNA, 25 bp, E. coli
aacattgtcgagttctacctgggca

SEQ ID NO: 169138 - DNA, 25 bp, E. coli
aacggataacacctcgctcgctgag

SEQ ID NO: 169139 - DNA, 25 bp, E. coli
tagtctgtggctatatctcgccgag

SEQ ID NO: 169140 - DNA, 25 bp, E. coli
tagtctgtggctttatctcgccgag

SEQ ID NO: 169141 - DNA, 25 bp, E. coli
tttaaccgatgacgaacgcgcacag

SEQ ID NO: 169142 - DNA, 25 bp, E. coli
tttaaccgatgaggaacgcgcacag

SEQ ID NO: 169143 - DNA, 25 bp, E. coli
taaaagtgaagtgctcgcggtacca

SEQ ID NO: 169144 - DNA, 25 bp, E. coli
taaaagtgaagtcctcgcggtacca

SEQ ID NO: 169145 - DNA, 25 bp, E. coli
tctgagggcatttgcgcgtaacgat

SEQ ID NO: 169146 - DNA, 25 bp, E. coli
tctgagggcattagcgcgtaacgat

SEQ ID NO: 169147 - DNA, 25 bp, E. coli
ggcatatatttatcgcaggcaggca

SEQ ID NO: 169148 - DNA, 25 bp, E. coli
ggcatatatttaacgcaggcaggca

SEQ ID NO: 169149 - DNA, 25 bp, E. coli
cacagactgagcactccggggcgtc

SEQ ID NO: 169150 - DNA, 25 bp, E. coli
cacagactgagctctccggggcgtc

SEQ ID NO: 169151 - DNA, 25 bp, E. coli
acgccttcagggacagattgcatca

SEQ ID NO: 169152 - DNA, 25 bp, E. coli
acgccttcagggtcagattgcatca

SEQ ID NO: 169153 - DNA, 25 bp, E. coli
agtctgcacagagtgagctctccgg

SEQ ID NO: 169154 - DNA, 25 bp, E. coli
agtctgcacagactgagctctccgg

SEQ ID NO: 169155 - DNA, 25 bp, E. coli
ttcagggacagattgcatcagcgca

SEQ ID NO: 169156 - DNA, 25 bp, E. coli
ttcagggacagaatgcatcagcgca

SEQ ID NO: 169157 - DNA, 25 bp, E. coli
tgccattgcctgtactcagtctgca

SEQ ID NO: 169158 - DNA, 25 bp, E. coli
tgcctgtactcactctgcacagact

SEQ ID NO: 169159 - DNA, 25 bp, E. coli
tgcctgtactcagtctgcacagact

SEQ ID NO: 169160 - DNA, 25 bp, E. coli
tgccattgcctgaactcagtctgca

SEQ ID NO: 169161 - DNA, 25 bp, E. coli
tcagggacagatagcatcagcgcag

SEQ ID NO: 169162 - DNA, 25 bp, E. coli
tcagggacagattgcatcagcgcag

SEQ ID NO: 169163 - DNA, 25 bp, E. coli
cttcagggacagtttgcatcagcgc

SEQ ID NO: 169164 - DNA, 25 bp, E. coli
cttcagggacagattgcatcagcgc

SEQ ID NO: 169165 - DNA, 25 bp, E. coli
gtctgcacagactgagctctccggg

SEQ ID NO: 169166 - DNA, 25 bp, E. coli
gtcgggtgattctggtgcctgaatc

SEQ ID NO: 169167 - DNA, 25 bp, E. coli
ggtgattctggtgcctgaatcacgc

SEQ ID NO: 169168 - DNA, 25 bp, E. coli
gtcgggtgattcaggtgcctgaatc

SEQ ID NO: 169169 - DNA, 25 bp, E. coli
ggtgattctggtccctgaatcacgc

SEQ ID NO: 169170 - DNA, 25 bp, E. coli
gtctgcacagacagagctctccggg

SEQ ID NO: 169171 - DNA, 25 bp, E. coli
ttatggtcacatggcgcttagcgta

SEQ ID NO: 169172 - DNA, 25 bp, E. coli
ttatggtcacatcgcgcttagcgta

SEQ ID NO: 169173 - DNA, 25 bp, E. coli
tttgtggaagatccggacggttaca

SEQ ID NO: 169174 - DNA, 25 bp, E. coli
tttgtggaagatgcggacggttaca

SEQ ID NO: 169175 - DNA, 25 bp, E. coli
ttaatcgaagagaaagacgccggtc

SEQ ID NO: 169176 - DNA, 25 bp, E. coli
ttaatcgaagagtaagacgccggtc

SEQ ID NO: 169177 - DNA, 25 bp, E. coli
tgctgggcatgaaactgctgcgtac

SEQ ID NO: 169178 - DNA, 25 bp, E. coli
tgctgggcatgatactgctgcgtac

SEQ ID NO: 169179 - DNA, 25 bp, E. coli
tcttcataccatcctgcgcgttggc

SEQ ID NO: 169180 - DNA, 25 bp, E. coli
tcttcataccatgctgcgcgttggc

SEQ ID NO: 169181 - DNA, 25 bp, E. coli
gctgaagcgtgccaaaaaatccgtc

SEQ ID NO: 169182 - DNA, 25 bp, E. coli
gctgaagcgtgcgaaaaaatccgtc

SEQ ID NO: 169183 - DNA, 25 bp, E. coli
gaactcggcactgcttatggtcaca

SEQ ID NO: 169184 - DNA, 25 bp, E. coli
gaactcggcactccttatggtcaca

SEQ ID NO: 169185 - DNA, 25 bp, E. coli
cgccggtcgcggactgggcaactaa

SEQ ID NO: 169186 - DNA, 25 bp, E. coli
cgccggtcgcggtctgggcaactaa

SEQ ID NO: 169187 - DNA, 25 bp, E. coli
cggaatacaaattctcactggcgtt

SEQ ID NO: 169188 - DNA, 25 bp, E. coli
cggaatacaaatactcactggcgtt

SEQ ID NO: 169189 - DNA, 25 bp, E. coli
gtgattgaactgacctacaactggg

SEQ ID NO: 169190 - DNA, 25 bp, E. coli
gtgattgaactgtcctacaactggg

SEQ ID NO: 169191 - DNA, 25 bp, E. coli
ggcgtggataaatacgaactcggca

SEQ ID NO: 169192 - DNA, 25 bp, E. coli
ggcgtggataaaaacgaactcggca

SEQ ID NO: 169193 - DNA, 25 bp, E. coli
caaagatcgcatcagttagacctgt

SEQ ID NO: 169194 - DNA, 25 bp, E. coli
caaagatcgcatgagttagacctgt

SEQ ID NO: 169195 - DNA, 25 bp, E. coli
cagacctcgtggctgaagaaagtaa

SEQ ID NO: 169196 - DNA, 25 bp, E. coli
cagacctcgtgggtgaagaaagtaa

SEQ ID NO: 169197 - DNA, 25 bp, E. coli
tgggctacatccacaaatcgcgcat

SEQ ID NO: 169198 - DNA, 25 bp, E. coli
tgggctacatcctcaaatcgcgcat

SEQ ID NO: 169199 - DNA, 25 bp, E. coli
tgggattgcagagaaacagttagcc

SEQ ID NO: 169200 - DNA, 25 bp, E. coli
tgggattgcagacaaacagttagcc

SEQ ID NO: 169201 - DNA, 25 bp, E. coli
tctcaacagtgttaatcgggctggt

SEQ ID NO: 169202 - DNA, 25 bp, E. coli
tctcaacagtgtaaatcgggctggt

SEQ ID NO: 169203 - DNA, 25 bp, E. coli
gaatccgaactggtcttgggctaca

SEQ ID NO: 169204 - DNA, 25 bp, E. coli
gaatccgaactgctcttgggctaca

SEQ ID NO: 169205 - DNA, 25 bp, E. coli
cattcttacagatacagatgggcca

SEQ ID NO: 169206 - DNA, 25 bp, E. coli
cattcttacagaaacagatgggcca

SEQ ID NO: 169207 - DNA, 25 bp, E. coli
gtttcgtaatgacccactaatgcca

SEQ ID NO: 169208 - DNA, 25 bp, E. coli
gtttcgtaatgagccactaatgcca

SEQ ID NO: 169209 - DNA, 25 bp, E. coli
gggcctgctatgctcgatacaataa

SEQ ID NO: 169210 - DNA, 25 bp, E. coli
gggcctgctatggtcgatacaataa

SEQ ID NO: 169211 - DNA, 25 bp, E. coli
ggttcactggaagacctaagcagct

SEQ ID NO: 169212 - DNA, 25 bp, E. coli
ggttcactggaacacctaagcagct

SEQ ID NO: 169213 - DNA, 25 bp, E. coli
tggctaaagaaactcaacgaatccg

SEQ ID NO: 169214 - DNA, 25 bp, E. coli
tggctaaagaaagtcaacgaatccg

SEQ ID NO: 169215 - DNA, 25 bp, E. coli
cacttttgcggacggagccgctgtc

SEQ ID NO: 169216 - DNA, 25 bp, E. coli
cagcgccacttttgcggagggagcc

SEQ ID NO: 169217 - DNA, 25 bp, E. coli
cacttttgcggagggagccgctgtc

SEQ ID NO: 169218 - DNA, 25 bp, E. coli
cagcgccactttagcggagggagcc

SEQ ID NO: 169219 - DNA, 25 bp, E. coli
agggagccgctgtccgggattatta

SEQ ID NO: 169220 - DNA, 25 bp, E. coli
agggagccgctgaccgggattatta

SEQ ID NO: 169221 - DNA, 25 bp, E. coli
atgatttccctcgagaacaccgtcg

SEQ ID NO: 169222 - DNA, 25 bp, E. coli
atgatttccctccagaacaccgtcg

SEQ ID NO: 169223 - DNA, 25 bp, E. coli
tgatttccctccagaacaccgtcga

SEQ ID NO: 169224 - DNA, 25 bp, E. coli
tgatttccctcctgaacaccgtcga

SEQ ID NO: 169225 - DNA, 25 bp, E. coli
tgtcagcgccacatttgcggaggga

SEQ ID NO: 169226 - DNA, 25 bp, E. coli
tgtcagcgccacttttgcggaggga

SEQ ID NO: 169227 - DNA, 25 bp, E. coli
tgatgatttcccaccagaacaccgt

SEQ ID NO: 169228 - DNA, 25 bp, E. coli
tgatgatttccctccagaacaccgt

SEQ ID NO: 169229 - DNA, 25 bp, E. coli
ccacttttgcggagggagccgctgt

SEQ ID NO: 169230 - DNA, 25 bp, E. coli
ccacttttgcggtgggagccgctgt

SEQ ID NO: 169231 - DNA, 25 bp, E. coli
ctccagaacaccctcgaaccggtag

SEQ ID NO: 169232 - DNA, 25 bp, E. coli
ctccagaacaccgtcgaaccggtag

SEQ ID NO: 169233 - DNA, 25 bp, E. coli
tcagcgccacttttgcggagggagc

SEQ ID NO: 169234 - DNA, 25 bp, E. coli
tcagcgccacttatgcggagggagc

SEQ ID NO: 169235 - DNA, 25 bp, E. coli
gatgatttccctgcagaacaccgtc

SEQ ID NO: 169236 - DNA, 25 bp, E. coli
gatgatttccctccagaacaccgtc

SEQ ID NO: 169237 - DNA, 25 bp, E. coli
agcatgttcacaactggtggattta

SEQ ID NO: 169238 - DNA, 25 bp, E. coli
agcgttattttctgagcagggagac

SEQ ID NO: 169239 - DNA, 25 bp, E. coli
agcatgttcacatctggtggattta

SEQ ID NO: 169240 - DNA, 25 bp, E. coli
agcgttattttcagagcagggagac

SEQ ID NO: 169241 - DNA, 25 bp, E. coli
tttgccatccgcgagccagtgtgac

SEQ ID NO: 169242 - DNA, 25 bp, E. coli
tttgccatccgccagccagtgtgac

SEQ ID NO: 169243 - DNA, 25 bp, E. coli
tgaagcatgttctcaactggtggat

SEQ ID NO: 169244 - DNA, 25 bp, E. coli
tgaagcatgttcacaactggtggat

SEQ ID NO: 169245 - DNA, 25 bp, E. coli
tccgcgagccagtgtgacaggtgat

SEQ ID NO: 169246 - DNA, 25 bp, E. coli
tccgcgagccagagtgacaggtgat

SEQ ID NO: 169247 - DNA, 25 bp, E. coli
gccagtgtgacaggtgatgaagcat

SEQ ID NO: 169248 - DNA, 25 bp, E. coli
gccagtgtgacacgtgatgaagcat

SEQ ID NO: 169249 - DNA, 25 bp, E. coli
gacaggtgatgatgcatgttcacaa

SEQ ID NO: 169250 - DNA, 25 bp, E. coli
gacaggtgatgaagcatgttcacaa

SEQ ID NO: 169251 - DNA, 25 bp, E. coli
cgaagcgttattttcagagcaggga

SEQ ID NO: 169252 - DNA, 25 bp, E. coli
cgaagcgttattatcagagcaggga

SEQ ID NO: 169253 - DNA, 25 bp, E. coli
taaccgaagcgttattttcagagca

SEQ ID NO: 169254 - DNA, 25 bp, E. coli
taatcacacgaccagtccatcatcg

SEQ ID NO: 169255 - DNA, 25 bp, E. coli
taatcacacgacgagtccatcatcg

SEQ ID NO: 169256 - DNA, 25 bp, E. coli
taaccgaagcgtaattttcagagca

SEQ ID NO: 169257 - DNA, 25 bp, E. coli
gatgaagcatgttcacaactggtgg

SEQ ID NO: 169258 - DNA, 25 bp, E. coli
gatgaagcatgtacacaactggtgg

SEQ ID NO: 169259 - DNA, 25 bp, E. coli
cacaatggtgagtggaaattccgcg

SEQ ID NO: 169260 - DNA, 25 bp, E. coli
cacaatggtgagaggaaattccgcg

SEQ ID NO: 169261 - DNA, 25 bp, E. coli
aaattccgcgcactaggccagggtt

SEQ ID NO: 169262 - DNA, 25 bp, E. coli
aaattccgcgcagtaggccagggtt

SEQ ID NO: 169263 - DNA, 25 bp, E. coli
tataacaacctgtcgtcatccgacg

SEQ ID NO: 169264 - DNA, 25 bp, E. coli
tataacaacctgacgtcatccgacg

SEQ ID NO: 169265 - DNA, 25 bp, E. coli
tgcgcgttcaactgacggtcaggac

SEQ ID NO: 169266 - DNA, 25 bp, E. coli
tgcgcgttcaacagacggtcaggac

SEQ ID NO: 169267 - DNA, 25 bp, E. coli
ccagagctttggacaggtatccggt

SEQ ID NO: 169268 - DNA, 25 bp, E. coli
ccagagctttggtcaggtatccggt

SEQ ID NO: 169269 - DNA, 25 bp, E. coli
gctgaaaattaaactggacgccgtc

SEQ ID NO: 169270 - DNA, 25 bp, E. coli
gctgaaaattaatctggacgccgtc

SEQ ID NO: 169271 - DNA, 25 bp, E. coli
gaagatgcgtcctctgagactgcca

SEQ ID NO: 169272 - DNA, 25 bp, E. coli
gaagatgcgtccactgagactgcca

SEQ ID NO: 169273 - DNA, 25 bp, E. coli
gaacgtctccctcagtaaagcagct

SEQ ID NO: 169274 - DNA, 25 bp, E. coli
gaacgtctccctgagtaaagcagct

SEQ ID NO: 169275 - DNA, 25 bp, E. coli
gataaccagactgaagtcgctcgct

SEQ ID NO: 169276 - DNA, 25 bp, E. coli
gataaccagactcaagtcgctcgct

SEQ ID NO: 169277 - DNA, 25 bp, E. coli
tcaaacggcaaactgcgcggcgatt

SEQ ID NO: 169278 - DNA, 25 bp, E. coli
tcaatgaaaaatctcctggtgggcc

SEQ ID NO: 169279 - DNA, 25 bp, E. coli
tcaatgaaaaatgtcctggtgggcc

SEQ ID NO: 169280 - DNA, 25 bp, E. coli
tcaaacggcaaagtgcgcggcgatt

SEQ ID NO: 169281 - DNA, 25 bp, E. coli
aatgcacttgctcttggctgtggac

SEQ ID NO: 169282 - DNA, 25 bp, E. coli
aatgcacttgctgttggctgtggac

SEQ ID NO: 169283 - DNA, 25 bp, E. coli
tgcttcggctatcacactaaccagg

SEQ ID NO: 169284 - DNA, 25 bp, E. coli
tgaatgttgcacctgctcaggcgca

SEQ ID NO: 169285 - DNA, 25 bp, E. coli
tgaatgttgcacgtgctcaggcgca

SEQ ID NO: 169286 - DNA, 25 bp, E. coli
tgcttcggctatgacactaaccagg

SEQ ID NO: 169287 - DNA, 25 bp, E. coli
tcgattacctggtcgtgagcaagag

SEQ ID NO: 169288 - DNA, 25 bp, E. coli
tcgattacctggacgtgagcaagag

SEQ ID NO: 169289 - DNA, 25 bp, E. coli
tcttgataccggcaaaaggttggcg

SEQ ID NO: 169290 - DNA, 25 bp, E. coli
tcaggatggtgatgatgcctctaca

SEQ ID NO: 169291 - DNA, 25 bp, E. coli
tcttgataccgggaaaaggttggcg

SEQ ID NO: 169292 - DNA, 25 bp, E. coli
tcttatcagacatggagcgcagact

SEQ ID NO: 169293 - DNA, 25 bp, E. coli
tcaggatggtgaagatgcctctaca

SEQ ID NO: 169294 - DNA, 25 bp, E. coli
tcttatcagacaaggagcgcagact

SEQ ID NO: 169295 - DNA, 25 bp, E. coli
gcaagagttaatggcagaggcgttc

SEQ ID NO: 169296 - DNA, 25 bp, E. coli
gcaagagttaatcgcagaggcgttc

SEQ ID NO: 169297 - DNA, 25 bp, E. coli
gcactaatgcggcaaggcgtctgca

SEQ ID NO: 169298 - DNA, 25 bp, E. coli
gcactaatgcgggaaggcgtctgca

SEQ ID NO: 169299 - DNA, 25 bp, E. coli
tggcgaatcattgccgagcgtcttc

SEQ ID NO: 169300 - DNA, 25 bp, E. coli
tggcgaatcattcccgagcgtcttc

SEQ ID NO: 169301 - DNA, 25 bp, E. coli
taatactgaccttaaggaactctgg

SEQ ID NO: 169302 - DNA, 25 bp, E. coli
taatactgacctaaaggaactctgg

SEQ ID NO: 169303 - DNA, 25 bp, E. coli
acggcgatgtgggtcgattgctatc

SEQ ID NO: 169304 - DNA, 25 bp, E. coli
acggcgatgtggctcgattgctatc

SEQ ID NO: 169305 - DNA, 25 bp, E. coli
tattttgcgcaaggctggaagctcg

SEQ ID NO: 169306 - DNA, 25 bp, E. coli
tatcatgaaagaagtgccgcgaatc

SEQ ID NO: 169307 - DNA, 25 bp, E. coli
tatcatgaaagatgtgccgcgaatc

SEQ ID NO: 169308 - DNA, 25 bp, E. coli
tattttgcgcaacgctggaagctcg

SEQ ID NO: 169309 - DNA, 25 bp, E. coli
tgcccgttgccgtttgtggcgcgac

SEQ ID NO: 169310 - DNA, 25 bp, E. coli
tgcccgttgccgattgtggcgcgac

SEQ ID NO: 169311 - DNA, 25 bp, E. coli
ccttcgataaccacaaagtgccgtt

SEQ ID NO: 169312 - DNA, 25 bp, E. coli
ccttcgataacctcaaagtgccgtt

SEQ ID NO: 169313 - DNA, 25 bp, E. coli
cctgtttagcgcgtggatgttagcc

SEQ ID NO: 169314 - DNA, 25 bp, E. coli
cctgtttagcgcctggatgttagcc

SEQ ID NO: 169315 - DNA, 25 bp, E. coli
gcgaatcatgaaacgcgaatggcaa

SEQ ID NO: 169316 - DNA, 25 bp, E. coli
gcgaatcatgaatcgcgaatggcaa

SEQ ID NO: 169317 - DNA, 25 bp, E. coli
gcaacctgggatacggcgtttcgtt

SEQ ID NO: 169318 - DNA, 25 bp, E. coli
gcaacctgggattcggcgtttcgtt

SEQ ID NO: 169319 - DNA, 25 bp, E. coli
cgtcgcgccggttctgtggttcctg

SEQ ID NO: 169320 - DNA, 25 bp, E. coli
cgtcgcgccggtactgtggttcctg

SEQ ID NO: 169321 - DNA, 25 bp, E. coli
gtttaaagagatccgcaccgccctg

SEQ ID NO: 169322 - DNA, 25 bp, E. coli
gtttaaagagatgcgcaccgccctg

SEQ ID NO: 169323 - DNA, 25 bp, E. coli
gatgatcccgctccttaatctgttc

SEQ ID NO: 169324 - DNA, 25 bp, E. coli
gatgatcccgctgcttaatctgttc

SEQ ID NO: 169325 - DNA, 25 bp, E. coli
caaagtcgaagttttaagtgccggt

SEQ ID NO: 169326 - DNA, 25 bp, E. coli
caaagtcgaagtattaagtgccggt

SEQ ID NO: 169327 - DNA, 25 bp, E. coli
cagaagatgccaaagaagccgatta

SEQ ID NO: 169328 - DNA, 25 bp, E. coli
cagaagatgccatagaagccgatta

SEQ ID NO: 169329 - DNA, 25 bp, E. coli
aactctatccggttgcggagctgcg

SEQ ID NO: 169330 - DNA, 25 bp, E. coli
aactctatccggatgcggagctgcg

SEQ ID NO: 169331 - DNA, 25 bp, E. coli
tattaaccgcccctgaaagctggca

SEQ ID NO: 169332 - DNA, 25 bp, E. coli
tattaaccgcccgtgaaagctggca

SEQ ID NO: 169333 - DNA, 25 bp, E. coli
tgtactgatgggtcgtctgcgcaaa

SEQ ID NO: 169334 - DNA, 25 bp, E. coli
tgtactgatgggacgtctgcgcaaa

SEQ ID NO: 169335 - DNA, 25 bp, E. coli
tgacgaagtgatgaaactgaccgcg

SEQ ID NO: 169336 - DNA, 25 bp, E. coli
tgacgaagtgatcaaactgaccgcg

SEQ ID NO: 169337 - DNA, 25 bp, E. coli
tgcgcgtactggatgttgaagacaa

SEQ ID NO: 169338 - DNA, 25 bp, E. coli
tgcgcgtactggttgttgaagacaa

SEQ ID NO: 169339 - DNA, 25 bp, E. coli
tcatattgaagacgtgatggcgcga

SEQ ID NO: 169340 - DNA, 25 bp, E. coli
tcatattgaagaggtgatggcgcga

SEQ ID NO: 169341 - DNA, 25 bp, E. coli
gacaatgcgttgatacgtcaccacc

SEQ ID NO: 169342 - DNA, 25 bp, E. coli
gacaatgcgttgttacgtcaccacc

SEQ ID NO: 169343 - DNA, 25 bp, E. coli
gaaacgttgatacgcaataatggca

SEQ ID NO: 169344 - DNA, 25 bp, E. coli
gaaacgttgataggcaataatggca

SEQ ID NO: 169345 - DNA, 25 bp, E. coli
cgaatgcaggcattaatgcggcgta

SEQ ID NO: 169346 - DNA, 25 bp, E. coli
cgaatgcaggcaataatgcggcgta

SEQ ID NO: 169347 - DNA, 25 bp, E. coli
cacttggagccaccatgattctggg

SEQ ID NO: 169348 - DNA, 25 bp, E. coli
cacttggagccagcatgattctggg

SEQ ID NO: 169349 - DNA, 25 bp, E. coli
acttggagccagcatgattctgggc

SEQ ID NO: 169350 - DNA, 25 bp, E. coli
acttggagccaggatgattctgggc

SEQ ID NO: 169351 - DNA, 25 bp, E. coli
ttggagccagcatgattctgggcgg

SEQ ID NO: 169352 - DNA, 25 bp, E. coli
ttcacttggagccagcatgattctg

SEQ ID NO: 169353 - DNA, 25 bp, E. coli
tttcacttggaggcagcatgattct

SEQ ID NO: 169354 - DNA, 25 bp, E. coli
ttggagccagcaagattctgggcgg

SEQ ID NO: 169355 - DNA, 25 bp, E. coli
ttcacttggagcgagcatgattctg

SEQ ID NO: 169356 - DNA, 25 bp, E. coli
tttcacttggagccagcatgattct

SEQ ID NO: 169357 - DNA, 25 bp, E. coli
ttttcacttggacccagcatgattc

SEQ ID NO: 169358 - DNA, 25 bp, E. coli
ttttcacttggagccagcatgattc

SEQ ID NO: 169359 - DNA, 25 bp, E. coli
tcacttggagccagcatgattctgg

SEQ ID NO: 169360 - DNA, 25 bp, E. coli
cttggagccagcttgattctgggcg

SEQ ID NO: 169361 - DNA, 25 bp, E. coli
cttggagccagcatgattctgggcg

SEQ ID NO: 169362 - DNA, 25 bp, E. coli
gttttcacttggtgccagcatgatt

SEQ ID NO: 169363 - DNA, 25 bp, E. coli
gttttcacttggagccagcatgatt

SEQ ID NO: 169364 - DNA, 25 bp, E. coli
tggagccagcatgattctgggcggt

SEQ ID NO: 169365 - DNA, 25 bp, E. coli
tggagccagcatcattctgggcggt

SEQ ID NO: 169366 - DNA, 25 bp, E. coli
tcacttggagcctgcatgattctgg

SEQ ID NO: 169367 - DNA, 25 bp, E. coli
caagcgcagatatggcaaaaatgcc

SEQ ID NO: 169368 - DNA, 25 bp, E. coli
caagcgcagataaggcaaaaatgcc

SEQ ID NO: 169369 - DNA, 25 bp, E. coli
cagaagtcgccgcaagcgcagatat

SEQ ID NO: 169370 - DNA, 25 bp, E. coli
caccgccgagcttacggtgctgacg

SEQ ID NO: 169371 - DNA, 25 bp, E. coli
cagaagtcgccggaagcgcagatat

SEQ ID NO: 169372 - DNA, 25 bp, E. coli
caccgccgagctaacggtgctgacg

SEQ ID NO: 169373 - DNA, 25 bp, E. coli
tactgggtactggtggtcgtggttg

SEQ ID NO: 169374 - DNA, 25 bp, E. coli
tactgggtactgctggtcgtggttg

SEQ ID NO: 169375 - DNA, 25 bp, E. coli
agcttacggtgctgacgctggtcgc

SEQ ID NO: 169376 - DNA, 25 bp, E. coli
agcttacggtgcagacgctggtcgc

SEQ ID NO: 169377 - DNA, 25 bp, E. coli
aggtgcagcccacgcagaagtcgcc

SEQ ID NO: 169378 - DNA, 25 bp, E. coli
aggtgcagcccaggcagaagtcgcc

SEQ ID NO: 169379 - DNA, 25 bp, E. coli
ctgtacaggtgcagcccacgcagaa

SEQ ID NO: 169380 - DNA, 25 bp, E. coli
ctgtacaggtgctgcccacgcagaa

SEQ ID NO: 169381 - DNA, 25 bp, E. coli
tggtggtcccggtattagaaccatc

SEQ ID NO: 169382 - DNA, 25 bp, E. coli
ggtattagaaccatcaccgccaccg

SEQ ID NO: 169383 - DNA, 25 bp, E. coli
ggtattagaaccttcaccgccaccg

SEQ ID NO: 169384 - DNA, 25 bp, E. coli
tggtggtcccggaattagaaccatc

SEQ ID NO: 169385 - DNA, 25 bp, E. coli
ggcaaaaatgccatacagaactttt

SEQ ID NO: 169386 - DNA, 25 bp, E. coli
tggtcgcggaggtactccccgccga

SEQ ID NO: 169387 - DNA, 25 bp, E. coli
tggtcgcggaggaactccccgccga

SEQ ID NO: 169388 - DNA, 25 bp, E. coli
ggcaaaaatgccttacagaactttt

SEQ ID NO: 169389 - DNA, 25 bp, E. coli
cacctctctcttaatgaaattctgg

SEQ ID NO: 169390 - DNA, 25 bp, E. coli
cacctctctctttatgaaattctgg

SEQ ID NO: 169391 - DNA, 25 bp, E. coli
tacagcgcgaaatcacaaacaatcg

SEQ ID NO: 169392 - DNA, 25 bp, E. coli
tacagcgcgaaaacacaaacaatcg

SEQ ID NO: 169393 - DNA, 25 bp, E. coli
aaattctggattaaccaagcgctaa

SEQ ID NO: 169394 - DNA, 25 bp, E. coli
aaattctggatttaccaagcgctaa

SEQ ID NO: 169395 - DNA, 25 bp, E. coli
tagagttaatgtatccagtactccc

SEQ ID NO: 169396 - DNA, 25 bp, E. coli
tagagttaatgtttccagtactccc

SEQ ID NO: 169397 - DNA, 25 bp, E. coli
tgtattacagaataaacatgcctat

SEQ ID NO: 169398 - DNA, 25 bp, E. coli
tgtattacagaaaaaacatgcctat

SEQ ID NO: 169399 - DNA, 25 bp, E. coli
tcagcgctatgaaaaaacaccacct

SEQ ID NO: 169400 - DNA, 25 bp, E. coli
ccagtactccctattctcttgcata

SEQ ID NO: 169401 - DNA, 25 bp, E. coli
cctacgaggtcatactttaggaagt

SEQ ID NO: 169402 - DNA, 25 bp, E. coli
cctacgaggtcaaactttaggaagt

SEQ ID NO: 169403 - DNA, 25 bp, E. coli
ccagtactcccttttctcttgcata

SEQ ID NO: 169404 - DNA, 25 bp, E. coli
gaatgataatatacctacagcgcga

SEQ ID NO: 169405 - DNA, 25 bp, E. coli
gaatgataatattcctacagcgcga

SEQ ID NO: 169406 - DNA, 25 bp, E. coli
gttgcaacttacatctcagcgctat

SEQ ID NO: 169407 - DNA, 25 bp, E. coli
gtattgcatttatctccctacgagg

SEQ ID NO: 169408 - DNA, 25 bp, E. coli
gtattgcatttaactccctacgagg

SEQ ID NO: 169409 - DNA, 25 bp, E. coli
gttgcaacttacttctcagcgctat

SEQ ID NO: 169410 - DNA, 25 bp, E. coli
tcagcgctatgataaaacaccacct

SEQ ID NO: 169411 - DNA, 25 bp, E. coli
cagaacccctgaaacataatttgtc

SEQ ID NO: 169412 - DNA, 25 bp, E. coli
cagaacccctgatacataatttgtc

SEQ ID NO: 169413 - DNA, 25 bp, E. coli
tacgcggttaccgacgattcactgc

SEQ ID NO: 169414 - DNA, 25 bp, E. coli
tacgcggttacccacgattcactgc

SEQ ID NO: 169415 - DNA, 25 bp, E. coli
taccgacgattcactgctcattgca

SEQ ID NO: 169416 - DNA, 25 bp, E. coli
taccgacgattctctgctcattgca

SEQ ID NO: 169417 - DNA, 25 bp, E. coli
ttctggtcccgaggcattacagagg

SEQ ID NO: 169418 - DNA, 25 bp, E. coli
ttctggtcccgacgcattacagagg

SEQ ID NO: 169419 - DNA, 25 bp, E. coli
gctcattgcagcttgtcgttatcat

SEQ ID NO: 169420 - DNA, 25 bp, E. coli
gcattacagaggagcaccgtctggt

SEQ ID NO: 169421 - DNA, 25 bp, E. coli
gcattacagaggtgcaccgtctggt

SEQ ID NO: 169422 - DNA, 25 bp, E. coli
gctcattgcagcatgtcgttatcat

SEQ ID NO: 169423 - DNA, 25 bp, E. coli
gattatctgtacaggcaggaaacag

SEQ ID NO: 169424 - DNA, 25 bp, E. coli
gattatctgtactggcaggaaacag

SEQ ID NO: 169425 - DNA, 25 bp, E. coli
gggaagccagaacccctgaaacata

SEQ ID NO: 169426 - DNA, 25 bp, E. coli
gggaagccagaagccctgaaacata

SEQ ID NO: 169427 - DNA, 25 bp, E. coli
tggcaggaaacagataagcgaattg

SEQ ID NO: 169428 - DNA, 25 bp, E. coli
tggcaggaaacacataagcgaattg

SEQ ID NO: 169429 - DNA, 25 bp, E. coli
taatctggtctgtggaatcatggga

SEQ ID NO: 169430 - DNA, 25 bp, E. coli
taatctggtctgaggaatcatggga

SEQ ID NO: 169431 - DNA, 25 bp, E. coli
gagcaccgtctggtatacgcggtta

SEQ ID NO: 169432 - DNA, 25 bp, E. coli
gagcaccgtctgctatacgcggtta

SEQ ID NO: 169433 - DNA, 25 bp, E. coli
cataaattatccgtgtgactggcgt

SEQ ID NO: 169434 - DNA, 25 bp, E. coli
ctaaaattcttagccatactggaca

SEQ ID NO: 169435 - DNA, 25 bp, E. coli
ctaaaattcttacccatactggaca

SEQ ID NO: 169436 - DNA, 25 bp, E. coli
catactggacaactcccctatggag

SEQ ID NO: 169437 - DNA, 25 bp, E. coli
cataaattatccctgtgactggcgt

SEQ ID NO: 169438 - DNA, 25 bp, E. coli
catactggacaagtcccctatggag

SEQ ID NO: 169439 - DNA, 25 bp, E. coli
taccggtgtagtattcagggagata

SEQ ID NO: 169440 - DNA, 25 bp, E. coli
taccggtgtagttttcagggagata

SEQ ID NO: 169441 - DNA, 25 bp, E. coli
tgtgacgcagcgcataaattatccc

SEQ ID NO: 169442 - DNA, 25 bp, E. coli
tgtagcagtttttgtgacgcagcgc

SEQ ID NO: 169443 - DNA, 25 bp, E. coli
tgtagcagttttagtgacgcagcgc

SEQ ID NO: 169444 - DNA, 25 bp, E. coli
tgtgacgcagcggataaattatccc

SEQ ID NO: 169445 - DNA, 25 bp, E. coli
tcccctatggagacataatcttaat

SEQ ID NO: 169446 - DNA, 25 bp, E. coli
tcccctatggagtcataatcttaat

SEQ ID NO: 169447 - DNA, 25 bp, E. coli
tcagggagatactgaaaaggaaaat

SEQ ID NO: 169448 - DNA, 25 bp, E. coli
tcagggagatacagaaaaggaaaat

SEQ ID NO: 169449 - DNA, 25 bp, E. coli
ccacaatgtcatgagggagcggagt

SEQ ID NO: 169450 - DNA, 25 bp, E. coli
ccacaatgtcatcagggagcggagt

SEQ ID NO: 169451 - DNA, 25 bp, E. coli
cctgtgactggcgttgctaaaattc

SEQ ID NO: 169452 - DNA, 25 bp, E. coli
cctgtgactggccttgctaaaattc

SEQ ID NO: 169453 - DNA, 25 bp, E. coli
ggaaaatgacaataaccacaatgtc

SEQ ID NO: 169454 - DNA, 25 bp, E. coli
ggaaaatgacaaaaaccacaatgtc

SEQ ID NO: 169455 - DNA, 25 bp, E. coli
aatttctggaggtgtacggcctgcc

SEQ ID NO: 169456 - DNA, 25 bp, E. coli
aatttctggaggagtacggcctgcc

SEQ ID NO: 169457 - DNA, 25 bp, E. coli
aaaactattccgagcgcgatctggc

SEQ ID NO: 169458 - DNA, 25 bp, E. coli
aaaactattccgtgcgcgatctggc

SEQ ID NO: 169459 - DNA, 25 bp, E. coli
tattcctgcatggagattgagcacg

SEQ ID NO: 169460 - DNA, 25 bp, E. coli
tattcctgcatgcagattgagcacg

SEQ ID NO: 169461 - DNA, 25 bp, E. coli
tcttgccattcagagcgtgccctgg

SEQ ID NO: 169462 - DNA, 25 bp, E. coli
tcttgccattcacagcgtgccctgg

SEQ ID NO: 169463 - DNA, 25 bp, E. coli
tcttccgtgtccctcagagtggcaa

SEQ ID NO: 169464 - DNA, 25 bp, E. coli
tctgtttccagacaaaagagccggg

SEQ ID NO: 169465 - DNA, 25 bp, E. coli
tctgtttccagagaaaagagccggg

SEQ ID NO: 169466 - DNA, 25 bp, E. coli
tcttccgtgtccgtcagagtggcaa

SEQ ID NO: 169467 - DNA, 25 bp, E. coli
gttatattgaacttccggcctcggg

SEQ ID NO: 169468 - DNA, 25 bp, E. coli
gttatattgaacatccggcctcggg

SEQ ID NO: 169469 - DNA, 25 bp, E. coli
ggatacccacctatttgcagagctg

SEQ ID NO: 169470 - DNA, 25 bp, E. coli
ggatacccacctttttgcagagctg

SEQ ID NO: 169471 - DNA, 25 bp, E. coli
tcagacagacaaagagatgccaccg

SEQ ID NO: 169472 - DNA, 25 bp, E. coli
taacccggatgaattgagcgaactg

SEQ ID NO: 169473 - DNA, 25 bp, E. coli
taacccggatgatttgagcgaactg

SEQ ID NO: 169474 - DNA, 25 bp, E. coli
tcagacagacaatgagatgccaccg

SEQ ID NO: 169475 - DNA, 25 bp, E. coli
gatgccatgctgattgacgccacgg

SEQ ID NO: 169476 - DNA, 25 bp, E. coli
gatgccatgctgtttgacgccacgg

SEQ ID NO: 169477 - DNA, 25 bp, E. coli
aaccgctgccgatagagttgctgga

SEQ ID NO: 169478 - DNA, 25 bp, E. coli
caaacgccggtaaatgggataacag

SEQ ID NO: 169479 - DNA, 25 bp, E. coli
caaacgccggtatatgggataacag

SEQ ID NO: 169480 - DNA, 25 bp, E. coli
cacgctttcagcgatattttcgccg

SEQ ID NO: 169481 - DNA, 25 bp, E. coli
cacgctttcagccatattttcgccg

SEQ ID NO: 169482 - DNA, 25 bp, E. coli
actggcggcagatgctttctcgcgc

SEQ ID NO: 169483 - DNA, 25 bp, E. coli
aaccgctgccgaaagagttgctgga

SEQ ID NO: 169484 - DNA, 25 bp, E. coli
actggcggcagaagctttctcgcgc

SEQ ID NO: 169485 - DNA, 25 bp, E. coli
tattttcgccggaggttatgccgca

SEQ ID NO: 169486 - DNA, 25 bp, E. coli
tttccggtatcaccggtgtgccgtg

SEQ ID NO: 169487 - DNA, 25 bp, E. coli
tttccggtatcagcggtgtgccgtg

SEQ ID NO: 169488 - DNA, 25 bp, E. coli
tattttcgccggtggttatgccgca

SEQ ID NO: 169489 - DNA, 25 bp, E. coli
tgttcactcacgtcgaagtgatcac

SEQ ID NO: 169490 - DNA, 25 bp, E. coli
tgttcactcacgacgaagtgatcac

SEQ ID NO: 169491 - DNA, 25 bp, E. coli
ccggcgaaccgctgccgaaagagtt

SEQ ID NO: 169492 - DNA, 25 bp, E. coli
ccggcgaaccgcagccgaaagagtt

SEQ ID NO: 169493 - DNA, 25 bp, E. coli
cggcgctgttcagtcacgacgaagt

SEQ ID NO: 169494 - DNA, 25 bp, E. coli
cggcgctgttcactcacgacgaagt

SEQ ID NO: 169495 - DNA, 25 bp, E. coli
gtgtttccggtatcagcggtgtgcc

SEQ ID NO: 169496 - DNA, 25 bp, E. coli
gtgtttccggtaacagcggtgtgcc

SEQ ID NO: 169497 - DNA, 25 bp, E. coli
ggcagatgctttctcgcgctttgag

SEQ ID NO: 169498 - DNA, 25 bp, E. coli
ggcagatgctttgtcgcgctttgag

SEQ ID NO: 169499 - DNA, 25 bp, E. coli
caatgccgggcattttcaggtggtg

SEQ ID NO: 169500 - DNA, 25 bp, E. coli
caatgccgggcaatttcaggtggtg

SEQ ID NO: 169501 - DNA, 25 bp, E. coli
aagcacaatgaaggcgagatctccg

SEQ ID NO: 169502 - DNA, 25 bp, E. coli
aagcacaatgaacgcgagatctccg

SEQ ID NO: 169503 - DNA, 25 bp, E. coli
tactggcaggtgattgcgctggcaa

SEQ ID NO: 169504 - DNA, 25 bp, E. coli
tacgtcacctgatgaccggcagctt

SEQ ID NO: 169505 - DNA, 25 bp, E. coli
tactggcaggtgtttgcgctggcaa

SEQ ID NO: 169506 - DNA, 25 bp, E. coli
tacgtcacctgaagaccggcagctt

SEQ ID NO: 169507 - DNA, 25 bp, E. coli
tgctatgcggcctgaacggcgttat

SEQ ID NO: 169508 - DNA, 25 bp, E. coli
tgctatgcggccagaacggcgttat

SEQ ID NO: 169509 - DNA, 25 bp, E. coli
cctgggcacgctggacattgtttaa

SEQ ID NO: 169510 - DNA, 25 bp, E. coli
cctgggcacgctcgacattgtttaa

SEQ ID NO: 169511 - DNA, 25 bp, E. coli
gcttcccgatgctgtgcgcgatgat

SEQ ID NO: 169512 - DNA, 25 bp, E. coli
gcttcccgatgcagtgcgcgatgat

SEQ ID NO: 169513 - DNA, 25 bp, E. coli
gcaatattgcgacggtgagccactg

SEQ ID NO: 169514 - DNA, 25 bp, E. coli
gaagcgatcttcatctacctgccgg

SEQ ID NO: 169515 - DNA, 25 bp, E. coli
gaagcgatcttcttctacctgccgg

SEQ ID NO: 169516 - DNA, 25 bp, E. coli
gcaatattgcgagggtgagccactg

SEQ ID NO: 169517 - DNA, 25 bp, E. coli
gatcggcgatttccccatgagcaac

SEQ ID NO: 169518 - DNA, 25 bp, E. coli
gatcggcgatttgcccatgagcaac

SEQ ID NO: 169519 - DNA, 25 bp, E. coli
gatgaacgcttatctgctcgggcag

SEQ ID NO: 169520 - DNA, 25 bp, E. coli
gatgaacgcttaactgctcgggcag

SEQ ID NO: 169521 - DNA, 25 bp, E. coli
aatcagcagttaatgaatgcactgg

SEQ ID NO: 169522 - DNA, 25 bp, E. coli
aatcagcagttattgaatgcactgg

SEQ ID NO: 169523 - DNA, 25 bp, E. coli
caccggacaacacacctggcgattt

SEQ ID NO: 169524 - DNA, 25 bp, E. coli
cacagtgccaggtgatgcagcagct

SEQ ID NO: 169525 - DNA, 25 bp, E. coli
cacagtgccaggagatgcagcagct

SEQ ID NO: 169526 - DNA, 25 bp, E. coli
caccggacaacagacctggcgattt

SEQ ID NO: 169527 - DNA, 25 bp, E. coli
catttattctggaaggacttagccg

SEQ ID NO: 169528 - DNA, 25 bp, E. coli
taccgtatggcggttttggtgaaat

SEQ ID NO: 169529 - DNA, 25 bp, E. coli
taccgtatggcgcttttggtgaaat

SEQ ID NO: 169530 - DNA, 25 bp, E. coli
gaaggcgctggtcgaatatacccat

SEQ ID NO: 169531 - DNA, 25 bp, E. coli
gaaggcgctggtggaatatacccat

SEQ ID NO: 169532 - DNA, 25 bp, E. coli
gaaacaggacatttggttgaagggc

SEQ ID NO: 169533 - DNA, 25 bp, E. coli
gaaacaggacatatggttgaagggc

SEQ ID NO: 169534 - DNA, 25 bp, E. coli
gacttagccgttatcaaatcaatca

SEQ ID NO: 169535 - DNA, 25 bp, E. coli
gacttagccgttttcaaatcaatca

SEQ ID NO: 169536 - DNA, 25 bp, E. coli
ccgacaccgagccatttattctgga

SEQ ID NO: 169537 - DNA, 25 bp, E. coli
cgatttggcctgtcgcgtatgttgt

SEQ ID NO: 169538 - DNA, 25 bp, E. coli
cgatttggcctgacgcgtatgttgt

SEQ ID NO: 169539 - DNA, 25 bp, E. coli
ccgacaccgagcgatttattctgga

SEQ ID NO: 169540 - DNA, 25 bp, E. coli
catttattctggtaggacttagccg

SEQ ID NO: 169541 - DNA, 25 bp, E. coli
gggatttaccgtttggcgcttttgg

SEQ ID NO: 169542 - DNA, 25 bp, E. coli
gggatttaccgtatggcgcttttgg

SEQ ID NO: 169543 - DNA, 25 bp, E. coli
cagaaaaactatcgcggcgttgccg

SEQ ID NO: 169544 - DNA, 25 bp, E. coli
cagaaaaactatggcggcgttgccg

SEQ ID NO: 169545 - DNA, 25 bp, E. coli
tatcgcggcgttgccgagtggttac

SEQ ID NO: 169546 - DNA, 25 bp, E. coli
tatcgcggcgttcccgagtggttac

SEQ ID NO: 169547 - DNA, 25 bp, E. coli
ttacagcgtgctggtggcactcact

SEQ ID NO: 169548 - DNA, 25 bp, E. coli
ttacagcgtgctcgtggcactcact

SEQ ID NO: 169549 - DNA, 25 bp, E. coli
gcacttgtctacaaaattttttgca

SEQ ID NO: 169550 - DNA, 25 bp, E. coli
gcacttgtctactaaattttttgca

SEQ ID NO: 169551 - DNA, 25 bp, E. coli
gctcgatgtaacagaaaacgcttta

SEQ ID NO: 169552 - DNA, 25 bp, E. coli
gctcgatgtaactgaaaacgcttta

SEQ ID NO: 169553 - DNA, 25 bp, E. coli
cgctttattcaagcgccttcgtgca

SEQ ID NO: 169554 - DNA, 25 bp, E. coli
cgattgcttctgcttgtggagaaac

SEQ ID NO: 169555 - DNA, 25 bp, E. coli
cgattgcttctggttgtggagaaac

SEQ ID NO: 169556 - DNA, 25 bp, E. coli
cgctttattcaaccgccttcgtgca

SEQ ID NO: 169557 - DNA, 25 bp, E. coli
cgtcgtggcgtccattgcttctggt

SEQ ID NO: 169558 - DNA, 25 bp, E. coli
cgtcgtggcgtcgattgcttctggt

SEQ ID NO: 169559 - DNA, 25 bp, E. coli
ggctgactggctcgatgtaacagaa

SEQ ID NO: 169560 - DNA, 25 bp, E. coli
ggctgactggctggatgtaacagaa

SEQ ID NO: 169561 - DNA, 25 bp, E. coli
taaccagcgtctgctggaagtcatt

SEQ ID NO: 169562 - DNA, 25 bp, E. coli
taaccagcgtctcctggaagtcatt

SEQ ID NO: 169563 - DNA, 25 bp, E. coli
gatgggcaatggttttacagcgtgc

SEQ ID NO: 169564 - DNA, 25 bp, E. coli
gatgggcaatggatttacagcgtgc

SEQ ID NO: 169565 - DNA, 25 bp, E. coli
caatacggacaatttgtcgctggca

SEQ ID NO: 169566 - DNA, 25 bp, E. coli
caatacggacaaattgtcgctggca

SEQ ID NO: 169567 - DNA, 25 bp, E. coli
agtcgcaaagaaacgcggcatcaca

SEQ ID NO: 169568 - DNA, 25 bp, E. coli
agtcgcaaagaatcgcggcatcaca

SEQ ID NO: 169569 - DNA, 25 bp, E. coli
aacatttaccattccgttgattacg

SEQ ID NO: 169570 - DNA, 25 bp, E. coli
aacatttaccataccgttgattacg

SEQ ID NO: 169571 - DNA, 25 bp, E. coli
tattggcttacggagtcgcaaagaa

SEQ ID NO: 169572 - DNA, 25 bp, E. coli
tattggcttacgcagtcgcaaagaa

SEQ ID NO: 169573 - DNA, 25 bp, E. coli
ttatctcatttatcgccctgctcac

SEQ ID NO: 169574 - DNA, 25 bp, E. coli
ttatctcatttaacgccctgctcac

SEQ ID NO: 169575 - DNA, 25 bp, E. coli
tccgcaggcggtcttgtacaaattg

SEQ ID NO: 169576 - DNA, 25 bp, E. coli
tgctggcagcatagcaacatttacc

SEQ ID NO: 169577 - DNA, 25 bp, E. coli
tgctggcagcattgcaacatttacc

SEQ ID NO: 169578 - DNA, 25 bp, E. coli
tccgcaggcggtgttgtacaaattg

SEQ ID NO: 169579 - DNA, 25 bp, E. coli
tcatcggttttagctccgcaggcgg

SEQ ID NO: 169580 - DNA, 25 bp, E. coli
tcatcggttttacctccgcaggcgg

SEQ ID NO: 169581 - DNA, 25 bp, E. coli
cgctgctatcgggtttatactggca

SEQ ID NO: 169582 - DNA, 25 bp, E. coli
cgctggcatgtcttacaccatgtcg

SEQ ID NO: 169583 - DNA, 25 bp, E. coli
cgctgctatcggctttatactggca

SEQ ID NO: 169584 - DNA, 25 bp, E. coli
cgctggcatgtcatacaccatgtcg

SEQ ID NO: 169585 - DNA, 25 bp, E. coli
tccctacgctaatggaaaagcaacg

SEQ ID NO: 169586 - DNA, 25 bp, E. coli
tccctacgctaaaggaaaagcaacg

SEQ ID NO: 169587 - DNA, 25 bp, E. coli
aatggtttcaattgtgactgttacg

SEQ ID NO: 169588 - DNA, 25 bp, E. coli
aatggtttcaatagtgactgttacg

SEQ ID NO: 169589 - DNA, 25 bp, E. coli
taaaaaggaaaaatctctgccgaca

SEQ ID NO: 169590 - DNA, 25 bp, E. coli
taaaaaggaaaattctctgccgaca

SEQ ID NO: 169591 - DNA, 25 bp, E. coli
tattatttggtatgttagcacccac

SEQ ID NO: 169592 - DNA, 25 bp, E. coli
tattatttggtaagttagcacccac

SEQ ID NO: 169593 - DNA, 25 bp, E. coli
tcagaacggaatgaaatgccttagt

SEQ ID NO: 169594 - DNA, 25 bp, E. coli
tcagaacggaatcaaatgccttagt

SEQ ID NO: 169595 - DNA, 25 bp, E. coli
tctgccgacaacgataacgaagtgc

SEQ ID NO: 169596 - DNA, 25 bp, E. coli
tctgccgacaaccataacgaagtgc

SEQ ID NO: 169597 - DNA, 25 bp, E. coli
ccttagttcaggtatgaatgacgcg

SEQ ID NO: 169598 - DNA, 25 bp, E. coli
ccttagttcaggaatgaatgacgcg

SEQ ID NO: 169599 - DNA, 25 bp, E. coli
gaatgacgcgactattattcaccaa

SEQ ID NO: 169600 - DNA, 25 bp, E. coli
gaatgacgcgacaattattcaccaa

SEQ ID NO: 169601 - DNA, 25 bp, E. coli
ggcagtattcctccagtaataaaaa

SEQ ID NO: 169602 - DNA, 25 bp, E. coli
ggcatgaaatgccatcagaacggaa

SEQ ID NO: 169603 - DNA, 25 bp, E. coli
ggcagtattcctgcagtaataaaaa

SEQ ID NO: 169604 - DNA, 25 bp, E. coli
ggcatgaaatgcgatcagaacggaa

SEQ ID NO: 169605 - DNA, 25 bp, E. coli
taacgaagtgcactttatgcctggg

SEQ ID NO: 169606 - DNA, 25 bp, E. coli
taacgaagtgcagtttatgcctggg

SEQ ID NO: 169607 - DNA, 25 bp, E. coli
taagttagcaccgactatcgccaca

SEQ ID NO: 169608 - DNA, 25 bp, E. coli
taagttagcacccactatcgccaca

SEQ ID NO: 169609 - DNA, 25 bp, E. coli
catagcgtgcatggtcctttagagg

SEQ ID NO: 169610 - DNA, 25 bp, E. coli
catgtatatagcctcatgatcgtgc

SEQ ID NO: 169611 - DNA, 25 bp, E. coli
catagcgtgcatcgtcctttagagg

SEQ ID NO: 169612 - DNA, 25 bp, E. coli
catgtatatagcgtcatgatcgtgc

SEQ ID NO: 169613 - DNA, 25 bp, E. coli
catgatcgtgctttttcgctacaga

SEQ ID NO: 169614 - DNA, 25 bp, E. coli
catgatcgtgctatttcgctacaga

SEQ ID NO: 169615 - DNA, 25 bp, E. coli
tacatcatcaggcaggcatagcgtg

SEQ ID NO: 169616 - DNA, 25 bp, E. coli
tacatcatcagggaggcatagcgtg

SEQ ID NO: 169617 - DNA, 25 bp, E. coli
agtttgtatcctgaatattggcagg

SEQ ID NO: 169618 - DNA, 25 bp, E. coli
agtttgtatcctcaatattggcagg

SEQ ID NO: 169619 - DNA, 25 bp, E. coli
aaagcaccgtatgagttgacccagg

SEQ ID NO: 169620 - DNA, 25 bp, E. coli
aaagcaccgtatcagttgacccagg

SEQ ID NO: 169621 - DNA, 25 bp, E. coli
tcgctacagaataagggaaaatggc

SEQ ID NO: 169622 - DNA, 25 bp, E. coli
tcgctacagaattagggaaaatggc

SEQ ID NO: 169623 - DNA, 25 bp, E. coli
gcaggttaattgctgtttccccgca

SEQ ID NO: 169624 - DNA, 25 bp, E. coli
gcaggttaattggtgtttccccgca

SEQ ID NO: 169625 - DNA, 25 bp, E. coli
cccaggtgcagacgctagagtgttt

SEQ ID NO: 169626 - DNA, 25 bp, E. coli
cccaggtgcagaggctagagtgttt

SEQ ID NO: 169627 - DNA, 25 bp, E. coli
cattgtcacggccaaagcaccgtat

SEQ ID NO: 169628 - DNA, 25 bp, E. coli
cattgtcacggcgaaagcaccgtat

SEQ ID NO: 169629 - DNA, 25 bp, E. coli
gtggttatgccgatactagcgtgta

SEQ ID NO: 169630 - DNA, 25 bp, E. coli
gtggttatgccgttactagcgtgta

SEQ ID NO: 169631 - DNA, 25 bp, E. coli
caacgtcagtgaatttgccagcaac

SEQ ID NO: 169632 - DNA, 25 bp, E. coli
caacgtcagtgattttgccagcaac

SEQ ID NO: 169633 - DNA, 25 bp, E. coli
agaactttgtctgcgaacgcctgga

SEQ ID NO: 169634 - DNA, 25 bp, E. coli
agaactttgtctccgaacgcctgga

SEQ ID NO: 169635 - DNA, 25 bp, E. coli
ttccagaatgatgccgtagttgccg

SEQ ID NO: 169636 - DNA, 25 bp, E. coli
ttccagaatgatcccgtagttgccg

SEQ ID NO: 169637 - DNA, 25 bp, E. coli
tgataagaaccctgaacgtcgcctt

SEQ ID NO: 169638 - DNA, 25 bp, E. coli
tgataagaacccagaacgtcgcctt

SEQ ID NO: 169639 - DNA, 25 bp, E. coli
taatagcaccggacttacgcatgtt

SEQ ID NO: 169640 - DNA, 25 bp, E. coli
taatagcaccggtcttacgcatgtt

SEQ ID NO: 169641 - DNA, 25 bp, E. coli
gctgaccggtcagagaaacttcgcc

SEQ ID NO: 169642 - DNA, 25 bp, E. coli
gctgaccggtcacagaaacttcgcc

SEQ ID NO: 169643 - DNA, 25 bp, E. coli
gaaaccagcgtcttttgcaacgaag

SEQ ID NO: 169644 - DNA, 25 bp, E. coli
gaaaccagcgtcatttgcaacgaag

SEQ ID NO: 169645 - DNA, 25 bp, E. coli
gattgccagctcgatgtcgccgtta

SEQ ID NO: 169646 - DNA, 25 bp, E. coli
gttccataacgaacggctgaccggt

SEQ ID NO: 169647 - DNA, 25 bp, E. coli
gattgccagctccatgtcgccgtta

SEQ ID NO: 169648 - DNA, 25 bp, E. coli
gttccataacgatcggctgaccggt

SEQ ID NO: 169649 - DNA, 25 bp, E. coli
tcacgcagctcttttaccagggatg

SEQ ID NO: 169650 - DNA, 25 bp, E. coli
tcacgcagctctattaccagggatg

SEQ ID NO: 169651 - DNA, 25 bp, E. coli
gatgtgtttaacgagctcttcgtca

SEQ ID NO: 169652 - DNA, 25 bp, E. coli
gatgtgtttaaccagctcttcgtca

SEQ ID NO: 169653 - DNA, 25 bp, E. coli
aattgtagtttcagatcagcagccg

SEQ ID NO: 169654 - DNA, 25 bp, E. coli
aattgtagtttctgatcagcagccg

SEQ ID NO: 169655 - DNA, 25 bp, E. coli
cagccgtttatgtttgatgggataa

SEQ ID NO: 169656 - DNA, 25 bp, E. coli
cagccgtttatgattgatgggataa

SEQ ID NO: 169657 - DNA, 25 bp, E. coli
cagcagccgtttatgattgatggga

SEQ ID NO: 169658 - DNA, 25 bp, E. coli
cagcagccgtttttgattgatggga

SEQ ID NO: 169659 - DNA, 25 bp, E. coli
taaaattgtagtatcagatcagcag

SEQ ID NO: 169660 - DNA, 25 bp, E. coli
agctatagcggagtgtaacaaatct

SEQ ID NO: 169661 - DNA, 25 bp, E. coli
agctatagcggactgtaacaaatct

SEQ ID NO: 169662 - DNA, 25 bp, E. coli
ttgtagtttcagatcagcagccgtt

SEQ ID NO: 169663 - DNA, 25 bp, E. coli
ttgtagtttcagttcagcagccgtt

SEQ ID NO: 169664 - DNA, 25 bp, E. coli
gaagaaagctatagcggagtgtaac

SEQ ID NO: 169665 - DNA, 25 bp, E. coli
gaagaaagctattgcggagtgtaac

SEQ ID NO: 169666 - DNA, 25 bp, E. coli
ccgtttatgattcatgggataattg

SEQ ID NO: 169667 - DNA, 25 bp, E. coli
ccgtttatgattgatgggataattg

SEQ ID NO: 169668 - DNA, 25 bp, E. coli
gtttcagatcaggagccgtttatga

SEQ ID NO: 169669 - DNA, 25 bp, E. coli
gtagtttcagatcagcagccgttta

SEQ ID NO: 169670 - DNA, 25 bp, E. coli
gtttcagatcagcagccgtttatga

SEQ ID NO: 169671 - DNA, 25 bp, E. coli
gtagtttcagatgagcagccgttta

SEQ ID NO: 169672 - DNA, 25 bp, E. coli
gggctataaagatctgaagaaagct

SEQ ID NO: 169673 - DNA, 25 bp, E. coli
gggctataaagaactgaagaaagct

SEQ ID NO: 169674 - DNA, 25 bp, E. coli
taaaattgtagtttcagatcagcag

SEQ ID NO: 169675 - DNA, 25 bp, E. coli
aagcaaaatacttctgcccggatgc

SEQ ID NO: 169676 - DNA, 25 bp, E. coli
aagcaaaatactactgcccggatgc

SEQ ID NO: 169677 - DNA, 25 bp, E. coli
taattaacccacgttttgattctgg

SEQ ID NO: 169678 - DNA, 25 bp, E. coli
taattaacccaccttttgattctgg

SEQ ID NO: 169679 - DNA, 25 bp, E. coli
caaaatactactccccggatgcgat

SEQ ID NO: 169680 - DNA, 25 bp, E. coli
caaaatactactgcccggatgcgat

SEQ ID NO: 169681 - DNA, 25 bp, E. coli
tactgcccggatccgataattaacc

SEQ ID NO: 169682 - DNA, 25 bp, E. coli
tactactgcccggatgcgataatta

SEQ ID NO: 169683 - DNA, 25 bp, E. coli
tactactgcccgcatgcgataatta

SEQ ID NO: 169684 - DNA, 25 bp, E. coli
tactgcccggatgcgataattaacc

SEQ ID NO: 169685 - DNA, 25 bp, E. coli
aaaagcaaaatactactgcccggat

SEQ ID NO: 169686 - DNA, 25 bp, E. coli
aaaagcaaaatagtactgcccggat

SEQ ID NO: 169687 - DNA, 25 bp, E. coli
ttctgaaaaaagcaaaatactactg

SEQ ID NO: 169688 - DNA, 25 bp, E. coli
ttctgaaaaaaggaaaatactactg

SEQ ID NO: 169689 - DNA, 25 bp, E. coli
tgcgataattaacccaccttttgat

SEQ ID NO: 169690 - DNA, 25 bp, E. coli
tgcgataattaagccaccttttgat

SEQ ID NO: 169691 - DNA, 25 bp, E. coli
gcaaaatactacagcccggatgcga

SEQ ID NO: 169692 - DNA, 25 bp, E. coli
gcaaaatactactgcccggatgcga

SEQ ID NO: 169693 - DNA, 25 bp, E. coli
gaaaaaagcaaattactactgcccg

SEQ ID NO: 169694 - DNA, 25 bp, E. coli
gaaaaaagcaaaatactactgcccg

SEQ ID NO: 169695 - DNA, 25 bp, E. coli
taacccaccttttgattctggataa

SEQ ID NO: 169696 - DNA, 25 bp, E. coli
taacccacctttagattctggataa

SEQ ID NO: 169697 - DNA, 25 bp, E. coli
catcttctatctaactgcttctgca

SEQ ID NO: 169698 - DNA, 25 bp, E. coli
catcttctatcttactgcttctgca

SEQ ID NO: 169699 - DNA, 25 bp, E. coli
tactcttgcttgtagcaggcggtac

SEQ ID NO: 169700 - DNA, 25 bp, E. coli
tactcttgcttgaagcaggcggtac

SEQ ID NO: 169701 - DNA, 25 bp, E. coli
tattcagggaataagacactcatct

SEQ ID NO: 169702 - DNA, 25 bp, E. coli
tattcagggaattagacactcatct

SEQ ID NO: 169703 - DNA, 25 bp, E. coli
tgcttctgcagcctctgaccaatcg

SEQ ID NO: 169704 - DNA, 25 bp, E. coli
tgcttctgcagcgtctgaccaatcg

SEQ ID NO: 169705 - DNA, 25 bp, E. coli
tcctgaaagcgcgagaaaatacgac

SEQ ID NO: 169706 - DNA, 25 bp, E. coli
tcctgaaagcgccagaaaatacgac

SEQ ID NO: 169707 - DNA, 25 bp, E. coli
taaggattttcctgaaagcgcgaga

SEQ ID NO: 169708 - DNA, 25 bp, E. coli
taaggattttccagaaagcgcgaga

SEQ ID NO: 169709 - DNA, 25 bp, E. coli
gcgagaaaatacgacaaaagttgcc

SEQ ID NO: 169710 - DNA, 25 bp, E. coli
gcgagaaaataccacaaaagttgcc

SEQ ID NO: 169711 - DNA, 25 bp, E. coli
gaccaatcggtctcatttttaagga

SEQ ID NO: 169712 - DNA, 25 bp, E. coli
gaccaatcggtcacatttttaagga

SEQ ID NO: 169713 - DNA, 25 bp, E. coli
gacaaaagttgccagtaatcgttat

SEQ ID NO: 169714 - DNA, 25 bp, E. coli
gacaaaagttgcgagtaatcgttat

SEQ ID NO: 169715 - DNA, 25 bp, E. coli
taatcgttattctttaaggctatgg

SEQ ID NO: 169716 - DNA, 25 bp, E. coli
taatcgttattcattaaggctatgg

SEQ ID NO: 169717 - DNA, 25 bp, E. coli
tcattattaccggaagttaccgacg

SEQ ID NO: 169718 - DNA, 25 bp, E. coli
tcattattaccgcaagttaccgacg

SEQ ID NO: 169719 - DNA, 25 bp, E. coli
aacgcgtgcttattcaggttggccc

SEQ ID NO: 169720 - DNA, 25 bp, E. coli
aacgcgtgcttaatcaggttggccc

SEQ ID NO: 169721 - DNA, 25 bp, E. coli
ataaattcttttgtgcgggcggcga

SEQ ID NO: 169722 - DNA, 25 bp, E. coli
ataaattcttttctgcgggcggcga

SEQ ID NO: 169723 - DNA, 25 bp, E. coli
ttagtcgaattaacggcaaccggcg

SEQ ID NO: 169724 - DNA, 25 bp, E. coli
tagcgcagctggtaaaatgtggtcc

SEQ ID NO: 169725 - DNA, 25 bp, E. coli
tagcgcagctggaaaaatgtggtcc

SEQ ID NO: 169726 - DNA, 25 bp, E. coli
ttagtcgaattatcggcaaccggcg

SEQ ID NO: 169727 - DNA, 25 bp, E. coli
ttctgttcagcagagcggcggcttc

SEQ ID NO: 169728 - DNA, 25 bp, E. coli
ttaaatcgtggtcggcctattcgcc

SEQ ID NO: 169729 - DNA, 25 bp, E. coli
ttctgttcagcacagcggcggcttc

SEQ ID NO: 169730 - DNA, 25 bp, E. coli
ttaaatcgtggtgggcctattcgcc

SEQ ID NO: 169731 - DNA, 25 bp, E. coli
tgctgatgctgggtaaacgcctgac

SEQ ID NO: 169732 - DNA, 25 bp, E. coli
tgctgatgctggctaaacgcctgac

SEQ ID NO: 169733 - DNA, 25 bp, E. coli
gccgcctgacattgaaccgtgaaga

SEQ ID NO: 169734 - DNA, 25 bp, E. coli
gccgcctgacatagaaccgtgaaga

SEQ ID NO: 169735 - DNA, 25 bp, E. coli
gaaaaagccggcgtgagcttccaca

SEQ ID NO: 169736 - DNA, 25 bp, E. coli
gaaaaagccggcctgagcttccaca

SEQ ID NO: 169737 - DNA, 25 bp, E. coli
tcaacggtcatagcatcggtggcgg

SEQ ID NO: 169738 - DNA, 25 bp, E. coli
tcaacggtcataccatcggtggcgg

SEQ ID NO: 169739 - DNA, 25 bp, E. coli
taatgacgtttttaatcgcctgcgc

SEQ ID NO: 169740 - DNA, 25 bp, E. coli
taatgacgttttaaatcgcctgcgc

SEQ ID NO: 169741 - DNA, 25 bp, E. coli
caaaactaaacagagaggatgacgc

SEQ ID NO: 169742 - DNA, 25 bp, E. coli
caaaactaaacacagaggatgacgc

SEQ ID NO: 169743 - DNA, 25 bp, E. coli
catgtgggtaagtatgatggccatc

SEQ ID NO: 169744 - DNA, 25 bp, E. coli
catgtgggtaagaatgatggccatc

SEQ ID NO: 169745 - DNA, 25 bp, E. coli
tatttggccggtaatccctctcgaa

SEQ ID NO: 169746 - DNA, 25 bp, E. coli
tatttggccggttatccctctcgaa

SEQ ID NO: 169747 - DNA, 25 bp, E. coli
ttaagtctcagacctatttggccgg

SEQ ID NO: 169748 - DNA, 25 bp, E. coli
ttaagtctcagagctatttggccgg

SEQ ID NO: 169749 - DNA, 25 bp, E. coli
tgccgtcccgttgacacctgaatga

SEQ ID NO: 169750 - DNA, 25 bp, E. coli
tgccgtcccgttcacacctgaatga

SEQ ID NO: 169751 - DNA, 25 bp, E. coli
tctcaattatctggccatgacctgg

SEQ ID NO: 169752 - DNA, 25 bp, E. coli
tctcaattatctcgccatgacctgg

SEQ ID NO: 169753 - DNA, 25 bp, E. coli
gaatttgctcttattgcgccccgcc

SEQ ID NO: 169754 - DNA, 25 bp, E. coli
gaatttgctctttttgcgccccgcc

SEQ ID NO: 169755 - DNA, 25 bp, E. coli
gacccagccattatctgcgtaattg

SEQ ID NO: 169756 - DNA, 25 bp, E. coli
gacccagccattttctgcgtaattg

SEQ ID NO: 169757 - DNA, 25 bp, E. coli
gggatagccaacaatgaccccacga

SEQ ID NO: 169758 - DNA, 25 bp, E. coli
gggatagccaactatgaccccacga

SEQ ID NO: 169759 - DNA, 25 bp, E. coli
tggttcatccccattttgcctcggc

SEQ ID NO: 169760 - DNA, 25 bp, E. coli
tggctaagtcccagtccgatctctt

SEQ ID NO: 169761 - DNA, 25 bp, E. coli
tggttcatcccctttttgcctcggc

SEQ ID NO: 169762 - DNA, 25 bp, E. coli
tggctaagtccctgtccgatctctt

SEQ ID NO: 169763 - DNA, 25 bp, E. coli
catccggcataatcacaggcacttt

SEQ ID NO: 169764 - DNA, 25 bp, E. coli
catccggcataaacacaggcacttt

SEQ ID NO: 169765 - DNA, 25 bp, E. coli
taaacacaggcactttgtcaccaat

SEQ ID NO: 169766 - DNA, 25 bp, E. coli
taaacacaggcagtttgtcaccaat

SEQ ID NO: 169767 - DNA, 25 bp, E. coli
aaaaagccgattgctactcgacaag

SEQ ID NO: 169768 - DNA, 25 bp, E. coli
aaaaagccgattcctactcgacaag

SEQ ID NO: 169769 - DNA, 25 bp, E. coli
ttgtcaccaatctgaaaccagcgtc

SEQ ID NO: 169770 - DNA, 25 bp, E. coli
ttgtcaccaatcagaaaccagcgtc

SEQ ID NO: 169771 - DNA, 25 bp, E. coli
tgatgctaaacgcaaaatagcctgt

SEQ ID NO: 169772 - DNA, 25 bp, E. coli
tgatgctaaacggaaaatagcctgt

SEQ ID NO: 169773 - DNA, 25 bp, E. coli
tctggagccggtttgagactgatgc

SEQ ID NO: 169774 - DNA, 25 bp, E. coli
tctggagccggtatgagactgatgc

SEQ ID NO: 169775 - DNA, 25 bp, E. coli
ccaaaaccggctctatctggagccg

SEQ ID NO: 169776 - DNA, 25 bp, E. coli
ccaaaaccggctgtatctggagccg

SEQ ID NO: 169777 - DNA, 25 bp, E. coli
cctgttgtgctaagtatcaggtcta

SEQ ID NO: 169778 - DNA, 25 bp, E. coli
cctgttgtgctatgtatcaggtcta

SEQ ID NO: 169779 - DNA, 25 bp, E. coli
gacagaaaaccaaaaccggctctat

SEQ ID NO: 169780 - DNA, 25 bp, E. coli
gaaaccagcgtcataaaaagccgat

SEQ ID NO: 169781 - DNA, 25 bp, E. coli
gacagaaaaccataaccggctctat

SEQ ID NO: 169782 - DNA, 25 bp, E. coli
gaaaccagcgtcttaaaaagccgat

SEQ ID NO: 169783 - DNA, 25 bp, E. coli
cgattgctactccacaagacatcca

SEQ ID NO: 169784 - DNA, 25 bp, E. coli
cgattgctactcgacaagacatcca

SEQ ID NO: 169785 - DNA, 25 bp, E. coli
caatcagtgagctgatgctaacact

SEQ ID NO: 169786 - DNA, 25 bp, E. coli
caatcagtgagcagatgctaacact

SEQ ID NO: 169787 - DNA, 25 bp, E. coli
agtgagctgatggtaacactggctg

SEQ ID NO: 169788 - DNA, 25 bp, E. coli
agtgagctgatgctaacactggctg

SEQ ID NO: 169789 - DNA, 25 bp, E. coli
tgtcagtggttttgaccacgaggga

SEQ ID NO: 169790 - DNA, 25 bp, E. coli
tgtcagtggtttagaccacgaggga

SEQ ID NO: 169791 - DNA, 25 bp, E. coli
tcgttgatgtcactggttttgacca

SEQ ID NO: 169792 - DNA, 25 bp, E. coli
tcgttgatgtcagtggttttgacca

SEQ ID NO: 169793 - DNA, 25 bp, E. coli
gctaacactggcagatattccttat

SEQ ID NO: 169794 - DNA, 25 bp, E. coli
gctaacactggctgatattccttat

SEQ ID NO: 169795 - DNA, 25 bp, E. coli
cgttgtgtcaggttccgacactggc

SEQ ID NO: 169796 - DNA, 25 bp, E. coli
cgttgtgtcaggatccgacactggc

SEQ ID NO: 169797 - DNA, 25 bp, E. coli
cttatcagttcgatgatgtcagtgg

SEQ ID NO: 169798 - DNA, 25 bp, E. coli
cttatcagttcgttgatgtcagtgg

SEQ ID NO: 169799 - DNA, 25 bp, E. coli
gatattccttatcagttcgttgatg

SEQ ID NO: 169800 - DNA, 25 bp, E. coli
gatattccttatgagttcgttgatg

SEQ ID NO: 169801 - DNA, 25 bp, E. coli
gggctctacaatgagtgagctgatg

SEQ ID NO: 169802 - DNA, 25 bp, E. coli
gggctctacaatcagtgagctgatg

SEQ ID NO: 169803 - DNA, 25 bp, E. coli
gagctgatgctatcactggctgata

SEQ ID NO: 169804 - DNA, 25 bp, E. coli
gagctgatgctaacactggctgata

SEQ ID NO: 169805 - DNA, 25 bp, E. coli
gatgctaacactggctgatattcct

SEQ ID NO: 169806 - DNA, 25 bp, E. coli
gatgctaacactcgctgatattcct

SEQ ID NO: 169807 - DNA, 25 bp, E. coli
caacaagtttcaggcgtgcgggcca

SEQ ID NO: 169808 - DNA, 25 bp, E. coli
caacaagtttcacgcgtgcgggcca

SEQ ID NO: 169809 - DNA, 25 bp, E. coli
caggcatcgcgcaggtagtgaccgt

SEQ ID NO: 169810 - DNA, 25 bp, E. coli
caggatccgctgtagtttgaaaagg

SEQ ID NO: 169811 - DNA, 25 bp, E. coli
caggatccgctgaagtttgaaaagg

SEQ ID NO: 169812 - DNA, 25 bp, E. coli
caggcatcgcgctggtagtgaccgt

SEQ ID NO: 169813 - DNA, 25 bp, E. coli
catcagtgcgttaatcccgtgggcg

SEQ ID NO: 169814 - DNA, 25 bp, E. coli
catcagtgcgtttatcccgtgggcg

SEQ ID NO: 169815 - DNA, 25 bp, E. coli
tactgacgttgcacgatgatatcgc

SEQ ID NO: 169816 - DNA, 25 bp, E. coli
tactgacgttgctcgatgatatcgc

SEQ ID NO: 169817 - DNA, 25 bp, E. coli
tgcggaaatcgtcgccatcacgctg

SEQ ID NO: 169818 - DNA, 25 bp, E. coli
tgcggaaatcgtggccatcacgctg

SEQ ID NO: 169819 - DNA, 25 bp, E. coli
gcgccgttgctttatcaggtgctgg

SEQ ID NO: 169820 - DNA, 25 bp, E. coli
gcgccgttgcttaatcaggtgctgg

SEQ ID NO: 169821 - DNA, 25 bp, E. coli
cgtaaacataaagaagatccggcgc

SEQ ID NO: 169822 - DNA, 25 bp, E. coli
cgtaaacataaacaagatccggcgc

SEQ ID NO: 169823 - DNA, 25 bp, E. coli
gatatctccgtgatgggcaaactgg

SEQ ID NO: 169824 - DNA, 25 bp, E. coli
gatatctccgtgttgggcaaactgg

SEQ ID NO: 169825 - DNA, 25 bp, E. coli
gattatcgcgccgtggctgatgaaa

SEQ ID NO: 169826 - DNA, 25 bp, E. coli
gattatcgcgccctggctgatgaaa

SEQ ID NO: 169827 - DNA, 25 bp, E. coli
tggatttatcatgggcggcatcgtg

SEQ ID NO: 169828 - DNA, 25 bp, E. coli
tggatttatcatcggcggcatcgtg

SEQ ID NO: 169829 - DNA, 25 bp, E. coli
aacctgctggatgcgcgtaaagcca

SEQ ID NO: 169830 - DNA, 25 bp, E. coli
caacttcgaatacgcggatgtggac

SEQ ID NO: 169831 - DNA, 25 bp, E. coli
aacctgctggatccgcgtaaagcca

SEQ ID NO: 169832 - DNA, 25 bp, E. coli
aaccattggacaaggaagtcggcgc

SEQ ID NO: 169833 - DNA, 25 bp, E. coli
aaccattggacatggaagtcggcgc

SEQ ID NO: 169834 - DNA, 25 bp, E. coli
caacttcgaataggcggatgtggac

SEQ ID NO: 169835 - DNA, 25 bp, E. coli
catcagaacgaagtggagcagtcca

SEQ ID NO: 169836 - DNA, 25 bp, E. coli
catcagaacgaactggagcagtcca

SEQ ID NO: 169837 - DNA, 25 bp, E. coli
tacaggattactgggctcgccaggg

SEQ ID NO: 169838 - DNA, 25 bp, E. coli
tacaggattactcggctcgccaggg

SEQ ID NO: 169839 - DNA, 25 bp, E. coli
tacggtctggaacgtctggccatgt

SEQ ID NO: 169840 - DNA, 25 bp, E. coli
tacggtctggaaggtctggccatgt

SEQ ID NO: 169841 - DNA, 25 bp, E. coli
cattcagggcgttgacagcgtttac

SEQ ID NO: 169842 - DNA, 25 bp, E. coli
cattcagggcgtagacagcgtttac

SEQ ID NO: 169843 - DNA, 25 bp, E. coli
gataccaggaccttccagggcttga

SEQ ID NO: 169844 - DNA, 25 bp, E. coli
gataccaggaccatccagggcttga

SEQ ID NO: 169845 - DNA, 25 bp, E. coli
gataactgggaaaacccgacgctgg

SEQ ID NO: 169846 - DNA, 25 bp, E. coli
gataactgggaatacccgacgctgg

SEQ ID NO: 169847 - DNA, 25 bp, E. coli
ggtcattaagccttcgccggacaat

SEQ ID NO: 169848 - DNA, 25 bp, E. coli
ggtcattaagccatcgccggacaat

SEQ ID NO: 169849 - DNA, 25 bp, E. coli
ggcttcccgatgtgcaacaaagata

SEQ ID NO: 169850 - DNA, 25 bp, E. coli
ggcttcccgatgagcaacaaagata

SEQ ID NO: 169851 - DNA, 25 bp, E. coli
aacgacgcggtccatattctgatcc

SEQ ID NO: 169852 - DNA, 25 bp, E. coli
caacgcgatgttgagtggcccaatg

SEQ ID NO: 169853 - DNA, 25 bp, E. coli
caaatgctgatgtgctgggtggaac

SEQ ID NO: 169854 - DNA, 25 bp, E. coli
caaatgctgatgagctgggtggaac

SEQ ID NO: 169855 - DNA, 25 bp, E. coli
caacgcgatgttcagtggcccaatg

SEQ ID NO: 169856 - DNA, 25 bp, E. coli
tacattatggaactgacgactcgca

SEQ ID NO: 169857 - DNA, 25 bp, E. coli
tacattatggaagtgacgactcgca

SEQ ID NO: 169858 - DNA, 25 bp, E. coli
aacgacgcggtcgatattctgatcc

SEQ ID NO: 169859 - DNA, 25 bp, E. coli
tatgcaacaggctctaccggtaact

SEQ ID NO: 169860 - DNA, 25 bp, E. coli
tatgcaacaggcactaccggtaact

SEQ ID NO: 169861 - DNA, 25 bp, E. coli
tgaaagccttgcagcgtctggcgac

SEQ ID NO: 169862 - DNA, 25 bp, E. coli
tgaaagccttgctgcgtctggcgac

SEQ ID NO: 169863 - DNA, 25 bp, E. coli
gctggtggcacacgatcactgcaaa

SEQ ID NO: 169864 - DNA, 25 bp, E. coli
gctggtggcacaggatcactgcaaa

SEQ ID NO: 169865 - DNA, 25 bp, E. coli
gcaggttggcgcattgatctcagaa

SEQ ID NO: 169866 - DNA, 25 bp, E. coli
gcaggttggcgctttgatctcagaa

SEQ ID NO: 169867 - DNA, 25 bp, E. coli
gtctggcgacggaatggaacattcc

SEQ ID NO: 169868 - DNA, 25 bp, E. coli
gattatcagcgtaatctcgcggacc

SEQ ID NO: 169869 - DNA, 25 bp, E. coli
gtctggcgacggtatggaacattcc

SEQ ID NO: 169870 - DNA, 25 bp, E. coli
gattatcagcgttatctcgcggacc

SEQ ID NO: 169871 - DNA, 25 bp, E. coli
gaccggcatgaaggtcaacgcgatg

SEQ ID NO: 169872 - DNA, 25 bp, E. coli
gaccggcatgaacgtcaacgcgatg

SEQ ID NO: 169873 - DNA, 25 bp, E. coli
caaaagcatcattgggcatatggcc

SEQ ID NO: 169874 - DNA, 25 bp, E. coli
caaaagcatcatagggcatatggcc

SEQ ID NO: 169875 - DNA, 25 bp, E. coli
catcgtcatgcgatgtgggaaatcc

SEQ ID NO: 169876 - DNA, 25 bp, E. coli
catcgtcatgcgttgtgggaaatcc

SEQ ID NO: 169877 - DNA, 25 bp, E. coli
tgttgattatgacgacgcagccgta

SEQ ID NO: 169878 - DNA, 25 bp, E. coli
tggtgattgaatcctccggtgccaa

SEQ ID NO: 169879 - DNA, 25 bp, E. coli
tgtaatgcctacaaatccatcgcgc

SEQ ID NO: 169880 - DNA, 25 bp, E. coli
tgttgattatgaggacgcagccgta

SEQ ID NO: 169881 - DNA, 25 bp, E. coli
tggtgattgaatgctccggtgccaa

SEQ ID NO: 169882 - DNA, 25 bp, E. coli
tgtaatgcctactaatccatcgcgc

SEQ ID NO: 169883 - DNA, 25 bp, E. coli
tgcaaaagaactcggtgcgacggca

SEQ ID NO: 169884 - DNA, 25 bp, E. coli
tgaaacaagccaacgaaatgctccg

SEQ ID NO: 169885 - DNA, 25 bp, E. coli
tgcaaaagaactgggtgcgacggca

SEQ ID NO: 169886 - DNA, 25 bp, E. coli
tgaaacaagccatcgaaatgctccg

SEQ ID NO: 169887 - DNA, 25 bp, E. coli
tctgcggcgcagacatgaagcacta

SEQ ID NO: 169888 - DNA, 25 bp, E. coli
tctaccgaagatgtggtggcgcgct

SEQ ID NO: 169889 - DNA, 25 bp, E. coli
tctgcggcgcagtcatgaagcacta

SEQ ID NO: 169890 - DNA, 25 bp, E. coli
tctaccgaagatctggtggcgcgct

SEQ ID NO: 169891 - DNA, 25 bp, E. coli
gagtttaactctttccgcggccatg

SEQ ID NO: 169892 - DNA, 25 bp, E. coli
gagtttaactctatccgcggccatg

SEQ ID NO: 169893 - DNA, 25 bp, E. coli
gatgatcacgcatcgtatcggcctg

SEQ ID NO: 169894 - DNA, 25 bp, E. coli
gatgatcacgcaacgtatcggcctg

SEQ ID NO: 169895 - DNA, 25 bp, E. coli
catgtgcgagcactttggttacgaa

SEQ ID NO: 169896 - DNA, 25 bp, E. coli
catgtgcgagcagtttggttacgaa

SEQ ID NO: 169897 - DNA, 25 bp, E. coli
taccgatcctcgggacagtaactaa

SEQ ID NO: 169898 - DNA, 25 bp, E. coli
taccgatcctcgcgacagtaactaa

SEQ ID NO: 169899 - DNA, 25 bp, E. coli
cgggagtaccgatcctcgggacagt

SEQ ID NO: 169900 - DNA, 25 bp, E. coli
cgggagtaccgaacctcgggacagt

SEQ ID NO: 169901 - DNA, 25 bp, E. coli
tcagattcgtcggatgtgcgagcac

SEQ ID NO: 169902 - DNA, 25 bp, E. coli
tcagattcgtcgcatgtgcgagcac

SEQ ID NO: 169903 - DNA, 25 bp, E. coli
gagtaccgatcctcgggacagtaac

SEQ ID NO: 169904 - DNA, 25 bp, E. coli
gagtaccgatccacgggacagtaac

SEQ ID NO: 169905 - DNA, 25 bp, E. coli
gaaaacggtaggcatcaaacgtcca

SEQ ID NO: 169906 - DNA, 25 bp, E. coli
gaaaacggtagggatcaaacgtcca

SEQ ID NO: 169907 - DNA, 25 bp, E. coli
gccaaaccgaaaacggtaggcatca

SEQ ID NO: 169908 - DNA, 25 bp, E. coli
gccaaaccgaaatcggtaggcatca

SEQ ID NO: 169909 - DNA, 25 bp, E. coli
cgagcactttggttacgaagtgaaa

SEQ ID NO: 169910 - DNA, 25 bp, E. coli
cgtcgcatgtgcgagcactttggtt

SEQ ID NO: 169911 - DNA, 25 bp, E. coli
cgtcgcatgtgccagcactttggtt

SEQ ID NO: 169912 - DNA, 25 bp, E. coli
ctttggttacgatgtgaaaaagctg

SEQ ID NO: 169913 - DNA, 25 bp, E. coli
cgagcactttggatacgaagtgaaa

SEQ ID NO: 169914 - DNA, 25 bp, E. coli
ctttggttacgaagtgaaaaagctg

SEQ ID NO: 169915 - DNA, 25 bp, E. coli
gattcgtcgcatgtgcgagcacttt

SEQ ID NO: 169916 - DNA, 25 bp, E. coli
gattcgtcgcatctgcgagcacttt

SEQ ID NO: 169917 - DNA, 25 bp, E. coli
tatattgtcggcgaacattttggcg

SEQ ID NO: 169918 - DNA, 25 bp, E. coli
tattgtcggcgaacattttggcgat

SEQ ID NO: 169919 - DNA, 25 bp, E. coli
tatattgtcggccaacattttggcg

SEQ ID NO: 169920 - DNA, 25 bp, E. coli
tattgtcggcgatcattttggcgat

SEQ ID NO: 169921 - DNA, 25 bp, E. coli
ttgtcggcgaactttttggcgatgc

SEQ ID NO: 169922 - DNA, 25 bp, E. coli
ttgtcggcgaacattttggcgatgc

SEQ ID NO: 169923 - DNA, 25 bp, E. coli
tgtcggcgaacattttggcgatgca

SEQ ID NO: 169924 - DNA, 25 bp, E. coli
tgtcggcgaacaatttggcgatgca

SEQ ID NO: 169925 - DNA, 25 bp, E. coli
tgctgcgtttgcgacacaatacgca

SEQ ID NO: 169926 - DNA, 25 bp, E. coli
tgctgcgtttgccacacaatacgca

SEQ ID NO: 169927 - DNA, 25 bp, E. coli
tgcgtttgcgactcaatacgcagca

SEQ ID NO: 169928 - DNA, 25 bp, E. coli
tgcgtttgcgacacaatacgcagca

SEQ ID NO: 169929 - DNA, 25 bp, E. coli
gcgttgctgcgtatgcgacacaata

SEQ ID NO: 169930 - DNA, 25 bp, E. coli
gcgttgctgcgtttgcgacacaata

SEQ ID NO: 169931 - DNA, 25 bp, E. coli
gcgtttgcgacacaatacgcagcag

SEQ ID NO: 169932 - DNA, 25 bp, E. coli
gcgtttgcgacagaatacgcagcag

SEQ ID NO: 169933 - DNA, 25 bp, E. coli
gttgctgcgtttccgacacaatacg

SEQ ID NO: 169934 - DNA, 25 bp, E. coli
gttgctgcgtttgcgacacaatacg

SEQ ID NO: 169935 - DNA, 25 bp, E. coli
gggcgttgctgcgtttgcgacacaa

SEQ ID NO: 169936 - DNA, 25 bp, E. coli
gggcgttgctgcctttgcgacacaa

SEQ ID NO: 169937 - DNA, 25 bp, E. coli
ggcgttgctgcgattgcgacacaat

SEQ ID NO: 169938 - DNA, 25 bp, E. coli
ggcgttgctgcgtttgcgacacaat

SEQ ID NO: 169939 - DNA, 25 bp, E. coli
taaagatatccgctggctgttccgc

SEQ ID NO: 169940 - DNA, 25 bp, E. coli
taaagatatccggtggctgttccgc

SEQ ID NO: 169941 - DNA, 25 bp, E. coli
taccgggtacgtcaactggcgttcg

SEQ ID NO: 169942 - DNA, 25 bp, E. coli
taccgggtacgtgaactggcgttcg

SEQ ID NO: 169943 - DNA, 25 bp, E. coli
tacgatttacccgatgactgtgaag

SEQ ID NO: 169944 - DNA, 25 bp, E. coli
tacgatttaccccatgactgtgaag

SEQ ID NO: 169945 - DNA, 25 bp, E. coli
aacgctgatcgaagaagagtggcca

SEQ ID NO: 169946 - DNA, 25 bp, E. coli
aacgctgatcgatgaagagtggcca

SEQ ID NO: 169947 - DNA, 25 bp, E. coli
tattctggttgccaccgacgttgcc

SEQ ID NO: 169948 - DNA, 25 bp, E. coli
tattctggttgcgaccgacgttgcc

SEQ ID NO: 169949 - DNA, 25 bp, E. coli
ttgacattctgaatggcaccacggg

SEQ ID NO: 169950 - DNA, 25 bp, E. coli
ttgacattctgattggcaccacggg

SEQ ID NO: 169951 - DNA, 25 bp, E. coli
tgatgaccgatctgccaaaaccgct

SEQ ID NO: 169952 - DNA, 25 bp, E. coli
tgcatccgaaggatgtagaagccct

SEQ ID NO: 169953 - DNA, 25 bp, E. coli
tgcatccgaaggttgtagaagccct

SEQ ID NO: 169954 - DNA, 25 bp, E. coli
tgatgaccgatcagccaaaaccgct

SEQ ID NO: 169955 - DNA, 25 bp, E. coli
ccttaattatgggaccgacgcgtga

SEQ ID NO: 169956 - DNA, 25 bp, E. coli
ccttaattatggcaccgacgcgtga

SEQ ID NO: 169957 - DNA, 25 bp, E. coli
gcgatgtcgcgcagaaaaaacgtct

SEQ ID NO: 169958 - DNA, 25 bp, E. coli
gcgatgtcgcgctgaaaaaacgtct

SEQ ID NO: 169959 - DNA, 25 bp, E. coli
gaacttgccgtggagatccatgccg

SEQ ID NO: 169960 - DNA, 25 bp, E. coli
gaacttgccgtgcagatccatgccg

SEQ ID NO: 169961 - DNA, 25 bp, E. coli
caaactggcacagcttactggctgg

SEQ ID NO: 169962 - DNA, 25 bp, E. coli
caaactggcacaccttactggctgg

SEQ ID NO: 169963 - DNA, 25 bp, E. coli
taaagaaggtgaacccgcggaggcg

SEQ ID NO: 169964 - DNA, 25 bp, E. coli
taaagaaggtgatcccgcggaggcg

SEQ ID NO: 169965 - DNA, 25 bp, E. coli
aaactggcacagcttactggctggc

SEQ ID NO: 169966 - DNA, 25 bp, E. coli
acaaactggcacagcttactggctg

SEQ ID NO: 169967 - DNA, 25 bp, E. coli
acaaactggcactgcttactggctg

SEQ ID NO: 169968 - DNA, 25 bp, E. coli
aactggcacagcttactggctggca

SEQ ID NO: 169969 - DNA, 25 bp, E. coli
aactggcacagcatactggctggca

SEQ ID NO: 169970 - DNA, 25 bp, E. coli
aaactggcacaggttactggctggc

SEQ ID NO: 169971 - DNA, 25 bp, E. coli
tgaacccgcggaggcggaaattggt

SEQ ID NO: 169972 - DNA, 25 bp, E. coli
tgaacccgcggacgcggaaattggt

SEQ ID NO: 169973 - DNA, 25 bp, E. coli
gacaaactggcagagcttactggct

SEQ ID NO: 169974 - DNA, 25 bp, E. coli
gacaaactggcacagcttactggct

SEQ ID NO: 169975 - DNA, 25 bp, E. coli
ccgcggaggcggtaattggtgtcgc

SEQ ID NO: 169976 - DNA, 25 bp, E. coli
ccgccggtacccggcctgcgattgt

SEQ ID NO: 169977 - DNA, 25 bp, E. coli
ccgccggtaccccgcctgcgattgt

SEQ ID NO: 169978 - DNA, 25 bp, E. coli
ccgcggaggcggaaattggtgtcgc

SEQ ID NO: 169979 - DNA, 25 bp, E. coli
ggtgaacccgcgcaggcggaaattg

SEQ ID NO: 169980 - DNA, 25 bp, E. coli
ggtgaacccgcggaggcggaaattg

SEQ ID NO: 169981 - DNA, 25 bp, E. coli
gaggcggaaattggtgtcgcggtaa

SEQ ID NO: 169982 - DNA, 25 bp, E. coli
gaggcggaaattcgtgtcgcggtaa

SEQ ID NO: 169983 - DNA, 25 bp, E. coli
caaccggtggtaagtgcaaatgatc

SEQ ID NO: 169984 - DNA, 25 bp, E. coli
caagcatgtgcgtaaaccggttggt

SEQ ID NO: 169985 - DNA, 25 bp, E. coli
caagcatgtgcgaaaaccggttggt

SEQ ID NO: 169986 - DNA, 25 bp, E. coli
caaccggtggtatgtgcaaatgatc

SEQ ID NO: 169987 - DNA, 25 bp, E. coli
taaaaaacgcgggttccagtggtct

SEQ ID NO: 169988 - DNA, 25 bp, E. coli
tacctgaaatcgtgcggagtgacca

SEQ ID NO: 169989 - DNA, 25 bp, E. coli
tagacgacatgccaaaatgggcggc

SEQ ID NO: 169990 - DNA, 25 bp, E. coli
tagacgacatgcgaaaatgggcggc

SEQ ID NO: 169991 - DNA, 25 bp, E. coli
tacctgaaatcgagcggagtgacca

SEQ ID NO: 169992 - DNA, 25 bp, E. coli
tatcaaaagggaagcggactacagc

SEQ ID NO: 169993 - DNA, 25 bp, E. coli
tatcaaaagggatgcggactacagc

SEQ ID NO: 169994 - DNA, 25 bp, E. coli
ccttgaacatatccgccagtgggca

SEQ ID NO: 169995 - DNA, 25 bp, E. coli
ccttgaacatatgcgccagtgggca

SEQ ID NO: 169996 - DNA, 25 bp, E. coli
ggaattacctgaagaacgacgggct

SEQ ID NO: 169997 - DNA, 25 bp, E. coli
tggaaatatgtctccgctggcgtgg

SEQ ID NO: 169998 - DNA, 25 bp, E. coli
tggctgctgcgaagacaaccgaact

SEQ ID NO: 169999 - DNA, 25 bp, E. coli
ggaattacctgatgaacgacgggct

SEQ ID NO: 170000 - DNA, 25 bp, E. coli
tggctgctgcgatgacaaccgaact

SEQ ID NO: 170001 - DNA, 25 bp, E. coli
tggaaatatgtcaccgctggcgtgg

SEQ ID NO: 170002 - DNA, 25 bp, E. coli
tcaaaacagggtgcatgaagcagct

SEQ ID NO: 170003 - DNA, 25 bp, E. coli
taaaaaacgcggcttccagtggtct

SEQ ID NO: 170004 - DNA, 25 bp, E. coli
tcaaaacagggtccatgaagcagct

SEQ ID NO: 170005 - DNA, 25 bp, E. coli
tatcgcccaggatttgatgcctcgg

SEQ ID NO: 170006 - DNA, 25 bp, E. coli
tatcgcccaggaattgatgcctcgg

SEQ ID NO: 170007 - DNA, 25 bp, E. coli
tgagtcaactttgcgcccgcaataa

SEQ ID NO: 170008 - DNA, 25 bp, E. coli
tgagtcaactttccgcccgcaataa

SEQ ID NO: 170009 - DNA, 25 bp, E. coli
tcagcttgatacgttaatccgccag

SEQ ID NO: 170010 - DNA, 25 bp, E. coli
tcagcttgataccttaatccgccag

SEQ ID NO: 170011 - DNA, 25 bp, E. coli
cctctcaatgaatccggcgtaagcc

SEQ ID NO: 170012 - DNA, 25 bp, E. coli
cctctcaatgaaaccggcgtaagcc

SEQ ID NO: 170013 - DNA, 25 bp, E. coli
gctgaatgcgaagacgttacaacga

SEQ ID NO: 170014 - DNA, 25 bp, E. coli
gctgaatgcgaacacgttacaacga

SEQ ID NO: 170015 - DNA, 25 bp, E. coli
gaatatccattggtctggctgccgt

SEQ ID NO: 170016 - DNA, 25 bp, E. coli
gaatatccattgctctggctgccgt

SEQ ID NO: 170017 - DNA, 25 bp, E. coli
ggcgtaagcctgtgtcaactttccg

SEQ ID NO: 170018 - DNA, 25 bp, E. coli
ggcgtaagcctgagtcaactttccg

SEQ ID NO: 170019 - DNA, 25 bp, E. coli
ggctgccgtttatcaccaatttccg

SEQ ID NO: 170020 - DNA, 25 bp, E. coli
ggctgccgtttaacaccaatttccg

SEQ ID NO: 170021 - DNA, 25 bp, E. coli
taatgatgtttctacagcagagctg

SEQ ID NO: 170022 - DNA, 25 bp, E. coli
taatgatgtttcaacagcagagctg

SEQ ID NO: 170023 - DNA, 25 bp, E. coli
gatgtcgatgctccaggcgttgcca

SEQ ID NO: 170024 - DNA, 25 bp, E. coli
gatgtcgatgctgcaggcgttgcca

SEQ ID NO: 170025 - DNA, 25 bp, E. coli
gatgcctcggctcgatgtcgatgct

SEQ ID NO: 170026 - DNA, 25 bp, E. coli
gatgcctcggctggatgtcgatgct

SEQ ID NO: 170027 - DNA, 25 bp, E. coli
aaccttaagcgacctggcggtcacc

SEQ ID NO: 170028 - DNA, 25 bp, E. coli
atgacatcgtggctgaacgcgccgc

SEQ ID NO: 170029 - DNA, 25 bp, E. coli
atgacatcgtgggtgaacgcgccgc

SEQ ID NO: 170030 - DNA, 25 bp, E. coli
aaccttaagcgagctggcggtcacc

SEQ ID NO: 170031 - DNA, 25 bp, E. coli
tattgattatcagcccgccaaagcg

SEQ ID NO: 170032 - DNA, 25 bp, E. coli
tattgattatcaccccgccaaagcg

SEQ ID NO: 170033 - DNA, 25 bp, E. coli
tgcagtacgtgaaagttcgctccgg

SEQ ID NO: 170034 - DNA, 25 bp, E. coli
tgcagtacgtgatagttcgctccgg

SEQ ID NO: 170035 - DNA, 25 bp, E. coli
tcattgccctggaggttcaacccgg

SEQ ID NO: 170036 - DNA, 25 bp, E. coli
tcattgccctggtggttcaacccgg

SEQ ID NO: 170037 - DNA, 25 bp, E. coli
tcttgaacacttaggcgaagccgat

SEQ ID NO: 170038 - DNA, 25 bp, E. coli
tcttgaacactttggcgaagccgat

SEQ ID NO: 170039 - DNA, 25 bp, E. coli
gccagattgatgacgctttcgctca

SEQ ID NO: 170040 - DNA, 25 bp, E. coli
gccagattgatgtcgctttcgctca

SEQ ID NO: 170041 - DNA, 25 bp, E. coli
ggattcaccaattccgctgccgctg

SEQ ID NO: 170042 - DNA, 25 bp, E. coli
ggattcaccaataccgctgccgctg

SEQ ID NO: 170043 - DNA, 25 bp, E. coli
tggcggcgcgcaagaaaccttaagc

SEQ ID NO: 170044 - DNA, 25 bp, E. coli
tggcggcgcgcatgaaaccttaagc

SEQ ID NO: 170045 - DNA, 25 bp, E. coli
ggcgcgtggttatagctactcggat

SEQ ID NO: 170046 - DNA, 25 bp, E. coli
ggcgcgtggttaaagctactcggat

SEQ ID NO: 170047 - DNA, 25 bp, E. coli
gatcgcgtgcgcaattactggccgg

SEQ ID NO: 170048 - DNA, 25 bp, E. coli
gatcgcgtgcgctattactggccgg

SEQ ID NO: 170049 - DNA, 25 bp, E. coli
aatgacgggcagaaaggaattggtc

SEQ ID NO: 170050 - DNA, 25 bp, E. coli
aatgacgggcagtaaggaattggtc

SEQ ID NO: 170051 - DNA, 25 bp, E. coli
cactcattgtctgtcccatcgtggg

SEQ ID NO: 170052 - DNA, 25 bp, E. coli
cacgtactctcaactgccgtagcag

SEQ ID NO: 170053 - DNA, 25 bp, E. coli
cacgtactctcatctgccgtagcag

SEQ ID NO: 170054 - DNA, 25 bp, E. coli
cactcattgtctctcccatcgtggg

SEQ ID NO: 170055 - DNA, 25 bp, E. coli
catctgccgtaggaggaacgatggt

SEQ ID NO: 170056 - DNA, 25 bp, E. coli
catctgccgtagcaggaacgatggt

SEQ ID NO: 170057 - DNA, 25 bp, E. coli
tacgccgtttctggagtgggacgaa

SEQ ID NO: 170058 - DNA, 25 bp, E. coli
tacgccgtttctcgagtgggacgaa

SEQ ID NO: 170059 - DNA, 25 bp, E. coli
ttaaacctgcgcgaagtcaccaaga

SEQ ID NO: 170060 - DNA, 25 bp, E. coli
ttcacatggcgccaatgacgggcag

SEQ ID NO: 170061 - DNA, 25 bp, E. coli
ttaaacctgcgccaagtcaccaaga

SEQ ID NO: 170062 - DNA, 25 bp, E. coli
ttcacatggcgcgaatgacgggcag

SEQ ID NO: 170063 - DNA, 25 bp, E. coli
tgcttggcgggcttagcgttgccta

SEQ ID NO: 170064 - DNA, 25 bp, E. coli
tgcttggcgggcatagcgttgccta

SEQ ID NO: 170065 - DNA, 25 bp, E. coli
gctcccgccgggtttgtcgtcaata

SEQ ID NO: 170066 - DNA, 25 bp, E. coli
gctcccgccgggattgtcgtcaata

SEQ ID NO: 170067 - DNA, 25 bp, E. coli
gggctaatttttctgctacgccgtt

SEQ ID NO: 170068 - DNA, 25 bp, E. coli
gggctaatttttgtgctacgccgtt

SEQ ID NO: 170069 - DNA, 25 bp, E. coli
gaccgtattcatcgtattcctgaag

SEQ ID NO: 170070 - DNA, 25 bp, E. coli
gaccgtattcatggtattcctgaag

SEQ ID NO: 170071 - DNA, 25 bp, E. coli
cgccggttgccgcactaatctttat

SEQ ID NO: 170072 - DNA, 25 bp, E. coli
cgccggttgccggactaatctttat

SEQ ID NO: 170073 - DNA, 25 bp, E. coli
aggccattgcgcgtggtaccacact

SEQ ID NO: 170074 - DNA, 25 bp, E. coli
aggccattgcgcctggtaccacact

SEQ ID NO: 170075 - DNA, 25 bp, E. coli
aggcgctttcctgggcgacagatgc

SEQ ID NO: 170076 - DNA, 25 bp, E. coli
aggcgctttcctcggcgacagatgc

SEQ ID NO: 170077 - DNA, 25 bp, E. coli
tggtaccacactcctgcaaggctgg

SEQ ID NO: 170078 - DNA, 25 bp, E. coli
tcgcaggcgcttacctgggcgacag

SEQ ID NO: 170079 - DNA, 25 bp, E. coli
tgccgcactaatgtttatgctctgt

SEQ ID NO: 170080 - DNA, 25 bp, E. coli
tcgcaggcgctttcctgggcgacag

SEQ ID NO: 170081 - DNA, 25 bp, E. coli
tgccgcactaatctttatgctctgt

SEQ ID NO: 170082 - DNA, 25 bp, E. coli
cgctctggcaatcacttggtctgga

SEQ ID NO: 170083 - DNA, 25 bp, E. coli
cgctctggcaatgacttggtctgga

SEQ ID NO: 170084 - DNA, 25 bp, E. coli
ctttcctgggcgacagatgctgttg

SEQ ID NO: 170085 - DNA, 25 bp, E. coli
ctgggcgacagaagctgttgcgtct

SEQ ID NO: 170086 - DNA, 25 bp, E. coli
ctttcctgggcgtcagatgctgttg

SEQ ID NO: 170087 - DNA, 25 bp, E. coli
ctgggcgacagatgctgttgcgtct

SEQ ID NO: 170088 - DNA, 25 bp, E. coli
tggcaatcacttcgtctggagtgga

SEQ ID NO: 170089 - DNA, 25 bp, E. coli
tggtaccacactgctgcaaggctgg

SEQ ID NO: 170090 - DNA, 25 bp, E. coli
tggcaatcacttggtctggagtgga

SEQ ID NO: 170091 - DNA, 25 bp, E. coli
ggctggcctcgcactggcaatcact

SEQ ID NO: 170092 - DNA, 25 bp, E. coli
ggctggcctcgctctggcaatcact

SEQ ID NO: 170093 - DNA, 25 bp, E. coli
cacggatggcattgaatgaagcgca

SEQ ID NO: 170094 - DNA, 25 bp, E. coli
cacggatggcatagaatgaagcgca

SEQ ID NO: 170095 - DNA, 25 bp, E. coli
cagacgaaactgattgaaggcgatg

SEQ ID NO: 170096 - DNA, 25 bp, E. coli
cagacgaaactgtttgaaggcgatg

SEQ ID NO: 170097 - DNA, 25 bp, E. coli
tacgcaaacggaagctgaagagctg

SEQ ID NO: 170098 - DNA, 25 bp, E. coli
atttaatgacgtccatgcttgcgcg

SEQ ID NO: 170099 - DNA, 25 bp, E. coli
atttaatgacgtgcatgcttgcgcg

SEQ ID NO: 170100 - DNA, 25 bp, E. coli
actgaaacaggcgaagcagggcgat

SEQ ID NO: 170101 - DNA, 25 bp, E. coli
actgaaacaggccaagcagggcgat

SEQ ID NO: 170102 - DNA, 25 bp, E. coli
tacgcaaacggatgctgaagagctg

SEQ ID NO: 170103 - DNA, 25 bp, E. coli
ttgagcttcatgtaaaactgaaggc

SEQ ID NO: 170104 - DNA, 25 bp, E. coli
ttgagcttcatgaaaaactgaaggc

SEQ ID NO: 170105 - DNA, 25 bp, E. coli
tgatggatcagtcacggatggcatt

SEQ ID NO: 170106 - DNA, 25 bp, E. coli
tgcttgcgcgtgaactgattactga

SEQ ID NO: 170107 - DNA, 25 bp, E. coli
tgatggatcagtgacggatggcatt

SEQ ID NO: 170108 - DNA, 25 bp, E. coli
tgcttgcgcgtgtactgattactga

SEQ ID NO: 170109 - DNA, 25 bp, E. coli
gctggtccacgcacaggatcattta

SEQ ID NO: 170110 - DNA, 25 bp, E. coli
gctggtccacgctcaggatcattta

SEQ ID NO: 170111 - DNA, 25 bp, E. coli
gaatgaagcgcatctggtacagacg

SEQ ID NO: 170112 - DNA, 25 bp, E. coli
gaatgaagcgcaactggtacagacg

SEQ ID NO: 170113 - DNA, 25 bp, E. coli
gaaagtgagtctggtgctggtccac

SEQ ID NO: 170114 - DNA, 25 bp, E. coli
gaaagtgagtctcgtgctggtccac

SEQ ID NO: 170115 - DNA, 25 bp, E. coli
aagagcaaattgttgaaatggttca

SEQ ID NO: 170116 - DNA, 25 bp, E. coli
aagagcaaattgatgaaatggttca

SEQ ID NO: 170117 - DNA, 25 bp, E. coli
aattgttgaaatcgttcataacgga

SEQ ID NO: 170118 - DNA, 25 bp, E. coli
aattgttgaaatggttcataacgga

SEQ ID NO: 170119 - DNA, 25 bp, E. coli
aactgaattacaactacgaaacccg

SEQ ID NO: 170120 - DNA, 25 bp, E. coli
aactgaattacatctacgaaacccg

SEQ ID NO: 170121 - DNA, 25 bp, E. coli
tgaattacatctacgaaacccgaaa

SEQ ID NO: 170122 - DNA, 25 bp, E. coli
tgaattacatcttcgaaacccgaaa

SEQ ID NO: 170123 - DNA, 25 bp, E. coli
tctacgaaacccgaaaaccaggcat

SEQ ID NO: 170124 - DNA, 25 bp, E. coli
tctacgaaaccccaaaaccaggcat

SEQ ID NO: 170125 - DNA, 25 bp, E. coli
cctgcaaacgtgagtatttcaactg

SEQ ID NO: 170126 - DNA, 25 bp, E. coli
cctgcaaacgtgtgtatttcaactg

SEQ ID NO: 170127 - DNA, 25 bp, E. coli
ccaggcattaaacagcaaattgttg

SEQ ID NO: 170128 - DNA, 25 bp, E. coli
ccaggcattaaagagcaaattgttg

SEQ ID NO: 170129 - DNA, 25 bp, E. coli
gcaaacgtgtgtttttcaactgaat

SEQ ID NO: 170130 - DNA, 25 bp, E. coli
gcaaacgtgtgtatttcaactgaat

SEQ ID NO: 170131 - DNA, 25 bp, E. coli
gtgctaatcctggaaacgtgtgtat

SEQ ID NO: 170132 - DNA, 25 bp, E. coli
gtgctaatcctgcaaacgtgtgtat

SEQ ID NO: 170133 - DNA, 25 bp, E. coli
tacatctacgaaacccgaaaaccag

SEQ ID NO: 170134 - DNA, 25 bp, E. coli
taatcctgcaaaggtgtgtatttca

SEQ ID NO: 170135 - DNA, 25 bp, E. coli
tacatctacgaatcccgaaaaccag

SEQ ID NO: 170136 - DNA, 25 bp, E. coli
taatcctgcaaacgtgtgtatttca

SEQ ID NO: 170137 - DNA, 25 bp, E. coli
tactggatatccagaaatcgaccgt

SEQ ID NO: 170138 - DNA, 25 bp, E. coli
tactggatatcctgaaatcgaccgt

SEQ ID NO: 170139 - DNA, 25 bp, E. coli
cattaggtttgctgggaagaaagac

SEQ ID NO: 170140 - DNA, 25 bp, E. coli
cattaggtttgcagggaagaaagac

SEQ ID NO: 170141 - DNA, 25 bp, E. coli
tatcccggaacgctatagaaatgag

SEQ ID NO: 170142 - DNA, 25 bp, E. coli
tatcccggaacggtatagaaatgag

SEQ ID NO: 170143 - DNA, 25 bp, E. coli
tttgctgggaagaaagacagtctta

SEQ ID NO: 170144 - DNA, 25 bp, E. coli
tttgctgggaagtaagacagtctta

SEQ ID NO: 170145 - DNA, 25 bp, E. coli
tgttatcccggaacgctatagaaat

SEQ ID NO: 170146 - DNA, 25 bp, E. coli
tgaaatcgaccgttttgttatcccg

SEQ ID NO: 170147 - DNA, 25 bp, E. coli
tgttatcccggatcgctatagaaat

SEQ ID NO: 170148 - DNA, 25 bp, E. coli
tgaaatcgaccgatttgttatcccg

SEQ ID NO: 170149 - DNA, 25 bp, E. coli
gaaagacagtcttatggatgaactt

SEQ ID NO: 170150 - DNA, 25 bp, E. coli
gaaagacagtctaatggatgaactt

SEQ ID NO: 170151 - DNA, 25 bp, E. coli
cccggaacgctaaagaaatgagtgc

SEQ ID NO: 170152 - DNA, 25 bp, E. coli
cccggaacgctatagaaatgagtgc

SEQ ID NO: 170153 - DNA, 25 bp, E. coli
ctacattaggtttgctgggaagaaa

SEQ ID NO: 170154 - DNA, 25 bp, E. coli
ctacattaggttagctgggaagaaa

SEQ ID NO: 170155 - DNA, 25 bp, E. coli
ggatatcctgaaatcgaccgttttg

SEQ ID NO: 170156 - DNA, 25 bp, E. coli
ggatatcctgaattcgaccgttttg

SEQ ID NO: 170157 - DNA, 25 bp, E. coli
ggaacgctatagaaatgagtgctac

SEQ ID NO: 170158 - DNA, 25 bp, E. coli
ggaacgctatagtaatgagtgctac

SEQ ID NO: 170159 - DNA, 25 bp, E. coli
aattgatgggcgacaaacctgcgtc

SEQ ID NO: 170160 - DNA, 25 bp, E. coli
aattgatgggcgtcaaacctgcgtc

SEQ ID NO: 170161 - DNA, 25 bp, E. coli
tagccgcgatcgcatgttggaaatc

SEQ ID NO: 170162 - DNA, 25 bp, E. coli
tagccgcgatcggatgttggaaatc

SEQ ID NO: 170163 - DNA, 25 bp, E. coli
tgttggaaatcatgcgtgatagccg

SEQ ID NO: 170164 - DNA, 25 bp, E. coli
tgttggaaatcaagcgtgatagccg

SEQ ID NO: 170165 - DNA, 25 bp, E. coli
ccactggcggcactgtttagcgtac

SEQ ID NO: 170166 - DNA, 25 bp, E. coli
ccactggcggcagtgtttagcgtac

SEQ ID NO: 170167 - DNA, 25 bp, E. coli
gctggtcttcatggtgctgcaggca

SEQ ID NO: 170168 - DNA, 25 bp, E. coli
gcgatacgctggcagcagccataga

SEQ ID NO: 170169 - DNA, 25 bp, E. coli
gcgatacgctgggagcagccataga

SEQ ID NO: 170170 - DNA, 25 bp, E. coli
gctggtcttcatcgtgctgcaggca

SEQ ID NO: 170171 - DNA, 25 bp, E. coli
gacggcctcgctgatacctgtgatg

SEQ ID NO: 170172 - DNA, 25 bp, E. coli
gacggcctcgctcatacctgtgatg

SEQ ID NO: 170173 - DNA, 25 bp, E. coli
cgtattttctgctcgtagccgcgat

SEQ ID NO: 170174 - DNA, 25 bp, E. coli
cccacggcggtcaggcattgatttt

SEQ ID NO: 170175 - DNA, 25 bp, E. coli
cccagggactggatttcgagcatta

SEQ ID NO: 170176 - DNA, 25 bp, E. coli
cccagggactggttttcgagcatta

SEQ ID NO: 170177 - DNA, 25 bp, E. coli
cgtattttctgcacgtagccgcgat

SEQ ID NO: 170178 - DNA, 25 bp, E. coli
cccacggcggtctggcattgatttt

SEQ ID NO: 170179 - DNA, 25 bp, E. coli
cttctcaaacgtacgctgggcgggc

SEQ ID NO: 170180 - DNA, 25 bp, E. coli
cttctcaaacgttcgctgggcgggc

SEQ ID NO: 170181 - DNA, 25 bp, E. coli
tacttcccggaatcaggcgtctggg

SEQ ID NO: 170182 - DNA, 25 bp, E. coli
tacttcccggaaacaggcgtctggg

SEQ ID NO: 170183 - DNA, 25 bp, E. coli
tagcaaccattcaaacccttggcgg

SEQ ID NO: 170184 - DNA, 25 bp, E. coli
tagcaaccattctaacccttggcgg

SEQ ID NO: 170185 - DNA, 25 bp, E. coli
ttacccctggtatgacgaagcgact

SEQ ID NO: 170186 - DNA, 25 bp, E. coli
ttacccctggtaagacgaagcgact

SEQ ID NO: 170187 - DNA, 25 bp, E. coli
tgccggtatggaagaggatgcctac

SEQ ID NO: 170188 - DNA, 25 bp, E. coli
tgccggtatggatgaggatgcctac

SEQ ID NO: 170189 - DNA, 25 bp, E. coli
gaaaaccacgtaccaatattcgccg

SEQ ID NO: 170190 - DNA, 25 bp, E. coli
gaaaaccacgtagcaatattcgccg

SEQ ID NO: 170191 - DNA, 25 bp, E. coli
gattgaaattctcaaagcccgcgag

SEQ ID NO: 170192 - DNA, 25 bp, E. coli
gattatctgctttatcagcgcggca

SEQ ID NO: 170193 - DNA, 25 bp, E. coli
gattatctgcttaatcagcgcggca

SEQ ID NO: 170194 - DNA, 25 bp, E. coli
gatttcctgaaacgctacttcccgg

SEQ ID NO: 170195 - DNA, 25 bp, E. coli
gttttaaagaagtccctcgcagcga

SEQ ID NO: 170196 - DNA, 25 bp, E. coli
gttttaaagaagaccctcgcagcga

SEQ ID NO: 170197 - DNA, 25 bp, E. coli
gattgaaattctgaaagcccgcgag

SEQ ID NO: 170198 - DNA, 25 bp, E. coli
gatttcctgaaaggctacttcccgg

SEQ ID NO: 170199 - DNA, 25 bp, E. coli
gtgtctatctcaacgccagcggtcg

SEQ ID NO: 170200 - DNA, 25 bp, E. coli
gtgtctatctcatcgccagcggtcg

SEQ ID NO: 170201 - DNA, 25 bp, E. coli
tcaaaaagttgacgcctacgctggc

SEQ ID NO: 170202 - DNA, 25 bp, E. coli
tcaaaaagttgaggcctacgctggc

SEQ ID NO: 170203 - DNA, 25 bp, E. coli
caaatcatttctggtgccagcatgc

SEQ ID NO: 170204 - DNA, 25 bp, E. coli
caaatcatttctcgtgccagcatgc

SEQ ID NO: 170205 - DNA, 25 bp, E. coli
tatgagaaagacttcggtcgcgact

SEQ ID NO: 170206 - DNA, 25 bp, E. coli
tatgagaaagacatcggtcgcgact

SEQ ID NO: 170207 - DNA, 25 bp, E. coli
ttctcgtgccaggatgctgatggtt

SEQ ID NO: 170208 - DNA, 25 bp, E. coli
ttctcgtgccagcatgctgatggtt

SEQ ID NO: 170209 - DNA, 25 bp, E. coli
tgaatggcctggacctgaagtttgg

SEQ ID NO: 170210 - DNA, 25 bp, E. coli
tgaatggcctggtcctgaagtttgg

SEQ ID NO: 170211 - DNA, 25 bp, E. coli
tcctgaagtttgcttataaaggcga

SEQ ID NO: 170212 - DNA, 25 bp, E. coli
tccggccaacatggcggaagccaaa

SEQ ID NO: 170213 - DNA, 25 bp, E. coli
tccggccaacatcgcggaagccaaa

SEQ ID NO: 170214 - DNA, 25 bp, E. coli
tcctgaagtttggttataaaggcga

SEQ ID NO: 170215 - DNA, 25 bp, E. coli
gaaggtctgaatcgcctggtcctga

SEQ ID NO: 170216 - DNA, 25 bp, E. coli
gaacactatcaggatgatcttcatc

SEQ ID NO: 170217 - DNA, 25 bp, E. coli
gaaggtctgaatggcctggtcctga

SEQ ID NO: 170218 - DNA, 25 bp, E. coli
gaacactatcagcatgatcttcatc

SEQ ID NO: 170219 - DNA, 25 bp, E. coli
cgaacgtaaatgttcccaaatcatt

SEQ ID NO: 170220 - DNA, 25 bp, E. coli
cgaacgtaaatgatcccaaatcatt

SEQ ID NO: 170221 - DNA, 25 bp, E. coli
ctgtctccggcctacatggcggaag

SEQ ID NO: 170222 - DNA, 25 bp, E. coli
cgtgaagagtatgagaaagacttcg

SEQ ID NO: 170223 - DNA, 25 bp, E. coli
cgtgaagagtatcagaaagacttcg

SEQ ID NO: 170224 - DNA, 25 bp, E. coli
ctgtctccggccaacatggcggaag

SEQ ID NO: 170225 - DNA, 25 bp, E. coli
cactagggcggcagcttgtaggtat

SEQ ID NO: 170226 - DNA, 25 bp, E. coli
cactagggcggctgcttgtaggtat

SEQ ID NO: 170227 - DNA, 25 bp, E. coli
accgacaagtggtcaggcatccggg

SEQ ID NO: 170228 - DNA, 25 bp, E. coli
accgacaagtggacaggcatccggg

SEQ ID NO: 170229 - DNA, 25 bp, E. coli
tatgaaaaatcgtaaggtcctgagg

SEQ ID NO: 170230 - DNA, 25 bp, E. coli
taggtatcgcaactcgagtgagctc

SEQ ID NO: 170231 - DNA, 25 bp, E. coli
tatgaaaaatcgaaaggtcctgagg

SEQ ID NO: 170232 - DNA, 25 bp, E. coli
tagctgcctatgagcaatcgaagaa

SEQ ID NO: 170233 - DNA, 25 bp, E. coli
tagctgcctatgtgcaatcgaagaa

SEQ ID NO: 170234 - DNA, 25 bp, E. coli
taggtatcgcaagtcgagtgagctc

SEQ ID NO: 170235 - DNA, 25 bp, E. coli
tccaggctcgtcgaatgttaatgcg

SEQ ID NO: 170236 - DNA, 25 bp, E. coli
tccaggctcgtccaatgttaatgcg

SEQ ID NO: 170237 - DNA, 25 bp, E. coli
gcattaaaagagcacttggctgcct

SEQ ID NO: 170238 - DNA, 25 bp, E. coli
gcattaaaagaggacttggctgcct

SEQ ID NO: 170239 - DNA, 25 bp, E. coli
gaactggattttgtgtagcccctca

SEQ ID NO: 170240 - DNA, 25 bp, E. coli
gaactggattttctgtagcccctca

SEQ ID NO: 170241 - DNA, 25 bp, E. coli
cgatttttaatgtgagcagccaggt

SEQ ID NO: 170242 - DNA, 25 bp, E. coli
cgatttttaatgagagcagccaggt

SEQ ID NO: 170243 - DNA, 25 bp, E. coli
ggccgtgcgtctaactccggtgaaa

SEQ ID NO: 170244 - DNA, 25 bp, E. coli
ggccgtgcgtcttactccggtgaaa

SEQ ID NO: 170245 - DNA, 25 bp, E. coli
taacgctgcttctacactagggcgg

SEQ ID NO: 170246 - DNA, 25 bp, E. coli
taacgctgcttcaacactagggcgg

SEQ ID NO: 170247 - DNA, 25 bp, E. coli
tatggcgtgaaatcgtcaacgagat

SEQ ID NO: 170248 - DNA, 25 bp, E. coli
tatggcgtgaaaacgtcaacgagat

SEQ ID NO: 170249 - DNA, 25 bp, E. coli
tattttatggcgagaaatcgtcaac

SEQ ID NO: 170250 - DNA, 25 bp, E. coli
tattttatggcgtgaaatcgtcaac

SEQ ID NO: 170251 - DNA, 25 bp, E. coli
tttatggcgtgaaatcgtcaacgag

SEQ ID NO: 170252 - DNA, 25 bp, E. coli
tttatggcgtgatatcgtcaacgag

SEQ ID NO: 170253 - DNA, 25 bp, E. coli
tgaaatcgtcaaggagatcgccacg

SEQ ID NO: 170254 - DNA, 25 bp, E. coli
tgaaatcgtcaacgagatcgccacg

SEQ ID NO: 170255 - DNA, 25 bp, E. coli
tgctcgtaaacgtcgccataaagtg

SEQ ID NO: 170256 - DNA, 25 bp, E. coli
tgctcgtaaacgacgccataaagtg

SEQ ID NO: 170257 - DNA, 25 bp, E. coli
tctgctcgtaaaggtcgccataaag

SEQ ID NO: 170258 - DNA, 25 bp, E. coli
tctgctcgtaaacgtcgccataaag

SEQ ID NO: 170259 - DNA, 25 bp, E. coli
gctcgtaaacgtggccataaagtga

SEQ ID NO: 170260 - DNA, 25 bp, E. coli
gctcgtaaacgtcgccataaagtga

SEQ ID NO: 170261 - DNA, 25 bp, E. coli
gaatctgctcgtaaacgtcgccata

SEQ ID NO: 170262 - DNA, 25 bp, E. coli
gaatctgctcgttaacgtcgccata

SEQ ID NO: 170263 - DNA, 25 bp, E. coli
cgtgaaatcgtcaacgagatcgcca

SEQ ID NO: 170264 - DNA, 25 bp, E. coli
cgtgaaatcgtctacgagatcgcca

SEQ ID NO: 170265 - DNA, 25 bp, E. coli
gtaaacgtcgccttaaagtgacgtc

SEQ ID NO: 170266 - DNA, 25 bp, E. coli
gtaaacgtcgccataaagtgacgtc

SEQ ID NO: 170267 - DNA, 25 bp, E. coli
tggcgtgaaatcctcaacgagatcg

SEQ ID NO: 170268 - DNA, 25 bp, E. coli
tggcgtgaaatcgtcaacgagatcg

SEQ ID NO: 170269 - DNA, 25 bp, E. coli
attccggtcggctatcagtgcggta

SEQ ID NO: 170270 - DNA, 25 bp, E. coli
attccggtcggcaatcagtgcggta

SEQ ID NO: 170271 - DNA, 25 bp, E. coli
aaaaaattcgtcaggctgtgcgcca

SEQ ID NO: 170272 - DNA, 25 bp, E. coli
cactcgttccaggaattaaaaaaat

SEQ ID NO: 170273 - DNA, 25 bp, E. coli
aaaaaattcgtctggctgtgcgcca

SEQ ID NO: 170274 - DNA, 25 bp, E. coli
cactcgttccagcaattaaaaaaat

SEQ ID NO: 170275 - DNA, 25 bp, E. coli
tcgtcaggctgtccgccagttttcc

SEQ ID NO: 170276 - DNA, 25 bp, E. coli
tccgggccgcgcgtgaagtgatgga

SEQ ID NO: 170277 - DNA, 25 bp, E. coli
tgcggtaaatgtgtccgggccgcgc

SEQ ID NO: 170278 - DNA, 25 bp, E. coli
tccgggccgcgcctgaagtgatgga

SEQ ID NO: 170279 - DNA, 25 bp, E. coli
tcgtcaggctgtgcgccagttttcc

SEQ ID NO: 170280 - DNA, 25 bp, E. coli
tgcggtaaatgtctccgggccgcgc

SEQ ID NO: 170281 - DNA, 25 bp, E. coli
tctttgtaatggtatcagcgataaa

SEQ ID NO: 170282 - DNA, 25 bp, E. coli
tctttgtaatggaatcagcgataaa

SEQ ID NO: 170283 - DNA, 25 bp, E. coli
gccggagtttaaggagtccgcataa

SEQ ID NO: 170284 - DNA, 25 bp, E. coli
gccggagtttaacgagtccgcataa

SEQ ID NO: 170285 - DNA, 25 bp, E. coli
gaagtgatggaggatgaattaatgc

SEQ ID NO: 170286 - DNA, 25 bp, E. coli
gaagtgatggagcatgaattaatgc

SEQ ID NO: 170287 - DNA, 25 bp, E. coli
cgtttgtctttgaaatggtatcagc

SEQ ID NO: 170288 - DNA, 25 bp, E. coli
cgtttgtctttgtaatggtatcagc

SEQ ID NO: 170289 - DNA, 25 bp, E. coli
ggtcggcaatcagtgcggtaaatgt

SEQ ID NO: 170290 - DNA, 25 bp, E. coli
ggtcggcaatcactgcggtaaatgt

SEQ ID NO: 170291 - DNA, 25 bp, E. coli
cagtttgataaactcaccgccgtaa

SEQ ID NO: 170292 - DNA, 25 bp, E. coli
cagtttgataaagtcaccgccgtaa

SEQ ID NO: 170293 - DNA, 25 bp, E. coli
tacctgggactatcaataagtgtgc

SEQ ID NO: 170294 - DNA, 25 bp, E. coli
tacctgggactaacaataagtgtgc

SEQ ID NO: 170295 - DNA, 25 bp, E. coli
tttcatcataaactcccggtagtgg

SEQ ID NO: 170296 - DNA, 25 bp, E. coli
tttcatcataaagtcccggtagtgg

SEQ ID NO: 170297 - DNA, 25 bp, E. coli
tttatcaaagccaatttcgcctgag

SEQ ID NO: 170298 - DNA, 25 bp, E. coli
tttatcaaagcctatttcgcctgag

SEQ ID NO: 170299 - DNA, 25 bp, E. coli
tccgcgcggctgcaaaagactaatt

SEQ ID NO: 170300 - DNA, 25 bp, E. coli
tccgcgcggctggaaaagactaatt

SEQ ID NO: 170301 - DNA, 25 bp, E. coli
tcacaaattgatcccagcttctggt

SEQ ID NO: 170302 - DNA, 25 bp, E. coli
tcacaaattgatgccagcttctggt

SEQ ID NO: 170303 - DNA, 25 bp, E. coli
ccggtagtggaaagacaggcaaagt

SEQ ID NO: 170304 - DNA, 25 bp, E. coli
ccggtagtggaatgacaggcaaagt

SEQ ID NO: 170305 - DNA, 25 bp, E. coli
gatctgtgaaccatcaacgtcttca

SEQ ID NO: 170306 - DNA, 25 bp, E. coli
gatctgtgaaccttcaacgtcttca

SEQ ID NO: 170307 - DNA, 25 bp, E. coli
ggtgttttcacagctatacctggga

SEQ ID NO: 170308 - DNA, 25 bp, E. coli
ggtgttttcacacctatacctggga

SEQ ID NO: 170309 - DNA, 25 bp, E. coli
ggcaggctatctctcttcagtttga

SEQ ID NO: 170310 - DNA, 25 bp, E. coli
ggcaggctatctgtcttcagtttga

SEQ ID NO: 170311 - DNA, 25 bp, E. coli
taagtgtgccagtattatccgcgcg

SEQ ID NO: 170312 - DNA, 25 bp, E. coli
taagtgtgccagaattatccgcgcg

SEQ ID NO: 170313 - DNA, 25 bp, E. coli
cagccacagcagtagatgccgaggc

SEQ ID NO: 170314 - DNA, 25 bp, E. coli
cagccacagcagaagatgccgaggc

SEQ ID NO: 170315 - DNA, 25 bp, E. coli
catcagccacagcagtagatgccga

SEQ ID NO: 170316 - DNA, 25 bp, E. coli
catcagccacaggagtagatgccga

SEQ ID NO: 170317 - DNA, 25 bp, E. coli
tattggtgatgtctctgcgtttaag

SEQ ID NO: 170318 - DNA, 25 bp, E. coli
tattggtgatgtgtctgcgtttaag

SEQ ID NO: 170319 - DNA, 25 bp, E. coli
tatcaaggcgggacgctttgttggt

SEQ ID NO: 170320 - DNA, 25 bp, E. coli
tatcaaggcgggtcgctttgttggt

SEQ ID NO: 170321 - DNA, 25 bp, E. coli
ttggtgatgtctgtgcgtttaagcc

SEQ ID NO: 170322 - DNA, 25 bp, E. coli
ttggtgatgtctctgcgtttaagcc

SEQ ID NO: 170323 - DNA, 25 bp, E. coli
tcgctttgttggtttgacccggtga

SEQ ID NO: 170324 - DNA, 25 bp, E. coli
tcgctttgttggattgacccggtga

SEQ ID NO: 170325 - DNA, 25 bp, E. coli
gatttatatcaaggcgggtcgcttt

SEQ ID NO: 170326 - DNA, 25 bp, E. coli
gatttatatcaacgcgggtcgcttt

SEQ ID NO: 170327 - DNA, 25 bp, E. coli
ggatttatatcatggcgggtcgctt

SEQ ID NO: 170328 - DNA, 25 bp, E. coli
ggatttatatcaaggcgggtcgctt

SEQ ID NO: 170329 - DNA, 25 bp, E. coli
gggatttatatcaaggcgggtcgct

SEQ ID NO: 170330 - DNA, 25 bp, E. coli
gggatttatatctaggcgggtcgct

SEQ ID NO: 170331 - DNA, 25 bp, E. coli
tcagccacagcagtagatgccgagg

SEQ ID NO: 170332 - DNA, 25 bp, E. coli
tcagccacagcactagatgccgagg

SEQ ID NO: 170333 - DNA, 25 bp, E. coli
gtcgctttgttggtttgacccggtg

SEQ ID NO: 170334 - DNA, 25 bp, E. coli
gtcgctttgttgctttgacccggtg

SEQ ID NO: 170335 - DNA, 25 bp, E. coli
aagagggttgatcccagcatacagg

SEQ ID NO: 170336 - DNA, 25 bp, E. coli
aagagggttgatgccagcatacagg

SEQ ID NO: 170337 - DNA, 25 bp, E. coli
cagtctaaaagagggttgatgccag

SEQ ID NO: 170338 - DNA, 25 bp, E. coli
cagtctaaaagacggttgatgccag

SEQ ID NO: 170339 - DNA, 25 bp, E. coli
taaaagagggttcatgccagcatac

SEQ ID NO: 170340 - DNA, 25 bp, E. coli
tattcggagagaaacgtcaggcagt

SEQ ID NO: 170341 - DNA, 25 bp, E. coli
tattcggagagatacgtcaggcagt

SEQ ID NO: 170342 - DNA, 25 bp, E. coli
tgatgccagcatacaggggcgaagc

SEQ ID NO: 170343 - DNA, 25 bp, E. coli
tgatgccagcattcaggggcgaagc

SEQ ID NO: 170344 - DNA, 25 bp, E. coli
tgagtggcgtgttcagtctaaaaga

SEQ ID NO: 170345 - DNA, 25 bp, E. coli
tgagtggcgtgtacagtctaaaaga

SEQ ID NO: 170346 - DNA, 25 bp, E. coli
gaagctggtcaacaagtcaacatta

SEQ ID NO: 170347 - DNA, 25 bp, E. coli
gaagctggtcaagaagtcaacatta

SEQ ID NO: 170348 - DNA, 25 bp, E. coli
gaatattcggagagaaacgtcaggc

SEQ ID NO: 170349 - DNA, 25 bp, E. coli
gaatattcggagtgaaacgtcaggc

SEQ ID NO: 170350 - DNA, 25 bp, E. coli
cgtgttcagtcttaaagagggttga

SEQ ID NO: 170351 - DNA, 25 bp, E. coli
cgtgttcagtctaaaagagggttga

SEQ ID NO: 170352 - DNA, 25 bp, E. coli
gggcgaagctggacaacaagtcaac

SEQ ID NO: 170353 - DNA, 25 bp, E. coli
gggcgaagctggtcaacaagtcaac

SEQ ID NO: 170354 - DNA, 25 bp, E. coli
taaaagagggttgatgccagcatac

SEQ ID NO: 170355 - DNA, 25 bp, E. coli
taatggaatattgggagagaaacgt

SEQ ID NO: 170356 - DNA, 25 bp, E. coli
taatggaatattcggagagaaacgt

SEQ ID NO: 170357 - DNA, 25 bp, E. coli
aatgtgcggcgtttccttaatcaag

SEQ ID NO: 170358 - DNA, 25 bp, E. coli
aatgtgcggcgtatccttaatcaag

SEQ ID NO: 170359 - DNA, 25 bp, E. coli
tactacacccacagaccagcaagtg

SEQ ID NO: 170360 - DNA, 25 bp, E. coli
taaaggcaccttcagaagatatgcg

SEQ ID NO: 170361 - DNA, 25 bp, E. coli
taaaggcaccttgagaagatatgcg

SEQ ID NO: 170362 - DNA, 25 bp, E. coli
tactacacccactgaccagcaagtg

SEQ ID NO: 170363 - DNA, 25 bp, E. coli
aaaagcgccaacatagggcagagga

SEQ ID NO: 170364 - DNA, 25 bp, E. coli
aaaagcgccaacttagggcagagga

SEQ ID NO: 170365 - DNA, 25 bp, E. coli
tgcaggcggctccaaaatatcaaca

SEQ ID NO: 170366 - DNA, 25 bp, E. coli
tgcaggcggctcgaaaatatcaaca

SEQ ID NO: 170367 - DNA, 25 bp, E. coli
ccttgacgtcgataccggcagttat

SEQ ID NO: 170368 - DNA, 25 bp, E. coli
ccttgacgtcgaaaccggcagttat

SEQ ID NO: 170369 - DNA, 25 bp, E. coli
gcaacaagcggcaacaaaagtggct

SEQ ID NO: 170370 - DNA, 25 bp, E. coli
gcaacaagcggctacaaaagtggct

SEQ ID NO: 170371 - DNA, 25 bp, E. coli
cgttggcattcgcaataaaggcacc

SEQ ID NO: 170372 - DNA, 25 bp, E. coli
cgacaacgttgatgcgggtgatatt

SEQ ID NO: 170373 - DNA, 25 bp, E. coli
cgacaacgttgaagcgggtgatatt

SEQ ID NO: 170374 - DNA, 25 bp, E. coli
cgttggcattcggaataaaggcacc

SEQ ID NO: 170375 - DNA, 25 bp, E. coli
ctctcagaggcgcagaaagtgttga

SEQ ID NO: 170376 - DNA, 25 bp, E. coli
ctctcagaggcggagaaagtgttga

SEQ ID NO: 170377 - DNA, 25 bp, E. coli
gattcgttggaattccccacaggga

SEQ ID NO: 170378 - DNA, 25 bp, E. coli
gattcgttggaaatccccacaggga

SEQ ID NO: 170379 - DNA, 25 bp, E. coli
cattttgaggttaaagcgccggaca

SEQ ID NO: 170380 - DNA, 25 bp, E. coli
attttgcagcagctcacccgtgacg

SEQ ID NO: 170381 - DNA, 25 bp, E. coli
attttgcagcaggtcacccgtgacg

SEQ ID NO: 170382 - DNA, 25 bp, E. coli
aaacgaaggttgacgatccgcaggc

SEQ ID NO: 170383 - DNA, 25 bp, E. coli
aaacgaaggttgtcgatccgcaggc

SEQ ID NO: 170384 - DNA, 25 bp, E. coli
tagcgtgccgcaacaaacgaaggtt

SEQ ID NO: 170385 - DNA, 25 bp, E. coli
tagcgtgccgcatcaaacgaaggtt

SEQ ID NO: 170386 - DNA, 25 bp, E. coli
tgcgcgaagccgaaaagctgttaat

SEQ ID NO: 170387 - DNA, 25 bp, E. coli
tgcgcgaagccgtaaagctgttaat

SEQ ID NO: 170388 - DNA, 25 bp, E. coli
tctggccgaaccgacaacatgttgg

SEQ ID NO: 170389 - DNA, 25 bp, E. coli
tctggccgaacccacaacatgttgg

SEQ ID NO: 170390 - DNA, 25 bp, E. coli
gcagatttttcggaaacacaccggt

SEQ ID NO: 170391 - DNA, 25 bp, E. coli
gcagatttttcgcaaacacaccggt

SEQ ID NO: 170392 - DNA, 25 bp, E. coli
cattttgaggtttaagcgccggaca

SEQ ID NO: 170393 - DNA, 25 bp, E. coli
tggaagcggcgtaacagcaaggaac

SEQ ID NO: 170394 - DNA, 25 bp, E. coli
tggaagcggcgttacagcaaggaac

SEQ ID NO: 170395 - DNA, 25 bp, E. coli
taagcgaacaggaaaagcatcaacg

SEQ ID NO: 170396 - DNA, 25 bp, E. coli
taatgacgttggctatttccggcag

SEQ ID NO: 170397 - DNA, 25 bp, E. coli
taagcgaacaggtaaagcatcaacg

SEQ ID NO: 170398 - DNA, 25 bp, E. coli
taatgacgttgggtatttccggcag

SEQ ID NO: 170399 - DNA, 25 bp, E. coli
gacgttaacagaagcaatccatcgc

SEQ ID NO: 170400 - DNA, 25 bp, E. coli
gacgttaacagatgcaatccatcgc

SEQ ID NO: 170401 - DNA, 25 bp, E. coli
cataaagtgcctgacgcggtactgg

SEQ ID NO: 170402 - DNA, 25 bp, E. coli
cataaagtgcctcacgcggtactgg

SEQ ID NO: 170403 - DNA, 25 bp, E. coli
agttaagtttgcctgcggcccgtgc

SEQ ID NO: 170404 - DNA, 25 bp, E. coli
agttaagtttgcgtgcggcccgtgc

SEQ ID NO: 170405 - DNA, 25 bp, E. coli
aaaatgataacgcaccttgcccgcc

SEQ ID NO: 170406 - DNA, 25 bp, E. coli
aaaatgataacggaccttgcccgcc

SEQ ID NO: 170407 - DNA, 25 bp, E. coli
tatgctttctgagagggtgatgacg

SEQ ID NO: 170408 - DNA, 25 bp, E. coli
tatgctttctgacagggtgatgacg

SEQ ID NO: 170409 - DNA, 25 bp, E. coli
tgccaacggcgataagaaaacgtca

SEQ ID NO: 170410 - DNA, 25 bp, E. coli
tgcgccgttacttcgaacagcgtgt

SEQ ID NO: 170411 - DNA, 25 bp, E. coli
tgcgccgttactacgaacagcgtgt

SEQ ID NO: 170412 - DNA, 25 bp, E. coli
tgccaacggcgaaaagaaaacgtca

SEQ ID NO: 170413 - DNA, 25 bp, E. coli
tccgattatggaattcgcccaggag

SEQ ID NO: 170414 - DNA, 25 bp, E. coli
tccgattatggatttcgcccaggag

SEQ ID NO: 170415 - DNA, 25 bp, E. coli
gcgatcgcggcgacaatgaaatgag

SEQ ID NO: 170416 - DNA, 25 bp, E. coli
gcgatcgcggcgtcaatgaaatgag

SEQ ID NO: 170417 - DNA, 25 bp, E. coli
cgattatgtccagcgctgaagccgt

SEQ ID NO: 170418 - DNA, 25 bp, E. coli
cgattatgtccaccgctgaagccgt

SEQ ID NO: 170419 - DNA, 25 bp, E. coli
tcaaagataacgaagaagatcgcgc

SEQ ID NO: 170420 - DNA, 25 bp, E. coli
tcaaagataacgtagaagatcgcgc

SEQ ID NO: 170421 - DNA, 25 bp, E. coli
gagataacgcgttcaccgctggaag

SEQ ID NO: 170422 - DNA, 25 bp, E. coli
gagataacgcgtacaccgctggaag

SEQ ID NO: 170423 - DNA, 25 bp, E. coli
tatgagcagtatgtttgacggcgca

SEQ ID NO: 170424 - DNA, 25 bp, E. coli
tatgagcagtatctttgacggcgca

SEQ ID NO: 170425 - DNA, 25 bp, E. coli
tatttcactgggacgagagtaccca

SEQ ID NO: 170426 - DNA, 25 bp, E. coli
tatttcactgggtcgagagtaccca

SEQ ID NO: 170427 - DNA, 25 bp, E. coli
ttgctgatcccaatgaatcgccgcg

SEQ ID NO: 170428 - DNA, 25 bp, E. coli
ttgctgatcccattgaatcgccgcg

SEQ ID NO: 170429 - DNA, 25 bp, E. coli
tgttaaaaccacagcgcagtgaagg

SEQ ID NO: 170430 - DNA, 25 bp, E. coli
tgttaaaaccactgcgcagtgaagg

SEQ ID NO: 170431 - DNA, 25 bp, E. coli
tcatgtttaccttcctgttcgccag

SEQ ID NO: 170432 - DNA, 25 bp, E. coli
tcatgtttacctacctgttcgccag

SEQ ID NO: 170433 - DNA, 25 bp, E. coli
gccagcgtctcgagcttgatcacaa

SEQ ID NO: 170434 - DNA, 25 bp, E. coli
gccagcgtctcgtgcttgatcacaa

SEQ ID NO: 170435 - DNA, 25 bp, E. coli
gaagaagacatagaacgcatcgaag

SEQ ID NO: 170436 - DNA, 25 bp, E. coli
gaagaagacatacaacgcatcgaag

SEQ ID NO: 170437 - DNA, 25 bp, E. coli
gaaatgcgccgttagcccggtaaag

SEQ ID NO: 170438 - DNA, 25 bp, E. coli
gaaatgcgccgtaagcccggtaaag

SEQ ID NO: 170439 - DNA, 25 bp, E. coli
gattgtctggacaggcatggcacca

SEQ ID NO: 170440 - DNA, 25 bp, E. coli
gattgtctggactggcatggcacca

SEQ ID NO: 170441 - DNA, 25 bp, E. coli
ggcggacaccgactctttgatgaag

SEQ ID NO: 170442 - DNA, 25 bp, E. coli
ggcggacaccgagtctttgatgaag

SEQ ID NO: 170443 - DNA, 25 bp, E. coli
gagccgcctgcatgaagagatgatg

SEQ ID NO: 170444 - DNA, 25 bp, E. coli
gagccgcctgcaagaagagatgatg

SEQ ID NO: 170445 - DNA, 25 bp, E. coli
caattcattgcggatggtgcagctc

SEQ ID NO: 170446 - DNA, 25 bp, E. coli
caattcattgcgcatggtgcagctc

SEQ ID NO: 170447 - DNA, 25 bp, E. coli
catgcgctggaatactactggccgg

SEQ ID NO: 170448 - DNA, 25 bp, E. coli
catgcgctggaaaactactggccgg

SEQ ID NO: 170449 - DNA, 25 bp, E. coli
taaacgccgtatcgttcaggtgccg

SEQ ID NO: 170450 - DNA, 25 bp, E. coli
taaacgccgtatggttcaggtgccg

SEQ ID NO: 170451 - DNA, 25 bp, E. coli
tatccgtagtttagtgcgccgccag

SEQ ID NO: 170452 - DNA, 25 bp, E. coli
tatccgtagttttgtgcgccgccag

SEQ ID NO: 170453 - DNA, 25 bp, E. coli
tttttggccgtgaagcgccggtgac

SEQ ID NO: 170454 - DNA, 25 bp, E. coli
tttttggccgtgtagcgccggtgac

SEQ ID NO: 170455 - DNA, 25 bp, E. coli
tggtggcaatggctaaagatcgccc

SEQ ID NO: 170456 - DNA, 25 bp, E. coli
tggtaaaaagcaaactgcagctggg

SEQ ID NO: 170457 - DNA, 25 bp, E. coli
tggtggcaatgggtaaagatcgccc

SEQ ID NO: 170458 - DNA, 25 bp, E. coli
tggtaaaaagcatactgcagctggg

SEQ ID NO: 170459 - DNA, 25 bp, E. coli
tgaccaaaggccaggaacatgcgct

SEQ ID NO: 170460 - DNA, 25 bp, E. coli
tgaccaaaggcctggaacatgcgct

SEQ ID NO: 170461 - DNA, 25 bp, E. coli
gactgggaaccttatgcggaacata

SEQ ID NO: 170462 - DNA, 25 bp, E. coli
cattgaagtgcaatcaccgggcgtt

SEQ ID NO: 170463 - DNA, 25 bp, E. coli
cattgaagtgcattcaccgggcgtt

SEQ ID NO: 170464 - DNA, 25 bp, E. coli
gactgggaacctaatgcggaacata

SEQ ID NO: 170465 - DNA, 25 bp, E. coli
gagcaatgattacgtaccgcgtccg

SEQ ID NO: 170466 - DNA, 25 bp, E. coli
gagcaatgattaggtaccgcgtccg

SEQ ID NO: 170467 - DNA, 25 bp, E. coli
tacgttctgcactatgcgatgaagg

SEQ ID NO: 170468 - DNA, 25 bp, E. coli
tacgttctgcacaatgcgatgaagg

SEQ ID NO: 170469 - DNA, 25 bp, E. coli
tgtgcgttcgggacgtgaatctctg

SEQ ID NO: 170470 - DNA, 25 bp, E. coli
tgtcattccatatcaaaaacgcagc

SEQ ID NO: 170471 - DNA, 25 bp, E. coli
tgtgcgttcgggtcgtgaatctctg

SEQ ID NO: 170472 - DNA, 25 bp, E. coli
tgtcattccataacaaaaacgcagc

SEQ ID NO: 170473 - DNA, 25 bp, E. coli
tgaatcgtgtccgttgtgaagcaat

SEQ ID NO: 170474 - DNA, 25 bp, E. coli
tgaatcgtgtcccttgtgaagcaat

SEQ ID NO: 170475 - DNA, 25 bp, E. coli
tcatcaaaagtaccgccagattcac

SEQ ID NO: 170476 - DNA, 25 bp, E. coli
tcatcaaaagtagcgccagattcac

SEQ ID NO: 170477 - DNA, 25 bp, E. coli
ccttgacgactccaggataattaga

SEQ ID NO: 170478 - DNA, 25 bp, E. coli
ccttgacgactcgaggataattaga

SEQ ID NO: 170479 - DNA, 25 bp, E. coli
gcatttaatgccctttcaccccaga

SEQ ID NO: 170480 - DNA, 25 bp, E. coli
gcatttaatgccgtttcaccccaga

SEQ ID NO: 170481 - DNA, 25 bp, E. coli
gaagcaatggaataaatacgggtct

SEQ ID NO: 170482 - DNA, 25 bp, E. coli
gaagcaatggaaaaaatacgggtct

SEQ ID NO: 170483 - DNA, 25 bp, E. coli
gattcactgctcatcacggcagatg

SEQ ID NO: 170484 - DNA, 25 bp, E. coli
gattcactgctcttcacggcagatg

SEQ ID NO: 170485 - DNA, 25 bp, E. coli
gatggacgccacttcgattcatggg

SEQ ID NO: 170486 - DNA, 25 bp, E. coli
gatggacgccacatcgattcatggg

SEQ ID NO: 170487 - DNA, 25 bp, E. coli
gagtattttcttcatctgtgacacg

SEQ ID NO: 170488 - DNA, 25 bp, E. coli
gagtattttcttgatctgtgacacg

SEQ ID NO: 170489 - DNA, 25 bp, E. coli
aatgaggcggtatatgccattatcg

SEQ ID NO: 170490 - DNA, 25 bp, E. coli
aatgaggcggtaaatgccattatcg

SEQ ID NO: 170491 - DNA, 25 bp, E. coli
caacgggatgcccaacgcattctat

SEQ ID NO: 170492 - DNA, 25 bp, E. coli
caacgggatgccgaacgcattctat

SEQ ID NO: 170493 - DNA, 25 bp, E. coli
taaatgccattaacgccaccctgaa

SEQ ID NO: 170494 - DNA, 25 bp, E. coli
taaatgccattatcgccaccctgaa

SEQ ID NO: 170495 - DNA, 25 bp, E. coli
atcacagcatctggctcgtatgcgg

SEQ ID NO: 170496 - DNA, 25 bp, E. coli
agctgacgcgcaataccggactgag

SEQ ID NO: 170497 - DNA, 25 bp, E. coli
agctgacgcgcattaccggactgag

SEQ ID NO: 170498 - DNA, 25 bp, E. coli
atcacagcatctcgctcgtatgcgg

SEQ ID NO: 170499 - DNA, 25 bp, E. coli
tatcgccaccctcaaaaatgtctat

SEQ ID NO: 170500 - DNA, 25 bp, E. coli
tatcgccaccctgaaaaatgtctat

SEQ ID NO: 170501 - DNA, 25 bp, E. coli
gccaccctgaaaaatgtctattgtc

SEQ ID NO: 170502 - DNA, 25 bp, E. coli
gccaccctgaaatatgtctattgtc

SEQ ID NO: 170503 - DNA, 25 bp, E. coli
gcccaacgcattgtatattccatta

SEQ ID NO: 170504 - DNA, 25 bp, E. coli
gcgacatcacagcatctcgctcgta

SEQ ID NO: 170505 - DNA, 25 bp, E. coli
gcgacatcacaggatctcgctcgta

SEQ ID NO: 170506 - DNA, 25 bp, E. coli
gcccaacgcattctatattccatta

SEQ ID NO: 170507 - DNA, 25 bp, E. coli
cgcgggagagctcacgcgcattacc

SEQ ID NO: 170508 - DNA, 25 bp, E. coli
cgcgggagagctgacgcgcattacc

SEQ ID NO: 170509 - DNA, 25 bp, E. coli
ctatattccatttaaaatgaggcgg

SEQ ID NO: 170510 - DNA, 25 bp, E. coli
ctatattccattaaaaatgaggcgg

SEQ ID NO: 170511 - DNA, 25 bp, E. coli
cacgtctgacggcaaatggcattgt

SEQ ID NO: 170512 - DNA, 25 bp, E. coli
cacgtctgacgggaaatggcattgt

SEQ ID NO: 170513 - DNA, 25 bp, E. coli
tactcatgagctgatcgcgcgtttc

SEQ ID NO: 170514 - DNA, 25 bp, E. coli
tactcatgagctcatcgcgcgtttc

SEQ ID NO: 170515 - DNA, 25 bp, E. coli
tgtcggattactcgcaacccgcgga

SEQ ID NO: 170516 - DNA, 25 bp, E. coli
tgtcggattactggcaacccgcgga

SEQ ID NO: 170517 - DNA, 25 bp, E. coli
tgaagccccggatgcaaaatctgcc

SEQ ID NO: 170518 - DNA, 25 bp, E. coli
tgaagccccggaagcaaaatctgcc

SEQ ID NO: 170519 - DNA, 25 bp, E. coli
tcgaaacgctcgtaaaactggcagt

SEQ ID NO: 170520 - DNA, 25 bp, E. coli
tcgaaacgctcgaaaaactggcagt

SEQ ID NO: 170521 - DNA, 25 bp, E. coli
tcgtgccggcgattaaacctgctgc

SEQ ID NO: 170522 - DNA, 25 bp, E. coli
tcgtgccggcgaataaacctgctgc

SEQ ID NO: 170523 - DNA, 25 bp, E. coli
gcgcgtttcgctaatgaatgccaga

SEQ ID NO: 170524 - DNA, 25 bp, E. coli
gcgcgtttcgcttatgaatgccaga

SEQ ID NO: 170525 - DNA, 25 bp, E. coli
cgttatccccttgcgctggctgtgg

SEQ ID NO: 170526 - DNA, 25 bp, E. coli
ccgtggttaagaatgaaagagccgc

SEQ ID NO: 170527 - DNA, 25 bp, E. coli
ccgtggttaagattgaaagagccgc

SEQ ID NO: 170528 - DNA, 25 bp, E. coli
cgttatccccttccgctggctgtgg

SEQ ID NO: 170529 - DNA, 25 bp, E. coli
cggtctatgacgagatccggcatct

SEQ ID NO: 170530 - DNA, 25 bp, E. coli
cggtctatgacgtgatccggcatct

SEQ ID NO: 170531 - DNA, 25 bp, E. coli
gataacgtcgctttcccgtatggcg

SEQ ID NO: 170532 - DNA, 25 bp, E. coli
gataacgtcgctatcccgtatggcg

SEQ ID NO: 170533 - DNA, 25 bp, E. coli
caagcctggtgcagaaattcatgag

SEQ ID NO: 170534 - DNA, 25 bp, E. coli
caagcctggtgctgaaattcatgag

SEQ ID NO: 170535 - DNA, 25 bp, E. coli
catatcccggcactctttagcgaga

SEQ ID NO: 170536 - DNA, 25 bp, E. coli
catatcccggcagtctttagcgaga

SEQ ID NO: 170537 - DNA, 25 bp, E. coli
tacccctggcgatattaaacgtgcg

SEQ ID NO: 170538 - DNA, 25 bp, E. coli
tacccctggcgaaattaaacgtgcg

SEQ ID NO: 170539 - DNA, 25 bp, E. coli
tgagaatcagcgttggatggtcacc

SEQ ID NO: 170540 - DNA, 25 bp, E. coli
tgagaatcagcgatggatggtcacc

SEQ ID NO: 170541 - DNA, 25 bp, E. coli
tcatcgcggatatggccaaaaacgt

SEQ ID NO: 170542 - DNA, 25 bp, E. coli
tcatcgcggataaggccaaaaacgt

SEQ ID NO: 170543 - DNA, 25 bp, E. coli
gaagtctcatccttaaccaagcctg

SEQ ID NO: 170544 - DNA, 25 bp, E. coli
gaagtctcatccataaccaagcctg

SEQ ID NO: 170545 - DNA, 25 bp, E. coli
gattcctgagcagagaaaacggccc

SEQ ID NO: 170546 - DNA, 25 bp, E. coli
gattcctgagcacagaaaacggccc

SEQ ID NO: 170547 - DNA, 25 bp, E. coli
gatttccgataatccagcgcgtcag

SEQ ID NO: 170548 - DNA, 25 bp, E. coli
gatttccgataaaccagcgcgtcag

SEQ ID NO: 170549 - DNA, 25 bp, E. coli
gggctttttcttatctcgcacgcga

SEQ ID NO: 170550 - DNA, 25 bp, E. coli
gggctttttcttttctcgcacgcga

SEQ ID NO: 170551 - DNA, 25 bp, E. coli
taatgccgatcaacaaggaacaccg

SEQ ID NO: 170552 - DNA, 25 bp, E. coli
taatgccgatcatcaaggaacaccg

SEQ ID NO: 170553 - DNA, 25 bp, E. coli
gacgcctgtagggatcaccgaagga

SEQ ID NO: 170554 - DNA, 25 bp, E. coli
gacgcctgtaggcatcaccgaagga

SEQ ID NO: 170555 - DNA, 25 bp, E. coli
aattgccactcaggaaactttcagg

SEQ ID NO: 170556 - DNA, 25 bp, E. coli
aattgccactcacgaaactttcagg

SEQ ID NO: 170557 - DNA, 25 bp, E. coli
tttcgaccttgccattgaaccgcag

SEQ ID NO: 170558 - DNA, 25 bp, E. coli
tttcgaccttgcgattgaaccgcag

SEQ ID NO: 170559 - DNA, 25 bp, E. coli
ttgccggcggaggaataacaattgc

SEQ ID NO: 170560 - DNA, 25 bp, E. coli
ttgccggcggagcaataacaattgc

SEQ ID NO: 170561 - DNA, 25 bp, E. coli
tcgctggccatttgaagaaaacggg

SEQ ID NO: 170562 - DNA, 25 bp, E. coli
tcgctggccattagaagaaaacggg

SEQ ID NO: 170563 - DNA, 25 bp, E. coli
tctgcgtctgatcttgaggctggct

SEQ ID NO: 170564 - DNA, 25 bp, E. coli
tctgcgtctgatgttgaggctggct

SEQ ID NO: 170565 - DNA, 25 bp, E. coli
gcaatattgcaccaaagctccgcgc

SEQ ID NO: 170566 - DNA, 25 bp, E. coli
gcaatattgcacgaaagctccgcgc

SEQ ID NO: 170567 - DNA, 25 bp, E. coli
gattacgactaaagatctgcgtctg

SEQ ID NO: 170568 - DNA, 25 bp, E. coli
gattacgactaatgatctgcgtctg

SEQ ID NO: 170569 - DNA, 25 bp, E. coli
tgtatttcccactgcgtcgcaatat

SEQ ID NO: 170570 - DNA, 25 bp, E. coli
ggaggttgcgccatatcgctggcca

SEQ ID NO: 170571 - DNA, 25 bp, E. coli
ggaggttgcgccttatcgctggcca

SEQ ID NO: 170572 - DNA, 25 bp, E. coli
tgtatttcccacagcgtcgcaatat

SEQ ID NO: 170573 - DNA, 25 bp, E. coli
taagtgtatcgggtggcgtcagtcc

SEQ ID NO: 170574 - DNA, 25 bp, E. coli
taagtgtatcggctggcgtcagtcc

SEQ ID NO: 170575 - DNA, 25 bp, E. coli
gatgactttcttccacaatttccgg

SEQ ID NO: 170576 - DNA, 25 bp, E. coli
gatgactttcttgcacaatttccgg

SEQ ID NO: 170577 - DNA, 25 bp, E. coli
catttgtccggttggcgcgctgtat

SEQ ID NO: 170578 - DNA, 25 bp, E. coli
catttgtccggtaggcgcgctgtat

SEQ ID NO: 170579 - DNA, 25 bp, E. coli
accgatccgctgatgacgctgcaaa

SEQ ID NO: 170580 - DNA, 25 bp, E. coli
accgatccgctgttgacgctgcaaa

SEQ ID NO: 170581 - DNA, 25 bp, E. coli
tagcctgttattcgacaccgttccg

SEQ ID NO: 170582 - DNA, 25 bp, E. coli
tagcctgttattggacaccgttccg

SEQ ID NO: 170583 - DNA, 25 bp, E. coli
tgaacccgattaccgacttagcgaa

SEQ ID NO: 170584 - DNA, 25 bp, E. coli
tgatctactggtggttgaacacggc

SEQ ID NO: 170585 - DNA, 25 bp, E. coli
tgaacccgattagcgacttagcgaa

SEQ ID NO: 170586 - DNA, 25 bp, E. coli
tgatctactggtcgttgaacacggc

SEQ ID NO: 170587 - DNA, 25 bp, E. coli
gcaaatcgtaaacgtgacgccgggc

SEQ ID NO: 170588 - DNA, 25 bp, E. coli
gcaaatcgtaaaggtgacgccgggc

SEQ ID NO: 170589 - DNA, 25 bp, E. coli
gaactggttacgcaggcgctttgac

SEQ ID NO: 170590 - DNA, 25 bp, E. coli
gaaaaaaggctgctggcgcagtcac

SEQ ID NO: 170591 - DNA, 25 bp, E. coli
gaaaaaaggctggtggcgcagtcac

SEQ ID NO: 170592 - DNA, 25 bp, E. coli
gaactggttacggaggcgctttgac

SEQ ID NO: 170593 - DNA, 25 bp, E. coli
gatcggcagaaaagtaaccgctgta

SEQ ID NO: 170594 - DNA, 25 bp, E. coli
gattattttgcagctgggtctgccc

SEQ ID NO: 170595 - DNA, 25 bp, E. coli
gattattttgcacctgggtctgccc

SEQ ID NO: 170596 - DNA, 25 bp, E. coli
gatcggcagaaatgtaaccgctgta

SEQ ID NO: 170597 - DNA, 25 bp, E. coli
ggtgtgtggatcttgcacggcaact

SEQ ID NO: 170598 - DNA, 25 bp, E. coli
ggtgtgtggatcatgcacggcaact

SEQ ID NO: 170599 - DNA, 25 bp, E. coli
cagcagaatcatgtcggtgctggcg

SEQ ID NO: 170600 - DNA, 25 bp, E. coli
cagcagaatcatctcggtgctggcg

SEQ ID NO: 170601 - DNA, 25 bp, E. coli
agaatcatgtcgctgctggcggatg

SEQ ID NO: 170602 - DNA, 25 bp, E. coli
agaatcatgtcggtgctggcggatg

SEQ ID NO: 170603 - DNA, 25 bp, E. coli
tttctggtggtgttggtggatttca

SEQ ID NO: 170604 - DNA, 25 bp, E. coli
tttctggtggtgatggtggatttca

SEQ ID NO: 170605 - DNA, 25 bp, E. coli
tgtggctgcactgctgctgtttctg

SEQ ID NO: 170606 - DNA, 25 bp, E. coli
tgcactcctgctgtttctggtggtg

SEQ ID NO: 170607 - DNA, 25 bp, E. coli
tgcactcctgctctttctggtggtg

SEQ ID NO: 170608 - DNA, 25 bp, E. coli
tctggtggtgatggtggatttcacc

SEQ ID NO: 170609 - DNA, 25 bp, E. coli
tctggtggtgatcgtggatttcacc

SEQ ID NO: 170610 - DNA, 25 bp, E. coli
gctgcactcctggtgtttctggtgg

SEQ ID NO: 170611 - DNA, 25 bp, E. coli
gctgcactcctgctgtttctggtgg

SEQ ID NO: 170612 - DNA, 25 bp, E. coli
gatttcaccagctgaatcatgtcgg

SEQ ID NO: 170613 - DNA, 25 bp, E. coli
gatttcaccagcagaatcatgtcgg

SEQ ID NO: 170614 - DNA, 25 bp, E. coli
ggatttcaccaggagaatcatgtcg

SEQ ID NO: 170615 - DNA, 25 bp, E. coli
ggatttcaccagcagaatcatgtcg

SEQ ID NO: 170616 - DNA, 25 bp, E. coli
tggctgcactccagctgtttctggt

SEQ ID NO: 170617 - DNA, 25 bp, E. coli
tgtggctgcactcctgctgtttctg

SEQ ID NO: 170618 - DNA, 25 bp, E. coli
tggctgcactcctgctgtttctggt

SEQ ID NO: 170619 - DNA, 25 bp, E. coli
tcaccagcagaaacatgtcggtgct

SEQ ID NO: 170620 - DNA, 25 bp, E. coli
tcaccagcagaatcatgtcggtgct

SEQ ID NO: 170621 - DNA, 25 bp, E. coli
aatgcctgttggctgtcccctggcg

SEQ ID NO: 170622 - DNA, 25 bp, E. coli
aattccctaggttaaacagtctcag

SEQ ID NO: 170623 - DNA, 25 bp, E. coli
caatttaacaatatttgagcgggtg

SEQ ID NO: 170624 - DNA, 25 bp, E. coli
caatttaacaatttttgagcgggtg

SEQ ID NO: 170625 - DNA, 25 bp, E. coli
aattccctaggtaaaacagtctcag

SEQ ID NO: 170626 - DNA, 25 bp, E. coli
aatgcctgttgggtgtcccctggcg

SEQ ID NO: 170627 - DNA, 25 bp, E. coli
taaatattaacgagcgtccgccagc

SEQ ID NO: 170628 - DNA, 25 bp, E. coli
taaatattaacgtgcgtccgccagc

SEQ ID NO: 170629 - DNA, 25 bp, E. coli
tagcagcctaacaaaaaacaacggg

SEQ ID NO: 170630 - DNA, 25 bp, E. coli
tagcagcctaactaaaaacaacggg

SEQ ID NO: 170631 - DNA, 25 bp, E. coli
ttccgcatgtacgtgaacgctaagg

SEQ ID NO: 170632 - DNA, 25 bp, E. coli
ttccgcatgtacctgaacgctaagg

SEQ ID NO: 170633 - DNA, 25 bp, E. coli
cgagtcccgggtgagtagttgatac

SEQ ID NO: 170634 - DNA, 25 bp, E. coli
cgagtcccgggtcagtagttgatac

SEQ ID NO: 170635 - DNA, 25 bp, E. coli
gtagtagaactaccacctgaccggc

SEQ ID NO: 170636 - DNA, 25 bp, E. coli
gtagtagaactagcacctgaccggc

SEQ ID NO: 170637 - DNA, 25 bp, E. coli
taaggtgattgctcccaatgcctgt

SEQ ID NO: 170638 - DNA, 25 bp, E. coli
taaggtgattgcacccaatgcctgt

SEQ ID NO: 170639 - DNA, 25 bp, E. coli
gagtagttgatacaaaaccggcaat

SEQ ID NO: 170640 - DNA, 25 bp, E. coli
gagcgttacgctgccgttaataaat

SEQ ID NO: 170641 - DNA, 25 bp, E. coli
gagcgttacgctcccgttaataaat

SEQ ID NO: 170642 - DNA, 25 bp, E. coli
gagtagttgatagaaaaccggcaat

SEQ ID NO: 170643 - DNA, 25 bp, E. coli
taaagggagactcgctgacgccgct

SEQ ID NO: 170644 - DNA, 25 bp, E. coli
taaagggagactggctgacgccgct

SEQ ID NO: 170645 - DNA, 25 bp, E. coli
acgcactggctaatacgggccgcgg

SEQ ID NO: 170646 - DNA, 25 bp, E. coli
agtgcccaaattgctgaaatcgctg

SEQ ID NO: 170647 - DNA, 25 bp, E. coli
agtgcccaaattcctgaaatcgctg

SEQ ID NO: 170648 - DNA, 25 bp, E. coli
acgcactggctattacgggccgcgg

SEQ ID NO: 170649 - DNA, 25 bp, E. coli
tatcgtccggcactttccaatggtg

SEQ ID NO: 170650 - DNA, 25 bp, E. coli
tatcgtccggcagtttccaatggtg

SEQ ID NO: 170651 - DNA, 25 bp, E. coli
tatcaactacaatgacgcactggct

SEQ ID NO: 170652 - DNA, 25 bp, E. coli
tatcaactacaaagacgcactggct

SEQ ID NO: 170653 - DNA, 25 bp, E. coli
tgacatcaaaccagaaagacgagaa

SEQ ID NO: 170654 - DNA, 25 bp, E. coli
tgacatcaaacctgaaagacgagaa

SEQ ID NO: 170655 - DNA, 25 bp, E. coli
gctcacatcctgaatatcagaccgg

SEQ ID NO: 170656 - DNA, 25 bp, E. coli
gctcacatcctgtatatcagaccgg

SEQ ID NO: 170657 - DNA, 25 bp, E. coli
gaaatcgctgaaagcgagctgccac

SEQ ID NO: 170658 - DNA, 25 bp, E. coli
gaaatcgctgaatgcgagctgccac

SEQ ID NO: 170659 - DNA, 25 bp, E. coli
gattttgccggttcagtgtccgcca

SEQ ID NO: 170660 - DNA, 25 bp, E. coli
gattttgccggtacagtgtccgcca

SEQ ID NO: 170661 - DNA, 25 bp, E. coli
tggaggtcaatgtcgactgttcatc

SEQ ID NO: 170662 - DNA, 25 bp, E. coli
tggaggtcaatgacgactgttcatc

SEQ ID NO: 170663 - DNA, 25 bp, E. coli
taagatgtatggacgccacagtgcc

SEQ ID NO: 170664 - DNA, 25 bp, E. coli
taagatgtatggtcgccacagtgcc

SEQ ID NO: 170665 - DNA, 25 bp, E. coli
cacactttaggtcgaatgcacgtca

SEQ ID NO: 170666 - DNA, 25 bp, E. coli
cacactttaggtggaatgcacgtca

SEQ ID NO: 170667 - DNA, 25 bp, E. coli
cattcggttggatggcaaatctgga

SEQ ID NO: 170668 - DNA, 25 bp, E. coli
cattcggttggaaggcaaatctgga

SEQ ID NO: 170669 - DNA, 25 bp, E. coli
tgacactgagtgtaaaagaagcgct

SEQ ID NO: 170670 - DNA, 25 bp, E. coli
tgaacaaagttaacgtcgccaaggt

SEQ ID NO: 170671 - DNA, 25 bp, E. coli
tgacactgagtgaaaaagaagcgct

SEQ ID NO: 170672 - DNA, 25 bp, E. coli
tgcataccagccaattgacactgag

SEQ ID NO: 170673 - DNA, 25 bp, E. coli
tgaacaaagttatcgtcgccaaggt

SEQ ID NO: 170674 - DNA, 25 bp, E. coli
tgcataccagcctattgacactgag

SEQ ID NO: 170675 - DNA, 25 bp, E. coli
gaattgaaacaagggagctatatcc

SEQ ID NO: 170676 - DNA, 25 bp, E. coli
gcaattattcaacgccatatggccc

SEQ ID NO: 170677 - DNA, 25 bp, E. coli
gaattgaaacaacggagctatatcc

SEQ ID NO: 170678 - DNA, 25 bp, E. coli
gcatgacgatttcgcgcacacttta

SEQ ID NO: 170679 - DNA, 25 bp, E. coli
gcatgacgatttggcgcacacttta

SEQ ID NO: 170680 - DNA, 25 bp, E. coli
gcaattattcaaggccatatggccc

SEQ ID NO: 170681 - DNA, 25 bp, E. coli
gggcatagaatagcgcagtctgcat

SEQ ID NO: 170682 - DNA, 25 bp, E. coli
gggcatagaataccgcagtctgcat

SEQ ID NO: 170683 - DNA, 25 bp, E. coli
ggcggcaattgaagctgcaaaccaa

SEQ ID NO: 170684 - DNA, 25 bp, E. coli
ggcggcaattgatgctgcaaaccaa

SEQ ID NO: 170685 - DNA, 25 bp, E. coli
tcaattagggctgctgtcggcttca

SEQ ID NO: 170686 - DNA, 25 bp, E. coli
tcaattagggctcctgtcggcttca

SEQ ID NO: 170687 - DNA, 25 bp, E. coli
caatgatagtgcatttttttgcaat

SEQ ID NO: 170688 - DNA, 25 bp, E. coli
caatgatagtgcttttttttgcaat

SEQ ID NO: 170689 - DNA, 25 bp, E. coli
tttaccgcaagctgtcgaaaaaata

SEQ ID NO: 170690 - DNA, 25 bp, E. coli
acgtaaccattgcatgaaactgtcc

SEQ ID NO: 170691 - DNA, 25 bp, E. coli
tttaccgcaagcagtcgaaaaaata

SEQ ID NO: 170692 - DNA, 25 bp, E. coli
acgtaaccattggatgaaactgtcc

SEQ ID NO: 170693 - DNA, 25 bp, E. coli
taccgcaagctgacgaaaaaatatc

SEQ ID NO: 170694 - DNA, 25 bp, E. coli
taccgcaagctgtcgaaaaaatatc

SEQ ID NO: 170695 - DNA, 25 bp, E. coli
ttcatagagaaaaaaccatacagcc

SEQ ID NO: 170696 - DNA, 25 bp, E. coli
ttcatagagaaataaccatacagcc

SEQ ID NO: 170697 - DNA, 25 bp, E. coli
tgcatgaaactgaccaaaaaaattc

SEQ ID NO: 170698 - DNA, 25 bp, E. coli
tgcatgaaactgtccaaaaaaattc

SEQ ID NO: 170699 - DNA, 25 bp, E. coli
tcatagagaaaaaaccatacagcca

SEQ ID NO: 170700 - DNA, 25 bp, E. coli
tcatagagaaaataccatacagcca

SEQ ID NO: 170701 - DNA, 25 bp, E. coli
gctgtcgaaaaaatatcacacaatt

SEQ ID NO: 170702 - DNA, 25 bp, E. coli
gctgtcgaaaaattatcacacaatt

SEQ ID NO: 170703 - DNA, 25 bp, E. coli
gcaagctgtcgaaaaaatatcacac

SEQ ID NO: 170704 - DNA, 25 bp, E. coli
gcaagctgtcgataaaatatcacac

SEQ ID NO: 170705 - DNA, 25 bp, E. coli
ccgcaagctgtcgaaaaaatatcac

SEQ ID NO: 170706 - DNA, 25 bp, E. coli
ccgcaagctgtccaaaaaatatcac

SEQ ID NO: 170707 - DNA, 25 bp, E. coli
gtcgaaaaaataacacacaattgtt

SEQ ID NO: 170708 - DNA, 25 bp, E. coli
gtcgaaaaaatatcacacaattgtt

SEQ ID NO: 170709 - DNA, 25 bp, E. coli
ggacggcgaacctgtaccgtactgc

SEQ ID NO: 170710 - DNA, 25 bp, E. coli
ggacggcgaaccagtaccgtactgc

SEQ ID NO: 170711 - DNA, 25 bp, E. coli
aaaccttgaccgtacacggcactcg

SEQ ID NO: 170712 - DNA, 25 bp, E. coli
aaaccttgaccgaacacggcactcg

SEQ ID NO: 170713 - DNA, 25 bp, E. coli
ttgccgaaacctagaccgaacacgg

SEQ ID NO: 170714 - DNA, 25 bp, E. coli
ttgccgaaaccttgaccgaacacgg

SEQ ID NO: 170715 - DNA, 25 bp, E. coli
tcattgccgaaagcttgaccgaaca

SEQ ID NO: 170716 - DNA, 25 bp, E. coli
tcattgccgaaaccttgaccgaaca

SEQ ID NO: 170717 - DNA, 25 bp, E. coli
tggtggacggcgtaccagtaccgta

SEQ ID NO: 170718 - DNA, 25 bp, E. coli
gccgaaaccttgtccgaacacggca

SEQ ID NO: 170719 - DNA, 25 bp, E. coli
gccgaaaccttgaccgaacacggca

SEQ ID NO: 170720 - DNA, 25 bp, E. coli
cgtgctggtggtggacggcgaacca

SEQ ID NO: 170721 - DNA, 25 bp, E. coli
cgtgctggtggtcgacggcgaacca

SEQ ID NO: 170722 - DNA, 25 bp, E. coli
cggcgaaccagtaccgtactgcctg

SEQ ID NO: 170723 - DNA, 25 bp, E. coli
cggcgaaccagttccgtactgcctg

SEQ ID NO: 170724 - DNA, 25 bp, E. coli
ggcgtcattgcccaaaccttgaccg

SEQ ID NO: 170725 - DNA, 25 bp, E. coli
ggcgtcattgccgaaaccttgaccg

SEQ ID NO: 170726 - DNA, 25 bp, E. coli
tggtggacggcgaaccagtaccgta

SEQ ID NO: 170727 - DNA, 25 bp, E. coli
tggacggcgaaccagtaccgtactg

SEQ ID NO: 170728 - DNA, 25 bp, E. coli
tggacggcgaacgagtaccgtactg

SEQ ID NO: 170729 - DNA, 25 bp, E. coli
gaccgaacacgggactcgctactgc

SEQ ID NO: 170730 - DNA, 25 bp, E. coli
gaccgaacacggcactcgctactgc

SEQ ID NO: 170731 - DNA, 25 bp, E. coli
cataatgcgttactagcggcagcct

SEQ ID NO: 170732 - DNA, 25 bp, E. coli
cataatgcgttagtagcggcagcct

SEQ ID NO: 170733 - DNA, 25 bp, E. coli
taaactgtggaggatatcggcgcat

SEQ ID NO: 170734 - DNA, 25 bp, E. coli
taaactgtggagcatatcggcgcat

SEQ ID NO: 170735 - DNA, 25 bp, E. coli
attaatttttggagatggcgcggcg

SEQ ID NO: 170736 - DNA, 25 bp, E. coli
ggtcgttccacatcaggccagtcat

SEQ ID NO: 170737 - DNA, 25 bp, E. coli
ggtcgttccacaacaggccagtcat

SEQ ID NO: 170738 - DNA, 25 bp, E. coli
attaatttttggtgatggcgcggcg

SEQ ID NO: 170739 - DNA, 25 bp, E. coli
tattgcttcacgtggtatcgactgg

SEQ ID NO: 170740 - DNA, 25 bp, E. coli
tattgcttcacgaggtatcgactgg

SEQ ID NO: 170741 - DNA, 25 bp, E. coli
tttttacggcaatcaggtcgcggcc

SEQ ID NO: 170742 - DNA, 25 bp, E. coli
tttttacggcaaacaggtcgcggcc

SEQ ID NO: 170743 - DNA, 25 bp, E. coli
tgtaatgttgattggcacggcagcg

SEQ ID NO: 170744 - DNA, 25 bp, E. coli
tgtaatgttgataggcacggcagcg

SEQ ID NO: 170745 - DNA, 25 bp, E. coli
gaacatatgcgttaacggctgcgag

SEQ ID NO: 170746 - DNA, 25 bp, E. coli
gaaatgtatcccgaaggcagcgaac

SEQ ID NO: 170747 - DNA, 25 bp, E. coli
gaaatgtatccccaaggcagcgaac

SEQ ID NO: 170748 - DNA, 25 bp, E. coli
gaacatatgcgtaaacggctgcgag

SEQ ID NO: 170749 - DNA, 25 bp, E. coli
cgaactgtgtgatatacgcgccggc

SEQ ID NO: 170750 - DNA, 25 bp, E. coli
cgaactgtgtgaaatacgcgccggc

SEQ ID NO: 170751 - DNA, 25 bp, E. coli
gattagcggtcgattcacagcggat

SEQ ID NO: 170752 - DNA, 25 bp, E. coli
gattagcggtcgtttcacagcggat

SEQ ID NO: 170753 - DNA, 25 bp, E. coli
caggtattcgttaggcttcgcttta

SEQ ID NO: 170754 - DNA, 25 bp, E. coli
caggtattcgtttggcttcgcttta

SEQ ID NO: 170755 - DNA, 25 bp, E. coli
atgcgtctacaggaggcatctggcg

SEQ ID NO: 170756 - DNA, 25 bp, E. coli
atgcgtctacagcaggcatctggcg

SEQ ID NO: 170757 - DNA, 25 bp, E. coli
aacttgcacaaggagcaggtattcg

SEQ ID NO: 170758 - DNA, 25 bp, E. coli
aacttgcacaagcagcaggtattcg

SEQ ID NO: 170759 - DNA, 25 bp, E. coli
tgcttaaaactgacgctcttttgta

SEQ ID NO: 170760 - DNA, 25 bp, E. coli
tgcttaaaactgtcgctcttttgta

SEQ ID NO: 170761 - DNA, 25 bp, E. coli
tcgcgcgatgcgtctacaggaggca

SEQ ID NO: 170762 - DNA, 25 bp, E. coli
tcgcgcgatgcgactacaggaggca

SEQ ID NO: 170763 - DNA, 25 bp, E. coli
gacgctcttttgtatttcggttcaa

SEQ ID NO: 170764 - DNA, 25 bp, E. coli
gacgctcttttgaatttcggttcaa

SEQ ID NO: 170765 - DNA, 25 bp, E. coli
tcggttcaaaaacaaaacttgcaca

SEQ ID NO: 170766 - DNA, 25 bp, E. coli
tcggttcaaaaagaaaacttgcaca

SEQ ID NO: 170767 - DNA, 25 bp, E. coli
gatttagttcccgaaggtcgcgcga

SEQ ID NO: 170768 - DNA, 25 bp, E. coli
gatttagttccccaaggtcgcgcga

SEQ ID NO: 170769 - DNA, 25 bp, E. coli
ggagcttcagtatgatcccaaagtt

SEQ ID NO: 170770 - DNA, 25 bp, E. coli
ggcttcgctttaaagctggaaaggg

SEQ ID NO: 170771 - DNA, 25 bp, E. coli
ggcttcgctttatagctggaaaggg

SEQ ID NO: 170772 - DNA, 25 bp, E. coli
ggagcttcagtaagatcccaaagtt

SEQ ID NO: 170773 - DNA, 25 bp, E. coli
gatgaatatcgttagacgaagcggg

SEQ ID NO: 170774 - DNA, 25 bp, E. coli
gatgaatatcgtaagacgaagcggg

SEQ ID NO: 170775 - DNA, 25 bp, E. coli
aatgcctgctatgccaagcgggcaa

SEQ ID NO: 170776 - DNA, 25 bp, E. coli
aatgcctgctatcccaagcgggcaa

SEQ ID NO: 170777 - DNA, 25 bp, E. coli
aaaaatgcctgctatgccaagcggg

SEQ ID NO: 170778 - DNA, 25 bp, E. coli
aaaaatgcctgcaatgccaagcggg

SEQ ID NO: 170779 - DNA, 25 bp, E. coli
tgttttggtacgaggcacgccactg

SEQ ID NO: 170780 - DNA, 25 bp, E. coli
tgttttggtacgtggcacgccactg

SEQ ID NO: 170781 - DNA, 25 bp, E. coli
gccaagcgggcaaattgcttacatg

SEQ ID NO: 170782 - DNA, 25 bp, E. coli
cctgctatgccatgcgggcaaattg

SEQ ID NO: 170783 - DNA, 25 bp, E. coli
cctgctatgccaagcgggcaaattg

SEQ ID NO: 170784 - DNA, 25 bp, E. coli
gccaagcgggcatattgcttacatg

SEQ ID NO: 170785 - DNA, 25 bp, E. coli
gcttacatgtggtattaagtaatta

SEQ ID NO: 170786 - DNA, 25 bp, E. coli
gcttacatgtggaattaagtaatta

SEQ ID NO: 170787 - DNA, 25 bp, E. coli
ctggtgttttggaacgtggcacgcc

SEQ ID NO: 170788 - DNA, 25 bp, E. coli
cgggcaaattgcttacatgtggaat

SEQ ID NO: 170789 - DNA, 25 bp, E. coli
cggtgggtggttacgaatgagggct

SEQ ID NO: 170790 - DNA, 25 bp, E. coli
ctggtgttttggtacgtggcacgcc

SEQ ID NO: 170791 - DNA, 25 bp, E. coli
cggtgggtggtttcgaatgagggct

SEQ ID NO: 170792 - DNA, 25 bp, E. coli
cgggcaaattgcatacatgtggaat

SEQ ID NO: 170793 - DNA, 25 bp, E. coli
ggcacgccactggaatgtatttatc

SEQ ID NO: 170794 - DNA, 25 bp, E. coli
ggcacgccactgcaatgtatttatc

SEQ ID NO: 170795 - DNA, 25 bp, E. coli
ggaaaaaatgccagctatgccaagc

SEQ ID NO: 170796 - DNA, 25 bp, E. coli
ggaaaaaatgcctgctatgccaagc

SEQ ID NO: 170797 - DNA, 25 bp, E. coli
aattattattaagctcgtggacgcg

SEQ ID NO: 170798 - DNA, 25 bp, E. coli
aattattattaacctcgtggacgcg

SEQ ID NO: 170799 - DNA, 25 bp, E. coli
cacatttttgttacgggtgaataga

SEQ ID NO: 170800 - DNA, 25 bp, E. coli
cacatttttgtttcgggtgaataga

SEQ ID NO: 170801 - DNA, 25 bp, E. coli
aaagttggatttatctgcgtgtgac

SEQ ID NO: 170802 - DNA, 25 bp, E. coli
aaagttggatttttctgcgtgtgac

SEQ ID NO: 170803 - DNA, 25 bp, E. coli
tgctacgccgtgatttcaatattgg

SEQ ID NO: 170804 - DNA, 25 bp, E. coli
tgctacgccgtgttttcaatattgg

SEQ ID NO: 170805 - DNA, 25 bp, E. coli
tctgactttcaatattggtgatcca

SEQ ID NO: 170806 - DNA, 25 bp, E. coli
tctgactttcaaaattggtgatcca

SEQ ID NO: 170807 - DNA, 25 bp, E. coli
gagttaattccagtgtgaaaacgaa

SEQ ID NO: 170808 - DNA, 25 bp, E. coli
gaaaatttctttatgctacgccgtg

SEQ ID NO: 170809 - DNA, 25 bp, E. coli
gagttaattccactgtgaaaacgaa

SEQ ID NO: 170810 - DNA, 25 bp, E. coli
gaaaatttctttttgctacgccgtg

SEQ ID NO: 170811 - DNA, 25 bp, E. coli
cgtggacgcgttaatggctaactca

SEQ ID NO: 170812 - DNA, 25 bp, E. coli
cgtggacgcgtttatggctaactca

SEQ ID NO: 170813 - DNA, 25 bp, E. coli
ggctaactcataatgggtattcaat

SEQ ID NO: 170814 - DNA, 25 bp, E. coli
ggctaactcatattgggtattcaat

SEQ ID NO: 170815 - DNA, 25 bp, E. coli
taagctgtattcagtgattggtatc

SEQ ID NO: 170816 - DNA, 25 bp, E. coli
tcaatattggtgtggaacttaacaa

SEQ ID NO: 170817 - DNA, 25 bp, E. coli
taagctgtattctgtgattggtatc

SEQ ID NO: 170818 - DNA, 25 bp, E. coli
tcaatattggtgaggaacttaacaa

SEQ ID NO: 170819 - DNA, 25 bp, E. coli
cattaggcggagaaattaaggaagg

SEQ ID NO: 170820 - DNA, 25 bp, E. coli
cattaggcggagtaattaaggaagg

SEQ ID NO: 170821 - DNA, 25 bp, E. coli
catactaaatatcagcgttgcgtgt

SEQ ID NO: 170822 - DNA, 25 bp, E. coli
catactaaatatgagcgttgcgtgt

SEQ ID NO: 170823 - DNA, 25 bp, E. coli
taaaggcgctgtagaaagcgtgcgt

SEQ ID NO: 170824 - DNA, 25 bp, E. coli
taaaactcctgttcctcaagggatc

SEQ ID NO: 170825 - DNA, 25 bp, E. coli
taaaactcctgtacctcaagggatc

SEQ ID NO: 170826 - DNA, 25 bp, E. coli
taaaggcgctgttgaaagcgtgcgt

SEQ ID NO: 170827 - DNA, 25 bp, E. coli
tagagtcactggataaagcattagg

SEQ ID NO: 170828 - DNA, 25 bp, E. coli
tagagtcactggttaaagcattagg

SEQ ID NO: 170829 - DNA, 25 bp, E. coli
gaagaggttcgcgttgtaagctcat

SEQ ID NO: 170830 - DNA, 25 bp, E. coli
gaagaggttcgccttgtaagctcat

SEQ ID NO: 170831 - DNA, 25 bp, E. coli
gaaagcgtgcgtcactggttactaa

SEQ ID NO: 170832 - DNA, 25 bp, E. coli
gaaagcgtgcgtgactggttactaa

SEQ ID NO: 170833 - DNA, 25 bp, E. coli
cgttgcgtgtttccatcggcctcat

SEQ ID NO: 170834 - DNA, 25 bp, E. coli
tccgtcgccagaaaccgataaaggc

SEQ ID NO: 170835 - DNA, 25 bp, E. coli
tccgtcgccagataccgataaaggc

SEQ ID NO: 170836 - DNA, 25 bp, E. coli
cgttgcgtgtttgcatcggcctcat

SEQ ID NO: 170837 - DNA, 25 bp, E. coli
gttcctcaagggatcaagtggtctg

SEQ ID NO: 170838 - DNA, 25 bp, E. coli
gttcctcaagggttcaagtggtctg

SEQ ID NO: 170839 - DNA, 25 bp, E. coli
tcaagtggtctgttatagagtcact

SEQ ID NO: 170840 - DNA, 25 bp, E. coli
tcaagtggtctgatatagagtcact

SEQ ID NO: 170841 - DNA, 25 bp, E. coli
aaaatatcctgaccataatcggtga

SEQ ID NO: 170842 - DNA, 25 bp, E. coli
aaaatatcctgagcataatcggtga

SEQ ID NO: 170843 - DNA, 25 bp, E. coli
taccgtgccgtcatcaaaaatatcc

SEQ ID NO: 170844 - DNA, 25 bp, E. coli
taccgtgccgtcttcaaaaatatcc

SEQ ID NO: 170845 - DNA, 25 bp, E. coli
tgttacacaaccagggagatcggct

SEQ ID NO: 170846 - DNA, 25 bp, E. coli
tgttacacaacctgggagatcggct

SEQ ID NO: 170847 - DNA, 25 bp, E. coli
tgactggataccagatccccaaaag

SEQ ID NO: 170848 - DNA, 25 bp, E. coli
tgactggatacctgatccccaaaag

SEQ ID NO: 170849 - DNA, 25 bp, E. coli
tcgatgcgtgcacaaatcagcaagc

SEQ ID NO: 170850 - DNA, 25 bp, E. coli
tcgatgcgtgcagaaatcagcaagc

SEQ ID NO: 170851 - DNA, 25 bp, E. coli
tctggcactgaatgaaactgaagtc

SEQ ID NO: 170852 - DNA, 25 bp, E. coli
tctggcactgaaagaaactgaagtc

SEQ ID NO: 170853 - DNA, 25 bp, E. coli
gaaccattccggttcctctttcgcg

SEQ ID NO: 170854 - DNA, 25 bp, E. coli
gaaccattccggatcctctttcgcg

SEQ ID NO: 170855 - DNA, 25 bp, E. coli
gacaaatcttaaggccgtgttccag

SEQ ID NO: 170856 - DNA, 25 bp, E. coli
gacaaatcttaacgccgtgttccag

SEQ ID NO: 170857 - DNA, 25 bp, E. coli
ggatctcgccattaaaggaatcaag

SEQ ID NO: 170858 - DNA, 25 bp, E. coli
tggaaaaatttgctgaggcccgaca

SEQ ID NO: 170859 - DNA, 25 bp, E. coli
tggaaaaatttggtgaggcccgaca

SEQ ID NO: 170860 - DNA, 25 bp, E. coli
ggatctcgccataaaaggaatcaag

SEQ ID NO: 170861 - DNA, 25 bp, E. coli
gaggcccgacaagatttaaccataa

SEQ ID NO: 170862 - DNA, 25 bp, E. coli
gaggcccgacaacatttaaccataa

SEQ ID NO: 170863 - DNA, 25 bp, E. coli
aatagcgagcgtactttagttaagc

SEQ ID NO: 170864 - DNA, 25 bp, E. coli
aagacgaaattattgtgtgtgcaac

SEQ ID NO: 170865 - DNA, 25 bp, E. coli
aatagcgagcgttctttagttaagc

SEQ ID NO: 170866 - DNA, 25 bp, E. coli
aagacgaaattaatgtgtgtgcaac

SEQ ID NO: 170867 - DNA, 25 bp, E. coli
cacgctcattttgaattatctgaat

SEQ ID NO: 170868 - DNA, 25 bp, E. coli
cacgctcattttcaattatctgaat

SEQ ID NO: 170869 - DNA, 25 bp, E. coli
aaaaacataattcctatcatcacag

SEQ ID NO: 170870 - DNA, 25 bp, E. coli
aaaaacataattgctatcatcacag

SEQ ID NO: 170871 - DNA, 25 bp, E. coli
tatctgaataatagcgagcgttctt

SEQ ID NO: 170872 - DNA, 25 bp, E. coli
tatctgaataattgcgagcgttctt

SEQ ID NO: 170873 - DNA, 25 bp, E. coli
tgtgtgtgcaacttacttaataccg

SEQ ID NO: 170874 - DNA, 25 bp, E. coli
tgtgcaacttacataataccggaca

SEQ ID NO: 170875 - DNA, 25 bp, E. coli
tgtgcaacttacttaataccggaca

SEQ ID NO: 170876 - DNA, 25 bp, E. coli
tgtgtgtgcaacatacttaataccg

SEQ ID NO: 170877 - DNA, 25 bp, E. coli
gaattatctgaaaaatagcgagcgt

SEQ ID NO: 170878 - DNA, 25 bp, E. coli
gcagatcttaatagaagacgaaatt

SEQ ID NO: 170879 - DNA, 25 bp, E. coli
gcagatcttaattgaagacgaaatt

SEQ ID NO: 170880 - DNA, 25 bp, E. coli
gaattatctgaataatagcgagcgt

SEQ ID NO: 170881 - DNA, 25 bp, E. coli
cgagcgttctttagttaagcagatc

SEQ ID NO: 170882 - DNA, 25 bp, E. coli
cgagcgttcttttgttaagcagatc

SEQ ID NO: 170883 - DNA, 25 bp, E. coli
taagcagatctttattgaagacgaa

SEQ ID NO: 170884 - DNA, 25 bp, E. coli
taagcagatcttaattgaagacgaa

SEQ ID NO: 170885 - DNA, 25 bp, E. coli
atgggcgcagattgcacatgcagac

SEQ ID NO: 170886 - DNA, 25 bp, E. coli
atgggcgcagatagcacatgcagac

SEQ ID NO: 170887 - DNA, 25 bp, E. coli
actggatgatatcggcgcagatagc

SEQ ID NO: 170888 - DNA, 25 bp, E. coli
actgaaagaacagcaagccgcctga

SEQ ID NO: 170889 - DNA, 25 bp, E. coli
actggatgatatgggcgcagatagc

SEQ ID NO: 170890 - DNA, 25 bp, E. coli
actgaaagaacaccaagccgcctga

SEQ ID NO: 170891 - DNA, 25 bp, E. coli
tatgggcgcagaaagcacatgcaga

SEQ ID NO: 170892 - DNA, 25 bp, E. coli
tatgggcgcagatagcacatgcaga

SEQ ID NO: 170893 - DNA, 25 bp, E. coli
tgatatgggcgcagatagcacatgc

SEQ ID NO: 170894 - DNA, 25 bp, E. coli
tgatatgggcgctgatagcacatgc

SEQ ID NO: 170895 - DNA, 25 bp, E. coli
ccactggatgatatgggcgcagata

SEQ ID NO: 170896 - DNA, 25 bp, E. coli
ccaatattcgaaatgaagaactgaa

SEQ ID NO: 170897 - DNA, 25 bp, E. coli
ccactggatgatttgggcgcagata

SEQ ID NO: 170898 - DNA, 25 bp, E. coli
ccaatattcgaattgaagaactgaa

SEQ ID NO: 170899 - DNA, 25 bp, E. coli
cgaattgaagaagtgaaagaacacc

SEQ ID NO: 170900 - DNA, 25 bp, E. coli
cgaattgaagaactgaaagaacacc

SEQ ID NO: 170901 - DNA, 25 bp, E. coli
gatatgggcgcacatagcacatgca

SEQ ID NO: 170902 - DNA, 25 bp, E. coli
gatatgggcgcagatagcacatgca

SEQ ID NO: 170903 - DNA, 25 bp, E. coli
taaccaatattcgaattgaagaact

SEQ ID NO: 170904 - DNA, 25 bp, E. coli
taaccaatattccaattgaagaact

SEQ ID NO: 170905 - DNA, 25 bp, E. coli
gaccactggatgatatgggcgcaga

SEQ ID NO: 170906 - DNA, 25 bp, E. coli
gaccactggatgttatgggcgcaga

SEQ ID NO: 170907 - DNA, 25 bp, E. coli
aagatttacgtaagctggtcgagga

SEQ ID NO: 170908 - DNA, 25 bp, E. coli
aagatttacgtatgctggtcgagga

SEQ ID NO: 170909 - DNA, 25 bp, E. coli
taaaaccgtcagtagaaggcatcgc

SEQ ID NO: 170910 - DNA, 25 bp, E. coli
taaacaagtggcgttgatcgccgca

SEQ ID NO: 170911 - DNA, 25 bp, E. coli
taaacaagtggccttgatcgccgca

SEQ ID NO: 170912 - DNA, 25 bp, E. coli
taaaaccgtcagaagaaggcatcgc

SEQ ID NO: 170913 - DNA, 25 bp, E. coli
agttgaacaggatgtggaagtcgca

SEQ ID NO: 170914 - DNA, 25 bp, E. coli
agttgaacaggaagtggaagtcgca

SEQ ID NO: 170915 - DNA, 25 bp, E. coli
tatgaaggctatcgacggcatcaaa

SEQ ID NO: 170916 - DNA, 25 bp, E. coli
tatgaaggctatggacggcatcaaa

SEQ ID NO: 170917 - DNA, 25 bp, E. coli
tgtagtggctttctttgtacgggta

SEQ ID NO: 170918 - DNA, 25 bp, E. coli
tgtagtggctttgtttgtacgggta

SEQ ID NO: 170919 - DNA, 25 bp, E. coli
tcgaggataaattcgtcgatgccct

SEQ ID NO: 170920 - DNA, 25 bp, E. coli
tcgaggataaatacgtcgatgccct

SEQ ID NO: 170921 - DNA, 25 bp, E. coli
gaaatccgttgagcctatgaaggct

SEQ ID NO: 170922 - DNA, 25 bp, E. coli
gaaatccgttgaccctatgaaggct

SEQ ID NO: 170923 - DNA, 25 bp, E. coli
ggaagtcgcagtgcgtgagaaaaac

SEQ ID NO: 170924 - DNA, 25 bp, E. coli
ggcaacgcactctatcaccagaaga

SEQ ID NO: 170925 - DNA, 25 bp, E. coli
ggaagtcgcagtccgtgagaaaaac

SEQ ID NO: 170926 - DNA, 25 bp, E. coli
ggaagtcagccgatctactattgat

SEQ ID NO: 170927 - DNA, 25 bp, E. coli
ggcaacgcactcaatcaccagaaga

SEQ ID NO: 170928 - DNA, 25 bp, E. coli
ggaagtcagccgttctactattgat

SEQ ID NO: 170929 - DNA, 25 bp, E. coli
aatgggaattgtggataccacgccg

SEQ ID NO: 170930 - DNA, 25 bp, E. coli
aatgggaattgtcgataccacgccg

SEQ ID NO: 170931 - DNA, 25 bp, E. coli
catgtttggtgctaccgtcctggtg

SEQ ID NO: 170932 - DNA, 25 bp, E. coli
catgtttggtgcaaccgtcctggtg

SEQ ID NO: 170933 - DNA, 25 bp, E. coli
tatcgtcaaaaatgatctgctgcgc

SEQ ID NO: 170934 - DNA, 25 bp, E. coli
tattgccgaacaggtagggcacctg

SEQ ID NO: 170935 - DNA, 25 bp, E. coli
tatacgccgcgcatcgagtggtttg

SEQ ID NO: 170936 - DNA, 25 bp, E. coli
tattgccgaacacgtagggcacctg

SEQ ID NO: 170937 - DNA, 25 bp, E. coli
tatacgccgcgcttcgagtggtttg

SEQ ID NO: 170938 - DNA, 25 bp, E. coli
tatcgtcaaaaaagatctgctgcgc

SEQ ID NO: 170939 - DNA, 25 bp, E. coli
tgctgtttccacctgcggcaatggg

SEQ ID NO: 170940 - DNA, 25 bp, E. coli
tgctgtttccacgtgcggcaatggg

SEQ ID NO: 170941 - DNA, 25 bp, E. coli
tgccgttagggtttgaagtcgcgct

SEQ ID NO: 170942 - DNA, 25 bp, E. coli
tgccgttagggtatgaagtcgcgct

SEQ ID NO: 170943 - DNA, 25 bp, E. coli
gaaaacattggcgtgatggcgatca

SEQ ID NO: 170944 - DNA, 25 bp, E. coli
gaaaacattggcctgatggcgatca

SEQ ID NO: 170945 - DNA, 25 bp, E. coli
ccctgaagaagtcgtgctggacgca

SEQ ID NO: 170946 - DNA, 25 bp, E. coli
ccctgaagaagtggtgctggacgca

SEQ ID NO: 170947 - DNA, 25 bp, E. coli
cattctgactatactgccagcggcg

SEQ ID NO: 170948 - DNA, 25 bp, E. coli
cattctgactattctgccagcggcg

SEQ ID NO: 170949 - DNA, 25 bp, E. coli
gatcacccgtgtttacagtacctgg

SEQ ID NO: 170950 - DNA, 25 bp, E. coli
gatcacccgtgtatacagtacctgg

SEQ ID NO: 170951 - DNA, 25 bp, E. coli
catcttccagtgttgccgcttcgta

SEQ ID NO: 170952 - DNA, 25 bp, E. coli
catcttccagtgatgccgcttcgta

SEQ ID NO: 170953 - DNA, 25 bp, E. coli
tacggctgacgtcatcaactggctt

SEQ ID NO: 170954 - DNA, 25 bp, E. coli
tacggctgacgtgatcaactggctt

SEQ ID NO: 170955 - DNA, 25 bp, E. coli
tgaatcggcaaacgaatagtacggg

SEQ ID NO: 170956 - DNA, 25 bp, E. coli
tgaatcggcaaaggaatagtacggg

SEQ ID NO: 170957 - DNA, 25 bp, E. coli
tcatcggccaggatgtccagcaacg

SEQ ID NO: 170958 - DNA, 25 bp, E. coli
tcatcttgcgtggtatcttccggac

SEQ ID NO: 170959 - DNA, 25 bp, E. coli
tcatcttgcgtgctatcttccggac

SEQ ID NO: 170960 - DNA, 25 bp, E. coli
tcatcggccaggttgtccagcaacg

SEQ ID NO: 170961 - DNA, 25 bp, E. coli
ccagcttatgggacaactcacgtgc

SEQ ID NO: 170962 - DNA, 25 bp, E. coli
ccagcttatgggtcaactcacgtgc

SEQ ID NO: 170963 - DNA, 25 bp, E. coli
gaatctggcgaagacgttcacgggt

SEQ ID NO: 170964 - DNA, 25 bp, E. coli
gaatctggcgaacacgttcacgggt

SEQ ID NO: 170965 - DNA, 25 bp, E. coli
gaacagccatttgacgatgctctgc

SEQ ID NO: 170966 - DNA, 25 bp, E. coli
gaacagccatttcacgatgctctgc

SEQ ID NO: 170967 - DNA, 25 bp, E. coli
cgttaagacgaaccatacggctgac

SEQ ID NO: 170968 - DNA, 25 bp, E. coli
cgttaagacgaagcatacggctgac

SEQ ID NO: 170969 - DNA, 25 bp, E. coli
gttcacgggtgacgccaatttcacg

SEQ ID NO: 170970 - DNA, 25 bp, E. coli
gttcacgggtgaggccaatttcacg

SEQ ID NO: 170971 - DNA, 25 bp, E. coli
gatattcagcccgtgcgtttgcagg

SEQ ID NO: 170972 - DNA, 25 bp, E. coli
gatattcagcccctgcgtttgcagg

SEQ ID NO: 170973 - DNA, 25 bp, E. coli
tacgccggaaacctgatgtcgctgg

SEQ ID NO: 170974 - DNA, 25 bp, E. coli
tacgccggaaacgtgatgtcgctgg

SEQ ID NO: 170975 - DNA, 25 bp, E. coli
tatatggtgaccagcactcgacgga

SEQ ID NO: 170976 - DNA, 25 bp, E. coli
tatcatcaacgaaacgagcgacgcg

SEQ ID NO: 170977 - DNA, 25 bp, E. coli
tatatggtgacctgcactcgacgga

SEQ ID NO: 170978 - DNA, 25 bp, E. coli
tatcatcaacgatacgagcgacgcg

SEQ ID NO: 170979 - DNA, 25 bp, E. coli
tgtgtcatgcatctggcagccgaaa

SEQ ID NO: 170980 - DNA, 25 bp, E. coli
tgtgtcatgcatgtggcagccgaaa

SEQ ID NO: 170981 - DNA, 25 bp, E. coli
tcgataagctgacctacgccggaaa

SEQ ID NO: 170982 - DNA, 25 bp, E. coli
tcgataagctgagctacgccggaaa

SEQ ID NO: 170983 - DNA, 25 bp, E. coli
gacggcccggcaccgtttattgaaa

SEQ ID NO: 170984 - DNA, 25 bp, E. coli
gacggcccggcagcgtttattgaaa

SEQ ID NO: 170985 - DNA, 25 bp, E. coli
gaaagttgatatgtgcgatcgggca

SEQ ID NO: 170986 - DNA, 25 bp, E. coli
gaaagttgatatctgcgatcgggca

SEQ ID NO: 170987 - DNA, 25 bp, E. coli
cattgatgcttcgaaaattgcccgt

SEQ ID NO: 170988 - DNA, 25 bp, E. coli
cggtatatggcatcgggcagcaaat

SEQ ID NO: 170989 - DNA, 25 bp, E. coli
cggcagctatcacggcgagcgttta

SEQ ID NO: 170990 - DNA, 25 bp, E. coli
cattgatgcttccaaaattgcccgt

SEQ ID NO: 170991 - DNA, 25 bp, E. coli
cggcagctatcagggcgagcgttta

SEQ ID NO: 170992 - DNA, 25 bp, E. coli
cggtatatggcaacgggcagcaaat

SEQ ID NO: 170993 - DNA, 25 bp, E. coli
ggcgctggtgcgttatatcatcaac

SEQ ID NO: 170994 - DNA, 25 bp, E. coli
ggcgctggtgcgatatatcatcaac

SEQ ID NO: 170995 - DNA, 25 bp, E. coli
tatgccagcttgcacggaatgcagg

SEQ ID NO: 170996 - DNA, 25 bp, E. coli
tatgccagcttggacggaatgcagg

SEQ ID NO: 170997 - DNA, 25 bp, E. coli
ttcacgactggctgggtaaaccgct

SEQ ID NO: 170998 - DNA, 25 bp, E. coli
ttcacgactggcagggtaaaccgct

SEQ ID NO: 170999 - DNA, 25 bp, E. coli
tgccattatgcacgtctacgacggg

SEQ ID NO: 171000 - DNA, 25 bp, E. coli
tgccattatgcaggtctacgacggg

SEQ ID NO: 171001 - DNA, 25 bp, E. coli
tctgaagaagatcctcccggttggg

SEQ ID NO: 171002 - DNA, 25 bp, E. coli
tctgaagaagatgctcccggttggg

SEQ ID NO: 171003 - DNA, 25 bp, E. coli
gaattcaccgttaacattgcgctca

SEQ ID NO: 171004 - DNA, 25 bp, E. coli
gaattcaccgtttacattgcgctca

SEQ ID NO: 171005 - DNA, 25 bp, E. coli
gacaattctccggtaacggcagcgg

SEQ ID NO: 171006 - DNA, 25 bp, E. coli
gacaattctccgctaacggcagcgg

SEQ ID NO: 171007 - DNA, 25 bp, E. coli
gttactggctggaagacccgctgga

SEQ ID NO: 171008 - DNA, 25 bp, E. coli
gttgggaagtccctcagcactggca

SEQ ID NO: 171009 - DNA, 25 bp, E. coli
gttgggaagtccgtcagcactggca

SEQ ID NO: 171010 - DNA, 25 bp, E. coli
gttactggctggtagacccgctgga

SEQ ID NO: 171011 - DNA, 25 bp, E. coli
tggacgtcgtcagcaaagcggacaa

SEQ ID NO: 171012 - DNA, 25 bp, E. coli
tggacgtcgtcaccaaagcggacaa

SEQ ID NO: 171013 - DNA, 25 bp, E. coli
tggacggtttacctacgctgacacc

SEQ ID NO: 171014 - DNA, 25 bp, E. coli
tggacggtttacgtacgctgacacc

SEQ ID NO: 171015 - DNA, 25 bp, E. coli
taatgaacgtaatgtacagcgcggc

SEQ ID NO: 171016 - DNA, 25 bp, E. coli
taatgaacgtaaagtacagcgcggc

SEQ ID NO: 171017 - DNA, 25 bp, E. coli
caaaggcgtgaacttcgtcggctac

SEQ ID NO: 171018 - DNA, 25 bp, E. coli
caaaggcgtgaagttcgtcggctac

SEQ ID NO: 171019 - DNA, 25 bp, E. coli
cagagctggtgccagcaaatcctca

SEQ ID NO: 171020 - DNA, 25 bp, E. coli
cagagctggtgcgagcaaatcctca

SEQ ID NO: 171021 - DNA, 25 bp, E. coli
tatgaatttacctgcccgaaaccgg

SEQ ID NO: 171022 - DNA, 25 bp, E. coli
tatgaatttaccagcccgaaaccgg

SEQ ID NO: 171023 - DNA, 25 bp, E. coli
aaaccggtgattgctgacgggcaac

SEQ ID NO: 171024 - DNA, 25 bp, E. coli
aaaccggtgattcctgacgggcaac

SEQ ID NO: 171025 - DNA, 25 bp, E. coli
tatgggcttggccatcaactgggat

SEQ ID NO: 171026 - DNA, 25 bp, E. coli
tatgggcttggcgatcaactgggat

SEQ ID NO: 171027 - DNA, 25 bp, E. coli
tattatcggccctgaactggtgacc

SEQ ID NO: 171028 - DNA, 25 bp, E. coli
tattatcggcccagaactggtgacc

SEQ ID NO: 171029 - DNA, 25 bp, E. coli
tgacaaactctcgaccaaaggcgtg

SEQ ID NO: 171030 - DNA, 25 bp, E. coli
tgacaaactctccaccaaaggcgtg

SEQ ID NO: 171031 - DNA, 25 bp, E. coli
cctgttacaccgtaatggcggcaga

SEQ ID NO: 171032 - DNA, 25 bp, E. coli
cctgttacaccgaaatggcggcaga

SEQ ID NO: 171033 - DNA, 25 bp, E. coli
taaccagtatgagcttagcgacgag

SEQ ID NO: 171034 - DNA, 25 bp, E. coli
taaccagtatgaccttagcgacgag

SEQ ID NO: 171035 - DNA, 25 bp, E. coli
gatgtgctcattctgggtatcccga

SEQ ID NO: 171036 - DNA, 25 bp, E. coli
gatgtgctcattgtgggtatcccga

SEQ ID NO: 171037 - DNA, 25 bp, E. coli
gagtggttcctcgatgcgctcggta

SEQ ID NO: 171038 - DNA, 25 bp, E. coli
gagtggttcctccatgcgctcggta

SEQ ID NO: 171039 - DNA, 25 bp, E. coli
aatcactattgcagccgatggcaca

SEQ ID NO: 171040 - DNA, 25 bp, E. coli
aatcactattgctgccgatggcaca

SEQ ID NO: 171041 - DNA, 25 bp, E. coli
cactattgctgcggatggcacaatc

SEQ ID NO: 171042 - DNA, 25 bp, E. coli
cactattgctgccgatggcacaatc

SEQ ID NO: 171043 - DNA, 25 bp, E. coli
atcactattgctgccgatggcacaa

SEQ ID NO: 171044 - DNA, 25 bp, E. coli
atcactattgctcccgatggcacaa

SEQ ID NO: 171045 - DNA, 25 bp, E. coli
actattgctgccgatggcacaatct

SEQ ID NO: 171046 - DNA, 25 bp, E. coli
aaatcactattggtgccgatggcac

SEQ ID NO: 171047 - DNA, 25 bp, E. coli
actattgctgcccatggcacaatct

SEQ ID NO: 171048 - DNA, 25 bp, E. coli
aaatcactattgctgccgatggcac

SEQ ID NO: 171049 - DNA, 25 bp, E. coli
tattgctgccgaaggcacaatctcg

SEQ ID NO: 171050 - DNA, 25 bp, E. coli
tattgctgccgatggcacaatctcg

SEQ ID NO: 171051 - DNA, 25 bp, E. coli
gaaatcactattcctgccgatggca

SEQ ID NO: 171052 - DNA, 25 bp, E. coli
gaaatcactattgctgccgatggca

SEQ ID NO: 171053 - DNA, 25 bp, E. coli
ctattgctgccgatggcacaatctc

SEQ ID NO: 171054 - DNA, 25 bp, E. coli
ctattgctgccgttggcacaatctc

SEQ ID NO: 171055 - DNA, 25 bp, E. coli
ggaaatcactatagctgccgatggc

SEQ ID NO: 171056 - DNA, 25 bp, E. coli
ggaaatcactattgctgccgatggc

SEQ ID NO: 171057 - DNA, 25 bp, E. coli
tcactattgctgccgatggcacaat

SEQ ID NO: 171058 - DNA, 25 bp, E. coli
tcactattgctggcgatggcacaat

SEQ ID NO: 171059 - DNA, 25 bp, E. coli
caaagaatcggtcagcgcctatgtc

SEQ ID NO: 171060 - DNA, 25 bp, E. coli
caaagaatcggtgagcgcctatgtc

SEQ ID NO: 171061 - DNA, 25 bp, E. coli
caacaacagcgactcaaaagtccca

SEQ ID NO: 171062 - DNA, 25 bp, E. coli
caacaacagcgagtcaaaagtccca

SEQ ID NO: 171063 - DNA, 25 bp, E. coli
ctgaagggctacacgaccaaaggga

SEQ ID NO: 171064 - DNA, 25 bp, E. coli
ctgaagggctactcgaccaaaggga

SEQ ID NO: 171065 - DNA, 25 bp, E. coli
aaatcccgtggattaccttgcttga

SEQ ID NO: 171066 - DNA, 25 bp, E. coli
aaatcccgtggaataccttgcttga

SEQ ID NO: 171067 - DNA, 25 bp, E. coli
tgatttgcgaaattacccttccgga

SEQ ID NO: 171068 - DNA, 25 bp, E. coli
tgatttgcgaaaatacccttccgga

SEQ ID NO: 171069 - DNA, 25 bp, E. coli
tgaaaggacgttctaccaatgcgcc

SEQ ID NO: 171070 - DNA, 25 bp, E. coli
tgcttgaacgcgtagacattatccc

SEQ ID NO: 171071 - DNA, 25 bp, E. coli
tgcttgaacgcgaagacattatccc

SEQ ID NO: 171072 - DNA, 25 bp, E. coli
tgaaaggacgttgtaccaatgcgcc

SEQ ID NO: 171073 - DNA, 25 bp, E. coli
tcaaaacagtatcagggccaatggt

SEQ ID NO: 171074 - DNA, 25 bp, E. coli
tcaaaacagtatgagggccaatggt

SEQ ID NO: 171075 - DNA, 25 bp, E. coli
gacatcgccaaaggctacaaggtga

SEQ ID NO: 171076 - DNA, 25 bp, E. coli
gactgccacagcgatgattcacaag

SEQ ID NO: 171077 - DNA, 25 bp, E. coli
gactgccacagccatgattcacaag

SEQ ID NO: 171078 - DNA, 25 bp, E. coli
gacatcgccaaacgctacaaggtga

SEQ ID NO: 171079 - DNA, 25 bp, E. coli
taaccaacggtttatcgcggcgcat

SEQ ID NO: 171080 - DNA, 25 bp, E. coli
taaccaacggttaatcgcggcgcat

SEQ ID NO: 171081 - DNA, 25 bp, E. coli
caacttatccttttagagcgattaa

SEQ ID NO: 171082 - DNA, 25 bp, E. coli
caacttatccttatagagcgattaa

SEQ ID NO: 171083 - DNA, 25 bp, E. coli
ttctaagactttcatctttcgttaa

SEQ ID NO: 171084 - DNA, 25 bp, E. coli
ttctaagactttgatctttcgttaa

SEQ ID NO: 171085 - DNA, 25 bp, E. coli
aacgtcaacttatccttatagagcg

SEQ ID NO: 171086 - DNA, 25 bp, E. coli
aacgtcaacttaaccttatagagcg

SEQ ID NO: 171087 - DNA, 25 bp, E. coli
tcaaaatttgatatttacggatgga

SEQ ID NO: 171088 - DNA, 25 bp, E. coli
tcaaaatttgatttttacggatgga

SEQ ID NO: 171089 - DNA, 25 bp, E. coli
tataagtactttttctcaaaatttg

SEQ ID NO: 171090 - DNA, 25 bp, E. coli
tataagtactttatctcaaaatttg

SEQ ID NO: 171091 - DNA, 25 bp, E. coli
ttatcactttaatctaacgtcaact

SEQ ID NO: 171092 - DNA, 25 bp, E. coli
ttatcactttaaactaacgtcaact

SEQ ID NO: 171093 - DNA, 25 bp, E. coli
gtccatcaaagaaacgtcatttttt

SEQ ID NO: 171094 - DNA, 25 bp, E. coli
gtccatcaaagatacgtcatttttt

SEQ ID NO: 171095 - DNA, 25 bp, E. coli
tgatttttacggatggaagtccatc

SEQ ID NO: 171096 - DNA, 25 bp, E. coli
tgatttttacggttggaagtccatc

SEQ ID NO: 171097 - DNA, 25 bp, E. coli
ggaagtccatcaaagaaacgtcatt

SEQ ID NO: 171098 - DNA, 25 bp, E. coli
ggaagtccatcatagaaacgtcatt

SEQ ID NO: 171099 - DNA, 25 bp, E. coli
gatggaagtccatcaaagaaacgtc

SEQ ID NO: 171100 - DNA, 25 bp, E. coli
gatggaagtccaacaaagaaacgtc

SEQ ID NO: 171101 - DNA, 25 bp, E. coli
gagcgattaattactataagtactt

SEQ ID NO: 171102 - DNA, 25 bp, E. coli
gagcgattaatttctataagtactt

SEQ ID NO: 171103 - DNA, 25 bp, E. coli
aacggactcactgtttatgggcgca

SEQ ID NO: 171104 - DNA, 25 bp, E. coli
aacggactcactctttatgggcgca

SEQ ID NO: 171105 - DNA, 25 bp, E. coli
aacagtatggatttccgcgccggac

SEQ ID NO: 171106 - DNA, 25 bp, E. coli
aacagtatggatatccgcgccggac

SEQ ID NO: 171107 - DNA, 25 bp, E. coli
tgagccatggtagagggtctatcgc

SEQ ID NO: 171108 - DNA, 25 bp, E. coli
tgagccatggtacagggtctatcgc

SEQ ID NO: 171109 - DNA, 25 bp, E. coli
tccggcggcgctcatatgcatatcc

SEQ ID NO: 171110 - DNA, 25 bp, E. coli
tccggcggcgctgatatgcatatcc

SEQ ID NO: 171111 - DNA, 25 bp, E. coli
tctcggaaaggtggacagcagtctg

SEQ ID NO: 171112 - DNA, 25 bp, E. coli
tctcggaaaggtcgacagcagtctg

SEQ ID NO: 171113 - DNA, 25 bp, E. coli
tcgtgatgtgaagagccaggctgcc

SEQ ID NO: 171114 - DNA, 25 bp, E. coli
tcgtgatgtgaacagccaggctgcc

SEQ ID NO: 171115 - DNA, 25 bp, E. coli
gaaatacctgatggacagcgcggca

SEQ ID NO: 171116 - DNA, 25 bp, E. coli
gacgggatatcagctcagttgcgac

SEQ ID NO: 171117 - DNA, 25 bp, E. coli
gacgggatatcacctcagttgcgac

SEQ ID NO: 171118 - DNA, 25 bp, E. coli
gaaatacctgatcgacagcgcggca

SEQ ID NO: 171119 - DNA, 25 bp, E. coli
gatataaccatttcagcggaacgga

SEQ ID NO: 171120 - DNA, 25 bp, E. coli
gatataaccattacagcggaacgga

SEQ ID NO: 171121 - DNA, 25 bp, E. coli
taaccggccctgtatggaatgacgc

SEQ ID NO: 171122 - DNA, 25 bp, E. coli
taacctaacccgcacagaacagtgg

SEQ ID NO: 171123 - DNA, 25 bp, E. coli
taaccggccctgaatggaatgacgc

SEQ ID NO: 171124 - DNA, 25 bp, E. coli
taacctaacccggacagaacagtgg

SEQ ID NO: 171125 - DNA, 25 bp, E. coli
aaggcggtgcggatctgattctgat

SEQ ID NO: 171126 - DNA, 25 bp, E. coli
aaggcggtgcggttctgattctgat

SEQ ID NO: 171127 - DNA, 25 bp, E. coli
caataacgatctgctggtgctaagc

SEQ ID NO: 171128 - DNA, 25 bp, E. coli
caataacgatctcctggtgctaagc

SEQ ID NO: 171129 - DNA, 25 bp, E. coli
catgccgaagccgtgacttttggcc

SEQ ID NO: 171130 - DNA, 25 bp, E. coli
catgccgaagccctgacttttggcc

SEQ ID NO: 171131 - DNA, 25 bp, E. coli
caaaatgggaggacatcgaaaaggg

SEQ ID NO: 171132 - DNA, 25 bp, E. coli
caaaatgggaggtcatcgaaaaggg

SEQ ID NO: 171133 - DNA, 25 bp, E. coli
tatcgcgaatccaccaaagcattag

SEQ ID NO: 171134 - DNA, 25 bp, E. coli
tatcgcgaatcctccaaagcattag

SEQ ID NO: 171135 - DNA, 25 bp, E. coli
ttcgaagcgttacgcgttgagctgc

SEQ ID NO: 171136 - DNA, 25 bp, E. coli
ttcgaagcgttaggcgttgagctgc

SEQ ID NO: 171137 - DNA, 25 bp, E. coli
tgatgaagcagggagtggcctacct

SEQ ID NO: 171138 - DNA, 25 bp, E. coli
tgatgaagcaggcagtggcctacct

SEQ ID NO: 171139 - DNA, 25 bp, E. coli
tgacttttggccacaactgcgcgct

SEQ ID NO: 171140 - DNA, 25 bp, E. coli
tgacttttggcctcaactgcgcgct

SEQ ID NO: 171141 - DNA, 25 bp, E. coli
ccaaagcattagtggaaggcggtgc

SEQ ID NO: 171142 - DNA, 25 bp, E. coli
ccaaagcattagaggaaggcggtgc

SEQ ID NO: 171143 - DNA, 25 bp, E. coli
cattccgttactgatcggtggcgcg

SEQ ID NO: 171144 - DNA, 25 bp, E. coli
cattccgttactcatcggtggcgcg

SEQ ID NO: 171145 - DNA, 25 bp, E. coli
ggtatgagcgtcaccgatgttgagc

SEQ ID NO: 171146 - DNA, 25 bp, E. coli
ggtatgagcgtctccgatgttgagc

SEQ ID NO: 171147 - DNA, 25 bp, E. coli
cactggtgtttatagatcgcccgga

SEQ ID NO: 171148 - DNA, 25 bp, E. coli
cactggtgtttaaagatcgcccgga

SEQ ID NO: 171149 - DNA, 25 bp, E. coli
aaattgtcgatatcagccgtggcgg

SEQ ID NO: 171150 - DNA, 25 bp, E. coli
aaattgtcgataacagccgtggcgg

SEQ ID NO: 171151 - DNA, 25 bp, E. coli
ttatcaaaggcgtaactgcgacgcg

SEQ ID NO: 171152 - DNA, 25 bp, E. coli
ttatcaaaggcgaaactgcgacgcg

SEQ ID NO: 171153 - DNA, 25 bp, E. coli
tgaaattagcacagaacccggtcct

SEQ ID NO: 171154 - DNA, 25 bp, E. coli
tgaaatcactgtgcaaatggccgag

SEQ ID NO: 171155 - DNA, 25 bp, E. coli
tgaaattagcactgaacccggtcct

SEQ ID NO: 171156 - DNA, 25 bp, E. coli
tgaaatcactgtccaaatggccgag

SEQ ID NO: 171157 - DNA, 25 bp, E. coli
tccgccgccgcacatgaaaaaagtc

SEQ ID NO: 171158 - DNA, 25 bp, E. coli
tccgccgccgcagatgaaaaaagtc

SEQ ID NO: 171159 - DNA, 25 bp, E. coli
ccaaccgcgtggattgctgaaggca

SEQ ID NO: 171160 - DNA, 25 bp, E. coli
ccaaccgcgtggtttgctgaaggca

SEQ ID NO: 171161 - DNA, 25 bp, E. coli
gcacagaagataaggatgacgccct

SEQ ID NO: 171162 - DNA, 25 bp, E. coli
gcacagaagatatggatgacgccct

SEQ ID NO: 171163 - DNA, 25 bp, E. coli
gaaatgcgccgtcatccgctgaaag

SEQ ID NO: 171164 - DNA, 25 bp, E. coli
gaaatgcgccgtgatccgctgaaag

SEQ ID NO: 171165 - DNA, 25 bp, E. coli
tggaaaaagaaggaccagacggcgt

SEQ ID NO: 171166 - DNA, 25 bp, E. coli
tggaaaaagaagcaccagacggcgt

SEQ ID NO: 171167 - DNA, 25 bp, E. coli
tcactttggcctgggtctggaagca

SEQ ID NO: 171168 - DNA, 25 bp, E. coli
tcactttggcctcggtctggaagca

SEQ ID NO: 171169 - DNA, 25 bp, E. coli
aattttaggcgcgttgctggcaggc

SEQ ID NO: 171170 - DNA, 25 bp, E. coli
aattttaggcgccttgctggcaggc

SEQ ID NO: 171171 - DNA, 25 bp, E. coli
gctgctcagcatactggtgttaccg

SEQ ID NO: 171172 - DNA, 25 bp, E. coli
gcggcagcgttaggaatcagcattc

SEQ ID NO: 171173 - DNA, 25 bp, E. coli
gcggcagcgttacgaatcagcattc

SEQ ID NO: 171174 - DNA, 25 bp, E. coli
gctgctcagcattctggtgttaccg

SEQ ID NO: 171175 - DNA, 25 bp, E. coli
gactgttccgtgtcgatttgcagga

SEQ ID NO: 171176 - DNA, 25 bp, E. coli
gactgttccgtgacgatttgcagga

SEQ ID NO: 171177 - DNA, 25 bp, E. coli
cttaagcgcggtggtgtgctgctca

SEQ ID NO: 171178 - DNA, 25 bp, E. coli
cattaagtccttatgcgacggcggc

SEQ ID NO: 171179 - DNA, 25 bp, E. coli
cattaagtccttttgcgacggcggc

SEQ ID NO: 171180 - DNA, 25 bp, E. coli
cttaagcgcggtcgtgtgctgctca

SEQ ID NO: 171181 - DNA, 25 bp, E. coli
ggtgttaccgctgactatcccatta

SEQ ID NO: 171182 - DNA, 25 bp, E. coli
ggtgttaccgctcactatcccatta

SEQ ID NO: 171183 - DNA, 25 bp, E. coli
ggcaggcaccgcgacattaagtcct

SEQ ID NO: 171184 - DNA, 25 bp, E. coli
ggcaggcaccgccacattaagtcct

SEQ ID NO: 171185 - DNA, 25 bp, E. coli
tggacgcggcttctatgcatttgcc

SEQ ID NO: 171186 - DNA, 25 bp, E. coli
tggcgcactggaaggtaaccggtct

SEQ ID NO: 171187 - DNA, 25 bp, E. coli
tggcgcactggatggtaaccggtct

SEQ ID NO: 171188 - DNA, 25 bp, E. coli
tggacgcggcttgtatgcatttgcc

SEQ ID NO: 171189 - DNA, 25 bp, E. coli
gatgttgttgcccttacccttgccc

SEQ ID NO: 171190 - DNA, 25 bp, E. coli
gatgttgttgccgttacccttgccc

SEQ ID NO: 171191 - DNA, 25 bp, E. coli
taaagctcgaagatattacgccgga

SEQ ID NO: 171192 - DNA, 25 bp, E. coli
taaagctcgaagttattacgccgga

SEQ ID NO: 171193 - DNA, 25 bp, E. coli
aaacgaaaaggttacgctgccagcg

SEQ ID NO: 171194 - DNA, 25 bp, E. coli
aaacgaaaaggtaacgctgccagcg

SEQ ID NO: 171195 - DNA, 25 bp, E. coli
tgggttcagttctggcaggcattgc

SEQ ID NO: 171196 - DNA, 25 bp, E. coli
tgggttcagttcaggcaggcattgc

SEQ ID NO: 171197 - DNA, 25 bp, E. coli
gcgccataacgggaaaagctctaaa

SEQ ID NO: 171198 - DNA, 25 bp, E. coli
gcgccataacggcaaaagctctaaa

SEQ ID NO: 171199 - DNA, 25 bp, E. coli
ccagatgccgcaatagggaaagtca

SEQ ID NO: 171200 - DNA, 25 bp, E. coli
ccagatgccgcattagggaaagtca

SEQ ID NO: 171201 - DNA, 25 bp, E. coli
gaaagtcattcggttctgggcatgg

SEQ ID NO: 171202 - DNA, 25 bp, E. coli
gaaagtcattcgcttctgggcatgg

SEQ ID NO: 171203 - DNA, 25 bp, E. coli
cgctcgcggcgtaacaaaaagtgca

SEQ ID NO: 171204 - DNA, 25 bp, E. coli
cgctcgcggcgttacaaaaagtgca

SEQ ID NO: 171205 - DNA, 25 bp, E. coli
gatcaaaaagcgttaccagaggaag

SEQ ID NO: 171206 - DNA, 25 bp, E. coli
gatcaaaaagcgataccagaggaag

SEQ ID NO: 171207 - DNA, 25 bp, E. coli
ggccagagacgtagctccgacagat

SEQ ID NO: 171208 - DNA, 25 bp, E. coli
ggccagagacgttgctccgacagat

SEQ ID NO: 171209 - DNA, 25 bp, E. coli
taacgcagagtgtaacgctcgcggc

SEQ ID NO: 171210 - DNA, 25 bp, E. coli
taacgcagagtgaaacgctcgcggc

SEQ ID NO: 171211 - DNA, 25 bp, E. coli
gagctgcctgactggttgccggaaa

SEQ ID NO: 171212 - DNA, 25 bp, E. coli
gagctgcctgacaggttgccggaaa

SEQ ID NO: 171213 - DNA, 25 bp, E. coli
tgatggtcaccattaccgtcggcgc

SEQ ID NO: 171214 - DNA, 25 bp, E. coli
tgaagtggtctacgctgatggcaac

SEQ ID NO: 171215 - DNA, 25 bp, E. coli
tgaagtggtctaggctgatggcaac

SEQ ID NO: 171216 - DNA, 25 bp, E. coli
tgatggtcaccaataccgtcggcgc

SEQ ID NO: 171217 - DNA, 25 bp, E. coli
tctcgccgacgatattgaacatgtg

SEQ ID NO: 171218 - DNA, 25 bp, E. coli
tctcgccgacgaaattgaacatgtg

SEQ ID NO: 171219 - DNA, 25 bp, E. coli
tcaaccggtaacgaatgccagtggg

SEQ ID NO: 171220 - DNA, 25 bp, E. coli
tcaaccggtaaccaatgccagtggg

SEQ ID NO: 171221 - DNA, 25 bp, E. coli
tctgcaaattgataaggcgcgcttc

SEQ ID NO: 171222 - DNA, 25 bp, E. coli
tctgcaaattgaaaaggcgcgcttc

SEQ ID NO: 171223 - DNA, 25 bp, E. coli
gcgtttaccctggaaccgatagtgg

SEQ ID NO: 171224 - DNA, 25 bp, E. coli
gcgtttaccctgcaaccgatagtgg

SEQ ID NO: 171225 - DNA, 25 bp, E. coli
cgcgggcgcactgataaagtcttta

SEQ ID NO: 171226 - DNA, 25 bp, E. coli
cgcgggcgcactcataaagtcttta

SEQ ID NO: 171227 - DNA, 25 bp, E. coli
taacgttacgactaccatggaggga

SEQ ID NO: 171228 - DNA, 25 bp, E. coli
taagcgtcgcctctgagcctgatag

SEQ ID NO: 171229 - DNA, 25 bp, E. coli
tcacaactgctgcatacagggcgag

SEQ ID NO: 171230 - DNA, 25 bp, E. coli
taacgttacgacaaccatggaggga

SEQ ID NO: 171231 - DNA, 25 bp, E. coli
tcacaactgctggatacagggcgag

SEQ ID NO: 171232 - DNA, 25 bp, E. coli
taagcgtcgcctgtgagcctgatag

SEQ ID NO: 171233 - DNA, 25 bp, E. coli
gagatcaaactgcttcacgcccagg

SEQ ID NO: 171234 - DNA, 25 bp, E. coli
gagatcaaactggttcacgcccagg

SEQ ID NO: 171235 - DNA, 25 bp, E. coli
taaacatttcgaatctacgccggat

SEQ ID NO: 171236 - DNA, 25 bp, E. coli
tactgtagacgtcacgatccgccgt

SEQ ID NO: 171237 - DNA, 25 bp, E. coli
tactgtcagcgatgaacgtcgtagc

SEQ ID NO: 171238 - DNA, 25 bp, E. coli
tactgtcagcgaagaacgtcgtagc

SEQ ID NO: 171239 - DNA, 25 bp, E. coli
tactgtagacgtgacgatccgccgt

SEQ ID NO: 171240 - DNA, 25 bp, E. coli
taaacatttcgattctacgccggat

SEQ ID NO: 171241 - DNA, 25 bp, E. coli
tgggaactggacttcaacagccgtt

SEQ ID NO: 171242 - DNA, 25 bp, E. coli
tgttttcgaagccacagatggcgcg

SEQ ID NO: 171243 - DNA, 25 bp, E. coli
tgttttcgaagcgacagatggcgcg

SEQ ID NO: 171244 - DNA, 25 bp, E. coli
tgggaactggacatcaacagccgtt

SEQ ID NO: 171245 - DNA, 25 bp, E. coli
tgaaaccgcacgtccgtactgtaga

SEQ ID NO: 171246 - DNA, 25 bp, E. coli
tgaaaccgcacgaccgtactgtaga

SEQ ID NO: 171247 - DNA, 25 bp, E. coli
tgatggcgagcagtacaagctgccg

SEQ ID NO: 171248 - DNA, 25 bp, E. coli
tgatggcgagcactacaagctgccg

SEQ ID NO: 171249 - DNA, 25 bp, E. coli
tcctgactggccgtgacaacgaagt

SEQ ID NO: 171250 - DNA, 25 bp, E. coli
tcctgactggccctgacaacgaagt

SEQ ID NO: 171251 - DNA, 25 bp, E. coli
cctcgaaatcggtgcagatgactac

SEQ ID NO: 171252 - DNA, 25 bp, E. coli
cctcgaaatcggagcagatgactac

SEQ ID NO: 171253 - DNA, 25 bp, E. coli
gatcatggatatgaatctgccgggt

SEQ ID NO: 171254 - DNA, 25 bp, E. coli
gatcatggatatcaatctgccgggt

SEQ ID NO: 171255 - DNA, 25 bp, E. coli
tggcgcggaaatgcatcagatcctc

SEQ ID NO: 171256 - DNA, 25 bp, E. coli
tggcgcggaaatccatcagatcctc

SEQ ID NO: 171257 - DNA, 25 bp, E. coli
aagcgattcgcgctttccagttcca

SEQ ID NO: 171258 - DNA, 25 bp, E. coli
caacggttgcgttagcactttatct

SEQ ID NO: 171259 - DNA, 25 bp, E. coli
caacggttgcgtaagcactttatct

SEQ ID NO: 171260 - DNA, 25 bp, E. coli
acggttgcgtaagcactttatctga

SEQ ID NO: 171261 - DNA, 25 bp, E. coli
acggttgcgtaaccactttatctga

SEQ ID NO: 171262 - DNA, 25 bp, E. coli
aagcgattcgcggtttccagttcca

SEQ ID NO: 171263 - DNA, 25 bp, E. coli
tatcgcttcgaatccaacgtccgct

SEQ ID NO: 171264 - DNA, 25 bp, E. coli
tatcgcttcgaaaccaacgtccgct

SEQ ID NO: 171265 - DNA, 25 bp, E. coli
ttcgaatccaacctccgctcggcga

SEQ ID NO: 171266 - DNA, 25 bp, E. coli
ttcgaatccaacgtccgctcggcga

SEQ ID NO: 171267 - DNA, 25 bp, E. coli
tgctggatttcctctctcaacggtt

SEQ ID NO: 171268 - DNA, 25 bp, E. coli
tgctggatttccactctcaacggtt

SEQ ID NO: 171269 - DNA, 25 bp, E. coli
tctatcgcttcgaatccaacgtccg

SEQ ID NO: 171270 - DNA, 25 bp, E. coli
tctatcgcttcgtatccaacgtccg

SEQ ID NO: 171271 - DNA, 25 bp, E. coli
ctgtgggaagcgattcgcggtttcc

SEQ ID NO: 171272 - DNA, 25 bp, E. coli
ctgtgggaagcgtttcgcggtttcc

SEQ ID NO: 171273 - DNA, 25 bp, E. coli
ctctcaacggttccgtaagcacttt

SEQ ID NO: 171274 - DNA, 25 bp, E. coli
ctctcaacggttgcgtaagcacttt

SEQ ID NO: 171275 - DNA, 25 bp, E. coli
gatttcctctctgaacggttgcgta

SEQ ID NO: 171276 - DNA, 25 bp, E. coli
gatttcctctctcaacggttgcgta

SEQ ID NO: 171277 - DNA, 25 bp, E. coli
tggatttcctctctcaacggttgcg

SEQ ID NO: 171278 - DNA, 25 bp, E. coli
tggatttcctctgtcaacggttgcg

SEQ ID NO: 171279 - DNA, 25 bp, E. coli
caattcagggaattacctcaaccgt

SEQ ID NO: 171280 - DNA, 25 bp, E. coli
caattcagggaaatacctcaaccgt

SEQ ID NO: 171281 - DNA, 25 bp, E. coli
agcagttgttaacgcagcaggcaga

SEQ ID NO: 171282 - DNA, 25 bp, E. coli
agcagttgttaaggcagcaggcaga

SEQ ID NO: 171283 - DNA, 25 bp, E. coli
aaagacgatacaaataccgctggca

SEQ ID NO: 171284 - DNA, 25 bp, E. coli
aaatggctgcattggtacagaagca

SEQ ID NO: 171285 - DNA, 25 bp, E. coli
aaatggctgcataggtacagaagca

SEQ ID NO: 171286 - DNA, 25 bp, E. coli
aaagacgatacatataccgctggca

SEQ ID NO: 171287 - DNA, 25 bp, E. coli
aaaagcttgggaaaatctcatcgga

SEQ ID NO: 171288 - DNA, 25 bp, E. coli
aaaagcttgggataatctcatcgga

SEQ ID NO: 171289 - DNA, 25 bp, E. coli
tcaggtgctgacagaaaagcttggg

SEQ ID NO: 171290 - DNA, 25 bp, E. coli
tcaggtgctgactgaaaagcttggg

SEQ ID NO: 171291 - DNA, 25 bp, E. coli
gcctctgggctcaactggagcagtt

SEQ ID NO: 171292 - DNA, 25 bp, E. coli
gcctctgggctctactggagcagtt

SEQ ID NO: 171293 - DNA, 25 bp, E. coli
gaagcaaattgaaagcctctgggct

SEQ ID NO: 171294 - DNA, 25 bp, E. coli
gaatgaagacgccacagttcagcct

SEQ ID NO: 171295 - DNA, 25 bp, E. coli
gaatgaagacgcgacagttcagcct

SEQ ID NO: 171296 - DNA, 25 bp, E. coli
gaagcaaattgatagcctctgggct

SEQ ID NO: 171297 - DNA, 25 bp, E. coli
cgccccggaaggaacatcagaaata

SEQ ID NO: 171298 - DNA, 25 bp, E. coli
cgccccggaaggtacatcagaaata

SEQ ID NO: 171299 - DNA, 25 bp, E. coli
gggatgacgacagagcagaaaaaag

SEQ ID NO: 171300 - DNA, 25 bp, E. coli
gggatgacgacacagcagaaaaaag

SEQ ID NO: 171301 - DNA, 25 bp, E. coli
catttgcgcaatacttcccgccagg

SEQ ID NO: 171302 - DNA, 25 bp, E. coli
catttgcgcaattcttcccgccagg

SEQ ID NO: 171303 - DNA, 25 bp, E. coli
aaaacgttgatgtgtgaacaccgta

SEQ ID NO: 171304 - DNA, 25 bp, E. coli
aatcgccgggtgatgaaagtgaaac

SEQ ID NO: 171305 - DNA, 25 bp, E. coli
aatcgccgggtgttgaaagtgaaac

SEQ ID NO: 171306 - DNA, 25 bp, E. coli
aaaacgttgatgagtgaacaccgta

SEQ ID NO: 171307 - DNA, 25 bp, E. coli
tatagccaacgtgggcgtaaatcgc

SEQ ID NO: 171308 - DNA, 25 bp, E. coli
tatagccaacgtcggcgtaaatcgc

SEQ ID NO: 171309 - DNA, 25 bp, E. coli
tattttagacagaagccagtcaggc

SEQ ID NO: 171310 - DNA, 25 bp, E. coli
tattttagacagtagccagtcaggc

SEQ ID NO: 171311 - DNA, 25 bp, E. coli
tcggcaaccacgaatggcaaacatt

SEQ ID NO: 171312 - DNA, 25 bp, E. coli
tcagttacgcgaagaggaatggtct

SEQ ID NO: 171313 - DNA, 25 bp, E. coli
tcagttacgcgatgaggaatggtct

SEQ ID NO: 171314 - DNA, 25 bp, E. coli
tcggcaaccacgtatggcaaacatt

SEQ ID NO: 171315 - DNA, 25 bp, E. coli
gaattgatcaatgcttctggcagat

SEQ ID NO: 171316 - DNA, 25 bp, E. coli
gaattgatcaatccttctggcagat

SEQ ID NO: 171317 - DNA, 25 bp, E. coli
gaaatgacgctaacttcggcaacca

SEQ ID NO: 171318 - DNA, 25 bp, E. coli
gaaatgacgctatcttcggcaacca

SEQ ID NO: 171319 - DNA, 25 bp, E. coli
cgccaggacttgtaaaaccgtctgt

SEQ ID NO: 171320 - DNA, 25 bp, E. coli
cgccaggacttgaaaaaccgtctgt

SEQ ID NO: 171321 - DNA, 25 bp, E. coli
ggcagattaagccaaaatacccgtt

SEQ ID NO: 171322 - DNA, 25 bp, E. coli
ggcagattaagcgaaaatacccgtt

SEQ ID NO: 171323 - DNA, 25 bp, E. coli
aatcattaaccacggaaacagcgct

SEQ ID NO: 171324 - DNA, 25 bp, E. coli
aatcattaaccagggaaacagcgct

SEQ ID NO: 171325 - DNA, 25 bp, E. coli
caggacaatatccactgcggatcgg

SEQ ID NO: 171326 - DNA, 25 bp, E. coli
caggacaatatcgactgcggatcgg

SEQ ID NO: 171327 - DNA, 25 bp, E. coli
actgcggatcgggaattatctttga

SEQ ID NO: 171328 - DNA, 25 bp, E. coli
actgcggatcggcaattatctttga

SEQ ID NO: 171329 - DNA, 25 bp, E. coli
tatcgactgcggatcgggaattatc

SEQ ID NO: 171330 - DNA, 25 bp, E. coli
tatcgactgcggttcgggaattatc

SEQ ID NO: 171331 - DNA, 25 bp, E. coli
tgcgtcatctgctgcttctgcacca

SEQ ID NO: 171332 - DNA, 25 bp, E. coli
tgcgtcatctgcagcttctgcacca

SEQ ID NO: 171333 - DNA, 25 bp, E. coli
cctgtatcgaacaggcccgggagga

SEQ ID NO: 171334 - DNA, 25 bp, E. coli
cctgtatcgaactggcccgggagga

SEQ ID NO: 171335 - DNA, 25 bp, E. coli
gcggatcgggaattatctttgacaa

SEQ ID NO: 171336 - DNA, 25 bp, E. coli
gcggatcgggaaatatctttgacaa

SEQ ID NO: 171337 - DNA, 25 bp, E. coli
gaaatcattaacgacggaaacagcg

SEQ ID NO: 171338 - DNA, 25 bp, E. coli
gacaatatcgactgcggatcgggaa

SEQ ID NO: 171339 - DNA, 25 bp, E. coli
gacaatatcgacagcggatcgggaa

SEQ ID NO: 171340 - DNA, 25 bp, E. coli
gaaatcattaaccacggaaacagcg

SEQ ID NO: 171341 - DNA, 25 bp, E. coli
gatcgggaattatctttgacaacga

SEQ ID NO: 171342 - DNA, 25 bp, E. coli
gatcgggaattaactttgacaacga

SEQ ID NO: 171343 - DNA, 25 bp, E. coli
ggcccgggaggatgtccgtaccctg

SEQ ID NO: 171344 - DNA, 25 bp, E. coli
ggcccgggaggaagtccgtaccctg

SEQ ID NO: 171345 - DNA, 25 bp, E. coli
caacattgccgactatgaacaaaat

SEQ ID NO: 171346 - DNA, 25 bp, E. coli
caacattgccgagtatgaacaaaat

SEQ ID NO: 171347 - DNA, 25 bp, E. coli
cagttggcagcgctgccggatctta

SEQ ID NO: 171348 - DNA, 25 bp, E. coli
cagttggcagcggtgccggatctta

SEQ ID NO: 171349 - DNA, 25 bp, E. coli
atcacacttgcggatcaacatggcg

SEQ ID NO: 171350 - DNA, 25 bp, E. coli
atcacacttgcgcatcaacatggcg

SEQ ID NO: 171351 - DNA, 25 bp, E. coli
tatggtccgccgcacagacttggcg

SEQ ID NO: 171352 - DNA, 25 bp, E. coli
tatggtccgccggacagacttggcg

SEQ ID NO: 171353 - DNA, 25 bp, E. coli
tttccgttgatatggtgcgggccga

SEQ ID NO: 171354 - DNA, 25 bp, E. coli
tttccgttgataaggtgcgggccga

SEQ ID NO: 171355 - DNA, 25 bp, E. coli
tccgctggcggagatgatcacactt

SEQ ID NO: 171356 - DNA, 25 bp, E. coli
tccgctggcggacatgatcacactt

SEQ ID NO: 171357 - DNA, 25 bp, E. coli
ccccgacggtactctgcaactggag

SEQ ID NO: 171358 - DNA, 25 bp, E. coli
ccccgacggtacactgcaactggag

SEQ ID NO: 171359 - DNA, 25 bp, E. coli
cattacgcattgacgcagttggcag

SEQ ID NO: 171360 - DNA, 25 bp, E. coli
cattacgcattgtcgcagttggcag

SEQ ID NO: 171361 - DNA, 25 bp, E. coli
gtacgcccaataccggaggtattat

SEQ ID NO: 171362 - DNA, 25 bp, E. coli
gatcttacgctcaatggtccgccgg

SEQ ID NO: 171363 - DNA, 25 bp, E. coli
gtattattggccatggcgcggcgct

SEQ ID NO: 171364 - DNA, 25 bp, E. coli
gtacgcccaatagcggaggtattat

SEQ ID NO: 171365 - DNA, 25 bp, E. coli
gtattattggccttggcgcggcgct

SEQ ID NO: 171366 - DNA, 25 bp, E. coli
gatcttacgctctatggtccgccgg

SEQ ID NO: 171367 - DNA, 25 bp, E. coli
aagctacagcaacccaacacagcga

SEQ ID NO: 171368 - DNA, 25 bp, E. coli
aagctacagcaagccaacacagcga

SEQ ID NO: 171369 - DNA, 25 bp, E. coli
cagcaagccaacacagcgagaaatt

SEQ ID NO: 171370 - DNA, 25 bp, E. coli
cagcaagccaactcagcgagaaatt

SEQ ID NO: 171371 - DNA, 25 bp, E. coli
agcaagctacagcaagccaacacag

SEQ ID NO: 171372 - DNA, 25 bp, E. coli
atggcacaagcatgctacagcaagc

SEQ ID NO: 171373 - DNA, 25 bp, E. coli
agcaagctacaggaagccaacacag

SEQ ID NO: 171374 - DNA, 25 bp, E. coli
atggcacaagcaagctacagcaagc

SEQ ID NO: 171375 - DNA, 25 bp, E. coli
agcaagccaacacagcgagaaattg

SEQ ID NO: 171376 - DNA, 25 bp, E. coli
agcaagccaacagagcgagaaattg

SEQ ID NO: 171377 - DNA, 25 bp, E. coli
tatgcattggatggaatcacaaaga

SEQ ID NO: 171378 - DNA, 25 bp, E. coli
tatgcattggatcgaatcacaaaga

SEQ ID NO: 171379 - DNA, 25 bp, E. coli
gcacaagcaagctacagcaagccaa

SEQ ID NO: 171380 - DNA, 25 bp, E. coli
gcacaagcaagcaacagcaagccaa

SEQ ID NO: 171381 - DNA, 25 bp, E. coli
ctacagcaagcctacacagcgagaa

SEQ ID NO: 171382 - DNA, 25 bp, E. coli
ctacagcaagccaacacagcgagaa

SEQ ID NO: 171383 - DNA, 25 bp, E. coli
cattggatggaaacacaaagaaaaa

SEQ ID NO: 171384 - DNA, 25 bp, E. coli
cattggatggaatcacaaagaaaaa

SEQ ID NO: 171385 - DNA, 25 bp, E. coli
ggcttttaagtaagcattggatgga

SEQ ID NO: 171386 - DNA, 25 bp, E. coli
ggcttttaagtatgcattggatgga

SEQ ID NO: 171387 - DNA, 25 bp, E. coli
taagtatgcattcgatggaatcaca

SEQ ID NO: 171388 - DNA, 25 bp, E. coli
taagtatgcattggatggaatcaca

SEQ ID NO: 171389 - DNA, 25 bp, E. coli
caaaaggcggctaaaaaatgctgac

SEQ ID NO: 171390 - DNA, 25 bp, E. coli
caaaaggcggcttaaaaatgctgac

SEQ ID NO: 171391 - DNA, 25 bp, E. coli
tattggtccagggtacattgctaca

SEQ ID NO: 171392 - DNA, 25 bp, E. coli
tattggtccaggctacattgctaca

SEQ ID NO: 171393 - DNA, 25 bp, E. coli
ttatatcaaaaaggccagctggacg

SEQ ID NO: 171394 - DNA, 25 bp, E. coli
ttatatcaaaaacgccagctggacg

SEQ ID NO: 171395 - DNA, 25 bp, E. coli
tgaaattcaacctgatggcagccgc

SEQ ID NO: 171396 - DNA, 25 bp, E. coli
tgaaattcaaccagatggcagccgc

SEQ ID NO: 171397 - DNA, 25 bp, E. coli
tctggcctacataggcaaacagcct

SEQ ID NO: 171398 - DNA, 25 bp, E. coli
tctggcctacattggcaaacagcct

SEQ ID NO: 171399 - DNA, 25 bp, E. coli
gaattgggtcgcgaaaccgttgtag

SEQ ID NO: 171400 - DNA, 25 bp, E. coli
gaattgggtcgccaaaccgttgtag

SEQ ID NO: 171401 - DNA, 25 bp, E. coli
gaaaacattaaaaaaggcctggcag

SEQ ID NO: 171402 - DNA, 25 bp, E. coli
gaaaacattaaataaggcctggcag

SEQ ID NO: 171403 - DNA, 25 bp, E. coli
tggcagccgccatccatttgatcag

SEQ ID NO: 171404 - DNA, 25 bp, E. coli
ggcctggcagcatataaagagaaca

SEQ ID NO: 171405 - DNA, 25 bp, E. coli
ggcctggcagcaaataaagagaaca

SEQ ID NO: 171406 - DNA, 25 bp, E. coli
tgtaggctacgcatcggcaaaaggc

SEQ ID NO: 171407 - DNA, 25 bp, E. coli
tgtaggctacgcttcggcaaaaggc

SEQ ID NO: 171408 - DNA, 25 bp, E. coli
tggcagccgccaaccatttgatcag

SEQ ID NO: 171409 - DNA, 25 bp, E. coli
taagtaacgctgctgcaacgatcat

SEQ ID NO: 171410 - DNA, 25 bp, E. coli
taagtaacgctggtgcaacgatcat

SEQ ID NO: 171411 - DNA, 25 bp, E. coli
cacaattggttgtttgttagccaga

SEQ ID NO: 171412 - DNA, 25 bp, E. coli
cacaattggttgattgttagccaga

SEQ ID NO: 171413 - DNA, 25 bp, E. coli
cagattatgtgtattttcagcggca

SEQ ID NO: 171414 - DNA, 25 bp, E. coli
cagattatgtgttttttcagcggca

SEQ ID NO: 171415 - DNA, 25 bp, E. coli
cttttattgccgaacagattatgtg

SEQ ID NO: 171416 - DNA, 25 bp, E. coli
cttttattgccgtacagattatgtg

SEQ ID NO: 171417 - DNA, 25 bp, E. coli
tgttagccagataaggccgtgactt

SEQ ID NO: 171418 - DNA, 25 bp, E. coli
tgtttgttagcctgattaggccgtg

SEQ ID NO: 171419 - DNA, 25 bp, E. coli
tgtgaactatatcacaattggttgt

SEQ ID NO: 171420 - DNA, 25 bp, E. coli
tgttagccagattaggccgtgactt

SEQ ID NO: 171421 - DNA, 25 bp, E. coli
tgtgaactatatgacaattggttgt

SEQ ID NO: 171422 - DNA, 25 bp, E. coli
tgtttgttagccagattaggccgtg

SEQ ID NO: 171423 - DNA, 25 bp, E. coli
tgcagaacacaataatgaaacactc

SEQ ID NO: 171424 - DNA, 25 bp, E. coli
tgcagaacacaaaaatgaaacactc

SEQ ID NO: 171425 - DNA, 25 bp, E. coli
tcatgaattttgtgaactatatcac

SEQ ID NO: 171426 - DNA, 25 bp, E. coli
tcatgaattttgagaactatatcac

SEQ ID NO: 171427 - DNA, 25 bp, E. coli
ccgtgacttttaatgccgtacagat

SEQ ID NO: 171428 - DNA, 25 bp, E. coli
ccgtgacttttattgccgtacagat

SEQ ID NO: 171429 - DNA, 25 bp, E. coli
gaaacactctgtttgtttcatgaat

SEQ ID NO: 171430 - DNA, 25 bp, E. coli
gaaacactctgtatgtttcatgaat

SEQ ID NO: 171431 - DNA, 25 bp, E. coli
gattaggccgtgacttttattgccg

SEQ ID NO: 171432 - DNA, 25 bp, E. coli
gattaggccgtgtcttttattgccg

SEQ ID NO: 171433 - DNA, 25 bp, E. coli
tacgtaatcagcctgcgttgtctgc

SEQ ID NO: 171434 - DNA, 25 bp, E. coli
tacgtaatcagcgtgcgttgtctgc

SEQ ID NO: 171435 - DNA, 25 bp, E. coli
ttttaaaattggacgtcgtgccgcg

SEQ ID NO: 171436 - DNA, 25 bp, E. coli
ttttaaaattggtcgtcgtgccgcg

SEQ ID NO: 171437 - DNA, 25 bp, E. coli
tgcgttgtctgcgtttacctcggaa

SEQ ID NO: 171438 - DNA, 25 bp, E. coli
tgcgttgtctgcctttacctcggaa

SEQ ID NO: 171439 - DNA, 25 bp, E. coli
tcgaacaggtcttacgtaatcagcc

SEQ ID NO: 171440 - DNA, 25 bp, E. coli
tcgaacaggtctaacgtaatcagcc

SEQ ID NO: 171441 - DNA, 25 bp, E. coli
tcagcctgcgttgtctgcgtttacc

SEQ ID NO: 171442 - DNA, 25 bp, E. coli
gaagatcgaacacgtcttacgtaat

SEQ ID NO: 171443 - DNA, 25 bp, E. coli
gaagatcgaacaggtcttacgtaat

SEQ ID NO: 171444 - DNA, 25 bp, E. coli
ctgcgtttacctcggaaattaatgc

SEQ ID NO: 171445 - DNA, 25 bp, E. coli
ctgcgtttacctgggaaattaatgc

SEQ ID NO: 171446 - DNA, 25 bp, E. coli
cgttgtctgcgtatacctcggaaat

SEQ ID NO: 171447 - DNA, 25 bp, E. coli
cgttgtctgcgtttacctcggaaat

SEQ ID NO: 171448 - DNA, 25 bp, E. coli
gtcagctggatagcaattttaaaat

SEQ ID NO: 171449 - DNA, 25 bp, E. coli
gtcagctggataccaattttaaaat

SEQ ID NO: 171450 - DNA, 25 bp, E. coli
ggtcttacgtaatcagcctgcgttg

SEQ ID NO: 171451 - DNA, 25 bp, E. coli
ggtcttacgtaaacagcctgcgttg

SEQ ID NO: 171452 - DNA, 25 bp, E. coli
tgtctgcgtttagctcggaaattaa

SEQ ID NO: 171453 - DNA, 25 bp, E. coli
tgtctgcgtttacctcggaaattaa

SEQ ID NO: 171454 - DNA, 25 bp, E. coli
tcagcctgcgttctctgcgtttacc

SEQ ID NO: 171455 - DNA, 25 bp, E. coli
caacaatctatctttcatcccatat

SEQ ID NO: 171456 - DNA, 25 bp, E. coli
caacaatctatcattcatcccatat

SEQ ID NO: 171457 - DNA, 25 bp, E. coli
atcccatattcaacaacatccgcta

SEQ ID NO: 171458 - DNA, 25 bp, E. coli
atcccatattcatcaacatccgcta

SEQ ID NO: 171459 - DNA, 25 bp, E. coli
aacatccgctattattgatttccag

SEQ ID NO: 171460 - DNA, 25 bp, E. coli
aacatccgctataattgatttccag

SEQ ID NO: 171461 - DNA, 25 bp, E. coli
tttccagcttaatcatcacctgatg

SEQ ID NO: 171462 - DNA, 25 bp, E. coli
tattcatcaacaaccgctattattg

SEQ ID NO: 171463 - DNA, 25 bp, E. coli
tattcatcaacatccgctattattg

SEQ ID NO: 171464 - DNA, 25 bp, E. coli
tttccagcttaaacatcacctgatg

SEQ ID NO: 171465 - DNA, 25 bp, E. coli
ttcatcccatatacatcaacatccg

SEQ ID NO: 171466 - DNA, 25 bp, E. coli
ttcatcccatattcatcaacatccg

SEQ ID NO: 171467 - DNA, 25 bp, E. coli
tccagcttaatcttcacctgatgaa

SEQ ID NO: 171468 - DNA, 25 bp, E. coli
tccagcttaatcatcacctgatgaa

SEQ ID NO: 171469 - DNA, 25 bp, E. coli
ccatattcatcatcatccgctatta

SEQ ID NO: 171470 - DNA, 25 bp, E. coli
ccatattcatcaacatccgctatta

SEQ ID NO: 171471 - DNA, 25 bp, E. coli
gcttaatcatcagctgatgaacaaa

SEQ ID NO: 171472 - DNA, 25 bp, E. coli
gcttaatcatcacctgatgaacaaa

SEQ ID NO: 171473 - DNA, 25 bp, E. coli
gcacatttcaacaatctatctttca

SEQ ID NO: 171474 - DNA, 25 bp, E. coli
gcacatttcaactatctatctttca

SEQ ID NO: 171475 - DNA, 25 bp, E. coli
gatttccagcttaatcatcacctga

SEQ ID NO: 171476 - DNA, 25 bp, E. coli
gatttccagctttatcatcacctga

SEQ ID NO: 171477 - DNA, 25 bp, E. coli
tactggccgccgttgagttgcgcac

SEQ ID NO: 171478 - DNA, 25 bp, E. coli
atgttccgcacgctgacgcatcaga

SEQ ID NO: 171479 - DNA, 25 bp, E. coli
atgttccgcacggtgacgcatcaga

SEQ ID NO: 171480 - DNA, 25 bp, E. coli
tactggccgccgatgagttgcgcac

SEQ ID NO: 171481 - DNA, 25 bp, E. coli
tttttgatatcggaatggacctggg

SEQ ID NO: 171482 - DNA, 25 bp, E. coli
ttgaccagccgcataacattgatgt

SEQ ID NO: 171483 - DNA, 25 bp, E. coli
ttttccgtcggcagtttgatcgcac

SEQ ID NO: 171484 - DNA, 25 bp, E. coli
ttgaccagccgcttaacattgatgt

SEQ ID NO: 171485 - DNA, 25 bp, E. coli
tttttgatatcgcaatggacctggg

SEQ ID NO: 171486 - DNA, 25 bp, E. coli
ttttccgtcggctgtttgatcgcac

SEQ ID NO: 171487 - DNA, 25 bp, E. coli
tgatcgcactccgagcgattatcgc

SEQ ID NO: 171488 - DNA, 25 bp, E. coli
tgatcgcactcccagcgattatcgc

SEQ ID NO: 171489 - DNA, 25 bp, E. coli
gcaccaccgagcctccgatttttga

SEQ ID NO: 171490 - DNA, 25 bp, E. coli
gcaccaccgagcgtccgatttttga

SEQ ID NO: 171491 - DNA, 25 bp, E. coli
gaaaattattcaggatcttatcgca

SEQ ID NO: 171492 - DNA, 25 bp, E. coli
gaaaattattcacgatcttatcgca

SEQ ID NO: 171493 - DNA, 25 bp, E. coli
cgcatcagacgcatggcgattacat

SEQ ID NO: 171494 - DNA, 25 bp, E. coli
cgcatcagacgcttggcgattacat

SEQ ID NO: 171495 - DNA, 25 bp, E. coli
gattgacgagcatattgaccagccg

SEQ ID NO: 171496 - DNA, 25 bp, E. coli
gatcttatcgcaaggattgacgagc

SEQ ID NO: 171497 - DNA, 25 bp, E. coli
gattgacgagcaaattgaccagccg

SEQ ID NO: 171498 - DNA, 25 bp, E. coli
gatcttatcgcatggattgacgagc

SEQ ID NO: 171499 - DNA, 25 bp, E. coli
caacgtatggcagaggctatttatc

SEQ ID NO: 171500 - DNA, 25 bp, E. coli
caacgtatggcacaggctatttatc

SEQ ID NO: 171501 - DNA, 25 bp, E. coli
cagaggctatttatcaggagaaacc

SEQ ID NO: 171502 - DNA, 25 bp, E. coli
cagaggctatttttcaggagaaacc

SEQ ID NO: 171503 - DNA, 25 bp, E. coli
tatggcagaggctatttatcaggag

SEQ ID NO: 171504 - DNA, 25 bp, E. coli
tatggcagaggcaatttatcaggag

SEQ ID NO: 171505 - DNA, 25 bp, E. coli
tatcaggagaaagcagatatgccgg

SEQ ID NO: 171506 - DNA, 25 bp, E. coli
tatcaggagaaaccagatatgccgg

SEQ ID NO: 171507 - DNA, 25 bp, E. coli
tgcttcagcctctgccacaacgtat

SEQ ID NO: 171508 - DNA, 25 bp, E. coli
tgcttcagcctcagccacaacgtat

SEQ ID NO: 171509 - DNA, 25 bp, E. coli
tgccacaacgtatggcagaggctat

SEQ ID NO: 171510 - DNA, 25 bp, E. coli
tgccacaacgtaaggcagaggctat

SEQ ID NO: 171511 - DNA, 25 bp, E. coli
tcaggagaaaccagatatgccgggt

SEQ ID NO: 171512 - DNA, 25 bp, E. coli
tcaggagaaacctgatatgccgggt

SEQ ID NO: 171513 - DNA, 25 bp, E. coli
tcagcctctgccacaacgtatggca

SEQ ID NO: 171514 - DNA, 25 bp, E. coli
tcagcctctgcctcaacgtatggca

SEQ ID NO: 171515 - DNA, 25 bp, E. coli
ccagatatgccgggttacacacaga

SEQ ID NO: 171516 - DNA, 25 bp, E. coli
ccagatatgccgcgttacacacaga

SEQ ID NO: 171517 - DNA, 25 bp, E. coli
gaaaccagatatcccgggttacaca

SEQ ID NO: 171518 - DNA, 25 bp, E. coli
gaaaccagatatgccgggttacaca

SEQ ID NO: 171519 - DNA, 25 bp, E. coli
ggctatttatcacgagaaaccagat

SEQ ID NO: 171520 - DNA, 25 bp, E. coli
ggctatttatcaggagaaaccagat

SEQ ID NO: 171521 - DNA, 25 bp, E. coli
ttagcgcccgcacatttgcgtttta

SEQ ID NO: 171522 - DNA, 25 bp, E. coli
ttgatctcccaggtcacggtggttc

SEQ ID NO: 171523 - DNA, 25 bp, E. coli
ttgatctcccagctcacggtggttc

SEQ ID NO: 171524 - DNA, 25 bp, E. coli
ttagcgcccgcagatttgcgtttta

SEQ ID NO: 171525 - DNA, 25 bp, E. coli
tgctggaggcgacttctctcgccgt

SEQ ID NO: 171526 - DNA, 25 bp, E. coli
tgctggaggcgagttctctcgccgt

SEQ ID NO: 171527 - DNA, 25 bp, E. coli
tcctgcacgcgcaggcaaaacacgg

SEQ ID NO: 171528 - DNA, 25 bp, E. coli
tcctgcacgcgctggcaaaacacgg

SEQ ID NO: 171529 - DNA, 25 bp, E. coli
ggaggcgacttctctcgccgtccag

SEQ ID NO: 171530 - DNA, 25 bp, E. coli
gctgcgcagcaacaataatggcgca

SEQ ID NO: 171531 - DNA, 25 bp, E. coli
ggaggcgacttcactcgccgtccag

SEQ ID NO: 171532 - DNA, 25 bp, E. coli
gctgcgcagcaagaataatggcgca

SEQ ID NO: 171533 - DNA, 25 bp, E. coli
gaacgtcagcgtaccgatcgccaat

SEQ ID NO: 171534 - DNA, 25 bp, E. coli
gaacgtcagcgttccgatcgccaat

SEQ ID NO: 171535 - DNA, 25 bp, E. coli
ctcaatgacgatgaacgccgggagc

SEQ ID NO: 171536 - DNA, 25 bp, E. coli
cggttgtatgttgatctcccaggtc

SEQ ID NO: 171537 - DNA, 25 bp, E. coli
cgtcagcgttcccatcgccaatggg

SEQ ID NO: 171538 - DNA, 25 bp, E. coli
cgtcagcgttccgatcgccaatggg

SEQ ID NO: 171539 - DNA, 25 bp, E. coli
cggttgtatgttcatctcccaggtc

SEQ ID NO: 171540 - DNA, 25 bp, E. coli
ctcaatgacgatcaacgccgggagc

SEQ ID NO: 171541 - DNA, 25 bp, E. coli
gatttacgtgctaaccttagcgccc

SEQ ID NO: 171542 - DNA, 25 bp, E. coli
gatttacgtgcttaccttagcgccc

SEQ ID NO: 171543 - DNA, 25 bp, E. coli
aatttggcatcgaaattcgcggctg

SEQ ID NO: 171544 - DNA, 25 bp, E. coli
aaccgccatgcgcgttgcagcaggg

SEQ ID NO: 171545 - DNA, 25 bp, E. coli
aaccgccatgcgggttgcagcaggg

SEQ ID NO: 171546 - DNA, 25 bp, E. coli
aatttggcatcgtaattcgcggctg

SEQ ID NO: 171547 - DNA, 25 bp, E. coli
atttggcatcgaaattcgcggctgc

SEQ ID NO: 171548 - DNA, 25 bp, E. coli
atttggcatcgatattcgcggctgc

SEQ ID NO: 171549 - DNA, 25 bp, E. coli
aaatttggcatccaaattcgcggct

SEQ ID NO: 171550 - DNA, 25 bp, E. coli
aaatttggcatcgaaattcgcggct

SEQ ID NO: 171551 - DNA, 25 bp, E. coli
tttggcatcgaatttcgcggctgcc

SEQ ID NO: 171552 - DNA, 25 bp, E. coli
tttggcatcgaaattcgcggctgcc

SEQ ID NO: 171553 - DNA, 25 bp, E. coli
ttggcatcgaaaatcgcggctgcct

SEQ ID NO: 171554 - DNA, 25 bp, E. coli
ttggcatcgaaattcgcggctgcct

SEQ ID NO: 171555 - DNA, 25 bp, E. coli
gcatcgaaattcccggctgcctgac

SEQ ID NO: 171556 - DNA, 25 bp, E. coli
gcttggtgagcccgtctttgatcgc

SEQ ID NO: 171557 - DNA, 25 bp, E. coli
gcatcgaaattcgcggctgcctgac

SEQ ID NO: 171558 - DNA, 25 bp, E. coli
gcttggtgagccggtctttgatcgc

SEQ ID NO: 171559 - DNA, 25 bp, E. coli
cgggcttggtgagccggtctttgat

SEQ ID NO: 171560 - DNA, 25 bp, E. coli
cgggcttggtgacccggtctttgat

SEQ ID NO: 171561 - DNA, 25 bp, E. coli
ggcatcgaaattggcggctgcctga

SEQ ID NO: 171562 - DNA, 25 bp, E. coli
ggcatcgaaattcgcggctgcctga

SEQ ID NO: 171563 - DNA, 25 bp, E. coli
tggcatcgaaatacgcggctgcctg

SEQ ID NO: 171564 - DNA, 25 bp, E. coli
tggcatcgaaattcgcggctgcctg

SEQ ID NO: 171565 - DNA, 25 bp, E. coli
caatcctggcgttttgtgctggcga

SEQ ID NO: 171566 - DNA, 25 bp, E. coli
aatggtaaacgcctgaccgggatca

SEQ ID NO: 171567 - DNA, 25 bp, E. coli
caatcctggcgtattgtgctggcga

SEQ ID NO: 171568 - DNA, 25 bp, E. coli
aatggtaaacgcgtgaccgggatca

SEQ ID NO: 171569 - DNA, 25 bp, E. coli
cactatcttctggtggacgaacgcc

SEQ ID NO: 171570 - DNA, 25 bp, E. coli
cactatcttctgctggacgaacgcc

SEQ ID NO: 171571 - DNA, 25 bp, E. coli
taaagaacgcgttgaagcaccacct

SEQ ID NO: 171572 - DNA, 25 bp, E. coli
taaagaacgcgtagaagcaccacct

SEQ ID NO: 171573 - DNA, 25 bp, E. coli
tatcgcggtcctttccgtggtggca

SEQ ID NO: 171574 - DNA, 25 bp, E. coli
tatcggctggatgctggcttatggc

SEQ ID NO: 171575 - DNA, 25 bp, E. coli
tatcggctggatcctggcttatggc

SEQ ID NO: 171576 - DNA, 25 bp, E. coli
tatcgcggtcctatccgtggtggca

SEQ ID NO: 171577 - DNA, 25 bp, E. coli
tgatatctggcaaaacgaccagtgg

SEQ ID NO: 171578 - DNA, 25 bp, E. coli
tgatatctggcataacgaccagtgg

SEQ ID NO: 171579 - DNA, 25 bp, E. coli
tgaaaaccgttatggaacagctggc

SEQ ID NO: 171580 - DNA, 25 bp, E. coli
tgaaaaccgttaaggaacagctggc

SEQ ID NO: 171581 - DNA, 25 bp, E. coli
tctactgttctgttgatgccactgg

SEQ ID NO: 171582 - DNA, 25 bp, E. coli
tctactgttctgatgatgccactgg

SEQ ID NO: 171583 - DNA, 25 bp, E. coli
gatcgtctgtgtactggcctatagc

SEQ ID NO: 171584 - DNA, 25 bp, E. coli
gatcgtctgtgttctggcctatagc

SEQ ID NO: 171585 - DNA, 25 bp, E. coli
gagacgccgccacccacattatttt

SEQ ID NO: 171586 - DNA, 25 bp, E. coli
gagacgccgccagccacattatttt

SEQ ID NO: 171587 - DNA, 25 bp, E. coli
caatgaggacactactttcggtgaa

SEQ ID NO: 171588 - DNA, 25 bp, E. coli
caatgaggacacaactttcggtgaa

SEQ ID NO: 171589 - DNA, 25 bp, E. coli
caggtttgtctgtggataccgctta

SEQ ID NO: 171590 - DNA, 25 bp, E. coli
caggtttgtctgaggataccgctta

SEQ ID NO: 171591 - DNA, 25 bp, E. coli
caggctgtttgctaaactcaggagg

SEQ ID NO: 171592 - DNA, 25 bp, E. coli
caggctgtttgcaaaactcaggagg

SEQ ID NO: 171593 - DNA, 25 bp, E. coli
tattgatttgaatgggcaagctgcc

SEQ ID NO: 171594 - DNA, 25 bp, E. coli
tattgatttgaaagggcaagctgcc

SEQ ID NO: 171595 - DNA, 25 bp, E. coli
tcaggaggtaagcaatgaggacact

SEQ ID NO: 171596 - DNA, 25 bp, E. coli
tcaggaggtaaggaatgaggacact

SEQ ID NO: 171597 - DNA, 25 bp, E. coli
tctttgagaaggtcgagcagaacgc

SEQ ID NO: 171598 - DNA, 25 bp, E. coli
tctttgagaaggacgagcagaacgc

SEQ ID NO: 171599 - DNA, 25 bp, E. coli
cctggaaatgcagaaaagtaaactc

SEQ ID NO: 171600 - DNA, 25 bp, E. coli
cctggaaatgcacaaaagtaaactc

SEQ ID NO: 171601 - DNA, 25 bp, E. coli
gctatgcaggtgtctttatccaggc

SEQ ID NO: 171602 - DNA, 25 bp, E. coli
gctatgcaggtgactttatccaggc

SEQ ID NO: 171603 - DNA, 25 bp, E. coli
gaacgcctgaaaatatgcctttccc

SEQ ID NO: 171604 - DNA, 25 bp, E. coli
gaacgcctgaaattatgcctttccc

SEQ ID NO: 171605 - DNA, 25 bp, E. coli
gtgtatgagcgctcaatagccaggg

SEQ ID NO: 171606 - DNA, 25 bp, E. coli
gtgtatgagcgcacaatagccaggg

SEQ ID NO: 171607 - DNA, 25 bp, E. coli
ggagttaaagtcacctgctatgcag

SEQ ID NO: 171608 - DNA, 25 bp, E. coli
ggagttaaagtctcctgctatgcag

SEQ ID NO: 171609 - DNA, 25 bp, E. coli
catccctggtaaaagagctgcgtga

SEQ ID NO: 171610 - DNA, 25 bp, E. coli
catccctggtaatagagctgcgtga

SEQ ID NO: 171611 - DNA, 25 bp, E. coli
taacggcgacatggagctggcaatc

SEQ ID NO: 171612 - DNA, 25 bp, E. coli
tatcgcgatgcagtctggtaagccg

SEQ ID NO: 171613 - DNA, 25 bp, E. coli
tatcgcgatgcactctggtaagccg

SEQ ID NO: 171614 - DNA, 25 bp, E. coli
tgttgctggcaatatcactgacgtt

SEQ ID NO: 171615 - DNA, 25 bp, E. coli
tgttgctggcaaaatcactgacgtt

SEQ ID NO: 171616 - DNA, 25 bp, E. coli
tgacgaagagctggttaaacacatc

SEQ ID NO: 171617 - DNA, 25 bp, E. coli
tgacttcgttgcaaaagacgctggt

SEQ ID NO: 171618 - DNA, 25 bp, E. coli
tgacgaagagctcgttaaacacatc

SEQ ID NO: 171619 - DNA, 25 bp, E. coli
tgacttcgttgctaaagacgctggt

SEQ ID NO: 171620 - DNA, 25 bp, E. coli
tcgaaaacatgcctaagtccggtgc

SEQ ID NO: 171621 - DNA, 25 bp, E. coli
tcgaaaacatgcgtaagtccggtgc

SEQ ID NO: 171622 - DNA, 25 bp, E. coli
tctggttgctgctaaaggcgctgac

SEQ ID NO: 171623 - DNA, 25 bp, E. coli
tctggttgctgcaaaaggcgctgac

SEQ ID NO: 171624 - DNA, 25 bp, E. coli
gcaaaactgttgctcagctgctgaa

SEQ ID NO: 171625 - DNA, 25 bp, E. coli
gcaaaactgttggtcagctgctgaa

SEQ ID NO: 171626 - DNA, 25 bp, E. coli
ggtgaaaacatcaacattcgccgcg

SEQ ID NO: 171627 - DNA, 25 bp, E. coli
ggtgaaaacatctacattcgccgcg

SEQ ID NO: 171628 - DNA, 25 bp, E. coli
ggcaactacggcatcattctggaag

SEQ ID NO: 171629 - DNA, 25 bp, E. coli
ggcaactacggcttcattctggaag

SEQ ID NO: 171630 - DNA, 25 bp, E. coli
taacggcgacatcgagctggcaatc

SEQ ID NO: 171631 - DNA, 25 bp, E. coli
aagatgctacgcctttatgtatcga

SEQ ID NO: 171632 - DNA, 25 bp, E. coli
aagatgctacgcgtttatgtatcga

SEQ ID NO: 171633 - DNA, 25 bp, E. coli
caaagctaaatatgcgcggtggcta

SEQ ID NO: 171634 - DNA, 25 bp, E. coli
caaagctaaataagcgcggtggcta

SEQ ID NO: 171635 - DNA, 25 bp, E. coli
aacacccagtagcacgcgtacgtga

SEQ ID NO: 171636 - DNA, 25 bp, E. coli
aacacccagtaggacgcgtacgtga

SEQ ID NO: 171637 - DNA, 25 bp, E. coli
tatgtatcgatagctgcattgcgcg

SEQ ID NO: 171638 - DNA, 25 bp, E. coli
tatgtatcgatacctgcattgcgcg

SEQ ID NO: 171639 - DNA, 25 bp, E. coli
ttagccagaaggtagatgctacgcg

SEQ ID NO: 171640 - DNA, 25 bp, E. coli
ttagccagaaggaagatgctacgcg

SEQ ID NO: 171641 - DNA, 25 bp, E. coli
tgcacttcagccaattagccagaag

SEQ ID NO: 171642 - DNA, 25 bp, E. coli
tgcacttcagcctattagccagaag

SEQ ID NO: 171643 - DNA, 25 bp, E. coli
gccaacgaaatctaacacccagtag

SEQ ID NO: 171644 - DNA, 25 bp, E. coli
gccaacgaaatcaaacacccagtag

SEQ ID NO: 171645 - DNA, 25 bp, E. coli
cgatgcagacacttaaatatttgaa

SEQ ID NO: 171646 - DNA, 25 bp, E. coli
cgatgcagacacataaatatttgaa

SEQ ID NO: 171647 - DNA, 25 bp, E. coli
gatacctgcattgcgcgcaactggc

SEQ ID NO: 171648 - DNA, 25 bp, E. coli
gatacctgcattccgcgcaactggc

SEQ ID NO: 171649 - DNA, 25 bp, E. coli
gttaccgtatcaccaaagctaaata

SEQ ID NO: 171650 - DNA, 25 bp, E. coli
gttaccgtatcagcaaagctaaata

SEQ ID NO: 171651 - DNA, 25 bp, E. coli
taaatatgcgcggtggctatgaagt

SEQ ID NO: 171652 - DNA, 25 bp, E. coli
taaatatgcgcgctggctatgaagt

SEQ ID NO: 171653 - DNA, 25 bp, E. coli
aaataatcccaatattgaacaggct

SEQ ID NO: 171654 - DNA, 25 bp, E. coli
aaataatcccaaaattgaacaggct

SEQ ID NO: 171655 - DNA, 25 bp, E. coli
tatacggtattgcatttaacaatgc

SEQ ID NO: 171656 - DNA, 25 bp, E. coli
tatacggtattggatttaacaatgc

SEQ ID NO: 171657 - DNA, 25 bp, E. coli
tttaacaatgcgactaagcaagcat

SEQ ID NO: 171658 - DNA, 25 bp, E. coli
tttaacaatgcgtctaagcaagcat

SEQ ID NO: 171659 - DNA, 25 bp, E. coli
tcgttgccagcagagaggatatcgc

SEQ ID NO: 171660 - DNA, 25 bp, E. coli
tcgttgccagcacagaggatatcgc

SEQ ID NO: 171661 - DNA, 25 bp, E. coli
tcatcaagcatgacagatcgttgcc

SEQ ID NO: 171662 - DNA, 25 bp, E. coli
tcatcaagcatgtcagatcgttgcc

SEQ ID NO: 171663 - DNA, 25 bp, E. coli
cctggtaatgacaggttcaattccg

SEQ ID NO: 171664 - DNA, 25 bp, E. coli
cctggtaatgactggttcaattccg

SEQ ID NO: 171665 - DNA, 25 bp, E. coli
cctggcgtaaatgttaactaatggg

SEQ ID NO: 171666 - DNA, 25 bp, E. coli
gaacaggctttttatctacctggta

SEQ ID NO: 171667 - DNA, 25 bp, E. coli
gaacaggcttttaatctacctggta

SEQ ID NO: 171668 - DNA, 25 bp, E. coli
cctggcgtaaatcttaactaatggg

SEQ ID NO: 171669 - DNA, 25 bp, E. coli
gattttttcaagttgatcctggcgt

SEQ ID NO: 171670 - DNA, 25 bp, E. coli
gattttttcaagatgatcctggcgt

SEQ ID NO: 171671 - DNA, 25 bp, E. coli
ggttcaattccgttttcatcaagca

SEQ ID NO: 171672 - DNA, 25 bp, E. coli
ggttcaattccgatttcatcaagca

SEQ ID NO: 171673 - DNA, 25 bp, E. coli
gaggatatcgctcttacataccgaa

SEQ ID NO: 171674 - DNA, 25 bp, E. coli
gaggatatcgctgttacataccgaa

SEQ ID NO: 171675 - DNA, 25 bp, E. coli
atacgttcgttggagtaccgcacat

SEQ ID NO: 171676 - DNA, 25 bp, E. coli
atgctcccgaactgcagacaaccga

SEQ ID NO: 171677 - DNA, 25 bp, E. coli
atacgttcgttgcagtaccgcacat

SEQ ID NO: 171678 - DNA, 25 bp, E. coli
ggtaccggttatgtgttacgtactg

SEQ ID NO: 171679 - DNA, 25 bp, E. coli
ggtaccggttatctgttacgtactg

SEQ ID NO: 171680 - DNA, 25 bp, E. coli
atgctcccgaacagcagacaaccga

SEQ ID NO: 171681 - DNA, 25 bp, E. coli
ttactgcccttaccgacatacgttc

SEQ ID NO: 171682 - DNA, 25 bp, E. coli
ttactgcccttagcgacatacgttc

SEQ ID NO: 171683 - DNA, 25 bp, E. coli
ttacgtactgatccgtggtcgtatc

SEQ ID NO: 171684 - DNA, 25 bp, E. coli
ttacgtactgatgcgtggtcgtatc

SEQ ID NO: 171685 - DNA, 25 bp, E. coli
tctcatccggtgttatggcgtcggt

SEQ ID NO: 171686 - DNA, 25 bp, E. coli
tctcatccggtgatatggcgtcggt

SEQ ID NO: 171687 - DNA, 25 bp, E. coli
ccagtgcaggatctctgccgggcct

SEQ ID NO: 171688 - DNA, 25 bp, E. coli
gcttaaacgtcttggcctgtcaaaa

SEQ ID NO: 171689 - DNA, 25 bp, E. coli
ccagtgcaggatgtctgccgggcct

SEQ ID NO: 171690 - DNA, 25 bp, E. coli
gcttaaacgtctaggcctgtcaaaa

SEQ ID NO: 171691 - DNA, 25 bp, E. coli
gacatacgttcgatgcagtaccgca

SEQ ID NO: 171692 - DNA, 25 bp, E. coli
gacatacgttcgttgcagtaccgca

SEQ ID NO: 171693 - DNA, 25 bp, E. coli
cgtctggttgtctctctcatccggt

SEQ ID NO: 171694 - DNA, 25 bp, E. coli
cgtctggttgtcactctcatccggt

SEQ ID NO: 171695 - DNA, 25 bp, E. coli
tggttgtcactctcatccggtgtta

SEQ ID NO: 171696 - DNA, 25 bp, E. coli
tggttgtcactcacatccggtgtta

SEQ ID NO: 171697 - DNA, 25 bp, E. coli
atgtcgatgcggtgatctggaacgt

SEQ ID NO: 171698 - DNA, 25 bp, E. coli
atgtcgatgcggagatctggaacgt

SEQ ID NO: 171699 - DNA, 25 bp, E. coli
ttaaaggcgatgtcgatgcggtgat

SEQ ID NO: 171700 - DNA, 25 bp, E. coli
ttaaaggcgatgacgatgcggtgat

SEQ ID NO: 171701 - DNA, 25 bp, E. coli
tgtagataaacacgccctgctcgcc

SEQ ID NO: 171702 - DNA, 25 bp, E. coli
tgtctgcttaatggcgtgtatgaca

SEQ ID NO: 171703 - DNA, 25 bp, E. coli
tgtagataaacaggccctgctcgcc

SEQ ID NO: 171704 - DNA, 25 bp, E. coli
tgtctgcttaatcgcgtgtatgaca

SEQ ID NO: 171705 - DNA, 25 bp, E. coli
tgcggtgatctggaacgtggtggcg

SEQ ID NO: 171706 - DNA, 25 bp, E. coli
tgcggtgatctgcaacgtggtggcg

SEQ ID NO: 171707 - DNA, 25 bp, E. coli
tcgcgtggagtgactgcttaatggc

SEQ ID NO: 171708 - DNA, 25 bp, E. coli
tgccgttgtagaaaaacacgccctg

SEQ ID NO: 171709 - DNA, 25 bp, E. coli
tgccgttgtagataaacacgccctg

SEQ ID NO: 171710 - DNA, 25 bp, E. coli
tcgcgtggagtgtctgcttaatggc

SEQ ID NO: 171711 - DNA, 25 bp, E. coli
gctgcgtgccgtagtagataaacac

SEQ ID NO: 171712 - DNA, 25 bp, E. coli
gctgcgtgccgttgtagataaacac

SEQ ID NO: 171713 - DNA, 25 bp, E. coli
ctgctcgcccatcaacaacgggtag

SEQ ID NO: 171714 - DNA, 25 bp, E. coli
ctgctcgcccatgaacaacgggtag

SEQ ID NO: 171715 - DNA, 25 bp, E. coli
gttgtagataaacacgccctgctcg

SEQ ID NO: 171716 - DNA, 25 bp, E. coli
gttgtagataaagacgccctgctcg

SEQ ID NO: 171717 - DNA, 25 bp, E. coli
tggagtgtctgcttaatggcgtgta

SEQ ID NO: 171718 - DNA, 25 bp, E. coli
tggagtgtctgcataatggcgtgta

SEQ ID NO: 171719 - DNA, 25 bp, E. coli
agatggtatttcaatttccacccca

SEQ ID NO: 171720 - DNA, 25 bp, E. coli
agatggtatttctatttccacccca

SEQ ID NO: 171721 - DNA, 25 bp, E. coli
taggcagtggccactttaaataagg

SEQ ID NO: 171722 - DNA, 25 bp, E. coli
tatccatcacccgataatatagtgc

SEQ ID NO: 171723 - DNA, 25 bp, E. coli
tatccatcaccccataatatagtgc

SEQ ID NO: 171724 - DNA, 25 bp, E. coli
tatgcctgatagaaacgtaaacctg

SEQ ID NO: 171725 - DNA, 25 bp, E. coli
tatgcctgatagtaacgtaaacctg

SEQ ID NO: 171726 - DNA, 25 bp, E. coli
taggcagtggcctctttaaataagg

SEQ ID NO: 171727 - DNA, 25 bp, E. coli
tattctggtaatgatttgataagcg

SEQ ID NO: 171728 - DNA, 25 bp, E. coli
tatatctttttcattaggcagtggc

SEQ ID NO: 171729 - DNA, 25 bp, E. coli
tattctggtaatcatttgataagcg

SEQ ID NO: 171730 - DNA, 25 bp, E. coli
tatatctttttctttaggcagtggc

SEQ ID NO: 171731 - DNA, 25 bp, E. coli
tcctttctgttttggtgaactcagt

SEQ ID NO: 171732 - DNA, 25 bp, E. coli
tcctttctgtttaggtgaactcagt

SEQ ID NO: 171733 - DNA, 25 bp, E. coli
tcatctgattctcaggtgatatgcc

SEQ ID NO: 171734 - DNA, 25 bp, E. coli
tcatctgattctgaggtgatatgcc

SEQ ID NO: 171735 - DNA, 25 bp, E. coli
cctctttaaataaggcgtgtgtgac

SEQ ID NO: 171736 - DNA, 25 bp, E. coli
cctctttaaatatggcgtgtgtgac

SEQ ID NO: 171737 - DNA, 25 bp, E. coli
gataagcgaattgttttaccagatg

SEQ ID NO: 171738 - DNA, 25 bp, E. coli
gggcgtgacatgtatatccatcacc

SEQ ID NO: 171739 - DNA, 25 bp, E. coli
gggcgtgacatgaatatccatcacc

SEQ ID NO: 171740 - DNA, 25 bp, E. coli
gataagcgaattcttttaccagatg

SEQ ID NO: 171741 - DNA, 25 bp, E. coli
aattcaacctgggtcaacggtcagc

SEQ ID NO: 171742 - DNA, 25 bp, E. coli
aattcaacctggctcaacggtcagc

SEQ ID NO: 171743 - DNA, 25 bp, E. coli
taccggcagacttttgaaacgatcg

SEQ ID NO: 171744 - DNA, 25 bp, E. coli
taccgtggatggtcgaagacgaact

SEQ ID NO: 171745 - DNA, 25 bp, E. coli
taccggcagactattgaaacgatcg

SEQ ID NO: 171746 - DNA, 25 bp, E. coli
taccgtggatggacgaagacgaact

SEQ ID NO: 171747 - DNA, 25 bp, E. coli
tataggtatcgatttaggcggcacc

SEQ ID NO: 171748 - DNA, 25 bp, E. coli
tatcgtcgtttgagcggacatgcgc

SEQ ID NO: 171749 - DNA, 25 bp, E. coli
tatcgtcgtttgtgcggacatgcgc

SEQ ID NO: 171750 - DNA, 25 bp, E. coli
tataggtatcgaattaggcggcacc

SEQ ID NO: 171751 - DNA, 25 bp, E. coli
ccacgttggttgttatggcggagca

SEQ ID NO: 171752 - DNA, 25 bp, E. coli
cctggttgaagaaagcgatccggta

SEQ ID NO: 171753 - DNA, 25 bp, E. coli
cctggttgaagatagcgatccggta

SEQ ID NO: 171754 - DNA, 25 bp, E. coli
ccacgttggttgatatggcggagca

SEQ ID NO: 171755 - DNA, 25 bp, E. coli
cattgcgtcgcttcgagctgcggct

SEQ ID NO: 171756 - DNA, 25 bp, E. coli
cattgcgtcgctacgagctgcggct

SEQ ID NO: 171757 - DNA, 25 bp, E. coli
ggagcagttgtaccgccatcgtctg

SEQ ID NO: 171758 - DNA, 25 bp, E. coli
ggagcagttgtagcgccatcgtctg

SEQ ID NO: 171759 - DNA, 25 bp, E. coli
tgcgttatcgcgaggaagtcccttg

SEQ ID NO: 171760 - DNA, 25 bp, E. coli
tgcgttatcgcgtggaagtcccttg

SEQ ID NO: 171761 - DNA, 25 bp, E. coli
tggcaaaatcgcaggcacatgtcgt

SEQ ID NO: 171762 - DNA, 25 bp, E. coli
tggcaaaatcgctggcacatgtcgt

SEQ ID NO: 171763 - DNA, 25 bp, E. coli
cagacaatggcttaggtattccggc

SEQ ID NO: 171764 - DNA, 25 bp, E. coli
catcgctggaagagaatccggtggc

SEQ ID NO: 171765 - DNA, 25 bp, E. coli
cagacaatggctaaggtattccggc

SEQ ID NO: 171766 - DNA, 25 bp, E. coli
catcgctggaagtgaatccggtggc

SEQ ID NO: 171767 - DNA, 25 bp, E. coli
tatatatgccaagccagtgccagta

SEQ ID NO: 171768 - DNA, 25 bp, E. coli
tatcagcagtttcgatgtgcgagac

SEQ ID NO: 171769 - DNA, 25 bp, E. coli
tatatatgccaacccagtgccagta

SEQ ID NO: 171770 - DNA, 25 bp, E. coli
tatcagcagtttggatgtgcgagac

SEQ ID NO: 171771 - DNA, 25 bp, E. coli
tgctgacagttggttatcaaagggt

SEQ ID NO: 171772 - DNA, 25 bp, E. coli
tgctgacagttgcttatcaaagggt

SEQ ID NO: 171773 - DNA, 25 bp, E. coli
ccggtggcatgggtgcattcagaca

SEQ ID NO: 171774 - DNA, 25 bp, E. coli
ccaatggagattcatatgagcactt

SEQ ID NO: 171775 - DNA, 25 bp, E. coli
ccggtggcatggctgcattcagaca

SEQ ID NO: 171776 - DNA, 25 bp, E. coli
ccaatggagattgatatgagcactt

SEQ ID NO: 171777 - DNA, 25 bp, E. coli
cgaggagtaaaatcattgctgacag

SEQ ID NO: 171778 - DNA, 25 bp, E. coli
cgaggagtaaaaacattgctgacag

SEQ ID NO: 171779 - DNA, 25 bp, E. coli
gatatgagcacttttaccgacaaag

SEQ ID NO: 171780 - DNA, 25 bp, E. coli
gatatgagcactattaccgacaaag

SEQ ID NO: 171781 - DNA, 25 bp, E. coli
ggtattccggcaataacgaggagta

SEQ ID NO: 171782 - DNA, 25 bp, E. coli
ggtattccggcattaacgaggagta

SEQ ID NO: 171783 - DNA, 25 bp, E. coli
gatgtgcgagacaatgttgagcgcc

SEQ ID NO: 171784 - DNA, 25 bp, E. coli
gatgtgcgagactatgttgagcgcc

SEQ ID NO: 171785 - DNA, 25 bp, E. coli
cattgccagtgcagcaacatcagta

SEQ ID NO: 171786 - DNA, 25 bp, E. coli
cattgccagtgctgcaacatcagta

SEQ ID NO: 171787 - DNA, 25 bp, E. coli
acagcaaccgcgatgccgaattcct

SEQ ID NO: 171788 - DNA, 25 bp, E. coli
acagcaaccgcgttgccgaattcct

SEQ ID NO: 171789 - DNA, 25 bp, E. coli
tgccgaattcctctttacctcaatg

SEQ ID NO: 171790 - DNA, 25 bp, E. coli
tgccgaattcctgtttacctcaatg

SEQ ID NO: 171791 - DNA, 25 bp, E. coli
tcggcacggttggagaaaccgtatg

SEQ ID NO: 171792 - DNA, 25 bp, E. coli
tcggcacggttgcagaaaccgtatg

SEQ ID NO: 171793 - DNA, 25 bp, E. coli
ccgaacagtatgctgtgcagcaggc

SEQ ID NO: 171794 - DNA, 25 bp, E. coli
gctgcaacatcagtattgattggct

SEQ ID NO: 171795 - DNA, 25 bp, E. coli
gctgcaacatcactattgattggct

SEQ ID NO: 171796 - DNA, 25 bp, E. coli
gaaaccgtatgccatggtgtgcatc

SEQ ID NO: 171797 - DNA, 25 bp, E. coli
gaaaccgtatgcgatggtgtgcatc

SEQ ID NO: 171798 - DNA, 25 bp, E. coli
cgatggatgtgatggaagaattatt

SEQ ID NO: 171799 - DNA, 25 bp, E. coli
cgcgatgccgaattcctgtttacct

SEQ ID NO: 171800 - DNA, 25 bp, E. coli
cgatggatgtgaaggaagaattatt

SEQ ID NO: 171801 - DNA, 25 bp, E. coli
ccgaacagtatggtgtgcagcaggc

SEQ ID NO: 171802 - DNA, 25 bp, E. coli
cgcgatgccgaaatcctgtttacct

SEQ ID NO: 171803 - DNA, 25 bp, E. coli
ggatcagttctggtcgccgtccgaa

SEQ ID NO: 171804 - DNA, 25 bp, E. coli
ggatcagttctgctcgccgtccgaa

SEQ ID NO: 171805 - DNA, 25 bp, E. coli
tggtcgccgtccgaacagtatggtg

SEQ ID NO: 171806 - DNA, 25 bp, E. coli
tggtcgccgtcccaacagtatggtg

SEQ ID NO: 171807 - DNA, 25 bp, E. coli
aattcgctacttagctgggcttcag

SEQ ID NO: 171808 - DNA, 25 bp, E. coli
aattcgctactttgctgggcttcag

SEQ ID NO: 171809 - DNA, 25 bp, E. coli
tttgcggatggtgtgcgccagctca

SEQ ID NO: 171810 - DNA, 25 bp, E. coli
tttgcggatggtctgcgccagctca

SEQ ID NO: 171811 - DNA, 25 bp, E. coli
tcaggcgacggttcagagagcgaat

SEQ ID NO: 171812 - DNA, 25 bp, E. coli
tcaggcgacggtacagagagcgaat

SEQ ID NO: 171813 - DNA, 25 bp, E. coli
ccatggatggctcttcaggatgttc

SEQ ID NO: 171814 - DNA, 25 bp, E. coli
ccatggatggctgttcaggatgttc

SEQ ID NO: 171815 - DNA, 25 bp, E. coli
gaataaaccgggacgatatccacga

SEQ ID NO: 171816 - DNA, 25 bp, E. coli
gaataaaccgggtcgatatccacga

SEQ ID NO: 171817 - DNA, 25 bp, E. coli
cgagataacctaacagggaatggcg

SEQ ID NO: 171818 - DNA, 25 bp, E. coli
cgagataacctatcagggaatggcg

SEQ ID NO: 171819 - DNA, 25 bp, E. coli
gatatccacgacgactccgagataa

SEQ ID NO: 171820 - DNA, 25 bp, E. coli
gatatccacgaccactccgagataa

SEQ ID NO: 171821 - DNA, 25 bp, E. coli
ggagcggcgcgatgctcgtcattca

SEQ ID NO: 171822 - DNA, 25 bp, E. coli
ggatgttcatccagcaattcgctac

SEQ ID NO: 171823 - DNA, 25 bp, E. coli
ggatgttcatcctgcaattcgctac

SEQ ID NO: 171824 - DNA, 25 bp, E. coli
ggagcggcgcgaagctcgtcattca

SEQ ID NO: 171825 - DNA, 25 bp, E. coli
tggccgataccgtatttgctggcaa

SEQ ID NO: 171826 - DNA, 25 bp, E. coli
tggccgataccgaatttgctggcaa

SEQ ID NO: 171827 - DNA, 25 bp, E. coli
tcagccaggtaggtatgaaccggta

SEQ ID NO: 171828 - DNA, 25 bp, E. coli
tcagccaggtagctatgaaccggta

SEQ ID NO: 171829 - DNA, 25 bp, E. coli
caaagtaacgttcagttacatggca

SEQ ID NO: 171830 - DNA, 25 bp, E. coli
caaacatcattatcaaagtaacgtt

SEQ ID NO: 171831 - DNA, 25 bp, E. coli
caaagtaacgttgagttacatggca

SEQ ID NO: 171832 - DNA, 25 bp, E. coli
caaacatcattaacaaagtaacgtt

SEQ ID NO: 171833 - DNA, 25 bp, E. coli
catcattaacaatgtaacgttcagt

SEQ ID NO: 171834 - DNA, 25 bp, E. coli
catcattaacaaagtaacgttcagt

SEQ ID NO: 171835 - DNA, 25 bp, E. coli
tacatggcattggatcaaaatctca

SEQ ID NO: 171836 - DNA, 25 bp, E. coli
tacatggcattgcatcaaaatctca

SEQ ID NO: 171837 - DNA, 25 bp, E. coli
taacgttcagtttcatggcattgca

SEQ ID NO: 171838 - DNA, 25 bp, E. coli
tagtaaaaaacatacaaacatcatt

SEQ ID NO: 171839 - DNA, 25 bp, E. coli
tagtaaaaaacaaacaaacatcatt

SEQ ID NO: 171840 - DNA, 25 bp, E. coli
tgaatgtaatacttagtaaaaaaca

SEQ ID NO: 171841 - DNA, 25 bp, E. coli
tgaatgtaatacatagtaaaaaaca

SEQ ID NO: 171842 - DNA, 25 bp, E. coli
tcagttacatgggattgcatcaaaa

SEQ ID NO: 171843 - DNA, 25 bp, E. coli
tcagttacatggcattgcatcaaaa

SEQ ID NO: 171844 - DNA, 25 bp, E. coli
gcatcaaaatctcatcatcatgcaa

SEQ ID NO: 171845 - DNA, 25 bp, E. coli
gcatcaaaatctgatcatcatgcaa

SEQ ID NO: 171846 - DNA, 25 bp, E. coli
cgttcagttacaaggcattgcatca

SEQ ID NO: 171847 - DNA, 25 bp, E. coli
cgttcagttacatggcattgcatca

SEQ ID NO: 171848 - DNA, 25 bp, E. coli
tggcattgcatcaaaatctcatcat

SEQ ID NO: 171849 - DNA, 25 bp, E. coli
tggcattgcatctaaatctcatcat

SEQ ID NO: 171850 - DNA, 25 bp, E. coli
taacgttcagttacatggcattgca

SEQ ID NO: 171851 - DNA, 25 bp, E. coli
caagcatctgttttctttccgacat

SEQ ID NO: 171852 - DNA, 25 bp, E. coli
caatgttatggctgtggatatatcg

SEQ ID NO: 171853 - DNA, 25 bp, E. coli
caatgttatggcagtggatatatcg

SEQ ID NO: 171854 - DNA, 25 bp, E. coli
caagcatctgttatctttccgacat

SEQ ID NO: 171855 - DNA, 25 bp, E. coli
tcagataacgcatataattcgcaat

SEQ ID NO: 171856 - DNA, 25 bp, E. coli
cctacattcaggaaaaaggctggaa

SEQ ID NO: 171857 - DNA, 25 bp, E. coli
ccgacataccaaccatgtatcattg

SEQ ID NO: 171858 - DNA, 25 bp, E. coli
cctacattcaggtaaaaggctggaa

SEQ ID NO: 171859 - DNA, 25 bp, E. coli
gcattgaaaatggtaaaaaacaggg

SEQ ID NO: 171860 - DNA, 25 bp, E. coli
gcattgaaaatgctaaaaaacaggg

SEQ ID NO: 171861 - DNA, 25 bp, E. coli
ccgacataccaagcatgtatcattg

SEQ ID NO: 171862 - DNA, 25 bp, E. coli
ctggaaatggtaacaatgttatggc

SEQ ID NO: 171863 - DNA, 25 bp, E. coli
ctggaaatggtatcaatgttatggc

SEQ ID NO: 171864 - DNA, 25 bp, E. coli
ggatatatcgtataacaagcatctg

SEQ ID NO: 171865 - DNA, 25 bp, E. coli
ggtatactagttcaactgtctgaaa

SEQ ID NO: 171866 - DNA, 25 bp, E. coli
ggatatatcgtaaaacaagcatctg

SEQ ID NO: 171867 - DNA, 25 bp, E. coli
gggtactcagacgaatcagtcttgc

SEQ ID NO: 171868 - DNA, 25 bp, E. coli
ggtatactagttgaactgtctgaaa

SEQ ID NO: 171869 - DNA, 25 bp, E. coli
gggtactcagaccaatcagtcttgc

SEQ ID NO: 171870 - DNA, 25 bp, E. coli
tcagataacgcaaataattcgcaat

SEQ ID NO: 171871 - DNA, 25 bp, E. coli
gatgctgaacaagaatgtattggta

SEQ ID NO: 171872 - DNA, 25 bp, E. coli
gatgctgaacaacaatgtattggta

SEQ ID NO: 171873 - DNA, 25 bp, E. coli
cacggttaggtctatggcagggaaa

SEQ ID NO: 171874 - DNA, 25 bp, E. coli
cacggttaggtcaatggcagggaaa

SEQ ID NO: 171875 - DNA, 25 bp, E. coli
tatcgtactcatggtgacgacggca

SEQ ID NO: 171876 - DNA, 25 bp, E. coli
tatcgtactcatcgtgacgacggca

SEQ ID NO: 171877 - DNA, 25 bp, E. coli
tagtgatcatgcgaccgatgggtgc

SEQ ID NO: 171878 - DNA, 25 bp, E. coli
tagtgatcatgccaccgatgggtgc

SEQ ID NO: 171879 - DNA, 25 bp, E. coli
tattttatggccagctccgtagtcg

SEQ ID NO: 171880 - DNA, 25 bp, E. coli
tattttatggcctgctccgtagtcg

SEQ ID NO: 171881 - DNA, 25 bp, E. coli
tttttctggcggagggcaggcatcc

SEQ ID NO: 171882 - DNA, 25 bp, E. coli
tttttctggcggtgggcaggcatcc

SEQ ID NO: 171883 - DNA, 25 bp, E. coli
tcgtactgacgaatgttggcggcct

SEQ ID NO: 171884 - DNA, 25 bp, E. coli
tcgtactgacgattgttggcggcct

SEQ ID NO: 171885 - DNA, 25 bp, E. coli
tttggcgtcagtgcgaaaaacccga

SEQ ID NO: 171886 - DNA, 25 bp, E. coli
tttggcgtcagtccgaaaaacccga

SEQ ID NO: 171887 - DNA, 25 bp, E. coli
gacaaaatcatccagccacggttag

SEQ ID NO: 171888 - DNA, 25 bp, E. coli
gacaaaatcatcgagccacggttag

SEQ ID NO: 171889 - DNA, 25 bp, E. coli
tagcggttttgcaccacttggtgcg

SEQ ID NO: 171890 - DNA, 25 bp, E. coli
tagcggttttgctccacttggtgcg

SEQ ID NO: 171891 - DNA, 25 bp, E. coli
taatgcccgctacgccagttatatg

SEQ ID NO: 171892 - DNA, 25 bp, E. coli
taatgcccgctaggccagttatatg

SEQ ID NO: 171893 - DNA, 25 bp, E. coli
gatgagaaactggagacattgaccg

SEQ ID NO: 171894 - DNA, 25 bp, E. coli
gatgagaaactgcagacattgaccg

SEQ ID NO: 171895 - DNA, 25 bp, E. coli
tactggcgggcataagggtttgatc

SEQ ID NO: 171896 - DNA, 25 bp, E. coli
tactggcgggcaaaagggtttgatc

SEQ ID NO: 171897 - DNA, 25 bp, E. coli
agtgtccactcaacttgagcttgag

SEQ ID NO: 171898 - DNA, 25 bp, E. coli
agtgtccactcatcttgagcttgag

SEQ ID NO: 171899 - DNA, 25 bp, E. coli
aaaatagaacgctcgcgcggtcgct

SEQ ID NO: 171900 - DNA, 25 bp, E. coli
aaaatagaacgcacgcgcggtcgct

SEQ ID NO: 171901 - DNA, 25 bp, E. coli
tagttgccaactgtcattatcgcgc

SEQ ID NO: 171902 - DNA, 25 bp, E. coli
tagttgccaactctcattatcgcgc

SEQ ID NO: 171903 - DNA, 25 bp, E. coli
tgagcttgagaataaccgtggttac

SEQ ID NO: 171904 - DNA, 25 bp, E. coli
tgagcttgagaaaaaccgtggttac

SEQ ID NO: 171905 - DNA, 25 bp, E. coli
ccataaacaggtaaaggcagagccg

SEQ ID NO: 171906 - DNA, 25 bp, E. coli
ccataaacaggttaaggcagagccg

SEQ ID NO: 171907 - DNA, 25 bp, E. coli
cgctggcgtttcaatgacgagaacc

SEQ ID NO: 171908 - DNA, 25 bp, E. coli
cgctggcgtttctatgacgagaacc

SEQ ID NO: 171909 - DNA, 25 bp, E. coli
cattatcgcgcggtgaagagaaaat

SEQ ID NO: 171910 - DNA, 25 bp, E. coli
cattatcgcgcgctgaagagaaaat

SEQ ID NO: 171911 - DNA, 25 bp, E. coli
gatattcaactgctaaagtgtccac

SEQ ID NO: 171912 - DNA, 25 bp, E. coli
gatattcaactggtaaagtgtccac

SEQ ID NO: 171913 - DNA, 25 bp, E. coli
gggtttgatcgtcatagttgccaac

SEQ ID NO: 171914 - DNA, 25 bp, E. coli
gggtttgatcgtgatagttgccaac

SEQ ID NO: 171915 - DNA, 25 bp, E. coli
ggcagagccgatgctgtacacttta

SEQ ID NO: 171916 - DNA, 25 bp, E. coli
ggcagagccgatcctgtacacttta

SEQ ID NO: 171917 - DNA, 25 bp, E. coli
aacgtgctgcgggtggatgctattt

SEQ ID NO: 171918 - DNA, 25 bp, E. coli
atgccgcagcacgtcgtgcgcaaga

SEQ ID NO: 171919 - DNA, 25 bp, E. coli
atgccgcagcacctcgtgcgcaaga

SEQ ID NO: 171920 - DNA, 25 bp, E. coli
acgtgctgcggcaggatgctatttt

SEQ ID NO: 171921 - DNA, 25 bp, E. coli
acgtgctgcggctggatgctatttt

SEQ ID NO: 171922 - DNA, 25 bp, E. coli
aacgtgctgcggctggatgctattt

SEQ ID NO: 171923 - DNA, 25 bp, E. coli
tgctgcggctggttgctattttttc

SEQ ID NO: 171924 - DNA, 25 bp, E. coli
tgctgcggctggatgctattttttc

SEQ ID NO: 171925 - DNA, 25 bp, E. coli
tgcggctggatgctattttttccct

SEQ ID NO: 171926 - DNA, 25 bp, E. coli
tgccgcagcacgacgtgcgcaagaa

SEQ ID NO: 171927 - DNA, 25 bp, E. coli
tgcggctggatggtattttttccct

SEQ ID NO: 171928 - DNA, 25 bp, E. coli
tgccgcagcacgtcgtgcgcaagaa

SEQ ID NO: 171929 - DNA, 25 bp, E. coli
gcggctggatgcaattttttccctg

SEQ ID NO: 171930 - DNA, 25 bp, E. coli
gctgcggctggaagctattttttcc

SEQ ID NO: 171931 - DNA, 25 bp, E. coli
gcggctggatgctattttttccctg

SEQ ID NO: 171932 - DNA, 25 bp, E. coli
gctgcggctggatgctattttttcc

SEQ ID NO: 171933 - DNA, 25 bp, E. coli
gcagcacgtcgtccgcaagaacgtg

SEQ ID NO: 171934 - DNA, 25 bp, E. coli
gcagcacgtcgtgcgcaagaacgtg

SEQ ID NO: 171935 - DNA, 25 bp, E. coli
cgcagcacgtcgtgcgcaagaacgt

SEQ ID NO: 171936 - DNA, 25 bp, E. coli
cgcagcacgtcgagcgcaagaacgt

SEQ ID NO: 171937 - DNA, 25 bp, E. coli
cgtgctgcggctcgatgctattttt

SEQ ID NO: 171938 - DNA, 25 bp, E. coli
cgtgctgcggctggatgctattttt

SEQ ID NO: 171939 - DNA, 25 bp, E. coli
aatgaccggctggagttaaaaggcg

SEQ ID NO: 171940 - DNA, 25 bp, E. coli
caaacgtatcgaagttgtccgcggg

SEQ ID NO: 171941 - DNA, 25 bp, E. coli
caaacgtatcgatgttgtccgcggg

SEQ ID NO: 171942 - DNA, 25 bp, E. coli
tatacttccggtcggattacaggca

SEQ ID NO: 171943 - DNA, 25 bp, E. coli
tatacttccggtgggattacaggca

SEQ ID NO: 171944 - DNA, 25 bp, E. coli
tacatcggccgggatgctgaaaggt

SEQ ID NO: 171945 - DNA, 25 bp, E. coli
tacatcggccggcatgctgaaaggt

SEQ ID NO: 171946 - DNA, 25 bp, E. coli
aatgaccggctgcagttaaaaggcg

SEQ ID NO: 171947 - DNA, 25 bp, E. coli
tatcaaagtgatcgtgagcacgcac

SEQ ID NO: 171948 - DNA, 25 bp, E. coli
tatcaaagtgatggtgagcacgcac

SEQ ID NO: 171949 - DNA, 25 bp, E. coli
tgaaaaaaggcgttccccatcaggc

SEQ ID NO: 171950 - DNA, 25 bp, E. coli
tgaaaaaaggcgatccccatcaggc

SEQ ID NO: 171951 - DNA, 25 bp, E. coli
tcgcgacaggaaatcagaacacggt

SEQ ID NO: 171952 - DNA, 25 bp, E. coli
tcgcgacaggaattcagaacacggt

SEQ ID NO: 171953 - DNA, 25 bp, E. coli
tcttataatgtaacccgggcccgta

SEQ ID NO: 171954 - DNA, 25 bp, E. coli
tcttataatgtatcccgggcccgta

SEQ ID NO: 171955 - DNA, 25 bp, E. coli
cccaagggcggccatttcagtctca

SEQ ID NO: 171956 - DNA, 25 bp, E. coli
cccaagggcggcgatttcagtctca

SEQ ID NO: 171957 - DNA, 25 bp, E. coli
ggatgctttcttttaaccggacgga

SEQ ID NO: 171958 - DNA, 25 bp, E. coli
ggatgctttcttataaccggacgga

SEQ ID NO: 171959 - DNA, 25 bp, E. coli
ggaataacaccactgaaccgggcaa

SEQ ID NO: 171960 - DNA, 25 bp, E. coli
ggaataacaccagtgaaccgggcaa

SEQ ID NO: 171961 - DNA, 25 bp, E. coli
caattaaggtcacattatcttgaat

SEQ ID NO: 171962 - DNA, 25 bp, E. coli
caattaaggtcagattatcttgaat

SEQ ID NO: 171963 - DNA, 25 bp, E. coli
taacaaaaagcataaaacgaggctc

SEQ ID NO: 171964 - DNA, 25 bp, E. coli
taacaaaaagcaaaaaacgaggctc

SEQ ID NO: 171965 - DNA, 25 bp, E. coli
tacgccataatcatgaaagcacaaa

SEQ ID NO: 171966 - DNA, 25 bp, E. coli
tacgccataatcttgaaagcacaaa

SEQ ID NO: 171967 - DNA, 25 bp, E. coli
tatcttgaatattcaacaataatcg

SEQ ID NO: 171968 - DNA, 25 bp, E. coli
tatcttgaatatacaacaataatcg

SEQ ID NO: 171969 - DNA, 25 bp, E. coli
tcttgaaagcactaaagaatacata

SEQ ID NO: 171970 - DNA, 25 bp, E. coli
tcttgaaagcacaaaagaatacata

SEQ ID NO: 171971 - DNA, 25 bp, E. coli
tcatataaatattagagcctccata

SEQ ID NO: 171972 - DNA, 25 bp, E. coli
tcatataaatataagagcctccata

SEQ ID NO: 171973 - DNA, 25 bp, E. coli
cgtatgcttttataaaccttagtgg

SEQ ID NO: 171974 - DNA, 25 bp, E. coli
cgtatgcttttaaaaaccttagtgg

SEQ ID NO: 171975 - DNA, 25 bp, E. coli
gtattgcaattttcttacgccataa

SEQ ID NO: 171976 - DNA, 25 bp, E. coli
gtattgcaatttacttacgccataa

SEQ ID NO: 171977 - DNA, 25 bp, E. coli
ggtgacacctgcaaacgtatgcttt

SEQ ID NO: 171978 - DNA, 25 bp, E. coli
ggtgacacctgctaacgtatgcttt

SEQ ID NO: 171979 - DNA, 25 bp, E. coli
taaaccttagtggtgggatataatt

SEQ ID NO: 171980 - DNA, 25 bp, E. coli
taaaccttagtgctgggatataatt

SEQ ID NO: 171981 - DNA, 25 bp, E. coli
gagcctccatatattagtcgtttag

SEQ ID NO: 171982 - DNA, 25 bp, E. coli
gagcctccatattttagtcgtttag

SEQ ID NO: 171983 - DNA, 25 bp, E. coli
caatattcagaagacggtggcggag

SEQ ID NO: 171984 - DNA, 25 bp, E. coli
caatattcagaacacggtggcggag

SEQ ID NO: 171985 - DNA, 25 bp, E. coli
tatccgaaagagatcaacggcgttg

SEQ ID NO: 171986 - DNA, 25 bp, E. coli
taccgttccgtacatgcactgctga

SEQ ID NO: 171987 - DNA, 25 bp, E. coli
tatccgaaagagttcaacggcgttg

SEQ ID NO: 171988 - DNA, 25 bp, E. coli
taccgttccgtagatgcactgctga

SEQ ID NO: 171989 - DNA, 25 bp, E. coli
tctacgcgctcacgttgggataacg

SEQ ID NO: 171990 - DNA, 25 bp, E. coli
tctacgcgctcaggttgggataacg

SEQ ID NO: 171991 - DNA, 25 bp, E. coli
ccattgcaggcgcaactgagcgata

SEQ ID NO: 171992 - DNA, 25 bp, E. coli
ccattgcaggcggaactgagcgata

SEQ ID NO: 171993 - DNA, 25 bp, E. coli
cccgattgcaggttgagttaccagc

SEQ ID NO: 171994 - DNA, 25 bp, E. coli
cccgattgcaggatgagttaccagc

SEQ ID NO: 171995 - DNA, 25 bp, E. coli
gcggcacgggtctgggtaaaactca

SEQ ID NO: 171996 - DNA, 25 bp, E. coli
gcggcacgggtcagggtaaaactca

SEQ ID NO: 171997 - DNA, 25 bp, E. coli
ggttaaagccctccaaaacaacgcg

SEQ ID NO: 171998 - DNA, 25 bp, E. coli
ggtaaaactcacctgctgcatgcgg

SEQ ID NO: 171999 - DNA, 25 bp, E. coli
ggtaaaactcacgtgctgcatgcgg

SEQ ID NO: 172000 - DNA, 25 bp, E. coli
ggttaaagccctgcaaaacaacgcg

SEQ ID NO: 172001 - DNA, 25 bp, E. coli
taaccagtttctgcggagcggatgc

SEQ ID NO: 172002 - DNA, 25 bp, E. coli
taaccagtttctccggagcggatgc

SEQ ID NO: 172003 - DNA, 25 bp, E. coli
gatgccccacaggtgcgttttgaag

SEQ ID NO: 172004 - DNA, 25 bp, E. coli
gatgccccacagctgcgttttgaag

SEQ ID NO: 172005 - DNA, 25 bp, E. coli
tttgcctccgcagcgcaagaagacg

SEQ ID NO: 172006 - DNA, 25 bp, E. coli
tttgcctccgcaccgcaagaagacg

SEQ ID NO: 172007 - DNA, 25 bp, E. coli
tgacggttatcgacaccatgggtgc

SEQ ID NO: 172008 - DNA, 25 bp, E. coli
tgacggttatcgtcaccatgggtgc

SEQ ID NO: 172009 - DNA, 25 bp, E. coli
tgcggaagacgctttcccacagctg

SEQ ID NO: 172010 - DNA, 25 bp, E. coli
tgcggaagacgcattcccacagctg

SEQ ID NO: 172011 - DNA, 25 bp, E. coli
ccatgggtgccggagattcgttcat

SEQ ID NO: 172012 - DNA, 25 bp, E. coli
ccggattcctttccggctggtctgc

SEQ ID NO: 172013 - DNA, 25 bp, E. coli
ccatgggtgccgcagattcgttcat

SEQ ID NO: 172014 - DNA, 25 bp, E. coli
ccggattcctttgcggctggtctgc

SEQ ID NO: 172015 - DNA, 25 bp, E. coli
gcagttctggcgacaggctcctgaa

SEQ ID NO: 172016 - DNA, 25 bp, E. coli
gctgcgggcaaagttaccgctttcg

SEQ ID NO: 172017 - DNA, 25 bp, E. coli
gctgcgtctgaagatgaaagcgatt

SEQ ID NO: 172018 - DNA, 25 bp, E. coli
gctgcgtctgaacatgaaagcgatt

SEQ ID NO: 172019 - DNA, 25 bp, E. coli
gctgcgggcaaacttaccgctttcg

SEQ ID NO: 172020 - DNA, 25 bp, E. coli
gcagttctggcgtcaggctcctgaa

SEQ ID NO: 172021 - DNA, 25 bp, E. coli
ggcagacactggtgccgcatctcga

SEQ ID NO: 172022 - DNA, 25 bp, E. coli
ggcagacactggagccgcatctcga

SEQ ID NO: 172023 - DNA, 25 bp, E. coli
gatgaaagcgatagttgcccgtggc

SEQ ID NO: 172024 - DNA, 25 bp, E. coli
gagattcgttcaatgccggattcct

SEQ ID NO: 172025 - DNA, 25 bp, E. coli
gatgaaagcgattgttgcccgtggc

SEQ ID NO: 172026 - DNA, 25 bp, E. coli
gagattcgttcattgccggattcct

SEQ ID NO: 172027 - DNA, 25 bp, E. coli
caaatacagggctatcctggcggac

SEQ ID NO: 172028 - DNA, 25 bp, E. coli
caaatacagggcaatcctggcggac

SEQ ID NO: 172029 - DNA, 25 bp, E. coli
cattttggcgcgtacatcatgccgg

SEQ ID NO: 172030 - DNA, 25 bp, E. coli
cagttaagcacatcaacgggctggc

SEQ ID NO: 172031 - DNA, 25 bp, E. coli
cagttaagcacaacaacgggctggc

SEQ ID NO: 172032 - DNA, 25 bp, E. coli
cattttggcgcgaacatcatgccgg

SEQ ID NO: 172033 - DNA, 25 bp, E. coli
taaagagcattaccgcgtgatgcgc

SEQ ID NO: 172034 - DNA, 25 bp, E. coli
taaagagcattagcgcgtgatgcgc

SEQ ID NO: 172035 - DNA, 25 bp, E. coli
aattatccggccagagacgtggtta

SEQ ID NO: 172036 - DNA, 25 bp, E. coli
aattatccggcctgagacgtggtta

SEQ ID NO: 172037 - DNA, 25 bp, E. coli
taccggaagccaaagcgatgacgaa

SEQ ID NO: 172038 - DNA, 25 bp, E. coli
taccggaagccatagcgatgacgaa

SEQ ID NO: 172039 - DNA, 25 bp, E. coli
tgtttaccggaataagcgccgcgat

SEQ ID NO: 172040 - DNA, 25 bp, E. coli
tgtttaccggaaaaagcgccgcgat

SEQ ID NO: 172041 - DNA, 25 bp, E. coli
gactggatgcagttaagcggaagcc

SEQ ID NO: 172042 - DNA, 25 bp, E. coli
cccaaagtggataagcagtcaggcg

SEQ ID NO: 172043 - DNA, 25 bp, E. coli
cccaaagtggattagcagtcaggcg

SEQ ID NO: 172044 - DNA, 25 bp, E. coli
ggttacttaaagttcacgggctgaa

SEQ ID NO: 172045 - DNA, 25 bp, E. coli
ggttacttaaagatcacgggctgaa

SEQ ID NO: 172046 - DNA, 25 bp, E. coli
gatgacgaattaaagccacgcgttg

SEQ ID NO: 172047 - DNA, 25 bp, E. coli
gatgacgaattatagccacgcgttg

SEQ ID NO: 172048 - DNA, 25 bp, E. coli
gactggatgcagataagcggaagcc

SEQ ID NO: 172049 - DNA, 25 bp, E. coli
aacgcggtgagttaatcgaatgcca

SEQ ID NO: 172050 - DNA, 25 bp, E. coli
tacggactttctcgtcagatcggaa

SEQ ID NO: 172051 - DNA, 25 bp, E. coli
tacaaacttgagcaggcactggacg

SEQ ID NO: 172052 - DNA, 25 bp, E. coli
tacaaacttgaggaggcactggacg

SEQ ID NO: 172053 - DNA, 25 bp, E. coli
tacggactttctggtcagatcggaa

SEQ ID NO: 172054 - DNA, 25 bp, E. coli
aaagttccggtgcaacgtgcgatgc

SEQ ID NO: 172055 - DNA, 25 bp, E. coli
aaagcatgactatacgaacccgccg

SEQ ID NO: 172056 - DNA, 25 bp, E. coli
aaagttccggtggaacgtgcgatgc

SEQ ID NO: 172057 - DNA, 25 bp, E. coli
aacgcggtgagtaaatcgaatgcca

SEQ ID NO: 172058 - DNA, 25 bp, E. coli
aaagcatgactaaacgaacccgccg

SEQ ID NO: 172059 - DNA, 25 bp, E. coli
tgaatattctggtaaccggcccgct

SEQ ID NO: 172060 - DNA, 25 bp, E. coli
tgaatattctggaaaccggcccgct

SEQ ID NO: 172061 - DNA, 25 bp, E. coli
tgccaataagcctgaaagccggtgc

SEQ ID NO: 172062 - DNA, 25 bp, E. coli
tgccaataagccagaaagccggtgc

SEQ ID NO: 172063 - DNA, 25 bp, E. coli
gcaggctccgcgctatatctacaaa

SEQ ID NO: 172064 - DNA, 25 bp, E. coli
gcaggctccgcggtatatctacaaa

SEQ ID NO: 172065 - DNA, 25 bp, E. coli
cgctggcaggcaatgaagatccgaa

SEQ ID NO: 172066 - DNA, 25 bp, E. coli
cgctggcaggcattgaagatccgaa

SEQ ID NO: 172067 - DNA, 25 bp, E. coli
gatccgaaggtagtgcaatatgcgc

SEQ ID NO: 172068 - DNA, 25 bp, E. coli
taaaagcttcaagctccggacgtga

SEQ ID NO: 172069 - DNA, 25 bp, E. coli
taaaagcttcaacctccggacgtga

SEQ ID NO: 172070 - DNA, 25 bp, E. coli
gatccgaaggtactgcaatatgcgc

SEQ ID NO: 172071 - DNA, 25 bp, E. coli
aaggtgcacctttctccggctcagt

SEQ ID NO: 172072 - DNA, 25 bp, E. coli
aaggtgcaccttactccggctcagt

SEQ ID NO: 172073 - DNA, 25 bp, E. coli
caggttcgcgtaactggctggttgc

SEQ ID NO: 172074 - DNA, 25 bp, E. coli
caggttcgcgtatctggctggttgc

SEQ ID NO: 172075 - DNA, 25 bp, E. coli
cagttatccatgcttcttgaaggta

SEQ ID NO: 172076 - DNA, 25 bp, E. coli
cagttatccatggttcttgaaggta

SEQ ID NO: 172077 - DNA, 25 bp, E. coli
tatcaactggaaccacccgaaacga

SEQ ID NO: 172078 - DNA, 25 bp, E. coli
tatcaactggaagcacccgaaacga

SEQ ID NO: 172079 - DNA, 25 bp, E. coli
tatctggctggttgcaggtatcacc

SEQ ID NO: 172080 - DNA, 25 bp, E. coli
tatctggctggtagcaggtatcacc

SEQ ID NO: 172081 - DNA, 25 bp, E. coli
tgatatctctccctgcaggttcgcg

SEQ ID NO: 172082 - DNA, 25 bp, E. coli
tgatatctctccgtgcaggttcgcg

SEQ ID NO: 172083 - DNA, 25 bp, E. coli
tgaaggtatcaactggaagcacccg

SEQ ID NO: 172084 - DNA, 25 bp, E. coli
tgaaggtatcaagtggaagcacccg

SEQ ID NO: 172085 - DNA, 25 bp, E. coli
gcgaaatggcttaaacggcctggca

SEQ ID NO: 172086 - DNA, 25 bp, E. coli
gcgaaatggctttaacggcctggca

SEQ ID NO: 172087 - DNA, 25 bp, E. coli
cgaaacgaacggtacgcgctggaat

SEQ ID NO: 172088 - DNA, 25 bp, E. coli
cgaaacgaacggaacgcgctggaat

SEQ ID NO: 172089 - DNA, 25 bp, E. coli
cggcctggcatcaaaagttcagaac

SEQ ID NO: 172090 - DNA, 25 bp, E. coli
cggcctggcatctaaagttcagaac

SEQ ID NO: 172091 - DNA, 25 bp, E. coli
ggaacgcgctggaatccgcatataa

SEQ ID NO: 172092 - DNA, 25 bp, E. coli
ggaacgcgctggtatccgcatataa

SEQ ID NO: 172093 - DNA, 25 bp, E. coli
cacaggcagttttagaaaaattcgc

SEQ ID NO: 172094 - DNA, 25 bp, E. coli
cacaggcagtttaagaaaaattcgc

SEQ ID NO: 172095 - DNA, 25 bp, E. coli
tacctgataagtagttccgggcttt

SEQ ID NO: 172096 - DNA, 25 bp, E. coli
aggatttagcaatcgccgccagtta

SEQ ID NO: 172097 - DNA, 25 bp, E. coli
aggatttagcaaacgccgccagtta

SEQ ID NO: 172098 - DNA, 25 bp, E. coli
tacctgataagttgttccgggcttt

SEQ ID NO: 172099 - DNA, 25 bp, E. coli
ttcgctggaacccttctggaatggg

SEQ ID NO: 172100 - DNA, 25 bp, E. coli
ttcgctggaaccgttctggaatggg

SEQ ID NO: 172101 - DNA, 25 bp, E. coli
tcccactgccggtgacattatcgca

SEQ ID NO: 172102 - DNA, 25 bp, E. coli
tcccactgccggagacattatcgca

SEQ ID NO: 172103 - DNA, 25 bp, E. coli
gccgccagttattgctacctgataa

SEQ ID NO: 172104 - DNA, 25 bp, E. coli
gccgccagttatagctacctgataa

SEQ ID NO: 172105 - DNA, 25 bp, E. coli
gaaaaattcgctggaaccgttctgg

SEQ ID NO: 172106 - DNA, 25 bp, E. coli
gaaaaattcgctcgaaccgttctgg

SEQ ID NO: 172107 - DNA, 25 bp, E. coli
gaactacaaggaattagcaaacgcc

SEQ ID NO: 172108 - DNA, 25 bp, E. coli
gacattatcgcaggcacaggcagtt

SEQ ID NO: 172109 - DNA, 25 bp, E. coli
gaactacaaggatttagcaaacgcc

SEQ ID NO: 172110 - DNA, 25 bp, E. coli
gacattatcgcacgcacaggcagtt

SEQ ID NO: 172111 - DNA, 25 bp, E. coli
ccgggcttttcaggaactactcatt

SEQ ID NO: 172112 - DNA, 25 bp, E. coli
ccgggcttttcacgaactactcatt

SEQ ID NO: 172113 - DNA, 25 bp, E. coli
ctcattcaagatgccactgccggtg

SEQ ID NO: 172114 - DNA, 25 bp, E. coli
ctcattcaagatcccactgccggtg

SEQ ID NO: 172115 - DNA, 25 bp, E. coli
taaaaaatatatggcaacacacggt

SEQ ID NO: 172116 - DNA, 25 bp, E. coli
taaaaaatatatcgcaacacacggt

SEQ ID NO: 172117 - DNA, 25 bp, E. coli
acacggtaatctgcgcgcacctttt

SEQ ID NO: 172118 - DNA, 25 bp, E. coli
acacggtaatctccgcgcacctttt

SEQ ID NO: 172119 - DNA, 25 bp, E. coli
aaatatatcgcaacacacggtaatc

SEQ ID NO: 172120 - DNA, 25 bp, E. coli
aaatatatcgcatcacacggtaatc

SEQ ID NO: 172121 - DNA, 25 bp, E. coli
tatcgcaacacagggtaatctccgc

SEQ ID NO: 172122 - DNA, 25 bp, E. coli
tatcgcaacacacggtaatctccgc

SEQ ID NO: 172123 - DNA, 25 bp, E. coli
tatatcgcaacacacggtaatctcc

SEQ ID NO: 172124 - DNA, 25 bp, E. coli
tatatcgcaacagacggtaatctcc

SEQ ID NO: 172125 - DNA, 25 bp, E. coli
tgattattcccccatgaatcgtgat

SEQ ID NO: 172126 - DNA, 25 bp, E. coli
tgattattccccgatgaatcgtgat

SEQ ID NO: 172127 - DNA, 25 bp, E. coli
tgccacgcgaaactaaaaaatatat

SEQ ID NO: 172128 - DNA, 25 bp, E. coli
tgccacgcgaaagtaaaaaatatat

SEQ ID NO: 172129 - DNA, 25 bp, E. coli
gcaccttttctttcctgattattcc

SEQ ID NO: 172130 - DNA, 25 bp, E. coli
gcaccttttcttacctgattattcc

SEQ ID NO: 172131 - DNA, 25 bp, E. coli
ccgcgcaccttttcttacctgatta

SEQ ID NO: 172132 - DNA, 25 bp, E. coli
ccgcgcacctttacttacctgatta

SEQ ID NO: 172133 - DNA, 25 bp, E. coli
gtaatctccgcgcaccttttcttac

SEQ ID NO: 172134 - DNA, 25 bp, E. coli
gtattgccacgcgaaactaaaaaat

SEQ ID NO: 172135 - DNA, 25 bp, E. coli
gtattgccacgccaaactaaaaaat

SEQ ID NO: 172136 - DNA, 25 bp, E. coli
gtaatctccgcggaccttttcttac

SEQ ID NO: 172137 - DNA, 25 bp, E. coli
cagttacccaaactggaagtgcaca

SEQ ID NO: 172138 - DNA, 25 bp, E. coli
cagttacccaaagtggaagtgcaca

SEQ ID NO: 172139 - DNA, 25 bp, E. coli
tatcaccaaagaagtcatggctctg

SEQ ID NO: 172140 - DNA, 25 bp, E. coli
tatttataatcagtctgccgccgga

SEQ ID NO: 172141 - DNA, 25 bp, E. coli
tatcaccaaagatgtcatggctctg

SEQ ID NO: 172142 - DNA, 25 bp, E. coli
tatttataatcactctgccgccgga

SEQ ID NO: 172143 - DNA, 25 bp, E. coli
tcccgtgcgatagataatgccatag

SEQ ID NO: 172144 - DNA, 25 bp, E. coli
tcccgtgcgatacataatgccatag

SEQ ID NO: 172145 - DNA, 25 bp, E. coli
tcttcaggtgttctgcttgcgcata

SEQ ID NO: 172146 - DNA, 25 bp, E. coli
tcttcaggtgttgtgcttgcgcata

SEQ ID NO: 172147 - DNA, 25 bp, E. coli
gcaaaaagcattcgcagataacgcg

SEQ ID NO: 172148 - DNA, 25 bp, E. coli
gcaaaaagcattggcagataacgcg

SEQ ID NO: 172149 - DNA, 25 bp, E. coli
cgccggagacatcgtcagaaagcat

SEQ ID NO: 172150 - DNA, 25 bp, E. coli
cgccggagacatggtcagaaagcat

SEQ ID NO: 172151 - DNA, 25 bp, E. coli
cttgaaaaaggctatgaggatgcgc

SEQ ID NO: 172152 - DNA, 25 bp, E. coli
cttgaaaaaggcaatgaggatgcgc

SEQ ID NO: 172153 - DNA, 25 bp, E. coli
cttgcgcataaccagtcagctgata

SEQ ID NO: 172154 - DNA, 25 bp, E. coli
cttgcgcataacgagtcagctgata

SEQ ID NO: 172155 - DNA, 25 bp, E. coli
gataacgcgaattaagaggcgctgc

SEQ ID NO: 172156 - DNA, 25 bp, E. coli
gataacgcgaataaagaggcgctgc

SEQ ID NO: 172157 - DNA, 25 bp, E. coli
gaggcgctgcttgttgatgccagac

SEQ ID NO: 172158 - DNA, 25 bp, E. coli
gaggcgctgcttcttgatgccagac

SEQ ID NO: 172159 - DNA, 25 bp, E. coli
aaactgggcatccttcctgacagcg

SEQ ID NO: 172160 - DNA, 25 bp, E. coli
aaactgggcatcgttcctgacagcg

SEQ ID NO: 172161 - DNA, 25 bp, E. coli
tagtcaaccgcgaggttagccaggc

SEQ ID NO: 172162 - DNA, 25 bp, E. coli
tagtcaaccgcgtggttagccaggc

SEQ ID NO: 172163 - DNA, 25 bp, E. coli
tttaaaagcggcagcagaaggcgaa

SEQ ID NO: 172164 - DNA, 25 bp, E. coli
ttgcggcgctgaaagagatctaccg

SEQ ID NO: 172165 - DNA, 25 bp, E. coli
ttgcggcgctgatagagatctaccg

SEQ ID NO: 172166 - DNA, 25 bp, E. coli
tttaaaagcggctgcagaaggcgaa

SEQ ID NO: 172167 - DNA, 25 bp, E. coli
tgtttgtgccgaaaacgccagcttc

SEQ ID NO: 172168 - DNA, 25 bp, E. coli
tgtttgtgccgataacgccagcttc

SEQ ID NO: 172169 - DNA, 25 bp, E. coli
tgtcgccattataaccggtgccgga

SEQ ID NO: 172170 - DNA, 25 bp, E. coli
tgtcgccattattaccggtgccgga

SEQ ID NO: 172171 - DNA, 25 bp, E. coli
cggaactgatggataacgcccgcga

SEQ ID NO: 172172 - DNA, 25 bp, E. coli
cggaactgatggttaacgcccgcga

SEQ ID NO: 172173 - DNA, 25 bp, E. coli
tcaatgaaatggagatgaccggcag

SEQ ID NO: 172174 - DNA, 25 bp, E. coli
tcaatgaaatggtgatgaccggcag

SEQ ID NO: 172175 - DNA, 25 bp, E. coli
gagtgaatcattacatctgacccgc

SEQ ID NO: 172176 - DNA, 25 bp, E. coli
gacccgcaatggttcaattctggaa

SEQ ID NO: 172177 - DNA, 25 bp, E. coli
gacccgcaatggatcaattctggaa

SEQ ID NO: 172178 - DNA, 25 bp, E. coli
gagtgaatcatttcatctgacccgc

SEQ ID NO: 172179 - DNA, 25 bp, E. coli
gtcgtccctgaataagcaaaaatgg

SEQ ID NO: 172180 - DNA, 25 bp, E. coli
gtcgtccctgaaaaagcaaaaatgg

SEQ ID NO: 172181 - DNA, 25 bp, E. coli
cagggtgataaagctgttccaccgc

SEQ ID NO: 172182 - DNA, 25 bp, E. coli
cagggtgataaacctgttccaccgc

SEQ ID NO: 172183 - DNA, 25 bp, E. coli
acgcgctgaaatccccggcagcaaa

SEQ ID NO: 172184 - DNA, 25 bp, E. coli
acgcgctgaaatgcccggcagcaaa

SEQ ID NO: 172185 - DNA, 25 bp, E. coli
tttatgggatcagggtgataaacct

SEQ ID NO: 172186 - DNA, 25 bp, E. coli
tttatgggatcacggtgataaacct

SEQ ID NO: 172187 - DNA, 25 bp, E. coli
tggtgccggtattgcaggcaccgct

SEQ ID NO: 172188 - DNA, 25 bp, E. coli
tggtgccggtatagcaggcaccgct

SEQ ID NO: 172189 - DNA, 25 bp, E. coli
tgcaacgcccgggatggtaccgtac

SEQ ID NO: 172190 - DNA, 25 bp, E. coli
tgcaacgcccggcatggtaccgtac

SEQ ID NO: 172191 - DNA, 25 bp, E. coli
tgctgtcgctggaaacatccgctat

SEQ ID NO: 172192 - DNA, 25 bp, E. coli
tgctgtcgctggtaacatccgctat

SEQ ID NO: 172193 - DNA, 25 bp, E. coli
cgtacgtggcctgcgttaatgcagg

SEQ ID NO: 172194 - DNA, 25 bp, E. coli
cggcgggcggttatatacccatgca

SEQ ID NO: 172195 - DNA, 25 bp, E. coli
cgtacgtggcctccgttaatgcagg

SEQ ID NO: 172196 - DNA, 25 bp, E. coli
cggcgggcggttttatacccatgca

SEQ ID NO: 172197 - DNA, 25 bp, E. coli
ggttatatacccttgcactcgcgga

SEQ ID NO: 172198 - DNA, 25 bp, E. coli
ggttatatacccatgcactcgcgga

SEQ ID NO: 172199 - DNA, 25 bp, E. coli
tggtaccgtacgtggcctgcgttaa

SEQ ID NO: 172200 - DNA, 25 bp, E. coli
tggtaccgtacgaggcctgcgttaa

SEQ ID NO: 172201 - DNA, 25 bp, E. coli
tcaaagaagtgctgtcgctggaaac

SEQ ID NO: 172202 - DNA, 25 bp, E. coli
tcaaagaagtgcagtcgctggaaac

SEQ ID NO: 172203 - DNA, 25 bp, E. coli
aagcattgccgccttaaacgcgctg

SEQ ID NO: 172204 - DNA, 25 bp, E. coli
caagcaatgccgaagcacgcgtaaa

SEQ ID NO: 172205 - DNA, 25 bp, E. coli
aagcattgccgcgttaaacgcgctg

SEQ ID NO: 172206 - DNA, 25 bp, E. coli
aatgccgaagcaggcgtaaacgccg

SEQ ID NO: 172207 - DNA, 25 bp, E. coli
aatgccgaagcacgcgtaaacgccg

SEQ ID NO: 172208 - DNA, 25 bp, E. coli
caagcaatgccgtagcacgcgtaaa

SEQ ID NO: 172209 - DNA, 25 bp, E. coli
accacgtttgctcgaacgccagcag

SEQ ID NO: 172210 - DNA, 25 bp, E. coli
agcaatgccgaagcacgcgtaaacg

SEQ ID NO: 172211 - DNA, 25 bp, E. coli
agcaatgccgaaccacgcgtaaacg

SEQ ID NO: 172212 - DNA, 25 bp, E. coli
accacgtttgctggaacgccagcag

SEQ ID NO: 172213 - DNA, 25 bp, E. coli
tgccgcgttaaaggcgctggaaacg

SEQ ID NO: 172214 - DNA, 25 bp, E. coli
tgccgcgttaaacgcgctggaaacg

SEQ ID NO: 172215 - DNA, 25 bp, E. coli
tctgacaagcaaagccgaagcacgc

SEQ ID NO: 172216 - DNA, 25 bp, E. coli
tctgacaagcaatgccgaagcacgc

SEQ ID NO: 172217 - DNA, 25 bp, E. coli
gctggaacgccagcagttacgcgaa

SEQ ID NO: 172218 - DNA, 25 bp, E. coli
gctggaacgccaccagttacgcgaa

SEQ ID NO: 172219 - DNA, 25 bp, E. coli
cccgaacattcctggctgacaacga

SEQ ID NO: 172220 - DNA, 25 bp, E. coli
cccgaacattccaggctgacaacga

SEQ ID NO: 172221 - DNA, 25 bp, E. coli
cgcttttacccgaacattcctggct

SEQ ID NO: 172222 - DNA, 25 bp, E. coli
cgcttttacccgtacattcctggct

SEQ ID NO: 172223 - DNA, 25 bp, E. coli
cattgccgcgtttaacgcgctggaa

SEQ ID NO: 172224 - DNA, 25 bp, E. coli
cattgccgcgttaaacgcgctggaa

SEQ ID NO: 172225 - DNA, 25 bp, E. coli
caaactggtactcgtagaaagccca

SEQ ID NO: 172226 - DNA, 25 bp, E. coli
caaactggtactggtagaaagccca

SEQ ID NO: 172227 - DNA, 25 bp, E. coli
tttttgaaacctcgcgatctgctgg

SEQ ID NO: 172228 - DNA, 25 bp, E. coli
tttttgaaacctggcgatctgctgg

SEQ ID NO: 172229 - DNA, 25 bp, E. coli
tgaacaggcatttcgggcagcgctg

SEQ ID NO: 172230 - DNA, 25 bp, E. coli
tgaacaggcattacgggcagcgctg

SEQ ID NO: 172231 - DNA, 25 bp, E. coli
gtgattgctaaagacccggacgttg

SEQ ID NO: 172232 - DNA, 25 bp, E. coli
gctgcgtatctccaccggtattgaa

SEQ ID NO: 172233 - DNA, 25 bp, E. coli
gtgattgctaaacacccggacgttg

SEQ ID NO: 172234 - DNA, 25 bp, E. coli
gctgcgtatctcgaccggtattgaa

SEQ ID NO: 172235 - DNA, 25 bp, E. coli
gcaaacaatattggcgtgacgggcg

SEQ ID NO: 172236 - DNA, 25 bp, E. coli
gcaaacaatattcgcgtgacgggcg

SEQ ID NO: 172237 - DNA, 25 bp, E. coli
gaaagtttaatctctcacgccgcaa

SEQ ID NO: 172238 - DNA, 25 bp, E. coli
gaaagtttaatcactcacgccgcaa

SEQ ID NO: 172239 - DNA, 25 bp, E. coli
cgaagatttaattgccgacctggaa

SEQ ID NO: 172240 - DNA, 25 bp, E. coli
cgaagatttaatagccgacctggaa

SEQ ID NO: 172241 - DNA, 25 bp, E. coli
cgggcggcgcgtttgacagctatct

SEQ ID NO: 172242 - DNA, 25 bp, E. coli
cgggcggcgcgtatgacagctatct

SEQ ID NO: 172243 - DNA, 25 bp, E. coli
ggataacaccttgttaagcccggca

SEQ ID NO: 172244 - DNA, 25 bp, E. coli
ggataacaccttcttaagcccggca

SEQ ID NO: 172245 - DNA, 25 bp, E. coli
ggatttaatgaagcgcgcgcgcatg

SEQ ID NO: 172246 - DNA, 25 bp, E. coli
ggatttaatgaaccgcgcgcgcatg

SEQ ID NO: 172247 - DNA, 25 bp, E. coli
cacaaaacgtggataacgcgctgga

SEQ ID NO: 172248 - DNA, 25 bp, E. coli
cacaaaacgtggttaacgcgctgga

SEQ ID NO: 172249 - DNA, 25 bp, E. coli
catgtgatggatgcgccggaaattc

SEQ ID NO: 172250 - DNA, 25 bp, E. coli
catgtgatggatccgccggaaattc

SEQ ID NO: 172251 - DNA, 25 bp, E. coli
caggatctaaacaggcgaaggcgca

SEQ ID NO: 172252 - DNA, 25 bp, E. coli
caggatctaaactggcgaaggcgca

SEQ ID NO: 172253 - DNA, 25 bp, E. coli
taaaaccgtggtgcttacgggcagc

SEQ ID NO: 172254 - DNA, 25 bp, E. coli
taaaaccgtggtccttacgggcagc

SEQ ID NO: 172255 - DNA, 25 bp, E. coli
aaatggcgttttagtcagtgccgcg

SEQ ID NO: 172256 - DNA, 25 bp, E. coli
aaatggcgtttttgtcagtgccgcg

SEQ ID NO: 172257 - DNA, 25 bp, E. coli
tagcgtttaaatacccggcgcagga

SEQ ID NO: 172258 - DNA, 25 bp, E. coli
tagcgtttaaattcccggcgcagga

SEQ ID NO: 172259 - DNA, 25 bp, E. coli
tgtttgctaaccgacgtaatgcggc

SEQ ID NO: 172260 - DNA, 25 bp, E. coli
tgtttgctaacccacgtaatgcggc

SEQ ID NO: 172261 - DNA, 25 bp, E. coli
tgaacgcccggatgatacccgtgag

SEQ ID NO: 172262 - DNA, 25 bp, E. coli
tgaacgcccggaagatacccgtgag

SEQ ID NO: 172263 - DNA, 25 bp, E. coli
gcaaactgaccggactggagcgtat

SEQ ID NO: 172264 - DNA, 25 bp, E. coli
gcaaactgaccgcactggagcgtat

SEQ ID NO: 172265 - DNA, 25 bp, E. coli
tcaacaaacgtgagcaggaccgtct

SEQ ID NO: 172266 - DNA, 25 bp, E. coli
tcaacaaacgtgtgcaggaccgtct

SEQ ID NO: 172267 - DNA, 25 bp, E. coli
gatcccgcaggtggttaacgtcgtg

SEQ ID NO: 172268 - DNA, 25 bp, E. coli
gatcccgcaggtcgttaacgtcgtg

SEQ ID NO: 172269 - DNA, 25 bp, E. coli
cgaaaacgggcgaggatattcccat

SEQ ID NO: 172270 - DNA, 25 bp, E. coli
cgaaaacgggcgtggatattcccat

SEQ ID NO: 172271 - DNA, 25 bp, E. coli
agcacggcgcgtcgtgaccttcaga

SEQ ID NO: 172272 - DNA, 25 bp, E. coli
agcacggcgcgtggtgaccttcaga

SEQ ID NO: 172273 - DNA, 25 bp, E. coli
tgtttttcgaagagatccgtcgcgc

SEQ ID NO: 172274 - DNA, 25 bp, E. coli
tgataagaatcatcgcccgggacgt

SEQ ID NO: 172275 - DNA, 25 bp, E. coli
tgtttttcgaagtgatccgtcgcgc

SEQ ID NO: 172276 - DNA, 25 bp, E. coli
tgataagaatcaacgcccgggacgt

SEQ ID NO: 172277 - DNA, 25 bp, E. coli
tccgtcgcgctctggaaaacggcga

SEQ ID NO: 172278 - DNA, 25 bp, E. coli
tccgtcgcgctcaggaaaacggcga

SEQ ID NO: 172279 - DNA, 25 bp, E. coli
tcagacccgggctgaagttaaaaag

SEQ ID NO: 172280 - DNA, 25 bp, E. coli
tcagacccgggcagaagttaaaaag

SEQ ID NO: 172281 - DNA, 25 bp, E. coli
gaaaacggcgaagaggtgaaactct

SEQ ID NO: 172282 - DNA, 25 bp, E. coli
gaaaacggcgaacaggtgaaactct

SEQ ID NO: 172283 - DNA, 25 bp, E. coli
cttgggcttagctagcgggatgcca

SEQ ID NO: 172284 - DNA, 25 bp, E. coli
cttgggcttagcaagcgggatgcca

SEQ ID NO: 172285 - DNA, 25 bp, E. coli
gatattcccattacagcacggcgcg

SEQ ID NO: 172286 - DNA, 25 bp, E. coli
gatattcccatttcagcacggcgcg

SEQ ID NO: 172287 - DNA, 25 bp, E. coli
gtcgaaaacgctacgcccaaagacg

SEQ ID NO: 172288 - DNA, 25 bp, E. coli
gtcgaaaacgcttcgcccaaagacg

SEQ ID NO: 172289 - DNA, 25 bp, E. coli
ggcgcttacaaaagctgaaatgtca

SEQ ID NO: 172290 - DNA, 25 bp, E. coli
ggcgcttacaaatgctgaaatgtca

SEQ ID NO: 172291 - DNA, 25 bp, E. coli
aatatatcgccgccgcgccacagga

SEQ ID NO: 172292 - DNA, 25 bp, E. coli
aagtgcccgcgcgtccgccaatgag

SEQ ID NO: 172293 - DNA, 25 bp, E. coli
aaggtcagttactcaagtgcccgcg

SEQ ID NO: 172294 - DNA, 25 bp, E. coli
aatatatcgccggcgcgccacagga

SEQ ID NO: 172295 - DNA, 25 bp, E. coli
aaggtcagttacacaagtgcccgcg

SEQ ID NO: 172296 - DNA, 25 bp, E. coli
aagtgcccgcgcctccgccaatgag

SEQ ID NO: 172297 - DNA, 25 bp, E. coli
gattttccgttctctggtagtggac

SEQ ID NO: 172298 - DNA, 25 bp, E. coli
gattttccgttcactggtagtggac

SEQ ID NO: 172299 - DNA, 25 bp, E. coli
tccgttctctggaagtggacgatgg

SEQ ID NO: 172300 - DNA, 25 bp, E. coli
tccgttctctggtagtggacgatgg

SEQ ID NO: 172301 - DNA, 25 bp, E. coli
tcagtcggccatagtgaaggcgatg

SEQ ID NO: 172302 - DNA, 25 bp, E. coli
cgcgccacaggaccagaaggataat

SEQ ID NO: 172303 - DNA, 25 bp, E. coli
cgcgccacaggagcagaaggataat

SEQ ID NO: 172304 - DNA, 25 bp, E. coli
cttcagtcggccatagtgaaggcga

SEQ ID NO: 172305 - DNA, 25 bp, E. coli
cttcagtcggccttagtgaaggcga

SEQ ID NO: 172306 - DNA, 25 bp, E. coli
gtcggccatagtcaaggcgatgtat

SEQ ID NO: 172307 - DNA, 25 bp, E. coli
gtcggccatagtgaaggcgatgtat

SEQ ID NO: 172308 - DNA, 25 bp, E. coli
gtcagttactcaagtgcccgcgcct

SEQ ID NO: 172309 - DNA, 25 bp, E. coli
gtcagttactcatgtgcccgcgcct

SEQ ID NO: 172310 - DNA, 25 bp, E. coli
tcagtcggccattgtgaaggcgatg

SEQ ID NO: 172311 - DNA, 25 bp, E. coli
gaggatgattttccgttctctggta

SEQ ID NO: 172312 - DNA, 25 bp, E. coli
gaggatgattttgcgttctctggta

SEQ ID NO: 172313 - DNA, 25 bp, E. coli
aaccgaatgttgagtgggatgcgca

SEQ ID NO: 172314 - DNA, 25 bp, E. coli
aaccgaatgttgtgtgggatgcgca

SEQ ID NO: 172315 - DNA, 25 bp, E. coli
cagagacgctgccatttggtaccgg

SEQ ID NO: 172316 - DNA, 25 bp, E. coli
catttaacggcggatacgctgacgg

SEQ ID NO: 172317 - DNA, 25 bp, E. coli
cagggcggcgtattcgaaggcttct

SEQ ID NO: 172318 - DNA, 25 bp, E. coli
cagggcggcgtaatcgaaggcttct

SEQ ID NO: 172319 - DNA, 25 bp, E. coli
cagagacgctgcgatttggtaccgg

SEQ ID NO: 172320 - DNA, 25 bp, E. coli
catttaacggcgcatacgctgacgg

SEQ ID NO: 172321 - DNA, 25 bp, E. coli
aaaaagcggtgtcgcaaccgatgcc

SEQ ID NO: 172322 - DNA, 25 bp, E. coli
aaaaagcggtgtggcaaccgatgcc

SEQ ID NO: 172323 - DNA, 25 bp, E. coli
tattttccgttgacgccgcaaacgc

SEQ ID NO: 172324 - DNA, 25 bp, E. coli
tattttccgttgtcgccgcaaacgc

SEQ ID NO: 172325 - DNA, 25 bp, E. coli
tttgccggatggaatggtcaggccc

SEQ ID NO: 172326 - DNA, 25 bp, E. coli
tttgccggatggtatggtcaggccc

SEQ ID NO: 172327 - DNA, 25 bp, E. coli
tgggatgcgcacaatctacacggcg

SEQ ID NO: 172328 - DNA, 25 bp, E. coli
tgggatgcgcactatctacacggcg

SEQ ID NO: 172329 - DNA, 25 bp, E. coli
tcgaaggcttctggcgcgatacgac

SEQ ID NO: 172330 - DNA, 25 bp, E. coli
tcgaaggcttctcgcgcgatacgac

SEQ ID NO: 172331 - DNA, 25 bp, E. coli
gtgagttttgcgagcagctaccgca

SEQ ID NO: 172332 - DNA, 25 bp, E. coli
gtgagttttgcgtgcagctaccgca

SEQ ID NO: 172333 - DNA, 25 bp, E. coli
ggcgtgagtatcaactgcaaccgaa

SEQ ID NO: 172334 - DNA, 25 bp, E. coli
ggcgtgagtatctactgcaaccgaa

SEQ ID NO: 172335 - DNA, 25 bp, E. coli
caagagcgttgaatcatcgaccggg

SEQ ID NO: 172336 - DNA, 25 bp, E. coli
caagagcgttgattcatcgaccggg

SEQ ID NO: 172337 - DNA, 25 bp, E. coli
aaattcaggaagacacgcgaatgat

SEQ ID NO: 172338 - DNA, 25 bp, E. coli
aaattcaggaagtcacgcgaatgat

SEQ ID NO: 172339 - DNA, 25 bp, E. coli
taccgtactgttggtgacgcatgat

SEQ ID NO: 172340 - DNA, 25 bp, E. coli
taccgtactgttcgtgacgcatgat

SEQ ID NO: 172341 - DNA, 25 bp, E. coli
ttgtgtcactttcgcaggagcacgg

SEQ ID NO: 172342 - DNA, 25 bp, E. coli
ttgtgtcactttggcaggagcacgg

SEQ ID NO: 172343 - DNA, 25 bp, E. coli
gctgaaattcagcaagacacgcgaa

SEQ ID NO: 172344 - DNA, 25 bp, E. coli
gctgaaattcaggaagacacgcgaa

SEQ ID NO: 172345 - DNA, 25 bp, E. coli
ccgctggctgaatttcaggaagaca

SEQ ID NO: 172346 - DNA, 25 bp, E. coli
ccgctggctgaaattcaggaagaca

SEQ ID NO: 172347 - DNA, 25 bp, E. coli
ctgaaactcgcctgagaaaacaggg

SEQ ID NO: 172348 - DNA, 25 bp, E. coli
ctgaaactcgccagagaaaacaggg

SEQ ID NO: 172349 - DNA, 25 bp, E. coli
cgtggtgaatctgaaactcgcctga

SEQ ID NO: 172350 - DNA, 25 bp, E. coli
cgtggtgaatctcaaactcgcctga

SEQ ID NO: 172351 - DNA, 25 bp, E. coli
gatttgattgtgacactttggcagg

SEQ ID NO: 172352 - DNA, 25 bp, E. coli
gatttgattgtgtcactttggcagg

SEQ ID NO: 172353 - DNA, 25 bp, E. coli
ggtgaatctgaatctcgcctgagaa

SEQ ID NO: 172354 - DNA, 25 bp, E. coli
ggtgaatctgaaactcgcctgagaa

SEQ ID NO: 172355 - DNA, 25 bp, E. coli
ggcaagagcgttgattcatcgaccg

SEQ ID NO: 172356 - DNA, 25 bp, E. coli
ggcaagagcgttcattcatcgaccg

SEQ ID NO: 172357 - DNA, 25 bp, E. coli
caacacctgaaccacagttttctat

SEQ ID NO: 172358 - DNA, 25 bp, E. coli
caacacctgaacgacagttttctat

SEQ ID NO: 172359 - DNA, 25 bp, E. coli
taccgataccgcaccttgttttaca

SEQ ID NO: 172360 - DNA, 25 bp, E. coli
tactaaagccattgagttattgaac

SEQ ID NO: 172361 - DNA, 25 bp, E. coli
taaagcagccaaaagcgctaggcat

SEQ ID NO: 172362 - DNA, 25 bp, E. coli
tactaaagccatagagttattgaac

SEQ ID NO: 172363 - DNA, 25 bp, E. coli
taccgataccgctccttgttttaca

SEQ ID NO: 172364 - DNA, 25 bp, E. coli
taaagagaaaaacagaagtagtcgc

SEQ ID NO: 172365 - DNA, 25 bp, E. coli
taaagagaaaaagagaagtagtcgc

SEQ ID NO: 172366 - DNA, 25 bp, E. coli
taaagcagccaatagcgctaggcat

SEQ ID NO: 172367 - DNA, 25 bp, E. coli
aagtagtcgcgtgaaagtctttagc

SEQ ID NO: 172368 - DNA, 25 bp, E. coli
aagtagtcgcgtcaaagtctttagc

SEQ ID NO: 172369 - DNA, 25 bp, E. coli
gcggcatcctggctagcaactcaaa

SEQ ID NO: 172370 - DNA, 25 bp, E. coli
gcggcatcctgggtagcaactcaaa

SEQ ID NO: 172371 - DNA, 25 bp, E. coli
gggacatggaacatgtaaagcagcc

SEQ ID NO: 172372 - DNA, 25 bp, E. coli
gggacatggaacttgtaaagcagcc

SEQ ID NO: 172373 - DNA, 25 bp, E. coli
taataaccacgagatcaacacctga

SEQ ID NO: 172374 - DNA, 25 bp, E. coli
taatttgagtcaaccagcggcatcc

SEQ ID NO: 172375 - DNA, 25 bp, E. coli
taataaccacgacatcaacacctga

SEQ ID NO: 172376 - DNA, 25 bp, E. coli
taatttgagtcatccagcggcatcc

SEQ ID NO: 172377 - DNA, 25 bp, E. coli
gataacaaagaaaatctacctaccg

SEQ ID NO: 172378 - DNA, 25 bp, E. coli
gataacaaagaatatctacctaccg

SEQ ID NO: 172379 - DNA, 25 bp, E. coli
taaaaagagcttgctgtggatcccc

SEQ ID NO: 172380 - DNA, 25 bp, E. coli
taaaaagagcttcctgtggatcccc

SEQ ID NO: 172381 - DNA, 25 bp, E. coli
atttcacgcggctattgcggcgggc

SEQ ID NO: 172382 - DNA, 25 bp, E. coli
atttcacgcggcaattgcggcgggc

SEQ ID NO: 172383 - DNA, 25 bp, E. coli
aaaacgccgtatatccatctggatg

SEQ ID NO: 172384 - DNA, 25 bp, E. coli
aaaacgccgtatttccatctggatg

SEQ ID NO: 172385 - DNA, 25 bp, E. coli
tcgccgagctcgttaaagaagtcgc

SEQ ID NO: 172386 - DNA, 25 bp, E. coli
tcgccgagctcgataaagaagtcgc

SEQ ID NO: 172387 - DNA, 25 bp, E. coli
gaaacaatcgcagtaaagctcacgg

SEQ ID NO: 172388 - DNA, 25 bp, E. coli
gaaacatgtggcgacctttgggcat

SEQ ID NO: 172389 - DNA, 25 bp, E. coli
gaaacaatcgcactaaagctcacgg

SEQ ID NO: 172390 - DNA, 25 bp, E. coli
gaaacatgtggccacctttgggcat

SEQ ID NO: 172391 - DNA, 25 bp, E. coli
ggatccccttcttcgggcagttgta

SEQ ID NO: 172392 - DNA, 25 bp, E. coli
ggatccccttctacgggcagttgta

SEQ ID NO: 172393 - DNA, 25 bp, E. coli
ggtgattgtcgatatgctgccgcca

SEQ ID NO: 172394 - DNA, 25 bp, E. coli
gtcagtatggcaaagatcaggttcg

SEQ ID NO: 172395 - DNA, 25 bp, E. coli
gtcagtatggcatagatcaggttcg

SEQ ID NO: 172396 - DNA, 25 bp, E. coli
ggtgattgtcgaaatgctgccgcca

SEQ ID NO: 172397 - DNA, 25 bp, E. coli
ggcagttgtactggttaaccggcaa

SEQ ID NO: 172398 - DNA, 25 bp, E. coli
ggcagttgtactcgttaaccggcaa

SEQ ID NO: 172399 - DNA, 25 bp, E. coli
taaccggcaacttattgatcgacag

SEQ ID NO: 172400 - DNA, 25 bp, E. coli
taaccggcaactaattgatcgacag

SEQ ID NO: 172401 - DNA, 25 bp, E. coli
cagattaccgcagttgatttagccg

SEQ ID NO: 172402 - DNA, 25 bp, E. coli
cagattaccgcacttgatttagccg

SEQ ID NO: 172403 - DNA, 25 bp, E. coli
tattaccgtccatgcaggcgaagct

SEQ ID NO: 172404 - DNA, 25 bp, E. coli
tttcaccaggctacatggcaatggc

SEQ ID NO: 172405 - DNA, 25 bp, E. coli
tattaccgtccaagcaggcgaagct

SEQ ID NO: 172406 - DNA, 25 bp, E. coli
tttcaccaggcttcatggcaatggc

SEQ ID NO: 172407 - DNA, 25 bp, E. coli
ttctcgccgagcaacaaattggtat

SEQ ID NO: 172408 - DNA, 25 bp, E. coli
ttctcgccgagctacaaattggtat

SEQ ID NO: 172409 - DNA, 25 bp, E. coli
tgaaaacattgaagatgcagcccgt

SEQ ID NO: 172410 - DNA, 25 bp, E. coli
tgaaaacgttccttgagcatggcat

SEQ ID NO: 172411 - DNA, 25 bp, E. coli
tgaaaacattgatgatgcagcccgt

SEQ ID NO: 172412 - DNA, 25 bp, E. coli
tgaaaacgttccatgagcatggcat

SEQ ID NO: 172413 - DNA, 25 bp, E. coli
tccgccaggcactgattaatggtct

SEQ ID NO: 172414 - DNA, 25 bp, E. coli
tccgccaggcacagattaatggtct

SEQ ID NO: 172415 - DNA, 25 bp, E. coli
gaccattcttgatcttggccgccag

SEQ ID NO: 172416 - DNA, 25 bp, E. coli
gaccattcttgaacttggccgccag

SEQ ID NO: 172417 - DNA, 25 bp, E. coli
gattccccacgtacaggtcattgcc

SEQ ID NO: 172418 - DNA, 25 bp, E. coli
gattccccacgttcaggtcattgcc

SEQ ID NO: 172419 - DNA, 25 bp, E. coli
ggtcattgccaacgaacccgatctg

SEQ ID NO: 172420 - DNA, 25 bp, E. coli
ggtcattgccaaggaacccgatctg

SEQ ID NO: 172421 - DNA, 25 bp, E. coli
tggaggcctttttagcccaccgtga

SEQ ID NO: 172422 - DNA, 25 bp, E. coli
tggaggccttttaagcccaccgtga

SEQ ID NO: 172423 - DNA, 25 bp, E. coli
caggatgctgattttactgcgaaaa

SEQ ID NO: 172424 - DNA, 25 bp, E. coli
catcggttccgaacttggtgcgtcg

SEQ ID NO: 172425 - DNA, 25 bp, E. coli
catcggttccgatcttggtgcgtcg

SEQ ID NO: 172426 - DNA, 25 bp, E. coli
caggatgctgatattactgcgaaaa

SEQ ID NO: 172427 - DNA, 25 bp, E. coli
aaaaagctcggctccatcggttccg

SEQ ID NO: 172428 - DNA, 25 bp, E. coli
aaactatcgccgttaagcaggcgga

SEQ ID NO: 172429 - DNA, 25 bp, E. coli
aaaaagctcggcaccatcggttccg

SEQ ID NO: 172430 - DNA, 25 bp, E. coli
aaactatcgccgataagcaggcgga

SEQ ID NO: 172431 - DNA, 25 bp, E. coli
tggtgcgtcgatgaaaggctttaaa

SEQ ID NO: 172432 - DNA, 25 bp, E. coli
tgagcgatgatgtaccaaagcagga

SEQ ID NO: 172433 - DNA, 25 bp, E. coli
tgagcgatgatgaaccaaagcagga

SEQ ID NO: 172434 - DNA, 25 bp, E. coli
tcaggaacaggcaaaaacagaagac

SEQ ID NO: 172435 - DNA, 25 bp, E. coli
tcaggaacaggctaaaacagaagac

SEQ ID NO: 172436 - DNA, 25 bp, E. coli
gcaggcggataccaatcaggaacag

SEQ ID NO: 172437 - DNA, 25 bp, E. coli
gcaggcggatacgaatcaggaacag

SEQ ID NO: 172438 - DNA, 25 bp, E. coli
cgttgtactgctatttggcaccaaa

SEQ ID NO: 172439 - DNA, 25 bp, E. coli
cgaagcgccacgttaaagagcaggt

SEQ ID NO: 172440 - DNA, 25 bp, E. coli
cgttgtactgctttttggcaccaaa

SEQ ID NO: 172441 - DNA, 25 bp, E. coli
cgaagcgccacgataaagagcaggt

SEQ ID NO: 172442 - DNA, 25 bp, E. coli
gattattgccgtcatcgttgtactg

SEQ ID NO: 172443 - DNA, 25 bp, E. coli
gattattgccgtgatcgttgtactg

SEQ ID NO: 172444 - DNA, 25 bp, E. coli
tggtgcgtcgatcaaaggctttaaa

SEQ ID NO: 172445 - DNA, 25 bp, E. coli
attgccaccgcggatcatgcacagg

SEQ ID NO: 172446 - DNA, 25 bp, E. coli
attgccaccgcgcatcatgcacagg

SEQ ID NO: 172447 - DNA, 25 bp, E. coli
ttccgcagtcggaagccgacgaaac

SEQ ID NO: 172448 - DNA, 25 bp, E. coli
ttccgcagtcggtagccgacgaaac

SEQ ID NO: 172449 - DNA, 25 bp, E. coli
tgtactgcgcgcaattgccaccgcg

SEQ ID NO: 172450 - DNA, 25 bp, E. coli
tgtactgcgcgctattgccaccgcg

SEQ ID NO: 172451 - DNA, 25 bp, E. coli
tctgttccgcagtcggaagccgacg

SEQ ID NO: 172452 - DNA, 25 bp, E. coli
tctgttccgcagacggaagccgacg

SEQ ID NO: 172453 - DNA, 25 bp, E. coli
gccaccgcgcatcatgcacaggaga

SEQ ID NO: 172454 - DNA, 25 bp, E. coli
gccaccgcgcatgatgcacaggaga

SEQ ID NO: 172455 - DNA, 25 bp, E. coli
ccttgattctgttccgcagtcggaa

SEQ ID NO: 172456 - DNA, 25 bp, E. coli
ccttgattctgtaccgcagtcggaa

SEQ ID NO: 172457 - DNA, 25 bp, E. coli
gacacctgcattctgatccgctcgg

SEQ ID NO: 172458 - DNA, 25 bp, E. coli
gacacctgcattgtgatccgctcgg

SEQ ID NO: 172459 - DNA, 25 bp, E. coli
ctgcattgtgatccgctcggcgctg

SEQ ID NO: 172460 - DNA, 25 bp, E. coli
ctgcattgtgatgcgctcggcgctg

SEQ ID NO: 172461 - DNA, 25 bp, E. coli
gattctgttccgcagtcggaagccg

SEQ ID NO: 172462 - DNA, 25 bp, E. coli
gtagtccttgatactgttccgcagt

SEQ ID NO: 172463 - DNA, 25 bp, E. coli
gattctgttccggagtcggaagccg

SEQ ID NO: 172464 - DNA, 25 bp, E. coli
gtagtccttgattctgttccgcagt

SEQ ID NO: 172465 - DNA, 25 bp, E. coli
ggcgatctcgacacctgcattgtga

SEQ ID NO: 172466 - DNA, 25 bp, E. coli
ggcgatctcgactcctgcattgtga

SEQ ID NO: 172467 - DNA, 25 bp, E. coli
cacggcattaataacgcttcttgag

SEQ ID NO: 172468 - DNA, 25 bp, E. coli
cacggcattaattacgcttcttgag

SEQ ID NO: 172469 - DNA, 25 bp, E. coli
taaatgagttgcaggaaatagagac

SEQ ID NO: 172470 - DNA, 25 bp, E. coli
taaatgagttgctggaaatagagac

SEQ ID NO: 172471 - DNA, 25 bp, E. coli
tagaccgcgcatttcttgcactttc

SEQ ID NO: 172472 - DNA, 25 bp, E. coli
tagaccgcgcatatcttgcactttc

SEQ ID NO: 172473 - DNA, 25 bp, E. coli
tttaccacgaaacaatagaccgcgc

SEQ ID NO: 172474 - DNA, 25 bp, E. coli
tttaccacgaaagaatagaccgcgc

SEQ ID NO: 172475 - DNA, 25 bp, E. coli
ttacacgaccagaataaagcgcccc

SEQ ID NO: 172476 - DNA, 25 bp, E. coli
ttacacgaccagtataaagcgcccc

SEQ ID NO: 172477 - DNA, 25 bp, E. coli
taaagcgccccacaccggagaataa

SEQ ID NO: 172478 - DNA, 25 bp, E. coli
taaagcgccccagaccggagaataa

SEQ ID NO: 172479 - DNA, 25 bp, E. coli
gcttcttgagccagtaataaatgag

SEQ ID NO: 172480 - DNA, 25 bp, E. coli
gcttcttgagcctgtaataaatgag

SEQ ID NO: 172481 - DNA, 25 bp, E. coli
gaaatagagacaatacacgaccagt

SEQ ID NO: 172482 - DNA, 25 bp, E. coli
gaaatcaaggatagtcacggcatta

SEQ ID NO: 172483 - DNA, 25 bp, E. coli
gaaatagagacattacacgaccagt

SEQ ID NO: 172484 - DNA, 25 bp, E. coli
gaaatcaaggattgtcacggcatta

SEQ ID NO: 172485 - DNA, 25 bp, E. coli
cgcatatgtcttgaaacgcttggag

SEQ ID NO: 172486 - DNA, 25 bp, E. coli
cgcatatgtcttcaaacgcttggag

SEQ ID NO: 172487 - DNA, 25 bp, E. coli
cgcttggagataatgaacgtgataa

SEQ ID NO: 172488 - DNA, 25 bp, E. coli
cgcttggagatattgaacgtgataa

SEQ ID NO: 172489 - DNA, 25 bp, E. coli
caatatattccagcctcactgcggg

SEQ ID NO: 172490 - DNA, 25 bp, E. coli
caatatattccaccctcactgcggg

SEQ ID NO: 172491 - DNA, 25 bp, E. coli
aaaaagtgttgctcgaggccagtca

SEQ ID NO: 172492 - DNA, 25 bp, E. coli
aaaagtctgcgttgcctggaatacc

SEQ ID NO: 172493 - DNA, 25 bp, E. coli
aaaaagtgttgcacgaggccagtca

SEQ ID NO: 172494 - DNA, 25 bp, E. coli
aaaagtctgcgtagcctggaatacc

SEQ ID NO: 172495 - DNA, 25 bp, E. coli
tatatcgataccatccaggcggctg

SEQ ID NO: 172496 - DNA, 25 bp, E. coli
tatatcgataccttccaggcggctg

SEQ ID NO: 172497 - DNA, 25 bp, E. coli
tattgtctattacgctggcccggcg

SEQ ID NO: 172498 - DNA, 25 bp, E. coli
tattgtctattaggctggcccggcg

SEQ ID NO: 172499 - DNA, 25 bp, E. coli
tcttaacgatcaccaggccagcagt

SEQ ID NO: 172500 - DNA, 25 bp, E. coli
tcttaacgatcagcaggccagcagt

SEQ ID NO: 172501 - DNA, 25 bp, E. coli
gcttttcacaaattgcgccgctgga

SEQ ID NO: 172502 - DNA, 25 bp, E. coli
gcttttcacaaaatgcgccgctgga

SEQ ID NO: 172503 - DNA, 25 bp, E. coli
gaaaacaccggagaacatggcctgc

SEQ ID NO: 172504 - DNA, 25 bp, E. coli
gaaaacaccggacaacatggcctgc

SEQ ID NO: 172505 - DNA, 25 bp, E. coli
tcactgcgggaacaaaatcacgcgc

SEQ ID NO: 172506 - DNA, 25 bp, E. coli
taagtggtcccaacgtagtggcgcg

SEQ ID NO: 172507 - DNA, 25 bp, E. coli
tcactgcgggaagaaaatcacgcgc

SEQ ID NO: 172508 - DNA, 25 bp, E. coli
taagtggtcccatcgtagtggcgcg

SEQ ID NO: 172509 - DNA, 25 bp, E. coli
gatatggaccggtggtaacgacgcc

SEQ ID NO: 172510 - DNA, 25 bp, E. coli
gatatggaccggaggtaacgacgcc

SEQ ID NO: 172511 - DNA, 25 bp, E. coli
taaacccttcaagaaacagcaggct

SEQ ID NO: 172512 - DNA, 25 bp, E. coli
taaacccttcaacaaacagcaggct

SEQ ID NO: 172513 - DNA, 25 bp, E. coli
aacagcaggctgtaccccgcgaacg

SEQ ID NO: 172514 - DNA, 25 bp, E. coli
aacagcaggctgaaccccgcgaacg

SEQ ID NO: 172515 - DNA, 25 bp, E. coli
ttttgatccgcaggggcgtaccagc

SEQ ID NO: 172516 - DNA, 25 bp, E. coli
ttttgatccgcacgggcgtaccagc

SEQ ID NO: 172517 - DNA, 25 bp, E. coli
tgtccgtgagatgatctcggttgcg

SEQ ID NO: 172518 - DNA, 25 bp, E. coli
tgtccgtgagatcatctcggttgcg

SEQ ID NO: 172519 - DNA, 25 bp, E. coli
tctcggttgcgaatgagattgccga

SEQ ID NO: 172520 - DNA, 25 bp, E. coli
tctcggttgcgattgagattgccga

SEQ ID NO: 172521 - DNA, 25 bp, E. coli
cctatgcggacaacgtgcgtgaacg

SEQ ID NO: 172522 - DNA, 25 bp, E. coli
cctatgcggacatcgtgcgtgaacg

SEQ ID NO: 172523 - DNA, 25 bp, E. coli
gcgtaccagcgatgatctgctggat

SEQ ID NO: 172524 - DNA, 25 bp, E. coli
gcgtaccagcgaagatctgctggat

SEQ ID NO: 172525 - DNA, 25 bp, E. coli
ggttgcgaatgagattgccgaagct

SEQ ID NO: 172526 - DNA, 25 bp, E. coli
ggttgcgaatgacattgccgaagct

SEQ ID NO: 172527 - DNA, 25 bp, E. coli
tggcaggaaatatacccttcaacaa

SEQ ID NO: 172528 - DNA, 25 bp, E. coli
tggcaggaaataaacccttcaacaa

SEQ ID NO: 172529 - DNA, 25 bp, E. coli
tcaacaaacagctggctgaaccccg

SEQ ID NO: 172530 - DNA, 25 bp, E. coli
tcaacaaacagcaggctgaaccccg

SEQ ID NO: 172531 - DNA, 25 bp, E. coli
gagatgatctcgcttgcgaatgaga

SEQ ID NO: 172532 - DNA, 25 bp, E. coli
gagatgatctcggttgcgaatgaga

SEQ ID NO: 172533 - DNA, 25 bp, E. coli
caaccctggagaaagtctggcacgc

SEQ ID NO: 172534 - DNA, 25 bp, E. coli
aattttcgcttcttggacccgctgc

SEQ ID NO: 172535 - DNA, 25 bp, E. coli
aattttcgcttcatggacccgctgc

SEQ ID NO: 172536 - DNA, 25 bp, E. coli
catgcccgggcggtttgaactaaaa

SEQ ID NO: 172537 - DNA, 25 bp, E. coli
catgcccgggcgctttgaactaaaa

SEQ ID NO: 172538 - DNA, 25 bp, E. coli
caaccctggagatagtctggcacgc

SEQ ID NO: 172539 - DNA, 25 bp, E. coli
cagaagaacagcagcgggcgcaatt

SEQ ID NO: 172540 - DNA, 25 bp, E. coli
cagaagaacagctgcgggcgcaatt

SEQ ID NO: 172541 - DNA, 25 bp, E. coli
atcctgatcaggtggctccggtcgc

SEQ ID NO: 172542 - DNA, 25 bp, E. coli
atcctgatcaggaggctccggtcgc

SEQ ID NO: 172543 - DNA, 25 bp, E. coli
tgattgaggaactagacgcggagca

SEQ ID NO: 172544 - DNA, 25 bp, E. coli
tgattgaggaacaagacgcggagca

SEQ ID NO: 172545 - DNA, 25 bp, E. coli
tgacgggcttaagcattgatacggg

SEQ ID NO: 172546 - DNA, 25 bp, E. coli
tgacgggcttaaccattgatacggg

SEQ ID NO: 172547 - DNA, 25 bp, E. coli
gcaaccattccacccagatagcgga

SEQ ID NO: 172548 - DNA, 25 bp, E. coli
gcaaccattccagccagatagcgga

SEQ ID NO: 172549 - DNA, 25 bp, E. coli
gaagcgcagttagatattcagtcgc

SEQ ID NO: 172550 - DNA, 25 bp, E. coli
gaagcgcagttacatattcagtcgc

SEQ ID NO: 172551 - DNA, 25 bp, E. coli
tgtcgaacccggtaaaacgatggcg

SEQ ID NO: 172552 - DNA, 25 bp, E. coli
tgtcgaacccggaaaaacgatggcg

SEQ ID NO: 172553 - DNA, 25 bp, E. coli
gatggtgaaaatgcgccagaacgcc

SEQ ID NO: 172554 - DNA, 25 bp, E. coli
gatggtgaaaatccgccagaacgcc

SEQ ID NO: 172555 - DNA, 25 bp, E. coli
cacggtttatcacatcccggcggaa

SEQ ID NO: 172556 - DNA, 25 bp, E. coli
cacggtttatcagatcccggcggaa

SEQ ID NO: 172557 - DNA, 25 bp, E. coli
cagatcccggcggaatccaatggta

SEQ ID NO: 172558 - DNA, 25 bp, E. coli
cagatcccggcgcaatccaatggta

SEQ ID NO: 172559 - DNA, 25 bp, E. coli
tacgtatcaaccgtagttccatcag

SEQ ID NO: 172560 - DNA, 25 bp, E. coli
tacgtatcaaccctagttccatcag

SEQ ID NO: 172561 - DNA, 25 bp, E. coli
acttccctaatctggcaaaagtagg

SEQ ID NO: 172562 - DNA, 25 bp, E. coli
agttccatcagatatcaccccaggg

SEQ ID NO: 172563 - DNA, 25 bp, E. coli
agttccatcagaaatcaccccaggg

SEQ ID NO: 172564 - DNA, 25 bp, E. coli
acttccctaatcaggcaaaagtagg

SEQ ID NO: 172565 - DNA, 25 bp, E. coli
tattggcgagcgtagcccaaaaatt

SEQ ID NO: 172566 - DNA, 25 bp, E. coli
tattggcgagcgaagcccaaaaatt

SEQ ID NO: 172567 - DNA, 25 bp, E. coli
tcccggcggaatccaatggtattgt

SEQ ID NO: 172568 - DNA, 25 bp, E. coli
tcccggcggaatgcaatggtattgt

SEQ ID NO: 172569 - DNA, 25 bp, E. coli
ccgaacagtttcctaatattggcga

SEQ ID NO: 172570 - DNA, 25 bp, E. coli
gaatccaatggtattgtcaatgttg

SEQ ID NO: 172571 - DNA, 25 bp, E. coli
gaatccaatggttttgtcaatgttg

SEQ ID NO: 172572 - DNA, 25 bp, E. coli
ccgaacagtttcgtaatattggcga

SEQ ID NO: 172573 - DNA, 25 bp, E. coli
cgtaatattggccagcgtagcccaa

SEQ ID NO: 172574 - DNA, 25 bp, E. coli
cgtaatattggcgagcgtagcccaa

SEQ ID NO: 172575 - DNA, 25 bp, E. coli
taatctggcaaatgtaggctctttt

SEQ ID NO: 172576 - DNA, 25 bp, E. coli
taatctggcaaaagtaggctctttt

SEQ ID NO: 172577 - DNA, 25 bp, E. coli
caaacaggttgtatgactaatcaga

SEQ ID NO: 172578 - DNA, 25 bp, E. coli
caaacaggttgtttgactaatcaga

SEQ ID NO: 172579 - DNA, 25 bp, E. coli
cactttatgatccaggaaaaggcgt

SEQ ID NO: 172580 - DNA, 25 bp, E. coli
cactttatgatcgaggaaaaggcgt

SEQ ID NO: 172581 - DNA, 25 bp, E. coli
taaagtttgctatcctgtcgtacca

SEQ ID NO: 172582 - DNA, 25 bp, E. coli
taaaactgctcattaatcatcagga

SEQ ID NO: 172583 - DNA, 25 bp, E. coli
taaaactgctcaataatcatcagga

SEQ ID NO: 172584 - DNA, 25 bp, E. coli
tatgactaatcacaagggaacccat

SEQ ID NO: 172585 - DNA, 25 bp, E. coli
tatgactaatcagaagggaacccat

SEQ ID NO: 172586 - DNA, 25 bp, E. coli
tgtcgtaccaatacaaacaggttgt

SEQ ID NO: 172587 - DNA, 25 bp, E. coli
tgtcgtaccaattcaaacaggttgt

SEQ ID NO: 172588 - DNA, 25 bp, E. coli
tcgattaaaccaagatccgcgccac

SEQ ID NO: 172589 - DNA, 25 bp, E. coli
tcgattaaaccatgatccgcgccac

SEQ ID NO: 172590 - DNA, 25 bp, E. coli
gaatgcaatgtgttctaccacttta

SEQ ID NO: 172591 - DNA, 25 bp, E. coli
gaatgcaatgtgatctaccacttta

SEQ ID NO: 172592 - DNA, 25 bp, E. coli
cattacgcgcgaattgaatgcaatg

SEQ ID NO: 172593 - DNA, 25 bp, E. coli
cattacgcgcgatttgaatgcaatg

SEQ ID NO: 172594 - DNA, 25 bp, E. coli
gatccgcgccactcttttctcataa

SEQ ID NO: 172595 - DNA, 25 bp, E. coli
taatcatcaggacttgatcaaaaca

SEQ ID NO: 172596 - DNA, 25 bp, E. coli
taaagtttgctaacctgtcgtacca

SEQ ID NO: 172597 - DNA, 25 bp, E. coli
taatcatcaggagttgatcaaaaca

SEQ ID NO: 172598 - DNA, 25 bp, E. coli
gatccgcgccacacttttctcataa

SEQ ID NO: 172599 - DNA, 25 bp, E. coli
aacgataaaagaactggtctcaacc

SEQ ID NO: 172600 - DNA, 25 bp, E. coli
aacgataaaagatctggtctcaacc

SEQ ID NO: 172601 - DNA, 25 bp, E. coli
aaaacgctgagccattctgtgccag

SEQ ID NO: 172602 - DNA, 25 bp, E. coli
aaaacgctgagcgattctgtgccag

SEQ ID NO: 172603 - DNA, 25 bp, E. coli
tagagttgcagtttgcggttcagca

SEQ ID NO: 172604 - DNA, 25 bp, E. coli
tagaaagtggaatgttgaaaacgat

SEQ ID NO: 172605 - DNA, 25 bp, E. coli
tagaaagtggaaagttgaaaacgat

SEQ ID NO: 172606 - DNA, 25 bp, E. coli
tagagttgcagtatgcggttcagca

SEQ ID NO: 172607 - DNA, 25 bp, E. coli
tctgaaattactgaacaaatgggtg

SEQ ID NO: 172608 - DNA, 25 bp, E. coli
tctgaaattactcaacaaatgggtg

SEQ ID NO: 172609 - DNA, 25 bp, E. coli
tctgcttatgtttacgtagaaagtg

SEQ ID NO: 172610 - DNA, 25 bp, E. coli
tctgcttatgttaacgtagaaagtg

SEQ ID NO: 172611 - DNA, 25 bp, E. coli
gccagagttactaaatagcaccgat

SEQ ID NO: 172612 - DNA, 25 bp, E. coli
gccagagttacttaatagcaccgat

SEQ ID NO: 172613 - DNA, 25 bp, E. coli
gcggttcagcaatattctgcttatg

SEQ ID NO: 172614 - DNA, 25 bp, E. coli
gcggttcagcaaaattctgcttatg

SEQ ID NO: 172615 - DNA, 25 bp, E. coli
gcaccgatttggttaatgaccctga

SEQ ID NO: 172616 - DNA, 25 bp, E. coli
gcaccgatttggataatgaccctga

SEQ ID NO: 172617 - DNA, 25 bp, E. coli
ggtctcaaccatatctaaccgtagt

SEQ ID NO: 172618 - DNA, 25 bp, E. coli
ggtctcaaccatttctaaccgtagt

SEQ ID NO: 172619 - DNA, 25 bp, E. coli
gaccctgaaaaaatgttagagttgc

SEQ ID NO: 172620 - DNA, 25 bp, E. coli
gaccctgaaaaattgttagagttgc

SEQ ID NO: 172621 - DNA, 25 bp, E. coli
aagtgtttgtcgatacgccgctggc

SEQ ID NO: 172622 - DNA, 25 bp, E. coli
aagtgtttgtcgttacgccgctggc

SEQ ID NO: 172623 - DNA, 25 bp, E. coli
tacgaagcgcctgaatcggcagaaa

SEQ ID NO: 172624 - DNA, 25 bp, E. coli
acgaaaacgtcgtctggcatagcca

SEQ ID NO: 172625 - DNA, 25 bp, E. coli
acgaaaacgtcgactggcatagcca

SEQ ID NO: 172626 - DNA, 25 bp, E. coli
tacgaagcgcctcaatcggcagaaa

SEQ ID NO: 172627 - DNA, 25 bp, E. coli
ttatataagaaaccgcgtgccggtg

SEQ ID NO: 172628 - DNA, 25 bp, E. coli
ttatataagaaagcgcgtgccggtg

SEQ ID NO: 172629 - DNA, 25 bp, E. coli
gccacggattatgcagcgatctcgg

SEQ ID NO: 172630 - DNA, 25 bp, E. coli
gccacggattatccagcgatctcgg

SEQ ID NO: 172631 - DNA, 25 bp, E. coli
gcgaatttgatggttgaagccggac

SEQ ID NO: 172632 - DNA, 25 bp, E. coli
gcgaatttgatgcttgaagccggac

SEQ ID NO: 172633 - DNA, 25 bp, E. coli
gaatagattccgattacgaagcgcc

SEQ ID NO: 172634 - DNA, 25 bp, E. coli
gaatagattccgtttacgaagcgcc

SEQ ID NO: 172635 - DNA, 25 bp, E. coli
gaacgccagatggttcgcgaacgcg

SEQ ID NO: 172636 - DNA, 25 bp, E. coli
gaacgccagatgcttcgcgaacgcg

SEQ ID NO: 172637 - DNA, 25 bp, E. coli
cgtaaagagaatatccgtcgcgtcg

SEQ ID NO: 172638 - DNA, 25 bp, E. coli
ctggcgatttgccaagcccgcgatc

SEQ ID NO: 172639 - DNA, 25 bp, E. coli
cgtaaagagaatttccgtcgcgtcg

SEQ ID NO: 172640 - DNA, 25 bp, E. coli
ctggcgatttgcgaagcccgcgatc

SEQ ID NO: 172641 - DNA, 25 bp, E. coli
ggtgaactgcgcaactttacgggaa

SEQ ID NO: 172642 - DNA, 25 bp, E. coli
ggtgaactgcgctactttacgggaa

SEQ ID NO: 172643 - DNA, 25 bp, E. coli
tatgctggcggcacctttgacacag

SEQ ID NO: 172644 - DNA, 25 bp, E. coli
ttaagattagcgtttcctgtccggc

SEQ ID NO: 172645 - DNA, 25 bp, E. coli
tatgctggcggctcctttgacacag

SEQ ID NO: 172646 - DNA, 25 bp, E. coli
ttaagattagcgattcctgtccggc

SEQ ID NO: 172647 - DNA, 25 bp, E. coli
tcgaccgaagagcaaggcgatgcct

SEQ ID NO: 172648 - DNA, 25 bp, E. coli
tcgaccgaagaggaaggcgatgcct

SEQ ID NO: 172649 - DNA, 25 bp, E. coli
tcatcagcctgagttacgtcagccg

SEQ ID NO: 172650 - DNA, 25 bp, E. coli
tcatcagcctgacttacgtcagccg

SEQ ID NO: 172651 - DNA, 25 bp, E. coli
gacacaggcgatttcggtcggcaat

SEQ ID NO: 172652 - DNA, 25 bp, E. coli
gacacaggcgatatcggtcggcaat

SEQ ID NO: 172653 - DNA, 25 bp, E. coli
cgtaacattaacaaaggccctgctg

SEQ ID NO: 172654 - DNA, 25 bp, E. coli
cgtaacattaactaaggccctgctg

SEQ ID NO: 172655 - DNA, 25 bp, E. coli
ggtagtacgaccacgtcaggttcag

SEQ ID NO: 172656 - DNA, 25 bp, E. coli
gggaatcactatgtggtctataacg

SEQ ID NO: 172657 - DNA, 25 bp, E. coli
ggatataccgtaatgccatcagtgc

SEQ ID NO: 172658 - DNA, 25 bp, E. coli
ggatataccgtattgccatcagtgc

SEQ ID NO: 172659 - DNA, 25 bp, E. coli
gggaatcactatctggtctataacg

SEQ ID NO: 172660 - DNA, 25 bp, E. coli
ggtagtacgacctcgtcaggttcag

SEQ ID NO: 172661 - DNA, 25 bp, E. coli
ggcgatgcctggtatctacgtccgg

SEQ ID NO: 172662 - DNA, 25 bp, E. coli
ggcgatgcctggaatctacgtccgg

SEQ ID NO: 172663 - DNA, 25 bp, E. coli
tactaccgggtctcatttcgcgagg

SEQ ID NO: 172664 - DNA, 25 bp, E. coli
tactaccgggtcacatttcgcgagg

SEQ ID NO: 172665 - DNA, 25 bp, E. coli
caatactgtgttcacggtacgcgca

SEQ ID NO: 172666 - DNA, 25 bp, E. coli
caatactgtgttgacggtacgcgca

SEQ ID NO: 172667 - DNA, 25 bp, E. coli
caccgataaagtgatcagcctgatt

SEQ ID NO: 172668 - DNA, 25 bp, E. coli
caccgataaagtcatcagcctgatt

SEQ ID NO: 172669 - DNA, 25 bp, E. coli
aaccttcaccgataaagtgatcagc

SEQ ID NO: 172670 - DNA, 25 bp, E. coli
aaagtgatcagcgtgattaaccagc

SEQ ID NO: 172671 - DNA, 25 bp, E. coli
aaagtgatcagcctgattaaccagc

SEQ ID NO: 172672 - DNA, 25 bp, E. coli
aaccttcaccgaaaaagtgatcagc

SEQ ID NO: 172673 - DNA, 25 bp, E. coli
gcctcggctgggtaaccttcaccga

SEQ ID NO: 172674 - DNA, 25 bp, E. coli
gcctcggctgggaaaccttcaccga

SEQ ID NO: 172675 - DNA, 25 bp, E. coli
cgttctgctactcaatactgtgttg

SEQ ID NO: 172676 - DNA, 25 bp, E. coli
cgttctgctactgaatactgtgttg

SEQ ID NO: 172677 - DNA, 25 bp, E. coli
ctgtgttgacggaacgcgcaggtca

SEQ ID NO: 172678 - DNA, 25 bp, E. coli
ctgtgttgacggtacgcgcaggtca

SEQ ID NO: 172679 - DNA, 25 bp, E. coli
cttcaccgataaagtgatcagcctg

SEQ ID NO: 172680 - DNA, 25 bp, E. coli
cttcaccgataatgtgatcagcctg

SEQ ID NO: 172681 - DNA, 25 bp, E. coli
gggcgttctgcttctcaatactgtg

SEQ ID NO: 172682 - DNA, 25 bp, E. coli
gggcgttctgctactcaatactgtg

SEQ ID NO: 172683 - DNA, 25 bp, E. coli
ggctgggaaaccttcaccgataaag

SEQ ID NO: 172684 - DNA, 25 bp, E. coli
tgggaaaccttcaccgataaagtga

SEQ ID NO: 172685 - DNA, 25 bp, E. coli
tgggaaaccttctccgataaagtga

SEQ ID NO: 172686 - DNA, 25 bp, E. coli
ggctgggaaaccatcaccgataaag

SEQ ID NO: 172687 - DNA, 25 bp, E. coli
taaaaggctttaccgcgacgacgtt

SEQ ID NO: 172688 - DNA, 25 bp, E. coli
taaaaggctttagcgcgacgacgtt

SEQ ID NO: 172689 - DNA, 25 bp, E. coli
aaaaatccaaagtaccgcgatgcgc

SEQ ID NO: 172690 - DNA, 25 bp, E. coli
aaaaatccaaagaaccgcgatgcgc

SEQ ID NO: 172691 - DNA, 25 bp, E. coli
aacgtcggtcactggaaaaatgcgc

SEQ ID NO: 172692 - DNA, 25 bp, E. coli
aacgtcggtcacaggaaaaatgcgc

SEQ ID NO: 172693 - DNA, 25 bp, E. coli
ttggttcacgaccatgctcgcctgg

SEQ ID NO: 172694 - DNA, 25 bp, E. coli
ttggttcacgacgatgctcgcctgg

SEQ ID NO: 172695 - DNA, 25 bp, E. coli
tgacgccgccagtggtaaaaggctt

SEQ ID NO: 172696 - DNA, 25 bp, E. coli
tgacgccgccagaggtaaaaggctt

SEQ ID NO: 172697 - DNA, 25 bp, E. coli
tctgcatgaaaagaccgcgatagcg

SEQ ID NO: 172698 - DNA, 25 bp, E. coli
tctgcatgaaaacaccgcgatagcg

SEQ ID NO: 172699 - DNA, 25 bp, E. coli
cgatagcgttgtgttccgaatggaa

SEQ ID NO: 172700 - DNA, 25 bp, E. coli
cgatagcgttgtcttccgaatggaa

SEQ ID NO: 172701 - DNA, 25 bp, E. coli
cggttgatcgacagcttattgcgca

SEQ ID NO: 172702 - DNA, 25 bp, E. coli
cattgaaaaatcactgcctggcgag

SEQ ID NO: 172703 - DNA, 25 bp, E. coli
cattgaaaaatctctgcctggcgag

SEQ ID NO: 172704 - DNA, 25 bp, E. coli
cggttgatcgactgcttattgcgca

SEQ ID NO: 172705 - DNA, 25 bp, E. coli
gttacaacaatcatagcgacccagg

SEQ ID NO: 172706 - DNA, 25 bp, E. coli
gttacaacaatcttagcgacccagg

SEQ ID NO: 172707 - DNA, 25 bp, E. coli
ggaaaacctatcatgatgcccgacg

SEQ ID NO: 172708 - DNA, 25 bp, E. coli
ggaaaacctatcttgatgcccgacg

SEQ ID NO: 172709 - DNA, 25 bp, E. coli
acgaaaacagaggtaaagcgccgtt

SEQ ID NO: 172710 - DNA, 25 bp, E. coli
aatttcacgaaaacagagctaaagc

SEQ ID NO: 172711 - DNA, 25 bp, E. coli
aatttcacgaaatcagagctaaagc

SEQ ID NO: 172712 - DNA, 25 bp, E. coli
acgaaaacagagctaaagcgccgtt

SEQ ID NO: 172713 - DNA, 25 bp, E. coli
aagcgccgtttaacggcctggtgca

SEQ ID NO: 172714 - DNA, 25 bp, E. coli
aagcgccgtttatcggcctggtgca

SEQ ID NO: 172715 - DNA, 25 bp, E. coli
tatcggcctggtgcaactctggcag

SEQ ID NO: 172716 - DNA, 25 bp, E. coli
tatcggcctggtccaactctggcag

SEQ ID NO: 172717 - DNA, 25 bp, E. coli
tttcacgaaaactgagctaaagcgc

SEQ ID NO: 172718 - DNA, 25 bp, E. coli
tttcacgaaaacagagctaaagcgc

SEQ ID NO: 172719 - DNA, 25 bp, E. coli
tcacgaaaacagagctaaagcgccg

SEQ ID NO: 172720 - DNA, 25 bp, E. coli
gaaaacagagctaaagcgccgttta

SEQ ID NO: 172721 - DNA, 25 bp, E. coli
gaaaacagagcttaagcgccgttta

SEQ ID NO: 172722 - DNA, 25 bp, E. coli
ccgtttatcggcctggtgcaactct

SEQ ID NO: 172723 - DNA, 25 bp, E. coli
ccgtttatcggcgtggtgcaactct

SEQ ID NO: 172724 - DNA, 25 bp, E. coli
gtttatcggcctggtgcaactctgg

SEQ ID NO: 172725 - DNA, 25 bp, E. coli
gtttatcggcctcgtgcaactctgg

SEQ ID NO: 172726 - DNA, 25 bp, E. coli
tcacgaaaacagtgctaaagcgccg

SEQ ID NO: 172727 - DNA, 25 bp, E. coli
gagtgatgagcggttgaaggatatc

SEQ ID NO: 172728 - DNA, 25 bp, E. coli
gagtgatgagcgcttgaaggatatc

SEQ ID NO: 172729 - DNA, 25 bp, E. coli
gagcggttgaagcatatcgggttac

SEQ ID NO: 172730 - DNA, 25 bp, E. coli
gagcggttgaaggatatcgggttac

SEQ ID NO: 172731 - DNA, 25 bp, E. coli
aaccttgaagcctgcgcctggcgcg

SEQ ID NO: 172732 - DNA, 25 bp, E. coli
aaccttgaagccagcgcctggcgcg

SEQ ID NO: 172733 - DNA, 25 bp, E. coli
cataaaaaccttcaagcctgcgcct

SEQ ID NO: 172734 - DNA, 25 bp, E. coli
cataaaaaccttgaagcctgcgcct

SEQ ID NO: 172735 - DNA, 25 bp, E. coli
ctatggcaacaaccctaaaggcata

SEQ ID NO: 172736 - DNA, 25 bp, E. coli
ctatggcaacaagcctaaaggcata

SEQ ID NO: 172737 - DNA, 25 bp, E. coli
aaaaaccttgaaccctgcgcctggc

SEQ ID NO: 172738 - DNA, 25 bp, E. coli
aaaaaccttgaagcctgcgcctggc

SEQ ID NO: 172739 - DNA, 25 bp, E. coli
tatttatcaaccctcttacagacgc

SEQ ID NO: 172740 - DNA, 25 bp, E. coli
tatttatcaaccgtcttacagacgc

SEQ ID NO: 172741 - DNA, 25 bp, E. coli
tgccagcaaatttatttatcaaccg

SEQ ID NO: 172742 - DNA, 25 bp, E. coli
tgccagcaaattaatttatcaaccg

SEQ ID NO: 172743 - DNA, 25 bp, E. coli
tctggttagtggaagcgatgatgct

SEQ ID NO: 172744 - DNA, 25 bp, E. coli
tctggttagtggtagcgatgatgct

SEQ ID NO: 172745 - DNA, 25 bp, E. coli
gcgatgatgctatgcataaaaacct

SEQ ID NO: 172746 - DNA, 25 bp, E. coli
gcgatgatgctaagcataaaaacct

SEQ ID NO: 172747 - DNA, 25 bp, E. coli
cgcctggcgcggacaggtcggtgtc

SEQ ID NO: 172748 - DNA, 25 bp, E. coli
cgcctggcgcggtcaggtcggtgtc

SEQ ID NO: 172749 - DNA, 25 bp, E. coli
gtcttacagacggttccattctggt

SEQ ID NO: 172750 - DNA, 25 bp, E. coli
gtcttacagacgcttccattctggt

SEQ ID NO: 172751 - DNA, 25 bp, E. coli
gacgcttccattgtggttagtggta

SEQ ID NO: 172752 - DNA, 25 bp, E. coli
gacgcttccattctggttagtggta

SEQ ID NO: 172753 - DNA, 25 bp, E. coli
cagctcctgttattggtcgttcgcc

SEQ ID NO: 172754 - DNA, 25 bp, E. coli
caaactagcacaccaaaagcagcaa

SEQ ID NO: 172755 - DNA, 25 bp, E. coli
caaactagcacagcaaaagcagcaa

SEQ ID NO: 172756 - DNA, 25 bp, E. coli
cagctcctgttaatggtcgttcgcc

SEQ ID NO: 172757 - DNA, 25 bp, E. coli
tatacatcgcaggtcctgttattgg

SEQ ID NO: 172758 - DNA, 25 bp, E. coli
tatacatcgcagctcctgttattgg

SEQ ID NO: 172759 - DNA, 25 bp, E. coli
tgttattggtcgatcgccttacaaa

SEQ ID NO: 172760 - DNA, 25 bp, E. coli
tgttattggtcgttcgccttacaaa

SEQ ID NO: 172761 - DNA, 25 bp, E. coli
ccttacaaaatgaagaaagagaatc

SEQ ID NO: 172762 - DNA, 25 bp, E. coli
ccttacaaaatgtagaaagagaatc

SEQ ID NO: 172763 - DNA, 25 bp, E. coli
gaagaaagagaaactttactttcat

SEQ ID NO: 172764 - DNA, 25 bp, E. coli
gaagaaagagaatctttactttcat

SEQ ID NO: 172765 - DNA, 25 bp, E. coli
gaaagcaaactagcacagcaaaagc

SEQ ID NO: 172766 - DNA, 25 bp, E. coli
gaaataatatacttcgcagctcctg

SEQ ID NO: 172767 - DNA, 25 bp, E. coli
gaaagcaaactaccacagcaaaagc

SEQ ID NO: 172768 - DNA, 25 bp, E. coli
gaaataatatacatcgcagctcctg

SEQ ID NO: 172769 - DNA, 25 bp, E. coli
cgttcgccttactaaatgaagaaag

SEQ ID NO: 172770 - DNA, 25 bp, E. coli
cgttcgccttacaaaatgaagaaag

SEQ ID NO: 172771 - DNA, 25 bp, E. coli
cattttgaaagctaactagcacagc

SEQ ID NO: 172772 - DNA, 25 bp, E. coli
cattttgaaagcaaactagcacagc

SEQ ID NO: 172773 - DNA, 25 bp, E. coli
tggtcgttcgccttacaaaatgaag

SEQ ID NO: 172774 - DNA, 25 bp, E. coli
tggtcgttcgccatacaaaatgaag

SEQ ID NO: 172775 - DNA, 25 bp, E. coli
caaccgaaatatcggctggacaatg

SEQ ID NO: 172776 - DNA, 25 bp, E. coli
aatatcggctggtcaatggcgatct

SEQ ID NO: 172777 - DNA, 25 bp, E. coli
aatatcggctggacaatggcgatct

SEQ ID NO: 172778 - DNA, 25 bp, E. coli
aaccgaaatatccgctggacaatgg

SEQ ID NO: 172779 - DNA, 25 bp, E. coli
caaccgaaatatgggctggacaatg

SEQ ID NO: 172780 - DNA, 25 bp, E. coli
atatcggctggagaatggcgatctg

SEQ ID NO: 172781 - DNA, 25 bp, E. coli
atatcggctggacaatggcgatctg

SEQ ID NO: 172782 - DNA, 25 bp, E. coli
aaccgaaatatcggctggacaatgg

SEQ ID NO: 172783 - DNA, 25 bp, E. coli
aaatatcggctgcacaatggcgatc

SEQ ID NO: 172784 - DNA, 25 bp, E. coli
aaatatcggctggacaatggcgatc

SEQ ID NO: 172785 - DNA, 25 bp, E. coli
cctgcttcgtgataatacccgcatc

SEQ ID NO: 172786 - DNA, 25 bp, E. coli
cctgcttcgtgaaaatacccgcatc

SEQ ID NO: 172787 - DNA, 25 bp, E. coli
ccaaccgaaataacggctggacaat

SEQ ID NO: 172788 - DNA, 25 bp, E. coli
ccaaccgaaatatcggctggacaat

SEQ ID NO: 172789 - DNA, 25 bp, E. coli
gaaatatcggctcgacaatggcgat

SEQ ID NO: 172790 - DNA, 25 bp, E. coli
gaaatatcggctggacaatggcgat

SEQ ID NO: 172791 - DNA, 25 bp, E. coli
ccgaaatatcgggtggacaatggcg

SEQ ID NO: 172792 - DNA, 25 bp, E. coli
cgaaatatcggcaggacaatggcga

SEQ ID NO: 172793 - DNA, 25 bp, E. coli
ccctgcttcgtgaaaatacccgcat

SEQ ID NO: 172794 - DNA, 25 bp, E. coli
ccgaaatatcggctggacaatggcg

SEQ ID NO: 172795 - DNA, 25 bp, E. coli
cgaaatatcggctggacaatggcga

SEQ ID NO: 172796 - DNA, 25 bp, E. coli
ccctgcttcgtgtaaatacccgcat

SEQ ID NO: 172797 - DNA, 25 bp, E. coli
catggaacgagatattcgctgctta

SEQ ID NO: 172798 - DNA, 25 bp, E. coli
catggaacgagaaattcgctgctta

SEQ ID NO: 172799 - DNA, 25 bp, E. coli
tatgttggcctgaacggtgctatcg

SEQ ID NO: 172800 - DNA, 25 bp, E. coli
tatgttggcctgtacggtgctatcg

SEQ ID NO: 172801 - DNA, 25 bp, E. coli
ttggcctgaacggtgctatcgtcgg

SEQ ID NO: 172802 - DNA, 25 bp, E. coli
ttggcctgaacgctgctatcgtcgg

SEQ ID NO: 172803 - DNA, 25 bp, E. coli
tgttggcctgaacggtgctatcgtc

SEQ ID NO: 172804 - DNA, 25 bp, E. coli
tgttggcctgaagggtgctatcgtc

SEQ ID NO: 172805 - DNA, 25 bp, E. coli
gaacgagaaattggctgcttacgcg

SEQ ID NO: 172806 - DNA, 25 bp, E. coli
gaacgagaaattcgctgcttacgcg

SEQ ID NO: 172807 - DNA, 25 bp, E. coli
gaaattcgctgcttacgcgaaagct

SEQ ID NO: 172808 - DNA, 25 bp, E. coli
gaaattcgctgcatacgcgaaagct

SEQ ID NO: 172809 - DNA, 25 bp, E. coli
cgagaaattcgctgcttacgcgaaa

SEQ ID NO: 172810 - DNA, 25 bp, E. coli
cgcatggaacgagaaattcgctgct

SEQ ID NO: 172811 - DNA, 25 bp, E. coli
cgcatggaacgacaaattcgctgct

SEQ ID NO: 172812 - DNA, 25 bp, E. coli
cgagaaattcgcagcttacgcgaaa

SEQ ID NO: 172813 - DNA, 25 bp, E. coli
ctgggcgacgctgaaattgccctga

SEQ ID NO: 172814 - DNA, 25 bp, E. coli
ctgaaattgcccagacccgcgaaca

SEQ ID NO: 172815 - DNA, 25 bp, E. coli
ctgggcgacgctcaaattgccctga

SEQ ID NO: 172816 - DNA, 25 bp, E. coli
ctgaaattgccctgacccgcgaaca

SEQ ID NO: 172817 - DNA, 25 bp, E. coli
ggcgacgctgaatttgccctgaccc

SEQ ID NO: 172818 - DNA, 25 bp, E. coli
ggcgacgctgaaattgccctgaccc

SEQ ID NO: 172819 - DNA, 25 bp, E. coli
caattgtcccgaaatcgcctctggt

SEQ ID NO: 172820 - DNA, 25 bp, E. coli
caattgtcccgatatcgcctctggt

SEQ ID NO: 172821 - DNA, 25 bp, E. coli
caaaaatggcgatgcaatctgcggc

SEQ ID NO: 172822 - DNA, 25 bp, E. coli
caaaaatggcgaagcaatctgcggc

SEQ ID NO: 172823 - DNA, 25 bp, E. coli
cagacccgggcaggctgatattctc

SEQ ID NO: 172824 - DNA, 25 bp, E. coli
cagacccgggcacgctgatattctc

SEQ ID NO: 172825 - DNA, 25 bp, E. coli
agccgattcggccacaattgtcccg

SEQ ID NO: 172826 - DNA, 25 bp, E. coli
agccgattcggcgacaattgtcccg

SEQ ID NO: 172827 - DNA, 25 bp, E. coli
ttttccgccagacacgactttgtag

SEQ ID NO: 172828 - DNA, 25 bp, E. coli
ttttccgccagagacgactttgtag

SEQ ID NO: 172829 - DNA, 25 bp, E. coli
ttttatctatttgattcacccaggg

SEQ ID NO: 172830 - DNA, 25 bp, E. coli
ttttatctatttcattcacccaggg

SEQ ID NO: 172831 - DNA, 25 bp, E. coli
tcaggtatactgacagaccattttt

SEQ ID NO: 172832 - DNA, 25 bp, E. coli
tcaggtatactgtcagaccattttt

SEQ ID NO: 172833 - DNA, 25 bp, E. coli
gaaatcgcctctcgttcaggtatac

SEQ ID NO: 172834 - DNA, 25 bp, E. coli
gaaatcgcctctggttcaggtatac

SEQ ID NO: 172835 - DNA, 25 bp, E. coli
gatattctccgcagccagacttttt

SEQ ID NO: 172836 - DNA, 25 bp, E. coli
gatattctccgctgccagacttttt

SEQ ID NO: 172837 - DNA, 25 bp, E. coli
ggtaagccgcaacgaccattgacag

SEQ ID NO: 172838 - DNA, 25 bp, E. coli
ggtaagccgcaaggaccattgacag

SEQ ID NO: 172839 - DNA, 25 bp, E. coli
gatgatagcccactttcgaaagccg

SEQ ID NO: 172840 - DNA, 25 bp, E. coli
gatgatagcccagtttcgaaagccg

SEQ ID NO: 172841 - DNA, 25 bp, E. coli
cagcggatttccattgccagagcgt

SEQ ID NO: 172842 - DNA, 25 bp, E. coli
cagcggatttcctttgccagagcgt

SEQ ID NO: 172843 - DNA, 25 bp, E. coli
tatcgctacgaacaaggtgacggcc

SEQ ID NO: 172844 - DNA, 25 bp, E. coli
tatgcgcttcgctgaaccgatggcg

SEQ ID NO: 172845 - DNA, 25 bp, E. coli
tatgcgcttcgcagaaccgatggcg

SEQ ID NO: 172846 - DNA, 25 bp, E. coli
tatcgctacgaagaaggtgacggcc

SEQ ID NO: 172847 - DNA, 25 bp, E. coli
tatctccagcgtaggcagtcaggcc

SEQ ID NO: 172848 - DNA, 25 bp, E. coli
tatctccagcgttggcagtcaggcc

SEQ ID NO: 172849 - DNA, 25 bp, E. coli
tgagcagtttatcgcgatagcaccg

SEQ ID NO: 172850 - DNA, 25 bp, E. coli
tgagcagtttatggcgatagcaccg

SEQ ID NO: 172851 - DNA, 25 bp, E. coli
gcagatttctataggcggcgtcgat

SEQ ID NO: 172852 - DNA, 25 bp, E. coli
gcagatttctattggcggcgtcgat

SEQ ID NO: 172853 - DNA, 25 bp, E. coli
gacggccacgcgcttaatcatgttt

SEQ ID NO: 172854 - DNA, 25 bp, E. coli
gacggccacgcggttaatcatgttt

SEQ ID NO: 172855 - DNA, 25 bp, E. coli
cgggtgaaatgaacgccttgctgct

SEQ ID NO: 172856 - DNA, 25 bp, E. coli
cgggtgaaatgatcgccttgctgct

SEQ ID NO: 172857 - DNA, 25 bp, E. coli
taatcctgcggataacctggcctgg

SEQ ID NO: 172858 - DNA, 25 bp, E. coli
taatcctgcggaaaacctggcctgg

SEQ ID NO: 172859 - DNA, 25 bp, E. coli
gatgatggtattgcgcacctgcggc

SEQ ID NO: 172860 - DNA, 25 bp, E. coli
gatgatggtattccgcacctgcggc

SEQ ID NO: 172861 - DNA, 25 bp, E. coli
gacgcgccgcaagttcttaactggg

SEQ ID NO: 172862 - DNA, 25 bp, E. coli
gacgcgccgcaacttcttaactggg

SEQ ID NO: 172863 - DNA, 25 bp, E. coli
aagtcctgagtaaacacgttgacgt

SEQ ID NO: 172864 - DNA, 25 bp, E. coli
aagtcctgagtatacacgttgacgt

SEQ ID NO: 172865 - DNA, 25 bp, E. coli
catgcagtaatgtgtcagttttatc

SEQ ID NO: 172866 - DNA, 25 bp, E. coli
catgcagtaatgagtcagttttatc

SEQ ID NO: 172867 - DNA, 25 bp, E. coli
taaacacgttgacgttgaataccgc

SEQ ID NO: 172868 - DNA, 25 bp, E. coli
taaacacgttgaggttgaataccgc

SEQ ID NO: 172869 - DNA, 25 bp, E. coli
tttatctatgttatgcctgcgggcg

SEQ ID NO: 172870 - DNA, 25 bp, E. coli
tttatctatgttttgcctgcgggcg

SEQ ID NO: 172871 - DNA, 25 bp, E. coli
tggtgcctcatgcagtaatgtgtca

SEQ ID NO: 172872 - DNA, 25 bp, E. coli
tgtggcattttcagtaaagaagtcc

SEQ ID NO: 172873 - DNA, 25 bp, E. coli
tgtggcattttctgtaaagaagtcc

SEQ ID NO: 172874 - DNA, 25 bp, E. coli
tggtgcctcatggagtaatgtgtca

SEQ ID NO: 172875 - DNA, 25 bp, E. coli
tgaataccgcttgtctgccgagcct

SEQ ID NO: 172876 - DNA, 25 bp, E. coli
tgaataccgcttctctgccgagcct

SEQ ID NO: 172877 - DNA, 25 bp, E. coli
tgacgttgaatagcgcttctctgcc

SEQ ID NO: 172878 - DNA, 25 bp, E. coli
tgacgttgaataccgcttctctgcc

SEQ ID NO: 172879 - DNA, 25 bp, E. coli
tctctgccgagcgttatattggtgc

SEQ ID NO: 172880 - DNA, 25 bp, E. coli
tctctgccgagccttatattggtgc

SEQ ID NO: 172881 - DNA, 25 bp, E. coli
gcattttcagtatagaagtcctgag

SEQ ID NO: 172882 - DNA, 25 bp, E. coli
gcattttcagtaaagaagtcctgag

SEQ ID NO: 172883 - DNA, 25 bp, E. coli
gagccttatattggtgcctcatgca

SEQ ID NO: 172884 - DNA, 25 bp, E. coli
gagccttatattcgtgcctcatgca

SEQ ID NO: 172885 - DNA, 25 bp, E. coli
tacaccatggctcccacggcaatgt

SEQ ID NO: 172886 - DNA, 25 bp, E. coli
tacaccatggctgccacggcaatgt

SEQ ID NO: 172887 - DNA, 25 bp, E. coli
accatggctgcctcggcaatgtcca

SEQ ID NO: 172888 - DNA, 25 bp, E. coli
accatggctgccacggcaatgtcca

SEQ ID NO: 172889 - DNA, 25 bp, E. coli
tatgtacaccatggctgccacggca

SEQ ID NO: 172890 - DNA, 25 bp, E. coli
tatgtacaccatcgctgccacggca

SEQ ID NO: 172891 - DNA, 25 bp, E. coli
tgtacaccatggctgccacggcaat

SEQ ID NO: 172892 - DNA, 25 bp, E. coli
tgtacaccatgggtgccacggcaat

SEQ ID NO: 172893 - DNA, 25 bp, E. coli
tgccacggcaatctccaccgtgtcg

SEQ ID NO: 172894 - DNA, 25 bp, E. coli
tgccacggcaatgtccaccgtgtcg

SEQ ID NO: 172895 - DNA, 25 bp, E. coli
ccatggctgccagggcaatgtccac

SEQ ID NO: 172896 - DNA, 25 bp, E. coli
ccatggctgccacggcaatgtccac

SEQ ID NO: 172897 - DNA, 25 bp, E. coli
gctgccacggcaatgtccaccgtgt

SEQ ID NO: 172898 - DNA, 25 bp, E. coli
gctgccacggcattgtccaccgtgt

SEQ ID NO: 172899 - DNA, 25 bp, E. coli
ctgccacggcaatgtccaccgtgtc

SEQ ID NO: 172900 - DNA, 25 bp, E. coli
ctgccacggcaaagtccaccgtgtc

SEQ ID NO: 172901 - DNA, 25 bp, E. coli
gtacaccatggcagccacggcaatg

SEQ ID NO: 172902 - DNA, 25 bp, E. coli
gtacaccatggctgccacggcaatg

SEQ ID NO: 172903 - DNA, 25 bp, E. coli
tggctgccacggcaatgtccaccgt

SEQ ID NO: 172904 - DNA, 25 bp, E. coli
ggctgccacggcaatgtccaccgtg

SEQ ID NO: 172905 - DNA, 25 bp, E. coli
ggctgccacggctatgtccaccgtg

SEQ ID NO: 172906 - DNA, 25 bp, E. coli
tggctgccacgggaatgtccaccgt

SEQ ID NO: 172907 - DNA, 25 bp, E. coli
caataacgtgaaaacagctatctcc

SEQ ID NO: 172908 - DNA, 25 bp, E. coli
caataacgtgaatacagctatctcc

SEQ ID NO: 172909 - DNA, 25 bp, E. coli
cacgctaacaataacgtgaaaacag

SEQ ID NO: 172910 - DNA, 25 bp, E. coli
cacgctaacaattacgtgaaaacag

SEQ ID NO: 172911 - DNA, 25 bp, E. coli
taacaataacgtgaaaacagctatc

SEQ ID NO: 172912 - DNA, 25 bp, E. coli
taacaataacgtcaaaacagctatc

SEQ ID NO: 172913 - DNA, 25 bp, E. coli
aacgtgaaaacacctatctcccggg

SEQ ID NO: 172914 - DNA, 25 bp, E. coli
acgtcatcgttttttgccattgctg

SEQ ID NO: 172915 - DNA, 25 bp, E. coli
acgtcatcgtttattgccattgctg

SEQ ID NO: 172916 - DNA, 25 bp, E. coli
aacgtgaaaacagctatctcccggg

SEQ ID NO: 172917 - DNA, 25 bp, E. coli
gacactgattatgacgtcatcgttt

SEQ ID NO: 172918 - DNA, 25 bp, E. coli
gacactgattatcacgtcatcgttt

SEQ ID NO: 172919 - DNA, 25 bp, E. coli
cgctaacaataaggtgaaaacagct

SEQ ID NO: 172920 - DNA, 25 bp, E. coli
cgctaacaataacgtgaaaacagct

SEQ ID NO: 172921 - DNA, 25 bp, E. coli
gattatcacgtcttcgttttttgcc

SEQ ID NO: 172922 - DNA, 25 bp, E. coli
gattatcacgtcatcgttttttgcc

SEQ ID NO: 172923 - DNA, 25 bp, E. coli
gtcgagacactgattatcacgtcat

SEQ ID NO: 172924 - DNA, 25 bp, E. coli
gtcgagacactgtttatcacgtcat

SEQ ID NO: 172925 - DNA, 25 bp, E. coli
taacgtgaaaacagctatctcccgg

SEQ ID NO: 172926 - DNA, 25 bp, E. coli
taacgtgaaaactgctatctcccgg

SEQ ID NO: 172927 - DNA, 25 bp, E. coli
gagacactgattatcacgtcatcgt

SEQ ID NO: 172928 - DNA, 25 bp, E. coli
gagacactgattttcacgtcatcgt

SEQ ID NO: 172929 - DNA, 25 bp, E. coli
aatgtcggagcatatgaaggagaac

SEQ ID NO: 172930 - DNA, 25 bp, E. coli
aatgtcggagcaaatgaaggagaac

SEQ ID NO: 172931 - DNA, 25 bp, E. coli
taacttgcagatatgaaatgcatgc

SEQ ID NO: 172932 - DNA, 25 bp, E. coli
tatagaaatgcacgagaaatgtcgg

SEQ ID NO: 172933 - DNA, 25 bp, E. coli
tatagaaatgcaggagaaatgtcgg

SEQ ID NO: 172934 - DNA, 25 bp, E. coli
ttttaccgataagggaagtgtgccg

SEQ ID NO: 172935 - DNA, 25 bp, E. coli
ttttaccgataacggaagtgtgccg

SEQ ID NO: 172936 - DNA, 25 bp, E. coli
tgacgataataagaccaataacggt

SEQ ID NO: 172937 - DNA, 25 bp, E. coli
tgacgataataacaccaataacggt

SEQ ID NO: 172938 - DNA, 25 bp, E. coli
tcgggaatgattgttatcaatgacg

SEQ ID NO: 172939 - DNA, 25 bp, E. coli
tcgggaatgattcttatcaatgacg

SEQ ID NO: 172940 - DNA, 25 bp, E. coli
tagggaaggtgctcaatgtacatct

SEQ ID NO: 172941 - DNA, 25 bp, E. coli
tagggaaggtgcacaatgtacatct

SEQ ID NO: 172942 - DNA, 25 bp, E. coli
gaagtgtgccgacgtatagaaatgc

SEQ ID NO: 172943 - DNA, 25 bp, E. coli
gaagtgtgccgaggtatagaaatgc

SEQ ID NO: 172944 - DNA, 25 bp, E. coli
cccggtatgagaatttatattcaca

SEQ ID NO: 172945 - DNA, 25 bp, E. coli
cccggtatgagattttatattcaca

SEQ ID NO: 172946 - DNA, 25 bp, E. coli
tgtacatcttcttttaatttcccgg

SEQ ID NO: 172947 - DNA, 25 bp, E. coli
tgtacatcttctattaatttcccgg

SEQ ID NO: 172948 - DNA, 25 bp, E. coli
taataataaaacgaataacttgcag

SEQ ID NO: 172949 - DNA, 25 bp, E. coli
taataataaaaccaataacttgcag

SEQ ID NO: 172950 - DNA, 25 bp, E. coli
taacttgcagatttgaaatgcatgc

SEQ ID NO: 172951 - DNA, 25 bp, E. coli
caaatgcaggcaaccaggtcaacga

SEQ ID NO: 172952 - DNA, 25 bp, E. coli
caaatgcaggcatccaggtcaacga

SEQ ID NO: 172953 - DNA, 25 bp, E. coli
cacaggcggtttaccaacgattccg

SEQ ID NO: 172954 - DNA, 25 bp, E. coli
cacaggcggttttccaacgattccg

SEQ ID NO: 172955 - DNA, 25 bp, E. coli
taaactgatccgagatggccgtgtg

SEQ ID NO: 172956 - DNA, 25 bp, E. coli
taaactgatccgtgatggccgtgtg

SEQ ID NO: 172957 - DNA, 25 bp, E. coli
tatttccgccctcgagacaatggat

SEQ ID NO: 172958 - DNA, 25 bp, E. coli
tatttccgccctggagacaatggat

SEQ ID NO: 172959 - DNA, 25 bp, E. coli
ttaacgaagtgtggcctgatggccc

SEQ ID NO: 172960 - DNA, 25 bp, E. coli
ttaacgaagtgtcgcctgatggccc

SEQ ID NO: 172961 - DNA, 25 bp, E. coli
tgctgaaaattatcgccacaggcgg

SEQ ID NO: 172962 - DNA, 25 bp, E. coli
tgctgaaaattaacgccacaggcgg

SEQ ID NO: 172963 - DNA, 25 bp, E. coli
ccattacatgcgcagagtggcggca

SEQ ID NO: 172964 - DNA, 25 bp, E. coli
ccattacatgcggagagtggcggca

SEQ ID NO: 172965 - DNA, 25 bp, E. coli
gcgttactggttggctctgactctc

SEQ ID NO: 172966 - DNA, 25 bp, E. coli
gcgttactggttcgctctgactctc

SEQ ID NO: 172967 - DNA, 25 bp, E. coli
cgtgtgatccgtggctacattggca

SEQ ID NO: 172968 - DNA, 25 bp, E. coli
cgtgtgatccgtcgctacattggca

SEQ ID NO: 172969 - DNA, 25 bp, E. coli
tggtggacgtgagatcgccccatta

SEQ ID NO: 172970 - DNA, 25 bp, E. coli
tggtggacgtgacatcgccccatta

SEQ ID NO: 172971 - DNA, 25 bp, E. coli
gagtggcggcatggatcaactgcaa

SEQ ID NO: 172972 - DNA, 25 bp, E. coli
gagtggcggcatcgatcaactgcaa

SEQ ID NO: 172973 - DNA, 25 bp, E. coli
aattaaccgcgaatattgccagaga

SEQ ID NO: 172974 - DNA, 25 bp, E. coli
caataaagccgatttaaccgcgatt

SEQ ID NO: 172975 - DNA, 25 bp, E. coli
aagccgaattaagcgcgattattgc

SEQ ID NO: 172976 - DNA, 25 bp, E. coli
aattaaccgcgattattgccagaga

SEQ ID NO: 172977 - DNA, 25 bp, E. coli
aagccgaattaaccgcgattattgc

SEQ ID NO: 172978 - DNA, 25 bp, E. coli
caataaagccgaattaaccgcgatt

SEQ ID NO: 172979 - DNA, 25 bp, E. coli
taaagccgaatttaccgcgattatt

SEQ ID NO: 172980 - DNA, 25 bp, E. coli
taaagccgaattaaccgcgattatt

SEQ ID NO: 172981 - DNA, 25 bp, E. coli
agcaataaagcccaattaaccgcga

SEQ ID NO: 172982 - DNA, 25 bp, E. coli
agcaataaagccgaattaaccgcga

SEQ ID NO: 172983 - DNA, 25 bp, E. coli
aaagccgaattatccgcgattattg

SEQ ID NO: 172984 - DNA, 25 bp, E. coli
aaagccgaattaaccgcgattattg

SEQ ID NO: 172985 - DNA, 25 bp, E. coli
ttaaccgcgatttttgccagagaaa

SEQ ID NO: 172986 - DNA, 25 bp, E. coli
ttaaccgcgattattgccagagaaa

SEQ ID NO: 172987 - DNA, 25 bp, E. coli
gaattaaccgcgtttattgccagag

SEQ ID NO: 172988 - DNA, 25 bp, E. coli
gcaataaagccgtattaaccgcgat

SEQ ID NO: 172989 - DNA, 25 bp, E. coli
gcaataaagccgaattaaccgcgat

SEQ ID NO: 172990 - DNA, 25 bp, E. coli
gaattaaccgcgattattgccagag

SEQ ID NO: 172991 - DNA, 25 bp, E. coli
cgaattaaccgccattattgccaga

SEQ ID NO: 172992 - DNA, 25 bp, E. coli
cgaattaaccgcgattattgccaga

SEQ ID NO: 172993 - DNA, 25 bp, E. coli
taaccgcgattaatgccagagaaac

SEQ ID NO: 172994 - DNA, 25 bp, E. coli
taaccgcgattattgccagagaaac

SEQ ID NO: 172995 - DNA, 25 bp, E. coli
aggctcaggccttattacaatgtca

SEQ ID NO: 172996 - DNA, 25 bp, E. coli
aggccttattacaatgtcatgctag

SEQ ID NO: 172997 - DNA, 25 bp, E. coli
aggctcaggcctaattacaatgtca

SEQ ID NO: 172998 - DNA, 25 bp, E. coli
aggccttattactatgtcatgctag

SEQ ID NO: 172999 - DNA, 25 bp, E. coli
tatgacacacattaaagcgttaggc

SEQ ID NO: 173000 - DNA, 25 bp, E. coli
tatgaccagatggatttcgctggac

SEQ ID NO: 173001 - DNA, 25 bp, E. coli
tacgccactgagagtatgacacaca

SEQ ID NO: 173002 - DNA, 25 bp, E. coli
tacgccactgagtgtatgacacaca

SEQ ID NO: 173003 - DNA, 25 bp, E. coli
tatgacacacataaaagcgttaggc

SEQ ID NO: 173004 - DNA, 25 bp, E. coli
tatgaccagatgcatttcgctggac

SEQ ID NO: 173005 - DNA, 25 bp, E. coli
tattgtcaacgaatacgccactgag

SEQ ID NO: 173006 - DNA, 25 bp, E. coli
tattgtcaacgattacgccactgag

SEQ ID NO: 173007 - DNA, 25 bp, E. coli
tgcttcagattaagaccagatggat

SEQ ID NO: 173008 - DNA, 25 bp, E. coli
tgcttcagattatgaccagatggat

SEQ ID NO: 173009 - DNA, 25 bp, E. coli
cattaaagcgtttggctcaggcctt

SEQ ID NO: 173010 - DNA, 25 bp, E. coli
cattaaagcgttaggctcaggcctt

SEQ ID NO: 173011 - DNA, 25 bp, E. coli
gattacatgcaccatattgtcaacg

SEQ ID NO: 173012 - DNA, 25 bp, E. coli
gattacatgcacgatattgtcaacg

SEQ ID NO: 173013 - DNA, 25 bp, E. coli
gacgcttacgattacatgcaccata

SEQ ID NO: 173014 - DNA, 25 bp, E. coli
gatggatttcgctggacgcttacga

SEQ ID NO: 173015 - DNA, 25 bp, E. coli
gatggatttcgcaggacgcttacga

SEQ ID NO: 173016 - DNA, 25 bp, E. coli
gacgcttacgataacatgcaccata

SEQ ID NO: 173017 - DNA, 25 bp, E. coli
caaacgctatggtctaccgcgaaag

SEQ ID NO: 173018 - DNA, 25 bp, E. coli
caccagaggcctcattggaatttcc

SEQ ID NO: 173019 - DNA, 25 bp, E. coli
caaaacatgggctattgctggtgca

SEQ ID NO: 173020 - DNA, 25 bp, E. coli
caccagaggcctgattggaatttcc

SEQ ID NO: 173021 - DNA, 25 bp, E. coli
caaacgctatggactaccgcgaaag

SEQ ID NO: 173022 - DNA, 25 bp, E. coli
caaaacatgggcaattgctggtgca

SEQ ID NO: 173023 - DNA, 25 bp, E. coli
tcgcagaaaagagagaaggcatgcc

SEQ ID NO: 173024 - DNA, 25 bp, E. coli
tcgcagaaaagacagaaggcatgcc

SEQ ID NO: 173025 - DNA, 25 bp, E. coli
tcgactgcgacctaagaagatgcta

SEQ ID NO: 173026 - DNA, 25 bp, E. coli
tcgactgcgaccaaagaagatgcta

SEQ ID NO: 173027 - DNA, 25 bp, E. coli
tctccaaaactttgatagagtcggc

SEQ ID NO: 173028 - DNA, 25 bp, E. coli
tctccaaaacttagatagagtcggc

SEQ ID NO: 173029 - DNA, 25 bp, E. coli
gaattcaaggatgaatatagacgcc

SEQ ID NO: 173030 - DNA, 25 bp, E. coli
gcaatagccggtgtttccgctgtca

SEQ ID NO: 173031 - DNA, 25 bp, E. coli
gcaatagccggtctttccgctgtca

SEQ ID NO: 173032 - DNA, 25 bp, E. coli
gaattcaaggatcaatatagacgcc

SEQ ID NO: 173033 - DNA, 25 bp, E. coli
gattatccgccaagtttccaaacgc

SEQ ID NO: 173034 - DNA, 25 bp, E. coli
gattatccgccatgtttccaaacgc

SEQ ID NO: 173035 - DNA, 25 bp, E. coli
tacaaatttacgcttcgactgcgac

SEQ ID NO: 173036 - DNA, 25 bp, E. coli
taaccagtcgaggacatcaagagag

SEQ ID NO: 173037 - DNA, 25 bp, E. coli
taaccagtcgagcacatcaagagag

SEQ ID NO: 173038 - DNA, 25 bp, E. coli
tacaaatttacggttcgactgcgac

SEQ ID NO: 173039 - DNA, 25 bp, E. coli
gccggtaccgatcacccctttacag

SEQ ID NO: 173040 - DNA, 25 bp, E. coli
gccggtaccgatgacccctttacag

SEQ ID NO: 173041 - DNA, 25 bp, E. coli
accgcttctcgcctggcaggagccg

SEQ ID NO: 173042 - DNA, 25 bp, E. coli
accgcttctcgcgtggcaggagccg

SEQ ID NO: 173043 - DNA, 25 bp, E. coli
tagcgcgccggtaccgatgacccct

SEQ ID NO: 173044 - DNA, 25 bp, E. coli
tagcgcgccggttccgatgacccct

SEQ ID NO: 173045 - DNA, 25 bp, E. coli
ttctcgcgtggcaggagccggggcg

SEQ ID NO: 173046 - DNA, 25 bp, E. coli
ttctcgcgtggctggagccggggcg

SEQ ID NO: 173047 - DNA, 25 bp, E. coli
cgcttctcgcgtcgcaggagccggg

SEQ ID NO: 173048 - DNA, 25 bp, E. coli
cgcttctcgcgtggcaggagccggg

SEQ ID NO: 173049 - DNA, 25 bp, E. coli
ctggtggaggtgaatcgcgattacg

SEQ ID NO: 173050 - DNA, 25 bp, E. coli
ctggtggaggtgtatcgcgattacg

SEQ ID NO: 173051 - DNA, 25 bp, E. coli
cgtcaccgcttcacgcgtggcagga

SEQ ID NO: 173052 - DNA, 25 bp, E. coli
cgtcaccgcttctcgcgtggcagga

SEQ ID NO: 173053 - DNA, 25 bp, E. coli
ggtggaggtgaaacgcgattacgtc

SEQ ID NO: 173054 - DNA, 25 bp, E. coli
gtcaccgcttctggcgtggcaggag

SEQ ID NO: 173055 - DNA, 25 bp, E. coli
ggaggtgaatcgcgattacgtcacc

SEQ ID NO: 173056 - DNA, 25 bp, E. coli
ggtggaggtgaatcgcgattacgtc

SEQ ID NO: 173057 - DNA, 25 bp, E. coli
gtcaccgcttctcgcgtggcaggag

SEQ ID NO: 173058 - DNA, 25 bp, E. coli
ggaggtgaatcgggattacgtcacc

SEQ ID NO: 173059 - DNA, 25 bp, E. coli
tggaggtgaatcccgattacgtcac

SEQ ID NO: 173060 - DNA, 25 bp, E. coli
tggaggtgaatcgcgattacgtcac

SEQ ID NO: 173061 - DNA, 25 bp, E. coli
catcagggtctaagcttattaaaag

SEQ ID NO: 173062 - DNA, 25 bp, E. coli
catcagggtctatgcttattaaaag

SEQ ID NO: 173063 - DNA, 25 bp, E. coli
taacatgctgttatacgctgaaagc

SEQ ID NO: 173064 - DNA, 25 bp, E. coli
taacatgctgttttacgctgaaagc

SEQ ID NO: 173065 - DNA, 25 bp, E. coli
aaacccttaagcctgtgtcgcacag

SEQ ID NO: 173066 - DNA, 25 bp, E. coli
aaacccttaagcgtgtgtcgcacag

SEQ ID NO: 173067 - DNA, 25 bp, E. coli
tgcctgttaacccacacatcagggt

SEQ ID NO: 173068 - DNA, 25 bp, E. coli
tgcctgttaaccgacacatcagggt

SEQ ID NO: 173069 - DNA, 25 bp, E. coli
tcatcacagcctaaatgctccttag

SEQ ID NO: 173070 - DNA, 25 bp, E. coli
tcatcacagccttaatgctccttag

SEQ ID NO: 173071 - DNA, 25 bp, E. coli
gcaggcaaaaagcatgttttacggt

SEQ ID NO: 173072 - DNA, 25 bp, E. coli
gcaggcaaaaaggatgttttacggt

SEQ ID NO: 173073 - DNA, 25 bp, E. coli
cgctgaaagcgatgaagtgaggtaa

SEQ ID NO: 173074 - DNA, 25 bp, E. coli
cgctgaaagcgaagaagtgaggtaa

SEQ ID NO: 173075 - DNA, 25 bp, E. coli
gatacctaattcttagcgtgcctgt

SEQ ID NO: 173076 - DNA, 25 bp, E. coli
gatacctaattcatagcgtgcctgt

SEQ ID NO: 173077 - DNA, 25 bp, E. coli
ggtaaagcccctccgtttgctgggt

SEQ ID NO: 173078 - DNA, 25 bp, E. coli
ggttttcttatttctgaacgctgca

SEQ ID NO: 173079 - DNA, 25 bp, E. coli
ggttttcttattactgaacgctgca

SEQ ID NO: 173080 - DNA, 25 bp, E. coli
ggtaaagcccctgcgtttgctgggt

SEQ ID NO: 173081 - DNA, 25 bp, E. coli
tgtcgcacagacttaagggttttct

SEQ ID NO: 173082 - DNA, 25 bp, E. coli
tgtcgcacagacataagggttttct

SEQ ID NO: 173083 - DNA, 25 bp, E. coli
tacagtgccaggaaaaattgccgtt

SEQ ID NO: 173084 - DNA, 25 bp, E. coli
tacagtgccaggtaaaattgccgtt

SEQ ID NO: 173085 - DNA, 25 bp, E. coli
aaacaaagtcgggatttacagccgt

SEQ ID NO: 173086 - DNA, 25 bp, E. coli
aaacaaagtcggcatttacagccgt

SEQ ID NO: 173087 - DNA, 25 bp, E. coli
ttgaagaagctaatcgcgccagtgg

SEQ ID NO: 173088 - DNA, 25 bp, E. coli
ttcgcaggcaacgagcagaaaaatc

SEQ ID NO: 173089 - DNA, 25 bp, E. coli
ttgaagaagctattcgcgccagtgg

SEQ ID NO: 173090 - DNA, 25 bp, E. coli
ttcgcaggcaaccagcagaaaaatc

SEQ ID NO: 173091 - DNA, 25 bp, E. coli
tccgaaagagcttcgcaggcaacga

SEQ ID NO: 173092 - DNA, 25 bp, E. coli
tccgaaagagctacgcaggcaacga

SEQ ID NO: 173093 - DNA, 25 bp, E. coli
tctcattgccgaaccgaaagagctt

SEQ ID NO: 173094 - DNA, 25 bp, E. coli
tctcattgccgatccgaaagagctt

SEQ ID NO: 173095 - DNA, 25 bp, E. coli
tcggcatttacagccgtccggcaaa

SEQ ID NO: 173096 - DNA, 25 bp, E. coli
tcggcatttacacccgtccggcaaa

SEQ ID NO: 173097 - DNA, 25 bp, E. coli
gccaggtaaaattgccgttgaggtg

SEQ ID NO: 173098 - DNA, 25 bp, E. coli
gccaggtaaaatagccgttgaggtg

SEQ ID NO: 173099 - DNA, 25 bp, E. coli
gctggaattgcgaaccgatatcgat

SEQ ID NO: 173100 - DNA, 25 bp, E. coli
gctggaattgcgtaccgatatcgat

SEQ ID NO: 173101 - DNA, 25 bp, E. coli
ccgttgaggtggcttatgcgctacc

SEQ ID NO: 173102 - DNA, 25 bp, E. coli
ccgttgaggtgggttatgcgctacc

SEQ ID NO: 173103 - DNA, 25 bp, E. coli
ggcgcgacggttgaagaagctattc

SEQ ID NO: 173104 - DNA, 25 bp, E. coli
ggcgcgacggttcaagaagctattc

SEQ ID NO: 173105 - DNA, 25 bp, E. coli
cacactgggccactcactgatgaag

SEQ ID NO: 173106 - DNA, 25 bp, E. coli
cacactgggccagtcactgatgaag

SEQ ID NO: 173107 - DNA, 25 bp, E. coli
tactgctgccgattcctcgactgaa

SEQ ID NO: 173108 - DNA, 25 bp, E. coli
tactgctgccgaatcctcgactgaa

SEQ ID NO: 173109 - DNA, 25 bp, E. coli
aaaacaaacaatccggaacagctgg

SEQ ID NO: 173110 - DNA, 25 bp, E. coli
aaaacaaacaatgcggaacagctgg

SEQ ID NO: 173111 - DNA, 25 bp, E. coli
tgggccagtcacagatgaagcacgg

SEQ ID NO: 173112 - DNA, 25 bp, E. coli
tgggccagtcactgatgaagcacgg

SEQ ID NO: 173113 - DNA, 25 bp, E. coli
tgccgattcctccactgaaaacaaa

SEQ ID NO: 173114 - DNA, 25 bp, E. coli
tgccgattcctcgactgaaaacaaa

SEQ ID NO: 173115 - DNA, 25 bp, E. coli
gcgccagcaaatcaaaaacgtcggc

SEQ ID NO: 173116 - DNA, 25 bp, E. coli
cctcgactgaaaacaaacaatccgg

SEQ ID NO: 173117 - DNA, 25 bp, E. coli
cctcgactgaaatcaaacaatccgg

SEQ ID NO: 173118 - DNA, 25 bp, E. coli
ccagtcactgatgaagcacggagaa

SEQ ID NO: 173119 - DNA, 25 bp, E. coli
ccagtcactgatcaagcacggagaa

SEQ ID NO: 173120 - DNA, 25 bp, E. coli
gcgtcacgggccaggcgatcatatt

SEQ ID NO: 173121 - DNA, 25 bp, E. coli
gcgtcacgggcctggcgatcatatt

SEQ ID NO: 173122 - DNA, 25 bp, E. coli
gcgccagcaaatgaaaaacgtcggc

SEQ ID NO: 173123 - DNA, 25 bp, E. coli
gcaaatcaaaaaggtcggcgatcgc

SEQ ID NO: 173124 - DNA, 25 bp, E. coli
gcaaatcaaaaacgtcggcgatcgc

SEQ ID NO: 173125 - DNA, 25 bp, E. coli
ggcgatcatattcattctggcgatg

SEQ ID NO: 173126 - DNA, 25 bp, E. coli
ggcgatcatattgattctggcgatg

SEQ ID NO: 173127 - DNA, 25 bp, E. coli
aatatttcaccgcatctggcgtggg

SEQ ID NO: 173128 - DNA, 25 bp, E. coli
aatatttcaccggatctggcgtggg

SEQ ID NO: 173129 - DNA, 25 bp, E. coli
catttttaccgttcacgcgctggat

SEQ ID NO: 173130 - DNA, 25 bp, E. coli
cagtaacgatctgcgcgatggcgat

SEQ ID NO: 173131 - DNA, 25 bp, E. coli
cagtaacgatctccgcgatggcgat

SEQ ID NO: 173132 - DNA, 25 bp, E. coli
taccgcaagggtatggctctggtct

SEQ ID NO: 173133 - DNA, 25 bp, E. coli
taccgcaagggtttggctctggtct

SEQ ID NO: 173134 - DNA, 25 bp, E. coli
ttacgatggcgaaaatatttcaccg

SEQ ID NO: 173135 - DNA, 25 bp, E. coli
ttacgatggcgataatatttcaccg

SEQ ID NO: 173136 - DNA, 25 bp, E. coli
tgatacccgcgttttaccgcaaggg

SEQ ID NO: 173137 - DNA, 25 bp, E. coli
tgatacccgcgtattaccgcaaggg

SEQ ID NO: 173138 - DNA, 25 bp, E. coli
tgaaactcatcactaacgatctgcg

SEQ ID NO: 173139 - DNA, 25 bp, E. coli
tgaaactcatcagtaacgatctgcg

SEQ ID NO: 173140 - DNA, 25 bp, E. coli
ccagacggcgttatgcagacgcgta

SEQ ID NO: 173141 - DNA, 25 bp, E. coli
ccagacggcgttttgcagacgcgta

SEQ ID NO: 173142 - DNA, 25 bp, E. coli
cgaaaagttttgatgtcacctgcta

SEQ ID NO: 173143 - DNA, 25 bp, E. coli
cgaaaagttttgttgtcacctgcta

SEQ ID NO: 173144 - DNA, 25 bp, E. coli
cgcgatggtcgggtttaacgttcat

SEQ ID NO: 173145 - DNA, 25 bp, E. coli
cgcgatggtcggctttaacgttcat

SEQ ID NO: 173146 - DNA, 25 bp, E. coli
ctttaacggcatcggttacgatggc

SEQ ID NO: 173147 - DNA, 25 bp, E. coli
ctttaacggcatgggttacgatggc

SEQ ID NO: 173148 - DNA, 25 bp, E. coli
catttttaccgtacacgcgctggat

SEQ ID NO: 173149 - DNA, 25 bp, E. coli
caatccctgatgtggtgttgtccgc

SEQ ID NO: 173150 - DNA, 25 bp, E. coli
aatggctacagaacacgattaccgg

SEQ ID NO: 173151 - DNA, 25 bp, E. coli
aatggctacagatcacgattaccgg

SEQ ID NO: 173152 - DNA, 25 bp, E. coli
caatccctgatgaggtgttgtccgc

SEQ ID NO: 173153 - DNA, 25 bp, E. coli
catcacgggatgtaataccgttcgg

SEQ ID NO: 173154 - DNA, 25 bp, E. coli
catcacgggatgaaataccgttcgg

SEQ ID NO: 173155 - DNA, 25 bp, E. coli
taccgttcggactcgatgaagatca

SEQ ID NO: 173156 - DNA, 25 bp, E. coli
tatcggtagttgtctggatgaggcc

SEQ ID NO: 173157 - DNA, 25 bp, E. coli
taccgttcggacacgatgaagatca

SEQ ID NO: 173158 - DNA, 25 bp, E. coli
tatcggtagttgactggatgaggcc

SEQ ID NO: 173159 - DNA, 25 bp, E. coli
tgaaggtcgccacgcttcgtgcaga

SEQ ID NO: 173160 - DNA, 25 bp, E. coli
tgaaggtcgccaggcttcgtgcaga

SEQ ID NO: 173161 - DNA, 25 bp, E. coli
tgactgaattaagcaaagaatggct

SEQ ID NO: 173162 - DNA, 25 bp, E. coli
tgactgaattaaccaaagaatggct

SEQ ID NO: 173163 - DNA, 25 bp, E. coli
tcagatcgcagttgaagcgacacag

SEQ ID NO: 173164 - DNA, 25 bp, E. coli
tcagatcgcagtagaagcgacacag

SEQ ID NO: 173165 - DNA, 25 bp, E. coli
cgattaccggaattgagtcatcacg

SEQ ID NO: 173166 - DNA, 25 bp, E. coli
cgattaccggaaatgagtcatcacg

SEQ ID NO: 173167 - DNA, 25 bp, E. coli
cttctgaagtggacaggcgaggtat

SEQ ID NO: 173168 - DNA, 25 bp, E. coli
cttctgaagtggtcaggcgaggtat

SEQ ID NO: 173169 - DNA, 25 bp, E. coli
taacgaatacgcgagtcagatcgca

SEQ ID NO: 173170 - DNA, 25 bp, E. coli
taacgaatacgccagtcagatcgca

SEQ ID NO: 173171 - DNA, 25 bp, E. coli
cactggcatgactgataaatggttt

SEQ ID NO: 173172 - DNA, 25 bp, E. coli
cactggcatgacagataaatggttt

SEQ ID NO: 173173 - DNA, 25 bp, E. coli
cagcaacgaatccaggaatcccggg

SEQ ID NO: 173174 - DNA, 25 bp, E. coli
cagcaacgaatcgaggaatcccggg

SEQ ID NO: 173175 - DNA, 25 bp, E. coli
catcaccagtttgactggcatgaca

SEQ ID NO: 173176 - DNA, 25 bp, E. coli
cagtttcactggcatgacagataaa

SEQ ID NO: 173177 - DNA, 25 bp, E. coli
cagtttcactgggatgacagataaa

SEQ ID NO: 173178 - DNA, 25 bp, E. coli
catcaccagtttcactggcatgaca

SEQ ID NO: 173179 - DNA, 25 bp, E. coli
ttcactggcatgacagataaatggt

SEQ ID NO: 173180 - DNA, 25 bp, E. coli
ttcactggcatgtcagataaatggt

SEQ ID NO: 173181 - DNA, 25 bp, E. coli
tgcagcaacgaaacgaggaatcccg

SEQ ID NO: 173182 - DNA, 25 bp, E. coli
tgcagcaacgaatcgaggaatcccg

SEQ ID NO: 173183 - DNA, 25 bp, E. coli
tcaccagtttcactggcatgacaga

SEQ ID NO: 173184 - DNA, 25 bp, E. coli
gcagcaacgaatggaggaatcccgg

SEQ ID NO: 173185 - DNA, 25 bp, E. coli
gcagcaacgaatcgaggaatcccgg

SEQ ID NO: 173186 - DNA, 25 bp, E. coli
gtttcactggcatgacagataaatg

SEQ ID NO: 173187 - DNA, 25 bp, E. coli
gtttcactggcaagacagataaatg

SEQ ID NO: 173188 - DNA, 25 bp, E. coli
tggcatgacagaaaaatggttttac

SEQ ID NO: 173189 - DNA, 25 bp, E. coli
tggcatgacagataaatggttttac

SEQ ID NO: 173190 - DNA, 25 bp, E. coli
tcaccagtttcagtggcatgacaga

SEQ ID NO: 173191 - DNA, 25 bp, E. coli
gatgcagcaacgtatcgaggaatcc

SEQ ID NO: 173192 - DNA, 25 bp, E. coli
gatgcagcaacgaatcgaggaatcc

SEQ ID NO: 173193 - DNA, 25 bp, E. coli
caagaactttggatggaaccatacc

SEQ ID NO: 173194 - DNA, 25 bp, E. coli
caagaactttggttggaaccatacc

SEQ ID NO: 173195 - DNA, 25 bp, E. coli
catttcaaaatggtcatgcagacgc

SEQ ID NO: 173196 - DNA, 25 bp, E. coli
gaatacctaagcgagttcagcggaa

SEQ ID NO: 173197 - DNA, 25 bp, E. coli
gaatacctaagccagttcagcggaa

SEQ ID NO: 173198 - DNA, 25 bp, E. coli
tatcaggcccttgaaaatggacatg

SEQ ID NO: 173199 - DNA, 25 bp, E. coli
tatcaggcccttcaaaatggacatg

SEQ ID NO: 173200 - DNA, 25 bp, E. coli
tttctatgatcccaatcagaccgcg

SEQ ID NO: 173201 - DNA, 25 bp, E. coli
tttctatgatccgaatcagaccgcg

SEQ ID NO: 173202 - DNA, 25 bp, E. coli
tgggctaaaagatgacacactgtca

SEQ ID NO: 173203 - DNA, 25 bp, E. coli
tgggctaaaagaagacacactgtca

SEQ ID NO: 173204 - DNA, 25 bp, E. coli
tctcccggacatccaatggctctgg

SEQ ID NO: 173205 - DNA, 25 bp, E. coli
tctcccggacatgcaatggctctgg

SEQ ID NO: 173206 - DNA, 25 bp, E. coli
cgagaaattatgttggtgcaccagg

SEQ ID NO: 173207 - DNA, 25 bp, E. coli
cgagaaattatgatggtgcaccagg

SEQ ID NO: 173208 - DNA, 25 bp, E. coli
catttcaaaatgctcatgcagacgc

SEQ ID NO: 173209 - DNA, 25 bp, E. coli
gataatcaggatccttgaggcgaga

SEQ ID NO: 173210 - DNA, 25 bp, E. coli
gataatcaggatgcttgaggcgaga

SEQ ID NO: 173211 - DNA, 25 bp, E. coli
tcaatatatgcccagaaaaggtagc

SEQ ID NO: 173212 - DNA, 25 bp, E. coli
tcaatatatgccgagaaaaggtagc

SEQ ID NO: 173213 - DNA, 25 bp, E. coli
gaccgcgacgcaaaaacgagtattt

SEQ ID NO: 173214 - DNA, 25 bp, E. coli
gaccgcgacgcataaacgagtattt

SEQ ID NO: 173215 - DNA, 25 bp, E. coli
cactaggttctgatctggcacggtt

SEQ ID NO: 173216 - DNA, 25 bp, E. coli
cactaggttctgttctggcacggtt

SEQ ID NO: 173217 - DNA, 25 bp, E. coli
catcgcctgaaaccgctggagttaa

SEQ ID NO: 173218 - DNA, 25 bp, E. coli
catcgcctgaaagcgctggagttaa

SEQ ID NO: 173219 - DNA, 25 bp, E. coli
tacatggcatctgcgcagaggaact

SEQ ID NO: 173220 - DNA, 25 bp, E. coli
tacatggcatctccgcagaggaact

SEQ ID NO: 173221 - DNA, 25 bp, E. coli
tatccatcagtttcctccagaccag

SEQ ID NO: 173222 - DNA, 25 bp, E. coli
tatccatcagttacctccagaccag

SEQ ID NO: 173223 - DNA, 25 bp, E. coli
ttaaactgacggtaaaggcagagcc

SEQ ID NO: 173224 - DNA, 25 bp, E. coli
ttaaactgacggaaaaggcagagcc

SEQ ID NO: 173225 - DNA, 25 bp, E. coli
tgccagcgatcgtcgggctaaacgt

SEQ ID NO: 173226 - DNA, 25 bp, E. coli
tgccagcgatcgacgggctaaacgt

SEQ ID NO: 173227 - DNA, 25 bp, E. coli
cgcatatggcgtgctctgatagacc

SEQ ID NO: 173228 - DNA, 25 bp, E. coli
cgcatatggcgtcctctgatagacc

SEQ ID NO: 173229 - DNA, 25 bp, E. coli
gattggcatcgagcagccatcactg

SEQ ID NO: 173230 - DNA, 25 bp, E. coli
gattggcatcgaccagccatcactg

SEQ ID NO: 173231 - DNA, 25 bp, E. coli
tggagttaacactaacccattgggt

SEQ ID NO: 173232 - DNA, 25 bp, E. coli
tggagttaacacaaacccattgggt

SEQ ID NO: 173233 - DNA, 25 bp, E. coli
taatttcgcgtcaaacttgtgccag

SEQ ID NO: 173234 - DNA, 25 bp, E. coli
tcaactggcaaatgcgattggcatc

SEQ ID NO: 173235 - DNA, 25 bp, E. coli
taatttcgcgtctaacttgtgccag

SEQ ID NO: 173236 - DNA, 25 bp, E. coli
tcaactggcaaaagcgattggcatc

SEQ ID NO: 173237 - DNA, 25 bp, E. coli
cactgtcgctgactggtttcatcca

SEQ ID NO: 173238 - DNA, 25 bp, E. coli
cactgtcgctgagtggtttcatcca

SEQ ID NO: 173239 - DNA, 25 bp, E. coli
catccatactttgctgcgggctgaa

SEQ ID NO: 173240 - DNA, 25 bp, E. coli
catccatactttcctgcgggctgaa

SEQ ID NO: 173241 - DNA, 25 bp, E. coli
agctcctctgatcctgaggctggca

SEQ ID NO: 173242 - DNA, 25 bp, E. coli
agctcctctgatgctgaggctggca

SEQ ID NO: 173243 - DNA, 25 bp, E. coli
tggtgcacttctccccggaaaacgg

SEQ ID NO: 173244 - DNA, 25 bp, E. coli
gaagcctggcagacagtggtgcact

SEQ ID NO: 173245 - DNA, 25 bp, E. coli
gaagcctggcagtcagtggtgcact

SEQ ID NO: 173246 - DNA, 25 bp, E. coli
gcagatgagttggatcattaccgga

SEQ ID NO: 173247 - DNA, 25 bp, E. coli
gcagatgagttgcatcattaccgga

SEQ ID NO: 173248 - DNA, 25 bp, E. coli
cgatgacgtcttaactgcagatgag

SEQ ID NO: 173249 - DNA, 25 bp, E. coli
cgttgcgatgacagtctccggctca

SEQ ID NO: 173250 - DNA, 25 bp, E. coli
cgttgcgatgactgtctccggctca

SEQ ID NO: 173251 - DNA, 25 bp, E. coli
cgatgacgtctttactgcagatgag

SEQ ID NO: 173252 - DNA, 25 bp, E. coli
ggctcactggtaaccggtcacggaa

SEQ ID NO: 173253 - DNA, 25 bp, E. coli
ggctcactggtatccggtcacggaa

SEQ ID NO: 173254 - DNA, 25 bp, E. coli
ggagaatcactctgcggcagccgga

SEQ ID NO: 173255 - DNA, 25 bp, E. coli
tggtgcacttctgcccggaaaacgg

SEQ ID NO: 173256 - DNA, 25 bp, E. coli
ggagaatcactcagcggcagccgga

SEQ ID NO: 173257 - DNA, 25 bp, E. coli
taatgaggtgcccttaagcctccgg

SEQ ID NO: 173258 - DNA, 25 bp, E. coli
taatgaggtgccgttaagcctccgg

SEQ ID NO: 173259 - DNA, 25 bp, E. coli
caatggtttgtattaagtaagcgca

SEQ ID NO: 173260 - DNA, 25 bp, E. coli
aatatttatagggactgtatcagac

SEQ ID NO: 173261 - DNA, 25 bp, E. coli
aatatttataggcactgtatcagac

SEQ ID NO: 173262 - DNA, 25 bp, E. coli
caatggtttgtaataagtaagcgca

SEQ ID NO: 173263 - DNA, 25 bp, E. coli
tatggctttattatctgtcaggagg

SEQ ID NO: 173264 - DNA, 25 bp, E. coli
tatggctttattttctgtcaggagg

SEQ ID NO: 173265 - DNA, 25 bp, E. coli
tagactccactcgtgatgtgagcga

SEQ ID NO: 173266 - DNA, 25 bp, E. coli
tagactccactcctgatgtgagcga

SEQ ID NO: 173267 - DNA, 25 bp, E. coli
ttttattcagaggtatatggctggc

SEQ ID NO: 173268 - DNA, 25 bp, E. coli
ttttattcagagctatatggctggc

SEQ ID NO: 173269 - DNA, 25 bp, E. coli
tctgtcaggaggctatattcaatgg

SEQ ID NO: 173270 - DNA, 25 bp, E. coli
tctgtcaggagggtatattcaatgg

SEQ ID NO: 173271 - DNA, 25 bp, E. coli
gcatagactttctctattagactcc

SEQ ID NO: 173272 - DNA, 25 bp, E. coli
gcatagactttcactattagactcc

SEQ ID NO: 173273 - DNA, 25 bp, E. coli
gtatcagacattattggcgtaagga

SEQ ID NO: 173274 - DNA, 25 bp, E. coli
gtatcagacatttttggcgtaagga

SEQ ID NO: 173275 - DNA, 25 bp, E. coli
tggctggctttaacgcttttaatac

SEQ ID NO: 173276 - DNA, 25 bp, E. coli
tggctggctttatcgcttttaatac

SEQ ID NO: 173277 - DNA, 25 bp, E. coli
gatgtgagcgagttaattagtctca

SEQ ID NO: 173278 - DNA, 25 bp, E. coli
gatgtgagcgagataattagtctca

SEQ ID NO: 173279 - DNA, 25 bp, E. coli
gatggtaatatgttttccaacaggc

SEQ ID NO: 173280 - DNA, 25 bp, E. coli
gatggtaatatgatttccaacaggc

SEQ ID NO: 173281 - DNA, 25 bp, E. coli
caacaacagcgctactaattaagac

SEQ ID NO: 173282 - DNA, 25 bp, E. coli
caacaacagcgcaactaattaagac

SEQ ID NO: 173283 - DNA, 25 bp, E. coli
caaagtggacgaataatactctaaa

SEQ ID NO: 173284 - DNA, 25 bp, E. coli
caaagtggacgattaatactctaaa

SEQ ID NO: 173285 - DNA, 25 bp, E. coli
taacaatgtaaaaacaacaacagcg

SEQ ID NO: 173286 - DNA, 25 bp, E. coli
taacaatgtaaatacaacaacagcg

SEQ ID NO: 173287 - DNA, 25 bp, E. coli
tataaaaatgatcgagagattctct

SEQ ID NO: 173288 - DNA, 25 bp, E. coli
tatagtgtaaggcaagagcttctga

SEQ ID NO: 173289 - DNA, 25 bp, E. coli
tatattactgtccttggttgaccaa

SEQ ID NO: 173290 - DNA, 25 bp, E. coli
tataaaaatgatggagagattctct

SEQ ID NO: 173291 - DNA, 25 bp, E. coli
tatagtgtaagggaagagcttctga

SEQ ID NO: 173292 - DNA, 25 bp, E. coli
tatattactgtcgttggttgaccaa

SEQ ID NO: 173293 - DNA, 25 bp, E. coli
tggttctccagtagtaataaacgta

SEQ ID NO: 173294 - DNA, 25 bp, E. coli
tgcgtcgggacatattttagcggtt

SEQ ID NO: 173295 - DNA, 25 bp, E. coli
tgcgtcgggacaaattttagcggtt

SEQ ID NO: 173296 - DNA, 25 bp, E. coli
gaatttcatttcgtgcgtcgggaca

SEQ ID NO: 173297 - DNA, 25 bp, E. coli
gaatttcatttcctgcgtcgggaca

SEQ ID NO: 173298 - DNA, 25 bp, E. coli
tggttctccagttgtaataaacgta

SEQ ID NO: 173299 - DNA, 25 bp, E. coli
taaccttgatatctgtgagataaag

SEQ ID NO: 173300 - DNA, 25 bp, E. coli
taattaagacacgaacaaagtggac

SEQ ID NO: 173301 - DNA, 25 bp, E. coli
taaccttgatatgtgtgagataaag

SEQ ID NO: 173302 - DNA, 25 bp, E. coli
taattaagacaccaacaaagtggac

SEQ ID NO: 173303 - DNA, 25 bp, E. coli
caaaggaacgtcacgatgtttggaa

SEQ ID NO: 173304 - DNA, 25 bp, E. coli
cacccaaaggaacgtcacgatgttt

SEQ ID NO: 173305 - DNA, 25 bp, E. coli
caaaggaacgtctcgatgtttggaa

SEQ ID NO: 173306 - DNA, 25 bp, E. coli
cacccaaaggaaggtcacgatgttt

SEQ ID NO: 173307 - DNA, 25 bp, E. coli
ttggctcacccagccaaaggaacgt

SEQ ID NO: 173308 - DNA, 25 bp, E. coli
ttctctgtgggctgatcgctcccgg

SEQ ID NO: 173309 - DNA, 25 bp, E. coli
ttggctcacccacccaaaggaacgt

SEQ ID NO: 173310 - DNA, 25 bp, E. coli
ttctctgtgggcagatcgctcccgg

SEQ ID NO: 173311 - DNA, 25 bp, E. coli
gaacgtcacgatgtttggaatcttc

SEQ ID NO: 173312 - DNA, 25 bp, E. coli
gactttctctgtgggcagatcgctc

SEQ ID NO: 173313 - DNA, 25 bp, E. coli
gactttctctgtcggcagatcgctc

SEQ ID NO: 173314 - DNA, 25 bp, E. coli
gaacgtcacgatctttggaatcttc

SEQ ID NO: 173315 - DNA, 25 bp, E. coli
cccacccaaaggaacgtcacgatgt

SEQ ID NO: 173316 - DNA, 25 bp, E. coli
cccacccaaaggtacgtcacgatgt

SEQ ID NO: 173317 - DNA, 25 bp, E. coli
ctctgtgggcagttcgctcccgggc

SEQ ID NO: 173318 - DNA, 25 bp, E. coli
ctctgtgggcagatcgctcccgggc

SEQ ID NO: 173319 - DNA, 25 bp, E. coli
gtgactttctctctgggcagatcgc

SEQ ID NO: 173320 - DNA, 25 bp, E. coli
gtgactttctctgtgggcagatcgc

SEQ ID NO: 173321 - DNA, 25 bp, E. coli
gggcagatcgctcccgggcgttggc

SEQ ID NO: 173322 - DNA, 25 bp, E. coli
gggcgttggctctcccacccaaagg

SEQ ID NO: 173323 - DNA, 25 bp, E. coli
gggcagatcgctgccgggcgttggc

SEQ ID NO: 173324 - DNA, 25 bp, E. coli
gggcgttggctcacccacccaaagg

SEQ ID NO: 173325 - DNA, 25 bp, E. coli
cagcgctcagcggattggtcgtttt

SEQ ID NO: 173326 - DNA, 25 bp, E. coli
cactattcctcgttgaagtgggcga

SEQ ID NO: 173327 - DNA, 25 bp, E. coli
caacatggaatgcccgggcaacgtg

SEQ ID NO: 173328 - DNA, 25 bp, E. coli
cactattcctcgatgaagtgggcga

SEQ ID NO: 173329 - DNA, 25 bp, E. coli
cagcgctcagcgcattggtcgtttt

SEQ ID NO: 173330 - DNA, 25 bp, E. coli
caacatggaatggccgggcaacgtg

SEQ ID NO: 173331 - DNA, 25 bp, E. coli
catcctgagcaagatggaatggccg

SEQ ID NO: 173332 - DNA, 25 bp, E. coli
catcctgagcaacatggaatggccg

SEQ ID NO: 173333 - DNA, 25 bp, E. coli
tcagacggacgttcgtttaattgcc

SEQ ID NO: 173334 - DNA, 25 bp, E. coli
tcagacggacgtacgtttaattgcc

SEQ ID NO: 173335 - DNA, 25 bp, E. coli
tgcgcatcctgagcaacatggaatg

SEQ ID NO: 173336 - DNA, 25 bp, E. coli
tcctggaagaacaaaatgtcatata

SEQ ID NO: 173337 - DNA, 25 bp, E. coli
tcctggaagaactaaatgtcatata

SEQ ID NO: 173338 - DNA, 25 bp, E. coli
tgcgcatcctgaccaacatggaatg

SEQ ID NO: 173339 - DNA, 25 bp, E. coli
tcagcgcattggtcgttttgaactg

SEQ ID NO: 173340 - DNA, 25 bp, E. coli
tcagcgcattggacgttttgaactg

SEQ ID NO: 173341 - DNA, 25 bp, E. coli
gaagaacaaaatgtcatatacaccg

SEQ ID NO: 173342 - DNA, 25 bp, E. coli
gaagaacaaaatctcatatacaccg

SEQ ID NO: 173343 - DNA, 25 bp, E. coli
gataaaagctcactattcctcgatg

SEQ ID NO: 173344 - DNA, 25 bp, E. coli
gataaaagctcagtattcctcgatg

SEQ ID NO: 173345 - DNA, 25 bp, E. coli
gacgtacgtttatttgccgcgacta

SEQ ID NO: 173346 - DNA, 25 bp, E. coli
gacgtacgtttaattgccgcgacta

SEQ ID NO: 173347 - DNA, 25 bp, E. coli
cacttgagcggtagttcatgcagac

SEQ ID NO: 173348 - DNA, 25 bp, E. coli
cacttgagcggttgttcatgcagac

SEQ ID NO: 173349 - DNA, 25 bp, E. coli
tttatgccgtcgctccgaaagccgg

SEQ ID NO: 173350 - DNA, 25 bp, E. coli
ttcatggtcagatccgttacgcgca

SEQ ID NO: 173351 - DNA, 25 bp, E. coli
tttatgccgtcggtccgaaagccgg

SEQ ID NO: 173352 - DNA, 25 bp, E. coli
ttcatggtcagaaccgttacgcgca

SEQ ID NO: 173353 - DNA, 25 bp, E. coli
gcgatttgcctgttctcccggtgag

SEQ ID NO: 173354 - DNA, 25 bp, E. coli
gcgatttgcctgatctcccggtgag

SEQ ID NO: 173355 - DNA, 25 bp, E. coli
gaaatcgtgcttgcgtatgacaaag

SEQ ID NO: 173356 - DNA, 25 bp, E. coli
gaaatcgtgcttccgtatgacaaag

SEQ ID NO: 173357 - DNA, 25 bp, E. coli
taatcatgagctatttgtcggtcgg

SEQ ID NO: 173358 - DNA, 25 bp, E. coli
taatcatgagctttttgtcggtcgg

SEQ ID NO: 173359 - DNA, 25 bp, E. coli
gacgcagccagaaaccggatgaact

SEQ ID NO: 173360 - DNA, 25 bp, E. coli
gatgtggatatcagctccggacgct

SEQ ID NO: 173361 - DNA, 25 bp, E. coli
gatccgtcgggcatatcgtcataca

SEQ ID NO: 173362 - DNA, 25 bp, E. coli
gatgaactcctcacatggcctgaag

SEQ ID NO: 173363 - DNA, 25 bp, E. coli
gatgtggatatctgctccggacgct

SEQ ID NO: 173364 - DNA, 25 bp, E. coli
gatgctctgtcattggctgccgtgg

SEQ ID NO: 173365 - DNA, 25 bp, E. coli
gatgctctgtcaatggctgccgtgg

SEQ ID NO: 173366 - DNA, 25 bp, E. coli
gatccgtcgggcttatcgtcataca

SEQ ID NO: 173367 - DNA, 25 bp, E. coli
gacgcagccagataccggatgaact

SEQ ID NO: 173368 - DNA, 25 bp, E. coli
gatgaactcctctcatggcctgaag

SEQ ID NO: 173369 - DNA, 25 bp, E. coli
atgtcggacacactccccggaacaa

SEQ ID NO: 173370 - DNA, 25 bp, E. coli
atgtcggacacagtccccggaacaa

SEQ ID NO: 173371 - DNA, 25 bp, E. coli
acaccttgttttggcgcccgtctgg

SEQ ID NO: 173372 - DNA, 25 bp, E. coli
acaccttgttttcgcgcccgtctgg

SEQ ID NO: 173373 - DNA, 25 bp, E. coli
tatcaggggccggttcagcaatgcg

SEQ ID NO: 173374 - DNA, 25 bp, E. coli
tatcctgcgacccaaacggaaagta

SEQ ID NO: 173375 - DNA, 25 bp, E. coli
tatcctgcgaccgaaacggaaagta

SEQ ID NO: 173376 - DNA, 25 bp, E. coli
tatcaggggccgcttcagcaatgcg

SEQ ID NO: 173377 - DNA, 25 bp, E. coli
tgtttatcctgcgaccgaaacggaa

SEQ ID NO: 173378 - DNA, 25 bp, E. coli
tgtttatcctgccaccgaaacggaa

SEQ ID NO: 173379 - DNA, 25 bp, E. coli
tgccctgcgccgagacaccttgttt

SEQ ID NO: 173380 - DNA, 25 bp, E. coli
tgccctgcgccgtgacaccttgttt

SEQ ID NO: 173381 - DNA, 25 bp, E. coli
tctggctgtttatcctgcgaccgaa

SEQ ID NO: 173382 - DNA, 25 bp, E. coli
tctggctgtttaacctgcgaccgaa

SEQ ID NO: 173383 - DNA, 25 bp, E. coli
cctgcgccgtgagaccttgttttgg

SEQ ID NO: 173384 - DNA, 25 bp, E. coli
cctgcgccgtgacaccttgttttgg

SEQ ID NO: 173385 - DNA, 25 bp, E. coli
cgtgacaccttgatttggcgcccgt

SEQ ID NO: 173386 - DNA, 25 bp, E. coli
cgtgacaccttgttttggcgcccgt

SEQ ID NO: 173387 - DNA, 25 bp, E. coli
ggaacaacgcttcccgacgacaaca

SEQ ID NO: 173388 - DNA, 25 bp, E. coli
tggctgtttatcgtgcgaccgaaac

SEQ ID NO: 173389 - DNA, 25 bp, E. coli
ggaacaacgcttgccgacgacaaca

SEQ ID NO: 173390 - DNA, 25 bp, E. coli
tggctgtttatcctgcgaccgaaac

SEQ ID NO: 173391 - DNA, 25 bp, E. coli
cagattcgtcgtccggtgaaacgtc

SEQ ID NO: 173392 - DNA, 25 bp, E. coli
cagattcgtcgtgcggtgaaacgtc

SEQ ID NO: 173393 - DNA, 25 bp, E. coli
taaaaccatcaagttcagcggcggc

SEQ ID NO: 173394 - DNA, 25 bp, E. coli
taaaaccatcaacttcagcggcggc

SEQ ID NO: 173395 - DNA, 25 bp, E. coli
tgtgtacccgtatcgatccggaagg

SEQ ID NO: 173396 - DNA, 25 bp, E. coli
tgaccgaaggccgtaaccgtgaagt

SEQ ID NO: 173397 - DNA, 25 bp, E. coli
tgtgtacccgtaacgatccggaagg

SEQ ID NO: 173398 - DNA, 25 bp, E. coli
tgaccgaaggccctaaccgtgaagt

SEQ ID NO: 173399 - DNA, 25 bp, E. coli
tcgctgtagaaatagaccgtcgtcg

SEQ ID NO: 173400 - DNA, 25 bp, E. coli
tcgctgtagaaaaagaccgtcgtcg

SEQ ID NO: 173401 - DNA, 25 bp, E. coli
gctacagaaagtcctggcgcgtgcc

SEQ ID NO: 173402 - DNA, 25 bp, E. coli
gctacagaaagtgctggcgcgtgcc

SEQ ID NO: 173403 - DNA, 25 bp, E. coli
gcaaaattgctaaactcggcgatcg

SEQ ID NO: 173404 - DNA, 25 bp, E. coli
gaatctattattgaagccggtcgtg

SEQ ID NO: 173405 - DNA, 25 bp, E. coli
gaatctattattcaagccggtcgtg

SEQ ID NO: 173406 - DNA, 25 bp, E. coli
gcaaaattgctatactcggcgatcg

SEQ ID NO: 173407 - DNA, 25 bp, E. coli
gaaaatccgtatcgatggtcacctg

SEQ ID NO: 173408 - DNA, 25 bp, E. coli
gaaaatccgtatggatggtcacctg

SEQ ID NO: 173409 - DNA, 25 bp, E. coli
cgtgagtccgctgaacaaatttgtc

SEQ ID NO: 173410 - DNA, 25 bp, E. coli
cgtgagtccgctcaacaaatttgtc

SEQ ID NO: 173411 - DNA, 25 bp, E. coli
ggcgaagggatctaccagtggtaca

SEQ ID NO: 173412 - DNA, 25 bp, E. coli
ggcgaagggatcaaccagtggtaca

SEQ ID NO: 173413 - DNA, 25 bp, E. coli
caacaaattggtgcccgactgctgg

SEQ ID NO: 173414 - DNA, 25 bp, E. coli
caacaaattggtccccgactgctgg

SEQ ID NO: 173415 - DNA, 25 bp, E. coli
cagggctgtatgtcgatattctcgg

SEQ ID NO: 173416 - DNA, 25 bp, E. coli
cagattcaggcgctggagcaacaaa

SEQ ID NO: 173417 - DNA, 25 bp, E. coli
cagattcaggcggtggagcaacaaa

SEQ ID NO: 173418 - DNA, 25 bp, E. coli
catgaaccgcttttggcgatgatcc

SEQ ID NO: 173419 - DNA, 25 bp, E. coli
catgaaccgcttatggcgatgatcc

SEQ ID NO: 173420 - DNA, 25 bp, E. coli
cagggctgtatgacgatattctcgg

SEQ ID NO: 173421 - DNA, 25 bp, E. coli
tacaaacccgcgaaatgaacactcg

SEQ ID NO: 173422 - DNA, 25 bp, E. coli
tacaaacccgcgtaatgaacactcg

SEQ ID NO: 173423 - DNA, 25 bp, E. coli
tatgggattgctccgtaacacagcg

SEQ ID NO: 173424 - DNA, 25 bp, E. coli
tatgggattgctgcgtaacacagcg

SEQ ID NO: 173425 - DNA, 25 bp, E. coli
tctgaaatgtggatggtctggccga

SEQ ID NO: 173426 - DNA, 25 bp, E. coli
tctgaaatgtggttggtctggccga

SEQ ID NO: 173427 - DNA, 25 bp, E. coli
gctcaacgaaatccgctgggtgccg

SEQ ID NO: 173428 - DNA, 25 bp, E. coli
gctcaacgaaatgcgctgggtgccg

SEQ ID NO: 173429 - DNA, 25 bp, E. coli
gacgcccgtcatcactcaggaggtg

SEQ ID NO: 173430 - DNA, 25 bp, E. coli
gacgcccgtcatgactcaggaggtg

SEQ ID NO: 173431 - DNA, 25 bp, E. coli
cgctcattgaagcaacgctggatat

SEQ ID NO: 173432 - DNA, 25 bp, E. coli
cgctcattgaaggaacgctggatat

SEQ ID NO: 173433 - DNA, 25 bp, E. coli
ggtctggccgaatcatcatgaacaa

SEQ ID NO: 173434 - DNA, 25 bp, E. coli
ggtctggccgaaacatcatgaacaa

SEQ ID NO: 173435 - DNA, 25 bp, E. coli
aataaacgggaggcggtatgcacaa

SEQ ID NO: 173436 - DNA, 25 bp, E. coli
aataataaacggcaggcggtatgca

SEQ ID NO: 173437 - DNA, 25 bp, E. coli
aataataaacgggaggcggtatgca

SEQ ID NO: 173438 - DNA, 25 bp, E. coli
aataaacgggagccggtatgcacaa

SEQ ID NO: 173439 - DNA, 25 bp, E. coli
cagcggctggctgagaagataaata

SEQ ID NO: 173440 - DNA, 25 bp, E. coli
cagcggctggctcagaagataaata

SEQ ID NO: 173441 - DNA, 25 bp, E. coli
acgggaggcggtttgcacaaagcat

SEQ ID NO: 173442 - DNA, 25 bp, E. coli
agaaatccactgtaagcacagcggc

SEQ ID NO: 173443 - DNA, 25 bp, E. coli
agaaatccactgaaagcacagcggc

SEQ ID NO: 173444 - DNA, 25 bp, E. coli
atggcgatgacgcatcctcacgata

SEQ ID NO: 173445 - DNA, 25 bp, E. coli
acgggaggcggtatgcacaaagcat

SEQ ID NO: 173446 - DNA, 25 bp, E. coli
atggcgatgacggatcctcacgata

SEQ ID NO: 173447 - DNA, 25 bp, E. coli
aaacgggaggcgctatgcacaaagc

SEQ ID NO: 173448 - DNA, 25 bp, E. coli
aaacgggaggcggtatgcacaaagc

SEQ ID NO: 173449 - DNA, 25 bp, E. coli
tatcagaaatcctctgaaagcacag

SEQ ID NO: 173450 - DNA, 25 bp, E. coli
tatcagaaatccactgaaagcacag

SEQ ID NO: 173451 - DNA, 25 bp, E. coli
gataatatccggctaggcgcgatca

SEQ ID NO: 173452 - DNA, 25 bp, E. coli
gataatatccgggtaggcgcgatca

SEQ ID NO: 173453 - DNA, 25 bp, E. coli
tggcgatgacgcatcctcacgataa

SEQ ID NO: 173454 - DNA, 25 bp, E. coli
tggcgatgacgcttcctcacgataa

SEQ ID NO: 173455 - DNA, 25 bp, E. coli
taataaacgggaggcggtatgcaca

SEQ ID NO: 173456 - DNA, 25 bp, E. coli
taataaacgggacgcggtatgcaca

SEQ ID NO: 173457 - DNA, 25 bp, E. coli
caaatgcggcccatcagattgttgg

SEQ ID NO: 173458 - DNA, 25 bp, E. coli
caaatgcggcccttcagattgttgg

SEQ ID NO: 173459 - DNA, 25 bp, E. coli
aacaagtccgggtttctcccgcaga

SEQ ID NO: 173460 - DNA, 25 bp, E. coli
aacaagtccgggattctcccgcaga

SEQ ID NO: 173461 - DNA, 25 bp, E. coli
acatattgcaggaagtatgtaggcc

SEQ ID NO: 173462 - DNA, 25 bp, E. coli
acatattgcaggtagtatgtaggcc

SEQ ID NO: 173463 - DNA, 25 bp, E. coli
tagagataaacgcaactgtgctgcc

SEQ ID NO: 173464 - DNA, 25 bp, E. coli
tatccgtcctacaagattttgcaaa

SEQ ID NO: 173465 - DNA, 25 bp, E. coli
tatccgtcctactagattttgcaaa

SEQ ID NO: 173466 - DNA, 25 bp, E. coli
tagagataaacggaactgtgctgcc

SEQ ID NO: 173467 - DNA, 25 bp, E. coli
tttgctatcagtctcaagggccgcg

SEQ ID NO: 173468 - DNA, 25 bp, E. coli
tttgctatcagtgtcaagggccgcg

SEQ ID NO: 173469 - DNA, 25 bp, E. coli
gcttcaccgcgcaggcggatagctt

SEQ ID NO: 173470 - DNA, 25 bp, E. coli
gcttcaccgcgctggcggatagctt

SEQ ID NO: 173471 - DNA, 25 bp, E. coli
gtttaccgtccctacgctcagcagt

SEQ ID NO: 173472 - DNA, 25 bp, E. coli
gtttaccgtcccaacgctcagcagt

SEQ ID NO: 173473 - DNA, 25 bp, E. coli
gggatcatggtatcgggcagtttac

SEQ ID NO: 173474 - DNA, 25 bp, E. coli
ggatagcttctgcttcagccgcact

SEQ ID NO: 173475 - DNA, 25 bp, E. coli
gggatcatggtaacgggcagtttac

SEQ ID NO: 173476 - DNA, 25 bp, E. coli
ggatagcttctggttcagccgcact

SEQ ID NO: 173477 - DNA, 25 bp, E. coli
tcagcagtggtgtgggcaacaagtc

SEQ ID NO: 173478 - DNA, 25 bp, E. coli
tcagcagtggtgagggcaacaagtc

SEQ ID NO: 173479 - DNA, 25 bp, E. coli
caggttctacgtttagttgccgcgc

SEQ ID NO: 173480 - DNA, 25 bp, E. coli
caggttctacgtatagttgccgcgc

SEQ ID NO: 173481 - DNA, 25 bp, E. coli
aaagctcaataacacaggttctacg

SEQ ID NO: 173482 - DNA, 25 bp, E. coli
aaagctcaataagacaggttctacg

SEQ ID NO: 173483 - DNA, 25 bp, E. coli
tagttgccgcgcttttatatgcgct

SEQ ID NO: 173484 - DNA, 25 bp, E. coli
tagttgccgcgcatttatatgcgct

SEQ ID NO: 173485 - DNA, 25 bp, E. coli
tatatgcgcttgatttacaacatct

SEQ ID NO: 173486 - DNA, 25 bp, E. coli
tatatgcgcttgttttacaacatct

SEQ ID NO: 173487 - DNA, 25 bp, E. coli
tcgccggaaagcacaataagacagg

SEQ ID NO: 173488 - DNA, 25 bp, E. coli
tccttatctatcaaataacgttgag

SEQ ID NO: 173489 - DNA, 25 bp, E. coli
tccttatctatctaataacgttgag

SEQ ID NO: 173490 - DNA, 25 bp, E. coli
tcgccggaaagctcaataagacagg

SEQ ID NO: 173491 - DNA, 25 bp, E. coli
ccattgaactctggccggaaagctc

SEQ ID NO: 173492 - DNA, 25 bp, E. coli
ccattgaactctcgccggaaagctc

SEQ ID NO: 173493 - DNA, 25 bp, E. coli
gcttgatttacaacatcttctggat

SEQ ID NO: 173494 - DNA, 25 bp, E. coli
gcttgatttacatcatcttctggat

SEQ ID NO: 173495 - DNA, 25 bp, E. coli
tggaacctgtcccattgaactctcg

SEQ ID NO: 173496 - DNA, 25 bp, E. coli
tggaacctgtccgattgaactctcg

SEQ ID NO: 173497 - DNA, 25 bp, E. coli
taacgttgagttatctggaacctgt

SEQ ID NO: 173498 - DNA, 25 bp, E. coli
taacgttgagttttctggaacctgt

SEQ ID NO: 173499 - DNA, 25 bp, E. coli
gagttttctggatcctgtcccattg

SEQ ID NO: 173500 - DNA, 25 bp, E. coli
gagttttctggaacctgtcccattg

SEQ ID NO: 173501 - DNA, 25 bp, E. coli
caaaatggcgcaggatatcgtggca

SEQ ID NO: 173502 - DNA, 25 bp, E. coli
caaaatggcgcacgatatcgtggca

SEQ ID NO: 173503 - DNA, 25 bp, E. coli
cacttactgaatcggcgcaacggct

SEQ ID NO: 173504 - DNA, 25 bp, E. coli
cacttactgaatgggcgcaacggct

SEQ ID NO: 173505 - DNA, 25 bp, E. coli
taaacagcggatcccagaaagtcgc

SEQ ID NO: 173506 - DNA, 25 bp, E. coli
taaacagcggatgccagaaagtcgc

SEQ ID NO: 173507 - DNA, 25 bp, E. coli
aactgaccgggcatgatttgggcaa

SEQ ID NO: 173508 - DNA, 25 bp, E. coli
aactgaccgggcttgatttgggcaa

SEQ ID NO: 173509 - DNA, 25 bp, E. coli
tctgcgtaaatatggcgaactggtc

SEQ ID NO: 173510 - DNA, 25 bp, E. coli
tctgcgtaaataaggcgaactggtc

SEQ ID NO: 173511 - DNA, 25 bp, E. coli
gaactggtctgcatgacggctgaaa

SEQ ID NO: 173512 - DNA, 25 bp, E. coli
gaacaactgatttcccgcatgaaag

SEQ ID NO: 173513 - DNA, 25 bp, E. coli
gaaatgatgctgcaacagtcgcggt

SEQ ID NO: 173514 - DNA, 25 bp, E. coli
gaaatgatgctggaacagtcgcggt

SEQ ID NO: 173515 - DNA, 25 bp, E. coli
gaacaactgattacccgcatgaaag

SEQ ID NO: 173516 - DNA, 25 bp, E. coli
gaactggtctgcttgacggctgaaa

SEQ ID NO: 173517 - DNA, 25 bp, E. coli
cgttgaactcttttgggcgctggga

SEQ ID NO: 173518 - DNA, 25 bp, E. coli
cgttgaactcttatgggcgctggga

SEQ ID NO: 173519 - DNA, 25 bp, E. coli
ctattgttgaggtcgacagcggtca

SEQ ID NO: 173520 - DNA, 25 bp, E. coli
ctattgttgaggacgacagcggtca

SEQ ID NO: 173521 - DNA, 25 bp, E. coli
gatctcaatcaagcgcgagtggtgg

SEQ ID NO: 173522 - DNA, 25 bp, E. coli
gatctcaatcaaccgcgagtggtgg

SEQ ID NO: 173523 - DNA, 25 bp, E. coli
cacaaatgcagggaggaaacagagg

SEQ ID NO: 173524 - DNA, 25 bp, E. coli
cacaaatgcaggcaggaaacagagg

SEQ ID NO: 173525 - DNA, 25 bp, E. coli
agtttggacacgaacagcgcggaga

SEQ ID NO: 173526 - DNA, 25 bp, E. coli
agtttggacacgtacagcgcggaga

SEQ ID NO: 173527 - DNA, 25 bp, E. coli
taccgtttggtgttttggaagttga

SEQ ID NO: 173528 - DNA, 25 bp, E. coli
taccgtttggtgatttggaagttga

SEQ ID NO: 173529 - DNA, 25 bp, E. coli
tgttgcagtcagattggacacgaac

SEQ ID NO: 173530 - DNA, 25 bp, E. coli
tgttgcagtcagtttggacacgaac

SEQ ID NO: 173531 - DNA, 25 bp, E. coli
tgcgcacccttaaaaatttaatgac

SEQ ID NO: 173532 - DNA, 25 bp, E. coli
tataacggacgtcaaaggagtaacg

SEQ ID NO: 173533 - DNA, 25 bp, E. coli
tataacggacgtgaaaggagtaacg

SEQ ID NO: 173534 - DNA, 25 bp, E. coli
tgcgcacccttataaatttaatgac

SEQ ID NO: 173535 - DNA, 25 bp, E. coli
gccatcatatttataacggacgtga

SEQ ID NO: 173536 - DNA, 25 bp, E. coli
gccatcatatttttaacggacgtga

SEQ ID NO: 173537 - DNA, 25 bp, E. coli
gaataagaacttcgttcaacaggcg

SEQ ID NO: 173538 - DNA, 25 bp, E. coli
gaataagaacttggttcaacaggcg

SEQ ID NO: 173539 - DNA, 25 bp, E. coli
gaaatcctccccacaaatgcaggga

SEQ ID NO: 173540 - DNA, 25 bp, E. coli
gaaatcctcccctcaaatgcaggga

SEQ ID NO: 173541 - DNA, 25 bp, E. coli
gaacttagttcaagacgaaatcctc

SEQ ID NO: 173542 - DNA, 25 bp, E. coli
gaacttagttcatgacgaaatcctc

SEQ ID NO: 173543 - DNA, 25 bp, E. coli
taaaatagcctgctgaacttagttc

SEQ ID NO: 173544 - DNA, 25 bp, E. coli
taaaatagcctggtgaacttagttc

SEQ ID NO: 173545 - DNA, 25 bp, E. coli
aacgatttgaaacgcggcatgacca

SEQ ID NO: 173546 - DNA, 25 bp, E. coli
aatatatggcaatacgatcgggatc

SEQ ID NO: 173547 - DNA, 25 bp, E. coli
aatatatggcaaaacgatcgggatc

SEQ ID NO: 173548 - DNA, 25 bp, E. coli
caactcacggtggtattgccagagc

SEQ ID NO: 173549 - DNA, 25 bp, E. coli
caactcacggtgctattgccagagc

SEQ ID NO: 173550 - DNA, 25 bp, E. coli
cacaatggttctcgttaaggctcct

SEQ ID NO: 173551 - DNA, 25 bp, E. coli
cacaatggttctggttaaggctcct

SEQ ID NO: 173552 - DNA, 25 bp, E. coli
tacagtcggagtcgtgacagcagcc

SEQ ID NO: 173553 - DNA, 25 bp, E. coli
tacagtcggagtggtgacagcagcc

SEQ ID NO: 173554 - DNA, 25 bp, E. coli
aacgatttgaaaggcggcatgacca

SEQ ID NO: 173555 - DNA, 25 bp, E. coli
tgatggcatcacgtttggacagccg

SEQ ID NO: 173556 - DNA, 25 bp, E. coli
tgatggcatcacctttggacagccg

SEQ ID NO: 173557 - DNA, 25 bp, E. coli
gaaaccgtggtcactgtcatcccaa

SEQ ID NO: 173558 - DNA, 25 bp, E. coli
gaaaccgtggtctctgtcatcccaa

SEQ ID NO: 173559 - DNA, 25 bp, E. coli
gacagcagccagatttattacggaa

SEQ ID NO: 173560 - DNA, 25 bp, E. coli
gacatttttcagagccagtcgccaa

SEQ ID NO: 173561 - DNA, 25 bp, E. coli
gacatttttcagtgccagtcgccaa

SEQ ID NO: 173562 - DNA, 25 bp, E. coli
gacagcagccagttttattacggaa

SEQ ID NO: 173563 - DNA, 25 bp, E. coli
gttactggaacaggtcacgcagcga

SEQ ID NO: 173564 - DNA, 25 bp, E. coli
gttactggaacacgtcacgcagcga

SEQ ID NO: 173565 - DNA, 25 bp, E. coli
ggtaatacatcgactggcaccagtg

SEQ ID NO: 173566 - DNA, 25 bp, E. coli
ggtaatacatcgtctggcaccagtg

SEQ ID NO: 173567 - DNA, 25 bp, E. coli
tactgaaggcacaggtcagccatcc

SEQ ID NO: 173568 - DNA, 25 bp, E. coli
tactgaaggcactggtcagccatcc

SEQ ID NO: 173569 - DNA, 25 bp, E. coli
aaatgttccgcgaagacgagccgat

SEQ ID NO: 173570 - DNA, 25 bp, E. coli
aaatgttccgcgtagacgagccgat

SEQ ID NO: 173571 - DNA, 25 bp, E. coli
tatctcaccgaagaaggcttccagg

SEQ ID NO: 173572 - DNA, 25 bp, E. coli
tatctcaccgaacaaggcttccagg

SEQ ID NO: 173573 - DNA, 25 bp, E. coli
ttcaaacttaacgtcggtacgcgcg

SEQ ID NO: 173574 - DNA, 25 bp, E. coli
ttcaaacttaacctcggtacgcgcg

SEQ ID NO: 173575 - DNA, 25 bp, E. coli
tctgcgccgcatggtggaagaagat

SEQ ID NO: 173576 - DNA, 25 bp, E. coli
tctgcgccgcatcgtggaagaagat

SEQ ID NO: 173577 - DNA, 25 bp, E. coli
gctaatgcagaagagatggatcgcc

SEQ ID NO: 173578 - DNA, 25 bp, E. coli
gctaatgcagaacagatggatcgcc

SEQ ID NO: 173579 - DNA, 25 bp, E. coli
cgtcacaggaagaggcggtaattgc

SEQ ID NO: 173580 - DNA, 25 bp, E. coli
cgtcacaggaagtggcggtaattgc

SEQ ID NO: 173581 - DNA, 25 bp, E. coli
gtttaacccgcgtgaactgctggcc

SEQ ID NO: 173582 - DNA, 25 bp, E. coli
gtttaacccgcgagaactgctggcc

SEQ ID NO: 173583 - DNA, 25 bp, E. coli
gataagctgatgaaccttgcccgtg

SEQ ID NO: 173584 - DNA, 25 bp, E. coli
gataagctgatgtaccttgcccgtg

SEQ ID NO: 173585 - DNA, 25 bp, E. coli
tggaacgctccaacgacgtgcagat

SEQ ID NO: 173586 - DNA, 25 bp, E. coli
tggaacgctccatcgacgtgcagat

SEQ ID NO: 173587 - DNA, 25 bp, E. coli
gatggatcgcctcctgactcgtgaa

SEQ ID NO: 173588 - DNA, 25 bp, E. coli
gatggatcgcctgctgactcgtgaa

SEQ ID NO: 173589 - DNA, 25 bp, E. coli
catcctcgatgtggctctacgtctt

SEQ ID NO: 173590 - DNA, 25 bp, E. coli
catcctcgatgtcgctctacgtctt

SEQ ID NO: 173591 - DNA, 25 bp, E. coli
tttgatcttaaataagaagcccgcg

SEQ ID NO: 173592 - DNA, 25 bp, E. coli
tattatgcgcggctatatttccggc

SEQ ID NO: 173593 - DNA, 25 bp, E. coli
tttgatcttaaaaaagaagcccgcg

SEQ ID NO: 173594 - DNA, 25 bp, E. coli
tattatgcgcgggtatatttccggc

SEQ ID NO: 173595 - DNA, 25 bp, E. coli
tgttgcctgcggttttaatgacgcg

SEQ ID NO: 173596 - DNA, 25 bp, E. coli
tgttgcctgcggatttaatgacgcg

SEQ ID NO: 173597 - DNA, 25 bp, E. coli
tgcaaaagcagcaggcgttacgcgc

SEQ ID NO: 173598 - DNA, 25 bp, E. coli
tgcaaaagcagctggcgttacgcgc

SEQ ID NO: 173599 - DNA, 25 bp, E. coli
tccacggtgacagaagaacggcgtc

SEQ ID NO: 173600 - DNA, 25 bp, E. coli
tccacggtgacacaagaacggcgtc

SEQ ID NO: 173601 - DNA, 25 bp, E. coli
gcttgagtatcacgcaaaattccct

SEQ ID NO: 173602 - DNA, 25 bp, E. coli
gcttgagtatcaggcaaaattccct

SEQ ID NO: 173603 - DNA, 25 bp, E. coli
gaacggcgtcgattattgatggaga

SEQ ID NO: 173604 - DNA, 25 bp, E. coli
gaaaactggctcattgccccgcaat

SEQ ID NO: 173605 - DNA, 25 bp, E. coli
gaaaactggctctttgccccgcaat

SEQ ID NO: 173606 - DNA, 25 bp, E. coli
gaacggcgtcgaatattgatggaga

SEQ ID NO: 173607 - DNA, 25 bp, E. coli
gttacgcgcggtgcaatctactggc

SEQ ID NO: 173608 - DNA, 25 bp, E. coli
gttacgcgcggtccaatctactggc

SEQ ID NO: 173609 - DNA, 25 bp, E. coli
ggagatgtatctgctgtgccccacg

SEQ ID NO: 173610 - DNA, 25 bp, E. coli
ggagatgtatctcctgtgccccacg

SEQ ID NO: 173611 - DNA, 25 bp, E. coli
aagttgtttgcaattctttaaggcg

SEQ ID NO: 173612 - DNA, 25 bp, E. coli
aagttgtttgcatttctttaaggcg

SEQ ID NO: 173613 - DNA, 25 bp, E. coli
tttattcttcgtacaatggcgacag

SEQ ID NO: 173614 - DNA, 25 bp, E. coli
tttattcttcgttcaatggcgacag

SEQ ID NO: 173615 - DNA, 25 bp, E. coli
tgttcggagttctatgtgctttacc

SEQ ID NO: 173616 - DNA, 25 bp, E. coli
tgttcggagttcaatgtgctttacc

SEQ ID NO: 173617 - DNA, 25 bp, E. coli
tgctgattatgaaaccgaaaacggg

SEQ ID NO: 173618 - DNA, 25 bp, E. coli
tgctgattatgataccgaaaacggg

SEQ ID NO: 173619 - DNA, 25 bp, E. coli
tcagttcctttctacgttttggtca

SEQ ID NO: 173620 - DNA, 25 bp, E. coli
tcagttcctttcaacgttttggtca

SEQ ID NO: 173621 - DNA, 25 bp, E. coli
gctttaccgcattttggagactatt

SEQ ID NO: 173622 - DNA, 25 bp, E. coli
gctttaccgcatattggagactatt

SEQ ID NO: 173623 - DNA, 25 bp, E. coli
cgtacaatggcgtcagatgctgatt

SEQ ID NO: 173624 - DNA, 25 bp, E. coli
cgtacaatggcgacagatgctgatt

SEQ ID NO: 173625 - DNA, 25 bp, E. coli
cgtgcgaagcccgaacgtagtgttc

SEQ ID NO: 173626 - DNA, 25 bp, E. coli
cgtgcgaagccccaacgtagtgttc

SEQ ID NO: 173627 - DNA, 25 bp, E. coli
gatacttaaaacatttgatgcttcc

SEQ ID NO: 173628 - DNA, 25 bp, E. coli
gtttgaacgtgccaagcccgaacgt

SEQ ID NO: 173629 - DNA, 25 bp, E. coli
gtttgaacgtgcgaagcccgaacgt

SEQ ID NO: 173630 - DNA, 25 bp, E. coli
gatacttaaaacttttgatgcttcc

SEQ ID NO: 173631 - DNA, 25 bp, E. coli
gatgcttcctttgtcacttttttga

SEQ ID NO: 173632 - DNA, 25 bp, E. coli
gatgcttcctttctcacttttttga

SEQ ID NO: 173633 - DNA, 25 bp, E. coli
cagtctctggaacgtttacgagtcg

SEQ ID NO: 173634 - DNA, 25 bp, E. coli
catgacgatcatccgctacgtttgc

SEQ ID NO: 173635 - DNA, 25 bp, E. coli
catgacgatcatgcgctacgtttgc

SEQ ID NO: 173636 - DNA, 25 bp, E. coli
cagtctctggaaggtttacgagtcg

SEQ ID NO: 173637 - DNA, 25 bp, E. coli
tacgagtcgtttcttggccgtggaa

SEQ ID NO: 173638 - DNA, 25 bp, E. coli
tacgagtcgtttgttggccgtggaa

SEQ ID NO: 173639 - DNA, 25 bp, E. coli
aaaggtgcggtaccgctgaaagaac

SEQ ID NO: 173640 - DNA, 25 bp, E. coli
aaaggtgcggtagcgctgaaagaac

SEQ ID NO: 173641 - DNA, 25 bp, E. coli
actgtttaataatcgcttgcggcgc

SEQ ID NO: 173642 - DNA, 25 bp, E. coli
actgtttaataaacgcttgcggcgc

SEQ ID NO: 173643 - DNA, 25 bp, E. coli
tctctggaacgtatacgagtcgttt

SEQ ID NO: 173644 - DNA, 25 bp, E. coli
tctctggaacgtttacgagtcgttt

SEQ ID NO: 173645 - DNA, 25 bp, E. coli
gccactgtttaaaaaacgcttgcgg

SEQ ID NO: 173646 - DNA, 25 bp, E. coli
gccactgtttaataaacgcttgcgg

SEQ ID NO: 173647 - DNA, 25 bp, E. coli
cgatcatgcgctacgtttgcgccag

SEQ ID NO: 173648 - DNA, 25 bp, E. coli
cgccagtctctggaacgtttacgag

SEQ ID NO: 173649 - DNA, 25 bp, E. coli
cgccagtctctgcaacgtttacgag

SEQ ID NO: 173650 - DNA, 25 bp, E. coli
cgatcatgcgcttcgtttgcgccag

SEQ ID NO: 173651 - DNA, 25 bp, E. coli
cgtttgttggccgtggaaaggtgcg

SEQ ID NO: 173652 - DNA, 25 bp, E. coli
cgtttgttggccctggaaaggtgcg

SEQ ID NO: 173653 - DNA, 25 bp, E. coli
gagccatgacgatcatgcgctacgt

SEQ ID NO: 173654 - DNA, 25 bp, E. coli
gagccatgacgaacatgcgctacgt

SEQ ID NO: 173655 - DNA, 25 bp, E. coli
caccgtcggatcgaaccgcgatgag

SEQ ID NO: 173656 - DNA, 25 bp, E. coli
caccgtcggatccaaccgcgatgag

SEQ ID NO: 173657 - DNA, 25 bp, E. coli
atcgaaccgcgatgagttcatcatg

SEQ ID NO: 173658 - DNA, 25 bp, E. coli
atcgaaccgcgaagagttcatcatg

SEQ ID NO: 173659 - DNA, 25 bp, E. coli
acgcgttatctgtcgctgcttggcg

SEQ ID NO: 173660 - DNA, 25 bp, E. coli
acgcgttatctgacgctgcttggcg

SEQ ID NO: 173661 - DNA, 25 bp, E. coli
gctgcttggcggcacctgtttaagt

SEQ ID NO: 173662 - DNA, 25 bp, E. coli
gctgcttggcgggacctgtttaagt

SEQ ID NO: 173663 - DNA, 25 bp, E. coli
gaacgcgttatctgtcgctgcttgg

SEQ ID NO: 173664 - DNA, 25 bp, E. coli
gaacgcgttatcagtcgctgcttgg

SEQ ID NO: 173665 - DNA, 25 bp, E. coli
ccgtcggatcgatccgcgatgagtt

SEQ ID NO: 173666 - DNA, 25 bp, E. coli
ccgtcggatcgaaccgcgatgagtt

SEQ ID NO: 173667 - DNA, 25 bp, E. coli
gcttggcggcacgtgtttaagtttc

SEQ ID NO: 173668 - DNA, 25 bp, E. coli
cgtcggatcgaaccgcgatgagttc

SEQ ID NO: 173669 - DNA, 25 bp, E. coli
cgtcggatcgaagcgcgatgagttc

SEQ ID NO: 173670 - DNA, 25 bp, E. coli
cggaacgcgttaactgtcgctgctt

SEQ ID NO: 173671 - DNA, 25 bp, E. coli
gcttggcggcacctgtttaagtttc

SEQ ID NO: 173672 - DNA, 25 bp, E. coli
cggaacgcgttatctgtcgctgctt

SEQ ID NO: 173673 - DNA, 25 bp, E. coli
ggatcgaaccgccatgagttcatca

SEQ ID NO: 173674 - DNA, 25 bp, E. coli
ggatcgaaccgcgatgagttcatca

SEQ ID NO: 173675 - DNA, 25 bp, E. coli
tggcggcacctgattaagtttctac

SEQ ID NO: 173676 - DNA, 25 bp, E. coli
tggcggcacctgtttaagtttctac

SEQ ID NO: 173677 - DNA, 25 bp, E. coli
aatggctgacatcggcgctaaccac

SEQ ID NO: 173678 - DNA, 25 bp, E. coli
aatggctgacatgggcgctaaccac

SEQ ID NO: 173679 - DNA, 25 bp, E. coli
ttcagaccgaagagtgcaagacgcg

SEQ ID NO: 173680 - DNA, 25 bp, E. coli
ttcagaccgaagtgtgcaagacgcg

SEQ ID NO: 173681 - DNA, 25 bp, E. coli
tgattcgcaaactggcgctgatcct

SEQ ID NO: 173682 - DNA, 25 bp, E. coli
tggtgaacagatgcgccagatcagc

SEQ ID NO: 173683 - DNA, 25 bp, E. coli
tggtgaacagatccgccagatcagc

SEQ ID NO: 173684 - DNA, 25 bp, E. coli
tgattcgcaaacaggcgctgatcct

SEQ ID NO: 173685 - DNA, 25 bp, E. coli
gcttaatccccgatgagcaggcgat

SEQ ID NO: 173686 - DNA, 25 bp, E. coli
gcttaatccccgttgagcaggcgat

SEQ ID NO: 173687 - DNA, 25 bp, E. coli
ccctgcgctggaagaatggctgaca

SEQ ID NO: 173688 - DNA, 25 bp, E. coli
ccctgcgctggatgaatggctgaca

SEQ ID NO: 173689 - DNA, 25 bp, E. coli
cattcagttgctggaagggccatac

SEQ ID NO: 173690 - DNA, 25 bp, E. coli
cattcagttgctcgaagggccatac

SEQ ID NO: 173691 - DNA, 25 bp, E. coli
gtatttttgccagcgtaccgtactg

SEQ ID NO: 173692 - DNA, 25 bp, E. coli
gtatttttgccaccgtaccgtactg

SEQ ID NO: 173693 - DNA, 25 bp, E. coli
gatcagcctgcaatttgtaccaact

SEQ ID NO: 173694 - DNA, 25 bp, E. coli
ggcgatcatcgagcaaacgttgtgt

SEQ ID NO: 173695 - DNA, 25 bp, E. coli
ggcgatcatcgaccaaacgttgtgt

SEQ ID NO: 173696 - DNA, 25 bp, E. coli
gagttgccatctcgtgctcaccacg

SEQ ID NO: 173697 - DNA, 25 bp, E. coli
gagttgccatctggtgctcaccacg

SEQ ID NO: 173698 - DNA, 25 bp, E. coli
gatcagcctgcattttgtaccaact

SEQ ID NO: 173699 - DNA, 25 bp, E. coli
caacgggcgttgagcgcgtactttt

SEQ ID NO: 173700 - DNA, 25 bp, E. coli
caacgggcgttgtgcgcgtactttt

SEQ ID NO: 173701 - DNA, 25 bp, E. coli
tacaacgggcgtagagcgcgtactt

SEQ ID NO: 173702 - DNA, 25 bp, E. coli
tacaacgggcgttgagcgcgtactt

SEQ ID NO: 173703 - DNA, 25 bp, E. coli
agtccctgtggcgttgttgattgca

SEQ ID NO: 173704 - DNA, 25 bp, E. coli
agtccctgtggccttgttgattgca

SEQ ID NO: 173705 - DNA, 25 bp, E. coli
ttttcgcgcactaggcgtctctgac

SEQ ID NO: 173706 - DNA, 25 bp, E. coli
ttttcgcgcacttggcgtctctgac

SEQ ID NO: 173707 - DNA, 25 bp, E. coli
tctgctggcactcggcacggacagc

SEQ ID NO: 173708 - DNA, 25 bp, E. coli
tcttcccggtactacgggcgttgag

SEQ ID NO: 173709 - DNA, 25 bp, E. coli
tctgctggcactgggcacggacagc

SEQ ID NO: 173710 - DNA, 25 bp, E. coli
tcttcccggtacaacgggcgttgag

SEQ ID NO: 173711 - DNA, 25 bp, E. coli
gctagtccctgtggcgttgttgatt

SEQ ID NO: 173712 - DNA, 25 bp, E. coli
gctagtccctgtcgcgttgttgatt

SEQ ID NO: 173713 - DNA, 25 bp, E. coli
gcactgggcacgcacagcagcatca

SEQ ID NO: 173714 - DNA, 25 bp, E. coli
gcactgggcacggacagcagcatca

SEQ ID NO: 173715 - DNA, 25 bp, E. coli
gacattcctcttcccggtacaacgg

SEQ ID NO: 173716 - DNA, 25 bp, E. coli
gacattcctcttgccggtacaacgg

SEQ ID NO: 173717 - DNA, 25 bp, E. coli
ctcatctgctgggactgggcacgga

SEQ ID NO: 173718 - DNA, 25 bp, E. coli
ctcatctgctggcactgggcacgga

SEQ ID NO: 173719 - DNA, 25 bp, E. coli
taatgacattccacttcccggtaca

SEQ ID NO: 173720 - DNA, 25 bp, E. coli
taatgacattcctcttcccggtaca

SEQ ID NO: 173721 - DNA, 25 bp, E. coli
catgggcgttaaggtgacaggcaaa

SEQ ID NO: 173722 - DNA, 25 bp, E. coli
catgggcgttaacgtgacaggcaaa

SEQ ID NO: 173723 - DNA, 25 bp, E. coli
caggcaaaaatgacgcggaaggcgc

SEQ ID NO: 173724 - DNA, 25 bp, E. coli
caggcaaaaatgtcgcggaaggcgc

SEQ ID NO: 173725 - DNA, 25 bp, E. coli
tgtaatgccgttctgctgccacacg

SEQ ID NO: 173726 - DNA, 25 bp, E. coli
tgtaatgccgttgtgctgccacacg

SEQ ID NO: 173727 - DNA, 25 bp, E. coli
tgactgtgctgctgccatgggcgtt

SEQ ID NO: 173728 - DNA, 25 bp, E. coli
tgactgtgctgcagccatgggcgtt

SEQ ID NO: 173729 - DNA, 25 bp, E. coli
gaagcgtgcatcaatgccatccgtg

SEQ ID NO: 173730 - DNA, 25 bp, E. coli
gaagaagatattccagtgctggcaa

SEQ ID NO: 173731 - DNA, 25 bp, E. coli
gaagaagatattgcagtgctggcaa

SEQ ID NO: 173732 - DNA, 25 bp, E. coli
gaagcgtgcatctatgccatccgtg

SEQ ID NO: 173733 - DNA, 25 bp, E. coli
cggaaggcgcagtagcgtgcatcaa

SEQ ID NO: 173734 - DNA, 25 bp, E. coli
cggaaggcgcagaagcgtgcatcaa

SEQ ID NO: 173735 - DNA, 25 bp, E. coli
cttccgtgaatgttattggtgctga

SEQ ID NO: 173736 - DNA, 25 bp, E. coli
cttccgtgaatgatattggtgctga

SEQ ID NO: 173737 - DNA, 25 bp, E. coli
gtgctggcaacctatgccctgaaag

SEQ ID NO: 173738 - DNA, 25 bp, E. coli
ggtgacatccgcgattatgaaggcg

SEQ ID NO: 173739 - DNA, 25 bp, E. coli
gtgctggcaaccaatgccctgaaag

SEQ ID NO: 173740 - DNA, 25 bp, E. coli
ggtgacatccgccattatgaaggcg

SEQ ID NO: 173741 - DNA, 25 bp, E. coli
tggttgcagccaacggcggtgacat

SEQ ID NO: 173742 - DNA, 25 bp, E. coli
tggttgcagccatcggcggtgacat

SEQ ID NO: 173743 - DNA, 25 bp, E. coli
caagagagtgacaaaatagcagtat

SEQ ID NO: 173744 - DNA, 25 bp, E. coli
cagctacggtgaagttgatgaccag

SEQ ID NO: 173745 - DNA, 25 bp, E. coli
caaaatagcagtttatttataccaa

SEQ ID NO: 173746 - DNA, 25 bp, E. coli
caagagagtgactaaatagcagtat

SEQ ID NO: 173747 - DNA, 25 bp, E. coli
caaaatagcagtatatttataccaa

SEQ ID NO: 173748 - DNA, 25 bp, E. coli
cagctacggtgatgttgatgaccag

SEQ ID NO: 173749 - DNA, 25 bp, E. coli
agctggataggtatacttcccctgt

SEQ ID NO: 173750 - DNA, 25 bp, E. coli
agctggataggtttacttcccctgt

SEQ ID NO: 173751 - DNA, 25 bp, E. coli
tatgtttaagcccaggctttgcagc

SEQ ID NO: 173752 - DNA, 25 bp, E. coli
tatgtttaagccgaggctttgcagc

SEQ ID NO: 173753 - DNA, 25 bp, E. coli
tctaataggtgccttatttttagcg

SEQ ID NO: 173754 - DNA, 25 bp, E. coli
tctaataggtgcgttatttttagcg

SEQ ID NO: 173755 - DNA, 25 bp, E. coli
tctgagcttatcagctacggtgaag

SEQ ID NO: 173756 - DNA, 25 bp, E. coli
tctgagcttatctgctacggtgaag

SEQ ID NO: 173757 - DNA, 25 bp, E. coli
gattttgtctgaccttatcagctac

SEQ ID NO: 173758 - DNA, 25 bp, E. coli
gattttgtctgagcttatcagctac

SEQ ID NO: 173759 - DNA, 25 bp, E. coli
ggtgcgttatttttagcgttgccag

SEQ ID NO: 173760 - DNA, 25 bp, E. coli
ggtgcgttatttatagcgttgccag

SEQ ID NO: 173761 - DNA, 25 bp, E. coli
ggctttgcagctcgataggtttact

SEQ ID NO: 173762 - DNA, 25 bp, E. coli
ggctttgcagctggataggtttact

SEQ ID NO: 173763 - DNA, 25 bp, E. coli
taagcccaggctttgcagctggata

SEQ ID NO: 173764 - DNA, 25 bp, E. coli
taagcccaggctatgcagctggata

SEQ ID NO: 173765 - DNA, 25 bp, E. coli
caattgtactcaatcatttttgtga

SEQ ID NO: 173766 - DNA, 25 bp, E. coli
caattgtactcattcatttttgtga

SEQ ID NO: 173767 - DNA, 25 bp, E. coli
tagaaaagagaatgattagtaactg

SEQ ID NO: 173768 - DNA, 25 bp, E. coli
tagaaagcactataaattagaggat

SEQ ID NO: 173769 - DNA, 25 bp, E. coli
tagaaagcactaaaaattagaggat

SEQ ID NO: 173770 - DNA, 25 bp, E. coli
tagaaaagagaaagattagtaactg

SEQ ID NO: 173771 - DNA, 25 bp, E. coli
taatttacagtggattaaagacgaa

SEQ ID NO: 173772 - DNA, 25 bp, E. coli
taatttacagtgcattaaagacgaa

SEQ ID NO: 173773 - DNA, 25 bp, E. coli
tctgaatgggattacgcgataaggt

SEQ ID NO: 173774 - DNA, 25 bp, E. coli
tctgaatgggataacgcgataaggt

SEQ ID NO: 173775 - DNA, 25 bp, E. coli
cgcgataaggtattagaaagcacta

SEQ ID NO: 173776 - DNA, 25 bp, E. coli
cgcgataaggtaatagaaagcacta

SEQ ID NO: 173777 - DNA, 25 bp, E. coli
taaggactactattcattgaaatat

SEQ ID NO: 173778 - DNA, 25 bp, E. coli
tatctaaatatccattaagtaaaac

SEQ ID NO: 173779 - DNA, 25 bp, E. coli
tagtaactgttaattaaggactact

SEQ ID NO: 173780 - DNA, 25 bp, E. coli
tagtaactgttatttaaggactact

SEQ ID NO: 173781 - DNA, 25 bp, E. coli
taaggactactaatcattgaaatat

SEQ ID NO: 173782 - DNA, 25 bp, E. coli
tatctaaatatcgattaagtaaaac

SEQ ID NO: 173783 - DNA, 25 bp, E. coli
gaggattaattcttaatttacagtg

SEQ ID NO: 173784 - DNA, 25 bp, E. coli
gatggttttctgaatgggattacgc

SEQ ID NO: 173785 - DNA, 25 bp, E. coli
gaggattaattcataatttacagtg

SEQ ID NO: 173786 - DNA, 25 bp, E. coli
gatggttttctgtatgggattacgc

SEQ ID NO: 173787 - DNA, 25 bp, E. coli
aaataaaaatgaacacgggtgtggc

SEQ ID NO: 173788 - DNA, 25 bp, E. coli
aaataaaaatgatcacgggtgtggc

SEQ ID NO: 173789 - DNA, 25 bp, E. coli
tagtcctgttgtcaatagtcctctt

SEQ ID NO: 173790 - DNA, 25 bp, E. coli
ttagttactgatggtgagcctgacg

SEQ ID NO: 173791 - DNA, 25 bp, E. coli
tagtcctgttgtgaatagtcctctt

SEQ ID NO: 173792 - DNA, 25 bp, E. coli
ttagttactgatcgtgagcctgacg

SEQ ID NO: 173793 - DNA, 25 bp, E. coli
ccggagatcaaggaaaatgtggctt

SEQ ID NO: 173794 - DNA, 25 bp, E. coli
ccggagatcaagcaaaatgtggctt

SEQ ID NO: 173795 - DNA, 25 bp, E. coli
ccaaatgtctgtttggaaccacgta

SEQ ID NO: 173796 - DNA, 25 bp, E. coli
ccaaatgtctgtatggaaccacgta

SEQ ID NO: 173797 - DNA, 25 bp, E. coli
gactttgatgattactcccctgagg

SEQ ID NO: 173798 - DNA, 25 bp, E. coli
gactttgatgataactcccctgagg

SEQ ID NO: 173799 - DNA, 25 bp, E. coli
cccctgaggatgctcccattgagaa

SEQ ID NO: 173800 - DNA, 25 bp, E. coli
cccctgaggatggtcccattgagaa

SEQ ID NO: 173801 - DNA, 25 bp, E. coli
tggttcacttaacccaggtagtatg

SEQ ID NO: 173802 - DNA, 25 bp, E. coli
tggttcacttaagccaggtagtatg

SEQ ID NO: 173803 - DNA, 25 bp, E. coli
ggcttctgaagttcataaatcagcg

SEQ ID NO: 173804 - DNA, 25 bp, E. coli
ggcttctgaagtacataaatcagcg

SEQ ID NO: 173805 - DNA, 25 bp, E. coli
taatacgcctgcaaaccatgagagt

SEQ ID NO: 173806 - DNA, 25 bp, E. coli
tcagcgaataaacgtgagattgagc

SEQ ID NO: 173807 - DNA, 25 bp, E. coli
taatacgcctgctaaccatgagagt

SEQ ID NO: 173808 - DNA, 25 bp, E. coli
tcagcgaataaaggtgagattgagc

SEQ ID NO: 173809 - DNA, 25 bp, E. coli
caaaatcgtcgacctgaatgccacg

SEQ ID NO: 173810 - DNA, 25 bp, E. coli
caaaatcgtcgagctgaatgccacg

SEQ ID NO: 173811 - DNA, 25 bp, E. coli
taaaggcgattactgaacagcgtcg

SEQ ID NO: 173812 - DNA, 25 bp, E. coli
taaaggcgattagtgaacagcgtcg

SEQ ID NO: 173813 - DNA, 25 bp, E. coli
tacgatttaaacacggcgacagtga

SEQ ID NO: 173814 - DNA, 25 bp, E. coli
tacgatttaaactcggcgacagtga

SEQ ID NO: 173815 - DNA, 25 bp, E. coli
tctgcgccagggaaatgacgaacgc

SEQ ID NO: 173816 - DNA, 25 bp, E. coli
tctgcgccagggtaatgacgaacgc

SEQ ID NO: 173817 - DNA, 25 bp, E. coli
gcgctggcccgtgaaatgattgaag

SEQ ID NO: 173818 - DNA, 25 bp, E. coli
gcgctggcccgtcaaatgattgaag

SEQ ID NO: 173819 - DNA, 25 bp, E. coli
ccttgctgtatgtagagactgcgga

SEQ ID NO: 173820 - DNA, 25 bp, E. coli
ccttgctgtatgaagagactgcgga

SEQ ID NO: 173821 - DNA, 25 bp, E. coli
gaaacgcgaaaaaatggcgctggca

SEQ ID NO: 173822 - DNA, 25 bp, E. coli
gagcgccgcgacctgttacgattta

SEQ ID NO: 173823 - DNA, 25 bp, E. coli
gagcgccgcgacgtgttacgattta

SEQ ID NO: 173824 - DNA, 25 bp, E. coli
gaaacgcgaaaatatggcgctggca

SEQ ID NO: 173825 - DNA, 25 bp, E. coli
tggataaatggctatgggctgcccg

SEQ ID NO: 173826 - DNA, 25 bp, E. coli
tggcgctggcacctaaacttaatgc

SEQ ID NO: 173827 - DNA, 25 bp, E. coli
tggcgctggcacgtaaacttaatgc

SEQ ID NO: 173828 - DNA, 25 bp, E. coli
tggataaatggcaatgggctgcccg

SEQ ID NO: 173829 - DNA, 25 bp, E. coli
taaggtgcattacaacgggcagcgc

SEQ ID NO: 173830 - DNA, 25 bp, E. coli
taaggtgcattagaacgggcagcgc

SEQ ID NO: 173831 - DNA, 25 bp, E. coli
aatcgctacgacctgacccgtgatg

SEQ ID NO: 173832 - DNA, 25 bp, E. coli
aatcgctacgacgtgacccgtgatg

SEQ ID NO: 173833 - DNA, 25 bp, E. coli
aacgaatgtttgtcgtgtggtgcca

SEQ ID NO: 173834 - DNA, 25 bp, E. coli
aacgaatgtttgacgtgtggtgcca

SEQ ID NO: 173835 - DNA, 25 bp, E. coli
acggcttttgagatctgggttcgca

SEQ ID NO: 173836 - DNA, 25 bp, E. coli
acggcttttgagttctgggttcgca

SEQ ID NO: 173837 - DNA, 25 bp, E. coli
tttgacgtgtggtgccactgccgtg

SEQ ID NO: 173838 - DNA, 25 bp, E. coli
tttgacgtgtggagccactgccgtg

SEQ ID NO: 173839 - DNA, 25 bp, E. coli
tgcatacggcttttgagttctgggt

SEQ ID NO: 173840 - DNA, 25 bp, E. coli
tgcatacggcttatgagttctgggt

SEQ ID NO: 173841 - DNA, 25 bp, E. coli
tctactgccgtgaagttgtgaaacg

SEQ ID NO: 173842 - DNA, 25 bp, E. coli
tctactgccgtgtagttgtgaaacg

SEQ ID NO: 173843 - DNA, 25 bp, E. coli
tctgggttcgcatgacattcggcaa

SEQ ID NO: 173844 - DNA, 25 bp, E. coli
tctgggttcgcaagacattcggcaa

SEQ ID NO: 173845 - DNA, 25 bp, E. coli
gccgtgaagttgagaaacgaatgtt

SEQ ID NO: 173846 - DNA, 25 bp, E. coli
gccgtgaagttgtgaaacgaatgtt

SEQ ID NO: 173847 - DNA, 25 bp, E. coli
gacattcggcaaacgctacgacctg

SEQ ID NO: 173848 - DNA, 25 bp, E. coli
gacattcggcaatcgctacgacctg

SEQ ID NO: 173849 - DNA, 25 bp, E. coli
gacctgacccgtcatgtcgacggct

SEQ ID NO: 173850 - DNA, 25 bp, E. coli
gacctgacccgtgatgtcgacggct

SEQ ID NO: 173851 - DNA, 25 bp, E. coli
gatgtcgacggcatctactgccgtg

SEQ ID NO: 173852 - DNA, 25 bp, E. coli
gatgtcgacggcttctactgccgtg

SEQ ID NO: 173853 - DNA, 25 bp, E. coli
caatggattttacctggcaggtcgc

SEQ ID NO: 173854 - DNA, 25 bp, E. coli
caatggattttagctggcaggtcgc

SEQ ID NO: 173855 - DNA, 25 bp, E. coli
catgggctggaaatcaacggacaaa

SEQ ID NO: 173856 - DNA, 25 bp, E. coli
catgggctggaattcaacggacaaa

SEQ ID NO: 173857 - DNA, 25 bp, E. coli
tgaaggccggtctgtactatgccga

SEQ ID NO: 173858 - DNA, 25 bp, E. coli
tgaaggccggtcagtactatgccga

SEQ ID NO: 173859 - DNA, 25 bp, E. coli
tgagaaccttgcagatggcgtcgcc

SEQ ID NO: 173860 - DNA, 25 bp, E. coli
tgaccgatgcgcaggtagtatcccg

SEQ ID NO: 173861 - DNA, 25 bp, E. coli
tgaccgatgcgctggtagtatcccg

SEQ ID NO: 173862 - DNA, 25 bp, E. coli
tgagaaccttgctgatggcgtcgcc

SEQ ID NO: 173863 - DNA, 25 bp, E. coli
tctctatgatcgaccgggaagcccg

SEQ ID NO: 173864 - DNA, 25 bp, E. coli
tctctatgatcgtccgggaagcccg

SEQ ID NO: 173865 - DNA, 25 bp, E. coli
gcaacgtcaggcaatggcaatggat

SEQ ID NO: 173866 - DNA, 25 bp, E. coli
gcaacgtcaggctatggcaatggat

SEQ ID NO: 173867 - DNA, 25 bp, E. coli
gacaaatctctttcctgaaggccgg

SEQ ID NO: 173868 - DNA, 25 bp, E. coli
gacaaatctcttacctgaaggccgg

SEQ ID NO: 173869 - DNA, 25 bp, E. coli
cttaaggttgaccataaagtgccgc

SEQ ID NO: 173870 - DNA, 25 bp, E. coli
cttaaggttgacgataaagtgccgc

SEQ ID NO: 173871 - DNA, 25 bp, E. coli
gttacacccgcgttacgttggaaga

SEQ ID NO: 173872 - DNA, 25 bp, E. coli
gttacacccgcgatacgttggaaga

SEQ ID NO: 173873 - DNA, 25 bp, E. coli
gatgttcccgctccttaaaaccggc

SEQ ID NO: 173874 - DNA, 25 bp, E. coli
gatgttcccgctgcttaaaaccggc

SEQ ID NO: 173875 - DNA, 25 bp, E. coli
ctgcttttgcacgaggcaccggtac

SEQ ID NO: 173876 - DNA, 25 bp, E. coli
ctgcttttgcaccaggcaccggtac

SEQ ID NO: 173877 - DNA, 25 bp, E. coli
actgcggcgatctggtatatgcctt

SEQ ID NO: 173878 - DNA, 25 bp, E. coli
actgcggcgatcaggtatatgcctt

SEQ ID NO: 173879 - DNA, 25 bp, E. coli
tgcttttgcacctggcaccggtacg

SEQ ID NO: 173880 - DNA, 25 bp, E. coli
tgcttttgcaccaggcaccggtacg

SEQ ID NO: 173881 - DNA, 25 bp, E. coli
tgcctggatcctccttttgcaccag

SEQ ID NO: 173882 - DNA, 25 bp, E. coli
tcctgcttttgcaccaggcaccggt

SEQ ID NO: 173883 - DNA, 25 bp, E. coli
tcctgcttttgctccaggcaccggt

SEQ ID NO: 173884 - DNA, 25 bp, E. coli
tgcctggatcctgcttttgcaccag

SEQ ID NO: 173885 - DNA, 25 bp, E. coli
gactgcggcgatctggtatatgcct

SEQ ID NO: 173886 - DNA, 25 bp, E. coli
gactgcggcgatgtggtatatgcct

SEQ ID NO: 173887 - DNA, 25 bp, E. coli
ctggatcctgcttttgcaccaggca

SEQ ID NO: 173888 - DNA, 25 bp, E. coli
ctgcctggatccagcttttgcacca

SEQ ID NO: 173889 - DNA, 25 bp, E. coli
ctgcctggatcctgcttttgcacca

SEQ ID NO: 173890 - DNA, 25 bp, E. coli
ctggatcctgctattgcaccaggca

SEQ ID NO: 173891 - DNA, 25 bp, E. coli
ggatcctgctttagcaccaggcacc

SEQ ID NO: 173892 - DNA, 25 bp, E. coli
ggatcctgcttttgcaccaggcacc

SEQ ID NO: 173893 - DNA, 25 bp, E. coli
ggactgcggcgatctggtatatgcc

SEQ ID NO: 173894 - DNA, 25 bp, E. coli
ggactgcggcgaactggtatatgcc

SEQ ID NO: 173895 - DNA, 25 bp, E. coli
tggatcctgcttttgcaccaggcac

SEQ ID NO: 173896 - DNA, 25 bp, E. coli
tggatcctgcttatgcaccaggcac

SEQ ID NO: 173897 - DNA, 25 bp, E. coli
aatatgaccccgtttggcgacagcg

SEQ ID NO: 173898 - DNA, 25 bp, E. coli
caatggcgtcgccacttatcgtaat

SEQ ID NO: 173899 - DNA, 25 bp, E. coli
aatgaccaggtttaccatactgcgg

SEQ ID NO: 173900 - DNA, 25 bp, E. coli
caatggcgtcgcgacttatcgtaat

SEQ ID NO: 173901 - DNA, 25 bp, E. coli
aatatgaccccgattggcgacagcg

SEQ ID NO: 173902 - DNA, 25 bp, E. coli
aatgaccaggttaaccatactgcgg

SEQ ID NO: 173903 - DNA, 25 bp, E. coli
caacggacgtgatgttcgccatgaa

SEQ ID NO: 173904 - DNA, 25 bp, E. coli
caacggacgtgaagttcgccatgaa

SEQ ID NO: 173905 - DNA, 25 bp, E. coli
tggtgataaagctgacgcgtggact

SEQ ID NO: 173906 - DNA, 25 bp, E. coli
tggtgataaagcagacgcgtggact

SEQ ID NO: 173907 - DNA, 25 bp, E. coli
cctgatgtctaatggccgtgacctg

SEQ ID NO: 173908 - DNA, 25 bp, E. coli
ccagtaatggtcaggaaggcaccaa

SEQ ID NO: 173909 - DNA, 25 bp, E. coli
ccagtaatggtctggaaggcaccaa

SEQ ID NO: 173910 - DNA, 25 bp, E. coli
cctgatgtctaaaggccgtgacctg

SEQ ID NO: 173911 - DNA, 25 bp, E. coli
gctgggctaaaatacgatgctaaca

SEQ ID NO: 173912 - DNA, 25 bp, E. coli
gctgggctaaaaaacgatgctaaca

SEQ ID NO: 173913 - DNA, 25 bp, E. coli
gaatttggcggtgactcttatacca

SEQ ID NO: 173914 - DNA, 25 bp, E. coli
gaatttggcggtcactcttatacca

SEQ ID NO: 173915 - DNA, 25 bp, E. coli
cccggcaggtgtagatgataaagat

SEQ ID NO: 173916 - DNA, 25 bp, E. coli
cccggcaggtgttgatgataaagat

SEQ ID NO: 173917 - DNA, 25 bp, E. coli
tggcaaccatgtattcagaaacgcg

SEQ ID NO: 173918 - DNA, 25 bp, E. coli
tggcaaccatgttttcagaaacgcg

SEQ ID NO: 173919 - DNA, 25 bp, E. coli
cagacgctaaagttttgccacccgg

SEQ ID NO: 173920 - DNA, 25 bp, E. coli
cagacgctaaagatttgccacccgg

SEQ ID NO: 173921 - DNA, 25 bp, E. coli
cagagacaataaggttaaggagttc

SEQ ID NO: 173922 - DNA, 25 bp, E. coli
cagagacaataacgttaaggagttc

SEQ ID NO: 173923 - DNA, 25 bp, E. coli
taccgttatcagaagcagagacaat

SEQ ID NO: 173924 - DNA, 25 bp, E. coli
taccgttatcagtagcagagacaat

SEQ ID NO: 173925 - DNA, 25 bp, E. coli
tttgccacccgggtaccgttatcag

SEQ ID NO: 173926 - DNA, 25 bp, E. coli
tttgccacccggctaccgttatcag

SEQ ID NO: 173927 - DNA, 25 bp, E. coli
tgtcatgtgcttatgcagttttcga

SEQ ID NO: 173928 - DNA, 25 bp, E. coli
tgtcatgtgcttttgcagttttcga

SEQ ID NO: 173929 - DNA, 25 bp, E. coli
ccatcaagaatgagacggtaagcaa

SEQ ID NO: 173930 - DNA, 25 bp, E. coli
ccatcaagaatgtgacggtaagcaa

SEQ ID NO: 173931 - DNA, 25 bp, E. coli
gcagttttcgacaataccatcaaga

SEQ ID NO: 173932 - DNA, 25 bp, E. coli
gacccaggaaaggaaattaataacg

SEQ ID NO: 173933 - DNA, 25 bp, E. coli
gcagttttcgactataccatcaaga

SEQ ID NO: 173934 - DNA, 25 bp, E. coli
gacccaggaaagcaaattaataacg

SEQ ID NO: 173935 - DNA, 25 bp, E. coli
cccttatatatttatacgattgtgc

SEQ ID NO: 173936 - DNA, 25 bp, E. coli
cccttatatattaatacgattgtgc

SEQ ID NO: 173937 - DNA, 25 bp, E. coli
taaccaaatgcgataactcagacgc

SEQ ID NO: 173938 - DNA, 25 bp, E. coli
taaccaaatgcgttaactcagacgc

SEQ ID NO: 173939 - DNA, 25 bp, E. coli
gagagtaatctcttaaccaaatgcg

SEQ ID NO: 173940 - DNA, 25 bp, E. coli
gagagtaatctcataaccaaatgcg

SEQ ID NO: 173941 - DNA, 25 bp, E. coli
catgttattctcaatagcgaagaac

SEQ ID NO: 173942 - DNA, 25 bp, E. coli
catgttattctctatagcgaagaac

SEQ ID NO: 173943 - DNA, 25 bp, E. coli
agtcgcctatctattcagcaacaaa

SEQ ID NO: 173944 - DNA, 25 bp, E. coli
agtcgcctatcttttcagcaacaaa

SEQ ID NO: 173945 - DNA, 25 bp, E. coli
aaactctgttttttgatctcacccg

SEQ ID NO: 173946 - DNA, 25 bp, E. coli
aaactctgttttatgatctcacccg

SEQ ID NO: 173947 - DNA, 25 bp, E. coli
tatatcactctctcaaattcgctca

SEQ ID NO: 173948 - DNA, 25 bp, E. coli
tatatcactctcacaaattcgctca

SEQ ID NO: 173949 - DNA, 25 bp, E. coli
tggtatgaccaatgcaccattcatg

SEQ ID NO: 173950 - DNA, 25 bp, E. coli
tggtatgaccaaagcaccattcatg

SEQ ID NO: 173951 - DNA, 25 bp, E. coli
tgatgcgctccgaattctgtgggtc

SEQ ID NO: 173952 - DNA, 25 bp, E. coli
tgatgcgctccgtattctgtgggtc

SEQ ID NO: 173953 - DNA, 25 bp, E. coli
tccgacagtcgagcatcaatgcctg

SEQ ID NO: 173954 - DNA, 25 bp, E. coli
tccgacagtcgaccatcaatgcctg

SEQ ID NO: 173955 - DNA, 25 bp, E. coli
gccctcgtcgcaacaggtaaccttg

SEQ ID NO: 173956 - DNA, 25 bp, E. coli
gccctcgtcgcatcaggtaaccttg

SEQ ID NO: 173957 - DNA, 25 bp, E. coli
gaagaacattttcattgctgtaacc

SEQ ID NO: 173958 - DNA, 25 bp, E. coli
gaagaacattttgattgctgtaacc

SEQ ID NO: 173959 - DNA, 25 bp, E. coli
gatctcacccggaaaagtcgcctat

SEQ ID NO: 173960 - DNA, 25 bp, E. coli
taaccttgccggtacctgatgcgct

SEQ ID NO: 173961 - DNA, 25 bp, E. coli
taaccttgccggaacctgatgcgct

SEQ ID NO: 173962 - DNA, 25 bp, E. coli
gatctcacccggtaaagtcgcctat

SEQ ID NO: 173963 - DNA, 25 bp, E. coli
aatcgcccatgctggcgctttccgg

SEQ ID NO: 173964 - DNA, 25 bp, E. coli
aatcgcccatgcaggcgctttccgg

SEQ ID NO: 173965 - DNA, 25 bp, E. coli
caggatgaagcaaaacgccgtctta

SEQ ID NO: 173966 - DNA, 25 bp, E. coli
caggatgaagcataacgccgtctta

SEQ ID NO: 173967 - DNA, 25 bp, E. coli
tacgttgaatctggcggagcaaacc

SEQ ID NO: 173968 - DNA, 25 bp, E. coli
aacagcgaacggagagaacggtgcc

SEQ ID NO: 173969 - DNA, 25 bp, E. coli
aacagcgaacggtgagaacggtgcc

SEQ ID NO: 173970 - DNA, 25 bp, E. coli
tacgttgaatctcgcggagcaaacc

SEQ ID NO: 173971 - DNA, 25 bp, E. coli
tctacaggatgatgcaaaacgccgt

SEQ ID NO: 173972 - DNA, 25 bp, E. coli
tctacaggatgaagcaaaacgccgt

SEQ ID NO: 173973 - DNA, 25 bp, E. coli
gccgtcttaacgtctgggccgagcg

SEQ ID NO: 173974 - DNA, 25 bp, E. coli
gccgtcttaacgactgggccgagcg

SEQ ID NO: 173975 - DNA, 25 bp, E. coli
gcgtaaacatcttcaggatgaagca

SEQ ID NO: 173976 - DNA, 25 bp, E. coli
gcgtaaacatctacaggatgaagca

SEQ ID NO: 173977 - DNA, 25 bp, E. coli
gcaaaacgccgtgttaacgactggg

SEQ ID NO: 173978 - DNA, 25 bp, E. coli
gcaaaacgccgtcttaacgactggg

SEQ ID NO: 173979 - DNA, 25 bp, E. coli
ccccttaatgaatcagcgaacggtg

SEQ ID NO: 173980 - DNA, 25 bp, E. coli
ccccttaatgaaacagcgaacggtg

SEQ ID NO: 173981 - DNA, 25 bp, E. coli
ctggtacgttgaatctggcggagca

SEQ ID NO: 173982 - DNA, 25 bp, E. coli
ctggtacgttgattctggcggagca

SEQ ID NO: 173983 - DNA, 25 bp, E. coli
taatgaaacagcgaacggtgagaac

SEQ ID NO: 173984 - DNA, 25 bp, E. coli
taatgaaacagccaacggtgagaac

SEQ ID NO: 173985 - DNA, 25 bp, E. coli
cagattgaaatggtggcgcgagcaa

SEQ ID NO: 173986 - DNA, 25 bp, E. coli
cagattgaaatgctggcgcgagcaa

SEQ ID NO: 173987 - DNA, 25 bp, E. coli
tttagcggcgcagtggtgaaaacgc

SEQ ID NO: 173988 - DNA, 25 bp, E. coli
tttagcggcgcactggtgaaaacgc

SEQ ID NO: 173989 - DNA, 25 bp, E. coli
tgaaaacgcgtgaagcaacgccggg

SEQ ID NO: 173990 - DNA, 25 bp, E. coli
tgaaaacgcgtgtagcaacgccggg

SEQ ID NO: 173991 - DNA, 25 bp, E. coli
tcaggtctatgtacgcaccgtagcg

SEQ ID NO: 173992 - DNA, 25 bp, E. coli
tcaggtctatgttcgcaccgtagcg

SEQ ID NO: 173993 - DNA, 25 bp, E. coli
gcgctggaaagtggtctgcatcaaa

SEQ ID NO: 173994 - DNA, 25 bp, E. coli
gcgctggaaagtcgtctgcatcaaa

SEQ ID NO: 173995 - DNA, 25 bp, E. coli
tggcgctgaaaaataaagaacctcg

SEQ ID NO: 173996 - DNA, 25 bp, E. coli
tggcgctgaaaattaaagaacctcg

SEQ ID NO: 173997 - DNA, 25 bp, E. coli
taataatttcatagcactggcgctg

SEQ ID NO: 173998 - DNA, 25 bp, E. coli
taacccaggatctatgcttacgcgc

SEQ ID NO: 173999 - DNA, 25 bp, E. coli
taacccaggatcaatgcttacgcgc

SEQ ID NO: 174000 - DNA, 25 bp, E. coli
taatgcggaaatccgtgaactggca

SEQ ID NO: 174001 - DNA, 25 bp, E. coli
taagcatcaaggctgttaataccgg

SEQ ID NO: 174002 - DNA, 25 bp, E. coli
taataatttcattgcactggcgctg

SEQ ID NO: 174003 - DNA, 25 bp, E. coli
taatcgtcgggttaacacgctggaa

SEQ ID NO: 174004 - DNA, 25 bp, E. coli
taagcatcaagggtgttaataccgg

SEQ ID NO: 174005 - DNA, 25 bp, E. coli
taatgcggaaatgcgtgaactggca

SEQ ID NO: 174006 - DNA, 25 bp, E. coli
taatcgtcgggtaaacacgctggaa

SEQ ID NO: 174007 - DNA, 25 bp, E. coli
aatatgcttttctggtcgcgctggc

SEQ ID NO: 174008 - DNA, 25 bp, E. coli
aatatgcttttcaggtcgcgctggc

SEQ ID NO: 174009 - DNA, 25 bp, E. coli
cacgattctcaggtgcaatattggg

SEQ ID NO: 174010 - DNA, 25 bp, E. coli
cacgattctcagctgcaatattggg

SEQ ID NO: 174011 - DNA, 25 bp, E. coli
catggcggtaaatctggtcgcttta

SEQ ID NO: 174012 - DNA, 25 bp, E. coli
caggtgcaatattgggaaccggcaa

SEQ ID NO: 174013 - DNA, 25 bp, E. coli
catggcggtaaaactggtcgcttta

SEQ ID NO: 174014 - DNA, 25 bp, E. coli
catcttttattgctctgtaccgaca

SEQ ID NO: 174015 - DNA, 25 bp, E. coli
caggtgcaatatagggaaccggcaa

SEQ ID NO: 174016 - DNA, 25 bp, E. coli
catcttttattggtctgtaccgaca

SEQ ID NO: 174017 - DNA, 25 bp, E. coli
tacgaaggcgtagcgatggaatatg

SEQ ID NO: 174018 - DNA, 25 bp, E. coli
ggtcgctttaaatcgtacgaaggcg

SEQ ID NO: 174019 - DNA, 25 bp, E. coli
ggtcgctttaaaacgtacgaaggcg

SEQ ID NO: 174020 - DNA, 25 bp, E. coli
tacgaaggcgtaccgatggaatatg

SEQ ID NO: 174021 - DNA, 25 bp, E. coli
ttgggaaccggctaaatgggtcgct

SEQ ID NO: 174022 - DNA, 25 bp, E. coli
ttgggaaccggcaaaatgggtcgct

SEQ ID NO: 174023 - DNA, 25 bp, E. coli
tgaaaagctacagcccgtatgacaa

SEQ ID NO: 174024 - DNA, 25 bp, E. coli
tgaaaagctacaccccgtatgacaa

SEQ ID NO: 174025 - DNA, 25 bp, E. coli
tgctctgtaccgacatggactcagg

SEQ ID NO: 174026 - DNA, 25 bp, E. coli
tgctctgtaccgtcatggactcagg

SEQ ID NO: 174027 - DNA, 25 bp, E. coli
gctacagcccgtttgacaacgtcac

SEQ ID NO: 174028 - DNA, 25 bp, E. coli
gctacagcccgtatgacaacgtcac

SEQ ID NO: 174029 - DNA, 25 bp, E. coli
caaatccgagccgtaggccggataa

SEQ ID NO: 174030 - DNA, 25 bp, E. coli
caaatccgagccctaggccggataa

SEQ ID NO: 174031 - DNA, 25 bp, E. coli
cctacaaatccgagccgtaggccgg

SEQ ID NO: 174032 - DNA, 25 bp, E. coli
gcctacaaaccgagccgtaggccgg

SEQ ID NO: 174033 - DNA, 25 bp, E. coli
atccggcacccgcagcctgatgcga

SEQ ID NO: 174034 - DNA, 25 bp, E. coli
atccggcacccggagcctgatgcga

SEQ ID NO: 174035 - DNA, 25 bp, E. coli
attttacgccgcatcctgtgcctga

SEQ ID NO: 174036 - DNA, 25 bp, E. coli
attttacgccgcttcctgtgcctga

SEQ ID NO: 174037 - DNA, 25 bp, E. coli
cctacaaatccgtgccgtaggccgg

SEQ ID NO: 174038 - DNA, 25 bp, E. coli
gcctacaaaccgtgccgtaggccgg

SEQ ID NO: 174039 - DNA, 25 bp, E. coli
ttcacgctgcatccggcacccggag

SEQ ID NO: 174040 - DNA, 25 bp, E. coli
ttcacgctgcatgcggcacccggag

SEQ ID NO: 174041 - DNA, 25 bp, E. coli
cctgttgggagtataatgccggata

SEQ ID NO: 174042 - DNA, 25 bp, E. coli
cctgttgggagtttaatgccggata

SEQ ID NO: 174043 - DNA, 25 bp, E. coli
tgtcctgttgggagtttaatgccgg

SEQ ID NO: 174044 - DNA, 25 bp, E. coli
tgtcctgttgggtgtttaatgccgg

SEQ ID NO: 174045 - DNA, 25 bp, E. coli
ttgggagtttaatgccggataaggc

SEQ ID NO: 174046 - DNA, 25 bp, E. coli
ttgggagtttaaagccggataaggc

SEQ ID NO: 174047 - DNA, 25 bp, E. coli
taatgccggataaggcattttacgc

SEQ ID NO: 174048 - DNA, 25 bp, E. coli
taaggcattttaggccgcatcctgt

SEQ ID NO: 174049 - DNA, 25 bp, E. coli
taaggcattttacgccgcatcctgt

SEQ ID NO: 174050 - DNA, 25 bp, E. coli
taatgccggatatggcattttacgc

SEQ ID NO: 174051 - DNA, 25 bp, E. coli
caacttcgggttgagcacatgaatt

SEQ ID NO: 174052 - DNA, 25 bp, E. coli
caacttcgggttcagcacatgaatt

SEQ ID NO: 174053 - DNA, 25 bp, E. coli
attacaccagccagcgcagatgcgc

SEQ ID NO: 174054 - DNA, 25 bp, E. coli
attacaccagcctgcgcagatgcgc

SEQ ID NO: 174055 - DNA, 25 bp, E. coli
acatgaattacaccagcctgcgcag

SEQ ID NO: 174056 - DNA, 25 bp, E. coli
acatgaattacagcagcctgcgcag

SEQ ID NO: 174057 - DNA, 25 bp, E. coli
taggtgaagtcatcttcgggttgag

SEQ ID NO: 174058 - DNA, 25 bp, E. coli
taggtgaagtcaacttcgggttgag

SEQ ID NO: 174059 - DNA, 25 bp, E. coli
tattgataggtgaagtcaacttcgg

SEQ ID NO: 174060 - DNA, 25 bp, E. coli
ttcgggttgagcacatgaattacac

SEQ ID NO: 174061 - DNA, 25 bp, E. coli
tattgataggtgtagtcaacttcgg

SEQ ID NO: 174062 - DNA, 25 bp, E. coli
ttcgggttgagctcatgaattacac

SEQ ID NO: 174063 - DNA, 25 bp, E. coli
tgagcacatgaattacaccagcctg

SEQ ID NO: 174064 - DNA, 25 bp, E. coli
tgagcacatgaaatacaccagcctg

SEQ ID NO: 174065 - DNA, 25 bp, E. coli
tgaattacaccaccctgcgcagatg

SEQ ID NO: 174066 - DNA, 25 bp, E. coli
tgaattacaccagcctgcgcagatg

SEQ ID NO: 174067 - DNA, 25 bp, E. coli
cccagaggtattgataggtgaagtc

SEQ ID NO: 174068 - DNA, 25 bp, E. coli
cccagaggtattcataggtgaagtc

SEQ ID NO: 174069 - DNA, 25 bp, E. coli
gtcaacttcgggttgagcacatgaa

SEQ ID NO: 174070 - DNA, 25 bp, E. coli
gtcaacttcgggatgagcacatgaa

SEQ ID NO: 174071 - DNA, 25 bp, E. coli
ggttgagcacatgaattacaccagc

SEQ ID NO: 174072 - DNA, 25 bp, E. coli
ggttgagcacatcaattacaccagc

SEQ ID NO: 174073 - DNA, 25 bp, E. coli
aatggcaggctgacgaatacggcaa

SEQ ID NO: 174074 - DNA, 25 bp, E. coli
aatggcaggctgtcgaatacggcaa

SEQ ID NO: 174075 - DNA, 25 bp, E. coli
catgagctggaaagtcaggccgcta

SEQ ID NO: 174076 - DNA, 25 bp, E. coli
catgagctggaatgtcaggccgcta

SEQ ID NO: 174077 - DNA, 25 bp, E. coli
tacggcaatcaatggcgtcaggcgt

SEQ ID NO: 174078 - DNA, 25 bp, E. coli
tacggcaatcaaaggcgtcaggcgt

SEQ ID NO: 174079 - DNA, 25 bp, E. coli
tacgtgcggaatctgccgattgcca

SEQ ID NO: 174080 - DNA, 25 bp, E. coli
tacgtgcggaatgtgccgattgcca

SEQ ID NO: 174081 - DNA, 25 bp, E. coli
ataaaaatggatgacaacgcggcgc

SEQ ID NO: 174082 - DNA, 25 bp, E. coli
ataaaaatggatcacaacgcggcgc

SEQ ID NO: 174083 - DNA, 25 bp, E. coli
aacttgacgatagctattgcgctgg

SEQ ID NO: 174084 - DNA, 25 bp, E. coli
aacttgacgatacctattgcgctgg

SEQ ID NO: 174085 - DNA, 25 bp, E. coli
tattgcctcgcaaagtgaatctgcg

SEQ ID NO: 174086 - DNA, 25 bp, E. coli
tattgcctcgcatagtgaatctgcg

SEQ ID NO: 174087 - DNA, 25 bp, E. coli
cgattgccatattccaaagtcaggg

SEQ ID NO: 174088 - DNA, 25 bp, E. coli
cgattgccatataccaaagtcaggg

SEQ ID NO: 174089 - DNA, 25 bp, E. coli
gataagttcgaagctcatcgccagg

SEQ ID NO: 174090 - DNA, 25 bp, E. coli
gataagttcgaacctcatcgccagg

SEQ ID NO: 174091 - DNA, 25 bp, E. coli
gtgaaaacacgctctacctggcggc

SEQ ID NO: 174092 - DNA, 25 bp, E. coli
gtgaaaacacgcactacctggcggc

SEQ ID NO: 174093 - DNA, 25 bp, E. coli
ggcattgcccattttccgccagaaa

SEQ ID NO: 174094 - DNA, 25 bp, E. coli
ggcattgcccatattccgccagaaa

SEQ ID NO: 174095 - DNA, 25 bp, E. coli
cagacctttaatccgttgaccggag

SEQ ID NO: 174096 - DNA, 25 bp, E. coli
cagacctttaatgcgttgaccggag

SEQ ID NO: 174097 - DNA, 25 bp, E. coli
agctggtagtacatgggcggacaaa

SEQ ID NO: 174098 - DNA, 25 bp, E. coli
agtacatgggcgcacaaaagagcag

SEQ ID NO: 174099 - DNA, 25 bp, E. coli
agctggtagtacttgggcggacaaa

SEQ ID NO: 174100 - DNA, 25 bp, E. coli
agtacatgggcggacaaaagagcag

SEQ ID NO: 174101 - DNA, 25 bp, E. coli
ttggtgcgggaaatactgaccgaag

SEQ ID NO: 174102 - DNA, 25 bp, E. coli
ttggtgcgggaattactgaccgaag

SEQ ID NO: 174103 - DNA, 25 bp, E. coli
tttaatccgttgaccggaggcgcta

SEQ ID NO: 174104 - DNA, 25 bp, E. coli
tttaatccgttgtccggaggcgcta

SEQ ID NO: 174105 - DNA, 25 bp, E. coli
tgtacttgactcattggtgcgggaa

SEQ ID NO: 174106 - DNA, 25 bp, E. coli
tgtacttgactctttggtgcgggaa

SEQ ID NO: 174107 - DNA, 25 bp, E. coli
tgactctttggtccgggaattactg

SEQ ID NO: 174108 - DNA, 25 bp, E. coli
tctttggtgcgggaattactgaccg

SEQ ID NO: 174109 - DNA, 25 bp, E. coli
tctttggtgcggcaattactgaccg

SEQ ID NO: 174110 - DNA, 25 bp, E. coli
tgactctttggtgcgggaattactg

SEQ ID NO: 174111 - DNA, 25 bp, E. coli
ccgatggagggtgtacttgactctt

SEQ ID NO: 174112 - DNA, 25 bp, E. coli
ccgttgaccggaggcgctaacatag

SEQ ID NO: 174113 - DNA, 25 bp, E. coli
ccgttgaccggacgcgctaacatag

SEQ ID NO: 174114 - DNA, 25 bp, E. coli
ccgatggagggtctacttgactctt

SEQ ID NO: 174115 - DNA, 25 bp, E. coli
cgggtgatgatatgcgtgtgttact

SEQ ID NO: 174116 - DNA, 25 bp, E. coli
cgggtgatgataagcgtgtgttact

SEQ ID NO: 174117 - DNA, 25 bp, E. coli
aagaaattttttgtgcgcaaacagc

SEQ ID NO: 174118 - DNA, 25 bp, E. coli
aagaaattttttctgcgcaaacagc

SEQ ID NO: 174119 - DNA, 25 bp, E. coli
caaacagcgaccgaattgacagaca

SEQ ID NO: 174120 - DNA, 25 bp, E. coli
caaacagcgacccaattgacagaca

SEQ ID NO: 174121 - DNA, 25 bp, E. coli
attttttctgcggaaacagcgaccg

SEQ ID NO: 174122 - DNA, 25 bp, E. coli
attttttctgcgcaaacagcgaccg

SEQ ID NO: 174123 - DNA, 25 bp, E. coli
aacagcgaccgatttgacagacaac

SEQ ID NO: 174124 - DNA, 25 bp, E. coli
aacagcgaccgaattgacagacaac

SEQ ID NO: 174125 - DNA, 25 bp, E. coli
ttttctgcgcaaacagcgaccgaat

SEQ ID NO: 174126 - DNA, 25 bp, E. coli
tttttctgcgcatacagcgaccgaa

SEQ ID NO: 174127 - DNA, 25 bp, E. coli
tttttctgcgcaaacagcgaccgaa

SEQ ID NO: 174128 - DNA, 25 bp, E. coli
ttttctgcgcaatcagcgaccgaat

SEQ ID NO: 174129 - DNA, 25 bp, E. coli
tgcgcaaacagcgaccgaattgaca

SEQ ID NO: 174130 - DNA, 25 bp, E. coli
tgcgcaaacagccaccgaattgaca

SEQ ID NO: 174131 - DNA, 25 bp, E. coli
tctgcgcaaacaccgaccgaattga

SEQ ID NO: 174132 - DNA, 25 bp, E. coli
tctgcgcaaacagcgaccgaattga

SEQ ID NO: 174133 - DNA, 25 bp, E. coli
ccactgcggggctacggcattggcc

SEQ ID NO: 174134 - DNA, 25 bp, E. coli
ccactgcggggcaacggcattggcc

SEQ ID NO: 174135 - DNA, 25 bp, E. coli
gaaattttttctccgcaaacagcga

SEQ ID NO: 174136 - DNA, 25 bp, E. coli
gaaattttttctgcgcaaacagcga

SEQ ID NO: 174137 - DNA, 25 bp, E. coli
cgcaaacagcgagcgaattgacaga

SEQ ID NO: 174138 - DNA, 25 bp, E. coli
cgcaaacagcgaccgaattgacaga

SEQ ID NO: 174139 - DNA, 25 bp, E. coli
caagtctgctcgagcaaaggtccag

SEQ ID NO: 174140 - DNA, 25 bp, E. coli
caagtctgctcgtgcaaaggtccag

SEQ ID NO: 174141 - DNA, 25 bp, E. coli
aataatgcgatcgatcagggcgtct

SEQ ID NO: 174142 - DNA, 25 bp, E. coli
aataatgcgatccatcagggcgtct

SEQ ID NO: 174143 - DNA, 25 bp, E. coli
caaagagtgtatagaggcgctggta

SEQ ID NO: 174144 - DNA, 25 bp, E. coli
caaagagtgtattgaggcgctggta

SEQ ID NO: 174145 - DNA, 25 bp, E. coli
catagaaaacgtccctgcggatgcg

SEQ ID NO: 174146 - DNA, 25 bp, E. coli
cagtcatcaatgtaccggcgaaagt

SEQ ID NO: 174147 - DNA, 25 bp, E. coli
cagtcatcaatgaaccggcgaaagt

SEQ ID NO: 174148 - DNA, 25 bp, E. coli
catagaaaacgtgcctgcggatgcg

SEQ ID NO: 174149 - DNA, 25 bp, E. coli
tatccgctgggattgcaacaggctt

SEQ ID NO: 174150 - DNA, 25 bp, E. coli
tatccgctgggaatgcaacaggctt

SEQ ID NO: 174151 - DNA, 25 bp, E. coli
ttcacttcctcgctgggatccacga

SEQ ID NO: 174152 - DNA, 25 bp, E. coli
ttcacttcctcggtgggatccacga

SEQ ID NO: 174153 - DNA, 25 bp, E. coli
tgaaacgtgtgagggataaaccact

SEQ ID NO: 174154 - DNA, 25 bp, E. coli
tgaaacgtgtgacggataaaccact

SEQ ID NO: 174155 - DNA, 25 bp, E. coli
ccaatgcggttaaggcgatgaaaca

SEQ ID NO: 174156 - DNA, 25 bp, E. coli
ccaatgcggttatggcgatgaaaca

SEQ ID NO: 174157 - DNA, 25 bp, E. coli
ggatgagtaaaccttctgcgcccgg

SEQ ID NO: 174158 - DNA, 25 bp, E. coli
ggatgagtaaacgttctgcgcccgg

SEQ ID NO: 174159 - DNA, 25 bp, E. coli
gagtttgctcagacagccaatgcgg

SEQ ID NO: 174160 - DNA, 25 bp, E. coli
gagtttgctcagtcagccaatgcgg

SEQ ID NO: 174161 - DNA, 25 bp, E. coli
tactgaatgccgattacgccgggca

SEQ ID NO: 174162 - DNA, 25 bp, E. coli
tactgaatgccgtttacgccgggca

SEQ ID NO: 174163 - DNA, 25 bp, E. coli
tattcacaggattttgcgccactgc

SEQ ID NO: 174164 - DNA, 25 bp, E. coli
tattcacaggatattgcgccactgc

SEQ ID NO: 174165 - DNA, 25 bp, E. coli
tgtaactccggtccggaagccaacg

SEQ ID NO: 174166 - DNA, 25 bp, E. coli
tgtaactccggtgcggaagccaacg

SEQ ID NO: 174167 - DNA, 25 bp, E. coli
tgcggtgattgtggaacccatccag

SEQ ID NO: 174168 - DNA, 25 bp, E. coli
tgcggtgattgtcgaacccatccag

SEQ ID NO: 174169 - DNA, 25 bp, E. coli
ccgggcaagcgatacagatctctca

SEQ ID NO: 174170 - DNA, 25 bp, E. coli
ccgggcaagcgaaacagatctctca

SEQ ID NO: 174171 - DNA, 25 bp, E. coli
gaaagagtatatggacttcgcgggt

SEQ ID NO: 174172 - DNA, 25 bp, E. coli
gaaagagtatatcgacttcgcgggt

SEQ ID NO: 174173 - DNA, 25 bp, E. coli
cggtactgcgacaggcgaaaaaatt

SEQ ID NO: 174174 - DNA, 25 bp, E. coli
cggtactgcgactggcgaaaaaatt

SEQ ID NO: 174175 - DNA, 25 bp, E. coli
gtaaattcgctcacgaccgctacgg

SEQ ID NO: 174176 - DNA, 25 bp, E. coli
gtaaattcgctctcgaccgctacgg

SEQ ID NO: 174177 - DNA, 25 bp, E. coli
ggcgtgacgcctgatctgttaacta

SEQ ID NO: 174178 - DNA, 25 bp, E. coli
ggcgtgacgcctcatctgttaacta

SEQ ID NO: 174179 - DNA, 25 bp, E. coli
taagttctggcataccggcaacggt

SEQ ID NO: 174180 - DNA, 25 bp, E. coli
taagttctggcaaaccggcaacggt

SEQ ID NO: 174181 - DNA, 25 bp, E. coli
gatgatacctgtatacgctccggca

SEQ ID NO: 174182 - DNA, 25 bp, E. coli
gatgatacctgtttacgctccggca

SEQ ID NO: 174183 - DNA, 25 bp, E. coli
caatggttgtacctgcgggaatgac

SEQ ID NO: 174184 - DNA, 25 bp, E. coli
caagagaaactttcaggctggagcg

SEQ ID NO: 174185 - DNA, 25 bp, E. coli
caatggttgtacgtgcgggaatgac

SEQ ID NO: 174186 - DNA, 25 bp, E. coli
caagagaaacttacaggctggagcg

SEQ ID NO: 174187 - DNA, 25 bp, E. coli
cagaggtacgtttcaccgtcggcaa

SEQ ID NO: 174188 - DNA, 25 bp, E. coli
cagaggtacgttacaccgtcggcaa

SEQ ID NO: 174189 - DNA, 25 bp, E. coli
aaattagtgtgtggctgaaccgcgc

SEQ ID NO: 174190 - DNA, 25 bp, E. coli
aaattagtgtgtcgctgaaccgcgc

SEQ ID NO: 174191 - DNA, 25 bp, E. coli
cgtgaagggcttttagcaggcaacc

SEQ ID NO: 174192 - DNA, 25 bp, E. coli
cgtgaagggcttatagcaggcaacc

SEQ ID NO: 174193 - DNA, 25 bp, E. coli
gtttatggatcttaacccgcggaga

SEQ ID NO: 174194 - DNA, 25 bp, E. coli
gatttgcgctattcccaacaactgg

SEQ ID NO: 174195 - DNA, 25 bp, E. coli
gtttatggatctaaacccgcggaga

SEQ ID NO: 174196 - DNA, 25 bp, E. coli
gatttgcgctatacccaacaactgg

SEQ ID NO: 174197 - DNA, 25 bp, E. coli
ggagcgatccgcgtatttctcagga

SEQ ID NO: 174198 - DNA, 25 bp, E. coli
ggagcgatccgcctatttctcagga

SEQ ID NO: 174199 - DNA, 25 bp, E. coli
tcaactctttgtggcggaactggcg

SEQ ID NO: 174200 - DNA, 25 bp, E. coli
tcaactctttgtcgcggaactggcg

SEQ ID NO: 174201 - DNA, 25 bp, E. coli
gagaatgtgacgttcagactgccag

SEQ ID NO: 174202 - DNA, 25 bp, E. coli
gatgctccgactgacgatttgcgct

SEQ ID NO: 174203 - DNA, 25 bp, E. coli
gatgctccgactcacgatttgcgct

SEQ ID NO: 174204 - DNA, 25 bp, E. coli
gagaatgtgacgatcagactgccag

SEQ ID NO: 174205 - DNA, 25 bp, E. coli
agcggcaaggtgtgcaatctcgatg

SEQ ID NO: 174206 - DNA, 25 bp, E. coli
agcggcaaggtgagcaatctcgatg

SEQ ID NO: 174207 - DNA, 25 bp, E. coli
aaagcggcaaggtgagcaatctcga

SEQ ID NO: 174208 - DNA, 25 bp, E. coli
aaagcggcaaggagagcaatctcga

SEQ ID NO: 174209 - DNA, 25 bp, E. coli
ttgaaagcggcaaggtgagcaatct

SEQ ID NO: 174210 - DNA, 25 bp, E. coli
ttgaaagcggcatggtgagcaatct

SEQ ID NO: 174211 - DNA, 25 bp, E. coli
tgtcgagttgcccaaagatgaagct

SEQ ID NO: 174212 - DNA, 25 bp, E. coli
tggtcaatggttcgcgtggatggag

SEQ ID NO: 174213 - DNA, 25 bp, E. coli
tgtcgagttgccgaaagatgaagct

SEQ ID NO: 174214 - DNA, 25 bp, E. coli
ccggagctgttttttgtcgagttgc

SEQ ID NO: 174215 - DNA, 25 bp, E. coli
ccggagctgtttattgtcgagttgc

SEQ ID NO: 174216 - DNA, 25 bp, E. coli
gctgtttattgtggagttgccgaaa

SEQ ID NO: 174217 - DNA, 25 bp, E. coli
gctgtttattgtcgagttgccgaaa

SEQ ID NO: 174218 - DNA, 25 bp, E. coli
cgctgcgcggcgccagtcatgtaca

SEQ ID NO: 174219 - DNA, 25 bp, E. coli
cgctgcgcggcggcagtcatgtaca

SEQ ID NO: 174220 - DNA, 25 bp, E. coli
gtcatgtacatgtctttagcccaaa

SEQ ID NO: 174221 - DNA, 25 bp, E. coli
gtcatgtacatgactttagcccaaa

SEQ ID NO: 174222 - DNA, 25 bp, E. coli
ggtgtttgacgtgcggccttctggg

SEQ ID NO: 174223 - DNA, 25 bp, E. coli
ggtgtttgacgtccggccttctggg

SEQ ID NO: 174224 - DNA, 25 bp, E. coli
tggaggacggtctgttgtggatcac

SEQ ID NO: 174225 - DNA, 25 bp, E. coli
tggaggacggtcagttgtggatcac

SEQ ID NO: 174226 - DNA, 25 bp, E. coli
tggtcaatggttggcgtggatggag

SEQ ID NO: 174227 - DNA, 25 bp, E. coli
cagcctggataaagtacgcgagcaa

SEQ ID NO: 174228 - DNA, 25 bp, E. coli
cagcctggataatgtacgcgagcaa

SEQ ID NO: 174229 - DNA, 25 bp, E. coli
taaagtacgcgagcaagtgcaggcg

SEQ ID NO: 174230 - DNA, 25 bp, E. coli
taaagtacgcgaccaagtgcaggcg

SEQ ID NO: 174231 - DNA, 25 bp, E. coli
tcttccattgagacgagcttaggtc

SEQ ID NO: 174232 - DNA, 25 bp, E. coli
tcttccattgagtcgagcttaggtc

SEQ ID NO: 174233 - DNA, 25 bp, E. coli
ccattgagtcgaccttaggtctaac

SEQ ID NO: 174234 - DNA, 25 bp, E. coli
ccattgagtcgagcttaggtctaac

SEQ ID NO: 174235 - DNA, 25 bp, E. coli
ccagacaccattgcgggactggaca

SEQ ID NO: 174236 - DNA, 25 bp, E. coli
ccagacaccattccgggactggaca

SEQ ID NO: 174237 - DNA, 25 bp, E. coli
cgttagtggacgttgatgcactgga

SEQ ID NO: 174238 - DNA, 25 bp, E. coli
cgagcaagtgcacgcggcgcatgcg

SEQ ID NO: 174239 - DNA, 25 bp, E. coli
cgagcaagtgcaggcggcgcatgcg

SEQ ID NO: 174240 - DNA, 25 bp, E. coli
cgttagtggacgatgatgcactgga

SEQ ID NO: 174241 - DNA, 25 bp, E. coli
ctgccgttagtggacgttgatgcac

SEQ ID NO: 174242 - DNA, 25 bp, E. coli
ctgccgttagtgcacgttgatgcac

SEQ ID NO: 174243 - DNA, 25 bp, E. coli
ctggataaagtaggcgagcaagtgc

SEQ ID NO: 174244 - DNA, 25 bp, E. coli
ctggataaagtacgcgagcaagtgc

SEQ ID NO: 174245 - DNA, 25 bp, E. coli
gagcctgctgcccttagtggacgtt

SEQ ID NO: 174246 - DNA, 25 bp, E. coli
gtcgagcttaggactaacgcaactg

SEQ ID NO: 174247 - DNA, 25 bp, E. coli
gagcctgctgccgttagtggacgtt

SEQ ID NO: 174248 - DNA, 25 bp, E. coli
gtcgagcttaggtctaacgcaactg

SEQ ID NO: 174249 - DNA, 25 bp, E. coli
aagtggttgaaatccgtggcggtca

SEQ ID NO: 174250 - DNA, 25 bp, E. coli
aagtggttgaaaaccgtggcggtca

SEQ ID NO: 174251 - DNA, 25 bp, E. coli
cagcgtaccgcgtgtgatgggcttc

SEQ ID NO: 174252 - DNA, 25 bp, E. coli
cagcgtaccgcgagtgatgggcttc

SEQ ID NO: 174253 - DNA, 25 bp, E. coli
aaaaagcgctggtacgtcgttcagg

SEQ ID NO: 174254 - DNA, 25 bp, E. coli
aaaaagcgctggaacgtcgttcagg

SEQ ID NO: 174255 - DNA, 25 bp, E. coli
tttgaaggccgcctagcaacgtcgc

SEQ ID NO: 174256 - DNA, 25 bp, E. coli
tttgaaggccgcgtagcaacgtcgc

SEQ ID NO: 174257 - DNA, 25 bp, E. coli
tgtctgaagctcctaaaaagcgctg

SEQ ID NO: 174258 - DNA, 25 bp, E. coli
tgtctgaagctcgtaaaaagcgctg

SEQ ID NO: 174259 - DNA, 25 bp, E. coli
tcatggtaccaaccgaagaagtggt

SEQ ID NO: 174260 - DNA, 25 bp, E. coli
tcatggtaccaagcgaagaagtggt

SEQ ID NO: 174261 - DNA, 25 bp, E. coli
ggttggtgataagccgcgtccgaaa

SEQ ID NO: 174262 - DNA, 25 bp, E. coli
ggttggtgataacccgcgtccgaaa

SEQ ID NO: 174263 - DNA, 25 bp, E. coli
tggcggtcagcgtcgcaaaagcgaa

SEQ ID NO: 174264 - DNA, 25 bp, E. coli
tggcggtcagcgacgcaaaagcgaa

SEQ ID NO: 174265 - DNA, 25 bp, E. coli
tcagatggtgatcaacgacgcgagc

SEQ ID NO: 174266 - DNA, 25 bp, E. coli
tcagatggtgatgaacgacgcgagc

SEQ ID NO: 174267 - DNA, 25 bp, E. coli
gatgcgattatgtaccgcctgcagc

SEQ ID NO: 174268 - DNA, 25 bp, E. coli
gatgggcttcatgggcggtacttcc

SEQ ID NO: 174269 - DNA, 25 bp, E. coli
gatgggcttcatcggcggtacttcc

SEQ ID NO: 174270 - DNA, 25 bp, E. coli
gatgcgattatgaaccgcctgcagc

SEQ ID NO: 174271 - DNA, 25 bp, E. coli
taaagtttgtccgttacgaggcaga

SEQ ID NO: 174272 - DNA, 25 bp, E. coli
tatggtttttccaacggtcttggcg

SEQ ID NO: 174273 - DNA, 25 bp, E. coli
tatggtttttcctacggtcttggcg

SEQ ID NO: 174274 - DNA, 25 bp, E. coli
tttggctaatcctgtcaatcgctgg

SEQ ID NO: 174275 - DNA, 25 bp, E. coli
tttggctaatccagtcaatcgctgg

SEQ ID NO: 174276 - DNA, 25 bp, E. coli
tcatttttaatctccaccccggagg

SEQ ID NO: 174277 - DNA, 25 bp, E. coli
tgaacacccggatgactataaacag

SEQ ID NO: 174278 - DNA, 25 bp, E. coli
tgaacacccggaagactataaacag

SEQ ID NO: 174279 - DNA, 25 bp, E. coli
tcatttttaatcaccaccccggagg

SEQ ID NO: 174280 - DNA, 25 bp, E. coli
tcccttatttatccggtgctggtcg

SEQ ID NO: 174281 - DNA, 25 bp, E. coli
tcccttatttatgcggtgctggtcg

SEQ ID NO: 174282 - DNA, 25 bp, E. coli
tctgactcacgaaggcgaatacaaa

SEQ ID NO: 174283 - DNA, 25 bp, E. coli
tcatgataatgggagattcggcgcg

SEQ ID NO: 174284 - DNA, 25 bp, E. coli
tcatgataatggcagattcggcgcg

SEQ ID NO: 174285 - DNA, 25 bp, E. coli
tctgactcacgatggcgaatacaaa

SEQ ID NO: 174286 - DNA, 25 bp, E. coli
cccgcattgggtcacgctcatcatg

SEQ ID NO: 174287 - DNA, 25 bp, E. coli
cccgcattgggtgacgctcatcatg

SEQ ID NO: 174288 - DNA, 25 bp, E. coli
cgtcgcaaacagtccactaatgtcg

SEQ ID NO: 174289 - DNA, 25 bp, E. coli
cgtcgcaaacagaccactaatgtcg

SEQ ID NO: 174290 - DNA, 25 bp, E. coli
taaagtttgtcccttacgaggcaga

SEQ ID NO: 174291 - DNA, 25 bp, E. coli
gaggcagacagctttacaccattcg

SEQ ID NO: 174292 - DNA, 25 bp, E. coli
gaggcagacagcattacaccattcg

SEQ ID NO: 174293 - DNA, 25 bp, E. coli
aacgtgactgtgctctgcagcctgc

SEQ ID NO: 174294 - DNA, 25 bp, E. coli
aactggcggcttaatctggtctgca

SEQ ID NO: 174295 - DNA, 25 bp, E. coli
taccggatattcaggaacgtgactg

SEQ ID NO: 174296 - DNA, 25 bp, E. coli
taccggatattctggaacgtgactg

SEQ ID NO: 174297 - DNA, 25 bp, E. coli
aactggcggctttatctggtctgca

SEQ ID NO: 174298 - DNA, 25 bp, E. coli
aacgtgactgtggtctgcagcctgc

SEQ ID NO: 174299 - DNA, 25 bp, E. coli
ttgctgagggcgaaatggatccaca

SEQ ID NO: 174300 - DNA, 25 bp, E. coli
ttgctgagggcgtaatggatccaca

SEQ ID NO: 174301 - DNA, 25 bp, E. coli
tgaaaaacattcctcccgctggtgg

SEQ ID NO: 174302 - DNA, 25 bp, E. coli
tgaaaaacattcgtcccgctggtgg

SEQ ID NO: 174303 - DNA, 25 bp, E. coli
ccatctgggcaaaagcggtcgtgca

SEQ ID NO: 174304 - DNA, 25 bp, E. coli
ccatctgggcaatagcggtcgtgca

SEQ ID NO: 174305 - DNA, 25 bp, E. coli
ccggttgaccgatattctgactgaa

SEQ ID NO: 174306 - DNA, 25 bp, E. coli
ccgctggtggacatgacaaactcaa

SEQ ID NO: 174307 - DNA, 25 bp, E. coli
cgcgatcagatacccctgcgggtga

SEQ ID NO: 174308 - DNA, 25 bp, E. coli
ccgctggtggacttgacaaactcaa

SEQ ID NO: 174309 - DNA, 25 bp, E. coli
cgcgatcagatagccctgcgggtga

SEQ ID NO: 174310 - DNA, 25 bp, E. coli
ccggttgaccgaaattctgactgaa

SEQ ID NO: 174311 - DNA, 25 bp, E. coli
tggatccacatgaacgcaaagcctg

SEQ ID NO: 174312 - DNA, 25 bp, E. coli
tggatccacatgtacgcaaagcctg

SEQ ID NO: 174313 - DNA, 25 bp, E. coli
taagttcgaacaggaaacggcacaa

SEQ ID NO: 174314 - DNA, 25 bp, E. coli
taagttcgaacacgaaacggcacaa

SEQ ID NO: 174315 - DNA, 25 bp, E. coli
aacgcggcgatgtcgttgctcacca

SEQ ID NO: 174316 - DNA, 25 bp, E. coli
caaacagcgggaggtcaaagcatcg

SEQ ID NO: 174317 - DNA, 25 bp, E. coli
caaacagcgggacgtcaaagcatcg

SEQ ID NO: 174318 - DNA, 25 bp, E. coli
aactctattatgacgccgctgcaag

SEQ ID NO: 174319 - DNA, 25 bp, E. coli
aactctattatgtcgccgctgcaag

SEQ ID NO: 174320 - DNA, 25 bp, E. coli
aacgcggcgatgacgttgctcacca

SEQ ID NO: 174321 - DNA, 25 bp, E. coli
ttttgccgccgagatcatcgtgccg

SEQ ID NO: 174322 - DNA, 25 bp, E. coli
ttttgccgccgacatcatcgtgccg

SEQ ID NO: 174323 - DNA, 25 bp, E. coli
tctggtcttcgggaatattctggag

SEQ ID NO: 174324 - DNA, 25 bp, E. coli
tcattatctggtgctgaaaacagcc

SEQ ID NO: 174325 - DNA, 25 bp, E. coli
tctggtcttcggcaatattctggag

SEQ ID NO: 174326 - DNA, 25 bp, E. coli
tcattatctggtcctgaaaacagcc

SEQ ID NO: 174327 - DNA, 25 bp, E. coli
gccgttctgttatgcgatctcaata

SEQ ID NO: 174328 - DNA, 25 bp, E. coli
gccgttctgttaagcgatctcaata

SEQ ID NO: 174329 - DNA, 25 bp, E. coli
gctgtttatgctgctcgaagtgcca

SEQ ID NO: 174330 - DNA, 25 bp, E. coli
gctgtttatgctcctcgaagtgcca

SEQ ID NO: 174331 - DNA, 25 bp, E. coli
gaagtgccacaaatgcccggaaaat

SEQ ID NO: 174332 - DNA, 25 bp, E. coli
gaagtgccacaattgcccggaaaat

SEQ ID NO: 174333 - DNA, 25 bp, E. coli
taacccgctggtccaacacatggtc

SEQ ID NO: 174334 - DNA, 25 bp, E. coli
tcaacgagttgacgcggacgttacc

SEQ ID NO: 174335 - DNA, 25 bp, E. coli
taacccgctggtgcaacacatggtc

SEQ ID NO: 174336 - DNA, 25 bp, E. coli
tcaacgagttgaggcggacgttacc

SEQ ID NO: 174337 - DNA, 25 bp, E. coli
caaacgtgtaaaatattccggtgcg

SEQ ID NO: 174338 - DNA, 25 bp, E. coli
caaacgtgtaaattattccggtgcg

SEQ ID NO: 174339 - DNA, 25 bp, E. coli
catcggtgagtcagagtaagatcag

SEQ ID NO: 174340 - DNA, 25 bp, E. coli
catcggtgagtctgagtaagatcag

SEQ ID NO: 174341 - DNA, 25 bp, E. coli
tagtcggcaaacctctcaccttgag

SEQ ID NO: 174342 - DNA, 25 bp, E. coli
tagtcggcaaacgtctcaccttgag

SEQ ID NO: 174343 - DNA, 25 bp, E. coli
tatcagtacgctgataaaaatccat

SEQ ID NO: 174344 - DNA, 25 bp, E. coli
tatcagtacgctcataaaaatccat

SEQ ID NO: 174345 - DNA, 25 bp, E. coli
tgaggaatggctatcagtattgtca

SEQ ID NO: 174346 - DNA, 25 bp, E. coli
tgaggaatggctttcagtattgtca

SEQ ID NO: 174347 - DNA, 25 bp, E. coli
tccggtgcgagtaagaattatgagg

SEQ ID NO: 174348 - DNA, 25 bp, E. coli
tccggtgcgagttagaattatgagg

SEQ ID NO: 174349 - DNA, 25 bp, E. coli
gctaaattcgcataagactttgcac

SEQ ID NO: 174350 - DNA, 25 bp, E. coli
gctaatttcaccctaccgctctgtg

SEQ ID NO: 174351 - DNA, 25 bp, E. coli
gctctgtgacgttctatagtcggca

SEQ ID NO: 174352 - DNA, 25 bp, E. coli
gctaatttcaccgtaccgctctgtg

SEQ ID NO: 174353 - DNA, 25 bp, E. coli
gctctgtgacgtactatagtcggca

SEQ ID NO: 174354 - DNA, 25 bp, E. coli
gctaaattcgcaaaagactttgcac

SEQ ID NO: 174355 - DNA, 25 bp, E. coli
gaaaatatttatgctgcatcggtga

SEQ ID NO: 174356 - DNA, 25 bp, E. coli
gaaaatatttatcctgcatcggtga

SEQ ID NO: 174357 - DNA, 25 bp, E. coli
taagatcagactattgctaaattcg

SEQ ID NO: 174358 - DNA, 25 bp, E. coli
taagatcagacttttgctaaattcg

SEQ ID NO: 174359 - DNA, 25 bp, E. coli
caatacgggctatccaatatgcttt

SEQ ID NO: 174360 - DNA, 25 bp, E. coli
caatacgggctaaccaatatgcttt

SEQ ID NO: 174361 - DNA, 25 bp, E. coli
cagggtggatccgaaaactcatgtt

SEQ ID NO: 174362 - DNA, 25 bp, E. coli
cagggtggatcccaaaactcatgtt

SEQ ID NO: 174363 - DNA, 25 bp, E. coli
taaatgtattacgtgcaatacgggc

SEQ ID NO: 174364 - DNA, 25 bp, E. coli
taaatgtattacctgcaatacgggc

SEQ ID NO: 174365 - DNA, 25 bp, E. coli
tacctgccaccgcaatgaatgcttt

SEQ ID NO: 174366 - DNA, 25 bp, E. coli
tacctgccaccggaatgaatgcttt

SEQ ID NO: 174367 - DNA, 25 bp, E. coli
tcttgggcatgtttcctggctctgg

SEQ ID NO: 174368 - DNA, 25 bp, E. coli
tcttgggcatgtatcctggctctgg

SEQ ID NO: 174369 - DNA, 25 bp, E. coli
gaactattccgagccatcagggtgg

SEQ ID NO: 174370 - DNA, 25 bp, E. coli
gaactattccgacccatcagggtgg

SEQ ID NO: 174371 - DNA, 25 bp, E. coli
cattgactggattgctcctttcggg

SEQ ID NO: 174372 - DNA, 25 bp, E. coli
cattgactggatagctcctttcggg

SEQ ID NO: 174373 - DNA, 25 bp, E. coli
ggtgccctgtactaatatatgcgaa

SEQ ID NO: 174374 - DNA, 25 bp, E. coli
gggccagttccccattacacagaaa

SEQ ID NO: 174375 - DNA, 25 bp, E. coli
gggccagttcccgattacacagaaa

SEQ ID NO: 174376 - DNA, 25 bp, E. coli
ggtgccctgtacaaatatatgcgaa

SEQ ID NO: 174377 - DNA, 25 bp, E. coli
taatatcgttctctcacagactccg

SEQ ID NO: 174378 - DNA, 25 bp, E. coli
taatatcgttctgtcacagactccg

SEQ ID NO: 174379 - DNA, 25 bp, E. coli
gatgttacctcattagtcgcagaag

SEQ ID NO: 174380 - DNA, 25 bp, E. coli
gatgttacctcaatagtcgcagaag

SEQ ID NO: 174381 - DNA, 25 bp, E. coli
aagtgaacggaggtggcttcatcgc

SEQ ID NO: 174382 - DNA, 25 bp, E. coli
aagtgaacggagctggcttcatcgc

SEQ ID NO: 174383 - DNA, 25 bp, E. coli
taaagcgtgtcaggtggcctgtaaa

SEQ ID NO: 174384 - DNA, 25 bp, E. coli
taaagaatttgcatctgtcagcgac

SEQ ID NO: 174385 - DNA, 25 bp, E. coli
taaagaatttgcttctgtcagcgac

SEQ ID NO: 174386 - DNA, 25 bp, E. coli
taaagcgtgtcacgtggcctgtaaa

SEQ ID NO: 174387 - DNA, 25 bp, E. coli
tttcgccgcgtgtatgaagtgaacg

SEQ ID NO: 174388 - DNA, 25 bp, E. coli
tttcgccgcgtgaatgaagtgaacg

SEQ ID NO: 174389 - DNA, 25 bp, E. coli
tgagccaatttaaagaatttgcatc

SEQ ID NO: 174390 - DNA, 25 bp, E. coli
tgagccaatttatagaatttgcatc

SEQ ID NO: 174391 - DNA, 25 bp, E. coli
tcaggtggcctgtaaagacaaaaac

SEQ ID NO: 174392 - DNA, 25 bp, E. coli
tcaggtggcctgaaaagacaaaaac

SEQ ID NO: 174393 - DNA, 25 bp, E. coli
gactcttcgcgttgttcgggctgta

SEQ ID NO: 174394 - DNA, 25 bp, E. coli
gactcttcgcgtagttcgggctgta

SEQ ID NO: 174395 - DNA, 25 bp, E. coli
cgttgttcgggcagtaaagcgtgtc

SEQ ID NO: 174396 - DNA, 25 bp, E. coli
cttcatcgccactggagagggcggt

SEQ ID NO: 174397 - DNA, 25 bp, E. coli
cgttgttcgggctgtaaagcgtgtc

SEQ ID NO: 174398 - DNA, 25 bp, E. coli
cttcatcgccacaggagagggcggt

SEQ ID NO: 174399 - DNA, 25 bp, E. coli
tgtcagcgacaatcaattagggttc

SEQ ID NO: 174400 - DNA, 25 bp, E. coli
tgtcagcgacaaacaattagggttc

SEQ ID NO: 174401 - DNA, 25 bp, E. coli
tagggttctttattgactcttcgcg

SEQ ID NO: 174402 - DNA, 25 bp, E. coli
tagggttctttaatgactcttcgcg

SEQ ID NO: 174403 - DNA, 25 bp, E. coli
catacattgcctccgtttaactttc

SEQ ID NO: 174404 - DNA, 25 bp, E. coli
catacattgcctgcgtttaactttc

SEQ ID NO: 174405 - DNA, 25 bp, E. coli
taaaacgcgtaacatacattgcctg

SEQ ID NO: 174406 - DNA, 25 bp, E. coli
taaaacgcgtaagatacattgcctg

SEQ ID NO: 174407 - DNA, 25 bp, E. coli
aaactacctggtacgcaaaactgcg

SEQ ID NO: 174408 - DNA, 25 bp, E. coli
aaactacctggttcgcaaaactgcg

SEQ ID NO: 174409 - DNA, 25 bp, E. coli
ttaaaccgggacctcgcgagcaagg

SEQ ID NO: 174410 - DNA, 25 bp, E. coli
ttaaaccgggacgtcgcgagcaagg

SEQ ID NO: 174411 - DNA, 25 bp, E. coli
tcgcctggcaaatataaaatcaccc

SEQ ID NO: 174412 - DNA, 25 bp, E. coli
tcgcctggcaaaaataaaatcaccc

SEQ ID NO: 174413 - DNA, 25 bp, E. coli
tcgcaaaactgcctctaaagttaaa

SEQ ID NO: 174414 - DNA, 25 bp, E. coli
tcgcaaaactgcgtctaaagttaaa

SEQ ID NO: 174415 - DNA, 25 bp, E. coli
tcttgcagaaaattgagaattcgtg

SEQ ID NO: 174416 - DNA, 25 bp, E. coli
tcttgcagaaaaatgagaattcgtg

SEQ ID NO: 174417 - DNA, 25 bp, E. coli
cctatagatgcacaaaaaacgggca

SEQ ID NO: 174418 - DNA, 25 bp, E. coli
cctatagatgcagaaaaaacgggca

SEQ ID NO: 174419 - DNA, 25 bp, E. coli
gatcactcaaaaacgcctggcaaaa

SEQ ID NO: 174420 - DNA, 25 bp, E. coli
gatcactcaaaatcgcctggcaaaa

SEQ ID NO: 174421 - DNA, 25 bp, E. coli
taactttctttgtactcttgcagaa

SEQ ID NO: 174422 - DNA, 25 bp, E. coli
taactttctttgaactcttgcagaa

SEQ ID NO: 174423 - DNA, 25 bp, E. coli
gagaattcgtgactacgatcactca

SEQ ID NO: 174424 - DNA, 25 bp, E. coli
gagaattcgtgagtacgatcactca

SEQ ID NO: 174425 - DNA, 25 bp, E. coli
aatgacacggcctgttctgcagcca

SEQ ID NO: 174426 - DNA, 25 bp, E. coli
aatgacacggccagttctgcagcca

SEQ ID NO: 174427 - DNA, 25 bp, E. coli
tacatggccggacgtaaacgaccgg

SEQ ID NO: 174428 - DNA, 25 bp, E. coli
tacatggccggaggtaaacgaccgg

SEQ ID NO: 174429 - DNA, 25 bp, E. coli
tgacatgccaggtagcgaaaggacg

SEQ ID NO: 174430 - DNA, 25 bp, E. coli
tgatgagccatgtcagctatgccgg

SEQ ID NO: 174431 - DNA, 25 bp, E. coli
tgacatgccaggaagcgaaaggacg

SEQ ID NO: 174432 - DNA, 25 bp, E. coli
tgatgagccatgacagctatgccgg

SEQ ID NO: 174433 - DNA, 25 bp, E. coli
tgcggacgtgaaaatgctcatggcc

SEQ ID NO: 174434 - DNA, 25 bp, E. coli
tgcggacgtgaatatgctcatggcc

SEQ ID NO: 174435 - DNA, 25 bp, E. coli
gcaattaactgctacggaagccgcc

SEQ ID NO: 174436 - DNA, 25 bp, E. coli
gcaattaactgcaacggaagccgcc

SEQ ID NO: 174437 - DNA, 25 bp, E. coli
cattatggcgtgtgaagaagcgaac

SEQ ID NO: 174438 - DNA, 25 bp, E. coli
cattatggcgtgagaagaagcgaac

SEQ ID NO: 174439 - DNA, 25 bp, E. coli
tggccacggcgcagaacagtaatgt

SEQ ID NO: 174440 - DNA, 25 bp, E. coli
tggttacccagacatcccgtatcgg

SEQ ID NO: 174441 - DNA, 25 bp, E. coli
tggccacggcgctgaacagtaatgt

SEQ ID NO: 174442 - DNA, 25 bp, E. coli
tggttacccagagatcccgtatcgg

SEQ ID NO: 174443 - DNA, 25 bp, E. coli
taatgtcagaggaggcactatgccg

SEQ ID NO: 174444 - DNA, 25 bp, E. coli
taatgtcagaggtggcactatgccg

SEQ ID NO: 174445 - DNA, 25 bp, E. coli
gatcaggtaagggagaaccggtctc

SEQ ID NO: 174446 - DNA, 25 bp, E. coli
gatcaggtaaggcagaaccggtctc

SEQ ID NO: 174447 - DNA, 25 bp, E. coli
caatagctttcggatgttctcgcaa

SEQ ID NO: 174448 - DNA, 25 bp, E. coli
caatagctttcgcatgttctcgcaa

SEQ ID NO: 174449 - DNA, 25 bp, E. coli
ttctgaactgcaactggctcgggcc

SEQ ID NO: 174450 - DNA, 25 bp, E. coli
ttcacgatgataaaccagcgccagt

SEQ ID NO: 174451 - DNA, 25 bp, E. coli
ttctgaactgcatctggctcgggcc

SEQ ID NO: 174452 - DNA, 25 bp, E. coli
ttcacgatgatataccagcgccagt

SEQ ID NO: 174453 - DNA, 25 bp, E. coli
tgatgacggtttcgcctgtactacc

SEQ ID NO: 174454 - DNA, 25 bp, E. coli
tgatgacggtttggcctgtactacc

SEQ ID NO: 174455 - DNA, 25 bp, E. coli
tgctcgaacgtcatcggctactgcg

SEQ ID NO: 174456 - DNA, 25 bp, E. coli
tgctcgaacgtcttcggctactgcg

SEQ ID NO: 174457 - DNA, 25 bp, E. coli
tgcgctccgtaaccatttgaattca

SEQ ID NO: 174458 - DNA, 25 bp, E. coli
tgcgctccgtaagcatttgaattca

SEQ ID NO: 174459 - DNA, 25 bp, E. coli
gcgtaaacctgagcatgatgacggt

SEQ ID NO: 174460 - DNA, 25 bp, E. coli
gcgtaaacctgaccatgatgacggt

SEQ ID NO: 174461 - DNA, 25 bp, E. coli
cattgccgtcgaagagcatatgacc

SEQ ID NO: 174462 - DNA, 25 bp, E. coli
cattgccgtcgatgagcatatgacc

SEQ ID NO: 174463 - DNA, 25 bp, E. coli
gatttgccgcagtgaccttgatgcc

SEQ ID NO: 174464 - DNA, 25 bp, E. coli
gatttgccgcagagaccttgatgcc

SEQ ID NO: 174465 - DNA, 25 bp, E. coli
ggctactgcgtgacaacatcggcaa

SEQ ID NO: 174466 - DNA, 25 bp, E. coli
ggctactgcgtgtcaacatcggcaa

SEQ ID NO: 174467 - DNA, 25 bp, E. coli
gatccattaatgtgaacacgcgtta

SEQ ID NO: 174468 - DNA, 25 bp, E. coli
gatccattaatgagaacacgcgtta

SEQ ID NO: 174469 - DNA, 25 bp, E. coli
caatgaaggttacgataacggcaac

SEQ ID NO: 174470 - DNA, 25 bp, E. coli
caacgctggttgcatcatattcgta

SEQ ID NO: 174471 - DNA, 25 bp, E. coli
caatgaaggttaggataacggcaac

SEQ ID NO: 174472 - DNA, 25 bp, E. coli
caacgctggttggatcatattcgta

SEQ ID NO: 174473 - DNA, 25 bp, E. coli
tactgtaacaaaggcagaggttgac

SEQ ID NO: 174474 - DNA, 25 bp, E. coli
tactgtaacaaacgcagaggttgac

SEQ ID NO: 174475 - DNA, 25 bp, E. coli
tacgcccggaaatatcacaggtaat

SEQ ID NO: 174476 - DNA, 25 bp, E. coli
tacgcccggaaaaatcacaggtaat

SEQ ID NO: 174477 - DNA, 25 bp, E. coli
tatatcacttcatgccaaacttgga

SEQ ID NO: 174478 - DNA, 25 bp, E. coli
tatatcacttcaagccaaacttgga

SEQ ID NO: 174479 - DNA, 25 bp, E. coli
tgtacatgcagctgataatctgacc

SEQ ID NO: 174480 - DNA, 25 bp, E. coli
tgtacatgcagcagataatctgacc

SEQ ID NO: 174481 - DNA, 25 bp, E. coli
gactgcgataacattagggactcca

SEQ ID NO: 174482 - DNA, 25 bp, E. coli
gaaatgtagagattcagaccctgag

SEQ ID NO: 174483 - DNA, 25 bp, E. coli
gaaatgtagagaatcagaccctgag

SEQ ID NO: 174484 - DNA, 25 bp, E. coli
gactgcgataactttagggactcca

SEQ ID NO: 174485 - DNA, 25 bp, E. coli
gatttttctgcgtcagcaacgctgg

SEQ ID NO: 174486 - DNA, 25 bp, E. coli
gatttttctgcgacagcaacgctgg

SEQ ID NO: 174487 - DNA, 25 bp, E. coli
gattattcctgcctgtactgtaaca

SEQ ID NO: 174488 - DNA, 25 bp, E. coli
gattattcctgcgtgtactgtaaca

SEQ ID NO: 174489 - DNA, 25 bp, E. coli
gaggtttgtgtcatccggtaatgct

SEQ ID NO: 174490 - DNA, 25 bp, E. coli
gaggtttgtgtcttccggtaatgct

SEQ ID NO: 174491 - DNA, 25 bp, E. coli
caaatgcctgaacgtgcgacagagc

SEQ ID NO: 174492 - DNA, 25 bp, E. coli
caaatgcctgaaggtgcgacagagc

SEQ ID NO: 174493 - DNA, 25 bp, E. coli
tagcacgacgggtaaagcgcctaaa

SEQ ID NO: 174494 - DNA, 25 bp, E. coli
atttggtgaattgccctcctcggcg

SEQ ID NO: 174495 - DNA, 25 bp, E. coli
atttggtgaattcccctcctcggcg

SEQ ID NO: 174496 - DNA, 25 bp, E. coli
tagcacgacgggaaaagcgcctaaa

SEQ ID NO: 174497 - DNA, 25 bp, E. coli
tatactttgacggaggaactggagg

SEQ ID NO: 174498 - DNA, 25 bp, E. coli
tatactttgacgcaggaactggagg

SEQ ID NO: 174499 - DNA, 25 bp, E. coli
ttctaaaactcagcgcaatgccgcg

SEQ ID NO: 174500 - DNA, 25 bp, E. coli
ttctaaaactcaccgcaatgccgcg

SEQ ID NO: 174501 - DNA, 25 bp, E. coli
tcctttcaaaaaccagcaggcgctg

SEQ ID NO: 174502 - DNA, 25 bp, E. coli
tcctttcaaaaagcagcaggcgctg

SEQ ID NO: 174503 - DNA, 25 bp, E. coli
tgcgaaattaaagccggcacggtgc

SEQ ID NO: 174504 - DNA, 25 bp, E. coli
tgcgaaattaaacccggcacggtgc

SEQ ID NO: 174505 - DNA, 25 bp, E. coli
gaacattcgcatgagtaccagtgtg

SEQ ID NO: 174506 - DNA, 25 bp, E. coli
tgggcaaccccgatattggcgtact

SEQ ID NO: 174507 - DNA, 25 bp, E. coli
gaacattcgcatcagtaccagtgtg

SEQ ID NO: 174508 - DNA, 25 bp, E. coli
tgggcaaccccgttattggcgtact

SEQ ID NO: 174509 - DNA, 25 bp, E. coli
cgtattcggattttctggcaaggca

SEQ ID NO: 174510 - DNA, 25 bp, E. coli
cgtattcggattatctggcaaggca

SEQ ID NO: 174511 - DNA, 25 bp, E. coli
ggcgtgtcaccgaaacccaggattg

SEQ ID NO: 174512 - DNA, 25 bp, E. coli
ggcgtgtcaccgtaacccaggattg

SEQ ID NO: 174513 - DNA, 25 bp, E. coli
aataccttctgcctggtgcgcggtg

SEQ ID NO: 174514 - DNA, 25 bp, E. coli
aataccttctgcgtggtgcgcggtg

SEQ ID NO: 174515 - DNA, 25 bp, E. coli
caggcgaacggccttatcgttatcc

SEQ ID NO: 174516 - DNA, 25 bp, E. coli
caggcgaacggcgttatcgttatcc

SEQ ID NO: 174517 - DNA, 25 bp, E. coli
tatcgcgaatgtgagcacctgggcg

SEQ ID NO: 174518 - DNA, 25 bp, E. coli
taccccaggcgatcggcgttatcgt

SEQ ID NO: 174519 - DNA, 25 bp, E. coli
taccggcgggtgatggcggtttgtc

SEQ ID NO: 174520 - DNA, 25 bp, E. coli
taccccaggcgaacggcgttatcgt

SEQ ID NO: 174521 - DNA, 25 bp, E. coli
taccggcgggtgttggcggtttgtc

SEQ ID NO: 174522 - DNA, 25 bp, E. coli
tatcgcgaatgtcagcacctgggcg

SEQ ID NO: 174523 - DNA, 25 bp, E. coli
ttggttagcgggtgaagtccagaac

SEQ ID NO: 174524 - DNA, 25 bp, E. coli
ttggttagcgggagaagtccagaac

SEQ ID NO: 174525 - DNA, 25 bp, E. coli
tctggcagagcaacagtggccgctg

SEQ ID NO: 174526 - DNA, 25 bp, E. coli
tctggcagagcatcagtggccgctg

SEQ ID NO: 174527 - DNA, 25 bp, E. coli
gaactatcgcgaatgtgagcacctg

SEQ ID NO: 174528 - DNA, 25 bp, E. coli
gaactatcgcgattgtgagcacctg

SEQ ID NO: 174529 - DNA, 25 bp, E. coli
cgtgtctggcagagcatcagtggcc

SEQ ID NO: 174530 - DNA, 25 bp, E. coli
cgtgtctggcagtgcatcagtggcc

SEQ ID NO: 174531 - DNA, 25 bp, E. coli
cttgcctgcagtcgcgcttccgggt

SEQ ID NO: 174532 - DNA, 25 bp, E. coli
cttgcctgcagtggcgcttccgggt

SEQ ID NO: 174533 - DNA, 25 bp, E. coli
ggcgcggatctgtaaaataccttct

SEQ ID NO: 174534 - DNA, 25 bp, E. coli
ggcgcggatctgaaaaataccttct

SEQ ID NO: 174535 - DNA, 25 bp, E. coli
caaatggtggaattcctccgcgggc

SEQ ID NO: 174536 - DNA, 25 bp, E. coli
caaatggtggaaatcctccgcgggc

SEQ ID NO: 174537 - DNA, 25 bp, E. coli
aaaatgaagaacttgctggcggcgc

SEQ ID NO: 174538 - DNA, 25 bp, E. coli
aaaatgaagaacatgctggcggcgc

SEQ ID NO: 174539 - DNA, 25 bp, E. coli
tatccactggagtacgtttactgcg

SEQ ID NO: 174540 - DNA, 25 bp, E. coli
tatccactggagaacgtttactgcg

SEQ ID NO: 174541 - DNA, 25 bp, E. coli
tattgattgtcgttgagccgacgcg

SEQ ID NO: 174542 - DNA, 25 bp, E. coli
tattgattgtcgatgagccgacgcg

SEQ ID NO: 174543 - DNA, 25 bp, E. coli
ttaagcggcaaaaccagcgaactgt

SEQ ID NO: 174544 - DNA, 25 bp, E. coli
ttaagcggcaaatccagcgaactgt

SEQ ID NO: 174545 - DNA, 25 bp, E. coli
tgcaaacgagtgttacccgcgcgtt

SEQ ID NO: 174546 - DNA, 25 bp, E. coli
tgcaaacgagtgatacccgcgcgtt

SEQ ID NO: 174547 - DNA, 25 bp, E. coli
tgccttcggcgaaagtcagcgtcag

SEQ ID NO: 174548 - DNA, 25 bp, E. coli
tgccttcggcgatagtcagcgtcag

SEQ ID NO: 174549 - DNA, 25 bp, E. coli
tcataaccttcgtggattctgggcg

SEQ ID NO: 174550 - DNA, 25 bp, E. coli
tcataaccttcgaggattctgggcg

SEQ ID NO: 174551 - DNA, 25 bp, E. coli
cgcgaaagataaagccaccctggaa

SEQ ID NO: 174552 - DNA, 25 bp, E. coli
cgcgaaagataatgccaccctggaa

SEQ ID NO: 174553 - DNA, 25 bp, E. coli
ggtacgggaaaaatcgctctctgcc

SEQ ID NO: 174554 - DNA, 25 bp, E. coli
ggatgtcgccgaacgccaaatggtg

SEQ ID NO: 174555 - DNA, 25 bp, E. coli
ggtacgggaaaattcgctctctgcc

SEQ ID NO: 174556 - DNA, 25 bp, E. coli
ggatgtcgccgatcgccaaatggtg

SEQ ID NO: 174557 - DNA, 25 bp, E. coli
tgtttgaagcgcagcaggtgcatcg

SEQ ID NO: 174558 - DNA, 25 bp, E. coli
tgtttgaagcgctgcaggtgcatcg

SEQ ID NO: 174559 - DNA, 25 bp, E. coli
tgaaaaaccgttcctggatctgctg

SEQ ID NO: 174560 - DNA, 25 bp, E. coli
tgctgtcgattatgaccggagcttg

SEQ ID NO: 174561 - DNA, 25 bp, E. coli
tgaacgaacagagtcaggcgatgtg

SEQ ID NO: 174562 - DNA, 25 bp, E. coli
tgctgtcgattaagaccggagcttg

SEQ ID NO: 174563 - DNA, 25 bp, E. coli
tgaacgaacagactcaggcgatgtg

SEQ ID NO: 174564 - DNA, 25 bp, E. coli
tgaaaaaccgttgctggatctgctg

SEQ ID NO: 174565 - DNA, 25 bp, E. coli
tccggaagaagaaaaagacctgcaa

SEQ ID NO: 174566 - DNA, 25 bp, E. coli
tccggaagaagataaagacctgcaa

SEQ ID NO: 174567 - DNA, 25 bp, E. coli
ccgagcggttgaaggaagttgaaca

SEQ ID NO: 174568 - DNA, 25 bp, E. coli
gaagaatccccacgaacgcgatatg

SEQ ID NO: 174569 - DNA, 25 bp, E. coli
gaagaatccccaggaacgcgatatg

SEQ ID NO: 174570 - DNA, 25 bp, E. coli
gacacctcgccggagttttacggca

SEQ ID NO: 174571 - DNA, 25 bp, E. coli
gaaagcgtgccaatcaacatgctgg

SEQ ID NO: 174572 - DNA, 25 bp, E. coli
gacacctcgccgcagttttacggca

SEQ ID NO: 174573 - DNA, 25 bp, E. coli
gaaagcgtgccattcaacatgctgg

SEQ ID NO: 174574 - DNA, 25 bp, E. coli
cgcgctacaaaagcgggctggaagc

SEQ ID NO: 174575 - DNA, 25 bp, E. coli
ccgagcggttgatggaagttgaaca

SEQ ID NO: 174576 - DNA, 25 bp, E. coli
cgcgctacaaaaccgggctggaagc

SEQ ID NO: 174577 - DNA, 25 bp, E. coli
gatcctcgtcaggtgcaggtcagca

SEQ ID NO: 174578 - DNA, 25 bp, E. coli
gatcctcgtcagctgcaggtcagca

SEQ ID NO: 174579 - DNA, 25 bp, E. coli
cagaagacatcacgcctacttatcc

SEQ ID NO: 174580 - DNA, 25 bp, E. coli
cagaagacatcaggcctacttatcc

SEQ ID NO: 174581 - DNA, 25 bp, E. coli
cagtgatgacgacaacgcattctac

SEQ ID NO: 174582 - DNA, 25 bp, E. coli
cagtgatgacgagaacgcattctac

SEQ ID NO: 174583 - DNA, 25 bp, E. coli
atcacgcctactaatccgacaaagg

SEQ ID NO: 174584 - DNA, 25 bp, E. coli
acgcctacttatccgacaaaggcga

SEQ ID NO: 174585 - DNA, 25 bp, E. coli
acgcctacttatgcgacaaaggcga

SEQ ID NO: 174586 - DNA, 25 bp, E. coli
atcacgcctacttatccgacaaagg

SEQ ID NO: 174587 - DNA, 25 bp, E. coli
aaacctcacagaagacatcacgcct

SEQ ID NO: 174588 - DNA, 25 bp, E. coli
aaacctcacagatgacatcacgcct

SEQ ID NO: 174589 - DNA, 25 bp, E. coli
tcacagaagacatcacgcctactta

SEQ ID NO: 174590 - DNA, 25 bp, E. coli
gacatcacgccttcttatccgacaa

SEQ ID NO: 174591 - DNA, 25 bp, E. coli
gacaacgcattcaacaaaacttcag

SEQ ID NO: 174592 - DNA, 25 bp, E. coli
gacatcacgcctacttatccgacaa

SEQ ID NO: 174593 - DNA, 25 bp, E. coli
gacaacgcattctacaaaacttcag

SEQ ID NO: 174594 - DNA, 25 bp, E. coli
cgtcagtgatgacgacaacgcattc

SEQ ID NO: 174595 - DNA, 25 bp, E. coli
cgtcagtgatgaggacaacgcattc

SEQ ID NO: 174596 - DNA, 25 bp, E. coli
gtgatgacgacaacgcattctacaa

SEQ ID NO: 174597 - DNA, 25 bp, E. coli
gtgatgacgacatcgcattctacaa

SEQ ID NO: 174598 - DNA, 25 bp, E. coli
tcacagaagacaacacgcctactta

SEQ ID NO: 174599 - DNA, 25 bp, E. coli
gacgacaacgcattctacaaaactt

SEQ ID NO: 174600 - DNA, 25 bp, E. coli
gacgacaacgcaatctacaaaactt

SEQ ID NO: 174601 - DNA, 25 bp, E. coli
aacagtttctgcacaaccttcagga

SEQ ID NO: 174602 - DNA, 25 bp, E. coli
aacagtttctgctcaaccttcagga

SEQ ID NO: 174603 - DNA, 25 bp, E. coli
tttggcctgcaaactggcgggcgca

SEQ ID NO: 174604 - DNA, 25 bp, E. coli
tttggcctgcaatctggcgggcgca

SEQ ID NO: 174605 - DNA, 25 bp, E. coli
ttcaatctggtctgggatcgcggca

SEQ ID NO: 174606 - DNA, 25 bp, E. coli
tttatgcaggcgctaggcaaaggct

SEQ ID NO: 174607 - DNA, 25 bp, E. coli
tttatgcaggcggtaggcaaaggct

SEQ ID NO: 174608 - DNA, 25 bp, E. coli
ttcaatctggtcagggatcgcggca

SEQ ID NO: 174609 - DNA, 25 bp, E. coli
tggtgttttcgatcaggcaggcgtc

SEQ ID NO: 174610 - DNA, 25 bp, E. coli
tggtgttttcgaacaggcaggcgtc

SEQ ID NO: 174611 - DNA, 25 bp, E. coli
tgaaacccgacggacaccaggttaa

SEQ ID NO: 174612 - DNA, 25 bp, E. coli
tgaaacccgacgcacaccaggttaa

SEQ ID NO: 174613 - DNA, 25 bp, E. coli
cctgatgtcaatgccgccactggta

SEQ ID NO: 174614 - DNA, 25 bp, E. coli
ccttcaggatacgatttgtcagcag

SEQ ID NO: 174615 - DNA, 25 bp, E. coli
ccgtcgatggcggagaatttgtcga

SEQ ID NO: 174616 - DNA, 25 bp, E. coli
ccgtcgatggcgcagaatttgtcga

SEQ ID NO: 174617 - DNA, 25 bp, E. coli
cctgatgtcaatcccgccactggta

SEQ ID NO: 174618 - DNA, 25 bp, E. coli
ccttcaggataccatttgtcagcag

SEQ ID NO: 174619 - DNA, 25 bp, E. coli
cgcggtcgttatgtcgagttcaatc

SEQ ID NO: 174620 - DNA, 25 bp, E. coli
cgcggtcgttatctcgagttcaatc

SEQ ID NO: 174621 - DNA, 25 bp, E. coli
ggcaaaggctacaccgacgcttatt

SEQ ID NO: 174622 - DNA, 25 bp, E. coli
ggcaaaggctactccgacgcttatt

SEQ ID NO: 174623 - DNA, 25 bp, E. coli
cagaacttcggtccgtggctgcggg

SEQ ID NO: 174624 - DNA, 25 bp, E. coli
cagaacttcggtgcgtggctgcggg

SEQ ID NO: 174625 - DNA, 25 bp, E. coli
tactcaaacagacggtaatgagtcc

SEQ ID NO: 174626 - DNA, 25 bp, E. coli
tactcaaacagagggtaatgagtcc

SEQ ID NO: 174627 - DNA, 25 bp, E. coli
aagcggctcagctgaacttcggtgc

SEQ ID NO: 174628 - DNA, 25 bp, E. coli
aagcggctcagcagaacttcggtgc

SEQ ID NO: 174629 - DNA, 25 bp, E. coli
tgaactactcaatcagagggtaatg

SEQ ID NO: 174630 - DNA, 25 bp, E. coli
tgaactactcaaacagagggtaatg

SEQ ID NO: 174631 - DNA, 25 bp, E. coli
ccactggttaataatcaggggtgaa

SEQ ID NO: 174632 - DNA, 25 bp, E. coli
ccactggttaattatcaggggtgaa

SEQ ID NO: 174633 - DNA, 25 bp, E. coli
gcggctcagcagaacttcggtgcgt

SEQ ID NO: 174634 - DNA, 25 bp, E. coli
gcggctcagcagtacttcggtgcgt

SEQ ID NO: 174635 - DNA, 25 bp, E. coli
gaactactcaaagagagggtaatga

SEQ ID NO: 174636 - DNA, 25 bp, E. coli
gaactactcaaacagagggtaatga

SEQ ID NO: 174637 - DNA, 25 bp, E. coli
cgggtaagccactggttaataatca

SEQ ID NO: 174638 - DNA, 25 bp, E. coli
cggctcagcagaacttcggtgcgtg

SEQ ID NO: 174639 - DNA, 25 bp, E. coli
ctcagcagaacttcggtgcgtggct

SEQ ID NO: 174640 - DNA, 25 bp, E. coli
cgggtaagccacaggttaataatca

SEQ ID NO: 174641 - DNA, 25 bp, E. coli
cggctcagcagatcttcggtgcgtg

SEQ ID NO: 174642 - DNA, 25 bp, E. coli
ctcagcagaactacggtgcgtggct

SEQ ID NO: 174643 - DNA, 25 bp, E. coli
gtaagccactggttaataatcaggg

SEQ ID NO: 174644 - DNA, 25 bp, E. coli
gtaagccactggataataatcaggg

SEQ ID NO: 174645 - DNA, 25 bp, E. coli
agtgcctttattcgcgcaccagtgc

SEQ ID NO: 174646 - DNA, 25 bp, E. coli
agtgcctttattggcgcaccagtgc

SEQ ID NO: 174647 - DNA, 25 bp, E. coli
acatggcgcgctcgctggtaggtgc

SEQ ID NO: 174648 - DNA, 25 bp, E. coli
acatggcgcgctggctggtaggtgc

SEQ ID NO: 174649 - DNA, 25 bp, E. coli
tagtcagtgcctatattggcgcacc

SEQ ID NO: 174650 - DNA, 25 bp, E. coli
tagtcagtgcctttattggcgcacc

SEQ ID NO: 174651 - DNA, 25 bp, E. coli
gctgatcccggtgcttaccgctgga

SEQ ID NO: 174652 - DNA, 25 bp, E. coli
gcttaccgctggtgcaactgcgcta

SEQ ID NO: 174653 - DNA, 25 bp, E. coli
gcttaccgctggagcaactgcgcta

SEQ ID NO: 174654 - DNA, 25 bp, E. coli
gctgatcccggtccttaccgctgga

SEQ ID NO: 174655 - DNA, 25 bp, E. coli
cgatcctggtttgcttggcgtgaac

SEQ ID NO: 174656 - DNA, 25 bp, E. coli
cgatcctggtttccttggcgtgaac

SEQ ID NO: 174657 - DNA, 25 bp, E. coli
ctttattggcgcaccagtgctgatc

SEQ ID NO: 174658 - DNA, 25 bp, E. coli
ctttattggcgctccagtgctgatc

SEQ ID NO: 174659 - DNA, 25 bp, E. coli
gatcccggtgctaaccgctggagca

SEQ ID NO: 174660 - DNA, 25 bp, E. coli
gtgctcgacgcaggactgccgcgca

SEQ ID NO: 174661 - DNA, 25 bp, E. coli
ggtgcttaccgcaggagcaactgcg

SEQ ID NO: 174662 - DNA, 25 bp, E. coli
ggtgcttaccgctggagcaactgcg

SEQ ID NO: 174663 - DNA, 25 bp, E. coli
gtgctcgacgcacgactgccgcgca

SEQ ID NO: 174664 - DNA, 25 bp, E. coli
tggaagttcgtatgtctggttctgt

SEQ ID NO: 174665 - DNA, 25 bp, E. coli
tggaagttcgtaagtctggttctgt

SEQ ID NO: 174666 - DNA, 25 bp, E. coli
gatcccggtgcttaccgctggagca

SEQ ID NO: 174667 - DNA, 25 bp, E. coli
catcggaaggctgtaaattttttgg

SEQ ID NO: 174668 - DNA, 25 bp, E. coli
catcggaaggctctaaattttttgg

SEQ ID NO: 174669 - DNA, 25 bp, E. coli
tatcgcgtgagttaattgcggcaat

SEQ ID NO: 174670 - DNA, 25 bp, E. coli
tatggataacgatttcatcagtggt

SEQ ID NO: 174671 - DNA, 25 bp, E. coli
tatggataacgaattcatcagtggt

SEQ ID NO: 174672 - DNA, 25 bp, E. coli
tatcgcgtgagtaaattgcggcaat

SEQ ID NO: 174673 - DNA, 25 bp, E. coli
cgatatcggtctcggtctttcctga

SEQ ID NO: 174674 - DNA, 25 bp, E. coli
cgatatcggtctgggtctttcctga

SEQ ID NO: 174675 - DNA, 25 bp, E. coli
ctgatatttcagttgtatcgcgtga

SEQ ID NO: 174676 - DNA, 25 bp, E. coli
ctgatatttcagatgtatcgcgtga

SEQ ID NO: 174677 - DNA, 25 bp, E. coli
gtatctaacagttaaagccgccggg

SEQ ID NO: 174678 - DNA, 25 bp, E. coli
gtatctaacagtaaaagccgccggg

SEQ ID NO: 174679 - DNA, 25 bp, E. coli
gggtctttcctgttactgatatttc

SEQ ID NO: 174680 - DNA, 25 bp, E. coli
gggcattgaaacaccttcggtggaa

SEQ ID NO: 174681 - DNA, 25 bp, E. coli
gggtctttcctgatactgatatttc

SEQ ID NO: 174682 - DNA, 25 bp, E. coli
gggcattgaaactccttcggtggaa

SEQ ID NO: 174683 - DNA, 25 bp, E. coli
taaccaggacatcacgatatcggtc

SEQ ID NO: 174684 - DNA, 25 bp, E. coli
taaccaggacatgacgatatcggtc

SEQ ID NO: 174685 - DNA, 25 bp, E. coli
ggtggaaactccttcggaaggctct

SEQ ID NO: 174686 - DNA, 25 bp, E. coli
gatcgccaacatcgataaccaggac

SEQ ID NO: 174687 - DNA, 25 bp, E. coli
ggtggaaactccatcggaaggctct

SEQ ID NO: 174688 - DNA, 25 bp, E. coli
gatcgccaacatggataaccaggac

SEQ ID NO: 174689 - DNA, 25 bp, E. coli
aatggacggtcacacggcatgaacg

SEQ ID NO: 174690 - DNA, 25 bp, E. coli
aatggacggtcagacggcatgaacg

SEQ ID NO: 174691 - DNA, 25 bp, E. coli
tttatgacggactacaatggacggt

SEQ ID NO: 174692 - DNA, 25 bp, E. coli
tttatgacggacaacaatggacggt

SEQ ID NO: 174693 - DNA, 25 bp, E. coli
tgttttcttcgggataccgcccacg

SEQ ID NO: 174694 - DNA, 25 bp, E. coli
tgtctgatcccttttcccggctggc

SEQ ID NO: 174695 - DNA, 25 bp, E. coli
tgttttcttcggcataccgcccacg

SEQ ID NO: 174696 - DNA, 25 bp, E. coli
tgtctgatccctattcccggctggc

SEQ ID NO: 174697 - DNA, 25 bp, E. coli
tgaatgctctgtgcggacctgcggt

SEQ ID NO: 174698 - DNA, 25 bp, E. coli
tgctatcacggtcagaaagatggga

SEQ ID NO: 174699 - DNA, 25 bp, E. coli
tgaatgctctgtccggacctgcggt

SEQ ID NO: 174700 - DNA, 25 bp, E. coli
tgctatcacggtgagaaagatggga

SEQ ID NO: 174701 - DNA, 25 bp, E. coli
gcatgaacgctttaacggtaagcca

SEQ ID NO: 174702 - DNA, 25 bp, E. coli
gcatgaacgcttaaacggtaagcca

SEQ ID NO: 174703 - DNA, 25 bp, E. coli
gaaagatgggaaagacagcctcgat

SEQ ID NO: 174704 - DNA, 25 bp, E. coli
gaaagatgggaatgacagcctcgat

SEQ ID NO: 174705 - DNA, 25 bp, E. coli
gtgatcccgggagaaacactggcag

SEQ ID NO: 174706 - DNA, 25 bp, E. coli
gtgatcccgggacaaacactggcag

SEQ ID NO: 174707 - DNA, 25 bp, E. coli
tggcagcgcgtaaggatgctatcac

SEQ ID NO: 174708 - DNA, 25 bp, E. coli
tggcagcgcgtatggatgctatcac

SEQ ID NO: 174709 - DNA, 25 bp, E. coli
gatgtcgatatgactgtgatcccgg

SEQ ID NO: 174710 - DNA, 25 bp, E. coli
gatgtcgatatgtctgtgatcccgg

SEQ ID NO: 174711 - DNA, 25 bp, E. coli
cacactgccggagacggttagcgtc

SEQ ID NO: 174712 - DNA, 25 bp, E. coli
cacactgccggacacggttagcgtc

SEQ ID NO: 174713 - DNA, 25 bp, E. coli
cagaatgtgattgatggcggcagca

SEQ ID NO: 174714 - DNA, 25 bp, E. coli
cagaatgtgattcatggcggcagca

SEQ ID NO: 174715 - DNA, 25 bp, E. coli
cagtctggtattggcgttaacgcca

SEQ ID NO: 174716 - DNA, 25 bp, E. coli
cagtctggtattcgcgttaacgcca

SEQ ID NO: 174717 - DNA, 25 bp, E. coli
tctcccctgagatcgaaaagctggc

SEQ ID NO: 174718 - DNA, 25 bp, E. coli
tctcccctgagaacgaaaagctggc

SEQ ID NO: 174719 - DNA, 25 bp, E. coli
gctgccggagatgattgcccgcaaa

SEQ ID NO: 174720 - DNA, 25 bp, E. coli
gctgccggagatcattgcccgcaaa

SEQ ID NO: 174721 - DNA, 25 bp, E. coli
gacagcactgattacgggcgcattg

SEQ ID NO: 174722 - DNA, 25 bp, E. coli
gacagcactgataacgggcgcattg

SEQ ID NO: 174723 - DNA, 25 bp, E. coli
cgaaagcggcgattgttggcctgac

SEQ ID NO: 174724 - DNA, 25 bp, E. coli
cgaaagcggcgaatgttggcctgac

SEQ ID NO: 174725 - DNA, 25 bp, E. coli
ggatgaatccaggtatttaaccggt

SEQ ID NO: 174726 - DNA, 25 bp, E. coli
ggatgaatccagctatttaaccggt

SEQ ID NO: 174727 - DNA, 25 bp, E. coli
ggcggccttcctcgcatcggatgaa

SEQ ID NO: 174728 - DNA, 25 bp, E. coli
ggcggccttcctggcatcggatgaa

SEQ ID NO: 174729 - DNA, 25 bp, E. coli
taacgcaggcgtttgtcgtctgggc

SEQ ID NO: 174730 - DNA, 25 bp, E. coli
taatcttgctggttatctcccctga

SEQ ID NO: 174731 - DNA, 25 bp, E. coli
taacgcaggcgtatgtcgtctgggc

SEQ ID NO: 174732 - DNA, 25 bp, E. coli
taatcttgctggatatctcccctga

SEQ ID NO: 174733 - DNA, 25 bp, E. coli
tattacgataagatccgtcgtccgg

SEQ ID NO: 174734 - DNA, 25 bp, E. coli
tattggcgcgctctataaaatgaac

SEQ ID NO: 174735 - DNA, 25 bp, E. coli
tattacgataagttccgtcgtccgg

SEQ ID NO: 174736 - DNA, 25 bp, E. coli
tattggcgcgctgtataaaatgaac

SEQ ID NO: 174737 - DNA, 25 bp, E. coli
ttgccggacaggaacaaatcccgtg

SEQ ID NO: 174738 - DNA, 25 bp, E. coli
ttagtgaagaaatcgcagctggcgg

SEQ ID NO: 174739 - DNA, 25 bp, E. coli
ttgccggacaggtacaaatcccgtg

SEQ ID NO: 174740 - DNA, 25 bp, E. coli
ttagtgaagaaaacgcagctggcgg

SEQ ID NO: 174741 - DNA, 25 bp, E. coli
tccggtaaacgaccggtcaattgcc

SEQ ID NO: 174742 - DNA, 25 bp, E. coli
tgaacgcctccatctctggcgcgga

SEQ ID NO: 174743 - DNA, 25 bp, E. coli
tgaacgcctccaactctggcgcgga

SEQ ID NO: 174744 - DNA, 25 bp, E. coli
tccggtaaacgagcggtcaattgcc

SEQ ID NO: 174745 - DNA, 25 bp, E. coli
gaaatcgcgatggagcataaccttg

SEQ ID NO: 174746 - DNA, 25 bp, E. coli
gaaatcgcgatgcagcataaccttg

SEQ ID NO: 174747 - DNA, 25 bp, E. coli
cccgtatctggcaagtgatgcatga

SEQ ID NO: 174748 - DNA, 25 bp, E. coli
cgagacgatgtatgaaaccggcaaa

SEQ ID NO: 174749 - DNA, 25 bp, E. coli
cccgtatctggctagtgatgcatga

SEQ ID NO: 174750 - DNA, 25 bp, E. coli
cgagacgatgtaagaaaccggcaaa

SEQ ID NO: 174751 - DNA, 25 bp, E. coli
ggttaactgaacaactgggcggcag

SEQ ID NO: 174752 - DNA, 25 bp, E. coli
ggttaactgaactactgggcggcag

SEQ ID NO: 174753 - DNA, 25 bp, E. coli
ggcaccgcgtgtttcactcgataaa

SEQ ID NO: 174754 - DNA, 25 bp, E. coli
ggcaccgcgtgtatcactcgataaa

SEQ ID NO: 174755 - DNA, 25 bp, E. coli
cactgacgcttcagaatgggaagtc

SEQ ID NO: 174756 - DNA, 25 bp, E. coli
cactgacgcttctgaatgggaagtc

SEQ ID NO: 174757 - DNA, 25 bp, E. coli
tattgccgtgctcgaaccgcgctca

SEQ ID NO: 174758 - DNA, 25 bp, E. coli
tattgccgtgctggaaccgcgctca

SEQ ID NO: 174759 - DNA, 25 bp, E. coli
tgaccactgacgcttctgaatggga

SEQ ID NO: 174760 - DNA, 25 bp, E. coli
tgcggttacaaagcgggatttgtga

SEQ ID NO: 174761 - DNA, 25 bp, E. coli
tgaccactgacggttctgaatggga

SEQ ID NO: 174762 - DNA, 25 bp, E. coli
tgcggttacaaaccgggatttgtga

SEQ ID NO: 174763 - DNA, 25 bp, E. coli
ccgggcgatcacattctggtgatga

SEQ ID NO: 174764 - DNA, 25 bp, E. coli
ccgggcgatcactttctggtgatga

SEQ ID NO: 174765 - DNA, 25 bp, E. coli
gaaccgcgctcaaacaccatgaaaa

SEQ ID NO: 174766 - DNA, 25 bp, E. coli
gaaccgcgctcatacaccatgaaaa

SEQ ID NO: 174767 - DNA, 25 bp, E. coli
gaaaaagctgacgactgacgcttct

SEQ ID NO: 174768 - DNA, 25 bp, E. coli
gaaaaagctgaccactgacgcttct

SEQ ID NO: 174769 - DNA, 25 bp, E. coli
gaacaatgcggtaacaaaccgggat

SEQ ID NO: 174770 - DNA, 25 bp, E. coli
gaacaatgcggttacaaaccgggat

SEQ ID NO: 174771 - DNA, 25 bp, E. coli
ctcagccgggcgatcacattctggt

SEQ ID NO: 174772 - DNA, 25 bp, E. coli
ctcagccgggcgttcacattctggt

SEQ ID NO: 174773 - DNA, 25 bp, E. coli
tcacattctggtcatgagtaacggc

SEQ ID NO: 174774 - DNA, 25 bp, E. coli
tcacattctggtgatgagtaacggc

SEQ ID NO: 174775 - DNA, 25 bp, E. coli
gacgcttctgaaagggaagtcttgc

SEQ ID NO: 174776 - DNA, 25 bp, E. coli
gacgcttctgaatgggaagtcttgc

SEQ ID NO: 174777 - DNA, 25 bp, E. coli
aagataccgcgcctgaggtagttag

SEQ ID NO: 174778 - DNA, 25 bp, E. coli
aagataccgcgcgtgaggtagttag

SEQ ID NO: 174779 - DNA, 25 bp, E. coli
cacggcgtacgtgcggagatcgtgc

SEQ ID NO: 174780 - DNA, 25 bp, E. coli
cacggcgtacgtccggagatcgtgc

SEQ ID NO: 174781 - DNA, 25 bp, E. coli
aggtagttagcctcggcgtacgtgc

SEQ ID NO: 174782 - DNA, 25 bp, E. coli
accgcgcgtgaggtagttagccacg

SEQ ID NO: 174783 - DNA, 25 bp, E. coli
accgcgcgtgagctagttagccacg

SEQ ID NO: 174784 - DNA, 25 bp, E. coli
aggtagttagccacggcgtacgtgc

SEQ ID NO: 174785 - DNA, 25 bp, E. coli
tagccacggcgtacgtgcggagatc

SEQ ID NO: 174786 - DNA, 25 bp, E. coli
tagccacggcgttcgtgcggagatc

SEQ ID NO: 174787 - DNA, 25 bp, E. coli
taccgcgcgtgacgtagttagccac

SEQ ID NO: 174788 - DNA, 25 bp, E. coli
taccgcgcgtgaggtagttagccac

SEQ ID NO: 174789 - DNA, 25 bp, E. coli
ttagccacggcgtacgtgcggagat

SEQ ID NO: 174790 - DNA, 25 bp, E. coli
ttagccacggcgaacgtgcggagat

SEQ ID NO: 174791 - DNA, 25 bp, E. coli
gaagaaggggcaaaagataccgcgc

SEQ ID NO: 174792 - DNA, 25 bp, E. coli
gaagaaggggcataagataccgcgc

SEQ ID NO: 174793 - DNA, 25 bp, E. coli
cgtgaggtagtttgccacggcgtac

SEQ ID NO: 174794 - DNA, 25 bp, E. coli
cgtgaggtagttagccacggcgtac

SEQ ID NO: 174795 - DNA, 25 bp, E. coli
gataccgcgcgtgaggtagttagcc

SEQ ID NO: 174796 - DNA, 25 bp, E. coli
gataccgcgcgtcaggtagttagcc

SEQ ID NO: 174797 - DNA, 25 bp, E. coli
ggatcggcaaagagtgcgcgttatt

SEQ ID NO: 174798 - DNA, 25 bp, E. coli
ggatcggcaaagtgtgcgcgttatt

SEQ ID NO: 174799 - DNA, 25 bp, E. coli
cataccgggcacatcagtgaggagg

SEQ ID NO: 174800 - DNA, 25 bp, E. coli
cataccgggcacttcagtgaggagg

SEQ ID NO: 174801 - DNA, 25 bp, E. coli
tacaactgattatgcgtctgcagca

SEQ ID NO: 174802 - DNA, 25 bp, E. coli
tacaactgattaagcgtctgcagca

SEQ ID NO: 174803 - DNA, 25 bp, E. coli
atttgatggcaatgggcgtctgacg

SEQ ID NO: 174804 - DNA, 25 bp, E. coli
actgattaagcgactgcagcaattc

SEQ ID NO: 174805 - DNA, 25 bp, E. coli
actgattaagcgtctgcagcaattc

SEQ ID NO: 174806 - DNA, 25 bp, E. coli
atttgatggcaaagggcgtctgacg

SEQ ID NO: 174807 - DNA, 25 bp, E. coli
aaatcctttattgcatttgatggca

SEQ ID NO: 174808 - DNA, 25 bp, E. coli
aaatcctttattccatttgatggca

SEQ ID NO: 174809 - DNA, 25 bp, E. coli
gcacagactgcagcttacgatcgct

SEQ ID NO: 174810 - DNA, 25 bp, E. coli
gcacagactgcaccttacgatcgct

SEQ ID NO: 174811 - DNA, 25 bp, E. coli
gactgcaccttaggatcgctacact

SEQ ID NO: 174812 - DNA, 25 bp, E. coli
gactgcaccttacgatcgctacact

SEQ ID NO: 174813 - DNA, 25 bp, E. coli
cgcagggagatacaactgattaagc

SEQ ID NO: 174814 - DNA, 25 bp, E. coli
cccttatgtcagtccggaacgcagg

SEQ ID NO: 174815 - DNA, 25 bp, E. coli
cccttatgtcagaccggaacgcagg

SEQ ID NO: 174816 - DNA, 25 bp, E. coli
cgcagggagatagaactgattaagc

SEQ ID NO: 174817 - DNA, 25 bp, E. coli
gatcgctacactagccacctttgcg

SEQ ID NO: 174818 - DNA, 25 bp, E. coli
gaccggaacgcacggagatacaact

SEQ ID NO: 174819 - DNA, 25 bp, E. coli
gatcgctacacttgccacctttgcg

SEQ ID NO: 174820 - DNA, 25 bp, E. coli
gaccggaacgcagggagatacaact

SEQ ID NO: 174821 - DNA, 25 bp, E. coli
aagtctgaatgcgtggctacaggaa

SEQ ID NO: 174822 - DNA, 25 bp, E. coli
aagtctgaatgcctggctacaggaa

SEQ ID NO: 174823 - DNA, 25 bp, E. coli
cagcaacaaagtctgaatgcctggc

SEQ ID NO: 174824 - DNA, 25 bp, E. coli
caaagtctgaatgcctggctacagg

SEQ ID NO: 174825 - DNA, 25 bp, E. coli
caacaaagtctgtatgcctggctac

SEQ ID NO: 174826 - DNA, 25 bp, E. coli
cagcaacaaagtgtgaatgcctggc

SEQ ID NO: 174827 - DNA, 25 bp, E. coli
caaagtctgaatccctggctacagg

SEQ ID NO: 174828 - DNA, 25 bp, E. coli
caacaaagtctgaatgcctggctac

SEQ ID NO: 174829 - DNA, 25 bp, E. coli
acaaagtctgaaagcctggctacag

SEQ ID NO: 174830 - DNA, 25 bp, E. coli
aacaaagtctgattgcctggctaca

SEQ ID NO: 174831 - DNA, 25 bp, E. coli
acaaagtctgaatgcctggctacag

SEQ ID NO: 174832 - DNA, 25 bp, E. coli
aacaaagtctgaatgcctggctaca

SEQ ID NO: 174833 - DNA, 25 bp, E. coli
tctggcggaagtcgggtttgaagtc

SEQ ID NO: 174834 - DNA, 25 bp, E. coli
tctggcggaagtggggtttgaagtc

SEQ ID NO: 174835 - DNA, 25 bp, E. coli
gcaacaaagtctcaatgcctggcta

SEQ ID NO: 174836 - DNA, 25 bp, E. coli
gcaacaaagtctgaatgcctggcta

SEQ ID NO: 174837 - DNA, 25 bp, E. coli
cgacctggcgggttatctctcactg

SEQ ID NO: 174838 - DNA, 25 bp, E. coli
cgacctggcgggatatctctcactg

SEQ ID NO: 174839 - DNA, 25 bp, E. coli
gtctgaatgcctcgctacaggaaca

SEQ ID NO: 174840 - DNA, 25 bp, E. coli
gtctgaatgcctggctacaggaaca

SEQ ID NO: 174841 - DNA, 25 bp, E. coli
gacctggcgggttatctctcactgt

SEQ ID NO: 174842 - DNA, 25 bp, E. coli
gacctggcgggtaatctctcactgt

SEQ ID NO: 174843 - DNA, 25 bp, E. coli
caatcagcgttcagcaggtcgcaaa

SEQ ID NO: 174844 - DNA, 25 bp, E. coli
caatcagcgttctgcaggtcgcaaa

SEQ ID NO: 174845 - DNA, 25 bp, E. coli
catcacgaacatcgcgagtatcagg

SEQ ID NO: 174846 - DNA, 25 bp, E. coli
catcacgaacatggcgagtatcagg

SEQ ID NO: 174847 - DNA, 25 bp, E. coli
acatggcttcatgggcataatgcga

SEQ ID NO: 174848 - DNA, 25 bp, E. coli
acatggcttcatcggcataatgcga

SEQ ID NO: 174849 - DNA, 25 bp, E. coli
tatatgggcgtagatggcttcatgg

SEQ ID NO: 174850 - DNA, 25 bp, E. coli
tatatgggcgtacatggcttcatgg

SEQ ID NO: 174851 - DNA, 25 bp, E. coli
gcgttaacgcttgtcaccgtaggcg

SEQ ID NO: 174852 - DNA, 25 bp, E. coli
gcttgtcaccgttggcgttggcgca

SEQ ID NO: 174853 - DNA, 25 bp, E. coli
gcgttaacgcttctcaccgtaggcg

SEQ ID NO: 174854 - DNA, 25 bp, E. coli
gcgttcagcaggacgcaaaacgctg

SEQ ID NO: 174855 - DNA, 25 bp, E. coli
gcagcaatcagcgttcagcaggtcg

SEQ ID NO: 174856 - DNA, 25 bp, E. coli
gcgttcagcaggtcgcaaaacgctg

SEQ ID NO: 174857 - DNA, 25 bp, E. coli
gcttgtcaccgtaggcgttggcgca

SEQ ID NO: 174858 - DNA, 25 bp, E. coli
gcagcaatcagccttcagcaggtcg

SEQ ID NO: 174859 - DNA, 25 bp, E. coli
cgaacatggcgactatcaggatgcc

SEQ ID NO: 174860 - DNA, 25 bp, E. coli
cgaacatggcgagtatcaggatgcc

SEQ ID NO: 174861 - DNA, 25 bp, E. coli
tggacatcatcaccatcacgaacat

SEQ ID NO: 174862 - DNA, 25 bp, E. coli
tggacatcatcagcatcacgaacat

SEQ ID NO: 174863 - DNA, 25 bp, E. coli
ggcctggcgttatcgcttgtcaccg

SEQ ID NO: 174864 - DNA, 25 bp, E. coli
ggcctggcgttaacgcttgtcaccg

SEQ ID NO: 174865 - DNA, 25 bp, E. coli
caacggttgcggtgagtacttcgca

SEQ ID NO: 174866 - DNA, 25 bp, E. coli
caacggttgcggagagtacttcgca

SEQ ID NO: 174867 - DNA, 25 bp, E. coli
acgcttcttgcgcagtgggcagaca

SEQ ID NO: 174868 - DNA, 25 bp, E. coli
aactgtttgaatcaacggttgcgga

SEQ ID NO: 174869 - DNA, 25 bp, E. coli
aactgtttgaatgaacggttgcgga

SEQ ID NO: 174870 - DNA, 25 bp, E. coli
acgcttcttgcggagtgggcagaca

SEQ ID NO: 174871 - DNA, 25 bp, E. coli
gcttcttgcgcagtgggcagacaga

SEQ ID NO: 174872 - DNA, 25 bp, E. coli
gcttcttgcgcactgggcagacaga

SEQ ID NO: 174873 - DNA, 25 bp, E. coli
gcggacgttactcacgaccgcgttg

SEQ ID NO: 174874 - DNA, 25 bp, E. coli
gcggacgttactgacgaccgcgttg

SEQ ID NO: 174875 - DNA, 25 bp, E. coli
gaatcaacggttgcggagagtactt

SEQ ID NO: 174876 - DNA, 25 bp, E. coli
gaatcaacggttccggagagtactt

SEQ ID NO: 174877 - DNA, 25 bp, E. coli
ctgtttgaatcatcggttgcggaga

SEQ ID NO: 174878 - DNA, 25 bp, E. coli
ctgtttgaatcaacggttgcggaga

SEQ ID NO: 174879 - DNA, 25 bp, E. coli
cggagagtacttggcaaatgcaacc

SEQ ID NO: 174880 - DNA, 25 bp, E. coli
cggagagtacttcgcaaatgcaacc

SEQ ID NO: 174881 - DNA, 25 bp, E. coli
gtacttcgcaaatgcaaccggacag

SEQ ID NO: 174882 - DNA, 25 bp, E. coli
gtacttcgcaaaagcaaccggacag

SEQ ID NO: 174883 - DNA, 25 bp, E. coli
gagtacttcgcaaatgcaaccggac

SEQ ID NO: 174884 - DNA, 25 bp, E. coli
gagtacttcgcatatgcaaccggac

SEQ ID NO: 174885 - DNA, 25 bp, E. coli
gagagtacttcggaaatgcaaccgg

SEQ ID NO: 174886 - DNA, 25 bp, E. coli
gagagtacttcgcaaatgcaaccgg

SEQ ID NO: 174887 - DNA, 25 bp, E. coli
aatggcgtcgtattccggatgttgc

SEQ ID NO: 174888 - DNA, 25 bp, E. coli
aatggcgtcgtaatccggatgttgc

SEQ ID NO: 174889 - DNA, 25 bp, E. coli
cataatggcgtcctattccggatgt

SEQ ID NO: 174890 - DNA, 25 bp, E. coli
cataatggcgtcgtattccggatgt

SEQ ID NO: 174891 - DNA, 25 bp, E. coli
ataatggcgtcgtattccggatgtt

SEQ ID NO: 174892 - DNA, 25 bp, E. coli
atggcgtcgtattccggatgttgca

SEQ ID NO: 174893 - DNA, 25 bp, E. coli
atggcgtcgtataccggatgttgca

SEQ ID NO: 174894 - DNA, 25 bp, E. coli
ataatggcgtcgaattccggatgtt

SEQ ID NO: 174895 - DNA, 25 bp, E. coli
tcgtattccggatgttgcagggcgt

SEQ ID NO: 174896 - DNA, 25 bp, E. coli
tcgtattccggaagttgcagggcgt

SEQ ID NO: 174897 - DNA, 25 bp, E. coli
cgtattccggatcttgcagggcgta

SEQ ID NO: 174898 - DNA, 25 bp, E. coli
cgtattccggatgttgcagggcgta

SEQ ID NO: 174899 - DNA, 25 bp, E. coli
cgtcgtattccggatgttgcagggc

SEQ ID NO: 174900 - DNA, 25 bp, E. coli
cgtcgtattccgcatgttgcagggc

SEQ ID NO: 174901 - DNA, 25 bp, E. coli
gtcgtattccggttgttgcagggcg

SEQ ID NO: 174902 - DNA, 25 bp, E. coli
gtcgtattccggatgttgcagggcg

SEQ ID NO: 174903 - DNA, 25 bp, E. coli
tggcgtcgtattgcggatgttgcag

SEQ ID NO: 174904 - DNA, 25 bp, E. coli
tggcgtcgtattccggatgttgcag

SEQ ID NO: 174905 - DNA, 25 bp, E. coli
taatggcgtcgtattccggatgttg

SEQ ID NO: 174906 - DNA, 25 bp, E. coli
taatggcgtcgttttccggatgttg

SEQ ID NO: 174907 - DNA, 25 bp, E. coli
caattgccgatgatatgccgtgcgc

SEQ ID NO: 174908 - DNA, 25 bp, E. coli
aatgcatatcgcgagccagctatgc

SEQ ID NO: 174909 - DNA, 25 bp, E. coli
aatgcatatcgccagccagctatgc

SEQ ID NO: 174910 - DNA, 25 bp, E. coli
caattgccgatgttatgccgtgcgc

SEQ ID NO: 174911 - DNA, 25 bp, E. coli
tatgccgtgcgccttaatgggcgat

SEQ ID NO: 174912 - DNA, 25 bp, E. coli
tatgccgtgcgcgttaatgggcgat

SEQ ID NO: 174913 - DNA, 25 bp, E. coli
tgatcaatcgctggatgtatcgcaa

SEQ ID NO: 174914 - DNA, 25 bp, E. coli
tgatcaatcgctcgatgtatcgcaa

SEQ ID NO: 174915 - DNA, 25 bp, E. coli
tactgacgaagggtacattatcctg

SEQ ID NO: 174916 - DNA, 25 bp, E. coli
tactgacgaaggctacattatcctg

SEQ ID NO: 174917 - DNA, 25 bp, E. coli
gcaagtcaataaagatcaatcgctg

SEQ ID NO: 174918 - DNA, 25 bp, E. coli
gcaagtcaataatgatcaatcgctg

SEQ ID NO: 174919 - DNA, 25 bp, E. coli
gacgtattcgtctggttataaccaa

SEQ ID NO: 174920 - DNA, 25 bp, E. coli
gacgtattcgtcaggttataaccaa

SEQ ID NO: 174921 - DNA, 25 bp, E. coli
gacaacttccgcaggagcgacccag

SEQ ID NO: 174922 - DNA, 25 bp, E. coli
gacaacttccgctggagcgacccag

SEQ ID NO: 174923 - DNA, 25 bp, E. coli
cgatccacgacgtattcgtcaggtt

SEQ ID NO: 174924 - DNA, 25 bp, E. coli
cgatccacgacgaattcgtcaggtt

SEQ ID NO: 174925 - DNA, 25 bp, E. coli
ggcgaataatgccacaacttccgct

SEQ ID NO: 174926 - DNA, 25 bp, E. coli
ggcgaataatgcgacaacttccgct

SEQ ID NO: 174927 - DNA, 25 bp, E. coli
taatgcgacaacttccgctggagcg

SEQ ID NO: 174928 - DNA, 25 bp, E. coli
taatgcgacaacatccgctggagcg

SEQ ID NO: 174929 - DNA, 25 bp, E. coli
tatagcccaacggaattggcgaatg

SEQ ID NO: 174930 - DNA, 25 bp, E. coli
tatagcccaacgcaattggcgaatg

SEQ ID NO: 174931 - DNA, 25 bp, E. coli
ttggcgaatgcattgaaactggttc

SEQ ID NO: 174932 - DNA, 25 bp, E. coli
ttggcgaatgcaatgaaactggttc

SEQ ID NO: 174933 - DNA, 25 bp, E. coli
tgagctttcagaagatctatagccc

SEQ ID NO: 174934 - DNA, 25 bp, E. coli
tgagctttcagatgatctatagccc

SEQ ID NO: 174935 - DNA, 25 bp, E. coli
tcagaagatctaaagcccaacgcaa

SEQ ID NO: 174936 - DNA, 25 bp, E. coli
tcagaagatctatagcccaacgcaa

SEQ ID NO: 174937 - DNA, 25 bp, E. coli
gctatgcgacgcgaaaaatgcctcg

SEQ ID NO: 174938 - DNA, 25 bp, E. coli
gctatgcgacgccaaaaatgcctcg

SEQ ID NO: 174939 - DNA, 25 bp, E. coli
gaactctcaatgtcgctatgcgacg

SEQ ID NO: 174940 - DNA, 25 bp, E. coli
gaactctcaatgacgctatgcgacg

SEQ ID NO: 174941 - DNA, 25 bp, E. coli
cgacgcgaaaaatgcctcgccagaa

SEQ ID NO: 174942 - DNA, 25 bp, E. coli
cgacgcgaaaaaagcctcgccagaa

SEQ ID NO: 174943 - DNA, 25 bp, E. coli
cgctcacgacatattttaagatttt

SEQ ID NO: 174944 - DNA, 25 bp, E. coli
cgctcacgacattttttaagatttt

SEQ ID NO: 174945 - DNA, 25 bp, E. coli
taagattttacagtcgcttgaactc

SEQ ID NO: 174946 - DNA, 25 bp, E. coli
tacagtcgcttgaactctcaatgac

SEQ ID NO: 174947 - DNA, 25 bp, E. coli
tcaatgacgctatgcgacgcgaaaa

SEQ ID NO: 174948 - DNA, 25 bp, E. coli
tcaatgacgctaagcgacgcgaaaa

SEQ ID NO: 174949 - DNA, 25 bp, E. coli
taagattttacactcgcttgaactc

SEQ ID NO: 174950 - DNA, 25 bp, E. coli
tacagtcgcttgtactctcaatgac

SEQ ID NO: 174951 - DNA, 25 bp, E. coli
tacgtaaattcgacgcgcttgaagc

SEQ ID NO: 174952 - DNA, 25 bp, E. coli
aaacaaatgctgtgtacctggtacg

SEQ ID NO: 174953 - DNA, 25 bp, E. coli
aaacaaatgctgagtacctggtacg

SEQ ID NO: 174954 - DNA, 25 bp, E. coli
tacgtaaattcgtcgcgcttgaagc

SEQ ID NO: 174955 - DNA, 25 bp, E. coli
tttcttcgcgggtaatgtgtaccgc

SEQ ID NO: 174956 - DNA, 25 bp, E. coli
tttcttcgcgggaaatgtgtaccgc

SEQ ID NO: 174957 - DNA, 25 bp, E. coli
ttgatgctaacggagaaggctggct

SEQ ID NO: 174958 - DNA, 25 bp, E. coli
ttgatgctaacgcagaaggctggct

SEQ ID NO: 174959 - DNA, 25 bp, E. coli
tgtgtaccgcgacatctgaaagtga

SEQ ID NO: 174960 - DNA, 25 bp, E. coli
tgtgtaccgcgagatctgaaagtga

SEQ ID NO: 174961 - DNA, 25 bp, E. coli
gcttgaagctaattgtgcggcactg

SEQ ID NO: 174962 - DNA, 25 bp, E. coli
gcttgaagctaaatgtgcggcactg

SEQ ID NO: 174963 - DNA, 25 bp, E. coli
gaaaccggagaatggcagtggacat

SEQ ID NO: 174964 - DNA, 25 bp, E. coli
gaaaccggagaaaggcagtggacat

SEQ ID NO: 174965 - DNA, 25 bp, E. coli
gaaaacgtcaatttcactcactggg

SEQ ID NO: 174966 - DNA, 25 bp, E. coli
gaaaacgtcaatatcactcactggg

SEQ ID NO: 174967 - DNA, 25 bp, E. coli
tggcgttctctcaggtacacctggg

SEQ ID NO: 174968 - DNA, 25 bp, E. coli
tggcgttctctctggtacacctggg

SEQ ID NO: 174969 - DNA, 25 bp, E. coli
taataccagtgtgagctgaactgcc

SEQ ID NO: 174970 - DNA, 25 bp, E. coli
taatgccaaaaggaccggaggctgg

SEQ ID NO: 174971 - DNA, 25 bp, E. coli
taatgccaaaagcaccggaggctgg

SEQ ID NO: 174972 - DNA, 25 bp, E. coli
taataccagtgtcagctgaactgcc

SEQ ID NO: 174973 - DNA, 25 bp, E. coli
tttgaaacctatgccattgccagcg

SEQ ID NO: 174974 - DNA, 25 bp, E. coli
ttcgtgaacttctttgccgccagcg

SEQ ID NO: 174975 - DNA, 25 bp, E. coli
tttgaaacctatcccattgccagcg

SEQ ID NO: 174976 - DNA, 25 bp, E. coli
ttcgtgaacttcattgccgccagcg

SEQ ID NO: 174977 - DNA, 25 bp, E. coli
tggtttctgacatcgcgtatgcggc

SEQ ID NO: 174978 - DNA, 25 bp, E. coli
tgccgccagcgtaattgggatacct

SEQ ID NO: 174979 - DNA, 25 bp, E. coli
tgccgccagcgttattgggatacct

SEQ ID NO: 174980 - DNA, 25 bp, E. coli
tctccggtgtttctgcaggtctggc

SEQ ID NO: 174981 - DNA, 25 bp, E. coli
tctccggtgtttgtgcaggtctggc

SEQ ID NO: 174982 - DNA, 25 bp, E. coli
gcgaagcgagcgtgaagaaaccgtt

SEQ ID NO: 174983 - DNA, 25 bp, E. coli
gcgaagcgagcgagaagaaaccgtt

SEQ ID NO: 174984 - DNA, 25 bp, E. coli
gcaacatctacggactgggcggcaa

SEQ ID NO: 174985 - DNA, 25 bp, E. coli
gcaacatctacgcactgggcggcaa

SEQ ID NO: 174986 - DNA, 25 bp, E. coli
cggattaattatcgcggctgtcgcc

SEQ ID NO: 174987 - DNA, 25 bp, E. coli
cggattaattatggcggctgtcgcc

SEQ ID NO: 174988 - DNA, 25 bp, E. coli
gattggcgggttgatcatcggcacc

SEQ ID NO: 174989 - DNA, 25 bp, E. coli
gattctggcgctatccggtatggtg

SEQ ID NO: 174990 - DNA, 25 bp, E. coli
gattggcgggttcatcatcggcacc

SEQ ID NO: 174991 - DNA, 25 bp, E. coli
gattctggcgctttccggtatggtg

SEQ ID NO: 174992 - DNA, 25 bp, E. coli
ggcaccagtttcatcggcggcaagg

SEQ ID NO: 174993 - DNA, 25 bp, E. coli
ggcaccagtttcttcggcggcaagg

SEQ ID NO: 174994 - DNA, 25 bp, E. coli
tggtttctgacaacgcgtatgcggc

SEQ ID NO: 174995 - DNA, 25 bp, E. coli
caaatctacatagagacacgcccta

SEQ ID NO: 174996 - DNA, 25 bp, E. coli
caaatctacatacagacacgcccta

SEQ ID NO: 174997 - DNA, 25 bp, E. coli
agttaagtagaaaccgcggcgacca

SEQ ID NO: 174998 - DNA, 25 bp, E. coli
agttaagtagaatccgcggcgacca

SEQ ID NO: 174999 - DNA, 25 bp, E. coli
tatcagaagggtactataaagcgtt

SEQ ID NO: 175000 - DNA, 25 bp, E. coli
tatcagaagggttctataaagcgtt

SEQ ID NO: 175001 - DNA, 25 bp, E. coli
tgtctcgggcaggaaagttaagtag

SEQ ID NO: 175002 - DNA, 25 bp, E. coli
tgtctcgggcagcaaagttaagtag

SEQ ID NO: 175003 - DNA, 25 bp, E. coli
tcaccccagggttaactattatcag

SEQ ID NO: 175004 - DNA, 25 bp, E. coli
tcaccccagggtaaactattatcag

SEQ ID NO: 175005 - DNA, 25 bp, E. coli
gcggcgaccattcgacaaaagaggt

SEQ ID NO: 175006 - DNA, 25 bp, E. coli
gcggcgaccattggacaaaagaggt

SEQ ID NO: 175007 - DNA, 25 bp, E. coli
gacacgccctattatcatctatttt

SEQ ID NO: 175008 - DNA, 25 bp, E. coli
gaaatgagtgctgtctcgggcagca

SEQ ID NO: 175009 - DNA, 25 bp, E. coli
gtttaaattagtttcgatgaccgcg

SEQ ID NO: 175010 - DNA, 25 bp, E. coli
gtttaaattagtatcgatgaccgcg

SEQ ID NO: 175011 - DNA, 25 bp, E. coli
gaaatgagtgctctctcgggcagca

SEQ ID NO: 175012 - DNA, 25 bp, E. coli
gacacgccctataatcatctatttt

SEQ ID NO: 175013 - DNA, 25 bp, E. coli
cgatgaccgcgatatgagtgctgtc

SEQ ID NO: 175014 - DNA, 25 bp, E. coli
cgatgaccgcgaaatgagtgctgtc

SEQ ID NO: 175015 - DNA, 25 bp, E. coli
taaagcgttgtcgaacaaatctaca

SEQ ID NO: 175016 - DNA, 25 bp, E. coli
taaagcgttgtccaacaaatctaca

SEQ ID NO: 175017 - DNA, 25 bp, E. coli
aggcccttcaggctaactccatggg

SEQ ID NO: 175018 - DNA, 25 bp, E. coli
aggcccttcagggtaactccatggg

SEQ ID NO: 175019 - DNA, 25 bp, E. coli
tagtattcgctgaccccattgcaag

SEQ ID NO: 175020 - DNA, 25 bp, E. coli
tagtattcgctgtccccattgcaag

SEQ ID NO: 175021 - DNA, 25 bp, E. coli
tatctacagacctatcataaaggca

SEQ ID NO: 175022 - DNA, 25 bp, E. coli
tatctacagaccaatcataaaggca

SEQ ID NO: 175023 - DNA, 25 bp, E. coli
ttttgaaatttatcggtggcagccg

SEQ ID NO: 175024 - DNA, 25 bp, E. coli
ttttgaaatttaacggtggcagccg

SEQ ID NO: 175025 - DNA, 25 bp, E. coli
tgaatcctccatacttgaactgact

SEQ ID NO: 175026 - DNA, 25 bp, E. coli
tgaatcctccattcttgaactgact

SEQ ID NO: 175027 - DNA, 25 bp, E. coli
tgaactgactttttatcctccgact

SEQ ID NO: 175028 - DNA, 25 bp, E. coli
tgaactgactttatatcctccgact

SEQ ID NO: 175029 - DNA, 25 bp, E. coli
tcggtggcagcccttagtattcgct

SEQ ID NO: 175030 - DNA, 25 bp, E. coli
tcggtggcagccgttagtattcgct

SEQ ID NO: 175031 - DNA, 25 bp, E. coli
gaattacggacattgaggcccttca

SEQ ID NO: 175032 - DNA, 25 bp, E. coli
gaattacggacaatgaggcccttca

SEQ ID NO: 175033 - DNA, 25 bp, E. coli
cattgcaagctcctggtggtaacca

SEQ ID NO: 175034 - DNA, 25 bp, E. coli
cattgcaagctcgtggtggtaacca

SEQ ID NO: 175035 - DNA, 25 bp, E. coli
ggtggtaaccactgaatcctccata

SEQ ID NO: 175036 - DNA, 25 bp, E. coli
gtacaacatttcgtacataagtagg

SEQ ID NO: 175037 - DNA, 25 bp, E. coli
ggtggtaaccacagaatcctccata

SEQ ID NO: 175038 - DNA, 25 bp, E. coli
gtacaacatttcctacataagtagg

SEQ ID NO: 175039 - DNA, 25 bp, E. coli
aagttggactcatcataccagaggg

SEQ ID NO: 175040 - DNA, 25 bp, E. coli
aagttggactcaacataccagaggg

SEQ ID NO: 175041 - DNA, 25 bp, E. coli
cactcctgcctgtccgttaagcttt

SEQ ID NO: 175042 - DNA, 25 bp, E. coli
cactcctgcctgaccgttaagcttt

SEQ ID NO: 175043 - DNA, 25 bp, E. coli
catctctttccccttgactatcaag

SEQ ID NO: 175044 - DNA, 25 bp, E. coli
catctctttcccgttgactatcaag

SEQ ID NO: 175045 - DNA, 25 bp, E. coli
actatcaagacttgcctcactcctg

SEQ ID NO: 175046 - DNA, 25 bp, E. coli
actatcaagactagcctcactcctg

SEQ ID NO: 175047 - DNA, 25 bp, E. coli
tacgctgatagctgacaaaaagaag

SEQ ID NO: 175048 - DNA, 25 bp, E. coli
taccagagggcttactacgctgata

SEQ ID NO: 175049 - DNA, 25 bp, E. coli
taccagagggctaactacgctgata

SEQ ID NO: 175050 - DNA, 25 bp, E. coli
tacgctgatagcagacaaaaagaag

SEQ ID NO: 175051 - DNA, 25 bp, E. coli
tgagatttccattacacagcaaaac

SEQ ID NO: 175052 - DNA, 25 bp, E. coli
tgagatttccataacacagcaaaac

SEQ ID NO: 175053 - DNA, 25 bp, E. coli
gcctgaccgttatgctttgcgttta

SEQ ID NO: 175054 - DNA, 25 bp, E. coli
gcctgaccgttaagctttgcgttta

SEQ ID NO: 175055 - DNA, 25 bp, E. coli
gaagaaaaagggatcaaggcttcat

SEQ ID NO: 175056 - DNA, 25 bp, E. coli
gaagaaaaagggttcaaggcttcat

SEQ ID NO: 175057 - DNA, 25 bp, E. coli
ggatcaaggcttcattttccgcatc

SEQ ID NO: 175058 - DNA, 25 bp, E. coli
ggatcaaggcttgattttccgcatc

SEQ ID NO: 175059 - DNA, 25 bp, E. coli
taacacagcaaatcaaagttggact

SEQ ID NO: 175060 - DNA, 25 bp, E. coli
taacacagcaaaacaaagttggact

SEQ ID NO: 175061 - DNA, 25 bp, E. coli
caacccggatgtgttaatgctcgca

SEQ ID NO: 175062 - DNA, 25 bp, E. coli
caacccggatgtcttaatgctcgca

SEQ ID NO: 175063 - DNA, 25 bp, E. coli
cagatttgccgttaacctggatgcc

SEQ ID NO: 175064 - DNA, 25 bp, E. coli
cagatttgccgtaaacctggatgcc

SEQ ID NO: 175065 - DNA, 25 bp, E. coli
ttattttggcaacgagtcaccgaca

SEQ ID NO: 175066 - DNA, 25 bp, E. coli
ttattttggcaaggagtcaccgaca

SEQ ID NO: 175067 - DNA, 25 bp, E. coli
tgctcgcacggatgaaaaatgatgg

SEQ ID NO: 175068 - DNA, 25 bp, E. coli
tgctcgcacggaagaaaaatgatgg

SEQ ID NO: 175069 - DNA, 25 bp, E. coli
tcctgctgacggcagcaccaatact

SEQ ID NO: 175070 - DNA, 25 bp, E. coli
tcctgctgacgggagcaccaatact

SEQ ID NO: 175071 - DNA, 25 bp, E. coli
cctggatgccttatcgcgtagcggt

SEQ ID NO: 175072 - DNA, 25 bp, E. coli
cctggatgccttttcgcgtagcggt

SEQ ID NO: 175073 - DNA, 25 bp, E. coli
gctatcagggccaccaaagttatgt

SEQ ID NO: 175074 - DNA, 25 bp, E. coli
gctatcagggcctccaaagttatgt

SEQ ID NO: 175075 - DNA, 25 bp, E. coli
gaacaatatccgacaaaggcgttat

SEQ ID NO: 175076 - DNA, 25 bp, E. coli
gaacaatatccgtcaaaggcgttat

SEQ ID NO: 175077 - DNA, 25 bp, E. coli
ccgagtgcattaatggtagcgcctt

SEQ ID NO: 175078 - DNA, 25 bp, E. coli
ccgagtgcattattggtagcgcctt

SEQ ID NO: 175079 - DNA, 25 bp, E. coli
ggtattgtcagtaacacccgctggc

SEQ ID NO: 175080 - DNA, 25 bp, E. coli
ggtattgtcagttacacccgctggc

SEQ ID NO: 175081 - DNA, 25 bp, E. coli
taattgccgaacaaaataccgagtg

SEQ ID NO: 175082 - DNA, 25 bp, E. coli
taattgccgaactaaataccgagtg

SEQ ID NO: 175083 - DNA, 25 bp, E. coli
cacgatcaaaagttggcggatgcca

SEQ ID NO: 175084 - DNA, 25 bp, E. coli
cacgatcaaaagatggcggatgcca

SEQ ID NO: 175085 - DNA, 25 bp, E. coli
tacacagctgaacatatgatgcgcg

SEQ ID NO: 175086 - DNA, 25 bp, E. coli
tacacagctgaagatatgatgcgcg

SEQ ID NO: 175087 - DNA, 25 bp, E. coli
tatgatgcgcgcaggtcgtgacgtc

SEQ ID NO: 175088 - DNA, 25 bp, E. coli
tatgcgcacggaactggaagggatt

SEQ ID NO: 175089 - DNA, 25 bp, E. coli
tagcgcattgccagaaggctccgtg

SEQ ID NO: 175090 - DNA, 25 bp, E. coli
tatgatgcgcgctggtcgtgacgtc

SEQ ID NO: 175091 - DNA, 25 bp, E. coli
tatgcgcacggatctggaagggatt

SEQ ID NO: 175092 - DNA, 25 bp, E. coli
tagcgcattgcctgaaggctccgtg

SEQ ID NO: 175093 - DNA, 25 bp, E. coli
ttttaatgattcgaccctgctggcg

SEQ ID NO: 175094 - DNA, 25 bp, E. coli
ttttaatgattccaccctgctggcg

SEQ ID NO: 175095 - DNA, 25 bp, E. coli
tggtcactaaagtagcgcattgcct

SEQ ID NO: 175096 - DNA, 25 bp, E. coli
tgaatgacaatcaggacgaaggccc

SEQ ID NO: 175097 - DNA, 25 bp, E. coli
tgaatgacaatctggacgaaggccc

SEQ ID NO: 175098 - DNA, 25 bp, E. coli
gtgaagattattggcgcaaccgctc

SEQ ID NO: 175099 - DNA, 25 bp, E. coli
gtgaagattattcgcgcaaccgctc

SEQ ID NO: 175100 - DNA, 25 bp, E. coli
tggtcactaaagaagcgcattgcct

SEQ ID NO: 175101 - DNA, 25 bp, E. coli
gacgaaggcccaatcatcatgcagg

SEQ ID NO: 175102 - DNA, 25 bp, E. coli
gaccaaaaaggtctgatcgcacgta

SEQ ID NO: 175103 - DNA, 25 bp, E. coli
gacgaaggcccattcatcatgcagg

SEQ ID NO: 175104 - DNA, 25 bp, E. coli
gaccaaaaaggtgtgatcgcacgta

SEQ ID NO: 175105 - DNA, 25 bp, E. coli
cactccgccctgtatatgtggtccg

SEQ ID NO: 175106 - DNA, 25 bp, E. coli
cactccgccctgaatatgtggtccg

SEQ ID NO: 175107 - DNA, 25 bp, E. coli
tataaactggaaacgaaacctgatc

SEQ ID NO: 175108 - DNA, 25 bp, E. coli
tataaactggaatcgaaacctgatc

SEQ ID NO: 175109 - DNA, 25 bp, E. coli
tacgttgagcagcttggcgttaccg

SEQ ID NO: 175110 - DNA, 25 bp, E. coli
aaacctgatcgtcgcctggctaggc

SEQ ID NO: 175111 - DNA, 25 bp, E. coli
aaacctgatcgtggcctggctaggc

SEQ ID NO: 175112 - DNA, 25 bp, E. coli
tacccctctacgatgagcagcttgg

SEQ ID NO: 175113 - DNA, 25 bp, E. coli
tacccctctacgttgagcagcttgg

SEQ ID NO: 175114 - DNA, 25 bp, E. coli
tacgttgagcaggttggcgttaccg

SEQ ID NO: 175115 - DNA, 25 bp, E. coli
tgacacccctattaactggaaacga

SEQ ID NO: 175116 - DNA, 25 bp, E. coli
tgacacccctataaactggaaacga

SEQ ID NO: 175117 - DNA, 25 bp, E. coli
gcctggctaggcagttttcttaccg

SEQ ID NO: 175118 - DNA, 25 bp, E. coli
gcctggctaggctgttttcttaccg

SEQ ID NO: 175119 - DNA, 25 bp, E. coli
gcgtggcggctctgctaagtgcacc

SEQ ID NO: 175120 - DNA, 25 bp, E. coli
gcgtggcggctcagctaagtgcacc

SEQ ID NO: 175121 - DNA, 25 bp, E. coli
gttttcttaccgctgccgccttcag

SEQ ID NO: 175122 - DNA, 25 bp, E. coli
gtcaccctgtgaaaatgacacccct

SEQ ID NO: 175123 - DNA, 25 bp, E. coli
gttttcttaccggtgccgccttcag

SEQ ID NO: 175124 - DNA, 25 bp, E. coli
gtcaccctgtgataatgacacccct

SEQ ID NO: 175125 - DNA, 25 bp, E. coli
tggtaatgcccttcttacccctcta

SEQ ID NO: 175126 - DNA, 25 bp, E. coli
tggtaatgccctacttacccctcta

SEQ ID NO: 175127 - DNA, 25 bp, E. coli
taaatgatacttgtctgaaaaacag

SEQ ID NO: 175128 - DNA, 25 bp, E. coli
taaatgatacttctctgaaaaacag

SEQ ID NO: 175129 - DNA, 25 bp, E. coli
aagtaaaccccgctatagttatgct

SEQ ID NO: 175130 - DNA, 25 bp, E. coli
agtagcgctctggaaagtaaacccc

SEQ ID NO: 175131 - DNA, 25 bp, E. coli
agtagcgctctgcaaagtaaacccc

SEQ ID NO: 175132 - DNA, 25 bp, E. coli
aagtaaaccccggtatagttatgct

SEQ ID NO: 175133 - DNA, 25 bp, E. coli
tatgttcgctgaatttaagcaccga

SEQ ID NO: 175134 - DNA, 25 bp, E. coli
tatgttcgctgattttaagcaccga

SEQ ID NO: 175135 - DNA, 25 bp, E. coli
tatcatggccttatgaacgctgaaa

SEQ ID NO: 175136 - DNA, 25 bp, E. coli
tatcatggccttttgaacgctgaaa

SEQ ID NO: 175137 - DNA, 25 bp, E. coli
tgaacgctgaaatgtagcgctctgc

SEQ ID NO: 175138 - DNA, 25 bp, E. coli
tgaacgctgaaaagtagcgctctgc

SEQ ID NO: 175139 - DNA, 25 bp, E. coli
tccggtcttttagcaaataatgaag

SEQ ID NO: 175140 - DNA, 25 bp, E. coli
tctgaaaaacagatttacgacgata

SEQ ID NO: 175141 - DNA, 25 bp, E. coli
tctgaaaaacagttttacgacgata

SEQ ID NO: 175142 - DNA, 25 bp, E. coli
tccctccctggaagataattgtaaa

SEQ ID NO: 175143 - DNA, 25 bp, E. coli
tccggtcttttaccaaataatgaag

SEQ ID NO: 175144 - DNA, 25 bp, E. coli
tccctccctggatgataattgtaaa

SEQ ID NO: 175145 - DNA, 25 bp, E. coli
taatgaagaataatccctccctgga

SEQ ID NO: 175146 - DNA, 25 bp, E. coli
taatgaagaatattccctccctgga

SEQ ID NO: 175147 - DNA, 25 bp, E. coli
taagcaccgagactatccggtcttt

SEQ ID NO: 175148 - DNA, 25 bp, E. coli
taagcaccgagagtatccggtcttt

SEQ ID NO: 175149 - DNA, 25 bp, E. coli
aaggattccggcttgcgtagccacg

SEQ ID NO: 175150 - DNA, 25 bp, E. coli
aaggattccggcatgcgtagccacg

SEQ ID NO: 175151 - DNA, 25 bp, E. coli
cagggatcactttctctcaggagct

SEQ ID NO: 175152 - DNA, 25 bp, E. coli
cagggatcacttactctcaggagct

SEQ ID NO: 175153 - DNA, 25 bp, E. coli
tactctctgctgatgctggaacacg

SEQ ID NO: 175154 - DNA, 25 bp, E. coli
tactctctgctgttgctggaacacg

SEQ ID NO: 175155 - DNA, 25 bp, E. coli
tatgctgaaatccttggctacggcg

SEQ ID NO: 175156 - DNA, 25 bp, E. coli
tatcggtaacgcagtagagcagatc

SEQ ID NO: 175157 - DNA, 25 bp, E. coli
tatgctgaaatcgttggctacggcg

SEQ ID NO: 175158 - DNA, 25 bp, E. coli
tatcggtaacgctgtagagcagatc

SEQ ID NO: 175159 - DNA, 25 bp, E. coli
tgtggtcaccaatgcgatggcatcc

SEQ ID NO: 175160 - DNA, 25 bp, E. coli
tgtctaacagctacggcttcggcgg

SEQ ID NO: 175161 - DNA, 25 bp, E. coli
tgtctaacagcttcggcttcggcgg

SEQ ID NO: 175162 - DNA, 25 bp, E. coli
tgtggtcaccaaagcgatggcatcc

SEQ ID NO: 175163 - DNA, 25 bp, E. coli
tccaactgggcatacaggacatcgt

SEQ ID NO: 175164 - DNA, 25 bp, E. coli
tccaactgggcaaacaggacatcgt

SEQ ID NO: 175165 - DNA, 25 bp, E. coli
gaagtcctggcatctctgcgtgaag

SEQ ID NO: 175166 - DNA, 25 bp, E. coli
gaagtcctggcaactctgcgtgaag

SEQ ID NO: 175167 - DNA, 25 bp, E. coli
cattgaagagctggacgagcaggct

SEQ ID NO: 175168 - DNA, 25 bp, E. coli
cattgaagagctcgacgagcaggct

SEQ ID NO: 175169 - DNA, 25 bp, E. coli
gtaaaactggataccactggcctca

SEQ ID NO: 175170 - DNA, 25 bp, E. coli
gtaaaactggattccactggcctca

SEQ ID NO: 175171 - DNA, 25 bp, E. coli
catcaacgaaaatgcccacatctgt

SEQ ID NO: 175172 - DNA, 25 bp, E. coli
catcaacgaaaaagcccacatctgt

SEQ ID NO: 175173 - DNA, 25 bp, E. coli
tagcattttgctttccttcagtctg

SEQ ID NO: 175174 - DNA, 25 bp, E. coli
tagcattttgctatccttcagtctg

SEQ ID NO: 175175 - DNA, 25 bp, E. coli
tttcatgttacctggagccgcggct

SEQ ID NO: 175176 - DNA, 25 bp, E. coli
tttcatgttaccaggagccgcggct

SEQ ID NO: 175177 - DNA, 25 bp, E. coli
tttatgtctcctcaccgtctggtcg

SEQ ID NO: 175178 - DNA, 25 bp, E. coli
tttatgtctcctgaccgtctggtcg

SEQ ID NO: 175179 - DNA, 25 bp, E. coli
tgttggtcctaatagaaaatgtcag

SEQ ID NO: 175180 - DNA, 25 bp, E. coli
tgttggtcctaaaagaaaatgtcag

SEQ ID NO: 175181 - DNA, 25 bp, E. coli
tccaatcatgattggtgggctggcg

SEQ ID NO: 175182 - DNA, 25 bp, E. coli
tccaatcatgataggtgggctggcg

SEQ ID NO: 175183 - DNA, 25 bp, E. coli
gcggagtctgaattggttgtgtaac

SEQ ID NO: 175184 - DNA, 25 bp, E. coli
gcggagtctgaaatggttgtgtaac

SEQ ID NO: 175185 - DNA, 25 bp, E. coli
ccgtctggtcggtgttttgctgaga

SEQ ID NO: 175186 - DNA, 25 bp, E. coli
ccgtctggtcggagttttgctgaga

SEQ ID NO: 175187 - DNA, 25 bp, E. coli
gttgtccttacagcgtccaatcatg

SEQ ID NO: 175188 - DNA, 25 bp, E. coli
gttgtccttacaccgtccaatcatg

SEQ ID NO: 175189 - DNA, 25 bp, E. coli
ggttacagcgggtgtctcttcgtct

SEQ ID NO: 175190 - DNA, 25 bp, E. coli
ggttacagcgggagtctcttcgtct

SEQ ID NO: 175191 - DNA, 25 bp, E. coli
gagccgcggctcctttgcgtatcct

SEQ ID NO: 175192 - DNA, 25 bp, E. coli
gagccgcggctcgtttgcgtatcct

SEQ ID NO: 175193 - DNA, 25 bp, E. coli
aacggtcgatgtaggcttgcgtcgc

SEQ ID NO: 175194 - DNA, 25 bp, E. coli
cagcgcagcttgtggagcgcacagc

SEQ ID NO: 175195 - DNA, 25 bp, E. coli
cagcgcagcttgaggagcgcacagc

SEQ ID NO: 175196 - DNA, 25 bp, E. coli
cacgcttgaagagcaactggatgca

SEQ ID NO: 175197 - DNA, 25 bp, E. coli
cacgcttgaagaccaactggatgca

SEQ ID NO: 175198 - DNA, 25 bp, E. coli
taaagatgtcgcaaacgcactggcg

SEQ ID NO: 175199 - DNA, 25 bp, E. coli
taaagctgagcatcaaacggtcgat

SEQ ID NO: 175200 - DNA, 25 bp, E. coli
taaagatgtcgctaacgcactggcg

SEQ ID NO: 175201 - DNA, 25 bp, E. coli
tacaaaccgaatgacgctctggcag

SEQ ID NO: 175202 - DNA, 25 bp, E. coli
tacaaaccgaatcacgctctggcag

SEQ ID NO: 175203 - DNA, 25 bp, E. coli
taaagctgagcaacaaacggtcgat

SEQ ID NO: 175204 - DNA, 25 bp, E. coli
aacggtcgatgttggcttgcgtcgc

SEQ ID NO: 175205 - DNA, 25 bp, E. coli
tacctgaccgtgttgacggcgcagc

SEQ ID NO: 175206 - DNA, 25 bp, E. coli
tacctgaccgtgatgacggcgcagc

SEQ ID NO: 175207 - DNA, 25 bp, E. coli
gctgctggcactgcaactgactgat

SEQ ID NO: 175208 - DNA, 25 bp, E. coli
gctgctggcactccaactgactgat

SEQ ID NO: 175209 - DNA, 25 bp, E. coli
gttacgcagaaggacaaaagcgtgg

SEQ ID NO: 175210 - DNA, 25 bp, E. coli
gttacgcagaagcacaaaagcgtgg

SEQ ID NO: 175211 - DNA, 25 bp, E. coli
taatctggcgcaccttcgttacgca

SEQ ID NO: 175212 - DNA, 25 bp, E. coli
taatctggcgcagcttcgttacgca

SEQ ID NO: 175213 - DNA, 25 bp, E. coli
gatgcacagcgcgagtatgttaaag

SEQ ID NO: 175214 - DNA, 25 bp, E. coli
gatgcacagcgccagtatgttaaag

SEQ ID NO: 175215 - DNA, 25 bp, E. coli
aattcttgctgcgtttggagagcgc

SEQ ID NO: 175216 - DNA, 25 bp, E. coli
cacttggtggctgtaccgttcatgg

SEQ ID NO: 175217 - DNA, 25 bp, E. coli
cacttggtggctctaccgttcatgg

SEQ ID NO: 175218 - DNA, 25 bp, E. coli
caagaaattcttgctgcctttggag

SEQ ID NO: 175219 - DNA, 25 bp, E. coli
caagaaattcttcctgcctttggag

SEQ ID NO: 175220 - DNA, 25 bp, E. coli
aattcttgctgcctttggagagcgc

SEQ ID NO: 175221 - DNA, 25 bp, E. coli
catctatttctgcaacaaaaatgaa

SEQ ID NO: 175222 - DNA, 25 bp, E. coli
catcagacggttaaagttaaaatcg

SEQ ID NO: 175223 - DNA, 25 bp, E. coli
catcagacggtttaagttaaaatcg

SEQ ID NO: 175224 - DNA, 25 bp, E. coli
catctatttctggaacaaaaatgaa

SEQ ID NO: 175225 - DNA, 25 bp, E. coli
ttttataatatttccacttggtggc

SEQ ID NO: 175226 - DNA, 25 bp, E. coli
ttttataatattaccacttggtggc

SEQ ID NO: 175227 - DNA, 25 bp, E. coli
tgtaccgttcatggtaataaatccc

SEQ ID NO: 175228 - DNA, 25 bp, E. coli
tgtaccgttcatcgtaataaatccc

SEQ ID NO: 175229 - DNA, 25 bp, E. coli
tgcctttggagagcgctacgaatga

SEQ ID NO: 175230 - DNA, 25 bp, E. coli
tgcctttggagaccgctacgaatga

SEQ ID NO: 175231 - DNA, 25 bp, E. coli
gttcatggtaattaatccctaactg

SEQ ID NO: 175232 - DNA, 25 bp, E. coli
gttcatggtaataaatccctaactg

SEQ ID NO: 175233 - DNA, 25 bp, E. coli
gatgaaaatcatgagacggttaaag

SEQ ID NO: 175234 - DNA, 25 bp, E. coli
gagtctcacctttcatctatttctg

SEQ ID NO: 175235 - DNA, 25 bp, E. coli
gagtctcaccttacatctatttctg

SEQ ID NO: 175236 - DNA, 25 bp, E. coli
gatgaaaatcatcagacggttaaag

SEQ ID NO: 175237 - DNA, 25 bp, E. coli
caatggcctgatatatgaaaaacgc

SEQ ID NO: 175238 - DNA, 25 bp, E. coli
caatggcctgatttatgaaaaacgc

SEQ ID NO: 175239 - DNA, 25 bp, E. coli
aaggatgagtctgctccggcactgg

SEQ ID NO: 175240 - DNA, 25 bp, E. coli
aaggatgagtctcctccggcactgg

SEQ ID NO: 175241 - DNA, 25 bp, E. coli
cagcgtgcgctagattttgaaagcc

SEQ ID NO: 175242 - DNA, 25 bp, E. coli
cagcgtgcgctacattttgaaagcc

SEQ ID NO: 175243 - DNA, 25 bp, E. coli
tattttctgcgtcgactggcagcgc

SEQ ID NO: 175244 - DNA, 25 bp, E. coli
tattttctgcgtggactggcagcgc

SEQ ID NO: 175245 - DNA, 25 bp, E. coli
tgaaaaacgcggcaaggatgagtct

SEQ ID NO: 175246 - DNA, 25 bp, E. coli
tgaaaaacgcgggaaggatgagtct

SEQ ID NO: 175247 - DNA, 25 bp, E. coli
tgctgaaaaaattacgcatcgcgtt

SEQ ID NO: 175248 - DNA, 25 bp, E. coli
tgctgaaaaaataacgcatcgcgtt

SEQ ID NO: 175249 - DNA, 25 bp, E. coli
tcataaaaacttgcgcgaatgcggc

SEQ ID NO: 175250 - DNA, 25 bp, E. coli
tcataaaaacttccgcgaatgcggc

SEQ ID NO: 175251 - DNA, 25 bp, E. coli
gccaataataatgacctggtgcgta

SEQ ID NO: 175252 - DNA, 25 bp, E. coli
gccaataataatcacctggtgcgta

SEQ ID NO: 175253 - DNA, 25 bp, E. coli
gaacagatcgccgtctggctacgta

SEQ ID NO: 175254 - DNA, 25 bp, E. coli
gaacagatcgccctctggctacgta

SEQ ID NO: 175255 - DNA, 25 bp, E. coli
cgaagagggttttcagcgttgtccg

SEQ ID NO: 175256 - DNA, 25 bp, E. coli
cgaagagggtttacagcgttgtccg

SEQ ID NO: 175257 - DNA, 25 bp, E. coli
taacgatattctccgcagcgtgcgc

SEQ ID NO: 175258 - DNA, 25 bp, E. coli
taacgatattctgcgcagcgtgcgc

SEQ ID NO: 175259 - DNA, 25 bp, E. coli
caattttttaaaatctgcgcgggcg

SEQ ID NO: 175260 - DNA, 25 bp, E. coli
caattttttaaattctgcgcgggcg

SEQ ID NO: 175261 - DNA, 25 bp, E. coli
catactgttccgaaggttgcgggct

SEQ ID NO: 175262 - DNA, 25 bp, E. coli
catactgttccgtaggttgcgggct

SEQ ID NO: 175263 - DNA, 25 bp, E. coli
tttgccccgaagcaagcactggctc

SEQ ID NO: 175264 - DNA, 25 bp, E. coli
tttattgaaaagaacgagcagggcg

SEQ ID NO: 175265 - DNA, 25 bp, E. coli
tttattgaaaagtacgagcagggcg

SEQ ID NO: 175266 - DNA, 25 bp, E. coli
tttgccccgaaggaagcactggctc

SEQ ID NO: 175267 - DNA, 25 bp, E. coli
ccaggttctgactaatggcagcgca

SEQ ID NO: 175268 - DNA, 25 bp, E. coli
ccaggttctgacaaatggcagcgca

SEQ ID NO: 175269 - DNA, 25 bp, E. coli
gccggtttgctgcattacgtcaaca

SEQ ID NO: 175270 - DNA, 25 bp, E. coli
gccggtttgctggattacgtcaaca

SEQ ID NO: 175271 - DNA, 25 bp, E. coli
gcattctcccgttttgcgaagctga

SEQ ID NO: 175272 - DNA, 25 bp, E. coli
gcattctcccgtattgcgaagctga

SEQ ID NO: 175273 - DNA, 25 bp, E. coli
gatttatcacattgaaggtgacccg

SEQ ID NO: 175274 - DNA, 25 bp, E. coli
gatttatcacatagaaggtgacccg

SEQ ID NO: 175275 - DNA, 25 bp, E. coli
gtgccagcaacgtaaccgggatgct

SEQ ID NO: 175276 - DNA, 25 bp, E. coli
gtgccagcaacgaaaccgggatgct

SEQ ID NO: 175277 - DNA, 25 bp, E. coli
ggctcaggcgcgtaactacaaatta

SEQ ID NO: 175278 - DNA, 25 bp, E. coli
ggctcaggcgcgaaactacaaatta

SEQ ID NO: 175279 - DNA, 25 bp, E. coli
gaccgtgacgctaactttattgaaa

SEQ ID NO: 175280 - DNA, 25 bp, E. coli
gaccgtgacgcttactttattgaaa

SEQ ID NO: 175281 - DNA, 25 bp, E. coli
taaaaagtggtctgaagatcacgcc

SEQ ID NO: 175282 - DNA, 25 bp, E. coli
taaaaagtggtcagaagatcacgcc

SEQ ID NO: 175283 - DNA, 25 bp, E. coli
tagatagctatactggtaggccgct

SEQ ID NO: 175284 - DNA, 25 bp, E. coli
tagatagctatagtggtaggccgct

SEQ ID NO: 175285 - DNA, 25 bp, E. coli
tataacccggcacaagagatggctg

SEQ ID NO: 175286 - DNA, 25 bp, E. coli
tataacccggcagaagagatggctg

SEQ ID NO: 175287 - DNA, 25 bp, E. coli
tgtaatcgacaacatcgtcccgcgc

SEQ ID NO: 175288 - DNA, 25 bp, E. coli
tgtaatcgacaagatcgtcccgcgc

SEQ ID NO: 175289 - DNA, 25 bp, E. coli
gcagcgcttggtgaacgtaatatcg

SEQ ID NO: 175290 - DNA, 25 bp, E. coli
gcagcgcttggtcaacgtaatatcg

SEQ ID NO: 175291 - DNA, 25 bp, E. coli
gaaatcacactagcggatgccagag

SEQ ID NO: 175292 - DNA, 25 bp, E. coli
gaaatcacactaccggatgccagag

SEQ ID NO: 175293 - DNA, 25 bp, E. coli
cccgatgggcgaaagaactcacttt

SEQ ID NO: 175294 - DNA, 25 bp, E. coli
cccgatgggcgatagaactcacttt

SEQ ID NO: 175295 - DNA, 25 bp, E. coli
cgaaattcagtgagggccgcgtata

SEQ ID NO: 175296 - DNA, 25 bp, E. coli
cgaaattcagtgtgggccgcgtata

SEQ ID NO: 175297 - DNA, 25 bp, E. coli
ctatatggactatcccaccggagcg

SEQ ID NO: 175298 - DNA, 25 bp, E. coli
ctatatggactaacccaccggagcg

SEQ ID NO: 175299 - DNA, 25 bp, E. coli
gattcgcacaaagccatgagtgaga

SEQ ID NO: 175300 - DNA, 25 bp, E. coli
gattcgcacaaacccatgagtgaga

SEQ ID NO: 175301 - DNA, 25 bp, E. coli
taagctgcttgccaatggcgtcgat

SEQ ID NO: 175302 - DNA, 25 bp, E. coli
taagctgcttgcgaatggcgtcgat

SEQ ID NO: 175303 - DNA, 25 bp, E. coli
caaccagcgttatggcaaaggatat

SEQ ID NO: 175304 - DNA, 25 bp, E. coli
caaccagcgttaaggcaaaggatat

SEQ ID NO: 175305 - DNA, 25 bp, E. coli
agcgttatggcaaaggatattcagc

SEQ ID NO: 175306 - DNA, 25 bp, E. coli
agcgttatggcataggatattcagc

SEQ ID NO: 175307 - DNA, 25 bp, E. coli
aacatttttgctggcggcaaccagc

SEQ ID NO: 175308 - DNA, 25 bp, E. coli
aacatttttgctcgcggcaaccagc

SEQ ID NO: 175309 - DNA, 25 bp, E. coli
tatggcaaaggatattcagcttctt

SEQ ID NO: 175310 - DNA, 25 bp, E. coli
tatggcaaaggaaattcagcttctt

SEQ ID NO: 175311 - DNA, 25 bp, E. coli
ttaacatttttggtggcggcaacca

SEQ ID NO: 175312 - DNA, 25 bp, E. coli
ttaacatttttgctggcggcaacca

SEQ ID NO: 175313 - DNA, 25 bp, E. coli
ccagcgttatgggaaaggatattca

SEQ ID NO: 175314 - DNA, 25 bp, E. coli
ccagcgttatggcaaaggatattca

SEQ ID NO: 175315 - DNA, 25 bp, E. coli
gcggcaaccagccttatggcaaagg

SEQ ID NO: 175316 - DNA, 25 bp, E. coli
gcggcaaccagcgttatggcaaagg

SEQ ID NO: 175317 - DNA, 25 bp, E. coli
cgttatggcaaacgatattcagctt

SEQ ID NO: 175318 - DNA, 25 bp, E. coli
cgttatggcaaaggatattcagctt

SEQ ID NO: 175319 - DNA, 25 bp, E. coli
tggcaaaggataatcagcttcttaa

SEQ ID NO: 175320 - DNA, 25 bp, E. coli
ggcaaccagcgttatggcaaaggat

SEQ ID NO: 175321 - DNA, 25 bp, E. coli
ggcaaccagcgtaatggcaaaggat

SEQ ID NO: 175322 - DNA, 25 bp, E. coli
tggcggcaaccagcgttatggcaaa

SEQ ID NO: 175323 - DNA, 25 bp, E. coli
tggcaaaggatattcagcttcttaa

SEQ ID NO: 175324 - DNA, 25 bp, E. coli
tggcggcaaccaccgttatggcaaa

SEQ ID NO: 175325 - DNA, 25 bp, E. coli
caacctgattgataagagcgatttc

SEQ ID NO: 175326 - DNA, 25 bp, E. coli
caacctgattgaaaagagcgatttc

SEQ ID NO: 175327 - DNA, 25 bp, E. coli
tacgatatcggtgcatggaccgacg

SEQ ID NO: 175328 - DNA, 25 bp, E. coli
tatgctaaatctgaccgcactaatg

SEQ ID NO: 175329 - DNA, 25 bp, E. coli
tatgctaaatctcaccgcactaatg

SEQ ID NO: 175330 - DNA, 25 bp, E. coli
tacgatatcggtccatggaccgacg

SEQ ID NO: 175331 - DNA, 25 bp, E. coli
tcgtctgggcttcaaaggcgaaact

SEQ ID NO: 175332 - DNA, 25 bp, E. coli
tcgtctgggcttgaaaggcgaaact

SEQ ID NO: 175333 - DNA, 25 bp, E. coli
tcttctaacgatccagatgatggcg

SEQ ID NO: 175334 - DNA, 25 bp, E. coli
tctacggtaacaacagcctgaatgc

SEQ ID NO: 175335 - DNA, 25 bp, E. coli
tctaaaggaaaagacttgggtgcgt

SEQ ID NO: 175336 - DNA, 25 bp, E. coli
tcttctaacgatgcagatgatggcg

SEQ ID NO: 175337 - DNA, 25 bp, E. coli
tctaaaggaaaacacttgggtgcgt

SEQ ID NO: 175338 - DNA, 25 bp, E. coli
tctacggtaacatcagcctgaatgc

SEQ ID NO: 175339 - DNA, 25 bp, E. coli
gcatctggcgttcctaccgatgata

SEQ ID NO: 175340 - DNA, 25 bp, E. coli
gcatctggcgttgctaccgatgata

SEQ ID NO: 175341 - DNA, 25 bp, E. coli
ctggtcaaaatgctgaagtatgggc

SEQ ID NO: 175342 - DNA, 25 bp, E. coli
ctggtcaaaatggtgaagtatgggc

SEQ ID NO: 175343 - DNA, 25 bp, E. coli
gagcgatttcaccaaagcatctggc

SEQ ID NO: 175344 - DNA, 25 bp, E. coli
gatgatggcgacacaacttatgttc

SEQ ID NO: 175345 - DNA, 25 bp, E. coli
gatgatggcgactcaacttatgttc

SEQ ID NO: 175346 - DNA, 25 bp, E. coli
gagcgatttcacgaaagcatctggc

SEQ ID NO: 175347 - DNA, 25 bp, E. coli
caaattttacgagtgcgtgctggct

SEQ ID NO: 175348 - DNA, 25 bp, E. coli
caaattttacgactgcgtgctggct

SEQ ID NO: 175349 - DNA, 25 bp, E. coli
agcctttaactcagccgttgacaac

SEQ ID NO: 175350 - DNA, 25 bp, E. coli
agcctttaactctgccgttgacaac

SEQ ID NO: 175351 - DNA, 25 bp, E. coli
tacgagtgcgtggtggcttcagtct

SEQ ID NO: 175352 - DNA, 25 bp, E. coli
tacgagtgcgtgctggcttcagtct

SEQ ID NO: 175353 - DNA, 25 bp, E. coli
tgaattcccacacgcgttataaact

SEQ ID NO: 175354 - DNA, 25 bp, E. coli
tgaattcccacaggcgttataaact

SEQ ID NO: 175355 - DNA, 25 bp, E. coli
tgcgtgctggcttcagtcttgtcac

SEQ ID NO: 175356 - DNA, 25 bp, E. coli
tgcgtgctggctacagtcttgtcac

SEQ ID NO: 175357 - DNA, 25 bp, E. coli
tcagtcttgtcagctgagcgttcgg

SEQ ID NO: 175358 - DNA, 25 bp, E. coli
tcagtcttgtcacctgagcgttcgg

SEQ ID NO: 175359 - DNA, 25 bp, E. coli
gaactgaccgcatattttacgagtg

SEQ ID NO: 175360 - DNA, 25 bp, E. coli
gaactgaccgcaaattttacgagtg

SEQ ID NO: 175361 - DNA, 25 bp, E. coli
ctggcagaactgtccgcaaatttta

SEQ ID NO: 175362 - DNA, 25 bp, E. coli
ctggcagaactgaccgcaaatttta

SEQ ID NO: 175363 - DNA, 25 bp, E. coli
gtcttgtcacctcagcgttcggtaa

SEQ ID NO: 175364 - DNA, 25 bp, E. coli
gtcttgtcacctgagcgttcggtaa

SEQ ID NO: 175365 - DNA, 25 bp, E. coli
tggcttcagtcttgtcacctgagcg

SEQ ID NO: 175366 - DNA, 25 bp, E. coli
tggcttcagtctagtcacctgagcg

SEQ ID NO: 175367 - DNA, 25 bp, E. coli
taactctgccgttgacaaccggctg

SEQ ID NO: 175368 - DNA, 25 bp, E. coli
taactctgccgtagacaaccggctg

SEQ ID NO: 175369 - DNA, 25 bp, E. coli
aagtgggtattagcatcagatttcc

SEQ ID NO: 175370 - DNA, 25 bp, E. coli
aagtgggtattaccatcagatttcc

SEQ ID NO: 175371 - DNA, 25 bp, E. coli
tactatcagtggtacagaaaatgcg

SEQ ID NO: 175372 - DNA, 25 bp, E. coli
tactatcagtggaacagaaaatgcg

SEQ ID NO: 175373 - DNA, 25 bp, E. coli
taacatcattgtgagtcggccagaa

SEQ ID NO: 175374 - DNA, 25 bp, E. coli
taacatcattgtcagtcggccagaa

SEQ ID NO: 175375 - DNA, 25 bp, E. coli
tattttaccctgctgttccacgagt

SEQ ID NO: 175376 - DNA, 25 bp, E. coli
tattttaccctggtgttccacgagt

SEQ ID NO: 175377 - DNA, 25 bp, E. coli
tgccgttgtctgtagctaaagagcg

SEQ ID NO: 175378 - DNA, 25 bp, E. coli
tgccgttgtctgaagctaaagagcg

SEQ ID NO: 175379 - DNA, 25 bp, E. coli
gcatagtcgttgtttctgcggtcaa

SEQ ID NO: 175380 - DNA, 25 bp, E. coli
gcatagtcgttgattctgcggtcaa

SEQ ID NO: 175381 - DNA, 25 bp, E. coli
ccgtgaaattctaatggagcctagc

SEQ ID NO: 175382 - DNA, 25 bp, E. coli
ccgtgaaattcttatggagcctagc

SEQ ID NO: 175383 - DNA, 25 bp, E. coli
gatttgtctgcatgatattacggcc

SEQ ID NO: 175384 - DNA, 25 bp, E. coli
gatttgtctgcaagatattacggcc

SEQ ID NO: 175385 - DNA, 25 bp, E. coli
gataatgttcatttcctcgggtact

SEQ ID NO: 175386 - DNA, 25 bp, E. coli
gataatgttcatatcctcgggtact

SEQ ID NO: 175387 - DNA, 25 bp, E. coli
ggtcaattttaccactggcggtcca

SEQ ID NO: 175388 - DNA, 25 bp, E. coli
gggtcgtggctaaaacgtttgcact

SEQ ID NO: 175389 - DNA, 25 bp, E. coli
ggtcaattttacgactggcggtcca

SEQ ID NO: 175390 - DNA, 25 bp, E. coli
gggtcgtggctataacgtttgcact

SEQ ID NO: 175391 - DNA, 25 bp, E. coli
tacaagcggcaatgcaagcgctgcg

SEQ ID NO: 175392 - DNA, 25 bp, E. coli
taaacgatacacctccgcagctatg

SEQ ID NO: 175393 - DNA, 25 bp, E. coli
taaatgaactggtagctgcggctac

SEQ ID NO: 175394 - DNA, 25 bp, E. coli
tacagctggcatggaaaatggcacg

SEQ ID NO: 175395 - DNA, 25 bp, E. coli
tacagctggcatcgaaaatggcacg

SEQ ID NO: 175396 - DNA, 25 bp, E. coli
taaacgatacacgtccgcagctatg

SEQ ID NO: 175397 - DNA, 25 bp, E. coli
taaatgaactggaagctgcggctac

SEQ ID NO: 175398 - DNA, 25 bp, E. coli
tacaagcggcaaagcaagcgctgcg

SEQ ID NO: 175399 - DNA, 25 bp, E. coli
tagtgtcggtaaatcgttagccagc

SEQ ID NO: 175400 - DNA, 25 bp, E. coli
tatcgcagccgtcaatggttacgcg

SEQ ID NO: 175401 - DNA, 25 bp, E. coli
tagtgtcggtaattcgttagccagc

SEQ ID NO: 175402 - DNA, 25 bp, E. coli
tttgggttgccggaaatcactctcg

SEQ ID NO: 175403 - DNA, 25 bp, E. coli
tttgggttgccgcaaatcactctcg

SEQ ID NO: 175404 - DNA, 25 bp, E. coli
tatcgcagccgtgaatggttacgcg

SEQ ID NO: 175405 - DNA, 25 bp, E. coli
tgcccaggagcgtcagttattcacc

SEQ ID NO: 175406 - DNA, 25 bp, E. coli
tgcccaggagcgacagttattcacc

SEQ ID NO: 175407 - DNA, 25 bp, E. coli
gctggcggcaactgaagatcgtcat

SEQ ID NO: 175408 - DNA, 25 bp, E. coli
gctggcggcaacagaagatcgtcat

SEQ ID NO: 175409 - DNA, 25 bp, E. coli
gaaatggcagaataagatctcgcgg

SEQ ID NO: 175410 - DNA, 25 bp, E. coli
gaaatggcagaaaaagatctcgcgg

SEQ ID NO: 175411 - DNA, 25 bp, E. coli
taatgcgctaaaaaatgccctgctg

SEQ ID NO: 175412 - DNA, 25 bp, E. coli
taatgcgctaaataatgccctgctg

SEQ ID NO: 175413 - DNA, 25 bp, E. coli
caagatgattcgtcctttgatgccg

SEQ ID NO: 175414 - DNA, 25 bp, E. coli
caagatgattcgacctttgatgccg

SEQ ID NO: 175415 - DNA, 25 bp, E. coli
aacaatcgacgacacacatgagtgg

SEQ ID NO: 175416 - DNA, 25 bp, E. coli
acttatcattcataaagcagccggg

SEQ ID NO: 175417 - DNA, 25 bp, E. coli
acttatcattcaaaaagcagccggg

SEQ ID NO: 175418 - DNA, 25 bp, E. coli
aacaatcgacgagacacatgagtgg

SEQ ID NO: 175419 - DNA, 25 bp, E. coli
ttttcagcaaaatactccagggccg

SEQ ID NO: 175420 - DNA, 25 bp, E. coli
ttttcagcaaaaaactccagggccg

SEQ ID NO: 175421 - DNA, 25 bp, E. coli
tgttcaacgctttagccagcatgaa

SEQ ID NO: 175422 - DNA, 25 bp, E. coli
tgttcaacgcttaagccagcatgaa

SEQ ID NO: 175423 - DNA, 25 bp, E. coli
tgatgccgagtctattgttcaacgc

SEQ ID NO: 175424 - DNA, 25 bp, E. coli
tgatgccgagtcaattgttcaacgc

SEQ ID NO: 175425 - DNA, 25 bp, E. coli
tccagggccgttaacaaacaatcga

SEQ ID NO: 175426 - DNA, 25 bp, E. coli
tccagggccgtttacaaacaatcga

SEQ ID NO: 175427 - DNA, 25 bp, E. coli
gcgacgaagggctggatttgattaa

SEQ ID NO: 175428 - DNA, 25 bp, E. coli
gcgacgaagggcaggatttgattaa

SEQ ID NO: 175429 - DNA, 25 bp, E. coli
gaatggaggctcacgaaagcgacga

SEQ ID NO: 175430 - DNA, 25 bp, E. coli
gaatggaggctctcgaaagcgacga

SEQ ID NO: 175431 - DNA, 25 bp, E. coli
cgagcacgcgaataggcaaaagcat

SEQ ID NO: 175432 - DNA, 25 bp, E. coli
cgagcacgcgaaaaggcaaaagcat

SEQ ID NO: 175433 - DNA, 25 bp, E. coli
tcaactcgacagttatcggctcacg

SEQ ID NO: 175434 - DNA, 25 bp, E. coli
tcaactcgacagatatcggctcacg

SEQ ID NO: 175435 - DNA, 25 bp, E. coli
cacgtaatcagtacccagaagtgag

SEQ ID NO: 175436 - DNA, 25 bp, E. coli
cacgtaatcagttcccagaagtgag

SEQ ID NO: 175437 - DNA, 25 bp, E. coli
caaaagccggataatgttagccata

SEQ ID NO: 175438 - DNA, 25 bp, E. coli
caaaagccggattatgttagccata

SEQ ID NO: 175439 - DNA, 25 bp, E. coli
taaataaggttgtaaagacgcgctg

SEQ ID NO: 175440 - DNA, 25 bp, E. coli
taaatcacagtgtgtgtgagcgcga

SEQ ID NO: 175441 - DNA, 25 bp, E. coli
taaataaggttgaaaagacgcgctg

SEQ ID NO: 175442 - DNA, 25 bp, E. coli
taaatcacagtgagtgtgagcgcga

SEQ ID NO: 175443 - DNA, 25 bp, E. coli
gccacctggaagtgacgcattagag

SEQ ID NO: 175444 - DNA, 25 bp, E. coli
gccacctggaagagacgcattagag

SEQ ID NO: 175445 - DNA, 25 bp, E. coli
gcaaaacatgcttatgtagccacca

SEQ ID NO: 175446 - DNA, 25 bp, E. coli
gcaaaacatgctaatgtagccacca

SEQ ID NO: 175447 - DNA, 25 bp, E. coli
gacgcgctgacaatacgccttttga

SEQ ID NO: 175448 - DNA, 25 bp, E. coli
ctataatggcgataagcgatgctga

SEQ ID NO: 175449 - DNA, 25 bp, E. coli
ctataatggcgaaaagcgatgctga

SEQ ID NO: 175450 - DNA, 25 bp, E. coli
ggttagctccgaagcaaaagccgga

SEQ ID NO: 175451 - DNA, 25 bp, E. coli
ggttagctccgatgcaaaagccgga

SEQ ID NO: 175452 - DNA, 25 bp, E. coli
ggttaagcaaatgatcaccgcactg

SEQ ID NO: 175453 - DNA, 25 bp, E. coli
ggttaagcaaatcatcaccgcactg

SEQ ID NO: 175454 - DNA, 25 bp, E. coli
gagtaatcttgcatacgccacctgg

SEQ ID NO: 175455 - DNA, 25 bp, E. coli
gacgcgctgacattacgccttttga

SEQ ID NO: 175456 - DNA, 25 bp, E. coli
gagtaatcttgcttacgccacctgg

SEQ ID NO: 175457 - DNA, 25 bp, E. coli
catttctgatgatgacctgtgcgcc

SEQ ID NO: 175458 - DNA, 25 bp, E. coli
tacaggcaatggcatctggccatcc

SEQ ID NO: 175459 - DNA, 25 bp, E. coli
tacaggcaatgggatctggccatcc

SEQ ID NO: 175460 - DNA, 25 bp, E. coli
taccgtcccggagaaatcagtctgt

SEQ ID NO: 175461 - DNA, 25 bp, E. coli
taccgtcccggacaaatcagtctgt

SEQ ID NO: 175462 - DNA, 25 bp, E. coli
tgacctgtgcgcgtggtgtacccgt

SEQ ID NO: 175463 - DNA, 25 bp, E. coli
tgacctgtgcgcctggtgtacccgt

SEQ ID NO: 175464 - DNA, 25 bp, E. coli
tctgtgaccggaacggttacgcgta

SEQ ID NO: 175465 - DNA, 25 bp, E. coli
tctgtgaccggatcggttacgcgta

SEQ ID NO: 175466 - DNA, 25 bp, E. coli
tctggccatccgactgtgaccggaa

SEQ ID NO: 175467 - DNA, 25 bp, E. coli
tctggccatccgtctgtgaccggaa

SEQ ID NO: 175468 - DNA, 25 bp, E. coli
gaatttcagccgtatatcattcatc

SEQ ID NO: 175469 - DNA, 25 bp, E. coli
gaacggttacgcgtacggctgtccg

SEQ ID NO: 175470 - DNA, 25 bp, E. coli
gaacggttacgcctacggctgtccg

SEQ ID NO: 175471 - DNA, 25 bp, E. coli
gaatttcagccgaatatcattcatc

SEQ ID NO: 175472 - DNA, 25 bp, E. coli
cgcgtacggctgtccggaatttcag

SEQ ID NO: 175473 - DNA, 25 bp, E. coli
cgcgtacggctgaccggaatttcag

SEQ ID NO: 175474 - DNA, 25 bp, E. coli
catttctgatgaagacctgtgcgcc

SEQ ID NO: 175475 - DNA, 25 bp, E. coli
gggtgtcgttccttttctgatgatg

SEQ ID NO: 175476 - DNA, 25 bp, E. coli
gggtgtcgttccatttctgatgatg

SEQ ID NO: 175477 - DNA, 25 bp, E. coli
tggtgtacccgtctgctttaccgtc

SEQ ID NO: 175478 - DNA, 25 bp, E. coli
tggtgtacccgtgtgctttaccgtc

SEQ ID NO: 175479 - DNA, 25 bp, E. coli
aatctccgttgtactttgtttcgcg

SEQ ID NO: 175480 - DNA, 25 bp, E. coli
aatctccgttgttctttgtttcgcg

SEQ ID NO: 175481 - DNA, 25 bp, E. coli
caggcgatgatagaaatctccgttg

SEQ ID NO: 175482 - DNA, 25 bp, E. coli
caggcgatgatacaaatctccgttg

SEQ ID NO: 175483 - DNA, 25 bp, E. coli
tatcaggcgatgttacaaatctccg

SEQ ID NO: 175484 - DNA, 25 bp, E. coli
tatcaggcgatgatacaaatctccg

SEQ ID NO: 175485 - DNA, 25 bp, E. coli
tcgacacaatttttcaggcgatgat

SEQ ID NO: 175486 - DNA, 25 bp, E. coli
tcgcggatttcgacacaatttatca

SEQ ID NO: 175487 - DNA, 25 bp, E. coli
tcgacacaatttatcaggcgatgat

SEQ ID NO: 175488 - DNA, 25 bp, E. coli
tcgcggatttcgtcacaatttatca

SEQ ID NO: 175489 - DNA, 25 bp, E. coli
gcgatgatacaattctccgttgtac

SEQ ID NO: 175490 - DNA, 25 bp, E. coli
gcgatgatacaaatctccgttgtac

SEQ ID NO: 175491 - DNA, 25 bp, E. coli
cgttgtactttgtttcgcgcttggt

SEQ ID NO: 175492 - DNA, 25 bp, E. coli
cgttgtactttgattcgcgcttggt

SEQ ID NO: 175493 - DNA, 25 bp, E. coli
gtttcgcgcttgctataatcgctgg

SEQ ID NO: 175494 - DNA, 25 bp, E. coli
gtttcgcgcttggtataatcgctgg

SEQ ID NO: 175495 - DNA, 25 bp, E. coli
ggatttcgacactatttatcaggcg

SEQ ID NO: 175496 - DNA, 25 bp, E. coli
ggatttcgacacaatttatcaggcg

SEQ ID NO: 175497 - DNA, 25 bp, E. coli
ggtataatcgctgggggtcaaagat

SEQ ID NO: 175498 - DNA, 25 bp, E. coli
ggtataatcgctcggggtcaaagat

SEQ ID NO: 175499 - DNA, 25 bp, E. coli
gagcaggtcgcgcatttcgacacaa

SEQ ID NO: 175500 - DNA, 25 bp, E. coli
gagcaggtcgcggatttcgacacaa

SEQ ID NO: 175501 - DNA, 25 bp, E. coli
caacccagcctttggcgcagatatc

SEQ ID NO: 175502 - DNA, 25 bp, E. coli
caatactgataatggcgagatgctg

SEQ ID NO: 175503 - DNA, 25 bp, E. coli
caatactgataaaggcgagatgctg

SEQ ID NO: 175504 - DNA, 25 bp, E. coli
caacccagccttaggcgcagatatc

SEQ ID NO: 175505 - DNA, 25 bp, E. coli
cagtagcctgtggtctgctgatgag

SEQ ID NO: 175506 - DNA, 25 bp, E. coli
cattttaacgcctgtagcctgtgct

SEQ ID NO: 175507 - DNA, 25 bp, E. coli
cagtagcctgtgctctgctgatgag

SEQ ID NO: 175508 - DNA, 25 bp, E. coli
cattttaacgccagtagcctgtgct

SEQ ID NO: 175509 - DNA, 25 bp, E. coli
ttgatatcgaaacatgtacaggtcg

SEQ ID NO: 175510 - DNA, 25 bp, E. coli
ttgatatcgaaagatgtacaggtcg

SEQ ID NO: 175511 - DNA, 25 bp, E. coli
tcagttagcacaacagctcgcggac

SEQ ID NO: 175512 - DNA, 25 bp, E. coli
gggacggcagcgataaccaacccag

SEQ ID NO: 175513 - DNA, 25 bp, E. coli
gggacggcagcgttaaccaacccag

SEQ ID NO: 175514 - DNA, 25 bp, E. coli
cgcgataaagcccacaatactgata

SEQ ID NO: 175515 - DNA, 25 bp, E. coli
cgcgctggtgcaaaagttgatatcg

SEQ ID NO: 175516 - DNA, 25 bp, E. coli
cgcgctggtgcataagttgatatcg

SEQ ID NO: 175517 - DNA, 25 bp, E. coli
cgcgataaagccgacaatactgata

SEQ ID NO: 175518 - DNA, 25 bp, E. coli
ggagaattacaacccgctcactggc

SEQ ID NO: 175519 - DNA, 25 bp, E. coli
ggagaattacaagccgctcactggc

SEQ ID NO: 175520 - DNA, 25 bp, E. coli
tcagttagcacatcagctcgcggac

SEQ ID NO: 175521 - DNA, 25 bp, E. coli
gatgctggatccgaaagaattcaac

SEQ ID NO: 175522 - DNA, 25 bp, E. coli
gatgctggatcccaaagaattcaac

SEQ ID NO: 175523 - DNA, 25 bp, E. coli
tactgcatatggtggatattcaggc

SEQ ID NO: 175524 - DNA, 25 bp, E. coli
tactgcatatggaggatattcaggc

SEQ ID NO: 175525 - DNA, 25 bp, E. coli
taggcgtcacattagttgctcatgg

SEQ ID NO: 175526 - DNA, 25 bp, E. coli
taggcgtcacataagttgctcatgg

SEQ ID NO: 175527 - DNA, 25 bp, E. coli
tgagtccccattagttagattcgag

SEQ ID NO: 175528 - DNA, 25 bp, E. coli
tgcatacagcatggtggacttttcg

SEQ ID NO: 175529 - DNA, 25 bp, E. coli
tgagtccccatttgttagattcgag

SEQ ID NO: 175530 - DNA, 25 bp, E. coli
tgacatcaatgataaagcacgactt

SEQ ID NO: 175531 - DNA, 25 bp, E. coli
tgcatacagcatcgtggacttttcg

SEQ ID NO: 175532 - DNA, 25 bp, E. coli
tgacatcaatgaaaaagcacgactt

SEQ ID NO: 175533 - DNA, 25 bp, E. coli
tctttacgcaaaaccgcaacacttg

SEQ ID NO: 175534 - DNA, 25 bp, E. coli
tctttacgcaaatccgcaacacttg

SEQ ID NO: 175535 - DNA, 25 bp, E. coli
gacctggtacaggacgattatttca

SEQ ID NO: 175536 - DNA, 25 bp, E. coli
gacctggtacagcacgattatttca

SEQ ID NO: 175537 - DNA, 25 bp, E. coli
ccgaataaaaggtataggcgtcaca

SEQ ID NO: 175538 - DNA, 25 bp, E. coli
ccgaataaaaggaataggcgtcaca

SEQ ID NO: 175539 - DNA, 25 bp, E. coli
gatattgttgcatctgtaggacagg

SEQ ID NO: 175540 - DNA, 25 bp, E. coli
gatattgttgcaactgtaggacagg

SEQ ID NO: 175541 - DNA, 25 bp, E. coli
ggtccaatacgtcaactctacagag

SEQ ID NO: 175542 - DNA, 25 bp, E. coli
ggtaaggtagtggattcaaaccgaa

SEQ ID NO: 175543 - DNA, 25 bp, E. coli
ggtccaatacgtgaactctacagag

SEQ ID NO: 175544 - DNA, 25 bp, E. coli
ggtaaggtagtgcattcaaaccgaa

SEQ ID NO: 175545 - DNA, 25 bp, E. coli
catcaacgtgttaccacactctccg

SEQ ID NO: 175546 - DNA, 25 bp, E. coli
catggtgcacttagcccatcaacgt

SEQ ID NO: 175547 - DNA, 25 bp, E. coli
catggtgcactttgcccatcaacgt

SEQ ID NO: 175548 - DNA, 25 bp, E. coli
catcaacgtgtttccacactctccg

SEQ ID NO: 175549 - DNA, 25 bp, E. coli
cactttgcccatgaacgtgtttcca

SEQ ID NO: 175550 - DNA, 25 bp, E. coli
cactttgcccatcaacgtgtttcca

SEQ ID NO: 175551 - DNA, 25 bp, E. coli
tttgcccatcaacgtgtttccacac

SEQ ID NO: 175552 - DNA, 25 bp, E. coli
ttttagctacttcacccgcgagcag

SEQ ID NO: 175553 - DNA, 25 bp, E. coli
tttgcccatcaaggtgtttccacac

SEQ ID NO: 175554 - DNA, 25 bp, E. coli
ttttagctacttgacccgcgagcag

SEQ ID NO: 175555 - DNA, 25 bp, E. coli
ccataccggctagatctttcaacag

SEQ ID NO: 175556 - DNA, 25 bp, E. coli
ccataccggctacatctttcaacag

SEQ ID NO: 175557 - DNA, 25 bp, E. coli
gaacctgttttagctacttcacccg

SEQ ID NO: 175558 - DNA, 25 bp, E. coli
gaacctgttttacctacttcacccg

SEQ ID NO: 175559 - DNA, 25 bp, E. coli
cctgttttagcttcttcacccgcga

SEQ ID NO: 175560 - DNA, 25 bp, E. coli
cctgttttagctacttcacccgcga

SEQ ID NO: 175561 - DNA, 25 bp, E. coli
gtgcactttgcccatcaacgtgttt

SEQ ID NO: 175562 - DNA, 25 bp, E. coli
gtgcactttgccgatcaacgtgttt

SEQ ID NO: 175563 - DNA, 25 bp, E. coli
ggcgaacctgttttagctacttcac

SEQ ID NO: 175564 - DNA, 25 bp, E. coli
ggcgaacctgttatagctacttcac

SEQ ID NO: 175565 - DNA, 25 bp, E. coli
taccggctacatgtttcaacagttc

SEQ ID NO: 175566 - DNA, 25 bp, E. coli
taccggctacatctttcaacagttc

SEQ ID NO: 175567 - DNA, 25 bp, E. coli
cagttgaataaacattcacagagac

SEQ ID NO: 175568 - DNA, 25 bp, E. coli
cattcattaaacaaatccattgcca

SEQ ID NO: 175569 - DNA, 25 bp, E. coli
cagttgaataaagattcacagagac

SEQ ID NO: 175570 - DNA, 25 bp, E. coli
taaaatatataataaagcccttgct

SEQ ID NO: 175571 - DNA, 25 bp, E. coli
aagcccttgcttactaacgtgaaag

SEQ ID NO: 175572 - DNA, 25 bp, E. coli
aagcccttgctttctaacgtgaaag

SEQ ID NO: 175573 - DNA, 25 bp, E. coli
tagatcaaggtaatgtcagtgagac

SEQ ID NO: 175574 - DNA, 25 bp, E. coli
tagatcaaggtattgtcagtgagac

SEQ ID NO: 175575 - DNA, 25 bp, E. coli
tgtcagtgagacgaaaatccaggct

SEQ ID NO: 175576 - DNA, 25 bp, E. coli
tgtacaatgatgagcgttaattaac

SEQ ID NO: 175577 - DNA, 25 bp, E. coli
tgtcagtgagaccaaaatccaggct

SEQ ID NO: 175578 - DNA, 25 bp, E. coli
tgtacaatgatgtgcgttaattaac

SEQ ID NO: 175579 - DNA, 25 bp, E. coli
tgccatcagctaagaggacagtcct

SEQ ID NO: 175580 - DNA, 25 bp, E. coli
tgccatcagctatgaggacagtcct

SEQ ID NO: 175581 - DNA, 25 bp, E. coli
gcttcgctatttttggtgccatcag

SEQ ID NO: 175582 - DNA, 25 bp, E. coli
gcttcgctatttatggtgccatcag

SEQ ID NO: 175583 - DNA, 25 bp, E. coli
gacgaaaatccaggcttcgctattt

SEQ ID NO: 175584 - DNA, 25 bp, E. coli
gacgaaaatccacgcttcgctattt

SEQ ID NO: 175585 - DNA, 25 bp, E. coli
cattcattaaactaatccattgcca

SEQ ID NO: 175586 - DNA, 25 bp, E. coli
ggtttaggttaaaagacatcagttg

SEQ ID NO: 175587 - DNA, 25 bp, E. coli
ggtttaggttaatagacatcagttg

SEQ ID NO: 175588 - DNA, 25 bp, E. coli
taaaatatataaaaaagcccttgct

SEQ ID NO: 175589 - DNA, 25 bp, E. coli
aatgccgatgatattccgccagcca

SEQ ID NO: 175590 - DNA, 25 bp, E. coli
aatgccgatgattttccgccagcca

SEQ ID NO: 175591 - DNA, 25 bp, E. coli
ccgccagccaatgaaccggtaattg

SEQ ID NO: 175592 - DNA, 25 bp, E. coli
caaattgcggtacgtattattcgca

SEQ ID NO: 175593 - DNA, 25 bp, E. coli
ccgccagccaatcaaccggtaattg

SEQ ID NO: 175594 - DNA, 25 bp, E. coli
caaattgcggtaggtattattcgca

SEQ ID NO: 175595 - DNA, 25 bp, E. coli
aacaggcggtggtgcgtgaacttca

SEQ ID NO: 175596 - DNA, 25 bp, E. coli
aacaggcggtggagcgtgaacttca

SEQ ID NO: 175597 - DNA, 25 bp, E. coli
tattcgcaacgacaacaatgaaatc

SEQ ID NO: 175598 - DNA, 25 bp, E. coli
tattcgcaacgagaacaatgaaatc

SEQ ID NO: 175599 - DNA, 25 bp, E. coli
gcgaataaactgcagtttcccggcg

SEQ ID NO: 175600 - DNA, 25 bp, E. coli
gcgaataaactggagtttcccggcg

SEQ ID NO: 175601 - DNA, 25 bp, E. coli
gcagcagatgcggacatggcgaata

SEQ ID NO: 175602 - DNA, 25 bp, E. coli
gcagcagatgcgcacatggcgaata

SEQ ID NO: 175603 - DNA, 25 bp, E. coli
gaaatctttatatcgcgtcgcgcag

SEQ ID NO: 175604 - DNA, 25 bp, E. coli
gaaatctttataacgcgtcgcgcag

SEQ ID NO: 175605 - DNA, 25 bp, E. coli
cgctatttgaaaaactggaatatga

SEQ ID NO: 175606 - DNA, 25 bp, E. coli
cgctatttgaaatactggaatatga

SEQ ID NO: 175607 - DNA, 25 bp, E. coli
cgtgaacttcagcaagaagtcggga

SEQ ID NO: 175608 - DNA, 25 bp, E. coli
cgtgaacttcaggaagaagtcggga

SEQ ID NO: 175609 - DNA, 25 bp, E. coli
ggaatatgaattcccggacaggcat

SEQ ID NO: 175610 - DNA, 25 bp, E. coli
ggaatatgaattgccggacaggcat

SEQ ID NO: 175611 - DNA, 25 bp, E. coli
aatgctactcgcaactgcgctggcc

SEQ ID NO: 175612 - DNA, 25 bp, E. coli
aatgctactcgctactgcgctggcc

SEQ ID NO: 175613 - DNA, 25 bp, E. coli
atgctactcgcttctgcgctggccc

SEQ ID NO: 175614 - DNA, 25 bp, E. coli
atgctactcgctactgcgctggccc

SEQ ID NO: 175615 - DNA, 25 bp, E. coli
actgcgctggccctgcttattacag

SEQ ID NO: 175616 - DNA, 25 bp, E. coli
aaaaaatgctacacgctactgcgct

SEQ ID NO: 175617 - DNA, 25 bp, E. coli
aaaaaatgctactcgctactgcgct

SEQ ID NO: 175618 - DNA, 25 bp, E. coli
aaatgctactcgctactgcgctggc

SEQ ID NO: 175619 - DNA, 25 bp, E. coli
aaatgctactcggtactgcgctggc

SEQ ID NO: 175620 - DNA, 25 bp, E. coli
aaaaatgctactcgctactgcgctg

SEQ ID NO: 175621 - DNA, 25 bp, E. coli
aaaaatgctactggctactgcgctg

SEQ ID NO: 175622 - DNA, 25 bp, E. coli
actgcgctggccgtgcttattacag

SEQ ID NO: 175623 - DNA, 25 bp, E. coli
tgctactcgctagtgcgctggccct

SEQ ID NO: 175624 - DNA, 25 bp, E. coli
tgctactcgctactgcgctggccct

SEQ ID NO: 175625 - DNA, 25 bp, E. coli
tgcgctggccctccttattacagga

SEQ ID NO: 175626 - DNA, 25 bp, E. coli
tgcgctggccctgcttattacagga

SEQ ID NO: 175627 - DNA, 25 bp, E. coli
tcgctactgcgctggccctgcttat

SEQ ID NO: 175628 - DNA, 25 bp, E. coli
tcgctactgcgcaggccctgcttat

SEQ ID NO: 175629 - DNA, 25 bp, E. coli
gcgctggccctggttattacaggat

SEQ ID NO: 175630 - DNA, 25 bp, E. coli
gcgctggccctgcttattacaggat

SEQ ID NO: 175631 - DNA, 25 bp, E. coli
ctgcgctggccctgcttattacagg

SEQ ID NO: 175632 - DNA, 25 bp, E. coli
ctgcgctggcccagcttattacagg

SEQ ID NO: 175633 - DNA, 25 bp, E. coli
cataatgcgcttcatgctcgggcct

SEQ ID NO: 175634 - DNA, 25 bp, E. coli
cataatgcgcttgatgctcgggcct

SEQ ID NO: 175635 - DNA, 25 bp, E. coli
aactttcagatcctcaatgtcagcg

SEQ ID NO: 175636 - DNA, 25 bp, E. coli
aactttcagatcgtcaatgtcagcg

SEQ ID NO: 175637 - DNA, 25 bp, E. coli
taggtcaaaataaccagagcctgcg

SEQ ID NO: 175638 - DNA, 25 bp, E. coli
taggtcaaaatatccagagcctgcg

SEQ ID NO: 175639 - DNA, 25 bp, E. coli
tgtcagcgccatcgttgtgttcagc

SEQ ID NO: 175640 - DNA, 25 bp, E. coli
tgtcagcgccatggttgtgttcagc

SEQ ID NO: 175641 - DNA, 25 bp, E. coli
tcagcgttagcattggcagattcca

SEQ ID NO: 175642 - DNA, 25 bp, E. coli
tctgagcagaagaacgagcatggcg

SEQ ID NO: 175643 - DNA, 25 bp, E. coli
tctgagcagaagtacgagcatggcg

SEQ ID NO: 175644 - DNA, 25 bp, E. coli
tcagcgttagcaatggcagattcca

SEQ ID NO: 175645 - DNA, 25 bp, E. coli
gcgaatcaggtcagcaacaaggcga

SEQ ID NO: 175646 - DNA, 25 bp, E. coli
gcgaatcaggtctgcaacaaggcga

SEQ ID NO: 175647 - DNA, 25 bp, E. coli
gcgatcggacactaccacagtgatg

SEQ ID NO: 175648 - DNA, 25 bp, E. coli
gcgatcggacacaaccacagtgatg

SEQ ID NO: 175649 - DNA, 25 bp, E. coli
gcttcaggatgcgatctgcacgacc

SEQ ID NO: 175650 - DNA, 25 bp, E. coli
gcttcaggatgccatctgcacgacc

SEQ ID NO: 175651 - DNA, 25 bp, E. coli
gcacgaccttttgcacgcggcataa

SEQ ID NO: 175652 - DNA, 25 bp, E. coli
gcacgaccttttccacgcggcataa

SEQ ID NO: 175653 - DNA, 25 bp, E. coli
gaactttcttgaccagtacagccgc

SEQ ID NO: 175654 - DNA, 25 bp, E. coli
gaactttcttgagcagtacagccgc

SEQ ID NO: 175655 - DNA, 25 bp, E. coli
catttcccggatgtcgcgttatgga

SEQ ID NO: 175656 - DNA, 25 bp, E. coli
catttcccggatctcgcgttatgga

SEQ ID NO: 175657 - DNA, 25 bp, E. coli
taacgattaagagtgtgacgaggaa

SEQ ID NO: 175658 - DNA, 25 bp, E. coli
agggaggctgcgaatgcgcccctcc

SEQ ID NO: 175659 - DNA, 25 bp, E. coli
agggaggctgcgtatgcgcccctcc

SEQ ID NO: 175660 - DNA, 25 bp, E. coli
ttaaatccccgcatggcgagggagg

SEQ ID NO: 175661 - DNA, 25 bp, E. coli
ttaaatccccgcttggcgagggagg

SEQ ID NO: 175662 - DNA, 25 bp, E. coli
tgtgacgaggaaatgagatgatgcc

SEQ ID NO: 175663 - DNA, 25 bp, E. coli
tgtttcatcggcgtgagcggagcca

SEQ ID NO: 175664 - DNA, 25 bp, E. coli
tgtttcatcggcctgagcggagcca

SEQ ID NO: 175665 - DNA, 25 bp, E. coli
tgtgacgaggaattgagatgatgcc

SEQ ID NO: 175666 - DNA, 25 bp, E. coli
tgagcggagccacgcctgacatttg

SEQ ID NO: 175667 - DNA, 25 bp, E. coli
tgagcggagccaggcctgacatttg

SEQ ID NO: 175668 - DNA, 25 bp, E. coli
cctttgcttcccatgctaaacaggt

SEQ ID NO: 175669 - DNA, 25 bp, E. coli
cctttgcttcccttgctaaacaggt

SEQ ID NO: 175670 - DNA, 25 bp, E. coli
gctggtaatccagacatttcccgga

SEQ ID NO: 175671 - DNA, 25 bp, E. coli
gctggtaatccacacatttcccgga

SEQ ID NO: 175672 - DNA, 25 bp, E. coli
gcggcaacgggcttccgttaacgat

SEQ ID NO: 175673 - DNA, 25 bp, E. coli
gcggcaacgggcatccgttaacgat

SEQ ID NO: 175674 - DNA, 25 bp, E. coli
taacgattaagactgtgacgaggaa

SEQ ID NO: 175675 - DNA, 25 bp, E. coli
gatgatgccgatcattaaatccccg

SEQ ID NO: 175676 - DNA, 25 bp, E. coli
gatgatgccgatgattaaatccccg

SEQ ID NO: 175677 - DNA, 25 bp, E. coli
caacgttgtatctgagtggcagcca

SEQ ID NO: 175678 - DNA, 25 bp, E. coli
aacgctgaagtaaggtctgccggca

SEQ ID NO: 175679 - DNA, 25 bp, E. coli
caacgttgtatcagagtggcagcca

SEQ ID NO: 175680 - DNA, 25 bp, E. coli
tacagtgttctttcccaggacggag

SEQ ID NO: 175681 - DNA, 25 bp, E. coli
tacagtgttcttacccaggacggag

SEQ ID NO: 175682 - DNA, 25 bp, E. coli
acattaacacctggctggagcggga

SEQ ID NO: 175683 - DNA, 25 bp, E. coli
aacgctgaagtatggtctgccggca

SEQ ID NO: 175684 - DNA, 25 bp, E. coli
acattaacacctcgctggagcggga

SEQ ID NO: 175685 - DNA, 25 bp, E. coli
tataaattaccgaaggaaagcgccg

SEQ ID NO: 175686 - DNA, 25 bp, E. coli
tataaattaccgtaggaaagcgccg

SEQ ID NO: 175687 - DNA, 25 bp, E. coli
tccggacagccagagagggtatgca

SEQ ID NO: 175688 - DNA, 25 bp, E. coli
tccggacagccacagagggtatgca

SEQ ID NO: 175689 - DNA, 25 bp, E. coli
tcttcgggacaacaccagctggagt

SEQ ID NO: 175690 - DNA, 25 bp, E. coli
tcttcgggacaagaccagctggagt

SEQ ID NO: 175691 - DNA, 25 bp, E. coli
gaaatttaatattctgccgctggca

SEQ ID NO: 175692 - DNA, 25 bp, E. coli
gaaatttaatatactgccgctggca

SEQ ID NO: 175693 - DNA, 25 bp, E. coli
gataaatcactgaccggctctgctg

SEQ ID NO: 175694 - DNA, 25 bp, E. coli
gataaatcactgtccggctctgctg

SEQ ID NO: 175695 - DNA, 25 bp, E. coli
ggctgactataaaacccgtgtgggt

SEQ ID NO: 175696 - DNA, 25 bp, E. coli
ggctgactataatacccgtgtgggt

SEQ ID NO: 175697 - DNA, 25 bp, E. coli
taaacgatatttatccggccgggag

SEQ ID NO: 175698 - DNA, 25 bp, E. coli
taaacgatatttttccggccgggag

SEQ ID NO: 175699 - DNA, 25 bp, E. coli
cagaatattatgaatggccgcggcg

SEQ ID NO: 175700 - DNA, 25 bp, E. coli
cagaatattatgtatggccgcggcg

SEQ ID NO: 175701 - DNA, 25 bp, E. coli
tactttatagcgctgccagcctgaa

SEQ ID NO: 175702 - DNA, 25 bp, E. coli
tactttatagcggtgccagcctgaa

SEQ ID NO: 175703 - DNA, 25 bp, E. coli
taaaaggcagcgtccggaactggat

SEQ ID NO: 175704 - DNA, 25 bp, E. coli
taaaaggcagcgaccggaactggat

SEQ ID NO: 175705 - DNA, 25 bp, E. coli
tatctcgaacaggatgacggtggca

SEQ ID NO: 175706 - DNA, 25 bp, E. coli
tattatccagttgctgcgcgaaggg

SEQ ID NO: 175707 - DNA, 25 bp, E. coli
tatctcgaacagcatgacggtggca

SEQ ID NO: 175708 - DNA, 25 bp, E. coli
tattatccagttcctgcgcgaaggg

SEQ ID NO: 175709 - DNA, 25 bp, E. coli
ttatcatttccagggcgatgccgac

SEQ ID NO: 175710 - DNA, 25 bp, E. coli
ttatcatttccacggcgatgccgac

SEQ ID NO: 175711 - DNA, 25 bp, E. coli
tgaaggttcgtaaactcatccgccg

SEQ ID NO: 175712 - DNA, 25 bp, E. coli
tgaaggttcgtatactcatccgccg

SEQ ID NO: 175713 - DNA, 25 bp, E. coli
gcgcctggcgtcaggatctggaaaa

SEQ ID NO: 175714 - DNA, 25 bp, E. coli
gcgcctggcgtctggatctggaaaa

SEQ ID NO: 175715 - DNA, 25 bp, E. coli
gatattcgtctgttccgccaggagc

SEQ ID NO: 175716 - DNA, 25 bp, E. coli
gatattcgtctgatccgccaggagc

SEQ ID NO: 175717 - DNA, 25 bp, E. coli
ggcgctgcggcaactaacactaacg

SEQ ID NO: 175718 - DNA, 25 bp, E. coli
ggcgctgcggcatctaacactaacg

SEQ ID NO: 175719 - DNA, 25 bp, E. coli
gagacgctgctggaaaaaatagcca

SEQ ID NO: 175720 - DNA, 25 bp, E. coli
gagacgctgctgcaaaaaatagcca

SEQ ID NO: 175721 - DNA, 25 bp, E. coli
caacagaaacagtcaaatgccgcaa

SEQ ID NO: 175722 - DNA, 25 bp, E. coli
caacagaaacagacaaatgccgcaa

SEQ ID NO: 175723 - DNA, 25 bp, E. coli
caaatgccgcaatatgaactcagtt

SEQ ID NO: 175724 - DNA, 25 bp, E. coli
cactaaaactggataactgtgacga

SEQ ID NO: 175725 - DNA, 25 bp, E. coli
caaatgccgcaaaatgaactcagtt

SEQ ID NO: 175726 - DNA, 25 bp, E. coli
cactaaaactggttaactgtgacga

SEQ ID NO: 175727 - DNA, 25 bp, E. coli
cagtggattgaagtgctggcaacag

SEQ ID NO: 175728 - DNA, 25 bp, E. coli
cagtggattgaactgctggcaacag

SEQ ID NO: 175729 - DNA, 25 bp, E. coli
actgaattttcacgacagaatgtga

SEQ ID NO: 175730 - DNA, 25 bp, E. coli
actgaattttcaggacagaatgtga

SEQ ID NO: 175731 - DNA, 25 bp, E. coli
tgaactgctggcaacagaaacagac

SEQ ID NO: 175732 - DNA, 25 bp, E. coli
tgaactgctggctacagaaacagac

SEQ ID NO: 175733 - DNA, 25 bp, E. coli
tgaactcagttaatccactaaaact

SEQ ID NO: 175734 - DNA, 25 bp, E. coli
tgaactcagttattccactaaaact

SEQ ID NO: 175735 - DNA, 25 bp, E. coli
gattcgcaagtattggtggctcgtc

SEQ ID NO: 175736 - DNA, 25 bp, E. coli
gtttgatacttttctgatgcagtgg

SEQ ID NO: 175737 - DNA, 25 bp, E. coli
gattcgcaagtaatggtggctcgtc

SEQ ID NO: 175738 - DNA, 25 bp, E. coli
gtttgatactttactgatgcagtgg

SEQ ID NO: 175739 - DNA, 25 bp, E. coli
tggtggctcgtccttttcgctgtct

SEQ ID NO: 175740 - DNA, 25 bp, E. coli
tggtggctcgtcgttttcgctgtct

SEQ ID NO: 175741 - DNA, 25 bp, E. coli
taactgtgacgatctgaattttcag

SEQ ID NO: 175742 - DNA, 25 bp, E. coli
taactgtgacgaactgaattttcag

SEQ ID NO: 175743 - DNA, 25 bp, E. coli
aagtatggtcgggacgtctgatgtc

SEQ ID NO: 175744 - DNA, 25 bp, E. coli
aagtatggtcggcacgtctgatgtc

SEQ ID NO: 175745 - DNA, 25 bp, E. coli
cacgtctgatgtgtgcggtacttaa

SEQ ID NO: 175746 - DNA, 25 bp, E. coli
cacgtctgatgtctgcggtacttaa

SEQ ID NO: 175747 - DNA, 25 bp, E. coli
atggtcggtgcaggcgtcacccgta

SEQ ID NO: 175748 - DNA, 25 bp, E. coli
atggtcggtgcacgcgtcacccgta

SEQ ID NO: 175749 - DNA, 25 bp, E. coli
accctctggtgatccgcggacctgg

SEQ ID NO: 175750 - DNA, 25 bp, E. coli
acgcccgctggcggttggcgtacat

SEQ ID NO: 175751 - DNA, 25 bp, E. coli
acgcccgctggccgttggcgtacat

SEQ ID NO: 175752 - DNA, 25 bp, E. coli
accctctggtgaaccgcggacctgg

SEQ ID NO: 175753 - DNA, 25 bp, E. coli
aaccgaacctgacccgcgtgacgat

SEQ ID NO: 175754 - DNA, 25 bp, E. coli
aaccgaacctgagccgcgtgacgat

SEQ ID NO: 175755 - DNA, 25 bp, E. coli
tgaaacgcgcgcaggtacgcccgct

SEQ ID NO: 175756 - DNA, 25 bp, E. coli
tgaaacgcgcgctggtacgcccgct

SEQ ID NO: 175757 - DNA, 25 bp, E. coli
cgataaccctctggtgatccgcgga

SEQ ID NO: 175758 - DNA, 25 bp, E. coli
cgataaccctctcgtgatccgcgga

SEQ ID NO: 175759 - DNA, 25 bp, E. coli
cgatctctctggcaaagacgtgatg

SEQ ID NO: 175760 - DNA, 25 bp, E. coli
cgatctctctgggaaagacgtgatg

SEQ ID NO: 175761 - DNA, 25 bp, E. coli
ctgacccgcgtgacgatctctctgg

SEQ ID NO: 175762 - DNA, 25 bp, E. coli
ctgacccgcgtgtcgatctctctgg

SEQ ID NO: 175763 - DNA, 25 bp, E. coli
gaccaaatcctgaaacgcgcgcagg

SEQ ID NO: 175764 - DNA, 25 bp, E. coli
gaccaaatcctgtaacgcgcgcagg

SEQ ID NO: 175765 - DNA, 25 bp, E. coli
catggacgatgttattctgctggat

SEQ ID NO: 175766 - DNA, 25 bp, E. coli
cattatgaaggcttggacgatgtta

SEQ ID NO: 175767 - DNA, 25 bp, E. coli
cattatgaaggcatggacgatgtta

SEQ ID NO: 175768 - DNA, 25 bp, E. coli
catggacgatgtaattctgctggat

SEQ ID NO: 175769 - DNA, 25 bp, E. coli
acgcattcattaagaaggcatggac

SEQ ID NO: 175770 - DNA, 25 bp, E. coli
acgcattcattatgaaggcatggac

SEQ ID NO: 175771 - DNA, 25 bp, E. coli
tatgaaggcatggacgatgttattc

SEQ ID NO: 175772 - DNA, 25 bp, E. coli
tatgaaggcatgcacgatgttattc

SEQ ID NO: 175773 - DNA, 25 bp, E. coli
tattctgctggattttctgcccaaa

SEQ ID NO: 175774 - DNA, 25 bp, E. coli
tattctgctggaatttctgcccaaa

SEQ ID NO: 175775 - DNA, 25 bp, E. coli
tgttattctgctcgattttctgccc

SEQ ID NO: 175776 - DNA, 25 bp, E. coli
tgttattctgctggattttctgccc

SEQ ID NO: 175777 - DNA, 25 bp, E. coli
gcattcattatgtaggcatggacga

SEQ ID NO: 175778 - DNA, 25 bp, E. coli
gcattcattatgaaggcatggacga

SEQ ID NO: 175779 - DNA, 25 bp, E. coli
gaaggcatggaccatgttattctgc

SEQ ID NO: 175780 - DNA, 25 bp, E. coli
gaaggcatggacgatgttattctgc

SEQ ID NO: 175781 - DNA, 25 bp, E. coli
gacgatgttattctgctggattttc

SEQ ID NO: 175782 - DNA, 25 bp, E. coli
gacgatgttattgtgctggattttc

SEQ ID NO: 175783 - DNA, 25 bp, E. coli
cattcattatgatggcatggacgat

SEQ ID NO: 175784 - DNA, 25 bp, E. coli
cattcattatgaaggcatggacgat

SEQ ID NO: 175785 - DNA, 25 bp, E. coli
ggcatggacgatgttattctgctgg

SEQ ID NO: 175786 - DNA, 25 bp, E. coli
ggcatggacgatcttattctgctgg

SEQ ID NO: 175787 - DNA, 25 bp, E. coli
catttgtcgtaatgcccgttcgcac

SEQ ID NO: 175788 - DNA, 25 bp, E. coli
catttgtcgtaaagcccgttcgcac

SEQ ID NO: 175789 - DNA, 25 bp, E. coli
tagcgaccgatacattacctggcga

SEQ ID NO: 175790 - DNA, 25 bp, E. coli
tagcgaccgatagattacctggcga

SEQ ID NO: 175791 - DNA, 25 bp, E. coli
aacttgaagacctgctggaaaaagc

SEQ ID NO: 175792 - DNA, 25 bp, E. coli
gaatccaccgtctgggtgcctggta

SEQ ID NO: 175793 - DNA, 25 bp, E. coli
gaatccaccgtcagggtgcctggta

SEQ ID NO: 175794 - DNA, 25 bp, E. coli
aacttgaagaccagctggaaaaagc

SEQ ID NO: 175795 - DNA, 25 bp, E. coli
tatgccgcgtgaaatcagtttgttg

SEQ ID NO: 175796 - DNA, 25 bp, E. coli
tatgccgcgtgatatcagtttgttg

SEQ ID NO: 175797 - DNA, 25 bp, E. coli
tagcgcgcttgatttacagcactgg

SEQ ID NO: 175798 - DNA, 25 bp, E. coli
tagcgcgcttgaattacagcactgg

SEQ ID NO: 175799 - DNA, 25 bp, E. coli
tattatcggaagacgcagagccgcc

SEQ ID NO: 175800 - DNA, 25 bp, E. coli
tattatcggaagtcgcagagccgcc

SEQ ID NO: 175801 - DNA, 25 bp, E. coli
tgcgccattctatgaacgtcgctgg

SEQ ID NO: 175802 - DNA, 25 bp, E. coli
tgcgccattctaagaacgtcgctgg

SEQ ID NO: 175803 - DNA, 25 bp, E. coli
gcgaaacgctcttccttaatgccaa

SEQ ID NO: 175804 - DNA, 25 bp, E. coli
gcgaaacgctctaccttaatgccaa

SEQ ID NO: 175805 - DNA, 25 bp, E. coli
gcactgggaaaaagaagacggcacc

SEQ ID NO: 175806 - DNA, 25 bp, E. coli
gcactgggaaaatgaagacggcacc

SEQ ID NO: 175807 - DNA, 25 bp, E. coli
ggttgaagacgatcaggcatttgtc

SEQ ID NO: 175808 - DNA, 25 bp, E. coli
ggttgaagacgaacaggcatttgtc

SEQ ID NO: 175809 - DNA, 25 bp, E. coli
caaggcgaatttgtctaccgcgagc

SEQ ID NO: 175810 - DNA, 25 bp, E. coli
caaggcgaatttctctaccgcgagc

SEQ ID NO: 175811 - DNA, 25 bp, E. coli
caaataatgtgccagagctggccaa

SEQ ID NO: 175812 - DNA, 25 bp, E. coli
caaataatgtgcgagagctggccaa

SEQ ID NO: 175813 - DNA, 25 bp, E. coli
cagtatcggcgacgtttacagcagt

SEQ ID NO: 175814 - DNA, 25 bp, E. coli
cagtatcggcgaggtttacagcagt

SEQ ID NO: 175815 - DNA, 25 bp, E. coli
taacaatcctttagaggcgcaggcg

SEQ ID NO: 175816 - DNA, 25 bp, E. coli
taacaatccttttgaggcgcaggcg

SEQ ID NO: 175817 - DNA, 25 bp, E. coli
accgcttgacagacgagtggaggac

SEQ ID NO: 175818 - DNA, 25 bp, E. coli
accgcttgacagtcgagtggaggac

SEQ ID NO: 175819 - DNA, 25 bp, E. coli
tattggagacacctcgctggtcgag

SEQ ID NO: 175820 - DNA, 25 bp, E. coli
tattggagacacgtcgctggtcgag

SEQ ID NO: 175821 - DNA, 25 bp, E. coli
gcgcgtcgtcagtattgccaacaga

SEQ ID NO: 175822 - DNA, 25 bp, E. coli
gcgcgtcgtcagaattgccaacaga

SEQ ID NO: 175823 - DNA, 25 bp, E. coli
gcaaccatatcaacgcggagctcta

SEQ ID NO: 175824 - DNA, 25 bp, E. coli
gcaaccatatcatcgcggagctcta

SEQ ID NO: 175825 - DNA, 25 bp, E. coli
gacagataatcacagaggcgcttaa

SEQ ID NO: 175826 - DNA, 25 bp, E. coli
gacagataatcagagaggcgcttaa

SEQ ID NO: 175827 - DNA, 25 bp, E. coli
taaccatcctgtaccggaagtggga

SEQ ID NO: 175828 - DNA, 25 bp, E. coli
taaccatcctgttccggaagtggga

SEQ ID NO: 175829 - DNA, 25 bp, E. coli
gatgatgctgacctgctggacgcct

SEQ ID NO: 175830 - DNA, 25 bp, E. coli
gatgatgctgacgtgctggacgcct

SEQ ID NO: 175831 - DNA, 25 bp, E. coli
caaaatgatcggctgtaggaataaa

SEQ ID NO: 175832 - DNA, 25 bp, E. coli
caaaatgatcgggtgtaggaataaa

SEQ ID NO: 175833 - DNA, 25 bp, E. coli
tactcaaaatgaacggctgtaggaa

SEQ ID NO: 175834 - DNA, 25 bp, E. coli
tactcaaaatgatcggctgtaggaa

SEQ ID NO: 175835 - DNA, 25 bp, E. coli
aaatctacctttagtgaaattctcg

SEQ ID NO: 175836 - DNA, 25 bp, E. coli
aaatctaccttttgtgaaattctcg

SEQ ID NO: 175837 - DNA, 25 bp, E. coli
tagagttgttttcaatcagctatag

SEQ ID NO: 175838 - DNA, 25 bp, E. coli
tagagttgttttgaatcagctatag

SEQ ID NO: 175839 - DNA, 25 bp, E. coli
tattttactcaatatgatcggctgt

SEQ ID NO: 175840 - DNA, 25 bp, E. coli
tattttactcaaaatgatcggctgt

SEQ ID NO: 175841 - DNA, 25 bp, E. coli
gaaattctcgtcaatattttactca

SEQ ID NO: 175842 - DNA, 25 bp, E. coli
gaaattctcgtctatattttactca

SEQ ID NO: 175843 - DNA, 25 bp, E. coli
cggctgtaggaataaactatttgat

SEQ ID NO: 175844 - DNA, 25 bp, E. coli
cggctgtaggaaaaaactatttgat

SEQ ID NO: 175845 - DNA, 25 bp, E. coli
gttgttttcaatgagctatagatag

SEQ ID NO: 175846 - DNA, 25 bp, E. coli
gttgttttcaatcagctatagatag

SEQ ID NO: 175847 - DNA, 25 bp, E. coli
gatattattacgattttagagttgt

SEQ ID NO: 175848 - DNA, 25 bp, E. coli
gatattattacgtttttagagttgt

SEQ ID NO: 175849 - DNA, 25 bp, E. coli
taccttttgtgaaattctcgtcaat

SEQ ID NO: 175850 - DNA, 25 bp, E. coli
taccttttgtgatattctcgtcaat

SEQ ID NO: 175851 - DNA, 25 bp, E. coli
gatcggctgtagcaataaactattt

SEQ ID NO: 175852 - DNA, 25 bp, E. coli
gatcggctgtaggaataaactattt

SEQ ID NO: 175853 - DNA, 25 bp, E. coli
caacagttcctgttcgaagccgtac

SEQ ID NO: 175854 - DNA, 25 bp, E. coli
cagcttttcttacccggctgggaga

SEQ ID NO: 175855 - DNA, 25 bp, E. coli
caacagttcctgatcgaagccgtac

SEQ ID NO: 175856 - DNA, 25 bp, E. coli
cagcttttcttagccggctgggaga

SEQ ID NO: 175857 - DNA, 25 bp, E. coli
aaatgcggcacgactggatccagta

SEQ ID NO: 175858 - DNA, 25 bp, E. coli
aaatgcggcacgtctggatccagta

SEQ ID NO: 175859 - DNA, 25 bp, E. coli
tcggtggcgcgttgggaataacact

SEQ ID NO: 175860 - DNA, 25 bp, E. coli
tcggtggcgcgtagggaataacact

SEQ ID NO: 175861 - DNA, 25 bp, E. coli
gaagccgtactggtttgcctggtcg

SEQ ID NO: 175862 - DNA, 25 bp, E. coli
gaagccgtactgctttgcctggtcg

SEQ ID NO: 175863 - DNA, 25 bp, E. coli
cgcgagcaagcgttgttttgcaaca

SEQ ID NO: 175864 - DNA, 25 bp, E. coli
cgcgagcaagcgatgttttgcaaca

SEQ ID NO: 175865 - DNA, 25 bp, E. coli
cattcgcatggctgtaggtgcgcga

SEQ ID NO: 175866 - DNA, 25 bp, E. coli
cggacgcgggaaattggcattcgca

SEQ ID NO: 175867 - DNA, 25 bp, E. coli
cggacgcgggaatttggcattcgca

SEQ ID NO: 175868 - DNA, 25 bp, E. coli
cattcgcatggcagtaggtgcgcga

SEQ ID NO: 175869 - DNA, 25 bp, E. coli
gattttatttggctggttacccgca

SEQ ID NO: 175870 - DNA, 25 bp, E. coli
gatccagtagatcctctggcacgag

SEQ ID NO: 175871 - DNA, 25 bp, E. coli
gtttctctgctcgacggtcaccggg

SEQ ID NO: 175872 - DNA, 25 bp, E. coli
gattttatttgggtggttacccgca

SEQ ID NO: 175873 - DNA, 25 bp, E. coli
gtttctctgctccacggtcaccggg

SEQ ID NO: 175874 - DNA, 25 bp, E. coli
gatccagtagatgctctggcacgag

SEQ ID NO: 175875 - DNA, 25 bp, E. coli
aagagacggatggactgccttatcg

SEQ ID NO: 175876 - DNA, 25 bp, E. coli
aagagacggatgcactgccttatcg

SEQ ID NO: 175877 - DNA, 25 bp, E. coli
tatcgttatttgattcgtaaaggcg

SEQ ID NO: 175878 - DNA, 25 bp, E. coli
tatcgttatttgtttcgtaaaggcg

SEQ ID NO: 175879 - DNA, 25 bp, E. coli
cctttatggaactcgaactggttgc

SEQ ID NO: 175880 - DNA, 25 bp, E. coli
cctttatggaacacgaactggttgc

SEQ ID NO: 175881 - DNA, 25 bp, E. coli
aaagagacggatggactgccttatc

SEQ ID NO: 175882 - DNA, 25 bp, E. coli
aaagagacggatcgactgccttatc

SEQ ID NO: 175883 - DNA, 25 bp, E. coli
ttatttgattcgaaaaggcggttga

SEQ ID NO: 175884 - DNA, 25 bp, E. coli
ttatttgattcgtaaaggcggttga

SEQ ID NO: 175885 - DNA, 25 bp, E. coli
tgtacctttatggaacacgaactgg

SEQ ID NO: 175886 - DNA, 25 bp, E. coli
tgtacctttatgcaacacgaactgg

SEQ ID NO: 175887 - DNA, 25 bp, E. coli
tcgttatttgattcgtaaaggcggt

SEQ ID NO: 175888 - DNA, 25 bp, E. coli
tcgttatttgatacgtaaaggcggt

SEQ ID NO: 175889 - DNA, 25 bp, E. coli
gacggatggactcccttatcgttat

SEQ ID NO: 175890 - DNA, 25 bp, E. coli
gactgccttatccttatttgattcg

SEQ ID NO: 175891 - DNA, 25 bp, E. coli
gactgccttatcgttatttgattcg

SEQ ID NO: 175892 - DNA, 25 bp, E. coli
gacggatggactgccttatcgttat

SEQ ID NO: 175893 - DNA, 25 bp, E. coli
gatggactgcctaatcgttatttga

SEQ ID NO: 175894 - DNA, 25 bp, E. coli
gatggactgccttatcgttatttga

SEQ ID NO: 175895 - DNA, 25 bp, E. coli
gatctcttttcctgccctgaccaca

SEQ ID NO: 175896 - DNA, 25 bp, E. coli
gatctcttttccagccctgaccaca

SEQ ID NO: 175897 - DNA, 25 bp, E. coli
caccagtgcgcgatactatgaaacg

SEQ ID NO: 175898 - DNA, 25 bp, E. coli
caccagtgcgcgttactatgaaacg

SEQ ID NO: 175899 - DNA, 25 bp, E. coli
ctattaccgacgtagcctcggcgct

SEQ ID NO: 175900 - DNA, 25 bp, E. coli
ctattaccgacgaagcctcggcgct

SEQ ID NO: 175901 - DNA, 25 bp, E. coli
ataacattaaagacacgcgcccgga

SEQ ID NO: 175902 - DNA, 25 bp, E. coli
ataacattaaagtcacgcgcccgga

SEQ ID NO: 175903 - DNA, 25 bp, E. coli
tagatggcggtgttgagcgtgccga

SEQ ID NO: 175904 - DNA, 25 bp, E. coli
tagatggcggtgatgagcgtgccga

SEQ ID NO: 175905 - DNA, 25 bp, E. coli
tccatcctcagttggtcgaaggccg

SEQ ID NO: 175906 - DNA, 25 bp, E. coli
tccatcctcagtaggtcgaaggccg

SEQ ID NO: 175907 - DNA, 25 bp, E. coli
tctggcgaatcaaccgcaaatcacc

SEQ ID NO: 175908 - DNA, 25 bp, E. coli
tctggcgaatcatccgcaaatcacc

SEQ ID NO: 175909 - DNA, 25 bp, E. coli
gaatcatccgcatatcaccgttgta

SEQ ID NO: 175910 - DNA, 25 bp, E. coli
gaatcatccgcaaatcaccgttgta

SEQ ID NO: 175911 - DNA, 25 bp, E. coli
ccgcaaatcacccttgtagatggcg

SEQ ID NO: 175912 - DNA, 25 bp, E. coli
ccgcaaatcaccgttgtagatggcg

SEQ ID NO: 175913 - DNA, 25 bp, E. coli
tggtcgaaggccgtgcggataacat

SEQ ID NO: 175914 - DNA, 25 bp, E. coli
ggccgtgcggataacattaaagtca

SEQ ID NO: 175915 - DNA, 25 bp, E. coli
ggaatattgcggattccatcctcag

SEQ ID NO: 175916 - DNA, 25 bp, E. coli
tggtcgaaggccctgcggataacat

SEQ ID NO: 175917 - DNA, 25 bp, E. coli
ggccgtgcggattacattaaagtca

SEQ ID NO: 175918 - DNA, 25 bp, E. coli
ggaatattgcggtttccatcctcag

SEQ ID NO: 175919 - DNA, 25 bp, E. coli
cacattcaaggcttcgactacaacg

SEQ ID NO: 175920 - DNA, 25 bp, E. coli
cacattcaaggcatcgactacaacg

SEQ ID NO: 175921 - DNA, 25 bp, E. coli
caaacttcgcaggtttcgttgtggc

SEQ ID NO: 175922 - DNA, 25 bp, E. coli
caaacttcgcagctttcgttgtggc

SEQ ID NO: 175923 - DNA, 25 bp, E. coli
tatttgcaaagtacacctctattgg

SEQ ID NO: 175924 - DNA, 25 bp, E. coli
tatttgcaaagttcacctctattgg

SEQ ID NO: 175925 - DNA, 25 bp, E. coli
tgctgaacacccatatacactgggt

SEQ ID NO: 175926 - DNA, 25 bp, E. coli
tgctgaacacccttatacactgggt

SEQ ID NO: 175927 - DNA, 25 bp, E. coli
gctactgttggaagggctgctgata

SEQ ID NO: 175928 - DNA, 25 bp, E. coli
gctactgttggatgggctgctgata

SEQ ID NO: 175929 - DNA, 25 bp, E. coli
gactacaacgatccgctacatgcta

SEQ ID NO: 175930 - DNA, 25 bp, E. coli
gactacaacgatgcgctacatgcta

SEQ ID NO: 175931 - DNA, 25 bp, E. coli
ggtgtgcggtttcgtctattcaaag

SEQ ID NO: 175932 - DNA, 25 bp, E. coli
ggtgtgcggtttggtctattcaaag

SEQ ID NO: 175933 - DNA, 25 bp, E. coli
ggtgtttgtatcaatgtcgcgcata

SEQ ID NO: 175934 - DNA, 25 bp, E. coli
gtcgcgcatacaaaccaagctcttg

SEQ ID NO: 175935 - DNA, 25 bp, E. coli
ggtgtttgtatctatgtcgcgcata

SEQ ID NO: 175936 - DNA, 25 bp, E. coli
gtcgcgcatacataccaagctcttg

SEQ ID NO: 175937 - DNA, 25 bp, E. coli
ggctgctgatagatgcgcacttccc

SEQ ID NO: 175938 - DNA, 25 bp, E. coli
ggctgctgatagttgcgcacttccc

SEQ ID NO: 175939 - DNA, 25 bp, E. coli
gagctttagcttcttcgcgaatgca

SEQ ID NO: 175940 - DNA, 25 bp, E. coli
gagctttagcttgttcgcgaatgca

SEQ ID NO: 175941 - DNA, 25 bp, E. coli
aatcaccgattcacaacttagcgag

SEQ ID NO: 175942 - DNA, 25 bp, E. coli
aatcaccgattctcaacttagcgag

SEQ ID NO: 175943 - DNA, 25 bp, E. coli
cagatctcgatgttggttacgccag

SEQ ID NO: 175944 - DNA, 25 bp, E. coli
cagatctcgatgatggttacgccag

SEQ ID NO: 175945 - DNA, 25 bp, E. coli
taaaccaatggacagaatcaccgat

SEQ ID NO: 175946 - DNA, 25 bp, E. coli
taaaccaatggagagaatcaccgat

SEQ ID NO: 175947 - DNA, 25 bp, E. coli
acaggagcgtaatgtggcagatctc

SEQ ID NO: 175948 - DNA, 25 bp, E. coli
acaggagcgtaaagtggcagatctc

SEQ ID NO: 175949 - DNA, 25 bp, E. coli
gcttgccattctgcgtaaaacctat

SEQ ID NO: 175950 - DNA, 25 bp, E. coli
gcttgccattctccgtaaaacctat

SEQ ID NO: 175951 - DNA, 25 bp, E. coli
gaagccaagttagaactcgtcagaa

SEQ ID NO: 175952 - DNA, 25 bp, E. coli
gcaaggcggcatgtttggaccaaat

SEQ ID NO: 175953 - DNA, 25 bp, E. coli
gcaaggcggcatctttggaccaaat

SEQ ID NO: 175954 - DNA, 25 bp, E. coli
gaagccaagttacaactcgtcagaa

SEQ ID NO: 175955 - DNA, 25 bp, E. coli
gacagtttaaagagctgcttgccat

SEQ ID NO: 175956 - DNA, 25 bp, E. coli
gacagtttaaagtgctgcttgccat

SEQ ID NO: 175957 - DNA, 25 bp, E. coli
gtcaaacggtgctatgaagccaagt

SEQ ID NO: 175958 - DNA, 25 bp, E. coli
ggttacgccagactatcaaatatgc

SEQ ID NO: 175959 - DNA, 25 bp, E. coli
ggttacgccagagtatcaaatatgc

SEQ ID NO: 175960 - DNA, 25 bp, E. coli
gtcaaacggtgcaatgaagccaagt

SEQ ID NO: 175961 - DNA, 25 bp, E. coli
ggcgcagatctgtccaagcgacagt

SEQ ID NO: 175962 - DNA, 25 bp, E. coli
ggcgcagatctgaccaagcgacagt

SEQ ID NO: 175963 - DNA, 25 bp, E. coli
aatacatcgacaagctgatcccgcg

SEQ ID NO: 175964 - DNA, 25 bp, E. coli
aatacatcgacatgctgatcccgcg

SEQ ID NO: 175965 - DNA, 25 bp, E. coli
taaattagcgcaactctccagccgc

SEQ ID NO: 175966 - DNA, 25 bp, E. coli
taaattagcgcatctctccagccgc

SEQ ID NO: 175967 - DNA, 25 bp, E. coli
atgcgatcctgagccgcgatatgcg

SEQ ID NO: 175968 - DNA, 25 bp, E. coli
atgcgatcctgacccgcgatatgcg

SEQ ID NO: 175969 - DNA, 25 bp, E. coli
attgataatcctcaccgtgcgctgg

SEQ ID NO: 175970 - DNA, 25 bp, E. coli
attgataatcctgaccgtgcgctgg

SEQ ID NO: 175971 - DNA, 25 bp, E. coli
tcgccgatgaactggaagcacaaag

SEQ ID NO: 175972 - DNA, 25 bp, E. coli
tcgccgatgaacaggaagcacaaag

SEQ ID NO: 175973 - DNA, 25 bp, E. coli
gccaatggccttagcgaagcgatgc

SEQ ID NO: 175974 - DNA, 25 bp, E. coli
gccaatggcctttgcgaagcgatgc

SEQ ID NO: 175975 - DNA, 25 bp, E. coli
gaagcaagcctcgtataaattagcg

SEQ ID NO: 175976 - DNA, 25 bp, E. coli
gaagcaagcctcctataaattagcg

SEQ ID NO: 175977 - DNA, 25 bp, E. coli
gaagcgatgcttgaccgtctggcac

SEQ ID NO: 175978 - DNA, 25 bp, E. coli
gaagcgatgcttcaccgtctggcac

SEQ ID NO: 175979 - DNA, 25 bp, E. coli
cgtgatttatgaagcgcgcccgaac

SEQ ID NO: 175980 - DNA, 25 bp, E. coli
cgtgatttatgatgcgcgcccgaac

SEQ ID NO: 175981 - DNA, 25 bp, E. coli
gatgccatcgccgatattcgtgaac

SEQ ID NO: 175982 - DNA, 25 bp, E. coli
ggtaagcacacataaactccacgcg

SEQ ID NO: 175983 - DNA, 25 bp, E. coli
ggtaagcacacaaaaactccacgcg

SEQ ID NO: 175984 - DNA, 25 bp, E. coli
gatgccatcgcccatattcgtgaac

SEQ ID NO: 175985 - DNA, 25 bp, E. coli
caaggttttgtcctaattggcgcgg

SEQ ID NO: 175986 - DNA, 25 bp, E. coli
caaggttttgtcgtaattggcgcgg

SEQ ID NO: 175987 - DNA, 25 bp, E. coli
caacaaggttttgtcgtaattggcg

SEQ ID NO: 175988 - DNA, 25 bp, E. coli
cagcagcaggcgctcgatcgggtgg

SEQ ID NO: 175989 - DNA, 25 bp, E. coli
caacaaggttttctcgtaattggcg

SEQ ID NO: 175990 - DNA, 25 bp, E. coli
catttttagaacaaggcggcaaaga

SEQ ID NO: 175991 - DNA, 25 bp, E. coli
catcgccagcctcacatttttagaa

SEQ ID NO: 175992 - DNA, 25 bp, E. coli
cagcagcaggcggtcgatcgggtgg

SEQ ID NO: 175993 - DNA, 25 bp, E. coli
catcgccagcctgacatttttagaa

SEQ ID NO: 175994 - DNA, 25 bp, E. coli
ttttgtcgtaataggcgcgggcggc

SEQ ID NO: 175995 - DNA, 25 bp, E. coli
tttttagaacaacgcggcaaagaag

SEQ ID NO: 175996 - DNA, 25 bp, E. coli
tttttagaacaaggcggcaaagaag

SEQ ID NO: 175997 - DNA, 25 bp, E. coli
ttttgtcgtaattggcgcgggcggc

SEQ ID NO: 175998 - DNA, 25 bp, E. coli
gccagcctgacaattttagaacaag

SEQ ID NO: 175999 - DNA, 25 bp, E. coli
gccagcctgacatttttagaacaag

SEQ ID NO: 176000 - DNA, 25 bp, E. coli
gatccaacaaggttttgtcgtaatt

SEQ ID NO: 176001 - DNA, 25 bp, E. coli
gatccaacaaggatttgtcgtaatt

SEQ ID NO: 176002 - DNA, 25 bp, E. coli
gacatttttagatcaaggcggcaaa

SEQ ID NO: 176003 - DNA, 25 bp, E. coli
gacatttttagaacaaggcggcaaa

SEQ ID NO: 176004 - DNA, 25 bp, E. coli
ctgacatttttacaacaaggcggca

SEQ ID NO: 176005 - DNA, 25 bp, E. coli
catttttagaactaggcggcaaaga

SEQ ID NO: 176006 - DNA, 25 bp, E. coli
ctgacatttttagaacaaggcggca

SEQ ID NO: 176007 - DNA, 25 bp, E. coli
aagatgaactgaatgcccgtctccg

SEQ ID NO: 176008 - DNA, 25 bp, E. coli
aagatgaactgattgcccgtctccg

SEQ ID NO: 176009 - DNA, 25 bp, E. coli
agagcgcggcctggccagaatgcaa

SEQ ID NO: 176010 - DNA, 25 bp, E. coli
agagcgcggcctcgccagaatgcaa

SEQ ID NO: 176011 - DNA, 25 bp, E. coli
aactggcgctccgtgtggcagagct

SEQ ID NO: 176012 - DNA, 25 bp, E. coli
aactggcgctccctgtggcagagct

SEQ ID NO: 176013 - DNA, 25 bp, E. coli
tgattgcccgtcaccgctcgctggg

SEQ ID NO: 176014 - DNA, 25 bp, E. coli
tgattgcccgtctccgctcgctggg

SEQ ID NO: 176015 - DNA, 25 bp, E. coli
tgacgaaagatgtactgattgcccg

SEQ ID NO: 176016 - DNA, 25 bp, E. coli
tgacgaaagatgaactgattgcccg

SEQ ID NO: 176017 - DNA, 25 bp, E. coli
gcgcggcctggccagaatgcaataa

SEQ ID NO: 176018 - DNA, 25 bp, E. coli
gcgcggcctggcgagaatgcaataa

SEQ ID NO: 176019 - DNA, 25 bp, E. coli
gctgggtgaacatctgaaccgtgat

SEQ ID NO: 176020 - DNA, 25 bp, E. coli
gctgggtgaacaactgaaccgtgat

SEQ ID NO: 176021 - DNA, 25 bp, E. coli
gaaagaagaactcgcgctccgtgtg

SEQ ID NO: 176022 - DNA, 25 bp, E. coli
gaaagaagaactggcgctccgtgtg

SEQ ID NO: 176023 - DNA, 25 bp, E. coli
ccgctcgctgggtgaacaactgaac

SEQ ID NO: 176024 - DNA, 25 bp, E. coli
ccgctcgctgggagaacaactgaac

SEQ ID NO: 176025 - DNA, 25 bp, E. coli
ctgtggcatttgtgctgccgggaac

SEQ ID NO: 176026 - DNA, 25 bp, E. coli
gggacgaaagaacaactggcgctcc

SEQ ID NO: 176027 - DNA, 25 bp, E. coli
gggacgaaagaagaactggcgctcc

SEQ ID NO: 176028 - DNA, 25 bp, E. coli
ctgtggcatttgagctgccgggaac

SEQ ID NO: 176029 - DNA, 25 bp, E. coli
cactacagaggtagaattcgtttta

SEQ ID NO: 176030 - DNA, 25 bp, E. coli
cactacagaggttgaattcgtttta

SEQ ID NO: 176031 - DNA, 25 bp, E. coli
caggctggcactcgagtctctcatc

SEQ ID NO: 176032 - DNA, 25 bp, E. coli
caggctggcactggagtctctcatc

SEQ ID NO: 176033 - DNA, 25 bp, E. coli
gaattcgttttatagacctcctgtg

SEQ ID NO: 176034 - DNA, 25 bp, E. coli
gaattcgttttaaagacctcctgtg

SEQ ID NO: 176035 - DNA, 25 bp, E. coli
tatcagtgcctgtcagtttaccagg

SEQ ID NO: 176036 - DNA, 25 bp, E. coli
tatcagtgcctgacagtttaccagg

SEQ ID NO: 176037 - DNA, 25 bp, E. coli
tttaaagacctcgtgtggctatctg

SEQ ID NO: 176038 - DNA, 25 bp, E. coli
tttaaagacctcctgtggctatctg

SEQ ID NO: 176039 - DNA, 25 bp, E. coli
taaagacctcctgtggctatctgtt

SEQ ID NO: 176040 - DNA, 25 bp, E. coli
taaagacctcctctggctatctgtt

SEQ ID NO: 176041 - DNA, 25 bp, E. coli
tcccagcggacacgtatatcgtgcg

SEQ ID NO: 176042 - DNA, 25 bp, E. coli
tcccagcggacaggtatatcgtgcg

SEQ ID NO: 176043 - DNA, 25 bp, E. coli
gctatctgttgggtgatatccctta

SEQ ID NO: 176044 - DNA, 25 bp, E. coli
gctatctgttggctgatatccctta

SEQ ID NO: 176045 - DNA, 25 bp, E. coli
cgttttaaagacctcctgtggctat

SEQ ID NO: 176046 - DNA, 25 bp, E. coli
ctatctgttggctgatatcccttag

SEQ ID NO: 176047 - DNA, 25 bp, E. coli
cgttttaaagacgtcctgtggctat

SEQ ID NO: 176048 - DNA, 25 bp, E. coli
ctatctgttggcagatatcccttag

SEQ ID NO: 176049 - DNA, 25 bp, E. coli
gttttaaagacctcctgtggctatc

SEQ ID NO: 176050 - DNA, 25 bp, E. coli
gttttaaagaccacctgtggctatc

SEQ ID NO: 176051 - DNA, 25 bp, E. coli
taacagtgtggtcagccaggtccag

SEQ ID NO: 176052 - DNA, 25 bp, E. coli
taaaagctgtcggttttgagccgca

SEQ ID NO: 176053 - DNA, 25 bp, E. coli
taaaagctgtcgcttttgagccgca

SEQ ID NO: 176054 - DNA, 25 bp, E. coli
tgtcattactggttacggacgcgct

SEQ ID NO: 176055 - DNA, 25 bp, E. coli
tgtcattactggatacggacgcgct

SEQ ID NO: 176056 - DNA, 25 bp, E. coli
tgaattcccagatctgacgcacggg

SEQ ID NO: 176057 - DNA, 25 bp, E. coli
tgagcagtttactaccaacgccggg

SEQ ID NO: 176058 - DNA, 25 bp, E. coli
tgatgctaaaaacgaggagccgcct

SEQ ID NO: 176059 - DNA, 25 bp, E. coli
tgaattcccagaactgacgcacggg

SEQ ID NO: 176060 - DNA, 25 bp, E. coli
tgagcagtttacaaccaacgccggg

SEQ ID NO: 176061 - DNA, 25 bp, E. coli
tgatgctaaaaaggaggagccgcct

SEQ ID NO: 176062 - DNA, 25 bp, E. coli
tgcgaatacttggagggtgccgacc

SEQ ID NO: 176063 - DNA, 25 bp, E. coli
tgcgaatacttgcagggtgccgacc

SEQ ID NO: 176064 - DNA, 25 bp, E. coli
gccatcagatggaatacagccggaa

SEQ ID NO: 176065 - DNA, 25 bp, E. coli
gccatcagatggtatacagccggaa

SEQ ID NO: 176066 - DNA, 25 bp, E. coli
gcttcctggccgaaaaagatgcgga

SEQ ID NO: 176067 - DNA, 25 bp, E. coli
gcttcctggccgtaaaagatgcgga

SEQ ID NO: 176068 - DNA, 25 bp, E. coli
gaagaactcgataacctgcgccagc

SEQ ID NO: 176069 - DNA, 25 bp, E. coli
gaagaactcgattacctgcgccagc

SEQ ID NO: 176070 - DNA, 25 bp, E. coli
gattgaaaaccggagtacgacccgt

SEQ ID NO: 176071 - DNA, 25 bp, E. coli
gattgaaaaccgcagtacgacccgt

SEQ ID NO: 176072 - DNA, 25 bp, E. coli
taacagtgtggtgagccaggtccag

SEQ ID NO: 176073 - DNA, 25 bp, E. coli
cagccagagttttgaagccattacc

SEQ ID NO: 176074 - DNA, 25 bp, E. coli
cagccagagtttagaagccattacc

SEQ ID NO: 176075 - DNA, 25 bp, E. coli
tacgttaacagctgccggacctttc

SEQ ID NO: 176076 - DNA, 25 bp, E. coli
tacgttaacagcagccggacctttc

SEQ ID NO: 176077 - DNA, 25 bp, E. coli
tagactcgttgaaccacttaacctg

SEQ ID NO: 176078 - DNA, 25 bp, E. coli
tagactcgttgatccacttaacctg

SEQ ID NO: 176079 - DNA, 25 bp, E. coli
ttaccctggataccggagaagtgta

SEQ ID NO: 176080 - DNA, 25 bp, E. coli
ttaccctggatagcggagaagtgta

SEQ ID NO: 176081 - DNA, 25 bp, E. coli
gaagccaaaacctttagactcgttg

SEQ ID NO: 176082 - DNA, 25 bp, E. coli
gaagccaaaaccattagactcgttg

SEQ ID NO: 176083 - DNA, 25 bp, E. coli
gaagccattaccctggatagcggag

SEQ ID NO: 176084 - DNA, 25 bp, E. coli
gaagccattaccgtggatagcggag

SEQ ID NO: 176085 - DNA, 25 bp, E. coli
tgttacgttaactgctgccggacct

SEQ ID NO: 176086 - DNA, 25 bp, E. coli
tgaatttcgaactcaacgttctgac

SEQ ID NO: 176087 - DNA, 25 bp, E. coli
tgttacgttaacagctgccggacct

SEQ ID NO: 176088 - DNA, 25 bp, E. coli
tgaatttcgaacacaacgttctgac

SEQ ID NO: 176089 - DNA, 25 bp, E. coli
taacctgaccttaaatctttgccat

SEQ ID NO: 176090 - DNA, 25 bp, E. coli
tcaacgttctgagcttcagccagag

SEQ ID NO: 176091 - DNA, 25 bp, E. coli
taacctgacctttaatctttgccat

SEQ ID NO: 176092 - DNA, 25 bp, E. coli
tcaacgttctgaccttcagccagag

SEQ ID NO: 176093 - DNA, 25 bp, E. coli
gagtaatgaagccaaaacctttaga

SEQ ID NO: 176094 - DNA, 25 bp, E. coli
gagtaatgaagcgaaaacctttaga

SEQ ID NO: 176095 - DNA, 25 bp, E. coli
aagccgctgccgcagaattagcgct

SEQ ID NO: 176096 - DNA, 25 bp, E. coli
aagccgctgccggagaattagcgct

SEQ ID NO: 176097 - DNA, 25 bp, E. coli
aaagatgcgtcgggttaacctggca

SEQ ID NO: 176098 - DNA, 25 bp, E. coli
aaatgagccgtgtcgcggcacatca

SEQ ID NO: 176099 - DNA, 25 bp, E. coli
aaatgagccgtgacgcggcacatca

SEQ ID NO: 176100 - DNA, 25 bp, E. coli
aaagatgcgtcgcgttaacctggca

SEQ ID NO: 176101 - DNA, 25 bp, E. coli
ttaccaggaaatcagccgtgtcgcg

SEQ ID NO: 176102 - DNA, 25 bp, E. coli
ttaccaggaaatgagccgtgtcgcg

SEQ ID NO: 176103 - DNA, 25 bp, E. coli
tgtacgaatatcacatcactctggt

SEQ ID NO: 176104 - DNA, 25 bp, E. coli
tggttatatgtctaagatgcgtcgc

SEQ ID NO: 176105 - DNA, 25 bp, E. coli
tgatcattaccgtagattaccagga

SEQ ID NO: 176106 - DNA, 25 bp, E. coli
tgtacgaatatctcatcactctggt

SEQ ID NO: 176107 - DNA, 25 bp, E. coli
tgatcattaccgaagattaccagga

SEQ ID NO: 176108 - DNA, 25 bp, E. coli
tgccgcagaatttgcgctcggttaa

SEQ ID NO: 176109 - DNA, 25 bp, E. coli
tgccgcagaattagcgctcggttaa

SEQ ID NO: 176110 - DNA, 25 bp, E. coli
tctcatcactctggttaaaggtaag

SEQ ID NO: 176111 - DNA, 25 bp, E. coli
tctcatcactctcgttaaaggtaag

SEQ ID NO: 176112 - DNA, 25 bp, E. coli
ccaaaggcatgtacgaatatctcat

SEQ ID NO: 176113 - DNA, 25 bp, E. coli
ccaaaggcatgttcgaatatctcat

SEQ ID NO: 176114 - DNA, 25 bp, E. coli
gcggcacatcatgtgcttggttata

SEQ ID NO: 176115 - DNA, 25 bp, E. coli
gcggcacatcatctgcttggttata

SEQ ID NO: 176116 - DNA, 25 bp, E. coli
tggttatatgtcaaagatgcgtcgc

SEQ ID NO: 176117 - DNA, 25 bp, E. coli
atgcgttgtggcaacgaatgctggc

SEQ ID NO: 176118 - DNA, 25 bp, E. coli
atcgctttggcgtctttcgctttcc

SEQ ID NO: 176119 - DNA, 25 bp, E. coli
atgcgttgtggctacgaatgctggc

SEQ ID NO: 176120 - DNA, 25 bp, E. coli
atcgctttggcgactttcgctttcc

SEQ ID NO: 176121 - DNA, 25 bp, E. coli
tatcgcggcgtgctgaatggtattc

SEQ ID NO: 176122 - DNA, 25 bp, E. coli
tatcgcggcgtggtgaatggtattc

SEQ ID NO: 176123 - DNA, 25 bp, E. coli
tttaccggcggatactatcgcggcg

SEQ ID NO: 176124 - DNA, 25 bp, E. coli
tttaccggcggaaactatcgcggcg

SEQ ID NO: 176125 - DNA, 25 bp, E. coli
tgggcggaactgttaaacctgatgc

SEQ ID NO: 176126 - DNA, 25 bp, E. coli
tgggcggaactgataaacctgatgc

SEQ ID NO: 176127 - DNA, 25 bp, E. coli
tgaatggtattctcccgtgggcgga

SEQ ID NO: 176128 - DNA, 25 bp, E. coli
tgaatggtattcacccgtgggcgga

SEQ ID NO: 176129 - DNA, 25 bp, E. coli
ccagacggcgtggtgttattaagca

SEQ ID NO: 176130 - DNA, 25 bp, E. coli
ccgtcttgacgagtggcttacgcaa

SEQ ID NO: 176131 - DNA, 25 bp, E. coli
ccagacggcgtgctgttattaagca

SEQ ID NO: 176132 - DNA, 25 bp, E. coli
gaattactgcgcgagtttcccgact

SEQ ID NO: 176133 - DNA, 25 bp, E. coli
gaattactgcgccagtttcccgact

SEQ ID NO: 176134 - DNA, 25 bp, E. coli
ccgtcttgacgactggcttacgcaa

SEQ ID NO: 176135 - DNA, 25 bp, E. coli
tggcttacgcaagcgccagacggcg

SEQ ID NO: 176136 - DNA, 25 bp, E. coli
tggcttacgcaaccgccagacggcg

SEQ ID NO: 176137 - DNA, 25 bp, E. coli
taatgattggcgaattactgcgcga

SEQ ID NO: 176138 - DNA, 25 bp, E. coli
taatgattggcgtattactgcgcga

SEQ ID NO: 176139 - DNA, 25 bp, E. coli
atttttgtcatctgcacaggcgtag

SEQ ID NO: 176140 - DNA, 25 bp, E. coli
atttttgtcatcagcacaggcgtag

SEQ ID NO: 176141 - DNA, 25 bp, E. coli
tattcggcggcgtcggttccggcct

SEQ ID NO: 176142 - DNA, 25 bp, E. coli
tattcggcggcgacggttccggcct

SEQ ID NO: 176143 - DNA, 25 bp, E. coli
tgtcatctgcactggcgtagtgatg

SEQ ID NO: 176144 - DNA, 25 bp, E. coli
tgtcatctgcacaggcgtagtgatg

SEQ ID NO: 176145 - DNA, 25 bp, E. coli
tttgcgcttattcgcgcgtttaccc

SEQ ID NO: 176146 - DNA, 25 bp, E. coli
tttgcgcttattggcgcgtttaccc

SEQ ID NO: 176147 - DNA, 25 bp, E. coli
ccattcttggccagaatatactggg

SEQ ID NO: 176148 - DNA, 25 bp, E. coli
ccattcttggcctgaatatactggg

SEQ ID NO: 176149 - DNA, 25 bp, E. coli
gcggtgatttttgcgcttattcgcg

SEQ ID NO: 176150 - DNA, 25 bp, E. coli
gcggtgatttttccgcttattcgcg

SEQ ID NO: 176151 - DNA, 25 bp, E. coli
gcagtatctctctgccattcttggc

SEQ ID NO: 176152 - DNA, 25 bp, E. coli
gcagtatctctcagccattcttggc

SEQ ID NO: 176153 - DNA, 25 bp, E. coli
cttatcaggctgtgacgaccattga

SEQ ID NO: 176154 - DNA, 25 bp, E. coli
cttatcaggctgagacgaccattga

SEQ ID NO: 176155 - DNA, 25 bp, E. coli
gttatgggtgtttgcccctgtggca

SEQ ID NO: 176156 - DNA, 25 bp, E. coli
gttatgggtgttagcccctgtggca

SEQ ID NO: 176157 - DNA, 25 bp, E. coli
gtgttagcccctctggcattgttga

SEQ ID NO: 176158 - DNA, 25 bp, E. coli
gtgttagcccctgtggcattgttga

SEQ ID NO: 176159 - DNA, 25 bp, E. coli
gaccattgaaggttcgcaacagctg

SEQ ID NO: 176160 - DNA, 25 bp, E. coli
gaccattgaaggatcgcaacagctg

SEQ ID NO: 176161 - DNA, 25 bp, E. coli
cacagaggttagatctcgcgtcatt

SEQ ID NO: 176162 - DNA, 25 bp, E. coli
cacagaggttagttctcgcgtcatt

SEQ ID NO: 176163 - DNA, 25 bp, E. coli
atcctggaagagaacctggagcgtc

SEQ ID NO: 176164 - DNA, 25 bp, E. coli
atcctggaagagtacctggagcgtc

SEQ ID NO: 176165 - DNA, 25 bp, E. coli
aaagtggcaataggcggtattctcg

SEQ ID NO: 176166 - DNA, 25 bp, E. coli
aaagtggcaatacgcggtattctcg

SEQ ID NO: 176167 - DNA, 25 bp, E. coli
tgtagaaagttcaatcctggaagag

SEQ ID NO: 176168 - DNA, 25 bp, E. coli
tgtagaaagttctatcctggaagag

SEQ ID NO: 176169 - DNA, 25 bp, E. coli
tgctcacagaggatagttctcgcgt

SEQ ID NO: 176170 - DNA, 25 bp, E. coli
tgctcacagaggttagttctcgcgt

SEQ ID NO: 176171 - DNA, 25 bp, E. coli
ccagctgctcacagaggttagttct

SEQ ID NO: 176172 - DNA, 25 bp, E. coli
ccagctgctcactgaggttagttct

SEQ ID NO: 176173 - DNA, 25 bp, E. coli
cgaatttatgaatgtggcaataggc

SEQ ID NO: 176174 - DNA, 25 bp, E. coli
cgaatttatgaaagtggcaataggc

SEQ ID NO: 176175 - DNA, 25 bp, E. coli
cgtaatgatgtacaaagttcaatcc

SEQ ID NO: 176176 - DNA, 25 bp, E. coli
cgataaccagctgctcacagaggtt

SEQ ID NO: 176177 - DNA, 25 bp, E. coli
cgccgatggacgaaatgatgtagaa

SEQ ID NO: 176178 - DNA, 25 bp, E. coli
cgataaccagctcctcacagaggtt

SEQ ID NO: 176179 - DNA, 25 bp, E. coli
cgccgatggacgtaatgatgtagaa

SEQ ID NO: 176180 - DNA, 25 bp, E. coli
cgtaatgatgtagaaagttcaatcc

SEQ ID NO: 176181 - DNA, 25 bp, E. coli
tcaatcctggaagagaacctggagc

SEQ ID NO: 176182 - DNA, 25 bp, E. coli
tcaatcctggaacagaacctggagc

SEQ ID NO: 176183 - DNA, 25 bp, E. coli
caattagcggacctatcggcaaatc

SEQ ID NO: 176184 - DNA, 25 bp, E. coli
caattagcggacgtatcggcaaatc

SEQ ID NO: 176185 - DNA, 25 bp, E. coli
tatgacagcgcgtaaggcgaactgg

SEQ ID NO: 176186 - DNA, 25 bp, E. coli
tatgacagcgcgaaaggcgaactgg

SEQ ID NO: 176187 - DNA, 25 bp, E. coli
tttgcataaggaaaacgccaccagc

SEQ ID NO: 176188 - DNA, 25 bp, E. coli
tttgcataaggataacgccaccagc

SEQ ID NO: 176189 - DNA, 25 bp, E. coli
tgtgaccgttgatgaaagcaccggc

SEQ ID NO: 176190 - DNA, 25 bp, E. coli
tgtcagcggcctccaaaaagcgcgt

SEQ ID NO: 176191 - DNA, 25 bp, E. coli
tgtgaccgttgaagaaagcaccggc

SEQ ID NO: 176192 - DNA, 25 bp, E. coli
tgtcagcggcctgcaaaaagcgcgt

SEQ ID NO: 176193 - DNA, 25 bp, E. coli
tccgggagagcacgttaaagccact

SEQ ID NO: 176194 - DNA, 25 bp, E. coli
tccgggagagcaggttaaagccact

SEQ ID NO: 176195 - DNA, 25 bp, E. coli
gcacggattgatgaaggcgtccaac

SEQ ID NO: 176196 - DNA, 25 bp, E. coli
gcacggattgatcaaggcgtccaac

SEQ ID NO: 176197 - DNA, 25 bp, E. coli
gaaaggtacgctgcaattctccgat

SEQ ID NO: 176198 - DNA, 25 bp, E. coli
gaaagctcacgtcggtgaaccgcag

SEQ ID NO: 176199 - DNA, 25 bp, E. coli
gaaaggtacgctccaattctccgat

SEQ ID NO: 176200 - DNA, 25 bp, E. coli
gaaagctcacgtgggtgaaccgcag

SEQ ID NO: 176201 - DNA, 25 bp, E. coli
ctaatgggcaaacgactgaactggc

SEQ ID NO: 176202 - DNA, 25 bp, E. coli
ctaatgggcaaaggactgaactggc

SEQ ID NO: 176203 - DNA, 25 bp, E. coli
taagactgaatttccaggccgcacc

SEQ ID NO: 176204 - DNA, 25 bp, E. coli
taagactgaattaccaggccgcacc

SEQ ID NO: 176205 - DNA, 25 bp, E. coli
taaaaaccgcgaagccggtcatgct

SEQ ID NO: 176206 - DNA, 25 bp, E. coli
taaaaaccgcgatgccggtcatgct

SEQ ID NO: 176207 - DNA, 25 bp, E. coli
tttcgcatcatttagtggagtcacg

SEQ ID NO: 176208 - DNA, 25 bp, E. coli
tttcgcatcattaagtggagtcacg

SEQ ID NO: 176209 - DNA, 25 bp, E. coli
tgaaagccttcagccgaacgctaaa

SEQ ID NO: 176210 - DNA, 25 bp, E. coli
tgaaagccttcacccgaacgctaaa

SEQ ID NO: 176211 - DNA, 25 bp, E. coli
gccggtcatgctgcttttcgcatca

SEQ ID NO: 176212 - DNA, 25 bp, E. coli
gccggtcatgctccttttcgcatca

SEQ ID NO: 176213 - DNA, 25 bp, E. coli
gctgcttttcgcttcattaagtgga

SEQ ID NO: 176214 - DNA, 25 bp, E. coli
gctgcttttcgcatcattaagtgga

SEQ ID NO: 176215 - DNA, 25 bp, E. coli
gaacgctaaaaagcgcgatgccggt

SEQ ID NO: 176216 - DNA, 25 bp, E. coli
gcatcattaagtggagtcacgacaa

SEQ ID NO: 176217 - DNA, 25 bp, E. coli
gcatcattaagtcgagtcacgacaa

SEQ ID NO: 176218 - DNA, 25 bp, E. coli
gaacgctaaaaaccgcgatgccggt

SEQ ID NO: 176219 - DNA, 25 bp, E. coli
tcacccgaacgcaaaaaaccgcgat

SEQ ID NO: 176220 - DNA, 25 bp, E. coli
taagtggagtcacgacaatgagtta

SEQ ID NO: 176221 - DNA, 25 bp, E. coli
taagtggagtcaggacaatgagtta

SEQ ID NO: 176222 - DNA, 25 bp, E. coli
tcacccgaacgctaaaaaccgcgat

SEQ ID NO: 176223 - DNA, 25 bp, E. coli
gagtcacgacaatgagttatgctga

SEQ ID NO: 176224 - DNA, 25 bp, E. coli
gatgccggtcatgctgcttttcgca

SEQ ID NO: 176225 - DNA, 25 bp, E. coli
gagtcacgacaaagagttatgctga

SEQ ID NO: 176226 - DNA, 25 bp, E. coli
gatgccggtcatcctgcttttcgca

SEQ ID NO: 176227 - DNA, 25 bp, E. coli
accgtggttggtgtgttgttcctga

SEQ ID NO: 176228 - DNA, 25 bp, E. coli
accgtggttggtctgttgttcctga

SEQ ID NO: 176229 - DNA, 25 bp, E. coli
acagctcccgcactgatgtacgtgg

SEQ ID NO: 176230 - DNA, 25 bp, E. coli
acagctcccgcagtgatgtacgtgg

SEQ ID NO: 176231 - DNA, 25 bp, E. coli
tatcgtttctgatccccggttatgc

SEQ ID NO: 176232 - DNA, 25 bp, E. coli
tatcgtttctgaaccccggttatgc

SEQ ID NO: 176233 - DNA, 25 bp, E. coli
tcccgcactgatgtacgtgggtttg

SEQ ID NO: 176234 - DNA, 25 bp, E. coli
tcccgcactgatctacgtgggtttg

SEQ ID NO: 176235 - DNA, 25 bp, E. coli
tctgatccccggttatgccacagct

SEQ ID NO: 176236 - DNA, 25 bp, E. coli
tctgatccccggatatgccacagct

SEQ ID NO: 176237 - DNA, 25 bp, E. coli
ctttgtaacactggtggtgggtcgc

SEQ ID NO: 176238 - DNA, 25 bp, E. coli
ctttgtaacactcgtggtgggtcgc

SEQ ID NO: 176239 - DNA, 25 bp, E. coli
gttatgccacagctcccgcactgat

SEQ ID NO: 176240 - DNA, 25 bp, E. coli
gttatgccacaggtcccgcactgat

SEQ ID NO: 176241 - DNA, 25 bp, E. coli
ggtgtgttgttcgtgatgattctgt

SEQ ID NO: 176242 - DNA, 25 bp, E. coli
ggtgtgttgttcctgatgattctgt

SEQ ID NO: 176243 - DNA, 25 bp, E. coli
taacactggtggagggtcgcgtctt

SEQ ID NO: 176244 - DNA, 25 bp, E. coli
taacactggtggtgggtcgcgtctt

SEQ ID NO: 176245 - DNA, 25 bp, E. coli
taaccgcaaccgaggttggtgtgtt

SEQ ID NO: 176246 - DNA, 25 bp, E. coli
tcaccgttatcgtttctgatccccg

SEQ ID NO: 176247 - DNA, 25 bp, E. coli
tcaccgttatcgattctgatccccg

SEQ ID NO: 176248 - DNA, 25 bp, E. coli
taaccgcaaccgtggttggtgtgtt

SEQ ID NO: 176249 - DNA, 25 bp, E. coli
caaaagatccacatgacggctgagg

SEQ ID NO: 176250 - DNA, 25 bp, E. coli
caaaagatccacttgacggctgagg

SEQ ID NO: 176251 - DNA, 25 bp, E. coli
taaagatgcgctcagtcaggccggc

SEQ ID NO: 176252 - DNA, 25 bp, E. coli
taaagatgcgctgagtcaggccggc

SEQ ID NO: 176253 - DNA, 25 bp, E. coli
taaagatccgcatggttatgttccg

SEQ ID NO: 176254 - DNA, 25 bp, E. coli
taaagatccgcaaggttatgttccg

SEQ ID NO: 176255 - DNA, 25 bp, E. coli
ttatgaaatcgtgcggcagaacctg

SEQ ID NO: 176256 - DNA, 25 bp, E. coli
ttatgaaatcgtccggcagaacctg

SEQ ID NO: 176257 - DNA, 25 bp, E. coli
tgaatgcgatcccaacgttctgcgg

SEQ ID NO: 176258 - DNA, 25 bp, E. coli
tgaatgcgatccgaacgttctgcgg

SEQ ID NO: 176259 - DNA, 25 bp, E. coli
tcgtccgcgggatcagaggcatttt

SEQ ID NO: 176260 - DNA, 25 bp, E. coli
tcgtccgcgggaacagaggcatttt

SEQ ID NO: 176261 - DNA, 25 bp, E. coli
gctggccgtgctggatgaatcaaac

SEQ ID NO: 176262 - DNA, 25 bp, E. coli
gctggccgtgctcgatgaatcaaac

SEQ ID NO: 176263 - DNA, 25 bp, E. coli
gaaacttgcgctgaaccatgtcctg

SEQ ID NO: 176264 - DNA, 25 bp, E. coli
gaaaaatccgcgacgatggcgctgg

SEQ ID NO: 176265 - DNA, 25 bp, E. coli
gaaacttgcgctcaaccatgtcctg

SEQ ID NO: 176266 - DNA, 25 bp, E. coli
gaaaaatccgcgtcgatggcgctgg

SEQ ID NO: 176267 - DNA, 25 bp, E. coli
cgctctgggcctacaaagtgggtaa

SEQ ID NO: 176268 - DNA, 25 bp, E. coli
cgctctgggccttcaaagtgggtaa

SEQ ID NO: 176269 - DNA, 25 bp, E. coli
gatgctttccatcaaaccgggccag

SEQ ID NO: 176270 - DNA, 25 bp, E. coli
gatgctttccatgaaaccgggccag

SEQ ID NO: 176271 - DNA, 25 bp, E. coli
cacggacggattaatcttgcgcgaa

SEQ ID NO: 176272 - DNA, 25 bp, E. coli
cacggacggatttatcttgcgcgaa

SEQ ID NO: 176273 - DNA, 25 bp, E. coli
cattaccgcattatgtgtttgcgaa

SEQ ID NO: 176274 - DNA, 25 bp, E. coli
tgagtttgtcacatcattacaggca

SEQ ID NO: 176275 - DNA, 25 bp, E. coli
tgagtttgtcacttcattacaggca

SEQ ID NO: 176276 - DNA, 25 bp, E. coli
tcttgcgcgaaggtgagtttgtcac

SEQ ID NO: 176277 - DNA, 25 bp, E. coli
tcttgcgcgaagctgagtttgtcac

SEQ ID NO: 176278 - DNA, 25 bp, E. coli
gcctctatgctgtgtgcgttgaaaa

SEQ ID NO: 176279 - DNA, 25 bp, E. coli
gcctctatgctgagtgcgttgaaaa

SEQ ID NO: 176280 - DNA, 25 bp, E. coli
gctggcttttctcctttttcaggag

SEQ ID NO: 176281 - DNA, 25 bp, E. coli
gctggcttttctgctttttcaggag

SEQ ID NO: 176282 - DNA, 25 bp, E. coli
cattacaggcattgaaagagatcgg

SEQ ID NO: 176283 - DNA, 25 bp, E. coli
cattaccgcattttgtgtttgcgaa

SEQ ID NO: 176284 - DNA, 25 bp, E. coli
cattacaggcatagaaagagatcgg

SEQ ID NO: 176285 - DNA, 25 bp, E. coli
ggaaatcttgttagtcattaccgca

SEQ ID NO: 176286 - DNA, 25 bp, E. coli
ggaaatcttgtttgtcattaccgca

SEQ ID NO: 176287 - DNA, 25 bp, E. coli
taattttgtggaagctcgggtcacg

SEQ ID NO: 176288 - DNA, 25 bp, E. coli
taattttgtggatgctcgggtcacg

SEQ ID NO: 176289 - DNA, 25 bp, E. coli
gagatcggaataaaagctggctttt

SEQ ID NO: 176290 - DNA, 25 bp, E. coli
gatgaacatcgatgaactgcgtaaa

SEQ ID NO: 176291 - DNA, 25 bp, E. coli
gagatcggaatataagctggctttt

SEQ ID NO: 176292 - DNA, 25 bp, E. coli
gatgaacatcgaagaactgcgtaaa

SEQ ID NO: 176293 - DNA, 25 bp, E. coli
cagctgccgctgagtgtcgtactca

SEQ ID NO: 176294 - DNA, 25 bp, E. coli
cagcgtctggaagaactcgttggga

SEQ ID NO: 176295 - DNA, 25 bp, E. coli
cagctgccgctgtgtgtcgtactca

SEQ ID NO: 176296 - DNA, 25 bp, E. coli
cagcgtctggaacaactcgttggga

SEQ ID NO: 176297 - DNA, 25 bp, E. coli
aacacactggtagtgcgcagcggaa

SEQ ID NO: 176298 - DNA, 25 bp, E. coli
aacacactggtactgcgcagcggaa

SEQ ID NO: 176299 - DNA, 25 bp, E. coli
tcgtcacggtcgcaacaaactgtta

SEQ ID NO: 176300 - DNA, 25 bp, E. coli
tcttggttacgccaggaaaatcctg

SEQ ID NO: 176301 - DNA, 25 bp, E. coli
tcagtccgccgtaagtcagcaaatg

SEQ ID NO: 176302 - DNA, 25 bp, E. coli
tcttggttacgcgaggaaaatcctg

SEQ ID NO: 176303 - DNA, 25 bp, E. coli
tctatcaggcgatggagagctacca

SEQ ID NO: 176304 - DNA, 25 bp, E. coli
tctatcaggcgaaggagagctacca

SEQ ID NO: 176305 - DNA, 25 bp, E. coli
tcagtccgccgttagtcagcaaatg

SEQ ID NO: 176306 - DNA, 25 bp, E. coli
tcgtcacggtcggaacaaactgtta

SEQ ID NO: 176307 - DNA, 25 bp, E. coli
gcgttttaatgaagaggcctgctca

SEQ ID NO: 176308 - DNA, 25 bp, E. coli
gcgttttaatgatgaggcctgctca

SEQ ID NO: 176309 - DNA, 25 bp, E. coli
gaaagaactgttcgctcgtcacggt

SEQ ID NO: 176310 - DNA, 25 bp, E. coli
gaaagaactgttggctcgtcacggt

SEQ ID NO: 176311 - DNA, 25 bp, E. coli
cgatctgaacacttttgctgccgca

SEQ ID NO: 176312 - DNA, 25 bp, E. coli
cgatctgaacacatttgctgccgca

SEQ ID NO: 176313 - DNA, 25 bp, E. coli
taaggcattgaagctgcgtacctcg

SEQ ID NO: 176314 - DNA, 25 bp, E. coli
taaggcattgaacctgcgtacctcg

SEQ ID NO: 176315 - DNA, 25 bp, E. coli
cagtgtggcgtccagccttctgtca

SEQ ID NO: 176316 - DNA, 25 bp, E. coli
cagtgtggcgtcgagccttctgtca

SEQ ID NO: 176317 - DNA, 25 bp, E. coli
tgaccacggattttggcgatacctg

SEQ ID NO: 176318 - DNA, 25 bp, E. coli
tgaccacggattatggcgatacctg

SEQ ID NO: 176319 - DNA, 25 bp, E. coli
tgtcatccatcgttgcagccgtggt

SEQ ID NO: 176320 - DNA, 25 bp, E. coli
tgtcatccatcgatgcagccgtggt

SEQ ID NO: 176321 - DNA, 25 bp, E. coli
tcatcgtcagaaatggcgtttgaac

SEQ ID NO: 176322 - DNA, 25 bp, E. coli
tcatggacgaaatcagaaaacgctt

SEQ ID NO: 176323 - DNA, 25 bp, E. coli
tcatcgtcagaattggcgtttgaac

SEQ ID NO: 176324 - DNA, 25 bp, E. coli
tcatggacgaaaacagaaaacgctt

SEQ ID NO: 176325 - DNA, 25 bp, E. coli
gcggccattggtgcacgtccgtata

SEQ ID NO: 176326 - DNA, 25 bp, E. coli
gcggccattggtccacgtccgtata

SEQ ID NO: 176327 - DNA, 25 bp, E. coli
gatcaaatgagcgttatgcggccat

SEQ ID NO: 176328 - DNA, 25 bp, E. coli
gtggaaaagaccaggcccgcagtgt

SEQ ID NO: 176329 - DNA, 25 bp, E. coli
gatcaaatgagccttatgcggccat

SEQ ID NO: 176330 - DNA, 25 bp, E. coli
gtggaaaagacctggcccgcagtgt

SEQ ID NO: 176331 - DNA, 25 bp, E. coli
ggtcagatccttaccgcaagtggcg

SEQ ID NO: 176332 - DNA, 25 bp, E. coli
ggtcagatcctttccgcaagtggcg

SEQ ID NO: 176333 - DNA, 25 bp, E. coli
ggcaaaatcctgacgctgaacggcg

SEQ ID NO: 176334 - DNA, 25 bp, E. coli
ggcaaaatcctgtcgctgaacggcg

SEQ ID NO: 176335 - DNA, 25 bp, E. coli
gatacctgggcgctgattggatcaa

SEQ ID NO: 176336 - DNA, 25 bp, E. coli
gatacctgggcggtgattggatcaa

SEQ ID NO: 176337 - DNA, 25 bp, E. coli
tacgtgaccacaaactgatgaccgc

SEQ ID NO: 176338 - DNA, 25 bp, E. coli
aacaatccgcaactggctgtcgcca

SEQ ID NO: 176339 - DNA, 25 bp, E. coli
aacaatccgcaagtggctgtcgcca

SEQ ID NO: 176340 - DNA, 25 bp, E. coli
tacgtgaccacatactgatgaccgc

SEQ ID NO: 176341 - DNA, 25 bp, E. coli
tataatgcgcacaaaattgccgagc

SEQ ID NO: 176342 - DNA, 25 bp, E. coli
tataatgcgcactaaattgccgagc

SEQ ID NO: 176343 - DNA, 25 bp, E. coli
tgcattccgaaaagagcgcgcacgt

SEQ ID NO: 176344 - DNA, 25 bp, E. coli
tgcattccgaaatgagcgcgcacgt

SEQ ID NO: 176345 - DNA, 25 bp, E. coli
gccacgggcgtctgaatgtcacaag

SEQ ID NO: 176346 - DNA, 25 bp, E. coli
gccacgggcgtcagaatgtcacaag

SEQ ID NO: 176347 - DNA, 25 bp, E. coli
gacacgatattttcctgacgctgga

SEQ ID NO: 176348 - DNA, 25 bp, E. coli
gacacgatatttacctgacgctgga

SEQ ID NO: 176349 - DNA, 25 bp, E. coli
cattccggttacagggagctggcga

SEQ ID NO: 176350 - DNA, 25 bp, E. coli
cattccggttactgggagctggcga

SEQ ID NO: 176351 - DNA, 25 bp, E. coli
gataacaacaccgatctgcctgcgg

SEQ ID NO: 176352 - DNA, 25 bp, E. coli
gataacaacacccatctgcctgcgg

SEQ ID NO: 176353 - DNA, 25 bp, E. coli
gggatcgatcgcgtctccgaatgga

SEQ ID NO: 176354 - DNA, 25 bp, E. coli
ggattttgctgcagaccggcgtgct

SEQ ID NO: 176355 - DNA, 25 bp, E. coli
gggatcgatcgcctctccgaatgga

SEQ ID NO: 176356 - DNA, 25 bp, E. coli
ggattttgctgctgaccggcgtgct

SEQ ID NO: 176357 - DNA, 25 bp, E. coli
taacctgaccgatgtacaagtagct

SEQ ID NO: 176358 - DNA, 25 bp, E. coli
taacctgaccgaagtacaagtagct

SEQ ID NO: 176359 - DNA, 25 bp, E. coli
aactgcgcgcgtatgtgtatgccac

SEQ ID NO: 176360 - DNA, 25 bp, E. coli
caaaagtgatcgacgttcgcgtggc

SEQ ID NO: 176361 - DNA, 25 bp, E. coli
caaaagtgatcgtcgttcgcgtggc

SEQ ID NO: 176362 - DNA, 25 bp, E. coli
tactgatgaattctttggtcccgca

SEQ ID NO: 176363 - DNA, 25 bp, E. coli
tacattgaccatgagcagggctggc

SEQ ID NO: 176364 - DNA, 25 bp, E. coli
tactgatgaattgtttggtcccgca

SEQ ID NO: 176365 - DNA, 25 bp, E. coli
tacattgaccatcagcagggctggc

SEQ ID NO: 176366 - DNA, 25 bp, E. coli
aactgcgcgcgtttgtgtatgccac

SEQ ID NO: 176367 - DNA, 25 bp, E. coli
ttaaggctatcggagaccaggtgag

SEQ ID NO: 176368 - DNA, 25 bp, E. coli
ttaaggctatcgcagaccaggtgag

SEQ ID NO: 176369 - DNA, 25 bp, E. coli
tgacatcgaggaaaacagcaccacg

SEQ ID NO: 176370 - DNA, 25 bp, E. coli
tgacatcgaggataacagcaccacg

SEQ ID NO: 176371 - DNA, 25 bp, E. coli
gcagtttgaaaccatcgacagtcca

SEQ ID NO: 176372 - DNA, 25 bp, E. coli
gcagtttgaaacgatcgacagtcca

SEQ ID NO: 176373 - DNA, 25 bp, E. coli
gaaactcgttttcatggtgcccgtg

SEQ ID NO: 176374 - DNA, 25 bp, E. coli
gaaactcgttttgatggtgcccgtg

SEQ ID NO: 176375 - DNA, 25 bp, E. coli
taacacgatggcagaggcgattacc

SEQ ID NO: 176376 - DNA, 25 bp, E. coli
tcaatgacgtgctgggaaaatgcgg

SEQ ID NO: 176377 - DNA, 25 bp, E. coli
taacacgatggctgaggcgattacc

SEQ ID NO: 176378 - DNA, 25 bp, E. coli
tcaatgacgtgcagggaaaatgcgg

SEQ ID NO: 176379 - DNA, 25 bp, E. coli
gaggcggtaacataatccctgtgcg

SEQ ID NO: 176380 - DNA, 25 bp, E. coli
gaggcggtaacaaaatccctgtgcg

SEQ ID NO: 176381 - DNA, 25 bp, E. coli
aatcccgatgcatgctgataccgta

SEQ ID NO: 176382 - DNA, 25 bp, E. coli
aatcccgatgcaagctgataccgta

SEQ ID NO: 176383 - DNA, 25 bp, E. coli
agcgaatccggcgagttaggtttct

SEQ ID NO: 176384 - DNA, 25 bp, E. coli
agttaggtttctgggtactgctgtt

SEQ ID NO: 176385 - DNA, 25 bp, E. coli
agcgaatccggccagttaggtttct

SEQ ID NO: 176386 - DNA, 25 bp, E. coli
agttaggtttctcggtactgctgtt

SEQ ID NO: 176387 - DNA, 25 bp, E. coli
tatgcgaatgctgcgggagttaatc

SEQ ID NO: 176388 - DNA, 25 bp, E. coli
tatgcgaatgctccgggagttaatc

SEQ ID NO: 176389 - DNA, 25 bp, E. coli
tattgatgctgacccatttctcatg

SEQ ID NO: 176390 - DNA, 25 bp, E. coli
tattgatgctgagccatttctcatg

SEQ ID NO: 176391 - DNA, 25 bp, E. coli
tgcgcagttctgtgcggatgcagtt

SEQ ID NO: 176392 - DNA, 25 bp, E. coli
tgcgcagttctgagcggatgcagtt

SEQ ID NO: 176393 - DNA, 25 bp, E. coli
gaatccggccagataggtttctcgg

SEQ ID NO: 176394 - DNA, 25 bp, E. coli
gaatccggccagttaggtttctcgg

SEQ ID NO: 176395 - DNA, 25 bp, E. coli
cccatttctcatcgcaggcggcggt

SEQ ID NO: 176396 - DNA, 25 bp, E. coli
cgtttattgcgggtgtgctactggc

SEQ ID NO: 176397 - DNA, 25 bp, E. coli
cgtttattgcggctgtgctactggc

SEQ ID NO: 176398 - DNA, 25 bp, E. coli
cccatttctcatggcaggcggcggt

SEQ ID NO: 176399 - DNA, 25 bp, E. coli
cggtacgtttattgcgggtgtgcta

SEQ ID NO: 176400 - DNA, 25 bp, E. coli
cggtacgtttatagcgggtgtgcta

SEQ ID NO: 176401 - DNA, 25 bp, E. coli
ggagttaatcccgatgcatgctgat

SEQ ID NO: 176402 - DNA, 25 bp, E. coli
ggagttaatccccatgcatgctgat

SEQ ID NO: 176403 - DNA, 25 bp, E. coli
caatctcgctgatgagtgctgcgct

SEQ ID NO: 176404 - DNA, 25 bp, E. coli
aatgttcgcgtttgactcggtaccg

SEQ ID NO: 176405 - DNA, 25 bp, E. coli
caatctcgctgaagagtgctgcgct

SEQ ID NO: 176406 - DNA, 25 bp, E. coli
aatgttcgcgttagactcggtaccg

SEQ ID NO: 176407 - DNA, 25 bp, E. coli
tatgcaccgtgatgacaagccaatc

SEQ ID NO: 176408 - DNA, 25 bp, E. coli
tatgcaccgtgaagacaagccaatc

SEQ ID NO: 176409 - DNA, 25 bp, E. coli
tatctggccgaagctcagagggcat

SEQ ID NO: 176410 - DNA, 25 bp, E. coli
tatctggccgaacctcagagggcat

SEQ ID NO: 176411 - DNA, 25 bp, E. coli
ttatgcgctggacaaagtgctgtcg

SEQ ID NO: 176412 - DNA, 25 bp, E. coli
ttatgcgctggagaaagtgctgtcg

SEQ ID NO: 176413 - DNA, 25 bp, E. coli
tgttcccgggcaaacctgaatctga

SEQ ID NO: 176414 - DNA, 25 bp, E. coli
tgttcccgggcatacctgaatctga

SEQ ID NO: 176415 - DNA, 25 bp, E. coli
tgatggcaatctactcctggttcgc

SEQ ID NO: 176416 - DNA, 25 bp, E. coli
tgatggcaatcttctcctggttcgc

SEQ ID NO: 176417 - DNA, 25 bp, E. coli
tcatggttacagcatcgcggcaaca

SEQ ID NO: 176418 - DNA, 25 bp, E. coli
tcatggttacaggatcgcggcaaca

SEQ ID NO: 176419 - DNA, 25 bp, E. coli
gcaaaactcggcgtgaatgcgaccg

SEQ ID NO: 176420 - DNA, 25 bp, E. coli
gcaaaactcggcctgaatgcgaccg

SEQ ID NO: 176421 - DNA, 25 bp, E. coli
gataacctgttcgtcatgatggcaa

SEQ ID NO: 176422 - DNA, 25 bp, E. coli
gataacctgttcctcatgatggcaa

SEQ ID NO: 176423 - DNA, 25 bp, E. coli
tggcgaaaccagtaaacagcgatgt

SEQ ID NO: 176424 - DNA, 25 bp, E. coli
tggcgaaaccagaaaacagcgatgt

SEQ ID NO: 176425 - DNA, 25 bp, E. coli
catcccgcacaatcccgaagagatg

SEQ ID NO: 176426 - DNA, 25 bp, E. coli
catcccgcacaaacccgaagagatg

SEQ ID NO: 176427 - DNA, 25 bp, E. coli
tactggaatcaggaaaaccgcaccg

SEQ ID NO: 176428 - DNA, 25 bp, E. coli
tactggaatcagcaaaaccgcaccg

SEQ ID NO: 176429 - DNA, 25 bp, E. coli
tatcggcactgtcgcagcgccttat

SEQ ID NO: 176430 - DNA, 25 bp, E. coli
tattcacgggctccttgcctggcga

SEQ ID NO: 176431 - DNA, 25 bp, E. coli
tattcacgggctgcttgcctggcga

SEQ ID NO: 176432 - DNA, 25 bp, E. coli
tatcggcactgtggcagcgccttat

SEQ ID NO: 176433 - DNA, 25 bp, E. coli
ttaaggtgccttgtatgcaaatcac

SEQ ID NO: 176434 - DNA, 25 bp, E. coli
ttaaggtgccttctatgcaaatcac

SEQ ID NO: 176435 - DNA, 25 bp, E. coli
tgttccgatcaactctgggtgcagg

SEQ ID NO: 176436 - DNA, 25 bp, E. coli
tgttccgatcaagtctgggtgcagg

SEQ ID NO: 176437 - DNA, 25 bp, E. coli
cctggcgagactggcaaattagtga

SEQ ID NO: 176438 - DNA, 25 bp, E. coli
cctggcgagactcgcaaattagtga

SEQ ID NO: 176439 - DNA, 25 bp, E. coli
cgccttatggcgagggtattcatcc

SEQ ID NO: 176440 - DNA, 25 bp, E. coli
cgctggcgcatcagggtaaagtgct

SEQ ID NO: 176441 - DNA, 25 bp, E. coli
cgctggcgcatctgggtaaagtgct

SEQ ID NO: 176442 - DNA, 25 bp, E. coli
cgccttatggcgtgggtattcatcc

SEQ ID NO: 176443 - DNA, 25 bp, E. coli
ggttgtcatttactcatcccgcaca

SEQ ID NO: 176444 - DNA, 25 bp, E. coli
ggttgtcatttagtcatcccgcaca

SEQ ID NO: 176445 - DNA, 25 bp, E. coli
gatcgcaagccagaatatcggcact

SEQ ID NO: 176446 - DNA, 25 bp, E. coli
gatcgcaagccacaatatcggcact

SEQ ID NO: 176447 - DNA, 25 bp, E. coli
tacaagcctatgacaagctgcaggt

SEQ ID NO: 176448 - DNA, 25 bp, E. coli
tacaagcctatgtcaagctgcaggt

SEQ ID NO: 176449 - DNA, 25 bp, E. coli
aaagctgccgacttgactggtgccg

SEQ ID NO: 176450 - DNA, 25 bp, E. coli
aaagctgccgacatgactggtgccg

SEQ ID NO: 176451 - DNA, 25 bp, E. coli
tatcaagtctggatccggtaagccg

SEQ ID NO: 176452 - DNA, 25 bp, E. coli
tatcaagtctggttccggtaagccg

SEQ ID NO: 176453 - DNA, 25 bp, E. coli
tgattccatcgaaaaaggtctgccg

SEQ ID NO: 176454 - DNA, 25 bp, E. coli
tgattccatcgataaaggtctgccg

SEQ ID NO: 176455 - DNA, 25 bp, E. coli
tgggtaaaatttgccgcgctcagct

SEQ ID NO: 176456 - DNA, 25 bp, E. coli
tgcagctggtatggctaacccgagt

SEQ ID NO: 176457 - DNA, 25 bp, E. coli
tgcagctggtatcgctaacccgagt

SEQ ID NO: 176458 - DNA, 25 bp, E. coli
tgccgacattgatgcgatgactcgc

SEQ ID NO: 176459 - DNA, 25 bp, E. coli
tgccgacattgaagcgatgactcgc

SEQ ID NO: 176460 - DNA, 25 bp, E. coli
gaaggtactgcacgttccatgggcc

SEQ ID NO: 176461 - DNA, 25 bp, E. coli
gaaggtactgcaggttccatgggcc

SEQ ID NO: 176462 - DNA, 25 bp, E. coli
gaaatcgcgcagaccaaagctgccg

SEQ ID NO: 176463 - DNA, 25 bp, E. coli
gaaatcgcgcagtccaaagctgccg

SEQ ID NO: 176464 - DNA, 25 bp, E. coli
ggtcagcagggcgtaaacatcatgg

SEQ ID NO: 176465 - DNA, 25 bp, E. coli
ggtcagcagggcctaaacatcatgg

SEQ ID NO: 176466 - DNA, 25 bp, E. coli
tggaattctgcaaagcgttcaacgc

SEQ ID NO: 176467 - DNA, 25 bp, E. coli
tggaattctgcatagcgttcaacgc

SEQ ID NO: 176468 - DNA, 25 bp, E. coli
tgggtaaaatttcccgcgctcagct

SEQ ID NO: 176469 - DNA, 25 bp, E. coli
attaacggagctcaccggtgccggt

SEQ ID NO: 176470 - DNA, 25 bp, E. coli
attaacggagctgaccggtgccggt

SEQ ID NO: 176471 - DNA, 25 bp, E. coli
ttgccattaacggagctgaccggtg

SEQ ID NO: 176472 - DNA, 25 bp, E. coli
ttgccattaacgcagctgaccggtg

SEQ ID NO: 176473 - DNA, 25 bp, E. coli
tgaattttgggcatcccgcgctcat

SEQ ID NO: 176474 - DNA, 25 bp, E. coli
tgaattttgggcttcccgcgctcat

SEQ ID NO: 176475 - DNA, 25 bp, E. coli
tgccggtggattagaagtgtcagaa

SEQ ID NO: 176476 - DNA, 25 bp, E. coli
tgccggtggatttgaagtgtcagaa

SEQ ID NO: 176477 - DNA, 25 bp, E. coli
ccattaacggagctgaccggtgccg

SEQ ID NO: 176478 - DNA, 25 bp, E. coli
ccattaacggaggtgaccggtgccg

SEQ ID NO: 176479 - DNA, 25 bp, E. coli
ccagccatagcgaaaccagtgacaa

SEQ ID NO: 176480 - DNA, 25 bp, E. coli
ccagccatagcgtaaccagtgacaa

SEQ ID NO: 176481 - DNA, 25 bp, E. coli
gcattgccattaacggagctgaccg

SEQ ID NO: 176482 - DNA, 25 bp, E. coli
gcattgccattatcggagctgaccg

SEQ ID NO: 176483 - DNA, 25 bp, E. coli
gcaatgcggcgaacggtgaattttg

SEQ ID NO: 176484 - DNA, 25 bp, E. coli
gcaatgcggcgatcggtgaattttg

SEQ ID NO: 176485 - DNA, 25 bp, E. coli
ccgcaatgcggccaacggtgaattt

SEQ ID NO: 176486 - DNA, 25 bp, E. coli
ccgcaatgcggcgaacggtgaattt

SEQ ID NO: 176487 - DNA, 25 bp, E. coli
tggatttgaagtctcagaacagcct

SEQ ID NO: 176488 - DNA, 25 bp, E. coli
ggcgcattgccattaacggagctga

SEQ ID NO: 176489 - DNA, 25 bp, E. coli
ggcgcattgccaataacggagctga

SEQ ID NO: 176490 - DNA, 25 bp, E. coli
tggatttgaagtgtcagaacagcct

SEQ ID NO: 176491 - DNA, 25 bp, E. coli
tacggcaagtatcagcatgtccaca

SEQ ID NO: 176492 - DNA, 25 bp, E. coli
tacggcaagtatgagcatgtccaca

SEQ ID NO: 176493 - DNA, 25 bp, E. coli
tagacaaaaatgtggtgcgtcgcgc

SEQ ID NO: 176494 - DNA, 25 bp, E. coli
tatgccgacgatttctggcgctcgc

SEQ ID NO: 176495 - DNA, 25 bp, E. coli
tagacaaaaatgaggtgcgtcgcgc

SEQ ID NO: 176496 - DNA, 25 bp, E. coli
taccagctttatcacggtgacgggc

SEQ ID NO: 176497 - DNA, 25 bp, E. coli
taccagctttatgacggtgacgggc

SEQ ID NO: 176498 - DNA, 25 bp, E. coli
tatgccgacgatatctggcgctcgc

SEQ ID NO: 176499 - DNA, 25 bp, E. coli
ttaaagcagttctgccggttcaggc

SEQ ID NO: 176500 - DNA, 25 bp, E. coli
ttaaagcagttcagccggttcaggc

SEQ ID NO: 176501 - DNA, 25 bp, E. coli
tgatgcacgtaatctcagagccgaa

SEQ ID NO: 176502 - DNA, 25 bp, E. coli
tgcattagagactgttcgccgcctt

SEQ ID NO: 176503 - DNA, 25 bp, E. coli
tgcattagagacagttcgccgcctt

SEQ ID NO: 176504 - DNA, 25 bp, E. coli
tgatgcacgtaaactcagagccgaa

SEQ ID NO: 176505 - DNA, 25 bp, E. coli
gctcgaatgaagttgaaccgggacc

SEQ ID NO: 176506 - DNA, 25 bp, E. coli
gctcgaatgaagatgaaccgggacc

SEQ ID NO: 176507 - DNA, 25 bp, E. coli
gcaatggtgggcagatctcgtaaaa

SEQ ID NO: 176508 - DNA, 25 bp, E. coli
gcaatggtgggctgatctcgtaaaa

SEQ ID NO: 176509 - DNA, 25 bp, E. coli
gatttatgcgcacaacacaggcctg

SEQ ID NO: 176510 - DNA, 25 bp, E. coli
gattatcttgaggaacgtcgtccga

SEQ ID NO: 176511 - DNA, 25 bp, E. coli
gatttatgcgcagaacacaggcctg

SEQ ID NO: 176512 - DNA, 25 bp, E. coli
gattatcttgagcaacgtcgtccga

SEQ ID NO: 176513 - DNA, 25 bp, E. coli
aagccgcgagcgacatcagatagtc

SEQ ID NO: 176514 - DNA, 25 bp, E. coli
aagccgcgagcgtcatcagatagtc

SEQ ID NO: 176515 - DNA, 25 bp, E. coli
accgacggtggctaaaatgcttaag

SEQ ID NO: 176516 - DNA, 25 bp, E. coli
accgacggtggcaaaaatgcttaag

SEQ ID NO: 176517 - DNA, 25 bp, E. coli
ttccgccaggtcagagaggcgcatc

SEQ ID NO: 176518 - DNA, 25 bp, E. coli
ttttaacggcagaaggagagaagct

SEQ ID NO: 176519 - DNA, 25 bp, E. coli
ttccgccaggtctgagaggcgcatc

SEQ ID NO: 176520 - DNA, 25 bp, E. coli
ttttaacggcagtaggagagaagct

SEQ ID NO: 176521 - DNA, 25 bp, E. coli
tgttgggcgtcactccggaaatcgc

SEQ ID NO: 176522 - DNA, 25 bp, E. coli
tgttgggcgtcagtccggaaatcgc

SEQ ID NO: 176523 - DNA, 25 bp, E. coli
tgtttacccagatacacggtgccaa

SEQ ID NO: 176524 - DNA, 25 bp, E. coli
tgtttacccagaaacacggtgccaa

SEQ ID NO: 176525 - DNA, 25 bp, E. coli
gcgcaggtacgcgaacagcaaaaaa

SEQ ID NO: 176526 - DNA, 25 bp, E. coli
gcgcaggtacgccaacagcaaaaaa

SEQ ID NO: 176527 - DNA, 25 bp, E. coli
gaagagcacgttgaagggttccgcc

SEQ ID NO: 176528 - DNA, 25 bp, E. coli
gaagagcacgttcaagggttccgcc

SEQ ID NO: 176529 - DNA, 25 bp, E. coli
gattgaaatgatcccctggcgtggc

SEQ ID NO: 176530 - DNA, 25 bp, E. coli
gattgaaatgatgccctggcgtggc

SEQ ID NO: 176531 - DNA, 25 bp, E. coli
gattacgttgaggtgatttctgact

SEQ ID NO: 176532 - DNA, 25 bp, E. coli
gattacgttgagctgatttctgact

SEQ ID NO: 176533 - DNA, 25 bp, E. coli
gagcaccatgttagtgaagagacgc

SEQ ID NO: 176534 - DNA, 25 bp, E. coli
gagcaccatgtttgtgaagagacgc

SEQ ID NO: 176535 - DNA, 25 bp, E. coli
caaccctgaacaatatgatttagcg

SEQ ID NO: 176536 - DNA, 25 bp, E. coli
aagttcgacacctcttacgcggcag

SEQ ID NO: 176537 - DNA, 25 bp, E. coli
aagttcgacaccacttacgcggcag

SEQ ID NO: 176538 - DNA, 25 bp, E. coli
caaccctgaacattatgatttagcg

SEQ ID NO: 176539 - DNA, 25 bp, E. coli
taccagtaagattcagtgtccaaac

SEQ ID NO: 176540 - DNA, 25 bp, E. coli
tataaccgcacatcagataccgaca

SEQ ID NO: 176541 - DNA, 25 bp, E. coli
tataaccgcacaacagataccgaca

SEQ ID NO: 176542 - DNA, 25 bp, E. coli
taccagtaagatacagtgtccaaac

SEQ ID NO: 176543 - DNA, 25 bp, E. coli
tgccgcacgaacaccaaatatacag

SEQ ID NO: 176544 - DNA, 25 bp, E. coli
tgccgcacgaactccaaatatacag

SEQ ID NO: 176545 - DNA, 25 bp, E. coli
tctggagaaggatacaaccctgaac

SEQ ID NO: 176546 - DNA, 25 bp, E. coli
tctggagaaggaaacaaccctgaac

SEQ ID NO: 176547 - DNA, 25 bp, E. coli
ccacaaatttatgcgtgccgcacga

SEQ ID NO: 176548 - DNA, 25 bp, E. coli
ccacaaatttatccgtgccgcacga

SEQ ID NO: 176549 - DNA, 25 bp, E. coli
gcggcaacacctgccacaaatttat

SEQ ID NO: 176550 - DNA, 25 bp, E. coli
gcggcaacacctcccacaaatttat

SEQ ID NO: 176551 - DNA, 25 bp, E. coli
cgcggcaggcacaggaaatacttaa

SEQ ID NO: 176552 - DNA, 25 bp, E. coli
cgcggcaggcactggaaatacttaa

SEQ ID NO: 176553 - DNA, 25 bp, E. coli
gataccgacaatgttaaaacaccag

SEQ ID NO: 176554 - DNA, 25 bp, E. coli
gataccgacaatcttaaaacaccag

SEQ ID NO: 176555 - DNA, 25 bp, E. coli
taaccccaaaaattgtcacgcacgc

SEQ ID NO: 176556 - DNA, 25 bp, E. coli
taaccccaaaaaatgtcacgcacgc

SEQ ID NO: 176557 - DNA, 25 bp, E. coli
tacgattatctgatgcgcgtccagg

SEQ ID NO: 176558 - DNA, 25 bp, E. coli
taaaattgaccgtaagctgctggcc

SEQ ID NO: 176559 - DNA, 25 bp, E. coli
taaaattgaccgaaagctgctggcc

SEQ ID NO: 176560 - DNA, 25 bp, E. coli
tacgattatctgttgcgcgtccagg

SEQ ID NO: 176561 - DNA, 25 bp, E. coli
gccgacatgaaacgctacgacgagt

SEQ ID NO: 176562 - DNA, 25 bp, E. coli
tccggaaaaaattggcctcggcctg

SEQ ID NO: 176563 - DNA, 25 bp, E. coli
tccggaaaaaataggcctcggcctg

SEQ ID NO: 176564 - DNA, 25 bp, E. coli
gccgacatgaaaggctacgacgagt

SEQ ID NO: 176565 - DNA, 25 bp, E. coli
ccagcttcgcgaaggaacagattaa

SEQ ID NO: 176566 - DNA, 25 bp, E. coli
ccagcttcgcgatggaacagattaa

SEQ ID NO: 176567 - DNA, 25 bp, E. coli
gctgaagccgttaatctgacaacca

SEQ ID NO: 176568 - DNA, 25 bp, E. coli
gctgaagccgtttatctgacaacca

SEQ ID NO: 176569 - DNA, 25 bp, E. coli
ggattgcaccctctctttgcaggca

SEQ ID NO: 176570 - DNA, 25 bp, E. coli
gtcgccctgctggatccggaaaaaa

SEQ ID NO: 176571 - DNA, 25 bp, E. coli
ggattgcaccctgtctttgcaggca

SEQ ID NO: 176572 - DNA, 25 bp, E. coli
ggttaccgaaatcccagaagtgctg

SEQ ID NO: 176573 - DNA, 25 bp, E. coli
ggttaccgaaatgccagaagtgctg

SEQ ID NO: 176574 - DNA, 25 bp, E. coli
gtcgccctgctgcatccggaaaaaa

SEQ ID NO: 176575 - DNA, 25 bp, E. coli
tcacagcagcgattggtattgccgc

SEQ ID NO: 176576 - DNA, 25 bp, E. coli
tcacagcagcgaatggtattgccgc

SEQ ID NO: 176577 - DNA, 25 bp, E. coli
gacgacggtatccttatcggcaaag

SEQ ID NO: 176578 - DNA, 25 bp, E. coli
gacgacggtatcgttatcggcaaag

SEQ ID NO: 176579 - DNA, 25 bp, E. coli
aatgtcgcgctaccgtttaacaccg

SEQ ID NO: 176580 - DNA, 25 bp, E. coli
aatgtcgcgctagcgtttaacaccg

SEQ ID NO: 176581 - DNA, 25 bp, E. coli
taaattacccggacgagttggcgat

SEQ ID NO: 176582 - DNA, 25 bp, E. coli
taacaccgaaggtatgtatcgcgcc

SEQ ID NO: 176583 - DNA, 25 bp, E. coli
taaattacccggtcgagttggcgat

SEQ ID NO: 176584 - DNA, 25 bp, E. coli
tatcgaccatgaagggaatgtcgcg

SEQ ID NO: 176585 - DNA, 25 bp, E. coli
tatcgaccatgatgggaatgtcgcg

SEQ ID NO: 176586 - DNA, 25 bp, E. coli
gcggtggcttaatcgctatcgacca

SEQ ID NO: 176587 - DNA, 25 bp, E. coli
gcggtggcttaaacgctatcgacca

SEQ ID NO: 176588 - DNA, 25 bp, E. coli
gaaaaactccctccgcttggcggta

SEQ ID NO: 176589 - DNA, 25 bp, E. coli
gaaaaactccctgcgcttggcggta

SEQ ID NO: 176590 - DNA, 25 bp, E. coli
cggattaagtctcgcggaagcctgc

SEQ ID NO: 176591 - DNA, 25 bp, E. coli
cggattaagtctggcggaagcctgc

SEQ ID NO: 176592 - DNA, 25 bp, E. coli
ggcgaagtcttcttccgcgcgctgg

SEQ ID NO: 176593 - DNA, 25 bp, E. coli
ggcggaatgacctataaattacccg

SEQ ID NO: 176594 - DNA, 25 bp, E. coli
ggcgatacgccaaccaccggtatct

SEQ ID NO: 176595 - DNA, 25 bp, E. coli
ggcggaatgaccaataaattacccg

SEQ ID NO: 176596 - DNA, 25 bp, E. coli
ggcgatacgccatccaccggtatct

SEQ ID NO: 176597 - DNA, 25 bp, E. coli
ggcgaagtcttcatccgcgcgctgg

SEQ ID NO: 176598 - DNA, 25 bp, E. coli
taacaccgaaggaatgtatcgcgcc

SEQ ID NO: 176599 - DNA, 25 bp, E. coli
gaccatagcggtccgccactggatg

SEQ ID NO: 176600 - DNA, 25 bp, E. coli
gaccatagcggtgcgccactggatg

SEQ ID NO: 176601 - DNA, 25 bp, E. coli
cacttttttcgctgtgacattcgct

SEQ ID NO: 176602 - DNA, 25 bp, E. coli
cacttttttcgcagtgacattcgct

SEQ ID NO: 176603 - DNA, 25 bp, E. coli
tacatttcacagagcgaaaacgtgc

SEQ ID NO: 176604 - DNA, 25 bp, E. coli
tacatttcacagtgcgaaaacgtgc

SEQ ID NO: 176605 - DNA, 25 bp, E. coli
tatttcctatagtcaggctcattag

SEQ ID NO: 176606 - DNA, 25 bp, E. coli
tatttcctatagacaggctcattag

SEQ ID NO: 176607 - DNA, 25 bp, E. coli
tgtacgcagcgacaagaaaagtcac

SEQ ID NO: 176608 - DNA, 25 bp, E. coli
tgtacgcagcgagaagaaaagtcac

SEQ ID NO: 176609 - DNA, 25 bp, E. coli
tctatgcctgactagacttatttcc

SEQ ID NO: 176610 - DNA, 25 bp, E. coli
tctatgcctgacaagacttatttcc

SEQ ID NO: 176611 - DNA, 25 bp, E. coli
ccagtgtgatttcagtgtacgcagc

SEQ ID NO: 176612 - DNA, 25 bp, E. coli
ccagtgtgatttgagtgtacgcagc

SEQ ID NO: 176613 - DNA, 25 bp, E. coli
gctgtgacaagctccgcaaatcgtg

SEQ ID NO: 176614 - DNA, 25 bp, E. coli
gctgtgacaagcaccgcaaatcgtg

SEQ ID NO: 176615 - DNA, 25 bp, E. coli
gacattcgctttgtcagctgtgaca

SEQ ID NO: 176616 - DNA, 25 bp, E. coli
gacattcgctttctcagctgtgaca

SEQ ID NO: 176617 - DNA, 25 bp, E. coli
cgcaaatcgtgacaataaccgctta

SEQ ID NO: 176618 - DNA, 25 bp, E. coli
cgcaaatcgtgagaataaccgctta

SEQ ID NO: 176619 - DNA, 25 bp, E. coli
ggctcattagcttcgtttattgcaa

SEQ ID NO: 176620 - DNA, 25 bp, E. coli
ggctcattagctacgtttattgcaa

SEQ ID NO: 176621 - DNA, 25 bp, E. coli
taaccgcttatgtctctatgcctga

SEQ ID NO: 176622 - DNA, 25 bp, E. coli
taaccgcttatgactctatgcctga

SEQ ID NO: 176623 - DNA, 25 bp, E. coli
taggttatgtaaaaacgtatcggcg

SEQ ID NO: 176624 - DNA, 25 bp, E. coli
taggttatgtaataacgtatcggcg

SEQ ID NO: 176625 - DNA, 25 bp, E. coli
aaaaagtggcacattacggcgcgct

SEQ ID NO: 176626 - DNA, 25 bp, E. coli
aaaaagtggcactttacggcgcgct

SEQ ID NO: 176627 - DNA, 25 bp, E. coli
tattggcgttgttcaggcaagtcgt

SEQ ID NO: 176628 - DNA, 25 bp, E. coli
tatactgaagataagcctgatgagt

SEQ ID NO: 176629 - DNA, 25 bp, E. coli
tatactgaagattagcctgatgagt

SEQ ID NO: 176630 - DNA, 25 bp, E. coli
tattggcgttgtacaggcaagtcgt

SEQ ID NO: 176631 - DNA, 25 bp, E. coli
tccgtttctgcagtaaaaaagtggc

SEQ ID NO: 176632 - DNA, 25 bp, E. coli
tccgtttctgcactaaaaaagtggc

SEQ ID NO: 176633 - DNA, 25 bp, E. coli
cctgatgagtaagaggcttgctcgt

SEQ ID NO: 176634 - DNA, 25 bp, E. coli
cctgatgagtaacaggcttgctcgt

SEQ ID NO: 176635 - DNA, 25 bp, E. coli
gcaagtcgtaaaataacagcctggc

SEQ ID NO: 176636 - DNA, 25 bp, E. coli
gcaatgccgcctattctttttccga

SEQ ID NO: 176637 - DNA, 25 bp, E. coli
gcaagtcgtaaattaacagcctggc

SEQ ID NO: 176638 - DNA, 25 bp, E. coli
gcaatgccgccttttctttttccga

SEQ ID NO: 176639 - DNA, 25 bp, E. coli
cgtatcggcgtttatatactgaaga

SEQ ID NO: 176640 - DNA, 25 bp, E. coli
cgtatcggcgttaatatactgaaga

SEQ ID NO: 176641 - DNA, 25 bp, E. coli
ggcttgctcgtcatactttcgtgag

SEQ ID NO: 176642 - DNA, 25 bp, E. coli
ggcttgctcgtcttactttcgtgag

SEQ ID NO: 176643 - DNA, 25 bp, E. coli
taacagcctggcaattcagagtatg

SEQ ID NO: 176644 - DNA, 25 bp, E. coli
taacagcctggctattcagagtatg

SEQ ID NO: 176645 - DNA, 25 bp, E. coli
catcgtgattgatggcgacggcgaa

SEQ ID NO: 176646 - DNA, 25 bp, E. coli
catcgtgattgaaggcgacggcgaa

SEQ ID NO: 176647 - DNA, 25 bp, E. coli
tattccggcagtaaacggcgtcagc

SEQ ID NO: 176648 - DNA, 25 bp, E. coli
tattccggcagttaacggcgtcagc

SEQ ID NO: 176649 - DNA, 25 bp, E. coli
tcctctgtggcgatggttcttccga

SEQ ID NO: 176650 - DNA, 25 bp, E. coli
tcctctgtggcgttggttcttccga

SEQ ID NO: 176651 - DNA, 25 bp, E. coli
gctaaagcaacaggcagcagaggcg

SEQ ID NO: 176652 - DNA, 25 bp, E. coli
gctataagtgcgtgcctgatgaaca

SEQ ID NO: 176653 - DNA, 25 bp, E. coli
gctataagtgcgagcctgatgaaca

SEQ ID NO: 176654 - DNA, 25 bp, E. coli
gctaaagcaacacgcagcagaggcg

SEQ ID NO: 176655 - DNA, 25 bp, E. coli
gaagcggcttgcgagctaaagcaac

SEQ ID NO: 176656 - DNA, 25 bp, E. coli
gaagcggcttgccagctaaagcaac

SEQ ID NO: 176657 - DNA, 25 bp, E. coli
cgatctcaacgctattgaagcggct

SEQ ID NO: 176658 - DNA, 25 bp, E. coli
cgatctcaacgcaattgaagcggct

SEQ ID NO: 176659 - DNA, 25 bp, E. coli
cgccaaagggcgaaaagatgtgcta

SEQ ID NO: 176660 - DNA, 25 bp, E. coli
cgccaaagggcgtaaagatgtgcta

SEQ ID NO: 176661 - DNA, 25 bp, E. coli
gattgatgaccagttcgagcaggca

SEQ ID NO: 176662 - DNA, 25 bp, E. coli
gattgatgaccacttcgagcaggca

SEQ ID NO: 176663 - DNA, 25 bp, E. coli
gtcagaacaacaggttgccgcgccg

SEQ ID NO: 176664 - DNA, 25 bp, E. coli
gtcagaacaacacgttgccgcgccg

SEQ ID NO: 176665 - DNA, 25 bp, E. coli
taagtgtgggcggtaaagccctgac

SEQ ID NO: 176666 - DNA, 25 bp, E. coli
taagtgtgggcgctaaagccctgac

SEQ ID NO: 176667 - DNA, 25 bp, E. coli
aatcctcctggacttatgaactgga

SEQ ID NO: 176668 - DNA, 25 bp, E. coli
aatcctcctggagttatgaactgga

SEQ ID NO: 176669 - DNA, 25 bp, E. coli
caaacgcgataccacgctgcaacat

SEQ ID NO: 176670 - DNA, 25 bp, E. coli
caaacgcgatacgacgctgcaacat

SEQ ID NO: 176671 - DNA, 25 bp, E. coli
acgctgcaacatccgcgctgcgtgt

SEQ ID NO: 176672 - DNA, 25 bp, E. coli
acccggctgcacgtatctttaaaga

SEQ ID NO: 176673 - DNA, 25 bp, E. coli
acccggctgcacctatctttaaaga

SEQ ID NO: 176674 - DNA, 25 bp, E. coli
acgctgcaacatgcgcgctgcgtgt

SEQ ID NO: 176675 - DNA, 25 bp, E. coli
aaacgttatctcgaacccggctgca

SEQ ID NO: 176676 - DNA, 25 bp, E. coli
aaactgcctcgttcctgtatgccct

SEQ ID NO: 176677 - DNA, 25 bp, E. coli
cacgataaaactccctcgttcctgt

SEQ ID NO: 176678 - DNA, 25 bp, E. coli
actgaagttcctcgtcaccatcgac

SEQ ID NO: 176679 - DNA, 25 bp, E. coli
actgaagttcctggtcaccatcgac

SEQ ID NO: 176680 - DNA, 25 bp, E. coli
aaacgttatctccaacccggctgca

SEQ ID NO: 176681 - DNA, 25 bp, E. coli
cacgataaaactgcctcgttcctgt

SEQ ID NO: 176682 - DNA, 25 bp, E. coli
aaactgcctcgtacctgtatgccct

SEQ ID NO: 176683 - DNA, 25 bp, E. coli
cgaaactgaagttcctcgtcaccat

SEQ ID NO: 176684 - DNA, 25 bp, E. coli
cgaaactgaagtacctcgtcaccat

SEQ ID NO: 176685 - DNA, 25 bp, E. coli
gtacgataaatcgtcctggacttat

SEQ ID NO: 176686 - DNA, 25 bp, E. coli
gttgtctgtcgaaactgaagttcct

SEQ ID NO: 176687 - DNA, 25 bp, E. coli
gtacgataaatcctcctggacttat

SEQ ID NO: 176688 - DNA, 25 bp, E. coli
gttgtctgtcgatactgaagttcct

SEQ ID NO: 176689 - DNA, 25 bp, E. coli
tattactaaatgcttgcttagtcgc

SEQ ID NO: 176690 - DNA, 25 bp, E. coli
tattactaaatggttgcttagtcgc

SEQ ID NO: 176691 - DNA, 25 bp, E. coli
tgcttgatgaaaacggaattgaacc

SEQ ID NO: 176692 - DNA, 25 bp, E. coli
tgcttgatgaaatcggaattgaacc

SEQ ID NO: 176693 - DNA, 25 bp, E. coli
tctgtgctggcatcgatctgtcatg

SEQ ID NO: 176694 - DNA, 25 bp, E. coli
tctgtgctggcaacgatctgtcatg

SEQ ID NO: 176695 - DNA, 25 bp, E. coli
ccgtatattcggtatgtaacagcga

SEQ ID NO: 176696 - DNA, 25 bp, E. coli
ccgtatattcggaatgtaacagcga

SEQ ID NO: 176697 - DNA, 25 bp, E. coli
gcattgttaaatgcaataccgtata

SEQ ID NO: 176698 - DNA, 25 bp, E. coli
gcattgttaaatccaataccgtata

SEQ ID NO: 176699 - DNA, 25 bp, E. coli
gaattgaacctgtcattaccaggta

SEQ ID NO: 176700 - DNA, 25 bp, E. coli
gaattgaacctgacattaccaggta

SEQ ID NO: 176701 - DNA, 25 bp, E. coli
gacccattagtttagatttacgcca

SEQ ID NO: 176702 - DNA, 25 bp, E. coli
gacccattagttaagatttacgcca

SEQ ID NO: 176703 - DNA, 25 bp, E. coli
gataaaaagcctcttcaattttggg

SEQ ID NO: 176704 - DNA, 25 bp, E. coli
gatttacgccaggatcatcttgaaa

SEQ ID NO: 176705 - DNA, 25 bp, E. coli
gataaaaagcctgttcaattttggg

SEQ ID NO: 176706 - DNA, 25 bp, E. coli
gatttacgccagcatcatcttgaaa

SEQ ID NO: 176707 - DNA, 25 bp, E. coli
ggcaacgatctgacatgcttgatga

SEQ ID NO: 176708 - DNA, 25 bp, E. coli
ggcaacgatctgtcatgcttgatga

SEQ ID NO: 176709 - DNA, 25 bp, E. coli
taacagcgatatcctctgtgctggc

SEQ ID NO: 176710 - DNA, 25 bp, E. coli
taacagcgatatgctctgtgctggc

SEQ ID NO: 176711 - DNA, 25 bp, E. coli
cactggccgaaaataaagaatgtgg

SEQ ID NO: 176712 - DNA, 25 bp, E. coli
cactggccgaaattaaagaatgtgg

SEQ ID NO: 176713 - DNA, 25 bp, E. coli
cacgaatggtgatatctgccggact

SEQ ID NO: 176714 - DNA, 25 bp, E. coli
cacgaatggtgaaatctgccggact

SEQ ID NO: 176715 - DNA, 25 bp, E. coli
cagacgtttacagcggaatatgccg

SEQ ID NO: 176716 - DNA, 25 bp, E. coli
cagacgtttacaccggaatatgccg

SEQ ID NO: 176717 - DNA, 25 bp, E. coli
ttaatgaccgcagacgaatggtgat

SEQ ID NO: 176718 - DNA, 25 bp, E. coli
ttaatgaccgcacacgaatggtgat

SEQ ID NO: 176719 - DNA, 25 bp, E. coli
tgttggtgcgaaacaagtcagctaa

SEQ ID NO: 176720 - DNA, 25 bp, E. coli
tgttggtgcgaatcaagtcagctaa

SEQ ID NO: 176721 - DNA, 25 bp, E. coli
tctgccggacttcatcgcgaaggtg

SEQ ID NO: 176722 - DNA, 25 bp, E. coli
tctgccggacttgatcgcgaaggtg

SEQ ID NO: 176723 - DNA, 25 bp, E. coli
gaatatgccgttgtgttggtgcgaa

SEQ ID NO: 176724 - DNA, 25 bp, E. coli
gaatatgccgttctgttggtgcgaa

SEQ ID NO: 176725 - DNA, 25 bp, E. coli
cgcgaaggtgcgtcagacgtttaca

SEQ ID NO: 176726 - DNA, 25 bp, E. coli
cctggttaatttggataacgtgaag

SEQ ID NO: 176727 - DNA, 25 bp, E. coli
cctggttaatttcgataacgtgaag

SEQ ID NO: 176728 - DNA, 25 bp, E. coli
cgcgaaggtgcgacagacgtttaca

SEQ ID NO: 176729 - DNA, 25 bp, E. coli
gatatttacggacgcttttacctgg

SEQ ID NO: 176730 - DNA, 25 bp, E. coli
gatatttacggaggcttttacctgg

SEQ ID NO: 176731 - DNA, 25 bp, E. coli
taacgtgaaggtcatttcactggcc

SEQ ID NO: 176732 - DNA, 25 bp, E. coli
taacgtgaaggtgatttcactggcc

SEQ ID NO: 176733 - DNA, 25 bp, E. coli
cacgacatggtttgtaggagccgac

SEQ ID NO: 176734 - DNA, 25 bp, E. coli
cacgacatggttagtaggagccgac

SEQ ID NO: 176735 - DNA, 25 bp, E. coli
taaaaacgaccgttgaactggatgc

SEQ ID NO: 176736 - DNA, 25 bp, E. coli
taaaaacgaccgatgaactggatgc

SEQ ID NO: 176737 - DNA, 25 bp, E. coli
ttcagattatcgatgcccgcatggc

SEQ ID NO: 176738 - DNA, 25 bp, E. coli
ttcagattatcgttgcccgcatggc

SEQ ID NO: 176739 - DNA, 25 bp, E. coli
tgaaactgtacgtcggcgcatggag

SEQ ID NO: 176740 - DNA, 25 bp, E. coli
tgaaactgtacgacggcgcatggag

SEQ ID NO: 176741 - DNA, 25 bp, E. coli
tgcgcgaaggcgaactaaaaacgac

SEQ ID NO: 176742 - DNA, 25 bp, E. coli
tgcgcgaaggcgtactaaaaacgac

SEQ ID NO: 176743 - DNA, 25 bp, E. coli
gcagaagttgatcaacctcgcccag

SEQ ID NO: 176744 - DNA, 25 bp, E. coli
gaatggacatatacccggcgcagtg

SEQ ID NO: 176745 - DNA, 25 bp, E. coli
gcagaagttgatgaacctcgcccag

SEQ ID NO: 176746 - DNA, 25 bp, E. coli
gaatggacatattcccggcgcagtg

SEQ ID NO: 176747 - DNA, 25 bp, E. coli
ctggctcgccgatcatattgatgac

SEQ ID NO: 176748 - DNA, 25 bp, E. coli
ctggctcgccgaacatattgatgac

SEQ ID NO: 176749 - DNA, 25 bp, E. coli
gatattttttggtcgcggcgtcagc

SEQ ID NO: 176750 - DNA, 25 bp, E. coli
gatattttttggacgcggcgtcagc

SEQ ID NO: 176751 - DNA, 25 bp, E. coli
ggtaatcttttcacagccccacgag

SEQ ID NO: 176752 - DNA, 25 bp, E. coli
ggtaatcttttctcagccccacgag

SEQ ID NO: 176753 - DNA, 25 bp, E. coli
tggatgtgccaatcgtgaaactgta

SEQ ID NO: 176754 - DNA, 25 bp, E. coli
tggatgtgccaaacgtgaaactgta

SEQ ID NO: 176755 - DNA, 25 bp, E. coli
caaaggcgcgaattgcatccgggat

SEQ ID NO: 176756 - DNA, 25 bp, E. coli
caaagtcagaagtaaggcgctcaag

SEQ ID NO: 176757 - DNA, 25 bp, E. coli
caaagtcagaagaaaggcgctcaag

SEQ ID NO: 176758 - DNA, 25 bp, E. coli
caaaggcgcgaaatgcatccgggat

SEQ ID NO: 176759 - DNA, 25 bp, E. coli
cataaatctgattcaatggcggcgc

SEQ ID NO: 176760 - DNA, 25 bp, E. coli
cataaatctgatacaatggcggcgc

SEQ ID NO: 176761 - DNA, 25 bp, E. coli
tacactacagaaatgcagggaggcc

SEQ ID NO: 176762 - DNA, 25 bp, E. coli
tacactacagaattgcagggaggcc

SEQ ID NO: 176763 - DNA, 25 bp, E. coli
tatcacggtattaaacaaaggcgcg

SEQ ID NO: 176764 - DNA, 25 bp, E. coli
tatcacggtatttaacaaaggcgcg

SEQ ID NO: 176765 - DNA, 25 bp, E. coli
tgctaaacaccttcgtcgcagaagg

SEQ ID NO: 176766 - DNA, 25 bp, E. coli
tgctaaacacctacgtcgcagaagg

SEQ ID NO: 176767 - DNA, 25 bp, E. coli
gaatccagtaactacaacccgtgca

SEQ ID NO: 176768 - DNA, 25 bp, E. coli
gaatccagtaacaacaacccgtgca

SEQ ID NO: 176769 - DNA, 25 bp, E. coli
gaactacgtagtgtgtccgcgaggc

SEQ ID NO: 176770 - DNA, 25 bp, E. coli
gaactacgtagtctgtccgcgaggc

SEQ ID NO: 176771 - DNA, 25 bp, E. coli
cattggacagagtaaaacaggagcc

SEQ ID NO: 176772 - DNA, 25 bp, E. coli
cattggacagagaaaaacaggagcc

SEQ ID NO: 176773 - DNA, 25 bp, E. coli
gatctcgtttgaaggagacccaccg

SEQ ID NO: 176774 - DNA, 25 bp, E. coli
gacgcactcgacttctcactggttg

SEQ ID NO: 176775 - DNA, 25 bp, E. coli
gacgcactcgacatctcactggttg

SEQ ID NO: 176776 - DNA, 25 bp, E. coli
gatctcgtttgatggagacccaccg

SEQ ID NO: 176777 - DNA, 25 bp, E. coli
caacaggaagtaacaggcgactcgt

SEQ ID NO: 176778 - DNA, 25 bp, E. coli
caacaggaagtatcaggcgactcgt

SEQ ID NO: 176779 - DNA, 25 bp, E. coli
catcaacaggaactaacaggcgact

SEQ ID NO: 176780 - DNA, 25 bp, E. coli
catcaacaggaagtaacaggcgact

SEQ ID NO: 176781 - DNA, 25 bp, E. coli
tacgatgaaaatgacaaggtatacg

SEQ ID NO: 176782 - DNA, 25 bp, E. coli
tacgatgaaaatcacaaggtatacg

SEQ ID NO: 176783 - DNA, 25 bp, E. coli
atcaacaggaagaaacaggcgactc

SEQ ID NO: 176784 - DNA, 25 bp, E. coli
atcaacaggaagtaacaggcgactc

SEQ ID NO: 176785 - DNA, 25 bp, E. coli
actggcatcaacaggaagtaacagg

SEQ ID NO: 176786 - DNA, 25 bp, E. coli
actggcatcaactggaagtaacagg

SEQ ID NO: 176787 - DNA, 25 bp, E. coli
acaggaagtaactggcgactcgtat

SEQ ID NO: 176788 - DNA, 25 bp, E. coli
aacaggaagtaacaggcgactcgta

SEQ ID NO: 176789 - DNA, 25 bp, E. coli
aacaggaagtaagaggcgactcgta

SEQ ID NO: 176790 - DNA, 25 bp, E. coli
acaggaagtaacaggcgactcgtat

SEQ ID NO: 176791 - DNA, 25 bp, E. coli
gcatcaacaggaagtaacaggcgac

SEQ ID NO: 176792 - DNA, 25 bp, E. coli
gcatcaacaggatgtaacaggcgac

SEQ ID NO: 176793 - DNA, 25 bp, E. coli
ctggcatcaacacgaagtaacaggc

SEQ ID NO: 176794 - DNA, 25 bp, E. coli
ctggcatcaacaggaagtaacaggc

SEQ ID NO: 176795 - DNA, 25 bp, E. coli
tggcatcaacagcaagtaacaggcg

SEQ ID NO: 176796 - DNA, 25 bp, E. coli
tggcatcaacaggaagtaacaggcg

SEQ ID NO: 176797 - DNA, 25 bp, E. coli
tcacaaggtatacggtgtgcgtaaa

SEQ ID NO: 176798 - DNA, 25 bp, E. coli
tcacaaggtatagggtgtgcgtaaa

SEQ ID NO: 176799 - DNA, 25 bp, E. coli
cactgtacttgaagctttgagccga

SEQ ID NO: 176800 - DNA, 25 bp, E. coli
cactgtacttgatgctttgagccga

SEQ ID NO: 176801 - DNA, 25 bp, E. coli
acgtcgtgtcgctcaagaactggga

SEQ ID NO: 176802 - DNA, 25 bp, E. coli
acgtcgtgtcgcacaagaactggga

SEQ ID NO: 176803 - DNA, 25 bp, E. coli
ttttccccatttccgaagcaggaga

SEQ ID NO: 176804 - DNA, 25 bp, E. coli
ttttccccatttgcgaagcaggaga

SEQ ID NO: 176805 - DNA, 25 bp, E. coli
tcagtgaccgatttgaggcgagtcc

SEQ ID NO: 176806 - DNA, 25 bp, E. coli
tcagtgaccgatatgaggcgagtcc

SEQ ID NO: 176807 - DNA, 25 bp, E. coli
ccatcgtggcagcaaggactgattc

SEQ ID NO: 176808 - DNA, 25 bp, E. coli
ccatcgtggcaggaaggactgattc

SEQ ID NO: 176809 - DNA, 25 bp, E. coli
gaaaggctgggttcgatcagtgacc

SEQ ID NO: 176810 - DNA, 25 bp, E. coli
gaaaggctgggtacgatcagtgacc

SEQ ID NO: 176811 - DNA, 25 bp, E. coli
gaaagtgtaataggcgccgtccatg

SEQ ID NO: 176812 - DNA, 25 bp, E. coli
gaaagtgtaatacgcgccgtccatg

SEQ ID NO: 176813 - DNA, 25 bp, E. coli
ggatggagtgttgccgacttcaaag

SEQ ID NO: 176814 - DNA, 25 bp, E. coli
ggatggagtgttcccgacttcaaag

SEQ ID NO: 176815 - DNA, 25 bp, E. coli
tcaaaggatatggagagccagaacg

SEQ ID NO: 176816 - DNA, 25 bp, E. coli
taatcgtgctgaaaatgcctatgcg

SEQ ID NO: 176817 - DNA, 25 bp, E. coli
taatatagagtttggacccaccgag

SEQ ID NO: 176818 - DNA, 25 bp, E. coli
taatatagagttaggacccaccgag

SEQ ID NO: 176819 - DNA, 25 bp, E. coli
tcaaaggatatgcagagccagaacg

SEQ ID NO: 176820 - DNA, 25 bp, E. coli
taatcgtgctgataatgcctatgcg

SEQ ID NO: 176821 - DNA, 25 bp, E. coli
aatccgtcataaaaagcgaagtctt

SEQ ID NO: 176822 - DNA, 25 bp, E. coli
aatccgtcataataagcgaagtctt

SEQ ID NO: 176823 - DNA, 25 bp, E. coli
caccgcgccgcctttgagtgtaacg

SEQ ID NO: 176824 - DNA, 25 bp, E. coli
caccgcgccgccattgagtgtaacg

SEQ ID NO: 176825 - DNA, 25 bp, E. coli
catttcgatacaattgcggatcgca

SEQ ID NO: 176826 - DNA, 25 bp, E. coli
tagcccactcaaatgacttttcagt

SEQ ID NO: 176827 - DNA, 25 bp, E. coli
tagcccactcaattgacttttcagt

SEQ ID NO: 176828 - DNA, 25 bp, E. coli
actgtgaaatatcgttcccaccgcg

SEQ ID NO: 176829 - DNA, 25 bp, E. coli
actgtgaaatatggttcccaccgcg

SEQ ID NO: 176830 - DNA, 25 bp, E. coli
tatttctggagatagtcatttgacc

SEQ ID NO: 176831 - DNA, 25 bp, E. coli
tatttctggagaaagtcatttgacc

SEQ ID NO: 176832 - DNA, 25 bp, E. coli
cctttgagtgtatcggcgaagatta

SEQ ID NO: 176833 - DNA, 25 bp, E. coli
cctttgagtgtaacggcgaagatta

SEQ ID NO: 176834 - DNA, 25 bp, E. coli
gacttttcagtttcctgaatccgtc

SEQ ID NO: 176835 - DNA, 25 bp, E. coli
gacttttcagttacctgaatccgtc

SEQ ID NO: 176836 - DNA, 25 bp, E. coli
cgaagtcttttttgtgacatttcga

SEQ ID NO: 176837 - DNA, 25 bp, E. coli
cgaagtctttttagtgacatttcga

SEQ ID NO: 176838 - DNA, 25 bp, E. coli
catttcgatacatttgcggatcgca

SEQ ID NO: 176839 - DNA, 25 bp, E. coli
gatagtcatttgtccgatactgtga

SEQ ID NO: 176840 - DNA, 25 bp, E. coli
gatagtcatttgaccgatactgtga

SEQ ID NO: 176841 - DNA, 25 bp, E. coli
taacggcgaagattagcccactcaa

SEQ ID NO: 176842 - DNA, 25 bp, E. coli
taacggcgaagaatagcccactcaa

SEQ ID NO: 176843 - DNA, 25 bp, E. coli
cacgctatcaaggattattcgtatg

SEQ ID NO: 176844 - DNA, 25 bp, E. coli
cagccaggcatggtactgcgcctga

SEQ ID NO: 176845 - DNA, 25 bp, E. coli
cagccaggcatgctactgcgcctga

SEQ ID NO: 176846 - DNA, 25 bp, E. coli
cacgctatcaagcattattcgtatg

SEQ ID NO: 176847 - DNA, 25 bp, E. coli
taaagcaagcgatatgcagctgccg

SEQ ID NO: 176848 - DNA, 25 bp, E. coli
taaagcaagcgaaatgcagctgccg

SEQ ID NO: 176849 - DNA, 25 bp, E. coli
agcgatatgcagctgccgcaggtca

SEQ ID NO: 176850 - DNA, 25 bp, E. coli
agcgatatgcaggtgccgcaggtca

SEQ ID NO: 176851 - DNA, 25 bp, E. coli
tagtacactcgataccgtagtgttc

SEQ ID NO: 176852 - DNA, 25 bp, E. coli
tagtacactcgaaaccgtagtgttc

SEQ ID NO: 176853 - DNA, 25 bp, E. coli
tgattttgacgatgcgcaggcgctg

SEQ ID NO: 176854 - DNA, 25 bp, E. coli
tgttaaatgaccagcaagttgatac

SEQ ID NO: 176855 - DNA, 25 bp, E. coli
tgattttgacgaagcgcaggcgctg

SEQ ID NO: 176856 - DNA, 25 bp, E. coli
tgatactaaagccattgaagcagat

SEQ ID NO: 176857 - DNA, 25 bp, E. coli
tgatactaaagcgattgaagcagat

SEQ ID NO: 176858 - DNA, 25 bp, E. coli
tgttaaatgacctgcaagttgatac

SEQ ID NO: 176859 - DNA, 25 bp, E. coli
tgctactgcgcctgacgacgggcga

SEQ ID NO: 176860 - DNA, 25 bp, E. coli
tgctactgcgccagacgacgggcga

SEQ ID NO: 176861 - DNA, 25 bp, E. coli
gcaacgcgctagtacactcgatacc

SEQ ID NO: 176862 - DNA, 25 bp, E. coli
gcaacgcgctagaacactcgatacc

SEQ ID NO: 176863 - DNA, 25 bp, E. coli
tggcagccataccacgctatcaagg

SEQ ID NO: 176864 - DNA, 25 bp, E. coli
tggcagccatacgacgctatcaagg

SEQ ID NO: 176865 - DNA, 25 bp, E. coli
cagggaaaggtctttttactgctga

SEQ ID NO: 176866 - DNA, 25 bp, E. coli
cagggaaaggtcattttactgctga

SEQ ID NO: 176867 - DNA, 25 bp, E. coli
taacatctttgaaataggtgcaggg

SEQ ID NO: 176868 - DNA, 25 bp, E. coli
taacatctttgatataggtgcaggg

SEQ ID NO: 176869 - DNA, 25 bp, E. coli
tatttccatccataacctaaagtgg

SEQ ID NO: 176870 - DNA, 25 bp, E. coli
tatttccatccaaaacctaaagtgg

SEQ ID NO: 176871 - DNA, 25 bp, E. coli
ttggcagcatacgttacaacataag

SEQ ID NO: 176872 - DNA, 25 bp, E. coli
ttgttacggcgatagaaattgattc

SEQ ID NO: 176873 - DNA, 25 bp, E. coli
ttggcagcataccttacaacataag

SEQ ID NO: 176874 - DNA, 25 bp, E. coli
ttgttacggcgaaagaaattgattc

SEQ ID NO: 176875 - DNA, 25 bp, E. coli
tgtgaggtaactcgtaataagctct

SEQ ID NO: 176876 - DNA, 25 bp, E. coli
tgtgaggtaactggtaataagctct

SEQ ID NO: 176877 - DNA, 25 bp, E. coli
tgaaagttcagcgacaataagttat

SEQ ID NO: 176878 - DNA, 25 bp, E. coli
tgaaagttcagccacaataagttat

SEQ ID NO: 176879 - DNA, 25 bp, E. coli
taattgtattaataagaaagccagc

SEQ ID NO: 176880 - DNA, 25 bp, E. coli
taattgtattaaaaagaaagccagc

SEQ ID NO: 176881 - DNA, 25 bp, E. coli
cctaaagtggatagcgcattaattg

SEQ ID NO: 176882 - DNA, 25 bp, E. coli
cctaaagtggattgcgcattaattg

SEQ ID NO: 176883 - DNA, 25 bp, E. coli
ctagcattgctgataatggcagagg

SEQ ID NO: 176884 - DNA, 25 bp, E. coli
ctagcattgctgttaatggcagagg

SEQ ID NO: 176885 - DNA, 25 bp, E. coli
gatacaaacagatcactagcattgc

SEQ ID NO: 176886 - DNA, 25 bp, E. coli
gatacaaacagaacactagcattgc

SEQ ID NO: 176887 - DNA, 25 bp, E. coli
aaaaacggcattcttatcatcccgg

SEQ ID NO: 176888 - DNA, 25 bp, E. coli
aaaaacggcattgttatcatcccgg

SEQ ID NO: 176889 - DNA, 25 bp, E. coli
tacccgcaatgtgctggctttatcc

SEQ ID NO: 176890 - DNA, 25 bp, E. coli
tacccgcaatgtcctggctttatcc

SEQ ID NO: 176891 - DNA, 25 bp, E. coli
tgcctggtcggctgaatacaggata

SEQ ID NO: 176892 - DNA, 25 bp, E. coli
tgcctggtcggcagaatacaggata

SEQ ID NO: 176893 - DNA, 25 bp, E. coli
tcggggggactttattgcctggtcg

SEQ ID NO: 176894 - DNA, 25 bp, E. coli
tcggggggacttaattgcctggtcg

SEQ ID NO: 176895 - DNA, 25 bp, E. coli
gccccatggtttattcacggtattg

SEQ ID NO: 176896 - DNA, 25 bp, E. coli
gccccatggttttttcacggtattg

SEQ ID NO: 176897 - DNA, 25 bp, E. coli
ccaggattacccttacccgcaatgt

SEQ ID NO: 176898 - DNA, 25 bp, E. coli
ccaggattacccatacccgcaatgt

SEQ ID NO: 176899 - DNA, 25 bp, E. coli
gaatgccccatgctttattcacggt

SEQ ID NO: 176900 - DNA, 25 bp, E. coli
gaatgccccatggtttattcacggt

SEQ ID NO: 176901 - DNA, 25 bp, E. coli
cccggtgatacagcagacagattga

SEQ ID NO: 176902 - DNA, 25 bp, E. coli
cccggtgatacaccagacagattga

SEQ ID NO: 176903 - DNA, 25 bp, E. coli
gtagccaggattacccttacccgca

SEQ ID NO: 176904 - DNA, 25 bp, E. coli
gtagccaggatttcccttacccgca

SEQ ID NO: 176905 - DNA, 25 bp, E. coli
ggtaaaaacggcattgttatcatcc

SEQ ID NO: 176906 - DNA, 25 bp, E. coli
ggtaaaaacggctttgttatcatcc

SEQ ID NO: 176907 - DNA, 25 bp, E. coli
ggctattacgacactgcgcctggta

SEQ ID NO: 176908 - DNA, 25 bp, E. coli
ggctattacgactctgcgcctggta

SEQ ID NO: 176909 - DNA, 25 bp, E. coli
aatctccaagctctgccgtaaagcg

SEQ ID NO: 176910 - DNA, 25 bp, E. coli
aacgtggccttctgcgatcactacc

SEQ ID NO: 176911 - DNA, 25 bp, E. coli
aagctgtgccgtaaagcggttaagc

SEQ ID NO: 176912 - DNA, 25 bp, E. coli
aatctccaagctgtgccgtaaagcg

SEQ ID NO: 176913 - DNA, 25 bp, E. coli
aagctgtgccgttaagcggttaagc

SEQ ID NO: 176914 - DNA, 25 bp, E. coli
cagaacgtggccatcagcgatcact

SEQ ID NO: 176915 - DNA, 25 bp, E. coli
cagaacgtggccttcagcgatcact

SEQ ID NO: 176916 - DNA, 25 bp, E. coli
aacgtggccttcagcgatcactacc

SEQ ID NO: 176917 - DNA, 25 bp, E. coli
aaatctccaagctgtgccgtaaagc

SEQ ID NO: 176918 - DNA, 25 bp, E. coli
aaatctccaagcagtgccgtaaagc

SEQ ID NO: 176919 - DNA, 25 bp, E. coli
tctccaagctgtgccgtaaagcggt

SEQ ID NO: 176920 - DNA, 25 bp, E. coli
tctccaagctgtcccgtaaagcggt

SEQ ID NO: 176921 - DNA, 25 bp, E. coli
ccaagctgtgccctaaagcggttaa

SEQ ID NO: 176922 - DNA, 25 bp, E. coli
ccaagctgtgccgtaaagcggttaa

SEQ ID NO: 176923 - DNA, 25 bp, E. coli
gcagaacgtggccttcagcgatcac

SEQ ID NO: 176924 - DNA, 25 bp, E. coli
gcagaacgtggcgttcagcgatcac

SEQ ID NO: 176925 - DNA, 25 bp, E. coli
gaacgtggccttgagcgatcactac

SEQ ID NO: 176926 - DNA, 25 bp, E. coli
gaacgtggccttcagcgatcactac

SEQ ID NO: 176927 - DNA, 25 bp, E. coli
gtggccttcagccatcactacctgg

SEQ ID NO: 176928 - DNA, 25 bp, E. coli
gtggccttcagcgatcactacctgg

SEQ ID NO: 176929 - DNA, 25 bp, E. coli
tggccttcagcgttcactacctgga

SEQ ID NO: 176930 - DNA, 25 bp, E. coli
tggccttcagcgatcactacctgga

SEQ ID NO: 176931 - DNA, 25 bp, E. coli
tccccgtctgaggttccgttttctt

SEQ ID NO: 176932 - DNA, 25 bp, E. coli
aatgaaaccatcaccactccccgtc

SEQ ID NO: 176933 - DNA, 25 bp, E. coli
aatgaaaccatctccactccccgtc

SEQ ID NO: 176934 - DNA, 25 bp, E. coli
tccccgtctgagcttccgttttctt

SEQ ID NO: 176935 - DNA, 25 bp, E. coli
aaacagcaaagcctgccgaattaca

SEQ ID NO: 176936 - DNA, 25 bp, E. coli
aaacagcaaagcgtgccgaattaca

SEQ ID NO: 176937 - DNA, 25 bp, E. coli
actggaaacagcaaagcctgccgaa

SEQ ID NO: 176938 - DNA, 25 bp, E. coli
actggaaacagctaagcctgccgaa

SEQ ID NO: 176939 - DNA, 25 bp, E. coli
tttctctctcgagcgagaagcccgg

SEQ ID NO: 176940 - DNA, 25 bp, E. coli
tttctctctcgaccgagaagcccgg

SEQ ID NO: 176941 - DNA, 25 bp, E. coli
gcggcaattacagcggattattttc

SEQ ID NO: 176942 - DNA, 25 bp, E. coli
gcggcaattacaccggattattttc

SEQ ID NO: 176943 - DNA, 25 bp, E. coli
cccgacggtggagcggcaattacag

SEQ ID NO: 176944 - DNA, 25 bp, E. coli
cccgacggtggaccggcaattacag

SEQ ID NO: 176945 - DNA, 25 bp, E. coli
cggattattttctctctcgagcgag

SEQ ID NO: 176946 - DNA, 25 bp, E. coli
cggattattttcactctcgagcgag

SEQ ID NO: 176947 - DNA, 25 bp, E. coli
tggagcggcaattacagcggattat

SEQ ID NO: 176948 - DNA, 25 bp, E. coli
tggagcggcaataacagcggattat

SEQ ID NO: 176949 - DNA, 25 bp, E. coli
tttcttaacgtcagcccgacggtgg

SEQ ID NO: 176950 - DNA, 25 bp, E. coli
tttcttaacgtctgcccgacggtgg

SEQ ID NO: 176951 - DNA, 25 bp, E. coli
gagcttccgtttacttaacgtcagc

SEQ ID NO: 176952 - DNA, 25 bp, E. coli
gagcttccgttttcttaacgtcagc

SEQ ID NO: 176953 - DNA, 25 bp, E. coli
cactgtcacttatagtggcggcgct

SEQ ID NO: 176954 - DNA, 25 bp, E. coli
cactgtcacttaaagtggcggcgct

SEQ ID NO: 176955 - DNA, 25 bp, E. coli
tttagcgtggcagcacagcgtagtg

SEQ ID NO: 176956 - DNA, 25 bp, E. coli
ttaaaaccatcattctggagccggg

SEQ ID NO: 176957 - DNA, 25 bp, E. coli
ttaaaaccatcaatctggagccggg

SEQ ID NO: 176958 - DNA, 25 bp, E. coli
tttagcgtggcaccacagcgtagtg

SEQ ID NO: 176959 - DNA, 25 bp, E. coli
tttttcctcaaagtggcggcctggg

SEQ ID NO: 176960 - DNA, 25 bp, E. coli
tttttcctcaaactggcggcctggg

SEQ ID NO: 176961 - DNA, 25 bp, E. coli
tgatattcttgatgccgtgacactg

SEQ ID NO: 176962 - DNA, 25 bp, E. coli
tgatattcttgaagccgtgacactg

SEQ ID NO: 176963 - DNA, 25 bp, E. coli
tggtgtttaacaatgtcatcgcccg

SEQ ID NO: 176964 - DNA, 25 bp, E. coli
tggtgtttaacattgtcatcgcccg

SEQ ID NO: 176965 - DNA, 25 bp, E. coli
gcgtttaacactgaagatgcggcgt

SEQ ID NO: 176966 - DNA, 25 bp, E. coli
gcgtttaacactcaagatgcggcgt

SEQ ID NO: 176967 - DNA, 25 bp, E. coli
cgcgctgtggcgtcgagactttttc

SEQ ID NO: 176968 - DNA, 25 bp, E. coli
cgctgccgggcaatgtcactggtct

SEQ ID NO: 176969 - DNA, 25 bp, E. coli
cgcgctgtggcgacgagactttttc

SEQ ID NO: 176970 - DNA, 25 bp, E. coli
cgctgccgggcattgtcactggtct

SEQ ID NO: 176971 - DNA, 25 bp, E. coli
ggcgtttgccttctcgttcgatgaa

SEQ ID NO: 176972 - DNA, 25 bp, E. coli
ggcgtttgccttgtcgttcgatgaa

SEQ ID NO: 176973 - DNA, 25 bp, E. coli
gagccgggatttttcaccatcgtgg

SEQ ID NO: 176974 - DNA, 25 bp, E. coli
gagccgggatttatcaccatcgtgg

SEQ ID NO: 176975 - DNA, 25 bp, E. coli
catccgtcaggaagtgcaacagtct

SEQ ID NO: 176976 - DNA, 25 bp, E. coli
catgaacaataagcaggtacgtgaa

SEQ ID NO: 176977 - DNA, 25 bp, E. coli
caggtacgtgaatcaatgcgtgcca

SEQ ID NO: 176978 - DNA, 25 bp, E. coli
catgaacaataaccaggtacgtgaa

SEQ ID NO: 176979 - DNA, 25 bp, E. coli
caggtacgtgaaacaatgcgtgcca

SEQ ID NO: 176980 - DNA, 25 bp, E. coli
catccgtcaggatgtgcaacagtct

SEQ ID NO: 176981 - DNA, 25 bp, E. coli
tatcacagatgctaatggtgcggcg

SEQ ID NO: 176982 - DNA, 25 bp, E. coli
tatcacagatgcaaatggtgcggcg

SEQ ID NO: 176983 - DNA, 25 bp, E. coli
tgtctgaacttcagcgcaaagttct

SEQ ID NO: 176984 - DNA, 25 bp, E. coli
tgtctgaacttctgcgcaaagttct

SEQ ID NO: 176985 - DNA, 25 bp, E. coli
tgcaacagtctgttaatagtaaaat

SEQ ID NO: 176986 - DNA, 25 bp, E. coli
tgcaacagtctgataatagtaaaat

SEQ ID NO: 176987 - DNA, 25 bp, E. coli
tgcgtgccagaatggaagaattggc

SEQ ID NO: 176988 - DNA, 25 bp, E. coli
tgcgtgccagaaaggaagaattggc

SEQ ID NO: 176989 - DNA, 25 bp, E. coli
ccaggtaagattatgcaggatgtca

SEQ ID NO: 176990 - DNA, 25 bp, E. coli
ccaggtaagattttgcaggatgtca

SEQ ID NO: 176991 - DNA, 25 bp, E. coli
gaattggctgcaaaacgacaaggat

SEQ ID NO: 176992 - DNA, 25 bp, E. coli
gcaaagttctctgtgcaccaggtaa

SEQ ID NO: 176993 - DNA, 25 bp, E. coli
gaattggctgcataacgacaaggat

SEQ ID NO: 176994 - DNA, 25 bp, E. coli
gcaaagttctctctgcaccaggtaa

SEQ ID NO: 176995 - DNA, 25 bp, E. coli
ggtgcggcgaccataaacatgaaca

SEQ ID NO: 176996 - DNA, 25 bp, E. coli
ggtgcggcgaccttaaacatgaaca

SEQ ID NO: 176997 - DNA, 25 bp, E. coli
cactgctgtgtgtactgtagagtct

SEQ ID NO: 176998 - DNA, 25 bp, E. coli
cactgctgtgtgaactgtagagtct

SEQ ID NO: 176999 - DNA, 25 bp, E. coli
tactgtagagtcaggcggatgtcga

SEQ ID NO: 177000 - DNA, 25 bp, E. coli
taaaaccgttattacacagtcaccg

SEQ ID NO: 177001 - DNA, 25 bp, E. coli
tactgtagagtctggcggatgtcga

SEQ ID NO: 177002 - DNA, 25 bp, E. coli
taaaaccgttataacacagtcaccg

SEQ ID NO: 177003 - DNA, 25 bp, E. coli
agtcaccggcgcagaggagacaatg

SEQ ID NO: 177004 - DNA, 25 bp, E. coli
agtcaccggcgctgaggagacaatg

SEQ ID NO: 177005 - DNA, 25 bp, E. coli
tttaagacgcggatgcactgctgtg

SEQ ID NO: 177006 - DNA, 25 bp, E. coli
tttaagacgcggttgcactgctgtg

SEQ ID NO: 177007 - DNA, 25 bp, E. coli
tctgtcactgaacaaaattggcaac

SEQ ID NO: 177008 - DNA, 25 bp, E. coli
tctgtcactgaagaaaattggcaac

SEQ ID NO: 177009 - DNA, 25 bp, E. coli
cgttataacacactcaccggcgcag

SEQ ID NO: 177010 - DNA, 25 bp, E. coli
cgcagaggagactatgccggattta

SEQ ID NO: 177011 - DNA, 25 bp, E. coli
cgttataacacagtcaccggcgcag

SEQ ID NO: 177012 - DNA, 25 bp, E. coli
cgcagaggagacaatgccggattta

SEQ ID NO: 177013 - DNA, 25 bp, E. coli
ctgaagaaaattcgcaactaaaggt

SEQ ID NO: 177014 - DNA, 25 bp, E. coli
ctgaagaaaattggcaactaaaggt

SEQ ID NO: 177015 - DNA, 25 bp, E. coli
ggcggatgtcgagagactctatttt

SEQ ID NO: 177016 - DNA, 25 bp, E. coli
ggcggatgtcgacagactctatttt

SEQ ID NO: 177017 - DNA, 25 bp, E. coli
gagacaatgccggatttaagacgcg

SEQ ID NO: 177018 - DNA, 25 bp, E. coli
gagacaatgccgcatttaagacgcg

SEQ ID NO: 177019 - DNA, 25 bp, E. coli
tattctcggtgttaaccatgccgcc

SEQ ID NO: 177020 - DNA, 25 bp, E. coli
tattctcggtgtaaaccatgccgcc

SEQ ID NO: 177021 - DNA, 25 bp, E. coli
tgatgcgtagcatcaccggtggacg

SEQ ID NO: 177022 - DNA, 25 bp, E. coli
tgtgaagattgcgatcccgctgatg

SEQ ID NO: 177023 - DNA, 25 bp, E. coli
tgtgaagattgccatcccgctgatg

SEQ ID NO: 177024 - DNA, 25 bp, E. coli
tgagcctgagtttttgccgcgatct

SEQ ID NO: 177025 - DNA, 25 bp, E. coli
tgatgcgtagcaacaccggtggacg

SEQ ID NO: 177026 - DNA, 25 bp, E. coli
tgaacaacgccctgctgtggctgac

SEQ ID NO: 177027 - DNA, 25 bp, E. coli
tgaacaacgcccagctgtggctgac

SEQ ID NO: 177028 - DNA, 25 bp, E. coli
tgaagatgctggcaaagacccacca

SEQ ID NO: 177029 - DNA, 25 bp, E. coli
tgaagatgctgggaaagacccacca

SEQ ID NO: 177030 - DNA, 25 bp, E. coli
tgagcctgagttattgccgcgatct

SEQ ID NO: 177031 - DNA, 25 bp, E. coli
gctgggccagcctgacggattatct

SEQ ID NO: 177032 - DNA, 25 bp, E. coli
gctttattggtcacgtggtgccgca

SEQ ID NO: 177033 - DNA, 25 bp, E. coli
gctttattggtctcgtggtgccgca

SEQ ID NO: 177034 - DNA, 25 bp, E. coli
gctgggccagccagacggattatct

SEQ ID NO: 177035 - DNA, 25 bp, E. coli
gattttatttctgccgctgagcctg

SEQ ID NO: 177036 - DNA, 25 bp, E. coli
gattttatttctcccgctgagcctg

SEQ ID NO: 177037 - DNA, 25 bp, E. coli
gtattgatggagaaccgactgccgc

SEQ ID NO: 177038 - DNA, 25 bp, E. coli
gtattgatggagtaccgactgccgc

SEQ ID NO: 177039 - DNA, 25 bp, E. coli
ggcaggccggactcgagcattatta

SEQ ID NO: 177040 - DNA, 25 bp, E. coli
ggcaggccggacacgagcattatta

SEQ ID NO: 177041 - DNA, 25 bp, E. coli
caaggcgcttagttcgccagcctga

SEQ ID NO: 177042 - DNA, 25 bp, E. coli
caaggcgcttagatcgccagcctga

SEQ ID NO: 177043 - DNA, 25 bp, E. coli
tacataagcggattaacacgcgcag

SEQ ID NO: 177044 - DNA, 25 bp, E. coli
taacaactgctgagtattaaccgca

SEQ ID NO: 177045 - DNA, 25 bp, E. coli
tacataagcggaataacacgcgcag

SEQ ID NO: 177046 - DNA, 25 bp, E. coli
aaccaaagattgattacataagcgg

SEQ ID NO: 177047 - DNA, 25 bp, E. coli
aaccaaagattgtttacataagcgg

SEQ ID NO: 177048 - DNA, 25 bp, E. coli
tattaaccgcatgaccgctacaaag

SEQ ID NO: 177049 - DNA, 25 bp, E. coli
tattaaccgcatcaccgctacaaag

SEQ ID NO: 177050 - DNA, 25 bp, E. coli
ttatcgttttaacaactgctgtgta

SEQ ID NO: 177051 - DNA, 25 bp, E. coli
ttatcgttttaagaactgctgtgta

SEQ ID NO: 177052 - DNA, 25 bp, E. coli
tcgccagcctgaccataagaattgt

SEQ ID NO: 177053 - DNA, 25 bp, E. coli
tcgccagcctgagcataagaattgt

SEQ ID NO: 177054 - DNA, 25 bp, E. coli
cgctacaaagcgacagccaaatgaa

SEQ ID NO: 177055 - DNA, 25 bp, E. coli
cgctacaaagcgtcagccaaatgaa

SEQ ID NO: 177056 - DNA, 25 bp, E. coli
cattgtgacccatagcaaggcgctt

SEQ ID NO: 177057 - DNA, 25 bp, E. coli
ctgaccataagatttgtttcgacgg

SEQ ID NO: 177058 - DNA, 25 bp, E. coli
cattgtgacccaaagcaaggcgctt

SEQ ID NO: 177059 - DNA, 25 bp, E. coli
ctgaccataagaattgtttcgacgg

SEQ ID NO: 177060 - DNA, 25 bp, E. coli
gattaacacgcgcaggatcacaaat

SEQ ID NO: 177061 - DNA, 25 bp, E. coli
gattaacacgcggaggatcacaaat

SEQ ID NO: 177062 - DNA, 25 bp, E. coli
taacaactgctgtgtattaaccgca

SEQ ID NO: 177063 - DNA, 25 bp, E. coli
cacaggcaaccagcgcggtgtattc

SEQ ID NO: 177064 - DNA, 25 bp, E. coli
cacaggcaaccaccgcggtgtattc

SEQ ID NO: 177065 - DNA, 25 bp, E. coli
cagtactctccgatgctgcacctgt

SEQ ID NO: 177066 - DNA, 25 bp, E. coli
cagtactctccgttgctgcacctgt

SEQ ID NO: 177067 - DNA, 25 bp, E. coli
agatgaacgcgcctatgccgccgac

SEQ ID NO: 177068 - DNA, 25 bp, E. coli
aggcgctctcacaggcgacggtgac

SEQ ID NO: 177069 - DNA, 25 bp, E. coli
agatgaacgcgcgtatgccgccgac

SEQ ID NO: 177070 - DNA, 25 bp, E. coli
aggcgctctcactggcgacggtgac

SEQ ID NO: 177071 - DNA, 25 bp, E. coli
tatcgtcagctgctaccggaactgg

SEQ ID NO: 177072 - DNA, 25 bp, E. coli
tatcgtcagctggtaccggaactgg

SEQ ID NO: 177073 - DNA, 25 bp, E. coli
tgccgccgacataaccatgcatcag

SEQ ID NO: 177074 - DNA, 25 bp, E. coli
tgccgccgacattaccatgcatcag

SEQ ID NO: 177075 - DNA, 25 bp, E. coli
gccatttttcagtcccgtatctgcg

SEQ ID NO: 177076 - DNA, 25 bp, E. coli
gccatttttcagacccgtatctgcg

SEQ ID NO: 177077 - DNA, 25 bp, E. coli
gaataccggacagtttatcgtcagc

SEQ ID NO: 177078 - DNA, 25 bp, E. coli
gaataccggacactttatcgtcagc

SEQ ID NO: 177079 - DNA, 25 bp, E. coli
tgcccgtttcagatttccggcctgg

SEQ ID NO: 177080 - DNA, 25 bp, E. coli
tgcccgtttcagttttccggcctgg

SEQ ID NO: 177081 - DNA, 25 bp, E. coli
gggaccgcattatccacctgctgat

SEQ ID NO: 177082 - DNA, 25 bp, E. coli
gggaccgcattaaccacctgctgat

SEQ ID NO: 177083 - DNA, 25 bp, E. coli
tcacactgtgggtgcgtctgttctg

SEQ ID NO: 177084 - DNA, 25 bp, E. coli
tcacactgtgggagcgtctgttctg

SEQ ID NO: 177085 - DNA, 25 bp, E. coli
cacactgggttatgctgaagcgttg

SEQ ID NO: 177086 - DNA, 25 bp, E. coli
cacactgggttaagctgaagcgttg

SEQ ID NO: 177087 - DNA, 25 bp, E. coli
atgccacactggcttatgctgaagc

SEQ ID NO: 177088 - DNA, 25 bp, E. coli
atgccacactgggttatgctgaagc

SEQ ID NO: 177089 - DNA, 25 bp, E. coli
acactgggttatcctgaagcgttga

SEQ ID NO: 177090 - DNA, 25 bp, E. coli
acactgggttatgctgaagcgttga

SEQ ID NO: 177091 - DNA, 25 bp, E. coli
tgccacactgggatatgctgaagcg

SEQ ID NO: 177092 - DNA, 25 bp, E. coli
tgccacactgggttatgctgaagcg

SEQ ID NO: 177093 - DNA, 25 bp, E. coli
tccggtagtggctattggtattggc

SEQ ID NO: 177094 - DNA, 25 bp, E. coli
tccggtagtggcaattggtattggc

SEQ ID NO: 177095 - DNA, 25 bp, E. coli
gccacactgggtaatgctgaagcgt

SEQ ID NO: 177096 - DNA, 25 bp, E. coli
gccacactgggttatgctgaagcgt

SEQ ID NO: 177097 - DNA, 25 bp, E. coli
ccacactgggttatgctgaagcgtt

SEQ ID NO: 177098 - DNA, 25 bp, E. coli
ccacactgggttttgctgaagcgtt

SEQ ID NO: 177099 - DNA, 25 bp, E. coli
gcgatgccacactgggttatgctga

SEQ ID NO: 177100 - DNA, 25 bp, E. coli
gcttccggtagtggctattggtatt

SEQ ID NO: 177101 - DNA, 25 bp, E. coli
gcgatgccacacagggttatgctga

SEQ ID NO: 177102 - DNA, 25 bp, E. coli
gcttccggtagtcgctattggtatt

SEQ ID NO: 177103 - DNA, 25 bp, E. coli
cgatgccacactcggttatgctgaa

SEQ ID NO: 177104 - DNA, 25 bp, E. coli
cgatgccacactgggttatgctgaa

SEQ ID NO: 177105 - DNA, 25 bp, E. coli
gtgcttccggtagtggctattggta

SEQ ID NO: 177106 - DNA, 25 bp, E. coli
gtgcttccggtactggctattggta

SEQ ID NO: 177107 - DNA, 25 bp, E. coli
catatcaggagtacttccgcgaaac

SEQ ID NO: 177108 - DNA, 25 bp, E. coli
catatcaggagttcttccgcgaaac

SEQ ID NO: 177109 - DNA, 25 bp, E. coli
taccccgcaaggtacagaggtctcc

SEQ ID NO: 177110 - DNA, 25 bp, E. coli
taccccgcaaggaacagaggtctcc

SEQ ID NO: 177111 - DNA, 25 bp, E. coli
tatcaggagtacatccgcgaaacca

SEQ ID NO: 177112 - DNA, 25 bp, E. coli
tatcaggagtacttccgcgaaacca

SEQ ID NO: 177113 - DNA, 25 bp, E. coli
tggggcgcgatatcagtgagctgga

SEQ ID NO: 177114 - DNA, 25 bp, E. coli
tggggcgcgataacagtgagctgga

SEQ ID NO: 177115 - DNA, 25 bp, E. coli
tcaggagtacttgcgcgaaaccatc

SEQ ID NO: 177116 - DNA, 25 bp, E. coli
tcaggagtacttccgcgaaaccatc

SEQ ID NO: 177117 - DNA, 25 bp, E. coli
gccatatcaggagtacttccgcgaa

SEQ ID NO: 177118 - DNA, 25 bp, E. coli
gccatatcaggactacttccgcgaa

SEQ ID NO: 177119 - DNA, 25 bp, E. coli
gataccccgcaacgaacagaggtct

SEQ ID NO: 177120 - DNA, 25 bp, E. coli
gataccccgcaaggaacagaggtct

SEQ ID NO: 177121 - DNA, 25 bp, E. coli
gggataccccgctaggaacagaggt

SEQ ID NO: 177122 - DNA, 25 bp, E. coli
ggataccccgcaaggaacagaggtc

SEQ ID NO: 177123 - DNA, 25 bp, E. coli
ggataccccgcatggaacagaggtc

SEQ ID NO: 177124 - DNA, 25 bp, E. coli
ggagtacttccgcgaaaccatcgac

SEQ ID NO: 177125 - DNA, 25 bp, E. coli
gggataccccgcaaggaacagaggt

SEQ ID NO: 177126 - DNA, 25 bp, E. coli
ggagtacttccgggaaaccatcgac

SEQ ID NO: 177127 - DNA, 25 bp, E. coli
gagccatatcaggagtacttccgcg

SEQ ID NO: 177128 - DNA, 25 bp, E. coli
gagccatatcagcagtacttccgcg

SEQ ID NO: 177129 - DNA, 25 bp, E. coli
caatgccagcatagacggtgcagca

SEQ ID NO: 177130 - DNA, 25 bp, E. coli
caatgccagcattgacggtgcagca

SEQ ID NO: 177131 - DNA, 25 bp, E. coli
tagttggtatcaatgtgacctggta

SEQ ID NO: 177132 - DNA, 25 bp, E. coli
tacaccaaaggtgacgacattgaga

SEQ ID NO: 177133 - DNA, 25 bp, E. coli
tacaccaaaggtcacgacattgaga

SEQ ID NO: 177134 - DNA, 25 bp, E. coli
tagttggtatcattgtgacctggta

SEQ ID NO: 177135 - DNA, 25 bp, E. coli
aaaaacatgggagcatatgcaagcc

SEQ ID NO: 177136 - DNA, 25 bp, E. coli
aaaaacatgggaccatatgcaagcc

SEQ ID NO: 177137 - DNA, 25 bp, E. coli
tatgcaagccttcactacaccaaag

SEQ ID NO: 177138 - DNA, 25 bp, E. coli
tatgcaagccttgactacaccaaag

SEQ ID NO: 177139 - DNA, 25 bp, E. coli
tccgtctgggtgatgagtctgtcaa

SEQ ID NO: 177140 - DNA, 25 bp, E. coli
tccgtctgggtgttgagtctgtcaa

SEQ ID NO: 177141 - DNA, 25 bp, E. coli
gcattgacggtgcagcattccgcgt

SEQ ID NO: 177142 - DNA, 25 bp, E. coli
gctgatatcacctaaaacatgggag

SEQ ID NO: 177143 - DNA, 25 bp, E. coli
gcattgacggtggagcattccgcgt

SEQ ID NO: 177144 - DNA, 25 bp, E. coli
gctgatatcaccaaaaacatgggag

SEQ ID NO: 177145 - DNA, 25 bp, E. coli
ccgctacagggtctagttggtatca

SEQ ID NO: 177146 - DNA, 25 bp, E. coli
ccgctacagggtgtagttggtatca

SEQ ID NO: 177147 - DNA, 25 bp, E. coli
cattccgcgtggctgcaggtgtaca

SEQ ID NO: 177148 - DNA, 25 bp, E. coli
cattccgcgtgggtgcaggtgtaca

SEQ ID NO: 177149 - DNA, 25 bp, E. coli
ggtgatgagtctgtcaatgccagca

SEQ ID NO: 177150 - DNA, 25 bp, E. coli
ggtgatgagtctctcaatgccagca

SEQ ID NO: 177151 - DNA, 25 bp, E. coli
caatggcctgcaaagccagaacggt

SEQ ID NO: 177152 - DNA, 25 bp, E. coli
caatggcctgcatagccagaacggt

SEQ ID NO: 177153 - DNA, 25 bp, E. coli
tacgatctatcagctacgtgcactg

SEQ ID NO: 177154 - DNA, 25 bp, E. coli
agagcagcaacctgaacttattcca

SEQ ID NO: 177155 - DNA, 25 bp, E. coli
atcctgacgagaagtgcagcgaaat

SEQ ID NO: 177156 - DNA, 25 bp, E. coli
atcctgacgagatgtgcagcgaaat

SEQ ID NO: 177157 - DNA, 25 bp, E. coli
agagcagcaaccagaacttattcca

SEQ ID NO: 177158 - DNA, 25 bp, E. coli
tacgatctatcacctacgtgcactg

SEQ ID NO: 177159 - DNA, 25 bp, E. coli
tgacagagcagcaaccagaacttat

SEQ ID NO: 177160 - DNA, 25 bp, E. coli
tgacagagcagctaccagaacttat

SEQ ID NO: 177161 - DNA, 25 bp, E. coli
tgcccttcaatacgatctatcagct

SEQ ID NO: 177162 - DNA, 25 bp, E. coli
tgcccttcaataggatctatcagct

SEQ ID NO: 177163 - DNA, 25 bp, E. coli
cctgcatagccagaacggttatgtc

SEQ ID NO: 177164 - DNA, 25 bp, E. coli
cctgcatagccacaacggttatgtc

SEQ ID NO: 177165 - DNA, 25 bp, E. coli
gctacgtgcactgacagagcagcaa

SEQ ID NO: 177166 - DNA, 25 bp, E. coli
gctttgctgatagcggattacttta

SEQ ID NO: 177167 - DNA, 25 bp, E. coli
gctggcagccaaaatcaccaacgaa

SEQ ID NO: 177168 - DNA, 25 bp, E. coli
gctggcagccaatatcaccaacgaa

SEQ ID NO: 177169 - DNA, 25 bp, E. coli
gctttgctgataccggattacttta

SEQ ID NO: 177170 - DNA, 25 bp, E. coli
gctacgtgcactcacagagcagcaa

SEQ ID NO: 177171 - DNA, 25 bp, E. coli
ctttattaatcctgacgagatgtgc

SEQ ID NO: 177172 - DNA, 25 bp, E. coli
ctttattaatccagacgagatgtgc

SEQ ID NO: 177173 - DNA, 25 bp, E. coli
aatcggcgtgggacaacaacaaaat

SEQ ID NO: 177174 - DNA, 25 bp, E. coli
aatcggcgtgggtcaacaacaaaat

SEQ ID NO: 177175 - DNA, 25 bp, E. coli
caatcctcaggatgcaacagcgatg

SEQ ID NO: 177176 - DNA, 25 bp, E. coli
caatcctcaggaagcaacagcgatg

SEQ ID NO: 177177 - DNA, 25 bp, E. coli
caacagcgatgctggcagacgggtc

SEQ ID NO: 177178 - DNA, 25 bp, E. coli
caacagcgatgcaggcagacgggtc

SEQ ID NO: 177179 - DNA, 25 bp, E. coli
taaaactgtcgagcaactgacgttg

SEQ ID NO: 177180 - DNA, 25 bp, E. coli
taaaactgtcgaccaactgacgttg

SEQ ID NO: 177181 - DNA, 25 bp, E. coli
tttacaacggcaagatataggcgga

SEQ ID NO: 177182 - DNA, 25 bp, E. coli
tttacaacggcatgatataggcgga

SEQ ID NO: 177183 - DNA, 25 bp, E. coli
tcaggaagcaacagcgatgctggca

SEQ ID NO: 177184 - DNA, 25 bp, E. coli
tcaggaagcaactgcgatgctggca

SEQ ID NO: 177185 - DNA, 25 bp, E. coli
cggcatgatataggcggaaaaacgg

SEQ ID NO: 177186 - DNA, 25 bp, E. coli
ctggcgagcaggacgtgatttacaa

SEQ ID NO: 177187 - DNA, 25 bp, E. coli
cggcatgatatacgcggaaaaacgg

SEQ ID NO: 177188 - DNA, 25 bp, E. coli
ctggcgagcaggtcgtgatttacaa

SEQ ID NO: 177189 - DNA, 25 bp, E. coli
ggtaaaactgtcgaccaactgacgt

SEQ ID NO: 177190 - DNA, 25 bp, E. coli
ggtaaaactgtccaccaactgacgt

SEQ ID NO: 177191 - DNA, 25 bp, E. coli
ggtcgtgatttacaacggcatgata

SEQ ID NO: 177192 - DNA, 25 bp, E. coli
ggtcgtgatttagaacggcatgata

SEQ ID NO: 177193 - DNA, 25 bp, E. coli
gagcaggtcgtgttttacaacggca

SEQ ID NO: 177194 - DNA, 25 bp, E. coli
gagcaggtcgtgatttacaacggca

SEQ ID NO: 177195 - DNA, 25 bp, E. coli
caatcagcattgagcagcatgtctt

SEQ ID NO: 177196 - DNA, 25 bp, E. coli
caatcagcattgtgcagcatgtctt

SEQ ID NO: 177197 - DNA, 25 bp, E. coli
cagcaactgttgaccggcagcttca

SEQ ID NO: 177198 - DNA, 25 bp, E. coli
cagcaactgttgtccggcagcttca

SEQ ID NO: 177199 - DNA, 25 bp, E. coli
ttaccgcccgcatgtcaggtactgg

SEQ ID NO: 177200 - DNA, 25 bp, E. coli
ttaccgcccgcaagtcaggtactgg

SEQ ID NO: 177201 - DNA, 25 bp, E. coli
tgatgctcagccactggccgattag

SEQ ID NO: 177202 - DNA, 25 bp, E. coli
tgcgtaacgccagcggcaaactggt

SEQ ID NO: 177203 - DNA, 25 bp, E. coli
tgatgctcagcctctggccgattag

SEQ ID NO: 177204 - DNA, 25 bp, E. coli
tgcgtaacgccaccggcaaactggt

SEQ ID NO: 177205 - DNA, 25 bp, E. coli
gcattcgcctgtttctggtgaccta

SEQ ID NO: 177206 - DNA, 25 bp, E. coli
gcattcgcctgtatctggtgaccta

SEQ ID NO: 177207 - DNA, 25 bp, E. coli
gcaatccatcgtcgtcccacagtta

SEQ ID NO: 177208 - DNA, 25 bp, E. coli
gcaatccatcgtggtcccacagtta

SEQ ID NO: 177209 - DNA, 25 bp, E. coli
gacaaacgcgaggtgcgtaacgcca

SEQ ID NO: 177210 - DNA, 25 bp, E. coli
gacaaacgcgagctgcgtaacgcca

SEQ ID NO: 177211 - DNA, 25 bp, E. coli
gatcaaatccactttctggcgagcg

SEQ ID NO: 177212 - DNA, 25 bp, E. coli
gatcaaatccacattctggcgagcg

SEQ ID NO: 177213 - DNA, 25 bp, E. coli
ggcaaactggtcacggaaatcacct

SEQ ID NO: 177214 - DNA, 25 bp, E. coli
ggcaaactggtctcggaaatcacct

SEQ ID NO: 177215 - DNA, 25 bp, E. coli
gatcagaaaatctcccttgccgggc

SEQ ID NO: 177216 - DNA, 25 bp, E. coli
gatcagaaaatcacccttgccgggc

SEQ ID NO: 177217 - DNA, 25 bp, E. coli
aatggcatcccgtgactttattcag

SEQ ID NO: 177218 - DNA, 25 bp, E. coli
aatggcatcccgagactttattcag

SEQ ID NO: 177219 - DNA, 25 bp, E. coli
aatcacgtatgtggagatcaccggg

SEQ ID NO: 177220 - DNA, 25 bp, E. coli
aatcacgtatgtcgagatcaccggg

SEQ ID NO: 177221 - DNA, 25 bp, E. coli
tacccaaccaatagagcgaggcggc

SEQ ID NO: 177222 - DNA, 25 bp, E. coli
tacccaaccaattgagcgaggcggc

SEQ ID NO: 177223 - DNA, 25 bp, E. coli
tactgacactgtcaaagaaaccagt

SEQ ID NO: 177224 - DNA, 25 bp, E. coli
tactgacactgtgaaagaaaccagt

SEQ ID NO: 177225 - DNA, 25 bp, E. coli
tattgagcaggcaggatctctgcga

SEQ ID NO: 177226 - DNA, 25 bp, E. coli
tattgagcaggctggatctctgcga

SEQ ID NO: 177227 - DNA, 25 bp, E. coli
tgtgctgaatctgaaagcggaatcc

SEQ ID NO: 177228 - DNA, 25 bp, E. coli
tgtgctgaatctcaaagcggaatcc

SEQ ID NO: 177229 - DNA, 25 bp, E. coli
ccagtgagcgtgctgtaaaacttac

SEQ ID NO: 177230 - DNA, 25 bp, E. coli
ccagtgagcgtggtgtaaaacttac

SEQ ID NO: 177231 - DNA, 25 bp, E. coli
ccgcgactggatcaagtgacgatca

SEQ ID NO: 177232 - DNA, 25 bp, E. coli
cgaaaacacggtagttactgacact

SEQ ID NO: 177233 - DNA, 25 bp, E. coli
cgaaaacacggttgttactgacact

SEQ ID NO: 177234 - DNA, 25 bp, E. coli
ccgcgactggatgaagtgacgatca

SEQ ID NO: 177235 - DNA, 25 bp, E. coli
gatttgtcgctgtctgatgtgctga

SEQ ID NO: 177236 - DNA, 25 bp, E. coli
gatttgtcgctgactgatgtgctga

SEQ ID NO: 177237 - DNA, 25 bp, E. coli
ggaatccatgtttacgctgctgtca

SEQ ID NO: 177238 - DNA, 25 bp, E. coli
ggaatccatgttaacgctgctgtca

SEQ ID NO: 177239 - DNA, 25 bp, E. coli
atgaaacgattctagcggcgctcga

SEQ ID NO: 177240 - DNA, 25 bp, E. coli
atgaaacgattcaagcggcgctcga

SEQ ID NO: 177241 - DNA, 25 bp, E. coli
ttctagcggcgctcgagagtcgcaa

SEQ ID NO: 177242 - DNA, 25 bp, E. coli
ttctagcggcgcacgagagtcgcaa

SEQ ID NO: 177243 - DNA, 25 bp, E. coli
tgggatgaaacgattctagcggcgc

SEQ ID NO: 177244 - DNA, 25 bp, E. coli
tgggatgaaacgtttctagcggcgc

SEQ ID NO: 177245 - DNA, 25 bp, E. coli
tgaaacgattcttgcggcgctcgag

SEQ ID NO: 177246 - DNA, 25 bp, E. coli
tgaaacgattctagcggcgctcgag

SEQ ID NO: 177247 - DNA, 25 bp, E. coli
tcgagagtcgcaaaggtgagcaccc

SEQ ID NO: 177248 - DNA, 25 bp, E. coli
tcgagagtcgcataggtgagcaccc

SEQ ID NO: 177249 - DNA, 25 bp, E. coli
gaaacgattctaccggcgctcgaga

SEQ ID NO: 177250 - DNA, 25 bp, E. coli
gaaacgattctagcggcgctcgaga

SEQ ID NO: 177251 - DNA, 25 bp, E. coli
cgagagtcgcaaaggtgagcaccca

SEQ ID NO: 177252 - DNA, 25 bp, E. coli
cgagagtcgcaatggtgagcaccca

SEQ ID NO: 177253 - DNA, 25 bp, E. coli
ctcgagagtcgcaaaggtgagcacc

SEQ ID NO: 177254 - DNA, 25 bp, E. coli
ctagcggcgctcgagagtcgcaaag

SEQ ID NO: 177255 - DNA, 25 bp, E. coli
ctcgagagtcgctaaggtgagcacc

SEQ ID NO: 177256 - DNA, 25 bp, E. coli
ctagcggcgctccagagtcgcaaag

SEQ ID NO: 177257 - DNA, 25 bp, E. coli
ggatgaaacgattctagcggcgctc

SEQ ID NO: 177258 - DNA, 25 bp, E. coli
ggatgaaacgatactagcggcgctc

SEQ ID NO: 177259 - DNA, 25 bp, E. coli
gatgaaacgattgtagcggcgctcg

SEQ ID NO: 177260 - DNA, 25 bp, E. coli
gatgaaacgattctagcggcgctcg

SEQ ID NO: 177261 - DNA, 25 bp, E. coli
tacagaaaacggcaggtgtcgcgct

SEQ ID NO: 177262 - DNA, 25 bp, E. coli
taacgtcatcggagttgaacgctgg

SEQ ID NO: 177263 - DNA, 25 bp, E. coli
tacagaaaacgggaggtgtcgcgct

SEQ ID NO: 177264 - DNA, 25 bp, E. coli
tataaatccattcactggccgagca

SEQ ID NO: 177265 - DNA, 25 bp, E. coli
tataaatccattgactggccgagca

SEQ ID NO: 177266 - DNA, 25 bp, E. coli
tattcccgtggtcttaagcgttgcc

SEQ ID NO: 177267 - DNA, 25 bp, E. coli
tattcccgtggtgttaagcgttgcc

SEQ ID NO: 177268 - DNA, 25 bp, E. coli
ttttgttgatgctgaccgtcgcggg

SEQ ID NO: 177269 - DNA, 25 bp, E. coli
ttttgttgatgcagaccgtcgcggg

SEQ ID NO: 177270 - DNA, 25 bp, E. coli
ttcgccccggatggccaatgattgg

SEQ ID NO: 177271 - DNA, 25 bp, E. coli
ttcgccccggatcgccaatgattgg

SEQ ID NO: 177272 - DNA, 25 bp, E. coli
gaaactgatcggtatgctggccaaa

SEQ ID NO: 177273 - DNA, 25 bp, E. coli
gacttcgtagcgctgaacttaccgg

SEQ ID NO: 177274 - DNA, 25 bp, E. coli
gaaattcctaatgctgttgccgcta

SEQ ID NO: 177275 - DNA, 25 bp, E. coli
gaaactgatcggaatgctggccaaa

SEQ ID NO: 177276 - DNA, 25 bp, E. coli
gaaattcctaatcctgttgccgcta

SEQ ID NO: 177277 - DNA, 25 bp, E. coli
gacttcgtagcggtgaacttaccgg

SEQ ID NO: 177278 - DNA, 25 bp, E. coli
gtgaatatcgactgaccgggcgtgc

SEQ ID NO: 177279 - DNA, 25 bp, E. coli
ggtttctgaattacgcgcgcgtgac

SEQ ID NO: 177280 - DNA, 25 bp, E. coli
gtgaatatcgacagaccgggcgtgc

SEQ ID NO: 177281 - DNA, 25 bp, E. coli
ggtttctgaatttcgcgcgcgtgac

SEQ ID NO: 177282 - DNA, 25 bp, E. coli
taacgtcatcggtgttgaacgctgg

SEQ ID NO: 177283 - DNA, 25 bp, E. coli
cactgcgtggctgcattgatgaccg

SEQ ID NO: 177284 - DNA, 25 bp, E. coli
caccttagatggtaaatatctgccg

SEQ ID NO: 177285 - DNA, 25 bp, E. coli
cactgcgtggctccattgatgaccg

SEQ ID NO: 177286 - DNA, 25 bp, E. coli
caccttagatggaaaatatctgccg

SEQ ID NO: 177287 - DNA, 25 bp, E. coli
atatctgccgaccaaaccgttctga

SEQ ID NO: 177288 - DNA, 25 bp, E. coli
atatctgccgacgaaaccgttctga

SEQ ID NO: 177289 - DNA, 25 bp, E. coli
tattcgtcttgaacttgccgatgcc

SEQ ID NO: 177290 - DNA, 25 bp, E. coli
tttgctgggtcagcaggcgcttcct

SEQ ID NO: 177291 - DNA, 25 bp, E. coli
tattcgtcttgatcttgccgatgcc

SEQ ID NO: 177292 - DNA, 25 bp, E. coli
tttgctgggtcaccaggcgcttcct

SEQ ID NO: 177293 - DNA, 25 bp, E. coli
tctatgaaatgttgcaggtgtacgg

SEQ ID NO: 177294 - DNA, 25 bp, E. coli
tctatgaaatgtagcaggtgtacgg

SEQ ID NO: 177295 - DNA, 25 bp, E. coli
tctcatttgccgtgattgccgacgg

SEQ ID NO: 177296 - DNA, 25 bp, E. coli
tctcatttgccgagattgccgacgg

SEQ ID NO: 177297 - DNA, 25 bp, E. coli
gccgatgccattatgctcagcaaag

SEQ ID NO: 177298 - DNA, 25 bp, E. coli
gccgatgccattttgctcagcaaag

SEQ ID NO: 177299 - DNA, 25 bp, E. coli
gcgaacgtgcggtcatcaccttaga

SEQ ID NO: 177300 - DNA, 25 bp, E. coli
gcgaacgtgcggacatcaccttaga

SEQ ID NO: 177301 - DNA, 25 bp, E. coli
ccctgaaagcgtaggttcatgagaa

SEQ ID NO: 177302 - DNA, 25 bp, E. coli
ccctgaaagcgttggttcatgagaa

SEQ ID NO: 177303 - DNA, 25 bp, E. coli
tcaaactcgacgataagaaagtggc

SEQ ID NO: 177304 - DNA, 25 bp, E. coli
tcaaactcgacgttaagaaagtggc

SEQ ID NO: 177305 - DNA, 25 bp, E. coli
catcgcggatgtggaaagccagtac

SEQ ID NO: 177306 - DNA, 25 bp, E. coli
catcgcggatgtcgaaagccagtac

SEQ ID NO: 177307 - DNA, 25 bp, E. coli
tacatttcagatgaggcgttggcga

SEQ ID NO: 177308 - DNA, 25 bp, E. coli
tacatttcagatcaggcgttggcga

SEQ ID NO: 177309 - DNA, 25 bp, E. coli
ttaccgcaatgggagaaggacgtca

SEQ ID NO: 177310 - DNA, 25 bp, E. coli
ttaccgcaatggcagaaggacgtca

SEQ ID NO: 177311 - DNA, 25 bp, E. coli
tttacccaatgatgatgcgccgggc

SEQ ID NO: 177312 - DNA, 25 bp, E. coli
tttacccaatgaagatgcgccgggc

SEQ ID NO: 177313 - DNA, 25 bp, E. coli
tgtaaatcctgcgtggtggcctgtc

SEQ ID NO: 177314 - DNA, 25 bp, E. coli
tgtaaatcctgcctggtggcctgtc

SEQ ID NO: 177315 - DNA, 25 bp, E. coli
tgatgaagctaacatgccaggctcg

SEQ ID NO: 177316 - DNA, 25 bp, E. coli
tgatgaagctaagatgccaggctcg

SEQ ID NO: 177317 - DNA, 25 bp, E. coli
tcgaatttaacgaccagccggtggc

SEQ ID NO: 177318 - DNA, 25 bp, E. coli
tcgaatttaacgtccagccggtggc

SEQ ID NO: 177319 - DNA, 25 bp, E. coli
tcttcgttggcgtaggcacttaccg

SEQ ID NO: 177320 - DNA, 25 bp, E. coli
tcttcgttggcgaaggcacttaccg

SEQ ID NO: 177321 - DNA, 25 bp, E. coli
gaactggtgaaacccggaaacatcg

SEQ ID NO: 177322 - DNA, 25 bp, E. coli
gaactggtgaaagccggaaacatcg

SEQ ID NO: 177323 - DNA, 25 bp, E. coli
cttttggaacaatacgacgcggtct

SEQ ID NO: 177324 - DNA, 25 bp, E. coli
cttttggaacaaaacgacgcggtct

SEQ ID NO: 177325 - DNA, 25 bp, E. coli
gattgaagcgcggaaaaccggtttt

SEQ ID NO: 177326 - DNA, 25 bp, E. coli
gattgaagcgcgcaaaaccggtttt

SEQ ID NO: 177327 - DNA, 25 bp, E. coli
tacgcaggtctggagtattgccgat

SEQ ID NO: 177328 - DNA, 25 bp, E. coli
tacaacgcagtctgcggtgagagta

SEQ ID NO: 177329 - DNA, 25 bp, E. coli
tacaacgcagtcagcggtgagagta

SEQ ID NO: 177330 - DNA, 25 bp, E. coli
aaacctttgcgcactcattgacggg

SEQ ID NO: 177331 - DNA, 25 bp, E. coli
aaacctttgcgctctcattgacggg

SEQ ID NO: 177332 - DNA, 25 bp, E. coli
tacctcggcacaacgcaaatcgctt

SEQ ID NO: 177333 - DNA, 25 bp, E. coli
tacctcggcacatcgcaaatcgctt

SEQ ID NO: 177334 - DNA, 25 bp, E. coli
tacgcaggtctgcagtattgccgat

SEQ ID NO: 177335 - DNA, 25 bp, E. coli
tctgaacatgaagatggcgtggatc

SEQ ID NO: 177336 - DNA, 25 bp, E. coli
tctacaacgactcagcatgggcgtg

SEQ ID NO: 177337 - DNA, 25 bp, E. coli
tctacaacgactgagcatgggcgtg

SEQ ID NO: 177338 - DNA, 25 bp, E. coli
tctgaacatgaacatggcgtggatc

SEQ ID NO: 177339 - DNA, 25 bp, E. coli
cttatgcttcgtcgctatgggtcgg

SEQ ID NO: 177340 - DNA, 25 bp, E. coli
cttatgcttcgtggctatgggtcgg

SEQ ID NO: 177341 - DNA, 25 bp, E. coli
gattactgccaaagtcgatactcgc

SEQ ID NO: 177342 - DNA, 25 bp, E. coli
gataagtaccagaatcaggcagagc

SEQ ID NO: 177343 - DNA, 25 bp, E. coli
gattactgccaatgtcgatactcgc

SEQ ID NO: 177344 - DNA, 25 bp, E. coli
gataagtaccagtatcaggcagagc

SEQ ID NO: 177345 - DNA, 25 bp, E. coli
ggcggcgcaatcgatgtcacagata

SEQ ID NO: 177346 - DNA, 25 bp, E. coli
tggcaaatgacattcaatacctcgg

SEQ ID NO: 177347 - DNA, 25 bp, E. coli
tggcaaatgacaatcaatacctcgg

SEQ ID NO: 177348 - DNA, 25 bp, E. coli
ggcggcgcaatccatgtcacagata

SEQ ID NO: 177349 - DNA, 25 bp, E. coli
caacgctgttagcacagtgggcaga

SEQ ID NO: 177350 - DNA, 25 bp, E. coli
caacgctgttaggacagtgggcaga

SEQ ID NO: 177351 - DNA, 25 bp, E. coli
cacatgcagccggacagttgggcaa

SEQ ID NO: 177352 - DNA, 25 bp, E. coli
cacatgcagccgcacagttgggcaa

SEQ ID NO: 177353 - DNA, 25 bp, E. coli
aacggacgttactgaccaccgcgct

SEQ ID NO: 177354 - DNA, 25 bp, E. coli
aacggacgttacagaccaccgcgct

SEQ ID NO: 177355 - DNA, 25 bp, E. coli
tgtttgaatcaatcgtaccggaaag

SEQ ID NO: 177356 - DNA, 25 bp, E. coli
tgtttgaatcaaacgtaccggaaag

SEQ ID NO: 177357 - DNA, 25 bp, E. coli
gctgttagcacagtgggcagacaga

SEQ ID NO: 177358 - DNA, 25 bp, E. coli
gctgttagcacactgggcagacaga

SEQ ID NO: 177359 - DNA, 25 bp, E. coli
gaatcaaacgtagcggaaagcactt

SEQ ID NO: 177360 - DNA, 25 bp, E. coli
gaatcaaacgtaccggaaagcactt

SEQ ID NO: 177361 - DNA, 25 bp, E. coli
gacagttgggcatcgctgttagcac

SEQ ID NO: 177362 - DNA, 25 bp, E. coli
gaaagcacttcacacatgcagccgg

SEQ ID NO: 177363 - DNA, 25 bp, E. coli
gacagttgggcaacgctgttagcac

SEQ ID NO: 177364 - DNA, 25 bp, E. coli
gaaagcacttcagacatgcagccgg

SEQ ID NO: 177365 - DNA, 25 bp, E. coli
cttgaacagcggctgctggaaggca

SEQ ID NO: 177366 - DNA, 25 bp, E. coli
ctatcaggaaattaaggtgacgttt

SEQ ID NO: 177367 - DNA, 25 bp, E. coli
cttgaacagcgggtgctggaaggca

SEQ ID NO: 177368 - DNA, 25 bp, E. coli
ctatcaggaaataaaggtgacgttt

SEQ ID NO: 177369 - DNA, 25 bp, E. coli
ggtgacgtttatgcaacgagggata

SEQ ID NO: 177370 - DNA, 25 bp, E. coli
ggtgacgtttatccaacgagggata

SEQ ID NO: 177371 - DNA, 25 bp, E. coli
ttcacttcgcctgaagggtaaaccg

SEQ ID NO: 177372 - DNA, 25 bp, E. coli
ttcacttcgcctcaagggtaaaccg

SEQ ID NO: 177373 - DNA, 25 bp, E. coli
tgaagggtaaaccggtgtcctatgt

SEQ ID NO: 177374 - DNA, 25 bp, E. coli
tgaagggtaaacgggtgtcctatgt

SEQ ID NO: 177375 - DNA, 25 bp, E. coli
gaagggtaaaccggtgtcctatgtg

SEQ ID NO: 177376 - DNA, 25 bp, E. coli
gaagggtaaacccgtgtcctatgtg

SEQ ID NO: 177377 - DNA, 25 bp, E. coli
ctgaagggtaaaccggtgtcctatg

SEQ ID NO: 177378 - DNA, 25 bp, E. coli
ctgaagggtaaagcggtgtcctatg

SEQ ID NO: 177379 - DNA, 25 bp, E. coli
ggtggctgcaacgttttcacttcgc

SEQ ID NO: 177380 - DNA, 25 bp, E. coli
gtggctgcaacgttttcacttcgcc

SEQ ID NO: 177381 - DNA, 25 bp, E. coli
gtggctgcaacgatttcacttcgcc

SEQ ID NO: 177382 - DNA, 25 bp, E. coli
ggtggctgcaaccttttcacttcgc

SEQ ID NO: 177383 - DNA, 25 bp, E. coli
tggctgcaacgttttcacttcgcct

SEQ ID NO: 177384 - DNA, 25 bp, E. coli
tggctgcaacgtattcacttcgcct

SEQ ID NO: 177385 - DNA, 25 bp, E. coli
tcacttcgcctgtagggtaaaccgg

SEQ ID NO: 177386 - DNA, 25 bp, E. coli
tcacttcgcctgaagggtaaaccgg

SEQ ID NO: 177387 - DNA, 25 bp, E. coli
cagtgctccgcataacagatgtttc

SEQ ID NO: 177388 - DNA, 25 bp, E. coli
cagtgctccgcaaaacagatgtttc

SEQ ID NO: 177389 - DNA, 25 bp, E. coli
taaatctcactcttccgtaatagcg

SEQ ID NO: 177390 - DNA, 25 bp, E. coli
taaatctcactcatccgtaatagcg

SEQ ID NO: 177391 - DNA, 25 bp, E. coli
aaccgtgttaatgtaccggatgaca

SEQ ID NO: 177392 - DNA, 25 bp, E. coli
aaccgtgttaatctaccggatgaca

SEQ ID NO: 177393 - DNA, 25 bp, E. coli
tggtggttatgcagccagtgctccg

SEQ ID NO: 177394 - DNA, 25 bp, E. coli
tggtggttatgctgccagtgctccg

SEQ ID NO: 177395 - DNA, 25 bp, E. coli
tgtaaagcatcaaagtgtctcagga

SEQ ID NO: 177396 - DNA, 25 bp, E. coli
tgtaaagcatcatagtgtctcagga

SEQ ID NO: 177397 - DNA, 25 bp, E. coli
tgaaaggctatcgtcgctaagggaa

SEQ ID NO: 177398 - DNA, 25 bp, E. coli
tgaaaggctatcctcgctaagggaa

SEQ ID NO: 177399 - DNA, 25 bp, E. coli
tctggaaaacgatcatcatgagtcc

SEQ ID NO: 177400 - DNA, 25 bp, E. coli
tctggaaaacgaacatcatgagtcc

SEQ ID NO: 177401 - DNA, 25 bp, E. coli
gaaagcatcaatggaagccgaggta

SEQ ID NO: 177402 - DNA, 25 bp, E. coli
gaaagcatcaatcgaagccgaggta

SEQ ID NO: 177403 - DNA, 25 bp, E. coli
cgggcaggctctactcttgtcaaca

SEQ ID NO: 177404 - DNA, 25 bp, E. coli
cgggcaggctcttctcttgtcaaca

SEQ ID NO: 177405 - DNA, 25 bp, E. coli
gttattactttgttgccgggcaggc

SEQ ID NO: 177406 - DNA, 25 bp, E. coli
gttattactttgatgccgggcaggc

SEQ ID NO: 177407 - DNA, 25 bp, E. coli
gatgagcagcgtactaccaggaaaa

SEQ ID NO: 177408 - DNA, 25 bp, E. coli
gatgagcagcgttctaccaggaaaa

SEQ ID NO: 177409 - DNA, 25 bp, E. coli
caacctgaacgatctgctggcgaag

SEQ ID NO: 177410 - DNA, 25 bp, E. coli
caacctgaacgaactgctggcgaag

SEQ ID NO: 177411 - DNA, 25 bp, E. coli
aactggtgccgattcgccagctcgc

SEQ ID NO: 177412 - DNA, 25 bp, E. coli
aactggtgccgaatcgccagctcgc

SEQ ID NO: 177413 - DNA, 25 bp, E. coli
ttactggagcgtcttgatcgtcaac

SEQ ID NO: 177414 - DNA, 25 bp, E. coli
ttactggagcgtgttgatcgtcaac

SEQ ID NO: 177415 - DNA, 25 bp, E. coli
ttcaacggaatcacagcaaaacctg

SEQ ID NO: 177416 - DNA, 25 bp, E. coli
ttcaacggaatctcagcaaaacctg

SEQ ID NO: 177417 - DNA, 25 bp, E. coli
ttcaccagcatgatcagcctcagca

SEQ ID NO: 177418 - DNA, 25 bp, E. coli
ttcaccagcatgttcagcctcagca

SEQ ID NO: 177419 - DNA, 25 bp, E. coli
tgaacgctaagaaaattgcctcgct

SEQ ID NO: 177420 - DNA, 25 bp, E. coli
tgaacgctaagataattgcctcgct

SEQ ID NO: 177421 - DNA, 25 bp, E. coli
gaatttcggcattatttcaacggaa

SEQ ID NO: 177422 - DNA, 25 bp, E. coli
gaatttcggcataatttcaacggaa

SEQ ID NO: 177423 - DNA, 25 bp, E. coli
gaaaacctcgacaagctgaaaacct

SEQ ID NO: 177424 - DNA, 25 bp, E. coli
gacaagatctaccacttctttatga

SEQ ID NO: 177425 - DNA, 25 bp, E. coli
gacaagatctacgacttctttatga

SEQ ID NO: 177426 - DNA, 25 bp, E. coli
gaaaacctcgactagctgaaaacct

SEQ ID NO: 177427 - DNA, 25 bp, E. coli
ctggcgaagcggaaagatctcacct

SEQ ID NO: 177428 - DNA, 25 bp, E. coli
ctggcgaagcggtaagatctcacct

SEQ ID NO: 177429 - DNA, 25 bp, E. coli
taattgcctcgcaggccttcaccag

SEQ ID NO: 177430 - DNA, 25 bp, E. coli
taattgcctcgctggccttcaccag

SEQ ID NO: 177431 - DNA, 25 bp, E. coli
cacgaaatgccgcacaatttacggg

SEQ ID NO: 177432 - DNA, 25 bp, E. coli
cacgaaatgccggacaatttacggg

SEQ ID NO: 177433 - DNA, 25 bp, E. coli
tacggggtttattggttgatcaagg

SEQ ID NO: 177434 - DNA, 25 bp, E. coli
agcaaagcgcattattcaataaaca

SEQ ID NO: 177435 - DNA, 25 bp, E. coli
agcaaagcgcataattcaataaaca

SEQ ID NO: 177436 - DNA, 25 bp, E. coli
aaaagttaaaaggaaagcgcattat

SEQ ID NO: 177437 - DNA, 25 bp, E. coli
aaatgtcggcattcctcacgaaatg

SEQ ID NO: 177438 - DNA, 25 bp, E. coli
aataaacatagcacaaaataacggg

SEQ ID NO: 177439 - DNA, 25 bp, E. coli
aataaacatagctcaaaataacggg

SEQ ID NO: 177440 - DNA, 25 bp, E. coli
aaaagttaaaagcaaagcgcattat

SEQ ID NO: 177441 - DNA, 25 bp, E. coli
aaatgtcggcatacctcacgaaatg

SEQ ID NO: 177442 - DNA, 25 bp, E. coli
tacggggtttataggttgatcaagg

SEQ ID NO: 177443 - DNA, 25 bp, E. coli
tggtcggcgagcataaatgtcggca

SEQ ID NO: 177444 - DNA, 25 bp, E. coli
tggtcggcgagcttaaatgtcggca

SEQ ID NO: 177445 - DNA, 25 bp, E. coli
tcctcacgaaatgccggacaattta

SEQ ID NO: 177446 - DNA, 25 bp, E. coli
tcctcacgaaatcccggacaattta

SEQ ID NO: 177447 - DNA, 25 bp, E. coli
tcggcgagcatatatgtcggcattc

SEQ ID NO: 177448 - DNA, 25 bp, E. coli
tcggcgagcataaatgtcggcattc

SEQ ID NO: 177449 - DNA, 25 bp, E. coli
gcattcctcacgtaatgccggacaa

SEQ ID NO: 177450 - DNA, 25 bp, E. coli
gcattcctcacgaaatgccggacaa

SEQ ID NO: 177451 - DNA, 25 bp, E. coli
gagcataaatgtcggcattcctcac

SEQ ID NO: 177452 - DNA, 25 bp, E. coli
gagcataaatgtgggcattcctcac

SEQ ID NO: 177453 - DNA, 25 bp, E. coli
cacgcctcttaccagtgcttcgaag

SEQ ID NO: 177454 - DNA, 25 bp, E. coli
cacgcctcttacgagtgcttcgaag

SEQ ID NO: 177455 - DNA, 25 bp, E. coli
tatcgtttgcacacttcacgttcaa

SEQ ID NO: 177456 - DNA, 25 bp, E. coli
tatcgtttgcactcttcacgttcaa

SEQ ID NO: 177457 - DNA, 25 bp, E. coli
tatcgctcatcgtcgctgcgtggcg

SEQ ID NO: 177458 - DNA, 25 bp, E. coli
tatcgctcatcgacgctgcgtggcg

SEQ ID NO: 177459 - DNA, 25 bp, E. coli
tgcgtggcgcacttattactttctg

SEQ ID NO: 177460 - DNA, 25 bp, E. coli
tgcgtggcgcacatattactttctg

SEQ ID NO: 177461 - DNA, 25 bp, E. coli
tgaacgggagtaaagcgaaaagact

SEQ ID NO: 177462 - DNA, 25 bp, E. coli
tgaacgggagtatagcgaaaagact

SEQ ID NO: 177463 - DNA, 25 bp, E. coli
tctcaccgataaagatgagacgcgg

SEQ ID NO: 177464 - DNA, 25 bp, E. coli
tctcaccgataatgatgagacgcgg

SEQ ID NO: 177465 - DNA, 25 bp, E. coli
gcttcgaagaacatgtttatcgctc

SEQ ID NO: 177466 - DNA, 25 bp, E. coli
gcttcgaagaacttgtttatcgctc

SEQ ID NO: 177467 - DNA, 25 bp, E. coli
gaaattttgaggctgcgtctcaccg

SEQ ID NO: 177468 - DNA, 25 bp, E. coli
gaaattttgagggtgcgtctcaccg

SEQ ID NO: 177469 - DNA, 25 bp, E. coli
ggtctgacagatagtagtaatgcaa

SEQ ID NO: 177470 - DNA, 25 bp, E. coli
ggtctgacagattgtagtaatgcaa

SEQ ID NO: 177471 - DNA, 25 bp, E. coli
tcaacagaagaaaggaggtctgaca

SEQ ID NO: 177472 - DNA, 25 bp, E. coli
tcaacagaagaatggaggtctgaca

SEQ ID NO: 177473 - DNA, 25 bp, E. coli
gagacttaagttgaatgaacgggag

SEQ ID NO: 177474 - DNA, 25 bp, E. coli
gagacttaagttcaatgaacgggag

SEQ ID NO: 177475 - DNA, 25 bp, E. coli
aagaagccctggagcagatcggtca

SEQ ID NO: 177476 - DNA, 25 bp, E. coli
aagaagccctggtgcagatcggtca

SEQ ID NO: 177477 - DNA, 25 bp, E. coli
aatgccggcagaccagcggcttgct

SEQ ID NO: 177478 - DNA, 25 bp, E. coli
aatgccggcagagcagcggcttgct

SEQ ID NO: 177479 - DNA, 25 bp, E. coli
catcgctgaaaaagccctgcgggcg

SEQ ID NO: 177480 - DNA, 25 bp, E. coli
catcgctgaaaatgccctgcgggcg

SEQ ID NO: 177481 - DNA, 25 bp, E. coli
aaaacttcctgttcttcggctctga

SEQ ID NO: 177482 - DNA, 25 bp, E. coli
aaaacttcctgtacttcggctctga

SEQ ID NO: 177483 - DNA, 25 bp, E. coli
tcggtcagttgttcgccatagaggc

SEQ ID NO: 177484 - DNA, 25 bp, E. coli
tcggtcagttgtacgccatagaggc

SEQ ID NO: 177485 - DNA, 25 bp, E. coli
tcagtctgggtcgtaaaaacttcct

SEQ ID NO: 177486 - DNA, 25 bp, E. coli
tcagtctgggtcctaaaaacttcct

SEQ ID NO: 177487 - DNA, 25 bp, E. coli
gcggcttgctgatcgtcagcgaaaa

SEQ ID NO: 177488 - DNA, 25 bp, E. coli
gcggcttgctgaacgtcagcgaaaa

SEQ ID NO: 177489 - DNA, 25 bp, E. coli
cgtcagcactgacggaagaagccct

SEQ ID NO: 177490 - DNA, 25 bp, E. coli
cgtcagcactgagggaagaagccct

SEQ ID NO: 177491 - DNA, 25 bp, E. coli
cgtactatgcgaacgatggctgggt

SEQ ID NO: 177492 - DNA, 25 bp, E. coli
cgtactatgcgatcgatggctgggt

SEQ ID NO: 177493 - DNA, 25 bp, E. coli
gttcgcgtacgctcttaaccagtgg

SEQ ID NO: 177494 - DNA, 25 bp, E. coli
gttcgcgtacgcacttaaccagtgg

SEQ ID NO: 177495 - DNA, 25 bp, E. coli
ggccggcactgacgtactatgcgaa

SEQ ID NO: 177496 - DNA, 25 bp, E. coli
ggccggcactgaggtactatgcgaa

SEQ ID NO: 177497 - DNA, 25 bp, E. coli
caaaatggcaaagaagccaggccga

SEQ ID NO: 177498 - DNA, 25 bp, E. coli
cacgcagtacgtgaggatgacgagc

SEQ ID NO: 177499 - DNA, 25 bp, E. coli
caaaatggcaaacaagccaggccga

SEQ ID NO: 177500 - DNA, 25 bp, E. coli
cacgcagtacgtcaggatgacgagc

SEQ ID NO: 177501 - DNA, 25 bp, E. coli
agtcaccggagcgtacacgcagtac

SEQ ID NO: 177502 - DNA, 25 bp, E. coli
agtcaccggagcctacacgcagtac

SEQ ID NO: 177503 - DNA, 25 bp, E. coli
ttgctaactctggtgtaaaaggccg

SEQ ID NO: 177504 - DNA, 25 bp, E. coli
ttttactcatttatgcgggaattgc

SEQ ID NO: 177505 - DNA, 25 bp, E. coli
ttgctaactctgctgtaaaaggccg

SEQ ID NO: 177506 - DNA, 25 bp, E. coli
ttttactcatttttgcgggaattgc

SEQ ID NO: 177507 - DNA, 25 bp, E. coli
tgaggatgacgagcacatcccggtg

SEQ ID NO: 177508 - DNA, 25 bp, E. coli
tgaggatgacgaccacatcccggtg

SEQ ID NO: 177509 - DNA, 25 bp, E. coli
tctgctgtaaaaggccgtcggcggt

SEQ ID NO: 177510 - DNA, 25 bp, E. coli
tctgctgtaaaacgccgtcggcggt

SEQ ID NO: 177511 - DNA, 25 bp, E. coli
gcacatcccggtcccaaaatggcaa

SEQ ID NO: 177512 - DNA, 25 bp, E. coli
gcacatcccggtgccaaaatggcaa

SEQ ID NO: 177513 - DNA, 25 bp, E. coli
ggagtccggtgtcatattaaaagcc

SEQ ID NO: 177514 - DNA, 25 bp, E. coli
ggagtccggtgtgatattaaaagcc

SEQ ID NO: 177515 - DNA, 25 bp, E. coli
cgggaattgcaatcaacagttgcta

SEQ ID NO: 177516 - DNA, 25 bp, E. coli
cgggaattgcaaacaacagttgcta

SEQ ID NO: 177517 - DNA, 25 bp, E. coli
ggtgtcatattataagcccgaaaat

SEQ ID NO: 177518 - DNA, 25 bp, E. coli
ggtgtcatattaaaagcccgaaaat

SEQ ID NO: 177519 - DNA, 25 bp, E. coli
caagcgtaccttggatattcaccga

SEQ ID NO: 177520 - DNA, 25 bp, E. coli
caagcgtaccttcgatattcaccga

SEQ ID NO: 177521 - DNA, 25 bp, E. coli
caaaatgggtcattcgagaatatcg

SEQ ID NO: 177522 - DNA, 25 bp, E. coli
caaaatgggtcaatcgagaatatcg

SEQ ID NO: 177523 - DNA, 25 bp, E. coli
taaagggcatttaacgacgaaactg

SEQ ID NO: 177524 - DNA, 25 bp, E. coli
taaagggcattttacgacgaaactg

SEQ ID NO: 177525 - DNA, 25 bp, E. coli
agcaattgcttaagctgccagcgga

SEQ ID NO: 177526 - DNA, 25 bp, E. coli
agcaattgcttatgctgccagcgga

SEQ ID NO: 177527 - DNA, 25 bp, E. coli
tgaagaaggattgtacaagcgtacc

SEQ ID NO: 177528 - DNA, 25 bp, E. coli
tgaagaaggattctacaagcgtacc

SEQ ID NO: 177529 - DNA, 25 bp, E. coli
gccagcggaatggtttcatcctaaa

SEQ ID NO: 177530 - DNA, 25 bp, E. coli
gccataccacagttgttccagataa

SEQ ID NO: 177531 - DNA, 25 bp, E. coli
gccataccacagatgttccagataa

SEQ ID NO: 177532 - DNA, 25 bp, E. coli
tcctaaaccaagtgtaaacagtgtc

SEQ ID NO: 177533 - DNA, 25 bp, E. coli
tcctaaaccaagagtaaacagtgtc

SEQ ID NO: 177534 - DNA, 25 bp, E. coli
gccagcggaatgctttcatcctaaa

SEQ ID NO: 177535 - DNA, 25 bp, E. coli
cgaacactagggatgctcttgcaca

SEQ ID NO: 177536 - DNA, 25 bp, E. coli
cgaaattggaacaggtaaagggcat

SEQ ID NO: 177537 - DNA, 25 bp, E. coli
cgaacactagggttgctcttgcaca

SEQ ID NO: 177538 - DNA, 25 bp, E. coli
cgaaattggaactggtaaagggcat

SEQ ID NO: 177539 - DNA, 25 bp, E. coli
gtttttgaaagccatgcgtctgaca

SEQ ID NO: 177540 - DNA, 25 bp, E. coli
gtttttgaaagcgatgcgtctgaca

SEQ ID NO: 177541 - DNA, 25 bp, E. coli
caaatgccgttgtcgtggtgctaat

SEQ ID NO: 177542 - DNA, 25 bp, E. coli
caaatgccgttgacgtggtgctaat

SEQ ID NO: 177543 - DNA, 25 bp, E. coli
catcgtgcggtgtagacgccgttaa

SEQ ID NO: 177544 - DNA, 25 bp, E. coli
catcgtgcggtgaagacgccgttaa

SEQ ID NO: 177545 - DNA, 25 bp, E. coli
tataaaagtcgtgggtgaggcatcg

SEQ ID NO: 177546 - DNA, 25 bp, E. coli
tataaaagtcgtcggtgaggcatcg

SEQ ID NO: 177547 - DNA, 25 bp, E. coli
tttaccagcgaaagtcatgcaggcc

SEQ ID NO: 177548 - DNA, 25 bp, E. coli
tttaccagcgaatgtcatgcaggcc

SEQ ID NO: 177549 - DNA, 25 bp, E. coli
tgatgaccacgaactggtgcgcgca

SEQ ID NO: 177550 - DNA, 25 bp, E. coli
tgagctgactcagctggcaattcgc

SEQ ID NO: 177551 - DNA, 25 bp, E. coli
tgagctgactcacctggcaattcgc

SEQ ID NO: 177552 - DNA, 25 bp, E. coli
tgatgaccacgatctggtgcgcgca

SEQ ID NO: 177553 - DNA, 25 bp, E. coli
gctcaatctcagtccgaaaacggtg

SEQ ID NO: 177554 - DNA, 25 bp, E. coli
gctcaatctcagaccgaaaacggtg

SEQ ID NO: 177555 - DNA, 25 bp, E. coli
gaaagcccatttcccagtttgtctg

SEQ ID NO: 177556 - DNA, 25 bp, E. coli
gaaagcccatttgccagtttgtctg

SEQ ID NO: 177557 - DNA, 25 bp, E. coli
ctaatggacatgagtatgccgggca

SEQ ID NO: 177558 - DNA, 25 bp, E. coli
ctaatggacatgtgtatgccgggca

SEQ ID NO: 177559 - DNA, 25 bp, E. coli
gtaaaatcgcgcgttccacagctga

SEQ ID NO: 177560 - DNA, 25 bp, E. coli
gggatacgacgcattctggaagata

SEQ ID NO: 177561 - DNA, 25 bp, E. coli
gggatacgacgctttctggaagata

SEQ ID NO: 177562 - DNA, 25 bp, E. coli
gtaaaatcgcgccttccacagctga

SEQ ID NO: 177563 - DNA, 25 bp, E. coli
tatgagccgggtctgcatttcaaga

SEQ ID NO: 177564 - DNA, 25 bp, E. coli
tatgagccgggtgtgcatttcaaga

SEQ ID NO: 177565 - DNA, 25 bp, E. coli
tattcagaccatggacaaccaggcc

SEQ ID NO: 177566 - DNA, 25 bp, E. coli
tattcagaccatcgacaaccaggcc

SEQ ID NO: 177567 - DNA, 25 bp, E. coli
tttgtcgtcaaagaaggtgagcgcg

SEQ ID NO: 177568 - DNA, 25 bp, E. coli
tttgtcgtcaaacaaggtgagcgcg

SEQ ID NO: 177569 - DNA, 25 bp, E. coli
tgtgaccaaagagaagaaagacctg

SEQ ID NO: 177570 - DNA, 25 bp, E. coli
tgtgaccaaagacaagaaagacctg

SEQ ID NO: 177571 - DNA, 25 bp, E. coli
tgaaacggtgaaaatgctcgacgca

SEQ ID NO: 177572 - DNA, 25 bp, E. coli
tgaaacggtgaatatgctcgacgca

SEQ ID NO: 177573 - DNA, 25 bp, E. coli
tctgaaattggtggcctggacgtga

SEQ ID NO: 177574 - DNA, 25 bp, E. coli
tcttacatcaaatggcgcatcagcg

SEQ ID NO: 177575 - DNA, 25 bp, E. coli
tcttacatcaaaaggcgcatcagcg

SEQ ID NO: 177576 - DNA, 25 bp, E. coli
tctgaaattggtcgcctggacgtga

SEQ ID NO: 177577 - DNA, 25 bp, E. coli
tctgaccctcgaagtacgtgacgcg

SEQ ID NO: 177578 - DNA, 25 bp, E. coli
tctgaccctcgatgtacgtgacgcg

SEQ ID NO: 177579 - DNA, 25 bp, E. coli
gaacagcttctcaggcaatcaggac

SEQ ID NO: 177580 - DNA, 25 bp, E. coli
gaagcgatctactaccgtatgcgcg

SEQ ID NO: 177581 - DNA, 25 bp, E. coli
gaacagcttctctggcaatcaggac

SEQ ID NO: 177582 - DNA, 25 bp, E. coli
gactatgaagtgtccagaacgctgg

SEQ ID NO: 177583 - DNA, 25 bp, E. coli
gaagcgatctacaaccgtatgcgcg

SEQ ID NO: 177584 - DNA, 25 bp, E. coli
gactatgaagtgaccagaacgctgg

SEQ ID NO: 177585 - DNA, 25 bp, E. coli
tacaggaactgtggcgtattgcgga

SEQ ID NO: 177586 - DNA, 25 bp, E. coli
tacaggaactgtcgcgtattgcgga

SEQ ID NO: 177587 - DNA, 25 bp, E. coli
aggatgtgatccacaaccgtcgcga

SEQ ID NO: 177588 - DNA, 25 bp, E. coli
aggatgtgatcctcaaccgtcgcga

SEQ ID NO: 177589 - DNA, 25 bp, E. coli
tatctcgagccgttcattgaagcca

SEQ ID NO: 177590 - DNA, 25 bp, E. coli
tatctcgagccgatcattgaagcca

SEQ ID NO: 177591 - DNA, 25 bp, E. coli
tgcgtattcagcacggacgaaagaa

SEQ ID NO: 177592 - DNA, 25 bp, E. coli
tcgccacagtgaagggtgatgtcca

SEQ ID NO: 177593 - DNA, 25 bp, E. coli
tgcgtattcagctcggacgaaagaa

SEQ ID NO: 177594 - DNA, 25 bp, E. coli
tcgccacagtgatgggtgatgtcca

SEQ ID NO: 177595 - DNA, 25 bp, E. coli
tcatccagacaggaagtattacgcg

SEQ ID NO: 177596 - DNA, 25 bp, E. coli
tcatccagacagcaagtattacgcg

SEQ ID NO: 177597 - DNA, 25 bp, E. coli
gaaaaaatgctgaacccgcgtggtg

SEQ ID NO: 177598 - DNA, 25 bp, E. coli
gaaaaaatgctgtacccgcgtggtg

SEQ ID NO: 177599 - DNA, 25 bp, E. coli
ccgaagtcgagccttggttggcacc

SEQ ID NO: 177600 - DNA, 25 bp, E. coli
ccgaagtcgagcgttggttggcacc

SEQ ID NO: 177601 - DNA, 25 bp, E. coli
cggcaaagcggattacatcggcgca

SEQ ID NO: 177602 - DNA, 25 bp, E. coli
cgtgaatgggcagaagcaggctttc

SEQ ID NO: 177603 - DNA, 25 bp, E. coli
cggcaaagcggaatacatcggcgca

SEQ ID NO: 177604 - DNA, 25 bp, E. coli
cgtgaatgggcacaagcaggctttc

SEQ ID NO: 177605 - DNA, 25 bp, E. coli
ggtatgaaactctcggaatccttcg

SEQ ID NO: 177606 - DNA, 25 bp, E. coli
ggtatgaaactcacggaatccttcg

SEQ ID NO: 177607 - DNA, 25 bp, E. coli
tacggcatcgttgaggataaactcg

SEQ ID NO: 177608 - DNA, 25 bp, E. coli
tacggcatcgttcaggataaactcg

SEQ ID NO: 177609 - DNA, 25 bp, E. coli
acatctagggttgacagggacggaa

SEQ ID NO: 177610 - DNA, 25 bp, E. coli
acatctagggttcacagggacggaa

SEQ ID NO: 177611 - DNA, 25 bp, E. coli
tatccgtcttcaaatacagcgtggc

SEQ ID NO: 177612 - DNA, 25 bp, E. coli
tttgataagcgcctgtcgtcgacga

SEQ ID NO: 177613 - DNA, 25 bp, E. coli
tttcgaatatggaacagcgcgcgcc

SEQ ID NO: 177614 - DNA, 25 bp, E. coli
tttgataagcgcgtgtcgtcgacga

SEQ ID NO: 177615 - DNA, 25 bp, E. coli
tatccgtcttcatatacagcgtggc

SEQ ID NO: 177616 - DNA, 25 bp, E. coli
ttcttcctgagttaaaaacgcgagc

SEQ ID NO: 177617 - DNA, 25 bp, E. coli
tttcgaatatggtacagcgcgcgcc

SEQ ID NO: 177618 - DNA, 25 bp, E. coli
ttcttcctgagtaaaaaacgcgagc

SEQ ID NO: 177619 - DNA, 25 bp, E. coli
tgtgctgctttctacgccgactggg

SEQ ID NO: 177620 - DNA, 25 bp, E. coli
tgtgctgctttcaacgccgactggg

SEQ ID NO: 177621 - DNA, 25 bp, E. coli
gaatcacacgatctaggaacgcgcc

SEQ ID NO: 177622 - DNA, 25 bp, E. coli
gaatcacacgatgtaggaacgcgcc

SEQ ID NO: 177623 - DNA, 25 bp, E. coli
cattccaggtggtactcgaagcgct

SEQ ID NO: 177624 - DNA, 25 bp, E. coli
cattccaggtggaactcgaagcgct

SEQ ID NO: 177625 - DNA, 25 bp, E. coli
gggatactctttcaccacgcaggct

SEQ ID NO: 177626 - DNA, 25 bp, E. coli
gggatactctttgaccacgcaggct

SEQ ID NO: 177627 - DNA, 25 bp, E. coli
taaggatcaccagtgcgtagcggcg

SEQ ID NO: 177628 - DNA, 25 bp, E. coli
taaggatcaccactgcgtagcggcg

SEQ ID NO: 177629 - DNA, 25 bp, E. coli
aataatcagtggcaggtcacccgcc

SEQ ID NO: 177630 - DNA, 25 bp, E. coli
aataatcagtgggaggtcacccgcc

SEQ ID NO: 177631 - DNA, 25 bp, E. coli
cagcagcagtcgatttccggtgtca

SEQ ID NO: 177632 - DNA, 25 bp, E. coli
cagcagcagtcgttttccggtgtca

SEQ ID NO: 177633 - DNA, 25 bp, E. coli
tatggcgcaggcgaatagcacgttg

SEQ ID NO: 177634 - DNA, 25 bp, E. coli
tatggcgcaggccaatagcacgttg

SEQ ID NO: 177635 - DNA, 25 bp, E. coli
tattaccaaccagttacgtgcggcg

SEQ ID NO: 177636 - DNA, 25 bp, E. coli
tattaccaaccacttacgtgcggcg

SEQ ID NO: 177637 - DNA, 25 bp, E. coli
tctttgctatcgctaagcccgcggt

SEQ ID NO: 177638 - DNA, 25 bp, E. coli
tcttcgctggcaacacagatgcagg

SEQ ID NO: 177639 - DNA, 25 bp, E. coli
tcaggccctgctggatctgcaaagc

SEQ ID NO: 177640 - DNA, 25 bp, E. coli
tcaggccctgctcgatctgcaaagc

SEQ ID NO: 177641 - DNA, 25 bp, E. coli
tcttcgctggcatcacagatgcagg

SEQ ID NO: 177642 - DNA, 25 bp, E. coli
tctttgctatcggtaagcccgcggt

SEQ ID NO: 177643 - DNA, 25 bp, E. coli
gaaattactgaataccgggtcgctg

SEQ ID NO: 177644 - DNA, 25 bp, E. coli
gaaattactgaaaaccgggtcgctg

SEQ ID NO: 177645 - DNA, 25 bp, E. coli
gggcgtcacctatcaatctgctgga

SEQ ID NO: 177646 - DNA, 25 bp, E. coli
gggcgtcacctaacaatctgctgga

SEQ ID NO: 177647 - DNA, 25 bp, E. coli
taacgttgccggttatacccgccaa

SEQ ID NO: 177648 - DNA, 25 bp, E. coli
taacgttgccggatatacccgccaa

SEQ ID NO: 177649 - DNA, 25 bp, E. coli
tcaatatcgcgaaaggtgccagcgt

SEQ ID NO: 177650 - DNA, 25 bp, E. coli
tcaatatcgcgataggtgccagcgt

SEQ ID NO: 177651 - DNA, 25 bp, E. coli
catcactgtggtagtgtccgatcgc

SEQ ID NO: 177652 - DNA, 25 bp, E. coli
catcactgtggttgtgtccgatcgc

SEQ ID NO: 177653 - DNA, 25 bp, E. coli
tttcgtagacgaaggcccgagcatg

SEQ ID NO: 177654 - DNA, 25 bp, E. coli
tttcgtagacgatggcccgagcatg

SEQ ID NO: 177655 - DNA, 25 bp, E. coli
ttatgccgcgtggaaaaggtcgtgc

SEQ ID NO: 177656 - DNA, 25 bp, E. coli
ttatgccgcgtgcaaaaggtcgtgc

SEQ ID NO: 177657 - DNA, 25 bp, E. coli
ttgacctacaccaacaagaaagcgg

SEQ ID NO: 177658 - DNA, 25 bp, E. coli
ttgacctacacctacaagaaagcgg

SEQ ID NO: 177659 - DNA, 25 bp, E. coli
gccttgttgctgtcctgattcgcgg

SEQ ID NO: 177660 - DNA, 25 bp, E. coli
gccttgttgctgacctgattcgcgg

SEQ ID NO: 177661 - DNA, 25 bp, E. coli
gctgaacacaaccatggcgctgaca

SEQ ID NO: 177662 - DNA, 25 bp, E. coli
gcggtaagaaagtgtcgcaggctct

SEQ ID NO: 177663 - DNA, 25 bp, E. coli
gctgaacacaacgatggcgctgaca

SEQ ID NO: 177664 - DNA, 25 bp, E. coli
gcggtaagaaagagtcgcaggctct

SEQ ID NO: 177665 - DNA, 25 bp, E. coli
gaaactatcgcttaacatcgccatg

SEQ ID NO: 177666 - DNA, 25 bp, E. coli
gaaactatcgctaaacatcgccatg

SEQ ID NO: 177667 - DNA, 25 bp, E. coli
gaaagcggctgtactggtcaagaaa

SEQ ID NO: 177668 - DNA, 25 bp, E. coli
gaaagcggctgttctggtcaagaaa

SEQ ID NO: 177669 - DNA, 25 bp, E. coli
ggaatctgccatagctaacgctgaa

SEQ ID NO: 177670 - DNA, 25 bp, E. coli
ggcgctgacattgacgatctgaaag

SEQ ID NO: 177671 - DNA, 25 bp, E. coli
ggcgctgacattcacgatctgaaag

SEQ ID NO: 177672 - DNA, 25 bp, E. coli
ggaatctgccattgctaacgctgaa

SEQ ID NO: 177673 - DNA, 25 bp, E. coli
taaatcgcagtttgtttgccatcgg

SEQ ID NO: 177674 - DNA, 25 bp, E. coli
tacagatgatgcgtacgcttgctcc

SEQ ID NO: 177675 - DNA, 25 bp, E. coli
taaatcgcagttagtttgccatcgg

SEQ ID NO: 177676 - DNA, 25 bp, E. coli
tacagatgatgcctacgcttgctcc

SEQ ID NO: 177677 - DNA, 25 bp, E. coli
ttagtgaatctcagctcccgacggc

SEQ ID NO: 177678 - DNA, 25 bp, E. coli
tttaatccgctccaacgtcgctggg

SEQ ID NO: 177679 - DNA, 25 bp, E. coli
ttagtgaatctctgctcccgacggc

SEQ ID NO: 177680 - DNA, 25 bp, E. coli
tttaatccgctcgaacgtcgctggg

SEQ ID NO: 177681 - DNA, 25 bp, E. coli
tgatatcagcgatacaggacgggag

SEQ ID NO: 177682 - DNA, 25 bp, E. coli
tgatatcagcgaaacaggacgggag

SEQ ID NO: 177683 - DNA, 25 bp, E. coli
tcccgacggctggaaaaacgctttg

SEQ ID NO: 177684 - DNA, 25 bp, E. coli
tcccgacggctgcaaaaacgctttg

SEQ ID NO: 177685 - DNA, 25 bp, E. coli
ccttgaatttcaggtagcgcaggaa

SEQ ID NO: 177686 - DNA, 25 bp, E. coli
cctgaagagtgatctgaagcggcgc

SEQ ID NO: 177687 - DNA, 25 bp, E. coli
cctgaagagtgaactgaagcggcgc

SEQ ID NO: 177688 - DNA, 25 bp, E. coli
ccttgaatttcacgtagcgcaggaa

SEQ ID NO: 177689 - DNA, 25 bp, E. coli
cgcaggaaattggacgccactggca

SEQ ID NO: 177690 - DNA, 25 bp, E. coli
cgcaggaaattgcacgccactggca

SEQ ID NO: 177691 - DNA, 25 bp, E. coli
gatttgaaagtgtatacggcgtcca

SEQ ID NO: 177692 - DNA, 25 bp, E. coli
gatttgaaagtgaatacggcgtcca

SEQ ID NO: 177693 - DNA, 25 bp, E. coli
gacgggagatcctgcgctatcatca

SEQ ID NO: 177694 - DNA, 25 bp, E. coli
gacgggagatccagcgctatcatca

SEQ ID NO: 177695 - DNA, 25 bp, E. coli
tacattaaggcagaacaggacaaaa

SEQ ID NO: 177696 - DNA, 25 bp, E. coli
tacattaaggcacaacaggacaaaa

SEQ ID NO: 177697 - DNA, 25 bp, E. coli
aggcacaacaggacaaaatggtcaa

SEQ ID NO: 177698 - DNA, 25 bp, E. coli
aggcacaacaggtcaaaatggtcaa

SEQ ID NO: 177699 - DNA, 25 bp, E. coli
gacaaaatggtcaattcttcgttat

SEQ ID NO: 177700 - DNA, 25 bp, E. coli
gacggtacttacattaaggcacaac

SEQ ID NO: 177701 - DNA, 25 bp, E. coli
gacggtacttactttaaggcacaac

SEQ ID NO: 177702 - DNA, 25 bp, E. coli
gacaaaatggtctattcttcgttat

SEQ ID NO: 177703 - DNA, 25 bp, E. coli
cgtcagtggatacatattttaatgt

SEQ ID NO: 177704 - DNA, 25 bp, E. coli
cgtcagtggatagatattttaatgt

SEQ ID NO: 177705 - DNA, 25 bp, E. coli
cttacattaagggacaacaggacaa

SEQ ID NO: 177706 - DNA, 25 bp, E. coli
cttacattaaggcacaacaggacaa

SEQ ID NO: 177707 - DNA, 25 bp, E. coli
gatacatatttttatgttatggaag

SEQ ID NO: 177708 - DNA, 25 bp, E. coli
gatacatattttaatgttatggaag

SEQ ID NO: 177709 - DNA, 25 bp, E. coli
gtggacggtactaacattaaggcac

SEQ ID NO: 177710 - DNA, 25 bp, E. coli
ggtacttacatttaggcacaacagg

SEQ ID NO: 177711 - DNA, 25 bp, E. coli
ggtacttacattaaggcacaacagg

SEQ ID NO: 177712 - DNA, 25 bp, E. coli
gtggacggtacttacattaaggcac

SEQ ID NO: 177713 - DNA, 25 bp, E. coli
tggtcaattcttcgttatgtaaaaa

SEQ ID NO: 177714 - DNA, 25 bp, E. coli
tggtcaattcttggttatgtaaaaa

SEQ ID NO: 177715 - DNA, 25 bp, E. coli
taaggcacaacacgacaaaatggtc

SEQ ID NO: 177716 - DNA, 25 bp, E. coli
taaggcacaacaggacaaaatggtc

SEQ ID NO: 177717 - DNA, 25 bp, E. coli
caattaacaagcttaatattgccat

SEQ ID NO: 177718 - DNA, 25 bp, E. coli
caattaacaagcataatattgccat

SEQ ID NO: 177719 - DNA, 25 bp, E. coli
caaaatcgacataccttcctttaag

SEQ ID NO: 177720 - DNA, 25 bp, E. coli
caaaatcgacattccttcctttaag

SEQ ID NO: 177721 - DNA, 25 bp, E. coli
tagcatgccataaaaggacttttca

SEQ ID NO: 177722 - DNA, 25 bp, E. coli
tagcatgccatataaggacttttca

SEQ ID NO: 177723 - DNA, 25 bp, E. coli
tatatacgcctacaatttcctggag

SEQ ID NO: 177724 - DNA, 25 bp, E. coli
tatttgcccaattcatatattgaga

SEQ ID NO: 177725 - DNA, 25 bp, E. coli
tatatacgcctagaatttcctggag

SEQ ID NO: 177726 - DNA, 25 bp, E. coli
tatttgcccaatacatatattgaga

SEQ ID NO: 177727 - DNA, 25 bp, E. coli
tttctgagatggaaaaagggtgtca

SEQ ID NO: 177728 - DNA, 25 bp, E. coli
tttctgagatggtaaaagggtgtca

SEQ ID NO: 177729 - DNA, 25 bp, E. coli
ttcctggagtaaataaataacaatt

SEQ ID NO: 177730 - DNA, 25 bp, E. coli
ttcctggagtaattaaataacaatt

SEQ ID NO: 177731 - DNA, 25 bp, E. coli
ttgccattgataaaatagcatgcca

SEQ ID NO: 177732 - DNA, 25 bp, E. coli
ttgccattgatataatagcatgcca

SEQ ID NO: 177733 - DNA, 25 bp, E. coli
gaaaaagggtgtcattcaaaatcga

SEQ ID NO: 177734 - DNA, 25 bp, E. coli
gaaaaagggtgtgattcaaaatcga

SEQ ID NO: 177735 - DNA, 25 bp, E. coli
gatagtgccctttttctgagatgga

SEQ ID NO: 177736 - DNA, 25 bp, E. coli
gatagtgcccttattctgagatgga

SEQ ID NO: 177737 - DNA, 25 bp, E. coli
taactcataattacttcctaaagtg

SEQ ID NO: 177738 - DNA, 25 bp, E. coli
taactcataatttcttcctaaagtg

SEQ ID NO: 177739 - DNA, 25 bp, E. coli
caacgacaaaactcttcagcaaggg

SEQ ID NO: 177740 - DNA, 25 bp, E. coli
caacgacaaaacacttcagcaaggg

SEQ ID NO: 177741 - DNA, 25 bp, E. coli
tatgaatccccgagatatcaacgac

SEQ ID NO: 177742 - DNA, 25 bp, E. coli
tatgaatccccgtgatatcaacgac

SEQ ID NO: 177743 - DNA, 25 bp, E. coli
gcctgctgggtaggaagcaatatga

SEQ ID NO: 177744 - DNA, 25 bp, E. coli
gcctgctgggtacgaagcaatatga

SEQ ID NO: 177745 - DNA, 25 bp, E. coli
gctgggtacgaagcaatatgaatcc

SEQ ID NO: 177746 - DNA, 25 bp, E. coli
gctgggtacgaaccaatatgaatcc

SEQ ID NO: 177747 - DNA, 25 bp, E. coli
gaatccccgtgaaatcaacgacaaa

SEQ ID NO: 177748 - DNA, 25 bp, E. coli
gaagatatggccagctgggtacgaa

SEQ ID NO: 177749 - DNA, 25 bp, E. coli
gaagatatggcctgctgggtacgaa

SEQ ID NO: 177750 - DNA, 25 bp, E. coli
gaatccccgtgatatcaacgacaaa

SEQ ID NO: 177751 - DNA, 25 bp, E. coli
cgaagcaatatgtatccccgtgata

SEQ ID NO: 177752 - DNA, 25 bp, E. coli
cgaagcaatatgaatccccgtgata

SEQ ID NO: 177753 - DNA, 25 bp, E. coli
cgacaaaacacttcagcaagggata

SEQ ID NO: 177754 - DNA, 25 bp, E. coli
cgacaaaacactacagcaagggata

SEQ ID NO: 177755 - DNA, 25 bp, E. coli
gatatcaacgactaaacacttcagc

SEQ ID NO: 177756 - DNA, 25 bp, E. coli
gatatggcctgcagggtacgaagca

SEQ ID NO: 177757 - DNA, 25 bp, E. coli
gatatggcctgctgggtacgaagca

SEQ ID NO: 177758 - DNA, 25 bp, E. coli
gatatcaacgacaaaacacttcagc

SEQ ID NO: 177759 - DNA, 25 bp, E. coli
ggtacgaagcaatatgaatccccgt

SEQ ID NO: 177760 - DNA, 25 bp, E. coli
ggtacgaagcaaaatgaatccccgt

SEQ ID NO: 177761 - DNA, 25 bp, E. coli
cactggtcagggagacaagcgcacc

SEQ ID NO: 177762 - DNA, 25 bp, E. coli
cactggtcagggtgacaagcgcacc

SEQ ID NO: 177763 - DNA, 25 bp, E. coli
cagggatgcggaaagccgtcctgca

SEQ ID NO: 177764 - DNA, 25 bp, E. coli
cagggatgcggatagccgtcctgca

SEQ ID NO: 177765 - DNA, 25 bp, E. coli
tttcctcaacactggtcagggtgac

SEQ ID NO: 177766 - DNA, 25 bp, E. coli
tttcctcaacacaggtcagggtgac

SEQ ID NO: 177767 - DNA, 25 bp, E. coli
tgcataaacacctcccgggtttcct

SEQ ID NO: 177768 - DNA, 25 bp, E. coli
tgcataaacaccacccgggtttcct

SEQ ID NO: 177769 - DNA, 25 bp, E. coli
tgcggatagccgtcctgcataaaca

SEQ ID NO: 177770 - DNA, 25 bp, E. coli
tgcggatagccgacctgcataaaca

SEQ ID NO: 177771 - DNA, 25 bp, E. coli
tcagggtgacaagcgcaccatgatc

SEQ ID NO: 177772 - DNA, 25 bp, E. coli
tcagggtgacaaccgcaccatgatc

SEQ ID NO: 177773 - DNA, 25 bp, E. coli
ccgggtttcctctacactggtcagg

SEQ ID NO: 177774 - DNA, 25 bp, E. coli
gacaagcgcaccttgatcgtctttg

SEQ ID NO: 177775 - DNA, 25 bp, E. coli
gacaagcgcaccatgatcgtctttg

SEQ ID NO: 177776 - DNA, 25 bp, E. coli
ccgggtttcctcaacactggtcagg

SEQ ID NO: 177777 - DNA, 25 bp, E. coli
gtcctgcataaacaccacccgggtt

SEQ ID NO: 177778 - DNA, 25 bp, E. coli
ggatagccgtcctgcataaacacca

SEQ ID NO: 177779 - DNA, 25 bp, E. coli
ggatagccgtccagcataaacacca

SEQ ID NO: 177780 - DNA, 25 bp, E. coli
gtcctgcataaagaccacccgggtt

SEQ ID NO: 177781 - DNA, 25 bp, E. coli
tcaacactggtctgggtgacaagcg

SEQ ID NO: 177782 - DNA, 25 bp, E. coli
tcaacactggtcagggtgacaagcg

SEQ ID NO: 177783 - DNA, 25 bp, E. coli
aaaaatatgtatatcagcggcgacg

SEQ ID NO: 177784 - DNA, 25 bp, E. coli
aaaaatatgtatttcagcggcgacg

SEQ ID NO: 177785 - DNA, 25 bp, E. coli
tacgcggcgctgtcctttaaatatg

SEQ ID NO: 177786 - DNA, 25 bp, E. coli
tacgcggcgctgacctttaaatatg

SEQ ID NO: 177787 - DNA, 25 bp, E. coli
tattaaaggtcacgcgatctacgcc

SEQ ID NO: 177788 - DNA, 25 bp, E. coli
tattaaaggtcaggcgatctacgcc

SEQ ID NO: 177789 - DNA, 25 bp, E. coli
tgtacgcagaagaccgcaactgggt

SEQ ID NO: 177790 - DNA, 25 bp, E. coli
tgtacgcagaagtccgcaactgggt

SEQ ID NO: 177791 - DNA, 25 bp, E. coli
tcctggcgtagtcgagaagctgctt

SEQ ID NO: 177792 - DNA, 25 bp, E. coli
tcctggcgtagtggagaagctgctt

SEQ ID NO: 177793 - DNA, 25 bp, E. coli
gatatctactggagcaccgccgatg

SEQ ID NO: 177794 - DNA, 25 bp, E. coli
gatatctactggtgcaccgccgatg

SEQ ID NO: 177795 - DNA, 25 bp, E. coli
ggcgagccaattaacccggaagcgt

SEQ ID NO: 177796 - DNA, 25 bp, E. coli
tggtcgataacgtaggtaacccgct

SEQ ID NO: 177797 - DNA, 25 bp, E. coli
ggcgagccaatttacccggaagcgt

SEQ ID NO: 177798 - DNA, 25 bp, E. coli
tggtcgataacgaaggtaacccgct

SEQ ID NO: 177799 - DNA, 25 bp, E. coli
gagatgaacgcccaagatccgctgt

SEQ ID NO: 177800 - DNA, 25 bp, E. coli
gatcgtaccgccttcatctgggaag

SEQ ID NO: 177801 - DNA, 25 bp, E. coli
gaggaaccgtcagcagaactgtacg

SEQ ID NO: 177802 - DNA, 25 bp, E. coli
gatcgtaccgccatcatctgggaag

SEQ ID NO: 177803 - DNA, 25 bp, E. coli
gagatgaacgccgaagatccgctgt

SEQ ID NO: 177804 - DNA, 25 bp, E. coli
gaggaaccgtcaccagaactgtacg

SEQ ID NO: 177805 - DNA, 25 bp, E. coli
aattccggattctatatcttcagga

SEQ ID NO: 177806 - DNA, 25 bp, E. coli
aattccggattcaatatcttcagga

SEQ ID NO: 177807 - DNA, 25 bp, E. coli
taacaaaaatacataatgagtccga

SEQ ID NO: 177808 - DNA, 25 bp, E. coli
aaagatatggcggacagtgtgtcaa

SEQ ID NO: 177809 - DNA, 25 bp, E. coli
aaagatatggcgcacagtgtgtcaa

SEQ ID NO: 177810 - DNA, 25 bp, E. coli
ttaagtgatctggtaaatgtcctga

SEQ ID NO: 177811 - DNA, 25 bp, E. coli
ttaagtgatctgctaaatgtcctga

SEQ ID NO: 177812 - DNA, 25 bp, E. coli
tgatgaagaaagatatggcggacag

SEQ ID NO: 177813 - DNA, 25 bp, E. coli
tgatgaagaaagttatggcggacag

SEQ ID NO: 177814 - DNA, 25 bp, E. coli
tcaggatgaagatcaaaagagagtt

SEQ ID NO: 177815 - DNA, 25 bp, E. coli
tcaggatgaagaacaaaagagagtt

SEQ ID NO: 177816 - DNA, 25 bp, E. coli
ccggattcaatatcttcaggatgaa

SEQ ID NO: 177817 - DNA, 25 bp, E. coli
ccggattcaataacttcaggatgaa

SEQ ID NO: 177818 - DNA, 25 bp, E. coli
cggacagtgtgtgaatgacatggca

SEQ ID NO: 177819 - DNA, 25 bp, E. coli
cggacagtgtgtcaatgacatggca

SEQ ID NO: 177820 - DNA, 25 bp, E. coli
gtccgatacaagacgggtggcagaa

SEQ ID NO: 177821 - DNA, 25 bp, E. coli
gtccgatacaagtcgggtggcagaa

SEQ ID NO: 177822 - DNA, 25 bp, E. coli
ggtaaatgtcctcatttcaaaaaga

SEQ ID NO: 177823 - DNA, 25 bp, E. coli
ggtaaatgtcctgatttcaaaaaga

SEQ ID NO: 177824 - DNA, 25 bp, E. coli
taatgagtccgatacaagacgggtg

SEQ ID NO: 177825 - DNA, 25 bp, E. coli
taacaaaaatacttaatgagtccga

SEQ ID NO: 177826 - DNA, 25 bp, E. coli
taatgagtccgaaacaagacgggtg

SEQ ID NO: 177827 - DNA, 25 bp, E. coli
aataacccgatcctgccggtgctgt

SEQ ID NO: 177828 - DNA, 25 bp, E. coli
aataacccgatcgtgccggtgctgt

SEQ ID NO: 177829 - DNA, 25 bp, E. coli
aaaccgtgggtcaatcgcagttccg

SEQ ID NO: 177830 - DNA, 25 bp, E. coli
aaaccgtgggtctatcgcagttccg

SEQ ID NO: 177831 - DNA, 25 bp, E. coli
tttgaacatgatttgcttgccctgc

SEQ ID NO: 177832 - DNA, 25 bp, E. coli
tttgaacatgatatgcttgccctgc

SEQ ID NO: 177833 - DNA, 25 bp, E. coli
tgctgtcggcgctgaaatcgtatcc

SEQ ID NO: 177834 - DNA, 25 bp, E. coli
tgctgtcggcgcagaaatcgtatcc

SEQ ID NO: 177835 - DNA, 25 bp, E. coli
tctggtgacgctcgccgtgctgtta

SEQ ID NO: 177836 - DNA, 25 bp, E. coli
tctggtgacgctggccgtgctgtta

SEQ ID NO: 177837 - DNA, 25 bp, E. coli
gccatggcgatacgccaacgcagta

SEQ ID NO: 177838 - DNA, 25 bp, E. coli
gccatggcgataggccaacgcagta

SEQ ID NO: 177839 - DNA, 25 bp, E. coli
gcttgccctgcaacaacgctggttg

SEQ ID NO: 177840 - DNA, 25 bp, E. coli
gctgtggctggccaaaatctttgaa

SEQ ID NO: 177841 - DNA, 25 bp, E. coli
gctgtggctggcgaaaatctttgaa

SEQ ID NO: 177842 - DNA, 25 bp, E. coli
gcttgccctgcatcaacgctggttg

SEQ ID NO: 177843 - DNA, 25 bp, E. coli
gacaagaccgtggaccttctggaag

SEQ ID NO: 177844 - DNA, 25 bp, E. coli
gacaagaccgtgcaccttctggaag

SEQ ID NO: 177845 - DNA, 25 bp, E. coli
cgcggactggaaacattgatgctgg

SEQ ID NO: 177846 - DNA, 25 bp, E. coli
cgcggactggaatcattgatgctgg

SEQ ID NO: 177847 - DNA, 25 bp, E. coli
cattttgaatcggtggtgtgggact

SEQ ID NO: 177848 - DNA, 25 bp, E. coli
cattttgaatcgctggtgtgggact

SEQ ID NO: 177849 - DNA, 25 bp, E. coli
atgagttcgctcatcaccgcgcagg

SEQ ID NO: 177850 - DNA, 25 bp, E. coli
agtcagggccgatctaaacatcgcg

SEQ ID NO: 177851 - DNA, 25 bp, E. coli
atgagttcgctcttcaccgcgcagg

SEQ ID NO: 177852 - DNA, 25 bp, E. coli
agtcagggccgaactaaacatcgcg

SEQ ID NO: 177853 - DNA, 25 bp, E. coli
aaatgaaaaatgtgacgtggcggcc

SEQ ID NO: 177854 - DNA, 25 bp, E. coli
aaatgaaaaatgagacgtggcggcc

SEQ ID NO: 177855 - DNA, 25 bp, E. coli
taccatcagcgaaagtgaacaccgc

SEQ ID NO: 177856 - DNA, 25 bp, E. coli
taccatcagcgatagtgaacaccgc

SEQ ID NO: 177857 - DNA, 25 bp, E. coli
ttcaccgaagagtagtacgccacgc

SEQ ID NO: 177858 - DNA, 25 bp, E. coli
ttttattcataacgatgcggccggt

SEQ ID NO: 177859 - DNA, 25 bp, E. coli
ttcaccgaagagaagtacgccacgc

SEQ ID NO: 177860 - DNA, 25 bp, E. coli
ttttattcataaggatgcggccggt

SEQ ID NO: 177861 - DNA, 25 bp, E. coli
gcaacagaagaattagcccaggcct

SEQ ID NO: 177862 - DNA, 25 bp, E. coli
gaatcctgacgaagacttcgccgcc

SEQ ID NO: 177863 - DNA, 25 bp, E. coli
gaatcctgacgatgacttcgccgcc

SEQ ID NO: 177864 - DNA, 25 bp, E. coli
gcaacagaagaaatagcccaggcct

SEQ ID NO: 177865 - DNA, 25 bp, E. coli
cgatctcggctaagacgtggtggaa

SEQ ID NO: 177866 - DNA, 25 bp, E. coli
cgatctcggctatgacgtggtggaa

SEQ ID NO: 177867 - DNA, 25 bp, E. coli
ggatcatgcttatcggcgaacccta

SEQ ID NO: 177868 - DNA, 25 bp, E. coli
ggatcatgcttaacggcgaacccta

SEQ ID NO: 177869 - DNA, 25 bp, E. coli
tggcgtcagctagcagcaacagaag

SEQ ID NO: 177870 - DNA, 25 bp, E. coli
tggcgtcagctaccagcaacagaag

SEQ ID NO: 177871 - DNA, 25 bp, E. coli
aattggcgttcccatcgcctgggca

SEQ ID NO: 177872 - DNA, 25 bp, E. coli
aatgttcttaacgtggtatgcggcg

SEQ ID NO: 177873 - DNA, 25 bp, E. coli
aattggcgttccgatcgcctgggca

SEQ ID NO: 177874 - DNA, 25 bp, E. coli
caatgaaactggtaggccacaggcc

SEQ ID NO: 177875 - DNA, 25 bp, E. coli
caatgaaactggaaggccacaggcc

SEQ ID NO: 177876 - DNA, 25 bp, E. coli
aatgttcttaacctggtatgcggcg

SEQ ID NO: 177877 - DNA, 25 bp, E. coli
cacaaacgttggaaaatggcgcaga

SEQ ID NO: 177878 - DNA, 25 bp, E. coli
cacaaacgttggtaaatggcgcaga

SEQ ID NO: 177879 - DNA, 25 bp, E. coli
tactggcgggtgagatcatgaacgc

SEQ ID NO: 177880 - DNA, 25 bp, E. coli
tacgatcgccgaattacccatgatg

SEQ ID NO: 177881 - DNA, 25 bp, E. coli
tactggcgggtgtgatcatgaacgc

SEQ ID NO: 177882 - DNA, 25 bp, E. coli
tacgatcgccgatttacccatgatg

SEQ ID NO: 177883 - DNA, 25 bp, E. coli
tatcatgtgctgattaacgcggcaa

SEQ ID NO: 177884 - DNA, 25 bp, E. coli
tatcatgtgctgtttaacgcggcaa

SEQ ID NO: 177885 - DNA, 25 bp, E. coli
ttatttacaccgtccgaagcaggcg

SEQ ID NO: 177886 - DNA, 25 bp, E. coli
ttatttacaccgaccgaagcaggcg

SEQ ID NO: 177887 - DNA, 25 bp, E. coli
tcagtacggtcatggacttaacgcc

SEQ ID NO: 177888 - DNA, 25 bp, E. coli
tcagtacggtcaaggacttaacgcc

SEQ ID NO: 177889 - DNA, 25 bp, E. coli
gaaagcctcactgcgagaagtctgg

SEQ ID NO: 177890 - DNA, 25 bp, E. coli
gaaagcctcactccgagaagtctgg

SEQ ID NO: 177891 - DNA, 25 bp, E. coli
taatgccattagagaaagaagcggg

SEQ ID NO: 177892 - DNA, 25 bp, E. coli
taatgccattagtgaaagaagcggg

SEQ ID NO: 177893 - DNA, 25 bp, E. coli
aattgggcactcttgtcctgacggg

SEQ ID NO: 177894 - DNA, 25 bp, E. coli
aattgggcactcatgtcctgacggg

SEQ ID NO: 177895 - DNA, 25 bp, E. coli
caactatacggtaacggcggcggtg

SEQ ID NO: 177896 - DNA, 25 bp, E. coli
caactatacggttacggcggcggtg

SEQ ID NO: 177897 - DNA, 25 bp, E. coli
caacggttatttgctgcaagcggcg

SEQ ID NO: 177898 - DNA, 25 bp, E. coli
caacggttatttcctgcaagcggcg

SEQ ID NO: 177899 - DNA, 25 bp, E. coli
tacgtccgtgaaggaaatgacctgc

SEQ ID NO: 177900 - DNA, 25 bp, E. coli
tacgtccgtgaacgaaatgacctgc

SEQ ID NO: 177901 - DNA, 25 bp, E. coli
tatcggcattaacagcattgcgggc

SEQ ID NO: 177902 - DNA, 25 bp, E. coli
tatcggcattaagagcattgcgggc

SEQ ID NO: 177903 - DNA, 25 bp, E. coli
ttattaacgccagcgaacaggccgc

SEQ ID NO: 177904 - DNA, 25 bp, E. coli
ttaaatgggcagacgtatcagggcg

SEQ ID NO: 177905 - DNA, 25 bp, E. coli
ttaaatgggcagtcgtatcagggcg

SEQ ID NO: 177906 - DNA, 25 bp, E. coli
ttaataatgccgagcaggccgtcgc

SEQ ID NO: 177907 - DNA, 25 bp, E. coli
ttaataatgccgtgcaggccgtcgc

SEQ ID NO: 177908 - DNA, 25 bp, E. coli
ttattaacgccaccgaacaggccgc

SEQ ID NO: 177909 - DNA, 25 bp, E. coli
tgatctatatgcaggacggcacggt

SEQ ID NO: 177910 - DNA, 25 bp, E. coli
tgatctatatgctggacggcacggt

SEQ ID NO: 177911 - DNA, 25 bp, E. coli
gaaaagccatactgcaaccgtcggt

SEQ ID NO: 177912 - DNA, 25 bp, E. coli
gaaaagccatacagcaaccgtcggt

SEQ ID NO: 177913 - DNA, 25 bp, E. coli
cggttacagcataaggccaggccaa

SEQ ID NO: 177914 - DNA, 25 bp, E. coli
cggttacagcattaggccaggccaa

SEQ ID NO: 177915 - DNA, 25 bp, E. coli
catggtggatttgagcagtatgcgc

SEQ ID NO: 177916 - DNA, 25 bp, E. coli
catcagttcctggtggttggcacga

SEQ ID NO: 177917 - DNA, 25 bp, E. coli
catggtggatttcagcagtatgcgc

SEQ ID NO: 177918 - DNA, 25 bp, E. coli
catcagttcctgctggttggcacga

SEQ ID NO: 177919 - DNA, 25 bp, E. coli
tatatttgaactggaggatcgccct

SEQ ID NO: 177920 - DNA, 25 bp, E. coli
tattcagatgactggcgtcgcttca

SEQ ID NO: 177921 - DNA, 25 bp, E. coli
tattcagatgacaggcgtcgcttca

SEQ ID NO: 177922 - DNA, 25 bp, E. coli
tatatttgaactcgaggatcgccct

SEQ ID NO: 177923 - DNA, 25 bp, E. coli
tgatcggctttaactgctgtcgcag

SEQ ID NO: 177924 - DNA, 25 bp, E. coli
tgatcggctttatctgctgtcgcag

SEQ ID NO: 177925 - DNA, 25 bp, E. coli
tgaaaaccctatatgtgctggcggg

SEQ ID NO: 177926 - DNA, 25 bp, E. coli
tgaaaaccctatttgtgctggcggg

SEQ ID NO: 177927 - DNA, 25 bp, E. coli
tcgcagtccgttgctacgcatggga

SEQ ID NO: 177928 - DNA, 25 bp, E. coli
tcgcagtccgttcctacgcatggga

SEQ ID NO: 177929 - DNA, 25 bp, E. coli
tcatcaccaacgctttaaagcgccg

SEQ ID NO: 177930 - DNA, 25 bp, E. coli
tcatcaccaacggtttaaagcgccg

SEQ ID NO: 177931 - DNA, 25 bp, E. coli
gcttcacgttatctcgggcgaacca

SEQ ID NO: 177932 - DNA, 25 bp, E. coli
gcttcacgttatgtcgggcgaacca

SEQ ID NO: 177933 - DNA, 25 bp, E. coli
gcaattacgaacttctcggcgttgg

SEQ ID NO: 177934 - DNA, 25 bp, E. coli
gcaattacgaacatctcggcgttgg

SEQ ID NO: 177935 - DNA, 25 bp, E. coli
gatgatcgcctctggtattggtacc

SEQ ID NO: 177936 - DNA, 25 bp, E. coli
gatgatcgcctcaggtattggtacc

SEQ ID NO: 177937 - DNA, 25 bp, E. coli
cacagtttatcagatccctgcggac

SEQ ID NO: 177938 - DNA, 25 bp, E. coli
cacagtttatcacatccctgcggac

SEQ ID NO: 177939 - DNA, 25 bp, E. coli
tacgtatcaacccttgaagcatccg

SEQ ID NO: 177940 - DNA, 25 bp, E. coli
tacgtatcaaccgttgaagcatccg

SEQ ID NO: 177941 - DNA, 25 bp, E. coli
ttgaagcatccgtaatcaccccagg

SEQ ID NO: 177942 - DNA, 25 bp, E. coli
ttgaagcatccgaaatcaccccagg

SEQ ID NO: 177943 - DNA, 25 bp, E. coli
tttatcagatccgtgcggactccgc

SEQ ID NO: 177944 - DNA, 25 bp, E. coli
tttatcagatccctgcggactccgc

SEQ ID NO: 177945 - DNA, 25 bp, E. coli
tgtaggcgatcgaagcccaaaaatt

SEQ ID NO: 177946 - DNA, 25 bp, E. coli
tgtaggcgatcgtagcccaaaaatt

SEQ ID NO: 177947 - DNA, 25 bp, E. coli
tgcggactccgctggaattgtcaat

SEQ ID NO: 177948 - DNA, 25 bp, E. coli
tgcggactccgcaggaattgtcaat

SEQ ID NO: 177949 - DNA, 25 bp, E. coli
ccgaacagtttccttctgtaggcga

SEQ ID NO: 177950 - DNA, 25 bp, E. coli
ccgaacagtttcgttctgtaggcga

SEQ ID NO: 177951 - DNA, 25 bp, E. coli
ctccgctggaatagtcaatgttgac

SEQ ID NO: 177952 - DNA, 25 bp, E. coli
cgttctgtaggcgatcgtagcccaa

SEQ ID NO: 177953 - DNA, 25 bp, E. coli
cgttctgtaggccatcgtagcccaa

SEQ ID NO: 177954 - DNA, 25 bp, E. coli
ctccgctggaattgtcaatgttgac

SEQ ID NO: 177955 - DNA, 25 bp, E. coli
tccctaacttggcaaaagtgggctc

SEQ ID NO: 177956 - DNA, 25 bp, E. coli
tccctaacttgggaaaagtgggctc

SEQ ID NO: 177957 - DNA, 25 bp, E. coli
taacttggcaaaagtgggctctttt

SEQ ID NO: 177958 - DNA, 25 bp, E. coli
taacttggcaaatgtgggctctttt

SEQ ID NO: 177959 - DNA, 25 bp, E. coli
aacatgaattgtttgatttcgcgca

SEQ ID NO: 177960 - DNA, 25 bp, E. coli
aacgtgatttcaagcgtcattttga

SEQ ID NO: 177961 - DNA, 25 bp, E. coli
aacgtgatttcatgcgtcattttga

SEQ ID NO: 177962 - DNA, 25 bp, E. coli
aacatgaattgtatgatttcgcgca

SEQ ID NO: 177963 - DNA, 25 bp, E. coli
tgatttcgcgcatattcgctcataa

SEQ ID NO: 177964 - DNA, 25 bp, E. coli
tgatttcgcgcaaattcgctcataa

SEQ ID NO: 177965 - DNA, 25 bp, E. coli
tcgcggcaactctagaaacggcagg

SEQ ID NO: 177966 - DNA, 25 bp, E. coli
tcgcggcaactcaagaaacggcagg

SEQ ID NO: 177967 - DNA, 25 bp, E. coli
tcttatttaataatgtgtgcggcaa

SEQ ID NO: 177968 - DNA, 25 bp, E. coli
tcataaataagagcacgggccacgg

SEQ ID NO: 177969 - DNA, 25 bp, E. coli
tcttatttaatattgtgtgcggcaa

SEQ ID NO: 177970 - DNA, 25 bp, E. coli
tcataaataagaccacgggccacgg

SEQ ID NO: 177971 - DNA, 25 bp, E. coli
ccatttagccattgtaaaaacatga

SEQ ID NO: 177972 - DNA, 25 bp, E. coli
ccatttagccatagtaaaaacatga

SEQ ID NO: 177973 - DNA, 25 bp, E. coli
gctcataattcgaaagtgaaacgtg

SEQ ID NO: 177974 - DNA, 25 bp, E. coli
gctcataattcgtaagtgaaacgtg

SEQ ID NO: 177975 - DNA, 25 bp, E. coli
gaatcaggctgtaaatcataaataa

SEQ ID NO: 177976 - DNA, 25 bp, E. coli
gaatgttttctttacatcgcggcaa

SEQ ID NO: 177977 - DNA, 25 bp, E. coli
gaatcaggctgttaatcataaataa

SEQ ID NO: 177978 - DNA, 25 bp, E. coli
gaatgttttcttaacatcgcggcaa

SEQ ID NO: 177979 - DNA, 25 bp, E. coli
ggcaggttctctcactgaatcaggc

SEQ ID NO: 177980 - DNA, 25 bp, E. coli
ggcaggttctctgactgaatcaggc

SEQ ID NO: 177981 - DNA, 25 bp, E. coli
taaagaccggataggcgaaaatctc

SEQ ID NO: 177982 - DNA, 25 bp, E. coli
taaagaccggattggcgaaaatctc

SEQ ID NO: 177983 - DNA, 25 bp, E. coli
taaatcgcgcaagtttatcgcccag

SEQ ID NO: 177984 - DNA, 25 bp, E. coli
taaatcgcgcaactttatcgcccag

SEQ ID NO: 177985 - DNA, 25 bp, E. coli
acatagcgcggacttggtttctgac

SEQ ID NO: 177986 - DNA, 25 bp, E. coli
acatagcgcggagttggtttctgac

SEQ ID NO: 177987 - DNA, 25 bp, E. coli
tacgctgatcgctcagttgatcgcc

SEQ ID NO: 177988 - DNA, 25 bp, E. coli
tacgctgatcgcacagttgatcgcc

SEQ ID NO: 177989 - DNA, 25 bp, E. coli
ccttgcgggcgtcgttaaatggtca

SEQ ID NO: 177990 - DNA, 25 bp, E. coli
ccttgcgggcgtggttaaatggtca

SEQ ID NO: 177991 - DNA, 25 bp, E. coli
cccaatttttgggtgagcggcgtga

SEQ ID NO: 177992 - DNA, 25 bp, E. coli
cccaatttttggctgagcggcgtga

SEQ ID NO: 177993 - DNA, 25 bp, E. coli
gatcgtgcgcatgagatccgccatg

SEQ ID NO: 177994 - DNA, 25 bp, E. coli
gataaggtcgatctttccggcacca

SEQ ID NO: 177995 - DNA, 25 bp, E. coli
gattatcccgcgaaataaagaccgg

SEQ ID NO: 177996 - DNA, 25 bp, E. coli
gattatcccgcgtaataaagaccgg

SEQ ID NO: 177997 - DNA, 25 bp, E. coli
gataaggtcgatgtttccggcacca

SEQ ID NO: 177998 - DNA, 25 bp, E. coli
tggtttggcgaaacgttaattgccg

SEQ ID NO: 177999 - DNA, 25 bp, E. coli
tggtttggcgaatcgttaattgccg

SEQ ID NO: 178000 - DNA, 25 bp, E. coli
taattgccgatgttgccttgcgggc

SEQ ID NO: 178001 - DNA, 25 bp, E. coli
taattgccgatgatgccttgcgggc

SEQ ID NO: 178002 - DNA, 25 bp, E. coli
gatcgtgcgcatcagatccgccatg

SEQ ID NO: 178003 - DNA, 25 bp, E. coli
cagggacgccacttcatggaaataa

SEQ ID NO: 178004 - DNA, 25 bp, E. coli
cagggacgccacatcatggaaataa

SEQ ID NO: 178005 - DNA, 25 bp, E. coli
taaaggctatcggtgtgtctaagta

SEQ ID NO: 178006 - DNA, 25 bp, E. coli
tacacgcccacgaagatttcagatc

SEQ ID NO: 178007 - DNA, 25 bp, E. coli
tacacgcccacgtagatttcagatc

SEQ ID NO: 178008 - DNA, 25 bp, E. coli
atgttacttaacaggcagggacgcc

SEQ ID NO: 178009 - DNA, 25 bp, E. coli
atgttacttaactggcagggacgcc

SEQ ID NO: 178010 - DNA, 25 bp, E. coli
aacatcgtacgacattgcggattac

SEQ ID NO: 178011 - DNA, 25 bp, E. coli
aacatcgtacgagattgcggattac

SEQ ID NO: 178012 - DNA, 25 bp, E. coli
ttttgatagatgacagtacacgccc

SEQ ID NO: 178013 - DNA, 25 bp, E. coli
ttttgatagatgtcagtacacgccc

SEQ ID NO: 178014 - DNA, 25 bp, E. coli
tgaaaaggaatagccgcatctggat

SEQ ID NO: 178015 - DNA, 25 bp, E. coli
tgaaaaggaatacccgcatctggat

SEQ ID NO: 178016 - DNA, 25 bp, E. coli
tctggatgtcgataagcgcgatgtt

SEQ ID NO: 178017 - DNA, 25 bp, E. coli
tctggatgtcgaaaagcgcgatgtt

SEQ ID NO: 178018 - DNA, 25 bp, E. coli
tctcttctatcagcgaaagaactcg

SEQ ID NO: 178019 - DNA, 25 bp, E. coli
tctcttctatcaccgaaagaactcg

SEQ ID NO: 178020 - DNA, 25 bp, E. coli
gaactcgcagcatttcttgaaaagg

SEQ ID NO: 178021 - DNA, 25 bp, E. coli
gaactcgcagcaattcttgaaaagg

SEQ ID NO: 178022 - DNA, 25 bp, E. coli
gcgatgtttatcagcgcttaaaggc

SEQ ID NO: 178023 - DNA, 25 bp, E. coli
gcgatgtttatctgcgcttaaaggc

SEQ ID NO: 178024 - DNA, 25 bp, E. coli
taaaggctatcgctgtgtctaagta

SEQ ID NO: 178025 - DNA, 25 bp, E. coli
caatccacagtatgttgcccgtgaa

SEQ ID NO: 178026 - DNA, 25 bp, E. coli
aatccacagtatgttgcccgtgaat

SEQ ID NO: 178027 - DNA, 25 bp, E. coli
aatccacagtatcttgcccgtgaat

SEQ ID NO: 178028 - DNA, 25 bp, E. coli
caatccacagtaagttgcccgtgaa

SEQ ID NO: 178029 - DNA, 25 bp, E. coli
cacatctactcgctacgccggaaat

SEQ ID NO: 178030 - DNA, 25 bp, E. coli
cacatctactcggtacgccggaaat

SEQ ID NO: 178031 - DNA, 25 bp, E. coli
catctactcggtacgccggaaatcc

SEQ ID NO: 178032 - DNA, 25 bp, E. coli
catctactcggttcgccggaaatcc

SEQ ID NO: 178033 - DNA, 25 bp, E. coli
agtatgttgcccgtgaatcaatcac

SEQ ID NO: 178034 - DNA, 25 bp, E. coli
agtatgttgcccctgaatcaatcac

SEQ ID NO: 178035 - DNA, 25 bp, E. coli
tatgttgcccgtgaatcaatcactc

SEQ ID NO: 178036 - DNA, 25 bp, E. coli
tatgttgcccgtcaatcaatcactc

SEQ ID NO: 178037 - DNA, 25 bp, E. coli
tgttgcccgtgattcaatcactcag

SEQ ID NO: 178038 - DNA, 25 bp, E. coli
tgttgcccgtgaatcaatcactcag

SEQ ID NO: 178039 - DNA, 25 bp, E. coli
tccacagtatgttgcccgtgaatca

SEQ ID NO: 178040 - DNA, 25 bp, E. coli
tccacagtatgtagcccgtgaatca

SEQ ID NO: 178041 - DNA, 25 bp, E. coli
ccacagtatgttgcccgtgaatcaa

SEQ ID NO: 178042 - DNA, 25 bp, E. coli
ccacagtatgttccccgtgaatcaa

SEQ ID NO: 178043 - DNA, 25 bp, E. coli
cgcacatctactgggtacgccggaa

SEQ ID NO: 178044 - DNA, 25 bp, E. coli
cgcacatctactcggtacgccggaa

SEQ ID NO: 178045 - DNA, 25 bp, E. coli
tggcctcgcacatctactcggtacg

SEQ ID NO: 178046 - DNA, 25 bp, E. coli
tggcctcgcacaactactcggtacg

SEQ ID NO: 178047 - DNA, 25 bp, E. coli
cagttcacctatagcaaagacgcga

SEQ ID NO: 178048 - DNA, 25 bp, E. coli
cagttcacctattgcaaagacgcga

SEQ ID NO: 178049 - DNA, 25 bp, E. coli
tggttcgtggtaacccgtcgttgcc

SEQ ID NO: 178050 - DNA, 25 bp, E. coli
tggttcgtggtatcccgtcgttgcc

SEQ ID NO: 178051 - DNA, 25 bp, E. coli
tttttatgaagacagcgaaggcgat

SEQ ID NO: 178052 - DNA, 25 bp, E. coli
tttttatgaagagagcgaaggcgat

SEQ ID NO: 178053 - DNA, 25 bp, E. coli
ttttcaattcgactatcggcagcga

SEQ ID NO: 178054 - DNA, 25 bp, E. coli
ttttcaattcgagtatcggcagcga

SEQ ID NO: 178055 - DNA, 25 bp, E. coli
ccagtcattctcatcgcacgggtaa

SEQ ID NO: 178056 - DNA, 25 bp, E. coli
ccagtcattctcttcgcacgggtaa

SEQ ID NO: 178057 - DNA, 25 bp, E. coli
gaaggcgtcattcttgataccgtct

SEQ ID NO: 178058 - DNA, 25 bp, E. coli
gaaggcgtcattgttgataccgtct

SEQ ID NO: 178059 - DNA, 25 bp, E. coli
gataccgtctgggactccagtcatt

SEQ ID NO: 178060 - DNA, 25 bp, E. coli
gataccgtctggcactccagtcatt

SEQ ID NO: 178061 - DNA, 25 bp, E. coli
ggtatcggtctggtactgatcctca

SEQ ID NO: 178062 - DNA, 25 bp, E. coli
gtcgttgcctttcgaccgacgccag

SEQ ID NO: 178063 - DNA, 25 bp, E. coli
gtcgttgcctttggaccgacgccag

SEQ ID NO: 178064 - DNA, 25 bp, E. coli
ggtatcggtctgctactgatcctca

SEQ ID NO: 178065 - DNA, 25 bp, E. coli
ggctgagataaataacccgtgggtt

SEQ ID NO: 178066 - DNA, 25 bp, E. coli
ggctgagataaaaaacccgtgggtt

SEQ ID NO: 178067 - DNA, 25 bp, E. coli
gaccgacgccagtttacacgctaat

SEQ ID NO: 178068 - DNA, 25 bp, E. coli
gaccgacgccagattacacgctaat

SEQ ID NO: 178069 - DNA, 25 bp, E. coli
caaattatgcttgataaagggcgcg

SEQ ID NO: 178070 - DNA, 25 bp, E. coli
caaaatgaatcttccaggactgacc

SEQ ID NO: 178071 - DNA, 25 bp, E. coli
caaatgagattttccgtatggcggc

SEQ ID NO: 178072 - DNA, 25 bp, E. coli
caaatgagatttaccgtatggcggc

SEQ ID NO: 178073 - DNA, 25 bp, E. coli
caaattatgcttcataaagggcgcg

SEQ ID NO: 178074 - DNA, 25 bp, E. coli
caaaatgaatctaccaggactgacc

SEQ ID NO: 178075 - DNA, 25 bp, E. coli
taaatttgccaaagcctcgagtatg

SEQ ID NO: 178076 - DNA, 25 bp, E. coli
taaatttgccaatgcctcgagtatg

SEQ ID NO: 178077 - DNA, 25 bp, E. coli
tatgccgcagtttctccaggaaacg

SEQ ID NO: 178078 - DNA, 25 bp, E. coli
tatgccgcagttactccaggaaacg

SEQ ID NO: 178079 - DNA, 25 bp, E. coli
tataatgcgatatgggccggacttg

SEQ ID NO: 178080 - DNA, 25 bp, E. coli
tataatgcgataagggccggacttg

SEQ ID NO: 178081 - DNA, 25 bp, E. coli
ccttgtcaggatgagttggtacgtc

SEQ ID NO: 178082 - DNA, 25 bp, E. coli
ccttgtcaggatcagttggtacgtc

SEQ ID NO: 178083 - DNA, 25 bp, E. coli
gattatcgctccgatatgtgggccg

SEQ ID NO: 178084 - DNA, 25 bp, E. coli
gattatcgctcccatatgtgggccg

SEQ ID NO: 178085 - DNA, 25 bp, E. coli
gggccgttaattccactgtcacaga

SEQ ID NO: 178086 - DNA, 25 bp, E. coli
gggccgttaattgcactgtcacaga

SEQ ID NO: 178087 - DNA, 25 bp, E. coli
tagtcatttgggagtcgacctcaga

SEQ ID NO: 178088 - DNA, 25 bp, E. coli
tagtcatttgggtgtcgacctcaga

SEQ ID NO: 178089 - DNA, 25 bp, E. coli
gagaaactgagagttcaccggtcaa

SEQ ID NO: 178090 - DNA, 25 bp, E. coli
gagaaactgagacttcaccggtcaa

SEQ ID NO: 178091 - DNA, 25 bp, E. coli
tacacatacaccaggatgaaaacgg

SEQ ID NO: 178092 - DNA, 25 bp, E. coli
tacacatacacctggatgaaaacgg

SEQ ID NO: 178093 - DNA, 25 bp, E. coli
aacttgttgtcaggaagtgcaccgc

SEQ ID NO: 178094 - DNA, 25 bp, E. coli
aaaacggtgagttgtgttcaaactg

SEQ ID NO: 178095 - DNA, 25 bp, E. coli
aaaacggtgagtagtgttcaaactg

SEQ ID NO: 178096 - DNA, 25 bp, E. coli
aacttgttgtcacgaagtgcaccgc

SEQ ID NO: 178097 - DNA, 25 bp, E. coli
ttgtgccggtgtgttagtcattaac

SEQ ID NO: 178098 - DNA, 25 bp, E. coli
ttgtgccggtgtcttagtcattaac

SEQ ID NO: 178099 - DNA, 25 bp, E. coli
ttgctcccaggaagagtgaactcat

SEQ ID NO: 178100 - DNA, 25 bp, E. coli
ttgctcccaggatgagtgaactcat

SEQ ID NO: 178101 - DNA, 25 bp, E. coli
tgcctttatctcatgccacgccaga

SEQ ID NO: 178102 - DNA, 25 bp, E. coli
tgcctttatctcttgccacgccaga

SEQ ID NO: 178103 - DNA, 25 bp, E. coli
gccctctgttgggacaattatttgc

SEQ ID NO: 178104 - DNA, 25 bp, E. coli
gccctctgttggcacaattatttgc

SEQ ID NO: 178105 - DNA, 25 bp, E. coli
gactggacctgccagctatcatagg

SEQ ID NO: 178106 - DNA, 25 bp, E. coli
gactggacctgcgagctatcatagg

SEQ ID NO: 178107 - DNA, 25 bp, E. coli
gttctgattagtttgctttcctggg

SEQ ID NO: 178108 - DNA, 25 bp, E. coli
gttctgattagtatgctttcctggg

SEQ ID NO: 178109 - DNA, 25 bp, E. coli
ggaaagaatatgctatgaaccctta

SEQ ID NO: 178110 - DNA, 25 bp, E. coli
ggaaagaatatggtatgaaccctta

SEQ ID NO: 178111 - DNA, 25 bp, E. coli
gagtgaactcattcgttagcctggg

SEQ ID NO: 178112 - DNA, 25 bp, E. coli
gagtgaactcatacgttagcctggg

SEQ ID NO: 178113 - DNA, 25 bp, E. coli
taaaaatcgatatgcctgtggaact

SEQ ID NO: 178114 - DNA, 25 bp, E. coli
taaaaatcgataagcctgtggaact

SEQ ID NO: 178115 - DNA, 25 bp, E. coli
tataatcgttattctgaagtggctg

SEQ ID NO: 178116 - DNA, 25 bp, E. coli
tataatcgttatactgaagtggctg

SEQ ID NO: 178117 - DNA, 25 bp, E. coli
tgttcgtcttggtgcaggcgtacaa

SEQ ID NO: 178118 - DNA, 25 bp, E. coli
tgttcgtcttggagcaggcgtacaa

SEQ ID NO: 178119 - DNA, 25 bp, E. coli
cctaatccgggctgtaatatccata

SEQ ID NO: 178120 - DNA, 25 bp, E. coli
cctaatccgggcagtaatatccata

SEQ ID NO: 178121 - DNA, 25 bp, E. coli
gcaatatctttgaattacagtcgcg

SEQ ID NO: 178122 - DNA, 25 bp, E. coli
gaatcatatgaaggttctgtggcga

SEQ ID NO: 178123 - DNA, 25 bp, E. coli
gcaatatctttgtattacagtcgcg

SEQ ID NO: 178124 - DNA, 25 bp, E. coli
gaatcatatgaacgttctgtggcga

SEQ ID NO: 178125 - DNA, 25 bp, E. coli
gaaattcatcgtgtctatctaccaa

SEQ ID NO: 178126 - DNA, 25 bp, E. coli
gaaattcatcgtctctatctaccaa

SEQ ID NO: 178127 - DNA, 25 bp, E. coli
gtgactatctctaccctaatccggg

SEQ ID NO: 178128 - DNA, 25 bp, E. coli
gtgactatctcttccctaatccggg

SEQ ID NO: 178129 - DNA, 25 bp, E. coli
ggtattaatgcaaaatcaggtagcg

SEQ ID NO: 178130 - DNA, 25 bp, E. coli
ggtattaatgcataatcaggtagcg

SEQ ID NO: 178131 - DNA, 25 bp, E. coli
tcaattcttccggttctacagggca

SEQ ID NO: 178132 - DNA, 25 bp, E. coli
tcaattcttccgcttctacagggca

SEQ ID NO: 178133 - DNA, 25 bp, E. coli
gagcttatgtgatcaaccactagaa

SEQ ID NO: 178134 - DNA, 25 bp, E. coli
gagcttatgtgaacaaccactagaa

SEQ ID NO: 178135 - DNA, 25 bp, E. coli
catgctctcatccataacagcgaag

SEQ ID NO: 178136 - DNA, 25 bp, E. coli
catgctctcatcgataacagcgaag

SEQ ID NO: 178137 - DNA, 25 bp, E. coli
tacgcacggtaaagagtcggtggca

SEQ ID NO: 178138 - DNA, 25 bp, E. coli
tacgcacggtaatgagtcggtggca

SEQ ID NO: 178139 - DNA, 25 bp, E. coli
tatttacggtgaatgctgcggaagc

SEQ ID NO: 178140 - DNA, 25 bp, E. coli
tatttacggtgattgctgcggaagc

SEQ ID NO: 178141 - DNA, 25 bp, E. coli
tgaacgggtctaaacgggtacgcac

SEQ ID NO: 178142 - DNA, 25 bp, E. coli
tgaacgggtctatacgggtacgcac

SEQ ID NO: 178143 - DNA, 25 bp, E. coli
tgccagatatgtcccagtggagccg

SEQ ID NO: 178144 - DNA, 25 bp, E. coli
tgccagatatgtgccagtggagccg

SEQ ID NO: 178145 - DNA, 25 bp, E. coli
tctgctgcgttaaaccgtggtggga

SEQ ID NO: 178146 - DNA, 25 bp, E. coli
tctgctgcgttataccgtggtggga

SEQ ID NO: 178147 - DNA, 25 bp, E. coli
gccagtgggcatccgtatcaactca

SEQ ID NO: 178148 - DNA, 25 bp, E. coli
gccagtgggcatgcgtatcaactca

SEQ ID NO: 178149 - DNA, 25 bp, E. coli
cattaagtccggtgagcatgctctc

SEQ ID NO: 178150 - DNA, 25 bp, E. coli
cattaagtccggagagcatgctctc

SEQ ID NO: 178151 - DNA, 25 bp, E. coli
gttactgtcaccattaagactgccg

SEQ ID NO: 178152 - DNA, 25 bp, E. coli
gttactgtcacctttaagactgccg

SEQ ID NO: 178153 - DNA, 25 bp, E. coli
ggtactgcaaccctcagcattaagt

SEQ ID NO: 178154 - DNA, 25 bp, E. coli
ggtactgcaaccgtcagcattaagt

SEQ ID NO: 178155 - DNA, 25 bp, E. coli
ttcaacgggtggtctgggtactgca

SEQ ID NO: 178156 - DNA, 25 bp, E. coli
ttcaacgggtggactgggtactgca

SEQ ID NO: 178157 - DNA, 25 bp, E. coli
cattatttgtctggtaacggcgatt

SEQ ID NO: 178158 - DNA, 25 bp, E. coli
tttatatcgggaggtaactctcccg

SEQ ID NO: 178159 - DNA, 25 bp, E. coli
tttatatcgggacgtaactctcccg

SEQ ID NO: 178160 - DNA, 25 bp, E. coli
tgcgtcacacttccgtacagcggga

SEQ ID NO: 178161 - DNA, 25 bp, E. coli
tccgtacagcggcattaattctcca

SEQ ID NO: 178162 - DNA, 25 bp, E. coli
tgcgtcacacttgcgtacagcggga

SEQ ID NO: 178163 - DNA, 25 bp, E. coli
tccgtacagcgggattaattctcca

SEQ ID NO: 178164 - DNA, 25 bp, E. coli
cccgataatcttataaatcatacag

SEQ ID NO: 178165 - DNA, 25 bp, E. coli
cccgataatcttttaaatcatacag

SEQ ID NO: 178166 - DNA, 25 bp, E. coli
cattatttgtctcgtaacggcgatt

SEQ ID NO: 178167 - DNA, 25 bp, E. coli
cgggattaattcaccagtaaatgca

SEQ ID NO: 178168 - DNA, 25 bp, E. coli
cggcgatttgttttgcacgttcata

SEQ ID NO: 178169 - DNA, 25 bp, E. coli
cggcgatttgttatgcacgttcata

SEQ ID NO: 178170 - DNA, 25 bp, E. coli
cgggattaattctccagtaaatgca

SEQ ID NO: 178171 - DNA, 25 bp, E. coli
tgtgtcccctcacaaggtcgacctg

SEQ ID NO: 178172 - DNA, 25 bp, E. coli
tgtgtcccctcagaaggtcgacctg

SEQ ID NO: 178173 - DNA, 25 bp, E. coli
ggaggtaactctcccgataatcttt

SEQ ID NO: 178174 - DNA, 25 bp, E. coli
ggaggtaactctgccgataatcttt

SEQ ID NO: 178175 - DNA, 25 bp, E. coli
tcaatttttcttagtgtcccctcac

SEQ ID NO: 178176 - DNA, 25 bp, E. coli
tcaatttttctttgtgtcccctcac

SEQ ID NO: 178177 - DNA, 25 bp, E. coli
tcacaaggtcgacctgcgtcacact

SEQ ID NO: 178178 - DNA, 25 bp, E. coli
tcacaaggtcgagctgcgtcacact

SEQ ID NO: 178179 - DNA, 25 bp, E. coli
acaaggcagttccatgatcatgaag

SEQ ID NO: 178180 - DNA, 25 bp, E. coli
acaaggcagttcgatgatcatgaag

SEQ ID NO: 178181 - DNA, 25 bp, E. coli
tattctggctgtctgtggcaacgga

SEQ ID NO: 178182 - DNA, 25 bp, E. coli
tattctggctgtgtgtggcaacgga

SEQ ID NO: 178183 - DNA, 25 bp, E. coli
tgtgtggcaacgcacaaggcagttc

SEQ ID NO: 178184 - DNA, 25 bp, E. coli
tgtgtggcaacggacaaggcagttc

SEQ ID NO: 178185 - DNA, 25 bp, E. coli
tgaccgtacgtaatctggctgtgtg

SEQ ID NO: 178186 - DNA, 25 bp, E. coli
tgaccgtacgtattctggctgtgtg

SEQ ID NO: 178187 - DNA, 25 bp, E. coli
tcatgaagatgatagtggaccagtt

SEQ ID NO: 178188 - DNA, 25 bp, E. coli
tctacgcacattccgggcgaaatca

SEQ ID NO: 178189 - DNA, 25 bp, E. coli
tcatcgcttctaggcacattgcggg

SEQ ID NO: 178190 - DNA, 25 bp, E. coli
tcatgaagatgaaagtggaccagtt

SEQ ID NO: 178191 - DNA, 25 bp, E. coli
tctacgcacattgcgggcgaaatca

SEQ ID NO: 178192 - DNA, 25 bp, E. coli
tcatcgcttctacgcacattgcggg

SEQ ID NO: 178193 - DNA, 25 bp, E. coli
gactttggcccgtaactgctggaag

SEQ ID NO: 178194 - DNA, 25 bp, E. coli
gactttggcccgaaactgctggaag

SEQ ID NO: 178195 - DNA, 25 bp, E. coli
gaaatcaccgtgtccggcaacaaat

SEQ ID NO: 178196 - DNA, 25 bp, E. coli
gaaatcaccgtgaccggcaacaaat

SEQ ID NO: 178197 - DNA, 25 bp, E. coli
ggttggcgtgcggaacatgctctct

SEQ ID NO: 178198 - DNA, 25 bp, E. coli
ggttggcgtgcgcaacatgctctct

SEQ ID NO: 178199 - DNA, 25 bp, E. coli
ggcgcggatatcttcatcgcttcta

SEQ ID NO: 178200 - DNA, 25 bp, E. coli
ggcgcggatatcatcatcgcttcta

SEQ ID NO: 178201 - DNA, 25 bp, E. coli
caatactgttttgcgggtgatcgac

SEQ ID NO: 178202 - DNA, 25 bp, E. coli
aaccagtatttctcatgagtccgcg

SEQ ID NO: 178203 - DNA, 25 bp, E. coli
caatactgttttccgggtgatcgac

SEQ ID NO: 178204 - DNA, 25 bp, E. coli
agtgtcccagcctgtttatctacgg

SEQ ID NO: 178205 - DNA, 25 bp, E. coli
agtgtcccagccagtttatctacgg

SEQ ID NO: 178206 - DNA, 25 bp, E. coli
aaccagtatttcacatgagtccgcg

SEQ ID NO: 178207 - DNA, 25 bp, E. coli
taggttgcgcgacattatagagatc

SEQ ID NO: 178208 - DNA, 25 bp, E. coli
taggttgcgcgagattatagagatc

SEQ ID NO: 178209 - DNA, 25 bp, E. coli
ttctcaaacatatctcgcaagcctg

SEQ ID NO: 178210 - DNA, 25 bp, E. coli
ttctcaaacataactcgcaagcctg

SEQ ID NO: 178211 - DNA, 25 bp, E. coli
tctacggcttaataagtgttcgagg

SEQ ID NO: 178212 - DNA, 25 bp, E. coli
tctacggcttaaaaagtgttcgagg

SEQ ID NO: 178213 - DNA, 25 bp, E. coli
cctgacgcgggataaagtggtattc

SEQ ID NO: 178214 - DNA, 25 bp, E. coli
cctgacgcgggaaaaagtggtattc

SEQ ID NO: 178215 - DNA, 25 bp, E. coli
gctaaccctgtgacctgcaatactg

SEQ ID NO: 178216 - DNA, 25 bp, E. coli
gctaaccctgtgtcctgcaatactg

SEQ ID NO: 178217 - DNA, 25 bp, E. coli
gcaagcctgtcttgtgttgacaaca

SEQ ID NO: 178218 - DNA, 25 bp, E. coli
gcaagcctgtctagtgttgacaaca

SEQ ID NO: 178219 - DNA, 25 bp, E. coli
cgggtgatcgactaggagacttaac

SEQ ID NO: 178220 - DNA, 25 bp, E. coli
cgggtgatcgacaaggagacttaac

SEQ ID NO: 178221 - DNA, 25 bp, E. coli
gagatctggcgctctaaaaaccagt

SEQ ID NO: 178222 - DNA, 25 bp, E. coli
gagatctggcgcactaaaaaccagt

SEQ ID NO: 178223 - DNA, 25 bp, E. coli
cagggtgccgctcgagaatatcgaa

SEQ ID NO: 178224 - DNA, 25 bp, E. coli
cagggtgccgctggagaatatcgaa

SEQ ID NO: 178225 - DNA, 25 bp, E. coli
ttcctcatttggtttcgttactcag

SEQ ID NO: 178226 - DNA, 25 bp, E. coli
ttcctcatttggattcgttactcag

SEQ ID NO: 178227 - DNA, 25 bp, E. coli
actcagtccgctgggcgtgctggca

SEQ ID NO: 178228 - DNA, 25 bp, E. coli
actcagtccgctcggcgtgctggca

SEQ ID NO: 178229 - DNA, 25 bp, E. coli
tatcgaatacattgccgatcttggc

SEQ ID NO: 178230 - DNA, 25 bp, E. coli
tatcgaatacatagccgatcttggc

SEQ ID NO: 178231 - DNA, 25 bp, E. coli
tcccctccaggagaacggacagata

SEQ ID NO: 178232 - DNA, 25 bp, E. coli
tcccctccaggacaacggacagata

SEQ ID NO: 178233 - DNA, 25 bp, E. coli
ccaggagaacggacagatattgctg

SEQ ID NO: 178234 - DNA, 25 bp, E. coli
ccaggagaacggtcagatattgctg

SEQ ID NO: 178235 - DNA, 25 bp, E. coli
cctgtttgtggatgcagatatccgc

SEQ ID NO: 178236 - DNA, 25 bp, E. coli
gccgctggagaaaatcgaatacatt

SEQ ID NO: 178237 - DNA, 25 bp, E. coli
gccgctggagaatatcgaatacatt

SEQ ID NO: 178238 - DNA, 25 bp, E. coli
cctgtttgtggaagcagatatccgc

SEQ ID NO: 178239 - DNA, 25 bp, E. coli
gaagagcaatatgccctccaggaga

SEQ ID NO: 178240 - DNA, 25 bp, E. coli
gaagagcaatatcccctccaggaga

SEQ ID NO: 178241 - DNA, 25 bp, E. coli
gtttcgttactcagtccgctgggcg

SEQ ID NO: 178242 - DNA, 25 bp, E. coli
gtttcgttactctgtccgctgggcg

SEQ ID NO: 178243 - DNA, 25 bp, E. coli
gatgctggaagaccaatatcccctc

SEQ ID NO: 178244 - DNA, 25 bp, E. coli
gatgctggaagagcaatatcccctc

SEQ ID NO: 178245 - DNA, 25 bp, E. coli
caacgcggatatcttgatcttacgg

SEQ ID NO: 178246 - DNA, 25 bp, E. coli
caacgcggatatgttgatcttacgg

SEQ ID NO: 178247 - DNA, 25 bp, E. coli
catcgcgagcgagaaaaattgttca

SEQ ID NO: 178248 - DNA, 25 bp, E. coli
catcgcgagcgacaaaaattgttca

SEQ ID NO: 178249 - DNA, 25 bp, E. coli
tacgtgttgcaatcgtccaacgcgg

SEQ ID NO: 178250 - DNA, 25 bp, E. coli
tacgtgttgcaaacgtccaacgcgg

SEQ ID NO: 178251 - DNA, 25 bp, E. coli
actgggatacagacgggagaactac

SEQ ID NO: 178252 - DNA, 25 bp, E. coli
actgggatacagtcgggagaactac

SEQ ID NO: 178253 - DNA, 25 bp, E. coli
aaagaatcatatgcaatccgcccag

SEQ ID NO: 178254 - DNA, 25 bp, E. coli
aaagaattaatgaccctctgcgacc

SEQ ID NO: 178255 - DNA, 25 bp, E. coli
aaagaattaatgtccctctgcgacc

SEQ ID NO: 178256 - DNA, 25 bp, E. coli
aaagaatcatatccaatccgcccag

SEQ ID NO: 178257 - DNA, 25 bp, E. coli
tttattgataacagaaggcggcgac

SEQ ID NO: 178258 - DNA, 25 bp, E. coli
tttattgataactgaaggcggcgac

SEQ ID NO: 178259 - DNA, 25 bp, E. coli
tctttcagcgaaagatgccccatcg

SEQ ID NO: 178260 - DNA, 25 bp, E. coli
tctttcagcgaatgatgccccatcg

SEQ ID NO: 178261 - DNA, 25 bp, E. coli
gaattgcgcaggaaaaagctcaact

SEQ ID NO: 178262 - DNA, 25 bp, E. coli
gaattgcgcaggtaaaagctcaact

SEQ ID NO: 178263 - DNA, 25 bp, E. coli
gaaatactacctgaaccgatcgcta

SEQ ID NO: 178264 - DNA, 25 bp, E. coli
gaaatactacctcaaccgatcgcta

SEQ ID NO: 178265 - DNA, 25 bp, E. coli
ggaacaagttcggatcgcaaacaaa

SEQ ID NO: 178266 - DNA, 25 bp, E. coli
ggaacaagttcgcatcgcaaacaaa

SEQ ID NO: 178267 - DNA, 25 bp, E. coli
aattgagaacgataagctgcgccgg

SEQ ID NO: 178268 - DNA, 25 bp, E. coli
aattgagaacgaaaagctgcgccgg

SEQ ID NO: 178269 - DNA, 25 bp, E. coli
tatgccgaaagggatgctgaaattg

SEQ ID NO: 178270 - DNA, 25 bp, E. coli
tatccgtaccattcagaactggcag

SEQ ID NO: 178271 - DNA, 25 bp, E. coli
tatgccgaaaggcatgctgaaattg

SEQ ID NO: 178272 - DNA, 25 bp, E. coli
tatccgtaccatacagaactggcag

SEQ ID NO: 178273 - DNA, 25 bp, E. coli
ttgagaacgaaatgctgcgccggga

SEQ ID NO: 178274 - DNA, 25 bp, E. coli
ttgagaacgaaaagctgcgccggga

SEQ ID NO: 178275 - DNA, 25 bp, E. coli
tccgtaccattcagaactggcagga

SEQ ID NO: 178276 - DNA, 25 bp, E. coli
tccgtaccattctgaactggcagga

SEQ ID NO: 178277 - DNA, 25 bp, E. coli
gcgagtatccgttccattcagaact

SEQ ID NO: 178278 - DNA, 25 bp, E. coli
gcgagtatccgtaccattcagaact

SEQ ID NO: 178279 - DNA, 25 bp, E. coli
gaagtcaacaaaaagcagctggctg

SEQ ID NO: 178280 - DNA, 25 bp, E. coli
gaagtcaacaaatagcagctggctg

SEQ ID NO: 178281 - DNA, 25 bp, E. coli
gaaattgagaaccaaaagctgcgcc

SEQ ID NO: 178282 - DNA, 25 bp, E. coli
gaaattgagaacgaaaagctgcgcc

SEQ ID NO: 178283 - DNA, 25 bp, E. coli
cgaaagggatgctgaaattgagaac

SEQ ID NO: 178284 - DNA, 25 bp, E. coli
cgaaagggatgcagaaattgagaac

SEQ ID NO: 178285 - DNA, 25 bp, E. coli
tggtatgccgaaagggatgctgaaa

SEQ ID NO: 178286 - DNA, 25 bp, E. coli
tggtatgccgaatgggatgctgaaa

SEQ ID NO: 178287 - DNA, 25 bp, E. coli
tggaagtcaacaaaaagcagctggc

SEQ ID NO: 178288 - DNA, 25 bp, E. coli
tggaagtcaacataaagcagctggc

SEQ ID NO: 178289 - DNA, 25 bp, E. coli
caaaacctgacgctgtgcaataacg

SEQ ID NO: 178290 - DNA, 25 bp, E. coli
caaaacctgacggtgtgcaataacg

SEQ ID NO: 178291 - DNA, 25 bp, E. coli
taaattttaccggagcagcggcgcg

SEQ ID NO: 178292 - DNA, 25 bp, E. coli
taaattttaccgcagcagcggcgcg

SEQ ID NO: 178293 - DNA, 25 bp, E. coli
tacactgctggcctgggatcttctg

SEQ ID NO: 178294 - DNA, 25 bp, E. coli
tacactgctggcgtgggatcttctg

SEQ ID NO: 178295 - DNA, 25 bp, E. coli
tacgcgaaaaacacacaccactgga

SEQ ID NO: 178296 - DNA, 25 bp, E. coli
tacgcgaaaaactcacaccactgga

SEQ ID NO: 178297 - DNA, 25 bp, E. coli
ttatcccgaagaagaaacctgccac

SEQ ID NO: 178298 - DNA, 25 bp, E. coli
ttatcccgaagatgaaacctgccac

SEQ ID NO: 178299 - DNA, 25 bp, E. coli
tgattgagcgtcagcacgtggccaa

SEQ ID NO: 178300 - DNA, 25 bp, E. coli
tgattgagcgtctgcacgtggccaa

SEQ ID NO: 178301 - DNA, 25 bp, E. coli
tgcaataacgcatcgctggagtggt

SEQ ID NO: 178302 - DNA, 25 bp, E. coli
tgcaataacgcaacgctggagtggt

SEQ ID NO: 178303 - DNA, 25 bp, E. coli
tcatcggagaaaccttcagccacgg

SEQ ID NO: 178304 - DNA, 25 bp, E. coli
tcatcggagaaagcttcagccacgg

SEQ ID NO: 178305 - DNA, 25 bp, E. coli
gatcttctgtgcgttggacgtccgg

SEQ ID NO: 178306 - DNA, 25 bp, E. coli
ggagaacttaccagcgttgcccgga

SEQ ID NO: 178307 - DNA, 25 bp, E. coli
ggagaacttacctgcgttgcccgga

SEQ ID NO: 178308 - DNA, 25 bp, E. coli
taaccgtctggacatatgggtcgac

SEQ ID NO: 178309 - DNA, 25 bp, E. coli
taaccgtctggagatatgggtcgac

SEQ ID NO: 178310 - DNA, 25 bp, E. coli
gatcttctgtgccttggacgtccgg

SEQ ID NO: 178311 - DNA, 25 bp, E. coli
cagcagatggctgggtgaccaacct

SEQ ID NO: 178312 - DNA, 25 bp, E. coli
cagcagatggctcggtgaccaacct

SEQ ID NO: 178313 - DNA, 25 bp, E. coli
tattcgtctcgagaaccagcaagag

SEQ ID NO: 178314 - DNA, 25 bp, E. coli
tattcgtctcgacaaccagcaagag

SEQ ID NO: 178315 - DNA, 25 bp, E. coli
tcaacggcggttccgctggtgaaac

SEQ ID NO: 178316 - DNA, 25 bp, E. coli
tcaacggcggttgcgctggtgaaac

SEQ ID NO: 178317 - DNA, 25 bp, E. coli
tctcggtgtgcacgcgatgtctcgc

SEQ ID NO: 178318 - DNA, 25 bp, E. coli
tctcggtgtgcaggcgatgtctcgc

SEQ ID NO: 178319 - DNA, 25 bp, E. coli
gcgccggacgtttctggactcatta

SEQ ID NO: 178320 - DNA, 25 bp, E. coli
gcgccggacgttactggactcatta

SEQ ID NO: 178321 - DNA, 25 bp, E. coli
taatgcctgggtctattacaccgaa

SEQ ID NO: 178322 - DNA, 25 bp, E. coli
taagaaaattctcccgtacggccat

SEQ ID NO: 178323 - DNA, 25 bp, E. coli
taaccagctggtgaaaaaaggacag

SEQ ID NO: 178324 - DNA, 25 bp, E. coli
taatgcctgggtgtattacaccgaa

SEQ ID NO: 178325 - DNA, 25 bp, E. coli
taaccagctggtcaaaaaaggacag

SEQ ID NO: 178326 - DNA, 25 bp, E. coli
taagaaaattctgccgtacggccat

SEQ ID NO: 178327 - DNA, 25 bp, E. coli
gacccgcgatctggcaaaactggat

SEQ ID NO: 178328 - DNA, 25 bp, E. coli
gatgtctcgcgatgagatcgaccag

SEQ ID NO: 178329 - DNA, 25 bp, E. coli
gatgtctcgcgaagagatcgaccag

SEQ ID NO: 178330 - DNA, 25 bp, E. coli
gagatcacgccgcttggcagtaaca

SEQ ID NO: 178331 - DNA, 25 bp, E. coli
gacccgcgatctcgcaaaactggat

SEQ ID NO: 178332 - DNA, 25 bp, E. coli
gagatcacgccggttggcagtaaca

SEQ ID NO: 178333 - DNA, 25 bp, E. coli
agaagcagcgttaattgcctgcgag

SEQ ID NO: 178334 - DNA, 25 bp, E. coli
agaagcagcgtttattgcctgcgag

SEQ ID NO: 178335 - DNA, 25 bp, E. coli
acaagcagaagcagcgttaattgcc

SEQ ID NO: 178336 - DNA, 25 bp, E. coli
acaagcagaagctgcgttaattgcc

SEQ ID NO: 178337 - DNA, 25 bp, E. coli
tttgaaaaacatcggattaaccgcg

SEQ ID NO: 178338 - DNA, 25 bp, E. coli
tattacgccggtggttggggctgaa

SEQ ID NO: 178339 - DNA, 25 bp, E. coli
tttgaaaaacatgggattaaccgcg

SEQ ID NO: 178340 - DNA, 25 bp, E. coli
tattacgccggtcgttggggctgaa

SEQ ID NO: 178341 - DNA, 25 bp, E. coli
tgatttgaaaaacatcggattaacc

SEQ ID NO: 178342 - DNA, 25 bp, E. coli
tgatttgaaaaagatcggattaacc

SEQ ID NO: 178343 - DNA, 25 bp, E. coli
tctggtagttggattaattgctggc

SEQ ID NO: 178344 - DNA, 25 bp, E. coli
tctggtagttggtttaattgctggc

SEQ ID NO: 178345 - DNA, 25 bp, E. coli
gcagaagcagcgttaattgcctgcg

SEQ ID NO: 178346 - DNA, 25 bp, E. coli
gcagaagcagcgataattgcctgcg

SEQ ID NO: 178347 - DNA, 25 bp, E. coli
ccgggtctggtacttggattaattg

SEQ ID NO: 178348 - DNA, 25 bp, E. coli
ccgggtctggtagttggattaattg

SEQ ID NO: 178349 - DNA, 25 bp, E. coli
cggtgttaatgatttgaaaaacatc

SEQ ID NO: 178350 - DNA, 25 bp, E. coli
cggtgttaatgaattgaaaaacatc

SEQ ID NO: 178351 - DNA, 25 bp, E. coli
ctgaagtggtcaccggttcttcgcg

SEQ ID NO: 178352 - DNA, 25 bp, E. coli
ctgaagtggtcagcggttcttcgcg

SEQ ID NO: 178353 - DNA, 25 bp, E. coli
gggctgaagtggtcaccggttcttc

SEQ ID NO: 178354 - DNA, 25 bp, E. coli
gggctgaagtggacaccggttcttc

SEQ ID NO: 178355 - DNA, 25 bp, E. coli
aatgctttgcgtagcgacactgatg

SEQ ID NO: 178356 - DNA, 25 bp, E. coli
aatgctttgcgttgcgacactgatg

SEQ ID NO: 178357 - DNA, 25 bp, E. coli
catgcaacgggctatttgacgggcg

SEQ ID NO: 178358 - DNA, 25 bp, E. coli
catgcaacgggcaatttgacgggcg

SEQ ID NO: 178359 - DNA, 25 bp, E. coli
tttccatgacaataacgacagcctg

SEQ ID NO: 178360 - DNA, 25 bp, E. coli
tttgcgccaaatagccatgcaacgg

SEQ ID NO: 178361 - DNA, 25 bp, E. coli
ttgaagcagtgggaagacctgacac

SEQ ID NO: 178362 - DNA, 25 bp, E. coli
ttgaagcagtggcaagacctgacac

SEQ ID NO: 178363 - DNA, 25 bp, E. coli
tttgcgccaaattgccatgcaacgg

SEQ ID NO: 178364 - DNA, 25 bp, E. coli
tttccatgacaaaaacgacagcctg

SEQ ID NO: 178365 - DNA, 25 bp, E. coli
tgacgggcgtaatagtttgaagcag

SEQ ID NO: 178366 - DNA, 25 bp, E. coli
tgacgggcgtaaaagtttgaagcag

SEQ ID NO: 178367 - DNA, 25 bp, E. coli
tccgattgatgtggaatgctttgcg

SEQ ID NO: 178368 - DNA, 25 bp, E. coli
tccgattgatgtcgaatgctttgcg

SEQ ID NO: 178369 - DNA, 25 bp, E. coli
gaacggcgaactaaatgcgatcttt

SEQ ID NO: 178370 - DNA, 25 bp, E. coli
gaacggcgaacttaatgcgatcttt

SEQ ID NO: 178371 - DNA, 25 bp, E. coli
gtcagtagatagtattttgcgccaa

SEQ ID NO: 178372 - DNA, 25 bp, E. coli
gtcagtagatagaattttgcgccaa

SEQ ID NO: 178373 - DNA, 25 bp, E. coli
tcacataagtgaggatgaacggcga

SEQ ID NO: 178374 - DNA, 25 bp, E. coli
tcacataagtgacgatgaacggcga

SEQ ID NO: 178375 - DNA, 25 bp, E. coli
gacctgacacagaggattccgattg

SEQ ID NO: 178376 - DNA, 25 bp, E. coli
gacctgacacagtggattccgattg

SEQ ID NO: 178377 - DNA, 25 bp, E. coli
caatgaatgcggctaagtctacagc

SEQ ID NO: 178378 - DNA, 25 bp, E. coli
caatgaatgcgggtaagtctacagc

SEQ ID NO: 178379 - DNA, 25 bp, E. coli
catgcgcactgtggtatatacggca

SEQ ID NO: 178380 - DNA, 25 bp, E. coli
catgcgcactgtcgtatatacggca

SEQ ID NO: 178381 - DNA, 25 bp, E. coli
tacaattaccagcaacgcggcatgc

SEQ ID NO: 178382 - DNA, 25 bp, E. coli
tacaattaccaggaacgcggcatgc

SEQ ID NO: 178383 - DNA, 25 bp, E. coli
tatacggcagaaattgatgatcgct

SEQ ID NO: 178384 - DNA, 25 bp, E. coli
tatacggcagaatttgatgatcgct

SEQ ID NO: 178385 - DNA, 25 bp, E. coli
tgatgatcgcttaggtgccgggaaa

SEQ ID NO: 178386 - DNA, 25 bp, E. coli
tgatgatcgctttggtgccgggaaa

SEQ ID NO: 178387 - DNA, 25 bp, E. coli
tgtggccgtaaagcaagcatggtgc

SEQ ID NO: 178388 - DNA, 25 bp, E. coli
tgtggccgtaaaccaagcatggtgc

SEQ ID NO: 178389 - DNA, 25 bp, E. coli
tgcgtcttgatcaagcaggcagacc

SEQ ID NO: 178390 - DNA, 25 bp, E. coli
tgcgtcttgatctagcaggcagacc

SEQ ID NO: 178391 - DNA, 25 bp, E. coli
tgccgggaaagtgagttcgcgtata

SEQ ID NO: 178392 - DNA, 25 bp, E. coli
tgccgggaaagtcagttcgcgtata

SEQ ID NO: 178393 - DNA, 25 bp, E. coli
gcgtataggtttgtcatcgcctgca

SEQ ID NO: 178394 - DNA, 25 bp, E. coli
gcgtataggtttctcatcgcctgca

SEQ ID NO: 178395 - DNA, 25 bp, E. coli
cattatttgatgtgattcgtgcgga

SEQ ID NO: 178396 - DNA, 25 bp, E. coli
cattatttgatgagattcgtgcgga

SEQ ID NO: 178397 - DNA, 25 bp, E. coli
taacggctattcaggaaaggcatcg

SEQ ID NO: 178398 - DNA, 25 bp, E. coli
taacggctattctggaaaggcatcg

SEQ ID NO: 178399 - DNA, 25 bp, E. coli
caatagttgagctgttacgtcgtct

SEQ ID NO: 178400 - DNA, 25 bp, E. coli
caacgtcggcacgtgcttcagtgga

SEQ ID NO: 178401 - DNA, 25 bp, E. coli
caatagttgagcagttacgtcgtct

SEQ ID NO: 178402 - DNA, 25 bp, E. coli
caacgtcggcacctgcttcagtgga

SEQ ID NO: 178403 - DNA, 25 bp, E. coli
cagcgtgaacacgtactggcgacac

SEQ ID NO: 178404 - DNA, 25 bp, E. coli
cagcgtgaacacctactggcgacac

SEQ ID NO: 178405 - DNA, 25 bp, E. coli
cagtaagtatgagaaaccggcgggt

SEQ ID NO: 178406 - DNA, 25 bp, E. coli
cagtaagtatgacaaaccggcgggt

SEQ ID NO: 178407 - DNA, 25 bp, E. coli
tgaagctgatcctgccttttccgcc

SEQ ID NO: 178408 - DNA, 25 bp, E. coli
tgaagctgatccagccttttccgcc

SEQ ID NO: 178409 - DNA, 25 bp, E. coli
tctggacaactaaaacaaggcgctg

SEQ ID NO: 178410 - DNA, 25 bp, E. coli
tctggacaactataacaaggcgctg

SEQ ID NO: 178411 - DNA, 25 bp, E. coli
gcgaaaattccacagcgcggcgtgc

SEQ ID NO: 178412 - DNA, 25 bp, E. coli
gcgaaaattccagagcgcggcgtgc

SEQ ID NO: 178413 - DNA, 25 bp, E. coli
ccggaagggaagctcgagatcacta

SEQ ID NO: 178414 - DNA, 25 bp, E. coli
ccggaagggaaggtcgagatcacta

SEQ ID NO: 178415 - DNA, 25 bp, E. coli
ctggtaagagccagataagcgcggc

SEQ ID NO: 178416 - DNA, 25 bp, E. coli
ctggtaagagcctgataagcgcggc

SEQ ID NO: 178417 - DNA, 25 bp, E. coli
ggataaccggatccgcgatctggac

SEQ ID NO: 178418 - DNA, 25 bp, E. coli
ggataaccggatgcgcgatctggac

SEQ ID NO: 178419 - DNA, 25 bp, E. coli
gagatcgtgttgtttcctccggata

SEQ ID NO: 178420 - DNA, 25 bp, E. coli
gagatcgtgttgattcctccggata

SEQ ID NO: 178421 - DNA, 25 bp, E. coli
caatgatctggccaatggtgacatc

SEQ ID NO: 178422 - DNA, 25 bp, E. coli
caatgatctggcgaatggtgacatc

SEQ ID NO: 178423 - DNA, 25 bp, E. coli
catctgtgtcgcaattggctgggcg

SEQ ID NO: 178424 - DNA, 25 bp, E. coli
catctgtgtcgctattggctgggcg

SEQ ID NO: 178425 - DNA, 25 bp, E. coli
tacatcaatgatgtggcgaatggtg

SEQ ID NO: 178426 - DNA, 25 bp, E. coli
tacatcaatgatctggcgaatggtg

SEQ ID NO: 178427 - DNA, 25 bp, E. coli
tgacatctgtgtggctattggctgg

SEQ ID NO: 178428 - DNA, 25 bp, E. coli
tgacatctgtgtcgctattggctgg

SEQ ID NO: 178429 - DNA, 25 bp, E. coli
tcgctattggctcggcgggcgatgt

SEQ ID NO: 178430 - DNA, 25 bp, E. coli
tcgctattggctgggcgggcgatgt

SEQ ID NO: 178431 - DNA, 25 bp, E. coli
tctggcgaatggagacatctgtgtc

SEQ ID NO: 178432 - DNA, 25 bp, E. coli
tctggcgaatggtgacatctgtgtc

SEQ ID NO: 178433 - DNA, 25 bp, E. coli
tcatcccaatacttcaatgatctgg

SEQ ID NO: 178434 - DNA, 25 bp, E. coli
tagtgagcagtggaggccgggagag

SEQ ID NO: 178435 - DNA, 25 bp, E. coli
tcatcccaatacatcaatgatctgg

SEQ ID NO: 178436 - DNA, 25 bp, E. coli
tagtgagcagtgcaggccgggagag

SEQ ID NO: 178437 - DNA, 25 bp, E. coli
cgaatggtgacaactgtgtcgctat

SEQ ID NO: 178438 - DNA, 25 bp, E. coli
cgaatggtgacatctgtgtcgctat

SEQ ID NO: 178439 - DNA, 25 bp, E. coli
ggctctgatggctgtctctgtcagc

SEQ ID NO: 178440 - DNA, 25 bp, E. coli
ggaaagagatatcaccgccttaaat

SEQ ID NO: 178441 - DNA, 25 bp, E. coli
ggaaagagatatgaccgccttaaat

SEQ ID NO: 178442 - DNA, 25 bp, E. coli
ggctctgatggcagtctctgtcagc

SEQ ID NO: 178443 - DNA, 25 bp, E. coli
caaccagtatgccaaaacgacaccg

SEQ ID NO: 178444 - DNA, 25 bp, E. coli
caaccagtatgcgaaaacgacaccg

SEQ ID NO: 178445 - DNA, 25 bp, E. coli
tttggccgttttttctactcgtccg

SEQ ID NO: 178446 - DNA, 25 bp, E. coli
tttggccgttttatctactcgtccg

SEQ ID NO: 178447 - DNA, 25 bp, E. coli
ttttatctactcctccgtcggtgcc

SEQ ID NO: 178448 - DNA, 25 bp, E. coli
ttttatctactcgtccgtcggtgcc

SEQ ID NO: 178449 - DNA, 25 bp, E. coli
tgcgaaaacgacaccgatttaacag

SEQ ID NO: 178450 - DNA, 25 bp, E. coli
tgcgaaaacgactccgatttaacag

SEQ ID NO: 178451 - DNA, 25 bp, E. coli
tcagctttatctacttctttggccg

SEQ ID NO: 178452 - DNA, 25 bp, E. coli
tcagctttatcttcttctttggccg

SEQ ID NO: 178453 - DNA, 25 bp, E. coli
cgatttaacagtcgcatgacccgta

SEQ ID NO: 178454 - DNA, 25 bp, E. coli
cgatttaacagtggcatgacccgta

SEQ ID NO: 178455 - DNA, 25 bp, E. coli
cgcatgacccgtttcgtactgctca

SEQ ID NO: 178456 - DNA, 25 bp, E. coli
cgcatgacccgtatcgtactgctca

SEQ ID NO: 178457 - DNA, 25 bp, E. coli
cgtatcgtactggtcatcagcttta

SEQ ID NO: 178458 - DNA, 25 bp, E. coli
cgtatcgtactgctcatcagcttta

SEQ ID NO: 178459 - DNA, 25 bp, E. coli
gtccgtcggtgcgtggcagcaccat

SEQ ID NO: 178460 - DNA, 25 bp, E. coli
gtccgtcggtgcctggcagcaccat

SEQ ID NO: 178461 - DNA, 25 bp, E. coli
gtgagtcaggcatccagtatgcgaa

SEQ ID NO: 178462 - DNA, 25 bp, E. coli
gtgagtcaggcaaccagtatgcgaa

SEQ ID NO: 178463 - DNA, 25 bp, E. coli
tggcagcaccatgagagcaaaaaag

SEQ ID NO: 178464 - DNA, 25 bp, E. coli
tggcagcaccatcagagcaaaaaag

SEQ ID NO: 178465 - DNA, 25 bp, E. coli
tgattgccataatgggatagcgcac

SEQ ID NO: 178466 - DNA, 25 bp, E. coli
tgattgccataaagggatagcgcac

SEQ ID NO: 178467 - DNA, 25 bp, E. coli
tgggaaattctgtccgtaagcctgg

SEQ ID NO: 178468 - DNA, 25 bp, E. coli
tgcactacaacatccgtagcggcgt

SEQ ID NO: 178469 - DNA, 25 bp, E. coli
tgcactacaacaaccgtagcggcgt

SEQ ID NO: 178470 - DNA, 25 bp, E. coli
gcctgtggaaatcgtggcgtacccc

SEQ ID NO: 178471 - DNA, 25 bp, E. coli
gcctgtggaaatggtggcgtacccc

SEQ ID NO: 178472 - DNA, 25 bp, E. coli
gaagagttctgcattagctgccacg

SEQ ID NO: 178473 - DNA, 25 bp, E. coli
gaagagttctgctttagctgccacg

SEQ ID NO: 178474 - DNA, 25 bp, E. coli
cgcaggagtgccctaactgtcacaa

SEQ ID NO: 178475 - DNA, 25 bp, E. coli
cgcaggagtgccgtaactgtcacaa

SEQ ID NO: 178476 - DNA, 25 bp, E. coli
gttgccgcgaagttgcatgaccagg

SEQ ID NO: 178477 - DNA, 25 bp, E. coli
gattgtcacgttccgcacgagtttg

SEQ ID NO: 178478 - DNA, 25 bp, E. coli
gattgtcacgttgcgcacgagtttg

SEQ ID NO: 178479 - DNA, 25 bp, E. coli
gttgccgcgaagatgcatgaccagg

SEQ ID NO: 178480 - DNA, 25 bp, E. coli
tggcggcgcatgaaggacaataact

SEQ ID NO: 178481 - DNA, 25 bp, E. coli
tgggaaattctgaccgtaagcctgg

SEQ ID NO: 178482 - DNA, 25 bp, E. coli
tggcggcgcatgtaggacaataact

SEQ ID NO: 178483 - DNA, 25 bp, E. coli
taagcctggtctgattaagcgcctg

SEQ ID NO: 178484 - DNA, 25 bp, E. coli
taagcctggtctcattaagcgcctg

SEQ ID NO: 178485 - DNA, 25 bp, E. coli
gagtatatggattcaaccgcccaga

SEQ ID NO: 178486 - DNA, 25 bp, E. coli
gagtatatggatacaaccgcccaga

SEQ ID NO: 178487 - DNA, 25 bp, E. coli
tacccgattggtgcggtcttggcga

SEQ ID NO: 178488 - DNA, 25 bp, E. coli
aaaaaatgccaagcgacacgagact

SEQ ID NO: 178489 - DNA, 25 bp, E. coli
aaaaaatgccaaccgacacgagact

SEQ ID NO: 178490 - DNA, 25 bp, E. coli
tacctgggcatgttgaaacaattcc

SEQ ID NO: 178491 - DNA, 25 bp, E. coli
tacccgattggtccggtcttggcga

SEQ ID NO: 178492 - DNA, 25 bp, E. coli
tacctgggcatgatgaaacaattcc

SEQ ID NO: 178493 - DNA, 25 bp, E. coli
tatatgctgtgacgataatctaccg

SEQ ID NO: 178494 - DNA, 25 bp, E. coli
tatatgctgtgaggataatctaccg

SEQ ID NO: 178495 - DNA, 25 bp, E. coli
tgagtgaaacgcttgcaatccattc

SEQ ID NO: 178496 - DNA, 25 bp, E. coli
tgagtgaaacgcatgcaatccattc

SEQ ID NO: 178497 - DNA, 25 bp, E. coli
taatctaccgccgaggcaaaacgag

SEQ ID NO: 178498 - DNA, 25 bp, E. coli
taatctaccgcccaggcaaaacgag

SEQ ID NO: 178499 - DNA, 25 bp, E. coli
gcacggtgcgcatcatcaggattat

SEQ ID NO: 178500 - DNA, 25 bp, E. coli
gcaaaacgagttcgagattacccga

SEQ ID NO: 178501 - DNA, 25 bp, E. coli
gcacggtgcgcaacatcaggattat

SEQ ID NO: 178502 - DNA, 25 bp, E. coli
gcaaaacgagttggagattacccga

SEQ ID NO: 178503 - DNA, 25 bp, E. coli
gacacgagactatttacctgggcat

SEQ ID NO: 178504 - DNA, 25 bp, E. coli
gacacgagactaattacctgggcat

SEQ ID NO: 178505 - DNA, 25 bp, E. coli
cgttcgatagatgaaagcacggtgc

SEQ ID NO: 178506 - DNA, 25 bp, E. coli
cgttcgatagatcaaagcacggtgc

SEQ ID NO: 178507 - DNA, 25 bp, E. coli
taaggccaaatcagtggactaacgc

SEQ ID NO: 178508 - DNA, 25 bp, E. coli
taaggccaaatctgtggactaacgc

SEQ ID NO: 178509 - DNA, 25 bp, E. coli
caagccacgctatctgaaggagcca

SEQ ID NO: 178510 - DNA, 25 bp, E. coli
caagccacgctaactgaaggagcca

SEQ ID NO: 178511 - DNA, 25 bp, E. coli
tatatcgacctcaacaaattgccgg

SEQ ID NO: 178512 - DNA, 25 bp, E. coli
tatcagttgaacatcggcaccagtg

SEQ ID NO: 178513 - DNA, 25 bp, E. coli
tatatcgacctctacaaattgccgg

SEQ ID NO: 178514 - DNA, 25 bp, E. coli
tatcagttgaacttcggcaccagtg

SEQ ID NO: 178515 - DNA, 25 bp, E. coli
tgataacgagcacacagtgggcctt

SEQ ID NO: 178516 - DNA, 25 bp, E. coli
tgataacgagcagacagtgggcctt

SEQ ID NO: 178517 - DNA, 25 bp, E. coli
tgaagggcaatagacctctgcgggc

SEQ ID NO: 178518 - DNA, 25 bp, E. coli
tgaagggcaatacacctctgcgggc

SEQ ID NO: 178519 - DNA, 25 bp, E. coli
tcattcaggagcagacgcaacaggt

SEQ ID NO: 178520 - DNA, 25 bp, E. coli
tcattcaggagctgacgcaacaggt

SEQ ID NO: 178521 - DNA, 25 bp, E. coli
gccgtcatcagtcgtcaaaaagcga

SEQ ID NO: 178522 - DNA, 25 bp, E. coli
gccgtcatcagtggtcaaaaagcga

SEQ ID NO: 178523 - DNA, 25 bp, E. coli
gcataaaggcaaggtcgcgccggtt

SEQ ID NO: 178524 - DNA, 25 bp, E. coli
gcataaaggcaacgtcgcgccggtt

SEQ ID NO: 178525 - DNA, 25 bp, E. coli
cattgcgatatctacctgccggacc

SEQ ID NO: 178526 - DNA, 25 bp, E. coli
cattgcgatatcaacctgccggacc

SEQ ID NO: 178527 - DNA, 25 bp, E. coli
gttgacctcagtgcgaactaccatg

SEQ ID NO: 178528 - DNA, 25 bp, E. coli
gttgacctcagtccgaactaccatg

SEQ ID NO: 178529 - DNA, 25 bp, E. coli
taacggcaactaaggcagtgggacg

SEQ ID NO: 178530 - DNA, 25 bp, E. coli
taacggcaactatggcagtgggacg

SEQ ID NO: 178531 - DNA, 25 bp, E. coli
taaagcattgcaccttccgcctggc

SEQ ID NO: 178532 - DNA, 25 bp, E. coli
taaagcattgcagcttccgcctggc

SEQ ID NO: 178533 - DNA, 25 bp, E. coli
tatttatcaggttctcgcgatgccg

SEQ ID NO: 178534 - DNA, 25 bp, E. coli
tattgagttcgtccaggccatgccc

SEQ ID NO: 178535 - DNA, 25 bp, E. coli
tattgagttcgtgcaggccatgccc

SEQ ID NO: 178536 - DNA, 25 bp, E. coli
tatttatcaggtactcgcgatgccg

SEQ ID NO: 178537 - DNA, 25 bp, E. coli
tatcaacgcgcccttgaagagtggg

SEQ ID NO: 178538 - DNA, 25 bp, E. coli
tatcaacgcgccgttgaagagtggg

SEQ ID NO: 178539 - DNA, 25 bp, E. coli
tttgctgacccggaaaacgaagcgg

SEQ ID NO: 178540 - DNA, 25 bp, E. coli
tttgctgacccgcaaaacgaagcgg

SEQ ID NO: 178541 - DNA, 25 bp, E. coli
tgttacagcaaaagggcagcgggtc

SEQ ID NO: 178542 - DNA, 25 bp, E. coli
tgttacagcaaatgggcagcgggtc

SEQ ID NO: 178543 - DNA, 25 bp, E. coli
cattacgcggcttttcatctggaga

SEQ ID NO: 178544 - DNA, 25 bp, E. coli
cattacgcggctattcatctggaga

SEQ ID NO: 178545 - DNA, 25 bp, E. coli
ggacaccctgatgaagcaactctcg

SEQ ID NO: 178546 - DNA, 25 bp, E. coli
ggacaccctgatcaagcaactctcg

SEQ ID NO: 178547 - DNA, 25 bp, E. coli
tcaaaacctggtttcgcaaagccgg

SEQ ID NO: 178548 - DNA, 25 bp, E. coli
tcaaaacctggtatcgcaaagccgg

SEQ ID NO: 178549 - DNA, 25 bp, E. coli
gatgatgctcaaaaacctggtcgcg

SEQ ID NO: 178550 - DNA, 25 bp, E. coli
gagaacgtttgaaagcggcagcacc

SEQ ID NO: 178551 - DNA, 25 bp, E. coli
gatgatgctcaataacctggtcgcg

SEQ ID NO: 178552 - DNA, 25 bp, E. coli
gagaacgtttgatagcggcagcacc

SEQ ID NO: 178553 - DNA, 25 bp, E. coli
cattttcaattgctaacagtgccgg

SEQ ID NO: 178554 - DNA, 25 bp, E. coli
cagtgccggtgtagacgcaaatata

SEQ ID NO: 178555 - DNA, 25 bp, E. coli
cagtgccggtgttgacgcaaatata

SEQ ID NO: 178556 - DNA, 25 bp, E. coli
aaagagtctgacgatagctgctgca

SEQ ID NO: 178557 - DNA, 25 bp, E. coli
aaagagtctgaccatagctgctgca

SEQ ID NO: 178558 - DNA, 25 bp, E. coli
tttgaagacacagccgaacagacca

SEQ ID NO: 178559 - DNA, 25 bp, E. coli
tttgaagacacacccgaacagacca

SEQ ID NO: 178560 - DNA, 25 bp, E. coli
tgaacaaagcgcttgcttacttccg

SEQ ID NO: 178561 - DNA, 25 bp, E. coli
tgaacaaagcgcatgcttacttccg

SEQ ID NO: 178562 - DNA, 25 bp, E. coli
gccagcaagcaacgaaacttaatga

SEQ ID NO: 178563 - DNA, 25 bp, E. coli
gccagcaagcaaggaaacttaatga

SEQ ID NO: 178564 - DNA, 25 bp, E. coli
gctgcagactgaatccagagggata

SEQ ID NO: 178565 - DNA, 25 bp, E. coli
gctgcagactgattccagagggata

SEQ ID NO: 178566 - DNA, 25 bp, E. coli
cattttcaattggtaacagtgccgg

SEQ ID NO: 178567 - DNA, 25 bp, E. coli
tacttccgtctgcttccttagttgg

SEQ ID NO: 178568 - DNA, 25 bp, E. coli
gtacaatgaactgccaacaaatcct

SEQ ID NO: 178569 - DNA, 25 bp, E. coli
tacttccgtctggttccttagttgg

SEQ ID NO: 178570 - DNA, 25 bp, E. coli
gggatatatcctcaaaagtacaatg

SEQ ID NO: 178571 - DNA, 25 bp, E. coli
gtacaatgaactcccaacaaatcct

SEQ ID NO: 178572 - DNA, 25 bp, E. coli
gggatatatcctgaaaagtacaatg

SEQ ID NO: 178573 - DNA, 25 bp, E. coli
tggagttctcactcagccagcaagc

SEQ ID NO: 178574 - DNA, 25 bp, E. coli
tggagttctcacacagccagcaagc

SEQ ID NO: 178575 - DNA, 25 bp, E. coli
aaggcgtccctctcagactgctgga

SEQ ID NO: 178576 - DNA, 25 bp, E. coli
aaggcgtccctcacagactgctgga

SEQ ID NO: 178577 - DNA, 25 bp, E. coli
caggctacgaggatattgcaatcac

SEQ ID NO: 178578 - DNA, 25 bp, E. coli
cagactgctggatcattggctggtc

SEQ ID NO: 178579 - DNA, 25 bp, E. coli
caggctacgaggttattgcaatcac

SEQ ID NO: 178580 - DNA, 25 bp, E. coli
cagactgctggaacattggctggtc

SEQ ID NO: 178581 - DNA, 25 bp, E. coli
aaaggcatcctctttcaggctacga

SEQ ID NO: 178582 - DNA, 25 bp, E. coli
aaaggcatcctcattcaggctacga

SEQ ID NO: 178583 - DNA, 25 bp, E. coli
tgtaccaccataaaggcatcctctt

SEQ ID NO: 178584 - DNA, 25 bp, E. coli
tgtaccaccatataggcatcctctt

SEQ ID NO: 178585 - DNA, 25 bp, E. coli
tgaaacattggcaggcagtcacccg

SEQ ID NO: 178586 - DNA, 25 bp, E. coli
tgaaacattggctggcagtcacccg

SEQ ID NO: 178587 - DNA, 25 bp, E. coli
tcagattgctgaaacattggctggc

SEQ ID NO: 178588 - DNA, 25 bp, E. coli
gaaggcgtttctgtcagattgctga

SEQ ID NO: 178589 - DNA, 25 bp, E. coli
gaaggcgtttctctcagattgctga

SEQ ID NO: 178590 - DNA, 25 bp, E. coli
gatattgcaatcacccgaaggcgtt

SEQ ID NO: 178591 - DNA, 25 bp, E. coli
gatattgcaatctcccgaaggcgtt

SEQ ID NO: 178592 - DNA, 25 bp, E. coli
tggaacattggctggtcgcaaaagc

SEQ ID NO: 178593 - DNA, 25 bp, E. coli
tggctggcagtctcccgaaggcgtc

SEQ ID NO: 178594 - DNA, 25 bp, E. coli
tggctggcagtcacccgaaggcgtc

SEQ ID NO: 178595 - DNA, 25 bp, E. coli
tggaacattggcaggtcgcaaaagc

SEQ ID NO: 178596 - DNA, 25 bp, E. coli
tcagattgctgatacattggctggc

SEQ ID NO: 178597 - DNA, 25 bp, E. coli
taagggggtcaccttgactacgcca

SEQ ID NO: 178598 - DNA, 25 bp, E. coli
cacagttacggttataaaggtctga

SEQ ID NO: 178599 - DNA, 25 bp, E. coli
cacagttacggtaataaaggtctga

SEQ ID NO: 178600 - DNA, 25 bp, E. coli
catcagatggcatcctgtgcaatga

SEQ ID NO: 178601 - DNA, 25 bp, E. coli
catagtgagttaacgaaacttggcg

SEQ ID NO: 178602 - DNA, 25 bp, E. coli
catctcgctgtaccgaatgcaccag

SEQ ID NO: 178603 - DNA, 25 bp, E. coli
catagtgagttatcgaaacttggcg

SEQ ID NO: 178604 - DNA, 25 bp, E. coli
catctcgctgtagcgaatgcaccag

SEQ ID NO: 178605 - DNA, 25 bp, E. coli
catcagatggcaacctgtgcaatga

SEQ ID NO: 178606 - DNA, 25 bp, E. coli
actgcacagttagggttataaaggt

SEQ ID NO: 178607 - DNA, 25 bp, E. coli
actgcacagttacggttataaaggt

SEQ ID NO: 178608 - DNA, 25 bp, E. coli
taagggggtcacgttgactacgcca

SEQ ID NO: 178609 - DNA, 25 bp, E. coli
tgcggcccatagtgagttaacgaaa

SEQ ID NO: 178610 - DNA, 25 bp, E. coli
tgcggcccatagagagttaacgaaa

SEQ ID NO: 178611 - DNA, 25 bp, E. coli
tctgctgcggcccatagtgagttaa

SEQ ID NO: 178612 - DNA, 25 bp, E. coli
tctgctgcggccgatagtgagttaa

SEQ ID NO: 178613 - DNA, 25 bp, E. coli
gccgcacatcagatggcaacctgtg

SEQ ID NO: 178614 - DNA, 25 bp, E. coli
gccgcacatcagttggcaacctgtg

SEQ ID NO: 178615 - DNA, 25 bp, E. coli
gctcaggccgcagatcagatggcaa

SEQ ID NO: 178616 - DNA, 25 bp, E. coli
gctcaggccgcacatcagatggcaa

SEQ ID NO: 178617 - DNA, 25 bp, E. coli
tggcaacctgtgcaatgaacaacat

SEQ ID NO: 178618 - DNA, 25 bp, E. coli
tggcaacctgtggaatgaacaacat

SEQ ID NO: 178619 - DNA, 25 bp, E. coli
aacgccgccgaacctcgaagataaa

SEQ ID NO: 178620 - DNA, 25 bp, E. coli
ttcatatcacaacaagtatcgttaa

SEQ ID NO: 178621 - DNA, 25 bp, E. coli
taacgaagatgcccgccgcagcgct

SEQ ID NO: 178622 - DNA, 25 bp, E. coli
agcaacgccgccgaagctcgaagat

SEQ ID NO: 178623 - DNA, 25 bp, E. coli
agcaacgccgcccaagctcgaagat

SEQ ID NO: 178624 - DNA, 25 bp, E. coli
aacgccgccgaagctcgaagataaa

SEQ ID NO: 178625 - DNA, 25 bp, E. coli
gccgaagctcgatgataaatcaccg

SEQ ID NO: 178626 - DNA, 25 bp, E. coli
gccgccgaagctcgaagataaatca

SEQ ID NO: 178627 - DNA, 25 bp, E. coli
gccgaagctcgaagataaatcaccg

SEQ ID NO: 178628 - DNA, 25 bp, E. coli
gccgccgaagctggaagataaatca

SEQ ID NO: 178629 - DNA, 25 bp, E. coli
gctcgaagataaatcaccggacagc

SEQ ID NO: 178630 - DNA, 25 bp, E. coli
gctcgaagataattcaccggacagc

SEQ ID NO: 178631 - DNA, 25 bp, E. coli
gcaattcatatctcaagaagtatcg

SEQ ID NO: 178632 - DNA, 25 bp, E. coli
gaagctcgaagaaaaatcaccggac

SEQ ID NO: 178633 - DNA, 25 bp, E. coli
gcaattcatatcacaagaagtatcg

SEQ ID NO: 178634 - DNA, 25 bp, E. coli
gaagctcgaagataaatcaccggac

SEQ ID NO: 178635 - DNA, 25 bp, E. coli
gaaaacgacccgcaattcatatcac

SEQ ID NO: 178636 - DNA, 25 bp, E. coli
gaaaacgacccggaattcatatcac

SEQ ID NO: 178637 - DNA, 25 bp, E. coli
taacgaagatgcgcgccgcagcgct

SEQ ID NO: 178638 - DNA, 25 bp, E. coli
ttcatatcacaagaagtatcgttaa

SEQ ID NO: 178639 - DNA, 25 bp, E. coli
gacccgcaattcatatcacaagaag

SEQ ID NO: 178640 - DNA, 25 bp, E. coli
gacccgcaattcttatcacaagaag

SEQ ID NO: 178641 - DNA, 25 bp, E. coli
cattttgcggtgatcggcgtactgg

SEQ ID NO: 178642 - DNA, 25 bp, E. coli
cattttgcggtgttcggcgtactgg

SEQ ID NO: 178643 - DNA, 25 bp, E. coli
tactgccggtgctctggtgtatgca

SEQ ID NO: 178644 - DNA, 25 bp, E. coli
tactgccggtgcactggtgtatgca

SEQ ID NO: 178645 - DNA, 25 bp, E. coli
tatgcaactcatcaaaggccgttgg

SEQ ID NO: 178646 - DNA, 25 bp, E. coli
tatgcaactcatgaaaggccgttgg

SEQ ID NO: 178647 - DNA, 25 bp, E. coli
tatgcaaccgcgcaatatgccacgt

SEQ ID NO: 178648 - DNA, 25 bp, E. coli
tatgcaaccgcggaatatgccacgt

SEQ ID NO: 178649 - DNA, 25 bp, E. coli
ttggcgacaccaggctattcaggcg

SEQ ID NO: 178650 - DNA, 25 bp, E. coli
ttggcgacaccacgctattcaggcg

SEQ ID NO: 178651 - DNA, 25 bp, E. coli
tgcgtttacaacagcacgctgccgt

SEQ ID NO: 178652 - DNA, 25 bp, E. coli
tgcgtttacaactgcacgctgccgt

SEQ ID NO: 178653 - DNA, 25 bp, E. coli
tcttgtaccgcgcatgaggcaggat

SEQ ID NO: 178654 - DNA, 25 bp, E. coli
tctggagtttgaacagtgccactgc

SEQ ID NO: 178655 - DNA, 25 bp, E. coli
tctggagtttgatcagtgccactgc

SEQ ID NO: 178656 - DNA, 25 bp, E. coli
tcttgtaccgcggatgaggcaggat

SEQ ID NO: 178657 - DNA, 25 bp, E. coli
gcgtttacctggatcgcgctgcgat

SEQ ID NO: 178658 - DNA, 25 bp, E. coli
gcgtttacctggttcgcgctgcgat

SEQ ID NO: 178659 - DNA, 25 bp, E. coli
gcttcgcaatgttcggtgcctggct

SEQ ID NO: 178660 - DNA, 25 bp, E. coli
gcttcgcaatgtacggtgcctggct

SEQ ID NO: 178661 - DNA, 25 bp, E. coli
tggatgactaaactcgaatgggcga

SEQ ID NO: 178662 - DNA, 25 bp, E. coli
tggatgactaaagtcgaatgggcga

SEQ ID NO: 178663 - DNA, 25 bp, E. coli
agtttaatatgggagaacttcttcg

SEQ ID NO: 178664 - DNA, 25 bp, E. coli
agtttaatatggcagaacttcttcg

SEQ ID NO: 178665 - DNA, 25 bp, E. coli
tttgagtttaatatggcagaacttc

SEQ ID NO: 178666 - DNA, 25 bp, E. coli
tttgagtttaatttggcagaacttc

SEQ ID NO: 178667 - DNA, 25 bp, E. coli
ttgagtttaataaggcagaacttct

SEQ ID NO: 178668 - DNA, 25 bp, E. coli
ttgagtttaatatggcagaacttct

SEQ ID NO: 178669 - DNA, 25 bp, E. coli
tgagtttaatatcgcagaacttctt

SEQ ID NO: 178670 - DNA, 25 bp, E. coli
tgagtttaatatggcagaacttctt

SEQ ID NO: 178671 - DNA, 25 bp, E. coli
gctgggggcgtctgcgcttatatcg

SEQ ID NO: 178672 - DNA, 25 bp, E. coli
gctgggggcgtcagcgcttatatcg

SEQ ID NO: 178673 - DNA, 25 bp, E. coli
ccgctgggggcgactgcgcttatat

SEQ ID NO: 178674 - DNA, 25 bp, E. coli
ccgctgggggcgtctgcgcttatat

SEQ ID NO: 178675 - DNA, 25 bp, E. coli
cgctgggggcgtctgcgcttatatc

SEQ ID NO: 178676 - DNA, 25 bp, E. coli
cgctgggggcgtgtgcgcttatatc

SEQ ID NO: 178677 - DNA, 25 bp, E. coli
cttcgccaccgcagggggcgtctgc

SEQ ID NO: 178678 - DNA, 25 bp, E. coli
ctgggggcgtctccgcttatatcgt

SEQ ID NO: 178679 - DNA, 25 bp, E. coli
cttcgccaccgctgggggcgtctgc

SEQ ID NO: 178680 - DNA, 25 bp, E. coli
ctgggggcgtctgcgcttatatcgt

SEQ ID NO: 178681 - DNA, 25 bp, E. coli
gtttaatatggcagaacttcttcgc

SEQ ID NO: 178682 - DNA, 25 bp, E. coli
gtttaatatggctgaacttcttcgc

SEQ ID NO: 178683 - DNA, 25 bp, E. coli
gagtttaatatggcagaacttcttc

SEQ ID NO: 178684 - DNA, 25 bp, E. coli
gagtttaatatgccagaacttcttc

SEQ ID NO: 178685 - DNA, 25 bp, E. coli
caggaaaagatcgattagcattagt

SEQ ID NO: 178686 - DNA, 25 bp, E. coli
caggaaaagatccattagcattagt

SEQ ID NO: 178687 - DNA, 25 bp, E. coli
cattagttaatgtgagtacgggaga

SEQ ID NO: 178688 - DNA, 25 bp, E. coli
cattagttaatgagagtacgggaga

SEQ ID NO: 178689 - DNA, 25 bp, E. coli
taaagaaatcaacaagaggtctccc

SEQ ID NO: 178690 - DNA, 25 bp, E. coli
taaagaaatcaagaagaggtctccc

SEQ ID NO: 178691 - DNA, 25 bp, E. coli
tcctcatccggtaagaaagtattca

SEQ ID NO: 178692 - DNA, 25 bp, E. coli
tcctcatccggttagaaagtattca

SEQ ID NO: 178693 - DNA, 25 bp, E. coli
gaagctttatgtggatggcgtatca

SEQ ID NO: 178694 - DNA, 25 bp, E. coli
gaagctttatgtcgatggcgtatca

SEQ ID NO: 178695 - DNA, 25 bp, E. coli
ctatggaagtagacaagacacagtt

SEQ ID NO: 178696 - DNA, 25 bp, E. coli
ctatggaagtagtcaagacacagtt

SEQ ID NO: 178697 - DNA, 25 bp, E. coli
cgtatcagctattgagggtttatcc

SEQ ID NO: 178698 - DNA, 25 bp, E. coli
cgtatcagctatagagggtttatcc

SEQ ID NO: 178699 - DNA, 25 bp, E. coli
ggcgtcagacgtattactacaggaa

SEQ ID NO: 178700 - DNA, 25 bp, E. coli
gtctacatacaataactggcgtcag

SEQ ID NO: 178701 - DNA, 25 bp, E. coli
ggcgtcagacgttttactacaggaa

SEQ ID NO: 178702 - DNA, 25 bp, E. coli
gtctacatacaaaaactggcgtcag

SEQ ID NO: 178703 - DNA, 25 bp, E. coli
taattgccaaggcaaaacacagtag

SEQ ID NO: 178704 - DNA, 25 bp, E. coli
taattgccaagggaaaacacagtag

SEQ ID NO: 178705 - DNA, 25 bp, E. coli
gaggtctcccacctcatactaaaaa

SEQ ID NO: 178706 - DNA, 25 bp, E. coli
gaggtctcccacgtcatactaaaaa

SEQ ID NO: 178707 - DNA, 25 bp, E. coli
aattgcagggctggcaatccttgcc

SEQ ID NO: 178708 - DNA, 25 bp, E. coli
aattgcagggctcgcaatccttgcc

SEQ ID NO: 178709 - DNA, 25 bp, E. coli
aagtggcaacaaggtgttcgtgtcg

SEQ ID NO: 178710 - DNA, 25 bp, E. coli
aagtggcaacaacgtgttcgtgtcg

SEQ ID NO: 178711 - DNA, 25 bp, E. coli
caactttttgctggcaattgcaggg

SEQ ID NO: 178712 - DNA, 25 bp, E. coli
caactttttgctcgcaattgcaggg

SEQ ID NO: 178713 - DNA, 25 bp, E. coli
catttactggtagtggcgctgctgg

SEQ ID NO: 178714 - DNA, 25 bp, E. coli
tattgtgtcacgctagtgatgatgc

SEQ ID NO: 178715 - DNA, 25 bp, E. coli
tattgtgtcacggtagtgatgatgc

SEQ ID NO: 178716 - DNA, 25 bp, E. coli
ttgctggcgaaacataagaagttac

SEQ ID NO: 178717 - DNA, 25 bp, E. coli
ttgctggcgaaagataagaagttac

SEQ ID NO: 178718 - DNA, 25 bp, E. coli
tgattgtgctgtggctgttgtcccg

SEQ ID NO: 178719 - DNA, 25 bp, E. coli
tgattgtgctgtcgctgttgtcccg

SEQ ID NO: 178720 - DNA, 25 bp, E. coli
catttactggtactggcgctgctgg

SEQ ID NO: 178721 - DNA, 25 bp, E. coli
ctggaagagctgtccacgacctggt

SEQ ID NO: 178722 - DNA, 25 bp, E. coli
ctggaagagctgaccacgacctggt

SEQ ID NO: 178723 - DNA, 25 bp, E. coli
ggattatgcgcactgtattgtgtca

SEQ ID NO: 178724 - DNA, 25 bp, E. coli
ggattatgcgcagtgtattgtgtca

SEQ ID NO: 178725 - DNA, 25 bp, E. coli
gtgatgatgctgctgtttcagcgcc

SEQ ID NO: 178726 - DNA, 25 bp, E. coli
gtgatgatgctggtgtttcagcgcc

SEQ ID NO: 178727 - DNA, 25 bp, E. coli
taagttgctggcagattatgttgca

SEQ ID NO: 178728 - DNA, 25 bp, E. coli
taagttgctggctgattatgttgca

SEQ ID NO: 178729 - DNA, 25 bp, E. coli
caatatcagttggacaggtaacccc

SEQ ID NO: 178730 - DNA, 25 bp, E. coli
caatatcagttgcacaggtaacccc

SEQ ID NO: 178731 - DNA, 25 bp, E. coli
cagtcgtgctggaatacctggtacg

SEQ ID NO: 178732 - DNA, 25 bp, E. coli
cataaacgagaacaaagttgcgacg

SEQ ID NO: 178733 - DNA, 25 bp, E. coli
cataaacgagaagaaagttgcgacg

SEQ ID NO: 178734 - DNA, 25 bp, E. coli
cagtggcttcaccatgggcgttact

SEQ ID NO: 178735 - DNA, 25 bp, E. coli
cagtcgtgctggtatacctggtacg

SEQ ID NO: 178736 - DNA, 25 bp, E. coli
cagtggcttcacgatgggcgttact

SEQ ID NO: 178737 - DNA, 25 bp, E. coli
taaaagcaataagcactgcaaccgg

SEQ ID NO: 178738 - DNA, 25 bp, E. coli
taaaagcaataaccactgcaaccgg

SEQ ID NO: 178739 - DNA, 25 bp, E. coli
tacccgtatgaaggataacgcctgg

SEQ ID NO: 178740 - DNA, 25 bp, E. coli
tacccgtatgaacgataacgcctgg

SEQ ID NO: 178741 - DNA, 25 bp, E. coli
tgctggcgcacagaatctatattta

SEQ ID NO: 178742 - DNA, 25 bp, E. coli
tgctggcgcacacaatctatattta

SEQ ID NO: 178743 - DNA, 25 bp, E. coli
gcaaccgggtttcaactgtacataa

SEQ ID NO: 178744 - DNA, 25 bp, E. coli
gcaaccgggtttgaactgtacataa

SEQ ID NO: 178745 - DNA, 25 bp, E. coli
taaggtggtcgcaaactcggaagaa

SEQ ID NO: 178746 - DNA, 25 bp, E. coli
taaccccaacgataacaatgtgctg

SEQ ID NO: 178747 - DNA, 25 bp, E. coli
taaggtggtcgctaactcggaagaa

SEQ ID NO: 178748 - DNA, 25 bp, E. coli
taactgtgaccgaatctgtagcaca

SEQ ID NO: 178749 - DNA, 25 bp, E. coli
taactgtgaccgtatctgtagcaca

SEQ ID NO: 178750 - DNA, 25 bp, E. coli
taaccccaacgaaaacaatgtgctg

SEQ ID NO: 178751 - DNA, 25 bp, E. coli
taaagcaatagcagacgcaggctgg

SEQ ID NO: 178752 - DNA, 25 bp, E. coli
taaagcaatagctgacgcaggctgg

SEQ ID NO: 178753 - DNA, 25 bp, E. coli
tacagcgacgttaaagcaggaagca

SEQ ID NO: 178754 - DNA, 25 bp, E. coli
tacagcgacgtttaagcaggaagca

SEQ ID NO: 178755 - DNA, 25 bp, E. coli
tatatagcaaagagcaagtcgccgc

SEQ ID NO: 178756 - DNA, 25 bp, E. coli
tatatagcaaagtgcaagtcgccgc

SEQ ID NO: 178757 - DNA, 25 bp, E. coli
ttttacccgacaactgagcaggctg

SEQ ID NO: 178758 - DNA, 25 bp, E. coli
ttttacccgacatctgagcaggctg

SEQ ID NO: 178759 - DNA, 25 bp, E. coli
tgtttgcgtcgaatccctcaaggtg

SEQ ID NO: 178760 - DNA, 25 bp, E. coli
tgtttgcgtcgattccctcaaggtg

SEQ ID NO: 178761 - DNA, 25 bp, E. coli
tgaatgcggcgctgaccatgatcgc

SEQ ID NO: 178762 - DNA, 25 bp, E. coli
tgaatgcggcgcagaccatgatcgc

SEQ ID NO: 178763 - DNA, 25 bp, E. coli
gaaaatcgccgattgccggatggac

SEQ ID NO: 178764 - DNA, 25 bp, E. coli
gaaaatcgccgaatgccggatggac

SEQ ID NO: 178765 - DNA, 25 bp, E. coli
taatgttcgtaattggcactgccct

SEQ ID NO: 178766 - DNA, 25 bp, E. coli
taatattaaagctgccgggctggca

SEQ ID NO: 178767 - DNA, 25 bp, E. coli
taatattaaagcagccgggctggca

SEQ ID NO: 178768 - DNA, 25 bp, E. coli
taatgttcgtaaatggcactgccct

SEQ ID NO: 178769 - DNA, 25 bp, E. coli
gagagcctgtaatccctgaatcgca

SEQ ID NO: 178770 - DNA, 25 bp, E. coli
gagagcctgtaaaccctgaatcgca

SEQ ID NO: 178771 - DNA, 25 bp, E. coli
gatcggttatctacaggccaacgct

SEQ ID NO: 178772 - DNA, 25 bp, E. coli
gatcggttatcttcaggccaacgct

SEQ ID NO: 178773 - DNA, 25 bp, E. coli
caatcacttattatccggtaccgaa

SEQ ID NO: 178774 - DNA, 25 bp, E. coli
caatcacttattttccggtaccgaa

SEQ ID NO: 178775 - DNA, 25 bp, E. coli
caccgaaatgaaagaagcgatagcg

SEQ ID NO: 178776 - DNA, 25 bp, E. coli
caccgaaatgaatgaagcgatagcg

SEQ ID NO: 178777 - DNA, 25 bp, E. coli
tacaggccaccgaaccatggatact

SEQ ID NO: 178778 - DNA, 25 bp, E. coli
tacaggccaccgtaccatggatact

SEQ ID NO: 178779 - DNA, 25 bp, E. coli
tatgacagcatcctctggaacccaa

SEQ ID NO: 178780 - DNA, 25 bp, E. coli
tatgacagcatcgtctggaacccaa

SEQ ID NO: 178781 - DNA, 25 bp, E. coli
tattgatgacatggcgaccgatgcc

SEQ ID NO: 178782 - DNA, 25 bp, E. coli
tattgatgacatcgcgaccgatgcc

SEQ ID NO: 178783 - DNA, 25 bp, E. coli
ttcgtcagggcgtaggtaaagacct

SEQ ID NO: 178784 - DNA, 25 bp, E. coli
ttcgtcagggcgaaggtaaagacct

SEQ ID NO: 178785 - DNA, 25 bp, E. coli
gaataacgaaagtacgccaatggct

SEQ ID NO: 178786 - DNA, 25 bp, E. coli
gaataacgaaagaacgccaatggct

SEQ ID NO: 178787 - DNA, 25 bp, E. coli
gatagcgcagcgaaaaccactggtt

SEQ ID NO: 178788 - DNA, 25 bp, E. coli
gatagcgcagcgtaaaccactggtt

SEQ ID NO: 178789 - DNA, 25 bp, E. coli
ggtagacccgagatttgatcaaagc

SEQ ID NO: 178790 - DNA, 25 bp, E. coli
tctgatttaaaacaaacaacctcgg

SEQ ID NO: 178791 - DNA, 25 bp, E. coli
ggtagacccgagttttgatcaaagc

SEQ ID NO: 178792 - DNA, 25 bp, E. coli
tctgatttaaaagaaacaacctcgg

SEQ ID NO: 178793 - DNA, 25 bp, E. coli
gatgcagcgacttataaaccggtta

SEQ ID NO: 178794 - DNA, 25 bp, E. coli
gatgcagcgactaataaaccggtta

SEQ ID NO: 178795 - DNA, 25 bp, E. coli
catgccggacggcactatcgtcgtc

SEQ ID NO: 178796 - DNA, 25 bp, E. coli
catgccggacgggactatcgtcgtc

SEQ ID NO: 178797 - DNA, 25 bp, E. coli
tataaacccgctgattttgtctatt

SEQ ID NO: 178798 - DNA, 25 bp, E. coli
tatcagacaattccgtgacttaaga

SEQ ID NO: 178799 - DNA, 25 bp, E. coli
tatcagacaattgcgtgacttaaga

SEQ ID NO: 178800 - DNA, 25 bp, E. coli
tataaacccgctcattttgtctatt

SEQ ID NO: 178801 - DNA, 25 bp, E. coli
tttgcacaaacatgaaatatcagac

SEQ ID NO: 178802 - DNA, 25 bp, E. coli
ttgctcatgccgcacggcactatcg

SEQ ID NO: 178803 - DNA, 25 bp, E. coli
ttgctcatgccggacggcactatcg

SEQ ID NO: 178804 - DNA, 25 bp, E. coli
tttgcacaaacaagaaatatcagac

SEQ ID NO: 178805 - DNA, 25 bp, E. coli
tcgtcgtccggcgttttcctctctt

SEQ ID NO: 178806 - DNA, 25 bp, E. coli
tcgtcgtccggccttttcctctctt

SEQ ID NO: 178807 - DNA, 25 bp, E. coli
tgaaatatcagacaattccgtgact

SEQ ID NO: 178808 - DNA, 25 bp, E. coli
tgaaatatcagagaattccgtgact

SEQ ID NO: 178809 - DNA, 25 bp, E. coli
gctcattttgtctattttttgcaca

SEQ ID NO: 178810 - DNA, 25 bp, E. coli
gctcattttgtcaattttttgcaca

SEQ ID NO: 178811 - DNA, 25 bp, E. coli
gacaattccgtgacttaagaaaatt

SEQ ID NO: 178812 - DNA, 25 bp, E. coli
gacaattccgtgtcttaagaaaatt

SEQ ID NO: 178813 - DNA, 25 bp, E. coli
ccccgctacgtggatctatttctat

SEQ ID NO: 178814 - DNA, 25 bp, E. coli
ccccgctacgtgcatctatttctat

SEQ ID NO: 178815 - DNA, 25 bp, E. coli
gtgcatctatttctataaacccgct

SEQ ID NO: 178816 - DNA, 25 bp, E. coli
gtgcatctatttgtataaacccgct

SEQ ID NO: 178817 - DNA, 25 bp, E. coli
aattctctgaaccaggaacagccca

SEQ ID NO: 178818 - DNA, 25 bp, E. coli
aattctctgaacgaggaacagccca

SEQ ID NO: 178819 - DNA, 25 bp, E. coli
cagaactggcgcgataacctggtgc

SEQ ID NO: 178820 - DNA, 25 bp, E. coli
cagaactggcgccataacctggtgc

SEQ ID NO: 178821 - DNA, 25 bp, E. coli
tacgatccgaatacccaacgacggg

SEQ ID NO: 178822 - DNA, 25 bp, E. coli
tacgatccgaattcccaacgacggg

SEQ ID NO: 178823 - DNA, 25 bp, E. coli
gaattgttggttaacccgccgctgg

SEQ ID NO: 178824 - DNA, 25 bp, E. coli
gaattgttggtttacccgccgctgg

SEQ ID NO: 178825 - DNA, 25 bp, E. coli
gacgtcctgccgttagaaaaacccg

SEQ ID NO: 178826 - DNA, 25 bp, E. coli
gacgtcctgccgatagaaaaacccg

SEQ ID NO: 178827 - DNA, 25 bp, E. coli
cattcagcatgaacgagccgctacg

SEQ ID NO: 178828 - DNA, 25 bp, E. coli
cattcagcatgatcgagccgctacg

SEQ ID NO: 178829 - DNA, 25 bp, E. coli
gataacctgtttcgcggcgatggac

SEQ ID NO: 178830 - DNA, 25 bp, E. coli
gattggcaacctcaccggcgaattt

SEQ ID NO: 178831 - DNA, 25 bp, E. coli
gattggcaacctgaccggcgaattt

SEQ ID NO: 178832 - DNA, 25 bp, E. coli
gataacctgtttggcggcgatggac

SEQ ID NO: 178833 - DNA, 25 bp, E. coli
ggttaacacgcccttccatgtggag

SEQ ID NO: 178834 - DNA, 25 bp, E. coli
ggttaacacgccgttccatgtggag

SEQ ID NO: 178835 - DNA, 25 bp, E. coli
tggacgcttccccaccaaagtggaa

SEQ ID NO: 178836 - DNA, 25 bp, E. coli
tggacgcttcccgaccaaagtggaa

SEQ ID NO: 178837 - DNA, 25 bp, E. coli
gagtttacccattccgaacagcgcg

SEQ ID NO: 178838 - DNA, 25 bp, E. coli
gagtttacccataccgaacagcgcg

SEQ ID NO: 178839 - DNA, 25 bp, E. coli
aattcccattatgcagcaggcgatg

SEQ ID NO: 178840 - DNA, 25 bp, E. coli
aattcccattatccagcaggcgatg

SEQ ID NO: 178841 - DNA, 25 bp, E. coli
caggagctgctccatattttcgacg

SEQ ID NO: 178842 - DNA, 25 bp, E. coli
caggagctgctcgatattttcgacg

SEQ ID NO: 178843 - DNA, 25 bp, E. coli
accgcgcgcgccagtgagttaatgc

SEQ ID NO: 178844 - DNA, 25 bp, E. coli
accgcgcgcgcctgtgagttaatgc

SEQ ID NO: 178845 - DNA, 25 bp, E. coli
tttgctgcaaatgcgtgaacggttg

SEQ ID NO: 178846 - DNA, 25 bp, E. coli
tttgctgcaaatccgtgaacggttg

SEQ ID NO: 178847 - DNA, 25 bp, E. coli
ttatcgatttatgtggctgcggcga

SEQ ID NO: 178848 - DNA, 25 bp, E. coli
ttatcgatttatctggctgcggcga

SEQ ID NO: 178849 - DNA, 25 bp, E. coli
tctggatggctaacgctggctgaag

SEQ ID NO: 178850 - DNA, 25 bp, E. coli
tctggatggctatcgctggctgaag

SEQ ID NO: 178851 - DNA, 25 bp, E. coli
gctgacatcgcgatatgcacttggc

SEQ ID NO: 178852 - DNA, 25 bp, E. coli
gctgacatcgcgttatgcacttggc

SEQ ID NO: 178853 - DNA, 25 bp, E. coli
cgcccgcgccaaaatggaagcgatg

SEQ ID NO: 178854 - DNA, 25 bp, E. coli
cgcccgcgccaatatggaagcgatg

SEQ ID NO: 178855 - DNA, 25 bp, E. coli
cgtctatgtcagtgcaggagctgct

SEQ ID NO: 178856 - DNA, 25 bp, E. coli
cgtctatgtcagagcaggagctgct

SEQ ID NO: 178857 - DNA, 25 bp, E. coli
tcaaaaagggtaacgggtggcgtct

SEQ ID NO: 178858 - DNA, 25 bp, E. coli
tcaaaaagggtatcgggtggcgtct

SEQ ID NO: 178859 - DNA, 25 bp, E. coli
gaggcagacgttctcgcaaaagcgc

SEQ ID NO: 178860 - DNA, 25 bp, E. coli
gaggcagacgttgtcgcaaaagcgc

SEQ ID NO: 178861 - DNA, 25 bp, E. coli
aattccagcggtgcgaagtgcaggc

SEQ ID NO: 178862 - DNA, 25 bp, E. coli
aattccagcggtccgaagtgcaggc

SEQ ID NO: 178863 - DNA, 25 bp, E. coli
cacacatggtcagcagggttgcaga

SEQ ID NO: 178864 - DNA, 25 bp, E. coli
caacagcaatagtggtagacgggcc

SEQ ID NO: 178865 - DNA, 25 bp, E. coli
caacagcaatagaggtagacgggcc

SEQ ID NO: 178866 - DNA, 25 bp, E. coli
cacacatggtcaccagggttgcaga

SEQ ID NO: 178867 - DNA, 25 bp, E. coli
tacgcaggaaggagcgaatgcccag

SEQ ID NO: 178868 - DNA, 25 bp, E. coli
taaagtgacgaactacgcgaccaga

SEQ ID NO: 178869 - DNA, 25 bp, E. coli
tacgcaggaaggtgcgaatgcccag

SEQ ID NO: 178870 - DNA, 25 bp, E. coli
taaagtgacgaagtacgcgaccaga

SEQ ID NO: 178871 - DNA, 25 bp, E. coli
tagcgcccgttgtaccgatacgcag

SEQ ID NO: 178872 - DNA, 25 bp, E. coli
tatcgtaacgttcctgacctgggta

SEQ ID NO: 178873 - DNA, 25 bp, E. coli
tagcgcccgttgaaccgatacgcag

SEQ ID NO: 178874 - DNA, 25 bp, E. coli
tatcgtaacgttgctgacctgggta

SEQ ID NO: 178875 - DNA, 25 bp, E. coli
ttaatatgcggctgaatagcgcccg

SEQ ID NO: 178876 - DNA, 25 bp, E. coli
ttaatatgcggcagaatagcgcccg

SEQ ID NO: 178877 - DNA, 25 bp, E. coli
gaattcgcggtgtgatgccagctta

SEQ ID NO: 178878 - DNA, 25 bp, E. coli
gaattcgcggtgagatgccagctta

SEQ ID NO: 178879 - DNA, 25 bp, E. coli
cattcgaaatcagcgacagccggga

SEQ ID NO: 178880 - DNA, 25 bp, E. coli
cattcgaaatcaccgacagccggga

SEQ ID NO: 178881 - DNA, 25 bp, E. coli
gatttcgcagctacaaccagcgcag

SEQ ID NO: 178882 - DNA, 25 bp, E. coli
gatttcgcagcttcaaccagcgcag

SEQ ID NO: 178883 - DNA, 25 bp, E. coli
cacgggagacgaagaattaaaagag

SEQ ID NO: 178884 - DNA, 25 bp, E. coli
cacgggagacgatgaattaaaagag

SEQ ID NO: 178885 - DNA, 25 bp, E. coli
catcgcgctctggtattgaactgga

SEQ ID NO: 178886 - DNA, 25 bp, E. coli
catcagggccgctggaatcaaagaa

SEQ ID NO: 178887 - DNA, 25 bp, E. coli
catcgcgctctgctattgaactgga

SEQ ID NO: 178888 - DNA, 25 bp, E. coli
catcagggccgcaggaatcaaagaa

SEQ ID NO: 178889 - DNA, 25 bp, E. coli
actggtggtcaaaagacaaaagcca

SEQ ID NO: 178890 - DNA, 25 bp, E. coli
actggtggtcaatagacaaaagcca

SEQ ID NO: 178891 - DNA, 25 bp, E. coli
tattgaactggaaatcgactggccc

SEQ ID NO: 178892 - DNA, 25 bp, E. coli
tattgaactggatatcgactggccc

SEQ ID NO: 178893 - DNA, 25 bp, E. coli
tgggcgtgacaatacggtaattgca

SEQ ID NO: 178894 - DNA, 25 bp, E. coli
tgcagtaatgaaagccatcagggcc

SEQ ID NO: 178895 - DNA, 25 bp, E. coli
tgcagtaatgaatgccatcagggcc

SEQ ID NO: 178896 - DNA, 25 bp, E. coli
gaacgatagctagcgacagtttgaa

SEQ ID NO: 178897 - DNA, 25 bp, E. coli
gaacgatagctaccgacagtttgaa

SEQ ID NO: 178898 - DNA, 25 bp, E. coli
gacaaaagccagttcacgggagacg

SEQ ID NO: 178899 - DNA, 25 bp, E. coli
gacaaaagccagatcacgggagacg

SEQ ID NO: 178900 - DNA, 25 bp, E. coli
cgactggcccgaatcgaatgacgac

SEQ ID NO: 178901 - DNA, 25 bp, E. coli
cgactggcccgattcgaatgacgac

SEQ ID NO: 178902 - DNA, 25 bp, E. coli
ggtgatatggcaggcatcgcgctct

SEQ ID NO: 178903 - DNA, 25 bp, E. coli
ggtgatatggcacgcatcgcgctct

SEQ ID NO: 178904 - DNA, 25 bp, E. coli
tgggcgtgacaaaacggtaattgca

SEQ ID NO: 178905 - DNA, 25 bp, E. coli
aatgggaagcccctctacaggtgac

SEQ ID NO: 178906 - DNA, 25 bp, E. coli
aatgggaagcccgtctacaggtgac

SEQ ID NO: 178907 - DNA, 25 bp, E. coli
cagtcgtgcaaatttaatcagggcg

SEQ ID NO: 178908 - DNA, 25 bp, E. coli
cagtcgtgcaaaattaatcagggcg

SEQ ID NO: 178909 - DNA, 25 bp, E. coli
tacaggcaaacgacattccaggact

SEQ ID NO: 178910 - DNA, 25 bp, E. coli
tacaggcaaacgtcattccaggact

SEQ ID NO: 178911 - DNA, 25 bp, E. coli
tattctgctgcaacccaaacgggtg

SEQ ID NO: 178912 - DNA, 25 bp, E. coli
tattctgctgcatcccaaacgggtg

SEQ ID NO: 178913 - DNA, 25 bp, E. coli
tatcgattcaggcaaatctcaccgc

SEQ ID NO: 178914 - DNA, 25 bp, E. coli
tatcgattcagggaaatctcaccgc

SEQ ID NO: 178915 - DNA, 25 bp, E. coli
tgtatgtcaccatgccatttctcgg

SEQ ID NO: 178916 - DNA, 25 bp, E. coli
tgtttgccagggagatacgtctcgt

SEQ ID NO: 178917 - DNA, 25 bp, E. coli
tgtatgtcaccaagccatttctcgg

SEQ ID NO: 178918 - DNA, 25 bp, E. coli
tgtttgccagggtgatacgtctcgt

SEQ ID NO: 178919 - DNA, 25 bp, E. coli
gctcgatgaccaatccgaaaacgga

SEQ ID NO: 178920 - DNA, 25 bp, E. coli
gctcgatgaccattccgaaaacgga

SEQ ID NO: 178921 - DNA, 25 bp, E. coli
ccaggttgtctcagttaacacccga

SEQ ID NO: 178922 - DNA, 25 bp, E. coli
ccaggttgtctctgttaacacccga

SEQ ID NO: 178923 - DNA, 25 bp, E. coli
gatattgccgtcattaaaggcgcgt

SEQ ID NO: 178924 - DNA, 25 bp, E. coli
gatattgccgtctttaaaggcgcgt

SEQ ID NO: 178925 - DNA, 25 bp, E. coli
gacccgttaataatggtgcgaacac

SEQ ID NO: 178926 - DNA, 25 bp, E. coli
gacccgttaatattggtgcgaacac

SEQ ID NO: 178927 - DNA, 25 bp, E. coli
cagagcgttcgggtatgaattacat

SEQ ID NO: 178928 - DNA, 25 bp, E. coli
cagagcgttcggctatgaattacat

SEQ ID NO: 178929 - DNA, 25 bp, E. coli
cagaagaaggctgtcaacagagcgt

SEQ ID NO: 178930 - DNA, 25 bp, E. coli
cagaagaaggctctcaacagagcgt

SEQ ID NO: 178931 - DNA, 25 bp, E. coli
aatccgcaatatccgtttccccaat

SEQ ID NO: 178932 - DNA, 25 bp, E. coli
agcctgcagaagaaggctgtcaaca

SEQ ID NO: 178933 - DNA, 25 bp, E. coli
agcctgcagaagtaggctgtcaaca

SEQ ID NO: 178934 - DNA, 25 bp, E. coli
aatccgcaatatgcgtttccccaat

SEQ ID NO: 178935 - DNA, 25 bp, E. coli
tgattgaacagaacaatatcgccct

SEQ ID NO: 178936 - DNA, 25 bp, E. coli
tgattgaacagatcaatatcgccct

SEQ ID NO: 178937 - DNA, 25 bp, E. coli
tccgtttccccaatcacatgattga

SEQ ID NO: 178938 - DNA, 25 bp, E. coli
tcgcccttgaacttaaaggttccgg

SEQ ID NO: 178939 - DNA, 25 bp, E. coli
tcgcccttgaacataaaggttccgg

SEQ ID NO: 178940 - DNA, 25 bp, E. coli
tccgtttccccattcacatgattga

SEQ ID NO: 178941 - DNA, 25 bp, E. coli
gcgttcgggtatcaattacataatt

SEQ ID NO: 178942 - DNA, 25 bp, E. coli
gcgttcgggtatgaattacataatt

SEQ ID NO: 178943 - DNA, 25 bp, E. coli
gaacagatcaatttcgcccttgaac

SEQ ID NO: 178944 - DNA, 25 bp, E. coli
gaacagatcaatatcgcccttgaac

SEQ ID NO: 178945 - DNA, 25 bp, E. coli
cccgcagaaccacaatccgcaatat

SEQ ID NO: 178946 - DNA, 25 bp, E. coli
cccgcagaaccagaatccgcaatat

SEQ ID NO: 178947 - DNA, 25 bp, E. coli
ggctgtcaacagtgcgttcgggtat

SEQ ID NO: 178948 - DNA, 25 bp, E. coli
ggctgtcaacagagcgttcgggtat

SEQ ID NO: 178949 - DNA, 25 bp, E. coli
aatggcaatcctctatttaaagaac

SEQ ID NO: 178950 - DNA, 25 bp, E. coli
aatggcaatcctgtatttaaagaac

SEQ ID NO: 178951 - DNA, 25 bp, E. coli
tatttaaagaacaattctggaaagc

SEQ ID NO: 178952 - DNA, 25 bp, E. coli
tatttaaagaactattctggaaagc

SEQ ID NO: 178953 - DNA, 25 bp, E. coli
tatcttaaagatctgatgatgcaac

SEQ ID NO: 178954 - DNA, 25 bp, E. coli
tatcttaaagatgtgatgatgcaac

SEQ ID NO: 178955 - DNA, 25 bp, E. coli
ttctggaaagcattagacgaattta

SEQ ID NO: 178956 - DNA, 25 bp, E. coli
ttctggaaagcaatagacgaattta

SEQ ID NO: 178957 - DNA, 25 bp, E. coli
tgatgatgcaactggaagcgaagaa

SEQ ID NO: 178958 - DNA, 25 bp, E. coli
tgatgatgcaacaggaagcgaagaa

SEQ ID NO: 178959 - DNA, 25 bp, E. coli
tcggctaaagcattatcgttctctg

SEQ ID NO: 178960 - DNA, 25 bp, E. coli
tcggctaaagcaatatcgttctctg

SEQ ID NO: 178961 - DNA, 25 bp, E. coli
gaaggcaaatatctaataagcaagg

SEQ ID NO: 178962 - DNA, 25 bp, E. coli
gaaggcaaatatgtaataagcaagg

SEQ ID NO: 178963 - DNA, 25 bp, E. coli
gacgaatttaactttccgcaagagg

SEQ ID NO: 178964 - DNA, 25 bp, E. coli
gacgaatttaacattccgcaagagg

SEQ ID NO: 178965 - DNA, 25 bp, E. coli
cgcaagaggagcttaatcggctaaa

SEQ ID NO: 178966 - DNA, 25 bp, E. coli
cgcaagaggagcataatcggctaaa

SEQ ID NO: 178967 - DNA, 25 bp, E. coli
ctggaagcgaagtataatgaaggca

SEQ ID NO: 178968 - DNA, 25 bp, E. coli
ctggaagcgaagaataatgaaggca

SEQ ID NO: 178969 - DNA, 25 bp, E. coli
taataagcaagggaaatggcaatcc

SEQ ID NO: 178970 - DNA, 25 bp, E. coli
taataagcaaggcaaatggcaatcc

SEQ ID NO: 178971 - DNA, 25 bp, E. coli
cataagccgctcttatgattaaaaa

SEQ ID NO: 178972 - DNA, 25 bp, E. coli
cataagccgctcatatgattaaaaa

SEQ ID NO: 178973 - DNA, 25 bp, E. coli
tacggaatagagttaacacgaggag

SEQ ID NO: 178974 - DNA, 25 bp, E. coli
tacggaatagagataacacgaggag

SEQ ID NO: 178975 - DNA, 25 bp, E. coli
tacgtgcttgtgaaagttgttataa

SEQ ID NO: 178976 - DNA, 25 bp, E. coli
aaataagtggttctgaaatttgcac

SEQ ID NO: 178977 - DNA, 25 bp, E. coli
aaataagtggttgtgaaatttgcac

SEQ ID NO: 178978 - DNA, 25 bp, E. coli
aaacgcgatgagataaaaatgtgtc

SEQ ID NO: 178979 - DNA, 25 bp, E. coli
aaacgcgatgagttaaaaatgtgtc

SEQ ID NO: 178980 - DNA, 25 bp, E. coli
tagcgaatcgctacggaatagagat

SEQ ID NO: 178981 - DNA, 25 bp, E. coli
tagcgaatcgcttcggaatagagat

SEQ ID NO: 178982 - DNA, 25 bp, E. coli
tacgtgcttgtgtaagttgttataa

SEQ ID NO: 178983 - DNA, 25 bp, E. coli
tttgcgacaaaaatacgtgcttgtg

SEQ ID NO: 178984 - DNA, 25 bp, E. coli
tttgcgacaaaattacgtgcttgtg

SEQ ID NO: 178985 - DNA, 25 bp, E. coli
tgaaatttgcacactgaaaaggacg

SEQ ID NO: 178986 - DNA, 25 bp, E. coli
tgaaatttgcactctgaaaaggacg

SEQ ID NO: 178987 - DNA, 25 bp, E. coli
tccaataattatgcataagccgctc

SEQ ID NO: 178988 - DNA, 25 bp, E. coli
tccaataattatccataagccgctc

SEQ ID NO: 178989 - DNA, 25 bp, E. coli
gcactctgaaaacgacgtcttatct

SEQ ID NO: 178990 - DNA, 25 bp, E. coli
gcactctgaaaaggacgtcttatct

SEQ ID NO: 178991 - DNA, 25 bp, E. coli
ctttaaataagtggtagcgaatcgc

SEQ ID NO: 178992 - DNA, 25 bp, E. coli
ctttaaataagtcgtagcgaatcgc

SEQ ID NO: 178993 - DNA, 25 bp, E. coli
aattggcgagaccttgaaatcagcg

SEQ ID NO: 178994 - DNA, 25 bp, E. coli
aattggcgagacgttgaaatcagcg

SEQ ID NO: 178995 - DNA, 25 bp, E. coli
caagactggtgcaggcgcataatcc

SEQ ID NO: 178996 - DNA, 25 bp, E. coli
caagactggtgctggcgcataatcc

SEQ ID NO: 178997 - DNA, 25 bp, E. coli
cactggtgacttttgggccggacaa

SEQ ID NO: 178998 - DNA, 25 bp, E. coli
cactggtgacttatgggccggacaa

SEQ ID NO: 178999 - DNA, 25 bp, E. coli
catgcgtgatgaaccctgggatctg

SEQ ID NO: 179000 - DNA, 25 bp, E. coli
catgcgtgatgatccctgggatctg

SEQ ID NO: 179001 - DNA, 25 bp, E. coli
tacacaacccgtcgcgtgggcagtt

SEQ ID NO: 179002 - DNA, 25 bp, E. coli
tacacaacccgtggcgtgggcagtt

SEQ ID NO: 179003 - DNA, 25 bp, E. coli
tatggtttgcgtctgaactgccgcc

SEQ ID NO: 179004 - DNA, 25 bp, E. coli
tatggtttgcgtgtgaactgccgcc

SEQ ID NO: 179005 - DNA, 25 bp, E. coli
tgtttaaccagggtacggtgatcgc

SEQ ID NO: 179006 - DNA, 25 bp, E. coli
tgtttaaccaggctacggtgatcgc

SEQ ID NO: 179007 - DNA, 25 bp, E. coli
gccgcccggaagtaacgatgctgga

SEQ ID NO: 179008 - DNA, 25 bp, E. coli
gccgcccggaagaaacgatgctgga

SEQ ID NO: 179009 - DNA, 25 bp, E. coli
gcaattcgaactggtaggcactggt

SEQ ID NO: 179010 - DNA, 25 bp, E. coli
gcaattcgaactcgtaggcactggt

SEQ ID NO: 179011 - DNA, 25 bp, E. coli
tggtgaaccttttgcccctgtcgaa

SEQ ID NO: 179012 - DNA, 25 bp, E. coli
tggtgaacctttagcccctgtcgaa

SEQ ID NO: 179013 - DNA, 25 bp, E. coli
taagcctgatttgtgacgcgattgc

SEQ ID NO: 179014 - DNA, 25 bp, E. coli
taagcctgatttctgacgcgattgc

SEQ ID NO: 179015 - DNA, 25 bp, E. coli
aacgggctggtgaacccatattagc

SEQ ID NO: 179016 - DNA, 25 bp, E. coli
caacggctggactttactggctggc

SEQ ID NO: 179017 - DNA, 25 bp, E. coli
cactggcgcatctggttatgtccga

SEQ ID NO: 179018 - DNA, 25 bp, E. coli
cactggcgcatcaggttatgtccga

SEQ ID NO: 179019 - DNA, 25 bp, E. coli
caacggctggacattactggctggc

SEQ ID NO: 179020 - DNA, 25 bp, E. coli
aaattattctcgtgccgcttcccgg

SEQ ID NO: 179021 - DNA, 25 bp, E. coli
aaattattctcgagccgcttcccgg

SEQ ID NO: 179022 - DNA, 25 bp, E. coli
aacgggctggtgtacccatattagc

SEQ ID NO: 179023 - DNA, 25 bp, E. coli
tatttcgatccgcaacaggcgctgg

SEQ ID NO: 179024 - DNA, 25 bp, E. coli
tatttcgatccggaacaggcgctgg

SEQ ID NO: 179025 - DNA, 25 bp, E. coli
tctttatcgtcaggtcacgccggtt

SEQ ID NO: 179026 - DNA, 25 bp, E. coli
tctttatcgtcacgtcacgccggtt

SEQ ID NO: 179027 - DNA, 25 bp, E. coli
gaactctgcgtgctgtcactgcgct

SEQ ID NO: 179028 - DNA, 25 bp, E. coli
gacatgctgccggacatattggcgc

SEQ ID NO: 179029 - DNA, 25 bp, E. coli
gacatgctgccgcacatattggcgc

SEQ ID NO: 179030 - DNA, 25 bp, E. coli
gaactctgcgtggtgtcactgcgct

SEQ ID NO: 179031 - DNA, 25 bp, E. coli
ggttcgaacactacacgcaatctgg

SEQ ID NO: 179032 - DNA, 25 bp, E. coli
ggttcgaacacttcacgcaatctgg

SEQ ID NO: 179033 - DNA, 25 bp, E. coli
ggctggcggcaactaagaactctgc

SEQ ID NO: 179034 - DNA, 25 bp, E. coli
ggctgaaagtgtgcaaattccccgc

SEQ ID NO: 179035 - DNA, 25 bp, E. coli
ggctgaaagtgtccaaattccccgc

SEQ ID NO: 179036 - DNA, 25 bp, E. coli
ggctggcggcaagtaagaactctgc

SEQ ID NO: 179037 - DNA, 25 bp, E. coli
caaaaaccagctagaggtgatgcgc

SEQ ID NO: 179038 - DNA, 25 bp, E. coli
caaaaaccagcttgaggtgatgcgc

SEQ ID NO: 179039 - DNA, 25 bp, E. coli
tattcagcagcagcaggatatcgat

SEQ ID NO: 179040 - DNA, 25 bp, E. coli
tattcagcagcaccaggatatcgat

SEQ ID NO: 179041 - DNA, 25 bp, E. coli
tgacgaggagctgcacgatgactga

SEQ ID NO: 179042 - DNA, 25 bp, E. coli
tgacgaggagctccacgatgactga

SEQ ID NO: 179043 - DNA, 25 bp, E. coli
gctcacccgggcgttgctgatacgg

SEQ ID NO: 179044 - DNA, 25 bp, E. coli
gctcacccgggccttgctgatacgg

SEQ ID NO: 179045 - DNA, 25 bp, E. coli
cgggccttgctgatacggcaatggc

SEQ ID NO: 179046 - DNA, 25 bp, E. coli
cgggccttgctgttacggcaatggc

SEQ ID NO: 179047 - DNA, 25 bp, E. coli
gatattctcggctcccgcaaaaacc

SEQ ID NO: 179048 - DNA, 25 bp, E. coli
gatattctcggcacccgcaaaaacc

SEQ ID NO: 179049 - DNA, 25 bp, E. coli
ggatatcgataacggaatgttgcct

SEQ ID NO: 179050 - DNA, 25 bp, E. coli
ggatatcgataagggaatgttgcct

SEQ ID NO: 179051 - DNA, 25 bp, E. coli
ggctcccgcaaataccagcttgagg

SEQ ID NO: 179052 - DNA, 25 bp, E. coli
ggctcccgcaaaaaccagcttgagg

SEQ ID NO: 179053 - DNA, 25 bp, E. coli
tcagctatagcattgaagcaggcaa

SEQ ID NO: 179054 - DNA, 25 bp, E. coli
tcagctatagcaatgaagcaggcaa

SEQ ID NO: 179055 - DNA, 25 bp, E. coli
taacggcaccatgagctatagcaat

SEQ ID NO: 179056 - DNA, 25 bp, E. coli
taacggcaccatcagctatagcaat

SEQ ID NO: 179057 - DNA, 25 bp, E. coli
gagctgcacgatcactgaacaggca

SEQ ID NO: 179058 - DNA, 25 bp, E. coli
gagctgcacgatgactgaacaggca

SEQ ID NO: 179059 - DNA, 25 bp, E. coli
aatacgcctctggtgaagttgcagc

SEQ ID NO: 179060 - DNA, 25 bp, E. coli
aatacgcctctgctgaagttgcagc

SEQ ID NO: 179061 - DNA, 25 bp, E. coli
tagaacaaacaaaaggcaatacgcc

SEQ ID NO: 179062 - DNA, 25 bp, E. coli
tagaacaaacaataggcaatacgcc

SEQ ID NO: 179063 - DNA, 25 bp, E. coli
tatcgcatgaaattgctgatgcccg

SEQ ID NO: 179064 - DNA, 25 bp, E. coli
tatcgcatgaaaatgctgatgcccg

SEQ ID NO: 179065 - DNA, 25 bp, E. coli
tcgaagccaccagtggtaacaccgg

SEQ ID NO: 179066 - DNA, 25 bp, E. coli
tcgaagccaccactggtaacaccgg

SEQ ID NO: 179067 - DNA, 25 bp, E. coli
tgcggaaaacacgatgcgcgaactg

SEQ ID NO: 179068 - DNA, 25 bp, E. coli
tgcggaaaacaccatgcgcgaactg

SEQ ID NO: 179069 - DNA, 25 bp, E. coli
gctgatgcccgacaacatgagccag

SEQ ID NO: 179070 - DNA, 25 bp, E. coli
gctttatgcgcgaacaatccaaacc

SEQ ID NO: 179071 - DNA, 25 bp, E. coli
gctgatgcccgagaacatgagccag

SEQ ID NO: 179072 - DNA, 25 bp, E. coli
gctttatgcgcgtacaatccaaacc

SEQ ID NO: 179073 - DNA, 25 bp, E. coli
cgatcatctgcgatcgtggcgatcg

SEQ ID NO: 179074 - DNA, 25 bp, E. coli
cgatcatctgcgttcgtggcgatcg

SEQ ID NO: 179075 - DNA, 25 bp, E. coli
ggtaacaccggctttgcgctggcaa

SEQ ID NO: 179076 - DNA, 25 bp, E. coli
ggtaacaccggcattgcgctggcaa

SEQ ID NO: 179077 - DNA, 25 bp, E. coli
tggatattcatctgcgcgatgcgga

SEQ ID NO: 179078 - DNA, 25 bp, E. coli
tggatattcatcagcgcgatgcgga

SEQ ID NO: 179079 - DNA, 25 bp, E. coli
gagcactgcgggaggcaaaagctaa

SEQ ID NO: 179080 - DNA, 25 bp, E. coli
gagcactgcgggtggcaaaagctaa

SEQ ID NO: 179081 - DNA, 25 bp, E. coli
caaaaagccaatggcgaagcgtggg

SEQ ID NO: 179082 - DNA, 25 bp, E. coli
caaaaagccaatcgcgaagcgtggg

SEQ ID NO: 179083 - DNA, 25 bp, E. coli
tacttcccttgtttgctgttgccgc

SEQ ID NO: 179084 - DNA, 25 bp, E. coli
taaagtcggcatggttcgtctggat

SEQ ID NO: 179085 - DNA, 25 bp, E. coli
taaagtcggcatcgttcgtctggat

SEQ ID NO: 179086 - DNA, 25 bp, E. coli
tacttcccttgtatgctgttgccgc

SEQ ID NO: 179087 - DNA, 25 bp, E. coli
tatgatgaaagctatgcgccgctcg

SEQ ID NO: 179088 - DNA, 25 bp, E. coli
tatgtcgcgggacataaagtcggca

SEQ ID NO: 179089 - DNA, 25 bp, E. coli
tatgatgaaagcaatgcgccgctcg

SEQ ID NO: 179090 - DNA, 25 bp, E. coli
tatgtcgcgggagataaagtcggca

SEQ ID NO: 179091 - DNA, 25 bp, E. coli
tgaacggcggcaactatgatgaaag

SEQ ID NO: 179092 - DNA, 25 bp, E. coli
tgaacggcggcatctatgatgaaag

SEQ ID NO: 179093 - DNA, 25 bp, E. coli
tcgaaaacggtctgcagaaggtggc

SEQ ID NO: 179094 - DNA, 25 bp, E. coli
tcgaaaacggtcagcagaaggtggc

SEQ ID NO: 179095 - DNA, 25 bp, E. coli
tcagtttgcggtgcagtcagggcca

SEQ ID NO: 179096 - DNA, 25 bp, E. coli
tcagtttgcggtccagtcagggcca

SEQ ID NO: 179097 - DNA, 25 bp, E. coli
gctgaccgtacaggcgtataccgtt

SEQ ID NO: 179098 - DNA, 25 bp, E. coli
gctgaccgtacacgcgtataccgtt

SEQ ID NO: 179099 - DNA, 25 bp, E. coli
cgttaaatctcgcttcaggtgaagg

SEQ ID NO: 179100 - DNA, 25 bp, E. coli
cgttaaatctcggttcaggtgaagg

SEQ ID NO: 179101 - DNA, 25 bp, E. coli
cgttaatcctcatacagagcgggtg

SEQ ID NO: 179102 - DNA, 25 bp, E. coli
cgttaatcctcaaacagagcgggtg

SEQ ID NO: 179103 - DNA, 25 bp, E. coli
aaccgcgagcacctagaactgactg

SEQ ID NO: 179104 - DNA, 25 bp, E. coli
cactattggatcctaaaggcccacg

SEQ ID NO: 179105 - DNA, 25 bp, E. coli
cactttgccggatcatcctgctggg

SEQ ID NO: 179106 - DNA, 25 bp, E. coli
cactattggatcgtaaaggcccacg

SEQ ID NO: 179107 - DNA, 25 bp, E. coli
cactttgccggaacatcctgctggg

SEQ ID NO: 179108 - DNA, 25 bp, E. coli
tacactgcgtggctgtatctggcct

SEQ ID NO: 179109 - DNA, 25 bp, E. coli
tacactgcgtgggtgtatctggcct

SEQ ID NO: 179110 - DNA, 25 bp, E. coli
aaccgcgagcacgtagaactgactg

SEQ ID NO: 179111 - DNA, 25 bp, E. coli
tgaagcgccgatcaacccatgcggt

SEQ ID NO: 179112 - DNA, 25 bp, E. coli
tgaagcgccgatgaacccatgcggt

SEQ ID NO: 179113 - DNA, 25 bp, E. coli
gattaagtgccaccgaaatcggcgc

SEQ ID NO: 179114 - DNA, 25 bp, E. coli
gattaagtgccagcgaaatcggcgc

SEQ ID NO: 179115 - DNA, 25 bp, E. coli
gtatatgctctatcgcaaccgcgag

SEQ ID NO: 179116 - DNA, 25 bp, E. coli
ggattagttcaaggcagtacccgaa

SEQ ID NO: 179117 - DNA, 25 bp, E. coli
gtatatgctctaacgcaaccgcgag

SEQ ID NO: 179118 - DNA, 25 bp, E. coli
ggattagttcaacgcagtacccgaa

SEQ ID NO: 179119 - DNA, 25 bp, E. coli
tcaatgcaggtagcgtcaatgcccg

SEQ ID NO: 179120 - DNA, 25 bp, E. coli
tcaatgcaggtaccgtcaatgcccg

SEQ ID NO: 179121 - DNA, 25 bp, E. coli
taagcccaccgattctggcggcgat

SEQ ID NO: 179122 - DNA, 25 bp, E. coli
taagcccaccgaatctggcggcgat

SEQ ID NO: 179123 - DNA, 25 bp, E. coli
gatccgctcagttttgccgaatggc

SEQ ID NO: 179124 - DNA, 25 bp, E. coli
gatccgctcagtattgccgaatggc

SEQ ID NO: 179125 - DNA, 25 bp, E. coli
aatgtagacacattttcactgcctg

SEQ ID NO: 179126 - DNA, 25 bp, E. coli
aatgtagacacaatttcactgcctg

SEQ ID NO: 179127 - DNA, 25 bp, E. coli
cacaactgccatcagaaatgccgac

SEQ ID NO: 179128 - DNA, 25 bp, E. coli
cacaactgccatgagaaatgccgac

SEQ ID NO: 179129 - DNA, 25 bp, E. coli
cgattttgacggattcctgcccgag

SEQ ID NO: 179130 - DNA, 25 bp, E. coli
cgattttgacggtttcctgcccgag

SEQ ID NO: 179131 - DNA, 25 bp, E. coli
ttttatcacccagaactgccatcag

SEQ ID NO: 179132 - DNA, 25 bp, E. coli
ttttatcacccacaactgccatcag

SEQ ID NO: 179133 - DNA, 25 bp, E. coli
tgaaacgcagtctgccattgcgggc

SEQ ID NO: 179134 - DNA, 25 bp, E. coli
tgaaacgcagtcagccattgcgggc

SEQ ID NO: 179135 - DNA, 25 bp, E. coli
tgccatcagaaatgccgacctggcc

SEQ ID NO: 179136 - DNA, 25 bp, E. coli
tgccatcagaaaagccgacctggcc

SEQ ID NO: 179137 - DNA, 25 bp, E. coli
tcagctccgggaccaaactggctgt

SEQ ID NO: 179138 - DNA, 25 bp, E. coli
tcagctccgggagcaaactggctgt

SEQ ID NO: 179139 - DNA, 25 bp, E. coli
gcccgagttttatcacccacaactg

SEQ ID NO: 179140 - DNA, 25 bp, E. coli
gcccgagttttaacacccacaactg

SEQ ID NO: 179141 - DNA, 25 bp, E. coli
cgcagtcagccaatgcgggcaatga

SEQ ID NO: 179142 - DNA, 25 bp, E. coli
cgcagtcagccattgcgggcaatga

SEQ ID NO: 179143 - DNA, 25 bp, E. coli
tgacggtttcctgcccgagttttat

SEQ ID NO: 179144 - DNA, 25 bp, E. coli
tgacggtttcctccccgagttttat

SEQ ID NO: 179145 - DNA, 25 bp, E. coli
gatggtcgattttgacggtttcctg

SEQ ID NO: 179146 - DNA, 25 bp, E. coli
gatggtcgatttagacggtttcctg

SEQ ID NO: 179147 - DNA, 25 bp, E. coli
caatggatacatagacgagggcaag

SEQ ID NO: 179148 - DNA, 25 bp, E. coli
caatggatacattgacgagggcaag

SEQ ID NO: 179149 - DNA, 25 bp, E. coli
cacagtatcgtgttgacagaggcag

SEQ ID NO: 179150 - DNA, 25 bp, E. coli
cacagtatcgtgatgacagaggcag

SEQ ID NO: 179151 - DNA, 25 bp, E. coli
cactgagcgatgcattccgagaggc

SEQ ID NO: 179152 - DNA, 25 bp, E. coli
cactgagcgatggattccgagaggc

SEQ ID NO: 179153 - DNA, 25 bp, E. coli
tatcaaggtattttatgcgcgcacg

SEQ ID NO: 179154 - DNA, 25 bp, E. coli
tatcaaggtattatatgcgcgcacg

SEQ ID NO: 179155 - DNA, 25 bp, E. coli
tcgcgcagcaaattcagaggtaagg

SEQ ID NO: 179156 - DNA, 25 bp, E. coli
tgcgcgcacgaatagcatcaggtct

SEQ ID NO: 179157 - DNA, 25 bp, E. coli
tgcgcgcacgaaaagcatcaggtct

SEQ ID NO: 179158 - DNA, 25 bp, E. coli
tcgcgcagcaaaatcagaggtaagg

SEQ ID NO: 179159 - DNA, 25 bp, E. coli
gctttcatccggcacagtatcaagg

SEQ ID NO: 179160 - DNA, 25 bp, E. coli
gctttcatccgggacagtatcaagg

SEQ ID NO: 179161 - DNA, 25 bp, E. coli
gcggcgtcagccaagttaatcagat

SEQ ID NO: 179162 - DNA, 25 bp, E. coli
gcggcgtcagcctagttaatcagat

SEQ ID NO: 179163 - DNA, 25 bp, E. coli
gacttacggctgacgaatacctgaa

SEQ ID NO: 179164 - DNA, 25 bp, E. coli
gacttacggctgtcgaatacctgaa

SEQ ID NO: 179165 - DNA, 25 bp, E. coli
tggaactggctgatgttaccgggca

SEQ ID NO: 179166 - DNA, 25 bp, E. coli
tggaactggctgttgttaccgggca

SEQ ID NO: 179167 - DNA, 25 bp, E. coli
taagtcggacacgatggcatcacag

SEQ ID NO: 179168 - DNA, 25 bp, E. coli
taagtcggacaccatggcatcacag

SEQ ID NO: 179169 - DNA, 25 bp, E. coli
agtcgatcaatgtcaccggcggtca

SEQ ID NO: 179170 - DNA, 25 bp, E. coli
agtcgatcaatgacaccggcggtca

SEQ ID NO: 179171 - DNA, 25 bp, E. coli
tttatcagcgacatccagctcggcg

SEQ ID NO: 179172 - DNA, 25 bp, E. coli
tttatcagcgacttccagctcggcg

SEQ ID NO: 179173 - DNA, 25 bp, E. coli
tgaatatgctgctgttctacgccag

SEQ ID NO: 179174 - DNA, 25 bp, E. coli
tgctcggtaacctgctgaaatcgcc

SEQ ID NO: 179175 - DNA, 25 bp, E. coli
tgaatatgctgcagttctacgccag

SEQ ID NO: 179176 - DNA, 25 bp, E. coli
tgctcggtaaccagctgaaatcgcc

SEQ ID NO: 179177 - DNA, 25 bp, E. coli
tcgaaatccggctaagtgggcagca

SEQ ID NO: 179178 - DNA, 25 bp, E. coli
tcgatattcagaccgacaaagccgc

SEQ ID NO: 179179 - DNA, 25 bp, E. coli
tcgaaatccggcaaagtgggcagca

SEQ ID NO: 179180 - DNA, 25 bp, E. coli
tcgatattcagagcgacaaagccgc

SEQ ID NO: 179181 - DNA, 25 bp, E. coli
cgttgtcatcggaggtgggcaaacc

SEQ ID NO: 179182 - DNA, 25 bp, E. coli
cgttgtcatcggtggtgggcaaacc

SEQ ID NO: 179183 - DNA, 25 bp, E. coli
gattttgaccgttcgctacaggtga

SEQ ID NO: 179184 - DNA, 25 bp, E. coli
gattttgaccgtacgctacaggtga

SEQ ID NO: 179185 - DNA, 25 bp, E. coli
tggatctggcggtgtacggcattac

SEQ ID NO: 179186 - DNA, 25 bp, E. coli
ggctgactcaatcactggcgctgga

SEQ ID NO: 179187 - DNA, 25 bp, E. coli
tgggcaaaccttaggcgcgttcctg

SEQ ID NO: 179188 - DNA, 25 bp, E. coli
tgggcaaacctttggcgcgttcctg

SEQ ID NO: 179189 - DNA, 25 bp, E. coli
ggctgactcaatgactggcgctgga

SEQ ID NO: 179190 - DNA, 25 bp, E. coli
tggatctggcggagtacggcattac

SEQ ID NO: 179191 - DNA, 25 bp, E. coli
aaggcggcaacgaatctctgaccaa

SEQ ID NO: 179192 - DNA, 25 bp, E. coli
aaggcggcaacgtatctctgaccaa

SEQ ID NO: 179193 - DNA, 25 bp, E. coli
cagtttctctcgaaaaaggcggcaa

SEQ ID NO: 179194 - DNA, 25 bp, E. coli
cagtttctctcgtaaaaggcggcaa

SEQ ID NO: 179195 - DNA, 25 bp, E. coli
taaacaaaacttcggcatggtgagc

SEQ ID NO: 179196 - DNA, 25 bp, E. coli
taaaaccagcccagatggcgcagta

SEQ ID NO: 179197 - DNA, 25 bp, E. coli
taaacaaaacttgggcatggtgagc

SEQ ID NO: 179198 - DNA, 25 bp, E. coli
taaaaccagccctgatggcgcagta

SEQ ID NO: 179199 - DNA, 25 bp, E. coli
tggtgagcaacagcttcatgcgcgt

SEQ ID NO: 179200 - DNA, 25 bp, E. coli
tggtgagcaacaccttcatgcgcgt

SEQ ID NO: 179201 - DNA, 25 bp, E. coli
tctgaccaaagaagcaccaaccatg

SEQ ID NO: 179202 - DNA, 25 bp, E. coli
tctgaccaaagatgcaccaaccatg

SEQ ID NO: 179203 - DNA, 25 bp, E. coli
tcttcggtgaactgtatcgccatgg

SEQ ID NO: 179204 - DNA, 25 bp, E. coli
tcttcggtgaacagtatcgccatgg

SEQ ID NO: 179205 - DNA, 25 bp, E. coli
ccatctatgatggagaagcgcgtaa

SEQ ID NO: 179206 - DNA, 25 bp, E. coli
ccatctatgatgcagaagcgcgtaa

SEQ ID NO: 179207 - DNA, 25 bp, E. coli
gatctggacgctaccgtattcgcag

SEQ ID NO: 179208 - DNA, 25 bp, E. coli
gatctggacgcttccgtattcgcag

SEQ ID NO: 179209 - DNA, 25 bp, E. coli
gggatgcccgtgtaaccgatggtca

SEQ ID NO: 179210 - DNA, 25 bp, E. coli
gggatgcccgtgaaaccgatggtca

SEQ ID NO: 179211 - DNA, 25 bp, E. coli
gatctgtctgaagacgcctcaaccg

SEQ ID NO: 179212 - DNA, 25 bp, E. coli
gatctgtctgaacacgcctcaaccg

SEQ ID NO: 179213 - DNA, 25 bp, E. coli
cagcggttacgtcagtcggtacaaa

SEQ ID NO: 179214 - DNA, 25 bp, E. coli
cagcggttacgtgagtcggtacaaa

SEQ ID NO: 179215 - DNA, 25 bp, E. coli
tacgaagagtttaacgagatccgcg

SEQ ID NO: 179216 - DNA, 25 bp, E. coli
tacgaagagttttacgagatccgcg

SEQ ID NO: 179217 - DNA, 25 bp, E. coli
tatgccaatgcccatcgtctgctgg

SEQ ID NO: 179218 - DNA, 25 bp, E. coli
tagcgcaagcagttttcaccggact

SEQ ID NO: 179219 - DNA, 25 bp, E. coli
tagcgcaagcagatttcaccggact

SEQ ID NO: 179220 - DNA, 25 bp, E. coli
tatgccaatgccgatcgtctgctgg

SEQ ID NO: 179221 - DNA, 25 bp, E. coli
tttgagcaaacctgcgaaaccatcg

SEQ ID NO: 179222 - DNA, 25 bp, E. coli
tttgagcaaaccagcgaaaccatcg

SEQ ID NO: 179223 - DNA, 25 bp, E. coli
tgtggattggcttcgaccgccacgt

SEQ ID NO: 179224 - DNA, 25 bp, E. coli
tgtggattggctacgaccgccacgt

SEQ ID NO: 179225 - DNA, 25 bp, E. coli
tgcctgggccagaaaaaatgacttc

SEQ ID NO: 179226 - DNA, 25 bp, E. coli
tgcctgggccagtaaaaatgacttc

SEQ ID NO: 179227 - DNA, 25 bp, E. coli
cctattttgatgtgccgtgggcgct

SEQ ID NO: 179228 - DNA, 25 bp, E. coli
cctattttgatgagccgtgggcgct

SEQ ID NO: 179229 - DNA, 25 bp, E. coli
gcgatcatcgaagaacaacttgccg

SEQ ID NO: 179230 - DNA, 25 bp, E. coli
gcgatcatcgaacaacaacttgccg

SEQ ID NO: 179231 - DNA, 25 bp, E. coli
gaaacttccggatcgctgcgtgaat

SEQ ID NO: 179232 - DNA, 25 bp, E. coli
gaaacttccggaacgctgcgtgaat

SEQ ID NO: 179233 - DNA, 25 bp, E. coli
gtgaattttccctgacagtccccga

SEQ ID NO: 179234 - DNA, 25 bp, E. coli
gtgaattttcccagacagtccccga

SEQ ID NO: 179235 - DNA, 25 bp, E. coli
catttctgattgaaatgtggaccga

SEQ ID NO: 179236 - DNA, 25 bp, E. coli
catttctgattgtaatgtggaccga

SEQ ID NO: 179237 - DNA, 25 bp, E. coli
aacgtacttcgctggttaccgcgat

SEQ ID NO: 179238 - DNA, 25 bp, E. coli
aacgtacttcgcaggttaccgcgat

SEQ ID NO: 179239 - DNA, 25 bp, E. coli
tagccccggacacttcctcgatgtg

SEQ ID NO: 179240 - DNA, 25 bp, E. coli
tagccccggacagttcctcgatgtg

SEQ ID NO: 179241 - DNA, 25 bp, E. coli
tattccgtcaatgtgcctgtccgca

SEQ ID NO: 179242 - DNA, 25 bp, E. coli
tattccgtcaatctgcctgtccgca

SEQ ID NO: 179243 - DNA, 25 bp, E. coli
tgaaagacactcaacccgttaccga

SEQ ID NO: 179244 - DNA, 25 bp, E. coli
tgaaagacactctacccgttaccga

SEQ ID NO: 179245 - DNA, 25 bp, E. coli
gctgcatgagctcaactatcgcgga

SEQ ID NO: 179246 - DNA, 25 bp, E. coli
gctgcatgagctgaactatcgcgga

SEQ ID NO: 179247 - DNA, 25 bp, E. coli
cgcgatgatcgatacgggtgttgct

SEQ ID NO: 179248 - DNA, 25 bp, E. coli
cgcgatgatcgaaacgggtgttgct

SEQ ID NO: 179249 - DNA, 25 bp, E. coli
gttaccgaacatagccccggacagt

SEQ ID NO: 179250 - DNA, 25 bp, E. coli
gttaccgaacattgccccggacagt

SEQ ID NO: 179251 - DNA, 25 bp, E. coli
ggcaagcgtgcgtaatcatccgtta

SEQ ID NO: 179252 - DNA, 25 bp, E. coli
ggcaagcgtgcgaaatcatccgtta

SEQ ID NO: 179253 - DNA, 25 bp, E. coli
ggcattcgtacttttcaactggcag

SEQ ID NO: 179254 - DNA, 25 bp, E. coli
ggcattcgtactattcaactggcag

SEQ ID NO: 179255 - DNA, 25 bp, E. coli
tcaactggcaggttacgacgtctat

SEQ ID NO: 179256 - DNA, 25 bp, E. coli
tcaactggcaggatacgacgtctat

SEQ ID NO: 179257 - DNA, 25 bp, E. coli
aaactgttctgttcattgggcggca

SEQ ID NO: 179258 - DNA, 25 bp, E. coli
aaactgttctgtacattgggcggca

SEQ ID NO: 179259 - DNA, 25 bp, E. coli
tattgctgcgacgaacgtgaacgat

SEQ ID NO: 179260 - DNA, 25 bp, E. coli
tattgctgcgaccaacgtgaacgat

SEQ ID NO: 179261 - DNA, 25 bp, E. coli
tctcggtgccaaccggaaacttcgg

SEQ ID NO: 179262 - DNA, 25 bp, E. coli
tcagtggtcaccgaaagcgactcag

SEQ ID NO: 179263 - DNA, 25 bp, E. coli
tctcggtgaaaccttggatctgcca

SEQ ID NO: 179264 - DNA, 25 bp, E. coli
tctcggtgccaagcggaaacttcgg

SEQ ID NO: 179265 - DNA, 25 bp, E. coli
tctcggtgaaacgttggatctgcca

SEQ ID NO: 179266 - DNA, 25 bp, E. coli
tcagtggtcacccaaagcgactcag

SEQ ID NO: 179267 - DNA, 25 bp, E. coli
gcatttaaagatatcggcggtcgct

SEQ ID NO: 179268 - DNA, 25 bp, E. coli
gcatttaaagatttcggcggtcgct

SEQ ID NO: 179269 - DNA, 25 bp, E. coli
gaatatggcttgttcctcggcaccg

SEQ ID NO: 179270 - DNA, 25 bp, E. coli
gaatatggcttgatcctcggcaccg

SEQ ID NO: 179271 - DNA, 25 bp, E. coli
gaaactgttgccttcgacggcgatt

SEQ ID NO: 179272 - DNA, 25 bp, E. coli
gaaactgttgccatcgacggcgatt

SEQ ID NO: 179273 - DNA, 25 bp, E. coli
tggattttgtcagccgcagtgcgaa

SEQ ID NO: 179274 - DNA, 25 bp, E. coli
tggattttgtcacccgcagtgcgaa

SEQ ID NO: 179275 - DNA, 25 bp, E. coli
taagccagtgacgattctgaccgcg

SEQ ID NO: 179276 - DNA, 25 bp, E. coli
taagccagtgaccattctgaccgcg

SEQ ID NO: 179277 - DNA, 25 bp, E. coli
gacctgccggaaatcagcctgactg

SEQ ID NO: 179278 - DNA, 25 bp, E. coli
gacctgccggaattcagcctgactg

SEQ ID NO: 179279 - DNA, 25 bp, E. coli
caccgcgcggcctgaagtttgagct

SEQ ID NO: 179280 - DNA, 25 bp, E. coli
caccgcgcggccagaagtttgagct

SEQ ID NO: 179281 - DNA, 25 bp, E. coli
catttgctgggaacagagcgatacc

SEQ ID NO: 179282 - DNA, 25 bp, E. coli
catttgctgggatcagagcgatacc

SEQ ID NO: 179283 - DNA, 25 bp, E. coli
ttaagagcgtggtttgacgacccgc

SEQ ID NO: 179284 - DNA, 25 bp, E. coli
ttaagagcgtggattgacgacccgc

SEQ ID NO: 179285 - DNA, 25 bp, E. coli
tctggttacgcatagatcatccggc

SEQ ID NO: 179286 - DNA, 25 bp, E. coli
tctggttacgcaaagatcatccggc

SEQ ID NO: 179287 - DNA, 25 bp, E. coli
gccggaattcgagcagtcactgttt

SEQ ID NO: 179288 - DNA, 25 bp, E. coli
gccggaattcgaccagtcactgttt

SEQ ID NO: 179289 - DNA, 25 bp, E. coli
cctgggcgctggtcaatgtgttaca

SEQ ID NO: 179290 - DNA, 25 bp, E. coli
cctgggcgctggacaatgtgttaca

SEQ ID NO: 179291 - DNA, 25 bp, E. coli
gacgacccgctctttgtgaactcac

SEQ ID NO: 179292 - DNA, 25 bp, E. coli
cgcaggcgaccatcaaattacgtaa

SEQ ID NO: 179293 - DNA, 25 bp, E. coli
cgcaggcgaccaacaaattacgtaa

SEQ ID NO: 179294 - DNA, 25 bp, E. coli
tggatgcaaatgtgcaacctgctgc

SEQ ID NO: 179295 - DNA, 25 bp, E. coli
tggatgcaaatgagcaacctgctgc

SEQ ID NO: 179296 - DNA, 25 bp, E. coli
tcagcatggagctaaatctggcgga

SEQ ID NO: 179297 - DNA, 25 bp, E. coli
tcagcatggagcaaaatctggcgga

SEQ ID NO: 179298 - DNA, 25 bp, E. coli
gatgatcatgctaaatgcgctgtcg

SEQ ID NO: 179299 - DNA, 25 bp, E. coli
gatgatcatgcttaatgcgctgtcg

SEQ ID NO: 179300 - DNA, 25 bp, E. coli
gacgacccgctcattgtgaactcac

SEQ ID NO: 179301 - DNA, 25 bp, E. coli
cacggtgatttacgcatttcgatga

SEQ ID NO: 179302 - DNA, 25 bp, E. coli
cacggtgatttaggcatttcgatga

SEQ ID NO: 179303 - DNA, 25 bp, E. coli
tactcgatgccaattttctggtggg

SEQ ID NO: 179304 - DNA, 25 bp, E. coli
tactcgatgccatttttctggtggg

SEQ ID NO: 179305 - DNA, 25 bp, E. coli
tgatttaggcatatcgatgaaaagc

SEQ ID NO: 179306 - DNA, 25 bp, E. coli
tgtctccggtcgagtgagcgacatg

SEQ ID NO: 179307 - DNA, 25 bp, E. coli
tgtctccggtcgtgtgagcgacatg

SEQ ID NO: 179308 - DNA, 25 bp, E. coli
tgatttaggcatttcgatgaaaagc

SEQ ID NO: 179309 - DNA, 25 bp, E. coli
tgccaaaggtctaacccggatgcgg

SEQ ID NO: 179310 - DNA, 25 bp, E. coli
tgccaaaggtcttacccggatgcgg

SEQ ID NO: 179311 - DNA, 25 bp, E. coli
tcttacccggatccgggtgattatc

SEQ ID NO: 179312 - DNA, 25 bp, E. coli
tcttacccggatgcgggtgattatc

SEQ ID NO: 179313 - DNA, 25 bp, E. coli
gcgcgtgccaaaggtcttacccgga

SEQ ID NO: 179314 - DNA, 25 bp, E. coli
gcctgtctccggtcgtgtgagcgac

SEQ ID NO: 179315 - DNA, 25 bp, E. coli
gcctgtctccggacgtgtgagcgac

SEQ ID NO: 179316 - DNA, 25 bp, E. coli
gcctggcgctgagcggctactcgat

SEQ ID NO: 179317 - DNA, 25 bp, E. coli
gcgcgtgccaaacgtcttacccgga

SEQ ID NO: 179318 - DNA, 25 bp, E. coli
gcctggcgctgaccggctactcgat

SEQ ID NO: 179319 - DNA, 25 bp, E. coli
gcgtaatgcacgctgatttaggcat

SEQ ID NO: 179320 - DNA, 25 bp, E. coli
gcgtaatgcacggtgatttaggcat

SEQ ID NO: 179321 - DNA, 25 bp, E. coli
gctgaccggctactcgatgccaatt

SEQ ID NO: 179322 - DNA, 25 bp, E. coli
gctgaccggctagtcgatgccaatt

SEQ ID NO: 179323 - DNA, 25 bp, E. coli
cacagcaacaattcacagacgagga

SEQ ID NO: 179324 - DNA, 25 bp, E. coli
cacagcaacaatacacagacgagga

SEQ ID NO: 179325 - DNA, 25 bp, E. coli
tagagcgtaacgaaaaaggccgaca

SEQ ID NO: 179326 - DNA, 25 bp, E. coli
tagagcgtaacgtaaaaggccgaca

SEQ ID NO: 179327 - DNA, 25 bp, E. coli
tatatagctattacccagaaacggg

SEQ ID NO: 179328 - DNA, 25 bp, E. coli
tatatagctatttcccagaaacggg

SEQ ID NO: 179329 - DNA, 25 bp, E. coli
tgcaactctggatggaaaaagccca

SEQ ID NO: 179330 - DNA, 25 bp, E. coli
tgcaactctggaaggaaaaagccca

SEQ ID NO: 179331 - DNA, 25 bp, E. coli
tccgatcatgaatgagctgaactcc

SEQ ID NO: 179332 - DNA, 25 bp, E. coli
tccgatcatgaaagagctgaactcc

SEQ ID NO: 179333 - DNA, 25 bp, E. coli
ccaatgctgaaatgcctgcgggcaa

SEQ ID NO: 179334 - DNA, 25 bp, E. coli
ccaatgctgaaaagcctgcgggcaa

SEQ ID NO: 179335 - DNA, 25 bp, E. coli
gaactcctcatacacgaacaagctg

SEQ ID NO: 179336 - DNA, 25 bp, E. coli
gaaacttcgcaacatgcagtcggca

SEQ ID NO: 179337 - DNA, 25 bp, E. coli
gacattgcgtttgagaccatctaca

SEQ ID NO: 179338 - DNA, 25 bp, E. coli
gacattgcgtttcagaccatctaca

SEQ ID NO: 179339 - DNA, 25 bp, E. coli
gaaacttcgcaagatgcagtcggca

SEQ ID NO: 179340 - DNA, 25 bp, E. coli
gaactcctcatagacgaacaagctg

SEQ ID NO: 179341 - DNA, 25 bp, E. coli
ggccgacagataggcagatacttca

SEQ ID NO: 179342 - DNA, 25 bp, E. coli
ggccgacagatacgcagatacttca

SEQ ID NO: 179343 - DNA, 25 bp, E. coli
gagtttcgtagttcagcgggccaga

SEQ ID NO: 179344 - DNA, 25 bp, E. coli
gagtttcgtagtacagcgggccaga

SEQ ID NO: 179345 - DNA, 25 bp, E. coli
caccgttcggtgaatattgcagagc

SEQ ID NO: 179346 - DNA, 25 bp, E. coli
caccgttcggtgtatattgcagagc

SEQ ID NO: 179347 - DNA, 25 bp, E. coli
cagaaatgtccgttcacgagctggc

SEQ ID NO: 179348 - DNA, 25 bp, E. coli
cagaaatgtccgatcacgagctggc

SEQ ID NO: 179349 - DNA, 25 bp, E. coli
aacacggtatccctatcgatgcaga

SEQ ID NO: 179350 - DNA, 25 bp, E. coli
aacacggtatccgtatcgatgcaga

SEQ ID NO: 179351 - DNA, 25 bp, E. coli
aaatgctgcgtagccgtctgctggg

SEQ ID NO: 179352 - DNA, 25 bp, E. coli
aaatgctgcgtacccgtctgctggg

SEQ ID NO: 179353 - DNA, 25 bp, E. coli
taccagacgcgatgctatcttgagc

SEQ ID NO: 179354 - DNA, 25 bp, E. coli
taccagacgcgaagctatcttgagc

SEQ ID NO: 179355 - DNA, 25 bp, E. coli
tgttcgtaatatcccggagtcacca

SEQ ID NO: 179356 - DNA, 25 bp, E. coli
tgttcgtaatatgccggagtcacca

SEQ ID NO: 179357 - DNA, 25 bp, E. coli
tcaggttcaggttaatctgtcgccc

SEQ ID NO: 179358 - DNA, 25 bp, E. coli
tcaggttcaggtaaatctgtcgccc

SEQ ID NO: 179359 - DNA, 25 bp, E. coli
cgctcgcgcggttaaaacgtccagt

SEQ ID NO: 179360 - DNA, 25 bp, E. coli
cgctcgcgcggtaaaaacgtccagt

SEQ ID NO: 179361 - DNA, 25 bp, E. coli
taattcgtcgtttcagtgacacgcg

SEQ ID NO: 179362 - DNA, 25 bp, E. coli
taattcgtcgttacagtgacacgcg

SEQ ID NO: 179363 - DNA, 25 bp, E. coli
gagtctttcggcatcaaacacggta

SEQ ID NO: 179364 - DNA, 25 bp, E. coli
gatgagtaacctccctgacgctttc

SEQ ID NO: 179365 - DNA, 25 bp, E. coli
gatgagtaacctgcctgacgctttc

SEQ ID NO: 179366 - DNA, 25 bp, E. coli
gagtctttcggcttcaaacacggta

SEQ ID NO: 179367 - DNA, 25 bp, E. coli
caaaactcaagggaattatccggcg

SEQ ID NO: 179368 - DNA, 25 bp, E. coli
caaaactcaaggcaattatccggcg

SEQ ID NO: 179369 - DNA, 25 bp, E. coli
catcctggaggtagttgaaacggga

SEQ ID NO: 179370 - DNA, 25 bp, E. coli
catcctggaggttgttgaaacggga

SEQ ID NO: 179371 - DNA, 25 bp, E. coli
catgcgctgaagaacagttgggatc

SEQ ID NO: 179372 - DNA, 25 bp, E. coli
catgcgctgaagtacagttgggatc

SEQ ID NO: 179373 - DNA, 25 bp, E. coli
taaaccggacaacttcattgctggc

SEQ ID NO: 179374 - DNA, 25 bp, E. coli
taaaccggacaagttcattgctggc

SEQ ID NO: 179375 - DNA, 25 bp, E. coli
aaaacaaagagttgcgaggcgtggt

SEQ ID NO: 179376 - DNA, 25 bp, E. coli
aaaacaaagagtagcgaggcgtggt

SEQ ID NO: 179377 - DNA, 25 bp, E. coli
ttatccggcgactgaacgcatcctg

SEQ ID NO: 179378 - DNA, 25 bp, E. coli
ttatccggcgacagaacgcatcctg

SEQ ID NO: 179379 - DNA, 25 bp, E. coli
ttgaaacgggattagcgcagggcac

SEQ ID NO: 179380 - DNA, 25 bp, E. coli
ttgaaacgggataagcgcagggcac

SEQ ID NO: 179381 - DNA, 25 bp, E. coli
tgctggcgcagacatcaacatgatc

SEQ ID NO: 179382 - DNA, 25 bp, E. coli
tgctggcgcagagatcaacatgatc

SEQ ID NO: 179383 - DNA, 25 bp, E. coli
cgttgtgttgatcagcaggttatcc

SEQ ID NO: 179384 - DNA, 25 bp, E. coli
cgttgtgttgatgagcaggttatcc

SEQ ID NO: 179385 - DNA, 25 bp, E. coli
ggcgtggtgtttctctccgctaaac

SEQ ID NO: 179386 - DNA, 25 bp, E. coli
ggcgtggtgtttgtctccgctaaac

SEQ ID NO: 179387 - DNA, 25 bp, E. coli
taagcaactccgtgaaaacaaagag

SEQ ID NO: 179388 - DNA, 25 bp, E. coli
taagcaactccgagaaaacaaagag

SEQ ID NO: 179389 - DNA, 25 bp, E. coli
aacgttgtctatccagcggaccgcg

SEQ ID NO: 179390 - DNA, 25 bp, E. coli
cagcgacggtctggtgttaatccac

SEQ ID NO: 179391 - DNA, 25 bp, E. coli
cagcgacggtctcgtgttaatccac

SEQ ID NO: 179392 - DNA, 25 bp, E. coli
taaagatgtccccattgccaaccgt

SEQ ID NO: 179393 - DNA, 25 bp, E. coli
tacaagcgctgatcgaagctgacgg

SEQ ID NO: 179394 - DNA, 25 bp, E. coli
taaagatgtcccgattgccaaccgt

SEQ ID NO: 179395 - DNA, 25 bp, E. coli
tacaagcgctgaacgaagctgacgg

SEQ ID NO: 179396 - DNA, 25 bp, E. coli
aacgttgtctatgcagcggaccgcg

SEQ ID NO: 179397 - DNA, 25 bp, E. coli
aaatgaccgggtcatggcgttgacc

SEQ ID NO: 179398 - DNA, 25 bp, E. coli
aaatgaccgggtgatggcgttgacc

SEQ ID NO: 179399 - DNA, 25 bp, E. coli
tataatggtaacgtgacggcgcttg

SEQ ID NO: 179400 - DNA, 25 bp, E. coli
tataatggtaacctgacggcgcttg

SEQ ID NO: 179401 - DNA, 25 bp, E. coli
tgtggcatggcatactaaagtcgcg

SEQ ID NO: 179402 - DNA, 25 bp, E. coli
tgtggcatggcaaactaaagtcgcg

SEQ ID NO: 179403 - DNA, 25 bp, E. coli
tgtggacacaaaccgatctgctgca

SEQ ID NO: 179404 - DNA, 25 bp, E. coli
tgatccaggcaatagacggaaccgt

SEQ ID NO: 179405 - DNA, 25 bp, E. coli
tgtggacacaaagcgatctgctgca

SEQ ID NO: 179406 - DNA, 25 bp, E. coli
tgatccaggcaaaagacggaaccgt

SEQ ID NO: 179407 - DNA, 25 bp, E. coli
gaccgtctgagccatgttgacacga

SEQ ID NO: 179408 - DNA, 25 bp, E. coli
gatggtcgtttcgttgcccagcaaa

SEQ ID NO: 179409 - DNA, 25 bp, E. coli
gaccgtctgagcgatgttgacacga

SEQ ID NO: 179410 - DNA, 25 bp, E. coli
gatggtcgtttccttgcccagcaaa

SEQ ID NO: 179411 - DNA, 25 bp, E. coli
aatcgtcagcgccaagcctttatgg

SEQ ID NO: 179412 - DNA, 25 bp, E. coli
gaaggcccggctcattttaatgacc

SEQ ID NO: 179413 - DNA, 25 bp, E. coli
aatcgtcagcgcgaagcctttatgg

SEQ ID NO: 179414 - DNA, 25 bp, E. coli
gaaggcccggctgattttaatgacc

SEQ ID NO: 179415 - DNA, 25 bp, E. coli
cacttgttcgaagatgaaagccagc

SEQ ID NO: 179416 - DNA, 25 bp, E. coli
cacttgcaggcaacggtgaagaacg

SEQ ID NO: 179417 - DNA, 25 bp, E. coli
cacttgttcgaacatgaaagccagc

SEQ ID NO: 179418 - DNA, 25 bp, E. coli
cacttgcaggcatcggtgaagaacg

SEQ ID NO: 179419 - DNA, 25 bp, E. coli
tatcaccacatgtcttagccaggcg

SEQ ID NO: 179420 - DNA, 25 bp, E. coli
tatcaccacatgacttagccaggcg

SEQ ID NO: 179421 - DNA, 25 bp, E. coli
ttagaagccgatatgctggacgcgg

SEQ ID NO: 179422 - DNA, 25 bp, E. coli
ttagaagccgatttgctggacgcgg

SEQ ID NO: 179423 - DNA, 25 bp, E. coli
tgaagaacgctggaaattaacccgc

SEQ ID NO: 179424 - DNA, 25 bp, E. coli
tgaagaacgctgcaaattaacccgc

SEQ ID NO: 179425 - DNA, 25 bp, E. coli
tgaaatcgttaatcgaaagccagcg

SEQ ID NO: 179426 - DNA, 25 bp, E. coli
tgaaatcgttaaacgaaagccagcg

SEQ ID NO: 179427 - DNA, 25 bp, E. coli
gaaaagcgccttcatgtgctggcag

SEQ ID NO: 179428 - DNA, 25 bp, E. coli
gaaaagcgccttgatgtgctggcag

SEQ ID NO: 179429 - DNA, 25 bp, E. coli
taacgttgatagtcacattagcggg

SEQ ID NO: 179430 - DNA, 25 bp, E. coli
taacgttgatagacacattagcggg

SEQ ID NO: 179431 - DNA, 25 bp, E. coli
gatgtcacctgcgaactggaacgta

SEQ ID NO: 179432 - DNA, 25 bp, E. coli
gatgtcacctgccaactggaacgta

SEQ ID NO: 179433 - DNA, 25 bp, E. coli
cacttggtgatgactttcgttgatt

SEQ ID NO: 179434 - DNA, 25 bp, E. coli
cacttggtgatgtctttcgttgatt

SEQ ID NO: 179435 - DNA, 25 bp, E. coli
taaaggaagcaaaagggattgctgg

SEQ ID NO: 179436 - DNA, 25 bp, E. coli
taaaggaagcaatagggattgctgg

SEQ ID NO: 179437 - DNA, 25 bp, E. coli
tagtctgatgaacttgacgtcgggc

SEQ ID NO: 179438 - DNA, 25 bp, E. coli
tagtctgatgaagttgacgtcgggc

SEQ ID NO: 179439 - DNA, 25 bp, E. coli
tgcggtcaccaactgtaggtcggat

SEQ ID NO: 179440 - DNA, 25 bp, E. coli
tgcggtcaccaagtgtaggtcggat

SEQ ID NO: 179441 - DNA, 25 bp, E. coli
tctatagaaaagtaactgaaagttc

SEQ ID NO: 179442 - DNA, 25 bp, E. coli
tctatagaaaagaaactgaaagttc

SEQ ID NO: 179443 - DNA, 25 bp, E. coli
gcctttcgtttcttttcacttggtg

SEQ ID NO: 179444 - DNA, 25 bp, E. coli
gcctttcgtttcatttcacttggtg

SEQ ID NO: 179445 - DNA, 25 bp, E. coli
gctttatccggcgttgcggtcacca

SEQ ID NO: 179446 - DNA, 25 bp, E. coli
gctttatccggccttgcggtcacca

SEQ ID NO: 179447 - DNA, 25 bp, E. coli
gaagtgaaggcccaataaaggagca

SEQ ID NO: 179448 - DNA, 25 bp, E. coli
gaagtgaaggccgaataaaggagca

SEQ ID NO: 179449 - DNA, 25 bp, E. coli
gacgtcgggcgtagtcgctttcact

SEQ ID NO: 179450 - DNA, 25 bp, E. coli
gacaccgctgcagagatcaaaacga

SEQ ID NO: 179451 - DNA, 25 bp, E. coli
gacaccgctgcacagatcaaaacga

SEQ ID NO: 179452 - DNA, 25 bp, E. coli
gacgtcgggcgttgtcgctttcact

SEQ ID NO: 179453 - DNA, 25 bp, E. coli
cgaaatttgtgatcgttgaaagaaa

SEQ ID NO: 179454 - DNA, 25 bp, E. coli
cgaaatttgtgaacgttgaaagaaa

SEQ ID NO: 179455 - DNA, 25 bp, E. coli
aatcaatctgctgcataaacttccc

SEQ ID NO: 179456 - DNA, 25 bp, E. coli
aatcaatctgctccataaacttccc

SEQ ID NO: 179457 - DNA, 25 bp, E. coli
atcctcgctgctccctggctggtaa

SEQ ID NO: 179458 - DNA, 25 bp, E. coli
atcctcgctgctgcctggctggtaa

SEQ ID NO: 179459 - DNA, 25 bp, E. coli
aacgcactggcgttaacggtctgaa

SEQ ID NO: 179460 - DNA, 25 bp, E. coli
aacgcactggcgataacggtctgaa

SEQ ID NO: 179461 - DNA, 25 bp, E. coli
tgagcggcgcacacatcgccattat

SEQ ID NO: 179462 - DNA, 25 bp, E. coli
tgcacggctggtgctcggcgttacc

SEQ ID NO: 179463 - DNA, 25 bp, E. coli
tgcacggctggtcctcggcgttacc

SEQ ID NO: 179464 - DNA, 25 bp, E. coli
tgagcggcgcactcatcgccattat

SEQ ID NO: 179465 - DNA, 25 bp, E. coli
gccattattgccgtgatcctcgctg

SEQ ID NO: 179466 - DNA, 25 bp, E. coli
gccattattgccctgatcctcgctg

SEQ ID NO: 179467 - DNA, 25 bp, E. coli
gaccgattttcactcggtcatgaaa

SEQ ID NO: 179468 - DNA, 25 bp, E. coli
gaccgattttcagtcggtcatgaaa

SEQ ID NO: 179469 - DNA, 25 bp, E. coli
cggtcatgaaaaatttgcttaagcg

SEQ ID NO: 179470 - DNA, 25 bp, E. coli
cggtcatgaaaattttgcttaagcg

SEQ ID NO: 179471 - DNA, 25 bp, E. coli
gttaacggtctgaaaattagcgcca

SEQ ID NO: 179472 - DNA, 25 bp, E. coli
gtctgaaaattaccgccagtgcttc

SEQ ID NO: 179473 - DNA, 25 bp, E. coli
gttaacggtctgtaaattagcgcca

SEQ ID NO: 179474 - DNA, 25 bp, E. coli
gtctgaaaattagcgccagtgcttc

SEQ ID NO: 179475 - DNA, 25 bp, E. coli
gagataccgcagtccgattttcagt

SEQ ID NO: 179476 - DNA, 25 bp, E. coli
gagataccgcagaccgattttcagt

SEQ ID NO: 179477 - DNA, 25 bp, E. coli
taaacttttctccctgcgtgttgat

SEQ ID NO: 179478 - DNA, 25 bp, E. coli
taaacttttctcgctgcgtgttgat

SEQ ID NO: 179479 - DNA, 25 bp, E. coli
atgtcggtaaacatttctccctgcg

SEQ ID NO: 179480 - DNA, 25 bp, E. coli
atgtcggtaaacttttctccctgcg

SEQ ID NO: 179481 - DNA, 25 bp, E. coli
tgtcggtaaacttttctccctgcgt

SEQ ID NO: 179482 - DNA, 25 bp, E. coli
tgtcggtaaactattctccctgcgt

SEQ ID NO: 179483 - DNA, 25 bp, E. coli
tcggtaaacttttctccctgcgtgt

SEQ ID NO: 179484 - DNA, 25 bp, E. coli
tcggtaaactttactccctgcgtgt

SEQ ID NO: 179485 - DNA, 25 bp, E. coli
cctgctacaaccacggcgcgatgat

SEQ ID NO: 179486 - DNA, 25 bp, E. coli
cctgctacaacctcggcgcgatgat

SEQ ID NO: 179487 - DNA, 25 bp, E. coli
gtaaacttttctgcctgcgtgttga

SEQ ID NO: 179488 - DNA, 25 bp, E. coli
gtaaacttttctccctgcgtgttga

SEQ ID NO: 179489 - DNA, 25 bp, E. coli
ggtaaacttttctccctgcgtgttg

SEQ ID NO: 179490 - DNA, 25 bp, E. coli
ggtaaacttttcaccctgcgtgttg

SEQ ID NO: 179491 - DNA, 25 bp, E. coli
gtcggtaaacttttctccctgcgtg

SEQ ID NO: 179492 - DNA, 25 bp, E. coli
gtcggtaaacttatctccctgcgtg

SEQ ID NO: 179493 - DNA, 25 bp, E. coli
tacgcctcgggctggctacttaacc

SEQ ID NO: 179494 - DNA, 25 bp, E. coli
taccactgcctggtaactcgaagta

SEQ ID NO: 179495 - DNA, 25 bp, E. coli
taccactgcctgctaactcgaagta

SEQ ID NO: 179496 - DNA, 25 bp, E. coli
tacgcctcgggcaggctacttaacc

SEQ ID NO: 179497 - DNA, 25 bp, E. coli
tatgctggaactttaggtaatgcct

SEQ ID NO: 179498 - DNA, 25 bp, E. coli
tatgctggaactataggtaatgcct

SEQ ID NO: 179499 - DNA, 25 bp, E. coli
taggctatgcctaatgttttgagcg

SEQ ID NO: 179500 - DNA, 25 bp, E. coli
taggctatgccttatgttttgagcg

SEQ ID NO: 179501 - DNA, 25 bp, E. coli
tgttttgagcgttacctaataggtg

SEQ ID NO: 179502 - DNA, 25 bp, E. coli
tgttttgagcgtaacctaataggtg

SEQ ID NO: 179503 - DNA, 25 bp, E. coli
cctaataggtgaaggcgacagcaga

SEQ ID NO: 179504 - DNA, 25 bp, E. coli
cctaataggtgatggcgacagcaga

SEQ ID NO: 179505 - DNA, 25 bp, E. coli
gaatccaggagtattccgtcagacc

SEQ ID NO: 179506 - DNA, 25 bp, E. coli
gaatccaggagttttccgtcagacc

SEQ ID NO: 179507 - DNA, 25 bp, E. coli
gcaaaatttgaatcccgccgtcatg

SEQ ID NO: 179508 - DNA, 25 bp, E. coli
gcaaaatttgaaacccgccgtcatg

SEQ ID NO: 179509 - DNA, 25 bp, E. coli
gtcatgttcatacgcctcgggctgg

SEQ ID NO: 179510 - DNA, 25 bp, E. coli
gtcatgttcataggcctcgggctgg

SEQ ID NO: 179511 - DNA, 25 bp, E. coli
taattgattgtctataggctatgcc

SEQ ID NO: 179512 - DNA, 25 bp, E. coli
taactcgaagtaatgcccggcgttc

SEQ ID NO: 179513 - DNA, 25 bp, E. coli
taactcgaagtattgcccggcgttc

SEQ ID NO: 179514 - DNA, 25 bp, E. coli
taattgattgtcaataggctatgcc

SEQ ID NO: 179515 - DNA, 25 bp, E. coli
cagctacaacatcctcaacaagttg

SEQ ID NO: 179516 - DNA, 25 bp, E. coli
cagctacaacatgctcaacaagttg

SEQ ID NO: 179517 - DNA, 25 bp, E. coli
caggaacagctagaacatgctcaac

SEQ ID NO: 179518 - DNA, 25 bp, E. coli
caggaacagctacaacatgctcaac

SEQ ID NO: 179519 - DNA, 25 bp, E. coli
atgctcaacaagatgctgcccgtga

SEQ ID NO: 179520 - DNA, 25 bp, E. coli
atgctcaacaagttgctgcccgtga

SEQ ID NO: 179521 - DNA, 25 bp, E. coli
ttaagccaggaacagctacaacatg

SEQ ID NO: 179522 - DNA, 25 bp, E. coli
ttaagccaggaagagctacaacatg

SEQ ID NO: 179523 - DNA, 25 bp, E. coli
tgctcaacaagttgctgcccgtgat

SEQ ID NO: 179524 - DNA, 25 bp, E. coli
tgctcaacaagtagctgcccgtgat

SEQ ID NO: 179525 - DNA, 25 bp, E. coli
gccaggaacagctacaacatgctca

SEQ ID NO: 179526 - DNA, 25 bp, E. coli
gccaggaacagcaacaacatgctca

SEQ ID NO: 179527 - DNA, 25 bp, E. coli
gctacaacatgcacaacaagttgct

SEQ ID NO: 179528 - DNA, 25 bp, E. coli
gctacaacatgctcaacaagttgct

SEQ ID NO: 179529 - DNA, 25 bp, E. coli
gaacagctacaagatgctcaacaag

SEQ ID NO: 179530 - DNA, 25 bp, E. coli
gaacagctacaacatgctcaacaag

SEQ ID NO: 179531 - DNA, 25 bp, E. coli
cttaagccaggatcagctacaacat

SEQ ID NO: 179532 - DNA, 25 bp, E. coli
ctacaacatgctcaacaagttgctg

SEQ ID NO: 179533 - DNA, 25 bp, E. coli
cttaagccaggaacagctacaacat

SEQ ID NO: 179534 - DNA, 25 bp, E. coli
ctacaacatgctgaacaagttgctg

SEQ ID NO: 179535 - DNA, 25 bp, E. coli
taagccaggaactgctacaacatgc

SEQ ID NO: 179536 - DNA, 25 bp, E. coli
taagccaggaacagctacaacatgc

SEQ ID NO: 179537 - DNA, 25 bp, E. coli
aagctaacgccggtgcggcctgaaa

SEQ ID NO: 179538 - DNA, 25 bp, E. coli
aagctaacgccgctgcggcctgaaa

SEQ ID NO: 179539 - DNA, 25 bp, E. coli
catgaatgtattgaggttattagcg

SEQ ID NO: 179540 - DNA, 25 bp, E. coli
catgaatgtattcaggttattagcg

SEQ ID NO: 179541 - DNA, 25 bp, E. coli
taccgacggatagaacgacccggtg

SEQ ID NO: 179542 - DNA, 25 bp, E. coli
taccgacggatacaacgacccggtg

SEQ ID NO: 179543 - DNA, 25 bp, E. coli
acgacgggtatgaccgccggagata

SEQ ID NO: 179544 - DNA, 25 bp, E. coli
acgacgggtatgtccgccggagata

SEQ ID NO: 179545 - DNA, 25 bp, E. coli
tagcgaatagactaatcggttgccg

SEQ ID NO: 179546 - DNA, 25 bp, E. coli
tagcgaatagacaaatcggttgccg

SEQ ID NO: 179547 - DNA, 25 bp, E. coli
gcaagcgccagaatccccaggagct

SEQ ID NO: 179548 - DNA, 25 bp, E. coli
gcaagcgccagattccccaggagct

SEQ ID NO: 179549 - DNA, 25 bp, E. coli
ccctatggatttctgggtgcagcaa

SEQ ID NO: 179550 - DNA, 25 bp, E. coli
ccctatggatttgtgggtgcagcaa

SEQ ID NO: 179551 - DNA, 25 bp, E. coli
ctgcggcctgaaagacgacgggtat

SEQ ID NO: 179552 - DNA, 25 bp, E. coli
ctgcggcctgaatgacgacgggtat

SEQ ID NO: 179553 - DNA, 25 bp, E. coli
gtgcagcaaggtagcaagcgccaga

SEQ ID NO: 179554 - DNA, 25 bp, E. coli
ggtattacttcacataccctatgga

SEQ ID NO: 179555 - DNA, 25 bp, E. coli
ggtattacttcagataccctatgga

SEQ ID NO: 179556 - DNA, 25 bp, E. coli
gtgcagcaaggttgcaagcgccaga

SEQ ID NO: 179557 - DNA, 25 bp, E. coli
ggccggcttttttctggtaatctca

SEQ ID NO: 179558 - DNA, 25 bp, E. coli
ggccggctttttactggtaatctca

SEQ ID NO: 179559 - DNA, 25 bp, E. coli
caaacatgcgcgttctggttgtgct

SEQ ID NO: 179560 - DNA, 25 bp, E. coli
caaacatgcgcgatctggttgtgct

SEQ ID NO: 179561 - DNA, 25 bp, E. coli
catgcgcgttctggttgtgcttagc

SEQ ID NO: 179562 - DNA, 25 bp, E. coli
catgcgcgttctcgttgtgcttagc

SEQ ID NO: 179563 - DNA, 25 bp, E. coli
acctgtgcgagctcgatgccgttac

SEQ ID NO: 179564 - DNA, 25 bp, E. coli
acctgtgcgagcacgatgccgttac

SEQ ID NO: 179565 - DNA, 25 bp, E. coli
acatgcgcgttctggttgtgcttag

SEQ ID NO: 179566 - DNA, 25 bp, E. coli
acatgcgcgttcaggttgtgcttag

SEQ ID NO: 179567 - DNA, 25 bp, E. coli
aacatgcgcgttgtggttgtgctta

SEQ ID NO: 179568 - DNA, 25 bp, E. coli
aacatgcgcgttctggttgtgctta

SEQ ID NO: 179569 - DNA, 25 bp, E. coli
ttgtgcttagccggaacctgtgcga

SEQ ID NO: 179570 - DNA, 25 bp, E. coli
ttgtgcttagcccgaacctgtgcga

SEQ ID NO: 179571 - DNA, 25 bp, E. coli
tgtgcgagcacgatgccgttacgtg

SEQ ID NO: 179572 - DNA, 25 bp, E. coli
tgtgcgagcacgttgccgttacgtg

SEQ ID NO: 179573 - DNA, 25 bp, E. coli
tgcgagcacgatcccgttacgtgaa

SEQ ID NO: 179574 - DNA, 25 bp, E. coli
tgcgagcacgatgccgttacgtgaa

SEQ ID NO: 179575 - DNA, 25 bp, E. coli
cctgtgcgagcacgatgccgttacg

SEQ ID NO: 179576 - DNA, 25 bp, E. coli
cctgtgcgagcaggatgccgttacg

SEQ ID NO: 179577 - DNA, 25 bp, E. coli
cgagcacgatgcggttacgtgaaag

SEQ ID NO: 179578 - DNA, 25 bp, E. coli
cgagcacgatgccgttacgtgaaag

SEQ ID NO: 179579 - DNA, 25 bp, E. coli
ctgtgcgagcaccatgccgttacgt

SEQ ID NO: 179580 - DNA, 25 bp, E. coli
ctgtgcgagcacgatgccgttacgt

SEQ ID NO: 179581 - DNA, 25 bp, E. coli
aatggacgaggcactggctgaaatt

SEQ ID NO: 179582 - DNA, 25 bp, E. coli
acatggcccaggtgcagtacagcat

SEQ ID NO: 179583 - DNA, 25 bp, E. coli
aaaaatggacgaggcactggctgaa

SEQ ID NO: 179584 - DNA, 25 bp, E. coli
aatggacgaggctctggctgaaatt

SEQ ID NO: 179585 - DNA, 25 bp, E. coli
acatggcccaggagcagtacagcat

SEQ ID NO: 179586 - DNA, 25 bp, E. coli
aaaaatggacgacgcactggctgaa

SEQ ID NO: 179587 - DNA, 25 bp, E. coli
ttcatcgaaaaaatggacgaggcac

SEQ ID NO: 179588 - DNA, 25 bp, E. coli
ttcatcgaaaaattggacgaggcac

SEQ ID NO: 179589 - DNA, 25 bp, E. coli
tgccggagttcatcgaaaaaatgga

SEQ ID NO: 179590 - DNA, 25 bp, E. coli
tgcctggtactttgccaactatgac

SEQ ID NO: 179591 - DNA, 25 bp, E. coli
tgcctggtacttagccaactatgac

SEQ ID NO: 179592 - DNA, 25 bp, E. coli
tgccggagttcaacgaaaaaatgga

SEQ ID NO: 179593 - DNA, 25 bp, E. coli
ccggagttcatcgaaaaaatggacg

SEQ ID NO: 179594 - DNA, 25 bp, E. coli
ccggagttcatccaaaaaatggacg

SEQ ID NO: 179595 - DNA, 25 bp, E. coli
gcttacatggcccaggtgcagtaca

SEQ ID NO: 179596 - DNA, 25 bp, E. coli
gcttacatggccgaggtgcagtaca

SEQ ID NO: 179597 - DNA, 25 bp, E. coli
cccaggtgcagtacagcatgtgggt

SEQ ID NO: 179598 - DNA, 25 bp, E. coli
cccaggtgcagttcagcatgtgggt

SEQ ID NO: 179599 - DNA, 25 bp, E. coli
cgaaaaaatggaggaggcactggct

SEQ ID NO: 179600 - DNA, 25 bp, E. coli
cgaaaaaatggacgaggcactggct

SEQ ID NO: 179601 - DNA, 25 bp, E. coli
tggcccaggtgctgtacagcatgtg

SEQ ID NO: 179602 - DNA, 25 bp, E. coli
tggcccaggtgcagtacagcatgtg

SEQ ID NO: 179603 - DNA, 25 bp, E. coli
ttaacgccggcgtggaagtgacctt

SEQ ID NO: 179604 - DNA, 25 bp, E. coli
ttaacgccggcgaggaagtgacctt

SEQ ID NO: 179605 - DNA, 25 bp, E. coli
tatgcccaggtgtaagacagctctg

SEQ ID NO: 179606 - DNA, 25 bp, E. coli
tatgcccaggtgaaagacagctctg

SEQ ID NO: 179607 - DNA, 25 bp, E. coli
tatcgataacacctggaatcagcgc

SEQ ID NO: 179608 - DNA, 25 bp, E. coli
tatcgataacacgtggaatcagcgc

SEQ ID NO: 179609 - DNA, 25 bp, E. coli
tgtcgcgcagaaaaaggtcgatgcc

SEQ ID NO: 179610 - DNA, 25 bp, E. coli
tgtcgcgcagaataaggtcgatgcc

SEQ ID NO: 179611 - DNA, 25 bp, E. coli
gccgcaaacgcaaagatcgctggat

SEQ ID NO: 179612 - DNA, 25 bp, E. coli
gccgcaaacgcatagatcgctggat

SEQ ID NO: 179613 - DNA, 25 bp, E. coli
gcttggcttgctcctcggtctggta

SEQ ID NO: 179614 - DNA, 25 bp, E. coli
gcttggcttgctgctcggtctggta

SEQ ID NO: 179615 - DNA, 25 bp, E. coli
gaaaaacgagctgattgtcgcgcag

SEQ ID NO: 179616 - DNA, 25 bp, E. coli
gactgccgtctcacacgctgaagaa

SEQ ID NO: 179617 - DNA, 25 bp, E. coli
gaaaaacgagctcattgtcgcgcag

SEQ ID NO: 179618 - DNA, 25 bp, E. coli
gactgccgtctctcacgctgaagaa

SEQ ID NO: 179619 - DNA, 25 bp, E. coli
gattaactttacacgcacttagcgc

SEQ ID NO: 179620 - DNA, 25 bp, E. coli
gattaactttactcgcacttagcgc

SEQ ID NO: 179621 - DNA, 25 bp, E. coli
tcagcgcaccgctgaaatgcagcaa

SEQ ID NO: 179622 - DNA, 25 bp, E. coli
tcagcgcaccgcagaaatgcagcaa

SEQ ID NO: 179623 - DNA, 25 bp, E. coli
gacgccaacacctattatgcccagg

SEQ ID NO: 179624 - DNA, 25 bp, E. coli
gacgccaacaccaattatgcccagg

SEQ ID NO: 179625 - DNA, 25 bp, E. coli
aatagcggtgaatccattctcgacg

SEQ ID NO: 179626 - DNA, 25 bp, E. coli
aatagcggtgaaaccattctcgacg

SEQ ID NO: 179627 - DNA, 25 bp, E. coli
cagagcaggaagacgacatgctgga

SEQ ID NO: 179628 - DNA, 25 bp, E. coli
cagagcaggaagtcgacatgctgga

SEQ ID NO: 179629 - DNA, 25 bp, E. coli
catcaggatctctgccctgatggcg

SEQ ID NO: 179630 - DNA, 25 bp, E. coli
catcaggatctcagccctgatggcg

SEQ ID NO: 179631 - DNA, 25 bp, E. coli
acctgccactgcttcgttcgtgaag

SEQ ID NO: 179632 - DNA, 25 bp, E. coli
acctgccactgcatcgttcgtgaag

SEQ ID NO: 179633 - DNA, 25 bp, E. coli
aaaatcctgtgcatgcaccacctgc

SEQ ID NO: 179634 - DNA, 25 bp, E. coli
aaaatcctgtgcttgcaccacctgc

SEQ ID NO: 179635 - DNA, 25 bp, E. coli
aaagccgtttaagctgccaggcgcg

SEQ ID NO: 179636 - DNA, 25 bp, E. coli
aaagccgtttaacctgccaggcgcg

SEQ ID NO: 179637 - DNA, 25 bp, E. coli
tattttgcctcaacaggatctctgc

SEQ ID NO: 179638 - DNA, 25 bp, E. coli
tattttgcctcatcaggatctctgc

SEQ ID NO: 179639 - DNA, 25 bp, E. coli
tgaacacgcctgagaaaaatcctgt

SEQ ID NO: 179640 - DNA, 25 bp, E. coli
tgaacacgcctgtgaaaaatcctgt

SEQ ID NO: 179641 - DNA, 25 bp, E. coli
gcatcgttcgtgtaggttttgactc

SEQ ID NO: 179642 - DNA, 25 bp, E. coli
gcatcgttcgtgaaggttttgactc

SEQ ID NO: 179643 - DNA, 25 bp, E. coli
taacggtatcgagattgaacacgcc

SEQ ID NO: 179644 - DNA, 25 bp, E. coli
taacggtatcgacattgaacacgcc

SEQ ID NO: 179645 - DNA, 25 bp, E. coli
gacgacatgctgcacaaagcctggg

SEQ ID NO: 179646 - DNA, 25 bp, E. coli
gacgacatgctggacaaagcctggg

SEQ ID NO: 179647 - DNA, 25 bp, E. coli
attaacctgcgtcgaagcaggcgta

SEQ ID NO: 179648 - DNA, 25 bp, E. coli
attaacctgcgtggaagcaggcgta

SEQ ID NO: 179649 - DNA, 25 bp, E. coli
tatggaaggtcaaatcaccgtcttt

SEQ ID NO: 179650 - DNA, 25 bp, E. coli
tagccgtttgttaggtgaaaatgca

SEQ ID NO: 179651 - DNA, 25 bp, E. coli
tagccgtttgtttggtgaaaatgca

SEQ ID NO: 179652 - DNA, 25 bp, E. coli
tatggaaggtcatatcaccgtcttt

SEQ ID NO: 179653 - DNA, 25 bp, E. coli
tttggtgaaaatccattaacctgcg

SEQ ID NO: 179654 - DNA, 25 bp, E. coli
tttggtgaaaatgcattaacctgcg

SEQ ID NO: 179655 - DNA, 25 bp, E. coli
ttctcgcgtgctcatagtgggcctg

SEQ ID NO: 179656 - DNA, 25 bp, E. coli
ttctcgcgtgctgatagtgggcctg

SEQ ID NO: 179657 - DNA, 25 bp, E. coli
tgatagtgggccagggcggcctcgg

SEQ ID NO: 179658 - DNA, 25 bp, E. coli
tgatagtgggcctgggcggcctcgg

SEQ ID NO: 179659 - DNA, 25 bp, E. coli
gctgaaagattctcgcgtgctgata

SEQ ID NO: 179660 - DNA, 25 bp, E. coli
gctgaaagattcacgcgtgctgata

SEQ ID NO: 179661 - DNA, 25 bp, E. coli
gaaaatgcattatcctgcgtggaag

SEQ ID NO: 179662 - DNA, 25 bp, E. coli
gaaaatgcattaacctgcgtggaag

SEQ ID NO: 179663 - DNA, 25 bp, E. coli
cgtctttacttatcaggacggtgaa

SEQ ID NO: 179664 - DNA, 25 bp, E. coli
cggcctcggctgagcagcctcgcag

SEQ ID NO: 179665 - DNA, 25 bp, E. coli
cggcctcggctgtgcagcctcgcag

SEQ ID NO: 179666 - DNA, 25 bp, E. coli
cgtctttacttaacaggacggtgaa

SEQ ID NO: 179667 - DNA, 25 bp, E. coli
ggaaggtcaaatgaccgtctttact

SEQ ID NO: 179668 - DNA, 25 bp, E. coli
ggaaggtcaaatcaccgtctttact

SEQ ID NO: 179669 - DNA, 25 bp, E. coli
tatctctggtcatcacggcaaaagg

SEQ ID NO: 179670 - DNA, 25 bp, E. coli
tatactgaagaattgcggcctgcca

SEQ ID NO: 179671 - DNA, 25 bp, E. coli
tattattgatgatgcctcgcagcag

SEQ ID NO: 179672 - DNA, 25 bp, E. coli
tattattgatgaagcctcgcagcag

SEQ ID NO: 179673 - DNA, 25 bp, E. coli
tattcatgcgtatccgggccagttg

SEQ ID NO: 179674 - DNA, 25 bp, E. coli
tattcatgcgtaaccgggccagttg

SEQ ID NO: 179675 - DNA, 25 bp, E. coli
tatctctggtcaacacggcaaaagg

SEQ ID NO: 179676 - DNA, 25 bp, E. coli
tatactgaagaaatgcggcctgcca

SEQ ID NO: 179677 - DNA, 25 bp, E. coli
gaatgtcgctgtatcaagggcccga

SEQ ID NO: 179678 - DNA, 25 bp, E. coli
gaatgtcgctgtttcaagggcccga

SEQ ID NO: 179679 - DNA, 25 bp, E. coli
gacaggcggattcgattcagaaaca

SEQ ID NO: 179680 - DNA, 25 bp, E. coli
gacaggcggattggattcagaaaca

SEQ ID NO: 179681 - DNA, 25 bp, E. coli
taatctggctgataaagtgctgcct

SEQ ID NO: 179682 - DNA, 25 bp, E. coli
taatcctgaactggtgaatgtcgct

SEQ ID NO: 179683 - DNA, 25 bp, E. coli
taatctggctgaaaaagtgctgcct

SEQ ID NO: 179684 - DNA, 25 bp, E. coli
tcagaatcttcgtccggaggagctt

SEQ ID NO: 179685 - DNA, 25 bp, E. coli
taatcctgaactcgtgaatgtcgct

SEQ ID NO: 179686 - DNA, 25 bp, E. coli
tcagaatcttcgaccggaggagctt

SEQ ID NO: 179687 - DNA, 25 bp, E. coli
gatgtatttgaaggccacgctggac

SEQ ID NO: 179688 - DNA, 25 bp, E. coli
gagagattttcgagagcccggtcat

SEQ ID NO: 179689 - DNA, 25 bp, E. coli
gagagattttcgtgagcccggtcat

SEQ ID NO: 179690 - DNA, 25 bp, E. coli
gatgtatttgaacgccacgctggac

SEQ ID NO: 179691 - DNA, 25 bp, E. coli
tacgctggcagtataacgggaaagg

SEQ ID NO: 179692 - DNA, 25 bp, E. coli
tacgctggcagtttaacgggaaagg

SEQ ID NO: 179693 - DNA, 25 bp, E. coli
tacgacgaccctataaaacgaccat

SEQ ID NO: 179694 - DNA, 25 bp, E. coli
tacgacgaccctttaaaacgaccat

SEQ ID NO: 179695 - DNA, 25 bp, E. coli
aacgaccatatttttcacagggtca

SEQ ID NO: 179696 - DNA, 25 bp, E. coli
aacgaccatattattcacagggtca

SEQ ID NO: 179697 - DNA, 25 bp, E. coli
ttatctggtgaaagactcgccttcg

SEQ ID NO: 179698 - DNA, 25 bp, E. coli
ttatctggtgaatgactcgccttcg

SEQ ID NO: 179699 - DNA, 25 bp, E. coli
tgtgacttatccattacgctggcag

SEQ ID NO: 179700 - DNA, 25 bp, E. coli
tgtgacttatcctttacgctggcag

SEQ ID NO: 179701 - DNA, 25 bp, E. coli
tcccctccagaattatgtgacttat

SEQ ID NO: 179702 - DNA, 25 bp, E. coli
tcccctccagaaatatgtgacttat

SEQ ID NO: 179703 - DNA, 25 bp, E. coli
ccgctgttgccctaaatcaaattta

SEQ ID NO: 179704 - DNA, 25 bp, E. coli
ccgctgttgcccaaaatcaaattta

SEQ ID NO: 179705 - DNA, 25 bp, E. coli
cgtgcactacactgtcaatcagaca

SEQ ID NO: 179706 - DNA, 25 bp, E. coli
cgtgcactacacagtcaatcagaca

SEQ ID NO: 179707 - DNA, 25 bp, E. coli
gggaaaggccttgctaatacgtgat

SEQ ID NO: 179708 - DNA, 25 bp, E. coli
gggaaaggccttcctaatacgtgat

SEQ ID NO: 179709 - DNA, 25 bp, E. coli
ggattaaatcttatgcgtgcactac

SEQ ID NO: 179710 - DNA, 25 bp, E. coli
ggattaaatcttttgcgtgcactac

SEQ ID NO: 179711 - DNA, 25 bp, E. coli
tagccgcgcattatttccgtcgtca

SEQ ID NO: 179712 - DNA, 25 bp, E. coli
tagccgcgcattttttccgtcgtca

SEQ ID NO: 179713 - DNA, 25 bp, E. coli
caacactaccaccttcagtgctggg

SEQ ID NO: 179714 - DNA, 25 bp, E. coli
caacactaccacgttcagtgctggg

SEQ ID NO: 179715 - DNA, 25 bp, E. coli
actggtggcagaacgtgacggcatt

SEQ ID NO: 179716 - DNA, 25 bp, E. coli
actggtggcagatcgtgacggcatt

SEQ ID NO: 179717 - DNA, 25 bp, E. coli
tggtgcttgcgaccggcagtttctt

SEQ ID NO: 179718 - DNA, 25 bp, E. coli
tcccgctgcgcccacgatttgtggt

SEQ ID NO: 179719 - DNA, 25 bp, E. coli
tcccgctgcgccgacgatttgtggt

SEQ ID NO: 179720 - DNA, 25 bp, E. coli
tctttagcggcgcactggtggcaga

SEQ ID NO: 179721 - DNA, 25 bp, E. coli
tcttgcggcggcttcgttgcgcgaa

SEQ ID NO: 179722 - DNA, 25 bp, E. coli
tctttagcggcggactggtggcaga

SEQ ID NO: 179723 - DNA, 25 bp, E. coli
tcttgcggcggcatcgttgcgcgaa

SEQ ID NO: 179724 - DNA, 25 bp, E. coli
ccacgatttgtgctgcttgcgagcg

SEQ ID NO: 179725 - DNA, 25 bp, E. coli
ccacgatttgtggtgcttgcgagcg

SEQ ID NO: 179726 - DNA, 25 bp, E. coli
ctggccgctgattattgatgcgcta

SEQ ID NO: 179727 - DNA, 25 bp, E. coli
ctggccgctgataattgatgcgcta

SEQ ID NO: 179728 - DNA, 25 bp, E. coli
tggtgcttgcgagcggcagtttctt

SEQ ID NO: 179729 - DNA, 25 bp, E. coli
tggcagaacgtgacggcattcgcga

SEQ ID NO: 179730 - DNA, 25 bp, E. coli
tggcagaacgtgtcggcattcgcga

SEQ ID NO: 179731 - DNA, 25 bp, E. coli
taattgatgcgcaaatccctgtcgc

SEQ ID NO: 179732 - DNA, 25 bp, E. coli
taattgatgcgctaatccctgtcgc

SEQ ID NO: 179733 - DNA, 25 bp, E. coli
tcactgatgcttgtgccaacactac

SEQ ID NO: 179734 - DNA, 25 bp, E. coli
tcactgatgcttctgccaacactac

SEQ ID NO: 179735 - DNA, 25 bp, E. coli
caccgtgcgtgacctggctacaaat

SEQ ID NO: 179736 - DNA, 25 bp, E. coli
caccgtgcgtgagctggctacaaat

SEQ ID NO: 179737 - DNA, 25 bp, E. coli
taaagatggcccaacggatctggta

SEQ ID NO: 179738 - DNA, 25 bp, E. coli
taaagatggccctacggatctggta

SEQ ID NO: 179739 - DNA, 25 bp, E. coli
aaatcaccgtgcgtgacctggctac

SEQ ID NO: 179740 - DNA, 25 bp, E. coli
aaatcaccgtgcctgacctggctac

SEQ ID NO: 179741 - DNA, 25 bp, E. coli
gcccaacggatctggtaacgccata

SEQ ID NO: 179742 - DNA, 25 bp, E. coli
gcccaacggatcaggtaacgccata

SEQ ID NO: 179743 - DNA, 25 bp, E. coli
gcgtgacctggcaacaaatccgatt

SEQ ID NO: 179744 - DNA, 25 bp, E. coli
gcgtgacctggctacaaatccgatt

SEQ ID NO: 179745 - DNA, 25 bp, E. coli
gcctggtcaccggtaaaaaagccat

SEQ ID NO: 179746 - DNA, 25 bp, E. coli
gcctggtcaccgctaaaaaagccat

SEQ ID NO: 179747 - DNA, 25 bp, E. coli
cggatctggtaaggccatatctgtc

SEQ ID NO: 179748 - DNA, 25 bp, E. coli
cggatctggtaacgccatatctgtc

SEQ ID NO: 179749 - DNA, 25 bp, E. coli
ggtaacgccataactgtccacattc

SEQ ID NO: 179750 - DNA, 25 bp, E. coli
ggtaacgccatatctgtccacattc

SEQ ID NO: 179751 - DNA, 25 bp, E. coli
gatccataaagatggcccaacggat

SEQ ID NO: 179752 - DNA, 25 bp, E. coli
gagaagggtccggaaggcctggtca

SEQ ID NO: 179753 - DNA, 25 bp, E. coli
gatccataaagaaggcccaacggat

SEQ ID NO: 179754 - DNA, 25 bp, E. coli
gatggcccaacgcatctggtaacgc

SEQ ID NO: 179755 - DNA, 25 bp, E. coli
gagaagggtccgcaaggcctggtca

SEQ ID NO: 179756 - DNA, 25 bp, E. coli
gatggcccaacggatctggtaacgc

SEQ ID NO: 179757 - DNA, 25 bp, E. coli
atcagcacctggaaggtttaccggg

SEQ ID NO: 179758 - DNA, 25 bp, E. coli
atcagcacctggtaggtttaccggg

SEQ ID NO: 179759 - DNA, 25 bp, E. coli
tcagcacctggatggtttaccgggg

SEQ ID NO: 179760 - DNA, 25 bp, E. coli
tcagcacctggaaggtttaccgggg

SEQ ID NO: 179761 - DNA, 25 bp, E. coli
gcgcgatcagcagctggaaggttta

SEQ ID NO: 179762 - DNA, 25 bp, E. coli
gcgcgatcagcacctggaaggttta

SEQ ID NO: 179763 - DNA, 25 bp, E. coli
gcgatcagcaccaggaaggtttacc

SEQ ID NO: 179764 - DNA, 25 bp, E. coli
gcgatcagcacctggaaggtttacc

SEQ ID NO: 179765 - DNA, 25 bp, E. coli
gcggtgaacaacctcaatcttgaac

SEQ ID NO: 179766 - DNA, 25 bp, E. coli
gcggtgaacaacgtcaatcttgaac

SEQ ID NO: 179767 - DNA, 25 bp, E. coli
gaaggtttaccggggcagcaaattg

SEQ ID NO: 179768 - DNA, 25 bp, E. coli
gaaggtttaccgcggcagcaaattg

SEQ ID NO: 179769 - DNA, 25 bp, E. coli
cgatcagcacctcgaaggtttaccg

SEQ ID NO: 179770 - DNA, 25 bp, E. coli
cgcgatcagcacctggaaggtttac

SEQ ID NO: 179771 - DNA, 25 bp, E. coli
cgcgatcagcacgtggaaggtttac

SEQ ID NO: 179772 - DNA, 25 bp, E. coli
cgatcagcacctggaaggtttaccg

SEQ ID NO: 179773 - DNA, 25 bp, E. coli
cggtgaacaacgtcaatcttgaact

SEQ ID NO: 179774 - DNA, 25 bp, E. coli
cggtgaacaacgacaatcttgaact

SEQ ID NO: 179775 - DNA, 25 bp, E. coli
gatcagcacctggaaggtttaccgg

SEQ ID NO: 179776 - DNA, 25 bp, E. coli
gatcagcacctgcaaggtttaccgg

SEQ ID NO: 179777 - DNA, 25 bp, E. coli
ggtgaacaacgtcaatcttgaactg

SEQ ID NO: 179778 - DNA, 25 bp, E. coli
ggtgaacaacgtgaatcttgaactg

SEQ ID NO: 179779 - DNA, 25 bp, E. coli
cagcgcctgctcggcaagaaaacga

SEQ ID NO: 179780 - DNA, 25 bp, E. coli
cagcgcctgctccgcaagaaaacga

SEQ ID NO: 179781 - DNA, 25 bp, E. coli
tgtcgccgccggagaacaggttgtt

SEQ ID NO: 179782 - DNA, 25 bp, E. coli
tgtcgccgccggtgaacaggttgtt

SEQ ID NO: 179783 - DNA, 25 bp, E. coli
tgctcggcaagataacgatggaaaa

SEQ ID NO: 179784 - DNA, 25 bp, E. coli
tgctcggcaagaaaacgatggaaaa

SEQ ID NO: 179785 - DNA, 25 bp, E. coli
tcgccgccggagtacaggttgttcc

SEQ ID NO: 179786 - DNA, 25 bp, E. coli
tcgccgccggagaacaggttgttcc

SEQ ID NO: 179787 - DNA, 25 bp, E. coli
gcctgctcggcatgaaaacgatgga

SEQ ID NO: 179788 - DNA, 25 bp, E. coli
gcctgctcggcaagaaaacgatgga

SEQ ID NO: 179789 - DNA, 25 bp, E. coli
ccagcgcctgctcggcaagaaaacg

SEQ ID NO: 179790 - DNA, 25 bp, E. coli
ccagcgcctgctgggcaagaaaacg

SEQ ID NO: 179791 - DNA, 25 bp, E. coli
gctcggcaagaaaacgatggaaaat

SEQ ID NO: 179792 - DNA, 25 bp, E. coli
gctcggcaagaatacgatggaaaat

SEQ ID NO: 179793 - DNA, 25 bp, E. coli
cgccgccggagatcaggttgttcct

SEQ ID NO: 179794 - DNA, 25 bp, E. coli
cgcctgctcggcaagaaaacgatgg

SEQ ID NO: 179795 - DNA, 25 bp, E. coli
cgcctgctcggctagaaaacgatgg

SEQ ID NO: 179796 - DNA, 25 bp, E. coli
cgccgccggagaacaggttgttcct

SEQ ID NO: 179797 - DNA, 25 bp, E. coli
ctgtcgccgccgcagaacaggttgt

SEQ ID NO: 179798 - DNA, 25 bp, E. coli
ctgtcgccgccggagaacaggttgt

SEQ ID NO: 179799 - DNA, 25 bp, E. coli
gtcgccgccggagaacaggttgttc

SEQ ID NO: 179800 - DNA, 25 bp, E. coli
gtcgccgccggacaacaggttgttc

SEQ ID NO: 179801 - DNA, 25 bp, E. coli
cattcagaaagcactccagtcgtga

SEQ ID NO: 179802 - DNA, 25 bp, E. coli
catcattcagaatgctctccagtcg

SEQ ID NO: 179803 - DNA, 25 bp, E. coli
cattcagaaagctctccagtcgtga

SEQ ID NO: 179804 - DNA, 25 bp, E. coli
catcattcagaaagctctccagtcg

SEQ ID NO: 179805 - DNA, 25 bp, E. coli
tatcgtaccagacaaagcaatcatc

SEQ ID NO: 179806 - DNA, 25 bp, E. coli
tatcgtaccagagaaagcaatcatc

SEQ ID NO: 179807 - DNA, 25 bp, E. coli
ccagacaaagcaatcatcattcaga

SEQ ID NO: 179808 - DNA, 25 bp, E. coli
ccgggatatcgttccagacaaagca

SEQ ID NO: 179809 - DNA, 25 bp, E. coli
ccaccgggatatggtaccagacaaa

SEQ ID NO: 179810 - DNA, 25 bp, E. coli
ccgggatatcgtaccagacaaagca

SEQ ID NO: 179811 - DNA, 25 bp, E. coli
ccagacaaagcattcatcattcaga

SEQ ID NO: 179812 - DNA, 25 bp, E. coli
ccaccgggatatcgtaccagacaaa

SEQ ID NO: 179813 - DNA, 25 bp, E. coli
gcaatcatcattcagaaagctctcc

SEQ ID NO: 179814 - DNA, 25 bp, E. coli
gcaatcatcattgagaaagctctcc

SEQ ID NO: 179815 - DNA, 25 bp, E. coli
gacaaagcaatcttcattcagaaag

SEQ ID NO: 179816 - DNA, 25 bp, E. coli
gacaaagcaatcatcattcagaaag

SEQ ID NO: 179817 - DNA, 25 bp, E. coli
cgtaccagacaatgcaatcatcatt

SEQ ID NO: 179818 - DNA, 25 bp, E. coli
cgtaccagacaaagcaatcatcatt

SEQ ID NO: 179819 - DNA, 25 bp, E. coli
cgtcccaccgggatatcgtaccaga

SEQ ID NO: 179820 - DNA, 25 bp, E. coli
cgtcccaccgggttatcgtaccaga

SEQ ID NO: 179821 - DNA, 25 bp, E. coli
gggatatcgtacgagacaaagcaat

SEQ ID NO: 179822 - DNA, 25 bp, E. coli
gggatatcgtaccagacaaagcaat

SEQ ID NO: 179823 - DNA, 25 bp, E. coli
aaaataatggctcctgccggtccgc

SEQ ID NO: 179824 - DNA, 25 bp, E. coli
aaaataatggctgctgccggtccgc

SEQ ID NO: 179825 - DNA, 25 bp, E. coli
tcctcgatgccggagtgctggaagt

SEQ ID NO: 179826 - DNA, 25 bp, E. coli
tccaatcattatcgccggagcagga

SEQ ID NO: 179827 - DNA, 25 bp, E. coli
tcctcgatgccgcagtgctggaagt

SEQ ID NO: 179828 - DNA, 25 bp, E. coli
tccaatcattatggccggagcagga

SEQ ID NO: 179829 - DNA, 25 bp, E. coli
tcagggcaaaaaacagacgcactgc

SEQ ID NO: 179830 - DNA, 25 bp, E. coli
tcagggcaaaaatcagacgcactgc

SEQ ID NO: 179831 - DNA, 25 bp, E. coli
gcattgcccgggtactgacatcagg

SEQ ID NO: 179832 - DNA, 25 bp, E. coli
gcattgcccgggaactgacatcagg

SEQ ID NO: 179833 - DNA, 25 bp, E. coli
gaaaacctgcaccacttcctcgatg

SEQ ID NO: 179834 - DNA, 25 bp, E. coli
gaacttattgcccatcgtgatgctc

SEQ ID NO: 179835 - DNA, 25 bp, E. coli
gaaaacctgcacgacttcctcgatg

SEQ ID NO: 179836 - DNA, 25 bp, E. coli
gaacttattgccgatcgtgatgctc

SEQ ID NO: 179837 - DNA, 25 bp, E. coli
cgtggcaagcctgaccgatgcgtta

SEQ ID NO: 179838 - DNA, 25 bp, E. coli
ctggaagtccatagctccgcgggag

SEQ ID NO: 179839 - DNA, 25 bp, E. coli
ctggaagtccattgctccgcgggag

SEQ ID NO: 179840 - DNA, 25 bp, E. coli
cgtggcaagcctcaccgatgcgtta

SEQ ID NO: 179841 - DNA, 25 bp, E. coli
ggaatcattgaacgccatcaggcca

SEQ ID NO: 179842 - DNA, 25 bp, E. coli
ggaatcattgaaggccatcaggcca

SEQ ID NO: 179843 - DNA, 25 bp, E. coli
gacgcactgcaaggtttatcaaaaa

SEQ ID NO: 179844 - DNA, 25 bp, E. coli
gacgcactgcaacgtttatcaaaaa

SEQ ID NO: 179845 - DNA, 25 bp, E. coli
aataaaattcagcaggcggagtcgc

SEQ ID NO: 179846 - DNA, 25 bp, E. coli
aataaaattcaggaggcggagtcgc

SEQ ID NO: 179847 - DNA, 25 bp, E. coli
cacggtatttgccatgacgccgcca

SEQ ID NO: 179848 - DNA, 25 bp, E. coli
cacggtatttgcgatgacgccgcca

SEQ ID NO: 179849 - DNA, 25 bp, E. coli
cacccgctggctgtatggaccggaa

SEQ ID NO: 179850 - DNA, 25 bp, E. coli
cacccgctggctctatggaccggaa

SEQ ID NO: 179851 - DNA, 25 bp, E. coli
aaagcctccagttcggatatcgccg

SEQ ID NO: 179852 - DNA, 25 bp, E. coli
aaagcctccagtacggatatcgccg

SEQ ID NO: 179853 - DNA, 25 bp, E. coli
tatactggtgcttctgccgaaacgc

SEQ ID NO: 179854 - DNA, 25 bp, E. coli
tatactggtgctactgccgaaacgc

SEQ ID NO: 179855 - DNA, 25 bp, E. coli
tctgcaagtcttaggcgcggaatac

SEQ ID NO: 179856 - DNA, 25 bp, E. coli
tcattgcaggagtaactggccagcg

SEQ ID NO: 179857 - DNA, 25 bp, E. coli
tctgcaagtctttggcgcggaatac

SEQ ID NO: 179858 - DNA, 25 bp, E. coli
tcattgcaggagaaactggccagcg

SEQ ID NO: 179859 - DNA, 25 bp, E. coli
gctattgaagcggaaaacgtgcagg

SEQ ID NO: 179860 - DNA, 25 bp, E. coli
gctattgaagcgcaaaacgtgcagg

SEQ ID NO: 179861 - DNA, 25 bp, E. coli
gactggctttagatccggcgatgca

SEQ ID NO: 179862 - DNA, 25 bp, E. coli
gactggctttagttccggcgatgca

SEQ ID NO: 179863 - DNA, 25 bp, E. coli
cgtacagcagaactgaatcgccaga

SEQ ID NO: 179864 - DNA, 25 bp, E. coli
cgtacagcagaagtgaatcgccaga

SEQ ID NO: 179865 - DNA, 25 bp, E. coli
gacgctggtcaaggataagattgcc

SEQ ID NO: 179866 - DNA, 25 bp, E. coli
gacgctggtcaacgataagattgcc

SEQ ID NO: 179867 - DNA, 25 bp, E. coli
caagaaaagtacgtgaatgccatca

SEQ ID NO: 179868 - DNA, 25 bp, E. coli
caagaaaagtacctgaatgccatca

SEQ ID NO: 179869 - DNA, 25 bp, E. coli
caaccggtggttcgttgcatcgcaa

SEQ ID NO: 179870 - DNA, 25 bp, E. coli
caatcatcctttagcgctgggcgta

SEQ ID NO: 179871 - DNA, 25 bp, E. coli
caatcatccttttgcgctgggcgta

SEQ ID NO: 179872 - DNA, 25 bp, E. coli
caaccggtggttggttgcatcgcaa

SEQ ID NO: 179873 - DNA, 25 bp, E. coli
cagtggcacccgcaatggaacagta

SEQ ID NO: 179874 - DNA, 25 bp, E. coli
cagtggcacccggaatggaacagta

SEQ ID NO: 179875 - DNA, 25 bp, E. coli
cgaaggtcgttaccccacggttgcg

SEQ ID NO: 179876 - DNA, 25 bp, E. coli
cgaaggtcgttagcccacggttgcg

SEQ ID NO: 179877 - DNA, 25 bp, E. coli
tatgcaccgtcggatgaagttcagg

SEQ ID NO: 179878 - DNA, 25 bp, E. coli
tatgcaccgtcgcatgaagttcagg

SEQ ID NO: 179879 - DNA, 25 bp, E. coli
tgaaaacggcgatgagcctgacgcc

SEQ ID NO: 179880 - DNA, 25 bp, E. coli
tgaaaacggcgaagagcctgacgcc

SEQ ID NO: 179881 - DNA, 25 bp, E. coli
gaattgctggaacatcgggaagatc

SEQ ID NO: 179882 - DNA, 25 bp, E. coli
gaattgctggaagatcgggaagatc

SEQ ID NO: 179883 - DNA, 25 bp, E. coli
ggaagatcccgaactgccggtggaa

SEQ ID NO: 179884 - DNA, 25 bp, E. coli
tggtagtcccaggaatgtgcagccg

SEQ ID NO: 179885 - DNA, 25 bp, E. coli
ggaagatcccgatctgccggtggaa

SEQ ID NO: 179886 - DNA, 25 bp, E. coli
tggtagtcccagcaatgtgcagccg

SEQ ID NO: 179887 - DNA, 25 bp, E. coli
taattaatgccgcactcgaaaggcg

SEQ ID NO: 179888 - DNA, 25 bp, E. coli
taattaatgccggactcgaaaggcg

SEQ ID NO: 179889 - DNA, 25 bp, E. coli
caatatgaccgctggaactgccatc

SEQ ID NO: 179890 - DNA, 25 bp, E. coli
caatatgaccgcaggaactgccatc

SEQ ID NO: 179891 - DNA, 25 bp, E. coli
caaagatggctggttggcaaacgcg

SEQ ID NO: 179892 - DNA, 25 bp, E. coli
caaagatggctgcttggcaaacgcg

SEQ ID NO: 179893 - DNA, 25 bp, E. coli
actgcagatgcgctggccaaagaca

SEQ ID NO: 179894 - DNA, 25 bp, E. coli
actgcagatgcggtggccaaagaca

SEQ ID NO: 179895 - DNA, 25 bp, E. coli
tgcaggccaacatttcgggcaccag

SEQ ID NO: 179896 - DNA, 25 bp, E. coli
tgcaggccaacaattcgggcaccag

SEQ ID NO: 179897 - DNA, 25 bp, E. coli
ccaggtatggctggagcagaatgcc

SEQ ID NO: 179898 - DNA, 25 bp, E. coli
ccaggtatggctcgagcagaatgcc

SEQ ID NO: 179899 - DNA, 25 bp, E. coli
gctgcccatcagcaaaagagtgtga

SEQ ID NO: 179900 - DNA, 25 bp, E. coli
gctgcccatcaggaaaagagtgtga

SEQ ID NO: 179901 - DNA, 25 bp, E. coli
gaatgcccagctaccggaaactggc

SEQ ID NO: 179902 - DNA, 25 bp, E. coli
gaatgcccagcttccggaaactggc

SEQ ID NO: 179903 - DNA, 25 bp, E. coli
gggcgttgccacaatggctgaacaa

SEQ ID NO: 179904 - DNA, 25 bp, E. coli
gggcgttgccactatggctgaacaa

SEQ ID NO: 179905 - DNA, 25 bp, E. coli
ggttagcgcggttaatccgaaacag

SEQ ID NO: 179906 - DNA, 25 bp, E. coli
ggttagcgcggtaaatccgaaacag

SEQ ID NO: 179907 - DNA, 25 bp, E. coli
ggaaatcagtcggtcatcaacaagg

SEQ ID NO: 179908 - DNA, 25 bp, E. coli
ggaaatcagtcgctcatcaacaagg

SEQ ID NO: 179909 - DNA, 25 bp, E. coli
tggaactgccatgaactggttgcgt

SEQ ID NO: 179910 - DNA, 25 bp, E. coli
tggaactgccatcaactggttgcgt

SEQ ID NO: 179911 - DNA, 25 bp, E. coli
caactgctgtgccaggatgaacacc

SEQ ID NO: 179912 - DNA, 25 bp, E. coli
cacacaactgctgtgccaggatgaa

SEQ ID NO: 179913 - DNA, 25 bp, E. coli
cacaatgtggcggttgagtaccagt

SEQ ID NO: 179914 - DNA, 25 bp, E. coli
caactgctgtgcgaggatgaacacc

SEQ ID NO: 179915 - DNA, 25 bp, E. coli
cacaatgtggcgcttgagtaccagt

SEQ ID NO: 179916 - DNA, 25 bp, E. coli
cacacaactgctctgccaggatgaa

SEQ ID NO: 179917 - DNA, 25 bp, E. coli
tgctgtgccaggttgaacacccttc

SEQ ID NO: 179918 - DNA, 25 bp, E. coli
tgctgtgccaggatgaacacccttc

SEQ ID NO: 179919 - DNA, 25 bp, E. coli
tctggcggcgctcgaatcccacaat

SEQ ID NO: 179920 - DNA, 25 bp, E. coli
tctggcggcgctggaatcccacaat

SEQ ID NO: 179921 - DNA, 25 bp, E. coli
gcggcgctggaaacccacaatgtgg

SEQ ID NO: 179922 - DNA, 25 bp, E. coli
gcggcgctggaatcccacaatgtgg

SEQ ID NO: 179923 - DNA, 25 bp, E. coli
gctggaatcccagaatgtggcggtt

SEQ ID NO: 179924 - DNA, 25 bp, E. coli
gctggaatcccacaatgtggcggtt

SEQ ID NO: 179925 - DNA, 25 bp, E. coli
cgcgaaggttactgcggctcctgtc

SEQ ID NO: 179926 - DNA, 25 bp, E. coli
cgcgaaggttacagcggctcctgtc

SEQ ID NO: 179927 - DNA, 25 bp, E. coli
gggaaattttgcgctgttgttgccg

SEQ ID NO: 179928 - DNA, 25 bp, E. coli
gtgccaggatgaacacccttccctt

SEQ ID NO: 179929 - DNA, 25 bp, E. coli
gtgccaggatgatcacccttccctt

SEQ ID NO: 179930 - DNA, 25 bp, E. coli
gggaaattttgccctgttgttgccg

SEQ ID NO: 179931 - DNA, 25 bp, E. coli
gatgaacacccttcccttctggcgg

SEQ ID NO: 179932 - DNA, 25 bp, E. coli
gatgaacaccctacccttctggcgg

SEQ ID NO: 179933 - DNA, 25 bp, E. coli
tactgcgtgacgaaaacagctacac

SEQ ID NO: 179934 - DNA, 25 bp, E. coli
tactgcgtgacgtaaacagctacac

SEQ ID NO: 179935 - DNA, 25 bp, E. coli
tcattggcctgaatactcacggcgg

SEQ ID NO: 179936 - DNA, 25 bp, E. coli
tctcctgggatcactggaaactggc

SEQ ID NO: 179937 - DNA, 25 bp, E. coli
tcttcttgctgggtcaacgctggct

SEQ ID NO: 179938 - DNA, 25 bp, E. coli
tcttcttgctggctcaacgctggct

SEQ ID NO: 179939 - DNA, 25 bp, E. coli
tcattggcctgattactcacggcgg

SEQ ID NO: 179940 - DNA, 25 bp, E. coli
tctcctgggatctctggaaactggc

SEQ ID NO: 179941 - DNA, 25 bp, E. coli
ccatcgacagttggctggaagaagc

SEQ ID NO: 179942 - DNA, 25 bp, E. coli
ccatcgacagttcgctggaagaagc

SEQ ID NO: 179943 - DNA, 25 bp, E. coli
gcgattggcattgtggcgctctcca

SEQ ID NO: 179944 - DNA, 25 bp, E. coli
gcgattggcattctggcgctctcca

SEQ ID NO: 179945 - DNA, 25 bp, E. coli
gcaaagcgacgctgctgaaaggaat

SEQ ID NO: 179946 - DNA, 25 bp, E. coli
gcaaagcgacgcagctgaaaggaat

SEQ ID NO: 179947 - DNA, 25 bp, E. coli
gaacaggctgatcgtcgcattacgc

SEQ ID NO: 179948 - DNA, 25 bp, E. coli
gaacaggctgatggtcgcattacgc

SEQ ID NO: 179949 - DNA, 25 bp, E. coli
cattactgaagttccggtcgcgtcg

SEQ ID NO: 179950 - DNA, 25 bp, E. coli
cattactgaagtaccggtcgcgtcg

SEQ ID NO: 179951 - DNA, 25 bp, E. coli
ctgctgtggctgtggaactcggtaa

SEQ ID NO: 179952 - DNA, 25 bp, E. coli
ctgctgtggctgaggaactcggtaa

SEQ ID NO: 179953 - DNA, 25 bp, E. coli
gattttccagatcttcccggcagta

SEQ ID NO: 179954 - DNA, 25 bp, E. coli
gattttccagatgttcccggcagta

SEQ ID NO: 179955 - DNA, 25 bp, E. coli
caacgaatcaatgcccgtggcggat

SEQ ID NO: 179956 - DNA, 25 bp, E. coli
caagaaacgccgcatgtgtggacga

SEQ ID NO: 179957 - DNA, 25 bp, E. coli
aatcgctgaaggttacgtactggcc

SEQ ID NO: 179958 - DNA, 25 bp, E. coli
aatcgctgaaggatacgtactggcc

SEQ ID NO: 179959 - DNA, 25 bp, E. coli
caagaaacgccggatgtgtggacga

SEQ ID NO: 179960 - DNA, 25 bp, E. coli
caacgaatcaatccccgtggcggat

SEQ ID NO: 179961 - DNA, 25 bp, E. coli
taaaacgcggtgtttatctctggct

SEQ ID NO: 179962 - DNA, 25 bp, E. coli
taaaacgcggtgattatctctggct

SEQ ID NO: 179963 - DNA, 25 bp, E. coli
aaggctttatcggtggtcgtctcac

SEQ ID NO: 179964 - DNA, 25 bp, E. coli
aaggctttatcgctggtcgtctcac

SEQ ID NO: 179965 - DNA, 25 bp, E. coli
tgatctacaacgagcgtacgccgca

SEQ ID NO: 179966 - DNA, 25 bp, E. coli
tgatctacaacgtgcgtacgccgca

SEQ ID NO: 179967 - DNA, 25 bp, E. coli
tgaaattcaccatactgcaaccggc

SEQ ID NO: 179968 - DNA, 25 bp, E. coli
tgagtggcgtaactatccggtaacg

SEQ ID NO: 179969 - DNA, 25 bp, E. coli
tgagtggcgtaagtatccggtaacg

SEQ ID NO: 179970 - DNA, 25 bp, E. coli
tgaaattcaccaaactgcaaccggc

SEQ ID NO: 179971 - DNA, 25 bp, E. coli
cgattatgtcgaagcgtcgctggct

SEQ ID NO: 179972 - DNA, 25 bp, E. coli
cgattatgtcgatgcgtcgctggct

SEQ ID NO: 179973 - DNA, 25 bp, E. coli
ggacgatttcccagatttgccacga

SEQ ID NO: 179974 - DNA, 25 bp, E. coli
ggacgatttccctgatttgccacga

SEQ ID NO: 179975 - DNA, 25 bp, E. coli
gaggcgctggaaagcaataacgttc

SEQ ID NO: 179976 - DNA, 25 bp, E. coli
gaggcgctggaatgcaataacgttc

SEQ ID NO: 179977 - DNA, 25 bp, E. coli
tacaacctggcgaaaactggacgaa

SEQ ID NO: 179978 - DNA, 25 bp, E. coli
tacaacctggcgtaaactggacgaa

SEQ ID NO: 179979 - DNA, 25 bp, E. coli
attatcaaacgtccattgctctgcg

SEQ ID NO: 179980 - DNA, 25 bp, E. coli
actcaacacccgtggtacaacctgg

SEQ ID NO: 179981 - DNA, 25 bp, E. coli
actcaacacccgaggtacaacctgg

SEQ ID NO: 179982 - DNA, 25 bp, E. coli
attatcaaacgtgcattgctctgcg

SEQ ID NO: 179983 - DNA, 25 bp, E. coli
aaaaggctcgccgttggctggaagc

SEQ ID NO: 179984 - DNA, 25 bp, E. coli
aaaaggctcgcccttggctggaagc

SEQ ID NO: 179985 - DNA, 25 bp, E. coli
tatcaacgaatttggctgggaagcg

SEQ ID NO: 179986 - DNA, 25 bp, E. coli
tatcaacgaattaggctgggaagcg

SEQ ID NO: 179987 - DNA, 25 bp, E. coli
ttgtgacaccataaaaaaggctcgc

SEQ ID NO: 179988 - DNA, 25 bp, E. coli
ttgtgacaccattaaaaaggctcgc

SEQ ID NO: 179989 - DNA, 25 bp, E. coli
tgggaagcgttagtcaacacccgtg

SEQ ID NO: 179990 - DNA, 25 bp, E. coli
gaaatgcctgcatttatcaaacgtc

SEQ ID NO: 179991 - DNA, 25 bp, E. coli
gaaatgcctgcaattatcaaacgtc

SEQ ID NO: 179992 - DNA, 25 bp, E. coli
cattaatgactgtaatgcctgcaat

SEQ ID NO: 179993 - DNA, 25 bp, E. coli
cattaatgactgaaatgcctgcaat

SEQ ID NO: 179994 - DNA, 25 bp, E. coli
ggtaagcctatggtgctgggtttca

SEQ ID NO: 179995 - DNA, 25 bp, E. coli
ggtaagcctatgctgctgggtttca

SEQ ID NO: 179996 - DNA, 25 bp, E. coli
tggaagccaatatcatcgactatcg

SEQ ID NO: 179997 - DNA, 25 bp, E. coli
tgggaagcgttactcaacacccgtg

SEQ ID NO: 179998 - DNA, 25 bp, E. coli
tggaagccaataacatcgactatcg

SEQ ID NO: 179999 - DNA, 25 bp, E. coli
aagattcgcgcgacgacggctggca

SEQ ID NO: 180000 - DNA, 25 bp, E. coli
aagattcgcgcgtcgacggctggca

SEQ ID NO: 180001 - DNA, 25 bp, E. coli
caatattcagcaggcgattaacgac

SEQ ID NO: 180002 - DNA, 25 bp, E. coli
caatattcagcacgcgattaacgac

SEQ ID NO: 180003 - DNA, 25 bp, E. coli
caccattggcaaaattcagcaggcg

SEQ ID NO: 180004 - DNA, 25 bp, E. coli
caccattggcaatattcagcaggcg

SEQ ID NO: 180005 - DNA, 25 bp, E. coli
agtgagcgacgatcggcgcagacaa

SEQ ID NO: 180006 - DNA, 25 bp, E. coli
agtgagcgacgaacggcgcagacaa

SEQ ID NO: 180007 - DNA, 25 bp, E. coli
tattcagcaggccattaacgacgct

SEQ ID NO: 180008 - DNA, 25 bp, E. coli
tattcagcaggcgattaacgacgct

SEQ ID NO: 180009 - DNA, 25 bp, E. coli
gacaccattggctatattcagcagg

SEQ ID NO: 180010 - DNA, 25 bp, E. coli
gacaccattggcaatattcagcagg

SEQ ID NO: 180011 - DNA, 25 bp, E. coli
cggctggcagcgtgaagtgagcgac

SEQ ID NO: 180012 - DNA, 25 bp, E. coli
cattggcaatatacagcaggcgatt

SEQ ID NO: 180013 - DNA, 25 bp, E. coli
cggctggcagcgagaagtgagcgac

SEQ ID NO: 180014 - DNA, 25 bp, E. coli
cggagaatggaagatgagtatgggc

SEQ ID NO: 180015 - DNA, 25 bp, E. coli
cattggcaatattcagcaggcgatt

SEQ ID NO: 180016 - DNA, 25 bp, E. coli
cggagaatggaacatgagtatgggc

SEQ ID NO: 180017 - DNA, 25 bp, E. coli
tggcaatattcaccaggcgattaac

SEQ ID NO: 180018 - DNA, 25 bp, E. coli
tggcaatattcagcaggcgattaac

SEQ ID NO: 180019 - DNA, 25 bp, E. coli
gatgaagagcggagaatggaagatg

SEQ ID NO: 180020 - DNA, 25 bp, E. coli
gatgaagagcggtgaatggaagatg

SEQ ID NO: 180021 - DNA, 25 bp, E. coli
cacctggttgctctggcgcagagta

SEQ ID NO: 180022 - DNA, 25 bp, E. coli
cacctggttgctgtggcgcagagta

SEQ ID NO: 180023 - DNA, 25 bp, E. coli
catcttcgggaaaaagaaccggcat

SEQ ID NO: 180024 - DNA, 25 bp, E. coli
catcttcgggaataagaaccggcat

SEQ ID NO: 180025 - DNA, 25 bp, E. coli
tacaccatgaataatactgacaggc

SEQ ID NO: 180026 - DNA, 25 bp, E. coli
tacaccatgaattatactgacaggc

SEQ ID NO: 180027 - DNA, 25 bp, E. coli
agcataaaagccagatccatcgaag

SEQ ID NO: 180028 - DNA, 25 bp, E. coli
agcataaaagcctgatccatcgaag

SEQ ID NO: 180029 - DNA, 25 bp, E. coli
tccatcgaagattcatacagccaga

SEQ ID NO: 180030 - DNA, 25 bp, E. coli
tcgtcacaaggaatcacaagaagca

SEQ ID NO: 180031 - DNA, 25 bp, E. coli
tccatcgaagatacatacagccaga

SEQ ID NO: 180032 - DNA, 25 bp, E. coli
tcgtcacaaggattcacaagaagca

SEQ ID NO: 180033 - DNA, 25 bp, E. coli
gccaaattccgaggacaacaggtta

SEQ ID NO: 180034 - DNA, 25 bp, E. coli
gccaaattccgacgacaacaggtta

SEQ ID NO: 180035 - DNA, 25 bp, E. coli
gccccaggatgtcgaaattactcga

SEQ ID NO: 180036 - DNA, 25 bp, E. coli
gccccaggatgtggaaattactcga

SEQ ID NO: 180037 - DNA, 25 bp, E. coli
gcaattggtgcccatcctgatgata

SEQ ID NO: 180038 - DNA, 25 bp, E. coli
gcaattggtgccgatcctgatgata

SEQ ID NO: 180039 - DNA, 25 bp, E. coli
gacaggcatcaggatcacattgctg

SEQ ID NO: 180040 - DNA, 25 bp, E. coli
gacaggcatcagcatcacattgctg

SEQ ID NO: 180041 - DNA, 25 bp, E. coli
taattgagaatgtaacgccccagga

SEQ ID NO: 180042 - DNA, 25 bp, E. coli
taattgagaatgaaacgccccagga

SEQ ID NO: 180043 - DNA, 25 bp, E. coli
aaggcattatccctgctggaaggcg

SEQ ID NO: 180044 - DNA, 25 bp, E. coli
aaggcattatccgtgctggaaggcg

SEQ ID NO: 180045 - DNA, 25 bp, E. coli
tacttaaaattctgacccaggctgt

SEQ ID NO: 180046 - DNA, 25 bp, E. coli
tacttaaaattcagacccaggctgt

SEQ ID NO: 180047 - DNA, 25 bp, E. coli
tacagcaatattatcgagttccagg

SEQ ID NO: 180048 - DNA, 25 bp, E. coli
tacagcaatattttcgagttccagg

SEQ ID NO: 180049 - DNA, 25 bp, E. coli
tagaagaaacgtcgatgtcagtggc

SEQ ID NO: 180050 - DNA, 25 bp, E. coli
tagaagaaacgtggatgtcagtggc

SEQ ID NO: 180051 - DNA, 25 bp, E. coli
tattcacagaaagcatggttcagga

SEQ ID NO: 180052 - DNA, 25 bp, E. coli
tattcacagaaaccatggttcagga

SEQ ID NO: 180053 - DNA, 25 bp, E. coli
tgttgccgtcagtagcggaactcgc

SEQ ID NO: 180054 - DNA, 25 bp, E. coli
tgttgccgtcagaagcggaactcgc

SEQ ID NO: 180055 - DNA, 25 bp, E. coli
tgcgggatcaaaatcattggcacct

SEQ ID NO: 180056 - DNA, 25 bp, E. coli
tgcgggatcaaattcattggcacct

SEQ ID NO: 180057 - DNA, 25 bp, E. coli
gcgtaataccctgcgtaaggcatta

SEQ ID NO: 180058 - DNA, 25 bp, E. coli
gcgtaataccctccgtaaggcatta

SEQ ID NO: 180059 - DNA, 25 bp, E. coli
cccaggctgtggatagtaactctat

SEQ ID NO: 180060 - DNA, 25 bp, E. coli
cccaggctgtggttagtaactctat

SEQ ID NO: 180061 - DNA, 25 bp, E. coli
gtattttacggatcagcccacggga

SEQ ID NO: 180062 - DNA, 25 bp, E. coli
gtattttacggaacagcccacggga

SEQ ID NO: 180063 - DNA, 25 bp, E. coli
gattgcccgctttcttaaatccgag

SEQ ID NO: 180064 - DNA, 25 bp, E. coli
gattgcccgcttacttaaatccgag

SEQ ID NO: 180065 - DNA, 25 bp, E. coli
aatcaatagattaatcttgtgaggg

SEQ ID NO: 180066 - DNA, 25 bp, E. coli
aatcaatagatttatcttgtgaggg

SEQ ID NO: 180067 - DNA, 25 bp, E. coli
catcttcaatgaacacgggtatata

SEQ ID NO: 180068 - DNA, 25 bp, E. coli
catcttcaatgatcacgggtatata

SEQ ID NO: 180069 - DNA, 25 bp, E. coli
tatcttgtgaggcattgctttttct

SEQ ID NO: 180070 - DNA, 25 bp, E. coli
tatcttgtgagggattgctttttct

SEQ ID NO: 180071 - DNA, 25 bp, E. coli
ttgctgaaaaatgaagcatcttcaa

SEQ ID NO: 180072 - DNA, 25 bp, E. coli
ttgctgaaaaatcaagcatcttcaa

SEQ ID NO: 180073 - DNA, 25 bp, E. coli
tgatcacgggtatatatcaatttga

SEQ ID NO: 180074 - DNA, 25 bp, E. coli
tgatcacgggtaaatatcaatttga

SEQ ID NO: 180075 - DNA, 25 bp, E. coli
tgagcttaacgatcaaacattttaa

SEQ ID NO: 180076 - DNA, 25 bp, E. coli
tgagcttaacgaacaaacattttaa

SEQ ID NO: 180077 - DNA, 25 bp, E. coli
tcttatataaaaacaataatggcag

SEQ ID NO: 180078 - DNA, 25 bp, E. coli
tcttatataaaatcaataatggcag

SEQ ID NO: 180079 - DNA, 25 bp, E. coli
gcaaggatgtgaccttaacgatcaa

SEQ ID NO: 180080 - DNA, 25 bp, E. coli
gcaaggatgtgagcttaacgatcaa

SEQ ID NO: 180081 - DNA, 25 bp, E. coli
gaaatatctggcaaggatgtgagct

SEQ ID NO: 180082 - DNA, 25 bp, E. coli
gaaatatctggctaggatgtgagct

SEQ ID NO: 180083 - DNA, 25 bp, E. coli
taatggcagtaagaaatatctggca

SEQ ID NO: 180084 - DNA, 25 bp, E. coli
tcaagcatcttcaatgatcacgggt

SEQ ID NO: 180085 - DNA, 25 bp, E. coli
taatggcagtaacaaatatctggca

SEQ ID NO: 180086 - DNA, 25 bp, E. coli
tcaagcatcttctatgatcacgggt

SEQ ID NO: 180087 - DNA, 25 bp, E. coli
caataccgcggttgaagaggcgctg

SEQ ID NO: 180088 - DNA, 25 bp, E. coli
caataccgcggtagaagaggcgctg

SEQ ID NO: 180089 - DNA, 25 bp, E. coli
taaactgcttatcctgggttcaggc

SEQ ID NO: 180090 - DNA, 25 bp, E. coli
taaactgcttatgctgggttcaggc

SEQ ID NO: 180091 - DNA, 25 bp, E. coli
ttaccggcatggtaaaaggcggcca

SEQ ID NO: 180092 - DNA, 25 bp, E. coli
ttaccggcatggaaaaaggcggcca

SEQ ID NO: 180093 - DNA, 25 bp, E. coli
tgattattgccagcggagcttctgc

SEQ ID NO: 180094 - DNA, 25 bp, E. coli
tgattattgccaccggagcttctgc

SEQ ID NO: 180095 - DNA, 25 bp, E. coli
gatccaaacgatctgaccggtccgt

SEQ ID NO: 180096 - DNA, 25 bp, E. coli
gatccaaacgatgtgaccggtccgt

SEQ ID NO: 180097 - DNA, 25 bp, E. coli
gaaaactggcctcgcgatccaaacg

SEQ ID NO: 180098 - DNA, 25 bp, E. coli
gaaaactggcctggcgatccaaacg

SEQ ID NO: 180099 - DNA, 25 bp, E. coli
ggtattcatggttatgccacccaga

SEQ ID NO: 180100 - DNA, 25 bp, E. coli
ggatcacatttatcgccaggccatt

SEQ ID NO: 180101 - DNA, 25 bp, E. coli
ggtattcatggtaatgccacccaga

SEQ ID NO: 180102 - DNA, 25 bp, E. coli
ggatcacatttaacgccaggccatt

SEQ ID NO: 180103 - DNA, 25 bp, E. coli
ggcgaatacactagcgacgcgctga

SEQ ID NO: 180104 - DNA, 25 bp, E. coli
tgggcacgaccaaacacagtaaact

SEQ ID NO: 180105 - DNA, 25 bp, E. coli
tgggcacgaccatacacagtaaact

SEQ ID NO: 180106 - DNA, 25 bp, E. coli
ggcgaatacacttgcgacgcgctga

SEQ ID NO: 180107 - DNA, 25 bp, E. coli
taatggagcgcaagcacgaacatgc

SEQ ID NO: 180108 - DNA, 25 bp, E. coli
taatggagcgcatgcacgaacatgc

SEQ ID NO: 180109 - DNA, 25 bp, E. coli
aattcaggtgggacaaaagttgccg

SEQ ID NO: 180110 - DNA, 25 bp, E. coli
aattcaggtgggtcaaaagttgccg

SEQ ID NO: 180111 - DNA, 25 bp, E. coli
agcgcaatcattaccagcaagctgg

SEQ ID NO: 180112 - DNA, 25 bp, E. coli
agcgcaatcatttccagcaagctgg

SEQ ID NO: 180113 - DNA, 25 bp, E. coli
tattaagaattcaaggcgacgggag

SEQ ID NO: 180114 - DNA, 25 bp, E. coli
tattaagaattctaggcgacgggag

SEQ ID NO: 180115 - DNA, 25 bp, E. coli
tcccggtcggtcttagagagtcgcc

SEQ ID NO: 180116 - DNA, 25 bp, E. coli
tcccggtcggtcatagagagtcgcc

SEQ ID NO: 180117 - DNA, 25 bp, E. coli
ttaaggtgggtctaaagttgccgag

SEQ ID NO: 180118 - DNA, 25 bp, E. coli
ttaaggtgggtcaaaagttgccgag

SEQ ID NO: 180119 - DNA, 25 bp, E. coli
gccagcttaaaacacgggcttagca

SEQ ID NO: 180120 - DNA, 25 bp, E. coli
gccagcttaaaagacgggcttagca

SEQ ID NO: 180121 - DNA, 25 bp, E. coli
gagagtcgcctagagttaaacagaa

SEQ ID NO: 180122 - DNA, 25 bp, E. coli
gaagaattatttcgccgcctgatag

SEQ ID NO: 180123 - DNA, 25 bp, E. coli
gaagaattatttggccgcctgatag

SEQ ID NO: 180124 - DNA, 25 bp, E. coli
gagagtcgcctacagttaaacagaa

SEQ ID NO: 180125 - DNA, 25 bp, E. coli
gatttcttattgctgggccttcgga

SEQ ID NO: 180126 - DNA, 25 bp, E. coli
gatttcttattggtgggccttcgga

SEQ ID NO: 180127 - DNA, 25 bp, E. coli
ggaaggcttcgaccaattgccagct

SEQ ID NO: 180128 - DNA, 25 bp, E. coli
ggaaggcttcgagcaattgccagct

SEQ ID NO: 180129 - DNA, 25 bp, E. coli
gagcgcggtatatctcaaagggtga

SEQ ID NO: 180130 - DNA, 25 bp, E. coli
gagcgcggtataactcaaagggtga

SEQ ID NO: 180131 - DNA, 25 bp, E. coli
caattaagcattatcccgtcgttcg

SEQ ID NO: 180132 - DNA, 25 bp, E. coli
caattaagcattttcccgtcgttcg

SEQ ID NO: 180133 - DNA, 25 bp, E. coli
caacgtggcgcgagtaaatcttatc

SEQ ID NO: 180134 - DNA, 25 bp, E. coli
cactatcgacaatcatcgttcggaa

SEQ ID NO: 180135 - DNA, 25 bp, E. coli
caacgtggcgcgtgtaaatcttatc

SEQ ID NO: 180136 - DNA, 25 bp, E. coli
cactatcgacaaacatcgttcggaa

SEQ ID NO: 180137 - DNA, 25 bp, E. coli
ttatccgacaggaacaggagccacg

SEQ ID NO: 180138 - DNA, 25 bp, E. coli
tttacctccagagggcgcgaatacg

SEQ ID NO: 180139 - DNA, 25 bp, E. coli
ttacttctgcgcgaccaacgtggcg

SEQ ID NO: 180140 - DNA, 25 bp, E. coli
tttacctccagacggcgcgaatacg

SEQ ID NO: 180141 - DNA, 25 bp, E. coli
ttacttctgcgccaccaacgtggcg

SEQ ID NO: 180142 - DNA, 25 bp, E. coli
ttatccgacaggtacaggagccacg

SEQ ID NO: 180143 - DNA, 25 bp, E. coli
tcgttcggaaaaggatgcacaccac

SEQ ID NO: 180144 - DNA, 25 bp, E. coli
tcgttcggaaaacgatgcacaccac

SEQ ID NO: 180145 - DNA, 25 bp, E. coli
gaacgcctgatttccactatcgaca

SEQ ID NO: 180146 - DNA, 25 bp, E. coli
gaacgcctgattaccactatcgaca

SEQ ID NO: 180147 - DNA, 25 bp, E. coli
gcgaatacgaggtcgacgaacgcct

SEQ ID NO: 180148 - DNA, 25 bp, E. coli
gcgaatacgaggacgacgaacgcct

SEQ ID NO: 180149 - DNA, 25 bp, E. coli
cgtcgttcgcttaacctccagaggg

SEQ ID NO: 180150 - DNA, 25 bp, E. coli
cgtcgttcgctttacctccagaggg

SEQ ID NO: 180151 - DNA, 25 bp, E. coli
tcactgacggcagttacttctgcgc

SEQ ID NO: 180152 - DNA, 25 bp, E. coli
tcactgacggcacttacttctgcgc

SEQ ID NO: 180153 - DNA, 25 bp, E. coli
aacgccgcgccgcatattattgcag

SEQ ID NO: 180154 - DNA, 25 bp, E. coli
aacgccgcgccggatattattgcag

SEQ ID NO: 180155 - DNA, 25 bp, E. coli
cactcggtggtcttcaggcggatag

SEQ ID NO: 180156 - DNA, 25 bp, E. coli
cactcggtggtcatcaggcggatag

SEQ ID NO: 180157 - DNA, 25 bp, E. coli
cactggatgaaaaatatgcgctgcg

SEQ ID NO: 180158 - DNA, 25 bp, E. coli
cactggatgaaatatatgcgctgcg

SEQ ID NO: 180159 - DNA, 25 bp, E. coli
cacaacaacgcctgcgcaggtatcg

SEQ ID NO: 180160 - DNA, 25 bp, E. coli
cacaacaacgccagcgcaggtatcg

SEQ ID NO: 180161 - DNA, 25 bp, E. coli
agtgacagtgcttccgcgcactcgg

SEQ ID NO: 180162 - DNA, 25 bp, E. coli
agtgacagtgctaccgcgcactcgg

SEQ ID NO: 180163 - DNA, 25 bp, E. coli
aaaatatgcgctgcgggtgacacaa

SEQ ID NO: 180164 - DNA, 25 bp, E. coli
aaaatatgcgctccgggtgacacaa

SEQ ID NO: 180165 - DNA, 25 bp, E. coli
tattgcagcgcgtaaatctgccaca

SEQ ID NO: 180166 - DNA, 25 bp, E. coli
tattgcagcgcgaaaatctgccaca

SEQ ID NO: 180167 - DNA, 25 bp, E. coli
tcatcaggcggatagccgatcgtgg

SEQ ID NO: 180168 - DNA, 25 bp, E. coli
tcatcaggcggaaagccgatcgtgg

SEQ ID NO: 180169 - DNA, 25 bp, E. coli
gctgaaatggttaaacgcactggat

SEQ ID NO: 180170 - DNA, 25 bp, E. coli
gctgaaatggtttaacgcactggat

SEQ ID NO: 180171 - DNA, 25 bp, E. coli
gaacggattgaggaacaggagacaa

SEQ ID NO: 180172 - DNA, 25 bp, E. coli
gaacggattgagcaacaggagacaa

SEQ ID NO: 180173 - DNA, 25 bp, E. coli
tggcgatgaacagccgactgaagaa

SEQ ID NO: 180174 - DNA, 25 bp, E. coli
tggcgatgaacacccgactgaagaa

SEQ ID NO: 180175 - DNA, 25 bp, E. coli
catcgcgttgcctgtggctgcggca

SEQ ID NO: 180176 - DNA, 25 bp, E. coli
catcgcgttgccagtggctgcggca

SEQ ID NO: 180177 - DNA, 25 bp, E. coli
taaagcagcggatgaagcacggttt

SEQ ID NO: 180178 - DNA, 25 bp, E. coli
taaagcagcggaagaagcacggttt

SEQ ID NO: 180179 - DNA, 25 bp, E. coli
atccacagtggcctaaagctgaacc

SEQ ID NO: 180180 - DNA, 25 bp, E. coli
atccacagtggcgtaaagctgaacc

SEQ ID NO: 180181 - DNA, 25 bp, E. coli
tagctctcggctggatgaacgtcgg

SEQ ID NO: 180182 - DNA, 25 bp, E. coli
tacgctggaattgatagctctcggc

SEQ ID NO: 180183 - DNA, 25 bp, E. coli
tagctctcggctcgatgaacgtcgg

SEQ ID NO: 180184 - DNA, 25 bp, E. coli
tacgctggaattcatagctctcggc

SEQ ID NO: 180185 - DNA, 25 bp, E. coli
tgtttgcccgtaccatcaccgtagt

SEQ ID NO: 180186 - DNA, 25 bp, E. coli
tcctcggtttccacgcaggtggcta

SEQ ID NO: 180187 - DNA, 25 bp, E. coli
tcctcggtttcctcgcaggtggcta

SEQ ID NO: 180188 - DNA, 25 bp, E. coli
tgtttgcccgtagcatcaccgtagt

SEQ ID NO: 180189 - DNA, 25 bp, E. coli
gaagcacggtttggcactctcgata

SEQ ID NO: 180190 - DNA, 25 bp, E. coli
gaagcacggtttcgcactctcgata

SEQ ID NO: 180191 - DNA, 25 bp, E. coli
gttggtcagcaaagcatcgccaccg

SEQ ID NO: 180192 - DNA, 25 bp, E. coli
gatattctgcatgtctccgcgcttg

SEQ ID NO: 180193 - DNA, 25 bp, E. coli
gatattctgcatctctccgcgcttg

SEQ ID NO: 180194 - DNA, 25 bp, E. coli
gttggtcagcaatgcatcgccaccg

SEQ ID NO: 180195 - DNA, 25 bp, E. coli
ggtggctacctcgatctcagtctgc

SEQ ID NO: 180196 - DNA, 25 bp, E. coli
ggtggctacctccatctcagtctgc

SEQ ID NO: 180197 - DNA, 25 bp, E. coli
aagagcgaaacaattttcttgcgcg

SEQ ID NO: 180198 - DNA, 25 bp, E. coli
aagagcgaaacatttttcttgcgcg

SEQ ID NO: 180199 - DNA, 25 bp, E. coli
cagcaagcgcgcagtatcgggtgaa

SEQ ID NO: 180200 - DNA, 25 bp, E. coli
cagcaagcgcgctgtatcgggtgaa

SEQ ID NO: 180201 - DNA, 25 bp, E. coli
catttcccgcgggtgactgagatac

SEQ ID NO: 180202 - DNA, 25 bp, E. coli
catttcccgcggctgactgagatac

SEQ ID NO: 180203 - DNA, 25 bp, E. coli
tacggaaaagcagcaagcgcgctgt

SEQ ID NO: 180204 - DNA, 25 bp, E. coli
actgagataccgcaggagccggaac

SEQ ID NO: 180205 - DNA, 25 bp, E. coli
actgagataccggaggagccggaac

SEQ ID NO: 180206 - DNA, 25 bp, E. coli
tacggaaaagcaccaagcgcgctgt

SEQ ID NO: 180207 - DNA, 25 bp, E. coli
ccagcaagagcgaaacaattttctt

SEQ ID NO: 180208 - DNA, 25 bp, E. coli
ccagcaagagcgtaacaattttctt

SEQ ID NO: 180209 - DNA, 25 bp, E. coli
gaaaagcagcaagcgcgctgtatcg

SEQ ID NO: 180210 - DNA, 25 bp, E. coli
gaaaagcagcaaccgcgctgtatcg

SEQ ID NO: 180211 - DNA, 25 bp, E. coli
cgctgtatcgggtgaagagtggtat

SEQ ID NO: 180212 - DNA, 25 bp, E. coli
cgctgtatcgggagaagagtggtat

SEQ ID NO: 180213 - DNA, 25 bp, E. coli
cggctgactgagttaccgcaggagc

SEQ ID NO: 180214 - DNA, 25 bp, E. coli
cggctgactgagataccgcaggagc

SEQ ID NO: 180215 - DNA, 25 bp, E. coli
gataccgcaggagccggaaccgcaa

SEQ ID NO: 180216 - DNA, 25 bp, E. coli
gataccgcaggacccggaaccgcaa

SEQ ID NO: 180217 - DNA, 25 bp, E. coli
ggatacacgcagacatttcccgcgg

SEQ ID NO: 180218 - DNA, 25 bp, E. coli
ggatacacgcagtcatttcccgcgg

SEQ ID NO: 180219 - DNA, 25 bp, E. coli
cacagcaagtttatccgcttaaggg

SEQ ID NO: 180220 - DNA, 25 bp, E. coli
cacagcaagtttttccgcttaaggg

SEQ ID NO: 180221 - DNA, 25 bp, E. coli
taaacgctgcgaaatccgcgatcgc

SEQ ID NO: 180222 - DNA, 25 bp, E. coli
taaacgctgcgatatccgcgatcgc

SEQ ID NO: 180223 - DNA, 25 bp, E. coli
tattaagccgcatgccatctcgaca

SEQ ID NO: 180224 - DNA, 25 bp, E. coli
tattaagccgcaagccatctcgaca

SEQ ID NO: 180225 - DNA, 25 bp, E. coli
tttgaagtcggcaatattaagccgc

SEQ ID NO: 180226 - DNA, 25 bp, E. coli
tttgaagtcggctatattaagccgc

SEQ ID NO: 180227 - DNA, 25 bp, E. coli
ccatctcgacatccggcttatacgg

SEQ ID NO: 180228 - DNA, 25 bp, E. coli
ccatctcgacatgcggcttatacgg

SEQ ID NO: 180229 - DNA, 25 bp, E. coli
gctctacgggattaacgctgcgata

SEQ ID NO: 180230 - DNA, 25 bp, E. coli
gctctacgggataaacgctgcgata

SEQ ID NO: 180231 - DNA, 25 bp, E. coli
gaaacacatcttttccgctctacgg

SEQ ID NO: 180232 - DNA, 25 bp, E. coli
gaaacacatcttatccgctctacgg

SEQ ID NO: 180233 - DNA, 25 bp, E. coli
cgttgatgcgccctttgaagtcggc

SEQ ID NO: 180234 - DNA, 25 bp, E. coli
ccgcgatcgcggttaaaaaggagga

SEQ ID NO: 180235 - DNA, 25 bp, E. coli
ccgcgatcgcggataaaaaggagga

SEQ ID NO: 180236 - DNA, 25 bp, E. coli
cgttgatgcgccgtttgaagtcggc

SEQ ID NO: 180237 - DNA, 25 bp, E. coli
ggatttaaataacgcgttgatgcgc

SEQ ID NO: 180238 - DNA, 25 bp, E. coli
ggatttaaataaggcgttgatgcgc

SEQ ID NO: 180239 - DNA, 25 bp, E. coli
gaggataagtcaatctggaaacaca

SEQ ID NO: 180240 - DNA, 25 bp, E. coli
gaggataagtcattctggaaacaca

SEQ ID NO: 180241 - DNA, 25 bp, E. coli
caattgctctggaatggcgctaaga

SEQ ID NO: 180242 - DNA, 25 bp, E. coli
caattgctctggtatggcgctaaga

SEQ ID NO: 180243 - DNA, 25 bp, E. coli
cagagtctgcttcaaaacgcggcac

SEQ ID NO: 180244 - DNA, 25 bp, E. coli
cataacgtcgtaccgggcgtggata

SEQ ID NO: 180245 - DNA, 25 bp, E. coli
cataacgtcgtagcgggcgtggata

SEQ ID NO: 180246 - DNA, 25 bp, E. coli
cagagtctgcttgaaaacgcggcac

SEQ ID NO: 180247 - DNA, 25 bp, E. coli
tgattgacgagctactcaggcgctt

SEQ ID NO: 180248 - DNA, 25 bp, E. coli
tgattgacgagcaactcaggcgctt

SEQ ID NO: 180249 - DNA, 25 bp, E. coli
gctaagacgctggtacgaacaacag

SEQ ID NO: 180250 - DNA, 25 bp, E. coli
gctaagacgctgctacgaacaacag

SEQ ID NO: 180251 - DNA, 25 bp, E. coli
gacgttaacctgcaactctcctggg

SEQ ID NO: 180252 - DNA, 25 bp, E. coli
gacgttaacctggaactctcctggg

SEQ ID NO: 180253 - DNA, 25 bp, E. coli
gaaaaccgcctttcgcaacaactgg

SEQ ID NO: 180254 - DNA, 25 bp, E. coli
gaaaaccgccttacgcaacaactgg

SEQ ID NO: 180255 - DNA, 25 bp, E. coli
ctttaatggcgcacagggtgcagca

SEQ ID NO: 180256 - DNA, 25 bp, E. coli
ctttaatggcgctcagggtgcagca

SEQ ID NO: 180257 - DNA, 25 bp, E. coli
gatatgacccaacactgcgcgtgtg

SEQ ID NO: 180258 - DNA, 25 bp, E. coli
gatatgacccaagactgcgcgtgtg

SEQ ID NO: 180259 - DNA, 25 bp, E. coli
taatctgttcgaacccgatgcggtg

SEQ ID NO: 180260 - DNA, 25 bp, E. coli
taacgctcgctgacatggtctggtg

SEQ ID NO: 180261 - DNA, 25 bp, E. coli
taatctgttcgatcccgatgcggtg

SEQ ID NO: 180262 - DNA, 25 bp, E. coli
taacgctcgctgtcatggtctggtg

SEQ ID NO: 180263 - DNA, 25 bp, E. coli
catggctatgtgctgactgacggta

SEQ ID NO: 180264 - DNA, 25 bp, E. coli
catggctatgtggtgactgacggta

SEQ ID NO: 180265 - DNA, 25 bp, E. coli
ttcgcatacgccctgaaccagtggc

SEQ ID NO: 180266 - DNA, 25 bp, E. coli
ttcaacgagctgaaccgggatggcc

SEQ ID NO: 180267 - DNA, 25 bp, E. coli
ttcgcatacgccgtgaaccagtggc

SEQ ID NO: 180268 - DNA, 25 bp, E. coli
ttcaacgagctgtaccgggatggcc

SEQ ID NO: 180269 - DNA, 25 bp, E. coli
tcccggtgctgtagccaggcaataa

SEQ ID NO: 180270 - DNA, 25 bp, E. coli
tcccggtgctgttgccaggcaataa

SEQ ID NO: 180271 - DNA, 25 bp, E. coli
tcagttgaaaacgaaaccgctgctg

SEQ ID NO: 180272 - DNA, 25 bp, E. coli
gccggcgctgacctactatgcagat

SEQ ID NO: 180273 - DNA, 25 bp, E. coli
gccggataacggtagccgcctgttg

SEQ ID NO: 180274 - DNA, 25 bp, E. coli
gccggataacggaagccgcctgttg

SEQ ID NO: 180275 - DNA, 25 bp, E. coli
gcgccttgccgaacgtcagttgaaa

SEQ ID NO: 180276 - DNA, 25 bp, E. coli
gcgccttgccgatcgtcagttgaaa

SEQ ID NO: 180277 - DNA, 25 bp, E. coli
gccggcgctgacgtactatgcagat

SEQ ID NO: 180278 - DNA, 25 bp, E. coli
gctgaaacggatgggcgaactgtac

SEQ ID NO: 180279 - DNA, 25 bp, E. coli
gctgaaacggatcggcgaactgtac

SEQ ID NO: 180280 - DNA, 25 bp, E. coli
gacggtaagctccatgctgatgaca

SEQ ID NO: 180281 - DNA, 25 bp, E. coli
gtctgggccgcataaactacctgtt

SEQ ID NO: 180282 - DNA, 25 bp, E. coli
gtctgggccgcaaaaactacctgtt

SEQ ID NO: 180283 - DNA, 25 bp, E. coli
tcagttgaaaaccaaaccgctgctg

SEQ ID NO: 180284 - DNA, 25 bp, E. coli
gacggtaagctcgatgctgatgaca

SEQ ID NO: 180285 - DNA, 25 bp, E. coli
caaaagatgtctctgtttgtatgaa

SEQ ID NO: 180286 - DNA, 25 bp, E. coli
caaaagatgtctgtgtttgtatgaa

SEQ ID NO: 180287 - DNA, 25 bp, E. coli
cattcgtttcaaaagatgtctgtgt

SEQ ID NO: 180288 - DNA, 25 bp, E. coli
aaaatgtatcattcgtttcaaaaga

SEQ ID NO: 180289 - DNA, 25 bp, E. coli
aaaatgtatcatacgtttcaaaaga

SEQ ID NO: 180290 - DNA, 25 bp, E. coli
tattttcgtggattctaatgatgat

SEQ ID NO: 180291 - DNA, 25 bp, E. coli
tattttcgtggaatctaatgatgat

SEQ ID NO: 180292 - DNA, 25 bp, E. coli
tgttgctttacaataatgacagtga

SEQ ID NO: 180293 - DNA, 25 bp, E. coli
tgttgctttacattaatgacagtga

SEQ ID NO: 180294 - DNA, 25 bp, E. coli
gacagtgatgtgagtcgattaaata

SEQ ID NO: 180295 - DNA, 25 bp, E. coli
gacagtgatgtgtgtcgattaaata

SEQ ID NO: 180296 - DNA, 25 bp, E. coli
cattaatgacagagatgtgtgtcga

SEQ ID NO: 180297 - DNA, 25 bp, E. coli
cgtggattctaatgatgattattaa

SEQ ID NO: 180298 - DNA, 25 bp, E. coli
cgtggattctaaagatgattattaa

SEQ ID NO: 180299 - DNA, 25 bp, E. coli
cattcgtttcaatagatgtctgtgt

SEQ ID NO: 180300 - DNA, 25 bp, E. coli
cattaatgacagtgatgtgtgtcga

SEQ ID NO: 180301 - DNA, 25 bp, E. coli
taagcattcattttaaaaatgtatc

SEQ ID NO: 180302 - DNA, 25 bp, E. coli
taagcattcattataaaaatgtatc

SEQ ID NO: 180303 - DNA, 25 bp, E. coli
gatgtctgtgtttgtatgaatatat

SEQ ID NO: 180304 - DNA, 25 bp, E. coli
gatgtgtgtcgattaaatattgttt

SEQ ID NO: 180305 - DNA, 25 bp, E. coli
gatgtgtgtcgaataaatattgttt

SEQ ID NO: 180306 - DNA, 25 bp, E. coli
gatgtctgtgttagtatgaatatat

SEQ ID NO: 180307 - DNA, 25 bp, E. coli
catgtgcaacaattctggattcagg

SEQ ID NO: 180308 - DNA, 25 bp, E. coli
catcaccgcgaaccgggaatggttg

SEQ ID NO: 180309 - DNA, 25 bp, E. coli
catgtgcaacaaatctggattcagg

SEQ ID NO: 180310 - DNA, 25 bp, E. coli
catcaccgcgaagcgggaatggttg

SEQ ID NO: 180311 - DNA, 25 bp, E. coli
atatggcgtcgctgcatccggcgcg

SEQ ID NO: 180312 - DNA, 25 bp, E. coli
atatggcgtcgcagcatccggcgcg

SEQ ID NO: 180313 - DNA, 25 bp, E. coli
acaagcgcgcctggctggaactgat

SEQ ID NO: 180314 - DNA, 25 bp, E. coli
acaagcgcgcctcgctggaactgat

SEQ ID NO: 180315 - DNA, 25 bp, E. coli
tgcattgctataacgggatgacagg

SEQ ID NO: 180316 - DNA, 25 bp, E. coli
tgcattgctatatcgggatgacagg

SEQ ID NO: 180317 - DNA, 25 bp, E. coli
tcgtactgatcaccgacgcgatgca

SEQ ID NO: 180318 - DNA, 25 bp, E. coli
tcgtactgatcagcgacgcgatgca

SEQ ID NO: 180319 - DNA, 25 bp, E. coli
ctggaactgatacccgatggtcatc

SEQ ID NO: 180320 - DNA, 25 bp, E. coli
ctggaactgatagccgatggtcatc

SEQ ID NO: 180321 - DNA, 25 bp, E. coli
ggatcgcttaaaccgggcaaacgcg

SEQ ID NO: 180322 - DNA, 25 bp, E. coli
ggatgacaggtttacatcaccgcga

SEQ ID NO: 180323 - DNA, 25 bp, E. coli
tggtgttctgggatcgcttaaaccg

SEQ ID NO: 180324 - DNA, 25 bp, E. coli
tggtgttctgggttcgcttaaaccg

SEQ ID NO: 180325 - DNA, 25 bp, E. coli
tggattcagggtcaattagcttcgt

SEQ ID NO: 180326 - DNA, 25 bp, E. coli
tggattcagggtgaattagcttcgt

SEQ ID NO: 180327 - DNA, 25 bp, E. coli
ggatgacaggttaacatcaccgcga

SEQ ID NO: 180328 - DNA, 25 bp, E. coli
ggatcgcttaaagcgggcaaacgcg

SEQ ID NO: 180329 - DNA, 25 bp, E. coli
aagacgaaccgcgtcttctcaggca

SEQ ID NO: 180330 - DNA, 25 bp, E. coli
aagacgaaccgcctcttctcaggca

SEQ ID NO: 180331 - DNA, 25 bp, E. coli
cacttgcaagaaggctcatatcaga

SEQ ID NO: 180332 - DNA, 25 bp, E. coli
cacttgcaagaacgctcatatcaga

SEQ ID NO: 180333 - DNA, 25 bp, E. coli
catcattactcatcgccggatgcgg

SEQ ID NO: 180334 - DNA, 25 bp, E. coli
catcattactcaacgccggatgcgg

SEQ ID NO: 180335 - DNA, 25 bp, E. coli
tatcgccttcgtgatggtaatcaga

SEQ ID NO: 180336 - DNA, 25 bp, E. coli
tatatctaaataaaactcgcaaatg

SEQ ID NO: 180337 - DNA, 25 bp, E. coli
tatagtctgatatgacgaaccgcct

SEQ ID NO: 180338 - DNA, 25 bp, E. coli
tatagtctgataagacgaaccgcct

SEQ ID NO: 180339 - DNA, 25 bp, E. coli
tatcgccttcgtcatggtaatcaga

SEQ ID NO: 180340 - DNA, 25 bp, E. coli
tatatctaaatataactcgcaaatg

SEQ ID NO: 180341 - DNA, 25 bp, E. coli
tgttaatcatgaaaaatgcaagcga

SEQ ID NO: 180342 - DNA, 25 bp, E. coli
tgttaatcatgataaatgcaagcga

SEQ ID NO: 180343 - DNA, 25 bp, E. coli
tccggcctacgtctgagatgagtcc

SEQ ID NO: 180344 - DNA, 25 bp, E. coli
tccggcctacgtgtgagatgagtcc

SEQ ID NO: 180345 - DNA, 25 bp, E. coli
tctaattaagcaaaaggaggctgat

SEQ ID NO: 180346 - DNA, 25 bp, E. coli
tctaattaagcataaggaggctgat

SEQ ID NO: 180347 - DNA, 25 bp, E. coli
gcaagcgatttgtagaactgatatg

SEQ ID NO: 180348 - DNA, 25 bp, E. coli
gcaagcgatttgaagaactgatatg

SEQ ID NO: 180349 - DNA, 25 bp, E. coli
gagatgagtccaggtttaaaaatca

SEQ ID NO: 180350 - DNA, 25 bp, E. coli
gagatgagtccacgtttaaaaatca

SEQ ID NO: 180351 - DNA, 25 bp, E. coli
tattcgcgatcttcaacagcacggt

SEQ ID NO: 180352 - DNA, 25 bp, E. coli
tattggcgcgaattacgagatctac

SEQ ID NO: 180353 - DNA, 25 bp, E. coli
tattggcgcgaaatacgagatctac

SEQ ID NO: 180354 - DNA, 25 bp, E. coli
tattcgcgatctacaacagcacggt

SEQ ID NO: 180355 - DNA, 25 bp, E. coli
cctgtttggtgtgtggcccggacaa

SEQ ID NO: 180356 - DNA, 25 bp, E. coli
cctgtttggtgtctggcccggacaa

SEQ ID NO: 180357 - DNA, 25 bp, E. coli
gaattacctgaactgctcggcctta

SEQ ID NO: 180358 - DNA, 25 bp, E. coli
gaattacctgaagtgctcggcctta

SEQ ID NO: 180359 - DNA, 25 bp, E. coli
taattaaccaacacgtccagcaggg

SEQ ID NO: 180360 - DNA, 25 bp, E. coli
ctattggacgtttgagcggcggcaa

SEQ ID NO: 180361 - DNA, 25 bp, E. coli
ctattggacgttagagcggcggcaa

SEQ ID NO: 180362 - DNA, 25 bp, E. coli
taattaaccaactcgtccagcaggg

SEQ ID NO: 180363 - DNA, 25 bp, E. coli
gattatgacctgatgacgctacgct

SEQ ID NO: 180364 - DNA, 25 bp, E. coli
gattatgacctgttgacgctacgct

SEQ ID NO: 180365 - DNA, 25 bp, E. coli
gtattgaacatcagacggcatggca

SEQ ID NO: 180366 - DNA, 25 bp, E. coli
gtattgaacatctgacggcatggca

SEQ ID NO: 180367 - DNA, 25 bp, E. coli
tcaccatgatggtcgggcgagagtt

SEQ ID NO: 180368 - DNA, 25 bp, E. coli
tcaccatgatggacgggcgagagtt

SEQ ID NO: 180369 - DNA, 25 bp, E. coli
taatgaaccacaaaccaccggagat

SEQ ID NO: 180370 - DNA, 25 bp, E. coli
taatgaaccacataccaccggagat

SEQ ID NO: 180371 - DNA, 25 bp, E. coli
gagattcaggcgagtcacatccgcg

SEQ ID NO: 180372 - DNA, 25 bp, E. coli
gagattcaggcgtgtcacatccgcg

SEQ ID NO: 180373 - DNA, 25 bp, E. coli
caacatggcggatggtctgagtgac

SEQ ID NO: 180374 - DNA, 25 bp, E. coli
caacatggcggaaggtctgagtgac

SEQ ID NO: 180375 - DNA, 25 bp, E. coli
cataacccactgtattgcgtagata

SEQ ID NO: 180376 - DNA, 25 bp, E. coli
cataacccactgaattgcgtagata

SEQ ID NO: 180377 - DNA, 25 bp, E. coli
taccgtacacggacatgcgggtgag

SEQ ID NO: 180378 - DNA, 25 bp, E. coli
taccgtacacggtcatgcgggtgag

SEQ ID NO: 180379 - DNA, 25 bp, E. coli
ttgctgggctgccagttgctgttct

SEQ ID NO: 180380 - DNA, 25 bp, E. coli
ttgctgggctgcgagttgctgttct

SEQ ID NO: 180381 - DNA, 25 bp, E. coli
tgggatgaccatgatgacggatgca

SEQ ID NO: 180382 - DNA, 25 bp, E. coli
tgggatgaccatcatgacggatgca

SEQ ID NO: 180383 - DNA, 25 bp, E. coli
tgagcgcttcttgtcgctggcgaat

SEQ ID NO: 180384 - DNA, 25 bp, E. coli
tgagcgcttcttctcgctggcgaat

SEQ ID NO: 180385 - DNA, 25 bp, E. coli
gacgtgaagctttctcatgcccaaa

SEQ ID NO: 180386 - DNA, 25 bp, E. coli
ggatgcaatccgaacctttaagttg

SEQ ID NO: 180387 - DNA, 25 bp, E. coli
gtgagctggtgctgggttatctcca

SEQ ID NO: 180388 - DNA, 25 bp, E. coli
ggatgcaatccgtacctttaagttg

SEQ ID NO: 180389 - DNA, 25 bp, E. coli
gtgagctggtgcagggttatctcca

SEQ ID NO: 180390 - DNA, 25 bp, E. coli
tggcagcagcggtactctcaaagca

SEQ ID NO: 180391 - DNA, 25 bp, E. coli
tggcagcagcggaactctcaaagca

SEQ ID NO: 180392 - DNA, 25 bp, E. coli
taatgatgaacgatttggtgagcgc

SEQ ID NO: 180393 - DNA, 25 bp, E. coli
taatgatgaacgttttggtgagcgc

SEQ ID NO: 180394 - DNA, 25 bp, E. coli
gacgtgaagcttactcatgcccaaa

SEQ ID NO: 180395 - DNA, 25 bp, E. coli
aagtcacctcaaacgacaaagccaa

SEQ ID NO: 180396 - DNA, 25 bp, E. coli
aagtcacctcaatcgacaaagccaa

SEQ ID NO: 180397 - DNA, 25 bp, E. coli
aagcgttctgccgactgcgtgctga

SEQ ID NO: 180398 - DNA, 25 bp, E. coli
aagcgttctgcccactgcgtgctga

SEQ ID NO: 180399 - DNA, 25 bp, E. coli
cacaaagtcacctcaatcgacaaag

SEQ ID NO: 180400 - DNA, 25 bp, E. coli
cacaaagtcaccacaatcgacaaag

SEQ ID NO: 180401 - DNA, 25 bp, E. coli
actgctgcctttgcgtaaacacttc

SEQ ID NO: 180402 - DNA, 25 bp, E. coli
actgctgcctttccgtaaacacttc

SEQ ID NO: 180403 - DNA, 25 bp, E. coli
tgcccactgcgtgctgacattgccg

SEQ ID NO: 180404 - DNA, 25 bp, E. coli
tgcccactgcgtcctgacattgccg

SEQ ID NO: 180405 - DNA, 25 bp, E. coli
gcactgctgcctatgcgtaaacact

SEQ ID NO: 180406 - DNA, 25 bp, E. coli
gcactgctgcctttgcgtaaacact

SEQ ID NO: 180407 - DNA, 25 bp, E. coli
cggcgcactgctgcctttgcgtaaa

SEQ ID NO: 180408 - DNA, 25 bp, E. coli
cattgataaccagggacagccgctg

SEQ ID NO: 180409 - DNA, 25 bp, E. coli
cattgataaccacggacagccgctg

SEQ ID NO: 180410 - DNA, 25 bp, E. coli
cggcgcactgctccctttgcgtaaa

SEQ ID NO: 180411 - DNA, 25 bp, E. coli
gttctgcccactccgtgctgacatt

SEQ ID NO: 180412 - DNA, 25 bp, E. coli
gttctgcccactgcgtgctgacatt

SEQ ID NO: 180413 - DNA, 25 bp, E. coli
gggctggaagcgatctgcccactgc

SEQ ID NO: 180414 - DNA, 25 bp, E. coli
gggctggaagcgttctgcccactgc

SEQ ID NO: 180415 - DNA, 25 bp, E. coli
gtcgccacaaagacacctcaatcga

SEQ ID NO: 180416 - DNA, 25 bp, E. coli
gtcgccacaaagtcacctcaatcga

SEQ ID NO: 180417 - DNA, 25 bp, E. coli
aagtgatttactatcttgccactgg

SEQ ID NO: 180418 - DNA, 25 bp, E. coli
aagtgatttactttcttgccactgg

SEQ ID NO: 180419 - DNA, 25 bp, E. coli
tgttttccttttggcatgtaactgc

SEQ ID NO: 180420 - DNA, 25 bp, E. coli
tgttttccttttcgcatgtaactgc

SEQ ID NO: 180421 - DNA, 25 bp, E. coli
tcggaataagggatcatgtagtaat

SEQ ID NO: 180422 - DNA, 25 bp, E. coli
tcggaataagggttcatgtagtaat

SEQ ID NO: 180423 - DNA, 25 bp, E. coli
tctgccctttagaatgctgatatcg

SEQ ID NO: 180424 - DNA, 25 bp, E. coli
tctgccctttagtatgctgatatcg

SEQ ID NO: 180425 - DNA, 25 bp, E. coli
gcttctatcgcattatcctttatct

SEQ ID NO: 180426 - DNA, 25 bp, E. coli
gcattatcctttatctgccctttag

SEQ ID NO: 180427 - DNA, 25 bp, E. coli
gcttctatcgcaatatcctttatct

SEQ ID NO: 180428 - DNA, 25 bp, E. coli
gcattatcctttttctgccctttag

SEQ ID NO: 180429 - DNA, 25 bp, E. coli
cgctgtcggaattagggatcatgta

SEQ ID NO: 180430 - DNA, 25 bp, E. coli
cgctgtcggaataagggatcatgta

SEQ ID NO: 180431 - DNA, 25 bp, E. coli
cttttcgcatgtaactgcctttccc

SEQ ID NO: 180432 - DNA, 25 bp, E. coli
cgattgccatgttttccttttcgca

SEQ ID NO: 180433 - DNA, 25 bp, E. coli
cgattgccatgtattccttttcgca

SEQ ID NO: 180434 - DNA, 25 bp, E. coli
cttttcgcatgttactgcctttccc

SEQ ID NO: 180435 - DNA, 25 bp, E. coli
gatcatgtagtattgcttctatcgc

SEQ ID NO: 180436 - DNA, 25 bp, E. coli
gatttactttctagccactggcctc

SEQ ID NO: 180437 - DNA, 25 bp, E. coli
gatttactttcttgccactggcctc

SEQ ID NO: 180438 - DNA, 25 bp, E. coli
gatcatgtagtaatgcttctatcgc

SEQ ID NO: 180439 - DNA, 25 bp, E. coli
aatggttcaacggtgacaaaggctt

SEQ ID NO: 180440 - DNA, 25 bp, E. coli
aatggttcaacgctgacaaaggctt

SEQ ID NO: 180441 - DNA, 25 bp, E. coli
aaaggcttcggcatcatcactcctg

SEQ ID NO: 180442 - DNA, 25 bp, E. coli
aaaggcttcggcttcatcactcctg

SEQ ID NO: 180443 - DNA, 25 bp, E. coli
tgtccttcaccaacgaaagcggcgc

SEQ ID NO: 180444 - DNA, 25 bp, E. coli
tgtccttcaccatcgaaagcggcgc

SEQ ID NO: 180445 - DNA, 25 bp, E. coli
tctgctatccagaacgatggttaca

SEQ ID NO: 180446 - DNA, 25 bp, E. coli
tctggacgaaggtcagaaagtgtcc

SEQ ID NO: 180447 - DNA, 25 bp, E. coli
tcactcctgacgatggctctaaaga

SEQ ID NO: 180448 - DNA, 25 bp, E. coli
tctgctatccagtacgatggttaca

SEQ ID NO: 180449 - DNA, 25 bp, E. coli
tctggacgaaggacagaaagtgtcc

SEQ ID NO: 180450 - DNA, 25 bp, E. coli
gaaagtgtccttcaccatcgaaagc

SEQ ID NO: 180451 - DNA, 25 bp, E. coli
gaaagtgtccttgaccatcgaaagc

SEQ ID NO: 180452 - DNA, 25 bp, E. coli
gactggtatcgtaaaatggttcaac

SEQ ID NO: 180453 - DNA, 25 bp, E. coli
gactggtatcgttaaatggttcaac

SEQ ID NO: 180454 - DNA, 25 bp, E. coli
gtacacttctctgctatccagaacg

SEQ ID NO: 180455 - DNA, 25 bp, E. coli
gtacacttctctcctatccagaacg

SEQ ID NO: 180456 - DNA, 25 bp, E. coli
tgtccggtaaaaagactggtatcgt

SEQ ID NO: 180457 - DNA, 25 bp, E. coli
tgtccggtaaaatgactggtatcgt

SEQ ID NO: 180458 - DNA, 25 bp, E. coli
tcactcctgacgttggctctaaaga

SEQ ID NO: 180459 - DNA, 25 bp, E. coli
gatggttacaaatctctggacgaag

SEQ ID NO: 180460 - DNA, 25 bp, E. coli
gatggttacaaaactctggacgaag

SEQ ID NO: 180461 - DNA, 25 bp, E. coli
cagaggtcagtgaggcgcacctgtc

SEQ ID NO: 180462 - DNA, 25 bp, E. coli
cagaggtcagtgtggcgcacctgtc

SEQ ID NO: 180463 - DNA, 25 bp, E. coli
cagtgaggcgcagctgtcactcgat

SEQ ID NO: 180464 - DNA, 25 bp, E. coli
cagtgaggcgcacctgtcactcgat

SEQ ID NO: 180465 - DNA, 25 bp, E. coli
atgtaacagaggacagtgaggcgca

SEQ ID NO: 180466 - DNA, 25 bp, E. coli
atgtaacagaggtcagtgaggcgca

SEQ ID NO: 180467 - DNA, 25 bp, E. coli
agaggtcagtgacgcgcacctgtca

SEQ ID NO: 180468 - DNA, 25 bp, E. coli
agaggtcagtgaggcgcacctgtca

SEQ ID NO: 180469 - DNA, 25 bp, E. coli
acagaggtcagtcaggcgcacctgt

SEQ ID NO: 180470 - DNA, 25 bp, E. coli
aacagaggtcagtgaggcgcacctg

SEQ ID NO: 180471 - DNA, 25 bp, E. coli
aacagaggtcagagaggcgcacctg

SEQ ID NO: 180472 - DNA, 25 bp, E. coli
acagaggtcagtgaggcgcacctgt

SEQ ID NO: 180473 - DNA, 25 bp, E. coli
tcagtgaggcgcacctgtcactcga

SEQ ID NO: 180474 - DNA, 25 bp, E. coli
tcagtgaggcgctcctgtcactcga

SEQ ID NO: 180475 - DNA, 25 bp, E. coli
gtaacagaggtcagtgaggcgcacc

SEQ ID NO: 180476 - DNA, 25 bp, E. coli
gtaacagaggtctgtgaggcgcacc

SEQ ID NO: 180477 - DNA, 25 bp, E. coli
gtcagtgaggcgcacctgtcactcg

SEQ ID NO: 180478 - DNA, 25 bp, E. coli
gtcagtgaggcggacctgtcactcg

SEQ ID NO: 180479 - DNA, 25 bp, E. coli
taacagaggtcactgaggcgcacct

SEQ ID NO: 180480 - DNA, 25 bp, E. coli
taacagaggtcagtgaggcgcacct

SEQ ID NO: 180481 - DNA, 25 bp, E. coli
gaggtcagtgaggcgcacctgtcac

SEQ ID NO: 180482 - DNA, 25 bp, E. coli
gaggtcagtgagccgcacctgtcac

SEQ ID NO: 180483 - DNA, 25 bp, E. coli
cagatgaggcacgagaaagaaggtc

SEQ ID NO: 180484 - DNA, 25 bp, E. coli
cagatgaggcaccagaaagaaggtc

SEQ ID NO: 180485 - DNA, 25 bp, E. coli
aggctcgacgccatctattacagga

SEQ ID NO: 180486 - DNA, 25 bp, E. coli
cttagggcgtcacctccaggattcc

SEQ ID NO: 180487 - DNA, 25 bp, E. coli
aggctcgacgccttctattacagga

SEQ ID NO: 180488 - DNA, 25 bp, E. coli
cttagggcgtcagctccaggattcc

SEQ ID NO: 180489 - DNA, 25 bp, E. coli
aaagagggctttgtcgtgcatcaag

SEQ ID NO: 180490 - DNA, 25 bp, E. coli
aaagagggctttctcgtgcatcaag

SEQ ID NO: 180491 - DNA, 25 bp, E. coli
tgaagaaggttcacagacagcctca

SEQ ID NO: 180492 - DNA, 25 bp, E. coli
tgaagaaggttctcagacagcctca

SEQ ID NO: 180493 - DNA, 25 bp, E. coli
gccaataacattgcgctctctggag

SEQ ID NO: 180494 - DNA, 25 bp, E. coli
gccaataacattccgctctctggag

SEQ ID NO: 180495 - DNA, 25 bp, E. coli
gctgaacgtgctcggatgtcgccaa

SEQ ID NO: 180496 - DNA, 25 bp, E. coli
gctgaacgtgctgggatgtcgccaa

SEQ ID NO: 180497 - DNA, 25 bp, E. coli
gaaacttgctcgattacgacgcagg

SEQ ID NO: 180498 - DNA, 25 bp, E. coli
gaaagaaggtcatctcaccacggat

SEQ ID NO: 180499 - DNA, 25 bp, E. coli
gaaagaaggtcaactcaccacggat

SEQ ID NO: 180500 - DNA, 25 bp, E. coli
gaaacttgctcgtttacgacgcagg

SEQ ID NO: 180501 - DNA, 25 bp, E. coli
cttgcagctgaagacgacttagggc

SEQ ID NO: 180502 - DNA, 25 bp, E. coli
cttgcagctgaacacgacttagggc

SEQ ID NO: 180503 - DNA, 25 bp, E. coli
gacgcaggcttaccgcaaagcaagt

SEQ ID NO: 180504 - DNA, 25 bp, E. coli
gacgcaggcttagcgcaaagcaagt

SEQ ID NO: 180505 - DNA, 25 bp, E. coli
tagaagacaattccggaggtatccc

SEQ ID NO: 180506 - DNA, 25 bp, E. coli
tagaagacaattgcggaggtatccc

SEQ ID NO: 180507 - DNA, 25 bp, E. coli
tgagaacacgactccaacagcagac

SEQ ID NO: 180508 - DNA, 25 bp, E. coli
tgagaacacgacaccaacagcagac

SEQ ID NO: 180509 - DNA, 25 bp, E. coli
tctttggacatgaagatgctagcgc

SEQ ID NO: 180510 - DNA, 25 bp, E. coli
tctgcttgataactgcgtcgatggg

SEQ ID NO: 180511 - DNA, 25 bp, E. coli
tctgcttgataagtgcgtcgatggg

SEQ ID NO: 180512 - DNA, 25 bp, E. coli
tctttggacatgtagatgctagcgc

SEQ ID NO: 180513 - DNA, 25 bp, E. coli
ccaatcagtggataggtgagcatct

SEQ ID NO: 180514 - DNA, 25 bp, E. coli
ccaatcagtggaaaggtgagcatct

SEQ ID NO: 180515 - DNA, 25 bp, E. coli
gaaaataccgatgcacgagagtgac

SEQ ID NO: 180516 - DNA, 25 bp, E. coli
gaaaatgaaggcaccgttggcgtct

SEQ ID NO: 180517 - DNA, 25 bp, E. coli
gaaaatgaaggctccgttggcgtct

SEQ ID NO: 180518 - DNA, 25 bp, E. coli
gaaaataccgatccacgagagtgac

SEQ ID NO: 180519 - DNA, 25 bp, E. coli
cccgatggcgcattcactgtagata

SEQ ID NO: 180520 - DNA, 25 bp, E. coli
cccgatggcgcaatcactgtagata

SEQ ID NO: 180521 - DNA, 25 bp, E. coli
gataagacacatgtcacaggttggg

SEQ ID NO: 180522 - DNA, 25 bp, E. coli
gataagacacatctcacaggttggg

SEQ ID NO: 180523 - DNA, 25 bp, E. coli
tgggacgaccccatcaaaaagaaga

SEQ ID NO: 180524 - DNA, 25 bp, E. coli
tgggacgaccccttcaaaaagaaga

SEQ ID NO: 180525 - DNA, 25 bp, E. coli
gaggtatccctaaaagcttccgaga

SEQ ID NO: 180526 - DNA, 25 bp, E. coli
gaggtatccctataagcttccgaga

SEQ ID NO: 180527 - DNA, 25 bp, E. coli
caaagcatattgttatcgcaggcgt

SEQ ID NO: 180528 - DNA, 25 bp, E. coli
caaagcatattgatatcgcaggcgt

SEQ ID NO: 180529 - DNA, 25 bp, E. coli
cattagccaataaacgcattcagcg

SEQ ID NO: 180530 - DNA, 25 bp, E. coli
aaagttgtgctgcaaatgcgcgatc

SEQ ID NO: 180531 - DNA, 25 bp, E. coli
aaagttgtgctggaaatgcgcgatc

SEQ ID NO: 180532 - DNA, 25 bp, E. coli
tatcgcaggcgtattacgtacagca

SEQ ID NO: 180533 - DNA, 25 bp, E. coli
taccgagaaatgtgcagagttgtcg

SEQ ID NO: 180534 - DNA, 25 bp, E. coli
taccgagaaatgagcagagttgtcg

SEQ ID NO: 180535 - DNA, 25 bp, E. coli
tatcgcaggcgttttacgtacagca

SEQ ID NO: 180536 - DNA, 25 bp, E. coli
gcgtattacgtacagcattagccaa

SEQ ID NO: 180537 - DNA, 25 bp, E. coli
gcgtattacgtagagcattagccaa

SEQ ID NO: 180538 - DNA, 25 bp, E. coli
gcagagttgtcggtaaagttgtgct

SEQ ID NO: 180539 - DNA, 25 bp, E. coli
gcagagttgtcgctaaagttgtgct

SEQ ID NO: 180540 - DNA, 25 bp, E. coli
cgcattcagcgctgtgagctggaaa

SEQ ID NO: 180541 - DNA, 25 bp, E. coli
cgcattcagcgcagtgagctggaaa

SEQ ID NO: 180542 - DNA, 25 bp, E. coli
cattagccaatatacgcattcagcg

SEQ ID NO: 180543 - DNA, 25 bp, E. coli
cggacaaaagagcatgaactgtacc

SEQ ID NO: 180544 - DNA, 25 bp, E. coli
cggacaaaagaggatgaactgtacc

SEQ ID NO: 180545 - DNA, 25 bp, E. coli
ggatgaactgtaccgagaaatgtgc

SEQ ID NO: 180546 - DNA, 25 bp, E. coli
gggcaggaaccaaagcatattgtta

SEQ ID NO: 180547 - DNA, 25 bp, E. coli
gggcaggaaccatagcatattgtta

SEQ ID NO: 180548 - DNA, 25 bp, E. coli
ggatgaactgtagcgagaaatgtgc

SEQ ID NO: 180549 - DNA, 25 bp, E. coli
aatgtaccggcccattgtcggatgc

SEQ ID NO: 180550 - DNA, 25 bp, E. coli
aatgtaccggccgattgtcggatgc

SEQ ID NO: 180551 - DNA, 25 bp, E. coli
catttcctgtcataatttgcgcccc

SEQ ID NO: 180552 - DNA, 25 bp, E. coli
catttcctgtcaaaatttgcgcccc

SEQ ID NO: 180553 - DNA, 25 bp, E. coli
ttggcgcagcctggtagcgcacttc

SEQ ID NO: 180554 - DNA, 25 bp, E. coli
ttggcgcagcctcgtagcgcacttc

SEQ ID NO: 180555 - DNA, 25 bp, E. coli
tattcgatctactcaccacacattt

SEQ ID NO: 180556 - DNA, 25 bp, E. coli
tattcgatctacacaccacacattt

SEQ ID NO: 180557 - DNA, 25 bp, E. coli
ttttgtgcgatacttatggctggcg

SEQ ID NO: 180558 - DNA, 25 bp, E. coli
ttttgtgcgatagttatggctggcg

SEQ ID NO: 180559 - DNA, 25 bp, E. coli
tgtagctcatgaggaagagaacccc

SEQ ID NO: 180560 - DNA, 25 bp, E. coli
tggtagcgcactacgttcgggacga

SEQ ID NO: 180561 - DNA, 25 bp, E. coli
tgtagctcatgacgaagagaacccc

SEQ ID NO: 180562 - DNA, 25 bp, E. coli
gcatcaggcaaaagtaccggcccat

SEQ ID NO: 180563 - DNA, 25 bp, E. coli
gcatcaggcaaatgtaccggcccat

SEQ ID NO: 180564 - DNA, 25 bp, E. coli
cattcggtgattcgcgcagcctggt

SEQ ID NO: 180565 - DNA, 25 bp, E. coli
cattcggtgattggcgcagcctggt

SEQ ID NO: 180566 - DNA, 25 bp, E. coli
gatgcgccccgctttcggtgattgg

SEQ ID NO: 180567 - DNA, 25 bp, E. coli
ggtcggaggttccaatcctctatca

SEQ ID NO: 180568 - DNA, 25 bp, E. coli
ggtcggaggttcgaatcctctatca

SEQ ID NO: 180569 - DNA, 25 bp, E. coli
tggtagcgcacttcgttcgggacga

SEQ ID NO: 180570 - DNA, 25 bp, E. coli
gatgcgccccgcattcggtgattgg

SEQ ID NO: 180571 - DNA, 25 bp, E. coli
tatcaggaaaaaatgccggagcgct

SEQ ID NO: 180572 - DNA, 25 bp, E. coli
tatcaggaaaaattgccggagcgct

SEQ ID NO: 180573 - DNA, 25 bp, E. coli
tattgatttttcgacggccagcccg

SEQ ID NO: 180574 - DNA, 25 bp, E. coli
tattgatttttccacggccagcccg

SEQ ID NO: 180575 - DNA, 25 bp, E. coli
tggtggtcagtaacatcaggcaacg

SEQ ID NO: 180576 - DNA, 25 bp, E. coli
tgaaaatctgaacgcgaatctggcc

SEQ ID NO: 180577 - DNA, 25 bp, E. coli
tgaaaatctgaaggcgaatctggcc

SEQ ID NO: 180578 - DNA, 25 bp, E. coli
tctggagatcattttcgccgccggt

SEQ ID NO: 180579 - DNA, 25 bp, E. coli
tctctggcactgctagctgtcacaa

SEQ ID NO: 180580 - DNA, 25 bp, E. coli
tctctggcactggtagctgtcacaa

SEQ ID NO: 180581 - DNA, 25 bp, E. coli
tctggagatcatattcgccgccggt

SEQ ID NO: 180582 - DNA, 25 bp, E. coli
ccggtgcgcagtacatcaggaatct

SEQ ID NO: 180583 - DNA, 25 bp, E. coli
ccggtgcgcagttcatcaggaatct

SEQ ID NO: 180584 - DNA, 25 bp, E. coli
tgctgtccaggctggaaaaaccttc

SEQ ID NO: 180585 - DNA, 25 bp, E. coli
tgctgtccaggcaggaaaaaccttc

SEQ ID NO: 180586 - DNA, 25 bp, E. coli
gaatgattgcctccgctgtatcagg

SEQ ID NO: 180587 - DNA, 25 bp, E. coli
gaatgattgcctgcgctgtatcagg

SEQ ID NO: 180588 - DNA, 25 bp, E. coli
tggtggtcagtatcatcaggcaacg

SEQ ID NO: 180589 - DNA, 25 bp, E. coli
tcaacgaaaagctgagagagagcct

SEQ ID NO: 180590 - DNA, 25 bp, E. coli
tcaacgaaaagcagagagagagcct

SEQ ID NO: 180591 - DNA, 25 bp, E. coli
gagagagcctgtcatttacccctga

SEQ ID NO: 180592 - DNA, 25 bp, E. coli
gagagagcctgtgatttacccctga

SEQ ID NO: 180593 - DNA, 25 bp, E. coli
cacagcataaaagaaaaagtatcac

SEQ ID NO: 180594 - DNA, 25 bp, E. coli
cacagcataaaacaaaaagtatcac

SEQ ID NO: 180595 - DNA, 25 bp, E. coli
agtatcacagataaaaaaggagcgt

SEQ ID NO: 180596 - DNA, 25 bp, E. coli
agtatcacagattaaaaaggagcgt

SEQ ID NO: 180597 - DNA, 25 bp, E. coli
aaaataatgccctcacacagcataa

SEQ ID NO: 180598 - DNA, 25 bp, E. coli
aaaataatgcccacacacagcataa

SEQ ID NO: 180599 - DNA, 25 bp, E. coli
tatcacagataaaaaaggagcgtaa

SEQ ID NO: 180600 - DNA, 25 bp, E. coli
tataaaaataatgcccacacacagc

SEQ ID NO: 180601 - DNA, 25 bp, E. coli
tatcacagataataaaggagcgtaa

SEQ ID NO: 180602 - DNA, 25 bp, E. coli
tataaaaataatccccacacacagc

SEQ ID NO: 180603 - DNA, 25 bp, E. coli
gcgggtttattttatctgtaaatat

SEQ ID NO: 180604 - DNA, 25 bp, E. coli
gcttcggcgggtatattttatctgt

SEQ ID NO: 180605 - DNA, 25 bp, E. coli
gcataaaacaaatagtatcacagat

SEQ ID NO: 180606 - DNA, 25 bp, E. coli
gcgggtttatttaatctgtaaatat

SEQ ID NO: 180607 - DNA, 25 bp, E. coli
gcttcggcgggtttattttatctgt

SEQ ID NO: 180608 - DNA, 25 bp, E. coli
gcataaaacaaaaagtatcacagat

SEQ ID NO: 180609 - DNA, 25 bp, E. coli
cccacacacagcataaaacaaaaag

SEQ ID NO: 180610 - DNA, 25 bp, E. coli
cccacacacagcttaaaacaaaaag

SEQ ID NO: 180611 - DNA, 25 bp, E. coli
cgcttcggcgggattattttatctg

SEQ ID NO: 180612 - DNA, 25 bp, E. coli
cgcttcggcgggtttattttatctg

SEQ ID NO: 180613 - DNA, 25 bp, E. coli
taatgcccacacacagcataaaaca

SEQ ID NO: 180614 - DNA, 25 bp, E. coli
taatgcccacactcagcataaaaca

SEQ ID NO: 180615 - DNA, 25 bp, E. coli
cactgataatgcgtccgttcgtaaa

SEQ ID NO: 180616 - DNA, 25 bp, E. coli
cactgataatgcctccgttcgtaaa

SEQ ID NO: 180617 - DNA, 25 bp, E. coli
catatgtgaataaattaaccagtgg

SEQ ID NO: 180618 - DNA, 25 bp, E. coli
catatgtgaatatattaaccagtgg

SEQ ID NO: 180619 - DNA, 25 bp, E. coli
tacatgttgtagcaaccccgtactg

SEQ ID NO: 180620 - DNA, 25 bp, E. coli
tacatgttgtaggaaccccgtactg

SEQ ID NO: 180621 - DNA, 25 bp, E. coli
tttcactttgcccatgccgttaaag

SEQ ID NO: 180622 - DNA, 25 bp, E. coli
tttcactttgccgatgccgttaaag

SEQ ID NO: 180623 - DNA, 25 bp, E. coli
tccgttcgtaaattcaaaatggcgt

SEQ ID NO: 180624 - DNA, 25 bp, E. coli
tccgttcgtaaaatcaaaatggcgt

SEQ ID NO: 180625 - DNA, 25 bp, E. coli
tctgatacacaagaaataacactct

SEQ ID NO: 180626 - DNA, 25 bp, E. coli
tctgatacacaacaaataacactct

SEQ ID NO: 180627 - DNA, 25 bp, E. coli
gcccatgccgttaaagtcactgata

SEQ ID NO: 180628 - DNA, 25 bp, E. coli
gcccatgccgtttaagtcactgata

SEQ ID NO: 180629 - DNA, 25 bp, E. coli
gaatgaatgcttattgtctgataca

SEQ ID NO: 180630 - DNA, 25 bp, E. coli
gcaaccccgtacagattatgaagaa

SEQ ID NO: 180631 - DNA, 25 bp, E. coli
gaatgaatgctttttgtctgataca

SEQ ID NO: 180632 - DNA, 25 bp, E. coli
gcaaccccgtactgattatgaagaa

SEQ ID NO: 180633 - DNA, 25 bp, E. coli
gattatgaagaaaaatcagtacggg

SEQ ID NO: 180634 - DNA, 25 bp, E. coli
gattatgaagaataatcagtacggg

SEQ ID NO: 180635 - DNA, 25 bp, E. coli
taaccagtggaatacctgtgttttg

SEQ ID NO: 180636 - DNA, 25 bp, E. coli
taaccagtggaaaacctgtgttttg

SEQ ID NO: 180637 - DNA, 25 bp, E. coli
catggcggcaaaacgattattctcg

SEQ ID NO: 180638 - DNA, 25 bp, E. coli
catggcggcaaatcgattattctcg

SEQ ID NO: 180639 - DNA, 25 bp, E. coli
cagttttatgagtaacatggcggca

SEQ ID NO: 180640 - DNA, 25 bp, E. coli
cagttttatgagaaacatggcggca

SEQ ID NO: 180641 - DNA, 25 bp, E. coli
tgaaaccggtctggtggtaacgccg

SEQ ID NO: 180642 - DNA, 25 bp, E. coli
tgaaaccggtctcgtggtaacgccg

SEQ ID NO: 180643 - DNA, 25 bp, E. coli
tgacgcggtcaattacactatcggg

SEQ ID NO: 180644 - DNA, 25 bp, E. coli
tgacgcggtcaaatacactatcggg

SEQ ID NO: 180645 - DNA, 25 bp, E. coli
gaatgggccacaagtcgtaccgtca

SEQ ID NO: 180646 - DNA, 25 bp, E. coli
gaatgggccacatgtcgtaccgtca

SEQ ID NO: 180647 - DNA, 25 bp, E. coli
cgattttatcctgcacattgacgtg

SEQ ID NO: 180648 - DNA, 25 bp, E. coli
cgcccgttttgtgccgatcgtcaga

SEQ ID NO: 180649 - DNA, 25 bp, E. coli
cgattttatcctccacattgacgtg

SEQ ID NO: 180650 - DNA, 25 bp, E. coli
cgcccgttttgtcccgatcgtcaga

SEQ ID NO: 180651 - DNA, 25 bp, E. coli
cgtttgttgcggcaatgggccacat

SEQ ID NO: 180652 - DNA, 25 bp, E. coli
cattgacgtgcaactggcagagctg

SEQ ID NO: 180653 - DNA, 25 bp, E. coli
cgtttgttgcgggaatgggccacat

SEQ ID NO: 180654 - DNA, 25 bp, E. coli
cattgacgtgcatctggcagagctg

SEQ ID NO: 180655 - DNA, 25 bp, E. coli
gatctcaacgtcgatatgatggtgg

SEQ ID NO: 180656 - DNA, 25 bp, E. coli
gattcattgctgtttgttgccggag

SEQ ID NO: 180657 - DNA, 25 bp, E. coli
gatctcaacgtccatatgatggtgg

SEQ ID NO: 180658 - DNA, 25 bp, E. coli
gattcattgctgattgttgccggag

SEQ ID NO: 180659 - DNA, 25 bp, E. coli
aagaggcaatagatctgttgctgaa

SEQ ID NO: 180660 - DNA, 25 bp, E. coli
aatgattcagaggaacaagaggcaa

SEQ ID NO: 180661 - DNA, 25 bp, E. coli
aagcgatggcgcatgaggcattcga

SEQ ID NO: 180662 - DNA, 25 bp, E. coli
aagcgatggcgcttgaggcattcga

SEQ ID NO: 180663 - DNA, 25 bp, E. coli
aagaggcaatagttctgttgctgaa

SEQ ID NO: 180664 - DNA, 25 bp, E. coli
aatgattcagagcaacaagaggcaa

SEQ ID NO: 180665 - DNA, 25 bp, E. coli
caacaagaggcaatagatctgttgc

SEQ ID NO: 180666 - DNA, 25 bp, E. coli
caacaagaggcattagatctgttgc

SEQ ID NO: 180667 - DNA, 25 bp, E. coli
agagcaacaagacgcaatagatctg

SEQ ID NO: 180668 - DNA, 25 bp, E. coli
agagcaacaagaggcaatagatctg

SEQ ID NO: 180669 - DNA, 25 bp, E. coli
ttgaggcattcgtaactggcgatgg

SEQ ID NO: 180670 - DNA, 25 bp, E. coli
ttgaggcattcgaaactggcgatgg

SEQ ID NO: 180671 - DNA, 25 bp, E. coli
tcagagcaacaagaggcaatagatc

SEQ ID NO: 180672 - DNA, 25 bp, E. coli
tcagagcaacaacaggcaatagatc

SEQ ID NO: 180673 - DNA, 25 bp, E. coli
gcttgaggcattggaaactggcgat

SEQ ID NO: 180674 - DNA, 25 bp, E. coli
gcttgaggcattcgaaactggcgat

SEQ ID NO: 180675 - DNA, 25 bp, E. coli
gattcagagcaacaagaggcaatag

SEQ ID NO: 180676 - DNA, 25 bp, E. coli
gattcagagcaagaagaggcaatag

SEQ ID NO: 180677 - DNA, 25 bp, E. coli
ggcgcttgaggctttcgaaactggc

SEQ ID NO: 180678 - DNA, 25 bp, E. coli
ggcgcttgaggcattcgaaactggc

SEQ ID NO: 180679 - DNA, 25 bp, E. coli
gatggcgcttgacgcattcgaaact

SEQ ID NO: 180680 - DNA, 25 bp, E. coli
gatggcgcttgaggcattcgaaact

SEQ ID NO: 180681 - DNA, 25 bp, E. coli
aagtggcgcttgtccaacagcaacg

SEQ ID NO: 180682 - DNA, 25 bp, E. coli
aagtggcgcttgaccaacagcaacg

SEQ ID NO: 180683 - DNA, 25 bp, E. coli
cagcaacggcctattgagtacagca

SEQ ID NO: 180684 - DNA, 25 bp, E. coli
cagcaacggccttttgagtacagca

SEQ ID NO: 180685 - DNA, 25 bp, E. coli
taacaagcgtgtcgtgaaatgtccc

SEQ ID NO: 180686 - DNA, 25 bp, E. coli
taacaagcgtgtggtgaaatgtccc

SEQ ID NO: 180687 - DNA, 25 bp, E. coli
tattgcgcgggataaagcccgatac

SEQ ID NO: 180688 - DNA, 25 bp, E. coli
tattgcgcgggaaaaagcccgatac

SEQ ID NO: 180689 - DNA, 25 bp, E. coli
tgattgcccaacagaacgagcgtat

SEQ ID NO: 180690 - DNA, 25 bp, E. coli
tgattgcccaactgaacgagcgtat

SEQ ID NO: 180691 - DNA, 25 bp, E. coli
tgctggtgatcaagcaagtggcgct

SEQ ID NO: 180692 - DNA, 25 bp, E. coli
tgctggtgatcatgcaagtggcgct

SEQ ID NO: 180693 - DNA, 25 bp, E. coli
tgcccggtgagcgtgatttaagtca

SEQ ID NO: 180694 - DNA, 25 bp, E. coli
tgcccggtgagcctgatttaagtca

SEQ ID NO: 180695 - DNA, 25 bp, E. coli
tcagttagatagcaaaataccggtg

SEQ ID NO: 180696 - DNA, 25 bp, E. coli
gaaatgtcccgaagaagtcgcgcag

SEQ ID NO: 180697 - DNA, 25 bp, E. coli
gaaatgtcccgatgaagtcgcgcag

SEQ ID NO: 180698 - DNA, 25 bp, E. coli
cgagcgtatttttgcggcggataac

SEQ ID NO: 180699 - DNA, 25 bp, E. coli
cgagcgtattttagcggcggataac

SEQ ID NO: 180700 - DNA, 25 bp, E. coli
tggaacaagcgcatacccagctgat

SEQ ID NO: 180701 - DNA, 25 bp, E. coli
tggaacaagcgcttacccagctgat

SEQ ID NO: 180702 - DNA, 25 bp, E. coli
tcagttagataggaaaataccggtg

SEQ ID NO: 180703 - DNA, 25 bp, E. coli
cagtacagagggaccagaggttcgt

SEQ ID NO: 180704 - DNA, 25 bp, E. coli
cagtacagagggtccagaggttcgt

SEQ ID NO: 180705 - DNA, 25 bp, E. coli
tacagagacaacagtgtccggcatc

SEQ ID NO: 180706 - DNA, 25 bp, E. coli
tacagagacaactgtgtccggcatc

SEQ ID NO: 180707 - DNA, 25 bp, E. coli
aaaggtcaaccaggcgtctacagag

SEQ ID NO: 180708 - DNA, 25 bp, E. coli
aaaggtcaaccacgcgtctacagag

SEQ ID NO: 180709 - DNA, 25 bp, E. coli
tttgagggaaacccgggcactgcca

SEQ ID NO: 180710 - DNA, 25 bp, E. coli
tttgagggaaacgcgggcactgcca

SEQ ID NO: 180711 - DNA, 25 bp, E. coli
tccctccgccagttacgacgtttga

SEQ ID NO: 180712 - DNA, 25 bp, E. coli
tccctccgccagatacgacgtttga

SEQ ID NO: 180713 - DNA, 25 bp, E. coli
gcgtctacagagtcaacagtgtccg

SEQ ID NO: 180714 - DNA, 25 bp, E. coli
gcgtctacagagacaacagtgtccg

SEQ ID NO: 180715 - DNA, 25 bp, E. coli
gcattcagtacagagggtccagagg

SEQ ID NO: 180716 - DNA, 25 bp, E. coli
gcattcagtacacagggtccagagg

SEQ ID NO: 180717 - DNA, 25 bp, E. coli
cgccagatacgaggtttgagggaaa

SEQ ID NO: 180718 - DNA, 25 bp, E. coli
cgccagatacgacgtttgagggaaa

SEQ ID NO: 180719 - DNA, 25 bp, E. coli
gtcacaaaggtcaaccacgcgtcta

SEQ ID NO: 180720 - DNA, 25 bp, E. coli
gtcacaaaggtctaccacgcgtcta

SEQ ID NO: 180721 - DNA, 25 bp, E. coli
tcaaccacgcgtctacagagacaac

SEQ ID NO: 180722 - DNA, 25 bp, E. coli
tcaaccacgcgtgtacagagacaac

SEQ ID NO: 180723 - DNA, 25 bp, E. coli
gagacaacagtgtccggcatccctc

SEQ ID NO: 180724 - DNA, 25 bp, E. coli
gagacaacagtgaccggcatccctc

SEQ ID NO: 180725 - DNA, 25 bp, E. coli
cagtaaaaggcgcagtaaccaccat

SEQ ID NO: 180726 - DNA, 25 bp, E. coli
cagtaaaaggcggagtaaccaccat

SEQ ID NO: 180727 - DNA, 25 bp, E. coli
taacaccagggcatatgatcccgac

SEQ ID NO: 180728 - DNA, 25 bp, E. coli
taacaccagggcttatgatcccgac

SEQ ID NO: 180729 - DNA, 25 bp, E. coli
tagtcattcgctgtggtctggaaag

SEQ ID NO: 180730 - DNA, 25 bp, E. coli
tagtcattcgctctggtctggaaag

SEQ ID NO: 180731 - DNA, 25 bp, E. coli
ttgcagcagcggaaaaagcgaaact

SEQ ID NO: 180732 - DNA, 25 bp, E. coli
ttgcagcagcggtaaaagcgaaact

SEQ ID NO: 180733 - DNA, 25 bp, E. coli
tgagagtaaaaagcaacgcccgtgg

SEQ ID NO: 180734 - DNA, 25 bp, E. coli
tgagagtaaaaaccaacgcccgtgg

SEQ ID NO: 180735 - DNA, 25 bp, E. coli
gcaaagtcggcactaacgggcaaag

SEQ ID NO: 180736 - DNA, 25 bp, E. coli
gcaaagtcggcagtaacgggcaaag

SEQ ID NO: 180737 - DNA, 25 bp, E. coli
gaagcgtattgcagataacaccagg

SEQ ID NO: 180738 - DNA, 25 bp, E. coli
gaagcgtattgctgataacaccagg

SEQ ID NO: 180739 - DNA, 25 bp, E. coli
gaaactgaagctaatcgcggagaaa

SEQ ID NO: 180740 - DNA, 25 bp, E. coli
gaaactgaagcttatcgcggagaaa

SEQ ID NO: 180741 - DNA, 25 bp, E. coli
gatcaattatctccgcaaagacggt

SEQ ID NO: 180742 - DNA, 25 bp, E. coli
gatcaattatctgcgcaaagacggt

SEQ ID NO: 180743 - DNA, 25 bp, E. coli
tggaaagcgccgttgaaatcgtcct

SEQ ID NO: 180744 - DNA, 25 bp, E. coli
tggaaagcgccgatgaaatcgtcct

SEQ ID NO: 180745 - DNA, 25 bp, E. coli
taatcaacagactgggagtgcgcaa

SEQ ID NO: 180746 - DNA, 25 bp, E. coli
taatcaacagacagggagtgcgcaa

SEQ ID NO: 180747 - DNA, 25 bp, E. coli
cagacagcaaaccggtaatggcagc

SEQ ID NO: 180748 - DNA, 25 bp, E. coli
cagacagcaaacgggtaatggcagc

SEQ ID NO: 180749 - DNA, 25 bp, E. coli
aactaccatgttcccgaaagcacac

SEQ ID NO: 180750 - DNA, 25 bp, E. coli
aactaccatgttgccgaaagcacac

SEQ ID NO: 180751 - DNA, 25 bp, E. coli
aaactaccatgttgccgaaagcaca

SEQ ID NO: 180752 - DNA, 25 bp, E. coli
aaactaccatgtagccgaaagcaca

SEQ ID NO: 180753 - DNA, 25 bp, E. coli
tgcatagtctgcagggccgaatcat

SEQ ID NO: 180754 - DNA, 25 bp, E. coli
tgcatagtctgctgggccgaatcat

SEQ ID NO: 180755 - DNA, 25 bp, E. coli
ccatttctacggatcggacagtgac

SEQ ID NO: 180756 - DNA, 25 bp, E. coli
cctggcggagtatagctcccatttc

SEQ ID NO: 180757 - DNA, 25 bp, E. coli
cctggcggagtaaagctcccatttc

SEQ ID NO: 180758 - DNA, 25 bp, E. coli
ccatttctacggttcggacagtgac

SEQ ID NO: 180759 - DNA, 25 bp, E. coli
gctatgttggcgtccgaccgcgcac

SEQ ID NO: 180760 - DNA, 25 bp, E. coli
gctatgttggcgaccgaccgcgcac

SEQ ID NO: 180761 - DNA, 25 bp, E. coli
cccatttctacgcttcggacagtga

SEQ ID NO: 180762 - DNA, 25 bp, E. coli
cccatttctacggttcggacagtga

SEQ ID NO: 180763 - DNA, 25 bp, E. coli
cgctgcatagtctgctgggccgaat

SEQ ID NO: 180764 - DNA, 25 bp, E. coli
cgctgcatagtcagctgggccgaat

SEQ ID NO: 180765 - DNA, 25 bp, E. coli
cggagtatagctgccatttctacgg

SEQ ID NO: 180766 - DNA, 25 bp, E. coli
cggagtatagctcccatttctacgg

SEQ ID NO: 180767 - DNA, 25 bp, E. coli
gtctgctgggcccaatcatgaaaaa

SEQ ID NO: 180768 - DNA, 25 bp, E. coli
gtctgctgggccgaatcatgaaaaa

SEQ ID NO: 180769 - DNA, 25 bp, E. coli
aatatccccataggtattgcgggcc

SEQ ID NO: 180770 - DNA, 25 bp, E. coli
aatatccccatacgtattgcgggcc

SEQ ID NO: 180771 - DNA, 25 bp, E. coli
taacagtgttctcgcggtcacgcag

SEQ ID NO: 180772 - DNA, 25 bp, E. coli
taggcaatattggaacccgtctggg

SEQ ID NO: 180773 - DNA, 25 bp, E. coli
taggcaatattgcaacccgtctggg

SEQ ID NO: 180774 - DNA, 25 bp, E. coli
tattgctggctgtatgatggcaccg

SEQ ID NO: 180775 - DNA, 25 bp, E. coli
tattgctggctgaatgatggcaccg

SEQ ID NO: 180776 - DNA, 25 bp, E. coli
tcatcagttataggctgacggtggc

SEQ ID NO: 180777 - DNA, 25 bp, E. coli
tcatcagttatacgctgacggtggc

SEQ ID NO: 180778 - DNA, 25 bp, E. coli
gccagctggattcccttgacggtaa

SEQ ID NO: 180779 - DNA, 25 bp, E. coli
cctgggcaacctcgcactggatatt

SEQ ID NO: 180780 - DNA, 25 bp, E. coli
gccagctggattgccttgacggtaa

SEQ ID NO: 180781 - DNA, 25 bp, E. coli
cctgggcaacctggcactggatatt

SEQ ID NO: 180782 - DNA, 25 bp, E. coli
gaattttgtcgccatgccgggtctg

SEQ ID NO: 180783 - DNA, 25 bp, E. coli
gaattttgtcgcgatgccgggtctg

SEQ ID NO: 180784 - DNA, 25 bp, E. coli
gggaaaagattgacgccagctggat

SEQ ID NO: 180785 - DNA, 25 bp, E. coli
gggaaaagattgtcgccagctggat

SEQ ID NO: 180786 - DNA, 25 bp, E. coli
taacagtgttctggcggtcacgcag

SEQ ID NO: 180787 - DNA, 25 bp, E. coli
gatgcctgttgctcggctggcctta

SEQ ID NO: 180788 - DNA, 25 bp, E. coli
gacggtaattgtgaccagcatcggg

SEQ ID NO: 180789 - DNA, 25 bp, E. coli
gatgcctgttgcacggctggcctta

SEQ ID NO: 180790 - DNA, 25 bp, E. coli
gacggtaattgtcaccagcatcggg

SEQ ID NO: 180791 - DNA, 25 bp, E. coli
cattatcgagcgtttactgaaagag

SEQ ID NO: 180792 - DNA, 25 bp, E. coli
acgccggactggaacattatcgagc

SEQ ID NO: 180793 - DNA, 25 bp, E. coli
actggaacattatcgagcgtttact

SEQ ID NO: 180794 - DNA, 25 bp, E. coli
actggaacattaacgagcgtttact

SEQ ID NO: 180795 - DNA, 25 bp, E. coli
acgccggactggtacattatcgagc

SEQ ID NO: 180796 - DNA, 25 bp, E. coli
ccggactggaactttatcgagcgtt

SEQ ID NO: 180797 - DNA, 25 bp, E. coli
gccggactggaagattatcgagcgt

SEQ ID NO: 180798 - DNA, 25 bp, E. coli
ccggactggaacattatcgagcgtt

SEQ ID NO: 180799 - DNA, 25 bp, E. coli
gccggactggaacattatcgagcgt

SEQ ID NO: 180800 - DNA, 25 bp, E. coli
gaacattatcgaccgtttactgaaa

SEQ ID NO: 180801 - DNA, 25 bp, E. coli
gactggaacattatcgagcgtttac

SEQ ID NO: 180802 - DNA, 25 bp, E. coli
gaacattatcgagcgtttactgaaa

SEQ ID NO: 180803 - DNA, 25 bp, E. coli
gactggaacattttcgagcgtttac

SEQ ID NO: 180804 - DNA, 25 bp, E. coli
ctggaacattatggagcgtttactg

SEQ ID NO: 180805 - DNA, 25 bp, E. coli
cattatcgagcgattactgaaagag

SEQ ID NO: 180806 - DNA, 25 bp, E. coli
cggactggaacattatcgagcgttt

SEQ ID NO: 180807 - DNA, 25 bp, E. coli
ctggaacattatcgagcgtttactg

SEQ ID NO: 180808 - DNA, 25 bp, E. coli
cggactggaacaatatcgagcgttt

SEQ ID NO: 180809 - DNA, 25 bp, E. coli
ggactggaacattatcgagcgttta

SEQ ID NO: 180810 - DNA, 25 bp, E. coli
ggactggaacataatcgagcgttta

SEQ ID NO: 180811 - DNA, 25 bp, E. coli
ggaacattatcgtgcgtttactgaa

SEQ ID NO: 180812 - DNA, 25 bp, E. coli
ggaacattatcgagcgtttactgaa

SEQ ID NO: 180813 - DNA, 25 bp, E. coli
aatatatcctgaggccggtgctgtg

SEQ ID NO: 180814 - DNA, 25 bp, E. coli
caattttaaaacgtgcgctggcgaa

SEQ ID NO: 180815 - DNA, 25 bp, E. coli
aatatatcctgacgccggtgctgtg

SEQ ID NO: 180816 - DNA, 25 bp, E. coli
caattttaaaacctgcgctggcgaa

SEQ ID NO: 180817 - DNA, 25 bp, E. coli
caaaaatcaaactggcggtggcgtt

SEQ ID NO: 180818 - DNA, 25 bp, E. coli
caaaaatcaaacaggcggtggcgtt

SEQ ID NO: 180819 - DNA, 25 bp, E. coli
tatgcgaaaaaacatcaggcgcgcg

SEQ ID NO: 180820 - DNA, 25 bp, E. coli
tatgcgaaaaaagatcaggcgcgcg

SEQ ID NO: 180821 - DNA, 25 bp, E. coli
tatcgaaaaagaactcgctcgggcg

SEQ ID NO: 180822 - DNA, 25 bp, E. coli
tatcgaaaaagatctcgctcgggcg

SEQ ID NO: 180823 - DNA, 25 bp, E. coli
tgagaatcactgcagcgcggcaatt

SEQ ID NO: 180824 - DNA, 25 bp, E. coli
tgagaatcactggagcgcggcaatt

SEQ ID NO: 180825 - DNA, 25 bp, E. coli
tgaatcagcaacatcgtccacgtcg

SEQ ID NO: 180826 - DNA, 25 bp, E. coli
tgaatcagcaacttcgtccacgtcg

SEQ ID NO: 180827 - DNA, 25 bp, E. coli
tgcgtcagcaagtggcacaacatgg

SEQ ID NO: 180828 - DNA, 25 bp, E. coli
tgcgtcagcaagaggcacaacatgg

SEQ ID NO: 180829 - DNA, 25 bp, E. coli
gattcatacagcaccgggaatgccg

SEQ ID NO: 180830 - DNA, 25 bp, E. coli
gattcatacagctccgggaatgccg

SEQ ID NO: 180831 - DNA, 25 bp, E. coli
gagaaagactttgacgatccgctga

SEQ ID NO: 180832 - DNA, 25 bp, E. coli
gacgctggacgatctgggctatgac

SEQ ID NO: 180833 - DNA, 25 bp, E. coli
gacgctggacgaactgggctatgac

SEQ ID NO: 180834 - DNA, 25 bp, E. coli
gagaaagactttcacgatccgctga

SEQ ID NO: 180835 - DNA, 25 bp, E. coli
tatttcaacgttaatggaccgcgtg

SEQ ID NO: 180836 - DNA, 25 bp, E. coli
tatttcaacgtttatggaccgcgtg

SEQ ID NO: 180837 - DNA, 25 bp, E. coli
tcgaagcgattttccacgaaggcgc

SEQ ID NO: 180838 - DNA, 25 bp, E. coli
tcgaagcgatttaccacgaaggcgc

SEQ ID NO: 180839 - DNA, 25 bp, E. coli
ccataaaggcaggatggcgagcgtc

SEQ ID NO: 180840 - DNA, 25 bp, E. coli
ccaccgagtgggtcggcaagtatat

SEQ ID NO: 180841 - DNA, 25 bp, E. coli
ccataaaggcagcatggcgagcgtc

SEQ ID NO: 180842 - DNA, 25 bp, E. coli
ccaccgagtgggacggcaagtatat

SEQ ID NO: 180843 - DNA, 25 bp, E. coli
gcttatcacaagaaaggccagatcg

SEQ ID NO: 180844 - DNA, 25 bp, E. coli
gcttatcacaagtaaggccagatcg

SEQ ID NO: 180845 - DNA, 25 bp, E. coli
gacggcaccaagattgtgaacctgg

SEQ ID NO: 180846 - DNA, 25 bp, E. coli
gacggcaccaagtttgtgaacctgg

SEQ ID NO: 180847 - DNA, 25 bp, E. coli
gataaaggcatctccgatattctgg

SEQ ID NO: 180848 - DNA, 25 bp, E. coli
gataaaggcatcaccgatattctgg

SEQ ID NO: 180849 - DNA, 25 bp, E. coli
ggaccgcgtgaaggccataaaggca

SEQ ID NO: 180850 - DNA, 25 bp, E. coli
ggacgcacctccgactttattgaat

SEQ ID NO: 180851 - DNA, 25 bp, E. coli
tggtggacaaccagaaagacggcac

SEQ ID NO: 180852 - DNA, 25 bp, E. coli
ggacgcacctcccactttattgaat

SEQ ID NO: 180853 - DNA, 25 bp, E. coli
ggaccgcgtgaacgccataaaggca

SEQ ID NO: 180854 - DNA, 25 bp, E. coli
tggtggacaacctgaaagacggcac

SEQ ID NO: 180855 - DNA, 25 bp, E. coli
taacggaatacaaggcctggctgaa

SEQ ID NO: 180856 - DNA, 25 bp, E. coli
taacggaatacatggcctggctgaa

SEQ ID NO: 180857 - DNA, 25 bp, E. coli
cacgatcatcatagtatcggtcggt

SEQ ID NO: 180858 - DNA, 25 bp, E. coli
cacgatcatcattgtatcggtcggt

SEQ ID NO: 180859 - DNA, 25 bp, E. coli
cagtctttaccaggatcatcattgt

SEQ ID NO: 180860 - DNA, 25 bp, E. coli
cagtctttaccacgatcatcattgt

SEQ ID NO: 180861 - DNA, 25 bp, E. coli
tacgataatccagtctttaccacga

SEQ ID NO: 180862 - DNA, 25 bp, E. coli
tacgataatccactctttaccacga

SEQ ID NO: 180863 - DNA, 25 bp, E. coli
tttaccacgatcatcattgtatcgg

SEQ ID NO: 180864 - DNA, 25 bp, E. coli
tttaccacgatcttcattgtatcgg

SEQ ID NO: 180865 - DNA, 25 bp, E. coli
tcatttttctggatttatgacctaa

SEQ ID NO: 180866 - DNA, 25 bp, E. coli
tgtatcggtcggtcatttttctgga

SEQ ID NO: 180867 - DNA, 25 bp, E. coli
tcatttttctggttttatgacctaa

SEQ ID NO: 180868 - DNA, 25 bp, E. coli
tgtatcggtcggacatttttctgga

SEQ ID NO: 180869 - DNA, 25 bp, E. coli
ctatgctgttttgatatctacgata

SEQ ID NO: 180870 - DNA, 25 bp, E. coli
cggtcggtcattattctggatttat

SEQ ID NO: 180871 - DNA, 25 bp, E. coli
cggtcggtcatttttctggatttat

SEQ ID NO: 180872 - DNA, 25 bp, E. coli
ctatgctgttttcatatctacgata

SEQ ID NO: 180873 - DNA, 25 bp, E. coli
gatatctacgataatccagtcttta

SEQ ID NO: 180874 - DNA, 25 bp, E. coli
gataatccagtctttaccacgatca

SEQ ID NO: 180875 - DNA, 25 bp, E. coli
gataatccagtcattaccacgatca

SEQ ID NO: 180876 - DNA, 25 bp, E. coli
gatatctacgattatccagtcttta

SEQ ID NO: 180877 - DNA, 25 bp, E. coli
gatcatcattgtttcggtcggtcat

SEQ ID NO: 180878 - DNA, 25 bp, E. coli
gatcatcattgtatcggtcggtcat

SEQ ID NO: 180879 - DNA, 25 bp, E. coli
caataaacaggttgtcggcgtgccg

SEQ ID NO: 180880 - DNA, 25 bp, E. coli
caataaacaggtagtcggcgtgccg

SEQ ID NO: 180881 - DNA, 25 bp, E. coli
catgggatttgggaacgcgttacac

SEQ ID NO: 180882 - DNA, 25 bp, E. coli
catgggatttggcaacgcgttacac

SEQ ID NO: 180883 - DNA, 25 bp, E. coli
tactctcccagtacgcaaatgcagg

SEQ ID NO: 180884 - DNA, 25 bp, E. coli
tactctcccagttcgcaaatgcagg

SEQ ID NO: 180885 - DNA, 25 bp, E. coli
tacgctcggcgatacggtgacattt

SEQ ID NO: 180886 - DNA, 25 bp, E. coli
aaaaatctggcgctcagcactgcgg

SEQ ID NO: 180887 - DNA, 25 bp, E. coli
aaaaatctggcggtcagcactgcgg

SEQ ID NO: 180888 - DNA, 25 bp, E. coli
tacgctcggcgaaacggtgacattt

SEQ ID NO: 180889 - DNA, 25 bp, E. coli
tttccggtggaaatgcttgagcgca

SEQ ID NO: 180890 - DNA, 25 bp, E. coli
tttccggtggaattgcttgagcgca

SEQ ID NO: 180891 - DNA, 25 bp, E. coli
tgaaaatcagcacgcgcaaagcgtc

SEQ ID NO: 180892 - DNA, 25 bp, E. coli
tgcttaacagtttgaccggcgcgct

SEQ ID NO: 180893 - DNA, 25 bp, E. coli
tgcttaacagttagaccggcgcgct

SEQ ID NO: 180894 - DNA, 25 bp, E. coli
tgaaaatcagcaggcgcaaagcgtc

SEQ ID NO: 180895 - DNA, 25 bp, E. coli
gaacgatatagaagtcggcccgctg

SEQ ID NO: 180896 - DNA, 25 bp, E. coli
gaaactgaaagaaacggcgaatgcc

SEQ ID NO: 180897 - DNA, 25 bp, E. coli
gaacgatatagatgtcggcccgctg

SEQ ID NO: 180898 - DNA, 25 bp, E. coli
gaaactgaaagatacggcgaatgcc

SEQ ID NO: 180899 - DNA, 25 bp, E. coli
gtttaatttcgtcgcgaagcgccca

SEQ ID NO: 180900 - DNA, 25 bp, E. coli
gtttaatttcgtggcgaagcgccca

SEQ ID NO: 180901 - DNA, 25 bp, E. coli
caagttagccgccaacaggtgttag

SEQ ID NO: 180902 - DNA, 25 bp, E. coli
caagttagccgcgaacaggtgttag

SEQ ID NO: 180903 - DNA, 25 bp, E. coli
taaaagtgatgtcggtcgatgcgac

SEQ ID NO: 180904 - DNA, 25 bp, E. coli
taaaagtgatgtgggtcgatgcgac

SEQ ID NO: 180905 - DNA, 25 bp, E. coli
aaacgtgtttttctgcaattcggca

SEQ ID NO: 180906 - DNA, 25 bp, E. coli
aaacgtgtttttgtgcaattcggca

SEQ ID NO: 180907 - DNA, 25 bp, E. coli
tgtcgcgctgaatcccgatctggtg

SEQ ID NO: 180908 - DNA, 25 bp, E. coli
tgtcgcgctgaaacccgatctggtg

SEQ ID NO: 180909 - DNA, 25 bp, E. coli
gcaaaagattgagcaggtttccacc

SEQ ID NO: 180910 - DNA, 25 bp, E. coli
gcaaaagattgaccaggtttccacc

SEQ ID NO: 180911 - DNA, 25 bp, E. coli
gactggtttgaacgtgcaagcccac

SEQ ID NO: 180912 - DNA, 25 bp, E. coli
gattgtcattacaggcggaccggac

SEQ ID NO: 180913 - DNA, 25 bp, E. coli
gattgtcattactggcggaccggac

SEQ ID NO: 180914 - DNA, 25 bp, E. coli
gggtgaacagctgaaaattcccgtt

SEQ ID NO: 180915 - DNA, 25 bp, E. coli
gggtgaacagctcaaaattcccgtt

SEQ ID NO: 180916 - DNA, 25 bp, E. coli
taagtcactgttcagggcgctggtc

SEQ ID NO: 180917 - DNA, 25 bp, E. coli
taagtcactgttgagggcgctggtc

SEQ ID NO: 180918 - DNA, 25 bp, E. coli
gatgaatctggatcgcattgtcgcg

SEQ ID NO: 180919 - DNA, 25 bp, E. coli
tctttaaagacagccgggttccctg

SEQ ID NO: 180920 - DNA, 25 bp, E. coli
gactggtttgaaggtgcaagcccac

SEQ ID NO: 180921 - DNA, 25 bp, E. coli
gatgaatctggaacgcattgtcgcg

SEQ ID NO: 180922 - DNA, 25 bp, E. coli
tctttaaagacacccgggttccctg

SEQ ID NO: 180923 - DNA, 25 bp, E. coli
ttccgacggcggtgatatcacaacg

SEQ ID NO: 180924 - DNA, 25 bp, E. coli
ttttccctgattatccagccgcaaa

SEQ ID NO: 180925 - DNA, 25 bp, E. coli
ttccgacggcggagatatcacaacg

SEQ ID NO: 180926 - DNA, 25 bp, E. coli
ttttccctgattttccagccgcaaa

SEQ ID NO: 180927 - DNA, 25 bp, E. coli
tggtgcatcaattccgacggcggag

SEQ ID NO: 180928 - DNA, 25 bp, E. coli
tgtacgaatcaaagaatccatcgcc

SEQ ID NO: 180929 - DNA, 25 bp, E. coli
tggtgcatcaataccgacggcggag

SEQ ID NO: 180930 - DNA, 25 bp, E. coli
tgtacgaatcaatgaatccatcgcc

SEQ ID NO: 180931 - DNA, 25 bp, E. coli
gcgcagcatcaacgtaaattcggaa

SEQ ID NO: 180932 - DNA, 25 bp, E. coli
gcgcagcatcaaggtaaattcggaa

SEQ ID NO: 180933 - DNA, 25 bp, E. coli
cggagatatcacaacgcgcagcatc

SEQ ID NO: 180934 - DNA, 25 bp, E. coli
cggagatatcactacgcgcagcatc

SEQ ID NO: 180935 - DNA, 25 bp, E. coli
gattaccgtctggatatcagtgaga

SEQ ID NO: 180936 - DNA, 25 bp, E. coli
gattaccgtctgcatatcagtgaga

SEQ ID NO: 180937 - DNA, 25 bp, E. coli
ggccttaaacatatgcactccatgc

SEQ ID NO: 180938 - DNA, 25 bp, E. coli
ggccttaaacatttgcactccatgc

SEQ ID NO: 180939 - DNA, 25 bp, E. coli
tcaagatgtggtcgatgaatgccct

SEQ ID NO: 180940 - DNA, 25 bp, E. coli
tcaagatgtggtggatgaatgccct

SEQ ID NO: 180941 - DNA, 25 bp, E. coli
gagataccatctatcactgtacgaa

SEQ ID NO: 180942 - DNA, 25 bp, E. coli
gatgaatgccctacacatctgtttg

SEQ ID NO: 180943 - DNA, 25 bp, E. coli
gatgaatgcccttcacatctgtttg

SEQ ID NO: 180944 - DNA, 25 bp, E. coli
gagataccatctttcactgtacgaa

SEQ ID NO: 180945 - DNA, 25 bp, E. coli
catttatgatgttaaccttgaggcg

SEQ ID NO: 180946 - DNA, 25 bp, E. coli
taaagaattacgatggtgaacctct

SEQ ID NO: 180947 - DNA, 25 bp, E. coli
taaagaattacgttggtgaacctct

SEQ ID NO: 180948 - DNA, 25 bp, E. coli
tgtgggacagtctaatatctggaac

SEQ ID NO: 180949 - DNA, 25 bp, E. coli
tgtgggacagtcaaatatctggaac

SEQ ID NO: 180950 - DNA, 25 bp, E. coli
tcatgaggcggataaaggagagtta

SEQ ID NO: 180951 - DNA, 25 bp, E. coli
tcggtataaaccagaggagagcatc

SEQ ID NO: 180952 - DNA, 25 bp, E. coli
tcatgaggcggaaaaaggagagtta

SEQ ID NO: 180953 - DNA, 25 bp, E. coli
tctggaacgaaaagatcatgaggcg

SEQ ID NO: 180954 - DNA, 25 bp, E. coli
tcggtataaacctgaggagagcatc

SEQ ID NO: 180955 - DNA, 25 bp, E. coli
tctggaacgaaatgatcatgaggcg

SEQ ID NO: 180956 - DNA, 25 bp, E. coli
ccttgaggcggttccgatagaaagt

SEQ ID NO: 180957 - DNA, 25 bp, E. coli
ccttgaggcggtaccgatagaaagt

SEQ ID NO: 180958 - DNA, 25 bp, E. coli
cgcaatgatattgccgaagcattcg

SEQ ID NO: 180959 - DNA, 25 bp, E. coli
cgcaatgatattcccgaagcattcg

SEQ ID NO: 180960 - DNA, 25 bp, E. coli
catttatgatgtaaaccttgaggcg

SEQ ID NO: 180961 - DNA, 25 bp, E. coli
gatagaaagtccaggaacaaccgga

SEQ ID NO: 180962 - DNA, 25 bp, E. coli
ggcgactatgtaattcctgactcag

SEQ ID NO: 180963 - DNA, 25 bp, E. coli
ggcgactatgtatttcctgactcag

SEQ ID NO: 180964 - DNA, 25 bp, E. coli
taatttgcattataagcgccttgag

SEQ ID NO: 180965 - DNA, 25 bp, E. coli
taatttgcattaaaagcgccttgag

SEQ ID NO: 180966 - DNA, 25 bp, E. coli
gatagaaagtcctggaacaaccgga

SEQ ID NO: 180967 - DNA, 25 bp, E. coli
aagcaatggtgcgacttatccacca

SEQ ID NO: 180968 - DNA, 25 bp, E. coli
aagcaatggtgccacttatccacca

SEQ ID NO: 180969 - DNA, 25 bp, E. coli
agagcgatatctggcttaacagcgc

SEQ ID NO: 180970 - DNA, 25 bp, E. coli
agagcgatatctcgcttaacagcgc

SEQ ID NO: 180971 - DNA, 25 bp, E. coli
tacgctgccgctcgatttttcgctg

SEQ ID NO: 180972 - DNA, 25 bp, E. coli
tacgctgccgctggatttttcgctg

SEQ ID NO: 180973 - DNA, 25 bp, E. coli
tgccacttatcctccactggctgat

SEQ ID NO: 180974 - DNA, 25 bp, E. coli
tgccacttatccaccactggctgat

SEQ ID NO: 180975 - DNA, 25 bp, E. coli
tttacgctgccgctggatttttcgc

SEQ ID NO: 180976 - DNA, 25 bp, E. coli
tttacgctgccggtggatttttcgc

SEQ ID NO: 180977 - DNA, 25 bp, E. coli
gctgccgctggatttttcgctgttc

SEQ ID NO: 180978 - DNA, 25 bp, E. coli
gctgccgctggaattttcgctgttc

SEQ ID NO: 180979 - DNA, 25 bp, E. coli
cgctggatttttcgctgttcgcgca

SEQ ID NO: 180980 - DNA, 25 bp, E. coli
cgctggatttttggctgttcgcgca

SEQ ID NO: 180981 - DNA, 25 bp, E. coli
gatcgagagcgaaatctggcttaac

SEQ ID NO: 180982 - DNA, 25 bp, E. coli
ggtgccacttatgcaccactggctg

SEQ ID NO: 180983 - DNA, 25 bp, E. coli
ggtgccacttatccaccactggctg

SEQ ID NO: 180984 - DNA, 25 bp, E. coli
tggcatgaaggagagatcgagagcg

SEQ ID NO: 180985 - DNA, 25 bp, E. coli
tggaaatcaaagtgatcagctacga

SEQ ID NO: 180986 - DNA, 25 bp, E. coli
tggcatgaaggacagatcgagagcg

SEQ ID NO: 180987 - DNA, 25 bp, E. coli
tggaaatcaaagagatcagctacga

SEQ ID NO: 180988 - DNA, 25 bp, E. coli
gatcgagagcgatatctggcttaac

SEQ ID NO: 180989 - DNA, 25 bp, E. coli
aagctgggctcgtcggtacgtgaac

SEQ ID NO: 180990 - DNA, 25 bp, E. coli
aagctgggctcgacggtacgtgaac

SEQ ID NO: 180991 - DNA, 25 bp, E. coli
caaacaagctccctggtatgcctga

SEQ ID NO: 180992 - DNA, 25 bp, E. coli
caaacaagctccgtggtatgcctga

SEQ ID NO: 180993 - DNA, 25 bp, E. coli
taaaggaatggccaaagctgggctc

SEQ ID NO: 180994 - DNA, 25 bp, E. coli
taaaggaatggcgaaagctgggctc

SEQ ID NO: 180995 - DNA, 25 bp, E. coli
taccaggttatagacgagaaagttg

SEQ ID NO: 180996 - DNA, 25 bp, E. coli
taccaggttatacacgagaaagttg

SEQ ID NO: 180997 - DNA, 25 bp, E. coli
tttctggattttcacgagcgggcac

SEQ ID NO: 180998 - DNA, 25 bp, E. coli
tatagcgaggcggtcaaacgcattc

SEQ ID NO: 180999 - DNA, 25 bp, E. coli
tttctggattttgacgagcgggcac

SEQ ID NO: 181000 - DNA, 25 bp, E. coli
tatagcgaggcgctcaaacgcattc

SEQ ID NO: 181001 - DNA, 25 bp, E. coli
tgattgttacaagattaagctccgg

SEQ ID NO: 181002 - DNA, 25 bp, E. coli
tgattgttacaacattaagctccgg

SEQ ID NO: 181003 - DNA, 25 bp, E. coli
tctgttgggaaaagagaacgctcgg

SEQ ID NO: 181004 - DNA, 25 bp, E. coli
tctgttgggaaatgagaacgctcgg

SEQ ID NO: 181005 - DNA, 25 bp, E. coli
gttgaagtacttcagtcaccccgga

SEQ ID NO: 181006 - DNA, 25 bp, E. coli
gttgaagtacttgagtcaccccgga

SEQ ID NO: 181007 - DNA, 25 bp, E. coli
tcaccccggattcaagcaaacaagc

SEQ ID NO: 181008 - DNA, 25 bp, E. coli
taagctccggtcttcaggctatcgc

SEQ ID NO: 181009 - DNA, 25 bp, E. coli
taagctccggtcatcaggctatcgc

SEQ ID NO: 181010 - DNA, 25 bp, E. coli
tcaccccggattgaagcaaacaagc

SEQ ID NO: 181011 - DNA, 25 bp, E. coli
taaagtcgtggcatgaaacgctggc

SEQ ID NO: 181012 - DNA, 25 bp, E. coli
taaagtcgtggcttgaaacgctggc

SEQ ID NO: 181013 - DNA, 25 bp, E. coli
tatctcctgtttattgcgctgccag

SEQ ID NO: 181014 - DNA, 25 bp, E. coli
tatctcctgttttttgcgctgccag

SEQ ID NO: 181015 - DNA, 25 bp, E. coli
tgcactggcacaccactatttctgg

SEQ ID NO: 181016 - DNA, 25 bp, E. coli
tgcactggcacagcactatttctgg

SEQ ID NO: 181017 - DNA, 25 bp, E. coli
gcttcagaggccaatttcgaacggg

SEQ ID NO: 181018 - DNA, 25 bp, E. coli
gcttcagaggcctatttcgaacggg

SEQ ID NO: 181019 - DNA, 25 bp, E. coli
cgctggcgaatcagggatattttgt

SEQ ID NO: 181020 - DNA, 25 bp, E. coli
cgctggcgaatctgggatattttgt

SEQ ID NO: 181021 - DNA, 25 bp, E. coli
cgctgccagtgattggtttggtgat

SEQ ID NO: 181022 - DNA, 25 bp, E. coli
cgatgatgacgggactggcgcattt

SEQ ID NO: 181023 - DNA, 25 bp, E. coli
cgatgatgacggcactggcgcattt

SEQ ID NO: 181024 - DNA, 25 bp, E. coli
cgctgccagtgaatggtttggtgat

SEQ ID NO: 181025 - DNA, 25 bp, E. coli
ctatttctggaaggacaacacactt

SEQ ID NO: 181026 - DNA, 25 bp, E. coli
ctatttctggaacgacaacacactt

SEQ ID NO: 181027 - DNA, 25 bp, E. coli
ggtttcttcccaggtagcgatcggc

SEQ ID NO: 181028 - DNA, 25 bp, E. coli
ggtttcttcccacgtagcgatcggc

SEQ ID NO: 181029 - DNA, 25 bp, E. coli
tggtttgacgatgccttacgcttca

SEQ ID NO: 181030 - DNA, 25 bp, E. coli
tggtttgacgatcccttacgcttca

SEQ ID NO: 181031 - DNA, 25 bp, E. coli
taagccaaaacccatgatgacggga

SEQ ID NO: 181032 - DNA, 25 bp, E. coli
taagccaaaaccgatgatgacggga

SEQ ID NO: 181033 - DNA, 25 bp, E. coli
aatgcagaatctgggtaaggccgac

SEQ ID NO: 181034 - DNA, 25 bp, E. coli
aatgcagaatctcggtaaggccgac

SEQ ID NO: 181035 - DNA, 25 bp, E. coli
catgatgatcccttcacaggcggca

SEQ ID NO: 181036 - DNA, 25 bp, E. coli
catgatgatcccatcacaggcggca

SEQ ID NO: 181037 - DNA, 25 bp, E. coli
taaagcctttggagttaatgcctca

SEQ ID NO: 181038 - DNA, 25 bp, E. coli
taaagcctttggtgttaatgcctca

SEQ ID NO: 181039 - DNA, 25 bp, E. coli
tatgttgagcatttggcgaaacgca

SEQ ID NO: 181040 - DNA, 25 bp, E. coli
tatgttgagcatatggcgaaacgca

SEQ ID NO: 181041 - DNA, 25 bp, E. coli
tatttctaaagtcgatggtatgccg

SEQ ID NO: 181042 - DNA, 25 bp, E. coli
tatttctaaagtggatggtatgccg

SEQ ID NO: 181043 - DNA, 25 bp, E. coli
tccaggcagcggaaaaagtcgtggt

SEQ ID NO: 181044 - DNA, 25 bp, E. coli
tccaggcagcggtaaaagtcgtggt

SEQ ID NO: 181045 - DNA, 25 bp, E. coli
ccaacgtgctggaaccggtattcaa

SEQ ID NO: 181046 - DNA, 25 bp, E. coli
ccaacgtgctggtaccggtattcaa

SEQ ID NO: 181047 - DNA, 25 bp, E. coli
gaaaacctatccagacttgaaagcg

SEQ ID NO: 181048 - DNA, 25 bp, E. coli
gaaaacctatcctgacttgaaagcg

SEQ ID NO: 181049 - DNA, 25 bp, E. coli
gatatgcatgaagttacccgccgca

SEQ ID NO: 181050 - DNA, 25 bp, E. coli
gatatgcatgaacttacccgccgca

SEQ ID NO: 181051 - DNA, 25 bp, E. coli
tcaaaaaagcgccagatgccggaat

SEQ ID NO: 181052 - DNA, 25 bp, E. coli
tcaaaaaagcgcgagatgccggaat

SEQ ID NO: 181053 - DNA, 25 bp, E. coli
gaccgtgccgcagcataacttatgg

SEQ ID NO: 181054 - DNA, 25 bp, E. coli
gaccgtgccgcaccataacttatgg

SEQ ID NO: 181055 - DNA, 25 bp, E. coli
taaacaaattagtattcaggttaat

SEQ ID NO: 181056 - DNA, 25 bp, E. coli
taaacaaattagaattcaggttaat

SEQ ID NO: 181057 - DNA, 25 bp, E. coli
atcttggtgatcgagcaataaaaaa

SEQ ID NO: 181058 - DNA, 25 bp, E. coli
atcttggtgatccagcaataaaaaa

SEQ ID NO: 181059 - DNA, 25 bp, E. coli
tagaatatatcttggtgatcgagca

SEQ ID NO: 181060 - DNA, 25 bp, E. coli
tagaatatatctaggtgatcgagca

SEQ ID NO: 181061 - DNA, 25 bp, E. coli
tatcttggtgatcgagcaataaaaa

SEQ ID NO: 181062 - DNA, 25 bp, E. coli
tatcttggtgatggagcaataaaaa

SEQ ID NO: 181063 - DNA, 25 bp, E. coli
tatatcttggtgttcgagcaataaa

SEQ ID NO: 181064 - DNA, 25 bp, E. coli
tatatcttggtgatcgagcaataaa

SEQ ID NO: 181065 - DNA, 25 bp, E. coli
tgaatttgatttatggagtaaacaa

SEQ ID NO: 181066 - DNA, 25 bp, E. coli
tgaatttgatttttggagtaaacaa

SEQ ID NO: 181067 - DNA, 25 bp, E. coli
gaatatatcttggtgatcgagcaat

SEQ ID NO: 181068 - DNA, 25 bp, E. coli
gaatatatcttgctgatcgagcaat

SEQ ID NO: 181069 - DNA, 25 bp, E. coli
gatagaatatatgttggtgatcgag

SEQ ID NO: 181070 - DNA, 25 bp, E. coli
gatagaatatatcttggtgatcgag

SEQ ID NO: 181071 - DNA, 25 bp, E. coli
ggtgatcgagcattaaaaaaattga

SEQ ID NO: 181072 - DNA, 25 bp, E. coli
ggtgatcgagcaataaaaaaattga

SEQ ID NO: 181073 - DNA, 25 bp, E. coli
tggagtaaacaatttagaattcagg

SEQ ID NO: 181074 - DNA, 25 bp, E. coli
tggagtaaacaaattagaattcagg

SEQ ID NO: 181075 - DNA, 25 bp, E. coli
gagtaaacaaataagaattcaggtt

SEQ ID NO: 181076 - DNA, 25 bp, E. coli
gagtaaacaaattagaattcaggtt

SEQ ID NO: 181077 - DNA, 25 bp, E. coli
aatcctgagctgtaagttaagccga

SEQ ID NO: 181078 - DNA, 25 bp, E. coli
aatcctgagctgaaagttaagccga

SEQ ID NO: 181079 - DNA, 25 bp, E. coli
tagtgagggcttaattcgttcgttg

SEQ ID NO: 181080 - DNA, 25 bp, E. coli
tagtgagggctttattcgttcgttg

SEQ ID NO: 181081 - DNA, 25 bp, E. coli
tgagctgtataataatcctgagctg

SEQ ID NO: 181082 - DNA, 25 bp, E. coli
tgagctgtataaaaatcctgagctg

SEQ ID NO: 181083 - DNA, 25 bp, E. coli
gcgtcctctgtaaaaaatattttcg

SEQ ID NO: 181084 - DNA, 25 bp, E. coli
gcgtcctctgtataaaatattttcg

SEQ ID NO: 181085 - DNA, 25 bp, E. coli
gctgccatgttcatatctgctgtat

SEQ ID NO: 181086 - DNA, 25 bp, E. coli
gctgccatgttcttatctgctgtat

SEQ ID NO: 181087 - DNA, 25 bp, E. coli
gaatctgctgccatgttcttatctg

SEQ ID NO: 181088 - DNA, 25 bp, E. coli
gaatctgctgccttgttcttatctg

SEQ ID NO: 181089 - DNA, 25 bp, E. coli
cgttcgttgaatgtgctgccatgtt

SEQ ID NO: 181090 - DNA, 25 bp, E. coli
ctgctgtattacatcaagcagaaag

SEQ ID NO: 181091 - DNA, 25 bp, E. coli
ctgctgtattacttcaagcagaaag

SEQ ID NO: 181092 - DNA, 25 bp, E. coli
cgttcgttgaatctgctgccatgtt

SEQ ID NO: 181093 - DNA, 25 bp, E. coli
gggcagttaaaaccgtcctctgtaa

SEQ ID NO: 181094 - DNA, 25 bp, E. coli
gggcagttaaaagcgtcctctgtaa

SEQ ID NO: 181095 - DNA, 25 bp, E. coli
tggcgtcagggcagttaaaagcgtc

SEQ ID NO: 181096 - DNA, 25 bp, E. coli
tggcgtcagggctgttaaaagcgtc

SEQ ID NO: 181097 - DNA, 25 bp, E. coli
taattcgttcgttgaatctgctgcc

SEQ ID NO: 181098 - DNA, 25 bp, E. coli
taattcgttcgtagaatctgctgcc

SEQ ID NO: 181099 - DNA, 25 bp, E. coli
cagcgtatttctgcgtgccgataat

SEQ ID NO: 181100 - DNA, 25 bp, E. coli
cagcgtatttctccgtgccgataat

SEQ ID NO: 181101 - DNA, 25 bp, E. coli
acagcgtatttcagcgtgccgataa

SEQ ID NO: 181102 - DNA, 25 bp, E. coli
acagcgtatttctgcgtgccgataa

SEQ ID NO: 181103 - DNA, 25 bp, E. coli
tttctgcgtgcccataattccctga

SEQ ID NO: 181104 - DNA, 25 bp, E. coli
tttctgcgtgccgataattccctga

SEQ ID NO: 181105 - DNA, 25 bp, E. coli
ttctgcgtgccgataattccctgat

SEQ ID NO: 181106 - DNA, 25 bp, E. coli
ttctgcgtgccgttaattccctgat

SEQ ID NO: 181107 - DNA, 25 bp, E. coli
tgcgtgccgatatttccctgatcga

SEQ ID NO: 181108 - DNA, 25 bp, E. coli
tgcgtgccgataattccctgatcga

SEQ ID NO: 181109 - DNA, 25 bp, E. coli
tctgcgtgccgataattccctgatc

SEQ ID NO: 181110 - DNA, 25 bp, E. coli
tctgcgtgccgaaaattccctgatc

SEQ ID NO: 181111 - DNA, 25 bp, E. coli
gccgataattccgtgatcgacatga

SEQ ID NO: 181112 - DNA, 25 bp, E. coli
gccgataattccctgatcgacatga

SEQ ID NO: 181113 - DNA, 25 bp, E. coli
gcgtatttctgcctgccgataattc

SEQ ID NO: 181114 - DNA, 25 bp, E. coli
gcgtatttctgcgtgccgataattc

SEQ ID NO: 181115 - DNA, 25 bp, E. coli
gacagcgtatttctgcgtgccgata

SEQ ID NO: 181116 - DNA, 25 bp, E. coli
gacagcgtatttgtgcgtgccgata

SEQ ID NO: 181117 - DNA, 25 bp, E. coli
gtatttctgcgtcccgataattccc

SEQ ID NO: 181118 - DNA, 25 bp, E. coli
gtatttctgcgtgccgataattccc

SEQ ID NO: 181119 - DNA, 25 bp, E. coli
gtgccgataattgcctgatcgacat

SEQ ID NO: 181120 - DNA, 25 bp, E. coli
gtgccgataattccctgatcgacat

SEQ ID NO: 181121 - DNA, 25 bp, E. coli
cacgactggtgctggaaggtcatcg

SEQ ID NO: 181122 - DNA, 25 bp, E. coli
cacgactggtgcaggaaggtcatcg

SEQ ID NO: 181123 - DNA, 25 bp, E. coli
cattttgtcgcacatctggagctga

SEQ ID NO: 181124 - DNA, 25 bp, E. coli
cattttgtcgcagatctggagctga

SEQ ID NO: 181125 - DNA, 25 bp, E. coli
actggtgaagccgatacgctgggca

SEQ ID NO: 181126 - DNA, 25 bp, E. coli
actggtgaagcccatacgctgggca

SEQ ID NO: 181127 - DNA, 25 bp, E. coli
tatcgcaattttgaatcgccacggg

SEQ ID NO: 181128 - DNA, 25 bp, E. coli
tatcacaccgtgattcggagcacga

SEQ ID NO: 181129 - DNA, 25 bp, E. coli
tatcgcaattttcaatcgccacggg

SEQ ID NO: 181130 - DNA, 25 bp, E. coli
tatcacaccgtgtttcggagcacga

SEQ ID NO: 181131 - DNA, 25 bp, E. coli
tgtgagctgaatcccaggtacgcgc

SEQ ID NO: 181132 - DNA, 25 bp, E. coli
tgtgtcacactgtaccgtaacgggc

SEQ ID NO: 181133 - DNA, 25 bp, E. coli
tgtgtcacactgaaccgtaacgggc

SEQ ID NO: 181134 - DNA, 25 bp, E. coli
tgtgagctgaatgccaggtacgcgc

SEQ ID NO: 181135 - DNA, 25 bp, E. coli
tctacaactggatgaagccttcccg

SEQ ID NO: 181136 - DNA, 25 bp, E. coli
tctacaactggaagaagccttcccg

SEQ ID NO: 181137 - DNA, 25 bp, E. coli
gcattttctggcagaccgggctgga

SEQ ID NO: 181138 - DNA, 25 bp, E. coli
gcattttctggctgaccgggctgga

SEQ ID NO: 181139 - DNA, 25 bp, E. coli
ggtttaacagactcctccgagtcat

SEQ ID NO: 181140 - DNA, 25 bp, E. coli
ggattcaccggcacattcagtgagg

SEQ ID NO: 181141 - DNA, 25 bp, E. coli
ggattcaccggctcattcagtgagg

SEQ ID NO: 181142 - DNA, 25 bp, E. coli
ggtttaacagacacctccgagtcat

SEQ ID NO: 181143 - DNA, 25 bp, E. coli
aattattcatgggtaccgacggcat

SEQ ID NO: 181144 - DNA, 25 bp, E. coli
aattattcatggctaccgacggcat

SEQ ID NO: 181145 - DNA, 25 bp, E. coli
caatgcgttatcagaactggataat

SEQ ID NO: 181146 - DNA, 25 bp, E. coli
caatgcgttatctgaactggataat

SEQ ID NO: 181147 - DNA, 25 bp, E. coli
caaattattcatgggtaccgacggc

SEQ ID NO: 181148 - DNA, 25 bp, E. coli
caaattattcatcggtaccgacggc

SEQ ID NO: 181149 - DNA, 25 bp, E. coli
tattcatgggtaccgacggcatcga

SEQ ID NO: 181150 - DNA, 25 bp, E. coli
tattcatgggtagcgacggcatcga

SEQ ID NO: 181151 - DNA, 25 bp, E. coli
ttattcatgggtaccgacggcatcg

SEQ ID NO: 181152 - DNA, 25 bp, E. coli
ttcgacaaattattcatgggtaccg

SEQ ID NO: 181153 - DNA, 25 bp, E. coli
ttattcatgggttccgacggcatcg

SEQ ID NO: 181154 - DNA, 25 bp, E. coli
ttcgacaaattaatcatgggtaccg

SEQ ID NO: 181155 - DNA, 25 bp, E. coli
tcaccttcgacaaattattcatggg

SEQ ID NO: 181156 - DNA, 25 bp, E. coli
ccttcgacaaataattcatgggtac

SEQ ID NO: 181157 - DNA, 25 bp, E. coli
ccttcgacaaattattcatgggtac

SEQ ID NO: 181158 - DNA, 25 bp, E. coli
gcatttcaccttcgacaaattattc

SEQ ID NO: 181159 - DNA, 25 bp, E. coli
gcatttcaccttggacaaattattc

SEQ ID NO: 181160 - DNA, 25 bp, E. coli
gacaaattattcatgggtaccgacg

SEQ ID NO: 181161 - DNA, 25 bp, E. coli
gacaaattattcttgggtaccgacg

SEQ ID NO: 181162 - DNA, 25 bp, E. coli
cgttatctgaacaggataatgaaca

SEQ ID NO: 181163 - DNA, 25 bp, E. coli
cgttatctgaactggataatgaaca

SEQ ID NO: 181164 - DNA, 25 bp, E. coli
tcaccttcgacatattattcatggg

SEQ ID NO: 181165 - DNA, 25 bp, E. coli
cacctgtgcccaagatggtcagtat

SEQ ID NO: 181166 - DNA, 25 bp, E. coli
cacgaaaacgaattcgcgcagtcca

SEQ ID NO: 181167 - DNA, 25 bp, E. coli
cacctgtgcccatgatggtcagtat

SEQ ID NO: 181168 - DNA, 25 bp, E. coli
cacgaaaacgaaatcgcgcagtcca

SEQ ID NO: 181169 - DNA, 25 bp, E. coli
actactggatgctctcggggatggt

SEQ ID NO: 181170 - DNA, 25 bp, E. coli
actactggatgcactcggggatggt

SEQ ID NO: 181171 - DNA, 25 bp, E. coli
tatgtgaactactggatgcactcgg

SEQ ID NO: 181172 - DNA, 25 bp, E. coli
tatgtgaactacaggatgcactcgg

SEQ ID NO: 181173 - DNA, 25 bp, E. coli
tgcccatgatggtcagtatgtgaac

SEQ ID NO: 181174 - DNA, 25 bp, E. coli
tgcccatgatggacagtatgtgaac

SEQ ID NO: 181175 - DNA, 25 bp, E. coli
ccatgatggtcactatgtgaactac

SEQ ID NO: 181176 - DNA, 25 bp, E. coli
ccatgatggtcagtatgtgaactac

SEQ ID NO: 181177 - DNA, 25 bp, E. coli
gcaccacgaaaaggaaatcgcgcag

SEQ ID NO: 181178 - DNA, 25 bp, E. coli
gcagtccacctgtgcccatgatggt

SEQ ID NO: 181179 - DNA, 25 bp, E. coli
gcaccacgaaaacgaaatcgcgcag

SEQ ID NO: 181180 - DNA, 25 bp, E. coli
gcagtccacctgagcccatgatggt

SEQ ID NO: 181181 - DNA, 25 bp, E. coli
cgacaaacgcaagccaatggacttc

SEQ ID NO: 181182 - DNA, 25 bp, E. coli
cgaaaacgaaatcgcgcagtccacc

SEQ ID NO: 181183 - DNA, 25 bp, E. coli
cgaaaacgaaatggcgcagtccacc

SEQ ID NO: 181184 - DNA, 25 bp, E. coli
cgacaaacgcaacccaatggacttc

SEQ ID NO: 181185 - DNA, 25 bp, E. coli
tggtcgacgacaaacgcaacccaat

SEQ ID NO: 181186 - DNA, 25 bp, E. coli
tggtcgacgacatacgcaacccaat

SEQ ID NO: 181187 - DNA, 25 bp, E. coli
cacataccgtttatcttcgcattct

SEQ ID NO: 181188 - DNA, 25 bp, E. coli
cacataccgtttttcttcgcattct

SEQ ID NO: 181189 - DNA, 25 bp, E. coli
cataccgtttttgttcgcattcttt

SEQ ID NO: 181190 - DNA, 25 bp, E. coli
cataccgtttttcttcgcattcttt

SEQ ID NO: 181191 - DNA, 25 bp, E. coli
atgaaacacatagcgtttttcttcg

SEQ ID NO: 181192 - DNA, 25 bp, E. coli
atgaaacacataccgtttttcttcg

SEQ ID NO: 181193 - DNA, 25 bp, E. coli
acataccgtttttcttcgcattctt

SEQ ID NO: 181194 - DNA, 25 bp, E. coli
acacataccgtttttcttcgcattc

SEQ ID NO: 181195 - DNA, 25 bp, E. coli
aacacataccgtttttcttcgcatt

SEQ ID NO: 181196 - DNA, 25 bp, E. coli
aaacacataccgattttcttcgcat

SEQ ID NO: 181197 - DNA, 25 bp, E. coli
aaacacataccgtttttcttcgcat

SEQ ID NO: 181198 - DNA, 25 bp, E. coli
acataccgttttacttcgcattctt

SEQ ID NO: 181199 - DNA, 25 bp, E. coli
aacacataccgtatttcttcgcatt

SEQ ID NO: 181200 - DNA, 25 bp, E. coli
acacataccgttattcttcgcattc

SEQ ID NO: 181201 - DNA, 25 bp, E. coli
tgaaacacataccgtttttcttcgc

SEQ ID NO: 181202 - DNA, 25 bp, E. coli
tgaaacacatacggtttttcttcgc

SEQ ID NO: 181203 - DNA, 25 bp, E. coli
gaaacacataccctttttcttcgca

SEQ ID NO: 181204 - DNA, 25 bp, E. coli
gaaacacataccgtttttcttcgca

SEQ ID NO: 181205 - DNA, 25 bp, E. coli
tcgcattcttttataccttcccctg

SEQ ID NO: 181206 - DNA, 25 bp, E. coli
tcgcattcttttttaccttcccctg

SEQ ID NO: 181207 - DNA, 25 bp, E. coli
caaaaggttggctgacctatgccgt

SEQ ID NO: 181208 - DNA, 25 bp, E. coli
caaaaggttggcagacctatgccgt

SEQ ID NO: 181209 - DNA, 25 bp, E. coli
taaaaatccgccctgactggcacta

SEQ ID NO: 181210 - DNA, 25 bp, E. coli
taaaaatccgccgtgactggcacta

SEQ ID NO: 181211 - DNA, 25 bp, E. coli
tattcattcttattggcgtggtggg

SEQ ID NO: 181212 - DNA, 25 bp, E. coli
tattcattcttaatggcgtggtggg

SEQ ID NO: 181213 - DNA, 25 bp, E. coli
tgaatctgcctgaaaaaatccgccg

SEQ ID NO: 181214 - DNA, 25 bp, E. coli
tgacgtgggtgattagtttctggct

SEQ ID NO: 181215 - DNA, 25 bp, E. coli
tgaatctgcctgtaaaaatccgccg

SEQ ID NO: 181216 - DNA, 25 bp, E. coli
tgacgtgggtgaatagtttctggct

SEQ ID NO: 181217 - DNA, 25 bp, E. coli
cctatgccgtcgctctggtgacgtg

SEQ ID NO: 181218 - DNA, 25 bp, E. coli
cctatgccgtcggtctggtgacgtg

SEQ ID NO: 181219 - DNA, 25 bp, E. coli
gcaaggatgttgtttttcgttaacg

SEQ ID NO: 181220 - DNA, 25 bp, E. coli
gcaaggatgttgattttcgttaacg

SEQ ID NO: 181221 - DNA, 25 bp, E. coli
gactggcactacaatgcgttcgcca

SEQ ID NO: 181222 - DNA, 25 bp, E. coli
gactggcactactatgcgttcgcca

SEQ ID NO: 181223 - DNA, 25 bp, E. coli
cgatgaagaaactgaaaacgcccaa

SEQ ID NO: 181224 - DNA, 25 bp, E. coli
cgatgaagaaacagaaaacgcccaa

SEQ ID NO: 181225 - DNA, 25 bp, E. coli
gattattcgtcgtcgcgatgaagaa

SEQ ID NO: 181226 - DNA, 25 bp, E. coli
gattattcgtcgacgcgatgaagaa

SEQ ID NO: 181227 - DNA, 25 bp, E. coli
gggttactgggaattgaagcaaaag

SEQ ID NO: 181228 - DNA, 25 bp, E. coli
gggttactgggatttgaagcaaaag

SEQ ID NO: 181229 - DNA, 25 bp, E. coli
agtatctggagctccgcctggccag

SEQ ID NO: 181230 - DNA, 25 bp, E. coli
atttatcttcatgcgcagtatctgg

SEQ ID NO: 181231 - DNA, 25 bp, E. coli
atttatcttcatccgcagtatctgg

SEQ ID NO: 181232 - DNA, 25 bp, E. coli
agtatctggagcaccgcctggccag

SEQ ID NO: 181233 - DNA, 25 bp, E. coli
tatcttcatgcgcagtatctggagc

SEQ ID NO: 181234 - DNA, 25 bp, E. coli
tatcttcatgcggagtatctggagc

SEQ ID NO: 181235 - DNA, 25 bp, E. coli
tgcgcagtatctcgagcaccgcctg

SEQ ID NO: 181236 - DNA, 25 bp, E. coli
tgcgcagtatctggagcaccgcctg

SEQ ID NO: 181237 - DNA, 25 bp, E. coli
tcttcatgcgcagtatctggagcac

SEQ ID NO: 181238 - DNA, 25 bp, E. coli
tcttcatgcgcactatctggagcac

SEQ ID NO: 181239 - DNA, 25 bp, E. coli
tcatgcgcagtaactggagcaccgc

SEQ ID NO: 181240 - DNA, 25 bp, E. coli
tcatgcgcagtatctggagcaccgc

SEQ ID NO: 181241 - DNA, 25 bp, E. coli
gcctggccagtattttcatatttta

SEQ ID NO: 181242 - DNA, 25 bp, E. coli
gcctggccagtaatttcatatttta

SEQ ID NO: 181243 - DNA, 25 bp, E. coli
gcaccgcctggccagtaatttcata

SEQ ID NO: 181244 - DNA, 25 bp, E. coli
gcaccgcctggcgagtaatttcata

SEQ ID NO: 181245 - DNA, 25 bp, E. coli
gaaaaatttatcttcatgcgcagta

SEQ ID NO: 181246 - DNA, 25 bp, E. coli
gaaaaatttatcatcatgcgcagta

SEQ ID NO: 181247 - DNA, 25 bp, E. coli
ccgcctggccagaaatttcatattt

SEQ ID NO: 181248 - DNA, 25 bp, E. coli
ccgcctggccagtaatttcatattt

SEQ ID NO: 181249 - DNA, 25 bp, E. coli
tggagcaccgccaggccagtaattt

SEQ ID NO: 181250 - DNA, 25 bp, E. coli
tggagcaccgcctggccagtaattt

SEQ ID NO: 181251 - DNA, 25 bp, E. coli
caacgtctggaacaaagcggcagcg

SEQ ID NO: 181252 - DNA, 25 bp, E. coli
caacgtctggaagaaagcggcagcg

SEQ ID NO: 181253 - DNA, 25 bp, E. coli
atgagttattcacgctgccagcagg

SEQ ID NO: 181254 - DNA, 25 bp, E. coli
atgagttattcaggctgccagcagg

SEQ ID NO: 181255 - DNA, 25 bp, E. coli
aaaagatcgtgattgtgcccgccag

SEQ ID NO: 181256 - DNA, 25 bp, E. coli
aaaagatcgtgaatgtgcccgccag

SEQ ID NO: 181257 - DNA, 25 bp, E. coli
tagttgctgaaaaccgtgggctgac

SEQ ID NO: 181258 - DNA, 25 bp, E. coli
tagttgctgaaatccgtgggctgac

SEQ ID NO: 181259 - DNA, 25 bp, E. coli
ttacctaagccataccagagcgatg

SEQ ID NO: 181260 - DNA, 25 bp, E. coli
ttacctaagccaaaccagagcgatg

SEQ ID NO: 181261 - DNA, 25 bp, E. coli
tgtatcccgcctcgacagaagctgg

SEQ ID NO: 181262 - DNA, 25 bp, E. coli
tgtatcccgcctggacagaagctgg

SEQ ID NO: 181263 - DNA, 25 bp, E. coli
tgactatggctgaactggaagaccg

SEQ ID NO: 181264 - DNA, 25 bp, E. coli
tgactatggctgtactggaagaccg

SEQ ID NO: 181265 - DNA, 25 bp, E. coli
tcttatgaagatccgcgaaactggc

SEQ ID NO: 181266 - DNA, 25 bp, E. coli
tcttatgaagatgcgcgaaactggc

SEQ ID NO: 181267 - DNA, 25 bp, E. coli
gattttaggcaatgacgacaccgcg

SEQ ID NO: 181268 - DNA, 25 bp, E. coli
gattttaggcaaagacgacaccgcg

SEQ ID NO: 181269 - DNA, 25 bp, E. coli
tggctatggaaaacgaatcacccgg

SEQ ID NO: 181270 - DNA, 25 bp, E. coli
tggctatggaaatcgaatcacccgg

SEQ ID NO: 181271 - DNA, 25 bp, E. coli
taagcaaggccagtcaaaagcatcc

SEQ ID NO: 181272 - DNA, 25 bp, E. coli
taagcaaggccactcaaaagcatcc

SEQ ID NO: 181273 - DNA, 25 bp, E. coli
caacaacagcgtttgacctcctgta

SEQ ID NO: 181274 - DNA, 25 bp, E. coli
caacaacagcgtatgacctcctgta

SEQ ID NO: 181275 - DNA, 25 bp, E. coli
cattactggttagcttgcttttcgg

SEQ ID NO: 181276 - DNA, 25 bp, E. coli
cattactggttaccttgcttttcgg

SEQ ID NO: 181277 - DNA, 25 bp, E. coli
ttttaaccaccgacggcgctgccga

SEQ ID NO: 181278 - DNA, 25 bp, E. coli
ttttaaccaccgtcggcgctgccga

SEQ ID NO: 181279 - DNA, 25 bp, E. coli
tgaagaacagcatgtctgcgcctgg

SEQ ID NO: 181280 - DNA, 25 bp, E. coli
tgaagagggatgctgctatgaaaat

SEQ ID NO: 181281 - DNA, 25 bp, E. coli
tgaagaacagcaagtctgcgcctgg

SEQ ID NO: 181282 - DNA, 25 bp, E. coli
tgaagagggatggtgctatgaaaat

SEQ ID NO: 181283 - DNA, 25 bp, E. coli
cctacatgagtgtttgcctgaagaa

SEQ ID NO: 181284 - DNA, 25 bp, E. coli
gccacagcagcaaaagatgcgcgaa

SEQ ID NO: 181285 - DNA, 25 bp, E. coli
cctacatgagtgattgcctgaagaa

SEQ ID NO: 181286 - DNA, 25 bp, E. coli
gccacagcagcataagatgcgcgaa

SEQ ID NO: 181287 - DNA, 25 bp, E. coli
gaaaaaagtttgacgccacagcagc

SEQ ID NO: 181288 - DNA, 25 bp, E. coli
gaaaaaagtttgtcgccacagcagc

SEQ ID NO: 181289 - DNA, 25 bp, E. coli
ctgaaaggtgatcatcgtaataagt

SEQ ID NO: 181290 - DNA, 25 bp, E. coli
ctgaaaggtgatgatcgtaataagt

SEQ ID NO: 181291 - DNA, 25 bp, E. coli
gggatgctcgtatgacctacatgag

SEQ ID NO: 181292 - DNA, 25 bp, E. coli
gggatgctcgtaagacctacatgag

SEQ ID NO: 181293 - DNA, 25 bp, E. coli
gacctcctgtaatcagcaggcgacg

SEQ ID NO: 181294 - DNA, 25 bp, E. coli
gacctcctgtaaacagcaggcgacg

SEQ ID NO: 181295 - DNA, 25 bp, E. coli
cacttttttagtccagaaacggagt

SEQ ID NO: 181296 - DNA, 25 bp, E. coli
cacttttttagtgcagaaacggagt

SEQ ID NO: 181297 - DNA, 25 bp, E. coli
aaaagcgcgccgtaatgtgccactt

SEQ ID NO: 181298 - DNA, 25 bp, E. coli
aaaagcgcgccgaaatgtgccactt

SEQ ID NO: 181299 - DNA, 25 bp, E. coli
tagccaggctgtaattttacgactt

SEQ ID NO: 181300 - DNA, 25 bp, E. coli
tagccaggctgttattttacgactt

SEQ ID NO: 181301 - DNA, 25 bp, E. coli
tatcatactctgtatagccaggctg

SEQ ID NO: 181302 - DNA, 25 bp, E. coli
tatcatactctgaatagccaggctg

SEQ ID NO: 181303 - DNA, 25 bp, E. coli
tttacgacttgcctgtacaacgcca

SEQ ID NO: 181304 - DNA, 25 bp, E. coli
tttacgacttgcgtgtacaacgcca

SEQ ID NO: 181305 - DNA, 25 bp, E. coli
tgtacaacgccattactcacgaaag

SEQ ID NO: 181306 - DNA, 25 bp, E. coli
tgttactcatcacgcttatcttcag

SEQ ID NO: 181307 - DNA, 25 bp, E. coli
tgtacaacgccaatactcacgaaag

SEQ ID NO: 181308 - DNA, 25 bp, E. coli
tgttactcatcaggcttatcttcag

SEQ ID NO: 181309 - DNA, 25 bp, E. coli
tcggaaaaagaataggcggcattgc

SEQ ID NO: 181310 - DNA, 25 bp, E. coli
tcggaaaaagaaaaggcggcattgc

SEQ ID NO: 181311 - DNA, 25 bp, E. coli
tcttcagtatattaacgccgatacg

SEQ ID NO: 181312 - DNA, 25 bp, E. coli
tcttcagtatataaacgccgatacg

SEQ ID NO: 181313 - DNA, 25 bp, E. coli
tcacgaaagtatgacgagcaagcct

SEQ ID NO: 181314 - DNA, 25 bp, E. coli
tcacgaaagtatcacgagcaagcct

SEQ ID NO: 181315 - DNA, 25 bp, E. coli
gacgagcaagccagttactcatcag

SEQ ID NO: 181316 - DNA, 25 bp, E. coli
gacgagcaagcctgttactcatcag

SEQ ID NO: 181317 - DNA, 25 bp, E. coli
caatgatctctaggagtacgtggcg

SEQ ID NO: 181318 - DNA, 25 bp, E. coli
aatgatctctaccagtacgtggcgg

SEQ ID NO: 181319 - DNA, 25 bp, E. coli
aatgatctctacgagtacgtggcgg

SEQ ID NO: 181320 - DNA, 25 bp, E. coli
caatgatctctacgagtacgtggcg

SEQ ID NO: 181321 - DNA, 25 bp, E. coli
caccttcaatgatctctacgagtac

SEQ ID NO: 181322 - DNA, 25 bp, E. coli
caccttcaatgaactctacgagtac

SEQ ID NO: 181323 - DNA, 25 bp, E. coli
atgatctctacgagtacgtggcggg

SEQ ID NO: 181324 - DNA, 25 bp, E. coli
atgatctctacgtgtacgtggcggg

SEQ ID NO: 181325 - DNA, 25 bp, E. coli
tatcaccttcaatgatctctacgag

SEQ ID NO: 181326 - DNA, 25 bp, E. coli
tatcaccttcaaagatctctacgag

SEQ ID NO: 181327 - DNA, 25 bp, E. coli
ttcaatgatctctacgagtacgtgg

SEQ ID NO: 181328 - DNA, 25 bp, E. coli
ttcaatgatctcaacgagtacgtgg

SEQ ID NO: 181329 - DNA, 25 bp, E. coli
tgatctctacgactacgtggcgggc

SEQ ID NO: 181330 - DNA, 25 bp, E. coli
tgatctctacgagtacgtggcgggc

SEQ ID NO: 181331 - DNA, 25 bp, E. coli
tcttggtatcacgttcaatgatctc

SEQ ID NO: 181332 - DNA, 25 bp, E. coli
tcttggtatcaccttcaatgatctc

SEQ ID NO: 181333 - DNA, 25 bp, E. coli
cttcaatgatctctacgagtacgtg

SEQ ID NO: 181334 - DNA, 25 bp, E. coli
cttcaatgatctgtacgagtacgtg

SEQ ID NO: 181335 - DNA, 25 bp, E. coli
ggtatcaccttcaatgatctctacg

SEQ ID NO: 181336 - DNA, 25 bp, E. coli
ggtatcaccttctatgatctctacg

SEQ ID NO: 181337 - DNA, 25 bp, E. coli
tcaatgatctcttcgagtacgtggc

SEQ ID NO: 181338 - DNA, 25 bp, E. coli
tcaatgatctctacgagtacgtggc

SEQ ID NO: 181339 - DNA, 25 bp, E. coli
caacctggagctgggatttggcatc

SEQ ID NO: 181340 - DNA, 25 bp, E. coli
caacctggagctcggatttggcatc

SEQ ID NO: 181341 - DNA, 25 bp, E. coli
cagtctgcataagttcccggaaggg

SEQ ID NO: 181342 - DNA, 25 bp, E. coli
cagtctgcataacttcccggaaggg

SEQ ID NO: 181343 - DNA, 25 bp, E. coli
tattttggcctgcaccgcatgttgc

SEQ ID NO: 181344 - DNA, 25 bp, E. coli
tattttggcctggaccgcatgttgc

SEQ ID NO: 181345 - DNA, 25 bp, E. coli
tttaatgcaaaaatcggtgcagccg

SEQ ID NO: 181346 - DNA, 25 bp, E. coli
tttaatgcaaaattcggtgcagccg

SEQ ID NO: 181347 - DNA, 25 bp, E. coli
gcgtttctcggccttctcgggcaaa

SEQ ID NO: 181348 - DNA, 25 bp, E. coli
gcgtttctcggcgttctcgggcaaa

SEQ ID NO: 181349 - DNA, 25 bp, E. coli
gaattaatgccggtcgccaaagaga

SEQ ID NO: 181350 - DNA, 25 bp, E. coli
gaattaatgccgctcgccaaagaga

SEQ ID NO: 181351 - DNA, 25 bp, E. coli
cattaatggaaaagcttcctgccgc

SEQ ID NO: 181352 - DNA, 25 bp, E. coli
cattaatggaaatgcttcctgccgc

SEQ ID NO: 181353 - DNA, 25 bp, E. coli
gtgctgctacaaacggcgggaattg

SEQ ID NO: 181354 - DNA, 25 bp, E. coli
ggattgccacctttgtcacggcgag

SEQ ID NO: 181355 - DNA, 25 bp, E. coli
ggtgcagccgttcccaaaatcgatc

SEQ ID NO: 181356 - DNA, 25 bp, E. coli
ggtgcagccgttgccaaaatcgatc

SEQ ID NO: 181357 - DNA, 25 bp, E. coli
gtgctgctacaatcggcgggaattg

SEQ ID NO: 181358 - DNA, 25 bp, E. coli
ggattgccacctatgtcacggcgag

SEQ ID NO: 181359 - DNA, 25 bp, E. coli
taaccccagctatggcgtactatgt

SEQ ID NO: 181360 - DNA, 25 bp, E. coli
taaccccagctaaggcgtactatgt

SEQ ID NO: 181361 - DNA, 25 bp, E. coli
catttaaaattttcggcgcgcgacg

SEQ ID NO: 181362 - DNA, 25 bp, E. coli
catttaaaatttacggcgcgcgacg

SEQ ID NO: 181363 - DNA, 25 bp, E. coli
caggcgttatcagagagtgtgcaat

SEQ ID NO: 181364 - DNA, 25 bp, E. coli
caggcgttatcacagagtgtgcaat

SEQ ID NO: 181365 - DNA, 25 bp, E. coli
tatgtgatgcctcctttaccgtcgc

SEQ ID NO: 181366 - DNA, 25 bp, E. coli
tatgtgatgcctgctttaccgtcgc

SEQ ID NO: 181367 - DNA, 25 bp, E. coli
tattaaattatgagcccgttggcgg

SEQ ID NO: 181368 - DNA, 25 bp, E. coli
tattaaattatgtgcccgttggcgg

SEQ ID NO: 181369 - DNA, 25 bp, E. coli
tgatcttgcggcttgctgggccaat

SEQ ID NO: 181370 - DNA, 25 bp, E. coli
tgatcttgcggcatgctgggccaat

SEQ ID NO: 181371 - DNA, 25 bp, E. coli
tgaaacgattcatacatggcgcgaa

SEQ ID NO: 181372 - DNA, 25 bp, E. coli
tgaaacgattcaaacatggcgcgaa

SEQ ID NO: 181373 - DNA, 25 bp, E. coli
tccttggagcgcgagaagattaccg

SEQ ID NO: 181374 - DNA, 25 bp, E. coli
ttgaaggaacgccacctaccggaag

SEQ ID NO: 181375 - DNA, 25 bp, E. coli
ttgaaggaacgcgacctaccggaag

SEQ ID NO: 181376 - DNA, 25 bp, E. coli
tccttggagcgccagaagattaccg

SEQ ID NO: 181377 - DNA, 25 bp, E. coli
gaaaaagcagtaataaagcctcggt

SEQ ID NO: 181378 - DNA, 25 bp, E. coli
gaaaaagcagtattaaagcctcggt

SEQ ID NO: 181379 - DNA, 25 bp, E. coli
tggttaacaccccatgcaacgatgg

SEQ ID NO: 181380 - DNA, 25 bp, E. coli
tggttaacacccgatgcaacgatgg

SEQ ID NO: 181381 - DNA, 25 bp, E. coli
ggcatcggatccacagaaggcgcta

SEQ ID NO: 181382 - DNA, 25 bp, E. coli
ggcatcggatcctcagaaggcgcta

SEQ ID NO: 181383 - DNA, 25 bp, E. coli
tactgggtacgttcattatgctggc

SEQ ID NO: 181384 - DNA, 25 bp, E. coli
tactgggtacgtacattatgctggc

SEQ ID NO: 181385 - DNA, 25 bp, E. coli
tatcggcctgtatgttcgcgtgtcg

SEQ ID NO: 181386 - DNA, 25 bp, E. coli
tatcggcctgtaagttcgcgtgtcg

SEQ ID NO: 181387 - DNA, 25 bp, E. coli
tttggtcgccgttaaagcatggtaa

SEQ ID NO: 181388 - DNA, 25 bp, E. coli
tttggtcgccgtaaaagcatggtaa

SEQ ID NO: 181389 - DNA, 25 bp, E. coli
tgaagatcccgctgggtacgctgct

SEQ ID NO: 181390 - DNA, 25 bp, E. coli
tgaagatcccgcagggtacgctgct

SEQ ID NO: 181391 - DNA, 25 bp, E. coli
tctatgaccttttgtaccgccgccg

SEQ ID NO: 181392 - DNA, 25 bp, E. coli
tctatgacctttagtaccgccgccg

SEQ ID NO: 181393 - DNA, 25 bp, E. coli
gcatatcttcttgccgcagggcgat

SEQ ID NO: 181394 - DNA, 25 bp, E. coli
gctttcctggcttctgaccgacgag

SEQ ID NO: 181395 - DNA, 25 bp, E. coli
gcatatcttcttcccgcagggcgat

SEQ ID NO: 181396 - DNA, 25 bp, E. coli
gctttcctggctactgaccgacgag

SEQ ID NO: 181397 - DNA, 25 bp, E. coli
gacagaagtgcgatacaccggagca

SEQ ID NO: 181398 - DNA, 25 bp, E. coli
gacagaagtgcgttacaccggagca

SEQ ID NO: 181399 - DNA, 25 bp, E. coli
gacttttacatttacgccactgcgg

SEQ ID NO: 181400 - DNA, 25 bp, E. coli
gacttttacattaacgccactgcgg

SEQ ID NO: 181401 - DNA, 25 bp, E. coli
gtacgctgctgagcaaacatgttcg

SEQ ID NO: 181402 - DNA, 25 bp, E. coli
gtacgctgctgaccaaacatgttcg

SEQ ID NO: 181403 - DNA, 25 bp, E. coli
tggcctgccgcgaaacgaagtgttg

SEQ ID NO: 181404 - DNA, 25 bp, E. coli
tggcctgccgcgtaacgaagtgttg

SEQ ID NO: 181405 - DNA, 25 bp, E. coli
cagtgaaacaatgcgcggtatttgt

SEQ ID NO: 181406 - DNA, 25 bp, E. coli
cagtgaaacaatccgcggtatttgt

SEQ ID NO: 181407 - DNA, 25 bp, E. coli
acgctttgctttgactgtcatgagc

SEQ ID NO: 181408 - DNA, 25 bp, E. coli
acgctttgctttcactgtcatgagc

SEQ ID NO: 181409 - DNA, 25 bp, E. coli
tttcactgtcatgagccgtgctccg

SEQ ID NO: 181410 - DNA, 25 bp, E. coli
tttcactgtcatcagccgtgctccg

SEQ ID NO: 181411 - DNA, 25 bp, E. coli
gaaaaaacttacaggagccttatgg

SEQ ID NO: 181412 - DNA, 25 bp, E. coli
gaaaaaacttactggagccttatgg

SEQ ID NO: 181413 - DNA, 25 bp, E. coli
gacaaccacacaaaccgcaggcggg

SEQ ID NO: 181414 - DNA, 25 bp, E. coli
gacaaccacacataccgcaggcggg

SEQ ID NO: 181415 - DNA, 25 bp, E. coli
ggtatttgtaccgacaaccacacaa

SEQ ID NO: 181416 - DNA, 25 bp, E. coli
gggcagtgaaacaatgcgcggtatt

SEQ ID NO: 181417 - DNA, 25 bp, E. coli
ggtatttgtacccacaaccacacaa

SEQ ID NO: 181418 - DNA, 25 bp, E. coli
gggcagtgaaactatgcgcggtatt

SEQ ID NO: 181419 - DNA, 25 bp, E. coli
tgctccgttagataaaacttactgg

SEQ ID NO: 181420 - DNA, 25 bp, E. coli
ggaaagccttcattcaaggctgtag

SEQ ID NO: 181421 - DNA, 25 bp, E. coli
tgctccgttagaaaaaacttactgg

SEQ ID NO: 181422 - DNA, 25 bp, E. coli
ggaaagccttcaatcaaggctgtag

SEQ ID NO: 181423 - DNA, 25 bp, E. coli
tactggagccttttggttgcggtga

SEQ ID NO: 181424 - DNA, 25 bp, E. coli
tactggagccttatggttgcggtga

SEQ ID NO: 181425 - DNA, 25 bp, E. coli
gagccgtgctccgttagaaaaaact

SEQ ID NO: 181426 - DNA, 25 bp, E. coli
gagccgtgctcccttagaaaaaact

SEQ ID NO: 181427 - DNA, 25 bp, E. coli
caacagatctcgcatttattgcaac

SEQ ID NO: 181428 - DNA, 25 bp, E. coli
caacagatctcggatttattgcaac

SEQ ID NO: 181429 - DNA, 25 bp, E. coli
catctgcgcacaaatgccttatccg

SEQ ID NO: 181430 - DNA, 25 bp, E. coli
catctgcgcacatatgccttatccg

SEQ ID NO: 181431 - DNA, 25 bp, E. coli
tacttaataagttcaacagatctcg

SEQ ID NO: 181432 - DNA, 25 bp, E. coli
taccaaacccgctctgattgtaggc

SEQ ID NO: 181433 - DNA, 25 bp, E. coli
tacttaataagtacaacagatctcg

SEQ ID NO: 181434 - DNA, 25 bp, E. coli
taccaaacccgcactgattgtaggc

SEQ ID NO: 181435 - DNA, 25 bp, E. coli
atcagtgcacgaacgccggatgcgg

SEQ ID NO: 181436 - DNA, 25 bp, E. coli
atcagtgcacgatcgccggatgcgg

SEQ ID NO: 181437 - DNA, 25 bp, E. coli
tgactgactatcactgccgggaact

SEQ ID NO: 181438 - DNA, 25 bp, E. coli
tgactgactatctctgccgggaact

SEQ ID NO: 181439 - DNA, 25 bp, E. coli
gctttcagcaggttttgcatcaggc

SEQ ID NO: 181440 - DNA, 25 bp, E. coli
gctttcagcaggatttgcatcaggc

SEQ ID NO: 181441 - DNA, 25 bp, E. coli
ccgcgatctccaaagtgactgacta

SEQ ID NO: 181442 - DNA, 25 bp, E. coli
cccgcactgattgtaggcatgataa

SEQ ID NO: 181443 - DNA, 25 bp, E. coli
ccgcgatctccatagtgactgacta

SEQ ID NO: 181444 - DNA, 25 bp, E. coli
cccgcactgattctaggcatgataa

SEQ ID NO: 181445 - DNA, 25 bp, E. coli
gggaacttccgcagctacttaataa

SEQ ID NO: 181446 - DNA, 25 bp, E. coli
ggatttgcatcaggcatcagtgcac

SEQ ID NO: 181447 - DNA, 25 bp, E. coli
ggatttgcatcacgcatcagtgcac

SEQ ID NO: 181448 - DNA, 25 bp, E. coli
gggaacttccgctgctacttaataa

SEQ ID NO: 181449 - DNA, 25 bp, E. coli
caacaggtacaaggcgtctttaccg

SEQ ID NO: 181450 - DNA, 25 bp, E. coli
caacaggtacaacgcgtctttaccg

SEQ ID NO: 181451 - DNA, 25 bp, E. coli
caacaacaggtacaaggcgtcttta

SEQ ID NO: 181452 - DNA, 25 bp, E. coli
caacaacaggtagaaggcgtcttta

SEQ ID NO: 181453 - DNA, 25 bp, E. coli
taaagtgcatcatctgatgcgccgt

SEQ ID NO: 181454 - DNA, 25 bp, E. coli
taaagtgcatcaactgatgcgccgt

SEQ ID NO: 181455 - DNA, 25 bp, E. coli
tatgtgacgctctacaacaggtaca

SEQ ID NO: 181456 - DNA, 25 bp, E. coli
tatgtgacgctcaacaacaggtaca

SEQ ID NO: 181457 - DNA, 25 bp, E. coli
tgacgctcaacatcaggtacaaggc

SEQ ID NO: 181458 - DNA, 25 bp, E. coli
tgacgctcaacaacaggtacaaggc

SEQ ID NO: 181459 - DNA, 25 bp, E. coli
gctcaacaacaggtacaaggcgtct

SEQ ID NO: 181460 - DNA, 25 bp, E. coli
gctcaacaacagctacaaggcgtct

SEQ ID NO: 181461 - DNA, 25 bp, E. coli
gaataaagtgcatcatctgatgcgc

SEQ ID NO: 181462 - DNA, 25 bp, E. coli
gaataaagtgcaacatctgatgcgc

SEQ ID NO: 181463 - DNA, 25 bp, E. coli
ctggtggcggtatgtgacgctcaac

SEQ ID NO: 181464 - DNA, 25 bp, E. coli
ctggtggcggtaagtgacgctcaac

SEQ ID NO: 181465 - DNA, 25 bp, E. coli
tggaactcagccccaccggtctggg

SEQ ID NO: 181466 - DNA, 25 bp, E. coli
tggaactcagccgcaccggtctggg

SEQ ID NO: 181467 - DNA, 25 bp, E. coli
tggcggtatgtgacgctcaacaaca

SEQ ID NO: 181468 - DNA, 25 bp, E. coli
tggcggtatgtgtcgctcaacaaca

SEQ ID NO: 181469 - DNA, 25 bp, E. coli
gatcctgatgaagcgcaaaatcact

SEQ ID NO: 181470 - DNA, 25 bp, E. coli
gatcctgatgaaccgcaaaatcact

SEQ ID NO: 181471 - DNA, 25 bp, E. coli
cagtattgctaaagcaacgggcagc

SEQ ID NO: 181472 - DNA, 25 bp, E. coli
cagtattgctaatgcaacgggcagc

SEQ ID NO: 181473 - DNA, 25 bp, E. coli
aaactgtcacaattgtcactgcggg

SEQ ID NO: 181474 - DNA, 25 bp, E. coli
aaactgtcacaaatgtcactgcggg

SEQ ID NO: 181475 - DNA, 25 bp, E. coli
tattggcctgacagttactactgac

SEQ ID NO: 181476 - DNA, 25 bp, E. coli
tattggcctgactgttactactgac

SEQ ID NO: 181477 - DNA, 25 bp, E. coli
tgttgtcgattacccaatgagtgcg

SEQ ID NO: 181478 - DNA, 25 bp, E. coli
tgttgtcgattagccaatgagtgcg

SEQ ID NO: 181479 - DNA, 25 bp, E. coli
gcatcaacggcatcagcaaaagcag

SEQ ID NO: 181480 - DNA, 25 bp, E. coli
gcatcaacggcaacagcaaaagcag

SEQ ID NO: 181481 - DNA, 25 bp, E. coli
cgccgttgaggtgtggagcacatct

SEQ ID NO: 181482 - DNA, 25 bp, E. coli
cgccgttgaggtctggagcacatct

SEQ ID NO: 181483 - DNA, 25 bp, E. coli
ggagcacatctacgccaggtaagaa

SEQ ID NO: 181484 - DNA, 25 bp, E. coli
ggtggtcgcaaatgataaaactgtc

SEQ ID NO: 181485 - DNA, 25 bp, E. coli
ggagcacatctaggccaggtaagaa

SEQ ID NO: 181486 - DNA, 25 bp, E. coli
ggtggtcgcaaaagataaaactgtc

SEQ ID NO: 181487 - DNA, 25 bp, E. coli
taagaacggcgctaaacaattcagt

SEQ ID NO: 181488 - DNA, 25 bp, E. coli
tcaacgttgactgatgacggtacaa

SEQ ID NO: 181489 - DNA, 25 bp, E. coli
tcaacgttgactcatgacggtacaa

SEQ ID NO: 181490 - DNA, 25 bp, E. coli
taatggtcctggatttgctaacgca

SEQ ID NO: 181491 - DNA, 25 bp, E. coli
taagaacggcgcaaaacaattcagt

SEQ ID NO: 181492 - DNA, 25 bp, E. coli
taatggtcctggttttgctaacgca

SEQ ID NO: 181493 - DNA, 25 bp, E. coli
caacgcatggttgaagagcgcgact

SEQ ID NO: 181494 - DNA, 25 bp, E. coli
caacgcatggttcaagagcgcgact

SEQ ID NO: 181495 - DNA, 25 bp, E. coli
catcaggactttagttggcggtaac

SEQ ID NO: 181496 - DNA, 25 bp, E. coli
catcaggacttttgttggcggtaac

SEQ ID NO: 181497 - DNA, 25 bp, E. coli
taaaggccctcgttatcattgtgac

SEQ ID NO: 181498 - DNA, 25 bp, E. coli
taaaggccctcgatatcattgtgac

SEQ ID NO: 181499 - DNA, 25 bp, E. coli
tatgggaccagagttcctgtcagcc

SEQ ID NO: 181500 - DNA, 25 bp, E. coli
taccgtaagcctgatgttgatgtcg

SEQ ID NO: 181501 - DNA, 25 bp, E. coli
taccgtaagcctcatgttgatgtcg

SEQ ID NO: 181502 - DNA, 25 bp, E. coli
tatgggaccagacttcctgtcagcc

SEQ ID NO: 181503 - DNA, 25 bp, E. coli
tgattccgtggatcgacaaacagct

SEQ ID NO: 181504 - DNA, 25 bp, E. coli
tgattccgtggaacgacaaacagct

SEQ ID NO: 181505 - DNA, 25 bp, E. coli
tgtcagggcggcgattataccaacg

SEQ ID NO: 181506 - DNA, 25 bp, E. coli
tgtcagggcggccattataccaacg

SEQ ID NO: 181507 - DNA, 25 bp, E. coli
tctgcgcatgaatgatgacgccatc

SEQ ID NO: 181508 - DNA, 25 bp, E. coli
tctgcgcatgaaagatgacgccatc

SEQ ID NO: 181509 - DNA, 25 bp, E. coli
tcttttggcggaaccactggcacac

SEQ ID NO: 181510 - DNA, 25 bp, E. coli
tcttttggcggatccactggcacac

SEQ ID NO: 181511 - DNA, 25 bp, E. coli
gctgcgtcggatccttcgtcaactg

SEQ ID NO: 181512 - DNA, 25 bp, E. coli
gctgcgtcggatgcttcgtcaactg

SEQ ID NO: 181513 - DNA, 25 bp, E. coli
gattgggtgtcccttgcaacctacc

SEQ ID NO: 181514 - DNA, 25 bp, E. coli
gattgggtgtccgttgcaacctacc

SEQ ID NO: 181515 - DNA, 25 bp, E. coli
cacgctgtatctgtttgccggaagc

SEQ ID NO: 181516 - DNA, 25 bp, E. coli
cacgctgtatctctttgccggaagc

SEQ ID NO: 181517 - DNA, 25 bp, E. coli
caaattaaagagaggctggcgcgtc

SEQ ID NO: 181518 - DNA, 25 bp, E. coli
caaattaaagagtggctggcgcgtc

SEQ ID NO: 181519 - DNA, 25 bp, E. coli
tatgtgcgctctttgccatgacggg

SEQ ID NO: 181520 - DNA, 25 bp, E. coli
tatgtgcgctctatgccatgacggg

SEQ ID NO: 181521 - DNA, 25 bp, E. coli
tattcgctacggatgggaactggct

SEQ ID NO: 181522 - DNA, 25 bp, E. coli
tattcgctacggttgggaactggct

SEQ ID NO: 181523 - DNA, 25 bp, E. coli
tttcaaagtggtgtgccgatgccgc

SEQ ID NO: 181524 - DNA, 25 bp, E. coli
ttgtgcgggctgttcaacgccggat

SEQ ID NO: 181525 - DNA, 25 bp, E. coli
ttttgattgggctaagcccgcgcgt

SEQ ID NO: 181526 - DNA, 25 bp, E. coli
ttgtgcgggctgatcaacgccggat

SEQ ID NO: 181527 - DNA, 25 bp, E. coli
tttcaaagtggtctgccgatgccgc

SEQ ID NO: 181528 - DNA, 25 bp, E. coli
ttttgattgggcaaagcccgcgcgt

SEQ ID NO: 181529 - DNA, 25 bp, E. coli
tggttcagcacgttccgatctcggt

SEQ ID NO: 181530 - DNA, 25 bp, E. coli
tggttcagcacgatccgatctcggt

SEQ ID NO: 181531 - DNA, 25 bp, E. coli
tggctctggctgcataaaacccatg

SEQ ID NO: 181532 - DNA, 25 bp, E. coli
tggctctggctggataaaacccatg

SEQ ID NO: 181533 - DNA, 25 bp, E. coli
taacccgctggtcattacgcttggc

SEQ ID NO: 181534 - DNA, 25 bp, E. coli
taacccgctggtgattacgcttggc

SEQ ID NO: 181535 - DNA, 25 bp, E. coli
gagtgccaaatctggtgtccagcgc

SEQ ID NO: 181536 - DNA, 25 bp, E. coli
gagtgccaaatcaggtgtccagcgc

SEQ ID NO: 181537 - DNA, 25 bp, E. coli
tagaaaagaaacttctgtcaacgcc

SEQ ID NO: 181538 - DNA, 25 bp, E. coli
tagaaaagaaacatctgtcaacgcc

SEQ ID NO: 181539 - DNA, 25 bp, E. coli
ttttctgtaagtgtgcgccggttca

SEQ ID NO: 181540 - DNA, 25 bp, E. coli
ttttctgtaagtctgcgccggttca

SEQ ID NO: 181541 - DNA, 25 bp, E. coli
tgcgccggttcagtaaattagaaaa

SEQ ID NO: 181542 - DNA, 25 bp, E. coli
tgcgccggttcactaaattagaaaa

SEQ ID NO: 181543 - DNA, 25 bp, E. coli
tctgtcaacgcctagattgttagtc

SEQ ID NO: 181544 - DNA, 25 bp, E. coli
tctgtcaacgccaagattgttagtc

SEQ ID NO: 181545 - DNA, 25 bp, E. coli
gccaagattgttagtcgttacgcct

SEQ ID NO: 181546 - DNA, 25 bp, E. coli
gccaagattgtttgtcgttacgcct

SEQ ID NO: 181547 - DNA, 25 bp, E. coli
gaaacatctgtctacgccaagattg

SEQ ID NO: 181548 - DNA, 25 bp, E. coli
gaaacatctgtcaacgccaagattg

SEQ ID NO: 181549 - DNA, 25 bp, E. coli
cgctgacatttaactgtttcagtga

SEQ ID NO: 181550 - DNA, 25 bp, E. coli
cgctgacatttatctgtttcagtga

SEQ ID NO: 181551 - DNA, 25 bp, E. coli
gtgccggagtgtttttctgtaagtc

SEQ ID NO: 181552 - DNA, 25 bp, E. coli
gtgccggagtgtatttctgtaagtc

SEQ ID NO: 181553 - DNA, 25 bp, E. coli
gtcgttacgcctaatatcactggcg

SEQ ID NO: 181554 - DNA, 25 bp, E. coli
gtcgttacgccttatatcactggcg

SEQ ID NO: 181555 - DNA, 25 bp, E. coli
tcactggcgctgacatttatctgtt

SEQ ID NO: 181556 - DNA, 25 bp, E. coli
tcactggcgctgtcatttatctgtt

SEQ ID NO: 181557 - DNA, 25 bp, E. coli
gagtgtttttctctaagtctgcgcc

SEQ ID NO: 181558 - DNA, 25 bp, E. coli
gagtgtttttctgtaagtctgcgcc

SEQ ID NO: 181559 - DNA, 25 bp, E. coli
atcgactttttatgcctttgcggca

SEQ ID NO: 181560 - DNA, 25 bp, E. coli
atcgactttttaagcctttgcggca

SEQ ID NO: 181561 - DNA, 25 bp, E. coli
tattcaacgccatcgactttttatg

SEQ ID NO: 181562 - DNA, 25 bp, E. coli
tattcaacgccaacgactttttatg

SEQ ID NO: 181563 - DNA, 25 bp, E. coli
ttttatgcctttccggcatcgggca

SEQ ID NO: 181564 - DNA, 25 bp, E. coli
ttttatgcctttgcggcatcgggca

SEQ ID NO: 181565 - DNA, 25 bp, E. coli
tgcctttgcggcttcgggcaatgcg

SEQ ID NO: 181566 - DNA, 25 bp, E. coli
tgcctttgcggcatcgggcaatgcg

SEQ ID NO: 181567 - DNA, 25 bp, E. coli
tcaacgccatcgtctttttatgcct

SEQ ID NO: 181568 - DNA, 25 bp, E. coli
tcaacgccatcgactttttatgcct

SEQ ID NO: 181569 - DNA, 25 bp, E. coli
gccatcgactttatatgcctttgcg

SEQ ID NO: 181570 - DNA, 25 bp, E. coli
gcctttgcggcaacgggcaatgcgt

SEQ ID NO: 181571 - DNA, 25 bp, E. coli
gccatcgactttttatgcctttgcg

SEQ ID NO: 181572 - DNA, 25 bp, E. coli
gcctttgcggcatcgggcaatgcgt

SEQ ID NO: 181573 - DNA, 25 bp, E. coli
gcatcgggcaatccgtgtcggatgc

SEQ ID NO: 181574 - DNA, 25 bp, E. coli
gctgaaaaaataatcaacgccatcg

SEQ ID NO: 181575 - DNA, 25 bp, E. coli
gcatcgggcaatgcgtgtcggatgc

SEQ ID NO: 181576 - DNA, 25 bp, E. coli
gctgaaaaaatattcaacgccatcg

SEQ ID NO: 181577 - DNA, 25 bp, E. coli
gaaaaaatattcaacgccatcgact

SEQ ID NO: 181578 - DNA, 25 bp, E. coli
gaaaaaatattctacgccatcgact

SEQ ID NO: 181579 - DNA, 25 bp, E. coli
gactttttatgcgtttgcggcatcg

SEQ ID NO: 181580 - DNA, 25 bp, E. coli
gactttttatgcctttgcggcatcg

SEQ ID NO: 181581 - DNA, 25 bp, E. coli
caattgccggagtaggcgataatgc

SEQ ID NO: 181582 - DNA, 25 bp, E. coli
caattgccggagaaggcgataatgc

SEQ ID NO: 181583 - DNA, 25 bp, E. coli
tatccgacctacattggtggtcccg

SEQ ID NO: 181584 - DNA, 25 bp, E. coli
taggcctgataagacacgttaaacg

SEQ ID NO: 181585 - DNA, 25 bp, E. coli
tatccggtctacagtgcaggtgaaa

SEQ ID NO: 181586 - DNA, 25 bp, E. coli
taggcctgataacacacgttaaacg

SEQ ID NO: 181587 - DNA, 25 bp, E. coli
tatccggtctactgtgcaggtgaaa

SEQ ID NO: 181588 - DNA, 25 bp, E. coli
tatccgacctactttggtggtcccg

SEQ ID NO: 181589 - DNA, 25 bp, E. coli
tgttctgtccatccttcagtaatcg

SEQ ID NO: 181590 - DNA, 25 bp, E. coli
tgttctgtccatgcttcagtaatcg

SEQ ID NO: 181591 - DNA, 25 bp, E. coli
tcgcttccgggctttgtcggtcacc

SEQ ID NO: 181592 - DNA, 25 bp, E. coli
tcgcttccgggcattgtcggtcacc

SEQ ID NO: 181593 - DNA, 25 bp, E. coli
tcgcatcaggcttcaattgccggag

SEQ ID NO: 181594 - DNA, 25 bp, E. coli
tcgcatcaggctacaattgccggag

SEQ ID NO: 181595 - DNA, 25 bp, E. coli
gaatatttcgtatcgcttccgggca

SEQ ID NO: 181596 - DNA, 25 bp, E. coli
gaaggcgataatcccttatccggtc

SEQ ID NO: 181597 - DNA, 25 bp, E. coli
gaaggcgataatgccttatccggtc

SEQ ID NO: 181598 - DNA, 25 bp, E. coli
gaatatttcgtaacgcttccgggca

SEQ ID NO: 181599 - DNA, 25 bp, E. coli
gacacgttaaacctcacatcaggca

SEQ ID NO: 181600 - DNA, 25 bp, E. coli
gacacgttaaacgtcacatcaggca

SEQ ID NO: 181601 - DNA, 25 bp, E. coli
cattgtcggtcacccgtaggcctga

SEQ ID NO: 181602 - DNA, 25 bp, E. coli
cattgtcggtcagccgtaggcctga

SEQ ID NO: 181603 - DNA, 25 bp, E. coli
aagcgatgatgatacgcgggcgaac

SEQ ID NO: 181604 - DNA, 25 bp, E. coli
aagcgatgatgaaacgcgggcgaac

SEQ ID NO: 181605 - DNA, 25 bp, E. coli
cagcgctgagcagctcttaagcaag

SEQ ID NO: 181606 - DNA, 25 bp, E. coli
cagcgctgagcacctcttaagcaag

SEQ ID NO: 181607 - DNA, 25 bp, E. coli
tgccagtgaactcacccgctgggca

SEQ ID NO: 181608 - DNA, 25 bp, E. coli
tgccagtgaactgacccgctgggca

SEQ ID NO: 181609 - DNA, 25 bp, E. coli
tgcgccgccgctcgtcgctggaaaa

SEQ ID NO: 181610 - DNA, 25 bp, E. coli
tgcgccgccgctggtcgctggaaaa

SEQ ID NO: 181611 - DNA, 25 bp, E. coli
tctatcggcactgctcacgttctgg

SEQ ID NO: 181612 - DNA, 25 bp, E. coli
tctatcggcactcctcacgttctgg

SEQ ID NO: 181613 - DNA, 25 bp, E. coli
gaaggcaaagcacaaagatatggct

SEQ ID NO: 181614 - DNA, 25 bp, E. coli
gaaggcaaagcagaaagatatggct

SEQ ID NO: 181615 - DNA, 25 bp, E. coli
cgagcgcaatgccagtgaactgacc

SEQ ID NO: 181616 - DNA, 25 bp, E. coli
cgagcgcaatgcgagtgaactgacc

SEQ ID NO: 181617 - DNA, 25 bp, E. coli
gataaagggcgatccacaggatgga

SEQ ID NO: 181618 - DNA, 25 bp, E. coli
gataaagggcgaaccacaggatgga

SEQ ID NO: 181619 - DNA, 25 bp, E. coli
gtcgccagccgatctcagcgctgag

SEQ ID NO: 181620 - DNA, 25 bp, E. coli
gtcgccagccgaactcagcgctgag

SEQ ID NO: 181621 - DNA, 25 bp, E. coli
ggcgatatctctttcggcactcctc

SEQ ID NO: 181622 - DNA, 25 bp, E. coli
ggcgatatctctatcggcactcctc

SEQ ID NO: 181623 - DNA, 25 bp, E. coli
gatggatgatcaaacctttgggtcg

SEQ ID NO: 181624 - DNA, 25 bp, E. coli
gatggatgatcatacctttgggtcg

SEQ ID NO: 181625 - DNA, 25 bp, E. coli
cggtaccgtgcgtgaagccaccggc

SEQ ID NO: 181626 - DNA, 25 bp, E. coli
cggtaccgtgcgagaagccaccggc

SEQ ID NO: 181627 - DNA, 25 bp, E. coli
accgtgcgtgaagccaccggcacct

SEQ ID NO: 181628 - DNA, 25 bp, E. coli
accgtgcgtgaacccaccggcacct

SEQ ID NO: 181629 - DNA, 25 bp, E. coli
taccgtgcgtgatgccaccggcacc

SEQ ID NO: 181630 - DNA, 25 bp, E. coli
taccgtgcgtgaagccaccggcacc

SEQ ID NO: 181631 - DNA, 25 bp, E. coli
tgaagccaccggcacctccggcgtg

SEQ ID NO: 181632 - DNA, 25 bp, E. coli
tgaagccaccgggacctccggcgtg

SEQ ID NO: 181633 - DNA, 25 bp, E. coli
tgcgtgaagccaccggcacctccgg

SEQ ID NO: 181634 - DNA, 25 bp, E. coli
tgcgtgaagccagcggcacctccgg

SEQ ID NO: 181635 - DNA, 25 bp, E. coli
ccgtgcgtgaaggcaccggcacctc

SEQ ID NO: 181636 - DNA, 25 bp, E. coli
gcgcctgcggatgaacgccacctgc

SEQ ID NO: 181637 - DNA, 25 bp, E. coli
gcgcctgcggatcaacgccacctgc

SEQ ID NO: 181638 - DNA, 25 bp, E. coli
ccgtgcgtgaagccaccggcacctc

SEQ ID NO: 181639 - DNA, 25 bp, E. coli
cgtgcgtgaagcgaccggcacctcc

SEQ ID NO: 181640 - DNA, 25 bp, E. coli
cgtgcgtgaagccaccggcacctcc

SEQ ID NO: 181641 - DNA, 25 bp, E. coli
gtaccgtgcgtgaagccaccggcac

SEQ ID NO: 181642 - DNA, 25 bp, E. coli
ggtaccgtgcgtcaagccaccggca

SEQ ID NO: 181643 - DNA, 25 bp, E. coli
ggtaccgtgcgtgaagccaccggca

SEQ ID NO: 181644 - DNA, 25 bp, E. coli
gtaccgtgcgtgtagccaccggcac

SEQ ID NO: 181645 - DNA, 25 bp, E. coli
gtgcgtgaagccaccggcacctccg

SEQ ID NO: 181646 - DNA, 25 bp, E. coli
gtgcgtgaagcctccggcacctccg

SEQ ID NO: 181647 - DNA, 25 bp, E. coli
tacaaatacgatagcgccgggagtc

SEQ ID NO: 181648 - DNA, 25 bp, E. coli
tacaaatacgattgcgccgggagtc

SEQ ID NO: 181649 - DNA, 25 bp, E. coli
ttaatcagggttgcaaacccgcgca

SEQ ID NO: 181650 - DNA, 25 bp, E. coli
ttaatcagggttccaaacccgcgca

SEQ ID NO: 181651 - DNA, 25 bp, E. coli
tgtgctcaacaagtggctgacggaa

SEQ ID NO: 181652 - DNA, 25 bp, E. coli
tgtgctcaacaactggctgacggaa

SEQ ID NO: 181653 - DNA, 25 bp, E. coli
tgcgcccatggaaatacttaatcag

SEQ ID NO: 181654 - DNA, 25 bp, E. coli
tgcgcccatggatatacttaatcag

SEQ ID NO: 181655 - DNA, 25 bp, E. coli
tctgtcacgggtgggtgtgctcaac

SEQ ID NO: 181656 - DNA, 25 bp, E. coli
tctgtcacgggtcggtgtgctcaac

SEQ ID NO: 181657 - DNA, 25 bp, E. coli
gcgggaagcgatggtttctatgcca

SEQ ID NO: 181658 - DNA, 25 bp, E. coli
gcattaattgctggtggctcggaga

SEQ ID NO: 181659 - DNA, 25 bp, E. coli
gcgggaagcgatcgtttctatgcca

SEQ ID NO: 181660 - DNA, 25 bp, E. coli
gcattaattgctcgtggctcggaga

SEQ ID NO: 181661 - DNA, 25 bp, E. coli
cccctgaagagtcgaaagcattaat

SEQ ID NO: 181662 - DNA, 25 bp, E. coli
cccctgaagagtggaaagcattaat

SEQ ID NO: 181663 - DNA, 25 bp, E. coli
ggcttatatctgacatggcatcgct

SEQ ID NO: 181664 - DNA, 25 bp, E. coli
ggcttatatctgtcatggcatcgct

SEQ ID NO: 181665 - DNA, 25 bp, E. coli
gagtttatggctccaatcgcgcgtc

SEQ ID NO: 181666 - DNA, 25 bp, E. coli
gaggcgctaaccgtgtacaaatacg

SEQ ID NO: 181667 - DNA, 25 bp, E. coli
gaggcgctaaccctgtacaaatacg

SEQ ID NO: 181668 - DNA, 25 bp, E. coli
gagtttatggctgcaatcgcgcgtc

SEQ ID NO: 181669 - DNA, 25 bp, E. coli
cagaaaagcattagctggatgagcg

SEQ ID NO: 181670 - DNA, 25 bp, E. coli
cagaaaagcatttgctggatgagcg

SEQ ID NO: 181671 - DNA, 25 bp, E. coli
acacaccttatcagcctcggcgatg

SEQ ID NO: 181672 - DNA, 25 bp, E. coli
acacaccttatctgcctcggcgatg

SEQ ID NO: 181673 - DNA, 25 bp, E. coli
tatgtgcgggaagcgtatcaggata

SEQ ID NO: 181674 - DNA, 25 bp, E. coli
tatgtgcgggaaccgtatcaggata

SEQ ID NO: 181675 - DNA, 25 bp, E. coli
ttaacacaccttttctgcctcggcg

SEQ ID NO: 181676 - DNA, 25 bp, E. coli
ttaacacaccttatctgcctcggcg

SEQ ID NO: 181677 - DNA, 25 bp, E. coli
tgcctcggcgatcaagaaccgcagg

SEQ ID NO: 181678 - DNA, 25 bp, E. coli
tgccagaaaagcttttgctggatga

SEQ ID NO: 181679 - DNA, 25 bp, E. coli
tgcctcggcgatgaagaaccgcagg

SEQ ID NO: 181680 - DNA, 25 bp, E. coli
tgccagaaaagcatttgctggatga

SEQ ID NO: 181681 - DNA, 25 bp, E. coli
tctgcctcggcgttgaagaaccgca

SEQ ID NO: 181682 - DNA, 25 bp, E. coli
tctgcctcggcgatgaagaaccgca

SEQ ID NO: 181683 - DNA, 25 bp, E. coli
ccttatctgcctcggcgatgaagaa

SEQ ID NO: 181684 - DNA, 25 bp, E. coli
ccttatctgcctgggcgatgaagaa

SEQ ID NO: 181685 - DNA, 25 bp, E. coli
gcgggaagcgtaacaggatagcggc

SEQ ID NO: 181686 - DNA, 25 bp, E. coli
gcatttgctggatgagcggttacgt

SEQ ID NO: 181687 - DNA, 25 bp, E. coli
gcgggaagcgtatcaggatagcggc

SEQ ID NO: 181688 - DNA, 25 bp, E. coli
gcatttgctggaagagcggttacgt

SEQ ID NO: 181689 - DNA, 25 bp, E. coli
ctatgtgcgggatgcgtatcaggat

SEQ ID NO: 181690 - DNA, 25 bp, E. coli
ctatgtgcgggaagcgtatcaggat

SEQ ID NO: 181691 - DNA, 25 bp, E. coli
catcggcagcgattaaagtggtgac

SEQ ID NO: 181692 - DNA, 25 bp, E. coli
catgctgttgaattacctgcgggcg

SEQ ID NO: 181693 - DNA, 25 bp, E. coli
catgctgttgaaatacctgcgggcg

SEQ ID NO: 181694 - DNA, 25 bp, E. coli
catcggcagcgaataaagtggtgac

SEQ ID NO: 181695 - DNA, 25 bp, E. coli
tatagcgactttcgcgttccggcga

SEQ ID NO: 181696 - DNA, 25 bp, E. coli
tttaaaaagcatcctgccggacgcc

SEQ ID NO: 181697 - DNA, 25 bp, E. coli
tatagcgactttggcgttccggcga

SEQ ID NO: 181698 - DNA, 25 bp, E. coli
tattcagctgggaacctatgacggc

SEQ ID NO: 181699 - DNA, 25 bp, E. coli
tattcagctgggtacctatgacggc

SEQ ID NO: 181700 - DNA, 25 bp, E. coli
tttaaaaagcatgctgccggacgcc

SEQ ID NO: 181701 - DNA, 25 bp, E. coli
gctttgaaggatttgccgcggatca

SEQ ID NO: 181702 - DNA, 25 bp, E. coli
gctttgaaggatatgccgcggatca

SEQ ID NO: 181703 - DNA, 25 bp, E. coli
gactcagtcggtgcacaaacagcag

SEQ ID NO: 181704 - DNA, 25 bp, E. coli
gacaggcgcgttattgcccgcataa

SEQ ID NO: 181705 - DNA, 25 bp, E. coli
gactcagtcggtccacaaacagcag

SEQ ID NO: 181706 - DNA, 25 bp, E. coli
gacaggcgcgtttttgcccgcataa

SEQ ID NO: 181707 - DNA, 25 bp, E. coli
gtaatcaacggcaacgagcagcagt

SEQ ID NO: 181708 - DNA, 25 bp, E. coli
gattttacggacctcgcggcagtcg

SEQ ID NO: 181709 - DNA, 25 bp, E. coli
gattttacggacgtcgcggcagtcg

SEQ ID NO: 181710 - DNA, 25 bp, E. coli
gtaatcaacggctacgagcagcagt

SEQ ID NO: 181711 - DNA, 25 bp, E. coli
taatgaagagtatctgcgccagcaa

SEQ ID NO: 181712 - DNA, 25 bp, E. coli
taatgaagagtaactgcgccagcaa

SEQ ID NO: 181713 - DNA, 25 bp, E. coli
caattttcctgacagagtacgcgta

SEQ ID NO: 181714 - DNA, 25 bp, E. coli
caattttcctgagagagtacgcgta

SEQ ID NO: 181715 - DNA, 25 bp, E. coli
caaaggacgtcacattaccgtgcag

SEQ ID NO: 181716 - DNA, 25 bp, E. coli
caaaggacgtcagattaccgtgcag

SEQ ID NO: 181717 - DNA, 25 bp, E. coli
caggtagcgggatgcatatttcggc

SEQ ID NO: 181718 - DNA, 25 bp, E. coli
caggtagcgggaagcatatttcggc

SEQ ID NO: 181719 - DNA, 25 bp, E. coli
tactaaccaaatggcgcaacggaag

SEQ ID NO: 181720 - DNA, 25 bp, E. coli
tactaaccaaatcgcgcaacggaag

SEQ ID NO: 181721 - DNA, 25 bp, E. coli
taccgtgcagtagagttgatagccc

SEQ ID NO: 181722 - DNA, 25 bp, E. coli
taccgtgcagtacagttgatagccc

SEQ ID NO: 181723 - DNA, 25 bp, E. coli
tatttcggcaatccagagacagcgg

SEQ ID NO: 181724 - DNA, 25 bp, E. coli
tatttcggcaatgcagagacagcgg

SEQ ID NO: 181725 - DNA, 25 bp, E. coli
ttgatagcccctacccaggtagcgg

SEQ ID NO: 181726 - DNA, 25 bp, E. coli
ttgatagccccttcccaggtagcgg

SEQ ID NO: 181727 - DNA, 25 bp, E. coli
tcatgctgaagccagacaccaggag

SEQ ID NO: 181728 - DNA, 25 bp, E. coli
tcatgctgaagcgagacaccaggag

SEQ ID NO: 181729 - DNA, 25 bp, E. coli
ccaggagacacaaagcgaaagctat

SEQ ID NO: 181730 - DNA, 25 bp, E. coli
ccaggagacacatagcgaaagctat

SEQ ID NO: 181731 - DNA, 25 bp, E. coli
gacagcggcgttttctggctctgga

SEQ ID NO: 181732 - DNA, 25 bp, E. coli
gaaagctatgctaaaacagtcagga

SEQ ID NO: 181733 - DNA, 25 bp, E. coli
gaaagctatgcttaaacagtcagga

SEQ ID NO: 181734 - DNA, 25 bp, E. coli
gacagcggcgttatctggctctgga

SEQ ID NO: 181735 - DNA, 25 bp, E. coli
aattgcaggcggcttaatcgtcgcg

SEQ ID NO: 181736 - DNA, 25 bp, E. coli
aattgcaggcgggttaatcgtcgcg

SEQ ID NO: 181737 - DNA, 25 bp, E. coli
tacatttggcatatcgattcccggt

SEQ ID NO: 181738 - DNA, 25 bp, E. coli
tacatttggcatttcgattcccggt

SEQ ID NO: 181739 - DNA, 25 bp, E. coli
attgggtactgatggttgcgccgcc

SEQ ID NO: 181740 - DNA, 25 bp, E. coli
attgggtactgaaggttgcgccgcc

SEQ ID NO: 181741 - DNA, 25 bp, E. coli
tattattaacgggatcctggaaatc

SEQ ID NO: 181742 - DNA, 25 bp, E. coli
tattattaacggcatcctggaaatc

SEQ ID NO: 181743 - DNA, 25 bp, E. coli
tccacagtgcgtcagagttcaacct

SEQ ID NO: 181744 - DNA, 25 bp, E. coli
tccacagtgcgtgagagttcaacct

SEQ ID NO: 181745 - DNA, 25 bp, E. coli
gcgttatttcttcgcctggcaggca

SEQ ID NO: 181746 - DNA, 25 bp, E. coli
gcgttatttcttggcctggcaggca

SEQ ID NO: 181747 - DNA, 25 bp, E. coli
cgccgggcaactcgtgatggataca

SEQ ID NO: 181748 - DNA, 25 bp, E. coli
cgccgggcaactggtgatggataca

SEQ ID NO: 181749 - DNA, 25 bp, E. coli
gattcccggtctccgaattgcaggc

SEQ ID NO: 181750 - DNA, 25 bp, E. coli
gattcccggtctgcgaattgcaggc

SEQ ID NO: 181751 - DNA, 25 bp, E. coli
gtcggaagagctcgaagatgaaccc

SEQ ID NO: 181752 - DNA, 25 bp, E. coli
gtcggaagagctggaagatgaaccc

SEQ ID NO: 181753 - DNA, 25 bp, E. coli
taatcgtcagtcgttgatggcctcg

SEQ ID NO: 181754 - DNA, 25 bp, E. coli
taatcgtcagtccttgatggcctcg

SEQ ID NO: 181755 - DNA, 25 bp, E. coli
gagttcaaccttcgctgattgggta

SEQ ID NO: 181756 - DNA, 25 bp, E. coli
gagttcaaccttggctgattgggta

SEQ ID NO: 181757 - DNA, 25 bp, E. coli
aagaaagcgacatgcgagccgtatc

SEQ ID NO: 181758 - DNA, 25 bp, E. coli
aagcgacaagcgtgccgtatctggt

SEQ ID NO: 181759 - DNA, 25 bp, E. coli
aatgtcactgcgctacagctacacc

SEQ ID NO: 181760 - DNA, 25 bp, E. coli
aagaaagcgacaagcgagccgtatc

SEQ ID NO: 181761 - DNA, 25 bp, E. coli
aatgtcactgcggtacagctacacc

SEQ ID NO: 181762 - DNA, 25 bp, E. coli
aagcgacaagcgagccgtatctggt

SEQ ID NO: 181763 - DNA, 25 bp, E. coli
tccgtttcgcccgtttgattgatga

SEQ ID NO: 181764 - DNA, 25 bp, E. coli
tccgtttcgcccctttgattgatga

SEQ ID NO: 181765 - DNA, 25 bp, E. coli
tctgaagaatgtcactgcggtacag

SEQ ID NO: 181766 - DNA, 25 bp, E. coli
tctgaagaatgtgactgcggtacag

SEQ ID NO: 181767 - DNA, 25 bp, E. coli
ccggattgtgatgccagggattgtc

SEQ ID NO: 181768 - DNA, 25 bp, E. coli
ccggattgtgatcccagggattgtc

SEQ ID NO: 181769 - DNA, 25 bp, E. coli
gcgaagaaagcgtcaagcgagccgt

SEQ ID NO: 181770 - DNA, 25 bp, E. coli
gcgaagaaagcgacaagcgagccgt

SEQ ID NO: 181771 - DNA, 25 bp, E. coli
gaagaatgtcactgcggtacagcta

SEQ ID NO: 181772 - DNA, 25 bp, E. coli
gaagaatgtcacagcggtacagcta

SEQ ID NO: 181773 - DNA, 25 bp, E. coli
cgtttcgcccgtatgattgatgagg

SEQ ID NO: 181774 - DNA, 25 bp, E. coli
cgtttcgcccgtttgattgatgagg

SEQ ID NO: 181775 - DNA, 25 bp, E. coli
cgccagcttcaatgagatgcatggc

SEQ ID NO: 181776 - DNA, 25 bp, E. coli
cgccagcttcaaagagatgcatggc

SEQ ID NO: 181777 - DNA, 25 bp, E. coli
ggtacagctacacccggcaaaagtg

SEQ ID NO: 181778 - DNA, 25 bp, E. coli
ggtacagctacagccggcaaaagtg

SEQ ID NO: 181779 - DNA, 25 bp, E. coli
aatcgcgtaaatccaccttgctgcg

SEQ ID NO: 181780 - DNA, 25 bp, E. coli
aatcgcgtaaatgcaccttgctgcg

SEQ ID NO: 181781 - DNA, 25 bp, E. coli
taaatcgcgtaaatccaccttgctg

SEQ ID NO: 181782 - DNA, 25 bp, E. coli
taaatccaccttcctgcgccataca

SEQ ID NO: 181783 - DNA, 25 bp, E. coli
taaatcgcgtaattccaccttgctg

SEQ ID NO: 181784 - DNA, 25 bp, E. coli
taaatccaccttgctgcgccataca

SEQ ID NO: 181785 - DNA, 25 bp, E. coli
atcgcgtaaatcgaccttgctgcgc

SEQ ID NO: 181786 - DNA, 25 bp, E. coli
atcgcgtaaatccaccttgctgcgc

SEQ ID NO: 181787 - DNA, 25 bp, E. coli
acgtaaatcgcgtaaatccaccttg

SEQ ID NO: 181788 - DNA, 25 bp, E. coli
acgtaaatcgcgaaaatccaccttg

SEQ ID NO: 181789 - DNA, 25 bp, E. coli
aaatcgcgtaaatccaccttgctgc

SEQ ID NO: 181790 - DNA, 25 bp, E. coli
aaatcgcgtaaaaccaccttgctgc

SEQ ID NO: 181791 - DNA, 25 bp, E. coli
gcgtaaatccacgttgctgcgccat

SEQ ID NO: 181792 - DNA, 25 bp, E. coli
gcgtaaatccaccttgctgcgccat

SEQ ID NO: 181793 - DNA, 25 bp, E. coli
cgtaaatcgcgtaaatccaccttgc

SEQ ID NO: 181794 - DNA, 25 bp, E. coli
cgtaaatcgcgttaatccaccttgc

SEQ ID NO: 181795 - DNA, 25 bp, E. coli
cgtaaatccaccttgctgcgccata

SEQ ID NO: 181796 - DNA, 25 bp, E. coli
cgtaaatccaccatgctgcgccata

SEQ ID NO: 181797 - DNA, 25 bp, E. coli
gtaaatcgcgtaaatccaccttgct

SEQ ID NO: 181798 - DNA, 25 bp, E. coli
gtaaatccacctagctgcgccatac

SEQ ID NO: 181799 - DNA, 25 bp, E. coli
gtaaatcgcgtatatccaccttgct

SEQ ID NO: 181800 - DNA, 25 bp, E. coli
gtaaatccaccttgctgcgccatac

SEQ ID NO: 181801 - DNA, 25 bp, E. coli
taaaaagtttttggctacgctagca

SEQ ID NO: 181802 - DNA, 25 bp, E. coli
tatttttaaacagacacttaccgca

SEQ ID NO: 181803 - DNA, 25 bp, E. coli
tatttttaaacacacacttaccgca

SEQ ID NO: 181804 - DNA, 25 bp, E. coli
taaaaagtttttcgctacgctagca

SEQ ID NO: 181805 - DNA, 25 bp, E. coli
tatttacctgttagaccgagttggg

SEQ ID NO: 181806 - DNA, 25 bp, E. coli
tatttacctgtttgaccgagttggg

SEQ ID NO: 181807 - DNA, 25 bp, E. coli
tgcgcacagtcaaaataactcaccg

SEQ ID NO: 181808 - DNA, 25 bp, E. coli
tcgaaatgggatgttgcgcacagtc

SEQ ID NO: 181809 - DNA, 25 bp, E. coli
tgcgcacagtcataataactcaccg

SEQ ID NO: 181810 - DNA, 25 bp, E. coli
tcgaaatgggatcttgcgcacagtc

SEQ ID NO: 181811 - DNA, 25 bp, E. coli
ccacttgtttaaagcggagaatcag

SEQ ID NO: 181812 - DNA, 25 bp, E. coli
ccacttgtttaatgcggagaatcag

SEQ ID NO: 181813 - DNA, 25 bp, E. coli
gaaattatatgaacaccgggagtga

SEQ ID NO: 181814 - DNA, 25 bp, E. coli
gaaattatatgatcaccgggagtga

SEQ ID NO: 181815 - DNA, 25 bp, E. coli
gattgcgtcgtttctccattaggag

SEQ ID NO: 181816 - DNA, 25 bp, E. coli
gtcacctgaagttcacagaataagg

SEQ ID NO: 181817 - DNA, 25 bp, E. coli
gattgcgtcgttactccattaggag

SEQ ID NO: 181818 - DNA, 25 bp, E. coli
gtcacctgaagtacacagaataagg

SEQ ID NO: 181819 - DNA, 25 bp, E. coli
ggcagcatcacccataaatgtataa

SEQ ID NO: 181820 - DNA, 25 bp, E. coli
ggcagcatcaccgataaatgtataa

SEQ ID NO: 181821 - DNA, 25 bp, E. coli
gagtaaagcttttatgtcacctgaa

SEQ ID NO: 181822 - DNA, 25 bp, E. coli
gagtaaagctttaatgtcacctgaa

SEQ ID NO: 181823 - DNA, 25 bp, E. coli
aagacaatgcatttataggctcggg

SEQ ID NO: 181824 - DNA, 25 bp, E. coli
cactaaaagtgtacctgccggtata

SEQ ID NO: 181825 - DNA, 25 bp, E. coli
cactaaaagtgttcctgccggtata

SEQ ID NO: 181826 - DNA, 25 bp, E. coli
catactatgatacgtagtggcgcta

SEQ ID NO: 181827 - DNA, 25 bp, E. coli
catactatgataggtagtggcgcta

SEQ ID NO: 181828 - DNA, 25 bp, E. coli
cagcaagagaaaagaaaagatcgcc

SEQ ID NO: 181829 - DNA, 25 bp, E. coli
cagcaagagaaatgaaaagatcgcc

SEQ ID NO: 181830 - DNA, 25 bp, E. coli
taactgtgtgcgcaaatccagcaag

SEQ ID NO: 181831 - DNA, 25 bp, E. coli
aagacaatgcatatataggctcggg

SEQ ID NO: 181832 - DNA, 25 bp, E. coli
taggctcgggtggagtaattaagca

SEQ ID NO: 181833 - DNA, 25 bp, E. coli
taggctcgggtgcagtaattaagca

SEQ ID NO: 181834 - DNA, 25 bp, E. coli
tgaagtgctttctaccaactgcttt

SEQ ID NO: 181835 - DNA, 25 bp, E. coli
tgaagtgctttcaaccaactgcttt

SEQ ID NO: 181836 - DNA, 25 bp, E. coli
gaatgtggttctcactatgctctgg

SEQ ID NO: 181837 - DNA, 25 bp, E. coli
gaatgtggttctgactatgctctgg

SEQ ID NO: 181838 - DNA, 25 bp, E. coli
cccacttattattggcgcgggagcc

SEQ ID NO: 181839 - DNA, 25 bp, E. coli
cccacttattataggcgcgggagcc

SEQ ID NO: 181840 - DNA, 25 bp, E. coli
taagcagggtgtacctaatcgccca

SEQ ID NO: 181841 - DNA, 25 bp, E. coli
taagcagggtgttcctaatcgccca

SEQ ID NO: 181842 - DNA, 25 bp, E. coli
taactgtgtgcggaaatccagcaag

SEQ ID NO: 181843 - DNA, 25 bp, E. coli
taatgataagattcgacagagagtg

SEQ ID NO: 181844 - DNA, 25 bp, E. coli
taatgataagatacgacagagagtg

SEQ ID NO: 181845 - DNA, 25 bp, E. coli
cactcgcgcttaacgtgaagaggca

SEQ ID NO: 181846 - DNA, 25 bp, E. coli
cactcgcgcttatcgtgaagaggca

SEQ ID NO: 181847 - DNA, 25 bp, E. coli
tacaaagactggaccatcgagcaga

SEQ ID NO: 181848 - DNA, 25 bp, E. coli
tacaaagactggtccatcgagcaga

SEQ ID NO: 181849 - DNA, 25 bp, E. coli
tatcgatttactgaccgacagcggc

SEQ ID NO: 181850 - DNA, 25 bp, E. coli
tatcgatttactcaccgacagcggc

SEQ ID NO: 181851 - DNA, 25 bp, E. coli
tatttctttgataccacgcagggcc

SEQ ID NO: 181852 - DNA, 25 bp, E. coli
tatttctttgattccacgcagggcc

SEQ ID NO: 181853 - DNA, 25 bp, E. coli
ttgaccttgagggattagaacgcgg

SEQ ID NO: 181854 - DNA, 25 bp, E. coli
ttgaccttgaggcattagaacgcgg

SEQ ID NO: 181855 - DNA, 25 bp, E. coli
tgtccgccaagatagatgcgatggt

SEQ ID NO: 181856 - DNA, 25 bp, E. coli
tgtccgccaagaaagatgcgatggt

SEQ ID NO: 181857 - DNA, 25 bp, E. coli
gaacccgttcctcctggatagcgaa

SEQ ID NO: 181858 - DNA, 25 bp, E. coli
gaaaaccggtaatcaactgccatgc

SEQ ID NO: 181859 - DNA, 25 bp, E. coli
gaaaaccggtaaacaactgccatgc

SEQ ID NO: 181860 - DNA, 25 bp, E. coli
gaacccgttcctgctggatagcgaa

SEQ ID NO: 181861 - DNA, 25 bp, E. coli
ggaaaaaggcctcgatcgcagcaaa

SEQ ID NO: 181862 - DNA, 25 bp, E. coli
ggaaaaaggcctggatcgcagcaaa

SEQ ID NO: 181863 - DNA, 25 bp, E. coli
gagctgtataaactcgccggtatcc

SEQ ID NO: 181864 - DNA, 25 bp, E. coli
gagccagtaaaacgtaccactcgcg

SEQ ID NO: 181865 - DNA, 25 bp, E. coli
gagccagtaaaaggtaccactcgcg

SEQ ID NO: 181866 - DNA, 25 bp, E. coli
gagctgtataaagtcgccggtatcc

SEQ ID NO: 181867 - DNA, 25 bp, E. coli
cagtgattgcttggctagggattgc

SEQ ID NO: 181868 - DNA, 25 bp, E. coli
cagtgattgcttcgctagggattgc

SEQ ID NO: 181869 - DNA, 25 bp, E. coli
taccgctgaactgccagtgattgct

SEQ ID NO: 181870 - DNA, 25 bp, E. coli
taccgctgaactcccagtgattgct

SEQ ID NO: 181871 - DNA, 25 bp, E. coli
ttctaatagttggttctgcggcctg

SEQ ID NO: 181872 - DNA, 25 bp, E. coli
ttctaatagttgcttctgcggcctg

SEQ ID NO: 181873 - DNA, 25 bp, E. coli
tgattgcttcgctagggattgccga

SEQ ID NO: 181874 - DNA, 25 bp, E. coli
tgattgcttcgcaagggattgccga

SEQ ID NO: 181875 - DNA, 25 bp, E. coli
tgactaccgctgaactgccagtgat

SEQ ID NO: 181876 - DNA, 25 bp, E. coli
tgactaccgctgtactgccagtgat

SEQ ID NO: 181877 - DNA, 25 bp, E. coli
tcgcattcggtaaactttctaatag

SEQ ID NO: 181878 - DNA, 25 bp, E. coli
tcgcattcggtatactttctaatag

SEQ ID NO: 181879 - DNA, 25 bp, E. coli
gaactgccagtgtttgcttcgctag

SEQ ID NO: 181880 - DNA, 25 bp, E. coli
gaactgccagtgattgcttcgctag

SEQ ID NO: 181881 - DNA, 25 bp, E. coli
cgctgaactgcctgtgattgcttcg

SEQ ID NO: 181882 - DNA, 25 bp, E. coli
cgctgaactgccagtgattgcttcg

SEQ ID NO: 181883 - DNA, 25 bp, E. coli
ctgccagtgattgcttcgctaggga

SEQ ID NO: 181884 - DNA, 25 bp, E. coli
ctttctaatagtaggttctgcggcc

SEQ ID NO: 181885 - DNA, 25 bp, E. coli
ctttctaatagttggttctgcggcc

SEQ ID NO: 181886 - DNA, 25 bp, E. coli
ctgccagtgattccttcgctaggga

SEQ ID NO: 181887 - DNA, 25 bp, E. coli
gttcgcattcggaaaactttctaat

SEQ ID NO: 181888 - DNA, 25 bp, E. coli
gttcgcattcggtaaactttctaat

SEQ ID NO: 181889 - DNA, 25 bp, E. coli
attctggacgttctcgcccgctaca

SEQ ID NO: 181890 - DNA, 25 bp, E. coli
atgaaaataaaccagcccgccgttg

SEQ ID NO: 181891 - DNA, 25 bp, E. coli
atgaaaataaacgagcccgccgttg

SEQ ID NO: 181892 - DNA, 25 bp, E. coli
attctggacgttgtcgcccgctaca

SEQ ID NO: 181893 - DNA, 25 bp, E. coli
aaacagtttggccatgcaattcgca

SEQ ID NO: 181894 - DNA, 25 bp, E. coli
aaacagtttggcgatgcaattcgca

SEQ ID NO: 181895 - DNA, 25 bp, E. coli
tagcagcgttgacaaacagtttggc

SEQ ID NO: 181896 - DNA, 25 bp, E. coli
tagcagcgttgagaaacagtttggc

SEQ ID NO: 181897 - DNA, 25 bp, E. coli
ttcgcaccaccaatctggacgttct

SEQ ID NO: 181898 - DNA, 25 bp, E. coli
ttcgcaccaccattctggacgttct

SEQ ID NO: 181899 - DNA, 25 bp, E. coli
tgcaaatcaatagcagcgttgagaa

SEQ ID NO: 181900 - DNA, 25 bp, E. coli
tgcaaatcaataccagcgttgagaa

SEQ ID NO: 181901 - DNA, 25 bp, E. coli
tcgccccactcgttacgcaggatat

SEQ ID NO: 181902 - DNA, 25 bp, E. coli
tcgccccactcgatacgcaggatat

SEQ ID NO: 181903 - DNA, 25 bp, E. coli
gccgttgcaggctcccttgagtctg

SEQ ID NO: 181904 - DNA, 25 bp, E. coli
gccgttgcaggcacccttgagtctg

SEQ ID NO: 181905 - DNA, 25 bp, E. coli
ggatatcgacctgcaaatcaatagc

SEQ ID NO: 181906 - DNA, 25 bp, E. coli
ggatatcgacctccaaatcaatagc

SEQ ID NO: 181907 - DNA, 25 bp, E. coli
gatgtgatgatacgcatcgccccac

SEQ ID NO: 181908 - DNA, 25 bp, E. coli
gatgcaattcgcaccaccattctgg

SEQ ID NO: 181909 - DNA, 25 bp, E. coli
gatgcaattcgctccaccattctgg

SEQ ID NO: 181910 - DNA, 25 bp, E. coli
gatgtgatgataggcatcgccccac

SEQ ID NO: 181911 - DNA, 25 bp, E. coli
aagagcagacggagatgccggacga

SEQ ID NO: 181912 - DNA, 25 bp, E. coli
aagagcagacggtgatgccggacga

SEQ ID NO: 181913 - DNA, 25 bp, E. coli
actggacgctcatttttccgggctg

SEQ ID NO: 181914 - DNA, 25 bp, E. coli
atttcagtctgcatgctccagcgtg

SEQ ID NO: 181915 - DNA, 25 bp, E. coli
atttcagtctgcttgctccagcgtg

SEQ ID NO: 181916 - DNA, 25 bp, E. coli
actggacgctcaattttccgggctg

SEQ ID NO: 181917 - DNA, 25 bp, E. coli
tttcaggatacccaactggacgctc

SEQ ID NO: 181918 - DNA, 25 bp, E. coli
tttcaggataccgaactggacgctc

SEQ ID NO: 181919 - DNA, 25 bp, E. coli
tgtcagcgaggaagatgttgcatta

SEQ ID NO: 181920 - DNA, 25 bp, E. coli
tgtcagcgaggatgatgttgcatta

SEQ ID NO: 181921 - DNA, 25 bp, E. coli
tgccggacgaggaagaaatgctgat

SEQ ID NO: 181922 - DNA, 25 bp, E. coli
tgccggacgaggtagaaatgctgat

SEQ ID NO: 181923 - DNA, 25 bp, E. coli
ctccagcgtgtgaggaagagcagac

SEQ ID NO: 181924 - DNA, 25 bp, E. coli
ctccagcgtgtgtggaagagcagac

SEQ ID NO: 181925 - DNA, 25 bp, E. coli
gatatttcacctactgcggatgtgg

SEQ ID NO: 181926 - DNA, 25 bp, E. coli
gatatttcaccttctgcggatgtgg

SEQ ID NO: 181927 - DNA, 25 bp, E. coli
tcaccttctgcggatgtggtggatg

SEQ ID NO: 181928 - DNA, 25 bp, E. coli
tcaccttctgcgcatgtggtggatg

SEQ ID NO: 181929 - DNA, 25 bp, E. coli
gacgaggaagaattgctgatgcaga

SEQ ID NO: 181930 - DNA, 25 bp, E. coli
gagggcgcgatatttcaccttctgc

SEQ ID NO: 181931 - DNA, 25 bp, E. coli
gacgaggaagaaatgctgatgcaga

SEQ ID NO: 181932 - DNA, 25 bp, E. coli
gagggcgcgataattcaccttctgc

SEQ ID NO: 181933 - DNA, 25 bp, E. coli
caatcttgggattgtagagatcccg

SEQ ID NO: 181934 - DNA, 25 bp, E. coli
caatcttgggatagtagagatcccg

SEQ ID NO: 181935 - DNA, 25 bp, E. coli
aatcttgggattctagagatcccgg

SEQ ID NO: 181936 - DNA, 25 bp, E. coli
aatcttgggattgtagagatcccgg

SEQ ID NO: 181937 - DNA, 25 bp, E. coli
cttgggattgtacagatcccggtgc

SEQ ID NO: 181938 - DNA, 25 bp, E. coli
cttgggattgtagagatcccggtgc

SEQ ID NO: 181939 - DNA, 25 bp, E. coli
atcccggtgcagttgcagattgaaa

SEQ ID NO: 181940 - DNA, 25 bp, E. coli
atcccggtgcagatgcagattgaaa

SEQ ID NO: 181941 - DNA, 25 bp, E. coli
actatcaatcttgggattgtagaga

SEQ ID NO: 181942 - DNA, 25 bp, E. coli
actatcaatcttcggattgtagaga

SEQ ID NO: 181943 - DNA, 25 bp, E. coli
ttgggattgtagtgatcccggtgca

SEQ ID NO: 181944 - DNA, 25 bp, E. coli
ttgggattgtagagatcccggtgca

SEQ ID NO: 181945 - DNA, 25 bp, E. coli
tatcaatcttggcattgtagagatc

SEQ ID NO: 181946 - DNA, 25 bp, E. coli
tatcaatcttgggattgtagagatc

SEQ ID NO: 181947 - DNA, 25 bp, E. coli
tgcagattgaaatcttcgacgttag

SEQ ID NO: 181948 - DNA, 25 bp, E. coli
tgcagattgaaaacttcgacgttag

SEQ ID NO: 181949 - DNA, 25 bp, E. coli
tcttgggattgtagagatcccggtg

SEQ ID NO: 181950 - DNA, 25 bp, E. coli
tcttgggattgttgagatcccggtg

SEQ ID NO: 181951 - DNA, 25 bp, E. coli
gcagattgaaaagttcgacgttagc

SEQ ID NO: 181952 - DNA, 25 bp, E. coli
gcagattgaaaacttcgacgttagc

SEQ ID NO: 181953 - DNA, 25 bp, E. coli
tcaatcttgggaatgtagagatccc

SEQ ID NO: 181954 - DNA, 25 bp, E. coli
tcaatcttgggattgtagagatccc

SEQ ID NO: 181955 - DNA, 25 bp, E. coli
aatgcagaagaatgccatttgctaa

SEQ ID NO: 181956 - DNA, 25 bp, E. coli
aatgcagaagaaagccatttgctaa

SEQ ID NO: 181957 - DNA, 25 bp, E. coli
taaataataggctgcacagagggcg

SEQ ID NO: 181958 - DNA, 25 bp, E. coli
taaataataggcagcacagagggcg

SEQ ID NO: 181959 - DNA, 25 bp, E. coli
aaacgacaccgcgataaataatagg

SEQ ID NO: 181960 - DNA, 25 bp, E. coli
aaaacattcattacgctgatgtggg

SEQ ID NO: 181961 - DNA, 25 bp, E. coli
aaacgacaccgccataaataatagg

SEQ ID NO: 181962 - DNA, 25 bp, E. coli
aaaacattcatttcgctgatgtggg

SEQ ID NO: 181963 - DNA, 25 bp, E. coli
tgatcttcaagccaaacgacaccgc

SEQ ID NO: 181964 - DNA, 25 bp, E. coli
tgtcctgcgcgttgccccgcatttt

SEQ ID NO: 181965 - DNA, 25 bp, E. coli
tgatcttcaagcgaaacgacaccgc

SEQ ID NO: 181966 - DNA, 25 bp, E. coli
tgtcctgcgcgtagccccgcatttt

SEQ ID NO: 181967 - DNA, 25 bp, E. coli
gccctctgtttgatcaaaacattca

SEQ ID NO: 181968 - DNA, 25 bp, E. coli
gccctctgtttgttcaaaacattca

SEQ ID NO: 181969 - DNA, 25 bp, E. coli
tgccccgcatttatacttttttatg

SEQ ID NO: 181970 - DNA, 25 bp, E. coli
tgccccgcatttttacttttttatg

SEQ ID NO: 181971 - DNA, 25 bp, E. coli
gctgctcgcatcatttcttcctctg

SEQ ID NO: 181972 - DNA, 25 bp, E. coli
gctgctcgcatcttttcttcctctg

SEQ ID NO: 181973 - DNA, 25 bp, E. coli
cgtcgagagctgtcctgcgcgttgc

SEQ ID NO: 181974 - DNA, 25 bp, E. coli
cgtcgagagctgacctgcgcgttgc

SEQ ID NO: 181975 - DNA, 25 bp, E. coli
ggacacaaaagccaaaatgcagaag

SEQ ID NO: 181976 - DNA, 25 bp, E. coli
ggacacaaaagcgaaaatgcagaag

SEQ ID NO: 181977 - DNA, 25 bp, E. coli
cactggcgtggttaagggtatcgat

SEQ ID NO: 181978 - DNA, 25 bp, E. coli
cactggcgtggtaaagggtatcgat

SEQ ID NO: 181979 - DNA, 25 bp, E. coli
taaagggtatcgatctggaaagcaa

SEQ ID NO: 181980 - DNA, 25 bp, E. coli
taaagggtatcgttctggaaagcaa

SEQ ID NO: 181981 - DNA, 25 bp, E. coli
aaagggtatcgatctggaaagcaaa

SEQ ID NO: 181982 - DNA, 25 bp, E. coli
actggcgtggtatagggtatcgatc

SEQ ID NO: 181983 - DNA, 25 bp, E. coli
aaagggtatcgaactggaaagcaaa

SEQ ID NO: 181984 - DNA, 25 bp, E. coli
actggcgtggtaaagggtatcgatc

SEQ ID NO: 181985 - DNA, 25 bp, E. coli
cgtggtaaagggtatcgatctggaa

SEQ ID NO: 181986 - DNA, 25 bp, E. coli
ctggcgtggtaatgggtatcgatct

SEQ ID NO: 181987 - DNA, 25 bp, E. coli
cgtggtaaagggaatcgatctggaa

SEQ ID NO: 181988 - DNA, 25 bp, E. coli
ctggcgtggtaaagggtatcgatct

SEQ ID NO: 181989 - DNA, 25 bp, E. coli
gtaaagggtatccatctggaaagca

SEQ ID NO: 181990 - DNA, 25 bp, E. coli
gtaaagggtatcgatctggaaagca

SEQ ID NO: 181991 - DNA, 25 bp, E. coli
gtggtaaagggtatcgatctggaaa

SEQ ID NO: 181992 - DNA, 25 bp, E. coli
gtggtaaagggtttcgatctggaaa

SEQ ID NO: 181993 - DNA, 25 bp, E. coli
ggtaaagggtatcgatctggaaagc

SEQ ID NO: 181994 - DNA, 25 bp, E. coli
ggtaaagggtatggatctggaaagc

SEQ ID NO: 181995 - DNA, 25 bp, E. coli
tggcgtggtaaagggtatcgatctg

SEQ ID NO: 181996 - DNA, 25 bp, E. coli
tggcgtggtaaacggtatcgatctg

SEQ ID NO: 181997 - DNA, 25 bp, E. coli
tggtaaagggtaacgatctggaaag

SEQ ID NO: 181998 - DNA, 25 bp, E. coli
tggtaaagggtatcgatctggaaag

SEQ ID NO: 181999 - DNA, 25 bp, E. coli
aatcgggtgcacaatcttgcctggg

SEQ ID NO: 182000 - DNA, 25 bp, E. coli
aatcgggtgcactatcttgcctggg

SEQ ID NO: 182001 - DNA, 25 bp, E. coli
tacggttgtcagtgcagatccagaa

SEQ ID NO: 182002 - DNA, 25 bp, E. coli
tacggttgtcagagcagatccagaa

SEQ ID NO: 182003 - DNA, 25 bp, E. coli
agaatgatttatagctgcgggcgac

SEQ ID NO: 182004 - DNA, 25 bp, E. coli
agaatgatttattgctgcgggcgac

SEQ ID NO: 182005 - DNA, 25 bp, E. coli
aacttatacctgactgatggcgcgc

SEQ ID NO: 182006 - DNA, 25 bp, E. coli
aacttatacctgtctgatggcgcgc

SEQ ID NO: 182007 - DNA, 25 bp, E. coli
ttgttacagatgttacccgcgccgt

SEQ ID NO: 182008 - DNA, 25 bp, E. coli
ttgttacagatgatacccgcgccgt

SEQ ID NO: 182009 - DNA, 25 bp, E. coli
cctcgagcggctcaaagataagctg

SEQ ID NO: 182010 - DNA, 25 bp, E. coli
cctcgagcggctgaaagataagctg

SEQ ID NO: 182011 - DNA, 25 bp, E. coli
cgttctcaataagcaagcgggcgta

SEQ ID NO: 182012 - DNA, 25 bp, E. coli
cgttctcaataaccaagcgggcgta

SEQ ID NO: 182013 - DNA, 25 bp, E. coli
cttcagcttgaacggcaaacggcgt

SEQ ID NO: 182014 - DNA, 25 bp, E. coli
cttgcctgggaacaagacgctcgct

SEQ ID NO: 182015 - DNA, 25 bp, E. coli
cttgcctgggaagaagacgctcgct

SEQ ID NO: 182016 - DNA, 25 bp, E. coli
cttcagcttgaagggcaaacggcgt

SEQ ID NO: 182017 - DNA, 25 bp, E. coli
ggttcgtcgttttcagcagcagctg

SEQ ID NO: 182018 - DNA, 25 bp, E. coli
ggttcgtcgtttacagcagcagctg

SEQ ID NO: 182019 - DNA, 25 bp, E. coli
taagctgggtaatcgctctaacgcc

SEQ ID NO: 182020 - DNA, 25 bp, E. coli
taagctgggtaaacgctctaacgcc

SEQ ID NO: 182021 - DNA, 25 bp, E. coli
agccgttcggccatgcgctccgaag

SEQ ID NO: 182022 - DNA, 25 bp, E. coli
agccgttcggccttgcgctccgaag

SEQ ID NO: 182023 - DNA, 25 bp, E. coli
aacaccgtaggtgtccgtggcacga

SEQ ID NO: 182024 - DNA, 25 bp, E. coli
aacaccgtaggtctccgtggcacga

SEQ ID NO: 182025 - DNA, 25 bp, E. coli
ttttcgctggtgcttaacaccgtag

SEQ ID NO: 182026 - DNA, 25 bp, E. coli
ttttcgctggtggttaacaccgtag

SEQ ID NO: 182027 - DNA, 25 bp, E. coli
tgttcgataagaacgactggcaggg

SEQ ID NO: 182028 - DNA, 25 bp, E. coli
tgttcgataagatcgactggcaggg

SEQ ID NO: 182029 - DNA, 25 bp, E. coli
tgctgccagcggaaactttcttttt

SEQ ID NO: 182030 - DNA, 25 bp, E. coli
tgctgccagcggtaactttcttttt

SEQ ID NO: 182031 - DNA, 25 bp, E. coli
tcttcacagggacgttcttttcgct

SEQ ID NO: 182032 - DNA, 25 bp, E. coli
tcttcacagggaggttcttttcgct

SEQ ID NO: 182033 - DNA, 25 bp, E. coli
ccagcactgctgttcgataagatcg

SEQ ID NO: 182034 - DNA, 25 bp, E. coli
ccagcactgctgatcgataagatcg

SEQ ID NO: 182035 - DNA, 25 bp, E. coli
gcggtaactttctttttcttcacag

SEQ ID NO: 182036 - DNA, 25 bp, E. coli
gcggtaactttcattttcttcacag

SEQ ID NO: 182037 - DNA, 25 bp, E. coli
ggacgttcttttggctggtgcttaa

SEQ ID NO: 182038 - DNA, 25 bp, E. coli
ggacgttcttttcgctggtgcttaa

SEQ ID NO: 182039 - DNA, 25 bp, E. coli
gtggcacgactcgagcactgctgtt

SEQ ID NO: 182040 - DNA, 25 bp, E. coli
gtggcacgactccagcactgctgtt

SEQ ID NO: 182041 - DNA, 25 bp, E. coli
ggcttcccgcgggtgactttataat

SEQ ID NO: 182042 - DNA, 25 bp, E. coli
ggcttcccgcggctgactttataat

SEQ ID NO: 182043 - DNA, 25 bp, E. coli
cagaactggcgcagcctgttgccca

SEQ ID NO: 182044 - DNA, 25 bp, E. coli
cagaactggcgctgcctgttgccca

SEQ ID NO: 182045 - DNA, 25 bp, E. coli
tactcaaccccagtcagtgctgaag

SEQ ID NO: 182046 - DNA, 25 bp, E. coli
tactgtacgaacagggacatggcga

SEQ ID NO: 182047 - DNA, 25 bp, E. coli
tactgtacgaactgggacatggcga

SEQ ID NO: 182048 - DNA, 25 bp, E. coli
tactcaaccccactcagtgctgaag

SEQ ID NO: 182049 - DNA, 25 bp, E. coli
aaactcgaacacaactggagccagg

SEQ ID NO: 182050 - DNA, 25 bp, E. coli
aaactcgaacactactggagccagg

SEQ ID NO: 182051 - DNA, 25 bp, E. coli
tgttgctaatgaccccacagcggtg

SEQ ID NO: 182052 - DNA, 25 bp, E. coli
tgttgctaatgagcccacagcggtg

SEQ ID NO: 182053 - DNA, 25 bp, E. coli
tgcaacgtgtagctaaataccataa

SEQ ID NO: 182054 - DNA, 25 bp, E. coli
tgcaacgtgtaggtaaataccataa

SEQ ID NO: 182055 - DNA, 25 bp, E. coli
ccacagcggtgacaaaactcgaaca

SEQ ID NO: 182056 - DNA, 25 bp, E. coli
ccacagcggtgagaaaactcgaaca

SEQ ID NO: 182057 - DNA, 25 bp, E. coli
gcgaactcatttacattctaaggag

SEQ ID NO: 182058 - DNA, 25 bp, E. coli
gcgaactcattttcattctaaggag

SEQ ID NO: 182059 - DNA, 25 bp, E. coli
gaaatagccaatgagttggtaggcc

SEQ ID NO: 182060 - DNA, 25 bp, E. coli
gaaatagccaatcagttggtaggcc

SEQ ID NO: 182061 - DNA, 25 bp, E. coli
ggtaggccttgattgcccgcgaact

SEQ ID NO: 182062 - DNA, 25 bp, E. coli
ggtaggccttgaatgcccgcgaact

SEQ ID NO: 182063 - DNA, 25 bp, E. coli
gagcagttgcttaaacagggtccaa

SEQ ID NO: 182064 - DNA, 25 bp, E. coli
gagcagttgctttaacagggtccaa

SEQ ID NO: 182065 - DNA, 25 bp, E. coli
tgcgaaaaaattgccatcctgctgg

SEQ ID NO: 182066 - DNA, 25 bp, E. coli
tgaaaaggcattagagcgctccggt

SEQ ID NO: 182067 - DNA, 25 bp, E. coli
tgaaaaggcatttgagcgctccggt

SEQ ID NO: 182068 - DNA, 25 bp, E. coli
tgaaaaggctgctacccagggaaga

SEQ ID NO: 182069 - DNA, 25 bp, E. coli
tgaaaaggctgcaacccagggaaga

SEQ ID NO: 182070 - DNA, 25 bp, E. coli
tccggtaggaaaacacgaagagccc

SEQ ID NO: 182071 - DNA, 25 bp, E. coli
tccggtaggaaatcacgaagagccc

SEQ ID NO: 182072 - DNA, 25 bp, E. coli
tgcgaaaaaattcccatcctgctgg

SEQ ID NO: 182073 - DNA, 25 bp, E. coli
tctgaactgaatcaaaacctggtgc

SEQ ID NO: 182074 - DNA, 25 bp, E. coli
tctgaactgaatgaaaacctggtgc

SEQ ID NO: 182075 - DNA, 25 bp, E. coli
gccaaagtgttccatgcagagcgct

SEQ ID NO: 182076 - DNA, 25 bp, E. coli
gccaaagtgttcgatgcagagcgct

SEQ ID NO: 182077 - DNA, 25 bp, E. coli
gaagagccctgttggtacgtgagcc

SEQ ID NO: 182078 - DNA, 25 bp, E. coli
gaagagccctgtaggtacgtgagcc

SEQ ID NO: 182079 - DNA, 25 bp, E. coli
gaagcacgaactgatccccggattt

SEQ ID NO: 182080 - DNA, 25 bp, E. coli
gaagcacgaactcatccccggattt

SEQ ID NO: 182081 - DNA, 25 bp, E. coli
cattctaatggtgcactcggcgctg

SEQ ID NO: 182082 - DNA, 25 bp, E. coli
cattctaatggtccactcggcgctg

SEQ ID NO: 182083 - DNA, 25 bp, E. coli
ggatatctacctctaccaccggaag

SEQ ID NO: 182084 - DNA, 25 bp, E. coli
ggatatctacctgtaccaccggaag

SEQ ID NO: 182085 - DNA, 25 bp, E. coli
ggcgcattttgatcgggcaccttac

SEQ ID NO: 182086 - DNA, 25 bp, E. coli
ggcgcattttgaacgggcaccttac

SEQ ID NO: 182087 - DNA, 25 bp, E. coli
catttacctcataaacactatgggc

SEQ ID NO: 182088 - DNA, 25 bp, E. coli
catttacctcattaacactatgggc

SEQ ID NO: 182089 - DNA, 25 bp, E. coli
tacaccatgatcatgctgatgctga

SEQ ID NO: 182090 - DNA, 25 bp, E. coli
tacaccatgatcttgctgatgctga

SEQ ID NO: 182091 - DNA, 25 bp, E. coli
acgcgtagcgcgttacaccatgatc

SEQ ID NO: 182092 - DNA, 25 bp, E. coli
acgaacaacgttgtgggcaccagcc

SEQ ID NO: 182093 - DNA, 25 bp, E. coli
acgaacaacgttctgggcaccagcc

SEQ ID NO: 182094 - DNA, 25 bp, E. coli
acgcgtagcgcgatacaccatgatc

SEQ ID NO: 182095 - DNA, 25 bp, E. coli
acactatgggcaatggcggcctgca

SEQ ID NO: 182096 - DNA, 25 bp, E. coli
acactatgggcattggcggcctgca

SEQ ID NO: 182097 - DNA, 25 bp, E. coli
tatgcgggcattacggatccacaac

SEQ ID NO: 182098 - DNA, 25 bp, E. coli
tatgcgggcatttcggatccacaac

SEQ ID NO: 182099 - DNA, 25 bp, E. coli
ttcgccggagcgttggacgcatgct

SEQ ID NO: 182100 - DNA, 25 bp, E. coli
ttcgccggagcgatggacgcatgct

SEQ ID NO: 182101 - DNA, 25 bp, E. coli
tgatgctgacagaattcggagcgtg

SEQ ID NO: 182102 - DNA, 25 bp, E. coli
tgatgctgacagtattcggagcgtg

SEQ ID NO: 182103 - DNA, 25 bp, E. coli
gagcgttggacgcatgctattacgc

SEQ ID NO: 182104 - DNA, 25 bp, E. coli
gagcgttggacggatgctattacgc

SEQ ID NO: 182105 - DNA, 25 bp, E. coli
ggatccacaacccacgaacaacgtt

SEQ ID NO: 182106 - DNA, 25 bp, E. coli
ggatccacaaccgacgaacaacgtt

SEQ ID NO: 182107 - DNA, 25 bp, E. coli
gaccattttgccgatctatagcgcg

SEQ ID NO: 182108 - DNA, 25 bp, E. coli
gaccattttgcccatctatagcgcg

SEQ ID NO: 182109 - DNA, 25 bp, E. coli
tacagaagcatgtgacggtggatga

SEQ ID NO: 182110 - DNA, 25 bp, E. coli
tacagaagcatgagacggtggatga

SEQ ID NO: 182111 - DNA, 25 bp, E. coli
tatgatccggatctactgcagcagg

SEQ ID NO: 182112 - DNA, 25 bp, E. coli
tatgatccggatgtactgcagcagg

SEQ ID NO: 182113 - DNA, 25 bp, E. coli
tattacagaagcttgtgacggtgga

SEQ ID NO: 182114 - DNA, 25 bp, E. coli
tattacagaagcatgtgacggtgga

SEQ ID NO: 182115 - DNA, 25 bp, E. coli
tgtcggcggtattacagaagcatgt

SEQ ID NO: 182116 - DNA, 25 bp, E. coli
tgtcggcggtataacagaagcatgt

SEQ ID NO: 182117 - DNA, 25 bp, E. coli
tgatccggatgtactgcagcaggcg

SEQ ID NO: 182118 - DNA, 25 bp, E. coli
tgatccggatgttctgcagcaggcg

SEQ ID NO: 182119 - DNA, 25 bp, E. coli
tccggttctgcacgcgatggtggat

SEQ ID NO: 182120 - DNA, 25 bp, E. coli
tccctgtcggcggtattacagaagc

SEQ ID NO: 182121 - DNA, 25 bp, E. coli
tccctgtcggcgctattacagaagc

SEQ ID NO: 182122 - DNA, 25 bp, E. coli
tccggttctgcaggcgatggtggat

SEQ ID NO: 182123 - DNA, 25 bp, E. coli
tctgcaggcgatggtggatgacgct

SEQ ID NO: 182124 - DNA, 25 bp, E. coli
tctgcaggcgatcgtggatgacgct

SEQ ID NO: 182125 - DNA, 25 bp, E. coli
cggcggtattactgaagcatgtgac

SEQ ID NO: 182126 - DNA, 25 bp, E. coli
cggcggtattacagaagcatgtgac

SEQ ID NO: 182127 - DNA, 25 bp, E. coli
cattccggtaccccgtgatggtcgt

SEQ ID NO: 182128 - DNA, 25 bp, E. coli
cggtattacagaagcatgtgacggt

SEQ ID NO: 182129 - DNA, 25 bp, E. coli
cattccggtaccgcgtgatggtcgt

SEQ ID NO: 182130 - DNA, 25 bp, E. coli
cggtattacagatgcatgtgacggt

SEQ ID NO: 182131 - DNA, 25 bp, E. coli
caattacgccgcattaccggaacac

SEQ ID NO: 182132 - DNA, 25 bp, E. coli
caattacgccgctttaccggaacac

SEQ ID NO: 182133 - DNA, 25 bp, E. coli
gcattaccggaagaccgtttgaagc

SEQ ID NO: 182134 - DNA, 25 bp, E. coli
cattaccggaacaccgtttgaagca

SEQ ID NO: 182135 - DNA, 25 bp, E. coli
cattaccggaactccgtttgaagca

SEQ ID NO: 182136 - DNA, 25 bp, E. coli
gcattaccggaacaccgtttgaagc

SEQ ID NO: 182137 - DNA, 25 bp, E. coli
tacgccgcattaccggaacaccgtt

SEQ ID NO: 182138 - DNA, 25 bp, E. coli
attacgccgcattaccggaacaccg

SEQ ID NO: 182139 - DNA, 25 bp, E. coli
attacgccgcataaccggaacaccg

SEQ ID NO: 182140 - DNA, 25 bp, E. coli
tacgccgcattagcggaacaccgtt

SEQ ID NO: 182141 - DNA, 25 bp, E. coli
ttacgccgcatttccggaacaccgt

SEQ ID NO: 182142 - DNA, 25 bp, E. coli
ttacgccgcattaccggaacaccgt

SEQ ID NO: 182143 - DNA, 25 bp, E. coli
gccgcattaccgcaacaccgtttga

SEQ ID NO: 182144 - DNA, 25 bp, E. coli
gccgcattaccggaacaccgtttga

SEQ ID NO: 182145 - DNA, 25 bp, E. coli
gcaattacgccggattaccggaaca

SEQ ID NO: 182146 - DNA, 25 bp, E. coli
gcaattacgccgcattaccggaaca

SEQ ID NO: 182147 - DNA, 25 bp, E. coli
cgcattaccggatcaccgtttgaag

SEQ ID NO: 182148 - DNA, 25 bp, E. coli
cgcattaccggaacaccgtttgaag

SEQ ID NO: 182149 - DNA, 25 bp, E. coli
aagcctgtagctttcatatggaaaa

SEQ ID NO: 182150 - DNA, 25 bp, E. coli
aagcctgtagctatcatatggaaaa

SEQ ID NO: 182151 - DNA, 25 bp, E. coli
caggcgcaacataaacctcgtctgg

SEQ ID NO: 182152 - DNA, 25 bp, E. coli
caggcgcaacattaacctcgtctgg

SEQ ID NO: 182153 - DNA, 25 bp, E. coli
ctcgtctggtggagtttcacgggct

SEQ ID NO: 182154 - DNA, 25 bp, E. coli
ctcgtctggtggtgtttcacgggct

SEQ ID NO: 182155 - DNA, 25 bp, E. coli
atgctgaaccggttcgccaaaccga

SEQ ID NO: 182156 - DNA, 25 bp, E. coli
atgctgaaccggatcgccaaaccga

SEQ ID NO: 182157 - DNA, 25 bp, E. coli
aacctcgtctggtggtgtttcacgg

SEQ ID NO: 182158 - DNA, 25 bp, E. coli
aacctcgtctggaggtgtttcacgg

SEQ ID NO: 182159 - DNA, 25 bp, E. coli
tttatgctggaaccctgtagctatc

SEQ ID NO: 182160 - DNA, 25 bp, E. coli
tttatgctggaagcctgtagctatc

SEQ ID NO: 182161 - DNA, 25 bp, E. coli
tgcacaggcgcaacataaacctcgt

SEQ ID NO: 182162 - DNA, 25 bp, E. coli
tgcacaggcgcatcataaacctcgt

SEQ ID NO: 182163 - DNA, 25 bp, E. coli
ccggatcgccaatccgacgctgatt

SEQ ID NO: 182164 - DNA, 25 bp, E. coli
gccgatgctgaaccggatcgccaaa

SEQ ID NO: 182165 - DNA, 25 bp, E. coli
ccggatcgccaaaccgacgctgatt

SEQ ID NO: 182166 - DNA, 25 bp, E. coli
gccgatgctgaagcggatcgccaaa

SEQ ID NO: 182167 - DNA, 25 bp, E. coli
gcaacataaacctcgtctggtggtg

SEQ ID NO: 182168 - DNA, 25 bp, E. coli
gcaacataaaccacgtctggtggtg

SEQ ID NO: 182169 - DNA, 25 bp, E. coli
tggaagcctgtagctatcatatgga

SEQ ID NO: 182170 - DNA, 25 bp, E. coli
tggaagcctgtacctatcatatgga

SEQ ID NO: 182171 - DNA, 25 bp, E. coli
caacaactgggccttgatcaaccgg

SEQ ID NO: 182172 - DNA, 25 bp, E. coli
caacaactgggcgttgatcaaccgg

SEQ ID NO: 182173 - DNA, 25 bp, E. coli
taaagtgggcctgacacatccgaaa

SEQ ID NO: 182174 - DNA, 25 bp, E. coli
taaagtgggcctcacacatccgaaa

SEQ ID NO: 182175 - DNA, 25 bp, E. coli
aaaatggccagtgtgggtgaaccgc

SEQ ID NO: 182176 - DNA, 25 bp, E. coli
aaaatggccagtctgggtgaaccgc

SEQ ID NO: 182177 - DNA, 25 bp, E. coli
gccatgaagatgacgcgtaataacg

SEQ ID NO: 182178 - DNA, 25 bp, E. coli
gccatgaagatgtcgcgtaataacg

SEQ ID NO: 182179 - DNA, 25 bp, E. coli
gaatgcctgggagatccgcttaatg

SEQ ID NO: 182180 - DNA, 25 bp, E. coli
gaagcatactcttgagcaactggcg

SEQ ID NO: 182181 - DNA, 25 bp, E. coli
gaatgcgggcgaacgttttgaagcc

SEQ ID NO: 182182 - DNA, 25 bp, E. coli
gaagcatactctagagcaactggcg

SEQ ID NO: 182183 - DNA, 25 bp, E. coli
gaatgcctgggacatccgcttaatg

SEQ ID NO: 182184 - DNA, 25 bp, E. coli
gaatgcgggcgatcgttttgaagcc

SEQ ID NO: 182185 - DNA, 25 bp, E. coli
cattgaatgggtacttccggcgctg

SEQ ID NO: 182186 - DNA, 25 bp, E. coli
cattgaatgggttcttccggcgctg

SEQ ID NO: 182187 - DNA, 25 bp, E. coli
gattcagtttgtggataccgtggca

SEQ ID NO: 182188 - DNA, 25 bp, E. coli
gattcagtttgtcgataccgtggca

SEQ ID NO: 182189 - DNA, 25 bp, E. coli
ggttagacctgataaactgcgccat

SEQ ID NO: 182190 - DNA, 25 bp, E. coli
ggttagacctgaaaaactgcgccat

SEQ ID NO: 182191 - DNA, 25 bp, E. coli
gagatcgcactggtgttgaaccgcg

SEQ ID NO: 182192 - DNA, 25 bp, E. coli
gagatcgcactgctgttgaaccgcg

SEQ ID NO: 182193 - DNA, 25 bp, E. coli
cactcccctcggcagatgaactgga

SEQ ID NO: 182194 - DNA, 25 bp, E. coli
cactcccctcgggagatgaactgga

SEQ ID NO: 182195 - DNA, 25 bp, E. coli
cagcgagttattctggtcgttcagc

SEQ ID NO: 182196 - DNA, 25 bp, E. coli
cagcgagttattgtggtcgttcagc

SEQ ID NO: 182197 - DNA, 25 bp, E. coli
ttctcgggtacggtcagcaagatcc

SEQ ID NO: 182198 - DNA, 25 bp, E. coli
ttctcgggtacgctcagcaagatcc

SEQ ID NO: 182199 - DNA, 25 bp, E. coli
tccagcaggctttgctgaatgccga

SEQ ID NO: 182200 - DNA, 25 bp, E. coli
tccagcaggcttagctgaatgccga

SEQ ID NO: 182201 - DNA, 25 bp, E. coli
tctgaagggcagactgctgttgtca

SEQ ID NO: 182202 - DNA, 25 bp, E. coli
tctgaagggcagtctgctgttgtca

SEQ ID NO: 182203 - DNA, 25 bp, E. coli
tcggcctgattctgctgactatgca

SEQ ID NO: 182204 - DNA, 25 bp, E. coli
tcggcctgattcagctgactatgca

SEQ ID NO: 182205 - DNA, 25 bp, E. coli
gcgcataggcgacacggtaaccatt

SEQ ID NO: 182206 - DNA, 25 bp, E. coli
gcgtgacgcgctcttccagagcgat

SEQ ID NO: 182207 - DNA, 25 bp, E. coli
gcgtgacgcgctgttccagagcgat

SEQ ID NO: 182208 - DNA, 25 bp, E. coli
gcgcataggcgagacggtaaccatt

SEQ ID NO: 182209 - DNA, 25 bp, E. coli
gactatgcagctgaatatcagcgag

SEQ ID NO: 182210 - DNA, 25 bp, E. coli
gactatgcagctcaatatcagcgag

SEQ ID NO: 182211 - DNA, 25 bp, E. coli
cgtattcatcgcgttcctcgctggt

SEQ ID NO: 182212 - DNA, 25 bp, E. coli
cgtattcatcgccttcctcgctggt

SEQ ID NO: 182213 - DNA, 25 bp, E. coli
gagatcttcggttacttcgtttccg

SEQ ID NO: 182214 - DNA, 25 bp, E. coli
gagatcttcggtaacttcgtttccg

SEQ ID NO: 182215 - DNA, 25 bp, E. coli
caacgttattcgaggttcaatgcgt

SEQ ID NO: 182216 - DNA, 25 bp, E. coli
caacgttattcgtggttcaatgcgt

SEQ ID NO: 182217 - DNA, 25 bp, E. coli
tactagacaacgttattcgaggttc

SEQ ID NO: 182218 - DNA, 25 bp, E. coli
tactagacaacgatattcgaggttc

SEQ ID NO: 182219 - DNA, 25 bp, E. coli
taccaataagtatgggtattcaccg

SEQ ID NO: 182220 - DNA, 25 bp, E. coli
taccaataagtaagggtattcaccg

SEQ ID NO: 182221 - DNA, 25 bp, E. coli
tatatgaacaattaaacagcatgtc

SEQ ID NO: 182222 - DNA, 25 bp, E. coli
tatatgaacaataaaacagcatgtc

SEQ ID NO: 182223 - DNA, 25 bp, E. coli
gaagcaacttcagtataccaataag

SEQ ID NO: 182224 - DNA, 25 bp, E. coli
gaagcaacttcactataccaataag

SEQ ID NO: 182225 - DNA, 25 bp, E. coli
gcaattattttgtggaagtgtagaa

SEQ ID NO: 182226 - DNA, 25 bp, E. coli
gcaattattttgaggaagtgtagaa

SEQ ID NO: 182227 - DNA, 25 bp, E. coli
ccctaattcgtgatactagacaacg

SEQ ID NO: 182228 - DNA, 25 bp, E. coli
ccctaattcgtgttactagacaacg

SEQ ID NO: 182229 - DNA, 25 bp, E. coli
gggaaacagataaatttctgctttt

SEQ ID NO: 182230 - DNA, 25 bp, E. coli
gggaaacagatatatttctgctttt

SEQ ID NO: 182231 - DNA, 25 bp, E. coli
ggaagtgtagaaattttgtactcaa

SEQ ID NO: 182232 - DNA, 25 bp, E. coli
ggaagtgtagaatttttgtactcaa

SEQ ID NO: 182233 - DNA, 25 bp, E. coli
ggcgacccggcataaaaaatcactg

SEQ ID NO: 182234 - DNA, 25 bp, E. coli
ggcgacccggcaaaaaaaatcactg

SEQ ID NO: 182235 - DNA, 25 bp, E. coli
tcaatgcgttttaatctgaagcaac

SEQ ID NO: 182236 - DNA, 25 bp, E. coli
tcaatgcgtttttatctgaagcaac

SEQ ID NO: 182237 - DNA, 25 bp, E. coli
cacggcgctcactttaccagttggt

SEQ ID NO: 182238 - DNA, 25 bp, E. coli
cacggcgctcacattaccagttggt

SEQ ID NO: 182239 - DNA, 25 bp, E. coli
taccagttggtgataattatccgaa

SEQ ID NO: 182240 - DNA, 25 bp, E. coli
taccagttggtgttaattatccgaa

SEQ ID NO: 182241 - DNA, 25 bp, E. coli
tgtaaattccttccactgaatgcaa

SEQ ID NO: 182242 - DNA, 25 bp, E. coli
tgtaaattccttgcactgaatgcaa

SEQ ID NO: 182243 - DNA, 25 bp, E. coli
tccgaagctgaagtttgtaaattcc

SEQ ID NO: 182244 - DNA, 25 bp, E. coli
tccgaagctgaactttgtaaattcc

SEQ ID NO: 182245 - DNA, 25 bp, E. coli
tcatcaaacctaaaaatcaaacaaa

SEQ ID NO: 182246 - DNA, 25 bp, E. coli
tcatcaaacctataaatcaaacaaa

SEQ ID NO: 182247 - DNA, 25 bp, E. coli
gaatgcaacattgactctatttaag

SEQ ID NO: 182248 - DNA, 25 bp, E. coli
gaatgcaacattcactctatttaag

SEQ ID NO: 182249 - DNA, 25 bp, E. coli
ggtgataattatgcgaagctgaagt

SEQ ID NO: 182250 - DNA, 25 bp, E. coli
ggtgataattatccgaagctgaagt

SEQ ID NO: 182251 - DNA, 25 bp, E. coli
gggtataacctgaaaatgagtccaa

SEQ ID NO: 182252 - DNA, 25 bp, E. coli
gggaaatctccacggcgctcacttt

SEQ ID NO: 182253 - DNA, 25 bp, E. coli
gggtataacctgtaaatgagtccaa

SEQ ID NO: 182254 - DNA, 25 bp, E. coli
gggaaatctccagggcgctcacttt

SEQ ID NO: 182255 - DNA, 25 bp, E. coli
taacctgaaaatcagtccaataggg

SEQ ID NO: 182256 - DNA, 25 bp, E. coli
taagagaaatattcatcaaacctat

SEQ ID NO: 182257 - DNA, 25 bp, E. coli
taagagaaatatacatcaaacctat

SEQ ID NO: 182258 - DNA, 25 bp, E. coli
taacctgaaaatgagtccaataggg

SEQ ID NO: 182259 - DNA, 25 bp, E. coli
catggcggatctcgacaacttcgac

SEQ ID NO: 182260 - DNA, 25 bp, E. coli
catggcggatctggacaacttcgac

SEQ ID NO: 182261 - DNA, 25 bp, E. coli
taaattccacgggttgcaggatcag

SEQ ID NO: 182262 - DNA, 25 bp, E. coli
taaattccacggcttgcaggatcag

SEQ ID NO: 182263 - DNA, 25 bp, E. coli
tattctcggtaagacggaagtgacc

SEQ ID NO: 182264 - DNA, 25 bp, E. coli
tattctcggtaacacggaagtgacc

SEQ ID NO: 182265 - DNA, 25 bp, E. coli
ttaacaatgaactgaaaacgcgtcg

SEQ ID NO: 182266 - DNA, 25 bp, E. coli
ttaacaatgaacagaaaacgcgtcg

SEQ ID NO: 182267 - DNA, 25 bp, E. coli
tgaacatcgaagtcgccgttgctgg

SEQ ID NO: 182268 - DNA, 25 bp, E. coli
tgaacatcgaagacgccgttgctgg

SEQ ID NO: 182269 - DNA, 25 bp, E. coli
tcctggatcaggatgccgcgaaaga

SEQ ID NO: 182270 - DNA, 25 bp, E. coli
tcctggatcaggttgccgcgaaaga

SEQ ID NO: 182271 - DNA, 25 bp, E. coli
gccggaactgtagctcaagcgtctg

SEQ ID NO: 182272 - DNA, 25 bp, E. coli
gccggaactgtacctcaagcgtctg

SEQ ID NO: 182273 - DNA, 25 bp, E. coli
gcagttcaaaaaatgggacctcggc

SEQ ID NO: 182274 - DNA, 25 bp, E. coli
gcagttcaaaaattgggacctcggc

SEQ ID NO: 182275 - DNA, 25 bp, E. coli
gaaaaactgaccttgcgtgaagcga

SEQ ID NO: 182276 - DNA, 25 bp, E. coli
gaaaaactgaccatgcgtgaagcga

SEQ ID NO: 182277 - DNA, 25 bp, E. coli
gatgaatcccgcaacacctttaaag

SEQ ID NO: 182278 - DNA, 25 bp, E. coli
gacgcggtagtcgatcttaacaatg

SEQ ID NO: 182279 - DNA, 25 bp, E. coli
gacgcggtagtccatcttaacaatg

SEQ ID NO: 182280 - DNA, 25 bp, E. coli
gatgaatcccgctacacctttaaag

SEQ ID NO: 182281 - DNA, 25 bp, E. coli
taaaggagctgaacgtttacctgcg

SEQ ID NO: 182282 - DNA, 25 bp, E. coli
taaaggagctgatcgtttacctgcg

SEQ ID NO: 182283 - DNA, 25 bp, E. coli
tacgaagcggcaacactggaagatg

SEQ ID NO: 182284 - DNA, 25 bp, E. coli
aaaagcgttgctggacatcctggcc

SEQ ID NO: 182285 - DNA, 25 bp, E. coli
aaaagcgttgctcgacatcctggcc

SEQ ID NO: 182286 - DNA, 25 bp, E. coli
tacgaagcggcatcactggaagatg

SEQ ID NO: 182287 - DNA, 25 bp, E. coli
tccggaagatacgacgcaagatgac

SEQ ID NO: 182288 - DNA, 25 bp, E. coli
tccggaagataccacgcaagatgac

SEQ ID NO: 182289 - DNA, 25 bp, E. coli
gcacgtgagttgacccataagctgg

SEQ ID NO: 182290 - DNA, 25 bp, E. coli
gcacgtgagttgtcccataagctgg

SEQ ID NO: 182291 - DNA, 25 bp, E. coli
gaaattggcctctcccgtgaacgtg

SEQ ID NO: 182292 - DNA, 25 bp, E. coli
gaaattggcctcacccgtgaacgtg

SEQ ID NO: 182293 - DNA, 25 bp, E. coli
gattcaggttgatggcctgcgccgt

SEQ ID NO: 182294 - DNA, 25 bp, E. coli
gattcaggttgaaggcctgcgccgt

SEQ ID NO: 182295 - DNA, 25 bp, E. coli
ggctgaatatcgtagcgctgttccg

SEQ ID NO: 182296 - DNA, 25 bp, E. coli
ggctgaatatcgaagcgctgttccg

SEQ ID NO: 182297 - DNA, 25 bp, E. coli
taagccagttgaagacgtcagccgt

SEQ ID NO: 182298 - DNA, 25 bp, E. coli
tcaaatggctgttcgagctgaacgc

SEQ ID NO: 182299 - DNA, 25 bp, E. coli
tcaaatggctgtacgagctgaacgc

SEQ ID NO: 182300 - DNA, 25 bp, E. coli
taagccagttgatgacgtcagccgt

SEQ ID NO: 182301 - DNA, 25 bp, E. coli
gatcgcagagcaactggataagcca

SEQ ID NO: 182302 - DNA, 25 bp, E. coli
gatcgcagagcatctggataagcca

SEQ ID NO: 182303 - DNA, 25 bp, E. coli
aagggttttcatcccggataaggcg

SEQ ID NO: 182304 - DNA, 25 bp, E. coli
aagggttttcatgccggataaggcg

SEQ ID NO: 182305 - DNA, 25 bp, E. coli
tacacgttcactgcaatctattgga

SEQ ID NO: 182306 - DNA, 25 bp, E. coli
tacacgttcactccaatctattgga

SEQ ID NO: 182307 - DNA, 25 bp, E. coli
tacagcgccatttgaaactgatgac

SEQ ID NO: 182308 - DNA, 25 bp, E. coli
tacagcgccattagaaactgatgac

SEQ ID NO: 182309 - DNA, 25 bp, E. coli
ttgtctacaataagaaaatggcgcc

SEQ ID NO: 182310 - DNA, 25 bp, E. coli
ttgtctacaatatgaaaatgacgcc

SEQ ID NO: 182311 - DNA, 25 bp, E. coli
ttgtctacaataagaaaatgacgcc

SEQ ID NO: 182312 - DNA, 25 bp, E. coli
ttgtctacaatatgaaaatggcgcc

SEQ ID NO: 182313 - DNA, 25 bp, E. coli
gaaaatgacgccttttacagcgcca

SEQ ID NO: 182314 - DNA, 25 bp, E. coli
gaaaatggcgccatttacagcgcca

SEQ ID NO: 182315 - DNA, 25 bp, E. coli
gaaaatggcgccttttacagcgcca

SEQ ID NO: 182316 - DNA, 25 bp, E. coli
gaaaatgacgccatttacagcgcca

SEQ ID NO: 182317 - DNA, 25 bp, E. coli
gcgccattttcaccttaaagttcaa

SEQ ID NO: 182318 - DNA, 25 bp, E. coli
cgccatttagaactgatgacaaacg

SEQ ID NO: 182319 - DNA, 25 bp, E. coli
gcgccattttcagcttaaagttcaa

SEQ ID NO: 182320 - DNA, 25 bp, E. coli
cgccatttagaagtgatgacaaacg

SEQ ID NO: 182321 - DNA, 25 bp, E. coli
ggcactttataaagcgccatttaga

SEQ ID NO: 182322 - DNA, 25 bp, E. coli
ggcatgaacaaaccctacgttgtct

SEQ ID NO: 182323 - DNA, 25 bp, E. coli
ggcatgaacaaagcctacgttgtct

SEQ ID NO: 182324 - DNA, 25 bp, E. coli
ggcactttataatgcgccatttaga

SEQ ID NO: 182325 - DNA, 25 bp, E. coli
taaggttgcggggaaacgcaaaact

SEQ ID NO: 182326 - DNA, 25 bp, E. coli
caatatattgaaatcttgcggtttc

SEQ ID NO: 182327 - DNA, 25 bp, E. coli
taaggttgcgggcaaacgcaaaact

SEQ ID NO: 182328 - DNA, 25 bp, E. coli
caatatattgaattcttgcggtttc

SEQ ID NO: 182329 - DNA, 25 bp, E. coli
cactttgttagctatctcggggcaa

SEQ ID NO: 182330 - DNA, 25 bp, E. coli
cactttgttagcaatctcggggcaa

SEQ ID NO: 182331 - DNA, 25 bp, E. coli
taaatgtcccctaaggttgcgggca

SEQ ID NO: 182332 - DNA, 25 bp, E. coli
taaatgtccccttaggttgcgggca

SEQ ID NO: 182333 - DNA, 25 bp, E. coli
tgaattcttgcggtttcgtaggccg

SEQ ID NO: 182334 - DNA, 25 bp, E. coli
tgaattcttgcgctttcgtaggccg

SEQ ID NO: 182335 - DNA, 25 bp, E. coli
tcccctaaggttccgggcaaacgca

SEQ ID NO: 182336 - DNA, 25 bp, E. coli
tcccctaaggttgcgggcaaacgca

SEQ ID NO: 182337 - DNA, 25 bp, E. coli
gcaactaaatgtagccccctttcgt

SEQ ID NO: 182338 - DNA, 25 bp, E. coli
gctaaatgtcccgtaaggttgcggg

SEQ ID NO: 182339 - DNA, 25 bp, E. coli
gctaaatgtcccctaaggttgcggg

SEQ ID NO: 182340 - DNA, 25 bp, E. coli
gcaactaaatgttgccccctttcgt

SEQ ID NO: 182341 - DNA, 25 bp, E. coli
ggtcgctaaatgacccctaaggttg

SEQ ID NO: 182342 - DNA, 25 bp, E. coli
ggtcgctaaatgtcccctaaggttg

SEQ ID NO: 182343 - DNA, 25 bp, E. coli
gcaatctcgggggaactaaatgttg

SEQ ID NO: 182344 - DNA, 25 bp, E. coli
gcaatctcggggcaactaaatgttg

SEQ ID NO: 182345 - DNA, 25 bp, E. coli
tgtcccctaaggttgcgggcaaacg

SEQ ID NO: 182346 - DNA, 25 bp, E. coli
tgtcccctaaggatgcgggcaaacg

SEQ ID NO: 182347 - DNA, 25 bp, E. coli
aatgagatattttcgcgctgggacc

SEQ ID NO: 182348 - DNA, 25 bp, E. coli
aatgagatatttacgcgctgggacc

SEQ ID NO: 182349 - DNA, 25 bp, E. coli
agaaaattgaatgccttcgccgcca

SEQ ID NO: 182350 - DNA, 25 bp, E. coli
agaaaattgaatcccttcgccgcca

SEQ ID NO: 182351 - DNA, 25 bp, E. coli
tatcgaccgcctagatgacatccct

SEQ ID NO: 182352 - DNA, 25 bp, E. coli
tatcgaccgccttgatgacatccct

SEQ ID NO: 182353 - DNA, 25 bp, E. coli
tataccgtcataggcgaacagcgcc

SEQ ID NO: 182354 - DNA, 25 bp, E. coli
tataccgtcatacgcgaacagcgcc

SEQ ID NO: 182355 - DNA, 25 bp, E. coli
ttctcaaaaagatctggccgcggac

SEQ ID NO: 182356 - DNA, 25 bp, E. coli
ttctcaaaaagaactggccgcggac

SEQ ID NO: 182357 - DNA, 25 bp, E. coli
tctgcatctggctagaacgcaaccg

SEQ ID NO: 182358 - DNA, 25 bp, E. coli
tctgcatctggcaagaacgcaaccg

SEQ ID NO: 182359 - DNA, 25 bp, E. coli
gaatctctctttgccgagctgcgaa

SEQ ID NO: 182360 - DNA, 25 bp, E. coli
gaatctctctttcccgagctgcgaa

SEQ ID NO: 182361 - DNA, 25 bp, E. coli
gacagtgagcaagtgcacgccctta

SEQ ID NO: 182362 - DNA, 25 bp, E. coli
gacagtgagcaactgcacgccctta

SEQ ID NO: 182363 - DNA, 25 bp, E. coli
gaactggttgaagtcaccggcgcag

SEQ ID NO: 182364 - DNA, 25 bp, E. coli
gaactggttgaactcaccggcgcag

SEQ ID NO: 182365 - DNA, 25 bp, E. coli
cggtaaactggctcgcaaggtggct

SEQ ID NO: 182366 - DNA, 25 bp, E. coli
cattaccggatgtcagaaacccaga

SEQ ID NO: 182367 - DNA, 25 bp, E. coli
cattaccggatgacagaaacccaga

SEQ ID NO: 182368 - DNA, 25 bp, E. coli
cggtaaactggcacgcaaggtggct

SEQ ID NO: 182369 - DNA, 25 bp, E. coli
cagaaaacctggcaaagctatcact

SEQ ID NO: 182370 - DNA, 25 bp, E. coli
cagaaaacctgggaaagctatcact

SEQ ID NO: 182371 - DNA, 25 bp, E. coli
tatttaatacacagccgatgatggg

SEQ ID NO: 182372 - DNA, 25 bp, E. coli
tatttaatacactgccgatgatggg

SEQ ID NO: 182373 - DNA, 25 bp, E. coli
tccgctttaatgcatggcgaaacgc

SEQ ID NO: 182374 - DNA, 25 bp, E. coli
tccgctttaatggatggcgaaacgc

SEQ ID NO: 182375 - DNA, 25 bp, E. coli
gccattgaagaagagccagtacgtc

SEQ ID NO: 182376 - DNA, 25 bp, E. coli
gccattgaagaacagccagtacgtc

SEQ ID NO: 182377 - DNA, 25 bp, E. coli
gcttgcagttatcgttggcgtccag

SEQ ID NO: 182378 - DNA, 25 bp, E. coli
gcttgcagttatggttggcgtccag

SEQ ID NO: 182379 - DNA, 25 bp, E. coli
cgatgatgggtatagccagcccggt

SEQ ID NO: 182380 - DNA, 25 bp, E. coli
ccgctgtacaggagccaggaattca

SEQ ID NO: 182381 - DNA, 25 bp, E. coli
cgatgatgggtaaagccagcccggt

SEQ ID NO: 182382 - DNA, 25 bp, E. coli
ccgctgtacaggtgccaggaattca

SEQ ID NO: 182383 - DNA, 25 bp, E. coli
cattctggcagaaagtacgtccgtg

SEQ ID NO: 182384 - DNA, 25 bp, E. coli
cattctggcagatagtacgtccgtg

SEQ ID NO: 182385 - DNA, 25 bp, E. coli
gatactcccgaggtgctccatttcg

SEQ ID NO: 182386 - DNA, 25 bp, E. coli
gatactcccgagctgctccatttcg

SEQ ID NO: 182387 - DNA, 25 bp, E. coli
ggattacgaactgcaacgccgactc

SEQ ID NO: 182388 - DNA, 25 bp, E. coli
ggattacgaactccaacgccgactc

SEQ ID NO: 182389 - DNA, 25 bp, E. coli
tcaaactttaggtacgcaatcgcag

SEQ ID NO: 182390 - DNA, 25 bp, E. coli
tcaaactttaggaacgcaatcgcag

SEQ ID NO: 182391 - DNA, 25 bp, E. coli
aatgacctggatagtacctgcggga

SEQ ID NO: 182392 - DNA, 25 bp, E. coli
caatagatgccggtatcgaacgagt

SEQ ID NO: 182393 - DNA, 25 bp, E. coli
caatagatgccgctatcgaacgagt

SEQ ID NO: 182394 - DNA, 25 bp, E. coli
aatgacctggattgtacctgcggga

SEQ ID NO: 182395 - DNA, 25 bp, E. coli
tatgattgtgctgagtatcgccgcg

SEQ ID NO: 182396 - DNA, 25 bp, E. coli
tacctttattgagggcgcgcgggat

SEQ ID NO: 182397 - DNA, 25 bp, E. coli
tatgattgtgctcagtatcgccgcg

SEQ ID NO: 182398 - DNA, 25 bp, E. coli
tacctttattgacggcgcgcgggat

SEQ ID NO: 182399 - DNA, 25 bp, E. coli
tatgggatggcgcaagaatcactcc

SEQ ID NO: 182400 - DNA, 25 bp, E. coli
tatgggatggcggaagaatcactcc

SEQ ID NO: 182401 - DNA, 25 bp, E. coli
tatctgagatggctagcaccgctac

SEQ ID NO: 182402 - DNA, 25 bp, E. coli
tatcagatggtgtcaaatgccgcac

SEQ ID NO: 182403 - DNA, 25 bp, E. coli
tatcagatggtgacaaatgccgcac

SEQ ID NO: 182404 - DNA, 25 bp, E. coli
tatctgagatgggtagcaccgctac

SEQ ID NO: 182405 - DNA, 25 bp, E. coli
tgctcatgtacatcgcgatctggtg

SEQ ID NO: 182406 - DNA, 25 bp, E. coli
tgctcatgtacaacgcgatctggtg

SEQ ID NO: 182407 - DNA, 25 bp, E. coli
gacaactcgcctaaatggtcgggaa

SEQ ID NO: 182408 - DNA, 25 bp, E. coli
gacaactcgccttaatggtcgggaa

SEQ ID NO: 182409 - DNA, 25 bp, E. coli
gataagatggctgaaaaccaggcgc

SEQ ID NO: 182410 - DNA, 25 bp, E. coli
gataagatggctcaaaaccaggcgc

SEQ ID NO: 182411 - DNA, 25 bp, E. coli
tcaaacctacacagcgggagcgatt

SEQ ID NO: 182412 - DNA, 25 bp, E. coli
tcaaacctacactgcgggagcgatt

SEQ ID NO: 182413 - DNA, 25 bp, E. coli
cacgtgatgggaaacaaatgggcgc

SEQ ID NO: 182414 - DNA, 25 bp, E. coli
cacgtgatgggatacaaatgggcgc

SEQ ID NO: 182415 - DNA, 25 bp, E. coli
ataaggttggtcagtccggctgcgc

SEQ ID NO: 182416 - DNA, 25 bp, E. coli
ataaggttggtctgtccggctgcgc

SEQ ID NO: 182417 - DNA, 25 bp, E. coli
aacagtggaccacgcatgcaggctt

SEQ ID NO: 182418 - DNA, 25 bp, E. coli
aacagtggaccaggcatgcaggctt

SEQ ID NO: 182419 - DNA, 25 bp, E. coli
tatcgtcgaaggaaaggtagtcggc

SEQ ID NO: 182420 - DNA, 25 bp, E. coli
tatcgtcgaaggtaaggtagtcggc

SEQ ID NO: 182421 - DNA, 25 bp, E. coli
tatcggctgcatagcaagtcaggcg

SEQ ID NO: 182422 - DNA, 25 bp, E. coli
tatcggctgcattgcaagtcaggcg

SEQ ID NO: 182423 - DNA, 25 bp, E. coli
tgagcgaatgctgcgttcaacagtg

SEQ ID NO: 182424 - DNA, 25 bp, E. coli
tgaaatcggattacggagcccgtct

SEQ ID NO: 182425 - DNA, 25 bp, E. coli
tgctgatcgataccaagaccttgcc

SEQ ID NO: 182426 - DNA, 25 bp, E. coli
tgagcgaatgctccgttcaacagtg

SEQ ID NO: 182427 - DNA, 25 bp, E. coli
tgaaatcggatttcggagcccgtct

SEQ ID NO: 182428 - DNA, 25 bp, E. coli
tgctgatcgatagcaagaccttgcc

SEQ ID NO: 182429 - DNA, 25 bp, E. coli
tccggataggcggaagctgcaattt

SEQ ID NO: 182430 - DNA, 25 bp, E. coli
tccggataggcgcaagctgcaattt

SEQ ID NO: 182431 - DNA, 25 bp, E. coli
cgatattgatcgtgaagagccctgc

SEQ ID NO: 182432 - DNA, 25 bp, E. coli
cgatattgatcgagaagagccctgc

SEQ ID NO: 182433 - DNA, 25 bp, E. coli
gatgcttttgcccacgacgtgactg

SEQ ID NO: 182434 - DNA, 25 bp, E. coli
gatgcttttgccgacgacgtgactg

SEQ ID NO: 182435 - DNA, 25 bp, E. coli
cacggtcatgaagtgttaaatatga

SEQ ID NO: 182436 - DNA, 25 bp, E. coli
cacggtcatgaactgttaaatatga

SEQ ID NO: 182437 - DNA, 25 bp, E. coli
taaagcgcgttttggtgaacaggca

SEQ ID NO: 182438 - DNA, 25 bp, E. coli
taaagcgcgtttaggtgaacaggca

SEQ ID NO: 182439 - DNA, 25 bp, E. coli
accgatcagagtaagatttgccgtc

SEQ ID NO: 182440 - DNA, 25 bp, E. coli
accgatcagagttagatttgccgtc

SEQ ID NO: 182441 - DNA, 25 bp, E. coli
ttggtgaacaggcacgttttcacac

SEQ ID NO: 182442 - DNA, 25 bp, E. coli
ttggtgaacagggacgttttcacac

SEQ ID NO: 182443 - DNA, 25 bp, E. coli
tcagagtaagatatgccgtcactga

SEQ ID NO: 182444 - DNA, 25 bp, E. coli
tctattcacggtcatgaagtgttaa

SEQ ID NO: 182445 - DNA, 25 bp, E. coli
tcagagtaagatttgccgtcactga

SEQ ID NO: 182446 - DNA, 25 bp, E. coli
tctattcacggtgatgaagtgttaa

SEQ ID NO: 182447 - DNA, 25 bp, E. coli
gcaatatacgcatgccagtctggaa

SEQ ID NO: 182448 - DNA, 25 bp, E. coli
gcaatatacgcaagccagtctggaa

SEQ ID NO: 182449 - DNA, 25 bp, E. coli
cgtttctggcaggaaaaggcaaatt

SEQ ID NO: 182450 - DNA, 25 bp, E. coli
cgtttctggcagcaaaaggcaaatt

SEQ ID NO: 182451 - DNA, 25 bp, E. coli
ggcagcaaaagggaaatttatacct

SEQ ID NO: 182452 - DNA, 25 bp, E. coli
tggactctattctcggtcatgaagt

SEQ ID NO: 182453 - DNA, 25 bp, E. coli
ggcagcaaaaggcaaatttatacct

SEQ ID NO: 182454 - DNA, 25 bp, E. coli
tggactctattcacggtcatgaagt

SEQ ID NO: 182455 - DNA, 25 bp, E. coli
gagcaatatacggatgccagtctgg

SEQ ID NO: 182456 - DNA, 25 bp, E. coli
gagcaatatacgcatgccagtctgg

SEQ ID NO: 182457 - DNA, 25 bp, E. coli
caattgggcgtatcctatgaaggcg

SEQ ID NO: 182458 - DNA, 25 bp, E. coli
aagccttgggaatagccgcatcgac

SEQ ID NO: 182459 - DNA, 25 bp, E. coli
aagccttgggaaaagccgcatcgac

SEQ ID NO: 182460 - DNA, 25 bp, E. coli
caattgggcgtaacctatgaaggcg

SEQ ID NO: 182461 - DNA, 25 bp, E. coli
caaacggcgctgtagaaaaatcgga

SEQ ID NO: 182462 - DNA, 25 bp, E. coli
caaacggcgctgaagaaaaatcgga

SEQ ID NO: 182463 - DNA, 25 bp, E. coli
agaattgtcatcgacgccgggtacg

SEQ ID NO: 182464 - DNA, 25 bp, E. coli
agaattgtcatccacgccgggtacg

SEQ ID NO: 182465 - DNA, 25 bp, E. coli
tatgccgatttttccagcgacctgt

SEQ ID NO: 182466 - DNA, 25 bp, E. coli
tatgccgattttaccagcgacctgt

SEQ ID NO: 182467 - DNA, 25 bp, E. coli
tattgatatttagaccccggagcag

SEQ ID NO: 182468 - DNA, 25 bp, E. coli
tattcgtcgccatacgatgtcgcag

SEQ ID NO: 182469 - DNA, 25 bp, E. coli
tattgatatttacaccccggagcag

SEQ ID NO: 182470 - DNA, 25 bp, E. coli
ttacgttaaagtacgcgccatgccg

SEQ ID NO: 182471 - DNA, 25 bp, E. coli
tattcgtcgccaaacgatgtcgcag

SEQ ID NO: 182472 - DNA, 25 bp, E. coli
ttacgttaaagttcgcgccatgccg

SEQ ID NO: 182473 - DNA, 25 bp, E. coli
gctattttggtaccgcaaacggcgc

SEQ ID NO: 182474 - DNA, 25 bp, E. coli
gctattttggtagcgcaaacggcgc

SEQ ID NO: 182475 - DNA, 25 bp, E. coli
cgtacagtttgaaggcgcaggcagc

SEQ ID NO: 182476 - DNA, 25 bp, E. coli
cgtacagtttgatggcgcaggcagc

SEQ ID NO: 182477 - DNA, 25 bp, E. coli
gaccctaccgcgtagaatctgaaat

SEQ ID NO: 182478 - DNA, 25 bp, E. coli
gaccctaccgcgaagaatctgaaat

SEQ ID NO: 182479 - DNA, 25 bp, E. coli
aatgatgccaataagcgtaccgcgc

SEQ ID NO: 182480 - DNA, 25 bp, E. coli
aatgatgccaattagcgtaccgcgc

SEQ ID NO: 182481 - DNA, 25 bp, E. coli
tatatcaccggatgaacttattgcg

SEQ ID NO: 182482 - DNA, 25 bp, E. coli
tatatcaccggaagaacttattgcg

SEQ ID NO: 182483 - DNA, 25 bp, E. coli
tgatgcgaatataagccgctacggc

SEQ ID NO: 182484 - DNA, 25 bp, E. coli
tgatgcgaatattagccgctacggc

SEQ ID NO: 182485 - DNA, 25 bp, E. coli
tccgggtagggctgaggccattatc

SEQ ID NO: 182486 - DNA, 25 bp, E. coli
tccgggtagggcagaggccattatc

SEQ ID NO: 182487 - DNA, 25 bp, E. coli
gccagagttgccaacgaagagatca

SEQ ID NO: 182488 - DNA, 25 bp, E. coli
gccagagttgcctacgaagagatca

SEQ ID NO: 182489 - DNA, 25 bp, E. coli
gctacagcgagagggcatatattca

SEQ ID NO: 182490 - DNA, 25 bp, E. coli
gctacagcgagacggcatatattca

SEQ ID NO: 182491 - DNA, 25 bp, E. coli
gaagagatcacccaccttttcgaag

SEQ ID NO: 182492 - DNA, 25 bp, E. coli
gaagagatcaccgaccttttcgaag

SEQ ID NO: 182493 - DNA, 25 bp, E. coli
cattatcgggagagttcaggccaga

SEQ ID NO: 182494 - DNA, 25 bp, E. coli
cttactgtaggagctgcgactggcg

SEQ ID NO: 182495 - DNA, 25 bp, E. coli
cattatcgggagtgttcaggccaga

SEQ ID NO: 182496 - DNA, 25 bp, E. coli
cttactgtaggacctgcgactggcg

SEQ ID NO: 182497 - DNA, 25 bp, E. coli
gatatctgtatcatctgtcgccgac

SEQ ID NO: 182498 - DNA, 25 bp, E. coli
gattcacctgaagtggcagacctta

SEQ ID NO: 182499 - DNA, 25 bp, E. coli
gatatctgtatcttctgtcgccgac

SEQ ID NO: 182500 - DNA, 25 bp, E. coli
gattcacctgaactggcagacctta

SEQ ID NO: 182501 - DNA, 25 bp, E. coli
aatggacggctgatcatggttttca

SEQ ID NO: 182502 - DNA, 25 bp, E. coli
caatcaaatgatcgcacgctattcc

SEQ ID NO: 182503 - DNA, 25 bp, E. coli
aatggacggctgttcatggttttca

SEQ ID NO: 182504 - DNA, 25 bp, E. coli
caatcaaatgatggcacgctattcc

SEQ ID NO: 182505 - DNA, 25 bp, E. coli
catcgctggcttcaattgcagttgc

SEQ ID NO: 182506 - DNA, 25 bp, E. coli
catcgctggcttgaattgcagttgc

SEQ ID NO: 182507 - DNA, 25 bp, E. coli
catgcgcatgtcgttttctggatcg

SEQ ID NO: 182508 - DNA, 25 bp, E. coli
catgcgcatgtccttttctggatcg

SEQ ID NO: 182509 - DNA, 25 bp, E. coli
aaatatatatccgtttgcggagcgg

SEQ ID NO: 182510 - DNA, 25 bp, E. coli
aaatatatatccctttgcggagcgg

SEQ ID NO: 182511 - DNA, 25 bp, E. coli
tcttctacaggaaagatacgcctga

SEQ ID NO: 182512 - DNA, 25 bp, E. coli
tcttctgggtgattgaatggacggc

SEQ ID NO: 182513 - DNA, 25 bp, E. coli
tcttctacaggatagatacgcctga

SEQ ID NO: 182514 - DNA, 25 bp, E. coli
tcttctgggtgaatgaatggacggc

SEQ ID NO: 182515 - DNA, 25 bp, E. coli
gctggagcaggttgaacaatttgaa

SEQ ID NO: 182516 - DNA, 25 bp, E. coli
gctggagcaggtagaacaatttgaa

SEQ ID NO: 182517 - DNA, 25 bp, E. coli
gatacgcctgatatcttacaacctg

SEQ ID NO: 182518 - DNA, 25 bp, E. coli
gatacgcctgatttcttacaacctg

SEQ ID NO: 182519 - DNA, 25 bp, E. coli
gggccttacgcaaggatttcttcta

SEQ ID NO: 182520 - DNA, 25 bp, E. coli
ggatcgatcgtctgagggttaaaaa

SEQ ID NO: 182521 - DNA, 25 bp, E. coli
ggatcgatcgtcagagggttaaaaa

SEQ ID NO: 182522 - DNA, 25 bp, E. coli
gggccttacgcatggatttcttcta

SEQ ID NO: 182523 - DNA, 25 bp, E. coli
tacgatgaagagtgcttgtcgctgt

SEQ ID NO: 182524 - DNA, 25 bp, E. coli
tacgatgaagagagcttgtcgctgt

SEQ ID NO: 182525 - DNA, 25 bp, E. coli
tactacgatgaagagagcttgtcgc

SEQ ID NO: 182526 - DNA, 25 bp, E. coli
tactacgatgaacagagcttgtcgc

SEQ ID NO: 182527 - DNA, 25 bp, E. coli
atgaagtggaagacgcagcgcgcac

SEQ ID NO: 182528 - DNA, 25 bp, E. coli
agcgcgcacgctgaaaggcagcgaa

SEQ ID NO: 182529 - DNA, 25 bp, E. coli
agcgcgcacgctcaaaggcagcgaa

SEQ ID NO: 182530 - DNA, 25 bp, E. coli
atgaagtggaagtcgcagcgcgcac

SEQ ID NO: 182531 - DNA, 25 bp, E. coli
ttttcttcaggtcgttgcggcttac

SEQ ID NO: 182532 - DNA, 25 bp, E. coli
ttttcttcaggtggttgcggcttac

SEQ ID NO: 182533 - DNA, 25 bp, E. coli
tgaactactacgttgaagagagctt

SEQ ID NO: 182534 - DNA, 25 bp, E. coli
tgaactactacgatgaagagagctt

SEQ ID NO: 182535 - DNA, 25 bp, E. coli
tcttcaggtggttgcggcttaccgt

SEQ ID NO: 182536 - DNA, 25 bp, E. coli
tcttcaggtggtagcggcttaccgt

SEQ ID NO: 182537 - DNA, 25 bp, E. coli
cgttgaggattttcttcaggtggtt

SEQ ID NO: 182538 - DNA, 25 bp, E. coli
cgttgaggatttacttcaggtggtt

SEQ ID NO: 182539 - DNA, 25 bp, E. coli
tcaaaggcagcgtacgatcctggca

SEQ ID NO: 182540 - DNA, 25 bp, E. coli
tcaaaggcagcgaacgatcctggca

SEQ ID NO: 182541 - DNA, 25 bp, E. coli
ggttgcggcttaccgtaatttcgtg

SEQ ID NO: 182542 - DNA, 25 bp, E. coli
gagcttgtcgctgtgcggcgttgag

SEQ ID NO: 182543 - DNA, 25 bp, E. coli
gagcttgtcgctctgcggcgttgag

SEQ ID NO: 182544 - DNA, 25 bp, E. coli
ggttgcggcttagcgtaatttcgtg

SEQ ID NO: 182545 - DNA, 25 bp, E. coli
aactggcaactgcacttacagggca

SEQ ID NO: 182546 - DNA, 25 bp, E. coli
aactggcaactggacttacagggca

SEQ ID NO: 182547 - DNA, 25 bp, E. coli
tacgctggcaaaggaagaagtcatc

SEQ ID NO: 182548 - DNA, 25 bp, E. coli
tacgctggcaaacgaagaagtcatc

SEQ ID NO: 182549 - DNA, 25 bp, E. coli
tatatcgagtttagcccgcaggcat

SEQ ID NO: 182550 - DNA, 25 bp, E. coli
tatatcgagttttgcccgcaggcat

SEQ ID NO: 182551 - DNA, 25 bp, E. coli
tttgcgaaccgggtaaagacgccat

SEQ ID NO: 182552 - DNA, 25 bp, E. coli
tttgcgaaccggctaaagacgccat

SEQ ID NO: 182553 - DNA, 25 bp, E. coli
ttgccgcactgaaagagatcccctg

SEQ ID NO: 182554 - DNA, 25 bp, E. coli
ttgccgcactgatagagatcccctg

SEQ ID NO: 182555 - DNA, 25 bp, E. coli
gaaaattacgcggaatatgcaggcg

SEQ ID NO: 182556 - DNA, 25 bp, E. coli
gaaaccaactactttctggcgcgct

SEQ ID NO: 182557 - DNA, 25 bp, E. coli
gaaaattacgcgcaatatgcaggcg

SEQ ID NO: 182558 - DNA, 25 bp, E. coli
gaaaccaactacattctggcgcgct

SEQ ID NO: 182559 - DNA, 25 bp, E. coli
cattgacgcctttcgtgcggagcaa

SEQ ID NO: 182560 - DNA, 25 bp, E. coli
cgtcggaacccgagaagaaagccag

SEQ ID NO: 182561 - DNA, 25 bp, E. coli
cgtcggaacccgtgaagaaagccag

SEQ ID NO: 182562 - DNA, 25 bp, E. coli
cattgacgccttacgtgcggagcaa

SEQ ID NO: 182563 - DNA, 25 bp, E. coli
gatttagcgcgtgaaaacgtccgca

SEQ ID NO: 182564 - DNA, 25 bp, E. coli
gatttagcgcgtcaaaacgtccgca

SEQ ID NO: 182565 - DNA, 25 bp, E. coli
taagcggctgcctgcgaattaccgt

SEQ ID NO: 182566 - DNA, 25 bp, E. coli
taagcggctgccagcgaattaccgt

SEQ ID NO: 182567 - DNA, 25 bp, E. coli
caccaggactgtaaaatacctggag

SEQ ID NO: 182568 - DNA, 25 bp, E. coli
caccaggactgttaaatacctggag

SEQ ID NO: 182569 - DNA, 25 bp, E. coli
caggttacaagtcaatgtcggtgta

SEQ ID NO: 182570 - DNA, 25 bp, E. coli
caggttacaagtgaatgtcggtgta

SEQ ID NO: 182571 - DNA, 25 bp, E. coli
cagttgcttaacagactggcattac

SEQ ID NO: 182572 - DNA, 25 bp, E. coli
cataaaccggcaccattgtccttca

SEQ ID NO: 182573 - DNA, 25 bp, E. coli
cagttgcttaactgactggcattac

SEQ ID NO: 182574 - DNA, 25 bp, E. coli
cataaaccggcagcattgtccttca

SEQ ID NO: 182575 - DNA, 25 bp, E. coli
tactcaccaggagtgttaaatacct

SEQ ID NO: 182576 - DNA, 25 bp, E. coli
tactcaccaggactgttaaatacct

SEQ ID NO: 182577 - DNA, 25 bp, E. coli
gccatacgcttcgccgggacgtata

SEQ ID NO: 182578 - DNA, 25 bp, E. coli
gccatacgcttccccgggacgtata

SEQ ID NO: 182579 - DNA, 25 bp, E. coli
tgctcattggacaggcccttgattt

SEQ ID NO: 182580 - DNA, 25 bp, E. coli
tgctcattggactggcccttgattt

SEQ ID NO: 182581 - DNA, 25 bp, E. coli
gcttaactgactggcattacccctt

SEQ ID NO: 182582 - DNA, 25 bp, E. coli
gcagcattgtccttcatcatatttg

SEQ ID NO: 182583 - DNA, 25 bp, E. coli
gcagcattgtccatcatcatatttg

SEQ ID NO: 182584 - DNA, 25 bp, E. coli
gcttaactgactcgcattacccctt

SEQ ID NO: 182585 - DNA, 25 bp, E. coli
cttttccataaaccggcagcattgt

SEQ ID NO: 182586 - DNA, 25 bp, E. coli
cttttccataaagcggcagcattgt

SEQ ID NO: 182587 - DNA, 25 bp, E. coli
gacccgccagcgactgggaattgag

SEQ ID NO: 182588 - DNA, 25 bp, E. coli
gacccgccagcgtctgggaattgag

SEQ ID NO: 182589 - DNA, 25 bp, E. coli
aattgaggatttaccacctggctgg

SEQ ID NO: 182590 - DNA, 25 bp, E. coli
aattgaggattttccacctggctgg

SEQ ID NO: 182591 - DNA, 25 bp, E. coli
catgggtggccctagggtaattgct

SEQ ID NO: 182592 - DNA, 25 bp, E. coli
catgggtggcccaagggtaattgct

SEQ ID NO: 182593 - DNA, 25 bp, E. coli
tacatgttgtctgcattaaggcgca

SEQ ID NO: 182594 - DNA, 25 bp, E. coli
tacatgttgtctccattaaggcgca

SEQ ID NO: 182595 - DNA, 25 bp, E. coli
ttcacgttgttaacggaagagtacg

SEQ ID NO: 182596 - DNA, 25 bp, E. coli
ttcacgttgttatcggaagagtacg

SEQ ID NO: 182597 - DNA, 25 bp, E. coli
tacggaaagtacatgggtggcccaa

SEQ ID NO: 182598 - DNA, 25 bp, E. coli
tacggaaagtacttgggtggcccaa

SEQ ID NO: 182599 - DNA, 25 bp, E. coli
ccatttactggaaataagcaggttg

SEQ ID NO: 182600 - DNA, 25 bp, E. coli
ccatttactggatataagcaggttg

SEQ ID NO: 182601 - DNA, 25 bp, E. coli
gcgattctttattagtgagccggga

SEQ ID NO: 182602 - DNA, 25 bp, E. coli
gcgattctttataagtgagccggga

SEQ ID NO: 182603 - DNA, 25 bp, E. coli
cgcatggagttgagagggcacctta

SEQ ID NO: 182604 - DNA, 25 bp, E. coli
cgcatggagttgtgagggcacctta

SEQ ID NO: 182605 - DNA, 25 bp, E. coli
gggtaatcctgaggataagccattt

SEQ ID NO: 182606 - DNA, 25 bp, E. coli
gggtaatcctgacgataagccattt

SEQ ID NO: 182607 - DNA, 25 bp, E. coli
ggcaccttaatgtaatatatgacgg

SEQ ID NO: 182608 - DNA, 25 bp, E. coli
ggcaccttaatgaaatatatgacgg

SEQ ID NO: 182609 - DNA, 25 bp, E. coli
taataagaaagaaggaaacgcggca

SEQ ID NO: 182610 - DNA, 25 bp, E. coli
taataagaaagatggaaacgcggca

SEQ ID NO: 182611 - DNA, 25 bp, E. coli
caatctgaaggctggtatctgctac

SEQ ID NO: 182612 - DNA, 25 bp, E. coli
caatctgaaggcaggtatctgctac

SEQ ID NO: 182613 - DNA, 25 bp, E. coli
cgtacagggttgctctaccgatcca

SEQ ID NO: 182614 - DNA, 25 bp, E. coli
catgggcgcttataatcatcagagg

SEQ ID NO: 182615 - DNA, 25 bp, E. coli
catggcaccctgtgagcaatgtgta

SEQ ID NO: 182616 - DNA, 25 bp, E. coli
catggcaccctgagagcaatgtgta

SEQ ID NO: 182617 - DNA, 25 bp, E. coli
catgggcgcttaaaatcatcagagg

SEQ ID NO: 182618 - DNA, 25 bp, E. coli
catgcagtacataatccggatcccg

SEQ ID NO: 182619 - DNA, 25 bp, E. coli
catgcagtacattatccggatcccg

SEQ ID NO: 182620 - DNA, 25 bp, E. coli
ttaacctgccgcaggcacagtgggc

SEQ ID NO: 182621 - DNA, 25 bp, E. coli
ttaacctgccgctggcacagtgggc

SEQ ID NO: 182622 - DNA, 25 bp, E. coli
tcctgatggcgtgacactgagcagc

SEQ ID NO: 182623 - DNA, 25 bp, E. coli
tcctgatggcgtcacactgagcagc

SEQ ID NO: 182624 - DNA, 25 bp, E. coli
gcgtgatggcattttacggcagcat

SEQ ID NO: 182625 - DNA, 25 bp, E. coli
gcgtgatggcatattacggcagcat

SEQ ID NO: 182626 - DNA, 25 bp, E. coli
cgatgggcgcgttaattatcctggc

SEQ ID NO: 182627 - DNA, 25 bp, E. coli
cgatgggcgcgtaaattatcctggc

SEQ ID NO: 182628 - DNA, 25 bp, E. coli
cgtacagggttggtctaccgatcca

SEQ ID NO: 182629 - DNA, 25 bp, E. coli
tggaaagatcttcgcacatcaccag

SEQ ID NO: 182630 - DNA, 25 bp, E. coli
tggtcagatggctggagcaacgctt

SEQ ID NO: 182631 - DNA, 25 bp, E. coli
tggaaagatcttggcacatcaccag

SEQ ID NO: 182632 - DNA, 25 bp, E. coli
tggtcagatggcaggagcaacgctt

SEQ ID NO: 182633 - DNA, 25 bp, E. coli
caacaaaatcgctaaatgaccagtg

SEQ ID NO: 182634 - DNA, 25 bp, E. coli
caacaaaatcgcaaaatgaccagtg

SEQ ID NO: 182635 - DNA, 25 bp, E. coli
taccgacggattaaaggtcagctcc

SEQ ID NO: 182636 - DNA, 25 bp, E. coli
taacttactggaaattcgccgccac

SEQ ID NO: 182637 - DNA, 25 bp, E. coli
taccgacggatttaaggtcagctcc

SEQ ID NO: 182638 - DNA, 25 bp, E. coli
aaaatcgcaaaaagaccagtgtacc

SEQ ID NO: 182639 - DNA, 25 bp, E. coli
aaaatcgcaaaatgaccagtgtacc

SEQ ID NO: 182640 - DNA, 25 bp, E. coli
ttcagtatcaagacaacaaaatcgc

SEQ ID NO: 182641 - DNA, 25 bp, E. coli
ttactggatattcgccgccacacaa

SEQ ID NO: 182642 - DNA, 25 bp, E. coli
ttcagtatcaagtcaacaaaatcgc

SEQ ID NO: 182643 - DNA, 25 bp, E. coli
ttactggatattggccgccacacaa

SEQ ID NO: 182644 - DNA, 25 bp, E. coli
tgtcgaaaacattcagtatcaagac

SEQ ID NO: 182645 - DNA, 25 bp, E. coli
tgtcgaaaacatacagtatcaagac

SEQ ID NO: 182646 - DNA, 25 bp, E. coli
tgatttgggtaaatttaacttactg

SEQ ID NO: 182647 - DNA, 25 bp, E. coli
tgatttgggtaattttaacttactg

SEQ ID NO: 182648 - DNA, 25 bp, E. coli
tcagctcctcgtattataccgaaaa

SEQ ID NO: 182649 - DNA, 25 bp, E. coli
tcagctcctcgttttataccgaaaa

SEQ ID NO: 182650 - DNA, 25 bp, E. coli
gatttaaggtcacctcctcgtttta

SEQ ID NO: 182651 - DNA, 25 bp, E. coli
gatttaaggtcagctcctcgtttta

SEQ ID NO: 182652 - DNA, 25 bp, E. coli
gacggatttaagctcagctcctcgt

SEQ ID NO: 182653 - DNA, 25 bp, E. coli
gacggatttaaggtcagctcctcgt

SEQ ID NO: 182654 - DNA, 25 bp, E. coli
taacttactggatattcgccgccac

SEQ ID NO: 182655 - DNA, 25 bp, E. coli
atttataccggccttcaggcggcgg

SEQ ID NO: 182656 - DNA, 25 bp, E. coli
atttataccggcgttcaggcggcgg

SEQ ID NO: 182657 - DNA, 25 bp, E. coli
taggttttaactcccatatcggcgg

SEQ ID NO: 182658 - DNA, 25 bp, E. coli
taggttttaactgccatatcggcgg

SEQ ID NO: 182659 - DNA, 25 bp, E. coli
tgatcccaggagtgaatgacaattc

SEQ ID NO: 182660 - DNA, 25 bp, E. coli
tgatcccaggagagaatgacaattc

SEQ ID NO: 182661 - DNA, 25 bp, E. coli
gctggcacaccgctattgaaacaag

SEQ ID NO: 182662 - DNA, 25 bp, E. coli
gctggcacaccggtattgaaacaag

SEQ ID NO: 182663 - DNA, 25 bp, E. coli
gaatttgcccgccagctgcttaaag

SEQ ID NO: 182664 - DNA, 25 bp, E. coli
gcaacaccggcgtgaataacagagt

SEQ ID NO: 182665 - DNA, 25 bp, E. coli
gcaacaccggcgagaataacagagt

SEQ ID NO: 182666 - DNA, 25 bp, E. coli
gaatttgcccgcgagctgcttaaag

SEQ ID NO: 182667 - DNA, 25 bp, E. coli
gaaaatgtattgatgcttgcccaca

SEQ ID NO: 182668 - DNA, 25 bp, E. coli
gaaaatgtattgttgcttgcccaca

SEQ ID NO: 182669 - DNA, 25 bp, E. coli
cgcctgatgcagtacgtcgatacca

SEQ ID NO: 182670 - DNA, 25 bp, E. coli
cccgtgcgctggtaatgaagggcaa

SEQ ID NO: 182671 - DNA, 25 bp, E. coli
cccgtgcgctggaaatgaagggcaa

SEQ ID NO: 182672 - DNA, 25 bp, E. coli
cgcctgatgcagaacgtcgatacca

SEQ ID NO: 182673 - DNA, 25 bp, E. coli
taatgcctggttaatcaatcgcgac

SEQ ID NO: 182674 - DNA, 25 bp, E. coli
taatattgcggacttcgcccgcctg

SEQ ID NO: 182675 - DNA, 25 bp, E. coli
taatattgcggagttcgcccgcctg

SEQ ID NO: 182676 - DNA, 25 bp, E. coli
taatgcctggtttatcaatcgcgac

SEQ ID NO: 182677 - DNA, 25 bp, E. coli
agcctgagcctgcaattgtttgtcg

SEQ ID NO: 182678 - DNA, 25 bp, E. coli
agcctgagcctggaattgtttgtcg

SEQ ID NO: 182679 - DNA, 25 bp, E. coli
acaactacagttgctgaccagccgg

SEQ ID NO: 182680 - DNA, 25 bp, E. coli
acaactacagttcctgaccagccgg

SEQ ID NO: 182681 - DNA, 25 bp, E. coli
tatcatgggcaatggctctgtcaca

SEQ ID NO: 182682 - DNA, 25 bp, E. coli
tatgtacaggctgcatcaagggtaa

SEQ ID NO: 182683 - DNA, 25 bp, E. coli
tatgtacaggctccatcaagggtaa

SEQ ID NO: 182684 - DNA, 25 bp, E. coli
ttttttgcacccagaagacgttgcc

SEQ ID NO: 182685 - DNA, 25 bp, E. coli
ttttttgcaccctgaagacgttgcc

SEQ ID NO: 182686 - DNA, 25 bp, E. coli
tatcatgggcaaaggctctgtcaca

SEQ ID NO: 182687 - DNA, 25 bp, E. coli
tcgagtcaacaaagaagcgtaagcg

SEQ ID NO: 182688 - DNA, 25 bp, E. coli
tcgagtcaacaatgaagcgtaagcg

SEQ ID NO: 182689 - DNA, 25 bp, E. coli
gaagacgttgccaccgatccggctt

SEQ ID NO: 182690 - DNA, 25 bp, E. coli
gaagacgttgcctccgatccggctt

SEQ ID NO: 182691 - DNA, 25 bp, E. coli
cgttttatgtagtacgcctgtgcgg

SEQ ID NO: 182692 - DNA, 25 bp, E. coli
cgttttatgtagaacgcctgtgcgg

SEQ ID NO: 182693 - DNA, 25 bp, E. coli
cttttaatggactctatcatgggca

SEQ ID NO: 182694 - DNA, 25 bp, E. coli
cttttaatggacactatcatgggca

SEQ ID NO: 182695 - DNA, 25 bp, E. coli
taatgaagcatcaatcgccggttgc

SEQ ID NO: 182696 - DNA, 25 bp, E. coli
taatgaagcatctatcgccggttgc

SEQ ID NO: 182697 - DNA, 25 bp, E. coli
gatgctttgctgtacgcagcctgag

SEQ ID NO: 182698 - DNA, 25 bp, E. coli
gatgctttgctgaacgcagcctgag

SEQ ID NO: 182699 - DNA, 25 bp, E. coli
aatattcagtatgacttcctgccgg

SEQ ID NO: 182700 - DNA, 25 bp, E. coli
aatattcagtatcacttcctgccgg

SEQ ID NO: 182701 - DNA, 25 bp, E. coli
cacggaatgtcagacggatgagcag

SEQ ID NO: 182702 - DNA, 25 bp, E. coli
cacggaatgtcacacggatgagcag

SEQ ID NO: 182703 - DNA, 25 bp, E. coli
tacaactgggcttacgagacggaac

SEQ ID NO: 182704 - DNA, 25 bp, E. coli
tacaactgggctaacgagacggaac

SEQ ID NO: 182705 - DNA, 25 bp, E. coli
atcagccccggcacggaatgtcaga

SEQ ID NO: 182706 - DNA, 25 bp, E. coli
agaacgactacctcggcggcgacgg

SEQ ID NO: 182707 - DNA, 25 bp, E. coli
agaacgactaccacggcggcgacgg

SEQ ID NO: 182708 - DNA, 25 bp, E. coli
atcagccccggctcggaatgtcaga

SEQ ID NO: 182709 - DNA, 25 bp, E. coli
aaaaatgagtcgtgatttgaactga

SEQ ID NO: 182710 - DNA, 25 bp, E. coli
aaaaatgagtcgagatttgaactga

SEQ ID NO: 182711 - DNA, 25 bp, E. coli
tgtgctatatccgtggcaacgcgat

SEQ ID NO: 182712 - DNA, 25 bp, E. coli
tgggcttacgagtcggaacctgaac

SEQ ID NO: 182713 - DNA, 25 bp, E. coli
tgtgctatatccctggcaacgcgat

SEQ ID NO: 182714 - DNA, 25 bp, E. coli
cgtggcaacgcgttggatctcgaca

SEQ ID NO: 182715 - DNA, 25 bp, E. coli
cattatttttgagtgtaaacgcgcg

SEQ ID NO: 182716 - DNA, 25 bp, E. coli
cgtggcaacgcgatggatctcgaca

SEQ ID NO: 182717 - DNA, 25 bp, E. coli
cattatttttgactgtaaacgcgcg

SEQ ID NO: 182718 - DNA, 25 bp, E. coli
tgggcttacgagacggaacctgaac

SEQ ID NO: 182719 - DNA, 25 bp, E. coli
gatggatctcgacaactgggcaaaa

SEQ ID NO: 182720 - DNA, 25 bp, E. coli
gatggatctcgagaactgggcaaaa

SEQ ID NO: 182721 - DNA, 25 bp, E. coli
caatatcgccacgttaaaacgcgtg

SEQ ID NO: 182722 - DNA, 25 bp, E. coli
caatatcgccaccttaaaacgcgtg

SEQ ID NO: 182723 - DNA, 25 bp, E. coli
atggcgtgaagaacatcattgcggt

SEQ ID NO: 182724 - DNA, 25 bp, E. coli
atggcgtgaagatcatcattgcggt

SEQ ID NO: 182725 - DNA, 25 bp, E. coli
actgtcgcacaaaatcgccacctta

SEQ ID NO: 182726 - DNA, 25 bp, E. coli
actgtcgcacaatatcgccacctta

SEQ ID NO: 182727 - DNA, 25 bp, E. coli
tatcgccaccttaaaacgcgtgaag

SEQ ID NO: 182728 - DNA, 25 bp, E. coli
tatcgccacctttaaacgcgtgaag

SEQ ID NO: 182729 - DNA, 25 bp, E. coli
gcacaatatcgccaccttaaaacgc

SEQ ID NO: 182730 - DNA, 25 bp, E. coli
gcacaatatcgcgaccttaaaacgc

SEQ ID NO: 182731 - DNA, 25 bp, E. coli
gaaactgtcgcagaatatcgccacc

SEQ ID NO: 182732 - DNA, 25 bp, E. coli
gaaactgtcgcacaatatcgccacc

SEQ ID NO: 182733 - DNA, 25 bp, E. coli
cgccaccttaaatcgcgtgaagaat

SEQ ID NO: 182734 - DNA, 25 bp, E. coli
cgccaccttaaaacgcgtgaagaat

SEQ ID NO: 182735 - DNA, 25 bp, E. coli
gtcgcacaatatcgccaccttaaaa

SEQ ID NO: 182736 - DNA, 25 bp, E. coli
ggtattaatggcctgaagaacatca

SEQ ID NO: 182737 - DNA, 25 bp, E. coli
ggtattaatggcgtgaagaacatca

SEQ ID NO: 182738 - DNA, 25 bp, E. coli
gtcgcacaatatggccaccttaaaa

SEQ ID NO: 182739 - DNA, 25 bp, E. coli
tggaaactgtcggacaatatcgcca

SEQ ID NO: 182740 - DNA, 25 bp, E. coli
tggaaactgtcgcacaatatcgcca

SEQ ID NO: 182741 - DNA, 25 bp, E. coli
taatggcgtgaagaacatcattgcg

SEQ ID NO: 182742 - DNA, 25 bp, E. coli
taatggcgtgaacaacatcattgcg

SEQ ID NO: 182743 - DNA, 25 bp, E. coli
cagtgtcactaacctcagcagcaag

SEQ ID NO: 182744 - DNA, 25 bp, E. coli
cagtgtcactaagctcagcagcaag

SEQ ID NO: 182745 - DNA, 25 bp, E. coli
tacccagctatgttggcggaagtcg

SEQ ID NO: 182746 - DNA, 25 bp, E. coli
tacccagctatgatggcggaagtcg

SEQ ID NO: 182747 - DNA, 25 bp, E. coli
tattggtatcaaggaaacctcgcga

SEQ ID NO: 182748 - DNA, 25 bp, E. coli
tattggtatcaacgaaacctcgcga

SEQ ID NO: 182749 - DNA, 25 bp, E. coli
ttatcaagccgaatgaagccggttc

SEQ ID NO: 182750 - DNA, 25 bp, E. coli
ttatcaagccgattgaagccggttc

SEQ ID NO: 182751 - DNA, 25 bp, E. coli
tgttgatccaaatggcgatagcggg

SEQ ID NO: 182752 - DNA, 25 bp, E. coli
tgtgatccaagcaattgacccgctg

SEQ ID NO: 182753 - DNA, 25 bp, E. coli
tgttgatccaaaaggcgatagcggg

SEQ ID NO: 182754 - DNA, 25 bp, E. coli
tgtgatccaagctattgacccgctg

SEQ ID NO: 182755 - DNA, 25 bp, E. coli
tcgaaacttgggattgacgggtctg

SEQ ID NO: 182756 - DNA, 25 bp, E. coli
tcgaaacttgggtttgacgggtctg

SEQ ID NO: 182757 - DNA, 25 bp, E. coli
gcatcaacttgctgataccatggga

SEQ ID NO: 182758 - DNA, 25 bp, E. coli
gcatcaacttgcagataccatggga

SEQ ID NO: 182759 - DNA, 25 bp, E. coli
gaatcacagatcaaggagcaggcac

SEQ ID NO: 182760 - DNA, 25 bp, E. coli
gaatcacagatctaggagcaggcac

SEQ ID NO: 182761 - DNA, 25 bp, E. coli
gactgcttgaacaaatgaacctgcc

SEQ ID NO: 182762 - DNA, 25 bp, E. coli
gaaataccaattaatcagcgccacg

SEQ ID NO: 182763 - DNA, 25 bp, E. coli
gaaataccaatttatcagcgccacg

SEQ ID NO: 182764 - DNA, 25 bp, E. coli
gactgcttgaactaatgaacctgcc

SEQ ID NO: 182765 - DNA, 25 bp, E. coli
aatttcaggataactcgccgcagcg

SEQ ID NO: 182766 - DNA, 25 bp, E. coli
aatttcaggatatctcgccgcagcg

SEQ ID NO: 182767 - DNA, 25 bp, E. coli
tactgccggacgaaaaagtggtgcg

SEQ ID NO: 182768 - DNA, 25 bp, E. coli
tactgccggacgtaaaagtggtgcg

SEQ ID NO: 182769 - DNA, 25 bp, E. coli
aaaaatctggatctgccggtggcga

SEQ ID NO: 182770 - DNA, 25 bp, E. coli
aaaaatctggatgtgccggtggcga

SEQ ID NO: 182771 - DNA, 25 bp, E. coli
tattaaaagcctggaaaggtgcgct

SEQ ID NO: 182772 - DNA, 25 bp, E. coli
tattaaaagcctcgaaaggtgcgct

SEQ ID NO: 182773 - DNA, 25 bp, E. coli
gaaatgattgcctgtgcacccgaag

SEQ ID NO: 182774 - DNA, 25 bp, E. coli
gaaatgattgccagtgcacccgaag

SEQ ID NO: 182775 - DNA, 25 bp, E. coli
cgattatggaagtggcgctactgcc

SEQ ID NO: 182776 - DNA, 25 bp, E. coli
cgattatggaagaggcgctactgcc

SEQ ID NO: 182777 - DNA, 25 bp, E. coli
gttaatgtacgtggcgctgacccgg

SEQ ID NO: 182778 - DNA, 25 bp, E. coli
gtttattcagcagaacccaggccag

SEQ ID NO: 182779 - DNA, 25 bp, E. coli
gattcactgtaaccgcggtctggta

SEQ ID NO: 182780 - DNA, 25 bp, E. coli
gattcactgtaagcgcggtctggta

SEQ ID NO: 182781 - DNA, 25 bp, E. coli
gttaatgtacgtcgcgctgacccgg

SEQ ID NO: 182782 - DNA, 25 bp, E. coli
gtttattcagcacaacccaggccag

SEQ ID NO: 182783 - DNA, 25 bp, E. coli
ggattaaagtctgcggcgatcgcca

SEQ ID NO: 182784 - DNA, 25 bp, E. coli
ggattaaagtctccggcgatcgcca

SEQ ID NO: 182785 - DNA, 25 bp, E. coli
tggaaaatgatagcgctgcccgtca

SEQ ID NO: 182786 - DNA, 25 bp, E. coli
tggaaaatgataccgctgcccgtca

SEQ ID NO: 182787 - DNA, 25 bp, E. coli
caaagtggtaaaactcgctgcaggc

SEQ ID NO: 182788 - DNA, 25 bp, E. coli
caaagtggtaaatctcgctgcaggc

SEQ ID NO: 182789 - DNA, 25 bp, E. coli
tagatgaatcggcttaaccggtacg

SEQ ID NO: 182790 - DNA, 25 bp, E. coli
tacggaagccgatttagcacgaaac

SEQ ID NO: 182791 - DNA, 25 bp, E. coli
tagatgaatcgggttaaccggtacg

SEQ ID NO: 182792 - DNA, 25 bp, E. coli
tacggaagccgaattagcacgaaac

SEQ ID NO: 182793 - DNA, 25 bp, E. coli
acaagttatctttctgccgtcgcaa

SEQ ID NO: 182794 - DNA, 25 bp, E. coli
acaagttatcttactgccgtcgcaa

SEQ ID NO: 182795 - DNA, 25 bp, E. coli
ttatcacaccaatttccagagtccg

SEQ ID NO: 182796 - DNA, 25 bp, E. coli
ttatcacaccaaattccagagtccg

SEQ ID NO: 182797 - DNA, 25 bp, E. coli
tgatggctctcaccttttaaagttg

SEQ ID NO: 182798 - DNA, 25 bp, E. coli
tgatggctctcagcttttaaagttg

SEQ ID NO: 182799 - DNA, 25 bp, E. coli
tctgccgtcgcatatcataagtcga

SEQ ID NO: 182800 - DNA, 25 bp, E. coli
tctgccgtcgcaaatcataagtcga

SEQ ID NO: 182801 - DNA, 25 bp, E. coli
gccagtactggcgttgctgtcgtca

SEQ ID NO: 182802 - DNA, 25 bp, E. coli
ccagagtccgaagatattttcgtga

SEQ ID NO: 182803 - DNA, 25 bp, E. coli
ccagagtccgaacatattttcgtga

SEQ ID NO: 182804 - DNA, 25 bp, E. coli
gccagtactggccttgctgtcgtca

SEQ ID NO: 182805 - DNA, 25 bp, E. coli
gctgtcgtcaggaaatgtccctaca

SEQ ID NO: 182806 - DNA, 25 bp, E. coli
gctgtcgtcaggtaatgtccctaca

SEQ ID NO: 182807 - DNA, 25 bp, E. coli
taagtcgacggaatgcaaattgccg

SEQ ID NO: 182808 - DNA, 25 bp, E. coli
taagtcgacggattgcaaattgccg

SEQ ID NO: 182809 - DNA, 25 bp, E. coli
cagcgccagcttcgtttgagcaaaa

SEQ ID NO: 182810 - DNA, 25 bp, E. coli
cagcgccagcttggtttgagcaaaa

SEQ ID NO: 182811 - DNA, 25 bp, E. coli
tattatttctgtgaccgcaggcgtg

SEQ ID NO: 182812 - DNA, 25 bp, E. coli
tatctcaccggaccgaactgagcag

SEQ ID NO: 182813 - DNA, 25 bp, E. coli
tattgacccgcttgaggcaaaagtt

SEQ ID NO: 182814 - DNA, 25 bp, E. coli
tattgatggtgatatgcgcgcaggc

SEQ ID NO: 182815 - DNA, 25 bp, E. coli
tattatttctgtcaccgcaggcgtg

SEQ ID NO: 182816 - DNA, 25 bp, E. coli
tattgatggtgaaatgcgcgcaggc

SEQ ID NO: 182817 - DNA, 25 bp, E. coli
tattgacccgctagaggcaaaagtt

SEQ ID NO: 182818 - DNA, 25 bp, E. coli
tatctcaccggagcgaactgagcag

SEQ ID NO: 182819 - DNA, 25 bp, E. coli
tgttactcgtgtccccggtgaaagc

SEQ ID NO: 182820 - DNA, 25 bp, E. coli
tgttactcgtgtgcccggtgaaagc

SEQ ID NO: 182821 - DNA, 25 bp, E. coli
tcccgagtgcaataggaaagccagt

SEQ ID NO: 182822 - DNA, 25 bp, E. coli
tcccgagtgcaaaaggaaagccagt

SEQ ID NO: 182823 - DNA, 25 bp, E. coli
ccaaagagttcatcggcgtacaaga

SEQ ID NO: 182824 - DNA, 25 bp, E. coli
ccaaagagttcaacggcgtacaaga

SEQ ID NO: 182825 - DNA, 25 bp, E. coli
gaataagactaatcaacagctcgct

SEQ ID NO: 182826 - DNA, 25 bp, E. coli
gaataagactaaacaacagctcgct

SEQ ID NO: 182827 - DNA, 25 bp, E. coli
ggcaaaagttcttcgctcccgagtg

SEQ ID NO: 182828 - DNA, 25 bp, E. coli
ggcaaaagttctacgctcccgagtg

SEQ ID NO: 182829 - DNA, 25 bp, E. coli
taatagccaaaacatctcaccgggc

SEQ ID NO: 182830 - DNA, 25 bp, E. coli
taatagccaaaagatctcaccgggc

SEQ ID NO: 182831 - DNA, 25 bp, E. coli
caaccgctcaatcgatgtcatcagt

SEQ ID NO: 182832 - DNA, 25 bp, E. coli
caaccgctcaatggatgtcatcagt

SEQ ID NO: 182833 - DNA, 25 bp, E. coli
aatcagaacccaggaatacaaccgc

SEQ ID NO: 182834 - DNA, 25 bp, E. coli
aatcagaacccacgaatacaaccgc

SEQ ID NO: 182835 - DNA, 25 bp, E. coli
accgggctgcaactggacgaagaaa

SEQ ID NO: 182836 - DNA, 25 bp, E. coli
accgggctgcaagtggacgaagaaa

SEQ ID NO: 182837 - DNA, 25 bp, E. coli
aaacgagctttagcgcaatctgcgc

SEQ ID NO: 182838 - DNA, 25 bp, E. coli
aaacgagctttaccgcaatctgcgc

SEQ ID NO: 182839 - DNA, 25 bp, E. coli
tgggaagacgactgctggttacatt

SEQ ID NO: 182840 - DNA, 25 bp, E. coli
tgggaagacgacagctggttacatt

SEQ ID NO: 182841 - DNA, 25 bp, E. coli
tgaactcatggctaaaatcagaacc

SEQ ID NO: 182842 - DNA, 25 bp, E. coli
tgaactcatggcaaaaatcagaacc

SEQ ID NO: 182843 - DNA, 25 bp, E. coli
tctaacggtgtggaactgaccgggc

SEQ ID NO: 182844 - DNA, 25 bp, E. coli
tctaacggtgtgcaactgaccgggc

SEQ ID NO: 182845 - DNA, 25 bp, E. coli
tcgtatccgcaatggtagctctaac

SEQ ID NO: 182846 - DNA, 25 bp, E. coli
tcgtatccgcaaaggtagctctaac

SEQ ID NO: 182847 - DNA, 25 bp, E. coli
tcagttgaggtgacttttatgcgca

SEQ ID NO: 182848 - DNA, 25 bp, E. coli
cctggacgcccttgaaaacgagctt

SEQ ID NO: 182849 - DNA, 25 bp, E. coli
cctggacgccctagaaaacgagctt

SEQ ID NO: 182850 - DNA, 25 bp, E. coli
gattagtcagtctaccctggacgcc

SEQ ID NO: 182851 - DNA, 25 bp, E. coli
gattagtcagtcaaccctggacgcc

SEQ ID NO: 182852 - DNA, 25 bp, E. coli
tcagttgaggtgtcttttatgcgca

SEQ ID NO: 182853 - DNA, 25 bp, E. coli
catgtagtgcgtaaatagaatcagg

SEQ ID NO: 182854 - DNA, 25 bp, E. coli
catgtagtgcgttaatagaatcagg

SEQ ID NO: 182855 - DNA, 25 bp, E. coli
tacgtgctgcttacattcataaagc

SEQ ID NO: 182856 - DNA, 25 bp, E. coli
tacgtgctgctttcattcataaagc

SEQ ID NO: 182857 - DNA, 25 bp, E. coli
acggtgtacgtggtgcttacattca

SEQ ID NO: 182858 - DNA, 25 bp, E. coli
acggtgtacgtgctgcttacattca

SEQ ID NO: 182859 - DNA, 25 bp, E. coli
tagtgcgttaattgaatcaggtttg

SEQ ID NO: 182860 - DNA, 25 bp, E. coli
tagtgcgttaatagaatcaggtttg

SEQ ID NO: 182861 - DNA, 25 bp, E. coli
tgctgcttacattcataaagcagaa

SEQ ID NO: 182862 - DNA, 25 bp, E. coli
tgctgcttacatacataaagcagaa

SEQ ID NO: 182863 - DNA, 25 bp, E. coli
tgcgttaatagaatcaggtttgtgg

SEQ ID NO: 182864 - DNA, 25 bp, E. coli
tgaaaacaccgtaaataaagccctg

SEQ ID NO: 182865 - DNA, 25 bp, E. coli
tgaaaacaccgttaataaagccctg

SEQ ID NO: 182866 - DNA, 25 bp, E. coli
tgcgttaatagattcaggtttgtgg

SEQ ID NO: 182867 - DNA, 25 bp, E. coli
cgtaaataaagcgctgagggttatg

SEQ ID NO: 182868 - DNA, 25 bp, E. coli
cgtaaataaagccctgagggttatg

SEQ ID NO: 182869 - DNA, 25 bp, E. coli
cgtaacggtgtacgtgctgcttaca

SEQ ID NO: 182870 - DNA, 25 bp, E. coli
cgtaacggtgtaggtgctgcttaca

SEQ ID NO: 182871 - DNA, 25 bp, E. coli
ggcgatggcatgtagtgcgttaata

SEQ ID NO: 182872 - DNA, 25 bp, E. coli
ggcgatggcatgaagtgcgttaata

SEQ ID NO: 182873 - DNA, 25 bp, E. coli
ggaacgtaacggagtacgtgctgct

SEQ ID NO: 182874 - DNA, 25 bp, E. coli
ggaacgtaacggtgtacgtgctgct

SEQ ID NO: 182875 - DNA, 25 bp, E. coli
caaagcgcactatgtaaatcatttg

SEQ ID NO: 182876 - DNA, 25 bp, E. coli
caaagcgcactaagtaaatcatttg

SEQ ID NO: 182877 - DNA, 25 bp, E. coli
tacaaaggcggcctaactgcgccgc

SEQ ID NO: 182878 - DNA, 25 bp, E. coli
tacaaaggcggcgtaactgcgccgc

SEQ ID NO: 182879 - DNA, 25 bp, E. coli
taaatcatttgacgcggcgcaattg

SEQ ID NO: 182880 - DNA, 25 bp, E. coli
taaatcatttgaggcggcgcaattg

SEQ ID NO: 182881 - DNA, 25 bp, E. coli
agatgcggcgtgtaccttgcatccg

SEQ ID NO: 182882 - DNA, 25 bp, E. coli
agatgcggcgtgaaccttgcatccg

SEQ ID NO: 182883 - DNA, 25 bp, E. coli
tatgtaaatcatatgaggcggcgca

SEQ ID NO: 182884 - DNA, 25 bp, E. coli
tatgtaaatcatttgaggcggcgca

SEQ ID NO: 182885 - DNA, 25 bp, E. coli
tccggcgattaaatcctacaaaggc

SEQ ID NO: 182886 - DNA, 25 bp, E. coli
tccggcgattaattcctacaaaggc

SEQ ID NO: 182887 - DNA, 25 bp, E. coli
gcgtgaaccttgcatccggcgatta

SEQ ID NO: 182888 - DNA, 25 bp, E. coli
gcgtgaaccttggatccggcgatta

SEQ ID NO: 182889 - DNA, 25 bp, E. coli
ccgcttgagactcctgacaaacgca

SEQ ID NO: 182890 - DNA, 25 bp, E. coli
ccgcttgagactgctgacaaacgca

SEQ ID NO: 182891 - DNA, 25 bp, E. coli
gattaattcctacaaaggcggcgta

SEQ ID NO: 182892 - DNA, 25 bp, E. coli
gattaattcctagaaaggcggcgta

SEQ ID NO: 182893 - DNA, 25 bp, E. coli
gtgaggatgtttgccagatgcggcg

SEQ ID NO: 182894 - DNA, 25 bp, E. coli
gtgaggatgtttcccagatgcggcg

SEQ ID NO: 182895 - DNA, 25 bp, E. coli
taactgcgccgcatgagactgctga

SEQ ID NO: 182896 - DNA, 25 bp, E. coli
taactgcgccgcttgagactgctga

SEQ ID NO: 182897 - DNA, 25 bp, E. coli
aaacgcggctggattatgtacgcca

SEQ ID NO: 182898 - DNA, 25 bp, E. coli
aaacgcggctggtttatgtacgcca

SEQ ID NO: 182899 - DNA, 25 bp, E. coli
tatgctgcatctcgtttattgtggc

SEQ ID NO: 182900 - DNA, 25 bp, E. coli
tatgctgcatctggtttattgtggc

SEQ ID NO: 182901 - DNA, 25 bp, E. coli
tattttcggctactggctgtggcag

SEQ ID NO: 182902 - DNA, 25 bp, E. coli
tattgtggcgttgctctggataacc

SEQ ID NO: 182903 - DNA, 25 bp, E. coli
tatctcgaagaacacgatacccgtg

SEQ ID NO: 182904 - DNA, 25 bp, E. coli
tatctcgaagaagacgatacccgtg

SEQ ID NO: 182905 - DNA, 25 bp, E. coli
tattttcggctagtggctgtggcag

SEQ ID NO: 182906 - DNA, 25 bp, E. coli
tattgtggcgttcctctggataacc

SEQ ID NO: 182907 - DNA, 25 bp, E. coli
tgagtgcgcgcaagtttgtcttatg

SEQ ID NO: 182908 - DNA, 25 bp, E. coli
tgagtgcgcgcatgtttgtcttatg

SEQ ID NO: 182909 - DNA, 25 bp, E. coli
ccgcgctggacaaagagtggatgat

SEQ ID NO: 182910 - DNA, 25 bp, E. coli
ccgcgctggacatagagtggatgat

SEQ ID NO: 182911 - DNA, 25 bp, E. coli
cccgtgatgttgctgtgataatgac

SEQ ID NO: 182912 - DNA, 25 bp, E. coli
cccgtgatgttggtgtgataatgac

SEQ ID NO: 182913 - DNA, 25 bp, E. coli
cgggattaacaaggtctgcgatgtg

SEQ ID NO: 182914 - DNA, 25 bp, E. coli
cgggattaacaacgtctgcgatgtg

SEQ ID NO: 182915 - DNA, 25 bp, E. coli
tggataaccatcacttccgcgctgg

SEQ ID NO: 182916 - DNA, 25 bp, E. coli
tggataaccatctcttccgcgctgg

SEQ ID NO: 182917 - DNA, 25 bp, E. coli
gatgattgatggacgcgggattaac

SEQ ID NO: 182918 - DNA, 25 bp, E. coli
gatgattgatggtcgcgggattaac

SEQ ID NO: 182919 - DNA, 25 bp, E. coli
aatcaagcgaaaggccatccgaaag

SEQ ID NO: 182920 - DNA, 25 bp, E. coli
aatcaagcgaaacgccatccgaaag

SEQ ID NO: 182921 - DNA, 25 bp, E. coli
caaataaaacaataggctcagtcgg

SEQ ID NO: 182922 - DNA, 25 bp, E. coli
caaataaaacaaaaggctcagtcgg

SEQ ID NO: 182923 - DNA, 25 bp, E. coli
catccgaaaggatggcctttttgct

SEQ ID NO: 182924 - DNA, 25 bp, E. coli
catccgaaaggaaggcctttttgct

SEQ ID NO: 182925 - DNA, 25 bp, E. coli
aggacgcccgccttaaactgccaga

SEQ ID NO: 182926 - DNA, 25 bp, E. coli
aggacgcccgccataaactgccaga

SEQ ID NO: 182927 - DNA, 25 bp, E. coli
aactgccagacaacaaatcaagcga

SEQ ID NO: 182928 - DNA, 25 bp, E. coli
aactgccagacatcaaatcaagcga

SEQ ID NO: 182929 - DNA, 25 bp, E. coli
tgttgtttgtcgctgaacactctcc

SEQ ID NO: 182930 - DNA, 25 bp, E. coli
tgttgtttgtcggtgaacactctcc

SEQ ID NO: 182931 - DNA, 25 bp, E. coli
tcggtgaacactgtcccgagtagga

SEQ ID NO: 182932 - DNA, 25 bp, E. coli
tcggtgaacactctcccgagtagga

SEQ ID NO: 182933 - DNA, 25 bp, E. coli
gcggatttgaaccttgcgaagcaac

SEQ ID NO: 182934 - DNA, 25 bp, E. coli
gcggatttgaacgttgcgaagcaac

SEQ ID NO: 182935 - DNA, 25 bp, E. coli
ccgagtaggacaaatccgccgggag

SEQ ID NO: 182936 - DNA, 25 bp, E. coli
ccgagtaggacatatccgccgggag

SEQ ID NO: 182937 - DNA, 25 bp, E. coli
ctcagtcggaagactgggccttttg

SEQ ID NO: 182938 - DNA, 25 bp, E. coli
ctcagtcggaagtctgggccttttg

SEQ ID NO: 182939 - DNA, 25 bp, E. coli
gatggcctttttccttttcgaacta

SEQ ID NO: 182940 - DNA, 25 bp, E. coli
gatggcctttttgcttttcgaacta

SEQ ID NO: 182941 - DNA, 25 bp, E. coli
caaccttatttgaaggcgggcctgg

SEQ ID NO: 182942 - DNA, 25 bp, E. coli
caaccttatttgtaggcgggcctgg

SEQ ID NO: 182943 - DNA, 25 bp, E. coli
catttgacgctaatgcattagggaa

SEQ ID NO: 182944 - DNA, 25 bp, E. coli
catttgacgctattgcattagggaa

SEQ ID NO: 182945 - DNA, 25 bp, E. coli
tacaactctgatagaattgggtctc

SEQ ID NO: 182946 - DNA, 25 bp, E. coli
taaaatggttcggtgattactctgg

SEQ ID NO: 182947 - DNA, 25 bp, E. coli
taaatgacgcgaaggtaaaagctga

SEQ ID NO: 182948 - DNA, 25 bp, E. coli
tacaactctgattgaattgggtctc

SEQ ID NO: 182949 - DNA, 25 bp, E. coli
taaatgacgcgatggtaaaagctga

SEQ ID NO: 182950 - DNA, 25 bp, E. coli
taaaatggttcgctgattactctgg

SEQ ID NO: 182951 - DNA, 25 bp, E. coli
agatcatgcaacagcttttagggca

SEQ ID NO: 182952 - DNA, 25 bp, E. coli
agatcatgcaactgcttttagggca

SEQ ID NO: 182953 - DNA, 25 bp, E. coli
tttatttagtatccacgggagctac

SEQ ID NO: 182954 - DNA, 25 bp, E. coli
tttatttagtatgcacgggagctac

SEQ ID NO: 182955 - DNA, 25 bp, E. coli
tgggtctcaaaagacgcaatgcgtg

SEQ ID NO: 182956 - DNA, 25 bp, E. coli
tgggtctcaaaacacgcaatgcgtg

SEQ ID NO: 182957 - DNA, 25 bp, E. coli
ccttgcatgcgtcttccttcgggaa

SEQ ID NO: 182958 - DNA, 25 bp, E. coli
ccttgcatgcgtgttccttcgggaa

SEQ ID NO: 182959 - DNA, 25 bp, E. coli
gggagctactcaagattatcgattc

SEQ ID NO: 182960 - DNA, 25 bp, E. coli
gggagctactcatgattatcgattc

SEQ ID NO: 182961 - DNA, 25 bp, E. coli
gagggaaaggccacgatggatttca

SEQ ID NO: 182962 - DNA, 25 bp, E. coli
gagggaaaggcctcgatggatttca

SEQ ID NO: 182963 - DNA, 25 bp, E. coli
caataatcgtggcattacttcaggt

SEQ ID NO: 182964 - DNA, 25 bp, E. coli
caataatcgtgggattacttcaggt

SEQ ID NO: 182965 - DNA, 25 bp, E. coli
caccgcagctggcagacggatttat

SEQ ID NO: 182966 - DNA, 25 bp, E. coli
caccgcagctgggagacggatttat

SEQ ID NO: 182967 - DNA, 25 bp, E. coli
catttgatcgattaccagcagggcg

SEQ ID NO: 182968 - DNA, 25 bp, E. coli
accagcagggcgtcacctacggacg

SEQ ID NO: 182969 - DNA, 25 bp, E. coli
accacgccaggctgtgagcgcgttt

SEQ ID NO: 182970 - DNA, 25 bp, E. coli
accacgccaggcagtgagcgcgttt

SEQ ID NO: 182971 - DNA, 25 bp, E. coli
accagcagggcgacacctacggacg

SEQ ID NO: 182972 - DNA, 25 bp, E. coli
tgcctttctggaacgcggcgctggc

SEQ ID NO: 182973 - DNA, 25 bp, E. coli
tgcctttctggatcgcggcgctggc

SEQ ID NO: 182974 - DNA, 25 bp, E. coli
tcaggttttgcctttctggatcgcg

SEQ ID NO: 182975 - DNA, 25 bp, E. coli
tctggcctttttcagcaatcgtggg

SEQ ID NO: 182976 - DNA, 25 bp, E. coli
tctggcctttttgagcaatcgtggg

SEQ ID NO: 182977 - DNA, 25 bp, E. coli
tcaggttttgccattctggatcgcg

SEQ ID NO: 182978 - DNA, 25 bp, E. coli
gacggatttattgcgtttatcctgg

SEQ ID NO: 182979 - DNA, 25 bp, E. coli
gacggatttattccgtttatcctgg

SEQ ID NO: 182980 - DNA, 25 bp, E. coli
catttgatcgataaccagcagggcg

SEQ ID NO: 182981 - DNA, 25 bp, E. coli
ggcttcggtattctccagcatttga

SEQ ID NO: 182982 - DNA, 25 bp, E. coli
tgtgagcgcgtttgatctggccttt

SEQ ID NO: 182983 - DNA, 25 bp, E. coli
ggcttcggtattgtccagcatttga

SEQ ID NO: 182984 - DNA, 25 bp, E. coli
tgtgagcgcgttagatctggccttt

SEQ ID NO: 182985 - DNA, 25 bp, E. coli
cacagctatcgttgtacaggacccc

SEQ ID NO: 182986 - DNA, 25 bp, E. coli
cacagctatcgtagtacaggacccc

SEQ ID NO: 182987 - DNA, 25 bp, E. coli
cacacagctatccttgtacaggacc

SEQ ID NO: 182988 - DNA, 25 bp, E. coli
cacacagctatcgttgtacaggacc

SEQ ID NO: 182989 - DNA, 25 bp, E. coli
caggctgattgcgtcatacttgcag

SEQ ID NO: 182990 - DNA, 25 bp, E. coli
caggctgattgcctcatacttgcag

SEQ ID NO: 182991 - DNA, 25 bp, E. coli
tatcaggctgattgcgtcatacttg

SEQ ID NO: 182992 - DNA, 25 bp, E. coli
tatcaggctgatagcgtcatacttg

SEQ ID NO: 182993 - DNA, 25 bp, E. coli
tgcgtcatacttgcaggaaatgcgg

SEQ ID NO: 182994 - DNA, 25 bp, E. coli
tgcgtcatacttccaggaaatgcgg

SEQ ID NO: 182995 - DNA, 25 bp, E. coli
tcatacttgcaggaaatgcggttat

SEQ ID NO: 182996 - DNA, 25 bp, E. coli
tcatacttgcagcaaatgcggttat

SEQ ID NO: 182997 - DNA, 25 bp, E. coli
gctgattgcgtcatacttgcaggaa

SEQ ID NO: 182998 - DNA, 25 bp, E. coli
gctgattgcgtcttacttgcaggaa

SEQ ID NO: 182999 - DNA, 25 bp, E. coli
ccgtatcaggctcattgcgtcatac

SEQ ID NO: 183000 - DNA, 25 bp, E. coli
ccgtatcaggctgattgcgtcatac

SEQ ID NO: 183001 - DNA, 25 bp, E. coli
cgagttcacacacctatcgttgtac

SEQ ID NO: 183002 - DNA, 25 bp, E. coli
cgagttcacacagctatcgttgtac

SEQ ID NO: 183003 - DNA, 25 bp, E. coli
gattgcgtcatagttgcaggaaatg

SEQ ID NO: 183004 - DNA, 25 bp, E. coli
gttcacacagctttcgttgtacagg

SEQ ID NO: 183005 - DNA, 25 bp, E. coli
gattgcgtcatacttgcaggaaatg

SEQ ID NO: 183006 - DNA, 25 bp, E. coli
gttcacacagctatcgttgtacagg

SEQ ID NO: 183007 - DNA, 25 bp, E. coli
aagcaaaacgccaggtaagccagcg

SEQ ID NO: 183008 - DNA, 25 bp, E. coli
aagcaaaacgcctggtaagccagcg

SEQ ID NO: 183009 - DNA, 25 bp, E. coli
gaactgtcgaaagaaggcttttcca

SEQ ID NO: 183010 - DNA, 25 bp, E. coli
gaactgtcgaaacaaggcttttcca

SEQ ID NO: 183011 - DNA, 25 bp, E. coli
agccgatgagattctttacgcggcg

SEQ ID NO: 183012 - DNA, 25 bp, E. coli
agccgatgagatactttacgcggcg

SEQ ID NO: 183013 - DNA, 25 bp, E. coli
tgtcaccgaagcaaaacgccaggta

SEQ ID NO: 183014 - DNA, 25 bp, E. coli
tgtcaccgaagctaaacgccaggta

SEQ ID NO: 183015 - DNA, 25 bp, E. coli
tgactcacaggttattttactgacc

SEQ ID NO: 183016 - DNA, 25 bp, E. coli
tgactcacaggtaattttactgacc

SEQ ID NO: 183017 - DNA, 25 bp, E. coli
tgaaaacgcgtggcgatgaggccct

SEQ ID NO: 183018 - DNA, 25 bp, E. coli
tgaaaacgcgtgccgatgaggccct

SEQ ID NO: 183019 - DNA, 25 bp, E. coli
gccgatagccgatgagatactttac

SEQ ID NO: 183020 - DNA, 25 bp, E. coli
gccgatagccgaagagatactttac

SEQ ID NO: 183021 - DNA, 25 bp, E. coli
gaaagaaggcttttccacgctggct

SEQ ID NO: 183022 - DNA, 25 bp, E. coli
gaaagaaggcttatccacgctggct

SEQ ID NO: 183023 - DNA, 25 bp, E. coli
ctcgataacgtgtaaacgcgtggcg

SEQ ID NO: 183024 - DNA, 25 bp, E. coli
ctcgataacgtgaaaacgcgtggcg

SEQ ID NO: 183025 - DNA, 25 bp, E. coli
gataacgtgaaatcgcgtggcgatg

SEQ ID NO: 183026 - DNA, 25 bp, E. coli
gataacgtgaaaacgcgtggcgatg

SEQ ID NO: 183027 - DNA, 25 bp, E. coli
ggcttttccacggtggcttcgacca

SEQ ID NO: 183028 - DNA, 25 bp, E. coli
ggcttttccacgctggcttcgacca

SEQ ID NO: 183029 - DNA, 25 bp, E. coli
aggtcacccaacatgccgagcacgt

SEQ ID NO: 183030 - DNA, 25 bp, E. coli
aggtcacccaacttgccgagcacgt

SEQ ID NO: 183031 - DNA, 25 bp, E. coli
atacggaagcgatactgccctgcaa

SEQ ID NO: 183032 - DNA, 25 bp, E. coli
atggcccggaaagcctgcgtcaggt

SEQ ID NO: 183033 - DNA, 25 bp, E. coli
acgcgttcaccaccacctttgaaga

SEQ ID NO: 183034 - DNA, 25 bp, E. coli
acgcgttcaccagcacctttgaaga

SEQ ID NO: 183035 - DNA, 25 bp, E. coli
atacggaagcgaaactgccctgcaa

SEQ ID NO: 183036 - DNA, 25 bp, E. coli
atggcccggaaaccctgcgtcaggt

SEQ ID NO: 183037 - DNA, 25 bp, E. coli
tctgccaactgcttccgaagcgtgg

SEQ ID NO: 183038 - DNA, 25 bp, E. coli
tctgccaactgcatccgaagcgtgg

SEQ ID NO: 183039 - DNA, 25 bp, E. coli
ccggatctgccaactgcttccgaag

SEQ ID NO: 183040 - DNA, 25 bp, E. coli
ccagcatctgtatggcccggaaacc

SEQ ID NO: 183041 - DNA, 25 bp, E. coli
ccggatctgccatctgcttccgaag

SEQ ID NO: 183042 - DNA, 25 bp, E. coli
ccagcatctgtaaggcccggaaacc

SEQ ID NO: 183043 - DNA, 25 bp, E. coli
gctgaatacggatgcgaaactgccc

SEQ ID NO: 183044 - DNA, 25 bp, E. coli
gctgaatacggaagcgaaactgccc

SEQ ID NO: 183045 - DNA, 25 bp, E. coli
cgtcgatcgccgcagaagagaaacc

SEQ ID NO: 183046 - DNA, 25 bp, E. coli
cgtcgatcgccggagaagagaaacc

SEQ ID NO: 183047 - DNA, 25 bp, E. coli
gttcaccaccacctttgaagatttg

SEQ ID NO: 183048 - DNA, 25 bp, E. coli
gttcaccaccacgtttgaagatttg

SEQ ID NO: 183049 - DNA, 25 bp, E. coli
ggaaaccctgcgacaggtcacccaa

SEQ ID NO: 183050 - DNA, 25 bp, E. coli
ggaaaccctgcgtcaggtcacccaa

SEQ ID NO: 183051 - DNA, 25 bp, E. coli
cacaggctggatttttgcagaggca

SEQ ID NO: 183052 - DNA, 25 bp, E. coli
cacaggctggatatttgcagaggca

SEQ ID NO: 183053 - DNA, 25 bp, E. coli
cagatacagtattctcctgagcggg

SEQ ID NO: 183054 - DNA, 25 bp, E. coli
cagatacagtatactcctgagcggg

SEQ ID NO: 183055 - DNA, 25 bp, E. coli
tatgcgaatatactgccgccgctgc

SEQ ID NO: 183056 - DNA, 25 bp, E. coli
tatgcgaatatagtgccgccgctgc

SEQ ID NO: 183057 - DNA, 25 bp, E. coli
tatggcagtacagatttcaggcgtg

SEQ ID NO: 183058 - DNA, 25 bp, E. coli
tatggcagtacacatttcaggcgtg

SEQ ID NO: 183059 - DNA, 25 bp, E. coli
tattatttcaggaggcagcgcaacg

SEQ ID NO: 183060 - DNA, 25 bp, E. coli
tattatttcaggtggcagcgcaacg

SEQ ID NO: 183061 - DNA, 25 bp, E. coli
tgtctcaggcgataacaagtacgtg

SEQ ID NO: 183062 - DNA, 25 bp, E. coli
tgtctcaggcgaaaacaagtacgtg

SEQ ID NO: 183063 - DNA, 25 bp, E. coli
gcagaattacgggacgagtcaggaa

SEQ ID NO: 183064 - DNA, 25 bp, E. coli
gcagaattacggcacgagtcaggaa

SEQ ID NO: 183065 - DNA, 25 bp, E. coli
gcgcaacgacaacagccagtgattt

SEQ ID NO: 183066 - DNA, 25 bp, E. coli
gcgcaacgacaagagccagtgattt

SEQ ID NO: 183067 - DNA, 25 bp, E. coli
gaatgattttctcggcgctgcaaca

SEQ ID NO: 183068 - DNA, 25 bp, E. coli
gaatgattttctgggcgctgcaaca

SEQ ID NO: 183069 - DNA, 25 bp, E. coli
ccgggcagaaaatggatgaggctct

SEQ ID NO: 183070 - DNA, 25 bp, E. coli
ccgggcagaaaaaggatgaggctct

SEQ ID NO: 183071 - DNA, 25 bp, E. coli
tcaaacatggatctgcccgaaaccg

SEQ ID NO: 183072 - DNA, 25 bp, E. coli
tcaaacatggatgtgcccgaaaccg

SEQ ID NO: 183073 - DNA, 25 bp, E. coli
cacgctgggaacttcagacacgcaa

SEQ ID NO: 183074 - DNA, 25 bp, E. coli
cacgctgggaacatcagacacgcaa

SEQ ID NO: 183075 - DNA, 25 bp, E. coli
tacggagtatcagcatctatgggcc

SEQ ID NO: 183076 - DNA, 25 bp, E. coli
tacggagtatcaccatctatgggcc

SEQ ID NO: 183077 - DNA, 25 bp, E. coli
ttatccaccagagaggacggtcgct

SEQ ID NO: 183078 - DNA, 25 bp, E. coli
ttatccaccagacaggacggtcgct

SEQ ID NO: 183079 - DNA, 25 bp, E. coli
tgcgcaattggcacggctacttcaa

SEQ ID NO: 183080 - DNA, 25 bp, E. coli
tgcgcaattggctcggctacttcaa

SEQ ID NO: 183081 - DNA, 25 bp, E. coli
tctatgggccgaaatacaggtggtg

SEQ ID NO: 183082 - DNA, 25 bp, E. coli
tctatgggccgatatacaggtggtg

SEQ ID NO: 183083 - DNA, 25 bp, E. coli
cctgcctgggtgagaaatattctgc

SEQ ID NO: 183084 - DNA, 25 bp, E. coli
cctgcctgggtgtgaaatattctgc

SEQ ID NO: 183085 - DNA, 25 bp, E. coli
cggtcgctggcatcctgaaggatgt

SEQ ID NO: 183086 - DNA, 25 bp, E. coli
cggtcgctggcaacctgaaggatgt

SEQ ID NO: 183087 - DNA, 25 bp, E. coli
gatttcgccgtcattatgcctgagg

SEQ ID NO: 183088 - DNA, 25 bp, E. coli
gatttcgccgtctttatgcctgagg

SEQ ID NO: 183089 - DNA, 25 bp, E. coli
ggtctttaaagttccgcgcgacatg

SEQ ID NO: 183090 - DNA, 25 bp, E. coli
ggtctttaaagtaccgcgcgacatg

SEQ ID NO: 183091 - DNA, 25 bp, E. coli
taatctcaaccatttgtcgctggcg

SEQ ID NO: 183092 - DNA, 25 bp, E. coli
taatctcaaccaattgtcgctggcg

SEQ ID NO: 183093 - DNA, 25 bp, E. coli
gatgaagaacgtaagcccgatctgt

SEQ ID NO: 183094 - DNA, 25 bp, E. coli
gatgaagaacgttagcccgatctgt

SEQ ID NO: 183095 - DNA, 25 bp, E. coli
cataatgagccggaaggtgtcgtgt

SEQ ID NO: 183096 - DNA, 25 bp, E. coli
cataatgagccgcaaggtgtcgtgt

SEQ ID NO: 183097 - DNA, 25 bp, E. coli
tactggtctgttgaaccggaatcgg

SEQ ID NO: 183098 - DNA, 25 bp, E. coli
tacgactattgtaacgattgccggc

SEQ ID NO: 183099 - DNA, 25 bp, E. coli
taaatgttgagatgcgtgctggcgc

SEQ ID NO: 183100 - DNA, 25 bp, E. coli
tactggtctgttcaaccggaatcgg

SEQ ID NO: 183101 - DNA, 25 bp, E. coli
taaatgttgagaagcgtgctggcgc

SEQ ID NO: 183102 - DNA, 25 bp, E. coli
tacgactattgttacgattgccggc

SEQ ID NO: 183103 - DNA, 25 bp, E. coli
agtaattgagtcgtggcttgcgccg

SEQ ID NO: 183104 - DNA, 25 bp, E. coli
agtaattgagtcctggcttgcgccg

SEQ ID NO: 183105 - DNA, 25 bp, E. coli
aaattacatcatgcgacgtctcggg

SEQ ID NO: 183106 - DNA, 25 bp, E. coli
aaattacatcatccgacgtctcggg

SEQ ID NO: 183107 - DNA, 25 bp, E. coli
tatgcaggccagcaatgaagcgcgt

SEQ ID NO: 183108 - DNA, 25 bp, E. coli
tatgcaggccaggaatgaagcgcgt

SEQ ID NO: 183109 - DNA, 25 bp, E. coli
tatgatgtatcggaacacgcacggg

SEQ ID NO: 183110 - DNA, 25 bp, E. coli
tatgatgtatcgcaacacgcacggg

SEQ ID NO: 183111 - DNA, 25 bp, E. coli
tgtgtaatgaattatgccaggcgcg

SEQ ID NO: 183112 - DNA, 25 bp, E. coli
tgtgtaatgaataatgccaggcgcg

SEQ ID NO: 183113 - DNA, 25 bp, E. coli
tgtattcacgtctggatcccggaag

SEQ ID NO: 183114 - DNA, 25 bp, E. coli
tgtattcacgtcaggatcccggaag

SEQ ID NO: 183115 - DNA, 25 bp, E. coli
cattttcaggctccgatggagcggc

SEQ ID NO: 183116 - DNA, 25 bp, E. coli
cattttcaggctgcgatggagcggc

SEQ ID NO: 183117 - DNA, 25 bp, E. coli
ttgtggtctacttcatgttgaggaa

SEQ ID NO: 183118 - DNA, 25 bp, E. coli
ttgtggtctactacatgttgaggaa

SEQ ID NO: 183119 - DNA, 25 bp, E. coli
tttacccgaagggatggaagaagat

SEQ ID NO: 183120 - DNA, 25 bp, E. coli
tttacccgaaggcatggaagaagat

SEQ ID NO: 183121 - DNA, 25 bp, E. coli
tgaattcgacaaactggctggcgct

SEQ ID NO: 183122 - DNA, 25 bp, E. coli
tgaattcgacaatctggctggcgct

SEQ ID NO: 183123 - DNA, 25 bp, E. coli
tgccctggttttggtactggaaggt

SEQ ID NO: 183124 - DNA, 25 bp, E. coli
tgcgatgaccaatttgcccgataat

SEQ ID NO: 183125 - DNA, 25 bp, E. coli
tgcgatgaccaaattgcccgataat

SEQ ID NO: 183126 - DNA, 25 bp, E. coli
tgccctggttttcgtactggaaggt

SEQ ID NO: 183127 - DNA, 25 bp, E. coli
tttgcccgataatattttacgtcgt

SEQ ID NO: 183128 - DNA, 25 bp, E. coli
tttgcccgataaaattttacgtcgt

SEQ ID NO: 183129 - DNA, 25 bp, E. coli
ttacgtcgttttggcggtggacttg

SEQ ID NO: 183130 - DNA, 25 bp, E. coli
ttacgtcgttttcgcggtggacttg

SEQ ID NO: 183131 - DNA, 25 bp, E. coli
gaaggcatggaagaagatgatctct

SEQ ID NO: 183132 - DNA, 25 bp, E. coli
gaaggcatggaacaagatgatctct

SEQ ID NO: 183133 - DNA, 25 bp, E. coli
ctggcgcttgccgtggttttggtac

SEQ ID NO: 183134 - DNA, 25 bp, E. coli
ctggcgcttgccctggttttggtac

SEQ ID NO: 183135 - DNA, 25 bp, E. coli
gttgcgggcgttctggtctactaca

SEQ ID NO: 183136 - DNA, 25 bp, E. coli
gttgcgggcgttgtggtctactaca

SEQ ID NO: 183137 - DNA, 25 bp, E. coli
gatgatctctgcgatgaccaatttg

SEQ ID NO: 183138 - DNA, 25 bp, E. coli
gatgatctctgccatgaccaatttg

SEQ ID NO: 183139 - DNA, 25 bp, E. coli
aaccgtgcagaacatcctcgaccaa

SEQ ID NO: 183140 - DNA, 25 bp, E. coli
aaccgtgcagaagatcctcgaccaa

SEQ ID NO: 183141 - DNA, 25 bp, E. coli
caacttgatgattaacggagccatc

SEQ ID NO: 183142 - DNA, 25 bp, E. coli
caacttgatgataaacggagccatc

SEQ ID NO: 183143 - DNA, 25 bp, E. coli
ataaccgtgcagtacatcctcgacc

SEQ ID NO: 183144 - DNA, 25 bp, E. coli
ataaccgtgcagaacatcctcgacc

SEQ ID NO: 183145 - DNA, 25 bp, E. coli
tggtgccaccgtgaccataaccgtg

SEQ ID NO: 183146 - DNA, 25 bp, E. coli
tcggcgcatctcaggcactttcggg

SEQ ID NO: 183147 - DNA, 25 bp, E. coli
tcggcgcatctctggcactttcggg

SEQ ID NO: 183148 - DNA, 25 bp, E. coli
tctctggcacttacgggcaacattc

SEQ ID NO: 183149 - DNA, 25 bp, E. coli
tctctggcactttcgggcaacattc

SEQ ID NO: 183150 - DNA, 25 bp, E. coli
gcatctctggcagtttcgggcaaca

SEQ ID NO: 183151 - DNA, 25 bp, E. coli
gcatctctggcactttcgggcaaca

SEQ ID NO: 183152 - DNA, 25 bp, E. coli
gcgctcggcgcatctctggcacttt

SEQ ID NO: 183153 - DNA, 25 bp, E. coli
gcgctcggcgcaactctggcacttt

SEQ ID NO: 183154 - DNA, 25 bp, E. coli
cggagccatcatggaacagagaaaa

SEQ ID NO: 183155 - DNA, 25 bp, E. coli
cggagccatcatcgaacagagaaaa

SEQ ID NO: 183156 - DNA, 25 bp, E. coli
gattaacggagcgatcatggaacag

SEQ ID NO: 183157 - DNA, 25 bp, E. coli
gattaacggagccatcatggaacag

SEQ ID NO: 183158 - DNA, 25 bp, E. coli
ggcactttcgggcaacattctcggc

SEQ ID NO: 183159 - DNA, 25 bp, E. coli
ggcactttcggggaacattctcggc

SEQ ID NO: 183160 - DNA, 25 bp, E. coli
tggtgccaccgtcaccataaccgtg

SEQ ID NO: 183161 - DNA, 25 bp, E. coli
agtgcacgtacagcggcgacaaaac

SEQ ID NO: 183162 - DNA, 25 bp, E. coli
agtgcacgtacaccggcgacaaaac

SEQ ID NO: 183163 - DNA, 25 bp, E. coli
tgtttgtgggcgatacccgtattga

SEQ ID NO: 183164 - DNA, 25 bp, E. coli
tgtttgtgggcgttacccgtattga

SEQ ID NO: 183165 - DNA, 25 bp, E. coli
tgatggttctcctttgcgacgatct

SEQ ID NO: 183166 - DNA, 25 bp, E. coli
tgatggttctccattgcgacgatct

SEQ ID NO: 183167 - DNA, 25 bp, E. coli
gcgcagtggtgatcccggcaccaat

SEQ ID NO: 183168 - DNA, 25 bp, E. coli
gcgcagtggtgaacccggcaccaat

SEQ ID NO: 183169 - DNA, 25 bp, E. coli
gacaaaacaggccatcggcgcagtg

SEQ ID NO: 183170 - DNA, 25 bp, E. coli
gacaaaacaggcgatcggcgcagtg

SEQ ID NO: 183171 - DNA, 25 bp, E. coli
cgatacccgtatagatgaccggtaa

SEQ ID NO: 183172 - DNA, 25 bp, E. coli
cccgcttgtttgagggcgatacccg

SEQ ID NO: 183173 - DNA, 25 bp, E. coli
cgatacccgtattgatgaccggtaa

SEQ ID NO: 183174 - DNA, 25 bp, E. coli
cccgcttgtttgtgggcgatacccg

SEQ ID NO: 183175 - DNA, 25 bp, E. coli
ctttgcgacgatctccgccagtgca

SEQ ID NO: 183176 - DNA, 25 bp, E. coli
ctttgcgacgatgtccgccagtgca

SEQ ID NO: 183177 - DNA, 25 bp, E. coli
gtgatcccggcaccaatttgcccga

SEQ ID NO: 183178 - DNA, 25 bp, E. coli
gtacagcggcgagaaaacaggccat

SEQ ID NO: 183179 - DNA, 25 bp, E. coli
gtacagcggcgacaaaacaggccat

SEQ ID NO: 183180 - DNA, 25 bp, E. coli
gtgatcccggcagcaatttgcccga

SEQ ID NO: 183181 - DNA, 25 bp, E. coli
gatctccgccagtgcacgtacagcg

SEQ ID NO: 183182 - DNA, 25 bp, E. coli
gatctccgccagagcacgtacagcg

SEQ ID NO: 183183 - DNA, 25 bp, E. coli
caaccggtaagaaggaagaacgcac

SEQ ID NO: 183184 - DNA, 25 bp, E. coli
aagaatttatgtgtcgtgccggacg

SEQ ID NO: 183185 - DNA, 25 bp, E. coli
aagaatttatgtctcgtgccggacg

SEQ ID NO: 183186 - DNA, 25 bp, E. coli
caaccggtaagatggaagaacgcac

SEQ ID NO: 183187 - DNA, 25 bp, E. coli
taacaaaagggattcagcaactcgg

SEQ ID NO: 183188 - DNA, 25 bp, E. coli
taacaaaagggaatcagcaactcgg

SEQ ID NO: 183189 - DNA, 25 bp, E. coli
accaggctggatggcgttaaagaca

SEQ ID NO: 183190 - DNA, 25 bp, E. coli
accaggctggatcgcgttaaagaca

SEQ ID NO: 183191 - DNA, 25 bp, E. coli
tagatgttgcccctgcagagtatgg

SEQ ID NO: 183192 - DNA, 25 bp, E. coli
tagatgttgcccgtgcagagtatgg

SEQ ID NO: 183193 - DNA, 25 bp, E. coli
tccggttggtgatagcgagtcgaaa

SEQ ID NO: 183194 - DNA, 25 bp, E. coli
tccggttggtgaaagcgagtcgaaa

SEQ ID NO: 183195 - DNA, 25 bp, E. coli
gcccgtggaagccacattgcgattc

SEQ ID NO: 183196 - DNA, 25 bp, E. coli
gcccgtggaagcgacattgcgattc

SEQ ID NO: 183197 - DNA, 25 bp, E. coli
gctttcgttgcaaaaaccaggctgg

SEQ ID NO: 183198 - DNA, 25 bp, E. coli
gctttcgttgcataaaccaggctgg

SEQ ID NO: 183199 - DNA, 25 bp, E. coli
ggatatcagtatagccgacccagcc

SEQ ID NO: 183200 - DNA, 25 bp, E. coli
ggtacacaggtacgcaaattcagcc

SEQ ID NO: 183201 - DNA, 25 bp, E. coli
ggtacacaggtaggcaaattcagcc

SEQ ID NO: 183202 - DNA, 25 bp, E. coli
ggatatcagtattgccgacccagcc

SEQ ID NO: 183203 - DNA, 25 bp, E. coli
tggtaatgtcatcccagcactggca

SEQ ID NO: 183204 - DNA, 25 bp, E. coli
tggtaatgtcatgccagcactggca

SEQ ID NO: 183205 - DNA, 25 bp, E. coli
caagggtctggtctgcatacgatac

SEQ ID NO: 183206 - DNA, 25 bp, E. coli
caagggtctggtgtgcatacgatac

SEQ ID NO: 183207 - DNA, 25 bp, E. coli
tacttaccgggccatcagtcaatgg

SEQ ID NO: 183208 - DNA, 25 bp, E. coli
taaaaatggcgcatcacctgttccc

SEQ ID NO: 183209 - DNA, 25 bp, E. coli
tacttaccgggcgatcagtcaatgg

SEQ ID NO: 183210 - DNA, 25 bp, E. coli
taaaaatggcgcttcacctgttccc

SEQ ID NO: 183211 - DNA, 25 bp, E. coli
tacatctggcagagcgaatcctggt

SEQ ID NO: 183212 - DNA, 25 bp, E. coli
tacatctggcagtgcgaatcctggt

SEQ ID NO: 183213 - DNA, 25 bp, E. coli
gacagcgatctagaaactaagggtt

SEQ ID NO: 183214 - DNA, 25 bp, E. coli
gacagcgatctacaaactaagggtt

SEQ ID NO: 183215 - DNA, 25 bp, E. coli
tatgaaaccgaagatgacacctccg

SEQ ID NO: 183216 - DNA, 25 bp, E. coli
tatgaaaccgaacatgacacctccg

SEQ ID NO: 183217 - DNA, 25 bp, E. coli
tttttataaacccacgcagctcggc

SEQ ID NO: 183218 - DNA, 25 bp, E. coli
tttttataaaccgacgcagctcggc

SEQ ID NO: 183219 - DNA, 25 bp, E. coli
gttgataactatcgaggcccctcca

SEQ ID NO: 183220 - DNA, 25 bp, E. coli
gttgataactatggaggcccctcca

SEQ ID NO: 183221 - DNA, 25 bp, E. coli
ggaatattgctaacgaacccggcga

SEQ ID NO: 183222 - DNA, 25 bp, E. coli
ggaatattgctatcgaacccggcga

SEQ ID NO: 183223 - DNA, 25 bp, E. coli
taagggttgcaagaaagcagacgac

SEQ ID NO: 183224 - DNA, 25 bp, E. coli
taatcaaggtaacggcacatcacag

SEQ ID NO: 183225 - DNA, 25 bp, E. coli
taatcaaggtaagggcacatcacag

SEQ ID NO: 183226 - DNA, 25 bp, E. coli
taagggttgcaacaaagcagacgac

SEQ ID NO: 183227 - DNA, 25 bp, E. coli
caggatttgtgatgttggtaggaca

SEQ ID NO: 183228 - DNA, 25 bp, E. coli
caggatttgtgaagttggtaggaca

SEQ ID NO: 183229 - DNA, 25 bp, E. coli
tactggtgcagtttgttcaggccga

SEQ ID NO: 183230 - DNA, 25 bp, E. coli
tactggtgcagtatgttcaggccga

SEQ ID NO: 183231 - DNA, 25 bp, E. coli
atttgggcgacacgatttgtgatgt

SEQ ID NO: 183232 - DNA, 25 bp, E. coli
atttgggcgacaggatttgtgatgt

SEQ ID NO: 183233 - DNA, 25 bp, E. coli
ttaccgatcctcgtaatttgtatcg

SEQ ID NO: 183234 - DNA, 25 bp, E. coli
ttaccgatcctcctaatttgtatcg

SEQ ID NO: 183235 - DNA, 25 bp, E. coli
ttacggcagattataccgatcctcg

SEQ ID NO: 183236 - DNA, 25 bp, E. coli
ttacggcagattttaccgatcctcg

SEQ ID NO: 183237 - DNA, 25 bp, E. coli
tgttggtaggacagttcctcggcgc

SEQ ID NO: 183238 - DNA, 25 bp, E. coli
tgttggtaggactgttcctcggcgc

SEQ ID NO: 183239 - DNA, 25 bp, E. coli
cctcgtaatttgaatcggtctttat

SEQ ID NO: 183240 - DNA, 25 bp, E. coli
cctcgtaatttgtatcggtctttat

SEQ ID NO: 183241 - DNA, 25 bp, E. coli
gcagtatgttcacgccgatgtctta

SEQ ID NO: 183242 - DNA, 25 bp, E. coli
gcaggtggttgcgtcggtttttacg

SEQ ID NO: 183243 - DNA, 25 bp, E. coli
gcagtatgttcaggccgatgtctta

SEQ ID NO: 183244 - DNA, 25 bp, E. coli
gcaggtggttgcctcggtttttacg

SEQ ID NO: 183245 - DNA, 25 bp, E. coli
cggcgcgctactcgtgcagtatgtt

SEQ ID NO: 183246 - DNA, 25 bp, E. coli
cggcgcgctactggtgcagtatgtt

SEQ ID NO: 183247 - DNA, 25 bp, E. coli
ggtctttatttcttactgatgccaa

SEQ ID NO: 183248 - DNA, 25 bp, E. coli
ggtctttatttcatactgatgccaa

SEQ ID NO: 183249 - DNA, 25 bp, E. coli
tacgttgctgtataccgaaatggtg

SEQ ID NO: 183250 - DNA, 25 bp, E. coli
tacattgagcgtcaactcagccagg

SEQ ID NO: 183251 - DNA, 25 bp, E. coli
tacgttgctgtaaaccgaaatggtg

SEQ ID NO: 183252 - DNA, 25 bp, E. coli
tacattgagcgtgaactcagccagg

SEQ ID NO: 183253 - DNA, 25 bp, E. coli
tatccgcgtgtgtatcaactgaagc

SEQ ID NO: 183254 - DNA, 25 bp, E. coli
tatccgcgtgtgaatcaactgaagc

SEQ ID NO: 183255 - DNA, 25 bp, E. coli
ttgccgactgcgtgaaagcgatgcg

SEQ ID NO: 183256 - DNA, 25 bp, E. coli
ttgccgactgcgagaaagcgatgcg

SEQ ID NO: 183257 - DNA, 25 bp, E. coli
tgagatcaacctgaatgtcggctgc

SEQ ID NO: 183258 - DNA, 25 bp, E. coli
tgagatcaacctcaatgtcggctgc

SEQ ID NO: 183259 - DNA, 25 bp, E. coli
gaagaacatccgctagcgttgcaac

SEQ ID NO: 183260 - DNA, 25 bp, E. coli
gaagaacatccggtagcgttgcaac

SEQ ID NO: 183261 - DNA, 25 bp, E. coli
gtagtgcgcgccatgtatccgtaca

SEQ ID NO: 183262 - DNA, 25 bp, E. coli
gtagtgcgcgccttgtatccgtaca

SEQ ID NO: 183263 - DNA, 25 bp, E. coli
tggcgtacagtgtagaagaacatcc

SEQ ID NO: 183264 - DNA, 25 bp, E. coli
tggcgtacagtgaagaagaacatcc

SEQ ID NO: 183265 - DNA, 25 bp, E. coli
taatgcgcagctcgttgccgactgc

SEQ ID NO: 183266 - DNA, 25 bp, E. coli
taacggtggtatcaagtcgctggaa

SEQ ID NO: 183267 - DNA, 25 bp, E. coli
taacggtggtatgaagtcgctggaa

SEQ ID NO: 183268 - DNA, 25 bp, E. coli
taatgcgcagctggttgccgactgc

SEQ ID NO: 183269 - DNA, 25 bp, E. coli
gatgttcatcatgcacgcacgtaaa

SEQ ID NO: 183270 - DNA, 25 bp, E. coli
gatgttcatcatccacgcacgtaaa

SEQ ID NO: 183271 - DNA, 25 bp, E. coli
cagtggagcggtacctggcgttaca

SEQ ID NO: 183272 - DNA, 25 bp, E. coli
cagtggagcggttcctggcgttaca

SEQ ID NO: 183273 - DNA, 25 bp, E. coli
taaactttggcctcacagcgaatca

SEQ ID NO: 183274 - DNA, 25 bp, E. coli
tacagtggagcggttcctggcgtta

SEQ ID NO: 183275 - DNA, 25 bp, E. coli
tacagtggagcgcttcctggcgtta

SEQ ID NO: 183276 - DNA, 25 bp, E. coli
taaactttggccacacagcgaatca

SEQ ID NO: 183277 - DNA, 25 bp, E. coli
tcctgaaaacggtcgatctccgtca

SEQ ID NO: 183278 - DNA, 25 bp, E. coli
tcctgaaaacggacgatctccgtca

SEQ ID NO: 183279 - DNA, 25 bp, E. coli
tcagcgtacagtcgagcggttcctg

SEQ ID NO: 183280 - DNA, 25 bp, E. coli
tcagcgtacagtggagcggttcctg

SEQ ID NO: 183281 - DNA, 25 bp, E. coli
gaaaacggtcgaactccgtcagccg

SEQ ID NO: 183282 - DNA, 25 bp, E. coli
gaaaacggtcgatctccgtcagccg

SEQ ID NO: 183283 - DNA, 25 bp, E. coli
ctttggcctcactgcgaatcatata

SEQ ID NO: 183284 - DNA, 25 bp, E. coli
ctttggcctcacagcgaatcatata

SEQ ID NO: 183285 - DNA, 25 bp, E. coli
gtcgatctccgtgagccgctgcaaa

SEQ ID NO: 183286 - DNA, 25 bp, E. coli
gtcgatctccgtcagccgctgcaaa

SEQ ID NO: 183287 - DNA, 25 bp, E. coli
tggcctcacagccaatcatatatct

SEQ ID NO: 183288 - DNA, 25 bp, E. coli
tggcctcacagcgaatcatatatct

SEQ ID NO: 183289 - DNA, 25 bp, E. coli
taatggcgggctggaaatcctgaaa

SEQ ID NO: 183290 - DNA, 25 bp, E. coli
tcacagcgaatcatatatcttcgcc

SEQ ID NO: 183291 - DNA, 25 bp, E. coli
tcacagcgaatcttatatcttcgcc

SEQ ID NO: 183292 - DNA, 25 bp, E. coli
taatggcgggctcgaaatcctgaaa

SEQ ID NO: 183293 - DNA, 25 bp, E. coli
cactgcgaaccatctgaagaatctg

SEQ ID NO: 183294 - DNA, 25 bp, E. coli
caccggtgttaatatatagcttcag

SEQ ID NO: 183295 - DNA, 25 bp, E. coli
cactgcgaaccaactgaagaatctg

SEQ ID NO: 183296 - DNA, 25 bp, E. coli
caccggtgttaaaatatagcttcag

SEQ ID NO: 183297 - DNA, 25 bp, E. coli
tattaacccggacgagtcaccggtg

SEQ ID NO: 183298 - DNA, 25 bp, E. coli
tattaacccggaggagtcaccggtg

SEQ ID NO: 183299 - DNA, 25 bp, E. coli
acacgaagtgtataaactgatgcag

SEQ ID NO: 183300 - DNA, 25 bp, E. coli
acacgaagtgtaaaaactgatgcag

SEQ ID NO: 183301 - DNA, 25 bp, E. coli
acacttatgcactcggtggttcgga

SEQ ID NO: 183302 - DNA, 25 bp, E. coli
acacttatgcacacggtggttcgga

SEQ ID NO: 183303 - DNA, 25 bp, E. coli
tatagcttcagtaaacacgaagtgt

SEQ ID NO: 183304 - DNA, 25 bp, E. coli
tatagcttcagttaacacgaagtgt

SEQ ID NO: 183305 - DNA, 25 bp, E. coli
cctgcactgggcaagttattagcga

SEQ ID NO: 183306 - DNA, 25 bp, E. coli
cctgcactgggctagttattagcga

SEQ ID NO: 183307 - DNA, 25 bp, E. coli
gaagaatctgtatttattaacccgg

SEQ ID NO: 183308 - DNA, 25 bp, E. coli
gaagaatctgtaattattaacccgg

SEQ ID NO: 183309 - DNA, 25 bp, E. coli
gaaattggcatctccgacacttatg

SEQ ID NO: 183310 - DNA, 25 bp, E. coli
gaaattggcatcaccgacacttatg

SEQ ID NO: 183311 - DNA, 25 bp, E. coli
gataaaaagccatagcctgtccacg

SEQ ID NO: 183312 - DNA, 25 bp, E. coli
gataaaaagccaaagcctgtccacg

SEQ ID NO: 183313 - DNA, 25 bp, E. coli
tggttcggatatccgtcactgcgaa

SEQ ID NO: 183314 - DNA, 25 bp, E. coli
tggttcggatatgcgtcactgcgaa

SEQ ID NO: 183315 - DNA, 25 bp, E. coli
catgattgtgataaacccgccgtgg

SEQ ID NO: 183316 - DNA, 25 bp, E. coli
catgattgtgattaacccgccgtgg

SEQ ID NO: 183317 - DNA, 25 bp, E. coli
taaacataccgttcagagcctgatc

SEQ ID NO: 183318 - DNA, 25 bp, E. coli
taaacataccgtacagagcctgatc

SEQ ID NO: 183319 - DNA, 25 bp, E. coli
tactgcgtgaacaggacagcctgca

SEQ ID NO: 183320 - DNA, 25 bp, E. coli
tactgcgtgaactggacagcctgca

SEQ ID NO: 183321 - DNA, 25 bp, E. coli
tatcagttaggcagcgaacatgccg

SEQ ID NO: 183322 - DNA, 25 bp, E. coli
tatcagttaggctgcgaacatgccg

SEQ ID NO: 183323 - DNA, 25 bp, E. coli
tgaataacgtgctgccgtggctgca

SEQ ID NO: 183324 - DNA, 25 bp, E. coli
tgaataacgtgcagccgtggctgca

SEQ ID NO: 183325 - DNA, 25 bp, E. coli
tcagcgggataggagaaggttacaa

SEQ ID NO: 183326 - DNA, 25 bp, E. coli
tcagcgggatagcagaaggttacaa

SEQ ID NO: 183327 - DNA, 25 bp, E. coli
gcccgtatctgggagcaggacgatt

SEQ ID NO: 183328 - DNA, 25 bp, E. coli
gcccgtatctggcagcaggacgatt

SEQ ID NO: 183329 - DNA, 25 bp, E. coli
gaaggttacaaacgtttcgccactg

SEQ ID NO: 183330 - DNA, 25 bp, E. coli
gaaggttacaaaggtttcgccactg

SEQ ID NO: 183331 - DNA, 25 bp, E. coli
tggtaaaacacttcaaccgtagcgg

SEQ ID NO: 183332 - DNA, 25 bp, E. coli
tggtaaaacactacaaccgtagcgg

SEQ ID NO: 183333 - DNA, 25 bp, E. coli
gagcgtaccggcgaatatctcgaag

SEQ ID NO: 183334 - DNA, 25 bp, E. coli
gagcgtaccggccaatatctcgaag

SEQ ID NO: 183335 - DNA, 25 bp, E. coli
gacggtttccaggagcttaaggcca

SEQ ID NO: 183336 - DNA, 25 bp, E. coli
gacggtttccagcagcttaaggcca

SEQ ID NO: 183337 - DNA, 25 bp, E. coli
caaaatcctttctcgctcttgatag

SEQ ID NO: 183338 - DNA, 25 bp, E. coli
caaaatcctttcacgctcttgatag

SEQ ID NO: 183339 - DNA, 25 bp, E. coli
caggctgacagaccacggtcaacag

SEQ ID NO: 183340 - DNA, 25 bp, E. coli
caggctgacagagcacggtcaacag

SEQ ID NO: 183341 - DNA, 25 bp, E. coli
actcaggaggaattatgcgaattct

SEQ ID NO: 183342 - DNA, 25 bp, E. coli
actcaggaggaaatatgcgaattct

SEQ ID NO: 183343 - DNA, 25 bp, E. coli
tatgctcactacacctgccacttgt

SEQ ID NO: 183344 - DNA, 25 bp, E. coli
tatgctcactactcctgccacttgt

SEQ ID NO: 183345 - DNA, 25 bp, E. coli
tgtacaggccgcaccttatgctcac

SEQ ID NO: 183346 - DNA, 25 bp, E. coli
tgtacaggccgctccttatgctcac

SEQ ID NO: 183347 - DNA, 25 bp, E. coli
tgccagaccggacgattcagtattc

SEQ ID NO: 183348 - DNA, 25 bp, E. coli
tgccagaccggaggattcagtattc

SEQ ID NO: 183349 - DNA, 25 bp, E. coli
tctgacgggcgcccgtactgtacag

SEQ ID NO: 183350 - DNA, 25 bp, E. coli
tctgacgggcgcgcgtactgtacag

SEQ ID NO: 183351 - DNA, 25 bp, E. coli
ccacttgtgtggcagtgcactcaga

SEQ ID NO: 183352 - DNA, 25 bp, E. coli
ccacttgtgtgggagtgcactcaga

SEQ ID NO: 183353 - DNA, 25 bp, E. coli
ctttctcgctcttgatagcaacgga

SEQ ID NO: 183354 - DNA, 25 bp, E. coli
ctttctcgctctagatagcaacgga

SEQ ID NO: 183355 - DNA, 25 bp, E. coli
gtattccccggacaactcaggagga

SEQ ID NO: 183356 - DNA, 25 bp, E. coli
gtattccccggagaactcaggagga

SEQ ID NO: 183357 - DNA, 25 bp, E. coli
gaggattcagtattccccggacaac

SEQ ID NO: 183358 - DNA, 25 bp, E. coli
gaggattcagtaatccccggacaac

SEQ ID NO: 183359 - DNA, 25 bp, E. coli
aattgttaggtatatctcgttcgac

SEQ ID NO: 183360 - DNA, 25 bp, E. coli
aattgttaggtaaatctcgttcgac

SEQ ID NO: 183361 - DNA, 25 bp, E. coli
tacatactgtacgtgccagatcagc

SEQ ID NO: 183362 - DNA, 25 bp, E. coli
tacatactgtacctgccagatcagc

SEQ ID NO: 183363 - DNA, 25 bp, E. coli
atactacgatgctaccttccccagg

SEQ ID NO: 183364 - DNA, 25 bp, E. coli
atactacgatgcaaccttccccagg

SEQ ID NO: 183365 - DNA, 25 bp, E. coli
tttcttcagatatgaccatgagcag

SEQ ID NO: 183366 - DNA, 25 bp, E. coli
tttcttcagataagaccatgagcag

SEQ ID NO: 183367 - DNA, 25 bp, E. coli
tgaatccgttatggaaatactacga

SEQ ID NO: 183368 - DNA, 25 bp, E. coli
tgaatccgttatcgaaatactacga

SEQ ID NO: 183369 - DNA, 25 bp, E. coli
tccccaggccggaacgtcttggtag

SEQ ID NO: 183370 - DNA, 25 bp, E. coli
tgcctgaactgacccaattgttagg

SEQ ID NO: 183371 - DNA, 25 bp, E. coli
tgcctgaactgagccaattgttagg

SEQ ID NO: 183372 - DNA, 25 bp, E. coli
tccccaggccggtacgtcttggtag

SEQ ID NO: 183373 - DNA, 25 bp, E. coli
ccagatcagcagtcaaaggtgttaa

SEQ ID NO: 183374 - DNA, 25 bp, E. coli
ccagatcagcagacaaaggtgttaa

SEQ ID NO: 183375 - DNA, 25 bp, E. coli
cgttcatcagcttttgacgaatggc

SEQ ID NO: 183376 - DNA, 25 bp, E. coli
cgttcatcagctattgacgaatggc

SEQ ID NO: 183377 - DNA, 25 bp, E. coli
gttctgtgggctggcgttcatcagc

SEQ ID NO: 183378 - DNA, 25 bp, E. coli
gttctgtgggctcgcgttcatcagc

SEQ ID NO: 183379 - DNA, 25 bp, E. coli
gacgaatggctttctttacatactg

SEQ ID NO: 183380 - DNA, 25 bp, E. coli
gacgaatggcttactttacatactg

SEQ ID NO: 183381 - DNA, 25 bp, E. coli
caagatttaaacgagtatgggaggg

SEQ ID NO: 183382 - DNA, 25 bp, E. coli
caagatttaaaccagtatgggaggg

SEQ ID NO: 183383 - DNA, 25 bp, E. coli
cagagtcagcaatatatatcaagcg

SEQ ID NO: 183384 - DNA, 25 bp, E. coli
cagagtcagcaaaatatatcaagcg

SEQ ID NO: 183385 - DNA, 25 bp, E. coli
tatgtacatggtgttagggtaagcg

SEQ ID NO: 183386 - DNA, 25 bp, E. coli
tatgtacatggtcttagggtaagcg

SEQ ID NO: 183387 - DNA, 25 bp, E. coli
tatatacagccactaatgcagcaag

SEQ ID NO: 183388 - DNA, 25 bp, E. coli
tatatacagccagtaatgcagcaag

SEQ ID NO: 183389 - DNA, 25 bp, E. coli
tcccctgcaaaaagaaactgttctg

SEQ ID NO: 183390 - DNA, 25 bp, E. coli
tcccctgcaaaatgaaactgttctg

SEQ ID NO: 183391 - DNA, 25 bp, E. coli
gctaatcaagggatagacaccagac

SEQ ID NO: 183392 - DNA, 25 bp, E. coli
gctaatcaagggttagacaccagac

SEQ ID NO: 183393 - DNA, 25 bp, E. coli
gattagcgacattgacttttcagag

SEQ ID NO: 183394 - DNA, 25 bp, E. coli
gattatccacagtacatcccctgca

SEQ ID NO: 183395 - DNA, 25 bp, E. coli
gattagcgacatagacttttcagag

SEQ ID NO: 183396 - DNA, 25 bp, E. coli
gattatccacagaacatcccctgca

SEQ ID NO: 183397 - DNA, 25 bp, E. coli
gggcacagaaatatacatcatacgg

SEQ ID NO: 183398 - DNA, 25 bp, E. coli
gggcacagaaatttacatcatacgg

SEQ ID NO: 183399 - DNA, 25 bp, E. coli
tggctagcactacgtgataacatag

SEQ ID NO: 183400 - DNA, 25 bp, E. coli
tggctagcactaggtgataacatag

SEQ ID NO: 183401 - DNA, 25 bp, E. coli
taagcgagcttaatgcactaaagat

SEQ ID NO: 183402 - DNA, 25 bp, E. coli
taagcgagcttattgcactaaagat

SEQ ID NO: 183403 - DNA, 25 bp, E. coli
caacgctgtggctgaccataaccag

SEQ ID NO: 183404 - DNA, 25 bp, E. coli
caacgctgtggcagaccataaccag

SEQ ID NO: 183405 - DNA, 25 bp, E. coli
cattaacccggcaatcaggtacaag

SEQ ID NO: 183406 - DNA, 25 bp, E. coli
cattaacccggctatcaggtacaag

SEQ ID NO: 183407 - DNA, 25 bp, E. coli
tagtggtggatgagctttacgccgc

SEQ ID NO: 183408 - DNA, 25 bp, E. coli
tagtggtggatgtgctttacgccgc

SEQ ID NO: 183409 - DNA, 25 bp, E. coli
tatagaactggtccgtcagcagctg

SEQ ID NO: 183410 - DNA, 25 bp, E. coli
tatagaactggtgcgtcagcagctg

SEQ ID NO: 183411 - DNA, 25 bp, E. coli
tgatcccggtagtgaccatgatggg

SEQ ID NO: 183412 - DNA, 25 bp, E. coli
tgatcccggtagagaccatgatggg

SEQ ID NO: 183413 - DNA, 25 bp, E. coli
gcccgaagctgaagcgcaggttata

SEQ ID NO: 183414 - DNA, 25 bp, E. coli
gcccgaagctgatgcgcaggttata

SEQ ID NO: 183415 - DNA, 25 bp, E. coli
gaaacctgggttctcctcaaacacg

SEQ ID NO: 183416 - DNA, 25 bp, E. coli
gaaacctgggttgtcctcaaacacg

SEQ ID NO: 183417 - DNA, 25 bp, E. coli
gacgcttactcgatgactccgtaga

SEQ ID NO: 183418 - DNA, 25 bp, E. coli
gacgcttactcgttgactccgtaga

SEQ ID NO: 183419 - DNA, 25 bp, E. coli
cctaccgtgggagcagacagttggc

SEQ ID NO: 183420 - DNA, 25 bp, E. coli
cctaccgtgggaccagacagttggc

SEQ ID NO: 183421 - DNA, 25 bp, E. coli
gttgaactgggctggctgcctaccg

SEQ ID NO: 183422 - DNA, 25 bp, E. coli
gattatatgcgtaccgcgagggcga

SEQ ID NO: 183423 - DNA, 25 bp, E. coli
gttgaactgggcaggctgcctaccg

SEQ ID NO: 183424 - DNA, 25 bp, E. coli
gattatatgcgttccgcgagggcga

SEQ ID NO: 183425 - DNA, 25 bp, E. coli
catcgggcgtcgctttctggtgcct

SEQ ID NO: 183426 - DNA, 25 bp, E. coli
catcgggcgtcggtttctggtgcct

SEQ ID NO: 183427 - DNA, 25 bp, E. coli
aggggtcggtgtggccaaaatccat

SEQ ID NO: 183428 - DNA, 25 bp, E. coli
acgtgccatgccagaaagacctttc

SEQ ID NO: 183429 - DNA, 25 bp, E. coli
acgtgccatgcctgaaagacctttc

SEQ ID NO: 183430 - DNA, 25 bp, E. coli
aggggtcggtgtcgccaaaatccat

SEQ ID NO: 183431 - DNA, 25 bp, E. coli
ttttcatcgggcgtcggtttctggt

SEQ ID NO: 183432 - DNA, 25 bp, E. coli
ttttcatcgggcctcggtttctggt

SEQ ID NO: 183433 - DNA, 25 bp, E. coli
tgaaagacctttccccatggctggg

SEQ ID NO: 183434 - DNA, 25 bp, E. coli
tgaaattgtttatcagagatcaaaa

SEQ ID NO: 183435 - DNA, 25 bp, E. coli
tgaaagacctttgcccatggctggg

SEQ ID NO: 183436 - DNA, 25 bp, E. coli
tgaaattgtttaacagagatcaaaa

SEQ ID NO: 183437 - DNA, 25 bp, E. coli
gacctttccccaaggctgggtcgta

SEQ ID NO: 183438 - DNA, 25 bp, E. coli
gacctttccccatggctgggtcgta

SEQ ID NO: 183439 - DNA, 25 bp, E. coli
cgatggtgaaattgtttatcagaga

SEQ ID NO: 183440 - DNA, 25 bp, E. coli
cgatggtgaaatagtttatcagaga

SEQ ID NO: 183441 - DNA, 25 bp, E. coli
gattcggaacgtcccatgcctgaaa

SEQ ID NO: 183442 - DNA, 25 bp, E. coli
gattcggaacgtgccatgcctgaaa

SEQ ID NO: 183443 - DNA, 25 bp, E. coli
ggaacgtgccatgcctgaaagacct

SEQ ID NO: 183444 - DNA, 25 bp, E. coli
ggaacgtgccatccctgaaagacct

SEQ ID NO: 183445 - DNA, 25 bp, E. coli
gacgattcggaacgtgccatgcctg

SEQ ID NO: 183446 - DNA, 25 bp, E. coli
gacgattcggaaggtgccatgcctg

SEQ ID NO: 183447 - DNA, 25 bp, E. coli
cacggcggcactccttgcagaaaac

SEQ ID NO: 183448 - DNA, 25 bp, E. coli
cacggcggcactgcttgcagaaaac

SEQ ID NO: 183449 - DNA, 25 bp, E. coli
cagcaacttaatcagtggacgcaga

SEQ ID NO: 183450 - DNA, 25 bp, E. coli
cagcaacttaatgagtggacgcaga

SEQ ID NO: 183451 - DNA, 25 bp, E. coli
acaacgtttgcacgcctggcagaca

SEQ ID NO: 183452 - DNA, 25 bp, E. coli
aaagatggatgagttcgcccagcgc

SEQ ID NO: 183453 - DNA, 25 bp, E. coli
acaacgtttgcaggcctggcagaca

SEQ ID NO: 183454 - DNA, 25 bp, E. coli
aaaagccattacacagcatcgccag

SEQ ID NO: 183455 - DNA, 25 bp, E. coli
aaagatggatgacttcgcccagcgc

SEQ ID NO: 183456 - DNA, 25 bp, E. coli
aaaagccattactcagcatcgccag

SEQ ID NO: 183457 - DNA, 25 bp, E. coli
tatcagcagtttttccagacgctgg

SEQ ID NO: 183458 - DNA, 25 bp, E. coli
tatcagcagtttatccagacgctgg

SEQ ID NO: 183459 - DNA, 25 bp, E. coli
tgtcagcaggcggaagaacagctca

SEQ ID NO: 183460 - DNA, 25 bp, E. coli
tgtcagcaggcgcaagaacagctca

SEQ ID NO: 183461 - DNA, 25 bp, E. coli
gcgccgccatgaggaaacctgaatg

SEQ ID NO: 183462 - DNA, 25 bp, E. coli
gcgccgccatgacgaaacctgaatg

SEQ ID NO: 183463 - DNA, 25 bp, E. coli
gctggcgaccctcaaagatctggca

SEQ ID NO: 183464 - DNA, 25 bp, E. coli
gctggcgaccctgaaagatctggca

SEQ ID NO: 183465 - DNA, 25 bp, E. coli
gaaaaccgcctccatcagaaaaaga

SEQ ID NO: 183466 - DNA, 25 bp, E. coli
gaaaaccgcctcgatcagaaaaaga

SEQ ID NO: 183467 - DNA, 25 bp, E. coli
gacgcagaaagttgacattgccctg

SEQ ID NO: 183468 - DNA, 25 bp, E. coli
gacgcagaaagtagacattgccctg

SEQ ID NO: 183469 - DNA, 25 bp, E. coli
aagaagaagagaactggcgtcggca

SEQ ID NO: 183470 - DNA, 25 bp, E. coli
aagaagaagagatctggcgtcggca

SEQ ID NO: 183471 - DNA, 25 bp, E. coli
catctttgattctcgcctgcgtgaa

SEQ ID NO: 183472 - DNA, 25 bp, E. coli
cagagcgccgctaacgtctgcgtaa

SEQ ID NO: 183473 - DNA, 25 bp, E. coli
cagagcgccgcttacgtctgcgtaa

SEQ ID NO: 183474 - DNA, 25 bp, E. coli
catctttgattcacgcctgcgtgaa

SEQ ID NO: 183475 - DNA, 25 bp, E. coli
tacaggtatacctagtccgccacgg

SEQ ID NO: 183476 - DNA, 25 bp, E. coli
tacaggtataccaagtccgccacgg

SEQ ID NO: 183477 - DNA, 25 bp, E. coli
agtcaatgcaggagctcagcgatcg

SEQ ID NO: 183478 - DNA, 25 bp, E. coli
agtcaatgcaggtgctcagcgatcg

SEQ ID NO: 183479 - DNA, 25 bp, E. coli
tattcagggccactctgacagcccg

SEQ ID NO: 183480 - DNA, 25 bp, E. coli
tattcagggccagtctgacagcccg

SEQ ID NO: 183481 - DNA, 25 bp, E. coli
tctggacgcccctgcattagatgag

SEQ ID NO: 183482 - DNA, 25 bp, E. coli
tctggacgccccagcattagatgag

SEQ ID NO: 183483 - DNA, 25 bp, E. coli
gaatcttgccgggacttaccgcagg

SEQ ID NO: 183484 - DNA, 25 bp, E. coli
gaatcttgccggcacttaccgcagg

SEQ ID NO: 183485 - DNA, 25 bp, E. coli
gtaactgttctatttcgcgcgtgga

SEQ ID NO: 183486 - DNA, 25 bp, E. coli
gattctcggattaccagcatgggca

SEQ ID NO: 183487 - DNA, 25 bp, E. coli
gtaactgttctaattcgcgcgtgga

SEQ ID NO: 183488 - DNA, 25 bp, E. coli
gattctcggatttccagcatgggca

SEQ ID NO: 183489 - DNA, 25 bp, E. coli
ggcgtattcctgaaggcgagtcaat

SEQ ID NO: 183490 - DNA, 25 bp, E. coli
ggcgtattcctgtaggcgagtcaat

SEQ ID NO: 183491 - DNA, 25 bp, E. coli
cacggatcggaatacagaaggcggt

SEQ ID NO: 183492 - DNA, 25 bp, E. coli
cacggatcggaaaacagaaggcggt

SEQ ID NO: 183493 - DNA, 25 bp, E. coli
cagaaggcggtttaacagaggaaag

SEQ ID NO: 183494 - DNA, 25 bp, E. coli
caggtaatagttaatgacaatttca

SEQ ID NO: 183495 - DNA, 25 bp, E. coli
caggtaatagtttatgacaatttca

SEQ ID NO: 183496 - DNA, 25 bp, E. coli
cagaaggcggttaaacagaggaaag

SEQ ID NO: 183497 - DNA, 25 bp, E. coli
taaaacgatgcagccaaagtttgcc

SEQ ID NO: 183498 - DNA, 25 bp, E. coli
taaaacgatgcacccaaagtttgcc

SEQ ID NO: 183499 - DNA, 25 bp, E. coli
agctgcaaaaaaagcacggatcgga

SEQ ID NO: 183500 - DNA, 25 bp, E. coli
agctgcaaaaaatgcacggatcgga

SEQ ID NO: 183501 - DNA, 25 bp, E. coli
tatggcgactgttaaacgatgcagc

SEQ ID NO: 183502 - DNA, 25 bp, E. coli
tatggcgactgtaaaacgatgcagc

SEQ ID NO: 183503 - DNA, 25 bp, E. coli
tttgcagaaaaatggaattagctgc

SEQ ID NO: 183504 - DNA, 25 bp, E. coli
tttgcagaaaaaaggaattagctgc

SEQ ID NO: 183505 - DNA, 25 bp, E. coli
tccgtctcctttacctggtggttat

SEQ ID NO: 183506 - DNA, 25 bp, E. coli
tccgtctccttttcctggtggttat

SEQ ID NO: 183507 - DNA, 25 bp, E. coli
tggttattgtccttttttggccggg

SEQ ID NO: 183508 - DNA, 25 bp, E. coli
tggttattgtccatttttggccggg

SEQ ID NO: 183509 - DNA, 25 bp, E. coli
taacagaggaaacgcttatggcgac

SEQ ID NO: 183510 - DNA, 25 bp, E. coli
taacagaggaaaggcttatggcgac

SEQ ID NO: 183511 - DNA, 25 bp, E. coli
gatgcagccaaagtttgcctttggc

SEQ ID NO: 183512 - DNA, 25 bp, E. coli
gatgcagccaaactttgcctttggc

SEQ ID NO: 183513 - DNA, 25 bp, E. coli
tactggtggcgttagccactgtcaa

SEQ ID NO: 183514 - DNA, 25 bp, E. coli
tactggtggcgtaagccactgtcaa

SEQ ID NO: 183515 - DNA, 25 bp, E. coli
attggcgcggcggtgatcggtcagc

SEQ ID NO: 183516 - DNA, 25 bp, E. coli
attggcgcggcgctgatcggtcagc

SEQ ID NO: 183517 - DNA, 25 bp, E. coli
aaagccatctggcaatgccggtaca

SEQ ID NO: 183518 - DNA, 25 bp, E. coli
aactcaccctgatgcgcaattcgct

SEQ ID NO: 183519 - DNA, 25 bp, E. coli
aactcaccctgaagcgcaattcgct

SEQ ID NO: 183520 - DNA, 25 bp, E. coli
aaagccatctgggaatgccggtaca

SEQ ID NO: 183521 - DNA, 25 bp, E. coli
ttacccacatgcaggaaagccatct

SEQ ID NO: 183522 - DNA, 25 bp, E. coli
ttacccacatgctggaaagccatct

SEQ ID NO: 183523 - DNA, 25 bp, E. coli
tgtcaaaggttttcccacatgctgg

SEQ ID NO: 183524 - DNA, 25 bp, E. coli
tgtcaaaggtttacccacatgctgg

SEQ ID NO: 183525 - DNA, 25 bp, E. coli
tcggtcagcggcagagaaaacgcgc

SEQ ID NO: 183526 - DNA, 25 bp, E. coli
tcggtcagcggctgagaaaacgcgc

SEQ ID NO: 183527 - DNA, 25 bp, E. coli
ccctgatgcgcatttcgctggtgca

SEQ ID NO: 183528 - DNA, 25 bp, E. coli
ccctgatgcgcaattcgctggtgca

SEQ ID NO: 183529 - DNA, 25 bp, E. coli
ggaatgccggtagaaactcaccctg

SEQ ID NO: 183530 - DNA, 25 bp, E. coli
ggaatgccggtacaaactcaccctg

SEQ ID NO: 183531 - DNA, 25 bp, E. coli
ggcgttagccacagtcaaaggttta

SEQ ID NO: 183532 - DNA, 25 bp, E. coli
ggcgttagccactgtcaaaggttta

SEQ ID NO: 183533 - DNA, 25 bp, E. coli
tcagcggcagagaaaacgcgcatga

SEQ ID NO: 183534 - DNA, 25 bp, E. coli
tcagcggcagagtaaacgcgcatga

SEQ ID NO: 183535 - DNA, 25 bp, E. coli
tacagccgtattcgcgcgatgctgg

SEQ ID NO: 183536 - DNA, 25 bp, E. coli
tacagccgtattggcgcgatgctgg

SEQ ID NO: 183537 - DNA, 25 bp, E. coli
agacgccattccatttttctgacac

SEQ ID NO: 183538 - DNA, 25 bp, E. coli
agacgccattccttttttctgacac

SEQ ID NO: 183539 - DNA, 25 bp, E. coli
acccggtcagatgctgggtatctgc

SEQ ID NO: 183540 - DNA, 25 bp, E. coli
acccggtcagatcctgggtatctgc

SEQ ID NO: 183541 - DNA, 25 bp, E. coli
aaatattcaccacttcacgtatccg

SEQ ID NO: 183542 - DNA, 25 bp, E. coli
aaatattcaccagttcacgtatccg

SEQ ID NO: 183543 - DNA, 25 bp, E. coli
tggtgaacgatggtagcgaacccgt

SEQ ID NO: 183544 - DNA, 25 bp, E. coli
tggtgaacgatgctagcgaacccgt

SEQ ID NO: 183545 - DNA, 25 bp, E. coli
tgctggcacaactaagcggctggta

SEQ ID NO: 183546 - DNA, 25 bp, E. coli
tgctggcacaacaaagcggctggta

SEQ ID NO: 183547 - DNA, 25 bp, E. coli
tcatgatgtgctggcacaacaaagc

SEQ ID NO: 183548 - DNA, 25 bp, E. coli
tcatgatgtgctcgcacaacaaagc

SEQ ID NO: 183549 - DNA, 25 bp, E. coli
gaacgtggtagtcctgcgtacagcc

SEQ ID NO: 183550 - DNA, 25 bp, E. coli
gaacgtggtagtgctgcgtacagcc

SEQ ID NO: 183551 - DNA, 25 bp, E. coli
cgatggtagcgatcccgtgccggaa

SEQ ID NO: 183552 - DNA, 25 bp, E. coli
cgatggtagcgaacccgtgccggaa

SEQ ID NO: 183553 - DNA, 25 bp, E. coli
tggcgaataacaacgcgctgggttg

SEQ ID NO: 183554 - DNA, 25 bp, E. coli
ggcgtggcgaacaggatgtaaatat

SEQ ID NO: 183555 - DNA, 25 bp, E. coli
ggcgtggcgaactggatgtaaatat

SEQ ID NO: 183556 - DNA, 25 bp, E. coli
tggcgaataacatcgcgctgggttg

SEQ ID NO: 183557 - DNA, 25 bp, E. coli
caattggtctgcattccggtggcaa

SEQ ID NO: 183558 - DNA, 25 bp, E. coli
caattggtctgctttccggtggcaa

SEQ ID NO: 183559 - DNA, 25 bp, E. coli
cgttaaatgtctttccgggccgcgt

SEQ ID NO: 183560 - DNA, 25 bp, E. coli
cgttaaatgtctatccgggccgcgt

SEQ ID NO: 183561 - DNA, 25 bp, E. coli
catcgataaagccttcccgggcgta

SEQ ID NO: 183562 - DNA, 25 bp, E. coli
catcgataaagcgttcccgggcgta

SEQ ID NO: 183563 - DNA, 25 bp, E. coli
tatctccgaagagcgtaaacgtgac

SEQ ID NO: 183564 - DNA, 25 bp, E. coli
tatctccgaagaccgtaaacgtgac

SEQ ID NO: 183565 - DNA, 25 bp, E. coli
tttaaaagcgactagctggtgggcg

SEQ ID NO: 183566 - DNA, 25 bp, E. coli
tttaaaagcgacaagctggtgggcg

SEQ ID NO: 183567 - DNA, 25 bp, E. coli
tgtcggcgcgaataaagagatctat

SEQ ID NO: 183568 - DNA, 25 bp, E. coli
tgtcggcgcgaaaaaagagatctat

SEQ ID NO: 183569 - DNA, 25 bp, E. coli
tcgataatctctgcggacctggcgt

SEQ ID NO: 183570 - DNA, 25 bp, E. coli
tcgataatctctccggacctggcgt

SEQ ID NO: 183571 - DNA, 25 bp, E. coli
cctggatgggcaagaagtcgttacc

SEQ ID NO: 183572 - DNA, 25 bp, E. coli
cctggatgggcatgaagtcgttacc

SEQ ID NO: 183573 - DNA, 25 bp, E. coli
gaatttactcgtgagcaggccaccc

SEQ ID NO: 183574 - DNA, 25 bp, E. coli
gaatttactcgtcagcaggccaccc

SEQ ID NO: 183575 - DNA, 25 bp, E. coli
tggaaaaccatgaatgccgaagcgg

SEQ ID NO: 183576 - DNA, 25 bp, E. coli
ggcaagcttaatggcgtgaatcagg

SEQ ID NO: 183577 - DNA, 25 bp, E. coli
ggcaagcttaatcgcgtgaatcagg

SEQ ID NO: 183578 - DNA, 25 bp, E. coli
tggaaaaccatgtatgccgaagcgg

SEQ ID NO: 183579 - DNA, 25 bp, E. coli
cactgacctgaaagccggaattatc

SEQ ID NO: 183580 - DNA, 25 bp, E. coli
cactgacctgaatgccggaattatc

SEQ ID NO: 183581 - DNA, 25 bp, E. coli
ttatggctatgactttttattgacc

SEQ ID NO: 183582 - DNA, 25 bp, E. coli
ttatggctatgagtttttattgacc

SEQ ID NO: 183583 - DNA, 25 bp, E. coli
ttttattgaccacttttattccgca

SEQ ID NO: 183584 - DNA, 25 bp, E. coli
ttttattgaccagttttattccgca

SEQ ID NO: 183585 - DNA, 25 bp, E. coli
tgctcgatgtaaagcgcgaaaccgg

SEQ ID NO: 183586 - DNA, 25 bp, E. coli
tgctcgatgtaatgcgcgaaaccgg

SEQ ID NO: 183587 - DNA, 25 bp, E. coli
gctctgttgcaaccccacggagttg

SEQ ID NO: 183588 - DNA, 25 bp, E. coli
gctggagcaactcgctctgttgcaa

SEQ ID NO: 183589 - DNA, 25 bp, E. coli
gctctgttgcaagcccacggagttg

SEQ ID NO: 183590 - DNA, 25 bp, E. coli
gctggagcaactggctctgttgcaa

SEQ ID NO: 183591 - DNA, 25 bp, E. coli
gaattatcgcggtgatcggctccag

SEQ ID NO: 183592 - DNA, 25 bp, E. coli
gaattatcgcggagatcggctccag

SEQ ID NO: 183593 - DNA, 25 bp, E. coli
cgatggcactgacctgaaagccgga

SEQ ID NO: 183594 - DNA, 25 bp, E. coli
cgatggcactgagctgaaagccgga

SEQ ID NO: 183595 - DNA, 25 bp, E. coli
cattgcgatgctccatgcgctacgt

SEQ ID NO: 183596 - DNA, 25 bp, E. coli
ctccagcgaaggcaagattacgtcg

SEQ ID NO: 183597 - DNA, 25 bp, E. coli
ctccagcgaagggaagattacgtcg

SEQ ID NO: 183598 - DNA, 25 bp, E. coli
cattgcgatgctgcatgcgctacgt

SEQ ID NO: 183599 - DNA, 25 bp, E. coli
gttgcaagcccacggagttgatctt

SEQ ID NO: 183600 - DNA, 25 bp, E. coli
gttgcaagcccagggagttgatctt

SEQ ID NO: 183601 - DNA, 25 bp, E. coli
caggttctgccttattcctccgctg

SEQ ID NO: 183602 - DNA, 25 bp, E. coli
caggttctgcctaattcctccgctg

SEQ ID NO: 183603 - DNA, 25 bp, E. coli
tagcgattggtaacccgtttggtct

SEQ ID NO: 183604 - DNA, 25 bp, E. coli
tagcgattggtatcccgtttggtct

SEQ ID NO: 183605 - DNA, 25 bp, E. coli
tcctccgctgcataagcgggcatta

SEQ ID NO: 183606 - DNA, 25 bp, E. coli
tcctccgctgcaaaagcgggcatta

SEQ ID NO: 183607 - DNA, 25 bp, E. coli
ccagggtggccacggcggtaatggt

SEQ ID NO: 183608 - DNA, 25 bp, E. coli
ccagggtggccagggcggtaatggt

SEQ ID NO: 183609 - DNA, 25 bp, E. coli
ctccgctgcaaaagcgggcattaaa

SEQ ID NO: 183610 - DNA, 25 bp, E. coli
ctccgctgcaaatgcgggcattaaa

SEQ ID NO: 183611 - DNA, 25 bp, E. coli
ggttctgcctaattcctccgctgca

SEQ ID NO: 183612 - DNA, 25 bp, E. coli
ggttctgcctaaatcctccgctgca

SEQ ID NO: 183613 - DNA, 25 bp, E. coli
tggtctgggcgagacggtaacttcc

SEQ ID NO: 183614 - DNA, 25 bp, E. coli
tggtaactccggaggtgcgctggtt

SEQ ID NO: 183615 - DNA, 25 bp, E. coli
tggccagggcggtaatggtggcggc

SEQ ID NO: 183616 - DNA, 25 bp, E. coli
tggccagggcggaaatggtggcggc

SEQ ID NO: 183617 - DNA, 25 bp, E. coli
tggtctgggcgacacggtaacttcc

SEQ ID NO: 183618 - DNA, 25 bp, E. coli
tggtaactccggtggtgcgctggtt

SEQ ID NO: 183619 - DNA, 25 bp, E. coli
taattcctccgcagcaaaagcgggc

SEQ ID NO: 183620 - DNA, 25 bp, E. coli
taacccgtttggactgggcgagacg

SEQ ID NO: 183621 - DNA, 25 bp, E. coli
taacccgtttggtctgggcgagacg

SEQ ID NO: 183622 - DNA, 25 bp, E. coli
taattcctccgctgcaaaagcgggc

SEQ ID NO: 183623 - DNA, 25 bp, E. coli
aattcatcctcgtaatctccaccgg

SEQ ID NO: 183624 - DNA, 25 bp, E. coli
aattcatcctcgaaatctccaccgg

SEQ ID NO: 183625 - DNA, 25 bp, E. coli
atcctcgaaatcaccaccggctatt

SEQ ID NO: 183626 - DNA, 25 bp, E. coli
atcctcgaaatctccaccggctatt

SEQ ID NO: 183627 - DNA, 25 bp, E. coli
atgtatttcatcaggcgtcgcatca

SEQ ID NO: 183628 - DNA, 25 bp, E. coli
atgtatttcatctggcgtcgcatca

SEQ ID NO: 183629 - DNA, 25 bp, E. coli
tccaccggctatacccgtttcaata

SEQ ID NO: 183630 - DNA, 25 bp, E. coli
tccaccggctattcccgtttcaata

SEQ ID NO: 183631 - DNA, 25 bp, E. coli
tcatccacttcgtattcatcctcga

SEQ ID NO: 183632 - DNA, 25 bp, E. coli
tcatcatccacttcgaattcatcct

SEQ ID NO: 183633 - DNA, 25 bp, E. coli
tcaggcgtcgcaacatcatccactt

SEQ ID NO: 183634 - DNA, 25 bp, E. coli
tcatccacttcgaattcatcctcga

SEQ ID NO: 183635 - DNA, 25 bp, E. coli
tcaggcgtcgcatcatcatccactt

SEQ ID NO: 183636 - DNA, 25 bp, E. coli
tcatcatccactacgaattcatcct

SEQ ID NO: 183637 - DNA, 25 bp, E. coli
gcatcatcatccacttcgaattcat

SEQ ID NO: 183638 - DNA, 25 bp, E. coli
gcatcatcatcctcttcgaattcat

SEQ ID NO: 183639 - DNA, 25 bp, E. coli
cgtcgcatcatcatccacttcgaat

SEQ ID NO: 183640 - DNA, 25 bp, E. coli
cgtcgcatcatcttccacttcgaat

SEQ ID NO: 183641 - DNA, 25 bp, E. coli
ggcgtcgcatcaacatccacttcga

SEQ ID NO: 183642 - DNA, 25 bp, E. coli
ggcgtcgcatcatcatccacttcga

SEQ ID NO: 183643 - DNA, 25 bp, E. coli
tcaataattattataaactttcgca

SEQ ID NO: 183644 - DNA, 25 bp, E. coli
tcaataattattttaaactttcgca

SEQ ID NO: 183645 - DNA, 25 bp, E. coli
caaatacccctgtacgctatggtgt

SEQ ID NO: 183646 - DNA, 25 bp, E. coli
caaatacccctgaacgctatggtgt

SEQ ID NO: 183647 - DNA, 25 bp, E. coli
taaagacgacacactgaagcgcatg

SEQ ID NO: 183648 - DNA, 25 bp, E. coli
taaagacgacactctgaagcgcatg

SEQ ID NO: 183649 - DNA, 25 bp, E. coli
tatgcacggatttatggccctgaag

SEQ ID NO: 183650 - DNA, 25 bp, E. coli
tatgcacggattaatggccctgaag

SEQ ID NO: 183651 - DNA, 25 bp, E. coli
ttttggctggtttgacgtccccgcg

SEQ ID NO: 183652 - DNA, 25 bp, E. coli
ttttggctggttagacgtccccgcg

SEQ ID NO: 183653 - DNA, 25 bp, E. coli
tctcaactgccgatggtaaaccgat

SEQ ID NO: 183654 - DNA, 25 bp, E. coli
tctcaactgccgttggtaaaccgat

SEQ ID NO: 183655 - DNA, 25 bp, E. coli
gctatggtgttatatctgcggcctt

SEQ ID NO: 183656 - DNA, 25 bp, E. coli
gctatggtgttaaatctgcggcctt

SEQ ID NO: 183657 - DNA, 25 bp, E. coli
gaagcgcatgctcggaaagtcgtca

SEQ ID NO: 183658 - DNA, 25 bp, E. coli
gaagcgcatgctgggaaagtcgtca

SEQ ID NO: 183659 - DNA, 25 bp, E. coli
ccctgcatttttcgctcgcgtggag

SEQ ID NO: 183660 - DNA, 25 bp, E. coli
cgttctgtggcgagtcatatctcca

SEQ ID NO: 183661 - DNA, 25 bp, E. coli
ccctgcatttttggctcgcgtggag

SEQ ID NO: 183662 - DNA, 25 bp, E. coli
cgttctgtggcgtgtcatatctcca

SEQ ID NO: 183663 - DNA, 25 bp, E. coli
ggtccgctgccgtgttattcgccca

SEQ ID NO: 183664 - DNA, 25 bp, E. coli
ggatggtcacgcacagttattacga

SEQ ID NO: 183665 - DNA, 25 bp, E. coli
ggtccgctgccgagttattcgccca

SEQ ID NO: 183666 - DNA, 25 bp, E. coli
ggatggtcacgctcagttattacga

SEQ ID NO: 183667 - DNA, 25 bp, E. coli
cgggtcatcctggataaacacattg

SEQ ID NO: 183668 - DNA, 25 bp, E. coli
cattcccgggtcttcctggataaac

SEQ ID NO: 183669 - DNA, 25 bp, E. coli
cattcccgggtcatcctggataaac

SEQ ID NO: 183670 - DNA, 25 bp, E. coli
cgggtcatcctgcataaacacattg

SEQ ID NO: 183671 - DNA, 25 bp, E. coli
agcgtcgctgaccttccgcgttgcg

SEQ ID NO: 183672 - DNA, 25 bp, E. coli
acggaaatgcattcccgggtcatcc

SEQ ID NO: 183673 - DNA, 25 bp, E. coli
agcgtcgctgacgttccgcgttgcg

SEQ ID NO: 183674 - DNA, 25 bp, E. coli
acggaaatgcatacccgggtcatcc

SEQ ID NO: 183675 - DNA, 25 bp, E. coli
ttcccgggtcatcctggataaacac

SEQ ID NO: 183676 - DNA, 25 bp, E. coli
ttcccgggtcatgctggataaacac

SEQ ID NO: 183677 - DNA, 25 bp, E. coli
tgcattcccgggtcatcctggataa

SEQ ID NO: 183678 - DNA, 25 bp, E. coli
tgcattcccgggacatcctggataa

SEQ ID NO: 183679 - DNA, 25 bp, E. coli
gcattcccgggtcatcctggataaa

SEQ ID NO: 183680 - DNA, 25 bp, E. coli
gcattcccgggtgatcctggataaa

SEQ ID NO: 183681 - DNA, 25 bp, E. coli
cccgggtcatccaggataaacacat

SEQ ID NO: 183682 - DNA, 25 bp, E. coli
cccgggtcatcctggataaacacat

SEQ ID NO: 183683 - DNA, 25 bp, E. coli
gctgaccttccgcgttgcggataac

SEQ ID NO: 183684 - DNA, 25 bp, E. coli
gctgaccttccgggttgcggataac

SEQ ID NO: 183685 - DNA, 25 bp, E. coli
cggaaatgcattcccgggtcatcct

SEQ ID NO: 183686 - DNA, 25 bp, E. coli
cggaaatgcattgccgggtcatcct

SEQ ID NO: 183687 - DNA, 25 bp, E. coli
gtcgctgaccttccgcgttgcggat

SEQ ID NO: 183688 - DNA, 25 bp, E. coli
gtcgctgaccttgcgcgttgcggat

SEQ ID NO: 183689 - DNA, 25 bp, E. coli
aagtgatcgagctaccgcgtaacga

SEQ ID NO: 183690 - DNA, 25 bp, E. coli
aagtgatcgagcaaccgcgtaacga

SEQ ID NO: 183691 - DNA, 25 bp, E. coli
aagtggctatcttccatgcgccgga

SEQ ID NO: 183692 - DNA, 25 bp, E. coli
aagtggctatctaccatgcgccgga

SEQ ID NO: 183693 - DNA, 25 bp, E. coli
cagggatacagtcgagcagcgttca

SEQ ID NO: 183694 - DNA, 25 bp, E. coli
cagggatacagtggagcagcgttca

SEQ ID NO: 183695 - DNA, 25 bp, E. coli
tatgaaccgcaacaagcaaccagca

SEQ ID NO: 183696 - DNA, 25 bp, E. coli
tatgaaccgcaagaagcaaccagca

SEQ ID NO: 183697 - DNA, 25 bp, E. coli
tggtcaccatgacgctgattcaggg

SEQ ID NO: 183698 - DNA, 25 bp, E. coli
tggtcaccatgaggctgattcaggg

SEQ ID NO: 183699 - DNA, 25 bp, E. coli
gaagccgaggcggtaattgctcacg

SEQ ID NO: 183700 - DNA, 25 bp, E. coli
gcaaaactggttcgtcgcgagaaaa

SEQ ID NO: 183701 - DNA, 25 bp, E. coli
gaagccgaggcgctaattgctcacg

SEQ ID NO: 183702 - DNA, 25 bp, E. coli
gaatcgcgctcttcctgctaacgaa

SEQ ID NO: 183703 - DNA, 25 bp, E. coli
gcaaaactggttggtcgcgagaaaa

SEQ ID NO: 183704 - DNA, 25 bp, E. coli
gaatcgcgctctacctgctaacgaa

SEQ ID NO: 183705 - DNA, 25 bp, E. coli
gaaatcagccacatcgccaatggtg

SEQ ID NO: 183706 - DNA, 25 bp, E. coli
gaaatcagccacttcgccaatggtg

SEQ ID NO: 183707 - DNA, 25 bp, E. coli
gtttgctgcagaacatgagcccgga

SEQ ID NO: 183708 - DNA, 25 bp, E. coli
gtttgctgcagatcatgagcccgga

SEQ ID NO: 183709 - DNA, 25 bp, E. coli
tcaatactgtagcaacccaggctcg

SEQ ID NO: 183710 - DNA, 25 bp, E. coli
tcaatactgtaggaacccaggctcg

SEQ ID NO: 183711 - DNA, 25 bp, E. coli
acgccgtcatttttccagtctggag

SEQ ID NO: 183712 - DNA, 25 bp, E. coli
gggtacgccgtcttttttccagtct

SEQ ID NO: 183713 - DNA, 25 bp, E. coli
gggtacgccgtcatttttccagtct

SEQ ID NO: 183714 - DNA, 25 bp, E. coli
acgccgtcatttatccagtctggag

SEQ ID NO: 183715 - DNA, 25 bp, E. coli
tttgatgaacagatggcccgggtac

SEQ ID NO: 183716 - DNA, 25 bp, E. coli
tttgatgaacagttggcccgggtac

SEQ ID NO: 183717 - DNA, 25 bp, E. coli
ttttccagtctgcaggcggatgcca

SEQ ID NO: 183718 - DNA, 25 bp, E. coli
ttttccagtctggaggcggatgcca

SEQ ID NO: 183719 - DNA, 25 bp, E. coli
tgagcctgcgggcatagttcaccgc

SEQ ID NO: 183720 - DNA, 25 bp, E. coli
tgagcctgcggggatagttcaccgc

SEQ ID NO: 183721 - DNA, 25 bp, E. coli
tgatgaacagatggcccgggtacgc

SEQ ID NO: 183722 - DNA, 25 bp, E. coli
tgatgaacagatcgcccgggtacgc

SEQ ID NO: 183723 - DNA, 25 bp, E. coli
ccagccagcgggtgatctggttatt

SEQ ID NO: 183724 - DNA, 25 bp, E. coli
ccagccagcgggagatctggttatt

SEQ ID NO: 183725 - DNA, 25 bp, E. coli
gcgggtgatctgcttattgatttga

SEQ ID NO: 183726 - DNA, 25 bp, E. coli
gcgggtgatctggttattgatttga

SEQ ID NO: 183727 - DNA, 25 bp, E. coli
cccggtttgatgtacagatggcccg

SEQ ID NO: 183728 - DNA, 25 bp, E. coli
cccggtttgatgaacagatggcccg

SEQ ID NO: 183729 - DNA, 25 bp, E. coli
ctggaggcggatcccagaaaaaccg

SEQ ID NO: 183730 - DNA, 25 bp, E. coli
ctggaggcggatgccagaaaaaccg

SEQ ID NO: 183731 - DNA, 25 bp, E. coli
gatgcggcccggattgatgaacaga

SEQ ID NO: 183732 - DNA, 25 bp, E. coli
gatgcggcccggtttgatgaacaga

SEQ ID NO: 183733 - DNA, 25 bp, E. coli
taaacatagcggaattgcggcaggg

SEQ ID NO: 183734 - DNA, 25 bp, E. coli
taaacatagcggtattgcggcaggg

SEQ ID NO: 183735 - DNA, 25 bp, E. coli
agcgcggtcagattctgacaggcgc

SEQ ID NO: 183736 - DNA, 25 bp, E. coli
agcgcggtcagaatctgacaggcgc

SEQ ID NO: 183737 - DNA, 25 bp, E. coli
actgattcatgatcaacacgatcgc

SEQ ID NO: 183738 - DNA, 25 bp, E. coli
aaaattctcactccgggccgttggg

SEQ ID NO: 183739 - DNA, 25 bp, E. coli
actgattcatgaacaacacgatcgc

SEQ ID NO: 183740 - DNA, 25 bp, E. coli
aaaattctcactgcgggccgttggg

SEQ ID NO: 183741 - DNA, 25 bp, E. coli
tatggctggcgttcttctggtgtgt

SEQ ID NO: 183742 - DNA, 25 bp, E. coli
tatggctggcgtacttctggtgtgt

SEQ ID NO: 183743 - DNA, 25 bp, E. coli
tgaacacgctcataattgcctggag

SEQ ID NO: 183744 - DNA, 25 bp, E. coli
tgaacacgctcaaaattgcctggag

SEQ ID NO: 183745 - DNA, 25 bp, E. coli
gaacaacacgatcgcattcgcaaag

SEQ ID NO: 183746 - DNA, 25 bp, E. coli
gaacaacacgatggcattcgcaaag

SEQ ID NO: 183747 - DNA, 25 bp, E. coli
cgatcgcattcggaaagctaacgga

SEQ ID NO: 183748 - DNA, 25 bp, E. coli
cgatcgcattcgcaaagctaacgga

SEQ ID NO: 183749 - DNA, 25 bp, E. coli
gggatgaacccgctgaacacgctca

SEQ ID NO: 183750 - DNA, 25 bp, E. coli
gggatgaacccggtgaacacgctca

SEQ ID NO: 183751 - DNA, 25 bp, E. coli
ggcggcaaaattctcactgcgggcc

SEQ ID NO: 183752 - DNA, 25 bp, E. coli
ggcggcaaaattgtcactgcgggcc

SEQ ID NO: 183753 - DNA, 25 bp, E. coli
ggaacaagcgcgctcagattctgac

SEQ ID NO: 183754 - DNA, 25 bp, E. coli
ggaacaagcgcggtcagattctgac

SEQ ID NO: 183755 - DNA, 25 bp, E. coli
aacgtattgcacagcaaccgccgca

SEQ ID NO: 183756 - DNA, 25 bp, E. coli
agtgaaacgtattgcactgcaaccg

SEQ ID NO: 183757 - DNA, 25 bp, E. coli
agtgaaacgtatagcactgcaaccg

SEQ ID NO: 183758 - DNA, 25 bp, E. coli
acagcaatatcaccgtgacggcagg

SEQ ID NO: 183759 - DNA, 25 bp, E. coli
acagcaatatcagcgtgacggcagg

SEQ ID NO: 183760 - DNA, 25 bp, E. coli
aacgtattgcactgcaaccgccgca

SEQ ID NO: 183761 - DNA, 25 bp, E. coli
tatggctatcaaccggatgtcgaca

SEQ ID NO: 183762 - DNA, 25 bp, E. coli
tatggctatcaagcggatgtcgaca

SEQ ID NO: 183763 - DNA, 25 bp, E. coli
tatcaaccggatgtcgacagcaata

SEQ ID NO: 183764 - DNA, 25 bp, E. coli
tatcaaccggatctcgacagcaata

SEQ ID NO: 183765 - DNA, 25 bp, E. coli
tccgcaaagtgcatcagtatctgac

SEQ ID NO: 183766 - DNA, 25 bp, E. coli
tccgcaaagtgcttcagtatctgac

SEQ ID NO: 183767 - DNA, 25 bp, E. coli
tcagcgccgagaaccgcaaagtgca

SEQ ID NO: 183768 - DNA, 25 bp, E. coli
tcagcgccgagatccgcaaagtgca

SEQ ID NO: 183769 - DNA, 25 bp, E. coli
gcatccgcaattgcgtgagcgagcg

SEQ ID NO: 183770 - DNA, 25 bp, E. coli
gcatccgcaattccgtgagcgagcg

SEQ ID NO: 183771 - DNA, 25 bp, E. coli
cgtatctacgctggatgatgttgag

SEQ ID NO: 183772 - DNA, 25 bp, E. coli
cgtatctacgctcgatgatgttgag

SEQ ID NO: 183773 - DNA, 25 bp, E. coli
gattacagcgccctatctacgctgg

SEQ ID NO: 183774 - DNA, 25 bp, E. coli
gattacagcgccgtatctacgctgg

SEQ ID NO: 183775 - DNA, 25 bp, E. coli
gatgtcgacagcaatatcaccgtga

SEQ ID NO: 183776 - DNA, 25 bp, E. coli
gatgtcgacagctatatcaccgtga

SEQ ID NO: 183777 - DNA, 25 bp, E. coli
caaaatcgttagcaatccaccggga

SEQ ID NO: 183778 - DNA, 25 bp, E. coli
caatttccggagttgaacagggccg

SEQ ID NO: 183779 - DNA, 25 bp, E. coli
caatttccggagatgaacagggccg

SEQ ID NO: 183780 - DNA, 25 bp, E. coli
caaaatcgttaggaatccaccggga

SEQ ID NO: 183781 - DNA, 25 bp, E. coli
taaatggcgctctccttacggcgaa

SEQ ID NO: 183782 - DNA, 25 bp, E. coli
taaatggcgctcaccttacggcgaa

SEQ ID NO: 183783 - DNA, 25 bp, E. coli
aaaatctctactagtccggtcgacg

SEQ ID NO: 183784 - DNA, 25 bp, E. coli
aaaatctctacttgtccggtcgacg

SEQ ID NO: 183785 - DNA, 25 bp, E. coli
tagcctctattttgacggacagcgc

SEQ ID NO: 183786 - DNA, 25 bp, E. coli
tagcctctatttagacggacagcgc

SEQ ID NO: 183787 - DNA, 25 bp, E. coli
tctggcaaagcgatacccgtagatg

SEQ ID NO: 183788 - DNA, 25 bp, E. coli
tcataccactggttgacagacggcc

SEQ ID NO: 183789 - DNA, 25 bp, E. coli
tcataccactggatgacagacggcc

SEQ ID NO: 183790 - DNA, 25 bp, E. coli
tctggcaaagcgttacccgtagatg

SEQ ID NO: 183791 - DNA, 25 bp, E. coli
gaaggtaactctaccacgctggtgg

SEQ ID NO: 183792 - DNA, 25 bp, E. coli
gaagaccagcttcaaataatcccgc

SEQ ID NO: 183793 - DNA, 25 bp, E. coli
gaaggtaactcttccacgctggtgg

SEQ ID NO: 183794 - DNA, 25 bp, E. coli
gaagaccagcttgaaataatcccgc

SEQ ID NO: 183795 - DNA, 25 bp, E. coli
gaaagtcgcgttcgctggcgtaaac

SEQ ID NO: 183796 - DNA, 25 bp, E. coli
gaaagtcgcgttggctggcgtaaac

SEQ ID NO: 183797 - DNA, 25 bp, E. coli
cctgtacaggccttagggttcgact

SEQ ID NO: 183798 - DNA, 25 bp, E. coli
cctgtacaggccatagggttcgact

SEQ ID NO: 183799 - DNA, 25 bp, E. coli
cacattttacgctacatttgcgcat

SEQ ID NO: 183800 - DNA, 25 bp, E. coli
cacattttacgcaacatttgcgcat

SEQ ID NO: 183801 - DNA, 25 bp, E. coli
tacgctacatttgcgcattaaaaat

SEQ ID NO: 183802 - DNA, 25 bp, E. coli
tacgctacatttccgcattaaaaat

SEQ ID NO: 183803 - DNA, 25 bp, E. coli
tatttgttattttcaagcgcggcaa

SEQ ID NO: 183804 - DNA, 25 bp, E. coli
tatttgttatttacaagcgcggcaa

SEQ ID NO: 183805 - DNA, 25 bp, E. coli
ttacaagcgcggcaatttcgcccag

SEQ ID NO: 183806 - DNA, 25 bp, E. coli
ttacaagcgcgggaatttcgcccag

SEQ ID NO: 183807 - DNA, 25 bp, E. coli
taattaacatccacacattttacgc

SEQ ID NO: 183808 - DNA, 25 bp, E. coli
taattaacatcctcacattttacgc

SEQ ID NO: 183809 - DNA, 25 bp, E. coli
gccacaaattttggttgcgggcgaa

SEQ ID NO: 183810 - DNA, 25 bp, E. coli
gccacaaattttcgttgcgggcgaa

SEQ ID NO: 183811 - DNA, 25 bp, E. coli
gcccagtcttcagccacaaattttg

SEQ ID NO: 183812 - DNA, 25 bp, E. coli
gcccagtcttcacccacaaattttg

SEQ ID NO: 183813 - DNA, 25 bp, E. coli
gcaattatcgattattaacatccac

SEQ ID NO: 183814 - DNA, 25 bp, E. coli
gcaattatcgataattaacatccac

SEQ ID NO: 183815 - DNA, 25 bp, E. coli
tggttgcgggcgaaaaaatgcgaca

SEQ ID NO: 183816 - DNA, 25 bp, E. coli
tggttgcgggcgtaaaaatgcgaca

SEQ ID NO: 183817 - DNA, 25 bp, E. coli
ggcaatttcgcccagtcttcagcca

SEQ ID NO: 183818 - DNA, 25 bp, E. coli
ggcatgatatagcaattatcgataa

SEQ ID NO: 183819 - DNA, 25 bp, E. coli
ggcatgatataggaattatcgataa

SEQ ID NO: 183820 - DNA, 25 bp, E. coli
ggcaatttcgccgagtcttcagcca

SEQ ID NO: 183821 - DNA, 25 bp, E. coli
tacgccggatggatatcccgaagcc

SEQ ID NO: 183822 - DNA, 25 bp, E. coli
tacgccggatggttatcccgaagcc

SEQ ID NO: 183823 - DNA, 25 bp, E. coli
ttcgaccgggtgcatcacagactcc

SEQ ID NO: 183824 - DNA, 25 bp, E. coli
ttcgaccgggtggatcacagactcc

SEQ ID NO: 183825 - DNA, 25 bp, E. coli
tgattgacggaaactaccagccgcg

SEQ ID NO: 183826 - DNA, 25 bp, E. coli
tgattgacggaatctaccagccgcg

SEQ ID NO: 183827 - DNA, 25 bp, E. coli
tgaagaagaactggcgcagcgtcag

SEQ ID NO: 183828 - DNA, 25 bp, E. coli
tgaagaagaactcgcgcagcgtcag

SEQ ID NO: 183829 - DNA, 25 bp, E. coli
gcaacaggcacaccgttacatacgg

SEQ ID NO: 183830 - DNA, 25 bp, E. coli
gcaacaggcacagcgttacatacgg

SEQ ID NO: 183831 - DNA, 25 bp, E. coli
gacagtatccgtgagggctgcatga

SEQ ID NO: 183832 - DNA, 25 bp, E. coli
gacagtatccgtcagggctgcatga

SEQ ID NO: 183833 - DNA, 25 bp, E. coli
cgagagaaaaccagatgctggctta

SEQ ID NO: 183834 - DNA, 25 bp, E. coli
cgagagaaaacctgatgctggctta

SEQ ID NO: 183835 - DNA, 25 bp, E. coli
gattaatgaagctcaagcgcaggca

SEQ ID NO: 183836 - DNA, 25 bp, E. coli
gattaatgaagcacaagcgcaggca

SEQ ID NO: 183837 - DNA, 25 bp, E. coli
tggacaggcttaaccagcaggcggt

SEQ ID NO: 183838 - DNA, 25 bp, E. coli
tggacaggcttatccagcaggcggt

SEQ ID NO: 183839 - DNA, 25 bp, E. coli
tcagcgcgtggtcgaaaacaaaggc

SEQ ID NO: 183840 - DNA, 25 bp, E. coli
tcagcgcgtggtggaaaacaaaggc

SEQ ID NO: 183841 - DNA, 25 bp, E. coli
taacctcagcgtggcggagttgaaa

SEQ ID NO: 183842 - DNA, 25 bp, E. coli
taacctcagcgtcgcggagttgaaa

SEQ ID NO: 183843 - DNA, 25 bp, E. coli
tatcatggtgcatatctacgccgcc

SEQ ID NO: 183844 - DNA, 25 bp, E. coli
tatcatggtgcaaatctacgccgcc

SEQ ID NO: 183845 - DNA, 25 bp, E. coli
ttctgcttcatcgtggcggcggtga

SEQ ID NO: 183846 - DNA, 25 bp, E. coli
ttctgcttcatcctggcggcggtga

SEQ ID NO: 183847 - DNA, 25 bp, E. coli
gaaaggcacgataaccgccatggtg

SEQ ID NO: 183848 - DNA, 25 bp, E. coli
gaaaggcacgattaccgccatggtg

SEQ ID NO: 183849 - DNA, 25 bp, E. coli
cgccggaacgtaacaaccactggat

SEQ ID NO: 183850 - DNA, 25 bp, E. coli
cgccggaacgtatcaaccactggat

SEQ ID NO: 183851 - DNA, 25 bp, E. coli
gtaccgtgaggtccgcaagacaacg

SEQ ID NO: 183852 - DNA, 25 bp, E. coli
gatccgattcgccttaatgctgcat

SEQ ID NO: 183853 - DNA, 25 bp, E. coli
gtgacaccgggcgttataacttcgg

SEQ ID NO: 183854 - DNA, 25 bp, E. coli
gtaccgtgaggtgcgcaagacaacg

SEQ ID NO: 183855 - DNA, 25 bp, E. coli
gtgacaccgggccttataacttcgg

SEQ ID NO: 183856 - DNA, 25 bp, E. coli
tggcatcacaacctaatcaatcggg

SEQ ID NO: 183857 - DNA, 25 bp, E. coli
tggcatcacaacgtaatcaatcggg

SEQ ID NO: 183858 - DNA, 25 bp, E. coli
tacgccgccctttgggtgaaaggca

SEQ ID NO: 183859 - DNA, 25 bp, E. coli
tcaacgaggaagaaggtgacaccgg

SEQ ID NO: 183860 - DNA, 25 bp, E. coli
tcaacgaggaagtaggtgacaccgg

SEQ ID NO: 183861 - DNA, 25 bp, E. coli
tacgccgcccttagggtgaaaggca

SEQ ID NO: 183862 - DNA, 25 bp, E. coli
gatgcaaatcatcggcacaccgcag

SEQ ID NO: 183863 - DNA, 25 bp, E. coli
gatgcaaatcatgggcacaccgcag

SEQ ID NO: 183864 - DNA, 25 bp, E. coli
gatccgattcgcgttaatgctgcat

SEQ ID NO: 183865 - DNA, 25 bp, E. coli
aagttatctttgacgccatgcatgc

SEQ ID NO: 183866 - DNA, 25 bp, E. coli
caaacgaaagaagaactcccgcagt

SEQ ID NO: 183867 - DNA, 25 bp, E. coli
aagttatctttgtcgccatgcatgc

SEQ ID NO: 183868 - DNA, 25 bp, E. coli
caaacgaaagaacaactcccgcagt

SEQ ID NO: 183869 - DNA, 25 bp, E. coli
caaaatcccattggtaccgatgccg

SEQ ID NO: 183870 - DNA, 25 bp, E. coli
caaaatcccattcgtaccgatgccg

SEQ ID NO: 183871 - DNA, 25 bp, E. coli
cagaagctgaagtggcactgatcgc

SEQ ID NO: 183872 - DNA, 25 bp, E. coli
cagaagctgaagaggcactgatcgc

SEQ ID NO: 183873 - DNA, 25 bp, E. coli
taaaaggtatctcccttagcgccgg

SEQ ID NO: 183874 - DNA, 25 bp, E. coli
aaaagtacgtttgtgtgctgcgccg

SEQ ID NO: 183875 - DNA, 25 bp, E. coli
aaaagtacgtttctgtgctgcgccg

SEQ ID NO: 183876 - DNA, 25 bp, E. coli
tagtttcacatagcagccgactggg

SEQ ID NO: 183877 - DNA, 25 bp, E. coli
tagtttcacataccagccgactggg

SEQ ID NO: 183878 - DNA, 25 bp, E. coli
tggtcgaaggtagactggcagcaac

SEQ ID NO: 183879 - DNA, 25 bp, E. coli
gctggaagccaaacgtgaacaactg

SEQ ID NO: 183880 - DNA, 25 bp, E. coli
gctggaagccaatcgtgaacaactg

SEQ ID NO: 183881 - DNA, 25 bp, E. coli
gaaactgcgctgcaattgctggctc

SEQ ID NO: 183882 - DNA, 25 bp, E. coli
gaaactgcgctggaattgctggctc

SEQ ID NO: 183883 - DNA, 25 bp, E. coli
tggtcgaaggtacactggcagcaac

SEQ ID NO: 183884 - DNA, 25 bp, E. coli
taaaaggtatctgccttagcgccgg

SEQ ID NO: 183885 - DNA, 25 bp, E. coli
gatcgctttccgacagctggctgaa

SEQ ID NO: 183886 - DNA, 25 bp, E. coli
gatcgctttccgtcagctggctgaa

SEQ ID NO: 183887 - DNA, 25 bp, E. coli
tatgcgctaattgggttagtcgtcg

SEQ ID NO: 183888 - DNA, 25 bp, E. coli
tatgcgctaattcggttagtcgtcg

SEQ ID NO: 183889 - DNA, 25 bp, E. coli
tagtcgtcggcaacattattggtgc

SEQ ID NO: 183890 - DNA, 25 bp, E. coli
tagtcgtcggcatcattattggtgc

SEQ ID NO: 183891 - DNA, 25 bp, E. coli
tgttcatgacctcggaatatgcgct

SEQ ID NO: 183892 - DNA, 25 bp, E. coli
tgttcatgacctgggaatatgcgct

SEQ ID NO: 183893 - DNA, 25 bp, E. coli
taattgggttagtcgtcggcatcat

SEQ ID NO: 183894 - DNA, 25 bp, E. coli
tcgtcggcatcaatattggtgctgt

SEQ ID NO: 183895 - DNA, 25 bp, E. coli
taattgggttagacgtcggcatcat

SEQ ID NO: 183896 - DNA, 25 bp, E. coli
tcgtcggcatcattattggtgctgt

SEQ ID NO: 183897 - DNA, 25 bp, E. coli
tcatgacctgggaatatgcgctaat

SEQ ID NO: 183898 - DNA, 25 bp, E. coli
tcatgacctgggtatatgcgctaat

SEQ ID NO: 183899 - DNA, 25 bp, E. coli
gaatatgcgctatttgggttagtcg

SEQ ID NO: 183900 - DNA, 25 bp, E. coli
gaatatgcgctaattgggttagtcg

SEQ ID NO: 183901 - DNA, 25 bp, E. coli
cgctaattgggttagtcgtcggcat

SEQ ID NO: 183902 - DNA, 25 bp, E. coli
cgctaattgggtaagtcgtcggcat

SEQ ID NO: 183903 - DNA, 25 bp, E. coli
tgggttagtcgtcggcatcattatt

SEQ ID NO: 183904 - DNA, 25 bp, E. coli
tgggttagtcgtgggcatcattatt

SEQ ID NO: 183905 - DNA, 25 bp, E. coli
ggcatcattattggtgctgtggcca

SEQ ID NO: 183906 - DNA, 25 bp, E. coli
ggcatcattattcgtgctgtggcca

SEQ ID NO: 183907 - DNA, 25 bp, E. coli
gacctgggaatatgcgctaattggg

SEQ ID NO: 183908 - DNA, 25 bp, E. coli
gacctgggaataagcgctaattggg

SEQ ID NO: 183909 - DNA, 25 bp, E. coli
ccatttaatatcagggaaccggaca

SEQ ID NO: 183910 - DNA, 25 bp, E. coli
ccatttaatatctgggaaccggaca

SEQ ID NO: 183911 - DNA, 25 bp, E. coli
catcacaccccatttaatatcaggg

SEQ ID NO: 183912 - DNA, 25 bp, E. coli
catcacaccccaattaatatcaggg

SEQ ID NO: 183913 - DNA, 25 bp, E. coli
catgtgcgccttttgtgattacaac

SEQ ID NO: 183914 - DNA, 25 bp, E. coli
catgtgcgccttatgtgattacaac

SEQ ID NO: 183915 - DNA, 25 bp, E. coli
taaagggcactatgactccaaagaa

SEQ ID NO: 183916 - DNA, 25 bp, E. coli
taactccggtatgatgtgcgcctta

SEQ ID NO: 183917 - DNA, 25 bp, E. coli
taaagggcactaagactccaaagaa

SEQ ID NO: 183918 - DNA, 25 bp, E. coli
tattacatcttattcttaaagggca

SEQ ID NO: 183919 - DNA, 25 bp, E. coli
tattacatcttaatcttaaagggca

SEQ ID NO: 183920 - DNA, 25 bp, E. coli
gcgccttatgtgtttacaacgaaaa

SEQ ID NO: 183921 - DNA, 25 bp, E. coli
gcgccttatgtgattacaacgaaaa

SEQ ID NO: 183922 - DNA, 25 bp, E. coli
gactccaaagaagaagggttagcca

SEQ ID NO: 183923 - DNA, 25 bp, E. coli
gactccaaagaacaagggttagcca

SEQ ID NO: 183924 - DNA, 25 bp, E. coli
gctgcctccaccacattaagatgta

SEQ ID NO: 183925 - DNA, 25 bp, E. coli
gctgcctccacctcattaagatgta

SEQ ID NO: 183926 - DNA, 25 bp, E. coli
gaaaataaaaaccatcacaccccat

SEQ ID NO: 183927 - DNA, 25 bp, E. coli
gaaaataaaaacgatcacaccccat

SEQ ID NO: 183928 - DNA, 25 bp, E. coli
taatatcagggaaccggacataacc

SEQ ID NO: 183929 - DNA, 25 bp, E. coli
taatatcagggatccggacataacc

SEQ ID NO: 183930 - DNA, 25 bp, E. coli
taactccggtatcatgtgcgcctta

SEQ ID NO: 183931 - DNA, 25 bp, E. coli
tacttgcgacctagcgagtgatcac

SEQ ID NO: 183932 - DNA, 25 bp, E. coli
tacttgcgaccttgcgagtgatcac

SEQ ID NO: 183933 - DNA, 25 bp, E. coli
tatttcgctgctcgcgatttccggg

SEQ ID NO: 183934 - DNA, 25 bp, E. coli
tatttcgctgctggcgatttccggg

SEQ ID NO: 183935 - DNA, 25 bp, E. coli
tgttcgggcctttcgtactggcggt

SEQ ID NO: 183936 - DNA, 25 bp, E. coli
tgttcgggccttacgtactggcggt

SEQ ID NO: 183937 - DNA, 25 bp, E. coli
tcgacggtacgcgaatcagtgctaa

SEQ ID NO: 183938 - DNA, 25 bp, E. coli
tcgacggtacgccaatcagtgctaa

SEQ ID NO: 183939 - DNA, 25 bp, E. coli
tcgccggtgcgcaggaaattatcgt

SEQ ID NO: 183940 - DNA, 25 bp, E. coli
tcgccggtgcgctggaaattatcgt

SEQ ID NO: 183941 - DNA, 25 bp, E. coli
gacgacagcgcgtaaagaaaaacgg

SEQ ID NO: 183942 - DNA, 25 bp, E. coli
gaaattatcgtctacgcgggtgcca

SEQ ID NO: 183943 - DNA, 25 bp, E. coli
gaactggcttctttgctgctgctcg

SEQ ID NO: 183944 - DNA, 25 bp, E. coli
gaactggcttctatgctgctgctcg

SEQ ID NO: 183945 - DNA, 25 bp, E. coli
gaaattatcgtcaacgcgggtgcca

SEQ ID NO: 183946 - DNA, 25 bp, E. coli
gacgacagcgcgaaaagaaaaacgg

SEQ ID NO: 183947 - DNA, 25 bp, E. coli
gtgatgatgctctacctgggcggtt

SEQ ID NO: 183948 - DNA, 25 bp, E. coli
gtgatgatgctcaacctgggcggtt

SEQ ID NO: 183949 - DNA, 25 bp, E. coli
tgtggccttccaggtcggtcgtgaa

SEQ ID NO: 183950 - DNA, 25 bp, E. coli
tgtggccttccacgtcggtcgtgaa

SEQ ID NO: 183951 - DNA, 25 bp, E. coli
gagtgatcacccataccaatccggt

SEQ ID NO: 183952 - DNA, 25 bp, E. coli
gagtgatcacccttaccaatccggt

SEQ ID NO: 183953 - DNA, 25 bp, E. coli
cagccggataagttgggagcgaaaa

SEQ ID NO: 183954 - DNA, 25 bp, E. coli
cagccggataagatgggagcgaaaa

SEQ ID NO: 183955 - DNA, 25 bp, E. coli
agttgggagcgataaagtggatgtc

SEQ ID NO: 183956 - DNA, 25 bp, E. coli
agttgggagcgaaaaagtggatgtc

SEQ ID NO: 183957 - DNA, 25 bp, E. coli
aagttgggagcgaaaaagtggatgt

SEQ ID NO: 183958 - DNA, 25 bp, E. coli
aagttgggagcgtaaaagtggatgt

SEQ ID NO: 183959 - DNA, 25 bp, E. coli
ggataagttgggtgcgaaaaagtgg

SEQ ID NO: 183960 - DNA, 25 bp, E. coli
ggataagttgggagcgaaaaagtgg

SEQ ID NO: 183961 - DNA, 25 bp, E. coli
ttgggagcgaaatagtggatgtcct

SEQ ID NO: 183962 - DNA, 25 bp, E. coli
ttgggagcgaaaaagtggatgtcct

SEQ ID NO: 183963 - DNA, 25 bp, E. coli
gccggataagttcggagcgaaaaag

SEQ ID NO: 183964 - DNA, 25 bp, E. coli
gccggataagttgggagcgaaaaag

SEQ ID NO: 183965 - DNA, 25 bp, E. coli
taagttgggagcgaaaaagtggatg

SEQ ID NO: 183966 - DNA, 25 bp, E. coli
taagttgggagccaaaaagtggatg

SEQ ID NO: 183967 - DNA, 25 bp, E. coli
gataagttgggaccgaaaaagtgga

SEQ ID NO: 183968 - DNA, 25 bp, E. coli
gataagttgggagcgaaaaagtgga

SEQ ID NO: 183969 - DNA, 25 bp, E. coli
cggataagttgggagcgaaaaagtg

SEQ ID NO: 183970 - DNA, 25 bp, E. coli
cggataagttggcagcgaaaaagtg

SEQ ID NO: 183971 - DNA, 25 bp, E. coli
gggagcgaaaaagtggatgtcctag

SEQ ID NO: 183972 - DNA, 25 bp, E. coli
gggagcgaaaaactggatgtcctag

SEQ ID NO: 183973 - DNA, 25 bp, E. coli
tgggagcgaaaaagtggatgtccta

SEQ ID NO: 183974 - DNA, 25 bp, E. coli
tgggagcgaaaatgtggatgtccta

SEQ ID NO: 183975 - DNA, 25 bp, E. coli
caaaatcaagcaattacgctaaagt

SEQ ID NO: 183976 - DNA, 25 bp, E. coli
caaaaatatctcttttctaaataac

SEQ ID NO: 183977 - DNA, 25 bp, E. coli
caaaaatatctcatttctaaataac

SEQ ID NO: 183978 - DNA, 25 bp, E. coli
caaaatcaagcatttacgctaaagt

SEQ ID NO: 183979 - DNA, 25 bp, E. coli
atttccttcaaaaatatctcatttc

SEQ ID NO: 183980 - DNA, 25 bp, E. coli
attttcttctccttcgccatcagcg

SEQ ID NO: 183981 - DNA, 25 bp, E. coli
atttccttcaaatatatctcatttc

SEQ ID NO: 183982 - DNA, 25 bp, E. coli
attttcttctccatcgccatcagcg

SEQ ID NO: 183983 - DNA, 25 bp, E. coli
aaatcaagcaattacgctaaagtag

SEQ ID NO: 183984 - DNA, 25 bp, E. coli
aaatcaagcaataacgctaaagtag

SEQ ID NO: 183985 - DNA, 25 bp, E. coli
tatccatttcctgaattttcttctc

SEQ ID NO: 183986 - DNA, 25 bp, E. coli
tatccatttcctcaattttcttctc

SEQ ID NO: 183987 - DNA, 25 bp, E. coli
ttttcttctcctacgccatcagcga

SEQ ID NO: 183988 - DNA, 25 bp, E. coli
ttttcttctccttcgccatcagcga

SEQ ID NO: 183989 - DNA, 25 bp, E. coli
tcagcgacaaaatcaagcaattacg

SEQ ID NO: 183990 - DNA, 25 bp, E. coli
gccatcagcgactaaatcaagcaat

SEQ ID NO: 183991 - DNA, 25 bp, E. coli
gccatcagcgacaaaatcaagcaat

SEQ ID NO: 183992 - DNA, 25 bp, E. coli
gcgacaaaatcaagcaattacgcta

SEQ ID NO: 183993 - DNA, 25 bp, E. coli
gcgacaaaatcatgcaattacgcta

SEQ ID NO: 183994 - DNA, 25 bp, E. coli
gaattttcttctccttcgccatcag

SEQ ID NO: 183995 - DNA, 25 bp, E. coli
gaattttcttctgcttcgccatcag

SEQ ID NO: 183996 - DNA, 25 bp, E. coli
tcagcgacaaaaacaagcaattacg

SEQ ID NO: 183997 - DNA, 25 bp, E. coli
tactcgcctggctattgttggccgc

SEQ ID NO: 183998 - DNA, 25 bp, E. coli
tactcgcctggcaattgttggccgc

SEQ ID NO: 183999 - DNA, 25 bp, E. coli
taaagactacgcgtcgttgttccgc

SEQ ID NO: 184000 - DNA, 25 bp, E. coli
taaagactacgcctcgttgttccgc

SEQ ID NO: 184001 - DNA, 25 bp, E. coli
tattattgataccactccggcagaa

SEQ ID NO: 184002 - DNA, 25 bp, E. coli
tattattgatacgactccggcagaa

SEQ ID NO: 184003 - DNA, 25 bp, E. coli
ttgcggcacggcaacggcagtttca

SEQ ID NO: 184004 - DNA, 25 bp, E. coli
ttgcggcacggctacggcagtttca

SEQ ID NO: 184005 - DNA, 25 bp, E. coli
tggtactcccatcagcgactggcaa

SEQ ID NO: 184006 - DNA, 25 bp, E. coli
tggtactcccatgagcgactggcaa

SEQ ID NO: 184007 - DNA, 25 bp, E. coli
tgttgccagctggtcatggtactcc

SEQ ID NO: 184008 - DNA, 25 bp, E. coli
tgttgccagctgctcatggtactcc

SEQ ID NO: 184009 - DNA, 25 bp, E. coli
tcgaccgctcgatgattgccaatat

SEQ ID NO: 184010 - DNA, 25 bp, E. coli
tcgaccgctcgaagattgccaatat

SEQ ID NO: 184011 - DNA, 25 bp, E. coli
cgaattggtgaagacgcgcaccgca

SEQ ID NO: 184012 - DNA, 25 bp, E. coli
cgaattggtgaacacgcgcaccgca

SEQ ID NO: 184013 - DNA, 25 bp, E. coli
cttgctgcgctgtttgcctgctgga

SEQ ID NO: 184014 - DNA, 25 bp, E. coli
cttgctgcgctgattgcctgctgga

SEQ ID NO: 184015 - DNA, 25 bp, E. coli
gattgtcttacacaccatcggcagc

SEQ ID NO: 184016 - DNA, 25 bp, E. coli
gattgtcttacagaccatcggcagc

SEQ ID NO: 184017 - DNA, 25 bp, E. coli
gaccatcctgatagtcggcgaaacc

SEQ ID NO: 184018 - DNA, 25 bp, E. coli
gaccatcctgattgtcggcgaaacc

SEQ ID NO: 184019 - DNA, 25 bp, E. coli
caattgctttgaacgtccgggtaaa

SEQ ID NO: 184020 - DNA, 25 bp, E. coli
caattgctttgatcgtccgggtaaa

SEQ ID NO: 184021 - DNA, 25 bp, E. coli
catgaaagaaaatggcctgaaggcg

SEQ ID NO: 184022 - DNA, 25 bp, E. coli
catattaatgtttcgccctggcagt

SEQ ID NO: 184023 - DNA, 25 bp, E. coli
catattaatgttacgccctggcagt

SEQ ID NO: 184024 - DNA, 25 bp, E. coli
catgaaagaaaaaggcctgaaggcg

SEQ ID NO: 184025 - DNA, 25 bp, E. coli
taaatggaccgcatgtcgacgagtc

SEQ ID NO: 184026 - DNA, 25 bp, E. coli
taaaacgtgccgttagccgctttga

SEQ ID NO: 184027 - DNA, 25 bp, E. coli
taaagatattgatcgttcggccctg

SEQ ID NO: 184028 - DNA, 25 bp, E. coli
taaatggaccgcttgtcgacgagtc

SEQ ID NO: 184029 - DNA, 25 bp, E. coli
taaagatattgaacgttcggccctg

SEQ ID NO: 184030 - DNA, 25 bp, E. coli
taaaacgtgccgatagccgctttga

SEQ ID NO: 184031 - DNA, 25 bp, E. coli
aaaatacagaggtgattcaacgcgc

SEQ ID NO: 184032 - DNA, 25 bp, E. coli
aaaatacagaggagattcaacgcgc

SEQ ID NO: 184033 - DNA, 25 bp, E. coli
tcatcaaactgtgtggtctggaagc

SEQ ID NO: 184034 - DNA, 25 bp, E. coli
tcatcaaactgtctggtctggaagc

SEQ ID NO: 184035 - DNA, 25 bp, E. coli
tcaaattaggatgtgttcaggctca

SEQ ID NO: 184036 - DNA, 25 bp, E. coli
taacccatcgaatcgaccgtggtcg

SEQ ID NO: 184037 - DNA, 25 bp, E. coli
taacccatcgaaacgaccgtggtcg

SEQ ID NO: 184038 - DNA, 25 bp, E. coli
tcaaattaggatctgttcaggctca

SEQ ID NO: 184039 - DNA, 25 bp, E. coli
tggcacgctatatccggatcccggt

SEQ ID NO: 184040 - DNA, 25 bp, E. coli
tggcacgctataaccggatcccggt

SEQ ID NO: 184041 - DNA, 25 bp, E. coli
cagcgagctggtagatatggtttac

SEQ ID NO: 184042 - DNA, 25 bp, E. coli
cagcgagctggttgatatggtttac

SEQ ID NO: 184043 - DNA, 25 bp, E. coli
caggtagcgcagttcatcaacggtg

SEQ ID NO: 184044 - DNA, 25 bp, E. coli
catggtgccgggtagaagcatccgt

SEQ ID NO: 184045 - DNA, 25 bp, E. coli
catggtgccgggaagaagcatccgt

SEQ ID NO: 184046 - DNA, 25 bp, E. coli
caggtagcgcagatcatcaacggtg

SEQ ID NO: 184047 - DNA, 25 bp, E. coli
tagcccgtcggcagaatcgaccatt

SEQ ID NO: 184048 - DNA, 25 bp, E. coli
tagcccgtcggctgaatcgaccatt

SEQ ID NO: 184049 - DNA, 25 bp, E. coli
agttactggcaagtttcccggcgag

SEQ ID NO: 184050 - DNA, 25 bp, E. coli
agttactggcaactttcccggcgag

SEQ ID NO: 184051 - DNA, 25 bp, E. coli
aacagtacgacgtaaagccgcaggt

SEQ ID NO: 184052 - DNA, 25 bp, E. coli
aacagtacgacgaaaagccgcaggt

SEQ ID NO: 184053 - DNA, 25 bp, E. coli
ttaacgcaggaatgcgcgtagcccg

SEQ ID NO: 184054 - DNA, 25 bp, E. coli
ttaacgcaggaaagcgcgtagcccg

SEQ ID NO: 184055 - DNA, 25 bp, E. coli
tgatatggtttaggagtattgccgg

SEQ ID NO: 184056 - DNA, 25 bp, E. coli
tgatatggtttacgagtattgccgg

SEQ ID NO: 184057 - DNA, 25 bp, E. coli
tcacccgggcagtttgttgcatggt

SEQ ID NO: 184058 - DNA, 25 bp, E. coli
gactgccaaacgacagcgagctggt

SEQ ID NO: 184059 - DNA, 25 bp, E. coli
gactgccaaacgtcagcgagctggt

SEQ ID NO: 184060 - DNA, 25 bp, E. coli
tcaacggtgtgtacagccagttact

SEQ ID NO: 184061 - DNA, 25 bp, E. coli
tcaacggtgtgttcagccagttact

SEQ ID NO: 184062 - DNA, 25 bp, E. coli
tcacccgggcagattgttgcatggt

SEQ ID NO: 184063 - DNA, 25 bp, E. coli
caaaatatgaagcatggcgagggac

SEQ ID NO: 184064 - DNA, 25 bp, E. coli
caaaatatgaaggatggcgagggac

SEQ ID NO: 184065 - DNA, 25 bp, E. coli
atcgccaggcccaaacgtcgtcttg

SEQ ID NO: 184066 - DNA, 25 bp, E. coli
atcgccaggccctaacgtcgtcttg

SEQ ID NO: 184067 - DNA, 25 bp, E. coli
tataaaacggtacttctggtgcacc

SEQ ID NO: 184068 - DNA, 25 bp, E. coli
tataaaacggtagttctggtgcacc

SEQ ID NO: 184069 - DNA, 25 bp, E. coli
tggtgcaccccataggatatctggc

SEQ ID NO: 184070 - DNA, 25 bp, E. coli
tgaaagtgaatggtgttactacatc

SEQ ID NO: 184071 - DNA, 25 bp, E. coli
tgaaagtgaatgctgttactacatc

SEQ ID NO: 184072 - DNA, 25 bp, E. coli
gcgagggacgtttcagttatataga

SEQ ID NO: 184073 - DNA, 25 bp, E. coli
gcgagggacgttacagttatataga

SEQ ID NO: 184074 - DNA, 25 bp, E. coli
gcaccccaaaggatatctggcaggg

SEQ ID NO: 184075 - DNA, 25 bp, E. coli
gcaccccaaaggttatctggcaggg

SEQ ID NO: 184076 - DNA, 25 bp, E. coli
gaaatgattcatcgccaggccctaa

SEQ ID NO: 184077 - DNA, 25 bp, E. coli
gaaatgattcatggccaggccctaa

SEQ ID NO: 184078 - DNA, 25 bp, E. coli
ggtagttctggtgcaccccaaagga

SEQ ID NO: 184079 - DNA, 25 bp, E. coli
ggtgttactacatcaaaatatgaag

SEQ ID NO: 184080 - DNA, 25 bp, E. coli
ggtagttctggtccaccccaaagga

SEQ ID NO: 184081 - DNA, 25 bp, E. coli
ggccctaacgtcctcttgtcaagat

SEQ ID NO: 184082 - DNA, 25 bp, E. coli
ggccctaacgtcgtcttgtcaagat

SEQ ID NO: 184083 - DNA, 25 bp, E. coli
ggtgttactacaacaaaatatgaag

SEQ ID NO: 184084 - DNA, 25 bp, E. coli
tggtgcaccccaaaggatatctggc

SEQ ID NO: 184085 - DNA, 25 bp, E. coli
cagtgaaccatagcgtggaatataa

SEQ ID NO: 184086 - DNA, 25 bp, E. coli
cagtgaaccataccgtggaatataa

SEQ ID NO: 184087 - DNA, 25 bp, E. coli
actattcgactgcaacattcggcgc

SEQ ID NO: 184088 - DNA, 25 bp, E. coli
actattcgactggaacattcggcgc

SEQ ID NO: 184089 - DNA, 25 bp, E. coli
tgtagcaccagtcaaccatagcgtg

SEQ ID NO: 184090 - DNA, 25 bp, E. coli
tgtattgtctgtggcactattcgac

SEQ ID NO: 184091 - DNA, 25 bp, E. coli
tgtattgtctgtcgcactattcgac

SEQ ID NO: 184092 - DNA, 25 bp, E. coli
tgtctgtggcactattcgactgcaa

SEQ ID NO: 184093 - DNA, 25 bp, E. coli
tgtctgtggcacaattcgactgcaa

SEQ ID NO: 184094 - DNA, 25 bp, E. coli
tgtagcaccagtgaaccatagcgtg

SEQ ID NO: 184095 - DNA, 25 bp, E. coli
tctgatatggatgctcttagccgtt

SEQ ID NO: 184096 - DNA, 25 bp, E. coli
tctgatatggatcctcttagccgtt

SEQ ID NO: 184097 - DNA, 25 bp, E. coli
gcaccagtgaaccatagcgtggaat

SEQ ID NO: 184098 - DNA, 25 bp, E. coli
gcaccagtgaacgatagcgtggaat

SEQ ID NO: 184099 - DNA, 25 bp, E. coli
cgctgtttgtagcaccagtgaacca

SEQ ID NO: 184100 - DNA, 25 bp, E. coli
cgctgtttgtaggaccagtgaacca

SEQ ID NO: 184101 - DNA, 25 bp, E. coli
ctcaggagtctgatatggatgctct

SEQ ID NO: 184102 - DNA, 25 bp, E. coli
ctcaggagtctgttatggatgctct

SEQ ID NO: 184103 - DNA, 25 bp, E. coli
ggaaacgctgttagtagcaccagtg

SEQ ID NO: 184104 - DNA, 25 bp, E. coli
ggcactattcgagtgcaacattcgg

SEQ ID NO: 184105 - DNA, 25 bp, E. coli
ggaaacgctgtttgtagcaccagtg

SEQ ID NO: 184106 - DNA, 25 bp, E. coli
ggcactattcgactgcaacattcgg

SEQ ID NO: 184107 - DNA, 25 bp, E. coli
tactggatatttcccagggccagca

SEQ ID NO: 184108 - DNA, 25 bp, E. coli
tactggatatttgccagggccagca

SEQ ID NO: 184109 - DNA, 25 bp, E. coli
cttacgataaagttgccgagtgggc

SEQ ID NO: 184110 - DNA, 25 bp, E. coli
cttacgataaagatgccgagtgggc

SEQ ID NO: 184111 - DNA, 25 bp, E. coli
tattggcgttatctcaggcaccagc

SEQ ID NO: 184112 - DNA, 25 bp, E. coli
tattggcgttatgtcaggcaccagc

SEQ ID NO: 184113 - DNA, 25 bp, E. coli
tcgcgatattgcgttgggaggacaa

SEQ ID NO: 184114 - DNA, 25 bp, E. coli
tcgcgatattgccttgggaggacaa

SEQ ID NO: 184115 - DNA, 25 bp, E. coli
gacaattgatgaacaccgggtcgca

SEQ ID NO: 184116 - DNA, 25 bp, E. coli
gacaattgatgatcaccgggtcgca

SEQ ID NO: 184117 - DNA, 25 bp, E. coli
cgaatggtgctcaatattggcggca

SEQ ID NO: 184118 - DNA, 25 bp, E. coli
cgaatggtgctctatattggcggca

SEQ ID NO: 184119 - DNA, 25 bp, E. coli
cattagtggcgatgacatggaagca

SEQ ID NO: 184120 - DNA, 25 bp, E. coli
cattagtggcgaagacatggaagca

SEQ ID NO: 184121 - DNA, 25 bp, E. coli
gatctggcgtcacgccggtaaacct

SEQ ID NO: 184122 - DNA, 25 bp, E. coli
gatctggcgtcaggccggtaaacct

SEQ ID NO: 184123 - DNA, 25 bp, E. coli
gggccagcagcttacactttcgcag

SEQ ID NO: 184124 - DNA, 25 bp, E. coli
gggccagcagctaacactttcgcag

SEQ ID NO: 184125 - DNA, 25 bp, E. coli
ggaaatctgcctaccgtcactggcg

SEQ ID NO: 184126 - DNA, 25 bp, E. coli
ggaaatctgccttccgtcactggcg

SEQ ID NO: 184127 - DNA, 25 bp, E. coli
taacatgctgatcgatgcctggatc

SEQ ID NO: 184128 - DNA, 25 bp, E. coli
taacatgctgatggatgcctggatc

SEQ ID NO: 184129 - DNA, 25 bp, E. coli
cactgatgcggttgttgatacacac

SEQ ID NO: 184130 - DNA, 25 bp, E. coli
cactgatgcggtagttgatacacac

SEQ ID NO: 184131 - DNA, 25 bp, E. coli
taaaagattccacagtgacttcggg

SEQ ID NO: 184132 - DNA, 25 bp, E. coli
taaaagattccagagtgacttcggg

SEQ ID NO: 184133 - DNA, 25 bp, E. coli
tgaaccgagtgattatgctggcccg

SEQ ID NO: 184134 - DNA, 25 bp, E. coli
tgaaccgagtgaatatgctggcccg

SEQ ID NO: 184135 - DNA, 25 bp, E. coli
tctcgataacggaagcaagtgggtt

SEQ ID NO: 184136 - DNA, 25 bp, E. coli
tctcgataacggtagcaagtgggtt

SEQ ID NO: 184137 - DNA, 25 bp, E. coli
gcccgggtgatgttgcaatgtcctt

SEQ ID NO: 184138 - DNA, 25 bp, E. coli
gcccgggtgatgatgcaatgtcctt

SEQ ID NO: 184139 - DNA, 25 bp, E. coli
ccgttacagcacatgattgggatca

SEQ ID NO: 184140 - DNA, 25 bp, E. coli
ccgttacagcacttgattgggatca

SEQ ID NO: 184141 - DNA, 25 bp, E. coli
gatttcgatcagacctttaacggcg

SEQ ID NO: 184142 - DNA, 25 bp, E. coli
gatttcgatcagtcctttaacggcg

SEQ ID NO: 184143 - DNA, 25 bp, E. coli
gattacttctatcctgcctggcggt

SEQ ID NO: 184144 - DNA, 25 bp, E. coli
gatcatatggattaggcaggcactg

SEQ ID NO: 184145 - DNA, 25 bp, E. coli
gattacttctatgctgcctggcggt

SEQ ID NO: 184146 - DNA, 25 bp, E. coli
gatcatatggataaggcaggcactg

SEQ ID NO: 184147 - DNA, 25 bp, E. coli
gatgttgcctttaccagcacctgga

SEQ ID NO: 184148 - DNA, 25 bp, E. coli
gatgacaaggtcatccagagcggtg

SEQ ID NO: 184149 - DNA, 25 bp, E. coli
gatgttgccttttccagcacctgga

SEQ ID NO: 184150 - DNA, 25 bp, E. coli
gatgacaaggtcttccagagcggtg

SEQ ID NO: 184151 - DNA, 25 bp, E. coli
agaattaaagactcacctcgcggcc

SEQ ID NO: 184152 - DNA, 25 bp, E. coli
agaattaaagacacacctcgcggcc

SEQ ID NO: 184153 - DNA, 25 bp, E. coli
tatggagcaaaagggtctcccggtc

SEQ ID NO: 184154 - DNA, 25 bp, E. coli
tatggagcaaaacggtctcccggtc

SEQ ID NO: 184155 - DNA, 25 bp, E. coli
tatctggtaaaccaaggaagcgcct

SEQ ID NO: 184156 - DNA, 25 bp, E. coli
tatctggtaaacgaaggaagcgcct

SEQ ID NO: 184157 - DNA, 25 bp, E. coli
ttactaccggtggaacgggcgtcga

SEQ ID NO: 184158 - DNA, 25 bp, E. coli
tatctatggcatgggattctggcgc

SEQ ID NO: 184159 - DNA, 25 bp, E. coli
ttactaccggtgcaacgggcgtcga

SEQ ID NO: 184160 - DNA, 25 bp, E. coli
tatctatggcatcggattctggcgc

SEQ ID NO: 184161 - DNA, 25 bp, E. coli
tgaaaccaacatccgtccgtcaggg

SEQ ID NO: 184162 - DNA, 25 bp, E. coli
tgaaaccaacatgcgtccgtcaggg

SEQ ID NO: 184163 - DNA, 25 bp, E. coli
tgacagcccggtatgcgtgaagccg

SEQ ID NO: 184164 - DNA, 25 bp, E. coli
tgaagatatggtacgccagagcgct

SEQ ID NO: 184165 - DNA, 25 bp, E. coli
tgacagcccggtttgcgtgaagccg

SEQ ID NO: 184166 - DNA, 25 bp, E. coli
tgaagatatggttcgccagagcgct

SEQ ID NO: 184167 - DNA, 25 bp, E. coli
gaaacgatgtgaatggcaacccggt

SEQ ID NO: 184168 - DNA, 25 bp, E. coli
gaaacgatgtgattggcaacccggt

SEQ ID NO: 184169 - DNA, 25 bp, E. coli
ggaaggtttatcgtcccagcgagat

SEQ ID NO: 184170 - DNA, 25 bp, E. coli
ggaaggtttatcctcccagcgagat

SEQ ID NO: 184171 - DNA, 25 bp, E. coli
gatgacagtgctacgcctatggccg

SEQ ID NO: 184172 - DNA, 25 bp, E. coli
gatgacagtgcttcgcctatggccg

SEQ ID NO: 184173 - DNA, 25 bp, E. coli
taaacagctggcgaaccgtattctg

SEQ ID NO: 184174 - DNA, 25 bp, E. coli
taaatcccgcgatgtggttgagcag

SEQ ID NO: 184175 - DNA, 25 bp, E. coli
tactctttgtggtcagcgattggcc

SEQ ID NO: 184176 - DNA, 25 bp, E. coli
tactctttgtggacagcgattggcc

SEQ ID NO: 184177 - DNA, 25 bp, E. coli
taaatcccgcgaagtggttgagcag

SEQ ID NO: 184178 - DNA, 25 bp, E. coli
taaacagctggccaaccgtattctg

SEQ ID NO: 184179 - DNA, 25 bp, E. coli
tataccggcaaaccaatcactgacg

SEQ ID NO: 184180 - DNA, 25 bp, E. coli
tataccggcaaagcaatcactgacg

SEQ ID NO: 184181 - DNA, 25 bp, E. coli
ttctctggcgagaagatcaaccgca

SEQ ID NO: 184182 - DNA, 25 bp, E. coli
ttctctggcgagtagatcaaccgca

SEQ ID NO: 184183 - DNA, 25 bp, E. coli
tgaccagtatatgcaccgtttcgcg

SEQ ID NO: 184184 - DNA, 25 bp, E. coli
tgaccagtatatccaccgtttcgcg

SEQ ID NO: 184185 - DNA, 25 bp, E. coli
tcagggtaaagatccggcaacgctt

SEQ ID NO: 184186 - DNA, 25 bp, E. coli
tcagggtaaagaaccggcaacgctt

SEQ ID NO: 184187 - DNA, 25 bp, E. coli
gcctgccgagaaaaacctgcctgta

SEQ ID NO: 184188 - DNA, 25 bp, E. coli
gcctgccgagaataacctgcctgta

SEQ ID NO: 184189 - DNA, 25 bp, E. coli
gaaatcactccgatcagcctgggtg

SEQ ID NO: 184190 - DNA, 25 bp, E. coli
gaaatcactccgttcagcctgggtg

SEQ ID NO: 184191 - DNA, 25 bp, E. coli
gattaaccgctaaaaagcgtggcgc

SEQ ID NO: 184192 - DNA, 25 bp, E. coli
gattaaccgctataaagcgtggcgc

SEQ ID NO: 184193 - DNA, 25 bp, E. coli
tggcaggcactacagaaacacttcg

SEQ ID NO: 184194 - DNA, 25 bp, E. coli
tggcaggcactagagaaacacttcg

SEQ ID NO: 184195 - DNA, 25 bp, E. coli
cagtttgtggaaacagaaaacgcgc

SEQ ID NO: 184196 - DNA, 25 bp, E. coli
catgtactgcgagtgcgttcgttca

SEQ ID NO: 184197 - DNA, 25 bp, E. coli
cagtttgtggaatcagaaaacgcgc

SEQ ID NO: 184198 - DNA, 25 bp, E. coli
catgtactgcgactgcgttcgttca

SEQ ID NO: 184199 - DNA, 25 bp, E. coli
agaaaacgcgcacataccaggcggg

SEQ ID NO: 184200 - DNA, 25 bp, E. coli
agaaaacgcgcagataccaggcggg

SEQ ID NO: 184201 - DNA, 25 bp, E. coli
aaaggatttgtcatgatttacctcc

SEQ ID NO: 184202 - DNA, 25 bp, E. coli
aaaggatttgtcttgatttacctcc

SEQ ID NO: 184203 - DNA, 25 bp, E. coli
tataaaaatcaggaaatggcagacg

SEQ ID NO: 184204 - DNA, 25 bp, E. coli
tataaaaatcagcaaatggcagacg

SEQ ID NO: 184205 - DNA, 25 bp, E. coli
ccaggcgggcgttattttcattgca

SEQ ID NO: 184206 - DNA, 25 bp, E. coli
ccaggcgggcgtaattttcattgca

SEQ ID NO: 184207 - DNA, 25 bp, E. coli
gaattaatcctggaaaggtctgcaa

SEQ ID NO: 184208 - DNA, 25 bp, E. coli
gaattaatcctgcaaaggtctgcaa

SEQ ID NO: 184209 - DNA, 25 bp, E. coli
gatttacctccttgcagtttgtgga

SEQ ID NO: 184210 - DNA, 25 bp, E. coli
gatttacctcctagcagtttgtgga

SEQ ID NO: 184211 - DNA, 25 bp, E. coli
ggtctgcaaagactcattgataaag

SEQ ID NO: 184212 - DNA, 25 bp, E. coli
ggtctgcaaagagtcattgataaag

SEQ ID NO: 184213 - DNA, 25 bp, E. coli
tggcagacgaatgcagggcaagaaa

SEQ ID NO: 184214 - DNA, 25 bp, E. coli
ggcgttattttcattgcaagctgga

SEQ ID NO: 184215 - DNA, 25 bp, E. coli
ggcgttattttctttgcaagctgga

SEQ ID NO: 184216 - DNA, 25 bp, E. coli
tggcagacgaatccagggcaagaaa

SEQ ID NO: 184217 - DNA, 25 bp, E. coli
cacatattttatctcggaggaggga

SEQ ID NO: 184218 - DNA, 25 bp, E. coli
cacatattttatgtcggaggaggga

SEQ ID NO: 184219 - DNA, 25 bp, E. coli
catattttatctcggaggagggaaa

SEQ ID NO: 184220 - DNA, 25 bp, E. coli
catattttatctgggaggagggaaa

SEQ ID NO: 184221 - DNA, 25 bp, E. coli
cagcacatatttaatctcggaggag

SEQ ID NO: 184222 - DNA, 25 bp, E. coli
cagcacatattttatctcggaggag

SEQ ID NO: 184223 - DNA, 25 bp, E. coli
tatctcggaggagggaaagcgttat

SEQ ID NO: 184224 - DNA, 25 bp, E. coli
tattttatctcggaggagggaaagc

SEQ ID NO: 184225 - DNA, 25 bp, E. coli
ttatctcggaggagggaaagcgtta

SEQ ID NO: 184226 - DNA, 25 bp, E. coli
ttatctcggaggtgggaaagcgtta

SEQ ID NO: 184227 - DNA, 25 bp, E. coli
tattttatctcgcaggagggaaagc

SEQ ID NO: 184228 - DNA, 25 bp, E. coli
tatctcggaggacggaaagcgttat

SEQ ID NO: 184229 - DNA, 25 bp, E. coli
ttttatctcggacgagggaaagcgt

SEQ ID NO: 184230 - DNA, 25 bp, E. coli
ttttatctcggaggagggaaagcgt

SEQ ID NO: 184231 - DNA, 25 bp, E. coli
tcggaggagggatagcgttatcgcc

SEQ ID NO: 184232 - DNA, 25 bp, E. coli
tcggaggagggaaagcgttatcgcc

SEQ ID NO: 184233 - DNA, 25 bp, E. coli
gcagcacatattatatctcggagga

SEQ ID NO: 184234 - DNA, 25 bp, E. coli
gcacatattttaactcggaggaggg

SEQ ID NO: 184235 - DNA, 25 bp, E. coli
gcacatattttatctcggaggaggg

SEQ ID NO: 184236 - DNA, 25 bp, E. coli
gcagcacatattttatctcggagga

SEQ ID NO: 184237 - DNA, 25 bp, E. coli
ggcagcacatatattatctcggagg

SEQ ID NO: 184238 - DNA, 25 bp, E. coli
ggcagcacatattttatctcggagg

SEQ ID NO: 184239 - DNA, 25 bp, E. coli
aacgtgattaaacatctcaagcgcg

SEQ ID NO: 184240 - DNA, 25 bp, E. coli
acgatgacgacgactggccgaaaaa

SEQ ID NO: 184241 - DNA, 25 bp, E. coli
acgatgacgacgtctggccgaaaaa

SEQ ID NO: 184242 - DNA, 25 bp, E. coli
aacgtgattaaagatctcaagcgcg

SEQ ID NO: 184243 - DNA, 25 bp, E. coli
tttctcgccaacaagccggagcttc

SEQ ID NO: 184244 - DNA, 25 bp, E. coli
tttctcgccaactagccggagcttc

SEQ ID NO: 184245 - DNA, 25 bp, E. coli
gcgcgtcgaccataagaaatttctc

SEQ ID NO: 184246 - DNA, 25 bp, E. coli
gcgcgtcgaccaaaagaaatttctc

SEQ ID NO: 184247 - DNA, 25 bp, E. coli
gactggccgaaataggatcaaccga

SEQ ID NO: 184248 - DNA, 25 bp, E. coli
gactggccgaaaaaggatcaaccga

SEQ ID NO: 184249 - DNA, 25 bp, E. coli
gaaatttctcgccaacaagccggag

SEQ ID NO: 184250 - DNA, 25 bp, E. coli
gaaatttctcgcgaacaagccggag

SEQ ID NO: 184251 - DNA, 25 bp, E. coli
ccccgcatcgtgttttcaacgataa

SEQ ID NO: 184252 - DNA, 25 bp, E. coli
ccccgcatcgtgatttcaacgataa

SEQ ID NO: 184253 - DNA, 25 bp, E. coli
gattgtctttttcgtaggcgtcctg

SEQ ID NO: 184254 - DNA, 25 bp, E. coli
gattgtctttttggtaggcgtcctg

SEQ ID NO: 184255 - DNA, 25 bp, E. coli
taggcgtcctgcagaacgtgattaa

SEQ ID NO: 184256 - DNA, 25 bp, E. coli
taggcgtcctgctgaacgtgattaa

SEQ ID NO: 184257 - DNA, 25 bp, E. coli
tcaacgataagtcggacgatgacga

SEQ ID NO: 184258 - DNA, 25 bp, E. coli
tcaacgataagtgggacgatgacga

SEQ ID NO: 184259 - DNA, 25 bp, E. coli
gatctcaagcgcctcgaccataaga

SEQ ID NO: 184260 - DNA, 25 bp, E. coli
gatctcaagcgcgtcgaccataaga

SEQ ID NO: 184261 - DNA, 25 bp, E. coli
tacatgacaccgaagatggtcctgt

SEQ ID NO: 184262 - DNA, 25 bp, E. coli
tacatgacaccgtagatggtcctgt

SEQ ID NO: 184263 - DNA, 25 bp, E. coli
aaaataatcttcagtgggctatccg

SEQ ID NO: 184264 - DNA, 25 bp, E. coli
aaaataatcttctgtgggctatccg

SEQ ID NO: 184265 - DNA, 25 bp, E. coli
tatggctgagaaataaggccgaagc

SEQ ID NO: 184266 - DNA, 25 bp, E. coli
tatggctgagaattaaggccgaagc

SEQ ID NO: 184267 - DNA, 25 bp, E. coli
ccagtggaacgttatgaatatggct

SEQ ID NO: 184268 - DNA, 25 bp, E. coli
ccagtggaacgtaatgaatatggct

SEQ ID NO: 184269 - DNA, 25 bp, E. coli
gaatatggctgctggacgcatcctg

SEQ ID NO: 184270 - DNA, 25 bp, E. coli
gaatatggctgcaggacgcatcctg

SEQ ID NO: 184271 - DNA, 25 bp, E. coli
cgcagatggcccagatatttcagca

SEQ ID NO: 184272 - DNA, 25 bp, E. coli
cgcagatggccctgatatttcagca

SEQ ID NO: 184273 - DNA, 25 bp, E. coli
gattttaatctggacgcagatggcc

SEQ ID NO: 184274 - DNA, 25 bp, E. coli
gattttaatctgcacgcagatggcc

SEQ ID NO: 184275 - DNA, 25 bp, E. coli
ggtcctgtttgtctatggctgagaa

SEQ ID NO: 184276 - DNA, 25 bp, E. coli
ggtcctgtttgtgtatggctgagaa

SEQ ID NO: 184277 - DNA, 25 bp, E. coli
tcagcatgggaagctgagcgaccag

SEQ ID NO: 184278 - DNA, 25 bp, E. coli
taattaaagaaaagccagtggaacg

SEQ ID NO: 184279 - DNA, 25 bp, E. coli
tcagcatgggaacctgagcgaccag

SEQ ID NO: 184280 - DNA, 25 bp, E. coli
taattaaagaaatgccagtggaacg

SEQ ID NO: 184281 - DNA, 25 bp, E. coli
gagggatggtttttcggttcgatac

SEQ ID NO: 184282 - DNA, 25 bp, E. coli
gagggatggtttatcggttcgatac

SEQ ID NO: 184283 - DNA, 25 bp, E. coli
aataccggatgagcaatatgcaggg

SEQ ID NO: 184284 - DNA, 25 bp, E. coli
aataccggatgaccaatatgcaggg

SEQ ID NO: 184285 - DNA, 25 bp, E. coli
aagtgtcagagcgttcgggttactc

SEQ ID NO: 184286 - DNA, 25 bp, E. coli
aagtgtcagagccttcgggttactc

SEQ ID NO: 184287 - DNA, 25 bp, E. coli
cactgtcactggtgaaagtgtcaga

SEQ ID NO: 184288 - DNA, 25 bp, E. coli
cactgtcactggagaaagtgtcaga

SEQ ID NO: 184289 - DNA, 25 bp, E. coli
aaaattactttgttgttccgccgca

SEQ ID NO: 184290 - DNA, 25 bp, E. coli
aaaattactttgatgttccgccgca

SEQ ID NO: 184291 - DNA, 25 bp, E. coli
tatctggcagaacgatatggcttcg

SEQ ID NO: 184292 - DNA, 25 bp, E. coli
tttggactggatcgaggacaacctg

SEQ ID NO: 184293 - DNA, 25 bp, E. coli
tttggactggatggaggacaacctg

SEQ ID NO: 184294 - DNA, 25 bp, E. coli
tatctggcagaaggatatggcttcg

SEQ ID NO: 184295 - DNA, 25 bp, E. coli
tcgcgcaaaagcagaaggaaagtaa

SEQ ID NO: 184296 - DNA, 25 bp, E. coli
tcgcgcaaaagctgaaggaaagtaa

SEQ ID NO: 184297 - DNA, 25 bp, E. coli
cgtaagatgacggaaatcgcgcaaa

SEQ ID NO: 184298 - DNA, 25 bp, E. coli
cgtaagatgacgcaaatcgcgcaaa

SEQ ID NO: 184299 - DNA, 25 bp, E. coli
taacgagccgattctctatctggca

SEQ ID NO: 184300 - DNA, 25 bp, E. coli
taacgagccgatactctatctggca

SEQ ID NO: 184301 - DNA, 25 bp, E. coli
gatgttccgccgcataaataccgga

SEQ ID NO: 184302 - DNA, 25 bp, E. coli
gatgtccagacggaatactgacgct

SEQ ID NO: 184303 - DNA, 25 bp, E. coli
gatgtccagacgcaatactgacgct

SEQ ID NO: 184304 - DNA, 25 bp, E. coli
gatgttccgccggataaataccgga

SEQ ID NO: 184305 - DNA, 25 bp, E. coli
caatggcggttttcgctggcggtat

SEQ ID NO: 184306 - DNA, 25 bp, E. coli
caatggcggtttacgctggcggtat

SEQ ID NO: 184307 - DNA, 25 bp, E. coli
ccaactgcaaccacgggttactacg

SEQ ID NO: 184308 - DNA, 25 bp, E. coli
ccaactgcaacctcgggttactacg

SEQ ID NO: 184309 - DNA, 25 bp, E. coli
ttttgcttggttataacccaactgc

SEQ ID NO: 184310 - DNA, 25 bp, E. coli
ttttgcttggttttaacccaactgc

SEQ ID NO: 184311 - DNA, 25 bp, E. coli
tctgcttggcgtaggcgaaccgctg

SEQ ID NO: 184312 - DNA, 25 bp, E. coli
tcaggtgcaggtggtttttgggcca

SEQ ID NO: 184313 - DNA, 25 bp, E. coli
tcaggtgcaggtcgtttttgggcca

SEQ ID NO: 184314 - DNA, 25 bp, E. coli
tctgcttggcgttggcgaaccgctg

SEQ ID NO: 184315 - DNA, 25 bp, E. coli
gaataaacgccagttaaaagccaga

SEQ ID NO: 184316 - DNA, 25 bp, E. coli
gaataaacgccacttaaaagccaga

SEQ ID NO: 184317 - DNA, 25 bp, E. coli
gacctcgacatgctgttgacctcat

SEQ ID NO: 184318 - DNA, 25 bp, E. coli
gacctcgacatggtgttgacctcat

SEQ ID NO: 184319 - DNA, 25 bp, E. coli
cgccagttaaaacccagacaaactt

SEQ ID NO: 184320 - DNA, 25 bp, E. coli
cgccagttaaaagccagacaaactt

SEQ ID NO: 184321 - DNA, 25 bp, E. coli
ctgtttgaaggcttgtcgtggctgt

SEQ ID NO: 184322 - DNA, 25 bp, E. coli
ctgtttgaaggcatgtcgtggctgt

SEQ ID NO: 184323 - DNA, 25 bp, E. coli
gttataacccaagtgcaaccacggg

SEQ ID NO: 184324 - DNA, 25 bp, E. coli
gttataacccaactgcaaccacggg

SEQ ID NO: 184325 - DNA, 25 bp, E. coli
ggtttttgggccaggcaaagcgcat

SEQ ID NO: 184326 - DNA, 25 bp, E. coli
ggtttttgggcctggcaaagcgcat

SEQ ID NO: 184327 - DNA, 25 bp, E. coli
cacgtcgtgtggcatctcttctggc

SEQ ID NO: 184328 - DNA, 25 bp, E. coli
cacgtcgtgtgggatctcttctggc

SEQ ID NO: 184329 - DNA, 25 bp, E. coli
catttgggcgcgttccaactctgcg

SEQ ID NO: 184330 - DNA, 25 bp, E. coli
catttgggcgcgatccaactctgcg

SEQ ID NO: 184331 - DNA, 25 bp, E. coli
cagtgaatggaaacgccaacgcgca

SEQ ID NO: 184332 - DNA, 25 bp, E. coli
cagtgaatggaatcgccaacgcgca

SEQ ID NO: 184333 - DNA, 25 bp, E. coli
acttcaaggtggcttgcaacgccgc

SEQ ID NO: 184334 - DNA, 25 bp, E. coli
acttcaaggtgggttgcaacgccgc

SEQ ID NO: 184335 - DNA, 25 bp, E. coli
tttttgccggatacaccagcgtgcg

SEQ ID NO: 184336 - DNA, 25 bp, E. coli
tttttgccggattcaccagcgtgcg

SEQ ID NO: 184337 - DNA, 25 bp, E. coli
tcttctggcgaacacatttgggcgc

SEQ ID NO: 184338 - DNA, 25 bp, E. coli
tcttctggcgaagacatttgggcgc

SEQ ID NO: 184339 - DNA, 25 bp, E. coli
gccataacggaatgctgagtattgc

SEQ ID NO: 184340 - DNA, 25 bp, E. coli
gccataacggaaagctgagtattgc

SEQ ID NO: 184341 - DNA, 25 bp, E. coli
ggcacctaccggagccataacggaa

SEQ ID NO: 184342 - DNA, 25 bp, E. coli
ggtattcgagttgcagcacttcaag

SEQ ID NO: 184343 - DNA, 25 bp, E. coli
ggcacctaccggtgccataacggaa

SEQ ID NO: 184344 - DNA, 25 bp, E. coli
ggtattcgagttccagcacttcaag

SEQ ID NO: 184345 - DNA, 25 bp, E. coli
ggctgttcattgacaccacgtcgtg

SEQ ID NO: 184346 - DNA, 25 bp, E. coli
ggctgttcattgtcaccacgtcgtg

SEQ ID NO: 184347 - DNA, 25 bp, E. coli
taagattgcggattttaacccggct

SEQ ID NO: 184348 - DNA, 25 bp, E. coli
taagattgcggaatttaacccggct

SEQ ID NO: 184349 - DNA, 25 bp, E. coli
aattaacgcgcgttgatgaggcgga

SEQ ID NO: 184350 - DNA, 25 bp, E. coli
aattaacgcgcgatgatgaggcgga

SEQ ID NO: 184351 - DNA, 25 bp, E. coli
attaacgcgcgatgatgaggcggaa

SEQ ID NO: 184352 - DNA, 25 bp, E. coli
attaacgcgcgaagatgaggcggaa

SEQ ID NO: 184353 - DNA, 25 bp, E. coli
aaattaacgcgccatgatgaggcgg

SEQ ID NO: 184354 - DNA, 25 bp, E. coli
aaattaacgcgcgatgatgaggcgg

SEQ ID NO: 184355 - DNA, 25 bp, E. coli
aaaagaaattaacgcgcgatgatga

SEQ ID NO: 184356 - DNA, 25 bp, E. coli
aaaagaaattaaggcgcgatgatga

SEQ ID NO: 184357 - DNA, 25 bp, E. coli
tatgaaaagaaattaacgcgcgatg

SEQ ID NO: 184358 - DNA, 25 bp, E. coli
tatgaaaagaaaataacgcgcgatg

SEQ ID NO: 184359 - DNA, 25 bp, E. coli
ttaacgcgcgatgatgaggcggaaa

SEQ ID NO: 184360 - DNA, 25 bp, E. coli
ttaacgcgcgatcatgaggcggaaa

SEQ ID NO: 184361 - DNA, 25 bp, E. coli
tgaaaagaaatttacgcgcgatgat

SEQ ID NO: 184362 - DNA, 25 bp, E. coli
tgaaaagaaattaacgcgcgatgat

SEQ ID NO: 184363 - DNA, 25 bp, E. coli
gcgcgatgatgacgcggaaaagtga

SEQ ID NO: 184364 - DNA, 25 bp, E. coli
gcgcgatgatgaggcggaaaagtga

SEQ ID NO: 184365 - DNA, 25 bp, E. coli
gaaaagaaattaacgcgcgatgatg

SEQ ID NO: 184366 - DNA, 25 bp, E. coli
gaaaagaaattatcgcgcgatgatg

SEQ ID NO: 184367 - DNA, 25 bp, E. coli
gattatgaaaagaaattaacgcgcg

SEQ ID NO: 184368 - DNA, 25 bp, E. coli
gattatgaaaagtaattaacgcgcg

SEQ ID NO: 184369 - DNA, 25 bp, E. coli
taacgcgcgatgttgaggcggaaaa

SEQ ID NO: 184370 - DNA, 25 bp, E. coli
taacgcgcgatgatgaggcggaaaa

SEQ ID NO: 184371 - DNA, 25 bp, E. coli
caagaaattctccataacgcgtggc

SEQ ID NO: 184372 - DNA, 25 bp, E. coli
caagaaattctcgataacgcgtggc

SEQ ID NO: 184373 - DNA, 25 bp, E. coli
caccatgcctggagtggcaggacac

SEQ ID NO: 184374 - DNA, 25 bp, E. coli
caccatgcctggtgtggcaggacac

SEQ ID NO: 184375 - DNA, 25 bp, E. coli
gccggagccgcgtgatgaatcaatc

SEQ ID NO: 184376 - DNA, 25 bp, E. coli
ccgtggtctacaattgcgaacataa

SEQ ID NO: 184377 - DNA, 25 bp, E. coli
gccggagccgcgagatgaatcaatc

SEQ ID NO: 184378 - DNA, 25 bp, E. coli
ccgtggtctacatttgcgaacataa

SEQ ID NO: 184379 - DNA, 25 bp, E. coli
gaatcaatccgtgtggataaaccgg

SEQ ID NO: 184380 - DNA, 25 bp, E. coli
gaatcaatccgtctggataaaccgg

SEQ ID NO: 184381 - DNA, 25 bp, E. coli
gaaaagctgaagttcacgccggagc

SEQ ID NO: 184382 - DNA, 25 bp, E. coli
gaaaagctgaagatcacgccggagc

SEQ ID NO: 184383 - DNA, 25 bp, E. coli
ccgtctgacgtattggtggctctgg

SEQ ID NO: 184384 - DNA, 25 bp, E. coli
ccgtctgacgtaatggtggctctgg

SEQ ID NO: 184385 - DNA, 25 bp, E. coli
ggatcatcgtcatcaagccgctgga

SEQ ID NO: 184386 - DNA, 25 bp, E. coli
gtgctggaaacgctcggcaccgata

SEQ ID NO: 184387 - DNA, 25 bp, E. coli
ggatcatcgtcaacaagccgctgga

SEQ ID NO: 184388 - DNA, 25 bp, E. coli
gtgctggaaacggtcggcaccgata

SEQ ID NO: 184389 - DNA, 25 bp, E. coli
ggcaccgataaagaaccgtctgacg

SEQ ID NO: 184390 - DNA, 25 bp, E. coli
tggataaaccggatatgctcggcgg

SEQ ID NO: 184391 - DNA, 25 bp, E. coli
ggcaccgataaacaaccgtctgacg

SEQ ID NO: 184392 - DNA, 25 bp, E. coli
tggataaaccggttatgctcggcgg

SEQ ID NO: 184393 - DNA, 25 bp, E. coli
aatattggctgattaaagcagcggc

SEQ ID NO: 184394 - DNA, 25 bp, E. coli
aatattggctgaataaagcagcggc

SEQ ID NO: 184395 - DNA, 25 bp, E. coli
aaagcagcggcaaatttatgcactg

SEQ ID NO: 184396 - DNA, 25 bp, E. coli
aaagcagcggcatatttatgcactg

SEQ ID NO: 184397 - DNA, 25 bp, E. coli
aaatttatgcacagtgataagcggc

SEQ ID NO: 184398 - DNA, 25 bp, E. coli
aaatttatgcactgtgataagcggc

SEQ ID NO: 184399 - DNA, 25 bp, E. coli
tacctcacagtgaatattggctgat

SEQ ID NO: 184400 - DNA, 25 bp, E. coli
tacctcacagtgtatattggctgat

SEQ ID NO: 184401 - DNA, 25 bp, E. coli
tgaactgttttcagagcctgactaa

SEQ ID NO: 184402 - DNA, 25 bp, E. coli
tgaactgttttctgagcctgactaa

SEQ ID NO: 184403 - DNA, 25 bp, E. coli
gaaagactctctcgcgatgggttta

SEQ ID NO: 184404 - DNA, 25 bp, E. coli
gaaagactctctggcgatgggttta

SEQ ID NO: 184405 - DNA, 25 bp, E. coli
cgtttggtcgtttccggcttgagca

SEQ ID NO: 184406 - DNA, 25 bp, E. coli
cgtttggtcgttaccggcttgagca

SEQ ID NO: 184407 - DNA, 25 bp, E. coli
cggctttttcagtgagaaagactct

SEQ ID NO: 184408 - DNA, 25 bp, E. coli
cggctttttcagagagaaagactct

SEQ ID NO: 184409 - DNA, 25 bp, E. coli
gataagcggcttattcagagagaaa

SEQ ID NO: 184410 - DNA, 25 bp, E. coli
gataagcggctttttcagagagaaa

SEQ ID NO: 184411 - DNA, 25 bp, E. coli
ggcttgagcaaatacctcacagtga

SEQ ID NO: 184412 - DNA, 25 bp, E. coli
ggcttgagcaaaaacctcacagtga

SEQ ID NO: 184413 - DNA, 25 bp, E. coli
gagcctgactaaatatccgtttggt

SEQ ID NO: 184414 - DNA, 25 bp, E. coli
gagcctgactaattatccgtttggt

SEQ ID NO: 184415 - DNA, 25 bp, E. coli
cataaagcggtacgtgtcggtgcct

SEQ ID NO: 184416 - DNA, 25 bp, E. coli
cataaagcggtaggtgtcggtgcct

SEQ ID NO: 184417 - DNA, 25 bp, E. coli
aaaagaaactgggactgagcgcact

SEQ ID NO: 184418 - DNA, 25 bp, E. coli
aaaagaaactggcactgagcgcact

SEQ ID NO: 184419 - DNA, 25 bp, E. coli
tattaagctcaatgctgggcgcggg

SEQ ID NO: 184420 - DNA, 25 bp, E. coli
tattaagctcaaagctgggcgcggg

SEQ ID NO: 184421 - DNA, 25 bp, E. coli
tgttcactttttgatcctgcgcggg

SEQ ID NO: 184422 - DNA, 25 bp, E. coli
tgttcactttttcatcctgcgcggg

SEQ ID NO: 184423 - DNA, 25 bp, E. coli
tgttggcaaagccacactgctggcg

SEQ ID NO: 184424 - DNA, 25 bp, E. coli
tgttggcaaagcgacactgctggcg

SEQ ID NO: 184425 - DNA, 25 bp, E. coli
taattgcctcagttccggcgacctg

SEQ ID NO: 184426 - DNA, 25 bp, E. coli
taattgcctcagatccggcgacctg

SEQ ID NO: 184427 - DNA, 25 bp, E. coli
gacttcaccggacttgcacttggcg

SEQ ID NO: 184428 - DNA, 25 bp, E. coli
gaaaaacaccatgctgatcaccctg

SEQ ID NO: 184429 - DNA, 25 bp, E. coli
gacttcaccggagttgcacttggcg

SEQ ID NO: 184430 - DNA, 25 bp, E. coli
gaaaaacaccatcctgatcaccctg

SEQ ID NO: 184431 - DNA, 25 bp, E. coli
ggtggcacgtcctgaactggctgaa

SEQ ID NO: 184432 - DNA, 25 bp, E. coli
ggtatctttaccaatgcccgcgaag

SEQ ID NO: 184433 - DNA, 25 bp, E. coli
ggtatctttacctatgcccgcgaag

SEQ ID NO: 184434 - DNA, 25 bp, E. coli
ggtggcacgtccagaactggctgaa

SEQ ID NO: 184435 - DNA, 25 bp, E. coli
ggcgcgtacttatgctggaccatca

SEQ ID NO: 184436 - DNA, 25 bp, E. coli
ggcgcgtacttaagctggaccatca

SEQ ID NO: 184437 - DNA, 25 bp, E. coli
tactggcctgcatgcacgtccggcg

SEQ ID NO: 184438 - DNA, 25 bp, E. coli
tactggcctgcaagcacgtccggcg

SEQ ID NO: 184439 - DNA, 25 bp, E. coli
aacagtactggcgtgcatgcacgtc

SEQ ID NO: 184440 - DNA, 25 bp, E. coli
aaatatagctgttaagtgacgctgc

SEQ ID NO: 184441 - DNA, 25 bp, E. coli
aaatatagctgtaaagtgacgctgc

SEQ ID NO: 184442 - DNA, 25 bp, E. coli
aacagtactggcctgcatgcacgtc

SEQ ID NO: 184443 - DNA, 25 bp, E. coli
tgccaccagcatcatgaatattatg

SEQ ID NO: 184444 - DNA, 25 bp, E. coli
tgccaccagcatgatgaatattatg

SEQ ID NO: 184445 - DNA, 25 bp, E. coli
tccggcggcctgactggcgaaagcc

SEQ ID NO: 184446 - DNA, 25 bp, E. coli
tccggcggcctgtctggcgaaagcc

SEQ ID NO: 184447 - DNA, 25 bp, E. coli
tcagaaacagtactggcctgcatgc

SEQ ID NO: 184448 - DNA, 25 bp, E. coli
gcatgatgaatattatgcgcgccgg

SEQ ID NO: 184449 - DNA, 25 bp, E. coli
gcgaaagccgcctaaaaatatagct

SEQ ID NO: 184450 - DNA, 25 bp, E. coli
gctgtaaagtgaggctgcactatga

SEQ ID NO: 184451 - DNA, 25 bp, E. coli
gcgaaagccgccaaaaaatatagct

SEQ ID NO: 184452 - DNA, 25 bp, E. coli
gcatgatgaataatatgcgcgccgg

SEQ ID NO: 184453 - DNA, 25 bp, E. coli
gctgtaaagtgacgctgcactatga

SEQ ID NO: 184454 - DNA, 25 bp, E. coli
gaaaaacggtggtaatacgctgcga

SEQ ID NO: 184455 - DNA, 25 bp, E. coli
gaaaaacggtggaaatacgctgcga

SEQ ID NO: 184456 - DNA, 25 bp, E. coli
taatgatattaatgccaccagcatg

SEQ ID NO: 184457 - DNA, 25 bp, E. coli
taatgatattaaagccaccagcatg

SEQ ID NO: 184458 - DNA, 25 bp, E. coli
tcagaaacagtagtggcctgcatgc

SEQ ID NO: 184459 - DNA, 25 bp, E. coli
caaacagtccggcatatttatcaga

SEQ ID NO: 184460 - DNA, 25 bp, E. coli
caaacagtccgggatatttatcaga

SEQ ID NO: 184461 - DNA, 25 bp, E. coli
tagcagccctggcaagttttaccgt

SEQ ID NO: 184462 - DNA, 25 bp, E. coli
tacttctgttttaagcagccctggc

SEQ ID NO: 184463 - DNA, 25 bp, E. coli
tacttctgtttttagcagccctggc

SEQ ID NO: 184464 - DNA, 25 bp, E. coli
cttattttggtgtaaccggagagcg

SEQ ID NO: 184465 - DNA, 25 bp, E. coli
cttattttggtgaaaccggagagcg

SEQ ID NO: 184466 - DNA, 25 bp, E. coli
aacaggcgcttaccctgaacgacaa

SEQ ID NO: 184467 - DNA, 25 bp, E. coli
aacaggcgcttagcctgaacgacaa

SEQ ID NO: 184468 - DNA, 25 bp, E. coli
tatgatccggtttgtgattgtcagg

SEQ ID NO: 184469 - DNA, 25 bp, E. coli
tatgatccggttagtgattgtcagg

SEQ ID NO: 184470 - DNA, 25 bp, E. coli
tagcagccctgggaagttttaccgt

SEQ ID NO: 184471 - DNA, 25 bp, E. coli
tgtcaggattttggcgatctggtgc

SEQ ID NO: 184472 - DNA, 25 bp, E. coli
tgtcaggattttcgcgatctggtgc

SEQ ID NO: 184473 - DNA, 25 bp, E. coli
tgaacgacaatcttacgctgccggg

SEQ ID NO: 184474 - DNA, 25 bp, E. coli
tgaacgacaatcatacgctgccggg

SEQ ID NO: 184475 - DNA, 25 bp, E. coli
gccactgccccttattttggtgaaa

SEQ ID NO: 184476 - DNA, 25 bp, E. coli
gccactgcccctaattttggtgaaa

SEQ ID NO: 184477 - DNA, 25 bp, E. coli
gaactataaatctgatgccactgcc

SEQ ID NO: 184478 - DNA, 25 bp, E. coli
gaactataaatcagatgccactgcc

SEQ ID NO: 184479 - DNA, 25 bp, E. coli
tcacagaccgtacaacaaacagtcc

SEQ ID NO: 184480 - DNA, 25 bp, E. coli
tcacagaccgtagaacaaacagtcc

SEQ ID NO: 184481 - DNA, 25 bp, E. coli
aatggacatggccatccgcaaagcg

SEQ ID NO: 184482 - DNA, 25 bp, E. coli
aatggacatggcgatccgcaaagcg

SEQ ID NO: 184483 - DNA, 25 bp, E. coli
aacgacttcggcgtgctggaacaaa

SEQ ID NO: 184484 - DNA, 25 bp, E. coli
cataacgttgcgcagcatgtggact

SEQ ID NO: 184485 - DNA, 25 bp, E. coli
cataacgttgcggagcatgtggact

SEQ ID NO: 184486 - DNA, 25 bp, E. coli
aacgacttcggcctgctggaacaaa

SEQ ID NO: 184487 - DNA, 25 bp, E. coli
ttttatgaaggtttacacggcggcg

SEQ ID NO: 184488 - DNA, 25 bp, E. coli
ttttatgaaggtatacacggcggcg

SEQ ID NO: 184489 - DNA, 25 bp, E. coli
tcattgcggtaagaggatccagcgg

SEQ ID NO: 184490 - DNA, 25 bp, E. coli
tcattgaatacggtcagagcggcaa

SEQ ID NO: 184491 - DNA, 25 bp, E. coli
tcattgcggtaacaggatccagcgg

SEQ ID NO: 184492 - DNA, 25 bp, E. coli
tcattgaatacgctcagagcggcaa

SEQ ID NO: 184493 - DNA, 25 bp, E. coli
gccgggcggcatatcagctacttcg

SEQ ID NO: 184494 - DNA, 25 bp, E. coli
gccgctggtgcaacgattgatggaa

SEQ ID NO: 184495 - DNA, 25 bp, E. coli
gccgctggtgcatcgattgatggaa

SEQ ID NO: 184496 - DNA, 25 bp, E. coli
gccgggcggcatttcagctacttcg

SEQ ID NO: 184497 - DNA, 25 bp, E. coli
gtagtcacgccagagcataacgttg

SEQ ID NO: 184498 - DNA, 25 bp, E. coli
gtagtcacgccacagcataacgttg

SEQ ID NO: 184499 - DNA, 25 bp, E. coli
gatttcccctgggtgctggcgatgt

SEQ ID NO: 184500 - DNA, 25 bp, E. coli
gatttcccctggctgctggcgatgt

SEQ ID NO: 184501 - DNA, 25 bp, E. coli
taatctggaaggcatcgatttcccc

SEQ ID NO: 184502 - DNA, 25 bp, E. coli
taatctggaagggatcgatttcccc

SEQ ID NO: 184503 - DNA, 25 bp, E. coli
aagcgttgttccctattgccagaga

SEQ ID NO: 184504 - DNA, 25 bp, E. coli
aagcgttgttccgtattgccagaga

SEQ ID NO: 184505 - DNA, 25 bp, E. coli
caaaagacgggaggaaaatctgcgc

SEQ ID NO: 184506 - DNA, 25 bp, E. coli
caaaagacgggacgaaaatctgcgc

SEQ ID NO: 184507 - DNA, 25 bp, E. coli
tatccgcgattactgagctgcatgg

SEQ ID NO: 184508 - DNA, 25 bp, E. coli
tatccgcgattagtgagctgcatgg

SEQ ID NO: 184509 - DNA, 25 bp, E. coli
tatctgagaaaagatggcatcccgg

SEQ ID NO: 184510 - DNA, 25 bp, E. coli
tatctgagaaaacatggcatcccgg

SEQ ID NO: 184511 - DNA, 25 bp, E. coli
ttttttcagaagagcacctccggat

SEQ ID NO: 184512 - DNA, 25 bp, E. coli
ttttttcagaagtgcacctccggat

SEQ ID NO: 184513 - DNA, 25 bp, E. coli
tgagcctgtatggaatcagaccggg

SEQ ID NO: 184514 - DNA, 25 bp, E. coli
tgagcctgtatgcaatcagaccggg

SEQ ID NO: 184515 - DNA, 25 bp, E. coli
tcggctcaggaaatgcaggcttaat

SEQ ID NO: 184516 - DNA, 25 bp, E. coli
tcagtgaggactatccggcagtggc

SEQ ID NO: 184517 - DNA, 25 bp, E. coli
tcagtgaggactttccggcagtggc

SEQ ID NO: 184518 - DNA, 25 bp, E. coli
tcggctcaggaattgcaggcttaat

SEQ ID NO: 184519 - DNA, 25 bp, E. coli
ccagggctgtcacggatggctctac

SEQ ID NO: 184520 - DNA, 25 bp, E. coli
ccagggctgtcagggatggctctac

SEQ ID NO: 184521 - DNA, 25 bp, E. coli
gactctgttgcctgtcataaccggg

SEQ ID NO: 184522 - DNA, 25 bp, E. coli
gactctgttgccagtcataaccggg

SEQ ID NO: 184523 - DNA, 25 bp, E. coli
gagtgtcaatatttcccgggtggta

SEQ ID NO: 184524 - DNA, 25 bp, E. coli
gagtgtcaatatatcccgggtggta

SEQ ID NO: 184525 - DNA, 25 bp, E. coli
caagattaagcgctggctcgaggac

SEQ ID NO: 184526 - DNA, 25 bp, E. coli
caagattaagcggtggctcgaggac

SEQ ID NO: 184527 - DNA, 25 bp, E. coli
cactttccttttggcggtggacgct

SEQ ID NO: 184528 - DNA, 25 bp, E. coli
cactgtaccgatgaacggcgcgaga

SEQ ID NO: 184529 - DNA, 25 bp, E. coli
cactgtaccgatcaacggcgcgaga

SEQ ID NO: 184530 - DNA, 25 bp, E. coli
cactttccttttcgcggtggacgct

SEQ ID NO: 184531 - DNA, 25 bp, E. coli
cagggaaaatggttcgcagacagcg

SEQ ID NO: 184532 - DNA, 25 bp, E. coli
cagggaaaatggatcgcagacagcg

SEQ ID NO: 184533 - DNA, 25 bp, E. coli
cactggcggacggtctataaccttg

SEQ ID NO: 184534 - DNA, 25 bp, E. coli
agtctgagcgcacgcaaggcgttca

SEQ ID NO: 184535 - DNA, 25 bp, E. coli
agtctgagcgcaggcaaggcgttca

SEQ ID NO: 184536 - DNA, 25 bp, E. coli
cactggcggacgctctataaccttg

SEQ ID NO: 184537 - DNA, 25 bp, E. coli
tatgccctgggatgcgagagatacc

SEQ ID NO: 184538 - DNA, 25 bp, E. coli
tatgccctgggaagcgagagatacc

SEQ ID NO: 184539 - DNA, 25 bp, E. coli
tgtttgagcgttacggcctgccgga

SEQ ID NO: 184540 - DNA, 25 bp, E. coli
tgtttgagcgtttcggcctgccgga

SEQ ID NO: 184541 - DNA, 25 bp, E. coli
tgaccatggataacggctcaccgtg

SEQ ID NO: 184542 - DNA, 25 bp, E. coli
tgaccatggatatcggctcaccgtg

SEQ ID NO: 184543 - DNA, 25 bp, E. coli
gaaaaagtcgatgaccatgggtaaa

SEQ ID NO: 184544 - DNA, 25 bp, E. coli
gaaaaagtcgatcaccatgggtaaa

SEQ ID NO: 184545 - DNA, 25 bp, E. coli
ggagcgttttcaccgcagcctgaag

SEQ ID NO: 184546 - DNA, 25 bp, E. coli
ggagcgttttcagcgcagcctgaag

SEQ ID NO: 184547 - DNA, 25 bp, E. coli
aatcaagctattatatcgcccggaa

SEQ ID NO: 184548 - DNA, 25 bp, E. coli
aattaatgactttggcgctacgacg

SEQ ID NO: 184549 - DNA, 25 bp, E. coli
aatcaagctattttatcgcccggaa

SEQ ID NO: 184550 - DNA, 25 bp, E. coli
aattaatgacttaggcgctacgacg

SEQ ID NO: 184551 - DNA, 25 bp, E. coli
cactcagtgtgctaaatagcggtga

SEQ ID NO: 184552 - DNA, 25 bp, E. coli
cactcagtgtgcaaaatagcggtga

SEQ ID NO: 184553 - DNA, 25 bp, E. coli
tattaataatgcctccgcgggcggg

SEQ ID NO: 184554 - DNA, 25 bp, E. coli
tattaataatgcgtccgcgggcggg

SEQ ID NO: 184555 - DNA, 25 bp, E. coli
tgttaccaacgcgtaaagaagcttc

SEQ ID NO: 184556 - DNA, 25 bp, E. coli
tgttaccaacgcctaaagaagcttc

SEQ ID NO: 184557 - DNA, 25 bp, E. coli
taagactaatttcccgaccgatcgt

SEQ ID NO: 184558 - DNA, 25 bp, E. coli
taagactaatttgccgaccgatcgt

SEQ ID NO: 184559 - DNA, 25 bp, E. coli
gcccaatatgttagtaccaccgaaa

SEQ ID NO: 184560 - DNA, 25 bp, E. coli
gcccaatatgtttgtaccaccgaaa

SEQ ID NO: 184561 - DNA, 25 bp, E. coli
cgtaacgcgattcatttatccggca

SEQ ID NO: 184562 - DNA, 25 bp, E. coli
cgtaacgcgattgatttatccggca

SEQ ID NO: 184563 - DNA, 25 bp, E. coli
cgacggagcggcagaaaggaataat

SEQ ID NO: 184564 - DNA, 25 bp, E. coli
cgacggagcggctgaaaggaataat

SEQ ID NO: 184565 - DNA, 25 bp, E. coli
gttaaagcaattccgccaacagatg

SEQ ID NO: 184566 - DNA, 25 bp, E. coli
gatattacggtcacgtcgccagtga

SEQ ID NO: 184567 - DNA, 25 bp, E. coli
gatattacggtctcgtcgccagtga

SEQ ID NO: 184568 - DNA, 25 bp, E. coli
gttaaagcaattgcgccaacagatg

SEQ ID NO: 184569 - DNA, 25 bp, E. coli
caaagcctcggcattacggatcgta

SEQ ID NO: 184570 - DNA, 25 bp, E. coli
caaagcctcggctttacggatcgta

SEQ ID NO: 184571 - DNA, 25 bp, E. coli
taaaactgaaagtgaccgtgcggca

SEQ ID NO: 184572 - DNA, 25 bp, E. coli
tacagcaagctgtcttacggctacg

SEQ ID NO: 184573 - DNA, 25 bp, E. coli
tacagcaagctgacttacggctacg

SEQ ID NO: 184574 - DNA, 25 bp, E. coli
taaaactgaaagagaccgtgcggca

SEQ ID NO: 184575 - DNA, 25 bp, E. coli
aaattgactggcctttgctggccgc

SEQ ID NO: 184576 - DNA, 25 bp, E. coli
aaattgactggcgtttgctggccgc

SEQ ID NO: 184577 - DNA, 25 bp, E. coli
tattgcttatcaggaatcgcactgg

SEQ ID NO: 184578 - DNA, 25 bp, E. coli
tattgcttatcacgaatcgcactgg

SEQ ID NO: 184579 - DNA, 25 bp, E. coli
gcccctgtttgagaaatacgccgaa

SEQ ID NO: 184580 - DNA, 25 bp, E. coli
gcccctgtttgacaaatacgccgaa

SEQ ID NO: 184581 - DNA, 25 bp, E. coli
gcaactggcgcaggattatccggcg

SEQ ID NO: 184582 - DNA, 25 bp, E. coli
gcaactggcgcacgattatccggcg

SEQ ID NO: 184583 - DNA, 25 bp, E. coli
gattttgattacgtcgatacgcgca

SEQ ID NO: 184584 - DNA, 25 bp, E. coli
gattttgattacctcgatacgcgca

SEQ ID NO: 184585 - DNA, 25 bp, E. coli
gatcgtaccgatcccgaacagagca

SEQ ID NO: 184586 - DNA, 25 bp, E. coli
ggtactgccgcacttaaagcccctg

SEQ ID NO: 184587 - DNA, 25 bp, E. coli
ggtggttaacgaactccagaccctg

SEQ ID NO: 184588 - DNA, 25 bp, E. coli
ggtactgccgcagttaaagcccctg

SEQ ID NO: 184589 - DNA, 25 bp, E. coli
ggtggttaacgatctccagaccctg

SEQ ID NO: 184590 - DNA, 25 bp, E. coli
gatcgtaccgatgccgaacagagca

SEQ ID NO: 184591 - DNA, 25 bp, E. coli
gctcacttccttatttatttacact

SEQ ID NO: 184592 - DNA, 25 bp, E. coli
gctcacttccttttttatttacact

SEQ ID NO: 184593 - DNA, 25 bp, E. coli
cactttccgtctcgatgcagtgcga

SEQ ID NO: 184594 - DNA, 25 bp, E. coli
cactttccgtctggatgcagtgcga

SEQ ID NO: 184595 - DNA, 25 bp, E. coli
caggcttttacggattgctcacttc

SEQ ID NO: 184596 - DNA, 25 bp, E. coli
caggcttttacgcattgctcacttc

SEQ ID NO: 184597 - DNA, 25 bp, E. coli
cattcgcccgagacacgtactacga

SEQ ID NO: 184598 - DNA, 25 bp, E. coli
cattcgcccgagtcacgtactacga

SEQ ID NO: 184599 - DNA, 25 bp, E. coli
ttcacactgcctcatcgacggctac

SEQ ID NO: 184600 - DNA, 25 bp, E. coli
ttcacactgcctgatcgacggctac

SEQ ID NO: 184601 - DNA, 25 bp, E. coli
tcgcccgagtcacgtactacgagta

SEQ ID NO: 184602 - DNA, 25 bp, E. coli
tcgcccgagtcaggtactacgagta

SEQ ID NO: 184603 - DNA, 25 bp, E. coli
ccgtctcgatgcagtgcgaatgatt

SEQ ID NO: 184604 - DNA, 25 bp, E. coli
ccgtctcgatgctgtgcgaatgatt

SEQ ID NO: 184605 - DNA, 25 bp, E. coli
ggctctcattcagtttccgtctcga

SEQ ID NO: 184606 - DNA, 25 bp, E. coli
ggctctcattcactttccgtctcga

SEQ ID NO: 184607 - DNA, 25 bp, E. coli
gagtcacgtacttcgagtacgctcc

SEQ ID NO: 184608 - DNA, 25 bp, E. coli
gatgcagtgcgattgattttgtgta

SEQ ID NO: 184609 - DNA, 25 bp, E. coli
gatgcagtgcgaatgattttgtgta

SEQ ID NO: 184610 - DNA, 25 bp, E. coli
gagtcacgtactacgagtacgctcc

SEQ ID NO: 184611 - DNA, 25 bp, E. coli
gacggctacgctcattcgcccgagt

SEQ ID NO: 184612 - DNA, 25 bp, E. coli
gacggctacgctgattcgcccgagt

SEQ ID NO: 184613 - DNA, 25 bp, E. coli
agccattttggcttattggtggatg

SEQ ID NO: 184614 - DNA, 25 bp, E. coli
cccgttgtttatggctaccggccat

SEQ ID NO: 184615 - DNA, 25 bp, E. coli
agccattttggcatattggtggatg

SEQ ID NO: 184616 - DNA, 25 bp, E. coli
attttggcttattggtggatgtgcc

SEQ ID NO: 184617 - DNA, 25 bp, E. coli
cccgttgtttatcgctaccggccat

SEQ ID NO: 184618 - DNA, 25 bp, E. coli
attttggcttataggtggatgtgcc

SEQ ID NO: 184619 - DNA, 25 bp, E. coli
tttggcttattggtggatgtgccga

SEQ ID NO: 184620 - DNA, 25 bp, E. coli
tttggcttattgctggatgtgccga

SEQ ID NO: 184621 - DNA, 25 bp, E. coli
ttgtttatcgcttccggccatcggg

SEQ ID NO: 184622 - DNA, 25 bp, E. coli
ttgtttatcgctaccggccatcggg

SEQ ID NO: 184623 - DNA, 25 bp, E. coli
tgtttatcgctaccggccatcgggt

SEQ ID NO: 184624 - DNA, 25 bp, E. coli
tgtttatcgctagcggccatcgggt

SEQ ID NO: 184625 - DNA, 25 bp, E. coli
gccagccattttggcttattggtgg

SEQ ID NO: 184626 - DNA, 25 bp, E. coli
ccattttggcttattggtggatgtg

SEQ ID NO: 184627 - DNA, 25 bp, E. coli
ccattttggctttttggtggatgtg

SEQ ID NO: 184628 - DNA, 25 bp, E. coli
gccagccattttcgcttattggtgg

SEQ ID NO: 184629 - DNA, 25 bp, E. coli
cgttgtttatcgctaccggccatcg

SEQ ID NO: 184630 - DNA, 25 bp, E. coli
cgttgtttatcggtaccggccatcg

SEQ ID NO: 184631 - DNA, 25 bp, E. coli
gttgtttatcgcaaccggccatcgg

SEQ ID NO: 184632 - DNA, 25 bp, E. coli
gttgtttatcgctaccggccatcgg

SEQ ID NO: 184633 - DNA, 25 bp, E. coli
tgtaacccgttgtttatcgctaccg

SEQ ID NO: 184634 - DNA, 25 bp, E. coli
tgtaacccgttgattatcgctaccg

SEQ ID NO: 184635 - DNA, 25 bp, E. coli
cacacaaggagcaagtagcgatgcg

SEQ ID NO: 184636 - DNA, 25 bp, E. coli
cacacaaggagctagtagcgatgcg

SEQ ID NO: 184637 - DNA, 25 bp, E. coli
taaatgacaccgtagcacacaagga

SEQ ID NO: 184638 - DNA, 25 bp, E. coli
taaaagacgccacaaaccataccga

SEQ ID NO: 184639 - DNA, 25 bp, E. coli
taaaagacgccagaaaccataccga

SEQ ID NO: 184640 - DNA, 25 bp, E. coli
taaatgacaccgaagcacacaagga

SEQ ID NO: 184641 - DNA, 25 bp, E. coli
tagcgatgcgtgaaatgaatcagtt

SEQ ID NO: 184642 - DNA, 25 bp, E. coli
tagcgatgcgtgtaatgaatcagtt

SEQ ID NO: 184643 - DNA, 25 bp, E. coli
tgaagattcagcctggccaataatc

SEQ ID NO: 184644 - DNA, 25 bp, E. coli
tgaagattcagcgtggccaataatc

SEQ ID NO: 184645 - DNA, 25 bp, E. coli
tgacaacaaaatcaccgatgggtgc

SEQ ID NO: 184646 - DNA, 25 bp, E. coli
tgacaacaaaatgaccgatgggtgc

SEQ ID NO: 184647 - DNA, 25 bp, E. coli
tgcgcttgtctatggctccggaggt

SEQ ID NO: 184648 - DNA, 25 bp, E. coli
tccagaactggtaaaaagacgccac

SEQ ID NO: 184649 - DNA, 25 bp, E. coli
tgcgcttgtctaaggctccggaggt

SEQ ID NO: 184650 - DNA, 25 bp, E. coli
tccagaactggttaaaagacgccac

SEQ ID NO: 184651 - DNA, 25 bp, E. coli
gctccggaggtcagctgattgataa

SEQ ID NO: 184652 - DNA, 25 bp, E. coli
gctccggaggtctgctgattgataa

SEQ ID NO: 184653 - DNA, 25 bp, E. coli
gaaaccgcactttatcaattacagg

SEQ ID NO: 184654 - DNA, 25 bp, E. coli
gaaaccgcacttaatcaattacagg

SEQ ID NO: 184655 - DNA, 25 bp, E. coli
taataaagattttgccgaaaccgca

SEQ ID NO: 184656 - DNA, 25 bp, E. coli
taataaagatttagccgaaaccgca

SEQ ID NO: 184657 - DNA, 25 bp, E. coli
tactctccgtagtaacggctgcatt

SEQ ID NO: 184658 - DNA, 25 bp, E. coli
tactctccgtagaaacggctgcatt

SEQ ID NO: 184659 - DNA, 25 bp, E. coli
agtactctccgttgtaacggctgca

SEQ ID NO: 184660 - DNA, 25 bp, E. coli
agtactctccgtagtaacggctgca

SEQ ID NO: 184661 - DNA, 25 bp, E. coli
actctccgtagtaacggctgcattt

SEQ ID NO: 184662 - DNA, 25 bp, E. coli
actctccgtagttacggctgcattt

SEQ ID NO: 184663 - DNA, 25 bp, E. coli
tagtactctccgaagtaacggctgc

SEQ ID NO: 184664 - DNA, 25 bp, E. coli
tagtactctccgtagtaacggctgc

SEQ ID NO: 184665 - DNA, 25 bp, E. coli
ttagtactctccgtagtaacggctg

SEQ ID NO: 184666 - DNA, 25 bp, E. coli
ttagtactctccctagtaacggctg

SEQ ID NO: 184667 - DNA, 25 bp, E. coli
tctccgtagtaacggctgcattttc

SEQ ID NO: 184668 - DNA, 25 bp, E. coli
tctccgtagtaagggctgcattttc

SEQ ID NO: 184669 - DNA, 25 bp, E. coli
ccgtagtaacgggtgcattttcatt

SEQ ID NO: 184670 - DNA, 25 bp, E. coli
ccgtagtaacggctgcattttcatt

SEQ ID NO: 184671 - DNA, 25 bp, E. coli
ctccgtagtaacggctgcattttca

SEQ ID NO: 184672 - DNA, 25 bp, E. coli
ctccgtagtaaccgctgcattttca

SEQ ID NO: 184673 - DNA, 25 bp, E. coli
cgtagtaacggctgcattttcatta

SEQ ID NO: 184674 - DNA, 25 bp, E. coli
cgtagtaacggcagcattttcatta

SEQ ID NO: 184675 - DNA, 25 bp, E. coli
ctctccgtagtaacggctgcatttt

SEQ ID NO: 184676 - DNA, 25 bp, E. coli
ctctccgtagtatcggctgcatttt

SEQ ID NO: 184677 - DNA, 25 bp, E. coli
gtactctccgtagtaacggctgcat

SEQ ID NO: 184678 - DNA, 25 bp, E. coli
gtactctccgtactaacggctgcat

SEQ ID NO: 184679 - DNA, 25 bp, E. coli
cactacacgcacttacaacggaggg

SEQ ID NO: 184680 - DNA, 25 bp, E. coli
cactacacgcacatacaacggaggg

SEQ ID NO: 184681 - DNA, 25 bp, E. coli
cattagaatagttgcgataagctgc

SEQ ID NO: 184682 - DNA, 25 bp, E. coli
taacataaatgggtaatgactccaa

SEQ ID NO: 184683 - DNA, 25 bp, E. coli
taacataaatggctaatgactccaa

SEQ ID NO: 184684 - DNA, 25 bp, E. coli
tgtccttacaaatagaaatgggtct

SEQ ID NO: 184685 - DNA, 25 bp, E. coli
tgatgtcgccgggaagccccggtaa

SEQ ID NO: 184686 - DNA, 25 bp, E. coli
tgatgtcgccggcaagccccggtaa

SEQ ID NO: 184687 - DNA, 25 bp, E. coli
tgtccttacaaaaagaaatgggtct

SEQ ID NO: 184688 - DNA, 25 bp, E. coli
gcaataagcagatccacctttttgg

SEQ ID NO: 184689 - DNA, 25 bp, E. coli
gcaataagcagaaccacctttttgg

SEQ ID NO: 184690 - DNA, 25 bp, E. coli
cattagaatagtagcgataagctgc

SEQ ID NO: 184691 - DNA, 25 bp, E. coli
gatttttcctaattcgacgcaactg

SEQ ID NO: 184692 - DNA, 25 bp, E. coli
gatttttcctaaatcgacgcaactg

SEQ ID NO: 184693 - DNA, 25 bp, E. coli
gggctgcgattttcaataatgcgtg

SEQ ID NO: 184694 - DNA, 25 bp, E. coli
ggtttcaccgcagcccgtgatgtcg

SEQ ID NO: 184695 - DNA, 25 bp, E. coli
gggctgcgatttacaataatgcgtg

SEQ ID NO: 184696 - DNA, 25 bp, E. coli
ggtttcaccgcaccccgtgatgtcg

SEQ ID NO: 184697 - DNA, 25 bp, E. coli
gacgcaactgtactcgtcactacac

SEQ ID NO: 184698 - DNA, 25 bp, E. coli
gacgcaactgtagtcgtcactacac

SEQ ID NO: 184699 - DNA, 25 bp, E. coli
gatgcagatcactcaaaacactcaa

SEQ ID NO: 184700 - DNA, 25 bp, E. coli
gatgcagatcacacaaaacactcaa

SEQ ID NO: 184701 - DNA, 25 bp, E. coli
tacagcagttattacccgcgtggcc

SEQ ID NO: 184702 - DNA, 25 bp, E. coli
tacacgacgcggtatgagtatgacc

SEQ ID NO: 184703 - DNA, 25 bp, E. coli
taacaataggcgctaaggacaacgg

SEQ ID NO: 184704 - DNA, 25 bp, E. coli
taacaataggcggtaaggacaacgg

SEQ ID NO: 184705 - DNA, 25 bp, E. coli
tacagcagttataacccgcgtggcc

SEQ ID NO: 184706 - DNA, 25 bp, E. coli
tacacgacgcggaatgagtatgacc

SEQ ID NO: 184707 - DNA, 25 bp, E. coli
ttttgatggccgcacgcaacgttac

SEQ ID NO: 184708 - DNA, 25 bp, E. coli
ttttgatggccggacgcaacgttac

SEQ ID NO: 184709 - DNA, 25 bp, E. coli
tgctgacctttacggactgctcggg

SEQ ID NO: 184710 - DNA, 25 bp, E. coli
tgctgacctttagggactgctcggg

SEQ ID NO: 184711 - DNA, 25 bp, E. coli
gaagatgttcgcctgagtccgcata

SEQ ID NO: 184712 - DNA, 25 bp, E. coli
gaagtattccgttaacagcgcgcca

SEQ ID NO: 184713 - DNA, 25 bp, E. coli
gaagatgttcgcgtgagtccgcata

SEQ ID NO: 184714 - DNA, 25 bp, E. coli
gaagtattccgtaaacagcgcgcca

SEQ ID NO: 184715 - DNA, 25 bp, E. coli
gaaacccgttatcagtacagcgccg

SEQ ID NO: 184716 - DNA, 25 bp, E. coli
gaaacccgttatgagtacagcgccg

SEQ ID NO: 184717 - DNA, 25 bp, E. coli
gtacagctatgatgacccggcgagt

SEQ ID NO: 184718 - DNA, 25 bp, E. coli
gtttcccggcgacataagctacagc

SEQ ID NO: 184719 - DNA, 25 bp, E. coli
gtttcccggcgagataagctacagc

SEQ ID NO: 184720 - DNA, 25 bp, E. coli
ggagatatatcacccaggacccgat

SEQ ID NO: 184721 - DNA, 25 bp, E. coli
gtacagctatgaagacccggcgagt

SEQ ID NO: 184722 - DNA, 25 bp, E. coli
ggagatatatcagccaggacccgat

SEQ ID NO: 184723 - DNA, 25 bp, E. coli
taaatgaggaagtaatggcgcgccc

SEQ ID NO: 184724 - DNA, 25 bp, E. coli
taaatgaggaagaaatggcgcgccc

SEQ ID NO: 184725 - DNA, 25 bp, E. coli
taaagccttgcatgccattgcgagg

SEQ ID NO: 184726 - DNA, 25 bp, E. coli
taaagccttgcaagccattgcgagg

SEQ ID NO: 184727 - DNA, 25 bp, E. coli
tacctcaaaacaagtaaagccttgc

SEQ ID NO: 184728 - DNA, 25 bp, E. coli
tacctcaaaacatgtaaagccttgc

SEQ ID NO: 184729 - DNA, 25 bp, E. coli
tttaagtcaacaacttaccgcgcca

SEQ ID NO: 184730 - DNA, 25 bp, E. coli
tttaagtcaacatcttaccgcgcca

SEQ ID NO: 184731 - DNA, 25 bp, E. coli
tgcaggattcgaacctgcggcccac

SEQ ID NO: 184732 - DNA, 25 bp, E. coli
tgcaggattcgatcctgcggcccac

SEQ ID NO: 184733 - DNA, 25 bp, E. coli
tgcggcccacgagttagaagttcct

SEQ ID NO: 184734 - DNA, 25 bp, E. coli
tgcggcccacgacttagaagttcct

SEQ ID NO: 184735 - DNA, 25 bp, E. coli
gcctctaaaggcttggcacttaaat

SEQ ID NO: 184736 - DNA, 25 bp, E. coli
gcggaaacggataagacgggcataa

SEQ ID NO: 184737 - DNA, 25 bp, E. coli
gcctctaaaggcatggcacttaaat

SEQ ID NO: 184738 - DNA, 25 bp, E. coli
gcggaaacggattagacgggcataa

SEQ ID NO: 184739 - DNA, 25 bp, E. coli
cattgcgaggccttatgtgtctcag

SEQ ID NO: 184740 - DNA, 25 bp, E. coli
cattgcgaggccatatgtgtctcag

SEQ ID NO: 184741 - DNA, 25 bp, E. coli
taattaaaccaaaaacagatagcgc

SEQ ID NO: 184742 - DNA, 25 bp, E. coli
taattaaaccaataacagatagcgc

SEQ ID NO: 184743 - DNA, 25 bp, E. coli
gaggataaacctcatgctattttcg

SEQ ID NO: 184744 - DNA, 25 bp, E. coli
gaggataaacctgatgctattttcg

SEQ ID NO: 184745 - DNA, 25 bp, E. coli
aatggcggtgctggacggaaaatcc

SEQ ID NO: 184746 - DNA, 25 bp, E. coli
aatggcggtgctcgacggaaaatcc

SEQ ID NO: 184747 - DNA, 25 bp, E. coli
cagcagatgaccatggaaaacttat

SEQ ID NO: 184748 - DNA, 25 bp, E. coli
cagcagatgaccttggaaaacttat

SEQ ID NO: 184749 - DNA, 25 bp, E. coli
cagggacggcagcagtgggagcgcc

SEQ ID NO: 184750 - DNA, 25 bp, E. coli
cagggacggcaggagtgggagcgcc

SEQ ID NO: 184751 - DNA, 25 bp, E. coli
acttatctgagatccggcagggacg

SEQ ID NO: 184752 - DNA, 25 bp, E. coli
acttatctgagaaccggcagggacg

SEQ ID NO: 184753 - DNA, 25 bp, E. coli
tatacggaagctcaaatggcggtgc

SEQ ID NO: 184754 - DNA, 25 bp, E. coli
tatacggaagctgaaatggcggtgc

SEQ ID NO: 184755 - DNA, 25 bp, E. coli
ccatgattcagccttatacggaagc

SEQ ID NO: 184756 - DNA, 25 bp, E. coli
ccatgattcagcgttatacggaagc

SEQ ID NO: 184757 - DNA, 25 bp, E. coli
gaaccagaatgatatcgaagccatg

SEQ ID NO: 184758 - DNA, 25 bp, E. coli
gaaaatccgtcacctttaatggtca

SEQ ID NO: 184759 - DNA, 25 bp, E. coli
gaaccagaatgaaatcgaagccatg

SEQ ID NO: 184760 - DNA, 25 bp, E. coli
gaaaacttatctgagatccggcagg

SEQ ID NO: 184761 - DNA, 25 bp, E. coli
gaaaatccgtcagctttaatggtca

SEQ ID NO: 184762 - DNA, 25 bp, E. coli
gaaaacttatctcagatccggcagg

SEQ ID NO: 184763 - DNA, 25 bp, E. coli
gatatcgaagccatgattcagcgtt

SEQ ID NO: 184764 - DNA, 25 bp, E. coli
gatatcgaagccttgattcagcgtt

SEQ ID NO: 184765 - DNA, 25 bp, E. coli
tcacctttaatggtcagcagatgac

SEQ ID NO: 184766 - DNA, 25 bp, E. coli
tcacctttaatgctcagcagatgac

SEQ ID NO: 184767 - DNA, 25 bp, E. coli
cagtgctcacggacaggaactgcgg

SEQ ID NO: 184768 - DNA, 25 bp, E. coli
cagtgctcacggtcaggaactgcgg

SEQ ID NO: 184769 - DNA, 25 bp, E. coli
actgcgggagcgatacgaagattga

SEQ ID NO: 184770 - DNA, 25 bp, E. coli
actgcgggagcgttacgaagattga

SEQ ID NO: 184771 - DNA, 25 bp, E. coli
tttcagggagaaaggatttatcgtc

SEQ ID NO: 184772 - DNA, 25 bp, E. coli
tttcagggagaatggatttatcgtc

SEQ ID NO: 184773 - DNA, 25 bp, E. coli
ttaactcagagacggaggatgtgcc

SEQ ID NO: 184774 - DNA, 25 bp, E. coli
ttaactcagagagggaggatgtgcc

SEQ ID NO: 184775 - DNA, 25 bp, E. coli
gaaaaaatcccgcagtgctcacgga

SEQ ID NO: 184776 - DNA, 25 bp, E. coli
gaaaaaatcccggagtgctcacgga

SEQ ID NO: 184777 - DNA, 25 bp, E. coli
gacaaaaacatttactcagagaggg

SEQ ID NO: 184778 - DNA, 25 bp, E. coli
gaaaggatttatcgtcctgaggaat

SEQ ID NO: 184779 - DNA, 25 bp, E. coli
gaaaggatttatggtcctgaggaat

SEQ ID NO: 184780 - DNA, 25 bp, E. coli
gacaaaaacattaactcagagaggg

SEQ ID NO: 184781 - DNA, 25 bp, E. coli
ggcggcaggcattaaagcgaaaaaa

SEQ ID NO: 184782 - DNA, 25 bp, E. coli
ggaattattcttttgtcacgacaaa

SEQ ID NO: 184783 - DNA, 25 bp, E. coli
ggcggcaggcataaaagcgaaaaaa

SEQ ID NO: 184784 - DNA, 25 bp, E. coli
ggaattattcttatgtcacgacaaa

SEQ ID NO: 184785 - DNA, 25 bp, E. coli
tacgaagattgactgtaaggaatta

SEQ ID NO: 184786 - DNA, 25 bp, E. coli
tacgaagattgagtgtaaggaatta

SEQ ID NO: 184787 - DNA, 25 bp, E. coli
gaggatgtgccgatcttttcaggga

SEQ ID NO: 184788 - DNA, 25 bp, E. coli
gaggatgtgccgttcttttcaggga

SEQ ID NO: 184789 - DNA, 25 bp, E. coli
cacgctggcatgtgggtgggctgct

SEQ ID NO: 184790 - DNA, 25 bp, E. coli
cacgctggcatgagggtgggctgct

SEQ ID NO: 184791 - DNA, 25 bp, E. coli
acgctggcatgtgggtgggctgctg

SEQ ID NO: 184792 - DNA, 25 bp, E. coli
acacgctggcatgtgggtgggctgc

SEQ ID NO: 184793 - DNA, 25 bp, E. coli
acgctggcatgtcggtgggctgctg

SEQ ID NO: 184794 - DNA, 25 bp, E. coli
acacgctggcatctgggtgggctgc

SEQ ID NO: 184795 - DNA, 25 bp, E. coli
tgtgggtgggctcctgacagccgga

SEQ ID NO: 184796 - DNA, 25 bp, E. coli
tgtgggtgggctgctgacagccgga

SEQ ID NO: 184797 - DNA, 25 bp, E. coli
tgggtgggctgcagacagccggata

SEQ ID NO: 184798 - DNA, 25 bp, E. coli
tgggtgggctgctgacagccggata

SEQ ID NO: 184799 - DNA, 25 bp, E. coli
ccacacgctggcttgtgggtgggct

SEQ ID NO: 184800 - DNA, 25 bp, E. coli
ccacacgctggcatgtgggtgggct

SEQ ID NO: 184801 - DNA, 25 bp, E. coli
gctggcatgtggctgggctgctgac

SEQ ID NO: 184802 - DNA, 25 bp, E. coli
gctggcatgtgggtgggctgctgac

SEQ ID NO: 184803 - DNA, 25 bp, E. coli
cggccacacgctggcatgtgggtgg

SEQ ID NO: 184804 - DNA, 25 bp, E. coli
cggccacacgctcgcatgtgggtgg

SEQ ID NO: 184805 - DNA, 25 bp, E. coli
ctggcatgtgggagggctgctgaca

SEQ ID NO: 184806 - DNA, 25 bp, E. coli
ctggcatgtgggtgggctgctgaca

SEQ ID NO: 184807 - DNA, 25 bp, E. coli
gggtgggctgctcacagccggatat

SEQ ID NO: 184808 - DNA, 25 bp, E. coli
gggtgggctgctgacagccggatat

SEQ ID NO: 184809 - DNA, 25 bp, E. coli
tggcatgtgggtgggctgctgacag

SEQ ID NO: 184810 - DNA, 25 bp, E. coli
tggcatgtgggtcggctgctgacag

SEQ ID NO: 184811 - DNA, 25 bp, E. coli
tcaggagtgatgaagccgaagcctt

SEQ ID NO: 184812 - DNA, 25 bp, E. coli
tctttagagccaacgtcaggagtga

SEQ ID NO: 184813 - DNA, 25 bp, E. coli
tcaggagtgatgtagccgaagcctt

SEQ ID NO: 184814 - DNA, 25 bp, E. coli
tctttagagccatcgtcaggagtga

SEQ ID NO: 184815 - DNA, 25 bp, E. coli
gcgccgctttcgatggtgaaggaca

SEQ ID NO: 184816 - DNA, 25 bp, E. coli
gcgccgctttcgttggtgaaggaca

SEQ ID NO: 184817 - DNA, 25 bp, E. coli
gaagcctttgtctgcgttgaaccat

SEQ ID NO: 184818 - DNA, 25 bp, E. coli
gaagcctttgtcagcgttgaaccat

SEQ ID NO: 184819 - DNA, 25 bp, E. coli
gacactttctgagcttcgtccagag

SEQ ID NO: 184820 - DNA, 25 bp, E. coli
gacactttctgaccttcgtccagag

SEQ ID NO: 184821 - DNA, 25 bp, E. coli
cgataccagtcaatttaccggacat

SEQ ID NO: 184822 - DNA, 25 bp, E. coli
cgatggtgaaggacactttctgacc

SEQ ID NO: 184823 - DNA, 25 bp, E. coli
cgttctggatagcagagaagtgtac

SEQ ID NO: 184824 - DNA, 25 bp, E. coli
cgttctggataggagagaagtgtac

SEQ ID NO: 184825 - DNA, 25 bp, E. coli
cgataccagtcattttaccggacat

SEQ ID NO: 184826 - DNA, 25 bp, E. coli
cgatggtgaaggtcactttctgacc

SEQ ID NO: 184827 - DNA, 25 bp, E. coli
gttgaaccatttaacgataccagtc

SEQ ID NO: 184828 - DNA, 25 bp, E. coli
gatttgtaaccaacgttctggatag

SEQ ID NO: 184829 - DNA, 25 bp, E. coli
gttgaaccattttacgataccagtc

SEQ ID NO: 184830 - DNA, 25 bp, E. coli
gatttgtaaccatcgttctggatag

SEQ ID NO: 184831 - DNA, 25 bp, E. coli
gaccttcgtccagagatttgtaacc

SEQ ID NO: 184832 - DNA, 25 bp, E. coli
gaccttcgtccacagatttgtaacc

SEQ ID NO: 184833 - DNA, 25 bp, E. coli
taccgcgccgatcatcttgagcata

SEQ ID NO: 184834 - DNA, 25 bp, E. coli
taccgcgccgatgatcttgagcata

SEQ ID NO: 184835 - DNA, 25 bp, E. coli
ttaccgcgccgatgatcttgagcat

SEQ ID NO: 184836 - DNA, 25 bp, E. coli
ttgagcataaaaccgcgttgctggt

SEQ ID NO: 184837 - DNA, 25 bp, E. coli
ttaccgcgccgaagatcttgagcat

SEQ ID NO: 184838 - DNA, 25 bp, E. coli
ttgagcataaaagcgcgttgctggt

SEQ ID NO: 184839 - DNA, 25 bp, E. coli
tgatcttgagcaaaaaaccgcgttg

SEQ ID NO: 184840 - DNA, 25 bp, E. coli
tgatcttgagcataaaaccgcgttg

SEQ ID NO: 184841 - DNA, 25 bp, E. coli
tcttgagcataataccgcgttgctg

SEQ ID NO: 184842 - DNA, 25 bp, E. coli
tcttgagcataaaaccgcgttgctg

SEQ ID NO: 184843 - DNA, 25 bp, E. coli
gcgccgatgatcttgagcataaaac

SEQ ID NO: 184844 - DNA, 25 bp, E. coli
gccgatgatcttcagcataaaaccg

SEQ ID NO: 184845 - DNA, 25 bp, E. coli
gcgccgatgatcatgagcataaaac

SEQ ID NO: 184846 - DNA, 25 bp, E. coli
gccgatgatcttgagcataaaaccg

SEQ ID NO: 184847 - DNA, 25 bp, E. coli
cgatgatcttgagcataaaaccgcg

SEQ ID NO: 184848 - DNA, 25 bp, E. coli
ccgcgccgatgatcttgagcataaa

SEQ ID NO: 184849 - DNA, 25 bp, E. coli
ccgcgccgatgaacttgagcataaa

SEQ ID NO: 184850 - DNA, 25 bp, E. coli
cgatgatcttgaccataaaaccgcg

SEQ ID NO: 184851 - DNA, 25 bp, E. coli
gatcttgagcattaaaccgcgttgc

SEQ ID NO: 184852 - DNA, 25 bp, E. coli
gatcttgagcataaaaccgcgttgc

SEQ ID NO: 184853 - DNA, 25 bp, E. coli
gatgatcttgaggataaaaccgcgt

SEQ ID NO: 184854 - DNA, 25 bp, E. coli
gatgatcttgagcataaaaccgcgt

SEQ ID NO: 184855 - DNA, 25 bp, E. coli
aatctggcattggtgctggactccg

SEQ ID NO: 184856 - DNA, 25 bp, E. coli
caagttcatatccaaagcgttggcc

SEQ ID NO: 184857 - DNA, 25 bp, E. coli
aatctggcattgctgctggactccg

SEQ ID NO: 184858 - DNA, 25 bp, E. coli
caagttcatatcgaaagcgttggcc

SEQ ID NO: 184859 - DNA, 25 bp, E. coli
taacggcgacatgtcgcgatacctt

SEQ ID NO: 184860 - DNA, 25 bp, E. coli
actggcaggtgcgaaaacagaagca

SEQ ID NO: 184861 - DNA, 25 bp, E. coli
actggcaggtgccaaaacagaagca

SEQ ID NO: 184862 - DNA, 25 bp, E. coli
tatcgaaagcgttggccattactgg

SEQ ID NO: 184863 - DNA, 25 bp, E. coli
tatcgaaagcgtaggccattactgg

SEQ ID NO: 184864 - DNA, 25 bp, E. coli
tccgtagcgaacgacaaagctgcat

SEQ ID NO: 184865 - DNA, 25 bp, E. coli
tgcgaaaacagatgcaaaaggcgca

SEQ ID NO: 184866 - DNA, 25 bp, E. coli
tgcgaaaacagaagcaaaaggcgca

SEQ ID NO: 184867 - DNA, 25 bp, E. coli
tccgtagcgaaccacaaagctgcat

SEQ ID NO: 184868 - DNA, 25 bp, E. coli
gaaaaagagaagaatctggcattgc

SEQ ID NO: 184869 - DNA, 25 bp, E. coli
gacaaagctgcattaacggcgacat

SEQ ID NO: 184870 - DNA, 25 bp, E. coli
gaaaaagagaagtatctggcattgc

SEQ ID NO: 184871 - DNA, 25 bp, E. coli
gacaaagctgcaataacggcgacat

SEQ ID NO: 184872 - DNA, 25 bp, E. coli
cattgctgctggtctccgtagcgaa

SEQ ID NO: 184873 - DNA, 25 bp, E. coli
cattgctgctggactccgtagcgaa

SEQ ID NO: 184874 - DNA, 25 bp, E. coli
gattcactgggtaaactggcaggtg

SEQ ID NO: 184875 - DNA, 25 bp, E. coli
gattcactgggttaactggcaggtg

SEQ ID NO: 184876 - DNA, 25 bp, E. coli
taacggcgacatctcgcgatacctt

SEQ ID NO: 184877 - DNA, 25 bp, E. coli
aattgacaaagaaggtcagcacgcc

SEQ ID NO: 184878 - DNA, 25 bp, E. coli
aattgacaaagatggtcagcacgcc

SEQ ID NO: 184879 - DNA, 25 bp, E. coli
atatcaagacagatttaggtccagc

SEQ ID NO: 184880 - DNA, 25 bp, E. coli
atatcaagacagttttaggtccagc

SEQ ID NO: 184881 - DNA, 25 bp, E. coli
acaccaccagcgtcgatactaatca

SEQ ID NO: 184882 - DNA, 25 bp, E. coli
acaccaccagcgacgatactaatca

SEQ ID NO: 184883 - DNA, 25 bp, E. coli
tatttcagtggaaggcgtacagcag

SEQ ID NO: 184884 - DNA, 25 bp, E. coli
tatttcagtggatggcgtacagcag

SEQ ID NO: 184885 - DNA, 25 bp, E. coli
ttctctgccggttcagcggttgccg

SEQ ID NO: 184886 - DNA, 25 bp, E. coli
ttctctgccggtacagcggttgccg

SEQ ID NO: 184887 - DNA, 25 bp, E. coli
tgaatgtgacaaataacaccaccag

SEQ ID NO: 184888 - DNA, 25 bp, E. coli
tgaatgtgacaattaacaccaccag

SEQ ID NO: 184889 - DNA, 25 bp, E. coli
ctccaccagcgtcaagaaagacggt

SEQ ID NO: 184890 - DNA, 25 bp, E. coli
ctccaccagcgtgaagaaagacggt

SEQ ID NO: 184891 - DNA, 25 bp, E. coli
gatattaccggcgatctgacgctga

SEQ ID NO: 184892 - DNA, 25 bp, E. coli
gatattaccggccatctgacgctga

SEQ ID NO: 184893 - DNA, 25 bp, E. coli
ggttgccgccgattacaaaattgac

SEQ ID NO: 184894 - DNA, 25 bp, E. coli
ggttgccgccgaatacaaaattgac

SEQ ID NO: 184895 - DNA, 25 bp, E. coli
tcaataccgcaaaatatccacaggc

SEQ ID NO: 184896 - DNA, 25 bp, E. coli
tcaataccgcaatatatccacaggc

SEQ ID NO: 184897 - DNA, 25 bp, E. coli
gaggccgaaggcaaaattaagctca

SEQ ID NO: 184898 - DNA, 25 bp, E. coli
gaggccgaaggctaaattaagctca

SEQ ID NO: 184899 - DNA, 25 bp, E. coli
taacgacgggcgttatctggatcga

SEQ ID NO: 184900 - DNA, 25 bp, E. coli
tattgcgaatggttgccggactgga

SEQ ID NO: 184901 - DNA, 25 bp, E. coli
tattacgctgccactaaacggtggc

SEQ ID NO: 184902 - DNA, 25 bp, E. coli
tattgcgaatggatgccggactgga

SEQ ID NO: 184903 - DNA, 25 bp, E. coli
tatctggatcgaccgcaagcgtgtc

SEQ ID NO: 184904 - DNA, 25 bp, E. coli
tattacgctgcctctaaacggtggc

SEQ ID NO: 184905 - DNA, 25 bp, E. coli
tatctggatcgagcgcaagcgtgtc

SEQ ID NO: 184906 - DNA, 25 bp, E. coli
tgcgggaaatcgacgttattgcgaa

SEQ ID NO: 184907 - DNA, 25 bp, E. coli
tgcgggaaatcgtcgttattgcgaa

SEQ ID NO: 184908 - DNA, 25 bp, E. coli
gcccgcgtgagcaatctggcggtca

SEQ ID NO: 184909 - DNA, 25 bp, E. coli
gcccgcgtgagctatctggcggtca

SEQ ID NO: 184910 - DNA, 25 bp, E. coli
gaacctactggcaggccgcgtgaat

SEQ ID NO: 184911 - DNA, 25 bp, E. coli
gaacctactggctggccgcgtgaat

SEQ ID NO: 184912 - DNA, 25 bp, E. coli
gcaagcaacaaattgccgaacgtgt

SEQ ID NO: 184913 - DNA, 25 bp, E. coli
gcaagcaacaaaatgccgaacgtgt

SEQ ID NO: 184914 - DNA, 25 bp, E. coli
gcaagcgtgtcagcgaaatggagcc

SEQ ID NO: 184915 - DNA, 25 bp, E. coli
gcaagcgtgtcaccgaaatggagcc

SEQ ID NO: 184916 - DNA, 25 bp, E. coli
cgcatatgagcgtagaggagaacat

SEQ ID NO: 184917 - DNA, 25 bp, E. coli
cgcatatgagcgaagaggagaacat

SEQ ID NO: 184918 - DNA, 25 bp, E. coli
cgtgagccggcagtgttcctgtttg

SEQ ID NO: 184919 - DNA, 25 bp, E. coli
cgtgagccggcactgttcctgtttg

SEQ ID NO: 184920 - DNA, 25 bp, E. coli
taacgacgggcgatatctggatcga

SEQ ID NO: 184921 - DNA, 25 bp, E. coli
taccgatgtagtggaaaatcaaccc

SEQ ID NO: 184922 - DNA, 25 bp, E. coli
taccgatgtagtcgaaaatcaaccc

SEQ ID NO: 184923 - DNA, 25 bp, E. coli
ttgaggcgcggaatattaaacggac

SEQ ID NO: 184924 - DNA, 25 bp, E. coli
ttgaggcgcggattattaaacggac

SEQ ID NO: 184925 - DNA, 25 bp, E. coli
tccgggttgtagtcgccagcatgtt

SEQ ID NO: 184926 - DNA, 25 bp, E. coli
tccgggttgtagacgccagcatgtt

SEQ ID NO: 184927 - DNA, 25 bp, E. coli
tcttggtgccgatgtggatagcccc

SEQ ID NO: 184928 - DNA, 25 bp, E. coli
tcttggtgccgaagtggatagcccc

SEQ ID NO: 184929 - DNA, 25 bp, E. coli
gcatgttcgtaagcacgcgctttca

SEQ ID NO: 184930 - DNA, 25 bp, E. coli
gcatgttcgtaaccacgcgctttca

SEQ ID NO: 184931 - DNA, 25 bp, E. coli
gactggaaatcgacaatcccgttag

SEQ ID NO: 184932 - DNA, 25 bp, E. coli
cccgttagcgtactgaatgattgca

SEQ ID NO: 184933 - DNA, 25 bp, E. coli
cccgttagcgtagtgaatgattgca

SEQ ID NO: 184934 - DNA, 25 bp, E. coli
ggttttcacacaagccggttcctgg

SEQ ID NO: 184935 - DNA, 25 bp, E. coli
ggttatcgtaaaccccgacgcagtg

SEQ ID NO: 184936 - DNA, 25 bp, E. coli
ggttttcacacatgccggttcctgg

SEQ ID NO: 184937 - DNA, 25 bp, E. coli
ggttatcgtaaagcccgacgcagtg

SEQ ID NO: 184938 - DNA, 25 bp, E. coli
ggcaatgcagtatccacagccgatg

SEQ ID NO: 184939 - DNA, 25 bp, E. coli
ggcaatgcagtaaccacagccgatg

SEQ ID NO: 184940 - DNA, 25 bp, E. coli
taatcacgcacctgagaaggcggcg

SEQ ID NO: 184941 - DNA, 25 bp, E. coli
taatcacgcaccagagaaggcggcg

SEQ ID NO: 184942 - DNA, 25 bp, E. coli
gactggaaatcgtcaatcccgttag

SEQ ID NO: 184943 - DNA, 25 bp, E. coli
catggcaaactgcaagaagatactc

SEQ ID NO: 184944 - DNA, 25 bp, E. coli
catggcaaactggaagaagatactc

SEQ ID NO: 184945 - DNA, 25 bp, E. coli
taacagggaatgtacgcgaagccgc

SEQ ID NO: 184946 - DNA, 25 bp, E. coli
taacagggaatgaacgcgaagccgc

SEQ ID NO: 184947 - DNA, 25 bp, E. coli
taaaacgcacctccatactctgtcg

SEQ ID NO: 184948 - DNA, 25 bp, E. coli
acgtctggcggacaaaaccatctgc

SEQ ID NO: 184949 - DNA, 25 bp, E. coli
aaaaacgcgcccaggaaatcatcag

SEQ ID NO: 184950 - DNA, 25 bp, E. coli
aaaaacgcgccctggaaatcatcag

SEQ ID NO: 184951 - DNA, 25 bp, E. coli
aaaatgggcagtaccggtatcggca

SEQ ID NO: 184952 - DNA, 25 bp, E. coli
acgtctggcggagaaaaccatctgc

SEQ ID NO: 184953 - DNA, 25 bp, E. coli
aaaatgggcagttccggtatcggca

SEQ ID NO: 184954 - DNA, 25 bp, E. coli
ttacgcgcagcccagagcgatgaag

SEQ ID NO: 184955 - DNA, 25 bp, E. coli
tttttgaagctatcctgacgcggga

SEQ ID NO: 184956 - DNA, 25 bp, E. coli
tttttgaagctaacctgacgcggga

SEQ ID NO: 184957 - DNA, 25 bp, E. coli
ttacgcgcagccgagagcgatgaag

SEQ ID NO: 184958 - DNA, 25 bp, E. coli
tccactgtcagaccaaaaaacgcgc

SEQ ID NO: 184959 - DNA, 25 bp, E. coli
tccactgtcagagcaaaaaacgcgc

SEQ ID NO: 184960 - DNA, 25 bp, E. coli
gaaacgcctatagctttcgatgcca

SEQ ID NO: 184961 - DNA, 25 bp, E. coli
gaaacgcctatacctttcgatgcca

SEQ ID NO: 184962 - DNA, 25 bp, E. coli
gtgccggcagaccaaactaaaacgc

SEQ ID NO: 184963 - DNA, 25 bp, E. coli
gtgccggcagacgaaactaaaacgc

SEQ ID NO: 184964 - DNA, 25 bp, E. coli
taaaacgcacctgcatactctgtcg

SEQ ID NO: 184965 - DNA, 25 bp, E. coli
aattggcgggcaaccgtcgttgttg

SEQ ID NO: 184966 - DNA, 25 bp, E. coli
aattggcgggcatccgtcgttgttg

SEQ ID NO: 184967 - DNA, 25 bp, E. coli
catccgtcgttgttgttgccacatg

SEQ ID NO: 184968 - DNA, 25 bp, E. coli
catccgtcgttgatgttgccacatg

SEQ ID NO: 184969 - DNA, 25 bp, E. coli
actgtggcacttcaaattggcgggc

SEQ ID NO: 184970 - DNA, 25 bp, E. coli
actgtggcacttgaaattggcgggc

SEQ ID NO: 184971 - DNA, 25 bp, E. coli
aaattggcgggcttccgtcgttgtt

SEQ ID NO: 184972 - DNA, 25 bp, E. coli
aaattggcgggcatccgtcgttgtt

SEQ ID NO: 184973 - DNA, 25 bp, E. coli
tgtggcacttgaaattggcgggcat

SEQ ID NO: 184974 - DNA, 25 bp, E. coli
tgtggcacttgatattggcgggcat

SEQ ID NO: 184975 - DNA, 25 bp, E. coli
gcacttgaaattcgcgggcatccgt

SEQ ID NO: 184976 - DNA, 25 bp, E. coli
gcacttgaaattggcgggcatccgt

SEQ ID NO: 184977 - DNA, 25 bp, E. coli
cgttgttgttgccacatgtggcgat

SEQ ID NO: 184978 - DNA, 25 bp, E. coli
cgttgttgttgcgacatgtggcgat

SEQ ID NO: 184979 - DNA, 25 bp, E. coli
cgggcatccgtcgttgttgttgcca

SEQ ID NO: 184980 - DNA, 25 bp, E. coli
cgtcgttgttgtagccacatgtggc

SEQ ID NO: 184981 - DNA, 25 bp, E. coli
cgtcgttgttgttgccacatgtggc

SEQ ID NO: 184982 - DNA, 25 bp, E. coli
cgggcatccgtccttgttgttgcca

SEQ ID NO: 184983 - DNA, 25 bp, E. coli
ggcatccgtcgtagttgttgccaca

SEQ ID NO: 184984 - DNA, 25 bp, E. coli
tggcacttgaaaatggcgggcatcc

SEQ ID NO: 184985 - DNA, 25 bp, E. coli
tggcacttgaaattggcgggcatcc

SEQ ID NO: 184986 - DNA, 25 bp, E. coli
ggcatccgtcgttgttgttgccaca

SEQ ID NO: 184987 - DNA, 25 bp, E. coli
catcttaattactccctgacggacg

SEQ ID NO: 184988 - DNA, 25 bp, E. coli
catcttaattacaccctgacggacg

SEQ ID NO: 184989 - DNA, 25 bp, E. coli
aaatttcgcaaaatcagttcactcg

SEQ ID NO: 184990 - DNA, 25 bp, E. coli
aaatttcgcaaattcagttcactcg

SEQ ID NO: 184991 - DNA, 25 bp, E. coli
tgatcaatatgtatcgtgctgccga

SEQ ID NO: 184992 - DNA, 25 bp, E. coli
tgatcaatatgtttcgtgctgccga

SEQ ID NO: 184993 - DNA, 25 bp, E. coli
tcgaaagtctggaaaaactctacga

SEQ ID NO: 184994 - DNA, 25 bp, E. coli
tcgaaagtctggtaaaactctacga

SEQ ID NO: 184995 - DNA, 25 bp, E. coli
tcaccgtcgcgcagagctggtttct

SEQ ID NO: 184996 - DNA, 25 bp, E. coli
tcagttcactcgtaagtctggaaaa

SEQ ID NO: 184997 - DNA, 25 bp, E. coli
tcagttcactcgaaagtctggaaaa

SEQ ID NO: 184998 - DNA, 25 bp, E. coli
tctggcgggcgtatgtttgacctcg

SEQ ID NO: 184999 - DNA, 25 bp, E. coli
tctggcgggcgtttgtttgacctcg

SEQ ID NO: 185000 - DNA, 25 bp, E. coli
cctgacggacgatcaggaactgatc

SEQ ID NO: 185001 - DNA, 25 bp, E. coli
cctgacggacgaacaggaactgatc

SEQ ID NO: 185002 - DNA, 25 bp, E. coli
gactgttcaggagtacttattaaaa

SEQ ID NO: 185003 - DNA, 25 bp, E. coli
gactgttcaggactacttattaaaa

SEQ ID NO: 185004 - DNA, 25 bp, E. coli
gtaccgaagtccgtctggcactatg

SEQ ID NO: 185005 - DNA, 25 bp, E. coli
gtaccgaagtccctctggcactatg

SEQ ID NO: 185006 - DNA, 25 bp, E. coli
tttgacctcggcgaggtaccgaagt

SEQ ID NO: 185007 - DNA, 25 bp, E. coli
tttgacctcggccaggtaccgaagt

SEQ ID NO: 185008 - DNA, 25 bp, E. coli
tcaccgtcgcgctgagctggtttct

SEQ ID NO: 185009 - DNA, 25 bp, E. coli
tatgagccgggatgtaaaaaatcgt

SEQ ID NO: 185010 - DNA, 25 bp, E. coli
tagcggcaatatactggaaacggtg

SEQ ID NO: 185011 - DNA, 25 bp, E. coli
tatccctcaagggtgatcaaccagg

SEQ ID NO: 185012 - DNA, 25 bp, E. coli
tatgagccgggaagtaaaaaatcgt

SEQ ID NO: 185013 - DNA, 25 bp, E. coli
tagcggcaatattctggaaacggtg

SEQ ID NO: 185014 - DNA, 25 bp, E. coli
tataagttgccatagagagaactcc

SEQ ID NO: 185015 - DNA, 25 bp, E. coli
tataagttgccaaagagagaactcc

SEQ ID NO: 185016 - DNA, 25 bp, E. coli
tatccctcaaggctgatcaaccagg

SEQ ID NO: 185017 - DNA, 25 bp, E. coli
tgagccaggagaatcaactaaccct

SEQ ID NO: 185018 - DNA, 25 bp, E. coli
tgagccaggagattcaactaaccct

SEQ ID NO: 185019 - DNA, 25 bp, E. coli
tccactgaagagtggcaaagagtct

SEQ ID NO: 185020 - DNA, 25 bp, E. coli
tccactgaagagaggcaaagagtct

SEQ ID NO: 185021 - DNA, 25 bp, E. coli
tcaggaactctttccgagggaagaa

SEQ ID NO: 185022 - DNA, 25 bp, E. coli
tcaggaactcttaccgagggaagaa

SEQ ID NO: 185023 - DNA, 25 bp, E. coli
gaaacggtgagaaggcagagtacta

SEQ ID NO: 185024 - DNA, 25 bp, E. coli
gaaacggtgagatggcagagtacta

SEQ ID NO: 185025 - DNA, 25 bp, E. coli
taacccttgatgataaggcagcaca

SEQ ID NO: 185026 - DNA, 25 bp, E. coli
tcaattggagaagggactattagct

SEQ ID NO: 185027 - DNA, 25 bp, E. coli
tcaattggagaacggactattagct

SEQ ID NO: 185028 - DNA, 25 bp, E. coli
taacccttgatgttaaggcagcaca

SEQ ID NO: 185029 - DNA, 25 bp, E. coli
gagtcttttttcttgtgagccagga

SEQ ID NO: 185030 - DNA, 25 bp, E. coli
gagtcttttttcatgtgagccagga

SEQ ID NO: 185031 - DNA, 25 bp, E. coli
atgttgtggtcatcaaaacgccggg

SEQ ID NO: 185032 - DNA, 25 bp, E. coli
atgttgtggtcaacaaaacgccggg

SEQ ID NO: 185033 - DNA, 25 bp, E. coli
taccacgcagctggtgaacagcagg

SEQ ID NO: 185034 - DNA, 25 bp, E. coli
taccacgcagctcgtgaacagcagg

SEQ ID NO: 185035 - DNA, 25 bp, E. coli
tgtcaccaaaatgcccaacaatggg

SEQ ID NO: 185036 - DNA, 25 bp, E. coli
tgtcaccaaaatccccaacaatggg

SEQ ID NO: 185037 - DNA, 25 bp, E. coli
tgagcatggcgacctgaaagaaaac

SEQ ID NO: 185038 - DNA, 25 bp, E. coli
tgagcatggcgagctgaaagaaaac

SEQ ID NO: 185039 - DNA, 25 bp, E. coli
tcgaacgcgcaggtgattgatgtca

SEQ ID NO: 185040 - DNA, 25 bp, E. coli
tcgaagccaagctgtcgaacgcgca

SEQ ID NO: 185041 - DNA, 25 bp, E. coli
tcgaagccaagcagtcgaacgcgca

SEQ ID NO: 185042 - DNA, 25 bp, E. coli
tctgaaatctgtgcgccgtcctgaa

SEQ ID NO: 185043 - DNA, 25 bp, E. coli
tcgaacgcgcagctgattgatgtca

SEQ ID NO: 185044 - DNA, 25 bp, E. coli
tctgaaatctgtccgccgtcctgaa

SEQ ID NO: 185045 - DNA, 25 bp, E. coli
cctattgctcgtggcctgatcggca

SEQ ID NO: 185046 - DNA, 25 bp, E. coli
cctattgctcgtcgcctgatcggca

SEQ ID NO: 185047 - DNA, 25 bp, E. coli
gaaatcattgctgctatcgcggaag

SEQ ID NO: 185048 - DNA, 25 bp, E. coli
gaaatcattgctcctatcgcggaag

SEQ ID NO: 185049 - DNA, 25 bp, E. coli
gaacagacttatggcatcgttggcg

SEQ ID NO: 185050 - DNA, 25 bp, E. coli
gaacagacttatcgcatcgttggcg

SEQ ID NO: 185051 - DNA, 25 bp, E. coli
cttacgcggcgctgaaaaattacgc

SEQ ID NO: 185052 - DNA, 25 bp, E. coli
cttacgcggcgcagaaaaattacgc

SEQ ID NO: 185053 - DNA, 25 bp, E. coli
cacgtcggcatctagctttactggc

SEQ ID NO: 185054 - DNA, 25 bp, E. coli
cacgtcggcatcaagctttactggc

SEQ ID NO: 185055 - DNA, 25 bp, E. coli
taaagccgcaggtggaacactcgat

SEQ ID NO: 185056 - DNA, 25 bp, E. coli
taaaggtaatgtcacgctggctgct

SEQ ID NO: 185057 - DNA, 25 bp, E. coli
taaaggtaatgtgacgctggctgct

SEQ ID NO: 185058 - DNA, 25 bp, E. coli
taaagccgcaggaggaacactcgat

SEQ ID NO: 185059 - DNA, 25 bp, E. coli
aacactcgatgtggcagctacggca

SEQ ID NO: 185060 - DNA, 25 bp, E. coli
aacactcgatgtcgcagctacggca

SEQ ID NO: 185061 - DNA, 25 bp, E. coli
tatcgtttatcccaaggttcaggct

SEQ ID NO: 185062 - DNA, 25 bp, E. coli
tatgttaagtggctcaggaacggct

SEQ ID NO: 185063 - DNA, 25 bp, E. coli
tatgttaagtgggtcaggaacggct

SEQ ID NO: 185064 - DNA, 25 bp, E. coli
tatcgtttatccgaaggttcaggct

SEQ ID NO: 185065 - DNA, 25 bp, E. coli
tttactggcctgtcaaatactgtgg

SEQ ID NO: 185066 - DNA, 25 bp, E. coli
tttactggcctgacaaatactgtgg

SEQ ID NO: 185067 - DNA, 25 bp, E. coli
tgttaaagcgttttacacgtcggca

SEQ ID NO: 185068 - DNA, 25 bp, E. coli
tgttaaagcgttatacacgtcggca

SEQ ID NO: 185069 - DNA, 25 bp, E. coli
ggttcaggcttctcaaagagcgcag

SEQ ID NO: 185070 - DNA, 25 bp, E. coli
ggttcaggcttcacaaagagcgcag

SEQ ID NO: 185071 - DNA, 25 bp, E. coli
ggaacggctgctaaacccatcaatg

SEQ ID NO: 185072 - DNA, 25 bp, E. coli
tggctgttcaggcaaaaatcttccc

SEQ ID NO: 185073 - DNA, 25 bp, E. coli
tggctgttcagggaaaaatcttccc

SEQ ID NO: 185074 - DNA, 25 bp, E. coli
ggaacggctgcttaacccatcaatg

SEQ ID NO: 185075 - DNA, 25 bp, E. coli
aatacattgctatgttattcgcgcc

SEQ ID NO: 185076 - DNA, 25 bp, E. coli
aatacattgctaagttattcgcgcc

SEQ ID NO: 185077 - DNA, 25 bp, E. coli
cagcggaaagtgaagaaattaacaa

SEQ ID NO: 185078 - DNA, 25 bp, E. coli
cagcggaaagtgtagaaattaacaa

SEQ ID NO: 185079 - DNA, 25 bp, E. coli
catttcctcctaaaggctgatttca

SEQ ID NO: 185080 - DNA, 25 bp, E. coli
catttcctcctataggctgatttca

SEQ ID NO: 185081 - DNA, 25 bp, E. coli
taaaaatctgttttcgccacatgct

SEQ ID NO: 185082 - DNA, 25 bp, E. coli
taaaaatctgttatcgccacatgct

SEQ ID NO: 185083 - DNA, 25 bp, E. coli
ttccagggacgctaatctttgatcc

SEQ ID NO: 185084 - DNA, 25 bp, E. coli
ttccagggacgcaaatctttgatcc

SEQ ID NO: 185085 - DNA, 25 bp, E. coli
tcgttacctttcgagggacgctaat

SEQ ID NO: 185086 - DNA, 25 bp, E. coli
tcgttacctttccagggacgctaat

SEQ ID NO: 185087 - DNA, 25 bp, E. coli
tcgccacatgctaattcaaaaaatg

SEQ ID NO: 185088 - DNA, 25 bp, E. coli
tccgggaccgcgatggtctcttttt

SEQ ID NO: 185089 - DNA, 25 bp, E. coli
tccgggaccgcgttggtctcttttt

SEQ ID NO: 185090 - DNA, 25 bp, E. coli
tcgccacatgcttattcaaaaaatg

SEQ ID NO: 185091 - DNA, 25 bp, E. coli
tctggcaccgaatcagcggaaagtg

SEQ ID NO: 185092 - DNA, 25 bp, E. coli
tctttgatccttaagaaagtttccg

SEQ ID NO: 185093 - DNA, 25 bp, E. coli
tctggcaccgaaacagcggaaagtg

SEQ ID NO: 185094 - DNA, 25 bp, E. coli
tctttgatcctttagaaagtttccg

SEQ ID NO: 185095 - DNA, 25 bp, E. coli
ggctgatttcagactggcaccgaat

SEQ ID NO: 185096 - DNA, 25 bp, E. coli
ggctgatttcagtctggcaccgaat

SEQ ID NO: 185097 - DNA, 25 bp, E. coli
aatgcggttattccaccggccagaa

SEQ ID NO: 185098 - DNA, 25 bp, E. coli
caagggatcgctttaactcatcagg

SEQ ID NO: 185099 - DNA, 25 bp, E. coli
caagggatcgctataactcatcagg

SEQ ID NO: 185100 - DNA, 25 bp, E. coli
aatgcggttattgcaccggccagaa

SEQ ID NO: 185101 - DNA, 25 bp, E. coli
aggccaacacccacgatcaacagat

SEQ ID NO: 185102 - DNA, 25 bp, E. coli
aggccaacaccctcgatcaacagat

SEQ ID NO: 185103 - DNA, 25 bp, E. coli
tagcgttcatgatatgcagcggaat

SEQ ID NO: 185104 - DNA, 25 bp, E. coli
tagcgttcatgaaatgcagcggaat

SEQ ID NO: 185105 - DNA, 25 bp, E. coli
tcgctataactcttcaggccaacac

SEQ ID NO: 185106 - DNA, 25 bp, E. coli
tcgctataactcatcaggccaacac

SEQ ID NO: 185107 - DNA, 25 bp, E. coli
ccgtgggatgtgatccgcaaagaca

SEQ ID NO: 185108 - DNA, 25 bp, E. coli
cgcgttgaaaaaagcgaagccaacg

SEQ ID NO: 185109 - DNA, 25 bp, E. coli
ccgtgggatgtgttccgcaaagaca

SEQ ID NO: 185110 - DNA, 25 bp, E. coli
cgcgttgaaaaatgcgaagccaacg

SEQ ID NO: 185111 - DNA, 25 bp, E. coli
cattactcggagcatgctccagcgt

SEQ ID NO: 185112 - DNA, 25 bp, E. coli
cattactcggaggatgctccagcgt

SEQ ID NO: 185113 - DNA, 25 bp, E. coli
ggatgctccagcgtgatgtcccata

SEQ ID NO: 185114 - DNA, 25 bp, E. coli
ggatgctccagcctgatgtcccata

SEQ ID NO: 185115 - DNA, 25 bp, E. coli
taagaaatgtgttgttagcgttcat

SEQ ID NO: 185116 - DNA, 25 bp, E. coli
taagaaatgtgtagttagcgttcat

SEQ ID NO: 185117 - DNA, 25 bp, E. coli
gatgttattttctgcaagggatcgc

SEQ ID NO: 185118 - DNA, 25 bp, E. coli
gatgttattttcagcaagggatcgc

SEQ ID NO: 185119 - DNA, 25 bp, E. coli
caacggttcggcagtgagcgataac

SEQ ID NO: 185120 - DNA, 25 bp, E. coli
caacggttcggctgtgagcgataac

SEQ ID NO: 185121 - DNA, 25 bp, E. coli
cagtaaaggtgtggcgttcgcagaa

SEQ ID NO: 185122 - DNA, 25 bp, E. coli
cagtaaaggtgtcgcgttcgcagaa

SEQ ID NO: 185123 - DNA, 25 bp, E. coli
catggcttcgctggtacttacggac

SEQ ID NO: 185124 - DNA, 25 bp, E. coli
catggcttcgctcgtacttacggac

SEQ ID NO: 185125 - DNA, 25 bp, E. coli
taaagggcagatcggctataccgca

SEQ ID NO: 185126 - DNA, 25 bp, E. coli
taaagggcagatgggctataccgca

SEQ ID NO: 185127 - DNA, 25 bp, E. coli
taacgtgcacaacgtcatgcaggcc

SEQ ID NO: 185128 - DNA, 25 bp, E. coli
tatcgacgggctggattacaaatct

SEQ ID NO: 185129 - DNA, 25 bp, E. coli
tatctgaccggttttgggccgcgta

SEQ ID NO: 185130 - DNA, 25 bp, E. coli
tatcgacgggctcgattacaaatct

SEQ ID NO: 185131 - DNA, 25 bp, E. coli
tatctgaccggtattgggccgcgta

SEQ ID NO: 185132 - DNA, 25 bp, E. coli
tgctggataagctttgcctggccgg

SEQ ID NO: 185133 - DNA, 25 bp, E. coli
tgctggataagcattgcctggccgg

SEQ ID NO: 185134 - DNA, 25 bp, E. coli
cgcagaaggttttagcgcgctccta

SEQ ID NO: 185135 - DNA, 25 bp, E. coli
cgcagaaggtttaagcgcgctccta

SEQ ID NO: 185136 - DNA, 25 bp, E. coli
tggttcctggaaacgcaatcgatgc

SEQ ID NO: 185137 - DNA, 25 bp, E. coli
tggacagcgaactagtgcagccgtt

SEQ ID NO: 185138 - DNA, 25 bp, E. coli
tggacagcgaacaagtgcagccgtt

SEQ ID NO: 185139 - DNA, 25 bp, E. coli
tggttcctggaatcgcaatcgatgc

SEQ ID NO: 185140 - DNA, 25 bp, E. coli
taacgtgcacaaggtcatgcaggcc

SEQ ID NO: 185141 - DNA, 25 bp, E. coli
aacgcgttctgcttgaagtgtgccc

SEQ ID NO: 185142 - DNA, 25 bp, E. coli
tacaggatcgctcctacggcatgtt

SEQ ID NO: 185143 - DNA, 25 bp, E. coli
tacaggatcgctgctacggcatgtt

SEQ ID NO: 185144 - DNA, 25 bp, E. coli
aacgcgttctgcatgaagtgtgccc

SEQ ID NO: 185145 - DNA, 25 bp, E. coli
tttaccgatgagcaaaaaggtctgc

SEQ ID NO: 185146 - DNA, 25 bp, E. coli
tttaccgatgaggaaaaaggtctgc

SEQ ID NO: 185147 - DNA, 25 bp, E. coli
tgatctggcagaacgtcccggtgct

SEQ ID NO: 185148 - DNA, 25 bp, E. coli
tgatctggcagatcgtcccggtgct

SEQ ID NO: 185149 - DNA, 25 bp, E. coli
tgctggcgaccgcaatcattaaagc

SEQ ID NO: 185150 - DNA, 25 bp, E. coli
tgctggcgaccggaatcattaaagc

SEQ ID NO: 185151 - DNA, 25 bp, E. coli
gccgcgccgatcatcccggaatata

SEQ ID NO: 185152 - DNA, 25 bp, E. coli
gccgcgccgatcttcccggaatata

SEQ ID NO: 185153 - DNA, 25 bp, E. coli
gctcagcgaccgcattaaagcgcac

SEQ ID NO: 185154 - DNA, 25 bp, E. coli
gctcagcgaccggattaaagcgcac

SEQ ID NO: 185155 - DNA, 25 bp, E. coli
gcaatatgacctccggcgatgcgca

SEQ ID NO: 185156 - DNA, 25 bp, E. coli
gcaatatgacctgcggcgatgcgca

SEQ ID NO: 185157 - DNA, 25 bp, E. coli
gcaaccaggcaagcgaagttcgcgc

SEQ ID NO: 185158 - DNA, 25 bp, E. coli
gcaaccaggcaaccgaagttcgcgc

SEQ ID NO: 185159 - DNA, 25 bp, E. coli
cgctggtgcataatgtgaaaccgcc

SEQ ID NO: 185160 - DNA, 25 bp, E. coli
cgctggtgcatattgtgaaaccgcc

SEQ ID NO: 185161 - DNA, 25 bp, E. coli
ggtgagcgaagacaacaaacgcgtt

SEQ ID NO: 185162 - DNA, 25 bp, E. coli
ggtgagcgaagagaacaaacgcgtt

SEQ ID NO: 185163 - DNA, 25 bp, E. coli
caaaggtctgacattgccgctgatc

SEQ ID NO: 185164 - DNA, 25 bp, E. coli
caaaggtctgactttgccgctgatc

SEQ ID NO: 185165 - DNA, 25 bp, E. coli
tacagtgccacgttgctgctcggat

SEQ ID NO: 185166 - DNA, 25 bp, E. coli
tacagtgccacgatgctgctcggat

SEQ ID NO: 185167 - DNA, 25 bp, E. coli
aaactggagtatgtgccggaagcgc

SEQ ID NO: 185168 - DNA, 25 bp, E. coli
aaactggagtatctgccggaagcgc

SEQ ID NO: 185169 - DNA, 25 bp, E. coli
taccgcattctggaacccgtgggaa

SEQ ID NO: 185170 - DNA, 25 bp, E. coli
tacgctgcgtctcccgatggagttc

SEQ ID NO: 185171 - DNA, 25 bp, E. coli
tacgctgcgtctgccgatggagttc

SEQ ID NO: 185172 - DNA, 25 bp, E. coli
taccgcattctgcaacccgtgggaa

SEQ ID NO: 185173 - DNA, 25 bp, E. coli
tgggaagatcccattggcagcggct

SEQ ID NO: 185174 - DNA, 25 bp, E. coli
tgggaagatccctttggcagcggct

SEQ ID NO: 185175 - DNA, 25 bp, E. coli
tctccacggcgctaaagggctgggt

SEQ ID NO: 185176 - DNA, 25 bp, E. coli
tctccacggcgcaaaagggctgggt

SEQ ID NO: 185177 - DNA, 25 bp, E. coli
gaagtacgtaattacctgcgcggct

SEQ ID NO: 185178 - DNA, 25 bp, E. coli
gaagtacgtaataacctgcgcggct

SEQ ID NO: 185179 - DNA, 25 bp, E. coli
cattatcggtatgggcatttcagcg

SEQ ID NO: 185180 - DNA, 25 bp, E. coli
cattatcggtatcggcatttcagcg

SEQ ID NO: 185181 - DNA, 25 bp, E. coli
gggaaaaagataccgacagcctgat

SEQ ID NO: 185182 - DNA, 25 bp, E. coli
gggaaaaagatagcgacagcctgat

SEQ ID NO: 185183 - DNA, 25 bp, E. coli
tggagttctggcaacgctacagtgc

SEQ ID NO: 185184 - DNA, 25 bp, E. coli
tggagttctggctacgctacagtgc

SEQ ID NO: 185185 - DNA, 25 bp, E. coli
cactggatccagcaagggttaagcg

SEQ ID NO: 185186 - DNA, 25 bp, E. coli
cactggatccaggaagggttaagcg

SEQ ID NO: 185187 - DNA, 25 bp, E. coli
aaacgttggtatccgcactggatcc

SEQ ID NO: 185188 - DNA, 25 bp, E. coli
aaacgttggtatgcgcactggatcc

SEQ ID NO: 185189 - DNA, 25 bp, E. coli
tattgactggctcgagaggcactac

SEQ ID NO: 185190 - DNA, 25 bp, E. coli
tttaatagttcagcgtcgtaccggg

SEQ ID NO: 185191 - DNA, 25 bp, E. coli
tattgactggctggagaggcactac

SEQ ID NO: 185192 - DNA, 25 bp, E. coli
tttaatagttcaccgtcgtaccggg

SEQ ID NO: 185193 - DNA, 25 bp, E. coli
ttaagcgcggtgcaacaactgttgc

SEQ ID NO: 185194 - DNA, 25 bp, E. coli
ttaagcgcggtggaacaactgttgc

SEQ ID NO: 185195 - DNA, 25 bp, E. coli
tgctgactgacgagggcgaatcact

SEQ ID NO: 185196 - DNA, 25 bp, E. coli
tgctgactgacgtgggcgaatcact

SEQ ID NO: 185197 - DNA, 25 bp, E. coli
tgcgctacctgagcgaagaactgaa

SEQ ID NO: 185198 - DNA, 25 bp, E. coli
tgcgctacctgaccgaagaactgaa

SEQ ID NO: 185199 - DNA, 25 bp, E. coli
gcaaaatgaactggcctatcggcgg

SEQ ID NO: 185200 - DNA, 25 bp, E. coli
gcaaaatgaactcgcctatcggcgg

SEQ ID NO: 185201 - DNA, 25 bp, E. coli
gaatcactcggacaatcgctggcga

SEQ ID NO: 185202 - DNA, 25 bp, E. coli
gaatcactcggagaatcgctggcga

SEQ ID NO: 185203 - DNA, 25 bp, E. coli
gaactgcgatttcagcgggtatcca

SEQ ID NO: 185204 - DNA, 25 bp, E. coli
gaactgcgatttgagcgggtatcca

SEQ ID NO: 185205 - DNA, 25 bp, E. coli
cattgaataacttgcgcgtgctgcg

SEQ ID NO: 185206 - DNA, 25 bp, E. coli
cattgaataactagcgcgtgctgcg

SEQ ID NO: 185207 - DNA, 25 bp, E. coli
catttctttgctattctctgttgag

SEQ ID NO: 185208 - DNA, 25 bp, E. coli
cataatacgcctaccgctacagagt

SEQ ID NO: 185209 - DNA, 25 bp, E. coli
catttctttgcttttctctgttgag

SEQ ID NO: 185210 - DNA, 25 bp, E. coli
cataatacgccttccgctacagagt

SEQ ID NO: 185211 - DNA, 25 bp, E. coli
tatagacaaaaaggagccccgaagg

SEQ ID NO: 185212 - DNA, 25 bp, E. coli
tatagacaaaaacgagccccgaagg

SEQ ID NO: 185213 - DNA, 25 bp, E. coli
tgttaaagagcactgccgcttcgct

SEQ ID NO: 185214 - DNA, 25 bp, E. coli
tgttaaagagcagtgccgcttcgct

SEQ ID NO: 185215 - DNA, 25 bp, E. coli
tgagattctcagcagaaccccgccg

SEQ ID NO: 185216 - DNA, 25 bp, E. coli
tgagattctcaggagaaccccgccg

SEQ ID NO: 185217 - DNA, 25 bp, E. coli
gctacagagtcaagcatttctttgc

SEQ ID NO: 185218 - DNA, 25 bp, E. coli
gcttttctctgttgagattctcagg

SEQ ID NO: 185219 - DNA, 25 bp, E. coli
gctacagagtcatgcatttctttgc

SEQ ID NO: 185220 - DNA, 25 bp, E. coli
gcttttctctgtagagattctcagg

SEQ ID NO: 185221 - DNA, 25 bp, E. coli
gcagtgccgcttcgctttttctcag

SEQ ID NO: 185222 - DNA, 25 bp, E. coli
gcagtgccgcttggctttttctcag

SEQ ID NO: 185223 - DNA, 25 bp, E. coli
cttcgctttttctcagcggcgcggg

SEQ ID NO: 185224 - DNA, 25 bp, E. coli
cttcgctttttcacagcggcgcggg

SEQ ID NO: 185225 - DNA, 25 bp, E. coli
gtcttttccgtcaaacttatagaca

SEQ ID NO: 185226 - DNA, 25 bp, E. coli
gtcttttccgtctaacttatagaca

SEQ ID NO: 185227 - DNA, 25 bp, E. coli
gggtgtgcataaaacgccttccgct

SEQ ID NO: 185228 - DNA, 25 bp, E. coli
gggtgtgcataatacgccttccgct

SEQ ID NO: 185229 - DNA, 25 bp, E. coli
aagactggaccggttgcctttggcc

SEQ ID NO: 185230 - DNA, 25 bp, E. coli
aattggcgcaagactggaccgcttg

SEQ ID NO: 185231 - DNA, 25 bp, E. coli
aattggcgcaagtctggaccgcttg

SEQ ID NO: 185232 - DNA, 25 bp, E. coli
aagactggaccgcttgcctttggcc

SEQ ID NO: 185233 - DNA, 25 bp, E. coli
caaattggcgcaagactggaccgct

SEQ ID NO: 185234 - DNA, 25 bp, E. coli
caaattggcgcatgactggaccgct

SEQ ID NO: 185235 - DNA, 25 bp, E. coli
atcaaattggcgcaagactggaccg

SEQ ID NO: 185236 - DNA, 25 bp, E. coli
gcctttggcccgctttcattatcgt

SEQ ID NO: 185237 - DNA, 25 bp, E. coli
gcctttggcccggtttcattatcgt

SEQ ID NO: 185238 - DNA, 25 bp, E. coli
atcaaattggcggaagactggaccg

SEQ ID NO: 185239 - DNA, 25 bp, E. coli
tatgatcaaattcgcgcaagactgg

SEQ ID NO: 185240 - DNA, 25 bp, E. coli
tatgatcaaattggcgcaagactgg

SEQ ID NO: 185241 - DNA, 25 bp, E. coli
ttattggtgacttctttgggcggcg

SEQ ID NO: 185242 - DNA, 25 bp, E. coli
ttattggtgactactttgggcggcg

SEQ ID NO: 185243 - DNA, 25 bp, E. coli
ggtgggtttattcgtgactactttg

SEQ ID NO: 185244 - DNA, 25 bp, E. coli
ggtgggtttattggtgactactttg

SEQ ID NO: 185245 - DNA, 25 bp, E. coli
tggcccggtttctttatcgtatatt

SEQ ID NO: 185246 - DNA, 25 bp, E. coli
tggaccgcttgcctttggcccggtt

SEQ ID NO: 185247 - DNA, 25 bp, E. coli
tggaacaatatgttcaaattggcgc

SEQ ID NO: 185248 - DNA, 25 bp, E. coli
tggaccgcttgcgtttggcccggtt

SEQ ID NO: 185249 - DNA, 25 bp, E. coli
tggaacaatatgatcaaattggcgc

SEQ ID NO: 185250 - DNA, 25 bp, E. coli
tggcccggtttcattatcgtatatt

SEQ ID NO: 185251 - DNA, 25 bp, E. coli
cactcaggacaggagggatatcatt

SEQ ID NO: 185252 - DNA, 25 bp, E. coli
cactcaggacagcagggatatcatt

SEQ ID NO: 185253 - DNA, 25 bp, E. coli
catttgtagttaggctgcccgggcg

SEQ ID NO: 185254 - DNA, 25 bp, E. coli
catttgtagttacgctgcccgggcg

SEQ ID NO: 185255 - DNA, 25 bp, E. coli
aaagatctgtttggtcgctgtggcg

SEQ ID NO: 185256 - DNA, 25 bp, E. coli
aaattaatgtctcctctccccgtgg

SEQ ID NO: 185257 - DNA, 25 bp, E. coli
aaagatctgtttcgtcgctgtggcg

SEQ ID NO: 185258 - DNA, 25 bp, E. coli
aaattaatgtctgctctccccgtgg

SEQ ID NO: 185259 - DNA, 25 bp, E. coli
tatcgccccgcgtcgagatttacag

SEQ ID NO: 185260 - DNA, 25 bp, E. coli
tatgccagctgtgagacggtgtttc

SEQ ID NO: 185261 - DNA, 25 bp, E. coli
tatgccagctgtcagacggtgtttc

SEQ ID NO: 185262 - DNA, 25 bp, E. coli
tatcgccccgcgacgagatttacag

SEQ ID NO: 185263 - DNA, 25 bp, E. coli
tgggcgatccctcgttcaaacaaaa

SEQ ID NO: 185264 - DNA, 25 bp, E. coli
tgggcgatccctggttcaaacaaaa

SEQ ID NO: 185265 - DNA, 25 bp, E. coli
gaacactctattatgccgggcaggg

SEQ ID NO: 185266 - DNA, 25 bp, E. coli
gaacactctattttgccgggcaggg

SEQ ID NO: 185267 - DNA, 25 bp, E. coli
gatttcttcagtgagggagtcgcgc

SEQ ID NO: 185268 - DNA, 25 bp, E. coli
gatttcttcagtcagggagtcgcgc

SEQ ID NO: 185269 - DNA, 25 bp, E. coli
taatgtcgtgctggaaagaacggtg

SEQ ID NO: 185270 - DNA, 25 bp, E. coli
taatgtcgtgctcgaaagaacggtg

SEQ ID NO: 185271 - DNA, 25 bp, E. coli
gagaaattcgcggaacggtgctaca

SEQ ID NO: 185272 - DNA, 25 bp, E. coli
gagaaattcgcgcaacggtgctaca

SEQ ID NO: 185273 - DNA, 25 bp, E. coli
caaattgatgaccaatggctggagt

SEQ ID NO: 185274 - DNA, 25 bp, E. coli
caaattgatgacgaatggctggagt

SEQ ID NO: 185275 - DNA, 25 bp, E. coli
tactttcagtgctgtgtactaagcc

SEQ ID NO: 185276 - DNA, 25 bp, E. coli
tactaagcctggaattcctgacggt

SEQ ID NO: 185277 - DNA, 25 bp, E. coli
tactaagcctggtattcctgacggt

SEQ ID NO: 185278 - DNA, 25 bp, E. coli
tactttcagtgcagtgtactaagcc

SEQ ID NO: 185279 - DNA, 25 bp, E. coli
tagcaggaaagagtaaggctgaacc

SEQ ID NO: 185280 - DNA, 25 bp, E. coli
tagcaggaaagactaaggctgaacc

SEQ ID NO: 185281 - DNA, 25 bp, E. coli
tattggtcaggatctcacacctgct

SEQ ID NO: 185282 - DNA, 25 bp, E. coli
tattggtcaggaactcacacctgct

SEQ ID NO: 185283 - DNA, 25 bp, E. coli
tattttcaggagcaaaagactcggc

SEQ ID NO: 185284 - DNA, 25 bp, E. coli
tattttcaggaggaaaagactcggc

SEQ ID NO: 185285 - DNA, 25 bp, E. coli
tcctgacggttacctggttgttgag

SEQ ID NO: 185286 - DNA, 25 bp, E. coli
tcctgacggttagctggttgttgag

SEQ ID NO: 185287 - DNA, 25 bp, E. coli
cctgatgatttcagccgggctaccg

SEQ ID NO: 185288 - DNA, 25 bp, E. coli
cctgatgatttctgccgggctaccg

SEQ ID NO: 185289 - DNA, 25 bp, E. coli
gctgacaattcaaacgattacggga

SEQ ID NO: 185290 - DNA, 25 bp, E. coli
gctgacaattcatacgattacggga

SEQ ID NO: 185291 - DNA, 25 bp, E. coli
gactcggcatgtttgggattattaa

SEQ ID NO: 185292 - DNA, 25 bp, E. coli
gactcggcatgtatgggattattaa

SEQ ID NO: 185293 - DNA, 25 bp, E. coli
ggctaccggctacttctctttcgca

SEQ ID NO: 185294 - DNA, 25 bp, E. coli
ggctaccggctagttctctttcgca

SEQ ID NO: 185295 - DNA, 25 bp, E. coli
cagtaattacgagaccttcgacatg

SEQ ID NO: 185296 - DNA, 25 bp, E. coli
cagtaattacgacaccttcgacatg

SEQ ID NO: 185297 - DNA, 25 bp, E. coli
taccgcgatctctgcggcattggca

SEQ ID NO: 185298 - DNA, 25 bp, E. coli
tacctaacgggctaattcgtcgcgc

SEQ ID NO: 185299 - DNA, 25 bp, E. coli
tacctaacgggcaaattcgtcgcgc

SEQ ID NO: 185300 - DNA, 25 bp, E. coli
taccgcgatctcagcggcattggca

SEQ ID NO: 185301 - DNA, 25 bp, E. coli
tttctgaagaacgattgtggttacc

SEQ ID NO: 185302 - DNA, 25 bp, E. coli
ttaagcctgcttgcctacgtcaaat

SEQ ID NO: 185303 - DNA, 25 bp, E. coli
ttaagcctgcttccctacgtcaaat

SEQ ID NO: 185304 - DNA, 25 bp, E. coli
tttctgaagaaccattgtggttacc

SEQ ID NO: 185305 - DNA, 25 bp, E. coli
tgtggttaccagtacttacctaacg

SEQ ID NO: 185306 - DNA, 25 bp, E. coli
tcagaacagtgttattcggcagcct

SEQ ID NO: 185307 - DNA, 25 bp, E. coli
gaagatatggcccatttaacggcag

SEQ ID NO: 185308 - DNA, 25 bp, E. coli
gaagatatggccgatttaacggcag

SEQ ID NO: 185309 - DNA, 25 bp, E. coli
ggtgaagacagctaccgcgatctca

SEQ ID NO: 185310 - DNA, 25 bp, E. coli
ggtgaagacagcaaccgcgatctca

SEQ ID NO: 185311 - DNA, 25 bp, E. coli
tgtggttaccagaacttacctaacg

SEQ ID NO: 185312 - DNA, 25 bp, E. coli
ggcattggcattcccgtcgctaaaa

SEQ ID NO: 185313 - DNA, 25 bp, E. coli
ggcattggcattgccgtcgctaaaa

SEQ ID NO: 185314 - DNA, 25 bp, E. coli
tcagaacagtgtaattcggcagcct

SEQ ID NO: 185315 - DNA, 25 bp, E. coli
gagtctgaagccgaagatatggccg

SEQ ID NO: 185316 - DNA, 25 bp, E. coli
gagtctgaagcccaagatatggccg

SEQ ID NO: 185317 - DNA, 25 bp, E. coli
caatggctgacggaaaccttcggta

SEQ ID NO: 185318 - DNA, 25 bp, E. coli
caatggctgacgcaaaccttcggta

SEQ ID NO: 185319 - DNA, 25 bp, E. coli
caacgccgggcataagatgatgttc

SEQ ID NO: 185320 - DNA, 25 bp, E. coli
caacgccgggcaaaagatgatgttc

SEQ ID NO: 185321 - DNA, 25 bp, E. coli
caaatttattgaacgcgcctgtcac

SEQ ID NO: 185322 - DNA, 25 bp, E. coli
caaatttattgatcgcgcctgtcac

SEQ ID NO: 185323 - DNA, 25 bp, E. coli
catgattttcgtcctgctggtgacc

SEQ ID NO: 185324 - DNA, 25 bp, E. coli
catgattttcgtgctgctggtgacc

SEQ ID NO: 185325 - DNA, 25 bp, E. coli
aaaccttcggtacgccgcagatggg

SEQ ID NO: 185326 - DNA, 25 bp, E. coli
aaaccttcggtaggccgcagatggg

SEQ ID NO: 185327 - DNA, 25 bp, E. coli
ttcttcccgacgctgcaatggctga

SEQ ID NO: 185328 - DNA, 25 bp, E. coli
ttcttcccgacggtgcaatggctga

SEQ ID NO: 185329 - DNA, 25 bp, E. coli
tgtgcatcacaagatcccggataag

SEQ ID NO: 185330 - DNA, 25 bp, E. coli
tgtgcatcacaacatcccggataag

SEQ ID NO: 185331 - DNA, 25 bp, E. coli
tcgtgaaatcgacaaggcagaagcg

SEQ ID NO: 185332 - DNA, 25 bp, E. coli
tcgtgaaatcgagaaggcagaagcg

SEQ ID NO: 185333 - DNA, 25 bp, E. coli
gaagaaacaccaaccgcgctggtat

SEQ ID NO: 185334 - DNA, 25 bp, E. coli
gaagaaacaccatccgcgctggtat

SEQ ID NO: 185335 - DNA, 25 bp, E. coli
gatttgcttcttcctggtggcgctg

SEQ ID NO: 185336 - DNA, 25 bp, E. coli
gatttgcttcttgctggtggcgctg

SEQ ID NO: 185337 - DNA, 25 bp, E. coli
gatgtcggtaagtacaacgccgggc

SEQ ID NO: 185338 - DNA, 25 bp, E. coli
gatgtcggtaagaacaacgccgggc

SEQ ID NO: 185339 - DNA, 25 bp, E. coli
caaacgcggcatggctttatggctg

SEQ ID NO: 185340 - DNA, 25 bp, E. coli
caaacgcggcatcgctttatggctg

SEQ ID NO: 185341 - DNA, 25 bp, E. coli
actgcgcaaattgcggtgaccttac

SEQ ID NO: 185342 - DNA, 25 bp, E. coli
ctgggttgccaagaaattgcgggta

SEQ ID NO: 185343 - DNA, 25 bp, E. coli
actgcgcaaattccggtgaccttac

SEQ ID NO: 185344 - DNA, 25 bp, E. coli
ctgggttgccaacaaattgcgggta

SEQ ID NO: 185345 - DNA, 25 bp, E. coli
tacccacctgggatgaagtgattgg

SEQ ID NO: 185346 - DNA, 25 bp, E. coli
tacccacctgggttgaagtgattgg

SEQ ID NO: 185347 - DNA, 25 bp, E. coli
tgtggaagatgcagcgctcaaacgc

SEQ ID NO: 185348 - DNA, 25 bp, E. coli
tgtggaagatgctgcgctcaaacgc

SEQ ID NO: 185349 - DNA, 25 bp, E. coli
tgatcgaagcaatagaagcgttcca

SEQ ID NO: 185350 - DNA, 25 bp, E. coli
tgatcgaagcaaaagaagcgttcca

SEQ ID NO: 185351 - DNA, 25 bp, E. coli
cctggccaggtaaagagattggtca

SEQ ID NO: 185352 - DNA, 25 bp, E. coli
cctggccaggtatagagattggtca

SEQ ID NO: 185353 - DNA, 25 bp, E. coli
gaaatattgccgcacgtgaaggctg

SEQ ID NO: 185354 - DNA, 25 bp, E. coli
gaaatattgccggacgtgaaggctg

SEQ ID NO: 185355 - DNA, 25 bp, E. coli
cgatatcattcgagaagcggctaaa

SEQ ID NO: 185356 - DNA, 25 bp, E. coli
cgatatcattcgtgaagcggctaaa

SEQ ID NO: 185357 - DNA, 25 bp, E. coli
gatacctttcgtcgcacccgtgaag

SEQ ID NO: 185358 - DNA, 25 bp, E. coli
gatacctttcgtggcacccgtgaag

SEQ ID NO: 185359 - DNA, 25 bp, E. coli
gagtaagcataaaattcaggccagc

SEQ ID NO: 185360 - DNA, 25 bp, E. coli
gagtaagcataatattcaggccagc

SEQ ID NO: 185361 - DNA, 25 bp, E. coli
caagattcgtgttggagacgcacta

SEQ ID NO: 185362 - DNA, 25 bp, E. coli
caagattcgtgtaggagacgcacta

SEQ ID NO: 185363 - DNA, 25 bp, E. coli
catttacggcgacgactattgcaga

SEQ ID NO: 185364 - DNA, 25 bp, E. coli
catttacggcgaggactattgcaga

SEQ ID NO: 185365 - DNA, 25 bp, E. coli
tacttacccgagaacttgcagagga

SEQ ID NO: 185366 - DNA, 25 bp, E. coli
tacatcggagcatttgcgtgcggcg

SEQ ID NO: 185367 - DNA, 25 bp, E. coli
tactaacttgcgctattgggcagcg

SEQ ID NO: 185368 - DNA, 25 bp, E. coli
tacatcggagcaattgcgtgcggcg

SEQ ID NO: 185369 - DNA, 25 bp, E. coli
tacttacccgagtacttgcagagga

SEQ ID NO: 185370 - DNA, 25 bp, E. coli
tactaacttgcggtattgggcagcg

SEQ ID NO: 185371 - DNA, 25 bp, E. coli
tattaaggcgcgattaccaaaagcg

SEQ ID NO: 185372 - DNA, 25 bp, E. coli
tattaaggcgcgtttaccaaaagcg

SEQ ID NO: 185373 - DNA, 25 bp, E. coli
tgcagagtacttccgcgatcaaggt

SEQ ID NO: 185374 - DNA, 25 bp, E. coli
tgcagagtacttgcgcgatcaaggt

SEQ ID NO: 185375 - DNA, 25 bp, E. coli
tgcggcggcagattgcaaaaagctt

SEQ ID NO: 185376 - DNA, 25 bp, E. coli
tgcggcggcagaatgcaaaaagctt

SEQ ID NO: 185377 - DNA, 25 bp, E. coli
ccatttatacttcgcgtcagggcaa

SEQ ID NO: 185378 - DNA, 25 bp, E. coli
ccatttatacttggcgtcagggcaa

SEQ ID NO: 185379 - DNA, 25 bp, E. coli
gaacccagtcaaggtttagccgagg

SEQ ID NO: 185380 - DNA, 25 bp, E. coli
gaacccagtcaacgtttagccgagg

SEQ ID NO: 185381 - DNA, 25 bp, E. coli
cgctggaaaggaagaaagccgcatt

SEQ ID NO: 185382 - DNA, 25 bp, E. coli
cgctggaaaggatgaaagccgcatt

SEQ ID NO: 185383 - DNA, 25 bp, E. coli
cattttgctgttcatgcgggtgaaa

SEQ ID NO: 185384 - DNA, 25 bp, E. coli
cattttgctgttgatgcgggtgaaa

SEQ ID NO: 185385 - DNA, 25 bp, E. coli
tacgacagaatactaccattggaca

SEQ ID NO: 185386 - DNA, 25 bp, E. coli
tacgacagaatagtaccattggaca

SEQ ID NO: 185387 - DNA, 25 bp, E. coli
tccttttctggtcgcggttggctaa

SEQ ID NO: 185388 - DNA, 25 bp, E. coli
tccttttctggtggcggttggctaa

SEQ ID NO: 185389 - DNA, 25 bp, E. coli
gaaagcagccaaaaagttaaacagt

SEQ ID NO: 185390 - DNA, 25 bp, E. coli
gaaagcagccaataagttaaacagt

SEQ ID NO: 185391 - DNA, 25 bp, E. coli
cgggtgaaaatctggtattacgaca

SEQ ID NO: 185392 - DNA, 25 bp, E. coli
cggagctaattgttgcatcattgga

SEQ ID NO: 185393 - DNA, 25 bp, E. coli
cggagctaattgatgcatcattgga

SEQ ID NO: 185394 - DNA, 25 bp, E. coli
cgggtgaaaatcaggtattacgaca

SEQ ID NO: 185395 - DNA, 25 bp, E. coli
gatatgcctagttcaagagtaaaaa

SEQ ID NO: 185396 - DNA, 25 bp, E. coli
gatatgcctagtacaagagtaaaaa

SEQ ID NO: 185397 - DNA, 25 bp, E. coli
gggttgacaattccccatcatgctg

SEQ ID NO: 185398 - DNA, 25 bp, E. coli
gggttgacaattgcccatcatgctg

SEQ ID NO: 185399 - DNA, 25 bp, E. coli
tggtagtaacgttgatatcggagct

SEQ ID NO: 185400 - DNA, 25 bp, E. coli
tggtagtaacgtagatatcggagct

SEQ ID NO: 185401 - DNA, 25 bp, E. coli
tggacagatagaaggtgatatgcct

SEQ ID NO: 185402 - DNA, 25 bp, E. coli
tggacagatagatggtgatatgcct

SEQ ID NO: 185403 - DNA, 25 bp, E. coli
taagagagaaaatgcagcgtaaccg

SEQ ID NO: 185404 - DNA, 25 bp, E. coli
taagagagaaaaagcagcgtaaccg

SEQ ID NO: 185405 - DNA, 25 bp, E. coli
aaggttctctgctggatttacggga

SEQ ID NO: 185406 - DNA, 25 bp, E. coli
aaggttctctgcaggatttacggga

SEQ ID NO: 185407 - DNA, 25 bp, E. coli
cacagaatgcgctactgagtgccga

SEQ ID NO: 185408 - DNA, 25 bp, E. coli
cacagaatgcgcaactgagtgccga

SEQ ID NO: 185409 - DNA, 25 bp, E. coli
taaaaagcggtaacctccggctggt

SEQ ID NO: 185410 - DNA, 25 bp, E. coli
taaaaagcggtatcctccggctggt

SEQ ID NO: 185411 - DNA, 25 bp, E. coli
tgtgcgtctgacaccggacagtgat

SEQ ID NO: 185412 - DNA, 25 bp, E. coli
tgtgcgtctgactccggacagtgat

SEQ ID NO: 185413 - DNA, 25 bp, E. coli
ccatcaccggaggagcagcatttta

SEQ ID NO: 185414 - DNA, 25 bp, E. coli
ccatcaccggagcagcagcatttta

SEQ ID NO: 185415 - DNA, 25 bp, E. coli
cattcccggcactcgaaggttctct

SEQ ID NO: 185416 - DNA, 25 bp, E. coli
cattcccggcacacgaaggttctct

SEQ ID NO: 185417 - DNA, 25 bp, E. coli
gatttttcgctgtgtctgccgggaa

SEQ ID NO: 185418 - DNA, 25 bp, E. coli
gatttttcgctgagtctgccgggaa

SEQ ID NO: 185419 - DNA, 25 bp, E. coli
taacagccggattcagggacaacat

SEQ ID NO: 185420 - DNA, 25 bp, E. coli
tcagcgtggctattccgggatggca

SEQ ID NO: 185421 - DNA, 25 bp, E. coli
taacagccggatacagggacaacat

SEQ ID NO: 185422 - DNA, 25 bp, E. coli
taatggcggtaccataaatgccgac

SEQ ID NO: 185423 - DNA, 25 bp, E. coli
taatggcggtacgataaatgccgac

SEQ ID NO: 185424 - DNA, 25 bp, E. coli
tcagcgtggctaatccgggatggca

SEQ ID NO: 185425 - DNA, 25 bp, E. coli
gatgcactgagccttgataatcgca

SEQ ID NO: 185426 - DNA, 25 bp, E. coli
gatgcactgagcgttgataatcgca

SEQ ID NO: 185427 - DNA, 25 bp, E. coli
catggaatcggtcctgtgtaacgaa

SEQ ID NO: 185428 - DNA, 25 bp, E. coli
catggaatcggtgctgtgtaacgaa

SEQ ID NO: 185429 - DNA, 25 bp, E. coli
taaagtgcggatactggaacaaggc

SEQ ID NO: 185430 - DNA, 25 bp, E. coli
taaagtgcggattctggaacaaggc

SEQ ID NO: 185431 - DNA, 25 bp, E. coli
aaagcagcttgttgaatggcaggag

SEQ ID NO: 185432 - DNA, 25 bp, E. coli
aaagcagcttgtagaatggcaggag

SEQ ID NO: 185433 - DNA, 25 bp, E. coli
ttgagcgtacaactcgcaaggttac

SEQ ID NO: 185434 - DNA, 25 bp, E. coli
ttgagcgtacaagtcgcaaggttac

SEQ ID NO: 185435 - DNA, 25 bp, E. coli
gctgtatcccaaaattaaagtgcgg

SEQ ID NO: 185436 - DNA, 25 bp, E. coli
gctgtatcccaatattaaagtgcgg

SEQ ID NO: 185437 - DNA, 25 bp, E. coli
gaaggcatttgtgatactggcagag

SEQ ID NO: 185438 - DNA, 25 bp, E. coli
gaaggcatttgtcatactggcagag

SEQ ID NO: 185439 - DNA, 25 bp, E. coli
gacgttagcgtgtattccgaccgca

SEQ ID NO: 185440 - DNA, 25 bp, E. coli
gacgttagcgtgaattccgaccgca

SEQ ID NO: 185441 - DNA, 25 bp, E. coli
ccctggaagctggactggttttacg

SEQ ID NO: 185442 - DNA, 25 bp, E. coli
ccctggaagctgcactggttttacg

SEQ ID NO: 185443 - DNA, 25 bp, E. coli
gattttaccccactggtcaacgagc

SEQ ID NO: 185444 - DNA, 25 bp, E. coli
gattttaccccagtggtcaacgagc

SEQ ID NO: 185445 - DNA, 25 bp, E. coli
tcaacgagccgttcgtgctggcctg

SEQ ID NO: 185446 - DNA, 25 bp, E. coli
tcaacgagccgtacgtgctggcctg

SEQ ID NO: 185447 - DNA, 25 bp, E. coli
gaccaatatcgtcgaacgccagaga

SEQ ID NO: 185448 - DNA, 25 bp, E. coli
gaccaatatcgtggaacgccagaga

SEQ ID NO: 185449 - DNA, 25 bp, E. coli
cactgtttacggacaggcgggcgct

SEQ ID NO: 185450 - DNA, 25 bp, E. coli
cactgtttacggtcaggcgggcgct

SEQ ID NO: 185451 - DNA, 25 bp, E. coli
catccgtggtatgtcatgccatgcg

SEQ ID NO: 185452 - DNA, 25 bp, E. coli
catccgtggtatctcatgccatgcg

SEQ ID NO: 185453 - DNA, 25 bp, E. coli
tgcataaaagcgctgctgccacatc

SEQ ID NO: 185454 - DNA, 25 bp, E. coli
tgaagcgctggcctggctgcataaa

SEQ ID NO: 185455 - DNA, 25 bp, E. coli
tgaagcgctggcgtggctgcataaa

SEQ ID NO: 185456 - DNA, 25 bp, E. coli
tgcacaggcctaagctgatgaagcg

SEQ ID NO: 185457 - DNA, 25 bp, E. coli
tgcacaggcctatgctgatgaagcg

SEQ ID NO: 185458 - DNA, 25 bp, E. coli
tgcataaaagcggtgctgccacatc

SEQ ID NO: 185459 - DNA, 25 bp, E. coli
tgcggttccctgcaactgaacggcg

SEQ ID NO: 185460 - DNA, 25 bp, E. coli
tgcggttccctggaactgaacggcg

SEQ ID NO: 185461 - DNA, 25 bp, E. coli
tcttctgacggaaaacagcctgctg

SEQ ID NO: 185462 - DNA, 25 bp, E. coli
tcttctgacggataacagcctgctg

SEQ ID NO: 185463 - DNA, 25 bp, E. coli
gaaaagacgctgacctccgtggtca

SEQ ID NO: 185464 - DNA, 25 bp, E. coli
gaaaagacgctgtcctccgtggtca

SEQ ID NO: 185465 - DNA, 25 bp, E. coli
cgttggctcccgtctctggctgtta

SEQ ID NO: 185466 - DNA, 25 bp, E. coli
cgttggctcccgactctggctgtta

SEQ ID NO: 185467 - DNA, 25 bp, E. coli
gattccgatgaaatccctgacggca

SEQ ID NO: 185468 - DNA, 25 bp, E. coli
gatatcgctgtcctctgggatcagg

SEQ ID NO: 185469 - DNA, 25 bp, E. coli
gattccgatgaattccctgacggca

SEQ ID NO: 185470 - DNA, 25 bp, E. coli
gatatcgctgtcgtctgggatcagg

SEQ ID NO: 185471 - DNA, 25 bp, E. coli
aagccggctgcaagaatacgcgaga

SEQ ID NO: 185472 - DNA, 25 bp, E. coli
aagccggctgcatgaatacgcgaga

SEQ ID NO: 185473 - DNA, 25 bp, E. coli
ttaacagggtgttgcagagtgccgt

SEQ ID NO: 185474 - DNA, 25 bp, E. coli
ttaacagggtgtagcagagtgccgt

SEQ ID NO: 185475 - DNA, 25 bp, E. coli
tgtgaaggagaatatacgaccacct

SEQ ID NO: 185476 - DNA, 25 bp, E. coli
tgtgaaggagaaaatacgaccacct

SEQ ID NO: 185477 - DNA, 25 bp, E. coli
tgccgttattcaccgcgacgttaat

SEQ ID NO: 185478 - DNA, 25 bp, E. coli
tgccgttattcagcgcgacgttaat

SEQ ID NO: 185479 - DNA, 25 bp, E. coli
tctggatcgctgctggaacttcacg

SEQ ID NO: 185480 - DNA, 25 bp, E. coli
tctggatcgctggtggaacttcacg

SEQ ID NO: 185481 - DNA, 25 bp, E. coli
ccagcttgtttttcgatgtgagcca

SEQ ID NO: 185482 - DNA, 25 bp, E. coli
gccagaacgttatgaaccccagcga

SEQ ID NO: 185483 - DNA, 25 bp, E. coli
ccagcttgttttacgatgtgagcca

SEQ ID NO: 185484 - DNA, 25 bp, E. coli
gccagaacgttaagaaccccagcga

SEQ ID NO: 185485 - DNA, 25 bp, E. coli
cgcttggcagcgaccatttctggag

SEQ ID NO: 185486 - DNA, 25 bp, E. coli
cgcttggcagcgtccatttctggag

SEQ ID NO: 185487 - DNA, 25 bp, E. coli
cgacgttaatcatattgcgacgggc

SEQ ID NO: 185488 - DNA, 25 bp, E. coli
cgacgttaatcaaattgcgacgggc

SEQ ID NO: 185489 - DNA, 25 bp, E. coli
ggtttaccgcgaacagcttttcctg

SEQ ID NO: 185490 - DNA, 25 bp, E. coli
ggtttaccgcgatcagcttttcctg

SEQ ID NO: 185491 - DNA, 25 bp, E. coli
tcaacggatttagcacgcttggcag

SEQ ID NO: 185492 - DNA, 25 bp, E. coli
tcaacggatttaccacgcttggcag

SEQ ID NO: 185493 - DNA, 25 bp, E. coli
aatcggtaacacgacgctgggtctg

SEQ ID NO: 185494 - DNA, 25 bp, E. coli
taaaatcggtaagaccacgctgggt

SEQ ID NO: 185495 - DNA, 25 bp, E. coli
taaaatcggtaacaccacgctgggt

SEQ ID NO: 185496 - DNA, 25 bp, E. coli
aatcggtaacaccacgctgggtctg

SEQ ID NO: 185497 - DNA, 25 bp, E. coli
taacaccacgctcggtctgggttac

SEQ ID NO: 185498 - DNA, 25 bp, E. coli
tcggtaacttatgcgacggtgcgtt

SEQ ID NO: 185499 - DNA, 25 bp, E. coli
tcggtaacttatccgacggtgcgtt

SEQ ID NO: 185500 - DNA, 25 bp, E. coli
gcatttgtgacctccggtttaggta

SEQ ID NO: 185501 - DNA, 25 bp, E. coli
gcatttgtgaccaccggtttaggta

SEQ ID NO: 185502 - DNA, 25 bp, E. coli
gattggtaaaatcggtaacaccacg

SEQ ID NO: 185503 - DNA, 25 bp, E. coli
gattggtaaaatgggtaacaccacg

SEQ ID NO: 185504 - DNA, 25 bp, E. coli
gtgttctcggcgtttaccttaagcg

SEQ ID NO: 185505 - DNA, 25 bp, E. coli
gtgttctcggcgattaccttaagcg

SEQ ID NO: 185506 - DNA, 25 bp, E. coli
tggtggtggtcgctaacttatccga

SEQ ID NO: 185507 - DNA, 25 bp, E. coli
tggctggtgttcacggcgtttacct

SEQ ID NO: 185508 - DNA, 25 bp, E. coli
ggcgtttaccttaagcgccgcattt

SEQ ID NO: 185509 - DNA, 25 bp, E. coli
tggtggtggtcggtaacttatccga

SEQ ID NO: 185510 - DNA, 25 bp, E. coli
ggcgtttacctttagcgccgcattt

SEQ ID NO: 185511 - DNA, 25 bp, E. coli
tggctggtgttctcggcgtttacct

SEQ ID NO: 185512 - DNA, 25 bp, E. coli
taagcgccgcatttgtgaccaccgg

SEQ ID NO: 185513 - DNA, 25 bp, E. coli
taagcgccgcatatgtgaccaccgg

SEQ ID NO: 185514 - DNA, 25 bp, E. coli
taacaccacgctgggtctgggttac

SEQ ID NO: 185515 - DNA, 25 bp, E. coli
aatgacctggtgctccgtgacttcc

SEQ ID NO: 185516 - DNA, 25 bp, E. coli
aatgacctggtggtccgtgacttcc

SEQ ID NO: 185517 - DNA, 25 bp, E. coli
cagcgcacgcgttgtaaacgaggaa

SEQ ID NO: 185518 - DNA, 25 bp, E. coli
cagcgcacgcgtagtaaacgaggaa

SEQ ID NO: 185519 - DNA, 25 bp, E. coli
tgataaatcgcagaggaggatggta

SEQ ID NO: 185520 - DNA, 25 bp, E. coli
tgataaatcgcacaggaggatggta

SEQ ID NO: 185521 - DNA, 25 bp, E. coli
gcattatccagatcaggtgatacgg

SEQ ID NO: 185522 - DNA, 25 bp, E. coli
gcattatccagaacaggtgatacgg

SEQ ID NO: 185523 - DNA, 25 bp, E. coli
gaaaaacggcagatttacaatcgcg

SEQ ID NO: 185524 - DNA, 25 bp, E. coli
gaaaaacggcagttttacaatcgcg

SEQ ID NO: 185525 - DNA, 25 bp, E. coli
cccgagtcgtttggttgcgatgata

SEQ ID NO: 185526 - DNA, 25 bp, E. coli
cccgagtcgtttcgttgcgatgata

SEQ ID NO: 185527 - DNA, 25 bp, E. coli
cgtgacttccctacgctggcattat

SEQ ID NO: 185528 - DNA, 25 bp, E. coli
cgtgacttcccttcgctggcattat

SEQ ID NO: 185529 - DNA, 25 bp, E. coli
gtttgctcctgccataacgtgaaga

SEQ ID NO: 185530 - DNA, 25 bp, E. coli
gtttgctcctgcgataacgtgaaga

SEQ ID NO: 185531 - DNA, 25 bp, E. coli
gggtatttctcagccttcacgcaga

SEQ ID NO: 185532 - DNA, 25 bp, E. coli
gggtatttctcacccttcacgcaga

SEQ ID NO: 185533 - DNA, 25 bp, E. coli
taacgtgaagaagcaatgacctggt

SEQ ID NO: 185534 - DNA, 25 bp, E. coli
taacgtgaagaaccaatgacctggt

SEQ ID NO: 185535 - DNA, 25 bp, E. coli
gaggatggtaatgtccagcgcacgc

SEQ ID NO: 185536 - DNA, 25 bp, E. coli
gaggatggtaatctccagcgcacgc

SEQ ID NO: 185537 - DNA, 25 bp, E. coli
catttgaagaaatcgtacgcctgga

SEQ ID NO: 185538 - DNA, 25 bp, E. coli
catccgtaatgatatggtgcctggc

SEQ ID NO: 185539 - DNA, 25 bp, E. coli
catccgtaatgaaatggtgcctggc

SEQ ID NO: 185540 - DNA, 25 bp, E. coli
catttgaagaaaacgtacgcctgga

SEQ ID NO: 185541 - DNA, 25 bp, E. coli
tacgcctggaaaaggagcgcaacca

SEQ ID NO: 185542 - DNA, 25 bp, E. coli
tacgcctggaaatggagcgcaacca

SEQ ID NO: 185543 - DNA, 25 bp, E. coli
tttgaaggccgtatccatccgctgg

SEQ ID NO: 185544 - DNA, 25 bp, E. coli
tttgaaggccgtttccatccgctgg

SEQ ID NO: 185545 - DNA, 25 bp, E. coli
tgatgcaggactttaccggcgtacc

SEQ ID NO: 185546 - DNA, 25 bp, E. coli
tgatgcaggactataccggcgtacc

SEQ ID NO: 185547 - DNA, 25 bp, E. coli
tgaaagatatctggccatcggcaca

SEQ ID NO: 185548 - DNA, 25 bp, E. coli
tgaaagatatctcgccatcggcaca

SEQ ID NO: 185549 - DNA, 25 bp, E. coli
gctataagcaggtgcaaacgccgct

SEQ ID NO: 185550 - DNA, 25 bp, E. coli
gctataagcaggagcaaacgccgct

SEQ ID NO: 185551 - DNA, 25 bp, E. coli
gaatgacgttgatgcgagcctggca

SEQ ID NO: 185552 - DNA, 25 bp, E. coli
gaatgacgttgaagcgagcctggca

SEQ ID NO: 185553 - DNA, 25 bp, E. coli
gaaatgttccgctaagagtacgcag

SEQ ID NO: 185554 - DNA, 25 bp, E. coli
gaaaaatgcccatgctgaccgtgaa

SEQ ID NO: 185555 - DNA, 25 bp, E. coli
gaaatgttccgcaaagagtacgcag

SEQ ID NO: 185556 - DNA, 25 bp, E. coli
gaaaaatgcccaagctgaccgtgaa

SEQ ID NO: 185557 - DNA, 25 bp, E. coli
taaccatgaagtgatgatgcgcggc

SEQ ID NO: 185558 - DNA, 25 bp, E. coli
taaccatgaagtcatgatgcgcggc

SEQ ID NO: 185559 - DNA, 25 bp, E. coli
cagggctattataattagaagcaaa

SEQ ID NO: 185560 - DNA, 25 bp, E. coli
cagggctattattattagaagcaaa

SEQ ID NO: 185561 - DNA, 25 bp, E. coli
attggcggtgggttgtttgctttac

SEQ ID NO: 185562 - DNA, 25 bp, E. coli
accatctgggcggtaataattcctg

SEQ ID NO: 185563 - DNA, 25 bp, E. coli
attggcggtgggatgtttgctttac

SEQ ID NO: 185564 - DNA, 25 bp, E. coli
accatctgggcgctaataattcctg

SEQ ID NO: 185565 - DNA, 25 bp, E. coli
actggcaatcaaagcccgcaagaag

SEQ ID NO: 185566 - DNA, 25 bp, E. coli
actggcaatcaatgcccgcaagaag

SEQ ID NO: 185567 - DNA, 25 bp, E. coli
tatagccggtacagtaattggcggt

SEQ ID NO: 185568 - DNA, 25 bp, E. coli
tatcgcctggttatcaatgttacat

SEQ ID NO: 185569 - DNA, 25 bp, E. coli
tatcgcctggttttcaatgttacat

SEQ ID NO: 185570 - DNA, 25 bp, E. coli
tatagccggtactgtaattggcggt

SEQ ID NO: 185571 - DNA, 25 bp, E. coli
tgaccttgccggtgcctggtttttt

SEQ ID NO: 185572 - DNA, 25 bp, E. coli
tgaccttgccggagcctggtttttt

SEQ ID NO: 185573 - DNA, 25 bp, E. coli
gctgtactggcattcaaagcccgca

SEQ ID NO: 185574 - DNA, 25 bp, E. coli
gctgtactggcaatcaaagcccgca

SEQ ID NO: 185575 - DNA, 25 bp, E. coli
cgcttttattcttattatcgcctgg

SEQ ID NO: 185576 - DNA, 25 bp, E. coli
cgcttttattctaattatcgcctgg

SEQ ID NO: 185577 - DNA, 25 bp, E. coli
gtaataattcctgctgtactggcaa

SEQ ID NO: 185578 - DNA, 25 bp, E. coli
gtaataattcctcctgtactggcaa

SEQ ID NO: 185579 - DNA, 25 bp, E. coli
tcaatgttacatacagggctattat

SEQ ID NO: 185580 - DNA, 25 bp, E. coli
tcaatgttacattcagggctattat

SEQ ID NO: 185581 - DNA, 25 bp, E. coli
aaggtctggtttctgcaattgaagc

SEQ ID NO: 185582 - DNA, 25 bp, E. coli
caattgaagctggagataccatggt

SEQ ID NO: 185583 - DNA, 25 bp, E. coli
caattgaagctgcagataccatggt

SEQ ID NO: 185584 - DNA, 25 bp, E. coli
aaggtctggtttgtgcaattgaagc

SEQ ID NO: 185585 - DNA, 25 bp, E. coli
tttctatcggaaatattgaggtcgt

SEQ ID NO: 185586 - DNA, 25 bp, E. coli
tttctatcggaattattgaggtcgt

SEQ ID NO: 185587 - DNA, 25 bp, E. coli
ttgaggtcgttaagcaacaagaagc

SEQ ID NO: 185588 - DNA, 25 bp, E. coli
ttgaggtcgttatgcaacaagaagc

SEQ ID NO: 185589 - DNA, 25 bp, E. coli
tgtgcacgttttgtttctatcggaa

SEQ ID NO: 185590 - DNA, 25 bp, E. coli
tgggttatgaaaaaatcggctccgg

SEQ ID NO: 185591 - DNA, 25 bp, E. coli
tgggttatgaaataatcggctccgg

SEQ ID NO: 185592 - DNA, 25 bp, E. coli
tgtgcacgttttctttctatcggaa

SEQ ID NO: 185593 - DNA, 25 bp, E. coli
tccggcttggtgactgtgatggttc

SEQ ID NO: 185594 - DNA, 25 bp, E. coli
tccggcttggtgtctgtgatggttc

SEQ ID NO: 185595 - DNA, 25 bp, E. coli
tctgccaacgtgtccctagtgggtt

SEQ ID NO: 185596 - DNA, 25 bp, E. coli
tctgccaacgtgaccctagtgggtt

SEQ ID NO: 185597 - DNA, 25 bp, E. coli
gaaagccgcgactgatgcgggctcc

SEQ ID NO: 185598 - DNA, 25 bp, E. coli
gaaagccgcgacagatgcgggctcc

SEQ ID NO: 185599 - DNA, 25 bp, E. coli
gataccatggtgtaatctgccaacg

SEQ ID NO: 185600 - DNA, 25 bp, E. coli
gataccatggtgaaatctgccaacg

SEQ ID NO: 185601 - DNA, 25 bp, E. coli
taggaatggttgtaacgaaaggtct

SEQ ID NO: 185602 - DNA, 25 bp, E. coli
taggaatggttgaaacgaaaggtct

SEQ ID NO: 185603 - DNA, 25 bp, E. coli
caaaccctgtttagtggcagtggaa

SEQ ID NO: 185604 - DNA, 25 bp, E. coli
caaaccctgttttgtggcagtggaa

SEQ ID NO: 185605 - DNA, 25 bp, E. coli
taccgtagcggctgtatgcaaagcg

SEQ ID NO: 185606 - DNA, 25 bp, E. coli
taccgtagcggcagtatgcaaagcg

SEQ ID NO: 185607 - DNA, 25 bp, E. coli
tattgctgccgatccagaagctgct

SEQ ID NO: 185608 - DNA, 25 bp, E. coli
tattgctgccgaaccagaagctgct

SEQ ID NO: 185609 - DNA, 25 bp, E. coli
ttgatatcgacgcttgcctgggcaa

SEQ ID NO: 185610 - DNA, 25 bp, E. coli
ttgatatcgacggttgcctgggcaa

SEQ ID NO: 185611 - DNA, 25 bp, E. coli
tgcaaagcggctagcgaatgcacga

SEQ ID NO: 185612 - DNA, 25 bp, E. coli
tgactatctctcaacactgccgcag

SEQ ID NO: 185613 - DNA, 25 bp, E. coli
tgcaaagcggcttgcgaatgcacga

SEQ ID NO: 185614 - DNA, 25 bp, E. coli
tgactatctctctacactgccgcag

SEQ ID NO: 185615 - DNA, 25 bp, E. coli
gctgttactttcacaatgcccggaa

SEQ ID NO: 185616 - DNA, 25 bp, E. coli
gctgttactttctcaatgcccggaa

SEQ ID NO: 185617 - DNA, 25 bp, E. coli
gaatggctggctacgactttgttga

SEQ ID NO: 185618 - DNA, 25 bp, E. coli
gaatttacctcaggcacgacggtgg

SEQ ID NO: 185619 - DNA, 25 bp, E. coli
gaatttacctcacgcacgacggtgg

SEQ ID NO: 185620 - DNA, 25 bp, E. coli
gaatggctggcttcgactttgttga

SEQ ID NO: 185621 - DNA, 25 bp, E. coli
gaactcgacctgcaactgatgacca

SEQ ID NO: 185622 - DNA, 25 bp, E. coli
gaactcgacctggaactgatgacca

SEQ ID NO: 185623 - DNA, 25 bp, E. coli
ggaaaatgcttcacgccctgtttag

SEQ ID NO: 185624 - DNA, 25 bp, E. coli
ggaaaatgcttctcgccctgtttag

SEQ ID NO: 185625 - DNA, 25 bp, E. coli
taacagatgtcgagcatgccgggaa

SEQ ID NO: 185626 - DNA, 25 bp, E. coli
acaacgaattgtggccggctgaacc

SEQ ID NO: 185627 - DNA, 25 bp, E. coli
acaacgaattgtcgccggctgaacc

SEQ ID NO: 185628 - DNA, 25 bp, E. coli
tattcaaaaacttgacggcgcaggc

SEQ ID NO: 185629 - DNA, 25 bp, E. coli
tattcaaaaactagacggcgcaggc

SEQ ID NO: 185630 - DNA, 25 bp, E. coli
tgggcgcatcggcttcaggaaaatc

SEQ ID NO: 185631 - DNA, 25 bp, E. coli
tgaaattgcctcacagcgggcaggg

SEQ ID NO: 185632 - DNA, 25 bp, E. coli
tgagctttgactaccaccatggcga

SEQ ID NO: 185633 - DNA, 25 bp, E. coli
tgaaattgcctctcagcgggcaggg

SEQ ID NO: 185634 - DNA, 25 bp, E. coli
tgagctttgacttccaccatggcga

SEQ ID NO: 185635 - DNA, 25 bp, E. coli
gaacatatacgcgaggtgctggcac

SEQ ID NO: 185636 - DNA, 25 bp, E. coli
gaacagctgttatctgcaggcggcc

SEQ ID NO: 185637 - DNA, 25 bp, E. coli
gaacatatacgccaggtgctggcac

SEQ ID NO: 185638 - DNA, 25 bp, E. coli
gaacagctgttaactgcaggcggcc

SEQ ID NO: 185639 - DNA, 25 bp, E. coli
gatatggctcaacaccagcgaaggc

SEQ ID NO: 185640 - DNA, 25 bp, E. coli
gatatggctcaagaccagcgaaggc

SEQ ID NO: 185641 - DNA, 25 bp, E. coli
tggccggtaaagctcgcaaagtcac

SEQ ID NO: 185642 - DNA, 25 bp, E. coli
tgggcgcatcgggttcaggaaaatc

SEQ ID NO: 185643 - DNA, 25 bp, E. coli
tggccggtaaaggtcgcaaagtcac

SEQ ID NO: 185644 - DNA, 25 bp, E. coli
ttacttgcggaaaacggaacccacg

SEQ ID NO: 185645 - DNA, 25 bp, E. coli
taacagatgtcgtgcatgccgggaa

SEQ ID NO: 185646 - DNA, 25 bp, E. coli
ttacttgcggaatacggaacccacg

SEQ ID NO: 185647 - DNA, 25 bp, E. coli
taaataatctgatagcgtttggtcg

SEQ ID NO: 185648 - DNA, 25 bp, E. coli
taaataatctgaaagcgtttggtcg

SEQ ID NO: 185649 - DNA, 25 bp, E. coli
agcaaccttgagtgggtcgccagca

SEQ ID NO: 185650 - DNA, 25 bp, E. coli
agtgggtcgccagcaatggactcaa

SEQ ID NO: 185651 - DNA, 25 bp, E. coli
agtgggtcgccaccaatggactcaa

SEQ ID NO: 185652 - DNA, 25 bp, E. coli
agcaaccttgagagggtcgccagca

SEQ ID NO: 185653 - DNA, 25 bp, E. coli
tagtgtgacgcacacagcaagctaa

SEQ ID NO: 185654 - DNA, 25 bp, E. coli
tagtgtgacgcagacagcaagctaa

SEQ ID NO: 185655 - DNA, 25 bp, E. coli
tcagctacgagcaaccttgagtggg

SEQ ID NO: 185656 - DNA, 25 bp, E. coli
tcaggtgttcagattgtttcagaat

SEQ ID NO: 185657 - DNA, 25 bp, E. coli
tcaggtgttcagtttgtttcagaat

SEQ ID NO: 185658 - DNA, 25 bp, E. coli
tcagctacgagctaccttgagtggg

SEQ ID NO: 185659 - DNA, 25 bp, E. coli
gcaatggactcaaacccaatcaggt

SEQ ID NO: 185660 - DNA, 25 bp, E. coli
gcaatggactcatacccaatcaggt

SEQ ID NO: 185661 - DNA, 25 bp, E. coli
gactcaaacccaatcaggtgttcag

SEQ ID NO: 185662 - DNA, 25 bp, E. coli
gactcaaacccattcaggtgttcag

SEQ ID NO: 185663 - DNA, 25 bp, E. coli
cgtttggtcgtagtgtgacgcagac

SEQ ID NO: 185664 - DNA, 25 bp, E. coli
cgtttggtcgtactgtgacgcagac

SEQ ID NO: 185665 - DNA, 25 bp, E. coli
tggtttacactgactattgtttggg

SEQ ID NO: 185666 - DNA, 25 bp, E. coli
tggtttacactgtctattgtttggg

SEQ ID NO: 185667 - DNA, 25 bp, E. coli
taatttaagtaagtcagctacgagc

SEQ ID NO: 185668 - DNA, 25 bp, E. coli
taatttaagtaactcagctacgagc

SEQ ID NO: 185669 - DNA, 25 bp, E. coli
tactcaatcgaaaatggcgcagctg

SEQ ID NO: 185670 - DNA, 25 bp, E. coli
tactcaatcgaatatggcgcagctg

SEQ ID NO: 185671 - DNA, 25 bp, E. coli
attgaccctggcgaaaacattccgg

SEQ ID NO: 185672 - DNA, 25 bp, E. coli
attgaccctggccaaaacattccgg

SEQ ID NO: 185673 - DNA, 25 bp, E. coli
aaatgggtgacacacactgaggcac

SEQ ID NO: 185674 - DNA, 25 bp, E. coli
aaacatctgagtatacgggctggtc

SEQ ID NO: 185675 - DNA, 25 bp, E. coli
aaacatctgagtttacgggctggtc

SEQ ID NO: 185676 - DNA, 25 bp, E. coli
aaatgggtgacagacactgaggcac

SEQ ID NO: 185677 - DNA, 25 bp, E. coli
tatatcggtgccatcaaagacggtt

SEQ ID NO: 185678 - DNA, 25 bp, E. coli
tatttacaggtaagggatggagcca

SEQ ID NO: 185679 - DNA, 25 bp, E. coli
tatttacaggtatgggatggagcca

SEQ ID NO: 185680 - DNA, 25 bp, E. coli
tatatcggtgccttcaaagacggtt

SEQ ID NO: 185681 - DNA, 25 bp, E. coli
tgattcagctgatgttacaggccgg

SEQ ID NO: 185682 - DNA, 25 bp, E. coli
tgattcagctgaagttacaggccgg

SEQ ID NO: 185683 - DNA, 25 bp, E. coli
tgaaaatgggctggctacagtgccg

SEQ ID NO: 185684 - DNA, 25 bp, E. coli
tgaaaatgggctcgctacagtgccg

SEQ ID NO: 185685 - DNA, 25 bp, E. coli
gaagaagaccatggcaatgagactg

SEQ ID NO: 185686 - DNA, 25 bp, E. coli
gaagaagaccatcgcaatgagactg

SEQ ID NO: 185687 - DNA, 25 bp, E. coli
cattccgggaagtgtggcagtattt

SEQ ID NO: 185688 - DNA, 25 bp, E. coli
cattccgggaagagtggcagtattt

SEQ ID NO: 185689 - DNA, 25 bp, E. coli
taatactggcgttagtatgcccgcc

SEQ ID NO: 185690 - DNA, 25 bp, E. coli
taatactggcgtaagtatgcccgcc

SEQ ID NO: 185691 - DNA, 25 bp, E. coli
cattttaaagttgtgctggtcagcg

SEQ ID NO: 185692 - DNA, 25 bp, E. coli
cattttaaagttctgctggtcagcg

SEQ ID NO: 185693 - DNA, 25 bp, E. coli
ttccaacccgtattcctcgaagtag

SEQ ID NO: 185694 - DNA, 25 bp, E. coli
ttccaacccgtaatcctcgaagtag

SEQ ID NO: 185695 - DNA, 25 bp, E. coli
ttagcggaggaagtctctactaccg

SEQ ID NO: 185696 - DNA, 25 bp, E. coli
ttagcggaggaactctctactaccg

SEQ ID NO: 185697 - DNA, 25 bp, E. coli
tgatttacagtactttagcggagga

SEQ ID NO: 185698 - DNA, 25 bp, E. coli
tgtcccagccggctctgaaagccat

SEQ ID NO: 185699 - DNA, 25 bp, E. coli
tgtcccagccgggtctgaaagccat

SEQ ID NO: 185700 - DNA, 25 bp, E. coli
tgatttacagtagtttagcggagga

SEQ ID NO: 185701 - DNA, 25 bp, E. coli
tctactaccgttcatgcgctggctc

SEQ ID NO: 185702 - DNA, 25 bp, E. coli
tcagcgatcgttttacgggtgaacg

SEQ ID NO: 185703 - DNA, 25 bp, E. coli
tctactaccgttgatgcgctggctc

SEQ ID NO: 185704 - DNA, 25 bp, E. coli
cctcgaagtagtcgatgaaagctat

SEQ ID NO: 185705 - DNA, 25 bp, E. coli
cctcgaagtagtggatgaaagctat

SEQ ID NO: 185706 - DNA, 25 bp, E. coli
gaaagctatcgtgacaatgtcccag

SEQ ID NO: 185707 - DNA, 25 bp, E. coli
gaaagctatcgtcacaatgtcccag

SEQ ID NO: 185708 - DNA, 25 bp, E. coli
gaacgttttctgaatcgtcatcgaa

SEQ ID NO: 185709 - DNA, 25 bp, E. coli
gaacgttttctgtatcgtcatcgaa

SEQ ID NO: 185710 - DNA, 25 bp, E. coli
gatagaagaaaaattaagggcggcg

SEQ ID NO: 185711 - DNA, 25 bp, E. coli
gatagaagaaaatttaagggcggcg

SEQ ID NO: 185712 - DNA, 25 bp, E. coli
tcagcgatcgttatacgggtgaacg

SEQ ID NO: 185713 - DNA, 25 bp, E. coli
tagtttcagctatacacgagatttc

SEQ ID NO: 185714 - DNA, 25 bp, E. coli
tagtttcagctaaacacgagatttc

SEQ ID NO: 185715 - DNA, 25 bp, E. coli
ttttttcacgaatgcctcagatgca

SEQ ID NO: 185716 - DNA, 25 bp, E. coli
ttttttcacgaaagcctcagatgca

SEQ ID NO: 185717 - DNA, 25 bp, E. coli
tcctccgaggaacgctatgataaat

SEQ ID NO: 185718 - DNA, 25 bp, E. coli
tcctccgaggaaggctatgataaat

SEQ ID NO: 185719 - DNA, 25 bp, E. coli
gccctgaaggtgagcaaacagcatt

SEQ ID NO: 185720 - DNA, 25 bp, E. coli
gccctgaaggtgtgcaaacagcatt

SEQ ID NO: 185721 - DNA, 25 bp, E. coli
gaaaatatccactacacggtccagt

SEQ ID NO: 185722 - DNA, 25 bp, E. coli
gaatcacaacaatccgccaaacttg

SEQ ID NO: 185723 - DNA, 25 bp, E. coli
gaaaatatccacaacacggtccagt

SEQ ID NO: 185724 - DNA, 25 bp, E. coli
gaatcacaacaaaccgccaaacttg

SEQ ID NO: 185725 - DNA, 25 bp, E. coli
cgggttatcaacctcaacagacagc

SEQ ID NO: 185726 - DNA, 25 bp, E. coli
cgggttatcaacgtcaacagacagc

SEQ ID NO: 185727 - DNA, 25 bp, E. coli
gatatcaccgactaaaagttagcac

SEQ ID NO: 185728 - DNA, 25 bp, E. coli
gatatcaccgacaaaaagttagcac

SEQ ID NO: 185729 - DNA, 25 bp, E. coli
ggtacaaatacggatcctccgagga

SEQ ID NO: 185730 - DNA, 25 bp, E. coli
ggtacaaatacgcatcctccgagga

SEQ ID NO: 185731 - DNA, 25 bp, E. coli
taatggtacaactcagcaatgggca

SEQ ID NO: 185732 - DNA, 25 bp, E. coli
taatggtacaacacagcaatgggca

SEQ ID NO: 185733 - DNA, 25 bp, E. coli
gacctgctactagattctgagaaaa

SEQ ID NO: 185734 - DNA, 25 bp, E. coli
gacctgctactacattctgagaaaa

SEQ ID NO: 185735 - DNA, 25 bp, E. coli
aacctggcgggtagcaccgttatcg

SEQ ID NO: 185736 - DNA, 25 bp, E. coli
aacctggcgggttgcaccgttatcg

SEQ ID NO: 185737 - DNA, 25 bp, E. coli
ttactgggacgcaatgaaacctggc

SEQ ID NO: 185738 - DNA, 25 bp, E. coli
ttactgggacgctatgaaacctggc

SEQ ID NO: 185739 - DNA, 25 bp, E. coli
tgtcgcacgaccgaaagtaccactg

SEQ ID NO: 185740 - DNA, 25 bp, E. coli
tgtcgcacgacccaaagtaccactg

SEQ ID NO: 185741 - DNA, 25 bp, E. coli
ttaatcgaagattgtctgaacggtc

SEQ ID NO: 185742 - DNA, 25 bp, E. coli
ttaatcgaagatagtctgaacggtc

SEQ ID NO: 185743 - DNA, 25 bp, E. coli
ccggcggtgatgacgctggtaatct

SEQ ID NO: 185744 - DNA, 25 bp, E. coli
ccggcggtgatgtcgctggtaatct

SEQ ID NO: 185745 - DNA, 25 bp, E. coli
gcactattgttggatgaacgcttaa

SEQ ID NO: 185746 - DNA, 25 bp, E. coli
gcactattgttgcatgaacgcttaa

SEQ ID NO: 185747 - DNA, 25 bp, E. coli
gaaagtaccactgaatttgctgctg

SEQ ID NO: 185748 - DNA, 25 bp, E. coli
gaaagtaccactcaatttgctgctg

SEQ ID NO: 185749 - DNA, 25 bp, E. coli
cgctgattctcgatggttccgcaac

SEQ ID NO: 185750 - DNA, 25 bp, E. coli
cgctgattctcgttggttccgcaac

SEQ ID NO: 185751 - DNA, 25 bp, E. coli
ggttccgcaaccatgattcacagtc

SEQ ID NO: 185752 - DNA, 25 bp, E. coli
ggttccgcaaccttgattcacagtc

SEQ ID NO: 185753 - DNA, 25 bp, E. coli
ggcgtgtggcaacatcttcaataaa

SEQ ID NO: 185754 - DNA, 25 bp, E. coli
ggctttatgttgaccctggcggcag

SEQ ID NO: 185755 - DNA, 25 bp, E. coli
ggcgtgtggcaagatcttcaataaa

SEQ ID NO: 185756 - DNA, 25 bp, E. coli
ggctttatgttgtccctggcggcag

SEQ ID NO: 185757 - DNA, 25 bp, E. coli
cacgagcgccggatggaagtttatt

SEQ ID NO: 185758 - DNA, 25 bp, E. coli
cacgagcgccggttggaagtttatt

SEQ ID NO: 185759 - DNA, 25 bp, E. coli
taggcgataaccacaccagtaaccg

SEQ ID NO: 185760 - DNA, 25 bp, E. coli
taggcgataacctcaccagtaaccg

SEQ ID NO: 185761 - DNA, 25 bp, E. coli
tttgtcgccgatcagtacaccatgg

SEQ ID NO: 185762 - DNA, 25 bp, E. coli
tttgtcgccgatgagtacaccatgg

SEQ ID NO: 185763 - DNA, 25 bp, E. coli
ttttattacaattgcgcacccgcgc

SEQ ID NO: 185764 - DNA, 25 bp, E. coli
ttcaatatggatgatgacgcctgcg

SEQ ID NO: 185765 - DNA, 25 bp, E. coli
ttttattacaatagcgcacccgcgc

SEQ ID NO: 185766 - DNA, 25 bp, E. coli
ttcaatatggatcatgacgcctgcg

SEQ ID NO: 185767 - DNA, 25 bp, E. coli
ccatgtggccgttaaagatttgcgc

SEQ ID NO: 185768 - DNA, 25 bp, E. coli
ccatgtggccgtaaaagatttgcgc

SEQ ID NO: 185769 - DNA, 25 bp, E. coli
gcataacgagcaggcggtgatctcc

SEQ ID NO: 185770 - DNA, 25 bp, E. coli
gcataacgagcacgcggtgatctcc

SEQ ID NO: 185771 - DNA, 25 bp, E. coli
gaagtatctccactcacgttaggcg

SEQ ID NO: 185772 - DNA, 25 bp, E. coli
gaagtatctccagtcacgttaggcg

SEQ ID NO: 185773 - DNA, 25 bp, E. coli
gtaacttgtggaacaccatgccgtg

SEQ ID NO: 185774 - DNA, 25 bp, E. coli
gtaacttgtggatcaccatgccgtg

SEQ ID NO: 185775 - DNA, 25 bp, E. coli
taagacagagcatccacagtgcgca

SEQ ID NO: 185776 - DNA, 25 bp, E. coli
taagacagagcaaccacagtgcgca

SEQ ID NO: 185777 - DNA, 25 bp, E. coli
gacgcctgcgttttccacatgatgg

SEQ ID NO: 185778 - DNA, 25 bp, E. coli
gacgcctgcgttatccacatgatgg

SEQ ID NO: 185779 - DNA, 25 bp, E. coli
caaaaaatgtgacagagtgcaacct

SEQ ID NO: 185780 - DNA, 25 bp, E. coli
cagactttttctgtgcggcagttaa

SEQ ID NO: 185781 - DNA, 25 bp, E. coli
caaaaaatgtgagagagtgcaacct

SEQ ID NO: 185782 - DNA, 25 bp, E. coli
cagactttttctctgcggcagttaa

SEQ ID NO: 185783 - DNA, 25 bp, E. coli
taacatttttgataggtgcaaccgc

SEQ ID NO: 185784 - DNA, 25 bp, E. coli
tgtgagagagtggaacctgatgaaa

SEQ ID NO: 185785 - DNA, 25 bp, E. coli
tgtgagagagtgcaacctgatgaaa

SEQ ID NO: 185786 - DNA, 25 bp, E. coli
tgaaaggtgcaaccgcaaaaaatgt

SEQ ID NO: 185787 - DNA, 25 bp, E. coli
tgcaacctgatgaaaaatagtgtcg

SEQ ID NO: 185788 - DNA, 25 bp, E. coli
tgaaaggtgcaagcgcaaaaaatgt

SEQ ID NO: 185789 - DNA, 25 bp, E. coli
tgcaacctgatgtaaaatagtgtcg

SEQ ID NO: 185790 - DNA, 25 bp, E. coli
tctctgcggcagataacatttttga

SEQ ID NO: 185791 - DNA, 25 bp, E. coli
tctctgcggcagttaacatttttga

SEQ ID NO: 185792 - DNA, 25 bp, E. coli
gaaaaatagtgtggctgagcactaa

SEQ ID NO: 185793 - DNA, 25 bp, E. coli
gaaaaatagtgtcgctgagcactaa

SEQ ID NO: 185794 - DNA, 25 bp, E. coli
ctgatgaaaaatagtgtcgctgagc

SEQ ID NO: 185795 - DNA, 25 bp, E. coli
ctgatgaaaaattgtgtcgctgagc

SEQ ID NO: 185796 - DNA, 25 bp, E. coli
ggtgcaaccgcataaaatgtgagag

SEQ ID NO: 185797 - DNA, 25 bp, E. coli
ggtgcaaccgcaaaaaatgtgagag

SEQ ID NO: 185798 - DNA, 25 bp, E. coli
taactcagacttattctctgcggca

SEQ ID NO: 185799 - DNA, 25 bp, E. coli
taacatttttgaaaggtgcaaccgc

SEQ ID NO: 185800 - DNA, 25 bp, E. coli
taactcagactttttctctgcggca

SEQ ID NO: 185801 - DNA, 25 bp, E. coli
tagcgcattgcaccgtggaaatcat

SEQ ID NO: 185802 - DNA, 25 bp, E. coli
tagcgcattgcagcgtggaaatcat

SEQ ID NO: 185803 - DNA, 25 bp, E. coli
ttcaacaagatgtcgggatctggcc

SEQ ID NO: 185804 - DNA, 25 bp, E. coli
tttattctcttcgtcgccgcagggc

SEQ ID NO: 185805 - DNA, 25 bp, E. coli
ttcaacaagatgacgggatctggcc

SEQ ID NO: 185806 - DNA, 25 bp, E. coli
tttattctcttcctcgccgcagggc

SEQ ID NO: 185807 - DNA, 25 bp, E. coli
tcctgctggcgggatttcaacaaga

SEQ ID NO: 185808 - DNA, 25 bp, E. coli
tcctgctggcggcatttcaacaaga

SEQ ID NO: 185809 - DNA, 25 bp, E. coli
tcttcattaacgtaaccaccggcga

SEQ ID NO: 185810 - DNA, 25 bp, E. coli
tcatgaagccggtttgtggaaccac

SEQ ID NO: 185811 - DNA, 25 bp, E. coli
tcatgaagccggattgtggaaccac

SEQ ID NO: 185812 - DNA, 25 bp, E. coli
tcttcattaacgaaaccaccggcga

SEQ ID NO: 185813 - DNA, 25 bp, E. coli
cattcgcgcattacatgaagccgga

SEQ ID NO: 185814 - DNA, 25 bp, E. coli
cattcgcgcatttcatgaagccgga

SEQ ID NO: 185815 - DNA, 25 bp, E. coli
ggttttctggatccgcaaagtgtcg

SEQ ID NO: 185816 - DNA, 25 bp, E. coli
ggttttctggatgcgcaaagtgtcg

SEQ ID NO: 185817 - DNA, 25 bp, E. coli
tggaaatcatcaaggctgggcgctg

SEQ ID NO: 185818 - DNA, 25 bp, E. coli
tggaaatcatcatggctgggcgctg

SEQ ID NO: 185819 - DNA, 25 bp, E. coli
ggcggtattcgcctcaatcttggtg

SEQ ID NO: 185820 - DNA, 25 bp, E. coli
ggcggtattcgcgtcaatcttggtg

SEQ ID NO: 185821 - DNA, 25 bp, E. coli
gatcgccgtggtgatccttacctgg

SEQ ID NO: 185822 - DNA, 25 bp, E. coli
gatcgccgtggtcatccttacctgg

SEQ ID NO: 185823 - DNA, 25 bp, E. coli
cagagcggtacggtgaaattagcaa

SEQ ID NO: 185824 - DNA, 25 bp, E. coli
cagagcggtacgctgaaattagcaa

SEQ ID NO: 185825 - DNA, 25 bp, E. coli
taaaagatgaaactatcaacgtgtc

SEQ ID NO: 185826 - DNA, 25 bp, E. coli
taaatggatttttatgagcgtactg

SEQ ID NO: 185827 - DNA, 25 bp, E. coli
taaatggattttaatgagcgtactg

SEQ ID NO: 185828 - DNA, 25 bp, E. coli
taaaagatgaaagtatcaacgtgtc

SEQ ID NO: 185829 - DNA, 25 bp, E. coli
tgcgaatttagcaaaagtctgatct

SEQ ID NO: 185830 - DNA, 25 bp, E. coli
tgcgaatttagctaaagtctgatct

SEQ ID NO: 185831 - DNA, 25 bp, E. coli
tctgaaaatgacaatactgatagcc

SEQ ID NO: 185832 - DNA, 25 bp, E. coli
tcataattcttagtcgcaccggaat

SEQ ID NO: 185833 - DNA, 25 bp, E. coli
tctgaaaatgactatactgatagcc

SEQ ID NO: 185834 - DNA, 25 bp, E. coli
tcataattcttactcgcaccggaat

SEQ ID NO: 185835 - DNA, 25 bp, E. coli
cctcaaggtgagtcgtttgccgact

SEQ ID NO: 185836 - DNA, 25 bp, E. coli
cctcaaggtgagacgtttgccgact

SEQ ID NO: 185837 - DNA, 25 bp, E. coli
gcaccggaataaattacacgtttgg

SEQ ID NO: 185838 - DNA, 25 bp, E. coli
gcaccggaataatttacacgtttgg

SEQ ID NO: 185839 - DNA, 25 bp, E. coli
gactatagtacgacacagagcggta

SEQ ID NO: 185840 - DNA, 25 bp, E. coli
gactatagtacgtcacagagcggta

SEQ ID NO: 185841 - DNA, 25 bp, E. coli
gatcttactctgactcaccgatgca

SEQ ID NO: 185842 - DNA, 25 bp, E. coli
gatcttactctgtctcaccgatgca

SEQ ID NO: 185843 - DNA, 25 bp, E. coli
tcaccgatgcagcataaatattttc

SEQ ID NO: 185844 - DNA, 25 bp, E. coli
tcaccgatgcaggataaatattttc

SEQ ID NO: 185845 - DNA, 25 bp, E. coli
catttgtaagattgtaaggtgtcag

SEQ ID NO: 185846 - DNA, 25 bp, E. coli
catttgtaagatagtaaggtgtcag

SEQ ID NO: 185847 - DNA, 25 bp, E. coli
taacatgacatggtcgaattacaga

SEQ ID NO: 185848 - DNA, 25 bp, E. coli
agaaggtctgaatcaaactctacag

SEQ ID NO: 185849 - DNA, 25 bp, E. coli
agaaggtctgaaacaaactctacag

SEQ ID NO: 185850 - DNA, 25 bp, E. coli
tatctctcttgtagtaccgaatgcg

SEQ ID NO: 185851 - DNA, 25 bp, E. coli
tatctctcttgttgtaccgaatgcg

SEQ ID NO: 185852 - DNA, 25 bp, E. coli
tcaaactctacacattgctcatcgt

SEQ ID NO: 185853 - DNA, 25 bp, E. coli
tcaaactctacagattgctcatcgt

SEQ ID NO: 185854 - DNA, 25 bp, E. coli
gaattcacgcgttttatgctcgcgg

SEQ ID NO: 185855 - DNA, 25 bp, E. coli
gaattcacgcgtattatgctcgcgg

SEQ ID NO: 185856 - DNA, 25 bp, E. coli
gttgtaccgaatccgcgaattcacg

SEQ ID NO: 185857 - DNA, 25 bp, E. coli
gattgctcatcgtttcatgccggat

SEQ ID NO: 185858 - DNA, 25 bp, E. coli
gattgctcatcgattcatgccggat

SEQ ID NO: 185859 - DNA, 25 bp, E. coli
gttgtaccgaatgcgcgaattcacg

SEQ ID NO: 185860 - DNA, 25 bp, E. coli
gggcacggataagcgggaaaatata

SEQ ID NO: 185861 - DNA, 25 bp, E. coli
gggcacggataaccgggaaaatata

SEQ ID NO: 185862 - DNA, 25 bp, E. coli
gtcagaaagatgacaaggcggtgac

SEQ ID NO: 185863 - DNA, 25 bp, E. coli
gtcagaaagatgtcaaggcggtgac

SEQ ID NO: 185864 - DNA, 25 bp, E. coli
taagcgggaaaaaatagaaggtctg

SEQ ID NO: 185865 - DNA, 25 bp, E. coli
taacatgacatgctcgaattacaga

SEQ ID NO: 185866 - DNA, 25 bp, E. coli
taagcgggaaaatatagaaggtctg

SEQ ID NO: 185867 - DNA, 25 bp, E. coli
ctctacgggtttgacatcgcgtttt

SEQ ID NO: 185868 - DNA, 25 bp, E. coli
caggttccggttgtggctctaccac

SEQ ID NO: 185869 - DNA, 25 bp, E. coli
caggttccggttctggctctaccac

SEQ ID NO: 185870 - DNA, 25 bp, E. coli
cggacgcgactctacgggtttgaca

SEQ ID NO: 185871 - DNA, 25 bp, E. coli
cggacgcgactcaacgggtttgaca

SEQ ID NO: 185872 - DNA, 25 bp, E. coli
ctctacgggtttcacatcgcgtttt

SEQ ID NO: 185873 - DNA, 25 bp, E. coli
taggtttcggcttcggcttttcaat

SEQ ID NO: 185874 - DNA, 25 bp, E. coli
taggtttcggctacggcttttcaat

SEQ ID NO: 185875 - DNA, 25 bp, E. coli
acggtgatgccgcacgcgactctac

SEQ ID NO: 185876 - DNA, 25 bp, E. coli
acggtgatgccggacgcgactctac

SEQ ID NO: 185877 - DNA, 25 bp, E. coli
tttggcttaggtatcggcttcggct

SEQ ID NO: 185878 - DNA, 25 bp, E. coli
tttggcttaggtttcggcttcggct

SEQ ID NO: 185879 - DNA, 25 bp, E. coli
ttcaccggcttccgttttggcttag

SEQ ID NO: 185880 - DNA, 25 bp, E. coli
ttcaccggcttcggttttggcttag

SEQ ID NO: 185881 - DNA, 25 bp, E. coli
gccgtattttcatacggtgatgccg

SEQ ID NO: 185882 - DNA, 25 bp, E. coli
gccgtattttcaaacggtgatgccg

SEQ ID NO: 185883 - DNA, 25 bp, E. coli
gcttcggcttttgaatgaccaccgg

SEQ ID NO: 185884 - DNA, 25 bp, E. coli
gcttcggcttttcaatgaccaccgg

SEQ ID NO: 185885 - DNA, 25 bp, E. coli
cgactctacgggattgacatcgcgt

SEQ ID NO: 185886 - DNA, 25 bp, E. coli
cgactctacgggtttgacatcgcgt

SEQ ID NO: 185887 - DNA, 25 bp, E. coli
gatcggctcaggttccggttctggc

SEQ ID NO: 185888 - DNA, 25 bp, E. coli
gatcggctcaggatccggttctggc

SEQ ID NO: 185889 - DNA, 25 bp, E. coli
cacagactgaattgcccctgcgcat

SEQ ID NO: 185890 - DNA, 25 bp, E. coli
cacagactgaatagcccctgcgcat

SEQ ID NO: 185891 - DNA, 25 bp, E. coli
catcgaagggataactgaatgccat

SEQ ID NO: 185892 - DNA, 25 bp, E. coli
cattgttgcggcgacagactgaatt

SEQ ID NO: 185893 - DNA, 25 bp, E. coli
catcgaagggattactgaatgccat

SEQ ID NO: 185894 - DNA, 25 bp, E. coli
cattgttgcggccacagactgaatt

SEQ ID NO: 185895 - DNA, 25 bp, E. coli
actgaattgcccctgcgcattgcgc

SEQ ID NO: 185896 - DNA, 25 bp, E. coli
actgaattgcccgtgcgcattgcgc

SEQ ID NO: 185897 - DNA, 25 bp, E. coli
ttgcggccacagactgaattgcccc

SEQ ID NO: 185898 - DNA, 25 bp, E. coli
ttgcggccacagtctgaattgcccc

SEQ ID NO: 185899 - DNA, 25 bp, E. coli
tgttgcggccacagactgaattgcc

SEQ ID NO: 185900 - DNA, 25 bp, E. coli
tgttgcggccactgactgaattgcc

SEQ ID NO: 185901 - DNA, 25 bp, E. coli
tgaattgcccctgcgcattgcgcaa

SEQ ID NO: 185902 - DNA, 25 bp, E. coli
tgaattgcccctccgcattgcgcaa

SEQ ID NO: 185903 - DNA, 25 bp, E. coli
tcatcgaagggattactgaatgcca

SEQ ID NO: 185904 - DNA, 25 bp, E. coli
tcatcgaagggaatactgaatgcca

SEQ ID NO: 185905 - DNA, 25 bp, E. coli
gcggccacagactgaattgcccctg

SEQ ID NO: 185906 - DNA, 25 bp, E. coli
gcggccacagacagaattgcccctg

SEQ ID NO: 185907 - DNA, 25 bp, E. coli
ggccacagactgtattgcccctgcg

SEQ ID NO: 185908 - DNA, 25 bp, E. coli
ggccacagactgaattgcccctgcg

SEQ ID NO: 185909 - DNA, 25 bp, E. coli
gatcatcgaagggattactgaatgc

SEQ ID NO: 185910 - DNA, 25 bp, E. coli
gatcatcgaaggcattactgaatgc

SEQ ID NO: 185911 - DNA, 25 bp, E. coli
aacgttactattatttgctactgcg

SEQ ID NO: 185912 - DNA, 25 bp, E. coli
tactgcgctgtgagaaattattgga

SEQ ID NO: 185913 - DNA, 25 bp, E. coli
tactgcgctgtgtgaaattattgga

SEQ ID NO: 185914 - DNA, 25 bp, E. coli
agtatctggctgatgcttccggcgg

SEQ ID NO: 185915 - DNA, 25 bp, E. coli
agtatctggctgttgcttccggcgg

SEQ ID NO: 185916 - DNA, 25 bp, E. coli
aacgttactattttttgctactgcg

SEQ ID NO: 185917 - DNA, 25 bp, E. coli
aactgactctttttgactggacggg

SEQ ID NO: 185918 - DNA, 25 bp, E. coli
aactgactctttatgactggacggg

SEQ ID NO: 185919 - DNA, 25 bp, E. coli
tatggtggcgtttatgtctgcacgg

SEQ ID NO: 185920 - DNA, 25 bp, E. coli
tatggtggcgttaatgtctgcacgg

SEQ ID NO: 185921 - DNA, 25 bp, E. coli
tttcactggcgctgtttgtctggtt

SEQ ID NO: 185922 - DNA, 25 bp, E. coli
tttcactggcgcagtttgtctggtt

SEQ ID NO: 185923 - DNA, 25 bp, E. coli
ttgtctggttgttaacgttgcatcc

SEQ ID NO: 185924 - DNA, 25 bp, E. coli
ttgtggatggcgtgaaactgactct

SEQ ID NO: 185925 - DNA, 25 bp, E. coli
ttgtggatggcgagaaactgactct

SEQ ID NO: 185926 - DNA, 25 bp, E. coli
ttgtctggttgtaaacgttgcatcc

SEQ ID NO: 185927 - DNA, 25 bp, E. coli
tgtttacgcggcatatggtggcgtt

SEQ ID NO: 185928 - DNA, 25 bp, E. coli
tgtttacgcggcttatggtggcgtt

SEQ ID NO: 185929 - DNA, 25 bp, E. coli
gcgtttatgtctccacggcgttgat

SEQ ID NO: 185930 - DNA, 25 bp, E. coli
gcgtttatgtctgcacggcgttgat

SEQ ID NO: 185931 - DNA, 25 bp, E. coli
cgctttgcggcatgttgatcattgt

SEQ ID NO: 185932 - DNA, 25 bp, E. coli
cgctttgcggcaagttgatcattgt

SEQ ID NO: 185933 - DNA, 25 bp, E. coli
taaatgtgcttaagaaaggcttgtc

SEQ ID NO: 185934 - DNA, 25 bp, E. coli
taaatgtgcttatgaaaggcttgtc

SEQ ID NO: 185935 - DNA, 25 bp, E. coli
tatgaatgtatgattagtggcaggt

SEQ ID NO: 185936 - DNA, 25 bp, E. coli
tatgaatgtatgtttagtggcaggt

SEQ ID NO: 185937 - DNA, 25 bp, E. coli
tttttataccagttaatcgtgagca

SEQ ID NO: 185938 - DNA, 25 bp, E. coli
tttttataccagataatcgtgagca

SEQ ID NO: 185939 - DNA, 25 bp, E. coli
tgttacgcacaataaatatcttgag

SEQ ID NO: 185940 - DNA, 25 bp, E. coli
tgttacgcacaaaaaatatcttgag

SEQ ID NO: 185941 - DNA, 25 bp, E. coli
ccatgggtggaaagtagcaagtatt

SEQ ID NO: 185942 - DNA, 25 bp, E. coli
ccatgggtggaatgtagcaagtatt

SEQ ID NO: 185943 - DNA, 25 bp, E. coli
gcttatcagtttggtatgagttcaa

SEQ ID NO: 185944 - DNA, 25 bp, E. coli
gcaggttgttgtttgggaactctcc

SEQ ID NO: 185945 - DNA, 25 bp, E. coli
gcaggttgttgtatgggaactctcc

SEQ ID NO: 185946 - DNA, 25 bp, E. coli
gcttatcagtttcgtatgagttcaa

SEQ ID NO: 185947 - DNA, 25 bp, E. coli
gaatcaataagtagcctgtcatcga

SEQ ID NO: 185948 - DNA, 25 bp, E. coli
gaatcaataagttgcctgtcatcga

SEQ ID NO: 185949 - DNA, 25 bp, E. coli
gttcaaagactgagtatactcatat

SEQ ID NO: 185950 - DNA, 25 bp, E. coli
gttcaaagactgtgtatactcatat

SEQ ID NO: 185951 - DNA, 25 bp, E. coli
gggaactctccacataaattaacca

SEQ ID NO: 185952 - DNA, 25 bp, E. coli
gggaactctccagataaattaacca

SEQ ID NO: 185953 - DNA, 25 bp, E. coli
tgagcaggcattctattactattgg

SEQ ID NO: 185954 - DNA, 25 bp, E. coli
tgagcaggcattgtattactattgg

SEQ ID NO: 185955 - DNA, 25 bp, E. coli
tacgctttacagtcggcggtgaaac

SEQ ID NO: 185956 - DNA, 25 bp, E. coli
tacgctttacagacggcggtgaaac

SEQ ID NO: 185957 - DNA, 25 bp, E. coli
tatccagacgatgcagtgaaaattg

SEQ ID NO: 185958 - DNA, 25 bp, E. coli
tatcgctatgcatacagctgtcggg

SEQ ID NO: 185959 - DNA, 25 bp, E. coli
tatccagacgatccagtgaaaattg

SEQ ID NO: 185960 - DNA, 25 bp, E. coli
tatcgctatgcaaacagctgtcggg

SEQ ID NO: 185961 - DNA, 25 bp, E. coli
ttttgccggaggttagcagcagatc

SEQ ID NO: 185962 - DNA, 25 bp, E. coli
ttttgccggaggatagcagcagatc

SEQ ID NO: 185963 - DNA, 25 bp, E. coli
gcagatcgctgcacaatgtccgtca

SEQ ID NO: 185964 - DNA, 25 bp, E. coli
gcaaccgctgcgaaatgtcgtctat

SEQ ID NO: 185965 - DNA, 25 bp, E. coli
gcaaccgctgcgtaatgtcgtctat

SEQ ID NO: 185966 - DNA, 25 bp, E. coli
gcagatcgctgctcaatgtccgtca

SEQ ID NO: 185967 - DNA, 25 bp, E. coli
gaagattatctctttgcagcccctc

SEQ ID NO: 185968 - DNA, 25 bp, E. coli
gaagattatctcattgcagcccctc

SEQ ID NO: 185969 - DNA, 25 bp, E. coli
gaaaaggtgacaatggcgcaacgaa

SEQ ID NO: 185970 - DNA, 25 bp, E. coli
gaaaaggtgacattggcgcaacgaa

SEQ ID NO: 185971 - DNA, 25 bp, E. coli
gatacgcctccgtcgcctgttaggt

SEQ ID NO: 185972 - DNA, 25 bp, E. coli
gatacgcctccgacgcctgttaggt

SEQ ID NO: 185973 - DNA, 25 bp, E. coli
taagaagttccgtcgatgatggcgc

SEQ ID NO: 185974 - DNA, 25 bp, E. coli
taagaagttccgacgatgatggcgc

SEQ ID NO: 185975 - DNA, 25 bp, E. coli
ggcgtcccggccagctggaatttat

SEQ ID NO: 185976 - DNA, 25 bp, E. coli
ggcgtcccggcctgctggaatttat

SEQ ID NO: 185977 - DNA, 25 bp, E. coli
catgtccttattattacgctctgta

SEQ ID NO: 185978 - DNA, 25 bp, E. coli
catgtccttatttttacgctctgta

SEQ ID NO: 185979 - DNA, 25 bp, E. coli
catgcacaatgtctatttttacttg

SEQ ID NO: 185980 - DNA, 25 bp, E. coli
catgcacaatgtgtatttttacttg

SEQ ID NO: 185981 - DNA, 25 bp, E. coli
tatggagggcatttgagcaacctac

SEQ ID NO: 185982 - DNA, 25 bp, E. coli
tatggagggcatatgagcaacctac

SEQ ID NO: 185983 - DNA, 25 bp, E. coli
ttattcgtgtttactatggagggca

SEQ ID NO: 185984 - DNA, 25 bp, E. coli
ttacgctctgtagtggaaccatcca

SEQ ID NO: 185985 - DNA, 25 bp, E. coli
ttattcgtgttttctatggagggca

SEQ ID NO: 185986 - DNA, 25 bp, E. coli
ttacgctctgtactggaaccatcca

SEQ ID NO: 185987 - DNA, 25 bp, E. coli
tgtattcgcaaagtacatattgtat

SEQ ID NO: 185988 - DNA, 25 bp, E. coli
tgtattcgcaaactacatattgtat

SEQ ID NO: 185989 - DNA, 25 bp, E. coli
tgtatttttacttgtattcgcaaag

SEQ ID NO: 185990 - DNA, 25 bp, E. coli
tgtatttttactagtattcgcaaag

SEQ ID NO: 185991 - DNA, 25 bp, E. coli
tcataccatttctttttcatgtcct

SEQ ID NO: 185992 - DNA, 25 bp, E. coli
tcataccatttcattttcatgtcct

SEQ ID NO: 185993 - DNA, 25 bp, E. coli
tctgtactggaaccatccatgcaca

SEQ ID NO: 185994 - DNA, 25 bp, E. coli
tctgtactggaagcatccatgcaca

SEQ ID NO: 185995 - DNA, 25 bp, E. coli
tggaaccatccatgcacaatgtgta

SEQ ID NO: 185996 - DNA, 25 bp, E. coli
tggagggcatatcagcaacctacga

SEQ ID NO: 185997 - DNA, 25 bp, E. coli
tggagggcatatgagcaacctacga

SEQ ID NO: 185998 - DNA, 25 bp, E. coli
tggaaccatccaagcacaatgtgta

SEQ ID NO: 185999 - DNA, 25 bp, E. coli
caaccataaaggacgagggcgctta

SEQ ID NO: 186000 - DNA, 25 bp, E. coli
caaccataaaggtcgagggcgctta

SEQ ID NO: 186001 - DNA, 25 bp, E. coli
tagcaaaacgccctcaaccataaag

SEQ ID NO: 186002 - DNA, 25 bp, E. coli
tagcaaaacgccgtcaaccataaag

SEQ ID NO: 186003 - DNA, 25 bp, E. coli
ataactcaagttttataatcgaggg

SEQ ID NO: 186004 - DNA, 25 bp, E. coli
ataactcaagttatataatcgaggg

SEQ ID NO: 186005 - DNA, 25 bp, E. coli
acaatgttcaacaaaggtcagtgac

SEQ ID NO: 186006 - DNA, 25 bp, E. coli
acaatgttcaactaaggtcagtgac

SEQ ID NO: 186007 - DNA, 25 bp, E. coli
tttcgttaggcagttttgggtgtga

SEQ ID NO: 186008 - DNA, 25 bp, E. coli
tttcgttaggcacttttgggtgtga

SEQ ID NO: 186009 - DNA, 25 bp, E. coli
taagatgttaaaaacccgctatccg

SEQ ID NO: 186010 - DNA, 25 bp, E. coli
gctatccgttaaaaaacaatgttca

SEQ ID NO: 186011 - DNA, 25 bp, E. coli
gctatccgttaataaacaatgttca

SEQ ID NO: 186012 - DNA, 25 bp, E. coli
gaaaatggtgatcgcgttcatagca

SEQ ID NO: 186013 - DNA, 25 bp, E. coli
gaaaatggtgatggcgttcatagca

SEQ ID NO: 186014 - DNA, 25 bp, E. coli
ggtcgagggcgcttaagatgttaaa

SEQ ID NO: 186015 - DNA, 25 bp, E. coli
gggagactactgaataactcaagtt

SEQ ID NO: 186016 - DNA, 25 bp, E. coli
ggtcagtgacatagcgctaaaaaag

SEQ ID NO: 186017 - DNA, 25 bp, E. coli
ggtcgagggcgcataagatgttaaa

SEQ ID NO: 186018 - DNA, 25 bp, E. coli
gggagactactgtataactcaagtt

SEQ ID NO: 186019 - DNA, 25 bp, E. coli
ggtcagtgacattgcgctaaaaaag

SEQ ID NO: 186020 - DNA, 25 bp, E. coli
taagatgttaaatacccgctatccg

SEQ ID NO: 186021 - DNA, 25 bp, E. coli
taggtgaacgcatcttctgggatcc

SEQ ID NO: 186022 - DNA, 25 bp, E. coli
taggtgaacgcaacttctgggatcc

SEQ ID NO: 186023 - DNA, 25 bp, E. coli
tgatgcgatgctgttaggtgaacgc

SEQ ID NO: 186024 - DNA, 25 bp, E. coli
tgatgcgatgctcttaggtgaacgc

SEQ ID NO: 186025 - DNA, 25 bp, E. coli
tgaacgcatcttctgggatccagca

SEQ ID NO: 186026 - DNA, 25 bp, E. coli
tgaacgcatcttgtgggatccagca

SEQ ID NO: 186027 - DNA, 25 bp, E. coli
tgcgatgctgtttggtgaacgcatc

SEQ ID NO: 186028 - DNA, 25 bp, E. coli
tgcgatgctgttaggtgaacgcatc

SEQ ID NO: 186029 - DNA, 25 bp, E. coli
tcttctgggatccagcaaccgatac

SEQ ID NO: 186030 - DNA, 25 bp, E. coli
tcttctgggatcgagcaaccgatac

SEQ ID NO: 186031 - DNA, 25 bp, E. coli
gctgttaggtgatcgcatcttctgg

SEQ ID NO: 186032 - DNA, 25 bp, E. coli
gcatcttctgggatccagcaaccga

SEQ ID NO: 186033 - DNA, 25 bp, E. coli
gcatcttctgggttccagcaaccga

SEQ ID NO: 186034 - DNA, 25 bp, E. coli
gctgttaggtgaacgcatcttctgg

SEQ ID NO: 186035 - DNA, 25 bp, E. coli
cttctgggatccagcaaccgatacc

SEQ ID NO: 186036 - DNA, 25 bp, E. coli
cttctgggatcctgcaaccgatacc

SEQ ID NO: 186037 - DNA, 25 bp, E. coli
gttaggtgaacgcatcttctgggat

SEQ ID NO: 186038 - DNA, 25 bp, E. coli
gttaggtgaacggatcttctgggat

SEQ ID NO: 186039 - DNA, 25 bp, E. coli
ggtgaacgcatcttctgggatccag

SEQ ID NO: 186040 - DNA, 25 bp, E. coli
ggtgaacgcatcatctgggatccag

SEQ ID NO: 186041 - DNA, 25 bp, E. coli
gatgcgatgctgataggtgaacgca

SEQ ID NO: 186042 - DNA, 25 bp, E. coli
gatgcgatgctgttaggtgaacgca

SEQ ID NO: 186043 - DNA, 25 bp, E. coli
cacttaaagcgattggtccggtcga

SEQ ID NO: 186044 - DNA, 25 bp, E. coli
cacttaaagcgaatggtccggtcga

SEQ ID NO: 186045 - DNA, 25 bp, E. coli
tacgaggagactctgaatggcgctc

SEQ ID NO: 186046 - DNA, 25 bp, E. coli
tatcgaaggaaacccggatgcggtc

SEQ ID NO: 186047 - DNA, 25 bp, E. coli
tacgaggagactgtgaatggcgctc

SEQ ID NO: 186048 - DNA, 25 bp, E. coli
tatcgaaggaaagccggatgcggtc

SEQ ID NO: 186049 - DNA, 25 bp, E. coli
tacgcggaaggctataacggaggca

SEQ ID NO: 186050 - DNA, 25 bp, E. coli
tacgcggaaggcaataacggaggca

SEQ ID NO: 186051 - DNA, 25 bp, E. coli
tgagatgccgatgcttggaagaaac

SEQ ID NO: 186052 - DNA, 25 bp, E. coli
tggtccgctagcagaaacgctgacg

SEQ ID NO: 186053 - DNA, 25 bp, E. coli
tggtccgctagctgaaacgctgacg

SEQ ID NO: 186054 - DNA, 25 bp, E. coli
tgggaccgatcaccctacgaggaga

SEQ ID NO: 186055 - DNA, 25 bp, E. coli
tgggaccgatcagcctacgaggaga

SEQ ID NO: 186056 - DNA, 25 bp, E. coli
tgagatgccgatccttggaagaaac

SEQ ID NO: 186057 - DNA, 25 bp, E. coli
tcggttggatgacaaagcccgccgt

SEQ ID NO: 186058 - DNA, 25 bp, E. coli
tcggttggatgagaaagcccgccgt

SEQ ID NO: 186059 - DNA, 25 bp, E. coli
tcagtgctacctgttcgacgcgcag

SEQ ID NO: 186060 - DNA, 25 bp, E. coli
tcagtgctacctcttcgacgcgcag

SEQ ID NO: 186061 - DNA, 25 bp, E. coli
gaagaaacggtgaagtcgcctggaa

SEQ ID NO: 186062 - DNA, 25 bp, E. coli
gaagaaacggtgtagtcgcctggaa

SEQ ID NO: 186063 - DNA, 25 bp, E. coli
gttaccgcattgcactacgccgagg

SEQ ID NO: 186064 - DNA, 25 bp, E. coli
gttaccgcattggactacgccgagg

SEQ ID NO: 186065 - DNA, 25 bp, E. coli
catatgaacggctcttaacctgtgc

SEQ ID NO: 186066 - DNA, 25 bp, E. coli
catatgaacggcacttaacctgtgc

SEQ ID NO: 186067 - DNA, 25 bp, E. coli
taaacaaatgttaagcgggcgacaa

SEQ ID NO: 186068 - DNA, 25 bp, E. coli
taaacaaatgtttagcgggcgacaa

SEQ ID NO: 186069 - DNA, 25 bp, E. coli
ttttgaaggtgtttcaccgggcacg

SEQ ID NO: 186070 - DNA, 25 bp, E. coli
ttttgaaggtgtatcaccgggcacg

SEQ ID NO: 186071 - DNA, 25 bp, E. coli
ttgaaattaagatagccgtgcaggc

SEQ ID NO: 186072 - DNA, 25 bp, E. coli
ttgaaattaagaaagccgtgcaggc

SEQ ID NO: 186073 - DNA, 25 bp, E. coli
tgtgttttagcatgagacgtcgttc

SEQ ID NO: 186074 - DNA, 25 bp, E. coli
tgtgctaaaaaacgaaaggacggca

SEQ ID NO: 186075 - DNA, 25 bp, E. coli
tgtgttttagcaagagacgtcgttc

SEQ ID NO: 186076 - DNA, 25 bp, E. coli
tgtgctaaaaaaggaaaggacggca

SEQ ID NO: 186077 - DNA, 25 bp, E. coli
tccgggagcctctactattcatatg

SEQ ID NO: 186078 - DNA, 25 bp, E. coli
tcgttcagtttagctcttccgggag

SEQ ID NO: 186079 - DNA, 25 bp, E. coli
tcgttcagtttacctcttccgggag

SEQ ID NO: 186080 - DNA, 25 bp, E. coli
tccgggagcctcaactattcatatg

SEQ ID NO: 186081 - DNA, 25 bp, E. coli
gaatttagcgtttctggcgagcctg

SEQ ID NO: 186082 - DNA, 25 bp, E. coli
gaatttagcgttactggcgagcctg

SEQ ID NO: 186083 - DNA, 25 bp, E. coli
gacaccgcgcttacagccaaatgaa

SEQ ID NO: 186084 - DNA, 25 bp, E. coli
gacaccgcgctttcagccaaatgaa

SEQ ID NO: 186085 - DNA, 25 bp, E. coli
taattttcctgacgcggatgacacc

SEQ ID NO: 186086 - DNA, 25 bp, E. coli
taattttcctgaggcggatgacacc

SEQ ID NO: 186087 - DNA, 25 bp, E. coli
aaacagcgggaatctgggcgccaat

SEQ ID NO: 186088 - DNA, 25 bp, E. coli
aaacagcgggaaactgggcgccaat

SEQ ID NO: 186089 - DNA, 25 bp, E. coli
tacgatttcgcactttacagcctgg

SEQ ID NO: 186090 - DNA, 25 bp, E. coli
tacgatttcgcagtttacagcctgg

SEQ ID NO: 186091 - DNA, 25 bp, E. coli
tattacccactttcgaaacagcggg

SEQ ID NO: 186092 - DNA, 25 bp, E. coli
tattacccacttacgaaacagcggg

SEQ ID NO: 186093 - DNA, 25 bp, E. coli
ttacgtctggcacaaaacggcggct

SEQ ID NO: 186094 - DNA, 25 bp, E. coli
ttacgtctggcagaaaacggcggct

SEQ ID NO: 186095 - DNA, 25 bp, E. coli
tgtgacaaatcttgccgaaacctgg

SEQ ID NO: 186096 - DNA, 25 bp, E. coli
tgggaatcgccagcacgttgatcgg

SEQ ID NO: 186097 - DNA, 25 bp, E. coli
tgtgacaaatctagccgaaacctgg

SEQ ID NO: 186098 - DNA, 25 bp, E. coli
tgggaatcgccaccacgttgatcgg

SEQ ID NO: 186099 - DNA, 25 bp, E. coli
tctcggcagcgcactggaatactac

SEQ ID NO: 186100 - DNA, 25 bp, E. coli
tctcggcagcgctctggaatactac

SEQ ID NO: 186101 - DNA, 25 bp, E. coli
cctaatcaggaaccgggaatggcgc

SEQ ID NO: 186102 - DNA, 25 bp, E. coli
cctaatcaggaagcgggaatggcgc

SEQ ID NO: 186103 - DNA, 25 bp, E. coli
gagccgccgtacagatgaccgaata

SEQ ID NO: 186104 - DNA, 25 bp, E. coli
gagccgccgtactgatgaccgaata

SEQ ID NO: 186105 - DNA, 25 bp, E. coli
gaatatgctcctcacggcaaacggg

SEQ ID NO: 186106 - DNA, 25 bp, E. coli
gaatatgctcctgacggcaaacggg

SEQ ID NO: 186107 - DNA, 25 bp, E. coli
gaaatttgctgataacatcacgccg

SEQ ID NO: 186108 - DNA, 25 bp, E. coli
gaaatttgctgaaaacatcacgccg

SEQ ID NO: 186109 - DNA, 25 bp, E. coli
caggttgtacctgtcaacgtgcggg

SEQ ID NO: 186110 - DNA, 25 bp, E. coli
caggttgtacctctcaacgtgcggg

SEQ ID NO: 186111 - DNA, 25 bp, E. coli
ttgtacctctcaacgtgcgggggtt

SEQ ID NO: 186112 - DNA, 25 bp, E. coli
ttgtacctctcatcgtgcgggggtt

SEQ ID NO: 186113 - DNA, 25 bp, E. coli
ttgtcaggttgttcctctcaacgtg

SEQ ID NO: 186114 - DNA, 25 bp, E. coli
ttgtcaggttgtacctctcaacgtg

SEQ ID NO: 186115 - DNA, 25 bp, E. coli
tgtcaggttgtagctctcaacgtgc

SEQ ID NO: 186116 - DNA, 25 bp, E. coli
tgttgtcaggttctacctctcaacg

SEQ ID NO: 186117 - DNA, 25 bp, E. coli
tgttgtcaggttgtacctctcaacg

SEQ ID NO: 186118 - DNA, 25 bp, E. coli
tgtcaggttgtacctctcaacgtgc

SEQ ID NO: 186119 - DNA, 25 bp, E. coli
tcaggttgtaccactcaacgtgcgg

SEQ ID NO: 186120 - DNA, 25 bp, E. coli
tctggttcaagaatagcccccgttc

SEQ ID NO: 186121 - DNA, 25 bp, E. coli
tcaggttgtacctctcaacgtgcgg

SEQ ID NO: 186122 - DNA, 25 bp, E. coli
tctgttgtcaggatgtacctctcaa

SEQ ID NO: 186123 - DNA, 25 bp, E. coli
tctggttcaagattagcccccgttc

SEQ ID NO: 186124 - DNA, 25 bp, E. coli
tctgttgtcaggttgtacctctcaa

SEQ ID NO: 186125 - DNA, 25 bp, E. coli
cccgttctgttgtcaggttgtacct

SEQ ID NO: 186126 - DNA, 25 bp, E. coli
cccgttctgttgacaggttgtacct

SEQ ID NO: 186127 - DNA, 25 bp, E. coli
cgttctgttgtcaggttgtacctct

SEQ ID NO: 186128 - DNA, 25 bp, E. coli
cgttctgttgtctggttgtacctct

SEQ ID NO: 186129 - DNA, 25 bp, E. coli
gttctgttgtcacgttgtacctctc

SEQ ID NO: 186130 - DNA, 25 bp, E. coli
gttctgttgtcaggttgtacctctc

SEQ ID NO: 186131 - DNA, 25 bp, E. coli
cagccggcgtcgaagtgatctatcc

SEQ ID NO: 186132 - DNA, 25 bp, E. coli
cagccggcgtcgtagtgatctatcc

SEQ ID NO: 186133 - DNA, 25 bp, E. coli
tatgaagcgggtgtctatagccaga

SEQ ID NO: 186134 - DNA, 25 bp, E. coli
tatgaagcgggtctctatagccaga

SEQ ID NO: 186135 - DNA, 25 bp, E. coli
ttgccgattatgaacccgatttggg

SEQ ID NO: 186136 - DNA, 25 bp, E. coli
ttcgcaccgttgacgatctcgcagg

SEQ ID NO: 186137 - DNA, 25 bp, E. coli
ttgccgattatgtacccgatttggg

SEQ ID NO: 186138 - DNA, 25 bp, E. coli
ttaacccagggccttattgacggcg

SEQ ID NO: 186139 - DNA, 25 bp, E. coli
ttaacccagggcgttattgacggcg

SEQ ID NO: 186140 - DNA, 25 bp, E. coli
ttcgcaccgttgtcgatctcgcagg

SEQ ID NO: 186141 - DNA, 25 bp, E. coli
tgttgaaaaccaagcaggcagccgg

SEQ ID NO: 186142 - DNA, 25 bp, E. coli
tgttgaaaaccatgcaggcagccgg

SEQ ID NO: 186143 - DNA, 25 bp, E. coli
tcaattcccggaatggacaccaggt

SEQ ID NO: 186144 - DNA, 25 bp, E. coli
tcaattcccggattggacaccaggt

SEQ ID NO: 186145 - DNA, 25 bp, E. coli
ggaccattccagaagaaagcacgcg

SEQ ID NO: 186146 - DNA, 25 bp, E. coli
ggaccattccagtagaaagcacgcg

SEQ ID NO: 186147 - DNA, 25 bp, E. coli
taattatctctaaggcactcgacag

SEQ ID NO: 186148 - DNA, 25 bp, E. coli
taattatctctatggcactcgacag

SEQ ID NO: 186149 - DNA, 25 bp, E. coli
gatgtcaccgagcaagccatgatgg

SEQ ID NO: 186150 - DNA, 25 bp, E. coli
gaccgtatctgagtgacgatccgca

SEQ ID NO: 186151 - DNA, 25 bp, E. coli
gatgtcaccgaggaagccatgatgg

SEQ ID NO: 186152 - DNA, 25 bp, E. coli
gaccgtatctgactgacgatccgca

SEQ ID NO: 186153 - DNA, 25 bp, E. coli
taaatccagtcaacctgcccgtaga

SEQ ID NO: 186154 - DNA, 25 bp, E. coli
taaatccagtcatcctgcccgtaga

SEQ ID NO: 186155 - DNA, 25 bp, E. coli
aaacagctgggcattcggttgctta

SEQ ID NO: 186156 - DNA, 25 bp, E. coli
aaacagctgggctttcggttgctta

SEQ ID NO: 186157 - DNA, 25 bp, E. coli
tagcgattacctttaatgtcacgaa

SEQ ID NO: 186158 - DNA, 25 bp, E. coli
tatcatcctgttgtcccgcttcgtt

SEQ ID NO: 186159 - DNA, 25 bp, E. coli
tagcgattacctataatgtcacgaa

SEQ ID NO: 186160 - DNA, 25 bp, E. coli
tatcatcctgttctcccgcttcgtt

SEQ ID NO: 186161 - DNA, 25 bp, E. coli
tattggctgtcttttcatcgtgttg

SEQ ID NO: 186162 - DNA, 25 bp, E. coli
tattggctgtctattcatcgtgttg

SEQ ID NO: 186163 - DNA, 25 bp, E. coli
tgcccgtagaacatcacacattatc

SEQ ID NO: 186164 - DNA, 25 bp, E. coli
tgcccgtagaacttcacacattatc

SEQ ID NO: 186165 - DNA, 25 bp, E. coli
tcacgaaaagggtttatttgcttac

SEQ ID NO: 186166 - DNA, 25 bp, E. coli
tcacgaaaagggattatttgcttac

SEQ ID NO: 186167 - DNA, 25 bp, E. coli
gttgtaaaaaccgaatgcccagcct

SEQ ID NO: 186168 - DNA, 25 bp, E. coli
gttgtaaaaacccaatgcccagcct

SEQ ID NO: 186169 - DNA, 25 bp, E. coli
gggcggcgtgcttcattaataaaca

SEQ ID NO: 186170 - DNA, 25 bp, E. coli
gggcggcgtgctacattaataaaca

SEQ ID NO: 186171 - DNA, 25 bp, E. coli
taatttccctgtcttcttaaacacg

SEQ ID NO: 186172 - DNA, 25 bp, E. coli
taatttccctgtgttcttaaacacg

SEQ ID NO: 186173 - DNA, 25 bp, E. coli
tcaatttgactttagagggcggcgt

SEQ ID NO: 186174 - DNA, 25 bp, E. coli
tcaatttgacttaagagggcggcgt

SEQ ID NO: 186175 - DNA, 25 bp, E. coli
taaaaacctgatggaatggctgcca

SEQ ID NO: 186176 - DNA, 25 bp, E. coli
taaaaacctgatcgaatggctgcca

SEQ ID NO: 186177 - DNA, 25 bp, E. coli
aacccgggcggctcattagaactgg

SEQ ID NO: 186178 - DNA, 25 bp, E. coli
aacccgggcggcacattagaactgg

SEQ ID NO: 186179 - DNA, 25 bp, E. coli
tagaactgggtgacgactacggtcg

SEQ ID NO: 186180 - DNA, 25 bp, E. coli
tatgactataccaacgaaaccgcga

SEQ ID NO: 186181 - DNA, 25 bp, E. coli
tagaactgggtgtcgactacggtcg

SEQ ID NO: 186182 - DNA, 25 bp, E. coli
tatgactatacctacgaaaccgcga

SEQ ID NO: 186183 - DNA, 25 bp, E. coli
tatcaactgggaaaacgacaacggc

SEQ ID NO: 186184 - DNA, 25 bp, E. coli
tatcaactgggataacgacaacggc

SEQ ID NO: 186185 - DNA, 25 bp, E. coli
tattcgcccgatctacaagtggacg

SEQ ID NO: 186186 - DNA, 25 bp, E. coli
tattcgcccgatgtacaagtggacg

SEQ ID NO: 186187 - DNA, 25 bp, E. coli
tgtcttcgcaacgtacgccaagtgg

SEQ ID NO: 186188 - DNA, 25 bp, E. coli
tgtcttcgcaacctacgccaagtgg

SEQ ID NO: 186189 - DNA, 25 bp, E. coli
ccatctgggcagctaagcgcttcta

SEQ ID NO: 186190 - DNA, 25 bp, E. coli
ccatctgggcaggtaagcgcttcta

SEQ ID NO: 186191 - DNA, 25 bp, E. coli
ggtgccggtctgcaaaacatcgatg

SEQ ID NO: 186192 - DNA, 25 bp, E. coli
ggtgccggtctggaaaacatcgatg

SEQ ID NO: 186193 - DNA, 25 bp, E. coli
tggaccttcggtccccagatggaaa

SEQ ID NO: 186194 - DNA, 25 bp, E. coli
ggaaatcggctaggacaacgtcgaa

SEQ ID NO: 186195 - DNA, 25 bp, E. coli
tggaccttcggtgcccagatggaaa

SEQ ID NO: 186196 - DNA, 25 bp, E. coli
ggaaatcggctacgacaacgtcgaa

SEQ ID NO: 186197 - DNA, 25 bp, E. coli
aattatggaatacaaatggccacgg

SEQ ID NO: 186198 - DNA, 25 bp, E. coli
aattatggaatagaaatggccacgg

SEQ ID NO: 186199 - DNA, 25 bp, E. coli
caaatttaggtgttgcagaaagtcg

SEQ ID NO: 186200 - DNA, 25 bp, E. coli
caaatttaggtgatgcagaaagtcg

SEQ ID NO: 186201 - DNA, 25 bp, E. coli
tatatcattgacgattgtagcaccg

SEQ ID NO: 186202 - DNA, 25 bp, E. coli
tatatcattgaccattgtagcaccg

SEQ ID NO: 186203 - DNA, 25 bp, E. coli
ttaaagctgcaaaatggacatggag

SEQ ID NO: 186204 - DNA, 25 bp, E. coli
ttaaagctgcaatatggacatggag

SEQ ID NO: 186205 - DNA, 25 bp, E. coli
tgtggcacgagataaaattagagcg

SEQ ID NO: 186206 - DNA, 25 bp, E. coli
tgtggcacgagaaaaaattagagcg

SEQ ID NO: 186207 - DNA, 25 bp, E. coli
tgcgttcaaataattcactatcggg

SEQ ID NO: 186208 - DNA, 25 bp, E. coli
tgcgttcaaatatttcactatcggg

SEQ ID NO: 186209 - DNA, 25 bp, E. coli
ctacatagggaaattgacaggaatc

SEQ ID NO: 186210 - DNA, 25 bp, E. coli
ctacatagggaatttgacaggaatc

SEQ ID NO: 186211 - DNA, 25 bp, E. coli
ggcgaagttaatgctcctcatgtga

SEQ ID NO: 186212 - DNA, 25 bp, E. coli
ggcgaagttaatcctcctcatgtga

SEQ ID NO: 186213 - DNA, 25 bp, E. coli
tcactattaaggtgaaaggagacta

SEQ ID NO: 186214 - DNA, 25 bp, E. coli
taatctggcgtattacatgcgttca

SEQ ID NO: 186215 - DNA, 25 bp, E. coli
tagagcgtcaaaacgaagtgttaaa

SEQ ID NO: 186216 - DNA, 25 bp, E. coli
tagagcgtcaaatcgaagtgttaaa

SEQ ID NO: 186217 - DNA, 25 bp, E. coli
taatctggcgtaatacatgcgttca

SEQ ID NO: 186218 - DNA, 25 bp, E. coli
tcactattaaggagaaaggagacta

SEQ ID NO: 186219 - DNA, 25 bp, E. coli
tacttaaagtttatgcgccaaagca

SEQ ID NO: 186220 - DNA, 25 bp, E. coli
tacttaaagtttttgcgccaaagca

SEQ ID NO: 186221 - DNA, 25 bp, E. coli
tcgggtacgtggagaaggcatccaa

SEQ ID NO: 186222 - DNA, 25 bp, E. coli
tcgggtacgtggtgaaggcatccaa

SEQ ID NO: 186223 - DNA, 25 bp, E. coli
tcagggatgtaatagtcaaactagg

SEQ ID NO: 186224 - DNA, 25 bp, E. coli
tcagggatgtaaaagtcaaactagg

SEQ ID NO: 186225 - DNA, 25 bp, E. coli
gccaaagcataaaatgaccgaacgt

SEQ ID NO: 186226 - DNA, 25 bp, E. coli
gccaaagcataatatgaccgaacgt

SEQ ID NO: 186227 - DNA, 25 bp, E. coli
gctcgtggacctgttgtacttaaag

SEQ ID NO: 186228 - DNA, 25 bp, E. coli
gctcgtggacctcttgtacttaaag

SEQ ID NO: 186229 - DNA, 25 bp, E. coli
cattcttattgagactgctcgtgga

SEQ ID NO: 186230 - DNA, 25 bp, E. coli
cattcttattgacactgctcgtgga

SEQ ID NO: 186231 - DNA, 25 bp, E. coli
gataaaagagttccatcagcatgga

SEQ ID NO: 186232 - DNA, 25 bp, E. coli
gataatgatcccatttatgagcaag

SEQ ID NO: 186233 - DNA, 25 bp, E. coli
gataatgatcccttttatgagcaag

SEQ ID NO: 186234 - DNA, 25 bp, E. coli
gataaaagagttgcatcagcatgga

SEQ ID NO: 186235 - DNA, 25 bp, E. coli
ggtgtctggcgatcctcataaggga

SEQ ID NO: 186236 - DNA, 25 bp, E. coli
ggtgtctggcgaacctcataaggga

SEQ ID NO: 186237 - DNA, 25 bp, E. coli
taatttatcaaagcgatcgggtacg

SEQ ID NO: 186238 - DNA, 25 bp, E. coli
taatttatcaaaccgatcgggtacg

SEQ ID NO: 186239 - DNA, 25 bp, E. coli
gatcgcattgatgttgaacggcact

SEQ ID NO: 186240 - DNA, 25 bp, E. coli
gatcgcattgatcttgaacggcact

SEQ ID NO: 186241 - DNA, 25 bp, E. coli
acgccaacacctactgggtgtatgc

SEQ ID NO: 186242 - DNA, 25 bp, E. coli
acgccaacaccttctgggtgtatgc

SEQ ID NO: 186243 - DNA, 25 bp, E. coli
tgggtaacgccaacaccttctgggt

SEQ ID NO: 186244 - DNA, 25 bp, E. coli
tgggtaacgccatcaccttctgggt

SEQ ID NO: 186245 - DNA, 25 bp, E. coli
tgacattgtggctggtaccggaaac

SEQ ID NO: 186246 - DNA, 25 bp, E. coli
tgacattgtggcaggtaccggaaac

SEQ ID NO: 186247 - DNA, 25 bp, E. coli
tgctgacattgtcgctggtaccgga

SEQ ID NO: 186248 - DNA, 25 bp, E. coli
tgctgacattgtggctggtaccgga

SEQ ID NO: 186249 - DNA, 25 bp, E. coli
cctgctgacattctggctggtaccg

SEQ ID NO: 186250 - DNA, 25 bp, E. coli
cctgctgacattgtggctggtaccg

SEQ ID NO: 186251 - DNA, 25 bp, E. coli
gctgggtaacgcgaacaccttctgg

SEQ ID NO: 186252 - DNA, 25 bp, E. coli
gctgggtaacgccaacaccttctgg

SEQ ID NO: 186253 - DNA, 25 bp, E. coli
gacattgtggctggtaccggaaacc

SEQ ID NO: 186254 - DNA, 25 bp, E. coli
gacattgtggctcgtaccggaaacc

SEQ ID NO: 186255 - DNA, 25 bp, E. coli
ctgacattgtgggtggtaccggaaa

SEQ ID NO: 186256 - DNA, 25 bp, E. coli
cattgtggctggtaccggaaaccaa

SEQ ID NO: 186257 - DNA, 25 bp, E. coli
cattgtggctggaaccggaaaccaa

SEQ ID NO: 186258 - DNA, 25 bp, E. coli
ctgacattgtggctggtaccggaaa

SEQ ID NO: 186259 - DNA, 25 bp, E. coli
gggtaacgccaagaccttctgggtg

SEQ ID NO: 186260 - DNA, 25 bp, E. coli
gggtaacgccaacaccttctgggtg

SEQ ID NO: 186261 - DNA, 25 bp, E. coli
taacgccaacaccttctgggtgtat

SEQ ID NO: 186262 - DNA, 25 bp, E. coli
taacgccaacacgttctgggtgtat

SEQ ID NO: 186263 - DNA, 25 bp, E. coli
caactggtagaaacggtcatcaaac

SEQ ID NO: 186264 - DNA, 25 bp, E. coli
caactggtagaatcggtcatcaaac

SEQ ID NO: 186265 - DNA, 25 bp, E. coli
agcaactgggtaaccgcgacatggt

SEQ ID NO: 186266 - DNA, 25 bp, E. coli
aggccgtgatggttgcaatccgcac

SEQ ID NO: 186267 - DNA, 25 bp, E. coli
aggccgtgatggatgcaatccgcac

SEQ ID NO: 186268 - DNA, 25 bp, E. coli
agcaactgggtatccgcgacatggt

SEQ ID NO: 186269 - DNA, 25 bp, E. coli
aacatatgctgggaacactgcgtga

SEQ ID NO: 186270 - DNA, 25 bp, E. coli
aacatatgctggcaacactgcgtga

SEQ ID NO: 186271 - DNA, 25 bp, E. coli
tatgccgcgcgcgttcaactggtag

SEQ ID NO: 186272 - DNA, 25 bp, E. coli
tatgccgcgcgccttcaactggtag

SEQ ID NO: 186273 - DNA, 25 bp, E. coli
gcgcagtaagtatatcgtcattgag

SEQ ID NO: 186274 - DNA, 25 bp, E. coli
gcgacatggttttcactcgggaacc

SEQ ID NO: 186275 - DNA, 25 bp, E. coli
gcgacatggtttacactcgggaacc

SEQ ID NO: 186276 - DNA, 25 bp, E. coli
gcgcagtaagtaaatcgtcattgag

SEQ ID NO: 186277 - DNA, 25 bp, E. coli
gctggatatcaaatcggtaggcgat

SEQ ID NO: 186278 - DNA, 25 bp, E. coli
gctggatatcaattcggtaggcgat

SEQ ID NO: 186279 - DNA, 25 bp, E. coli
gcgagctggatcgtattgagcaaga

SEQ ID NO: 186280 - DNA, 25 bp, E. coli
gcgagctggatcctattgagcaaga

SEQ ID NO: 186281 - DNA, 25 bp, E. coli
gaagttctgatgttttatgccgcgc

SEQ ID NO: 186282 - DNA, 25 bp, E. coli
gaagttctgatgatttatgccgcgc

SEQ ID NO: 186283 - DNA, 25 bp, E. coli
cgctctatctcgttgttaccccgga

SEQ ID NO: 186284 - DNA, 25 bp, E. coli
cgctctatctcgatgttaccccgga

SEQ ID NO: 186285 - DNA, 25 bp, E. coli
taaatttgctttatgatctatctag

SEQ ID NO: 186286 - DNA, 25 bp, E. coli
taaatttgctttttgatctatctag

SEQ ID NO: 186287 - DNA, 25 bp, E. coli
tagtgtatctaatatggcaatgaaa

SEQ ID NO: 186288 - DNA, 25 bp, E. coli
tagtgtatctaaaatggcaatgaaa

SEQ ID NO: 186289 - DNA, 25 bp, E. coli
tgtatctaaaatcgcaatgaaatta

SEQ ID NO: 186290 - DNA, 25 bp, E. coli
tgtatctaaaatggcaatgaaatta

SEQ ID NO: 186291 - DNA, 25 bp, E. coli
tgctttatgatcaatctagtgtatc

SEQ ID NO: 186292 - DNA, 25 bp, E. coli
tgcatgacatgtctgattttattgt

SEQ ID NO: 186293 - DNA, 25 bp, E. coli
tgcatgacatgtgtgattttattgt

SEQ ID NO: 186294 - DNA, 25 bp, E. coli
tgctttatgatctatctagtgtatc

SEQ ID NO: 186295 - DNA, 25 bp, E. coli
tctagtgtatcttaaatggcaatga

SEQ ID NO: 186296 - DNA, 25 bp, E. coli
tctagtgtatctaaaatggcaatga

SEQ ID NO: 186297 - DNA, 25 bp, E. coli
gaaattatttctgcttgcaatttga

SEQ ID NO: 186298 - DNA, 25 bp, E. coli
gaaattatttctccttgcaatttga

SEQ ID NO: 186299 - DNA, 25 bp, E. coli
gacatgtctgatattattgttttaa

SEQ ID NO: 186300 - DNA, 25 bp, E. coli
gacatgtctgattttattgttttaa

SEQ ID NO: 186301 - DNA, 25 bp, E. coli
ctatctagtgtatctaaaatggcaa

SEQ ID NO: 186302 - DNA, 25 bp, E. coli
ctatctagtgtaactaaaatggcaa

SEQ ID NO: 186303 - DNA, 25 bp, E. coli
taaaatggcaatgaaattatttctc

SEQ ID NO: 186304 - DNA, 25 bp, E. coli
taaaatggcaatcaaattatttctc

SEQ ID NO: 186305 - DNA, 25 bp, E. coli
gatctatctagtgtatctaaaatgg

SEQ ID NO: 186306 - DNA, 25 bp, E. coli
gatctatctagtctatctaaaatgg

SEQ ID NO: 186307 - DNA, 25 bp, E. coli
caaacggagcagaacaatggtcagc

SEQ ID NO: 186308 - DNA, 25 bp, E. coli
caaacggagcagtacaatggtcagc

SEQ ID NO: 186309 - DNA, 25 bp, E. coli
taaaactgattattgcaaacggagc

SEQ ID NO: 186310 - DNA, 25 bp, E. coli
taaaactgattaatgcaaacggagc

SEQ ID NO: 186311 - DNA, 25 bp, E. coli
actgggttattcagagtatcgtcac

SEQ ID NO: 186312 - DNA, 25 bp, E. coli
aaagacatcgtactctcccgctatg

SEQ ID NO: 186313 - DNA, 25 bp, E. coli
aaagacatcgtagtctcccgctatg

SEQ ID NO: 186314 - DNA, 25 bp, E. coli
actgggttattctgagtatcgtcac

SEQ ID NO: 186315 - DNA, 25 bp, E. coli
tatacctgtattaacgcgcgccaaa

SEQ ID NO: 186316 - DNA, 25 bp, E. coli
tatacctgtatttacgcgcgccaaa

SEQ ID NO: 186317 - DNA, 25 bp, E. coli
tgagaacagtggacacacaattgat

SEQ ID NO: 186318 - DNA, 25 bp, E. coli
tgatgaccatttcgaggagatcctc

SEQ ID NO: 186319 - DNA, 25 bp, E. coli
tgatgaccatttggaggagatcctc

SEQ ID NO: 186320 - DNA, 25 bp, E. coli
tgagaacagtggtcacacaattgat

SEQ ID NO: 186321 - DNA, 25 bp, E. coli
tcctcgatatggtcaaaattggctc

SEQ ID NO: 186322 - DNA, 25 bp, E. coli
tcctcgatatggacaaaattggctc

SEQ ID NO: 186323 - DNA, 25 bp, E. coli
gccaaaagagcattaaaagacatcg

SEQ ID NO: 186324 - DNA, 25 bp, E. coli
gccaaaagagcaataaaagacatcg

SEQ ID NO: 186325 - DNA, 25 bp, E. coli
gcaagacaacttgggaaactactgg

SEQ ID NO: 186326 - DNA, 25 bp, E. coli
gcaagacaacttcggaaactactgg

SEQ ID NO: 186327 - DNA, 25 bp, E. coli
cgcgccaaagaaccctgtgagaaca

SEQ ID NO: 186328 - DNA, 25 bp, E. coli
cgcgccaaagaagcctgtgagaaca

SEQ ID NO: 186329 - DNA, 25 bp, E. coli
caatgggtcgatttctggcttaaaa

SEQ ID NO: 186330 - DNA, 25 bp, E. coli
caatgggtcgatatctggcttaaaa

SEQ ID NO: 186331 - DNA, 25 bp, E. coli
cacctgcaatggctcgatatctggc

SEQ ID NO: 186332 - DNA, 25 bp, E. coli
cacctgcaatgggtcgatatctggc

SEQ ID NO: 186333 - DNA, 25 bp, E. coli
caggccaagcgtatgctggttgatc

SEQ ID NO: 186334 - DNA, 25 bp, E. coli
caggccaagcgtttgctggttgatc

SEQ ID NO: 186335 - DNA, 25 bp, E. coli
agcgtatgctggatgatcaaataat

SEQ ID NO: 186336 - DNA, 25 bp, E. coli
agcgtatgctggttgatcaaataat

SEQ ID NO: 186337 - DNA, 25 bp, E. coli
tattaatattcacctgcaatgggtc

SEQ ID NO: 186338 - DNA, 25 bp, E. coli
tattaatattcagctgcaatgggtc

SEQ ID NO: 186339 - DNA, 25 bp, E. coli
taatattcacctccaatgggtcgat

SEQ ID NO: 186340 - DNA, 25 bp, E. coli
taatattcacctgcaatgggtcgat

SEQ ID NO: 186341 - DNA, 25 bp, E. coli
ccaagcgcagcattattaatattca

SEQ ID NO: 186342 - DNA, 25 bp, E. coli
ccaagcgtatgctggttgatcaaat

SEQ ID NO: 186343 - DNA, 25 bp, E. coli
ccaagcgtatgcaggttgatcaaat

SEQ ID NO: 186344 - DNA, 25 bp, E. coli
cctgcaatgggtggatatctggctt

SEQ ID NO: 186345 - DNA, 25 bp, E. coli
ccaagcgcagcaatattaatattca

SEQ ID NO: 186346 - DNA, 25 bp, E. coli
cctgcaatgggtcgatatctggctt

SEQ ID NO: 186347 - DNA, 25 bp, E. coli
gataaaccaggcgaagcgtatgctg

SEQ ID NO: 186348 - DNA, 25 bp, E. coli
gataaaccaggccaagcgtatgctg

SEQ ID NO: 186349 - DNA, 25 bp, E. coli
gggtcgatatctcgcttaaaaatat

SEQ ID NO: 186350 - DNA, 25 bp, E. coli
gggtcgatatctggcttaaaaatat

SEQ ID NO: 186351 - DNA, 25 bp, E. coli
caactggcgaagctggaaggcaaaa

SEQ ID NO: 186352 - DNA, 25 bp, E. coli
caactggcgaaggtggaaggcaaaa

SEQ ID NO: 186353 - DNA, 25 bp, E. coli
cacgcttgagctcaccatgatgatc

SEQ ID NO: 186354 - DNA, 25 bp, E. coli
caaacgcctcgtgatggaagcggcc

SEQ ID NO: 186355 - DNA, 25 bp, E. coli
cacgcttgagctgaccatgatgatc

SEQ ID NO: 186356 - DNA, 25 bp, E. coli
caaacgcctcgtcatggaagcggcc

SEQ ID NO: 186357 - DNA, 25 bp, E. coli
tatgtgatgctgtacgccattaccg

SEQ ID NO: 186358 - DNA, 25 bp, E. coli
taccgtcggcgctatgagatgctcg

SEQ ID NO: 186359 - DNA, 25 bp, E. coli
tatgtgatgctgaacgccattaccg

SEQ ID NO: 186360 - DNA, 25 bp, E. coli
taccgtcggcgcaatgagatgctcg

SEQ ID NO: 186361 - DNA, 25 bp, E. coli
tgttccgcaacagcgaaggtattcc

SEQ ID NO: 186362 - DNA, 25 bp, E. coli
tgttccgcaacaccgaaggtattcc

SEQ ID NO: 186363 - DNA, 25 bp, E. coli
tgaaacgcatatataccgcagcctg

SEQ ID NO: 186364 - DNA, 25 bp, E. coli
tgaaacgcatatttaccgcagcctg

SEQ ID NO: 186365 - DNA, 25 bp, E. coli
tgcaaggcgcaaaatgggaaattcc

SEQ ID NO: 186366 - DNA, 25 bp, E. coli
tgcaaggcgcaatatgggaaattcc

SEQ ID NO: 186367 - DNA, 25 bp, E. coli
gcccaacgtttgcaggtagagcaga

SEQ ID NO: 186368 - DNA, 25 bp, E. coli
gcccaacgtttggaggtagagcaga

SEQ ID NO: 186369 - DNA, 25 bp, E. coli
gaaatccagaatgcgacgaaagcct

SEQ ID NO: 186370 - DNA, 25 bp, E. coli
gaaatccagaatccgacgaaagcct

SEQ ID NO: 186371 - DNA, 25 bp, E. coli
taagcaattgctggaggcgttacgt

SEQ ID NO: 186372 - DNA, 25 bp, E. coli
taagcaattgctcgaggcgttacgt

SEQ ID NO: 186373 - DNA, 25 bp, E. coli
tatccgatgtctcgtttttcgcggg

SEQ ID NO: 186374 - DNA, 25 bp, E. coli
tagcggaaatagagcagacgattct

SEQ ID NO: 186375 - DNA, 25 bp, E. coli
tagcggaaatagtgcagacgattct

SEQ ID NO: 186376 - DNA, 25 bp, E. coli
tatccgatgtctggtttttcgcggg

SEQ ID NO: 186377 - DNA, 25 bp, E. coli
ttaacaccctcatagatcgcgatgg

SEQ ID NO: 186378 - DNA, 25 bp, E. coli
ttaacaccctcaaagatcgcgatgg

SEQ ID NO: 186379 - DNA, 25 bp, E. coli
tggtgggtagcagcattaacaccct

SEQ ID NO: 186380 - DNA, 25 bp, E. coli
tcagggcgctgcaattttctgccgg

SEQ ID NO: 186381 - DNA, 25 bp, E. coli
gctatagcgaaattaagcgaccggt

SEQ ID NO: 186382 - DNA, 25 bp, E. coli
gctatagcgaaaataagcgaccggt

SEQ ID NO: 186383 - DNA, 25 bp, E. coli
gaaacctgccggatatttattgcgc

SEQ ID NO: 186384 - DNA, 25 bp, E. coli
gaaacctgccggttatttattgcgc

SEQ ID NO: 186385 - DNA, 25 bp, E. coli
gattctctctttagtcgatgcctgc

SEQ ID NO: 186386 - DNA, 25 bp, E. coli
gattctctcttttgtcgatgcctgc

SEQ ID NO: 186387 - DNA, 25 bp, E. coli
gatttgtttcgtttgcgctatagcg

SEQ ID NO: 186388 - DNA, 25 bp, E. coli
gatttgtttcgtatgcgctatagcg

SEQ ID NO: 186389 - DNA, 25 bp, E. coli
gggacccggcaataaccgaagatga

SEQ ID NO: 186390 - DNA, 25 bp, E. coli
gggacccggcaaaaaccgaagatga

SEQ ID NO: 186391 - DNA, 25 bp, E. coli
tggtgggtagcaccattaacaccct

SEQ ID NO: 186392 - DNA, 25 bp, E. coli
tcagggcgctgctattttctgccgg

SEQ ID NO: 186393 - DNA, 25 bp, E. coli
gatgcctgccactcccgtaaagtgg

SEQ ID NO: 186394 - DNA, 25 bp, E. coli
gatgcctgccacacccgtaaagtgg

SEQ ID NO: 186395 - DNA, 25 bp, E. coli
caatatgtcgtttttagcaaaccac

SEQ ID NO: 186396 - DNA, 25 bp, E. coli
caatagcgattcgatatcgatggat

SEQ ID NO: 186397 - DNA, 25 bp, E. coli
caatagcgattccatatcgatggat

SEQ ID NO: 186398 - DNA, 25 bp, E. coli
caatatgtcgttattagcaaaccac

SEQ ID NO: 186399 - DNA, 25 bp, E. coli
tatcttttctcttttaatccacggt

SEQ ID NO: 186400 - DNA, 25 bp, E. coli
tatcttttctctattaatccacggt

SEQ ID NO: 186401 - DNA, 25 bp, E. coli
acttttctcacgcattcaatagcga

SEQ ID NO: 186402 - DNA, 25 bp, E. coli
acttttctcacggattcaatagcga

SEQ ID NO: 186403 - DNA, 25 bp, E. coli
tattggcgatattaattcctttgca

SEQ ID NO: 186404 - DNA, 25 bp, E. coli
tattggcgatataaattcctttgca

SEQ ID NO: 186405 - DNA, 25 bp, E. coli
tttctgtagggtcgaatctaacgcc

SEQ ID NO: 186406 - DNA, 25 bp, E. coli
ttttatagcgaggttgtcccggctc

SEQ ID NO: 186407 - DNA, 25 bp, E. coli
ttttatagcgagcttgtcccggctc

SEQ ID NO: 186408 - DNA, 25 bp, E. coli
tttctgtagggtggaatctaacgcc

SEQ ID NO: 186409 - DNA, 25 bp, E. coli
tccacggtaaaaactgtattggcga

SEQ ID NO: 186410 - DNA, 25 bp, E. coli
tccacggtaaaatctgtattggcga

SEQ ID NO: 186411 - DNA, 25 bp, E. coli
gcaaaccactttattaagcaatcta

SEQ ID NO: 186412 - DNA, 25 bp, E. coli
gaatctaacgcctttttatagcgag

SEQ ID NO: 186413 - DNA, 25 bp, E. coli
gcaaaccacttttttaagcaatcta

SEQ ID NO: 186414 - DNA, 25 bp, E. coli
gaatctaacgccattttatagcgag

SEQ ID NO: 186415 - DNA, 25 bp, E. coli
ggttgtcccggctcttaccaataca

SEQ ID NO: 186416 - DNA, 25 bp, E. coli
ggttgtcccggcacttaccaataca

SEQ ID NO: 186417 - DNA, 25 bp, E. coli
catgcagccctggactgaagagtta

SEQ ID NO: 186418 - DNA, 25 bp, E. coli
catgcagccctgcactgaagagtta

SEQ ID NO: 186419 - DNA, 25 bp, E. coli
aaatggatgacatacgtgacgaggc

SEQ ID NO: 186420 - DNA, 25 bp, E. coli
aaatggatgacaaacgtgacgaggc

SEQ ID NO: 186421 - DNA, 25 bp, E. coli
tatgatctgatgtgtgcccactcca

SEQ ID NO: 186422 - DNA, 25 bp, E. coli
tatgatctgatgagtgcccactcca

SEQ ID NO: 186423 - DNA, 25 bp, E. coli
tgggcggcgtttaactcagtgagct

SEQ ID NO: 186424 - DNA, 25 bp, E. coli
tgggcggcgttttactcagtgagct

SEQ ID NO: 186425 - DNA, 25 bp, E. coli
tgctccggcgtttcgacgatcgtga

SEQ ID NO: 186426 - DNA, 25 bp, E. coli
tgaaaaccggctggcaaacaggctg

SEQ ID NO: 186427 - DNA, 25 bp, E. coli
tgaaaaccggtgagagctgctgctc

SEQ ID NO: 186428 - DNA, 25 bp, E. coli
tgctccggcgttacgacgatcgtga

SEQ ID NO: 186429 - DNA, 25 bp, E. coli
tgaaaaccggctcgcaaacaggctg

SEQ ID NO: 186430 - DNA, 25 bp, E. coli
tgaaaaccggtgtgagctgctgctc

SEQ ID NO: 186431 - DNA, 25 bp, E. coli
gctacatcgtctgggtgaaaaccgg

SEQ ID NO: 186432 - DNA, 25 bp, E. coli
gctacatcgtctcggtgaaaaccgg

SEQ ID NO: 186433 - DNA, 25 bp, E. coli
gactctatcaggtcgtcaacccggg

SEQ ID NO: 186434 - DNA, 25 bp, E. coli
gaaaaaggcaccttcatctcagtgg

SEQ ID NO: 186435 - DNA, 25 bp, E. coli
gactctatcaggacgtcaacccggg

SEQ ID NO: 186436 - DNA, 25 bp, E. coli
gaaaaaggcaccatcatctcagtgg

SEQ ID NO: 186437 - DNA, 25 bp, E. coli
cttacacatttttatctgggcggcg

SEQ ID NO: 186438 - DNA, 25 bp, E. coli
cttacacattttaatctgggcggcg

SEQ ID NO: 186439 - DNA, 25 bp, E. coli
aaatcattgccgtggagcccactgc

SEQ ID NO: 186440 - DNA, 25 bp, E. coli
aaatcattgccgaggagcccactgc

SEQ ID NO: 186441 - DNA, 25 bp, E. coli
tacgcgctttcaataaccagatggc

SEQ ID NO: 186442 - DNA, 25 bp, E. coli
tacgcgctttcattaaccagatggc

SEQ ID NO: 186443 - DNA, 25 bp, E. coli
tattcgggccggtcaaatcattgcc

SEQ ID NO: 186444 - DNA, 25 bp, E. coli
tattcgggccggacaaatcattgcc

SEQ ID NO: 186445 - DNA, 25 bp, E. coli
ttggcgatcgactggcctatatcag

SEQ ID NO: 186446 - DNA, 25 bp, E. coli
ttggcgatcgacaggcctatatcag

SEQ ID NO: 186447 - DNA, 25 bp, E. coli
tgcgcgacgaagaaaacacccgttt

SEQ ID NO: 186448 - DNA, 25 bp, E. coli
tgcgcgacgaagtaaacacccgttt

SEQ ID NO: 186449 - DNA, 25 bp, E. coli
gccgctatgcgtttcctgtgttgaa

SEQ ID NO: 186450 - DNA, 25 bp, E. coli
gccgctatgcgtatcctgtgttgaa

SEQ ID NO: 186451 - DNA, 25 bp, E. coli
cgatgtcgcggcaggtgagtaacca

SEQ ID NO: 186452 - DNA, 25 bp, E. coli
cgatgtcgcggctggtgagtaacca

SEQ ID NO: 186453 - DNA, 25 bp, E. coli
cggtctgggcgctaattggtgacaa

SEQ ID NO: 186454 - DNA, 25 bp, E. coli
cggtctgggcgcaaattggtgacaa

SEQ ID NO: 186455 - DNA, 25 bp, E. coli
ggtgagtaaccacccgcagggataa

SEQ ID NO: 186456 - DNA, 25 bp, E. coli
ggtgagtaaccagccgcagggataa

SEQ ID NO: 186457 - DNA, 25 bp, E. coli
ggacaatttgcgctacccgattttg

SEQ ID NO: 186458 - DNA, 25 bp, E. coli
ggacaatttgcggtacccgattttg

SEQ ID NO: 186459 - DNA, 25 bp, E. coli
taagaacggattcgctggagacgat

SEQ ID NO: 186460 - DNA, 25 bp, E. coli
taagaacggattggctggagacgat

SEQ ID NO: 186461 - DNA, 25 bp, E. coli
aaggctacgcccttgcagcgatgtg

SEQ ID NO: 186462 - DNA, 25 bp, E. coli
aaggctacgcccatgcagcgatgtg

SEQ ID NO: 186463 - DNA, 25 bp, E. coli
aggctacgccctagcagcgatgtgt

SEQ ID NO: 186464 - DNA, 25 bp, E. coli
aggctacgcccttgcagcgatgtgt

SEQ ID NO: 186465 - DNA, 25 bp, E. coli
aaaggctacgcccttgcagcgatgt

SEQ ID NO: 186466 - DNA, 25 bp, E. coli
aaaggctacgccgttgcagcgatgt

SEQ ID NO: 186467 - DNA, 25 bp, E. coli
tacgcccttgcaccgatgtgtgaaa

SEQ ID NO: 186468 - DNA, 25 bp, E. coli
tacgcccttgcagcgatgtgtgaaa

SEQ ID NO: 186469 - DNA, 25 bp, E. coli
tccctcgtaaagataatttcccgct

SEQ ID NO: 186470 - DNA, 25 bp, E. coli
tcgtaaagataatttcccgctgttg

SEQ ID NO: 186471 - DNA, 25 bp, E. coli
tccctcgtaaagttaatttcccgct

SEQ ID NO: 186472 - DNA, 25 bp, E. coli
tcgtaaagataaattcccgctgttg

SEQ ID NO: 186473 - DNA, 25 bp, E. coli
cctcgtaaagataatttcccgctgt

SEQ ID NO: 186474 - DNA, 25 bp, E. coli
ccttgcagcgatctgtgaaattctt

SEQ ID NO: 186475 - DNA, 25 bp, E. coli
cctcgtaaagattatttcccgctgt

SEQ ID NO: 186476 - DNA, 25 bp, E. coli
ccttgcagcgatgtgtgaaattctt

SEQ ID NO: 186477 - DNA, 25 bp, E. coli
gctacgcccttggagcgatgtgtga

SEQ ID NO: 186478 - DNA, 25 bp, E. coli
gctacgcccttgcagcgatgtgtga

SEQ ID NO: 186479 - DNA, 25 bp, E. coli
cgcccttgcagcgatgtgtgaaatt

SEQ ID NO: 186480 - DNA, 25 bp, E. coli
cccttgcagcgaagtgtgaaattct

SEQ ID NO: 186481 - DNA, 25 bp, E. coli
cccttgcagcgatgtgtgaaattct

SEQ ID NO: 186482 - DNA, 25 bp, E. coli
cgcccttgcagccatgtgtgaaatt

SEQ ID NO: 186483 - DNA, 25 bp, E. coli
cacccttgcagtcaaagaaagcgca

SEQ ID NO: 186484 - DNA, 25 bp, E. coli
cacccttgcagtgaaagaaagcgca

SEQ ID NO: 186485 - DNA, 25 bp, E. coli
cagtggttaaccgagggcgacattg

SEQ ID NO: 186486 - DNA, 25 bp, E. coli
cagtggttaacccagggcgacattg

SEQ ID NO: 186487 - DNA, 25 bp, E. coli
actccgccaatggaccgatttggca

SEQ ID NO: 186488 - DNA, 25 bp, E. coli
actccgccaatgcaccgatttggca

SEQ ID NO: 186489 - DNA, 25 bp, E. coli
acaaaaggcgcggttgccagcctgc

SEQ ID NO: 186490 - DNA, 25 bp, E. coli
acaaaaggcgcgcttgccagcctgc

SEQ ID NO: 186491 - DNA, 25 bp, E. coli
ccagggcgacattgaccaacaaaca

SEQ ID NO: 186492 - DNA, 25 bp, E. coli
ccagggcgacatagaccaacaaaca

SEQ ID NO: 186493 - DNA, 25 bp, E. coli
gacattgaccaagaaacaaaaggcg

SEQ ID NO: 186494 - DNA, 25 bp, E. coli
gacattgaccaacaaacaaaaggcg

SEQ ID NO: 186495 - DNA, 25 bp, E. coli
cgcttgccagccagctgttgatgct

SEQ ID NO: 186496 - DNA, 25 bp, E. coli
cgcttgccagcctgctgttgatgct

SEQ ID NO: 186497 - DNA, 25 bp, E. coli
ctatctgctatgccgcagctggcgg

SEQ ID NO: 186498 - DNA, 25 bp, E. coli
ctatctgctatggcgcagctggcgg

SEQ ID NO: 186499 - DNA, 25 bp, E. coli
gatttggcatcgctctgggcctcac

SEQ ID NO: 186500 - DNA, 25 bp, E. coli
gatttggcatcggtctgggcctcac

SEQ ID NO: 186501 - DNA, 25 bp, E. coli
ggtctgggcctctcccttgcagtga

SEQ ID NO: 186502 - DNA, 25 bp, E. coli
ggtctgggcctcacccttgcagtga

SEQ ID NO: 186503 - DNA, 25 bp, E. coli
gggcctcaccctagcagtgaaagaa

SEQ ID NO: 186504 - DNA, 25 bp, E. coli
gggcctcacccttgcagtgaaagaa

SEQ ID NO: 186505 - DNA, 25 bp, E. coli
catcgtgctgctggaccatgctgaa

SEQ ID NO: 186506 - DNA, 25 bp, E. coli
catcgtgctgctcgaccatgctgaa

SEQ ID NO: 186507 - DNA, 25 bp, E. coli
catgctgaacgccatggtctggacg

SEQ ID NO: 186508 - DNA, 25 bp, E. coli
catgctgaacgcgatggtctggacg

SEQ ID NO: 186509 - DNA, 25 bp, E. coli
tatgccgcaaacagggcaacacgcg

SEQ ID NO: 186510 - DNA, 25 bp, E. coli
tatgtgagtgcgtagcggtaactgc

SEQ ID NO: 186511 - DNA, 25 bp, E. coli
tatgccgcaaactgggcaacacgcg

SEQ ID NO: 186512 - DNA, 25 bp, E. coli
tatgtgagtgcgaagcggtaactgc

SEQ ID NO: 186513 - DNA, 25 bp, E. coli
tgtacgtaaccatctcaccggcgaa

SEQ ID NO: 186514 - DNA, 25 bp, E. coli
tgtacgtaaccaactcaccggcgaa

SEQ ID NO: 186515 - DNA, 25 bp, E. coli
tgctggatgccaaagaacacggtgc

SEQ ID NO: 186516 - DNA, 25 bp, E. coli
tgctggatgccatagaacacggtgc

SEQ ID NO: 186517 - DNA, 25 bp, E. coli
gcctgtttatcaccctgccggaaga

SEQ ID NO: 186518 - DNA, 25 bp, E. coli
gccgatattctgctgcctggcgata

SEQ ID NO: 186519 - DNA, 25 bp, E. coli
gccgatattctggtgcctggcgata

SEQ ID NO: 186520 - DNA, 25 bp, E. coli
gcctgtttatcagcctgccggaaga

SEQ ID NO: 186521 - DNA, 25 bp, E. coli
gatttacgccgtcgtacccgtgtgg

SEQ ID NO: 186522 - DNA, 25 bp, E. coli
gatttacgccgtggtacccgtgtgg

SEQ ID NO: 186523 - DNA, 25 bp, E. coli
ggcaaactgatgacctatcggctga

SEQ ID NO: 186524 - DNA, 25 bp, E. coli
ggcaaactgatgtcctatcggctga

SEQ ID NO: 186525 - DNA, 25 bp, E. coli
gacgtccgcgcaatctatcgagcaa

SEQ ID NO: 186526 - DNA, 25 bp, E. coli
gacgtccgcgcattctatcgagcaa

SEQ ID NO: 186527 - DNA, 25 bp, E. coli
cacagcccgtagtggtggaacaggt

SEQ ID NO: 186528 - DNA, 25 bp, E. coli
cacagcccgtagaggtggaacaggt

SEQ ID NO: 186529 - DNA, 25 bp, E. coli
catagagaacctcaaaaatgttacc

SEQ ID NO: 186530 - DNA, 25 bp, E. coli
catagagaacctgaaaaatgttacc

SEQ ID NO: 186531 - DNA, 25 bp, E. coli
agaatgccgcataagcgggctggct

SEQ ID NO: 186532 - DNA, 25 bp, E. coli
agaatgccgcattagcgggctggct

SEQ ID NO: 186533 - DNA, 25 bp, E. coli
aatagaaccacaccccgtagtggtg

SEQ ID NO: 186534 - DNA, 25 bp, E. coli
actggctggttagcatagagaacct

SEQ ID NO: 186535 - DNA, 25 bp, E. coli
actggctggttaccatagagaacct

SEQ ID NO: 186536 - DNA, 25 bp, E. coli
aatagaaccacagcccgtagtggtg

SEQ ID NO: 186537 - DNA, 25 bp, E. coli
gctggttagcattgagaacctgaaa

SEQ ID NO: 186538 - DNA, 25 bp, E. coli
gctggttagcatagagaacctgaaa

SEQ ID NO: 186539 - DNA, 25 bp, E. coli
gcaactgaacatagtcccaggtgcg

SEQ ID NO: 186540 - DNA, 25 bp, E. coli
gcagcaactgaacatagtcccaggt

SEQ ID NO: 186541 - DNA, 25 bp, E. coli
gaaccacagcccctagtggtggaac

SEQ ID NO: 186542 - DNA, 25 bp, E. coli
gcagcaactgaagatagtcccaggt

SEQ ID NO: 186543 - DNA, 25 bp, E. coli
gcaactgaacattgtcccaggtgcg

SEQ ID NO: 186544 - DNA, 25 bp, E. coli
gaaccacagcccgtagtggtggaac

SEQ ID NO: 186545 - DNA, 25 bp, E. coli
gttagcatagagtacctgaaaaatg

SEQ ID NO: 186546 - DNA, 25 bp, E. coli
gttagcatagagaacctgaaaaatg

SEQ ID NO: 186547 - DNA, 25 bp, E. coli
tggctggttagcatagagaacctga

SEQ ID NO: 186548 - DNA, 25 bp, E. coli
tggctggttagcttagagaacctga

SEQ ID NO: 186549 - DNA, 25 bp, E. coli
cataaccttaggaggacattgcaca

SEQ ID NO: 186550 - DNA, 25 bp, E. coli
cataaccttaggtggacattgcaca

SEQ ID NO: 186551 - DNA, 25 bp, E. coli
tgctattttgattttcacggttgcg

SEQ ID NO: 186552 - DNA, 25 bp, E. coli
tgctattttgatattcacggttgcg

SEQ ID NO: 186553 - DNA, 25 bp, E. coli
tcatgctcgtagtgtcaaactgtgg

SEQ ID NO: 186554 - DNA, 25 bp, E. coli
tcatgctcgtagagtcaaactgtgg

SEQ ID NO: 186555 - DNA, 25 bp, E. coli
gccatcacagatataaatgagcaag

SEQ ID NO: 186556 - DNA, 25 bp, E. coli
gccatcacagatttaaatgagcaag

SEQ ID NO: 186557 - DNA, 25 bp, E. coli
gcaggtgagtttagaacaaatgtat

SEQ ID NO: 186558 - DNA, 25 bp, E. coli
gcaggtgagttttgaacaaatgtat

SEQ ID NO: 186559 - DNA, 25 bp, E. coli
gacattgcacatatttccgacgaat

SEQ ID NO: 186560 - DNA, 25 bp, E. coli
gacattgcacatttttccgacgaat

SEQ ID NO: 186561 - DNA, 25 bp, E. coli
ccccgttcagttttgcaggtgagtt

SEQ ID NO: 186562 - DNA, 25 bp, E. coli
ccgacgaatagaacacaatttatgc

SEQ ID NO: 186563 - DNA, 25 bp, E. coli
ccgacgaatagatcacaatttatgc

SEQ ID NO: 186564 - DNA, 25 bp, E. coli
ccccgttcagttatgcaggtgagtt

SEQ ID NO: 186565 - DNA, 25 bp, E. coli
tcacggttgcgtatgttcatgctcg

SEQ ID NO: 186566 - DNA, 25 bp, E. coli
tcacggttgcgtttgttcatgctcg

SEQ ID NO: 186567 - DNA, 25 bp, E. coli
gagcaagaactgaacaattgcatta

SEQ ID NO: 186568 - DNA, 25 bp, E. coli
gagtcaaactgtggttgccatcaca

SEQ ID NO: 186569 - DNA, 25 bp, E. coli
gagtcaaactgtcgttgccatcaca

SEQ ID NO: 186570 - DNA, 25 bp, E. coli
gagcaagaactgtacaattgcatta

SEQ ID NO: 186571 - DNA, 25 bp, E. coli
aggcggcgaaccagcttttccagtt

SEQ ID NO: 186572 - DNA, 25 bp, E. coli
aggcggcgaacctgcttttccagtt

SEQ ID NO: 186573 - DNA, 25 bp, E. coli
tatcgtattgtgttcctccaggcgg

SEQ ID NO: 186574 - DNA, 25 bp, E. coli
tattgtgttcctccaggcggcgaac

SEQ ID NO: 186575 - DNA, 25 bp, E. coli
tattgtgttcctgcaggcggcgaac

SEQ ID NO: 186576 - DNA, 25 bp, E. coli
tatcgtattgtgatcctccaggcgg

SEQ ID NO: 186577 - DNA, 25 bp, E. coli
ttcgcggatacgttgctggtctgga

SEQ ID NO: 186578 - DNA, 25 bp, E. coli
ttcgcggatacgatgctggtctgga

SEQ ID NO: 186579 - DNA, 25 bp, E. coli
tgtgttcctccaggcggcgaacctg

SEQ ID NO: 186580 - DNA, 25 bp, E. coli
tgtgttcctccacgcggcgaacctg

SEQ ID NO: 186581 - DNA, 25 bp, E. coli
tccaggcggcgatcctgcttttcca

SEQ ID NO: 186582 - DNA, 25 bp, E. coli
tccaggcggcgaacctgcttttcca

SEQ ID NO: 186583 - DNA, 25 bp, E. coli
tccagttcgcggttacgttgctggt

SEQ ID NO: 186584 - DNA, 25 bp, E. coli
tccagttcgcggatacgttgctggt

SEQ ID NO: 186585 - DNA, 25 bp, E. coli
gcttttccagttcgcggatacgttg

SEQ ID NO: 186586 - DNA, 25 bp, E. coli
gcttttccagttggcggatacgttg

SEQ ID NO: 186587 - DNA, 25 bp, E. coli
cgtattgtgttcgtccaggcggcga

SEQ ID NO: 186588 - DNA, 25 bp, E. coli
cgtattgtgttcctccaggcggcga

SEQ ID NO: 186589 - DNA, 25 bp, E. coli
cggatacgttgcaggtctggagtaa

SEQ ID NO: 186590 - DNA, 25 bp, E. coli
cggatacgttgctggtctggagtaa

SEQ ID NO: 186591 - DNA, 25 bp, E. coli
taatatcgtattctgttcctccagg

SEQ ID NO: 186592 - DNA, 25 bp, E. coli
taatatcgtattgtgttcctccagg

SEQ ID NO: 186593 - DNA, 25 bp, E. coli
cagggaccatctctggctgaactta

SEQ ID NO: 186594 - DNA, 25 bp, E. coli
cattgccaagaatggtagaaggccc

SEQ ID NO: 186595 - DNA, 25 bp, E. coli
cattgccaagaaaggtagaaggccc

SEQ ID NO: 186596 - DNA, 25 bp, E. coli
cagggaccatctgtggctgaactta

SEQ ID NO: 186597 - DNA, 25 bp, E. coli
aaaatactctgctaattcgtctggg

SEQ ID NO: 186598 - DNA, 25 bp, E. coli
aaaatactctgcaaattcgtctggg

SEQ ID NO: 186599 - DNA, 25 bp, E. coli
tgaccggacgtataaacaaatgtgt

SEQ ID NO: 186600 - DNA, 25 bp, E. coli
tgaccggacgtaaaaacaaatgtgt

SEQ ID NO: 186601 - DNA, 25 bp, E. coli
tcaacgattaagaaagctggaaagc

SEQ ID NO: 186602 - DNA, 25 bp, E. coli
tcaacgattaagtaagctggaaagc

SEQ ID NO: 186603 - DNA, 25 bp, E. coli
ccggcatggagatcgctggaaacga

SEQ ID NO: 186604 - DNA, 25 bp, E. coli
ccggcatggagaacgctggaaacga

SEQ ID NO: 186605 - DNA, 25 bp, E. coli
gaagagagcaaaatcctgttcacag

SEQ ID NO: 186606 - DNA, 25 bp, E. coli
gaagagagcaaattcctgttcacag

SEQ ID NO: 186607 - DNA, 25 bp, E. coli
gaaacataaacaggagcagggacca

SEQ ID NO: 186608 - DNA, 25 bp, E. coli
gaaacataaacacgagcagggacca

SEQ ID NO: 186609 - DNA, 25 bp, E. coli
cgagaattcgaagaaacggtatcac

SEQ ID NO: 186610 - DNA, 25 bp, E. coli
cgagaattcgaacaaacggtatcac

SEQ ID NO: 186611 - DNA, 25 bp, E. coli
gtgagatactgataaccccggcatg

SEQ ID NO: 186612 - DNA, 25 bp, E. coli
gtgagatactgaaaaccccggcatg

SEQ ID NO: 186613 - DNA, 25 bp, E. coli
gagaaatcattatcagcaggacgaa

SEQ ID NO: 186614 - DNA, 25 bp, E. coli
gagaaatcattaacagcaggacgaa

SEQ ID NO: 186615 - DNA, 25 bp, E. coli
aacgtcgccatcaggaattactgca

SEQ ID NO: 186616 - DNA, 25 bp, E. coli
aacgtcgccatctggaattactgca

SEQ ID NO: 186617 - DNA, 25 bp, E. coli
ttctatgagtatgcgggtattccgg

SEQ ID NO: 186618 - DNA, 25 bp, E. coli
ttttgcgctttcagggatctcgatc

SEQ ID NO: 186619 - DNA, 25 bp, E. coli
ttctatgagtatccgggtattccgg

SEQ ID NO: 186620 - DNA, 25 bp, E. coli
ttttgcgctttctgggatctcgatc

SEQ ID NO: 186621 - DNA, 25 bp, E. coli
tcctgggcctacttcttctatgagt

SEQ ID NO: 186622 - DNA, 25 bp, E. coli
tgcgctttctgggatctcgatcgcc

SEQ ID NO: 186623 - DNA, 25 bp, E. coli
tgcgctttctggcatctcgatcgcc

SEQ ID NO: 186624 - DNA, 25 bp, E. coli
tcctgggcctacatcttctatgagt

SEQ ID NO: 186625 - DNA, 25 bp, E. coli
tcttctatgagtttgcgggtattcc

SEQ ID NO: 186626 - DNA, 25 bp, E. coli
tcttctatgagtatgcgggtattcc

SEQ ID NO: 186627 - DNA, 25 bp, E. coli
cctacttcttctttgagtatgcggg

SEQ ID NO: 186628 - DNA, 25 bp, E. coli
cctacttcttctatgagtatgcggg

SEQ ID NO: 186629 - DNA, 25 bp, E. coli
gctttctgggatgtcgatcgcctat

SEQ ID NO: 186630 - DNA, 25 bp, E. coli
gctttctgggatctcgatcgcctat

SEQ ID NO: 186631 - DNA, 25 bp, E. coli
gaaaaacgtcgccatcaggaattac

SEQ ID NO: 186632 - DNA, 25 bp, E. coli
gaaaaacgtcgcgatcaggaattac

SEQ ID NO: 186633 - DNA, 25 bp, E. coli
cgccatcaggaaatactgcaaaaac

SEQ ID NO: 186634 - DNA, 25 bp, E. coli
cgccatcaggaattactgcaaaaac

SEQ ID NO: 186635 - DNA, 25 bp, E. coli
tgggatctcgatggcctatggattt

SEQ ID NO: 186636 - DNA, 25 bp, E. coli
tgggatctcgatcgcctatggattt

SEQ ID NO: 186637 - DNA, 25 bp, E. coli
cacgcagatgtttggttcaccgcaa

SEQ ID NO: 186638 - DNA, 25 bp, E. coli
cacgcagatgttaggttcaccgcaa

SEQ ID NO: 186639 - DNA, 25 bp, E. coli
catgttccgcgagatgacgaattta

SEQ ID NO: 186640 - DNA, 25 bp, E. coli
catgttccgcgacatgacgaattta

SEQ ID NO: 186641 - DNA, 25 bp, E. coli
agccgtagtttggtcttcacgcaga

SEQ ID NO: 186642 - DNA, 25 bp, E. coli
agccgtagtttgctcttcacgcaga

SEQ ID NO: 186643 - DNA, 25 bp, E. coli
aaatttaactgcgaacgtggctgga

SEQ ID NO: 186644 - DNA, 25 bp, E. coli
aaatttaactgccaacgtggctgga

SEQ ID NO: 186645 - DNA, 25 bp, E. coli
tttctgatgcgcagattgccgcagc

SEQ ID NO: 186646 - DNA, 25 bp, E. coli
tttctgatgcgctgattgccgcagc

SEQ ID NO: 186647 - DNA, 25 bp, E. coli
tgtacgctggaggaaacagccagaa

SEQ ID NO: 186648 - DNA, 25 bp, E. coli
tgtacgctggagcaaacagccagaa

SEQ ID NO: 186649 - DNA, 25 bp, E. coli
tgttcccgagtaattcccatggccc

SEQ ID NO: 186650 - DNA, 25 bp, E. coli
tgttcccgagtatttcccatggccc

SEQ ID NO: 186651 - DNA, 25 bp, E. coli
tgccgcagcgcgtcgaatggaatac

SEQ ID NO: 186652 - DNA, 25 bp, E. coli
tgccgcagcgcgacgaatggaatac

SEQ ID NO: 186653 - DNA, 25 bp, E. coli
gctgcgccagaagagagtaacgatg

SEQ ID NO: 186654 - DNA, 25 bp, E. coli
gctgcgccagaacagagtaacgatg

SEQ ID NO: 186655 - DNA, 25 bp, E. coli
taatttcaggcaacctgttcccgag

SEQ ID NO: 186656 - DNA, 25 bp, E. coli
taatttcaggcatcctgttcccgag

SEQ ID NO: 186657 - DNA, 25 bp, E. coli
gatgttcaccattaagtcagccgta

SEQ ID NO: 186658 - DNA, 25 bp, E. coli
gatgttcaccataaagtcagccgta

SEQ ID NO: 186659 - DNA, 25 bp, E. coli
caggattaatccgttcatagtgtaa

SEQ ID NO: 186660 - DNA, 25 bp, E. coli
caggattaatcccttcatagtgtaa

SEQ ID NO: 186661 - DNA, 25 bp, E. coli
tatgtcggataagctcttccaacag

SEQ ID NO: 186662 - DNA, 25 bp, E. coli
tatgtcggataacctcttccaacag

SEQ ID NO: 186663 - DNA, 25 bp, E. coli
ttcagccaggttttgaaacgcagca

SEQ ID NO: 186664 - DNA, 25 bp, E. coli
ttcagccaggttatgaaacgcagca

SEQ ID NO: 186665 - DNA, 25 bp, E. coli
tcttccaacagtccatttgcaggtg

SEQ ID NO: 186666 - DNA, 25 bp, E. coli
tcttccaacagtgcatttgcaggtg

SEQ ID NO: 186667 - DNA, 25 bp, E. coli
gcattggtttaacatttcagccagg

SEQ ID NO: 186668 - DNA, 25 bp, E. coli
gcattggtttaagatttcagccagg

SEQ ID NO: 186669 - DNA, 25 bp, E. coli
gaagtattgcatacactaagataag

SEQ ID NO: 186670 - DNA, 25 bp, E. coli
gaagtattgcattcactaagataag

SEQ ID NO: 186671 - DNA, 25 bp, E. coli
gaaacgcagcagtgaatcttgaaat

SEQ ID NO: 186672 - DNA, 25 bp, E. coli
gaaacgcagcagagaatcttgaaat

SEQ ID NO: 186673 - DNA, 25 bp, E. coli
cgtttacacattgtgacggaagata

SEQ ID NO: 186674 - DNA, 25 bp, E. coli
cgtttacacattctgacggaagata

SEQ ID NO: 186675 - DNA, 25 bp, E. coli
ggagagatctcgtttttcgcgacaa

SEQ ID NO: 186676 - DNA, 25 bp, E. coli
ggcgtttttcttcctaattccagga

SEQ ID NO: 186677 - DNA, 25 bp, E. coli
ggcgtttttcttgctaattccagga

SEQ ID NO: 186678 - DNA, 25 bp, E. coli
ggagagatctcgattttcgcgacaa

SEQ ID NO: 186679 - DNA, 25 bp, E. coli
taagtatggcaagactggaacagac

SEQ ID NO: 186680 - DNA, 25 bp, E. coli
taagtatggcaacactggaacagac

SEQ ID NO: 186681 - DNA, 25 bp, E. coli
cactaagcgtaatgcgatggcccgt

SEQ ID NO: 186682 - DNA, 25 bp, E. coli
cactaagcgtaaagcgatggcccgt

SEQ ID NO: 186683 - DNA, 25 bp, E. coli
cagattatgttacgcactgccggaa

SEQ ID NO: 186684 - DNA, 25 bp, E. coli
catgatcactttggcgtcagctggt

SEQ ID NO: 186685 - DNA, 25 bp, E. coli
catgatcactttcgcgtcagctggt

SEQ ID NO: 186686 - DNA, 25 bp, E. coli
cagattatgttaggcactgccggaa

SEQ ID NO: 186687 - DNA, 25 bp, E. coli
aaaatatttatttccgccagcggtg

SEQ ID NO: 186688 - DNA, 25 bp, E. coli
aaaatatttattaccgccagcggtg

SEQ ID NO: 186689 - DNA, 25 bp, E. coli
tacctattgcaaatctggccgccgg

SEQ ID NO: 186690 - DNA, 25 bp, E. coli
tacctattgcaattctggccgccgg

SEQ ID NO: 186691 - DNA, 25 bp, E. coli
tattcgtcgcgaactccatcaggaa

SEQ ID NO: 186692 - DNA, 25 bp, E. coli
tattcgtcgcgatctccatcaggaa

SEQ ID NO: 186693 - DNA, 25 bp, E. coli
tgataatggccacgagataccgctc

SEQ ID NO: 186694 - DNA, 25 bp, E. coli
tgattagcgatcctccgttaccggc

SEQ ID NO: 186695 - DNA, 25 bp, E. coli
tgttcgatgaagaagcctctgccag

SEQ ID NO: 186696 - DNA, 25 bp, E. coli
tgattagcgatcgtccgttaccggc

SEQ ID NO: 186697 - DNA, 25 bp, E. coli
tgttcgatgaagtagcctctgccag

SEQ ID NO: 186698 - DNA, 25 bp, E. coli
tgataatggccaggagataccgctc

SEQ ID NO: 186699 - DNA, 25 bp, E. coli
gaatccatttgatagacgcggcacg

SEQ ID NO: 186700 - DNA, 25 bp, E. coli
gaatccatttgaaagacgcggcacg

SEQ ID NO: 186701 - DNA, 25 bp, E. coli
taaggaaaattttgctcgcccgcca

SEQ ID NO: 186702 - DNA, 25 bp, E. coli
taaggaaaatttagctcgcccgcca

SEQ ID NO: 186703 - DNA, 25 bp, E. coli
aactggatgaaaacgctcggctggc

SEQ ID NO: 186704 - DNA, 25 bp, E. coli
tactgcctggaaagatgatccgcgc

SEQ ID NO: 186705 - DNA, 25 bp, E. coli
tactgcctggaatgatgatccgcgc

SEQ ID NO: 186706 - DNA, 25 bp, E. coli
aactggatgaaatcgctcggctggc

SEQ ID NO: 186707 - DNA, 25 bp, E. coli
tatgccaacagcaatgagcgggagg

SEQ ID NO: 186708 - DNA, 25 bp, E. coli
tatgccaacagctatgagcgggagg

SEQ ID NO: 186709 - DNA, 25 bp, E. coli
ttaaacgtaatcactatcgccgcgg

SEQ ID NO: 186710 - DNA, 25 bp, E. coli
ttaaacgtaatctctatcgccgcgg

SEQ ID NO: 186711 - DNA, 25 bp, E. coli
tgtcgcggaccagtgcaagctatgt

SEQ ID NO: 186712 - DNA, 25 bp, E. coli
tgtcgcggaccactgcaagctatgt

SEQ ID NO: 186713 - DNA, 25 bp, E. coli
tgcattgagcaccttttacagcgtc

SEQ ID NO: 186714 - DNA, 25 bp, E. coli
tgcattgagcacgttttacagcgtc

SEQ ID NO: 186715 - DNA, 25 bp, E. coli
gctaactatcttgaacgccaggcgc

SEQ ID NO: 186716 - DNA, 25 bp, E. coli
gctaactatcttcaacgccaggcgc

SEQ ID NO: 186717 - DNA, 25 bp, E. coli
gaaaaatggctgcaaacgcatccga

SEQ ID NO: 186718 - DNA, 25 bp, E. coli
gaaaaatggctggaaacgcatccga

SEQ ID NO: 186719 - DNA, 25 bp, E. coli
ctttggcgataacgaactgctcgac

SEQ ID NO: 186720 - DNA, 25 bp, E. coli
ctttggcgataaggaactgctcgac

SEQ ID NO: 186721 - DNA, 25 bp, E. coli
ttttatcaacgcagggctaacgacc

SEQ ID NO: 186722 - DNA, 25 bp, E. coli
ttttatcaacgctgggctaacgacc

SEQ ID NO: 186723 - DNA, 25 bp, E. coli
tggagaacaccacctatacccgcat

SEQ ID NO: 186724 - DNA, 25 bp, E. coli
tggagaacaccagctatacccgcat

SEQ ID NO: 186725 - DNA, 25 bp, E. coli
catgtgtctcaatcggaaacgcgga

SEQ ID NO: 186726 - DNA, 25 bp, E. coli
catgtgtctcaaacggaaacgcgga

SEQ ID NO: 186727 - DNA, 25 bp, E. coli
tacgggatcctgtatgccatgtgtc

SEQ ID NO: 186728 - DNA, 25 bp, E. coli
tacgggatcctgaatgccatgtgtc

SEQ ID NO: 186729 - DNA, 25 bp, E. coli
taaaacccgtcagaatgaacatccg

SEQ ID NO: 186730 - DNA, 25 bp, E. coli
taaaacccgtcacaatgaacatccg

SEQ ID NO: 186731 - DNA, 25 bp, E. coli
taccctgtgcggatgagaaaatcgc

SEQ ID NO: 186732 - DNA, 25 bp, E. coli
taccctgtgcggttgagaaaatcgc

SEQ ID NO: 186733 - DNA, 25 bp, E. coli
tatcaaaacgctctcaatggacatg

SEQ ID NO: 186734 - DNA, 25 bp, E. coli
tatcaaaacgctgtcaatggacatg

SEQ ID NO: 186735 - DNA, 25 bp, E. coli
tgaagctgacaacccagtgctgggc

SEQ ID NO: 186736 - DNA, 25 bp, E. coli
tgaagctgacaagccagtgctgggc

SEQ ID NO: 186737 - DNA, 25 bp, E. coli
tctggcggccaagagtgacgttcct

SEQ ID NO: 186738 - DNA, 25 bp, E. coli
tctggcggccaacagtgacgttcct

SEQ ID NO: 186739 - DNA, 25 bp, E. coli
ccttaacggacgtttgtggcacaga

SEQ ID NO: 186740 - DNA, 25 bp, E. coli
ccttaacggacgattgtggcacaga

SEQ ID NO: 186741 - DNA, 25 bp, E. coli
gctatataagaggagcgcgtatcca

SEQ ID NO: 186742 - DNA, 25 bp, E. coli
gctatataagagcagcgcgtatcca

SEQ ID NO: 186743 - DNA, 25 bp, E. coli
gttcctatgatgtaaaacgccgcga

SEQ ID NO: 186744 - DNA, 25 bp, E. coli
gttcctatgatgaaaaacgccgcga

SEQ ID NO: 186745 - DNA, 25 bp, E. coli
ggctatcttcgctcgcttactgacg

SEQ ID NO: 186746 - DNA, 25 bp, E. coli
ggctatcttcgcacgcttactgacg

SEQ ID NO: 186747 - DNA, 25 bp, E. coli
cacctggctgatcgaagtgacaccg

SEQ ID NO: 186748 - DNA, 25 bp, E. coli
cacctggctgatggaagtgacaccg

SEQ ID NO: 186749 - DNA, 25 bp, E. coli
cagtgggacacggaatccgatatgt

SEQ ID NO: 186750 - DNA, 25 bp, E. coli
cagtgggacacgcaatccgatatgt

SEQ ID NO: 186751 - DNA, 25 bp, E. coli
agcggatgattttctcggcacccag

SEQ ID NO: 186752 - DNA, 25 bp, E. coli
agcggatgatttactcggcacccag

SEQ ID NO: 186753 - DNA, 25 bp, E. coli
tccgatatgttctgcgcgctgcttg

SEQ ID NO: 186754 - DNA, 25 bp, E. coli
tccgatatgttcagcgcgctgcttg

SEQ ID NO: 186755 - DNA, 25 bp, E. coli
cgctggcgataagcgcgatgtatga

SEQ ID NO: 186756 - DNA, 25 bp, E. coli
cgctggcgataaccgcgatgtatga

SEQ ID NO: 186757 - DNA, 25 bp, E. coli
cggtgatattccacgctcgctttca

SEQ ID NO: 186758 - DNA, 25 bp, E. coli
cggtgatattcctcgctcgctttca

SEQ ID NO: 186759 - DNA, 25 bp, E. coli
ggcccatgacaatctcacctggctg

SEQ ID NO: 186760 - DNA, 25 bp, E. coli
ggcgctttggctagataaccggata

SEQ ID NO: 186761 - DNA, 25 bp, E. coli
ggcccatgacaaactcacctggctg

SEQ ID NO: 186762 - DNA, 25 bp, E. coli
ggcgctttggcttgataaccggata

SEQ ID NO: 186763 - DNA, 25 bp, E. coli
taacgccgctgcactatacgctcat

SEQ ID NO: 186764 - DNA, 25 bp, E. coli
taacgccgctgctctatacgctcat

SEQ ID NO: 186765 - DNA, 25 bp, E. coli
gatttataccgggatttcggcccat

SEQ ID NO: 186766 - DNA, 25 bp, E. coli
gacccgcacactgaagccgttaatt

SEQ ID NO: 186767 - DNA, 25 bp, E. coli
gatttataccggcatttcggcccat

SEQ ID NO: 186768 - DNA, 25 bp, E. coli
gacccgcacactcaagccgttaatt

SEQ ID NO: 186769 - DNA, 25 bp, E. coli
caatattgtgacagtggagcgccgg

SEQ ID NO: 186770 - DNA, 25 bp, E. coli
caatattgtgactgtggagcgccgg

SEQ ID NO: 186771 - DNA, 25 bp, E. coli
catttcactggaagaaacgacggcg

SEQ ID NO: 186772 - DNA, 25 bp, E. coli
catttcactggatgaaacgacggcg

SEQ ID NO: 186773 - DNA, 25 bp, E. coli
taaaaatgcctggaccctcgaaagt

SEQ ID NO: 186774 - DNA, 25 bp, E. coli
taaaaatgcctgcaccctcgaaagt

SEQ ID NO: 186775 - DNA, 25 bp, E. coli
tatccgctggagaagccaacttgcg

SEQ ID NO: 186776 - DNA, 25 bp, E. coli
tatccgctggagtagccaacttgcg

SEQ ID NO: 186777 - DNA, 25 bp, E. coli
tatacagcgagtttggtcgccgccc

SEQ ID NO: 186778 - DNA, 25 bp, E. coli
tatacagcgagtatggtcgccgccc

SEQ ID NO: 186779 - DNA, 25 bp, E. coli
tatcgtctggaggaacactctgcgc

SEQ ID NO: 186780 - DNA, 25 bp, E. coli
tatcgtctggagcaacactctgcgc

SEQ ID NO: 186781 - DNA, 25 bp, E. coli
tatttgcaacgtccaggtcgcgcgg

SEQ ID NO: 186782 - DNA, 25 bp, E. coli
tatttgcaacgtgcaggtcgcgcgg

SEQ ID NO: 186783 - DNA, 25 bp, E. coli
tcaggtatggtttgagcagcgccaa

SEQ ID NO: 186784 - DNA, 25 bp, E. coli
tcaggtatggttagagcagcgccaa

SEQ ID NO: 186785 - DNA, 25 bp, E. coli
tcatcaacttactgcgtggcgaacg

SEQ ID NO: 186786 - DNA, 25 bp, E. coli
tcatcaacttacagcgtggcgaacg

SEQ ID NO: 186787 - DNA, 25 bp, E. coli
gaaatcgcccgagaagaacgtctgg

SEQ ID NO: 186788 - DNA, 25 bp, E. coli
gaaatcgcccgacaagaacgtctgg

SEQ ID NO: 186789 - DNA, 25 bp, E. coli
gataaagttacatcctgcccgcagg

SEQ ID NO: 186790 - DNA, 25 bp, E. coli
gataaagttacaacctgcccgcagg

SEQ ID NO: 186791 - DNA, 25 bp, E. coli
tacattgcgcctgctgaaaaaataa

SEQ ID NO: 186792 - DNA, 25 bp, E. coli
tacattgcgcctcctgaaaaaataa

SEQ ID NO: 186793 - DNA, 25 bp, E. coli
aaacgttcgtctaatcaacgctatg

SEQ ID NO: 186794 - DNA, 25 bp, E. coli
aaacgttcgtcttatcaacgctatg

SEQ ID NO: 186795 - DNA, 25 bp, E. coli
aaaaatatacattgcgcctcctgaa

SEQ ID NO: 186796 - DNA, 25 bp, E. coli
aaagcgattagaggctgggctgaca

SEQ ID NO: 186797 - DNA, 25 bp, E. coli
aaagcgattagacgctgggctgaca

SEQ ID NO: 186798 - DNA, 25 bp, E. coli
aaaaatatacatagcgcctcctgaa

SEQ ID NO: 186799 - DNA, 25 bp, E. coli
tttcaaccatcaccacgctatctcg

SEQ ID NO: 186800 - DNA, 25 bp, E. coli
tttcaaccatcagcacgctatctcg

SEQ ID NO: 186801 - DNA, 25 bp, E. coli
tgcgcctcctgataaaataaatttt

SEQ ID NO: 186802 - DNA, 25 bp, E. coli
tgcgcctcctgaaaaaataaatttt

SEQ ID NO: 186803 - DNA, 25 bp, E. coli
tcatgcggagggagtggaaacgcct

SEQ ID NO: 186804 - DNA, 25 bp, E. coli
tcatgcggagggtgtggaaacgcct

SEQ ID NO: 186805 - DNA, 25 bp, E. coli
gctatctcgtttaattaaacgttcg

SEQ ID NO: 186806 - DNA, 25 bp, E. coli
gctatctcgttttattaaacgttcg

SEQ ID NO: 186807 - DNA, 25 bp, E. coli
cgattagacgctgggctgacagaac

SEQ ID NO: 186808 - DNA, 25 bp, E. coli
cgattagacgctcggctgacagaac

SEQ ID NO: 186809 - DNA, 25 bp, E. coli
gtgaagaaatgcctaataaaaatat

SEQ ID NO: 186810 - DNA, 25 bp, E. coli
gtgaagaaatgcgtaataaaaatat

SEQ ID NO: 186811 - DNA, 25 bp, E. coli
taataaaaatatacattgcgcctcc

SEQ ID NO: 186812 - DNA, 25 bp, E. coli
taataaaaatattcattgcgcctcc

SEQ ID NO: 186813 - DNA, 25 bp, E. coli
cacctgtgcgcacgatggccagtat

SEQ ID NO: 186814 - DNA, 25 bp, E. coli
cacgatggccagaatgtgaattact

SEQ ID NO: 186815 - DNA, 25 bp, E. coli
cacctgtgcgcaggatggccagtat

SEQ ID NO: 186816 - DNA, 25 bp, E. coli
cacgatggccagtatgtgaattact

SEQ ID NO: 186817 - DNA, 25 bp, E. coli
cgtggtcgatgacaaacgtaacccg

SEQ ID NO: 186818 - DNA, 25 bp, E. coli
cgtggtcgatgagaaacgtaacccg

SEQ ID NO: 186819 - DNA, 25 bp, E. coli
aaattgcccagtccacctgtgcgca

SEQ ID NO: 186820 - DNA, 25 bp, E. coli
aaattgcccagtgcacctgtgcgca

SEQ ID NO: 186821 - DNA, 25 bp, E. coli
tgtgcgcacgatggccagtatgtga

SEQ ID NO: 186822 - DNA, 25 bp, E. coli
tgtgcgcacgatcgccagtatgtga

SEQ ID NO: 186823 - DNA, 25 bp, E. coli
tgacaaacgtaagccgatggacttc

SEQ ID NO: 186824 - DNA, 25 bp, E. coli
tgacaaacgtaacccgatggacttc

SEQ ID NO: 186825 - DNA, 25 bp, E. coli
gcattccggtatggtgatggttgac

SEQ ID NO: 186826 - DNA, 25 bp, E. coli
gcattccggtatcgtgatggttgac

SEQ ID NO: 186827 - DNA, 25 bp, E. coli
gaattactggatgcattccggtatg

SEQ ID NO: 186828 - DNA, 25 bp, E. coli
gagaacgaaattgcccagtccacct

SEQ ID NO: 186829 - DNA, 25 bp, E. coli
gaattactggatccattccggtatg

SEQ ID NO: 186830 - DNA, 25 bp, E. coli
gagaacgaaattccccagtccacct

SEQ ID NO: 186831 - DNA, 25 bp, E. coli
gcaccacgagaaggaaattgcccag

SEQ ID NO: 186832 - DNA, 25 bp, E. coli
gcaccacgagaacgaaattgcccag

SEQ ID NO: 186833 - DNA, 25 bp, E. coli
gtcgatgacaaaggtaacccgatgg

SEQ ID NO: 186834 - DNA, 25 bp, E. coli
gtcgatgacaaacgtaacccgatgg

SEQ ID NO: 186835 - DNA, 25 bp, E. coli
aaggccgcagagttttatccctgcg

SEQ ID NO: 186836 - DNA, 25 bp, E. coli
aaggccgcagagatttatccctgcg

SEQ ID NO: 186837 - DNA, 25 bp, E. coli
ctgacgcccgtctggcacgttactt

SEQ ID NO: 186838 - DNA, 25 bp, E. coli
ctgacgcccgtcaggcacgttactt

SEQ ID NO: 186839 - DNA, 25 bp, E. coli
agttttatccctccggcctgatccg

SEQ ID NO: 186840 - DNA, 25 bp, E. coli
agttttatccctgcggcctgatccg

SEQ ID NO: 186841 - DNA, 25 bp, E. coli
tattatccgcttgcaaccgttgcat

SEQ ID NO: 186842 - DNA, 25 bp, E. coli
tattatccgcttccaaccgttgcat

SEQ ID NO: 186843 - DNA, 25 bp, E. coli
tgcatttttctttcgaaaaaggccg

SEQ ID NO: 186844 - DNA, 25 bp, E. coli
tgcatttttcttacgaaaaaggccg

SEQ ID NO: 186845 - DNA, 25 bp, E. coli
tgcgcattccgctgaatattatccg

SEQ ID NO: 186846 - DNA, 25 bp, E. coli
tgcgcattccgcagaatattatccg

SEQ ID NO: 186847 - DNA, 25 bp, E. coli
gaatattatccggttgcaaccgttg

SEQ ID NO: 186848 - DNA, 25 bp, E. coli
gcagaatattatccgcttgcaaccg

SEQ ID NO: 186849 - DNA, 25 bp, E. coli
gcaaccgttgcatttttcttacgaa

SEQ ID NO: 186850 - DNA, 25 bp, E. coli
gaatattatccgcttgcaaccgttg

SEQ ID NO: 186851 - DNA, 25 bp, E. coli
gcaaccgttgcaattttcttacgaa

SEQ ID NO: 186852 - DNA, 25 bp, E. coli
gcagaatattatgcgcttgcaaccg

SEQ ID NO: 186853 - DNA, 25 bp, E. coli
gtctggcacgtttcttccgcttgtt

SEQ ID NO: 186854 - DNA, 25 bp, E. coli
gtctggcacgttacttccgcttgtt

SEQ ID NO: 186855 - DNA, 25 bp, E. coli
gtgctgcgcattgcgcagaatatta

SEQ ID NO: 186856 - DNA, 25 bp, E. coli
gtgctgcgcattccgcagaatatta

SEQ ID NO: 186857 - DNA, 25 bp, E. coli
aagctggcagagtccgctaaccgtg

SEQ ID NO: 186858 - DNA, 25 bp, E. coli
aagctggcagagaccgctaaccgtg

SEQ ID NO: 186859 - DNA, 25 bp, E. coli
cagaggcgactcctgttcacctgga

SEQ ID NO: 186860 - DNA, 25 bp, E. coli
cagaggcgactcgtgttcacctgga

SEQ ID NO: 186861 - DNA, 25 bp, E. coli
tactggcgcatctctgatcgttggg

SEQ ID NO: 186862 - DNA, 25 bp, E. coli
tactggcgcatcactgatcgttggg

SEQ ID NO: 186863 - DNA, 25 bp, E. coli
tagacggtagaatggtcttcgagcg

SEQ ID NO: 186864 - DNA, 25 bp, E. coli
tagacggtagaaaggtcttcgagcg

SEQ ID NO: 186865 - DNA, 25 bp, E. coli
tatgtgccatatggcgatcagagca

SEQ ID NO: 186866 - DNA, 25 bp, E. coli
tatgtgccatatcgcgatcagagca

SEQ ID NO: 186867 - DNA, 25 bp, E. coli
tatacccagacactggaaccacgcg

SEQ ID NO: 186868 - DNA, 25 bp, E. coli
tatacccagacagtggaaccacgcg

SEQ ID NO: 186869 - DNA, 25 bp, E. coli
tcttcgagcgtgatatggaaatgct

SEQ ID NO: 186870 - DNA, 25 bp, E. coli
tcttcgagcgtgttatggaaatgct

SEQ ID NO: 186871 - DNA, 25 bp, E. coli
ccagagatgacatgccagaggcgac

SEQ ID NO: 186872 - DNA, 25 bp, E. coli
ccagagatgacaagccagaggcgac

SEQ ID NO: 186873 - DNA, 25 bp, E. coli
gctaaccgtgtaatgccgcagttca

SEQ ID NO: 186874 - DNA, 25 bp, E. coli
gctaaccgtgtattgccgcagttca

SEQ ID NO: 186875 - DNA, 25 bp, E. coli
gaaccacgcgcgcagtatctgtatg

SEQ ID NO: 186876 - DNA, 25 bp, E. coli
gaaccacgcgcggagtatctgtatg

SEQ ID NO: 186877 - DNA, 25 bp, E. coli
ccgcagttcaaggtagacggtagaa

SEQ ID NO: 186878 - DNA, 25 bp, E. coli
ccgcagttcaagctagacggtagaa

SEQ ID NO: 186879 - DNA, 25 bp, E. coli
cacaaatttacgactgcgaaggctt

SEQ ID NO: 186880 - DNA, 25 bp, E. coli
caacaaaggttatcgctggcagcat

SEQ ID NO: 186881 - DNA, 25 bp, E. coli
caacaaaggttaacgctggcagcat

SEQ ID NO: 186882 - DNA, 25 bp, E. coli
cacaaatttacgtctgcgaaggctt

SEQ ID NO: 186883 - DNA, 25 bp, E. coli
cagaaagcaatcaggaaatcgcagc

SEQ ID NO: 186884 - DNA, 25 bp, E. coli
cagaaagcaatctggaaatcgcagc

SEQ ID NO: 186885 - DNA, 25 bp, E. coli
ttgaagccctgatcggtaaagtccg

SEQ ID NO: 186886 - DNA, 25 bp, E. coli
ttgctcgtctgcctaaaactcaggc

SEQ ID NO: 186887 - DNA, 25 bp, E. coli
ttgaagccctgaacggtaaagtccg

SEQ ID NO: 186888 - DNA, 25 bp, E. coli
ttgctcgtctgcgtaaaactcaggc

SEQ ID NO: 186889 - DNA, 25 bp, E. coli
tgttacatgccattatcagccgctg

SEQ ID NO: 186890 - DNA, 25 bp, E. coli
tggtgcgtaaagttcccgatgcgct

SEQ ID NO: 186891 - DNA, 25 bp, E. coli
tgttacatgccaatatcagccgctg

SEQ ID NO: 186892 - DNA, 25 bp, E. coli
tgacggtaatgctccacagcgggtg

SEQ ID NO: 186893 - DNA, 25 bp, E. coli
tgacggtaatgcaccacagcgggtg

SEQ ID NO: 186894 - DNA, 25 bp, E. coli
tgccaatgagttttccgccagtcgg

SEQ ID NO: 186895 - DNA, 25 bp, E. coli
tgccaatgagttatccgccagtcgg

SEQ ID NO: 186896 - DNA, 25 bp, E. coli
tggtgcgtaaagatcccgatgcgct

SEQ ID NO: 186897 - DNA, 25 bp, E. coli
gatgccattttggtggacgctccct

SEQ ID NO: 186898 - DNA, 25 bp, E. coli
gatgccattttgctggacgctccct

SEQ ID NO: 186899 - DNA, 25 bp, E. coli
gacgcttacgccaattccgtggtgt

SEQ ID NO: 186900 - DNA, 25 bp, E. coli
gacgcttacgcctattccgtggtgt

SEQ ID NO: 186901 - DNA, 25 bp, E. coli
tacacgagcgccattatcgaagtgc

SEQ ID NO: 186902 - DNA, 25 bp, E. coli
tacacgagcgcctttatcgaagtgc

SEQ ID NO: 186903 - DNA, 25 bp, E. coli
taaaaggaccgatgcgtggcagacc

SEQ ID NO: 186904 - DNA, 25 bp, E. coli
taaaaggaccgaagcgtggcagacc

SEQ ID NO: 186905 - DNA, 25 bp, E. coli
tatgctatgcctttccggtcggtaa

SEQ ID NO: 186906 - DNA, 25 bp, E. coli
tatgctatgcctatccggtcggtaa

SEQ ID NO: 186907 - DNA, 25 bp, E. coli
tacgcaggcgggtgaatattcaggc

SEQ ID NO: 186908 - DNA, 25 bp, E. coli
tacgcaggcgggagaatattcaggc

SEQ ID NO: 186909 - DNA, 25 bp, E. coli
tattgccttttccagggtgtgcccg

SEQ ID NO: 186910 - DNA, 25 bp, E. coli
tattgccttttcgagggtgtgcccg

SEQ ID NO: 186911 - DNA, 25 bp, E. coli
tttgatataagcgacagccaccgcc

SEQ ID NO: 186912 - DNA, 25 bp, E. coli
tttgatataagccacagccaccgcc

SEQ ID NO: 186913 - DNA, 25 bp, E. coli
tccgtcgatcgtcaaaaactggcct

SEQ ID NO: 186914 - DNA, 25 bp, E. coli
tccgtcgatcgtgaaaaactggcct

SEQ ID NO: 186915 - DNA, 25 bp, E. coli
tctatcgtcagtcggctaaagcggg

SEQ ID NO: 186916 - DNA, 25 bp, E. coli
tctatcgtcagtgggctaaagcggg

SEQ ID NO: 186917 - DNA, 25 bp, E. coli
gcgactgcattgattacgaccggat

SEQ ID NO: 186918 - DNA, 25 bp, E. coli
gcgactgcattgtttacgaccggat

SEQ ID NO: 186919 - DNA, 25 bp, E. coli
ctaaagcgggctggatacgcacaac

SEQ ID NO: 186920 - DNA, 25 bp, E. coli
ctaaagcgggctcgatacgcacaac

SEQ ID NO: 186921 - DNA, 25 bp, E. coli
tcaccgaacaagttagacccgagcg

SEQ ID NO: 186922 - DNA, 25 bp, E. coli
tcaccgaacaagatagacccgagcg

SEQ ID NO: 186923 - DNA, 25 bp, E. coli
catagttttataggtcgaataaggc

SEQ ID NO: 186924 - DNA, 25 bp, E. coli
caggcgggaagccattaaaaaagag

SEQ ID NO: 186925 - DNA, 25 bp, E. coli
caggcgggaagcgattaaaaaagag

SEQ ID NO: 186926 - DNA, 25 bp, E. coli
catagttttatacgtcgaataaggc

SEQ ID NO: 186927 - DNA, 25 bp, E. coli
aaattactctttatcgcacaatcca

SEQ ID NO: 186928 - DNA, 25 bp, E. coli
aaattactctttttcgcacaatcca

SEQ ID NO: 186929 - DNA, 25 bp, E. coli
aaaaagaggcggctcgatgacaaag

SEQ ID NO: 186930 - DNA, 25 bp, E. coli
aaaaagaggcgggtcgatgacaaag

SEQ ID NO: 186931 - DNA, 25 bp, E. coli
tattcgactcctgcaatgtattgaa

SEQ ID NO: 186932 - DNA, 25 bp, E. coli
tattcgactcctccaatgtattgaa

SEQ ID NO: 186933 - DNA, 25 bp, E. coli
ttatctatccagtgtaacaggcggg

SEQ ID NO: 186934 - DNA, 25 bp, E. coli
ttatctatccagagtaacaggcggg

SEQ ID NO: 186935 - DNA, 25 bp, E. coli
gcctgtcaggccaattcgactcctg

SEQ ID NO: 186936 - DNA, 25 bp, E. coli
gcctgtcaggcctattcgactcctg

SEQ ID NO: 186937 - DNA, 25 bp, E. coli
gcatccggcgtgaacaaattactct

SEQ ID NO: 186938 - DNA, 25 bp, E. coli
gcatccggcgtgtacaaattactct

SEQ ID NO: 186939 - DNA, 25 bp, E. coli
gactccgaatgcaggttatctatcc

SEQ ID NO: 186940 - DNA, 25 bp, E. coli
gacaaaggttacaccgtctgacgtg

SEQ ID NO: 186941 - DNA, 25 bp, E. coli
gacaaaggttactccgtctgacgtg

SEQ ID NO: 186942 - DNA, 25 bp, E. coli
gactccgaatgctggttatctatcc

SEQ ID NO: 186943 - DNA, 25 bp, E. coli
cgtctgacgtgcaacgcctgtcagg

SEQ ID NO: 186944 - DNA, 25 bp, E. coli
cgtctgacgtgctacgcctgtcagg

SEQ ID NO: 186945 - DNA, 25 bp, E. coli
aatcagtggtctgttatttatcgca

SEQ ID NO: 186946 - DNA, 25 bp, E. coli
aatcagtggtctcttatttatcgca

SEQ ID NO: 186947 - DNA, 25 bp, E. coli
ttatcgcattttagttggttcctgc

SEQ ID NO: 186948 - DNA, 25 bp, E. coli
ttatcgcatttttgttggttcctgc

SEQ ID NO: 186949 - DNA, 25 bp, E. coli
gccctgtgtggctctattctcaata

SEQ ID NO: 186950 - DNA, 25 bp, E. coli
gccctgtgtggcactattctcaata

SEQ ID NO: 186951 - DNA, 25 bp, E. coli
cgcaattggtatagccctgtgtggc

SEQ ID NO: 186952 - DNA, 25 bp, E. coli
cgcaattggtattgccctgtgtggc

SEQ ID NO: 186953 - DNA, 25 bp, E. coli
cggctgaagttaccctctggtgtat

SEQ ID NO: 186954 - DNA, 25 bp, E. coli
cggctgaagttagcctctggtgtat

SEQ ID NO: 186955 - DNA, 25 bp, E. coli
cggatacctttcagctaatcagtgg

SEQ ID NO: 186956 - DNA, 25 bp, E. coli
cggatacctttctgctaatcagtgg

SEQ ID NO: 186957 - DNA, 25 bp, E. coli
gggaattccaaatgaacggctgaag

SEQ ID NO: 186958 - DNA, 25 bp, E. coli
ggttcctgctatcaataaatcatcc

SEQ ID NO: 186959 - DNA, 25 bp, E. coli
ggttcctgctatgaataaatcatcc

SEQ ID NO: 186960 - DNA, 25 bp, E. coli
ggaggcgcaaactatggcattttcg

SEQ ID NO: 186961 - DNA, 25 bp, E. coli
ggcttcaaccaatttattgagtcaa

SEQ ID NO: 186962 - DNA, 25 bp, E. coli
ggcttcaaccaaattattgagtcaa

SEQ ID NO: 186963 - DNA, 25 bp, E. coli
gggaattccaaaagaacggctgaag

SEQ ID NO: 186964 - DNA, 25 bp, E. coli
ggaggcgcaaacaatggcattttcg

SEQ ID NO: 186965 - DNA, 25 bp, E. coli
tcaattgatgctgagggaggcgcaa

SEQ ID NO: 186966 - DNA, 25 bp, E. coli
tcaattgatgctcagggaggcgcaa

SEQ ID NO: 186967 - DNA, 25 bp, E. coli
aatgttgctgctttgttaatatcgg

SEQ ID NO: 186968 - DNA, 25 bp, E. coli
aatgttgctgctatgttaatatcgg

SEQ ID NO: 186969 - DNA, 25 bp, E. coli
cactcaccgagggaaggcctgtaac

SEQ ID NO: 186970 - DNA, 25 bp, E. coli
cactcaccgaggcaaggcctgtaac

SEQ ID NO: 186971 - DNA, 25 bp, E. coli
cagttaactttcacggagaacgtct

SEQ ID NO: 186972 - DNA, 25 bp, E. coli
cagttaactttctcggagaacgtct

SEQ ID NO: 186973 - DNA, 25 bp, E. coli
agtcagttaactatcacggagaacg

SEQ ID NO: 186974 - DNA, 25 bp, E. coli
agtcagttaactttcacggagaacg

SEQ ID NO: 186975 - DNA, 25 bp, E. coli
tgttgctgctttcttaatatcggac

SEQ ID NO: 186976 - DNA, 25 bp, E. coli
tgtccgcatcgcaccgtgctgacgg

SEQ ID NO: 186977 - DNA, 25 bp, E. coli
tgttgctgctttgttaatatcggac

SEQ ID NO: 186978 - DNA, 25 bp, E. coli
tgtccgcatcgctccgtgctgacgg

SEQ ID NO: 186979 - DNA, 25 bp, E. coli
tgacggtcctcagtcaccgagggaa

SEQ ID NO: 186980 - DNA, 25 bp, E. coli
tgacggtcctcactcaccgagggaa

SEQ ID NO: 186981 - DNA, 25 bp, E. coli
gaaaaatagtttctgtggtgtccat

SEQ ID NO: 186982 - DNA, 25 bp, E. coli
gaaaaatagtttgtgtggtgtccat

SEQ ID NO: 186983 - DNA, 25 bp, E. coli
ccccgctgcctctggcttttgcaga

SEQ ID NO: 186984 - DNA, 25 bp, E. coli
ccccgctgcctcaggcttttgcaga

SEQ ID NO: 186985 - DNA, 25 bp, E. coli
ctcactcaccgagggaaggcctgta

SEQ ID NO: 186986 - DNA, 25 bp, E. coli
ctcactcaccgacggaaggcctgta

SEQ ID NO: 186987 - DNA, 25 bp, E. coli
gtgctgacggtcctcactcaccgag

SEQ ID NO: 186988 - DNA, 25 bp, E. coli
gtgctgacggtcgtcactcaccgag

SEQ ID NO: 186989 - DNA, 25 bp, E. coli
tacgcaatgaaaaagcgatgcgtct

SEQ ID NO: 186990 - DNA, 25 bp, E. coli
tacgcaatgaaatagcgatgcgtct

SEQ ID NO: 186991 - DNA, 25 bp, E. coli
ttttccggcgggttagcgatgtatg

SEQ ID NO: 186992 - DNA, 25 bp, E. coli
ttttccggcgggatagcgatgtatg

SEQ ID NO: 186993 - DNA, 25 bp, E. coli
tgttgttgtgtctgttttccggcgg

SEQ ID NO: 186994 - DNA, 25 bp, E. coli
tgttgttgtgtcagttttccggcgg

SEQ ID NO: 186995 - DNA, 25 bp, E. coli
tgccctacaccatcagcttattaat

SEQ ID NO: 186996 - DNA, 25 bp, E. coli
tcgcgaactgctcgcgttgttgttg

SEQ ID NO: 186997 - DNA, 25 bp, E. coli
tcgcgaactgctggcgttgttgttg

SEQ ID NO: 186998 - DNA, 25 bp, E. coli
tgccctacaccaacagcttattaat

SEQ ID NO: 186999 - DNA, 25 bp, E. coli
gcttctcgctggctaatgagcgtac

SEQ ID NO: 187000 - DNA, 25 bp, E. coli
gcttctcgctgggtaatgagcgtac

SEQ ID NO: 187001 - DNA, 25 bp, E. coli
cgttatgggactcgtgttgtatgcc

SEQ ID NO: 187002 - DNA, 25 bp, E. coli
cgttatgggactggtgttgtatgcc

SEQ ID NO: 187003 - DNA, 25 bp, E. coli
gggttgggcttgttcaacttgcgcc

SEQ ID NO: 187004 - DNA, 25 bp, E. coli
gggttgggcttgatcaacttgcgcc

SEQ ID NO: 187005 - DNA, 25 bp, E. coli
tcaacttgcgccagatttcgccacg

SEQ ID NO: 187006 - DNA, 25 bp, E. coli
tcaacttgcgcctgatttcgccacg

SEQ ID NO: 187007 - DNA, 25 bp, E. coli
gatgcgtctgaaagaggacctgccc

SEQ ID NO: 187008 - DNA, 25 bp, E. coli
gatgcgtctgaatgaggacctgccc

SEQ ID NO: 187009 - DNA, 25 bp, E. coli
gagcgtacttttgtggcgtggatcc

SEQ ID NO: 187010 - DNA, 25 bp, E. coli
gagcgtacttttctggcgtggatcc

SEQ ID NO: 187011 - DNA, 25 bp, E. coli
aagcagggcgaactagcgatcctgc

SEQ ID NO: 187012 - DNA, 25 bp, E. coli
aagcagggcgaagtagcgatcctgc

SEQ ID NO: 187013 - DNA, 25 bp, E. coli
tcggcgaacaacatgcctcacagct

SEQ ID NO: 187014 - DNA, 25 bp, E. coli
tcggcgaacaacttgcctcacagct

SEQ ID NO: 187015 - DNA, 25 bp, E. coli
gcaaacgcaaggcttaactccgcga

SEQ ID NO: 187016 - DNA, 25 bp, E. coli
gcttaactccgcgacaaatcatgat

SEQ ID NO: 187017 - DNA, 25 bp, E. coli
gctaggcgttaatcgcggtgatcaa

SEQ ID NO: 187018 - DNA, 25 bp, E. coli
gcgatcctgcaaacgcaaggcttaa

SEQ ID NO: 187019 - DNA, 25 bp, E. coli
gcttaactccgccacaaatcatgat

SEQ ID NO: 187020 - DNA, 25 bp, E. coli
gcgatcctgcaatcgcaaggcttaa

SEQ ID NO: 187021 - DNA, 25 bp, E. coli
gctaggcgttaaacgcggtgatcaa

SEQ ID NO: 187022 - DNA, 25 bp, E. coli
gaagtagcgatcctgcaaacgcaag

SEQ ID NO: 187023 - DNA, 25 bp, E. coli
gcaaggcttaactccgcgacaaatc

SEQ ID NO: 187024 - DNA, 25 bp, E. coli
gaacaacttgccacacagctaggcg

SEQ ID NO: 187025 - DNA, 25 bp, E. coli
gaagtagcgatcgtgcaaacgcaag

SEQ ID NO: 187026 - DNA, 25 bp, E. coli
gaacaacttgcctcacagctaggcg

SEQ ID NO: 187027 - DNA, 25 bp, E. coli
gcaaacgcaagggttaactccgcga

SEQ ID NO: 187028 - DNA, 25 bp, E. coli
gcaaggcttaacaccgcgacaaatc

SEQ ID NO: 187029 - DNA, 25 bp, E. coli
gggcgaagtagcgatcctgcaaacg

SEQ ID NO: 187030 - DNA, 25 bp, E. coli
gggcgaagtagccatcctgcaaacg

SEQ ID NO: 187031 - DNA, 25 bp, E. coli
tcacagctaggcgttaatcgcggtg

SEQ ID NO: 187032 - DNA, 25 bp, E. coli
tcacagctaggccttaatcgcggtg

SEQ ID NO: 187033 - DNA, 25 bp, E. coli
cagacatcgtaaagctgcgcaggat

SEQ ID NO: 187034 - DNA, 25 bp, E. coli
cagacatcgtaatgctgcgcaggat

SEQ ID NO: 187035 - DNA, 25 bp, E. coli
taaatgggccaacaccagacatcgt

SEQ ID NO: 187036 - DNA, 25 bp, E. coli
taaatgggccaagaccagacatcgt

SEQ ID NO: 187037 - DNA, 25 bp, E. coli
catctacgaaggatacggtcctggc

SEQ ID NO: 187038 - DNA, 25 bp, E. coli
catctacgaaggttacggtcctggc

SEQ ID NO: 187039 - DNA, 25 bp, E. coli
taccgttgctgatgtgcgtcatgca

SEQ ID NO: 187040 - DNA, 25 bp, E. coli
tatgctggaagattgcgacgacgtg

SEQ ID NO: 187041 - DNA, 25 bp, E. coli
taccgttgctgaagtgcgtcatgca

SEQ ID NO: 187042 - DNA, 25 bp, E. coli
tatgctggaagaatgcgacgacgtg

SEQ ID NO: 187043 - DNA, 25 bp, E. coli
tgatatggatgctgaaaccgcaccg

SEQ ID NO: 187044 - DNA, 25 bp, E. coli
tgatatggatgcagaaaccgcaccg

SEQ ID NO: 187045 - DNA, 25 bp, E. coli
tctgaaagcagagagcgcggaagtt

SEQ ID NO: 187046 - DNA, 25 bp, E. coli
tcattcgtgagctggtaaccgcggc

SEQ ID NO: 187047 - DNA, 25 bp, E. coli
tcattcgtgagcaggtaaccgcggc

SEQ ID NO: 187048 - DNA, 25 bp, E. coli
tctacactgcatgggaagaaatggg

SEQ ID NO: 187049 - DNA, 25 bp, E. coli
tctacactgcatcggaagaaatggg

SEQ ID NO: 187050 - DNA, 25 bp, E. coli
tctgaaagcagacagcgcggaagtt

SEQ ID NO: 187051 - DNA, 25 bp, E. coli
gcaaatgtggcgctaacctcggtac

SEQ ID NO: 187052 - DNA, 25 bp, E. coli
gcaaatgtggcggtaacctcggtac

SEQ ID NO: 187053 - DNA, 25 bp, E. coli
cgacgacgtgcacgaagtttaccat

SEQ ID NO: 187054 - DNA, 25 bp, E. coli
cgacgacgtgcaggaagtttaccat

SEQ ID NO: 187055 - DNA, 25 bp, E. coli
aaggctggcgcgttcgtgacgatca

SEQ ID NO: 187056 - DNA, 25 bp, E. coli
aaggctggcgcgatcgtgacgatca

SEQ ID NO: 187057 - DNA, 25 bp, E. coli
caaattacaaattggcgatcgcgat

SEQ ID NO: 187058 - DNA, 25 bp, E. coli
caaattggcgatcgcgatcattacg

SEQ ID NO: 187059 - DNA, 25 bp, E. coli
caaattggcgatggcgatcattacg

SEQ ID NO: 187060 - DNA, 25 bp, E. coli
caaattacaaataggcgatcgcgat

SEQ ID NO: 187061 - DNA, 25 bp, E. coli
cattacggtaattactgggacggtg

SEQ ID NO: 187062 - DNA, 25 bp, E. coli
tactgccatcaaacaaattacaaat

SEQ ID NO: 187063 - DNA, 25 bp, E. coli
tactgccatcaatcaaattacaaat

SEQ ID NO: 187064 - DNA, 25 bp, E. coli
actggcgcgaccgtgactactggca

SEQ ID NO: 187065 - DNA, 25 bp, E. coli
actggcgcgaccctgactactggca

SEQ ID NO: 187066 - DNA, 25 bp, E. coli
gcgatcgcgatcattacggtaatta

SEQ ID NO: 187067 - DNA, 25 bp, E. coli
gctggcgcgatcgtgacgatcatcg

SEQ ID NO: 187068 - DNA, 25 bp, E. coli
gctggcgcgatcctgacgatcatcg

SEQ ID NO: 187069 - DNA, 25 bp, E. coli
gcgatcgcgatctttacggtaatta

SEQ ID NO: 187070 - DNA, 25 bp, E. coli
cattacggtaataactgggacggtg

SEQ ID NO: 187071 - DNA, 25 bp, E. coli
cgtggctatcgtgaaggctggcgcg

SEQ ID NO: 187072 - DNA, 25 bp, E. coli
cgtggctatcgtcaaggctggcgcg

SEQ ID NO: 187073 - DNA, 25 bp, E. coli
gtaattactgggacggtggtcactg

SEQ ID NO: 187074 - DNA, 25 bp, E. coli
gtaattactgggtcggtggtcactg

SEQ ID NO: 187075 - DNA, 25 bp, E. coli
gtcactggcgcgtccgtgactactg

SEQ ID NO: 187076 - DNA, 25 bp, E. coli
gtcactggcgcgaccgtgactactg

SEQ ID NO: 187077 - DNA, 25 bp, E. coli
caagtatttttgatgcaacctcatg

SEQ ID NO: 187078 - DNA, 25 bp, E. coli
caagtatttttgttgcaacctcatg

SEQ ID NO: 187079 - DNA, 25 bp, E. coli
cagtttattgatataagctctgtac

SEQ ID NO: 187080 - DNA, 25 bp, E. coli
cagtttattgatttaagctctgtac

SEQ ID NO: 187081 - DNA, 25 bp, E. coli
tttcagagaacctggaagcaagtct

SEQ ID NO: 187082 - DNA, 25 bp, E. coli
tttcagagaaccaggaagcaagtct

SEQ ID NO: 187083 - DNA, 25 bp, E. coli
tgacattttcaggtatgctgcaatt

SEQ ID NO: 187084 - DNA, 25 bp, E. coli
tgacattttcagctatgctgcaatt

SEQ ID NO: 187085 - DNA, 25 bp, E. coli
gctctgtacatccattcaaaaccag

SEQ ID NO: 187086 - DNA, 25 bp, E. coli
gctctgtacatcgattcaaaaccag

SEQ ID NO: 187087 - DNA, 25 bp, E. coli
cattcaaaaccacttctttcagaga

SEQ ID NO: 187088 - DNA, 25 bp, E. coli
cattcaaaaccagttctttcagaga

SEQ ID NO: 187089 - DNA, 25 bp, E. coli
gtatgctgcaatttataacctctaa

SEQ ID NO: 187090 - DNA, 25 bp, E. coli
ggtaatgttgttattggctcactga

SEQ ID NO: 187091 - DNA, 25 bp, E. coli
gtatgctgcaatatataacctctaa

SEQ ID NO: 187092 - DNA, 25 bp, E. coli
ggtaatgttgtttttggctcactga

SEQ ID NO: 187093 - DNA, 25 bp, E. coli
ggctcactgattgataaagtctctc

SEQ ID NO: 187094 - DNA, 25 bp, E. coli
ggctcactgattcataaagtctctc

SEQ ID NO: 187095 - DNA, 25 bp, E. coli
taacctctaatgatgagcatccaac

SEQ ID NO: 187096 - DNA, 25 bp, E. coli
taacctctaatgttgagcatccaac

SEQ ID NO: 187097 - DNA, 25 bp, E. coli
gagcatccaaccatacttaatgaag

SEQ ID NO: 187098 - DNA, 25 bp, E. coli
gagcatccaaccttacttaatgaag

SEQ ID NO: 187099 - DNA, 25 bp, E. coli
cagcgatacgtttcgccgtaccgaa

SEQ ID NO: 187100 - DNA, 25 bp, E. coli
cagcgatacgttacgccgtaccgaa

SEQ ID NO: 187101 - DNA, 25 bp, E. coli
cagtttgcatctgcgatgcgcccta

SEQ ID NO: 187102 - DNA, 25 bp, E. coli
cagtttgcatctccgatgcgcccta

SEQ ID NO: 187103 - DNA, 25 bp, E. coli
taccgaaccgcttctgcgagaaggt

SEQ ID NO: 187104 - DNA, 25 bp, E. coli
taccgaaccgctactgcgagaaggt

SEQ ID NO: 187105 - DNA, 25 bp, E. coli
tttctgcggaagaggttgaccgtgc

SEQ ID NO: 187106 - DNA, 25 bp, E. coli
tttctgcggaagtggttgaccgtgc

SEQ ID NO: 187107 - DNA, 25 bp, E. coli
tgaccgtgcaagtaccgcacagcgt

SEQ ID NO: 187108 - DNA, 25 bp, E. coli
tgcaagaaccgctcagcgtgcggca

SEQ ID NO: 187109 - DNA, 25 bp, E. coli
tgcaagaaccgcacagcgtgcggca

SEQ ID NO: 187110 - DNA, 25 bp, E. coli
tgaccgtgcaagaaccgcacagcgt

SEQ ID NO: 187111 - DNA, 25 bp, E. coli
tccgtcgggcagtttgcatctgcga

SEQ ID NO: 187112 - DNA, 25 bp, E. coli
tccgtcgggcagattgcatctgcga

SEQ ID NO: 187113 - DNA, 25 bp, E. coli
gccgcgaaacaagccagcgatacgt

SEQ ID NO: 187114 - DNA, 25 bp, E. coli
gccgcgaaacaacccagcgatacgt

SEQ ID NO: 187115 - DNA, 25 bp, E. coli
gcgatgcgccctattttcactctaa

SEQ ID NO: 187116 - DNA, 25 bp, E. coli
gcgatgcgcccttttttcactctaa

SEQ ID NO: 187117 - DNA, 25 bp, E. coli
gcgagaaggtttagtttctgcggaa

SEQ ID NO: 187118 - DNA, 25 bp, E. coli
gcgagaaggttttgtttctgcggaa

SEQ ID NO: 187119 - DNA, 25 bp, E. coli
cgtgcggcagaagcggaccttaatg

SEQ ID NO: 187120 - DNA, 25 bp, E. coli
cgtgcggcagaaccggaccttaatg

SEQ ID NO: 187121 - DNA, 25 bp, E. coli
cataatgttggtgtgtgtgttctta

SEQ ID NO: 187122 - DNA, 25 bp, E. coli
cataatgttggtctgtgtgttctta

SEQ ID NO: 187123 - DNA, 25 bp, E. coli
ttgtagcagaataccataatgttgg

SEQ ID NO: 187124 - DNA, 25 bp, E. coli
ttggctcaatttgcctccatccagg

SEQ ID NO: 187125 - DNA, 25 bp, E. coli
ttggctcaatttccctccatccagg

SEQ ID NO: 187126 - DNA, 25 bp, E. coli
ttgtagcagaattccataatgttgg

SEQ ID NO: 187127 - DNA, 25 bp, E. coli
tgcagggagtggcagttatttttct

SEQ ID NO: 187128 - DNA, 25 bp, E. coli
tgctccttgtttcgacattgtcacg

SEQ ID NO: 187129 - DNA, 25 bp, E. coli
tgctccttgtttggacattgtcacg

SEQ ID NO: 187130 - DNA, 25 bp, E. coli
tgcagggagtgggagttatttttct

SEQ ID NO: 187131 - DNA, 25 bp, E. coli
tccatccaggaagggtttgtagcag

SEQ ID NO: 187132 - DNA, 25 bp, E. coli
tccatccaggaacggtttgtagcag

SEQ ID NO: 187133 - DNA, 25 bp, E. coli
tctgctgacctggatggattgctcc

SEQ ID NO: 187134 - DNA, 25 bp, E. coli
tcttatctggtttatagaaagtgaa

SEQ ID NO: 187135 - DNA, 25 bp, E. coli
tctgctgacctgcatggattgctcc

SEQ ID NO: 187136 - DNA, 25 bp, E. coli
tcttatctggttaatagaaagtgaa

SEQ ID NO: 187137 - DNA, 25 bp, E. coli
gccgcaaaggtccagaattggctca

SEQ ID NO: 187138 - DNA, 25 bp, E. coli
gccgcaaaggtcgagaattggctca

SEQ ID NO: 187139 - DNA, 25 bp, E. coli
cattcgcttgctgcgtgtgcaggga

SEQ ID NO: 187140 - DNA, 25 bp, E. coli
cattcgcttgctccgtgtgcaggga

SEQ ID NO: 187141 - DNA, 25 bp, E. coli
gtcacgtcccatatacattcgcttg

SEQ ID NO: 187142 - DNA, 25 bp, E. coli
gtcacgtcccatttacattcgcttg

SEQ ID NO: 187143 - DNA, 25 bp, E. coli
tgcccgccagcacggcattggtacg

SEQ ID NO: 187144 - DNA, 25 bp, E. coli
tgcccgccagcagggcattggtacg

SEQ ID NO: 187145 - DNA, 25 bp, E. coli
tcatcagcaatttggcgatacggta

SEQ ID NO: 187146 - DNA, 25 bp, E. coli
tcatcagcaattaggcgatacggta

SEQ ID NO: 187147 - DNA, 25 bp, E. coli
gcattccttgtgtgcttaaccggga

SEQ ID NO: 187148 - DNA, 25 bp, E. coli
gcttactgattctggcgggcattcc

SEQ ID NO: 187149 - DNA, 25 bp, E. coli
gcattccttgtgagcttaaccggga

SEQ ID NO: 187150 - DNA, 25 bp, E. coli
gcttactgattcaggcgggcattcc

SEQ ID NO: 187151 - DNA, 25 bp, E. coli
gaaaaactggaaattgacgcctatc

SEQ ID NO: 187152 - DNA, 25 bp, E. coli
gaaaaactggaatttgacgcctatc

SEQ ID NO: 187153 - DNA, 25 bp, E. coli
ccgttctggcagcatatgacggaac

SEQ ID NO: 187154 - DNA, 25 bp, E. coli
cgccagttggcgacggtggataaaa

SEQ ID NO: 187155 - DNA, 25 bp, E. coli
cgccagttggcgtcggtggataaaa

SEQ ID NO: 187156 - DNA, 25 bp, E. coli
ccgttctggcaggatatgacggaac

SEQ ID NO: 187157 - DNA, 25 bp, E. coli
gatattgtgcgtcaagcgcagcgcc

SEQ ID NO: 187158 - DNA, 25 bp, E. coli
gatattgtgcgtgaagcgcagcgcc

SEQ ID NO: 187159 - DNA, 25 bp, E. coli
gtggataaaaacaccattgccttct

SEQ ID NO: 187160 - DNA, 25 bp, E. coli
gtggataaaaactccattgccttct

SEQ ID NO: 187161 - DNA, 25 bp, E. coli
tgcttaaccgggaaaatccgttctg

SEQ ID NO: 187162 - DNA, 25 bp, E. coli
tgcttaaccgggtaaatccgttctg

SEQ ID NO: 187163 - DNA, 25 bp, E. coli
gagcatattgctcccttgcgcgccg

SEQ ID NO: 187164 - DNA, 25 bp, E. coli
gagcatattgctgccttgcgcgccg

SEQ ID NO: 187165 - DNA, 25 bp, E. coli
caagtgcagcgtatcgaggatgttc

SEQ ID NO: 187166 - DNA, 25 bp, E. coli
caagtgcagcgtttcgaggatgttc

SEQ ID NO: 187167 - DNA, 25 bp, E. coli
aaggcttacgtcagcttgtggcaca

SEQ ID NO: 187168 - DNA, 25 bp, E. coli
aaggcttacgtctgcttgtggcaca

SEQ ID NO: 187169 - DNA, 25 bp, E. coli
caaaaaattctttgcgagcgtcgca

SEQ ID NO: 187170 - DNA, 25 bp, E. coli
caaaaaattcttagcgagcgtcgca

SEQ ID NO: 187171 - DNA, 25 bp, E. coli
catattgcctgtcatgcggcgagta

SEQ ID NO: 187172 - DNA, 25 bp, E. coli
catattgcctgtgatgcggcgagta

SEQ ID NO: 187173 - DNA, 25 bp, E. coli
aaaattgcctgtctccggatacccg

SEQ ID NO: 187174 - DNA, 25 bp, E. coli
acaccagtgcgtagttatatgagcg

SEQ ID NO: 187175 - DNA, 25 bp, E. coli
acaccagtgcgttgttatatgagcg

SEQ ID NO: 187176 - DNA, 25 bp, E. coli
aaaattgcctgtgtccggatacccg

SEQ ID NO: 187177 - DNA, 25 bp, E. coli
tatttgcttgagcacgatacactgg

SEQ ID NO: 187178 - DNA, 25 bp, E. coli
tatttgcttgaggacgatacactgg

SEQ ID NO: 187179 - DNA, 25 bp, E. coli
tgaaaaagtgcttgcaacgacggat

SEQ ID NO: 187180 - DNA, 25 bp, E. coli
tgaaaaagtgctagcaacgacggat

SEQ ID NO: 187181 - DNA, 25 bp, E. coli
tcgacatcgatactaccgtcttcgg

SEQ ID NO: 187182 - DNA, 25 bp, E. coli
tgcggttgcccgcaatcaagtgcag

SEQ ID NO: 187183 - DNA, 25 bp, E. coli
tcggaccatttctgggcaaaattgc

SEQ ID NO: 187184 - DNA, 25 bp, E. coli
tcgacatcgatagtaccgtcttcgg

SEQ ID NO: 187185 - DNA, 25 bp, E. coli
tgcggttgcccggaatcaagtgcag

SEQ ID NO: 187186 - DNA, 25 bp, E. coli
tcggaccatttcagggcaaaattgc

SEQ ID NO: 187187 - DNA, 25 bp, E. coli
taaagaaaccccattcactgtggtt

SEQ ID NO: 187188 - DNA, 25 bp, E. coli
taaagaaacccctttcactgtggtt

SEQ ID NO: 187189 - DNA, 25 bp, E. coli
aaaaaatgtgcctggtgcatatcgg

SEQ ID NO: 187190 - DNA, 25 bp, E. coli
aaaaaatgtgccaggtgcatatcgg

SEQ ID NO: 187191 - DNA, 25 bp, E. coli
tgattaccaattatgaagccactgt

SEQ ID NO: 187192 - DNA, 25 bp, E. coli
tgattaccaattttgaagccactgt

SEQ ID NO: 187193 - DNA, 25 bp, E. coli
tcgatggtccatgaggcaacgtaaa

SEQ ID NO: 187194 - DNA, 25 bp, E. coli
tcgatggtccatcaggcaacgtaaa

SEQ ID NO: 187195 - DNA, 25 bp, E. coli
gcgcattggctaggtaattaaaaca

SEQ ID NO: 187196 - DNA, 25 bp, E. coli
gcgcattggctacgtaattaaaaca

SEQ ID NO: 187197 - DNA, 25 bp, E. coli
gaagccactgttgtaactaccgatg

SEQ ID NO: 187198 - DNA, 25 bp, E. coli
gaatttctggcaactctaattgcaa

SEQ ID NO: 187199 - DNA, 25 bp, E. coli
gaagccactgttctaactaccgatg

SEQ ID NO: 187200 - DNA, 25 bp, E. coli
gaatctggaaggaaagcgcattggc

SEQ ID NO: 187201 - DNA, 25 bp, E. coli
gaatctggaaggtaagcgcattggc

SEQ ID NO: 187202 - DNA, 25 bp, E. coli
gaatttctggcatctctaattgcaa

SEQ ID NO: 187203 - DNA, 25 bp, E. coli
ccgatgacattgttcacgaggtgaa

SEQ ID NO: 187204 - DNA, 25 bp, E. coli
ccgatgacattgatcacgaggtgaa

SEQ ID NO: 187205 - DNA, 25 bp, E. coli
ggtgcatatcggaaagaatctgccc

SEQ ID NO: 187206 - DNA, 25 bp, E. coli
ggtgcatatcggtaagaatctgccc

SEQ ID NO: 187207 - DNA, 25 bp, E. coli
ggcaacgtaaaaacacttgatgaag

SEQ ID NO: 187208 - DNA, 25 bp, E. coli
ggcaacgtaaaatcacttgatgaag

SEQ ID NO: 187209 - DNA, 25 bp, E. coli
catggcatacaggatttcaatggaa

SEQ ID NO: 187210 - DNA, 25 bp, E. coli
catggcatacagcatttcaatggaa

SEQ ID NO: 187211 - DNA, 25 bp, E. coli
aactcttgcacagctgtatccctga

SEQ ID NO: 187212 - DNA, 25 bp, E. coli
acgtcctgttatagattgcctgtga

SEQ ID NO: 187213 - DNA, 25 bp, E. coli
acgtcctgttattgattgcctgtga

SEQ ID NO: 187214 - DNA, 25 bp, E. coli
aactcttgcacacctgtatccctga

SEQ ID NO: 187215 - DNA, 25 bp, E. coli
tgaccttttctttcctcatggaacg

SEQ ID NO: 187216 - DNA, 25 bp, E. coli
tgaccttttcttacctcatggaacg

SEQ ID NO: 187217 - DNA, 25 bp, E. coli
tgcaagggtctttcatcacgtcctg

SEQ ID NO: 187218 - DNA, 25 bp, E. coli
tgcaagggtcttacatcacgtcctg

SEQ ID NO: 187219 - DNA, 25 bp, E. coli
tctgctgctatctaaagagaaagcg

SEQ ID NO: 187220 - DNA, 25 bp, E. coli
tctgctgctatcaaaagagaaagcg

SEQ ID NO: 187221 - DNA, 25 bp, E. coli
gactccccgacatctcagattttca

SEQ ID NO: 187222 - DNA, 25 bp, E. coli
gactccccgacaactcagattttca

SEQ ID NO: 187223 - DNA, 25 bp, E. coli
gtttattcatcgactactctccccg

SEQ ID NO: 187224 - DNA, 25 bp, E. coli
gtttattcatcgtctactctccccg

SEQ ID NO: 187225 - DNA, 25 bp, E. coli
ggtagccataaaatcctgcccttca

SEQ ID NO: 187226 - DNA, 25 bp, E. coli
ggtagccataaattcctgcccttca

SEQ ID NO: 187227 - DNA, 25 bp, E. coli
ggaatcacaatgtccaactcttgca

SEQ ID NO: 187228 - DNA, 25 bp, E. coli
ggaatcacaatgaccaactcttgca

SEQ ID NO: 187229 - DNA, 25 bp, E. coli
gagaaagcgcactaatgcaagggtc

SEQ ID NO: 187230 - DNA, 25 bp, E. coli
gagaaagcgcacaaatgcaagggtc

SEQ ID NO: 187231 - DNA, 25 bp, E. coli
catgttaattaaccgtggtgctatc

SEQ ID NO: 187232 - DNA, 25 bp, E. coli
catgttaattaagcgtggtgctatc

SEQ ID NO: 187233 - DNA, 25 bp, E. coli
tcctgccgccgtcatgttaattaag

SEQ ID NO: 187234 - DNA, 25 bp, E. coli
tgccgccgtcatcttaattaagcgt

SEQ ID NO: 187235 - DNA, 25 bp, E. coli
tgccgccgtcatgttaattaagcgt

SEQ ID NO: 187236 - DNA, 25 bp, E. coli
tcctgccgccgtgatgttaattaag

SEQ ID NO: 187237 - DNA, 25 bp, E. coli
cctgccgccgtcatgttaattaagc

SEQ ID NO: 187238 - DNA, 25 bp, E. coli
cctgccgccgtcttgttaattaagc

SEQ ID NO: 187239 - DNA, 25 bp, E. coli
gttaattaagcgaggtgctatcccg

SEQ ID NO: 187240 - DNA, 25 bp, E. coli
gcgtggtgctatcccgttaagctat

SEQ ID NO: 187241 - DNA, 25 bp, E. coli
gttaattaagcgtggtgctatcccg

SEQ ID NO: 187242 - DNA, 25 bp, E. coli
gcgtggtgctatgccgttaagctat

SEQ ID NO: 187243 - DNA, 25 bp, E. coli
ccgtcatgttaaataagcgtggtgc

SEQ ID NO: 187244 - DNA, 25 bp, E. coli
ccgtcatgttaattaagcgtggtgc

SEQ ID NO: 187245 - DNA, 25 bp, E. coli
ccgccgtcatgtaaattaagcgtgg

SEQ ID NO: 187246 - DNA, 25 bp, E. coli
ccgccgtcatgttaattaagcgtgg

SEQ ID NO: 187247 - DNA, 25 bp, E. coli
taattaagcgtgctgctatcccgtt

SEQ ID NO: 187248 - DNA, 25 bp, E. coli
taagcgtggtgcaatcccgttaagc

SEQ ID NO: 187249 - DNA, 25 bp, E. coli
taatccctacgctcggcgcgctggg

SEQ ID NO: 187250 - DNA, 25 bp, E. coli
taattaagcgtggtgctatcccgtt

SEQ ID NO: 187251 - DNA, 25 bp, E. coli
taatccctacgcacggcgcgctggg

SEQ ID NO: 187252 - DNA, 25 bp, E. coli
taagcgtggtgctatcccgttaagc

SEQ ID NO: 187253 - DNA, 25 bp, E. coli
taccgttgtcgaaaccgaacactgg

SEQ ID NO: 187254 - DNA, 25 bp, E. coli
acggaaatcgtctaaacctggcagg

SEQ ID NO: 187255 - DNA, 25 bp, E. coli
acggaaatcgtcaaaacctggcagg

SEQ ID NO: 187256 - DNA, 25 bp, E. coli
tatgttcagcgcgagctggcagacg

SEQ ID NO: 187257 - DNA, 25 bp, E. coli
tatgttcagcgccagctggcagacg

SEQ ID NO: 187258 - DNA, 25 bp, E. coli
taccgttgtcgataccgaacactgg

SEQ ID NO: 187259 - DNA, 25 bp, E. coli
ttcctgcctaacgaagctgagcgcg

SEQ ID NO: 187260 - DNA, 25 bp, E. coli
ttcctgcctaaccaagctgagcgcg

SEQ ID NO: 187261 - DNA, 25 bp, E. coli
tgttacctgcgctcgatccagattg

SEQ ID NO: 187262 - DNA, 25 bp, E. coli
tgttacctgcgcacgatccagattg

SEQ ID NO: 187263 - DNA, 25 bp, E. coli
gatatccattttggcgaatccggag

SEQ ID NO: 187264 - DNA, 25 bp, E. coli
gatatccattttcgcgaatccggag

SEQ ID NO: 187265 - DNA, 25 bp, E. coli
ggaaacgccagccaaacaggtgtta

SEQ ID NO: 187266 - DNA, 25 bp, E. coli
gtgacaggcgattaaaaccccgatt

SEQ ID NO: 187267 - DNA, 25 bp, E. coli
gtgacaggcgataaaaaccccgatt

SEQ ID NO: 187268 - DNA, 25 bp, E. coli
ggcgttgaaaaagctgaccagtcgt

SEQ ID NO: 187269 - DNA, 25 bp, E. coli
ggcaatggattctggtttcaccgca

SEQ ID NO: 187270 - DNA, 25 bp, E. coli
ggaaacgccagcgaaacaggtgtta

SEQ ID NO: 187271 - DNA, 25 bp, E. coli
ggcgttgaaaaacctgaccagtcgt

SEQ ID NO: 187272 - DNA, 25 bp, E. coli
ggcaatggattcaggtttcaccgca

SEQ ID NO: 187273 - DNA, 25 bp, E. coli
taatggcgaagagaatcaacactgg

SEQ ID NO: 187274 - DNA, 25 bp, E. coli
taatggcgaagacaatcaacactgg

SEQ ID NO: 187275 - DNA, 25 bp, E. coli
aagtggcgaaaaaggcgtggattgc

SEQ ID NO: 187276 - DNA, 25 bp, E. coli
aatcacatcgactgcttcctgatga

SEQ ID NO: 187277 - DNA, 25 bp, E. coli
aagtggcgaaaatggcgtggattgc

SEQ ID NO: 187278 - DNA, 25 bp, E. coli
aatcacatcgacagcttcctgatga

SEQ ID NO: 187279 - DNA, 25 bp, E. coli
tggtggtgatcaagcccagcggcgt

SEQ ID NO: 187280 - DNA, 25 bp, E. coli
tgatgaataaacacttcatgcgtaa

SEQ ID NO: 187281 - DNA, 25 bp, E. coli
tggtggtgatcatgcccagcggcgt

SEQ ID NO: 187282 - DNA, 25 bp, E. coli
tgatgaataaactcttcatgcgtaa

SEQ ID NO: 187283 - DNA, 25 bp, E. coli
tgcatacgccggcaattgtggtgta

SEQ ID NO: 187284 - DNA, 25 bp, E. coli
tgcatacgccgggaattgtggtgta

SEQ ID NO: 187285 - DNA, 25 bp, E. coli
gcgatcccggcgttaggcaccacgc

SEQ ID NO: 187286 - DNA, 25 bp, E. coli
gcgaacgcgggcaggtggtgatcaa

SEQ ID NO: 187287 - DNA, 25 bp, E. coli
gcgatcccggcgataggcaccacgc

SEQ ID NO: 187288 - DNA, 25 bp, E. coli
gcgaacgcgggctggtggtgatcaa

SEQ ID NO: 187289 - DNA, 25 bp, E. coli
gacagcttcctgatgaataaacact

SEQ ID NO: 187290 - DNA, 25 bp, E. coli
gacagcttcctgttgaataaacact

SEQ ID NO: 187291 - DNA, 25 bp, E. coli
ccgggaattgtggtgtatcagcacg

SEQ ID NO: 187292 - DNA, 25 bp, E. coli
ccgggaattgtgctgtatcagcacg

SEQ ID NO: 187293 - DNA, 25 bp, E. coli
ggctggtgacctatacctggggcaa

SEQ ID NO: 187294 - DNA, 25 bp, E. coli
ggctggtgacctttacctggggcaa

SEQ ID NO: 187295 - DNA, 25 bp, E. coli
gagccgctgcattcgccgggaattg

SEQ ID NO: 187296 - DNA, 25 bp, E. coli
gagccgctgcatacgccgggaattg

SEQ ID NO: 187297 - DNA, 25 bp, E. coli
caacgaatcacgcataatttatggc

SEQ ID NO: 187298 - DNA, 25 bp, E. coli
caacgaatcacggataatttatggc

SEQ ID NO: 187299 - DNA, 25 bp, E. coli
caaagataaattagataatagaggt

SEQ ID NO: 187300 - DNA, 25 bp, E. coli
caaagataaatttgataatagaggt

SEQ ID NO: 187301 - DNA, 25 bp, E. coli
aaatctattgattatgcagcgctgc

SEQ ID NO: 187302 - DNA, 25 bp, E. coli
aaatctattgataatgcagcgctgc

SEQ ID NO: 187303 - DNA, 25 bp, E. coli
ttatgcagcgctccgtcatcgggat

SEQ ID NO: 187304 - DNA, 25 bp, E. coli
ttatgcagcgctgcgtcatcgggat

SEQ ID NO: 187305 - DNA, 25 bp, E. coli
tctattgattatgcagcgctgcgtc

SEQ ID NO: 187306 - DNA, 25 bp, E. coli
tctattgattatccagcgctgcgtc

SEQ ID NO: 187307 - DNA, 25 bp, E. coli
cgcataatttatcgcatgcacgtaa

SEQ ID NO: 187308 - DNA, 25 bp, E. coli
cgcataatttatggcatgcacgtaa

SEQ ID NO: 187309 - DNA, 25 bp, E. coli
gatttgtttattgaacgaatcacgc

SEQ ID NO: 187310 - DNA, 25 bp, E. coli
gatttgtttattcaacgaatcacgc

SEQ ID NO: 187311 - DNA, 25 bp, E. coli
ggcatgcacgtataaaaatgtgttt

SEQ ID NO: 187312 - DNA, 25 bp, E. coli
ggcatgcacgtaaaaaaatgtgttt

SEQ ID NO: 187313 - DNA, 25 bp, E. coli
tagaggttcaatcaaaggtaaatta

SEQ ID NO: 187314 - DNA, 25 bp, E. coli
taatttatggcatgcacgtaaaaaa

SEQ ID NO: 187315 - DNA, 25 bp, E. coli
taatttatggcaagcacgtaaaaaa

SEQ ID NO: 187316 - DNA, 25 bp, E. coli
tagaggttcaatgaaaggtaaatta

SEQ ID NO: 187317 - DNA, 25 bp, E. coli
gataatagaggttcaatcaaaggta

SEQ ID NO: 187318 - DNA, 25 bp, E. coli
gataatagaggtacaatcaaaggta

SEQ ID NO: 187319 - DNA, 25 bp, E. coli
aacgcgctggcgctgattatcagta

SEQ ID NO: 187320 - DNA, 25 bp, E. coli
taaagagttgatcgaccagttgcgc

SEQ ID NO: 187321 - DNA, 25 bp, E. coli
taaagagttgatggaccagttgcgc

SEQ ID NO: 187322 - DNA, 25 bp, E. coli
aacgcgctggcggtgattatcagta

SEQ ID NO: 187323 - DNA, 25 bp, E. coli
tatgctgtgcatgaccgtctgggcg

SEQ ID NO: 187324 - DNA, 25 bp, E. coli
tatgctgtgcatcaccgtctgggcg

SEQ ID NO: 187325 - DNA, 25 bp, E. coli
tttgaaaacggcttgaacactggag

SEQ ID NO: 187326 - DNA, 25 bp, E. coli
tttgaaaacggcatgaacactggag

SEQ ID NO: 187327 - DNA, 25 bp, E. coli
ttcggatattcaaggccgcccgcta

SEQ ID NO: 187328 - DNA, 25 bp, E. coli
ttactggagtcgtcgcctgagctgg

SEQ ID NO: 187329 - DNA, 25 bp, E. coli
ttcggatattcatggccgcccgcta

SEQ ID NO: 187330 - DNA, 25 bp, E. coli
ttactggagtcgacgcctgagctgg

SEQ ID NO: 187331 - DNA, 25 bp, E. coli
tgaatttttcaaagccgtactacgc

SEQ ID NO: 187332 - DNA, 25 bp, E. coli
tgaatttttcaatgccgtactacgc

SEQ ID NO: 187333 - DNA, 25 bp, E. coli
tgaaaaaacatttcgacctggcggg

SEQ ID NO: 187334 - DNA, 25 bp, E. coli
tgaaaaaacattacgacctggcggg

SEQ ID NO: 187335 - DNA, 25 bp, E. coli
tcgttgttcgatccgggcaacagcc

SEQ ID NO: 187336 - DNA, 25 bp, E. coli
tcgttgttcgatgcgggcaacagcc

SEQ ID NO: 187337 - DNA, 25 bp, E. coli
gctggataatgagacctcgcgtaaa

SEQ ID NO: 187338 - DNA, 25 bp, E. coli
gctggataatgacacctcgcgtaaa

SEQ ID NO: 187339 - DNA, 25 bp, E. coli
tcaatatcgcgcgattgctggcagg

SEQ ID NO: 187340 - DNA, 25 bp, E. coli
tcaatatcgcgccattgctggcagg

SEQ ID NO: 187341 - DNA, 25 bp, E. coli
aacctggtgggccttgcggtaggca

SEQ ID NO: 187342 - DNA, 25 bp, E. coli
tacttccaggtagtatggccgctga

SEQ ID NO: 187343 - DNA, 25 bp, E. coli
tacttccaggtactatggccgctga

SEQ ID NO: 187344 - DNA, 25 bp, E. coli
acctctacgctgtactgggacgatc

SEQ ID NO: 187345 - DNA, 25 bp, E. coli
acctctacgctgaactgggacgatc

SEQ ID NO: 187346 - DNA, 25 bp, E. coli
aacctggtgggcgttgcggtaggca

SEQ ID NO: 187347 - DNA, 25 bp, E. coli
ttgcggtaggcatctggcgctactt

SEQ ID NO: 187348 - DNA, 25 bp, E. coli
ttgcggtaggcaactggcgctactt

SEQ ID NO: 187349 - DNA, 25 bp, E. coli
cctgattgttctaggcggcgcagtt

SEQ ID NO: 187350 - DNA, 25 bp, E. coli
cctgattgttcttggcggcgcagtt

SEQ ID NO: 187351 - DNA, 25 bp, E. coli
cttccaggtagtatggccgctgaat

SEQ ID NO: 187352 - DNA, 25 bp, E. coli
cttccaggtagtttggccgctgaat

SEQ ID NO: 187353 - DNA, 25 bp, E. coli
ctctacgctgaactgggacgatccg

SEQ ID NO: 187354 - DNA, 25 bp, E. coli
ctctacgctgaagtgggacgatccg

SEQ ID NO: 187355 - DNA, 25 bp, E. coli
gtgactgaagatgcgcatacttctc

SEQ ID NO: 187356 - DNA, 25 bp, E. coli
ggctacttccaggtagtatggccgc

SEQ ID NO: 187357 - DNA, 25 bp, E. coli
gtgactgaagatccgcatacttctc

SEQ ID NO: 187358 - DNA, 25 bp, E. coli
ggctacttccagctagtatggccgc

SEQ ID NO: 187359 - DNA, 25 bp, E. coli
tggcaacgatatctgggacgccact

SEQ ID NO: 187360 - DNA, 25 bp, E. coli
tggcaacgatatgtgggacgccact

SEQ ID NO: 187361 - DNA, 25 bp, E. coli
gatggcaacgatttgtgggacgcca

SEQ ID NO: 187362 - DNA, 25 bp, E. coli
gatggcaacgatatgtgggacgcca

SEQ ID NO: 187363 - DNA, 25 bp, E. coli
aagtggtacaggacggcacaccgga

SEQ ID NO: 187364 - DNA, 25 bp, E. coli
aagtggtacaggtcggcacaccgga

SEQ ID NO: 187365 - DNA, 25 bp, E. coli
attgcccgccggtcaccgaatggct

SEQ ID NO: 187366 - DNA, 25 bp, E. coli
agtttgtcggcgcagtctccatcga

SEQ ID NO: 187367 - DNA, 25 bp, E. coli
attgcccgccggacaccgaatggct

SEQ ID NO: 187368 - DNA, 25 bp, E. coli
agtttgtcggcggagtctccatcga

SEQ ID NO: 187369 - DNA, 25 bp, E. coli
tgtcggcgcagtctccatcgattcg

SEQ ID NO: 187370 - DNA, 25 bp, E. coli
tgtcggcgcagtgtccatcgattcg

SEQ ID NO: 187371 - DNA, 25 bp, E. coli
tctccatcgattggcttaaaaccgc

SEQ ID NO: 187372 - DNA, 25 bp, E. coli
tctccatcgattcgcttaaaaccgc

SEQ ID NO: 187373 - DNA, 25 bp, E. coli
gccggacaccgaatggcttaattcg

SEQ ID NO: 187374 - DNA, 25 bp, E. coli
gccggacaccgattggcttaattcg

SEQ ID NO: 187375 - DNA, 25 bp, E. coli
gcagtctccatcgattcgcttaaaa

SEQ ID NO: 187376 - DNA, 25 bp, E. coli
gtgaagtggtacaggtcggcacacc

SEQ ID NO: 187377 - DNA, 25 bp, E. coli
gtgaagtggtactggtcggcacacc

SEQ ID NO: 187378 - DNA, 25 bp, E. coli
gcagtctccatccattcgcttaaaa

SEQ ID NO: 187379 - DNA, 25 bp, E. coli
ccgccggacacccaatggcttaatt

SEQ ID NO: 187380 - DNA, 25 bp, E. coli
ccgccggacaccgaatggcttaatt

SEQ ID NO: 187381 - DNA, 25 bp, E. coli
ggtacaggtcggcacaccggatgaa

SEQ ID NO: 187382 - DNA, 25 bp, E. coli
ggtacaggtcgggacaccggatgaa

SEQ ID NO: 187383 - DNA, 25 bp, E. coli
ggcgcagtctccttcgattcgctta

SEQ ID NO: 187384 - DNA, 25 bp, E. coli
ggcgcagtctccatcgattcgctta

SEQ ID NO: 187385 - DNA, 25 bp, E. coli
catctttgaagcgtgcctttttgca

SEQ ID NO: 187386 - DNA, 25 bp, E. coli
catctttgaagcctgcctttttgca

SEQ ID NO: 187387 - DNA, 25 bp, E. coli
aactcaacggcatctttgaagcctg

SEQ ID NO: 187388 - DNA, 25 bp, E. coli
aactcaacggcaactttgaagcctg

SEQ ID NO: 187389 - DNA, 25 bp, E. coli
tttttgcaggctacctcgctcgctc

SEQ ID NO: 187390 - DNA, 25 bp, E. coli
tttttgcaggcttcctcgctcgctc

SEQ ID NO: 187391 - DNA, 25 bp, E. coli
tccccgggaaggttctgatgtgtcc

SEQ ID NO: 187392 - DNA, 25 bp, E. coli
tccccgggaaggatctgatgtgtcc

SEQ ID NO: 187393 - DNA, 25 bp, E. coli
tgtaaacaagcactgttttccccgg

SEQ ID NO: 187394 - DNA, 25 bp, E. coli
tgtaaacaagcagtgttttccccgg

SEQ ID NO: 187395 - DNA, 25 bp, E. coli
tcgcgtgctgatgtacgcttccggg

SEQ ID NO: 187396 - DNA, 25 bp, E. coli
tcgcgtgctgatctacgcttccggg

SEQ ID NO: 187397 - DNA, 25 bp, E. coli
cgttagcacaatgcgatgcaattga

SEQ ID NO: 187398 - DNA, 25 bp, E. coli
cgttagcacaatccgatgcaattga

SEQ ID NO: 187399 - DNA, 25 bp, E. coli
cgctcgctccggacgcgtgctgatg

SEQ ID NO: 187400 - DNA, 25 bp, E. coli
cgctcgctccggtcgcgtgctgatg

SEQ ID NO: 187401 - DNA, 25 bp, E. coli
ctatctcttttgaaccttcaggacg

SEQ ID NO: 187402 - DNA, 25 bp, E. coli
ctatctcttttgtaccttcaggacg

SEQ ID NO: 187403 - DNA, 25 bp, E. coli
gggttttgccgcctcgttagcacaa

SEQ ID NO: 187404 - DNA, 25 bp, E. coli
gggttttgccgcgtcgttagcacaa

SEQ ID NO: 187405 - DNA, 25 bp, E. coli
gatgtgtccgtgataaactaagaga

SEQ ID NO: 187406 - DNA, 25 bp, E. coli
gatgtgtccgtgttaaactaagaga

SEQ ID NO: 187407 - DNA, 25 bp, E. coli
cagagatcgattatgttaccgacca

SEQ ID NO: 187408 - DNA, 25 bp, E. coli
cagagatcgattttgttaccgacca

SEQ ID NO: 187409 - DNA, 25 bp, E. coli
tatttgtgattaaccctggcacgcc

SEQ ID NO: 187410 - DNA, 25 bp, E. coli
tatttgtgattatccctggcacgcc

SEQ ID NO: 187411 - DNA, 25 bp, E. coli
tgcacaagcgcactttgccaaactg

SEQ ID NO: 187412 - DNA, 25 bp, E. coli
tgcacaagcgcagtttgccaaactg

SEQ ID NO: 187413 - DNA, 25 bp, E. coli
tccgtatttccgttgctgcacaagc

SEQ ID NO: 187414 - DNA, 25 bp, E. coli
tccgtatttccgatgctgcacaagc

SEQ ID NO: 187415 - DNA, 25 bp, E. coli
cctgaaatttgagctgctgaccgcg

SEQ ID NO: 187416 - DNA, 25 bp, E. coli
cctgaaatttgacctgctgaccgcg

SEQ ID NO: 187417 - DNA, 25 bp, E. coli
gctgtaacggttgttccatggtcga

SEQ ID NO: 187418 - DNA, 25 bp, E. coli
gctgtaacggttcttccatggtcga

SEQ ID NO: 187419 - DNA, 25 bp, E. coli
gaagaagggacagaaatccgcgtat

SEQ ID NO: 187420 - DNA, 25 bp, E. coli
gaagaagggacacaaatccgcgtat

SEQ ID NO: 187421 - DNA, 25 bp, E. coli
gaaatcaccgaacacggttacgcca

SEQ ID NO: 187422 - DNA, 25 bp, E. coli
gaaatcaccgaagacggttacgcca

SEQ ID NO: 187423 - DNA, 25 bp, E. coli
ctggcacgcctatcgctgaatgtgg

SEQ ID NO: 187424 - DNA, 25 bp, E. coli
ctggcacgcctaacgctgaatgtgg

SEQ ID NO: 187425 - DNA, 25 bp, E. coli
tcaacccacagcttgctggtcacgg

SEQ ID NO: 187426 - DNA, 25 bp, E. coli
tcaacccacagcatgctggtcacgg

SEQ ID NO: 187427 - DNA, 25 bp, E. coli
gaccgcgtatgtagatgagttaagc

SEQ ID NO: 187428 - DNA, 25 bp, E. coli
gaccgcgtatgttgatgagttaagc

SEQ ID NO: 187429 - DNA, 25 bp, E. coli
caaaggcatgactacgcgggaaatc

SEQ ID NO: 187430 - DNA, 25 bp, E. coli
caaaggcatgacaacgcgggaaatc

SEQ ID NO: 187431 - DNA, 25 bp, E. coli
taaagaagcgcaaggtgttcccaac

SEQ ID NO: 187432 - DNA, 25 bp, E. coli
taaagaagcgcatggtgttcccaac

SEQ ID NO: 187433 - DNA, 25 bp, E. coli
agatcgaacttatcacgccgcgtga

SEQ ID NO: 187434 - DNA, 25 bp, E. coli
agatcgaacttaacacgccgcgtga

SEQ ID NO: 187435 - DNA, 25 bp, E. coli
taccgacggtcagaaagagctgctg

SEQ ID NO: 187436 - DNA, 25 bp, E. coli
taccgacggtcacaaagagctgctg

SEQ ID NO: 187437 - DNA, 25 bp, E. coli
tgatatccaaagtgaccgatgcggt

SEQ ID NO: 187438 - DNA, 25 bp, E. coli
tgatatccaaagagaccgatgcggt

SEQ ID NO: 187439 - DNA, 25 bp, E. coli
tgaacagcgtcaatcggcaggcgat

SEQ ID NO: 187440 - DNA, 25 bp, E. coli
tgactgagctgataaatcgtggcct

SEQ ID NO: 187441 - DNA, 25 bp, E. coli
tgactgagctgaaaaatcgtggcct

SEQ ID NO: 187442 - DNA, 25 bp, E. coli
tgaacagcgtcattcggcaggcgat

SEQ ID NO: 187443 - DNA, 25 bp, E. coli
gctggcgcacactctgggaaaatct

SEQ ID NO: 187444 - DNA, 25 bp, E. coli
gctggcgcacacactgggaaaatct

SEQ ID NO: 187445 - DNA, 25 bp, E. coli
gaaagcggtatatcaggccccgaca

SEQ ID NO: 187446 - DNA, 25 bp, E. coli
gaaacggcgctctatgcagaactga

SEQ ID NO: 187447 - DNA, 25 bp, E. coli
gaaacggcgctcaatgcagaactga

SEQ ID NO: 187448 - DNA, 25 bp, E. coli
gaaagcggtataacaggccccgaca

SEQ ID NO: 187449 - DNA, 25 bp, E. coli
cgccgcgtgaccctgaaaatacctt

SEQ ID NO: 187450 - DNA, 25 bp, E. coli
cgccgcgtgaccgtgaaaatacctt

SEQ ID NO: 187451 - DNA, 25 bp, E. coli
aagcgcctgtaactgatgacgtcag

SEQ ID NO: 187452 - DNA, 25 bp, E. coli
aagcgcctgtaagtgatgacgtcag

SEQ ID NO: 187453 - DNA, 25 bp, E. coli
ttgagattgactttgaaaaacggcc

SEQ ID NO: 187454 - DNA, 25 bp, E. coli
ttgagattgactatgaaaaacggcc

SEQ ID NO: 187455 - DNA, 25 bp, E. coli
ttttgctattaactgggtggcggtc

SEQ ID NO: 187456 - DNA, 25 bp, E. coli
ttttgctattaagtgggtggcggtc

SEQ ID NO: 187457 - DNA, 25 bp, E. coli
tgctgtgtctcccatgctgtatggg

SEQ ID NO: 187458 - DNA, 25 bp, E. coli
tgctgtgtctccgatgctgtatggg

SEQ ID NO: 187459 - DNA, 25 bp, E. coli
gccttgaactgatagcgcctgtaac

SEQ ID NO: 187460 - DNA, 25 bp, E. coli
gccttgaactgaaagcgcctgtaac

SEQ ID NO: 187461 - DNA, 25 bp, E. coli
ccgatgctgtatcggctggcaaaac

SEQ ID NO: 187462 - DNA, 25 bp, E. coli
gcagagcgctggcttttgctattaa

SEQ ID NO: 187463 - DNA, 25 bp, E. coli
gcagagcgctgggttttgctattaa

SEQ ID NO: 187464 - DNA, 25 bp, E. coli
gactatgaaaaacggccttgaactg

SEQ ID NO: 187465 - DNA, 25 bp, E. coli
gaaagtataaaccaattctgttgag

SEQ ID NO: 187466 - DNA, 25 bp, E. coli
gactatgaaaaagggccttgaactg

SEQ ID NO: 187467 - DNA, 25 bp, E. coli
gaaagtataaacgaattctgttgag

SEQ ID NO: 187468 - DNA, 25 bp, E. coli
ccgatgctgtatgggctggcaaaac

SEQ ID NO: 187469 - DNA, 25 bp, E. coli
tggcggtcggtattgctgtgtctcc

SEQ ID NO: 187470 - DNA, 25 bp, E. coli
tggcggtcggtaatgctgtgtctcc

SEQ ID NO: 187471 - DNA, 25 bp, E. coli
taactgatgacgacagcagagcgct

SEQ ID NO: 187472 - DNA, 25 bp, E. coli
taactgatgacgtcagcagagcgct

SEQ ID NO: 187473 - DNA, 25 bp, E. coli
caatcggtcggttatggcgcaatga

SEQ ID NO: 187474 - DNA, 25 bp, E. coli
caatcggtcggtaatggcgcaatga

SEQ ID NO: 187475 - DNA, 25 bp, E. coli
caagttgaaaactcgcctgcgcgaa

SEQ ID NO: 187476 - DNA, 25 bp, E. coli
caagttgaaaacacgcctgcgcgaa

SEQ ID NO: 187477 - DNA, 25 bp, E. coli
taaaatcgttgaaggctacacgccg

SEQ ID NO: 187478 - DNA, 25 bp, E. coli
taaaatcgttgatggctacacgccg

SEQ ID NO: 187479 - DNA, 25 bp, E. coli
aaattatcacccgtgcgcaggtcag

SEQ ID NO: 187480 - DNA, 25 bp, E. coli
aaattatcacccctgcgcaggtcag

SEQ ID NO: 187481 - DNA, 25 bp, E. coli
ttgaagatatcagcggcgtcagcgc

SEQ ID NO: 187482 - DNA, 25 bp, E. coli
tttatgaccaaatccgcgtcggcgg

SEQ ID NO: 187483 - DNA, 25 bp, E. coli
ttgaagatatcaccggcgtcagcgc

SEQ ID NO: 187484 - DNA, 25 bp, E. coli
tttatgaccaaaaccgcgtcggcgg

SEQ ID NO: 187485 - DNA, 25 bp, E. coli
gaaggcgtgtttactgcggctgacc

SEQ ID NO: 187486 - DNA, 25 bp, E. coli
gaaggcgtgttttctgcggctgacc

SEQ ID NO: 187487 - DNA, 25 bp, E. coli
gaaaaacggctccaacatcgcgctg

SEQ ID NO: 187488 - DNA, 25 bp, E. coli
gaaaaacggctcgaacatcgcgctg

SEQ ID NO: 187489 - DNA, 25 bp, E. coli
cattggtttgggtgcactcgcgtaa

SEQ ID NO: 187490 - DNA, 25 bp, E. coli
cattggtttgggagcactcgcgtaa

SEQ ID NO: 187491 - DNA, 25 bp, E. coli
gatttacatgacgtaccagtggtgg

SEQ ID NO: 187492 - DNA, 25 bp, E. coli
gatttacatgacctaccagtggtgg

SEQ ID NO: 187493 - DNA, 25 bp, E. coli
ggatttctacggtgcgacttacgag

SEQ ID NO: 187494 - DNA, 25 bp, E. coli
ggatttctacggagcgacttacgag

SEQ ID NO: 187495 - DNA, 25 bp, E. coli
aattggcagaagatcgtgtttcggt

SEQ ID NO: 187496 - DNA, 25 bp, E. coli
aattggcagaagttcgtgtttcggt

SEQ ID NO: 187497 - DNA, 25 bp, E. coli
aagagcgaaaaattggcagaagatc

SEQ ID NO: 187498 - DNA, 25 bp, E. coli
aagagcgaaaaaatggcagaagatc

SEQ ID NO: 187499 - DNA, 25 bp, E. coli
cagaagatcgtgtttcggtttggct

SEQ ID NO: 187500 - DNA, 25 bp, E. coli
cagaagatcgtgattcggtttggct

SEQ ID NO: 187501 - DNA, 25 bp, E. coli
aaaattggcagaagatcgtgtttcg

SEQ ID NO: 187502 - DNA, 25 bp, E. coli
aaaattggcagatgatcgtgtttcg

SEQ ID NO: 187503 - DNA, 25 bp, E. coli
tttcggtttggcatacagcagtcat

SEQ ID NO: 187504 - DNA, 25 bp, E. coli
tttcggtttggcttacagcagtcat

SEQ ID NO: 187505 - DNA, 25 bp, E. coli
tgcggaagagcgtaaaattggcaga

SEQ ID NO: 187506 - DNA, 25 bp, E. coli
tgcggaagagcgaaaaattggcaga

SEQ ID NO: 187507 - DNA, 25 bp, E. coli
gtttcggtttggcttacagcagtca

SEQ ID NO: 187508 - DNA, 25 bp, E. coli
gtttcggtttgggttacagcagtca

SEQ ID NO: 187509 - DNA, 25 bp, E. coli
gcgaaaaattggcagaagatcgtgt

SEQ ID NO: 187510 - DNA, 25 bp, E. coli
gcgaaaaattgggagaagatcgtgt

SEQ ID NO: 187511 - DNA, 25 bp, E. coli
cgtgtttcggttaggcttacagcag

SEQ ID NO: 187512 - DNA, 25 bp, E. coli
cggaagagcgaaaaattggcagaag

SEQ ID NO: 187513 - DNA, 25 bp, E. coli
cgtgtttcggtttggcttacagcag

SEQ ID NO: 187514 - DNA, 25 bp, E. coli
cggaagagcgaataattggcagaag

SEQ ID NO: 187515 - DNA, 25 bp, E. coli
gatcgtgtttcggtttggcttacag

SEQ ID NO: 187516 - DNA, 25 bp, E. coli
gatcgtgtttcgctttggcttacag

SEQ ID NO: 187517 - DNA, 25 bp, E. coli
cacgatttaacggactggaaactgt

SEQ ID NO: 187518 - DNA, 25 bp, E. coli
cacgatttaacgcactggaaactgt

SEQ ID NO: 187519 - DNA, 25 bp, E. coli
acgcgctgagttacgaagatggcgc

SEQ ID NO: 187520 - DNA, 25 bp, E. coli
acgcgctgagtttcgaagatggcgc

SEQ ID NO: 187521 - DNA, 25 bp, E. coli
aacaggcgggagatgcttatgcact

SEQ ID NO: 187522 - DNA, 25 bp, E. coli
aacaggcgggagttgcttatgcact

SEQ ID NO: 187523 - DNA, 25 bp, E. coli
tttccggtagcgttaacgtggtggt

SEQ ID NO: 187524 - DNA, 25 bp, E. coli
tttccggtagcgataacgtggtggt

SEQ ID NO: 187525 - DNA, 25 bp, E. coli
ttaacggactggaaactgtggccgc

SEQ ID NO: 187526 - DNA, 25 bp, E. coli
ttaacggactggtaactgtggccgc

SEQ ID NO: 187527 - DNA, 25 bp, E. coli
tcctcctgccagacgcgctgagtta

SEQ ID NO: 187528 - DNA, 25 bp, E. coli
tcctcctgccagtcgcgctgagtta

SEQ ID NO: 187529 - DNA, 25 bp, E. coli
gcgaggtttccggtagcgataacgt

SEQ ID NO: 187530 - DNA, 25 bp, E. coli
gcgaggtttccgctagcgataacgt

SEQ ID NO: 187531 - DNA, 25 bp, E. coli
gccagacgcgctgagttacgaagat

SEQ ID NO: 187532 - DNA, 25 bp, E. coli
gccagacgcgctcagttacgaagat

SEQ ID NO: 187533 - DNA, 25 bp, E. coli
gaaaagtcgagttcgaggttagcgc

SEQ ID NO: 187534 - DNA, 25 bp, E. coli
gaaaagtcgagtacgaggttagcgc

SEQ ID NO: 187535 - DNA, 25 bp, E. coli
cttatgcactgaaggcaagcggcaa

SEQ ID NO: 187536 - DNA, 25 bp, E. coli
cttatgcactgatggcaagcggcaa

SEQ ID NO: 187537 - DNA, 25 bp, E. coli
gagttcgaggtttgcgccgacctga

SEQ ID NO: 187538 - DNA, 25 bp, E. coli
gagttcgaggttagcgccgacctga

SEQ ID NO: 187539 - DNA, 25 bp, E. coli
cataaactggctggagataacaacc

SEQ ID NO: 187540 - DNA, 25 bp, E. coli
cagttgcgccaaatcagcagaacga

SEQ ID NO: 187541 - DNA, 25 bp, E. coli
cataaactggctcgagataacaacc

SEQ ID NO: 187542 - DNA, 25 bp, E. coli
cagttgcgccaattcagcagaacga

SEQ ID NO: 187543 - DNA, 25 bp, E. coli
tattcgcctgcatcttacagcagag

SEQ ID NO: 187544 - DNA, 25 bp, E. coli
tattcgcctgcaacttacagcagag

SEQ ID NO: 187545 - DNA, 25 bp, E. coli
ccagatatatttggtcgcgatgcac

SEQ ID NO: 187546 - DNA, 25 bp, E. coli
ccagatatatttcgtcgcgatgcac

SEQ ID NO: 187547 - DNA, 25 bp, E. coli
gctcattgccatactgaaacctgaa

SEQ ID NO: 187548 - DNA, 25 bp, E. coli
gctcattgccattctgaaacctgaa

SEQ ID NO: 187549 - DNA, 25 bp, E. coli
gcagaagcgtttggcatgcgttttt

SEQ ID NO: 187550 - DNA, 25 bp, E. coli
gcagaagcgtttcgcatgcgttttt

SEQ ID NO: 187551 - DNA, 25 bp, E. coli
gaataatccatttccgccacagttg

SEQ ID NO: 187552 - DNA, 25 bp, E. coli
gaataatccattaccgccacagttg

SEQ ID NO: 187553 - DNA, 25 bp, E. coli
gaaacctgaacctcataaactggct

SEQ ID NO: 187554 - DNA, 25 bp, E. coli
gaaacctgaaccacataaactggct

SEQ ID NO: 187555 - DNA, 25 bp, E. coli
cgtttgatgagctagcatggttgct

SEQ ID NO: 187556 - DNA, 25 bp, E. coli
cgtttgatgagcaagcatggttgct

SEQ ID NO: 187557 - DNA, 25 bp, E. coli
taagcgtgacggtgttttgccagat

SEQ ID NO: 187558 - DNA, 25 bp, E. coli
taagcgtgacggagttttgccagat

SEQ ID NO: 187559 - DNA, 25 bp, E. coli
gagcgagttgctcatattcatctgg

SEQ ID NO: 187560 - DNA, 25 bp, E. coli
gagcgagttgctgatattcatctgg

SEQ ID NO: 187561 - DNA, 25 bp, E. coli
aagcgcagaacatgcagaatatcgg

SEQ ID NO: 187562 - DNA, 25 bp, E. coli
aagcgcagaacaagcagaatatcgg

SEQ ID NO: 187563 - DNA, 25 bp, E. coli
cagaatatcggttcgggcattggta

SEQ ID NO: 187564 - DNA, 25 bp, E. coli
cagaatatcggtacgggcattggta

SEQ ID NO: 187565 - DNA, 25 bp, E. coli
agatggcggcgctacagaaagcgca

SEQ ID NO: 187566 - DNA, 25 bp, E. coli
agatggcggcgcaacagaaagcgca

SEQ ID NO: 187567 - DNA, 25 bp, E. coli
ttgaggctgcgatcaaacagatggc

SEQ ID NO: 187568 - DNA, 25 bp, E. coli
ttgaggctgcgaacaaacagatggc

SEQ ID NO: 187569 - DNA, 25 bp, E. coli
tcctgttggtgcagttgctggagca

SEQ ID NO: 187570 - DNA, 25 bp, E. coli
tcctgttggtgctgttgctggagca

SEQ ID NO: 187571 - DNA, 25 bp, E. coli
gaataagtgacgcagacagacgacg

SEQ ID NO: 187572 - DNA, 25 bp, E. coli
gaataagtgacggagacagacgacg

SEQ ID NO: 187573 - DNA, 25 bp, E. coli
gacgacgtgaagaaattgaggctgc

SEQ ID NO: 187574 - DNA, 25 bp, E. coli
gacgacgtgaagtaattgaggctgc

SEQ ID NO: 187575 - DNA, 25 bp, E. coli
cggcgtgaggcaatacagggaataa

SEQ ID NO: 187576 - DNA, 25 bp, E. coli
ctattggcgcatgcgttggtggtcc

SEQ ID NO: 187577 - DNA, 25 bp, E. coli
ctattggcgcatccgttggtggtcc

SEQ ID NO: 187578 - DNA, 25 bp, E. coli
ctggagcagtaaatggcggcattgc

SEQ ID NO: 187579 - DNA, 25 bp, E. coli
ctggagcagtaattggcggcattgc

SEQ ID NO: 187580 - DNA, 25 bp, E. coli
cggcgtgaggcattacagggaataa

SEQ ID NO: 187581 - DNA, 25 bp, E. coli
gatattgcaaatgagtcgcggcgtg

SEQ ID NO: 187582 - DNA, 25 bp, E. coli
gatattgcaaatcagtcgcggcgtg

SEQ ID NO: 187583 - DNA, 25 bp, E. coli
aatcggcagccggaattggcgttcc

SEQ ID NO: 187584 - DNA, 25 bp, E. coli
aatcggcagccgcaattggcgttcc

SEQ ID NO: 187585 - DNA, 25 bp, E. coli
tagctcaggcacaaccattttcagg

SEQ ID NO: 187586 - DNA, 25 bp, E. coli
tagctcaggcactaccattttcagg

SEQ ID NO: 187587 - DNA, 25 bp, E. coli
tatcgagataatggtagtccgggcg

SEQ ID NO: 187588 - DNA, 25 bp, E. coli
tatcgagataatcgtagtccgggcg

SEQ ID NO: 187589 - DNA, 25 bp, E. coli
ttcgggctgccagcagtgaaattgg

SEQ ID NO: 187590 - DNA, 25 bp, E. coli
ttcgggctgccaccagtgaaattgg

SEQ ID NO: 187591 - DNA, 25 bp, E. coli
tgtgtttgccgctatccgccgtgct

SEQ ID NO: 187592 - DNA, 25 bp, E. coli
tgtgtttgccgcaatccgccgtgct

SEQ ID NO: 187593 - DNA, 25 bp, E. coli
tgtctcctgcgaagagcgttccgcg

SEQ ID NO: 187594 - DNA, 25 bp, E. coli
tgtctcctgcgatgagcgttccgcg

SEQ ID NO: 187595 - DNA, 25 bp, E. coli
tcgggctggccgctttccaataagg

SEQ ID NO: 187596 - DNA, 25 bp, E. coli
tcgggctggccggtttccaataagg

SEQ ID NO: 187597 - DNA, 25 bp, E. coli
cgcgccgtttgcaagtccgagatta

SEQ ID NO: 187598 - DNA, 25 bp, E. coli
cgcgccgtttgctagtccgagatta

SEQ ID NO: 187599 - DNA, 25 bp, E. coli
ggtatagtttttccgctgtcgcaaa

SEQ ID NO: 187600 - DNA, 25 bp, E. coli
ggtatagtttttgcgctgtcgcaaa

SEQ ID NO: 187601 - DNA, 25 bp, E. coli
tggcgtttccggtggtagcaataac

SEQ ID NO: 187602 - DNA, 25 bp, E. coli
tggcgtttccggaggtagcaataac

SEQ ID NO: 187603 - DNA, 25 bp, E. coli
taaccgctacttattggaggctgcc

SEQ ID NO: 187604 - DNA, 25 bp, E. coli
taaccgctactttttggaggctgcc

SEQ ID NO: 187605 - DNA, 25 bp, E. coli
aatatgcaaggtatacagctgacgg

SEQ ID NO: 187606 - DNA, 25 bp, E. coli
caacaacgaaggactggcatccgaa

SEQ ID NO: 187607 - DNA, 25 bp, E. coli
aatatgcaaggtttacagctgacgg

SEQ ID NO: 187608 - DNA, 25 bp, E. coli
caacaacgaaggtctggcatccgaa

SEQ ID NO: 187609 - DNA, 25 bp, E. coli
cactcaggactttaccgatggcacg

SEQ ID NO: 187610 - DNA, 25 bp, E. coli
cactcaggacttaaccgatggcacg

SEQ ID NO: 187611 - DNA, 25 bp, E. coli
catccgaaggcgacaacgtctggtc

SEQ ID NO: 187612 - DNA, 25 bp, E. coli
catccgaaggcgtcaacgtctggtc

SEQ ID NO: 187613 - DNA, 25 bp, E. coli
tacaaaccgggcgatctggtgagtt

SEQ ID NO: 187614 - DNA, 25 bp, E. coli
tacaaaccgggccatctggtgagtt

SEQ ID NO: 187615 - DNA, 25 bp, E. coli
gaataccctgatggcagcgaaaact

SEQ ID NO: 187616 - DNA, 25 bp, E. coli
gaagcgtccaacctcgatctcagta

SEQ ID NO: 187617 - DNA, 25 bp, E. coli
gaagcgtccaacgtcgatctcagta

SEQ ID NO: 187618 - DNA, 25 bp, E. coli
gaataccctgatcgcagcgaaaact

SEQ ID NO: 187619 - DNA, 25 bp, E. coli
gtacgccgccgactattcagcaagg

SEQ ID NO: 187620 - DNA, 25 bp, E. coli
gtcaatatgatccttgcccagcgta

SEQ ID NO: 187621 - DNA, 25 bp, E. coli
gtacgccgccgagtattcagcaagg

SEQ ID NO: 187622 - DNA, 25 bp, E. coli
gtcaatatgatcgttgcccagcgta

SEQ ID NO: 187623 - DNA, 25 bp, E. coli
tggcaggtctacacccaggatagca

SEQ ID NO: 187624 - DNA, 25 bp, E. coli
tggccttttctcaagcggttagcgg

SEQ ID NO: 187625 - DNA, 25 bp, E. coli
tggcaggtctactcccaggatagca

SEQ ID NO: 187626 - DNA, 25 bp, E. coli
tggccttttctctagcggttagcgg

SEQ ID NO: 187627 - DNA, 25 bp, E. coli
caaccgtgcagcagtgggtaagcca

SEQ ID NO: 187628 - DNA, 25 bp, E. coli
caaccgtgcagctgtgggtaagcca

SEQ ID NO: 187629 - DNA, 25 bp, E. coli
caaagtgatgtaagtccgcagtgat

SEQ ID NO: 187630 - DNA, 25 bp, E. coli
caaagtgatgtatgtccgcagtgat

SEQ ID NO: 187631 - DNA, 25 bp, E. coli
taaaagcggcaacgtcaaagtgatg

SEQ ID NO: 187632 - DNA, 25 bp, E. coli
taaaagcggcaaggtcaaagtgatg

SEQ ID NO: 187633 - DNA, 25 bp, E. coli
tatgaagggttaccggatgccgcac

SEQ ID NO: 187634 - DNA, 25 bp, E. coli
tatgaagggttagcggatgccgcac

SEQ ID NO: 187635 - DNA, 25 bp, E. coli
tgaatatctctgacgcaaccggcgt

SEQ ID NO: 187636 - DNA, 25 bp, E. coli
tgaatatctctgtcgcaaccggcgt

SEQ ID NO: 187637 - DNA, 25 bp, E. coli
tgcgtcgtcagcgtgcggaagaaac

SEQ ID NO: 187638 - DNA, 25 bp, E. coli
tgcgtcgtcagcctgcggaagaaac

SEQ ID NO: 187639 - DNA, 25 bp, E. coli
gaaaaggccgatgacggtggcatca

SEQ ID NO: 187640 - DNA, 25 bp, E. coli
gaaaaggccgatcacggtggcatca

SEQ ID NO: 187641 - DNA, 25 bp, E. coli
gacaaaagcgtcaggcacggaacat

SEQ ID NO: 187642 - DNA, 25 bp, E. coli
gacaaaagcgtctggcacggaacat

SEQ ID NO: 187643 - DNA, 25 bp, E. coli
gatccgaacgatgtgcgcgtgaaga

SEQ ID NO: 187644 - DNA, 25 bp, E. coli
gagccgtccggaagcgattgttcgc

SEQ ID NO: 187645 - DNA, 25 bp, E. coli
gatccgaacgatctgcgcgtgaaga

SEQ ID NO: 187646 - DNA, 25 bp, E. coli
gagccgtccggatgcgattgttcgc

SEQ ID NO: 187647 - DNA, 25 bp, E. coli
gaccgcaagtggcaagattcgccgt

SEQ ID NO: 187648 - DNA, 25 bp, E. coli
gaccgcaagtgggaagattcgccgt

SEQ ID NO: 187649 - DNA, 25 bp, E. coli
caccaggcgggcatgttattctgga

SEQ ID NO: 187650 - DNA, 25 bp, E. coli
caaatttttgatgtccctcgcggtg

SEQ ID NO: 187651 - DNA, 25 bp, E. coli
caccaggcgggcttgttattctgga

SEQ ID NO: 187652 - DNA, 25 bp, E. coli
caaatttttgatctccctcgcggtg

SEQ ID NO: 187653 - DNA, 25 bp, E. coli
ttttcccaatttcacgtagtccgtg

SEQ ID NO: 187654 - DNA, 25 bp, E. coli
ttttcccaatttgacgtagtccgtg

SEQ ID NO: 187655 - DNA, 25 bp, E. coli
acatcactggcgaggtttcgtacca

SEQ ID NO: 187656 - DNA, 25 bp, E. coli
acatcactggcgtggtttcgtacca

SEQ ID NO: 187657 - DNA, 25 bp, E. coli
tatcaaacacaagtggcaccaggcg

SEQ ID NO: 187658 - DNA, 25 bp, E. coli
tttcgtaccatgctgggctacggcg

SEQ ID NO: 187659 - DNA, 25 bp, E. coli
tatcaaacacaactggcaccaggcg

SEQ ID NO: 187660 - DNA, 25 bp, E. coli
tttcgtaccatggtgggctacggcg

SEQ ID NO: 187661 - DNA, 25 bp, E. coli
tgatggcgttgggtatcaaacacaa

SEQ ID NO: 187662 - DNA, 25 bp, E. coli
tgatggcgttggctatcaaacacaa

SEQ ID NO: 187663 - DNA, 25 bp, E. coli
cgcggtgttatcactcgcaatactg

SEQ ID NO: 187664 - DNA, 25 bp, E. coli
cgcggtgttatctctcgcaatactg

SEQ ID NO: 187665 - DNA, 25 bp, E. coli
cgtatttattgacagagtcgcatga

SEQ ID NO: 187666 - DNA, 25 bp, E. coli
cgtatttattgagagagtcgcatga

SEQ ID NO: 187667 - DNA, 25 bp, E. coli
gatagccgcaaacccagacgcattg

SEQ ID NO: 187668 - DNA, 25 bp, E. coli
gatagccgcaaagccagacgcattg

SEQ ID NO: 187669 - DNA, 25 bp, E. coli
gatgtcacgaattgcgatttttccc

SEQ ID NO: 187670 - DNA, 25 bp, E. coli
gatgtcacgaatagcgatttttccc

SEQ ID NO: 187671 - DNA, 25 bp, E. coli
aacctgtcacaattcacaaaaaggg

SEQ ID NO: 187672 - DNA, 25 bp, E. coli
aacctgtcacaaatcacaaaaaggg

SEQ ID NO: 187673 - DNA, 25 bp, E. coli
aaactttttgtgtgctggcataggc

SEQ ID NO: 187674 - DNA, 25 bp, E. coli
aaactttttgtgagctggcataggc

SEQ ID NO: 187675 - DNA, 25 bp, E. coli
taggtttgccggtctttgtcgtgtg

SEQ ID NO: 187676 - DNA, 25 bp, E. coli
taggtttgccggactttgtcgtgtg

SEQ ID NO: 187677 - DNA, 25 bp, E. coli
tttgtgtgctgggataggctattcg

SEQ ID NO: 187678 - DNA, 25 bp, E. coli
tttgtgtgctggcataggctattcg

SEQ ID NO: 187679 - DNA, 25 bp, E. coli
ttgccggactttgtcgtgtgaacct

SEQ ID NO: 187680 - DNA, 25 bp, E. coli
ttgccggactttctcgtgtgaacct

SEQ ID NO: 187681 - DNA, 25 bp, E. coli
tgtgctggcatacgctattcgaagg

SEQ ID NO: 187682 - DNA, 25 bp, E. coli
tgtgctggcataggctattcgaagg

SEQ ID NO: 187683 - DNA, 25 bp, E. coli
tgaccccgacttgtctataatcctg

SEQ ID NO: 187684 - DNA, 25 bp, E. coli
tgaccccgacttctctataatcctg

SEQ ID NO: 187685 - DNA, 25 bp, E. coli
tgcgaccccacgatacaagaaagtt

SEQ ID NO: 187686 - DNA, 25 bp, E. coli
tgcgaccccacgttacaagaaagtt

SEQ ID NO: 187687 - DNA, 25 bp, E. coli
tcccaaaactttatgtgtgctggca

SEQ ID NO: 187688 - DNA, 25 bp, E. coli
tcccaaaactttttgtgtgctggca

SEQ ID NO: 187689 - DNA, 25 bp, E. coli
gggtcgatctttcaccccgacttct

SEQ ID NO: 187690 - DNA, 25 bp, E. coli
gggtcgatctttgaccccgacttct

SEQ ID NO: 187691 - DNA, 25 bp, E. coli
tataatcctgcgtccccacgttaca

SEQ ID NO: 187692 - DNA, 25 bp, E. coli
tataatcctgcgaccccacgttaca

SEQ ID NO: 187693 - DNA, 25 bp, E. coli
aggccatatcacgtgcggtcactgt

SEQ ID NO: 187694 - DNA, 25 bp, E. coli
ccgacgacctggcttccatttttga

SEQ ID NO: 187695 - DNA, 25 bp, E. coli
ccgacgacctgggttccatttttga

SEQ ID NO: 187696 - DNA, 25 bp, E. coli
aggccatatcacctgcggtcactgt

SEQ ID NO: 187697 - DNA, 25 bp, E. coli
tgcaggtccgataggtattatggct

SEQ ID NO: 187698 - DNA, 25 bp, E. coli
tgcaggtccgattggtattatggct

SEQ ID NO: 187699 - DNA, 25 bp, E. coli
tcggtgttaaccgtccgggctgctt

SEQ ID NO: 187700 - DNA, 25 bp, E. coli
tccgataggtataatggctgcggcg

SEQ ID NO: 187701 - DNA, 25 bp, E. coli
tcggtgttaaccctccgggctgctt

SEQ ID NO: 187702 - DNA, 25 bp, E. coli
tccgataggtattatggctgcggcg

SEQ ID NO: 187703 - DNA, 25 bp, E. coli
gaactgggcatgtccgaaggctttg

SEQ ID NO: 187704 - DNA, 25 bp, E. coli
gaactgggcatgaccgaaggctttg

SEQ ID NO: 187705 - DNA, 25 bp, E. coli
gacaatatctccgacgacctggctt

SEQ ID NO: 187706 - DNA, 25 bp, E. coli
gacaatatctcccacgacctggctt

SEQ ID NO: 187707 - DNA, 25 bp, E. coli
cctggcttccatatttgatcccttc

SEQ ID NO: 187708 - DNA, 25 bp, E. coli
cctggcttccatttttgatcccttc

SEQ ID NO: 187709 - DNA, 25 bp, E. coli
cggtcactgtcggaactgtcgtggc

SEQ ID NO: 187710 - DNA, 25 bp, E. coli
ctgtcgcaactgacgtggcggtcgt

SEQ ID NO: 187711 - DNA, 25 bp, E. coli
cggtcactgtcgcaactgtcgtggc

SEQ ID NO: 187712 - DNA, 25 bp, E. coli
ctgtcgcaactgtcgtggcggtcgt

SEQ ID NO: 187713 - DNA, 25 bp, E. coli
ctgggcatgacccaaggctttgatg

SEQ ID NO: 187714 - DNA, 25 bp, E. coli
ctgggcatgaccgaaggctttgatg

SEQ ID NO: 187715 - DNA, 25 bp, E. coli
aattcgacagtactgacaccggctg

SEQ ID NO: 187716 - DNA, 25 bp, E. coli
aattcgacagtagtgacaccggctg

SEQ ID NO: 187717 - DNA, 25 bp, E. coli
cacagtttattagcggtgacggcgc

SEQ ID NO: 187718 - DNA, 25 bp, E. coli
cacagtttattaccggtgacggcgc

SEQ ID NO: 187719 - DNA, 25 bp, E. coli
aaagattacccgtgcgtcattagcg

SEQ ID NO: 187720 - DNA, 25 bp, E. coli
aaagattacccgagcgtcattagcg

SEQ ID NO: 187721 - DNA, 25 bp, E. coli
tacctgcataccatcggcgtgacgg

SEQ ID NO: 187722 - DNA, 25 bp, E. coli
tacctgcataccttcggcgtgacgg

SEQ ID NO: 187723 - DNA, 25 bp, E. coli
ttcacgctggcgatgggacatgacg

SEQ ID NO: 187724 - DNA, 25 bp, E. coli
ttcacgctggcgttgggacatgacg

SEQ ID NO: 187725 - DNA, 25 bp, E. coli
tttcgcgaagcatcgcaagggatcg

SEQ ID NO: 187726 - DNA, 25 bp, E. coli
tttcgcgaagcaacgcaagggatcg

SEQ ID NO: 187727 - DNA, 25 bp, E. coli
tcccggcgtggcaggtttacaaagt

SEQ ID NO: 187728 - DNA, 25 bp, E. coli
tcccggcgtggctggtttacaaagt

SEQ ID NO: 187729 - DNA, 25 bp, E. coli
tcatcggtgattggttacccggcaa

SEQ ID NO: 187730 - DNA, 25 bp, E. coli
tcatcggtgattcgttacccggcaa

SEQ ID NO: 187731 - DNA, 25 bp, E. coli
gtaatgaacatcctgcgtcgcaaga

SEQ ID NO: 187732 - DNA, 25 bp, E. coli
ggtgatctcttatcgctcgcgggaa

SEQ ID NO: 187733 - DNA, 25 bp, E. coli
gtaatgaacatcgtgcgtcgcaaga

SEQ ID NO: 187734 - DNA, 25 bp, E. coli
ggtgatctcttaacgctcgcgggaa

SEQ ID NO: 187735 - DNA, 25 bp, E. coli
gagcagaatattaccgcgctggcga

SEQ ID NO: 187736 - DNA, 25 bp, E. coli
gagcagaatatttccgcgctggcga

SEQ ID NO: 187737 - DNA, 25 bp, E. coli
catgctctccggtgctcttgatgca

SEQ ID NO: 187738 - DNA, 25 bp, E. coli
catgctctccggagctcttgatgca

SEQ ID NO: 187739 - DNA, 25 bp, E. coli
tattcgccgactataacacccctta

SEQ ID NO: 187740 - DNA, 25 bp, E. coli
tatttgccgactttctgcaacgcga

SEQ ID NO: 187741 - DNA, 25 bp, E. coli
tttggtcttattggcatcctgttgc

SEQ ID NO: 187742 - DNA, 25 bp, E. coli
tatttgccgactatctgcaacgcga

SEQ ID NO: 187743 - DNA, 25 bp, E. coli
tattcgccgactttaacacccctta

SEQ ID NO: 187744 - DNA, 25 bp, E. coli
tttggtcttattcgcatcctgttgc

SEQ ID NO: 187745 - DNA, 25 bp, E. coli
tatttcctttgtactgttgatcggc

SEQ ID NO: 187746 - DNA, 25 bp, E. coli
tatttcctttgttctgttgatcggc

SEQ ID NO: 187747 - DNA, 25 bp, E. coli
ttatctgcggtcacatgctctccgg

SEQ ID NO: 187748 - DNA, 25 bp, E. coli
ttatctgcggtctcatgctctccgg

SEQ ID NO: 187749 - DNA, 25 bp, E. coli
tgatgcacatcttgaccattatgat

SEQ ID NO: 187750 - DNA, 25 bp, E. coli
tgatgcacatctagaccattatgat

SEQ ID NO: 187751 - DNA, 25 bp, E. coli
tctgcaacgcgaaatttggcggaaa

SEQ ID NO: 187752 - DNA, 25 bp, E. coli
tagccaggcactacattatctcaat

SEQ ID NO: 187753 - DNA, 25 bp, E. coli
tagccaggcacttcattatctcaat

SEQ ID NO: 187754 - DNA, 25 bp, E. coli
tctgcaacgcgatatttggcggaaa

SEQ ID NO: 187755 - DNA, 25 bp, E. coli
cctgcgaaggaatactcaccgatca

SEQ ID NO: 187756 - DNA, 25 bp, E. coli
cctgcgaaggaaaactcaccgatca

SEQ ID NO: 187757 - DNA, 25 bp, E. coli
taaccacaggtcttattagccaggc

SEQ ID NO: 187758 - DNA, 25 bp, E. coli
taaccacaggtcatattagccaggc

SEQ ID NO: 187759 - DNA, 25 bp, E. coli
tacggtgacgcccatcaggcttgga

SEQ ID NO: 187760 - DNA, 25 bp, E. coli
tacggtgacgccgatcaggcttgga

SEQ ID NO: 187761 - DNA, 25 bp, E. coli
agcacactgttatccgcatcggcga

SEQ ID NO: 187762 - DNA, 25 bp, E. coli
agcacactgttaaccgcatcggcga

SEQ ID NO: 187763 - DNA, 25 bp, E. coli
tatcagcgatggaatcggtcagcac

SEQ ID NO: 187764 - DNA, 25 bp, E. coli
tatcagcgatggtatcggtcagcac

SEQ ID NO: 187765 - DNA, 25 bp, E. coli
ttttgccagcgcctgatcggtacgc

SEQ ID NO: 187766 - DNA, 25 bp, E. coli
ttgtagcgcacgttgccctgggaca

SEQ ID NO: 187767 - DNA, 25 bp, E. coli
ttttgccagcgcgtgatcggtacgc

SEQ ID NO: 187768 - DNA, 25 bp, E. coli
ttgtagcgcacgatgccctgggaca

SEQ ID NO: 187769 - DNA, 25 bp, E. coli
tgatcggcaccaataatgcttacgg

SEQ ID NO: 187770 - DNA, 25 bp, E. coli
tgatcggcaccattaatgcttacgg

SEQ ID NO: 187771 - DNA, 25 bp, E. coli
tcttgcagcaggtaacgcagatcgc

SEQ ID NO: 187772 - DNA, 25 bp, E. coli
tcttgcagcaggaaacgcagatcgc

SEQ ID NO: 187773 - DNA, 25 bp, E. coli
ccttcaacgttgaagctggcacgat

SEQ ID NO: 187774 - DNA, 25 bp, E. coli
ccttcaacgttgtagctggcacgat

SEQ ID NO: 187775 - DNA, 25 bp, E. coli
cattttgttgccattctgcgcggta

SEQ ID NO: 187776 - DNA, 25 bp, E. coli
cattttgttgcctttctgcgcggta

SEQ ID NO: 187777 - DNA, 25 bp, E. coli
gattatcgcgggtgacttttgccag

SEQ ID NO: 187778 - DNA, 25 bp, E. coli
gattatcgcgggagacttttgccag

SEQ ID NO: 187779 - DNA, 25 bp, E. coli
gatgatttgcagattaaccgggcca

SEQ ID NO: 187780 - DNA, 25 bp, E. coli
gatgatttgcagtttaaccgggcca

SEQ ID NO: 187781 - DNA, 25 bp, E. coli
caataaaaaataatctggcagtcgc

SEQ ID NO: 187782 - DNA, 25 bp, E. coli
caataaaaaatattctggcagtcgc

SEQ ID NO: 187783 - DNA, 25 bp, E. coli
caactcatgggttgcggtgtatacc

SEQ ID NO: 187784 - DNA, 25 bp, E. coli
caactcatgggtagcggtgtatacc

SEQ ID NO: 187785 - DNA, 25 bp, E. coli
tgtataccgtacaaggatgtgggaa

SEQ ID NO: 187786 - DNA, 25 bp, E. coli
tgtataccgtactaggatgtgggaa

SEQ ID NO: 187787 - DNA, 25 bp, E. coli
tcgccggagggaaattaaaatgaat

SEQ ID NO: 187788 - DNA, 25 bp, E. coli
tcgccggagggatattaaaatgaat

SEQ ID NO: 187789 - DNA, 25 bp, E. coli
tcggttggcgaagtcgctgatacgc

SEQ ID NO: 187790 - DNA, 25 bp, E. coli
tcggttggcgaactcgctgatacgc

SEQ ID NO: 187791 - DNA, 25 bp, E. coli
ccacaacggcgggaaattgaaaaat

SEQ ID NO: 187792 - DNA, 25 bp, E. coli
ccacaacggcggcaaattgaaaaat

SEQ ID NO: 187793 - DNA, 25 bp, E. coli
gaatattacctccatgcgcgtctgg

SEQ ID NO: 187794 - DNA, 25 bp, E. coli
gaatattacctcgatgcgcgtctgg

SEQ ID NO: 187795 - DNA, 25 bp, E. coli
gaaaccgcttatggccaactcatgg

SEQ ID NO: 187796 - DNA, 25 bp, E. coli
gaaaccgcttatcgccaactcatgg

SEQ ID NO: 187797 - DNA, 25 bp, E. coli
ggcgctatcgctattaaagcaacaa

SEQ ID NO: 187798 - DNA, 25 bp, E. coli
ggcgctatcgcttttaaagcaacaa

SEQ ID NO: 187799 - DNA, 25 bp, E. coli
taacgaaaatgtcatctccagcgga

SEQ ID NO: 187800 - DNA, 25 bp, E. coli
taacgaaaatgtgatctccagcgga

SEQ ID NO: 187801 - DNA, 25 bp, E. coli
taatcaggaactcaccgaagttgct

SEQ ID NO: 187802 - DNA, 25 bp, E. coli
taatcaggaactgaccgaagttgct

SEQ ID NO: 187803 - DNA, 25 bp, E. coli
ttgttggcctctacccgacgttatt

SEQ ID NO: 187804 - DNA, 25 bp, E. coli
ttgttggcctcttcccgacgttatt

SEQ ID NO: 187805 - DNA, 25 bp, E. coli
tgtcgccattgtcgccatttatggg

SEQ ID NO: 187806 - DNA, 25 bp, E. coli
tgtcgccattgtggccatttatggg

SEQ ID NO: 187807 - DNA, 25 bp, E. coli
tctacccgacgttattaatgacgtt

SEQ ID NO: 187808 - DNA, 25 bp, E. coli
tctacccgacgtaattaatgacgtt

SEQ ID NO: 187809 - DNA, 25 bp, E. coli
gcctctacccgaggttattaatgac

SEQ ID NO: 187810 - DNA, 25 bp, E. coli
cctctacccgacgttattaatgacg

SEQ ID NO: 187811 - DNA, 25 bp, E. coli
cctctacccgaccttattaatgacg

SEQ ID NO: 187812 - DNA, 25 bp, E. coli
gcctctacccgacgttattaatgac

SEQ ID NO: 187813 - DNA, 25 bp, E. coli
gctgtcgccattctcgccatttatg

SEQ ID NO: 187814 - DNA, 25 bp, E. coli
gctgtcgccattgtcgccatttatg

SEQ ID NO: 187815 - DNA, 25 bp, E. coli
cgctgtcgccatagtcgccatttat

SEQ ID NO: 187816 - DNA, 25 bp, E. coli
cgctgtcgccattgtcgccatttat

SEQ ID NO: 187817 - DNA, 25 bp, E. coli
gttgttggcctctacccgacgttat

SEQ ID NO: 187818 - DNA, 25 bp, E. coli
gttgttggcctcaacccgacgttat

SEQ ID NO: 187819 - DNA, 25 bp, E. coli
tgttggcctctagccgacgttatta

SEQ ID NO: 187820 - DNA, 25 bp, E. coli
tgttggcctctacccgacgttatta

SEQ ID NO: 187821 - DNA, 25 bp, E. coli
tggcctctacccgacgttattaatg

SEQ ID NO: 187822 - DNA, 25 bp, E. coli
ggcctctacccgtcgttattaatga

SEQ ID NO: 187823 - DNA, 25 bp, E. coli
ggcctctacccgacgttattaatga

SEQ ID NO: 187824 - DNA, 25 bp, E. coli
tggcctctaccccacgttattaatg

SEQ ID NO: 187825 - DNA, 25 bp, E. coli
caacttgccgaagaaacagcgtttc

SEQ ID NO: 187826 - DNA, 25 bp, E. coli
caacttgccgaacaaacagcgtttc

SEQ ID NO: 187827 - DNA, 25 bp, E. coli
actcacaacggctggcgggagacac

SEQ ID NO: 187828 - DNA, 25 bp, E. coli
actcacaacggcaggcgggagacac

SEQ ID NO: 187829 - DNA, 25 bp, E. coli
tttcgcaacagttccatgcaggcgg

SEQ ID NO: 187830 - DNA, 25 bp, E. coli
tttcgcaacagtaccatgcaggcgg

SEQ ID NO: 187831 - DNA, 25 bp, E. coli
tgaacgaagccgttagcccaggtgc

SEQ ID NO: 187832 - DNA, 25 bp, E. coli
tgaacgaagccgatagcccaggtgc

SEQ ID NO: 187833 - DNA, 25 bp, E. coli
tctgctgattaatatcggctatggc

SEQ ID NO: 187834 - DNA, 25 bp, E. coli
tctgctgattaaaatcggctatggc

SEQ ID NO: 187835 - DNA, 25 bp, E. coli
gcacgctgaagagcaatctgctgat

SEQ ID NO: 187836 - DNA, 25 bp, E. coli
gcacgctgaagaccaatctgctgat

SEQ ID NO: 187837 - DNA, 25 bp, E. coli
gacagtgaattttatgaacggttac

SEQ ID NO: 187838 - DNA, 25 bp, E. coli
gacagtgaatttaatgaacggttac

SEQ ID NO: 187839 - DNA, 25 bp, E. coli
gtgcgcttagcaccctgttcaccga

SEQ ID NO: 187840 - DNA, 25 bp, E. coli
gtgcgcttagcagcctgttcaccga

SEQ ID NO: 187841 - DNA, 25 bp, E. coli
ggcaatctgcaataaaccctgaccg

SEQ ID NO: 187842 - DNA, 25 bp, E. coli
ggcaatctgcaaaaaaccctgaccg

SEQ ID NO: 187843 - DNA, 25 bp, E. coli
gagacacccgtcagcgatgagacgt

SEQ ID NO: 187844 - DNA, 25 bp, E. coli
gatgcccgcagtaggtttacctcca

SEQ ID NO: 187845 - DNA, 25 bp, E. coli
gatgcccgcagttggtttacctcca

SEQ ID NO: 187846 - DNA, 25 bp, E. coli
gagacacccgtctgcgatgagacgt

SEQ ID NO: 187847 - DNA, 25 bp, E. coli
caggaaaaccattatcgagacaacg

SEQ ID NO: 187848 - DNA, 25 bp, E. coli
caggaaaaccataatcgagacaacg

SEQ ID NO: 187849 - DNA, 25 bp, E. coli
taaacatttcaaagataacccgtgg

SEQ ID NO: 187850 - DNA, 25 bp, E. coli
taaacatttcaatgataacccgtgg

SEQ ID NO: 187851 - DNA, 25 bp, E. coli
agctcttatctcagcagttgtcgga

SEQ ID NO: 187852 - DNA, 25 bp, E. coli
agtacagtccatgcacttcaaaagg

SEQ ID NO: 187853 - DNA, 25 bp, E. coli
agctcttatctctgcagttgtcgga

SEQ ID NO: 187854 - DNA, 25 bp, E. coli
agtacagtccatccacttcaaaagg

SEQ ID NO: 187855 - DNA, 25 bp, E. coli
taggtgacgcaaaaaagcaacattt

SEQ ID NO: 187856 - DNA, 25 bp, E. coli
taggtgacgcaataaagcaacattt

SEQ ID NO: 187857 - DNA, 25 bp, E. coli
tagcagataatggtgtggatacccg

SEQ ID NO: 187858 - DNA, 25 bp, E. coli
tagcagataatgctgtggatacccg

SEQ ID NO: 187859 - DNA, 25 bp, E. coli
tataacatagttactgctgcgggta

SEQ ID NO: 187860 - DNA, 25 bp, E. coli
tataacatagtttctgctgcgggta

SEQ ID NO: 187861 - DNA, 25 bp, E. coli
tcatggtctgcgagttagtgagctc

SEQ ID NO: 187862 - DNA, 25 bp, E. coli
tcatggtctgcgtgttagtgagctc

SEQ ID NO: 187863 - DNA, 25 bp, E. coli
gtcttattcaggactatctcgggca

SEQ ID NO: 187864 - DNA, 25 bp, E. coli
ggtgattgcaattacaaactggctg

SEQ ID NO: 187865 - DNA, 25 bp, E. coli
gtcttattcaggtctatctcgggca

SEQ ID NO: 187866 - DNA, 25 bp, E. coli
ggtgattgcaataacaaactggctg

SEQ ID NO: 187867 - DNA, 25 bp, E. coli
gagttgctcttcacgcgatgtttgc

SEQ ID NO: 187868 - DNA, 25 bp, E. coli
gagttgctcttctcgcgatgtttgc

SEQ ID NO: 187869 - DNA, 25 bp, E. coli
tactgaccggtgaaccgcgaatgaa

SEQ ID NO: 187870 - DNA, 25 bp, E. coli
tactgaccggtgtaccgcgaatgaa

SEQ ID NO: 187871 - DNA, 25 bp, E. coli
aactgaaatttgctgagatcgccac

SEQ ID NO: 187872 - DNA, 25 bp, E. coli
aactgaaatttggtgagatcgccac

SEQ ID NO: 187873 - DNA, 25 bp, E. coli
tgtttctcgctggtcgcattatcag

SEQ ID NO: 187874 - DNA, 25 bp, E. coli
tgtttctcgctgctcgcattatcag

SEQ ID NO: 187875 - DNA, 25 bp, E. coli
tcttgatccaaattgtaccgctaaa

SEQ ID NO: 187876 - DNA, 25 bp, E. coli
tcttgatccaaaatgtaccgctaaa

SEQ ID NO: 187877 - DNA, 25 bp, E. coli
gcattatcagattcgcctgtgacga

SEQ ID NO: 187878 - DNA, 25 bp, E. coli
gcattatcagatacgcctgtgacga

SEQ ID NO: 187879 - DNA, 25 bp, E. coli
gctaaaacttttgcagactatttcg

SEQ ID NO: 187880 - DNA, 25 bp, E. coli
gctaaaacttttccagactatttcg

SEQ ID NO: 187881 - DNA, 25 bp, E. coli
gcaattggcgcggataagtcaaccc

SEQ ID NO: 187882 - DNA, 25 bp, E. coli
gcatgatttcatacgcattacgcca

SEQ ID NO: 187883 - DNA, 25 bp, E. coli
gcatgatttcattcgcattacgcca

SEQ ID NO: 187884 - DNA, 25 bp, E. coli
gcaattggcgcgcataagtcaaccc

SEQ ID NO: 187885 - DNA, 25 bp, E. coli
gactatttcgaggaattggcgcgga

SEQ ID NO: 187886 - DNA, 25 bp, E. coli
gactatttcgagcaattggcgcgga

SEQ ID NO: 187887 - DNA, 25 bp, E. coli
cgccacttataatgatcaccggatg

SEQ ID NO: 187888 - DNA, 25 bp, E. coli
cgccacttataaagatcaccggatg

SEQ ID NO: 187889 - DNA, 25 bp, E. coli
ggcgcggataagacaacccggctga

SEQ ID NO: 187890 - DNA, 25 bp, E. coli
ggcgcggataagtcaacccggctga

SEQ ID NO: 187891 - DNA, 25 bp, E. coli
caaaaaaggtgaagtgctgaaggcg

SEQ ID NO: 187892 - DNA, 25 bp, E. coli
caaaaaaggtgatgtgctgaaggcg

SEQ ID NO: 187893 - DNA, 25 bp, E. coli
caggcgtaggcgacatcatcaagat

SEQ ID NO: 187894 - DNA, 25 bp, E. coli
cagactatgctgtacgtcgccgaca

SEQ ID NO: 187895 - DNA, 25 bp, E. coli
caggcgtaggcgtcatcatcaagat

SEQ ID NO: 187896 - DNA, 25 bp, E. coli
cagactatgctgaacgtcgccgaca

SEQ ID NO: 187897 - DNA, 25 bp, E. coli
caccaagaagggtgttcgtcgcccg

SEQ ID NO: 187898 - DNA, 25 bp, E. coli
caccaagaagggagttcgtcgcccg

SEQ ID NO: 187899 - DNA, 25 bp, E. coli
tatcaaggttctgggtggctcgcac

SEQ ID NO: 187900 - DNA, 25 bp, E. coli
tatcaaggttctcggtggctcgcac

SEQ ID NO: 187901 - DNA, 25 bp, E. coli
tttttgggccggtaactcgtgagct

SEQ ID NO: 187902 - DNA, 25 bp, E. coli
tttttgggccggaaactcgtgagct

SEQ ID NO: 187903 - DNA, 25 bp, E. coli
tgaaaattatctctctggcaccaga

SEQ ID NO: 187904 - DNA, 25 bp, E. coli
tgaacaacaacagcgagcagcctat

SEQ ID NO: 187905 - DNA, 25 bp, E. coli
tgaacaacaacaccgagcagcctat

SEQ ID NO: 187906 - DNA, 25 bp, E. coli
tgaaaattatctgtctggcaccaga

SEQ ID NO: 187907 - DNA, 25 bp, E. coli
tccggtgcacgtggcgtaatgtgta

SEQ ID NO: 187908 - DNA, 25 bp, E. coli
tccggtgcacgtcgcgtaatgtgta

SEQ ID NO: 187909 - DNA, 25 bp, E. coli
gcaattccgcgtggtaaggtcaaaa

SEQ ID NO: 187910 - DNA, 25 bp, E. coli
gcaattccgcgtcgtaaggtcaaaa

SEQ ID NO: 187911 - DNA, 25 bp, E. coli
gatcaccatcaatgaagcaattccg

SEQ ID NO: 187912 - DNA, 25 bp, E. coli
gatcaccatcaaagaagcaattccg

SEQ ID NO: 187913 - DNA, 25 bp, E. coli
attgttggcgcgatattagggttag

SEQ ID NO: 187914 - DNA, 25 bp, E. coli
attgttggcgcgttattagggttag

SEQ ID NO: 187915 - DNA, 25 bp, E. coli
tatcgttcatcgctattttggcccg

SEQ ID NO: 187916 - DNA, 25 bp, E. coli
tatcgttcatcggtattttggcccg

SEQ ID NO: 187917 - DNA, 25 bp, E. coli
ttagggttagtgttgacccacttgt

SEQ ID NO: 187918 - DNA, 25 bp, E. coli
ttagggttagtgatgacccacttgt

SEQ ID NO: 187919 - DNA, 25 bp, E. coli
ttgctgattacggtgctacgttggg

SEQ ID NO: 187920 - DNA, 25 bp, E. coli
ttgctgattacgctgctacgttggg

SEQ ID NO: 187921 - DNA, 25 bp, E. coli
tgcgttgttaattgttggcgcgtta

SEQ ID NO: 187922 - DNA, 25 bp, E. coli
tgcgttgttaatagttggcgcgtta

SEQ ID NO: 187923 - DNA, 25 bp, E. coli
gcgcatcgcagaattttactgggaa

SEQ ID NO: 187924 - DNA, 25 bp, E. coli
gcgcatcgcagatttttactgggaa

SEQ ID NO: 187925 - DNA, 25 bp, E. coli
gcagcgttaccacccttgctgatta

SEQ ID NO: 187926 - DNA, 25 bp, E. coli
gcagcgttaccagccttgctgatta

SEQ ID NO: 187927 - DNA, 25 bp, E. coli
cgaccatcgccctaactattggtct

SEQ ID NO: 187928 - DNA, 25 bp, E. coli
cgaccatcgcccaaactattggtct

SEQ ID NO: 187929 - DNA, 25 bp, E. coli
gttcatcgctatattggcccgcatg

SEQ ID NO: 187930 - DNA, 25 bp, E. coli
gttcatcgctattttggcccgcatg

SEQ ID NO: 187931 - DNA, 25 bp, E. coli
tggctgctggcatcagcagcgttac

SEQ ID NO: 187932 - DNA, 25 bp, E. coli
tggctgctggcaacagcagcgttac

SEQ ID NO: 187933 - DNA, 25 bp, E. coli
gacccacttgtttgcgcatcgcaga

SEQ ID NO: 187934 - DNA, 25 bp, E. coli
gacccacttgttagcgcatcgcaga

SEQ ID NO: 187935 - DNA, 25 bp, E. coli
caacggctgaaagataatatcaacg

SEQ ID NO: 187936 - DNA, 25 bp, E. coli
caacggctgaaacataatatcaacg

SEQ ID NO: 187937 - DNA, 25 bp, E. coli
taacaccgctgatgcttcaacggct

SEQ ID NO: 187938 - DNA, 25 bp, E. coli
taacaccgctgaagcttcaacggct

SEQ ID NO: 187939 - DNA, 25 bp, E. coli
aatatcaacgcatgggttaatgaag

SEQ ID NO: 187940 - DNA, 25 bp, E. coli
aaaacgctggatattattaccacaa

SEQ ID NO: 187941 - DNA, 25 bp, E. coli
aaaacgctggattttattaccacaa

SEQ ID NO: 187942 - DNA, 25 bp, E. coli
aatatcaacgcaagggttaatgaag

SEQ ID NO: 187943 - DNA, 25 bp, E. coli
tattaccacaacattaacaccgctg

SEQ ID NO: 187944 - DNA, 25 bp, E. coli
tattaccacaactttaacaccgctg

SEQ ID NO: 187945 - DNA, 25 bp, E. coli
tctcgttacgcatgtcagcaaaaaa

SEQ ID NO: 187946 - DNA, 25 bp, E. coli
tcttgcagacccttacggtaagatc

SEQ ID NO: 187947 - DNA, 25 bp, E. coli
tctcgttacgcaagtcagcaaaaaa

SEQ ID NO: 187948 - DNA, 25 bp, E. coli
tcttgcagacccatacggtaagatc

SEQ ID NO: 187949 - DNA, 25 bp, E. coli
cctgcttatgggattctcgttacgc

SEQ ID NO: 187950 - DNA, 25 bp, E. coli
cctgcttatgggtttctcgttacgc

SEQ ID NO: 187951 - DNA, 25 bp, E. coli
gcaacaagcagctttcttgcagacc

SEQ ID NO: 187952 - DNA, 25 bp, E. coli
gcaacaagcagcattcttgcagacc

SEQ ID NO: 187953 - DNA, 25 bp, E. coli
ggtaagatctcacataaaacgctgg

SEQ ID NO: 187954 - DNA, 25 bp, E. coli
ggtaagatctcagataaaacgctgg

SEQ ID NO: 187955 - DNA, 25 bp, E. coli
taatgaagaatttagtcctccctgc

SEQ ID NO: 187956 - DNA, 25 bp, E. coli
taatgaagaattaagtcctccctgc

SEQ ID NO: 187957 - DNA, 25 bp, E. coli
cagccaatagtgaagcaagaaaatt

SEQ ID NO: 187958 - DNA, 25 bp, E. coli
cagccaatagtgtagcaagaaaatt

SEQ ID NO: 187959 - DNA, 25 bp, E. coli
caggcagccaatagtgaagcaagaa

SEQ ID NO: 187960 - DNA, 25 bp, E. coli
caggcagccaattgtgaagcaagaa

SEQ ID NO: 187961 - DNA, 25 bp, E. coli
aaattgttgtctcctttcgcgcagc

SEQ ID NO: 187962 - DNA, 25 bp, E. coli
aaattgttgtctgctttcgcgcagc

SEQ ID NO: 187963 - DNA, 25 bp, E. coli
tgttgtctgcttacgcgcagcacaa

SEQ ID NO: 187964 - DNA, 25 bp, E. coli
tgttgtctgctttcgcgcagcacaa

SEQ ID NO: 187965 - DNA, 25 bp, E. coli
tgcaggcagccattagtgaagcaag

SEQ ID NO: 187966 - DNA, 25 bp, E. coli
tgcaggcagccaatagtgaagcaag

SEQ ID NO: 187967 - DNA, 25 bp, E. coli
ccaatagtgaaggaagaaaattgtt

SEQ ID NO: 187968 - DNA, 25 bp, E. coli
ccaatagtgaagcaagaaaattgtt

SEQ ID NO: 187969 - DNA, 25 bp, E. coli
gaaaattgttgtgtgctttcgcgca

SEQ ID NO: 187970 - DNA, 25 bp, E. coli
gaaaattgttgtctgctttcgcgca

SEQ ID NO: 187971 - DNA, 25 bp, E. coli
gtctgctttcgcgcagcacaattaa

SEQ ID NO: 187972 - DNA, 25 bp, E. coli
gttgtctgctttcgcgcagcacaat

SEQ ID NO: 187973 - DNA, 25 bp, E. coli
gttgtctgctttggcgcagcacaat

SEQ ID NO: 187974 - DNA, 25 bp, E. coli
gtctgctttcgcccagcacaattaa

SEQ ID NO: 187975 - DNA, 25 bp, E. coli
gtgaagcaagaatattgttgtctgc

SEQ ID NO: 187976 - DNA, 25 bp, E. coli
gtgaagcaagaaaattgttgtctgc

SEQ ID NO: 187977 - DNA, 25 bp, E. coli
ggcagccaatagtgaagcaagaaaa

SEQ ID NO: 187978 - DNA, 25 bp, E. coli
ggcagccaatagagaagcaagaaaa

SEQ ID NO: 187979 - DNA, 25 bp, E. coli
aattcacacccttataaggctggga

SEQ ID NO: 187980 - DNA, 25 bp, E. coli
aattcacaccctaataaggctggga

SEQ ID NO: 187981 - DNA, 25 bp, E. coli
taacaagccggtgggtaaagcaccg

SEQ ID NO: 187982 - DNA, 25 bp, E. coli
taacaagccggtcggtaaagcaccg

SEQ ID NO: 187983 - DNA, 25 bp, E. coli
tcttcagaagagtatagcccatcgt

SEQ ID NO: 187984 - DNA, 25 bp, E. coli
tcggtgacagcgaatatcgtatggt

SEQ ID NO: 187985 - DNA, 25 bp, E. coli
tctacgctactgatcttcagaagag

SEQ ID NO: 187986 - DNA, 25 bp, E. coli
tcttcagaagagaatagcccatcgt

SEQ ID NO: 187987 - DNA, 25 bp, E. coli
tctacgctactgttcttcagaagag

SEQ ID NO: 187988 - DNA, 25 bp, E. coli
tcggtgacagcgtatatcgtatggt

SEQ ID NO: 187989 - DNA, 25 bp, E. coli
gcgagatcgacttactgcaccatat

SEQ ID NO: 187990 - DNA, 25 bp, E. coli
gcgagatcgactaactgcaccatat

SEQ ID NO: 187991 - DNA, 25 bp, E. coli
gcaccggcttgtaacaaagtaagaa

SEQ ID NO: 187992 - DNA, 25 bp, E. coli
gaatcaaaatgaaacgcaacgtgcg

SEQ ID NO: 187993 - DNA, 25 bp, E. coli
gcaccggcttgttacaaagtaagaa

SEQ ID NO: 187994 - DNA, 25 bp, E. coli
gaatcaaaatgatacgcaacgtgcg

SEQ ID NO: 187995 - DNA, 25 bp, E. coli
gatttaggacagattcaatctacgc

SEQ ID NO: 187996 - DNA, 25 bp, E. coli
gatagtttaagacggtaacaagccg

SEQ ID NO: 187997 - DNA, 25 bp, E. coli
gatagtttaagagggtaacaagccg

SEQ ID NO: 187998 - DNA, 25 bp, E. coli
gatttaggacagtttcaatctacgc

SEQ ID NO: 187999 - DNA, 25 bp, E. coli
taaggctgggaattcagacggaatc

SEQ ID NO: 188000 - DNA, 25 bp, E. coli
taaggctgggaaatcagacggaatc

SEQ ID NO: 188001 - DNA, 25 bp, E. coli
cacatgggtactggcagtgataagt

SEQ ID NO: 188002 - DNA, 25 bp, E. coli
cacatgggtactcgcagtgataagt

SEQ ID NO: 188003 - DNA, 25 bp, E. coli
cagtgataagtcggatgcgctcggc

SEQ ID NO: 188004 - DNA, 25 bp, E. coli
cagtgataagtccgatgcgctcggc

SEQ ID NO: 188005 - DNA, 25 bp, E. coli
tactggcagtgaaaagtcggatgcg

SEQ ID NO: 188006 - DNA, 25 bp, E. coli
tactggcagtgataagtcggatgcg

SEQ ID NO: 188007 - DNA, 25 bp, E. coli
actggcagtgataagtcggatgcgc

SEQ ID NO: 188008 - DNA, 25 bp, E. coli
actggcagtgattagtcggatgcgc

SEQ ID NO: 188009 - DNA, 25 bp, E. coli
tgataagtcggatgcgctcggcgtg

SEQ ID NO: 188010 - DNA, 25 bp, E. coli
tgataagtcggaagcgctcggcgtg

SEQ ID NO: 188011 - DNA, 25 bp, E. coli
gccctattataaacaacacgctatg

SEQ ID NO: 188012 - DNA, 25 bp, E. coli
gccctattataatcaacacgctatg

SEQ ID NO: 188013 - DNA, 25 bp, E. coli
ctattataatcaacacgctatgtag

SEQ ID NO: 188014 - DNA, 25 bp, E. coli
cgtgccctattaaaatcaacacgct

SEQ ID NO: 188015 - DNA, 25 bp, E. coli
ctattataatcatcacgctatgtag

SEQ ID NO: 188016 - DNA, 25 bp, E. coli
cgtgccctattataatcaacacgct

SEQ ID NO: 188017 - DNA, 25 bp, E. coli
gtactggcagtgataagtcggatgc

SEQ ID NO: 188018 - DNA, 25 bp, E. coli
gtactggcagtgttaagtcggatgc

SEQ ID NO: 188019 - DNA, 25 bp, E. coli
tggcagtgataagtcggatgcgctc

SEQ ID NO: 188020 - DNA, 25 bp, E. coli
tggcagtgataactcggatgcgctc

SEQ ID NO: 188021 - DNA, 25 bp, E. coli
taagtcggatgccctcggcgtgccc

SEQ ID NO: 188022 - DNA, 25 bp, E. coli
taagtcggatgcgctcggcgtgccc

SEQ ID NO: 188023 - DNA, 25 bp, E. coli
aagcgcactgaatgctcaggagatc

SEQ ID NO: 188024 - DNA, 25 bp, E. coli
aagcgcactgaaagctcaggagatc

SEQ ID NO: 188025 - DNA, 25 bp, E. coli
agcgcactgaaacctcaggagatcc

SEQ ID NO: 188026 - DNA, 25 bp, E. coli
agcgcactgaaagctcaggagatcc

SEQ ID NO: 188027 - DNA, 25 bp, E. coli
ttaagcgcactgaaagctcaggaga

SEQ ID NO: 188028 - DNA, 25 bp, E. coli
tttaagcgcactcaaagctcaggag

SEQ ID NO: 188029 - DNA, 25 bp, E. coli
tttaagcgcactgaaagctcaggag

SEQ ID NO: 188030 - DNA, 25 bp, E. coli
ttttaagcgcactgaaagctcagga

SEQ ID NO: 188031 - DNA, 25 bp, E. coli
ttttaagcgcacagaaagctcagga

SEQ ID NO: 188032 - DNA, 25 bp, E. coli
ttaagcgcactgtaagctcaggaga

SEQ ID NO: 188033 - DNA, 25 bp, E. coli
ccttaaaccagttttaagcgcactg

SEQ ID NO: 188034 - DNA, 25 bp, E. coli
ccttaaaccagtattaagcgcactg

SEQ ID NO: 188035 - DNA, 25 bp, E. coli
gcgcactgaaagctcaggagatcct

SEQ ID NO: 188036 - DNA, 25 bp, E. coli
gcgcactgaaaggtcaggagatcct

SEQ ID NO: 188037 - DNA, 25 bp, E. coli
tgcccttaaaccagttttaagcgca

SEQ ID NO: 188038 - DNA, 25 bp, E. coli
tgcccttaaacctgttttaagcgca

SEQ ID NO: 188039 - DNA, 25 bp, E. coli
taagcgcactgatagctcaggagat

SEQ ID NO: 188040 - DNA, 25 bp, E. coli
taagcgcactgaaagctcaggagat

SEQ ID NO: 188041 - DNA, 25 bp, E. coli
cagtgacactcgaagaacagacgca

SEQ ID NO: 188042 - DNA, 25 bp, E. coli
catcgggcttggtatgcaggttaaa

SEQ ID NO: 188043 - DNA, 25 bp, E. coli
catcgggcttggaatgcaggttaaa

SEQ ID NO: 188044 - DNA, 25 bp, E. coli
cagtgacactcgtagaacagacgca

SEQ ID NO: 188045 - DNA, 25 bp, E. coli
tactgttattactcggtggtgcggg

SEQ ID NO: 188046 - DNA, 25 bp, E. coli
tactgttattacacggtggtgcggg

SEQ ID NO: 188047 - DNA, 25 bp, E. coli
tacctgcggcgatcagtgaaataca

SEQ ID NO: 188048 - DNA, 25 bp, E. coli
tacctgcggcgaacagtgaaataca

SEQ ID NO: 188049 - DNA, 25 bp, E. coli
tgttggcctgctctctgacattgcg

SEQ ID NO: 188050 - DNA, 25 bp, E. coli
tgttggcctgctgtctgacattgcg

SEQ ID NO: 188051 - DNA, 25 bp, E. coli
gccgcccggcattgatgagcattta

SEQ ID NO: 188052 - DNA, 25 bp, E. coli
gccgcccggcatagatgagcattta

SEQ ID NO: 188053 - DNA, 25 bp, E. coli
gaagcgagcacacgcattgagttta

SEQ ID NO: 188054 - DNA, 25 bp, E. coli
gaagcgagcacaggcattgagttta

SEQ ID NO: 188055 - DNA, 25 bp, E. coli
gttttcacatgctaaccgctcaggt

SEQ ID NO: 188056 - DNA, 25 bp, E. coli
gttttcacatgcaaaccgctcaggt

SEQ ID NO: 188057 - DNA, 25 bp, E. coli
ggattcagcgccaactttgccacgg

SEQ ID NO: 188058 - DNA, 25 bp, E. coli
ggattcagcgcctactttgccacgg

SEQ ID NO: 188059 - DNA, 25 bp, E. coli
ggtgtttattgccagccacgtactg

SEQ ID NO: 188060 - DNA, 25 bp, E. coli
ggtgtttattgcgagccacgtactg

SEQ ID NO: 188061 - DNA, 25 bp, E. coli
taactgtggtggttgtcaccgccca

SEQ ID NO: 188062 - DNA, 25 bp, E. coli
taactgtggtggatgtcaccgccca

SEQ ID NO: 188063 - DNA, 25 bp, E. coli
tacgccttatggagtttaattcagc

SEQ ID NO: 188064 - DNA, 25 bp, E. coli
tacagcaacgaagaaatagcgggtg

SEQ ID NO: 188065 - DNA, 25 bp, E. coli
tacagcaacgaacaaatagcgggtg

SEQ ID NO: 188066 - DNA, 25 bp, E. coli
aacgaacaaatagcgggtgaactgg

SEQ ID NO: 188067 - DNA, 25 bp, E. coli
aacgaacaaataccgggtgaactgg

SEQ ID NO: 188068 - DNA, 25 bp, E. coli
tacgccttatggtgtttaattcagc

SEQ ID NO: 188069 - DNA, 25 bp, E. coli
tgccgtgcagcaggcgcagaaactg

SEQ ID NO: 188070 - DNA, 25 bp, E. coli
tccggttacagctacgaacaaatag

SEQ ID NO: 188071 - DNA, 25 bp, E. coli
tgcgcatccgaggacaactgttatg

SEQ ID NO: 188072 - DNA, 25 bp, E. coli
tgcgcatccgagcacaactgttatg

SEQ ID NO: 188073 - DNA, 25 bp, E. coli
tccggttacagcaacgaacaaatag

SEQ ID NO: 188074 - DNA, 25 bp, E. coli
tgccgtgcagcacgcgcagaaactg

SEQ ID NO: 188075 - DNA, 25 bp, E. coli
ccttatggagtttaattcagcaaag

SEQ ID NO: 188076 - DNA, 25 bp, E. coli
ccttatggagttaaattcagcaaag

SEQ ID NO: 188077 - DNA, 25 bp, E. coli
gacgtctggcactacgccttatgga

SEQ ID NO: 188078 - DNA, 25 bp, E. coli
ccgagcacaactcttatgggcctgg

SEQ ID NO: 188079 - DNA, 25 bp, E. coli
ccgagcacaactgttatgggcctgg

SEQ ID NO: 188080 - DNA, 25 bp, E. coli
gtttctggtgcgcatccgagcacaa

SEQ ID NO: 188081 - DNA, 25 bp, E. coli
gtttctggtgcggatccgagcacaa

SEQ ID NO: 188082 - DNA, 25 bp, E. coli
gtcaggctgccgagcagcacgcgca

SEQ ID NO: 188083 - DNA, 25 bp, E. coli
gtcaggctgccgtgcagcacgcgca

SEQ ID NO: 188084 - DNA, 25 bp, E. coli
gacgtctggcacaacgccttatgga

SEQ ID NO: 188085 - DNA, 25 bp, E. coli
caacccaggtagagttcaatcagaa

SEQ ID NO: 188086 - DNA, 25 bp, E. coli
caacccaggtagtgttcaatcagaa

SEQ ID NO: 188087 - DNA, 25 bp, E. coli
tacggcacagccgttggtgcaggca

SEQ ID NO: 188088 - DNA, 25 bp, E. coli
aactctgtggagattcgcgctctac

SEQ ID NO: 188089 - DNA, 25 bp, E. coli
aactctgtggagtttcgcgctctac

SEQ ID NO: 188090 - DNA, 25 bp, E. coli
tacggcacagcccttggtgcaggca

SEQ ID NO: 188091 - DNA, 25 bp, E. coli
ttattactgctctggtcgcctggcc

SEQ ID NO: 188092 - DNA, 25 bp, E. coli
ttattactgctcaggtcgcctggcc

SEQ ID NO: 188093 - DNA, 25 bp, E. coli
tgtttgttgcataaacccgaacgcg

SEQ ID NO: 188094 - DNA, 25 bp, E. coli
tgtttgttgcattaacccgaacgcg

SEQ ID NO: 188095 - DNA, 25 bp, E. coli
tcacttacggaacagctggcaaagc

SEQ ID NO: 188096 - DNA, 25 bp, E. coli
tcacttacggaagagctggcaaagc

SEQ ID NO: 188097 - DNA, 25 bp, E. coli
tcattcctgggttcgtactttggcg

SEQ ID NO: 188098 - DNA, 25 bp, E. coli
tcattcctgggtacgtactttggcg

SEQ ID NO: 188099 - DNA, 25 bp, E. coli
gaaaagtcgtgcatttaaccgcgca

SEQ ID NO: 188100 - DNA, 25 bp, E. coli
gaaaagtcgtgcttttaaccgcgca

SEQ ID NO: 188101 - DNA, 25 bp, E. coli
cgaacgccccaggatggttgtcaat

SEQ ID NO: 188102 - DNA, 25 bp, E. coli
cgaacgccccagcatggttgtcaat

SEQ ID NO: 188103 - DNA, 25 bp, E. coli
cgtcgtgttgatatatgcagtggca

SEQ ID NO: 188104 - DNA, 25 bp, E. coli
cgtcgtgttgatttatgcagtggca

SEQ ID NO: 188105 - DNA, 25 bp, E. coli
ggcgcggtaacagactactatggca

SEQ ID NO: 188106 - DNA, 25 bp, E. coli
ggcgcggtaacacactactatggca

SEQ ID NO: 188107 - DNA, 25 bp, E. coli
cggttttaccactcgttcgcagcga

SEQ ID NO: 188108 - DNA, 25 bp, E. coli
cggttttaccacacgttcgcagcga

SEQ ID NO: 188109 - DNA, 25 bp, E. coli
aaatctcactttcggcttcgctggg

SEQ ID NO: 188110 - DNA, 25 bp, E. coli
aaatctcactttgggcttcgctggg

SEQ ID NO: 188111 - DNA, 25 bp, E. coli
tagatcgtattgatagcctgacggc

SEQ ID NO: 188112 - DNA, 25 bp, E. coli
tagatcgtattgttagcctgacggc

SEQ ID NO: 188113 - DNA, 25 bp, E. coli
tattgtcgcagcgttagcctcagtg

SEQ ID NO: 188114 - DNA, 25 bp, E. coli
tattgtcgcagccttagcctcagtg

SEQ ID NO: 188115 - DNA, 25 bp, E. coli
tgttttacccagcttccgcagcaat

SEQ ID NO: 188116 - DNA, 25 bp, E. coli
tgttttacccaggttccgcagcaat

SEQ ID NO: 188117 - DNA, 25 bp, E. coli
tctggcgtaactgtaaaacattgcg

SEQ ID NO: 188118 - DNA, 25 bp, E. coli
tctggcgtaactctaaaacattgcg

SEQ ID NO: 188119 - DNA, 25 bp, E. coli
tcatttaattccaggacacggtggt

SEQ ID NO: 188120 - DNA, 25 bp, E. coli
tcatttaattcctggacacggtggt

SEQ ID NO: 188121 - DNA, 25 bp, E. coli
ccgaaatattcaacaaccgctggtt

SEQ ID NO: 188122 - DNA, 25 bp, E. coli
gaagcaggaattaaggacagcggtc

SEQ ID NO: 188123 - DNA, 25 bp, E. coli
gaagcaggaatttaggacagcggtc

SEQ ID NO: 188124 - DNA, 25 bp, E. coli
cgagaatcattacagtggcgcaata

SEQ ID NO: 188125 - DNA, 25 bp, E. coli
cgagaatcattagagtggcgcaata

SEQ ID NO: 188126 - DNA, 25 bp, E. coli
ccgaaatattcatcaaccgctggtt

SEQ ID NO: 188127 - DNA, 25 bp, E. coli
tggcaaggctttatcggtggactcg

SEQ ID NO: 188128 - DNA, 25 bp, E. coli
tggcaaggctttttcggtggactcg

SEQ ID NO: 188129 - DNA, 25 bp, E. coli
aatgccattgcgataattaccgcag

SEQ ID NO: 188130 - DNA, 25 bp, E. coli
caatctcgggcagaatttcttgcag

SEQ ID NO: 188131 - DNA, 25 bp, E. coli
caatctcgggcacaatttcttgcag

SEQ ID NO: 188132 - DNA, 25 bp, E. coli
aatgccattgcgttaattaccgcag

SEQ ID NO: 188133 - DNA, 25 bp, E. coli
ctgtttgtcggaactgtactggtca

SEQ ID NO: 188134 - DNA, 25 bp, E. coli
ctgtttgtcggatctgtactggtca

SEQ ID NO: 188135 - DNA, 25 bp, E. coli
tactggtcaagtatctcggtctctg

SEQ ID NO: 188136 - DNA, 25 bp, E. coli
tactggtcaagtttctcggtctctg

SEQ ID NO: 188137 - DNA, 25 bp, E. coli
taccgcaggtctaatgtctctggcc

SEQ ID NO: 188138 - DNA, 25 bp, E. coli
taccgcaggtcttatgtctctggcc

SEQ ID NO: 188139 - DNA, 25 bp, E. coli
tgtacggtttttgcgccgctgtcgg

SEQ ID NO: 188140 - DNA, 25 bp, E. coli
tgtacggtttttccgccgctgtcgg

SEQ ID NO: 188141 - DNA, 25 bp, E. coli
tgcgcctggcttatcgatacgtgga

SEQ ID NO: 188142 - DNA, 25 bp, E. coli
tccgcgaacgccttgctgtggctga

SEQ ID NO: 188143 - DNA, 25 bp, E. coli
tgcgcctggcttttcgatacgtgga

SEQ ID NO: 188144 - DNA, 25 bp, E. coli
tccgcgaacgccatgctgtggctga

SEQ ID NO: 188145 - DNA, 25 bp, E. coli
gcgttgctgaatatcaatctcgggc

SEQ ID NO: 188146 - DNA, 25 bp, E. coli
gcgttgctgaatttcaatctcgggc

SEQ ID NO: 188147 - DNA, 25 bp, E. coli
taatctgatttagctgcgcaccctg

SEQ ID NO: 188148 - DNA, 25 bp, E. coli
taatctgatttacctgcgcaccctg

SEQ ID NO: 188149 - DNA, 25 bp, E. coli
gatgtcccggcagcttttcgcggta

SEQ ID NO: 188150 - DNA, 25 bp, E. coli
gatgtcccggcaccttttcgcggta

SEQ ID NO: 188151 - DNA, 25 bp, E. coli
caacggtggagtccgtaattttcac

SEQ ID NO: 188152 - DNA, 25 bp, E. coli
caacggtggagtgcgtaattttcac

SEQ ID NO: 188153 - DNA, 25 bp, E. coli
taaaaacgtgatctgggattacccg

SEQ ID NO: 188154 - DNA, 25 bp, E. coli
taaaaacgtgatgtgggattacccg

SEQ ID NO: 188155 - DNA, 25 bp, E. coli
tatcccatgcgcagccaaaatggtg

SEQ ID NO: 188156 - DNA, 25 bp, E. coli
tattgacaccccaaaagcggagttg

SEQ ID NO: 188157 - DNA, 25 bp, E. coli
tattgacacccctaaagcggagttg

SEQ ID NO: 188158 - DNA, 25 bp, E. coli
tatcccatgcgctgccaaaatggtg

SEQ ID NO: 188159 - DNA, 25 bp, E. coli
ttcacggtgaaagttgctggtatcc

SEQ ID NO: 188160 - DNA, 25 bp, E. coli
ttcacggtgaaacttgctggtatcc

SEQ ID NO: 188161 - DNA, 25 bp, E. coli
tctgcgtgctgcagacaggcgaata

SEQ ID NO: 188162 - DNA, 25 bp, E. coli
tctgcgtgctgctgacaggcgaata

SEQ ID NO: 188163 - DNA, 25 bp, E. coli
gagcaagttacagcgggagatctat

SEQ ID NO: 188164 - DNA, 25 bp, E. coli
gagcaagttacaccgggagatctat

SEQ ID NO: 188165 - DNA, 25 bp, E. coli
gatctatgacttactgacgccaacg

SEQ ID NO: 188166 - DNA, 25 bp, E. coli
gatctatgactttctgacgccaacg

SEQ ID NO: 188167 - DNA, 25 bp, E. coli
tggaagcaccgaattaccgcgttat

SEQ ID NO: 188168 - DNA, 25 bp, E. coli
ggcgattagatcagttacggcgtaa

SEQ ID NO: 188169 - DNA, 25 bp, E. coli
ggcgattagatctgttacggcgtaa

SEQ ID NO: 188170 - DNA, 25 bp, E. coli
tggaagcaccgatttaccgcgttat

SEQ ID NO: 188171 - DNA, 25 bp, E. coli
gacgccaacgatcaacctgcaaatt

SEQ ID NO: 188172 - DNA, 25 bp, E. coli
gacgccaacgatgaacctgcaaatt

SEQ ID NO: 188173 - DNA, 25 bp, E. coli
cagcttgtgccagtcagtgatgtca

SEQ ID NO: 188174 - DNA, 25 bp, E. coli
cagcttgtgccactcagtgatgtca

SEQ ID NO: 188175 - DNA, 25 bp, E. coli
cagattgtggttgatgagatccgcg

SEQ ID NO: 188176 - DNA, 25 bp, E. coli
cagattgtggttcatgagatccgcg

SEQ ID NO: 188177 - DNA, 25 bp, E. coli
tagttcaggtactggaaacctggcc

SEQ ID NO: 188178 - DNA, 25 bp, E. coli
tagttcaggtacaggaaacctggcc

SEQ ID NO: 188179 - DNA, 25 bp, E. coli
cgagcgcgagcgtcttaaatttcag

SEQ ID NO: 188180 - DNA, 25 bp, E. coli
cgagcgcgagcgacttaaatttcag

SEQ ID NO: 188181 - DNA, 25 bp, E. coli
cattgactgttgtgatgaggccgat

SEQ ID NO: 188182 - DNA, 25 bp, E. coli
cattgactgttgagatgaggccgat

SEQ ID NO: 188183 - DNA, 25 bp, E. coli
ggtggactgcatgacaactgaatga

SEQ ID NO: 188184 - DNA, 25 bp, E. coli
ggatatggatcctcacgctcgtaag

SEQ ID NO: 188185 - DNA, 25 bp, E. coli
ggatatggatccacacgctcgtaag

SEQ ID NO: 188186 - DNA, 25 bp, E. coli
ggtggactgcatcacaactgaatga

SEQ ID NO: 188187 - DNA, 25 bp, E. coli
taaggcatggtaacagtccgagcgc

SEQ ID NO: 188188 - DNA, 25 bp, E. coli
taatcaactggctgccctttcaggt

SEQ ID NO: 188189 - DNA, 25 bp, E. coli
taaggcatggtatcagtccgagcgc

SEQ ID NO: 188190 - DNA, 25 bp, E. coli
taatcaactggcagccctttcaggt

SEQ ID NO: 188191 - DNA, 25 bp, E. coli
gagatccgcgactcactggaaaagg

SEQ ID NO: 188192 - DNA, 25 bp, E. coli
gagatccgcgacacactggaaaagg

SEQ ID NO: 188193 - DNA, 25 bp, E. coli
gatgttcctcttccaccaggcagta

SEQ ID NO: 188194 - DNA, 25 bp, E. coli
gatgttcctcttgcaccaggcagta

SEQ ID NO: 188195 - DNA, 25 bp, E. coli
tactggagggcgataatttaacaat

SEQ ID NO: 188196 - DNA, 25 bp, E. coli
tactggagggcgttaatttaacaat

SEQ ID NO: 188197 - DNA, 25 bp, E. coli
taaacgtcgcagttaataaagctct

SEQ ID NO: 188198 - DNA, 25 bp, E. coli
taaacgtcgcagataataaagctct

SEQ ID NO: 188199 - DNA, 25 bp, E. coli
tactgctactttgatattatttcgc

SEQ ID NO: 188200 - DNA, 25 bp, E. coli
taaaccaggcactatcagaaatcgc

SEQ ID NO: 188201 - DNA, 25 bp, E. coli
taaaccaggcacaatcagaaatcgc

SEQ ID NO: 188202 - DNA, 25 bp, E. coli
tactgctactttcatattatttcgc

SEQ ID NO: 188203 - DNA, 25 bp, E. coli
tatttcgctctcgttaactaaaaag

SEQ ID NO: 188204 - DNA, 25 bp, E. coli
tatttcgctctccttaactaaaaag

SEQ ID NO: 188205 - DNA, 25 bp, E. coli
tcttaaataaaattaaacgtcgcag

SEQ ID NO: 188206 - DNA, 25 bp, E. coli
tcttaaataaaaataaacgtcgcag

SEQ ID NO: 188207 - DNA, 25 bp, E. coli
taaaaagttaagtggagagcgaagt

SEQ ID NO: 188208 - DNA, 25 bp, E. coli
gagcgaagttaatatgttaaaccac

SEQ ID NO: 188209 - DNA, 25 bp, E. coli
gagcgaagttaaaatgttaaaccac

SEQ ID NO: 188210 - DNA, 25 bp, E. coli
taaaaagttaagaggagagcgaagt

SEQ ID NO: 188211 - DNA, 25 bp, E. coli
gaaatcgctcattactaacgtgtga

SEQ ID NO: 188212 - DNA, 25 bp, E. coli
gaaatcgctcataactaacgtgtga

SEQ ID NO: 188213 - DNA, 25 bp, E. coli
taataaagctctgattaaaccaggc

SEQ ID NO: 188214 - DNA, 25 bp, E. coli
taacgtgtgaagtattgtgtactgg

SEQ ID NO: 188215 - DNA, 25 bp, E. coli
taacgtgtgaagaattgtgtactgg

SEQ ID NO: 188216 - DNA, 25 bp, E. coli
taataaagctctcattaaaccaggc

SEQ ID NO: 188217 - DNA, 25 bp, E. coli
cagatcaagcggtgagaaagcgtat

SEQ ID NO: 188218 - DNA, 25 bp, E. coli
cagttaatttgcgtgccgattattg

SEQ ID NO: 188219 - DNA, 25 bp, E. coli
cagatcaagcggagagaaagcgtat

SEQ ID NO: 188220 - DNA, 25 bp, E. coli
cagttaatttgcctgccgattattg

SEQ ID NO: 188221 - DNA, 25 bp, E. coli
agcggtgagaaagcgtatttgcaca

SEQ ID NO: 188222 - DNA, 25 bp, E. coli
agcggtgagaaaccgtatttgcaca

SEQ ID NO: 188223 - DNA, 25 bp, E. coli
actgggtatttaacgcactaccatc

SEQ ID NO: 188224 - DNA, 25 bp, E. coli
actgggtatttatcgcactaccatc

SEQ ID NO: 188225 - DNA, 25 bp, E. coli
tatttatcgcactaccatcagccgc

SEQ ID NO: 188226 - DNA, 25 bp, E. coli
tatttatcgcacaaccatcagccgc

SEQ ID NO: 188227 - DNA, 25 bp, E. coli
ttatcgcactacgatcagccgcttg

SEQ ID NO: 188228 - DNA, 25 bp, E. coli
ttgcacaaatgtccagaaccaggag

SEQ ID NO: 188229 - DNA, 25 bp, E. coli
ttatcgcactaccatcagccgcttg

SEQ ID NO: 188230 - DNA, 25 bp, E. coli
ttgcacaaatgtgcagaaccaggag

SEQ ID NO: 188231 - DNA, 25 bp, E. coli
tcgcggcagttaatttgcgtgccga

SEQ ID NO: 188232 - DNA, 25 bp, E. coli
tcgcggcagttattttgcgtgccga

SEQ ID NO: 188233 - DNA, 25 bp, E. coli
gaaagcgtatttccacaaatgtgca

SEQ ID NO: 188234 - DNA, 25 bp, E. coli
gaaagcgtatttgcacaaatgtgca

SEQ ID NO: 188235 - DNA, 25 bp, E. coli
gggttatatcagatcaagcggtgag

SEQ ID NO: 188236 - DNA, 25 bp, E. coli
gtgccgattattcgcggcccgtccg

SEQ ID NO: 188237 - DNA, 25 bp, E. coli
gtgccgattattggcggcccgtccg

SEQ ID NO: 188238 - DNA, 25 bp, E. coli
gggttatatcagttcaagcggtgag

SEQ ID NO: 188239 - DNA, 25 bp, E. coli
caccactatcgaactgctggttcgc

SEQ ID NO: 188240 - DNA, 25 bp, E. coli
caccactatcgatctgctggttcgc

SEQ ID NO: 188241 - DNA, 25 bp, E. coli
agccgtcaccactatcgatctgctg

SEQ ID NO: 188242 - DNA, 25 bp, E. coli
agccgtcaccacaatcgatctgctg

SEQ ID NO: 188243 - DNA, 25 bp, E. coli
accactatcgatgtgctggttcgcg

SEQ ID NO: 188244 - DNA, 25 bp, E. coli
accactatcgatctgctggttcgcg

SEQ ID NO: 188245 - DNA, 25 bp, E. coli
aagccgtcaccactatcgatctgct

SEQ ID NO: 188246 - DNA, 25 bp, E. coli
aagccgtcaccagtatcgatctgct

SEQ ID NO: 188247 - DNA, 25 bp, E. coli
tgaagccgtcacgactatcgatctg

SEQ ID NO: 188248 - DNA, 25 bp, E. coli
tgaagccgtcaccactatcgatctg

SEQ ID NO: 188249 - DNA, 25 bp, E. coli
tcaccactatcgatctgctggttcg

SEQ ID NO: 188250 - DNA, 25 bp, E. coli
tcaccactatcgttctgctggttcg

SEQ ID NO: 188251 - DNA, 25 bp, E. coli
ccgtcaccactaacgatctgctggt

SEQ ID NO: 188252 - DNA, 25 bp, E. coli
ccgtcaccactatcgatctgctggt

SEQ ID NO: 188253 - DNA, 25 bp, E. coli
gccgtcaccactttcgatctgctgg

SEQ ID NO: 188254 - DNA, 25 bp, E. coli
gccgtcaccactatcgatctgctgg

SEQ ID NO: 188255 - DNA, 25 bp, E. coli
gaagccgtcacctctatcgatctgc

SEQ ID NO: 188256 - DNA, 25 bp, E. coli
gaagccgtcaccactatcgatctgc

SEQ ID NO: 188257 - DNA, 25 bp, E. coli
cgtcaccactatggatctgctggtt

SEQ ID NO: 188258 - DNA, 25 bp, E. coli
cgtcaccactatcgatctgctggtt

SEQ ID NO: 188259 - DNA, 25 bp, E. coli
gtcaccactatcgatctgctggttc

SEQ ID NO: 188260 - DNA, 25 bp, E. coli
gtcaccactatccatctgctggttc

SEQ ID NO: 188261 - DNA, 25 bp, E. coli
taaatatcacaatcacaaaccagat

SEQ ID NO: 188262 - DNA, 25 bp, E. coli
taaatatcacaaacacaaaccagat

SEQ ID NO: 188263 - DNA, 25 bp, E. coli
agcacagtatttcaacatgttgcag

SEQ ID NO: 188264 - DNA, 25 bp, E. coli
agcacagtatttgaacatgttgcag

SEQ ID NO: 188265 - DNA, 25 bp, E. coli
tatcctatgaatatgcaacaaagtt

SEQ ID NO: 188266 - DNA, 25 bp, E. coli
tatcctatgaatttgcaacaaagtt

SEQ ID NO: 188267 - DNA, 25 bp, E. coli
tattcaatttatagcagcgcaacca

SEQ ID NO: 188268 - DNA, 25 bp, E. coli
tattcaatttattgcagcgcaacca

SEQ ID NO: 188269 - DNA, 25 bp, E. coli
tctttcccctaagtccgaatgtgga

SEQ ID NO: 188270 - DNA, 25 bp, E. coli
tctttcccctaactccgaatgtgga

SEQ ID NO: 188271 - DNA, 25 bp, E. coli
gcgcaaccaaacaccaaaaaataat

SEQ ID NO: 188272 - DNA, 25 bp, E. coli
gcgcaaccaaactccaaaaaataat

SEQ ID NO: 188273 - DNA, 25 bp, E. coli
gctgcgttacagtcgaatggttcaa

SEQ ID NO: 188274 - DNA, 25 bp, E. coli
gcatcaaattcaaaaaagcacagta

SEQ ID NO: 188275 - DNA, 25 bp, E. coli
gctgcgttacagacgaatggttcaa

SEQ ID NO: 188276 - DNA, 25 bp, E. coli
gcatcaaattcataaaagcacagta

SEQ ID NO: 188277 - DNA, 25 bp, E. coli
gaagcatacgcataataaatatcac

SEQ ID NO: 188278 - DNA, 25 bp, E. coli
gaagcatacgcaaaataaatatcac

SEQ ID NO: 188279 - DNA, 25 bp, E. coli
taatttatggagtaaaacacgcatc

SEQ ID NO: 188280 - DNA, 25 bp, E. coli
taattttgtttttgaagcatacgca

SEQ ID NO: 188281 - DNA, 25 bp, E. coli
taatttatggagaaaaacacgcatc

SEQ ID NO: 188282 - DNA, 25 bp, E. coli
taattttgttttagaagcatacgca

SEQ ID NO: 188283 - DNA, 25 bp, E. coli
catcacgtttttgccgcatctcgaa

SEQ ID NO: 188284 - DNA, 25 bp, E. coli
catcacgtttttcccgcatctcgaa

SEQ ID NO: 188285 - DNA, 25 bp, E. coli
aactggcacgatattttcatatatg

SEQ ID NO: 188286 - DNA, 25 bp, E. coli
aactggcacgattttttcatatatg

SEQ ID NO: 188287 - DNA, 25 bp, E. coli
tatgtgaatgtctcgcaggggatcg

SEQ ID NO: 188288 - DNA, 25 bp, E. coli
tatgtgaatgtcacgcaggggatcg

SEQ ID NO: 188289 - DNA, 25 bp, E. coli
tttttgccgcatgtcgaaaaatcaa

SEQ ID NO: 188290 - DNA, 25 bp, E. coli
tttttgccgcatctcgaaaaatcaa

SEQ ID NO: 188291 - DNA, 25 bp, E. coli
tgcatcacgtttatgccgcatctcg

SEQ ID NO: 188292 - DNA, 25 bp, E. coli
tgcatcacgtttttgccgcatctcg

SEQ ID NO: 188293 - DNA, 25 bp, E. coli
tcatatatgtgattgtcacgcaggg

SEQ ID NO: 188294 - DNA, 25 bp, E. coli
tcatatatgtgaatgtcacgcaggg

SEQ ID NO: 188295 - DNA, 25 bp, E. coli
gcaaaactggcaggattttttcata

SEQ ID NO: 188296 - DNA, 25 bp, E. coli
gcaaaactggcacgattttttcata

SEQ ID NO: 188297 - DNA, 25 bp, E. coli
ccgtggatagaataaaggaaatgct

SEQ ID NO: 188298 - DNA, 25 bp, E. coli
ccgtggatagaaaaaaggaaatgct

SEQ ID NO: 188299 - DNA, 25 bp, E. coli
ggatcgtcccgtggatagaaaaaag

SEQ ID NO: 188300 - DNA, 25 bp, E. coli
ggatcgtcccgtcgatagaaaaaag

SEQ ID NO: 188301 - DNA, 25 bp, E. coli
gatcgtcccgtggatagaaaaaagg

SEQ ID NO: 188302 - DNA, 25 bp, E. coli
gagttgcaaaacaggcacgattttt

SEQ ID NO: 188303 - DNA, 25 bp, E. coli
gatcgtcccgtgcatagaaaaaagg

SEQ ID NO: 188304 - DNA, 25 bp, E. coli
gagttgcaaaactggcacgattttt

SEQ ID NO: 188305 - DNA, 25 bp, E. coli
aatacctggttctatgtcttccgcc

SEQ ID NO: 188306 - DNA, 25 bp, E. coli
aatacctggttcaatgtcttccgcc

SEQ ID NO: 188307 - DNA, 25 bp, E. coli
caaacctgcgctgagtggtaactaa

SEQ ID NO: 188308 - DNA, 25 bp, E. coli
caaacctgcgctcagtggtaactaa

SEQ ID NO: 188309 - DNA, 25 bp, E. coli
tacctggttctaagtcttccgccag

SEQ ID NO: 188310 - DNA, 25 bp, E. coli
tacctggttctatgtcttccgccag

SEQ ID NO: 188311 - DNA, 25 bp, E. coli
attgataacaaagctgcgctgagtg

SEQ ID NO: 188312 - DNA, 25 bp, E. coli
attgataacaaacctgcgctgagtg

SEQ ID NO: 188313 - DNA, 25 bp, E. coli
aacaaacctgcgctgagtggtaact

SEQ ID NO: 188314 - DNA, 25 bp, E. coli
aacaaacctgcggtgagtggtaact

SEQ ID NO: 188315 - DNA, 25 bp, E. coli
ttaacagtagcggtgtgttgaccaa

SEQ ID NO: 188316 - DNA, 25 bp, E. coli
ttaacagtagcgctgtgttgaccaa

SEQ ID NO: 188317 - DNA, 25 bp, E. coli
tggttctatgtcatccgccagcaac

SEQ ID NO: 188318 - DNA, 25 bp, E. coli
tgataacaaacctgcgctgagtggt

SEQ ID NO: 188319 - DNA, 25 bp, E. coli
tgataacaaaccagcgctgagtggt

SEQ ID NO: 188320 - DNA, 25 bp, E. coli
cctttaacagtagcggtgtgttgac

SEQ ID NO: 188321 - DNA, 25 bp, E. coli
cctttaacagtaccggtgtgttgac

SEQ ID NO: 188322 - DNA, 25 bp, E. coli
gataacaaacctccgctgagtggta

SEQ ID NO: 188323 - DNA, 25 bp, E. coli
gataacaaacctgcgctgagtggta

SEQ ID NO: 188324 - DNA, 25 bp, E. coli
ggttctatgtcttccgccagcaacc

SEQ ID NO: 188325 - DNA, 25 bp, E. coli
ggttctatgtctaccgccagcaacc

SEQ ID NO: 188326 - DNA, 25 bp, E. coli
tggttctatgtcttccgccagcaac

SEQ ID NO: 188327 - DNA, 25 bp, E. coli
aatcagtggatgctttaggtgccgc

SEQ ID NO: 188328 - DNA, 25 bp, E. coli
aatcagtggatggtttaggtgccgc

SEQ ID NO: 188329 - DNA, 25 bp, E. coli
caggctggctgaaatgcaatggtgc

SEQ ID NO: 188330 - DNA, 25 bp, E. coli
caggctggctgatatgcaatggtgc

SEQ ID NO: 188331 - DNA, 25 bp, E. coli
tacctgttggtgacccggttccgtg

SEQ ID NO: 188332 - DNA, 25 bp, E. coli
tacctgttggtgtcccggttccgtg

SEQ ID NO: 188333 - DNA, 25 bp, E. coli
tccacgattgtgactgatgcaacga

SEQ ID NO: 188334 - DNA, 25 bp, E. coli
tccacgattgtgtctgatgcaacga

SEQ ID NO: 188335 - DNA, 25 bp, E. coli
tctgctgaagaatacccggaactgg

SEQ ID NO: 188336 - DNA, 25 bp, E. coli
tctgctgaagaaaacccggaactgg

SEQ ID NO: 188337 - DNA, 25 bp, E. coli
tatgcaacggaggatcatgctcatg

SEQ ID NO: 188338 - DNA, 25 bp, E. coli
tatgcaacggagcatcatgctcatg

SEQ ID NO: 188339 - DNA, 25 bp, E. coli
ggattaccgtcatgatccacgattg

SEQ ID NO: 188340 - DNA, 25 bp, E. coli
ggattaccgtcaagatccacgattg

SEQ ID NO: 188341 - DNA, 25 bp, E. coli
ggaactggcaaacgcttatccgaca

SEQ ID NO: 188342 - DNA, 25 bp, E. coli
ggaactggcaaaggcttatccgaca

SEQ ID NO: 188343 - DNA, 25 bp, E. coli
taactatatcgtgagggcagcctga

SEQ ID NO: 188344 - DNA, 25 bp, E. coli
taactatatcgtcagggcagcctga

SEQ ID NO: 188345 - DNA, 25 bp, E. coli
gatgccggattagcagccccggatt

SEQ ID NO: 188346 - DNA, 25 bp, E. coli
gagaaggctctggattacctgttgg

SEQ ID NO: 188347 - DNA, 25 bp, E. coli
gatgccggattaccagccccggatt

SEQ ID NO: 188348 - DNA, 25 bp, E. coli
gagaaggctctgcattacctgttgg

SEQ ID NO: 188349 - DNA, 25 bp, E. coli
cactcgtcatatgggtggtggccac

SEQ ID NO: 188350 - DNA, 25 bp, E. coli
cactcgtcatatcggtggtggccac

SEQ ID NO: 188351 - DNA, 25 bp, E. coli
catatgctgcgcgttctgggtaaag

SEQ ID NO: 188352 - DNA, 25 bp, E. coli
cagactgccgtgcaactctgggcga

SEQ ID NO: 188353 - DNA, 25 bp, E. coli
catatgctgcgccttctgggtaaag

SEQ ID NO: 188354 - DNA, 25 bp, E. coli
cagactgccgtggaactctgggcga

SEQ ID NO: 188355 - DNA, 25 bp, E. coli
taaaggcctgaatgctggcgaccag

SEQ ID NO: 188356 - DNA, 25 bp, E. coli
taaagtggttaaccctgagctgcac

SEQ ID NO: 188357 - DNA, 25 bp, E. coli
taaagtggttaagcctgagctgcac

SEQ ID NO: 188358 - DNA, 25 bp, E. coli
taaaggcctgaaagctggcgaccag

SEQ ID NO: 188359 - DNA, 25 bp, E. coli
ttctgtacaaagacggtgaacgccg

SEQ ID NO: 188360 - DNA, 25 bp, E. coli
ttctgtacaaagtcggtgaacgccg

SEQ ID NO: 188361 - DNA, 25 bp, E. coli
tgacttcaaacgcaacaaagacggt

SEQ ID NO: 188362 - DNA, 25 bp, E. coli
tgacttcaaacggaacaaagacggt

SEQ ID NO: 188363 - DNA, 25 bp, E. coli
tccggtggtcgtaacaacaatggcc

SEQ ID NO: 188364 - DNA, 25 bp, E. coli
tccggtggtcgttacaacaatggcc

SEQ ID NO: 188365 - DNA, 25 bp, E. coli
gaaaccaggtaaaggcggtcagctg

SEQ ID NO: 188366 - DNA, 25 bp, E. coli
gaaaccaggtaatggcggtcagctg

SEQ ID NO: 188367 - DNA, 25 bp, E. coli
gataaattcatcctacgtcgccgta

SEQ ID NO: 188368 - DNA, 25 bp, E. coli
gataaattcatcgtacgtcgccgta

SEQ ID NO: 188369 - DNA, 25 bp, E. coli
taagaagacccgcagcaacaagcgt

SEQ ID NO: 188370 - DNA, 25 bp, E. coli
taagaagacccggagcaacaagcgt

SEQ ID NO: 188371 - DNA, 25 bp, E. coli
caatgaactcctagccgctgacaac

SEQ ID NO: 188372 - DNA, 25 bp, E. coli
caatgaactccttgccgctgacaac

SEQ ID NO: 188373 - DNA, 25 bp, E. coli
tacggtgaaccgggtatgcaacttt

SEQ ID NO: 188374 - DNA, 25 bp, E. coli
tactgaatctcgcttcggtttatcc

SEQ ID NO: 188375 - DNA, 25 bp, E. coli
tactgaatctcggttcggtttatcc

SEQ ID NO: 188376 - DNA, 25 bp, E. coli
tacggtgaaccgcgtatgcaacttt

SEQ ID NO: 188377 - DNA, 25 bp, E. coli
tattgagccaataactgaatctcgg

SEQ ID NO: 188378 - DNA, 25 bp, E. coli
tattgagccaattactgaatctcgg

SEQ ID NO: 188379 - DNA, 25 bp, E. coli
gcaactttttgtctacgggcgagaa

SEQ ID NO: 188380 - DNA, 25 bp, E. coli
gcaactttttgtgtacgggcgagaa

SEQ ID NO: 188381 - DNA, 25 bp, E. coli
cgatctggccgacccgcaattgctg

SEQ ID NO: 188382 - DNA, 25 bp, E. coli
cgatctggccgagccgcaattgctg

SEQ ID NO: 188383 - DNA, 25 bp, E. coli
cgggaagcactggatgtattgagcc

SEQ ID NO: 188384 - DNA, 25 bp, E. coli
cgggaagcactgcatgtattgagcc

SEQ ID NO: 188385 - DNA, 25 bp, E. coli
ggttatctcaatgaactccttgccg

SEQ ID NO: 188386 - DNA, 25 bp, E. coli
ggttatctcaatcaactccttgccg

SEQ ID NO: 188387 - DNA, 25 bp, E. coli
ggccgacccgcaattgctgcgcgaa

SEQ ID NO: 188388 - DNA, 25 bp, E. coli
ggcaaaccacaatcgtctcggcggt

SEQ ID NO: 188389 - DNA, 25 bp, E. coli
ggcaatgatacccggccttcccgtt

SEQ ID NO: 188390 - DNA, 25 bp, E. coli
ggccgacccgcatttgctgcgcgaa

SEQ ID NO: 188391 - DNA, 25 bp, E. coli
ggcaatgataccgggccttcccgtt

SEQ ID NO: 188392 - DNA, 25 bp, E. coli
ggcaaaccacaaacgtctcggcggt

SEQ ID NO: 188393 - DNA, 25 bp, E. coli
tagatgccaaagtgccggagatgct

SEQ ID NO: 188394 - DNA, 25 bp, E. coli
tagatgccaaagagccggagatgct

SEQ ID NO: 188395 - DNA, 25 bp, E. coli
tgattattattcgtggctggcgcgg

SEQ ID NO: 188396 - DNA, 25 bp, E. coli
tgattattattcctggctggcgcgg

SEQ ID NO: 188397 - DNA, 25 bp, E. coli
tgaaggacaagtcatgacctccgcc

SEQ ID NO: 188398 - DNA, 25 bp, E. coli
tgaaggacaagtgatgacctccgcc

SEQ ID NO: 188399 - DNA, 25 bp, E. coli
tcgccgaacgggtaaatatgagtcc

SEQ ID NO: 188400 - DNA, 25 bp, E. coli
tgcgggccttctacatcagcgaaaa

SEQ ID NO: 188401 - DNA, 25 bp, E. coli
tcgccgaacgggaaaatatgagtcc

SEQ ID NO: 188402 - DNA, 25 bp, E. coli
tcgcaatatcgctaaaacagccgtt

SEQ ID NO: 188403 - DNA, 25 bp, E. coli
tgcgggccttcttcatcagcgaaaa

SEQ ID NO: 188404 - DNA, 25 bp, E. coli
tcgcaatatcgcaaaaacagccgtt

SEQ ID NO: 188405 - DNA, 25 bp, E. coli
gactggagttattgcccaacgccga

SEQ ID NO: 188406 - DNA, 25 bp, E. coli
gactggagttatagcccaacgccga

SEQ ID NO: 188407 - DNA, 25 bp, E. coli
cattgcactggcatatgacgggcta

SEQ ID NO: 188408 - DNA, 25 bp, E. coli
cgtgaaagccagtcgttaggtgcct

SEQ ID NO: 188409 - DNA, 25 bp, E. coli
cgtgaaagccagacgttaggtgcct

SEQ ID NO: 188410 - DNA, 25 bp, E. coli
cattgcactggcttatgacgggcta

SEQ ID NO: 188411 - DNA, 25 bp, E. coli
gattgctaataatgtcgcccggcga

SEQ ID NO: 188412 - DNA, 25 bp, E. coli
gattgctaataaagtcgcccggcga

SEQ ID NO: 188413 - DNA, 25 bp, E. coli
gatgctatgccactcattgcgcgag

SEQ ID NO: 188414 - DNA, 25 bp, E. coli
gatgctatgccagtcattgcgcgag

SEQ ID NO: 188415 - DNA, 25 bp, E. coli
aatttcgtgaataaaaaggctggca

SEQ ID NO: 188416 - DNA, 25 bp, E. coli
aatttcgtgaattaaaaggctggca

SEQ ID NO: 188417 - DNA, 25 bp, E. coli
aataaaaaggctggcaacatcaacg

SEQ ID NO: 188418 - DNA, 25 bp, E. coli
aataaaaaggctcgcaacatcaacg

SEQ ID NO: 188419 - DNA, 25 bp, E. coli
catagtctggaaatattcaatgaac

SEQ ID NO: 188420 - DNA, 25 bp, E. coli
cttggtctcaaaacaatgaaaggtc

SEQ ID NO: 188421 - DNA, 25 bp, E. coli
catagtctggaattattcaatgaac

SEQ ID NO: 188422 - DNA, 25 bp, E. coli
cttggtctcaaatcaatgaaaggtc

SEQ ID NO: 188423 - DNA, 25 bp, E. coli
tttacttggaacgtgggtggaatgc

SEQ ID NO: 188424 - DNA, 25 bp, E. coli
caatgaaaggtctcaataaagtcct

SEQ ID NO: 188425 - DNA, 25 bp, E. coli
caatgaaaggtcacaataaagtcct

SEQ ID NO: 188426 - DNA, 25 bp, E. coli
aagaaaagtttatccatagtctgga

SEQ ID NO: 188427 - DNA, 25 bp, E. coli
aagaaaagtttaaccatagtctgga

SEQ ID NO: 188428 - DNA, 25 bp, E. coli
tgctacccacctttatgatgaggta

SEQ ID NO: 188429 - DNA, 25 bp, E. coli
tgctaccgtggagggtgctacccac

SEQ ID NO: 188430 - DNA, 25 bp, E. coli
tgctaccgtggacggtgctacccac

SEQ ID NO: 188431 - DNA, 25 bp, E. coli
tgctacccacctatatgatgaggta

SEQ ID NO: 188432 - DNA, 25 bp, E. coli
gaaaataaggagttatgtactcaga

SEQ ID NO: 188433 - DNA, 25 bp, E. coli
gaaaataaggagatatgtactcaga

SEQ ID NO: 188434 - DNA, 25 bp, E. coli
tttacttggaacctgggtggaatgc

SEQ ID NO: 188435 - DNA, 25 bp, E. coli
gagctgggtcgcacagaccttcggt

SEQ ID NO: 188436 - DNA, 25 bp, E. coli
gagctgggtcgctcagaccttcggt

SEQ ID NO: 188437 - DNA, 25 bp, E. coli
catcggctggcgcaagatatcctgc

SEQ ID NO: 188438 - DNA, 25 bp, E. coli
catcggctggcggaagatatcctgc

SEQ ID NO: 188439 - DNA, 25 bp, E. coli
taaaaacaaccggtatccgggctgt

SEQ ID NO: 188440 - DNA, 25 bp, E. coli
attatccactggacgagctacgccg

SEQ ID NO: 188441 - DNA, 25 bp, E. coli
attatccactggtcgagctacgccg

SEQ ID NO: 188442 - DNA, 25 bp, E. coli
tgaagatgtactgggagaagccctg

SEQ ID NO: 188443 - DNA, 25 bp, E. coli
tgatgctggacgtaacgcaaaccgc

SEQ ID NO: 188444 - DNA, 25 bp, E. coli
tgaagatgtactcggagaagccctg

SEQ ID NO: 188445 - DNA, 25 bp, E. coli
tgatgctggacgaaacgcaaaccgc

SEQ ID NO: 188446 - DNA, 25 bp, E. coli
tctggccagacaaagaggcaatcct

SEQ ID NO: 188447 - DNA, 25 bp, E. coli
tctggccagacatagaggcaatcct

SEQ ID NO: 188448 - DNA, 25 bp, E. coli
gccgaatgctggagaatcgtagcca

SEQ ID NO: 188449 - DNA, 25 bp, E. coli
gccgaatgctggtgaatcgtagcca

SEQ ID NO: 188450 - DNA, 25 bp, E. coli
gattgccaacacgacgctggagatg

SEQ ID NO: 188451 - DNA, 25 bp, E. coli
gattgccaacaccacgctggagatg

SEQ ID NO: 188452 - DNA, 25 bp, E. coli
ggcaatcctctaggatgcgctgcgt

SEQ ID NO: 188453 - DNA, 25 bp, E. coli
ggcaatcctctacgatgcgctgcgt

SEQ ID NO: 188454 - DNA, 25 bp, E. coli
taaaaacaaccgctatccgggctgt

SEQ ID NO: 188455 - DNA, 25 bp, E. coli
tcaactggccgatcagcaaaaaagc

SEQ ID NO: 188456 - DNA, 25 bp, E. coli
tcaactggccgaacagcaaaaaagc

SEQ ID NO: 188457 - DNA, 25 bp, E. coli
gatccggcgatgctagcaaagcaga

SEQ ID NO: 188458 - DNA, 25 bp, E. coli
gatccggcgatggtagcaaagcaga

SEQ ID NO: 188459 - DNA, 25 bp, E. coli
tacttttgtaaagaaaaacacagca

SEQ ID NO: 188460 - DNA, 25 bp, E. coli
tacttttgtaaacaaaaacacagca

SEQ ID NO: 188461 - DNA, 25 bp, E. coli
agatttcaggaattttggctcatgg

SEQ ID NO: 188462 - DNA, 25 bp, E. coli
agatttcaggaaatttggctcatgg

SEQ ID NO: 188463 - DNA, 25 bp, E. coli
aaaacgtgtcattctgattaagacc

SEQ ID NO: 188464 - DNA, 25 bp, E. coli
aaaacgtgtcatactgattaagacc

SEQ ID NO: 188465 - DNA, 25 bp, E. coli
tatcttacccttaagatttcaggaa

SEQ ID NO: 188466 - DNA, 25 bp, E. coli
tatcttaccctttagatttcaggaa

SEQ ID NO: 188467 - DNA, 25 bp, E. coli
tatttaaatttttcattccgcgatg

SEQ ID NO: 188468 - DNA, 25 bp, E. coli
tttgaagaaatttgcccttgggcag

SEQ ID NO: 188469 - DNA, 25 bp, E. coli
tatttaaattttacattccgcgatg

SEQ ID NO: 188470 - DNA, 25 bp, E. coli
tttgaagaaattagcccttgggcag

SEQ ID NO: 188471 - DNA, 25 bp, E. coli
tgattaaccacccatagcaaggatt

SEQ ID NO: 188472 - DNA, 25 bp, E. coli
taccttttgaagtaattagcccttg

SEQ ID NO: 188473 - DNA, 25 bp, E. coli
tgattaaccaccgatagcaaggatt

SEQ ID NO: 188474 - DNA, 25 bp, E. coli
taccttttgaagaaattagcccttg

SEQ ID NO: 188475 - DNA, 25 bp, E. coli
cccatagcaaggattacttttgtaa

SEQ ID NO: 188476 - DNA, 25 bp, E. coli
cccatagcaaggtttacttttgtaa

SEQ ID NO: 188477 - DNA, 25 bp, E. coli
cattccgcgatgaaaatgttccgat

SEQ ID NO: 188478 - DNA, 25 bp, E. coli
cattccgcgatgtaaatgttccgat

SEQ ID NO: 188479 - DNA, 25 bp, E. coli
ggctcatggaagtgtcctttttatt

SEQ ID NO: 188480 - DNA, 25 bp, E. coli
ggctcatggaagagtcctttttatt

SEQ ID NO: 188481 - DNA, 25 bp, E. coli
cacgccaccattgatcatctgattt

SEQ ID NO: 188482 - DNA, 25 bp, E. coli
caccattcatcatctgatttatctt

SEQ ID NO: 188483 - DNA, 25 bp, E. coli
caccattcatcaactgatttatctt

SEQ ID NO: 188484 - DNA, 25 bp, E. coli
cacgccaccattcatcatctgattt

SEQ ID NO: 188485 - DNA, 25 bp, E. coli
catcatctgattaatcttttatcgt

SEQ ID NO: 188486 - DNA, 25 bp, E. coli
cattcatcatctgatttatctttta

SEQ ID NO: 188487 - DNA, 25 bp, E. coli
cattcatcatctcatttatctttta

SEQ ID NO: 188488 - DNA, 25 bp, E. coli
catcatctgatttatcttttatcgt

SEQ ID NO: 188489 - DNA, 25 bp, E. coli
acgccaccattcttcatctgattta

SEQ ID NO: 188490 - DNA, 25 bp, E. coli
acgccaccattcatcatctgattta

SEQ ID NO: 188491 - DNA, 25 bp, E. coli
tgcacgccaccaatcatcatctgat

SEQ ID NO: 188492 - DNA, 25 bp, E. coli
tgcacgccaccattcatcatctgat

SEQ ID NO: 188493 - DNA, 25 bp, E. coli
tcatcatctgatttatcttttatcg

SEQ ID NO: 188494 - DNA, 25 bp, E. coli
tcatcatctgatatatcttttatcg

SEQ ID NO: 188495 - DNA, 25 bp, E. coli
gccaccattcatgatctgatttatc

SEQ ID NO: 188496 - DNA, 25 bp, E. coli
ccaccattcatcttctgatttatct

SEQ ID NO: 188497 - DNA, 25 bp, E. coli
ccaccattcatcatctgatttatct

SEQ ID NO: 188498 - DNA, 25 bp, E. coli
gccaccattcatcatctgatttatc

SEQ ID NO: 188499 - DNA, 25 bp, E. coli
gcacgccaccatacatcatctgatt

SEQ ID NO: 188500 - DNA, 25 bp, E. coli
gcacgccaccattcatcatctgatt

SEQ ID NO: 188501 - DNA, 25 bp, E. coli
cgccaccattcatcatctgatttat

SEQ ID NO: 188502 - DNA, 25 bp, E. coli
cgccaccattcaacatctgatttat

SEQ ID NO: 188503 - DNA, 25 bp, E. coli
caaaccacgtgcacgcaaagttgcg

SEQ ID NO: 188504 - DNA, 25 bp, E. coli
caaaccacgtgctcgcaaagttgcg

SEQ ID NO: 188505 - DNA, 25 bp, E. coli
tgaaggtcacaacctgcaggagcac

SEQ ID NO: 188506 - DNA, 25 bp, E. coli
tgaaggtcacaagctgcaggagcac

SEQ ID NO: 188507 - DNA, 25 bp, E. coli
tccgcgctgcgttaagtatgccgtg

SEQ ID NO: 188508 - DNA, 25 bp, E. coli
tgcgaaaagcaaggtgcctgcgctg

SEQ ID NO: 188509 - DNA, 25 bp, E. coli
tccgcgctgcgtaaagtatgccgtg

SEQ ID NO: 188510 - DNA, 25 bp, E. coli
tgcgaaaagcaacgtgcctgcgctg

SEQ ID NO: 188511 - DNA, 25 bp, E. coli
ccaagtatggcgtgaagcgtcctaa

SEQ ID NO: 188512 - DNA, 25 bp, E. coli
ccaagtatggcgagaagcgtcctaa

SEQ ID NO: 188513 - DNA, 25 bp, E. coli
gaagtgacttcctacatcggtggtg

SEQ ID NO: 188514 - DNA, 25 bp, E. coli
gaagtgacttccaacatcggtggtg

SEQ ID NO: 188515 - DNA, 25 bp, E. coli
gaagcatgcccgcaaaaacgtggcg

SEQ ID NO: 188516 - DNA, 25 bp, E. coli
gaagcatgcccggaaaaacgtggcg

SEQ ID NO: 188517 - DNA, 25 bp, E. coli
gactgctccggcgttaaagaccgta

SEQ ID NO: 188518 - DNA, 25 bp, E. coli
gactgctccggccttaaagaccgta

SEQ ID NO: 188519 - DNA, 25 bp, E. coli
ggagcactccgtcatcctgatccgt

SEQ ID NO: 188520 - DNA, 25 bp, E. coli
ggagcactccgtgatcctgatccgt

SEQ ID NO: 188521 - DNA, 25 bp, E. coli
tggcaacagttatccagctggtacg

SEQ ID NO: 188522 - DNA, 25 bp, E. coli
tggcaacagttaaccagctggtacg

SEQ ID NO: 188523 - DNA, 25 bp, E. coli
taagcaggctcgatccaagtatggc

SEQ ID NO: 188524 - DNA, 25 bp, E. coli
taagcaggctcgttccaagtatggc

SEQ ID NO: 188525 - DNA, 25 bp, E. coli
atgtttgctgtctcctccagacgcg

SEQ ID NO: 188526 - DNA, 25 bp, E. coli
atgtttgctgtcacctccagacgcg

SEQ ID NO: 188527 - DNA, 25 bp, E. coli
aaatatcgcgtggaagacggaagtg

SEQ ID NO: 188528 - DNA, 25 bp, E. coli
aaatatcgcgtgcaagacggaagtg

SEQ ID NO: 188529 - DNA, 25 bp, E. coli
tatcgccggaaatatcgcgtggaag

SEQ ID NO: 188530 - DNA, 25 bp, E. coli
tttgctgtctcctccagacgcgtgc

SEQ ID NO: 188531 - DNA, 25 bp, E. coli
tatcgccggaaaaatcgcgtggaag

SEQ ID NO: 188532 - DNA, 25 bp, E. coli
tttgctgtctccaccagacgcgtgc

SEQ ID NO: 188533 - DNA, 25 bp, E. coli
tgtctcctccagtcgcgtgctgccg

SEQ ID NO: 188534 - DNA, 25 bp, E. coli
tgtctcctccagacgcgtgctgccg

SEQ ID NO: 188535 - DNA, 25 bp, E. coli
tgctgtctcctcgagacgcgtgctg

SEQ ID NO: 188536 - DNA, 25 bp, E. coli
tgctgtctcctccagacgcgtgctg

SEQ ID NO: 188537 - DNA, 25 bp, E. coli
tcgccggaaatatcgcgtggaagac

SEQ ID NO: 188538 - DNA, 25 bp, E. coli
tcgccggaaataacgcgtggaagac

SEQ ID NO: 188539 - DNA, 25 bp, E. coli
gctatcgcttccgaggccgcacgct

SEQ ID NO: 188540 - DNA, 25 bp, E. coli
gctatcgcttcccaggccgcacgct

SEQ ID NO: 188541 - DNA, 25 bp, E. coli
gaaatatcgcgtcgaagacggaagt

SEQ ID NO: 188542 - DNA, 25 bp, E. coli
gaaatatcgcgtggaagacggaagt

SEQ ID NO: 188543 - DNA, 25 bp, E. coli
cggaaatatcgcctggaagacggaa

SEQ ID NO: 188544 - DNA, 25 bp, E. coli
cggaaatatcgcgtggaagacggaa

SEQ ID NO: 188545 - DNA, 25 bp, E. coli
gtttgctgtctcctccagacgcgtg

SEQ ID NO: 188546 - DNA, 25 bp, E. coli
gtttgctgtctcgtccagacgcgtg

SEQ ID NO: 188547 - DNA, 25 bp, E. coli
caatagtctctaatcccgggcaaac

SEQ ID NO: 188548 - DNA, 25 bp, E. coli
caatagtctctattcccgggcaaac

SEQ ID NO: 188549 - DNA, 25 bp, E. coli
cagcagagatgtataaggccggcac

SEQ ID NO: 188550 - DNA, 25 bp, E. coli
cagcagagatgtttaaggccggcac

SEQ ID NO: 188551 - DNA, 25 bp, E. coli
taaaaactggaccatgcacgggcag

SEQ ID NO: 188552 - DNA, 25 bp, E. coli
taaaaactggacgatgcacgggcag

SEQ ID NO: 188553 - DNA, 25 bp, E. coli
tatgcccctgctgtatatctgacgg

SEQ ID NO: 188554 - DNA, 25 bp, E. coli
tatgcccctgctctatatctgacgg

SEQ ID NO: 188555 - DNA, 25 bp, E. coli
taccctgagtgacgacagtggcacc

SEQ ID NO: 188556 - DNA, 25 bp, E. coli
taccctgagtgaggacagtggcacc

SEQ ID NO: 188557 - DNA, 25 bp, E. coli
tattaccctcagatatcccaggcgg

SEQ ID NO: 188558 - DNA, 25 bp, E. coli
tattaccctcagttatcccaggcgg

SEQ ID NO: 188559 - DNA, 25 bp, E. coli
tctgacggacggttatgacctgacc

SEQ ID NO: 188560 - DNA, 25 bp, E. coli
tctgacggacggatatgacctgacc

SEQ ID NO: 188561 - DNA, 25 bp, E. coli
ccggcagtcttcttgagggctataa

SEQ ID NO: 188562 - DNA, 25 bp, E. coli
ccggcagtcttcatgagggctataa

SEQ ID NO: 188563 - DNA, 25 bp, E. coli
gaatattcctctcgtcacggcaccg

SEQ ID NO: 188564 - DNA, 25 bp, E. coli
gaatattcctctggtcacggcaccg

SEQ ID NO: 188565 - DNA, 25 bp, E. coli
gacaccgtgaatcacaggagccagt

SEQ ID NO: 188566 - DNA, 25 bp, E. coli
gaaacgttcattcagccgcaggctg

SEQ ID NO: 188567 - DNA, 25 bp, E. coli
gacaccgtgaatgacaggagccagt

SEQ ID NO: 188568 - DNA, 25 bp, E. coli
gaaacgttcattgagccgcaggctg

SEQ ID NO: 188569 - DNA, 25 bp, E. coli
caagcgcccaatgtggttccagctt

SEQ ID NO: 188570 - DNA, 25 bp, E. coli
aagaagtcgcgcgagccatcaagcg

SEQ ID NO: 188571 - DNA, 25 bp, E. coli
aagaagtcgcgccagccatcaagcg

SEQ ID NO: 188572 - DNA, 25 bp, E. coli
caagcgcccaatctggttccagctt

SEQ ID NO: 188573 - DNA, 25 bp, E. coli
agctggacggtgaactctcttccgc

SEQ ID NO: 188574 - DNA, 25 bp, E. coli
agctggacggtgtactctcttccgc

SEQ ID NO: 188575 - DNA, 25 bp, E. coli
ccatcaagcgcccaatgtggttcca

SEQ ID NO: 188576 - DNA, 25 bp, E. coli
gccagctggacgctgtactctcttc

SEQ ID NO: 188577 - DNA, 25 bp, E. coli
gccagctggacggtgtactctcttc

SEQ ID NO: 188578 - DNA, 25 bp, E. coli
ccatcaagcgccgaatgtggttcca

SEQ ID NO: 188579 - DNA, 25 bp, E. coli
ccgccagctggagggtgtactctct

SEQ ID NO: 188580 - DNA, 25 bp, E. coli
cgattgaagaagacgcgccagccat

SEQ ID NO: 188581 - DNA, 25 bp, E. coli
ccgccagctggacggtgtactctct

SEQ ID NO: 188582 - DNA, 25 bp, E. coli
cgattgaagaagtcgcgccagccat

SEQ ID NO: 188583 - DNA, 25 bp, E. coli
cgtcgtggcgaagttcaggcagcca

SEQ ID NO: 188584 - DNA, 25 bp, E. coli
cgtcgtggcgaacttcaggcagcca

SEQ ID NO: 188585 - DNA, 25 bp, E. coli
gtcgtggcgaagttcaggcagccaa

SEQ ID NO: 188586 - DNA, 25 bp, E. coli
gtcgtggcgaagatcaggcagccaa

SEQ ID NO: 188587 - DNA, 25 bp, E. coli
tggccgccagctcgacggtgtactc

SEQ ID NO: 188588 - DNA, 25 bp, E. coli
tggccgccagctggacggtgtactc

SEQ ID NO: 188589 - DNA, 25 bp, E. coli
tcaagcgcccaaagtggttccagct

SEQ ID NO: 188590 - DNA, 25 bp, E. coli
tcaagcgcccaatgtggttccagct

SEQ ID NO: 188591 - DNA, 25 bp, E. coli
aacgcgatttttagcggcggcacca

SEQ ID NO: 188592 - DNA, 25 bp, E. coli
aatatcccggcgttaaaagtgcagg

SEQ ID NO: 188593 - DNA, 25 bp, E. coli
aatatcccggcgataaaagtgcagg

SEQ ID NO: 188594 - DNA, 25 bp, E. coli
caaacctgcgtgcatgaagtggctg

SEQ ID NO: 188595 - DNA, 25 bp, E. coli
caaacctgcgtggatgaagtggctg

SEQ ID NO: 188596 - DNA, 25 bp, E. coli
aacgcgattttttgcggcggcacca

SEQ ID NO: 188597 - DNA, 25 bp, E. coli
tataaagtagcattctccccggctg

SEQ ID NO: 188598 - DNA, 25 bp, E. coli
tataaagtagcaatctccccggctg

SEQ ID NO: 188599 - DNA, 25 bp, E. coli
tgatgttggtgaaagccgctacgcg

SEQ ID NO: 188600 - DNA, 25 bp, E. coli
tgatgttggtgatagccgctacgcg

SEQ ID NO: 188601 - DNA, 25 bp, E. coli
tccatgccggtgatattgaagggtc

SEQ ID NO: 188602 - DNA, 25 bp, E. coli
tccatgccggtgttattgaagggtc

SEQ ID NO: 188603 - DNA, 25 bp, E. coli
tcattgggattaaagacagcgccgg

SEQ ID NO: 188604 - DNA, 25 bp, E. coli
tcattgggattatagacagcgccgg

SEQ ID NO: 188605 - DNA, 25 bp, E. coli
gctttaatgtgctcaacggcccgga

SEQ ID NO: 188606 - DNA, 25 bp, E. coli
gctttaatgtgcacaacggcccgga

SEQ ID NO: 188607 - DNA, 25 bp, E. coli
gaagagttgattccgcattacagcg

SEQ ID NO: 188608 - DNA, 25 bp, E. coli
gaagagttgattgcgcattacagcg

SEQ ID NO: 188609 - DNA, 25 bp, E. coli
gaaacgattcgtgtgggtcagcaga

SEQ ID NO: 188610 - DNA, 25 bp, E. coli
gaaacgattcgtctgggtcagcaga

SEQ ID NO: 188611 - DNA, 25 bp, E. coli
cgtggcacacataggcgagatctct

SEQ ID NO: 188612 - DNA, 25 bp, E. coli
cgtggcacacattggcgagatctct

SEQ ID NO: 188613 - DNA, 25 bp, E. coli
caaaaactgctgaacgacgatgaat

SEQ ID NO: 188614 - DNA, 25 bp, E. coli
caaaaactgctgtacgacgatgaat

SEQ ID NO: 188615 - DNA, 25 bp, E. coli
tactgaagatgtacaaaaactgctg

SEQ ID NO: 188616 - DNA, 25 bp, E. coli
taaagatgatctgtctccccaggaa

SEQ ID NO: 188617 - DNA, 25 bp, E. coli
taaagatgatctctctccccaggaa

SEQ ID NO: 188618 - DNA, 25 bp, E. coli
tactgaagatgttcaaaaactgctg

SEQ ID NO: 188619 - DNA, 25 bp, E. coli
acgtgctggtgtgagggttatttac

SEQ ID NO: 188620 - DNA, 25 bp, E. coli
acgtgctggtgtcagggttatttac

SEQ ID NO: 188621 - DNA, 25 bp, E. coli
tgctcttcatcgtaacggaaatttt

SEQ ID NO: 188622 - DNA, 25 bp, E. coli
tgctcttcatcgaaacggaaatttt

SEQ ID NO: 188623 - DNA, 25 bp, E. coli
tcctgactatggtgaggtaatacct

SEQ ID NO: 188624 - DNA, 25 bp, E. coli
tcctggccttgattcctgactatgg

SEQ ID NO: 188625 - DNA, 25 bp, E. coli
tcctggccttgaatcctgactatgg

SEQ ID NO: 188626 - DNA, 25 bp, E. coli
tcctgactatggagaggtaatacct

SEQ ID NO: 188627 - DNA, 25 bp, E. coli
gcaatgctccggttgttaaatacga

SEQ ID NO: 188628 - DNA, 25 bp, E. coli
gcaatgctccggatgttaaatacga

SEQ ID NO: 188629 - DNA, 25 bp, E. coli
gtctccccaggaaaaagcaatgctc

SEQ ID NO: 188630 - DNA, 25 bp, E. coli
gtctccccaggataaagcaatgctc

SEQ ID NO: 188631 - DNA, 25 bp, E. coli
taagaaaggttcgatgggtctcagg

SEQ ID NO: 188632 - DNA, 25 bp, E. coli
taagaaaggttccatgggtctcagg

SEQ ID NO: 188633 - DNA, 25 bp, E. coli
gaggtaatacctcaaactggtgggt

SEQ ID NO: 188634 - DNA, 25 bp, E. coli
gaggtaatacctgaaactggtgggt

SEQ ID NO: 188635 - DNA, 25 bp, E. coli
aatggcaacgtctgaatgacgaaat

SEQ ID NO: 188636 - DNA, 25 bp, E. coli
aatggcaacgtcagaatgacgaaat

SEQ ID NO: 188637 - DNA, 25 bp, E. coli
cagctaaatactcgtgaagttagcg

SEQ ID NO: 188638 - DNA, 25 bp, E. coli
cagctaaatactggtgaagttagcg

SEQ ID NO: 188639 - DNA, 25 bp, E. coli
caccaagagggcttgttacttgaac

SEQ ID NO: 188640 - DNA, 25 bp, E. coli
caccaagagggcatgttacttgaac

SEQ ID NO: 188641 - DNA, 25 bp, E. coli
caggaaccgatgattggcagtggac

SEQ ID NO: 188642 - DNA, 25 bp, E. coli
caggaaccgatgtttggcagtggac

SEQ ID NO: 188643 - DNA, 25 bp, E. coli
tacttgaacagcaaaatactggtga

SEQ ID NO: 188644 - DNA, 25 bp, E. coli
tacttgaacagctaaatactggtga

SEQ ID NO: 188645 - DNA, 25 bp, E. coli
tctgaatgacgaaatgtttgaggtc

SEQ ID NO: 188646 - DNA, 25 bp, E. coli
tctgaatgacgatatgtttgaggtc

SEQ ID NO: 188647 - DNA, 25 bp, E. coli
gaaccgatgtttcgcagtggacgac

SEQ ID NO: 188648 - DNA, 25 bp, E. coli
gaaccgatgtttggcagtggacgac

SEQ ID NO: 188649 - DNA, 25 bp, E. coli
gcagcgaattgctggaaccgatgtt

SEQ ID NO: 188650 - DNA, 25 bp, E. coli
gcagcgaattgcaggaaccgatgtt

SEQ ID NO: 188651 - DNA, 25 bp, E. coli
gaatgacgaaatgtttgaggtcact

SEQ ID NO: 188652 - DNA, 25 bp, E. coli
gaatgacgaaatctttgaggtcact

SEQ ID NO: 188653 - DNA, 25 bp, E. coli
cgaattgcaggaaccgatgtttggc

SEQ ID NO: 188654 - DNA, 25 bp, E. coli
cgaattgcaggatccgatgtttggc

SEQ ID NO: 188655 - DNA, 25 bp, E. coli
gggcatgttacttgaacagctaaat

SEQ ID NO: 188656 - DNA, 25 bp, E. coli
gggcatgttactagaacagctaaat

SEQ ID NO: 188657 - DNA, 25 bp, E. coli
attatcgaaacgcaacgtgccccag

SEQ ID NO: 188658 - DNA, 25 bp, E. coli
attatcgaaacggaacgtgccccag

SEQ ID NO: 188659 - DNA, 25 bp, E. coli
tgagatcccggctgatgtgcaagat

SEQ ID NO: 188660 - DNA, 25 bp, E. coli
tgggcgatatcaacaagatgaccgt

SEQ ID NO: 188661 - DNA, 25 bp, E. coli
tgagatcccggcagatgtgcaagat

SEQ ID NO: 188662 - DNA, 25 bp, E. coli
tgggcgatatcatcaagatgaccgt

SEQ ID NO: 188663 - DNA, 25 bp, E. coli
cgcgcgtttgccgaaagatgtgaag

SEQ ID NO: 188664 - DNA, 25 bp, E. coli
cccaggcgcaatcggcccttatgtt

SEQ ID NO: 188665 - DNA, 25 bp, E. coli
cccaggcgcaatgggcccttatgtt

SEQ ID NO: 188666 - DNA, 25 bp, E. coli
cgcgcgtttgcccaaagatgtgaag

SEQ ID NO: 188667 - DNA, 25 bp, E. coli
gatttaggcagcatggtcttcacct

SEQ ID NO: 188668 - DNA, 25 bp, E. coli
gatcaggcgcgtataagcctcgaaa

SEQ ID NO: 188669 - DNA, 25 bp, E. coli
gatttaggcagcttggtcttcacct

SEQ ID NO: 188670 - DNA, 25 bp, E. coli
ggtttgcccacacaccggtgagatc

SEQ ID NO: 188671 - DNA, 25 bp, E. coli
ggtttgcccacagaccggtgagatc

SEQ ID NO: 188672 - DNA, 25 bp, E. coli
tcaccgatctgattgattttgccac

SEQ ID NO: 188673 - DNA, 25 bp, E. coli
taagcctcgaaaacgtcaaagcgat

SEQ ID NO: 188674 - DNA, 25 bp, E. coli
tcaaagcgatcgaggttgctgccgg

SEQ ID NO: 188675 - DNA, 25 bp, E. coli
tcaaagcgatcgtggttgctgccgg

SEQ ID NO: 188676 - DNA, 25 bp, E. coli
taagcctcgaaatcgtcaaagcgat

SEQ ID NO: 188677 - DNA, 25 bp, E. coli
tcaccgatctgaatgattttgccac

SEQ ID NO: 188678 - DNA, 25 bp, E. coli
gatcaggcgcgtttaagcctcgaaa

SEQ ID NO: 188679 - DNA, 25 bp, E. coli
caacgataggccatgatccaatggg

SEQ ID NO: 188680 - DNA, 25 bp, E. coli
caacgataggccttgatccaatggg

SEQ ID NO: 188681 - DNA, 25 bp, E. coli
tattgccagtatatccggtgagtcg

SEQ ID NO: 188682 - DNA, 25 bp, E. coli
tattgccagtatttccggtgagtcg

SEQ ID NO: 188683 - DNA, 25 bp, E. coli
tttatcggcatgatccccggtgcgg

SEQ ID NO: 188684 - DNA, 25 bp, E. coli
tttatcggcatgttccccggtgcgg

SEQ ID NO: 188685 - DNA, 25 bp, E. coli
tgacgaaacaggcaaaagcagggct

SEQ ID NO: 188686 - DNA, 25 bp, E. coli
tgacgaaacagggaaaagcagggct

SEQ ID NO: 188687 - DNA, 25 bp, E. coli
tcgggacttatggactgaacaacag

SEQ ID NO: 188688 - DNA, 25 bp, E. coli
tcgggacttatgcactgaacaacag

SEQ ID NO: 188689 - DNA, 25 bp, E. coli
gctgaaatttagagcctcggagtcc

SEQ ID NO: 188690 - DNA, 25 bp, E. coli
gctgaaatttagtgcctcggagtcc

SEQ ID NO: 188691 - DNA, 25 bp, E. coli
gaatgtgccatttatcccggtgatg

SEQ ID NO: 188692 - DNA, 25 bp, E. coli
gaatgtgccattaatcccggtgatg

SEQ ID NO: 188693 - DNA, 25 bp, E. coli
gaaattaaagctctggcctcctgtg

SEQ ID NO: 188694 - DNA, 25 bp, E. coli
gaaattaaagctgtggcctcctgtg

SEQ ID NO: 188695 - DNA, 25 bp, E. coli
cattgttacctaagctgacgctggg

SEQ ID NO: 188696 - DNA, 25 bp, E. coli
cattgttacctatgctgacgctggg

SEQ ID NO: 188697 - DNA, 25 bp, E. coli
ggagcaaaaccagcaaattcgtcgg

SEQ ID NO: 188698 - DNA, 25 bp, E. coli
ggagcaaaaccaccaaattcgtcgg

SEQ ID NO: 188699 - DNA, 25 bp, E. coli
taacgttacaggcaatgcaaccagg

SEQ ID NO: 188700 - DNA, 25 bp, E. coli
taacgttacagggaatgcaaccagg

SEQ ID NO: 188701 - DNA, 25 bp, E. coli
caactctggcgagctgctttcgtta

SEQ ID NO: 188702 - DNA, 25 bp, E. coli
caactctggcgacctgctttcgtta

SEQ ID NO: 188703 - DNA, 25 bp, E. coli
catctgttgaatgttttgcctttac

SEQ ID NO: 188704 - DNA, 25 bp, E. coli
catctgttgaatcttttgcctttac

SEQ ID NO: 188705 - DNA, 25 bp, E. coli
taactccagtggtacatgtttgccg

SEQ ID NO: 188706 - DNA, 25 bp, E. coli
tttgcctttacatcgtattgctacc

SEQ ID NO: 188707 - DNA, 25 bp, E. coli
tttgcctttacaacgtattgctacc

SEQ ID NO: 188708 - DNA, 25 bp, E. coli
tattgctaccaccaactctggcgag

SEQ ID NO: 188709 - DNA, 25 bp, E. coli
tattgctaccacgaactctggcgag

SEQ ID NO: 188710 - DNA, 25 bp, E. coli
tgagcaccgaagtcagccgccgcat

SEQ ID NO: 188711 - DNA, 25 bp, E. coli
tgagcaccgaagacagccgccgcat

SEQ ID NO: 188712 - DNA, 25 bp, E. coli
tccagtggaacaagtttgccgcctg

SEQ ID NO: 188713 - DNA, 25 bp, E. coli
tccagtggaacatgtttgccgcctg

SEQ ID NO: 188714 - DNA, 25 bp, E. coli
gccgcctggtgcgtgaatcttctcg

SEQ ID NO: 188715 - DNA, 25 bp, E. coli
gccgcctggtgcctgaatcttctcg

SEQ ID NO: 188716 - DNA, 25 bp, E. coli
ccaagtggcttgagcaccgaagaca

SEQ ID NO: 188717 - DNA, 25 bp, E. coli
ccaagtggcttgtgcaccgaagaca

SEQ ID NO: 188718 - DNA, 25 bp, E. coli
gctgctttcgtttactccagtggaa

SEQ ID NO: 188719 - DNA, 25 bp, E. coli
gctgctttcgttaactccagtggaa

SEQ ID NO: 188720 - DNA, 25 bp, E. coli
gaatcttctcgtcttgccgcctggc

SEQ ID NO: 188721 - DNA, 25 bp, E. coli
gaatcttctcgtgttgccgcctggc

SEQ ID NO: 188722 - DNA, 25 bp, E. coli
taactccagtggaacatgtttgccg

SEQ ID NO: 188723 - DNA, 25 bp, E. coli
cagaaggtgtaagcatccgatatta

SEQ ID NO: 188724 - DNA, 25 bp, E. coli
caggcagaagaaagaagataaatca

SEQ ID NO: 188725 - DNA, 25 bp, E. coli
caggcagaagaatgaagataaatca

SEQ ID NO: 188726 - DNA, 25 bp, E. coli
cagaaggtgtaaccatccgatatta

SEQ ID NO: 188727 - DNA, 25 bp, E. coli
taaatcagcagaaggtgtaagcatc

SEQ ID NO: 188728 - DNA, 25 bp, E. coli
taaaaatgaatgtagatgccagccg

SEQ ID NO: 188729 - DNA, 25 bp, E. coli
taaaaatgaatgaagatgccagccg

SEQ ID NO: 188730 - DNA, 25 bp, E. coli
taaatcagcagatggtgtaagcatc

SEQ ID NO: 188731 - DNA, 25 bp, E. coli
tatttcatcaaacgatatggatgct

SEQ ID NO: 188732 - DNA, 25 bp, E. coli
tatttcatcaaaggatatggatgct

SEQ ID NO: 188733 - DNA, 25 bp, E. coli
tgatcgagcacagtcttcattgggt

SEQ ID NO: 188734 - DNA, 25 bp, E. coli
tgatcgagcacactcttcattgggt

SEQ ID NO: 188735 - DNA, 25 bp, E. coli
tgccagccggattagaagaggaaac

SEQ ID NO: 188736 - DNA, 25 bp, E. coli
tgccagccggataagaagaggaaac

SEQ ID NO: 188737 - DNA, 25 bp, E. coli
tcagagcgcactcgctgatcgagca

SEQ ID NO: 188738 - DNA, 25 bp, E. coli
tcagagcgcactggctgatcgagca

SEQ ID NO: 188739 - DNA, 25 bp, E. coli
gaatttgcacatcctatcagagcgc

SEQ ID NO: 188740 - DNA, 25 bp, E. coli
gaatttgcacatgctatcagagcgc

SEQ ID NO: 188741 - DNA, 25 bp, E. coli
cttcattgggtgttagatgtaaaaa

SEQ ID NO: 188742 - DNA, 25 bp, E. coli
cttcattgggtgatagatgtaaaaa

SEQ ID NO: 188743 - DNA, 25 bp, E. coli
gatatggatgctaaagaatttgcac

SEQ ID NO: 188744 - DNA, 25 bp, E. coli
gatatggatgcttaagaatttgcac

SEQ ID NO: 188745 - DNA, 25 bp, E. coli
cagccacctctttattgtttaccga

SEQ ID NO: 188746 - DNA, 25 bp, E. coli
cagccacctcttaattgtttaccga

SEQ ID NO: 188747 - DNA, 25 bp, E. coli
tattgtttaccgagcagcgttcaga

SEQ ID NO: 188748 - DNA, 25 bp, E. coli
tattgtttaccgtgcagcgttcaga

SEQ ID NO: 188749 - DNA, 25 bp, E. coli
ttcgttacaggccatacatggcacg

SEQ ID NO: 188750 - DNA, 25 bp, E. coli
ttacaggcgatacatggcacgcttc

SEQ ID NO: 188751 - DNA, 25 bp, E. coli
ttcgttacaggcgatacatggcacg

SEQ ID NO: 188752 - DNA, 25 bp, E. coli
ttacaggcgatagatggcacgcttc

SEQ ID NO: 188753 - DNA, 25 bp, E. coli
tgaaggcagtatccagtcaaggcgc

SEQ ID NO: 188754 - DNA, 25 bp, E. coli
tgaaggcagtatgcagtcaaggcgc

SEQ ID NO: 188755 - DNA, 25 bp, E. coli
ccgagcagcgttgagagaaatatca

SEQ ID NO: 188756 - DNA, 25 bp, E. coli
gctatcgtcagccacctctttattg

SEQ ID NO: 188757 - DNA, 25 bp, E. coli
gctatcgtcagcgacctctttattg

SEQ ID NO: 188758 - DNA, 25 bp, E. coli
ccgagcagcgttcagagaaatatca

SEQ ID NO: 188759 - DNA, 25 bp, E. coli
gtatccagtcaaggcgcgctatcgt

SEQ ID NO: 188760 - DNA, 25 bp, E. coli
tccctgtcttccgtgtggctttgcg

SEQ ID NO: 188761 - DNA, 25 bp, E. coli
tccctgtcttccctgtggctttgcg

SEQ ID NO: 188762 - DNA, 25 bp, E. coli
gtatccagtcaacgcgcgctatcgt

SEQ ID NO: 188763 - DNA, 25 bp, E. coli
tggctttgcgtgaaggcagtatcca

SEQ ID NO: 188764 - DNA, 25 bp, E. coli
tggctttgcgtgtaggcagtatcca

SEQ ID NO: 188765 - DNA, 25 bp, E. coli
gagaaatatcaaatcgttacaggcg

SEQ ID NO: 188766 - DNA, 25 bp, E. coli
gagaaatatcaattcgttacaggcg

SEQ ID NO: 188767 - DNA, 25 bp, E. coli
aatcctcggcgaagctaatatgggc

SEQ ID NO: 188768 - DNA, 25 bp, E. coli
aatcctcggcgatgctaatatgggc

SEQ ID NO: 188769 - DNA, 25 bp, E. coli
tacagtaagaaaagccgttggccca

SEQ ID NO: 188770 - DNA, 25 bp, E. coli
tacagtaagaaatgccgttggccca

SEQ ID NO: 188771 - DNA, 25 bp, E. coli
tacgacaagcagttttgggagcact

SEQ ID NO: 188772 - DNA, 25 bp, E. coli
tacgacaagcagatttgggagcact

SEQ ID NO: 188773 - DNA, 25 bp, E. coli
tatcataagtaatagacgcgagtct

SEQ ID NO: 188774 - DNA, 25 bp, E. coli
tatcataagtaaaagacgcgagtct

SEQ ID NO: 188775 - DNA, 25 bp, E. coli
tataatgcttgcttctcgaaaggcg

SEQ ID NO: 188776 - DNA, 25 bp, E. coli
tataatgcttgcatctcgaaaggcg

SEQ ID NO: 188777 - DNA, 25 bp, E. coli
ttaaagcaaacaaggaggaagcccc

SEQ ID NO: 188778 - DNA, 25 bp, E. coli
ttcgcagcgatatcatccaacggtt

SEQ ID NO: 188779 - DNA, 25 bp, E. coli
ttcgcagcgataacatccaacggtt

SEQ ID NO: 188780 - DNA, 25 bp, E. coli
ttaaagcaaacatggaggaagcccc

SEQ ID NO: 188781 - DNA, 25 bp, E. coli
tccaacggtttgaatgaaagaggcc

SEQ ID NO: 188782 - DNA, 25 bp, E. coli
tccaacggtttgtatgaaagaggcc

SEQ ID NO: 188783 - DNA, 25 bp, E. coli
tctgaaacgctgcagttctggccgc

SEQ ID NO: 188784 - DNA, 25 bp, E. coli
tctgaaacgctggagttctggccgc

SEQ ID NO: 188785 - DNA, 25 bp, E. coli
gaaagaggcctgtttaccgcgggat

SEQ ID NO: 188786 - DNA, 25 bp, E. coli
gaaagaggcctgattaccgcgggat

SEQ ID NO: 188787 - DNA, 25 bp, E. coli
ggagcattttctttctggcgaccat

SEQ ID NO: 188788 - DNA, 25 bp, E. coli
ggagcattttctatctggcgaccat

SEQ ID NO: 188789 - DNA, 25 bp, E. coli
gcctatattacttcacatcgcgatg

SEQ ID NO: 188790 - DNA, 25 bp, E. coli
gcctatattactacacatcgcgatg

SEQ ID NO: 188791 - DNA, 25 bp, E. coli
catcgcgatgaatgtagccatagca

SEQ ID NO: 188792 - DNA, 25 bp, E. coli
catcgcgatgaaagtagccatagca

SEQ ID NO: 188793 - DNA, 25 bp, E. coli
catcagttataatctctgcattgca

SEQ ID NO: 188794 - DNA, 25 bp, E. coli
catcagttataaactctgcattgca

SEQ ID NO: 188795 - DNA, 25 bp, E. coli
tacatactttcgaacatttttgatg

SEQ ID NO: 188796 - DNA, 25 bp, E. coli
tacatactttcgtacatttttgatg

SEQ ID NO: 188797 - DNA, 25 bp, E. coli
aactcttttaaagtctggttccatg

SEQ ID NO: 188798 - DNA, 25 bp, E. coli
aactcttttaaactctggttccatg

SEQ ID NO: 188799 - DNA, 25 bp, E. coli
tatatccctgcatttgtaacatcag

SEQ ID NO: 188800 - DNA, 25 bp, E. coli
tatcttctgggagtaaggaaaacgg

SEQ ID NO: 188801 - DNA, 25 bp, E. coli
tatatccctgcaattgtaacatcag

SEQ ID NO: 188802 - DNA, 25 bp, E. coli
tatcttctgggactaaggaaaacgg

SEQ ID NO: 188803 - DNA, 25 bp, E. coli
tgcatctacaatttacatactttcg

SEQ ID NO: 188804 - DNA, 25 bp, E. coli
tgcatctacaatatacatactttcg

SEQ ID NO: 188805 - DNA, 25 bp, E. coli
taaggaaaacggtagagtggatagt

SEQ ID NO: 188806 - DNA, 25 bp, E. coli
taaggaaaacggaagagtggatagt

SEQ ID NO: 188807 - DNA, 25 bp, E. coli
ggttccatgataatatttatatccc

SEQ ID NO: 188808 - DNA, 25 bp, E. coli
ggttccatgatattatttatatccc

SEQ ID NO: 188809 - DNA, 25 bp, E. coli
gagtggatagttacgcaaatgtctt

SEQ ID NO: 188810 - DNA, 25 bp, E. coli
gagtggatagtttcgcaaatgtctt

SEQ ID NO: 188811 - DNA, 25 bp, E. coli
aatgcctgacagatcgcagaatgag

SEQ ID NO: 188812 - DNA, 25 bp, E. coli
aatgcctgacagttcgcagaatgag

SEQ ID NO: 188813 - DNA, 25 bp, E. coli
agcactaatggtttttaactacctg

SEQ ID NO: 188814 - DNA, 25 bp, E. coli
agcactaatggtatttaactacctg

SEQ ID NO: 188815 - DNA, 25 bp, E. coli
acccaacgccgctggctggctaata

SEQ ID NO: 188816 - DNA, 25 bp, E. coli
acccaacgccgcaggctggctaata

SEQ ID NO: 188817 - DNA, 25 bp, E. coli
ttctgatgtcatccggcaatttact

SEQ ID NO: 188818 - DNA, 25 bp, E. coli
ttctgatgtcatgcggcaatttact

SEQ ID NO: 188819 - DNA, 25 bp, E. coli
taactacctgttatatttttcacca

SEQ ID NO: 188820 - DNA, 25 bp, E. coli
taactacctgttttatttttcacca

SEQ ID NO: 188821 - DNA, 25 bp, E. coli
gccactgttcggttggcatcgttct

SEQ ID NO: 188822 - DNA, 25 bp, E. coli
gccactgttcggatggcatcgttct

SEQ ID NO: 188823 - DNA, 25 bp, E. coli
gctggctggctattaaacagacgtt

SEQ ID NO: 188824 - DNA, 25 bp, E. coli
gctggctggctaataaacagacgtt

SEQ ID NO: 188825 - DNA, 25 bp, E. coli
gcaatttactcaccactaatggttt

SEQ ID NO: 188826 - DNA, 25 bp, E. coli
gcaatttactcagcactaatggttt

SEQ ID NO: 188827 - DNA, 25 bp, E. coli
gacgttatttgatcactctatttcg

SEQ ID NO: 188828 - DNA, 25 bp, E. coli
gacgttatttgaacactctatttcg

SEQ ID NO: 188829 - DNA, 25 bp, E. coli
gatttttcttcggtaatcacgaacc

SEQ ID NO: 188830 - DNA, 25 bp, E. coli
gatttttcttcgctaatcacgaacc

SEQ ID NO: 188831 - DNA, 25 bp, E. coli
tggcatcgttctcatgtcatccggc

SEQ ID NO: 188832 - DNA, 25 bp, E. coli
tggcatcgttctgatgtcatccggc

SEQ ID NO: 188833 - DNA, 25 bp, E. coli
tactcggcgtcagtagcggttctgc

SEQ ID NO: 188834 - DNA, 25 bp, E. coli
tactcggcgtcactagcggttctgc

SEQ ID NO: 188835 - DNA, 25 bp, E. coli
tattaaccagccagcttggtggccc

SEQ ID NO: 188836 - DNA, 25 bp, E. coli
tattgctgatggcagacacgcttgc

SEQ ID NO: 188837 - DNA, 25 bp, E. coli
tattgctgatgggagacacgcttgc

SEQ ID NO: 188838 - DNA, 25 bp, E. coli
tattaaccagcctgcttggtggccc

SEQ ID NO: 188839 - DNA, 25 bp, E. coli
tgatgggcaatcttggacaggcgca

SEQ ID NO: 188840 - DNA, 25 bp, E. coli
tgtctcgccggatcgctgaatttac

SEQ ID NO: 188841 - DNA, 25 bp, E. coli
tgtctcgccggaacgctgaatttac

SEQ ID NO: 188842 - DNA, 25 bp, E. coli
tgatgggcaatcatggacaggcgca

SEQ ID NO: 188843 - DNA, 25 bp, E. coli
tgcagctcggtgttgaagaagccca

SEQ ID NO: 188844 - DNA, 25 bp, E. coli
tgcagctcggtgatgaagaagccca

SEQ ID NO: 188845 - DNA, 25 bp, E. coli
ccctttttgatgtggaataccgcga

SEQ ID NO: 188846 - DNA, 25 bp, E. coli
ccctttttgatgaggaataccgcga

SEQ ID NO: 188847 - DNA, 25 bp, E. coli
ggtgatcccgcaactgattcgcatg

SEQ ID NO: 188848 - DNA, 25 bp, E. coli
ggtgatcccgcatctgattcgcatg

SEQ ID NO: 188849 - DNA, 25 bp, E. coli
ggctcaatattcgtctaccacgggt

SEQ ID NO: 188850 - DNA, 25 bp, E. coli
tggtacagccagcagaaatgcccgt

SEQ ID NO: 188851 - DNA, 25 bp, E. coli
ggctcaatattcctctaccacgggt

SEQ ID NO: 188852 - DNA, 25 bp, E. coli
ggctttttcgcatcccaatggctga

SEQ ID NO: 188853 - DNA, 25 bp, E. coli
ggctttttcgcaacccaatggctga

SEQ ID NO: 188854 - DNA, 25 bp, E. coli
tggtacagccaggagaaatgcccgt

SEQ ID NO: 188855 - DNA, 25 bp, E. coli
aagaaatccgcttattgaaaaacag

SEQ ID NO: 188856 - DNA, 25 bp, E. coli
aagaaatccgctaattgaaaaacag

SEQ ID NO: 188857 - DNA, 25 bp, E. coli
taaataatgtcctttataatggcat

SEQ ID NO: 188858 - DNA, 25 bp, E. coli
taaaaactcattcagagttgaggct

SEQ ID NO: 188859 - DNA, 25 bp, E. coli
taaaaactcattgagagttgaggct

SEQ ID NO: 188860 - DNA, 25 bp, E. coli
taaataatgtccattataatggcat

SEQ ID NO: 188861 - DNA, 25 bp, E. coli
ttaatcgttctgttggtcgccgcgg

SEQ ID NO: 188862 - DNA, 25 bp, E. coli
ttaatcgttctgatggtcgccgcgg

SEQ ID NO: 188863 - DNA, 25 bp, E. coli
tgaatgcctggttaatcaactcagg

SEQ ID NO: 188864 - DNA, 25 bp, E. coli
tgaatgcctggtaaatcaactcagg

SEQ ID NO: 188865 - DNA, 25 bp, E. coli
gcggccctgctggtgtttccttata

SEQ ID NO: 188866 - DNA, 25 bp, E. coli
gcggccctgctgctgtttccttata

SEQ ID NO: 188867 - DNA, 25 bp, E. coli
gaatcagcattccacgataaattaa

SEQ ID NO: 188868 - DNA, 25 bp, E. coli
gaatcagcattcgacgataaattaa

SEQ ID NO: 188869 - DNA, 25 bp, E. coli
gaaaaacagattcaatgcctggtaa

SEQ ID NO: 188870 - DNA, 25 bp, E. coli
gaaaaacagattgaatgcctggtaa

SEQ ID NO: 188871 - DNA, 25 bp, E. coli
ggtaaatcaactgaggcaatcaggg

SEQ ID NO: 188872 - DNA, 25 bp, E. coli
ggtaaatcaactcaggcaatcaggg

SEQ ID NO: 188873 - DNA, 25 bp, E. coli
ggcaatcagggtaattaaaaactca

SEQ ID NO: 188874 - DNA, 25 bp, E. coli
ggcaatcagggttattaaaaactca

SEQ ID NO: 188875 - DNA, 25 bp, E. coli
gagttgaggctcacagaatcagcat

SEQ ID NO: 188876 - DNA, 25 bp, E. coli
gagttgaggctctcagaatcagcat

SEQ ID NO: 188877 - DNA, 25 bp, E. coli
taacgactacatcgcgaagctgggc

SEQ ID NO: 188878 - DNA, 25 bp, E. coli
taacaatgcgcgagactacttcgcc

SEQ ID NO: 188879 - DNA, 25 bp, E. coli
taacaatgcgcgtgactacttcgcc

SEQ ID NO: 188880 - DNA, 25 bp, E. coli
tgaacgtgaaaatggtcggcaccac

SEQ ID NO: 188881 - DNA, 25 bp, E. coli
tgaacccgcgcgataacgaagtgct

SEQ ID NO: 188882 - DNA, 25 bp, E. coli
tgaacccgcgcgttaacgaagtgct

SEQ ID NO: 188883 - DNA, 25 bp, E. coli
tgaacgtgaaaaaggtcggcaccac

SEQ ID NO: 188884 - DNA, 25 bp, E. coli
gaagctgggcgatgtttccgatacc

SEQ ID NO: 188885 - DNA, 25 bp, E. coli
gaagctgggcgaagtttccgatacc

SEQ ID NO: 188886 - DNA, 25 bp, E. coli
cgaatgtaacgaactgctggcgcag

SEQ ID NO: 188887 - DNA, 25 bp, E. coli
cgaatatgcacgacgcggctgggta

SEQ ID NO: 188888 - DNA, 25 bp, E. coli
cgaatatgcacgtcgcggctgggta

SEQ ID NO: 188889 - DNA, 25 bp, E. coli
cgaatgtaacgatctgctggcgcag

SEQ ID NO: 188890 - DNA, 25 bp, E. coli
gatcactacaaaaggcgcgctatgc

SEQ ID NO: 188891 - DNA, 25 bp, E. coli
gatcactacaaatggcgcgctatgc

SEQ ID NO: 188892 - DNA, 25 bp, E. coli
gtgaaaaatttgtcgcctgggcggc

SEQ ID NO: 188893 - DNA, 25 bp, E. coli
gtgaaaaatttgacgcctgggcggc

SEQ ID NO: 188894 - DNA, 25 bp, E. coli
ggcaaaatgcagttcggttccggct

SEQ ID NO: 188895 - DNA, 25 bp, E. coli
ggcaaaatgcagatcggttccggct

SEQ ID NO: 188896 - DNA, 25 bp, E. coli
tcaactgccgatcaaatctggaacg

SEQ ID NO: 188897 - DNA, 25 bp, E. coli
tcaactgccgatgaaatctggaacg

SEQ ID NO: 188898 - DNA, 25 bp, E. coli
taacgactacatggcgaagctgggc

SEQ ID NO: 188899 - DNA, 25 bp, E. coli
cactgttaagcaagcgcaaatcgta

SEQ ID NO: 188900 - DNA, 25 bp, E. coli
cactgttaagcatgcgcaaatcgta

SEQ ID NO: 188901 - DNA, 25 bp, E. coli
atcggcgcactgataagcatgcgca

SEQ ID NO: 188902 - DNA, 25 bp, E. coli
atcggcgcactgttaagcatgcgca

SEQ ID NO: 188903 - DNA, 25 bp, E. coli
actgttaagcatgcgcaaatcgtag

SEQ ID NO: 188904 - DNA, 25 bp, E. coli
actgttaagcatccgcaaatcgtag

SEQ ID NO: 188905 - DNA, 25 bp, E. coli
tatcggcgcactcttaagcatgcgc

SEQ ID NO: 188906 - DNA, 25 bp, E. coli
tatcggcgcactgttaagcatgcgc

SEQ ID NO: 188907 - DNA, 25 bp, E. coli
tttatcggcgcagtgttaagcatgc

SEQ ID NO: 188908 - DNA, 25 bp, E. coli
ttatcggcgcactgttaagcatgcg

SEQ ID NO: 188909 - DNA, 25 bp, E. coli
tttatcggcgcactgttaagcatgc

SEQ ID NO: 188910 - DNA, 25 bp, E. coli
ttatcggcgcacagttaagcatgcg

SEQ ID NO: 188911 - DNA, 25 bp, E. coli
tcggcgcactgttaagcatgcgcaa

SEQ ID NO: 188912 - DNA, 25 bp, E. coli
tcggcgcactgtaaagcatgcgcaa

SEQ ID NO: 188913 - DNA, 25 bp, E. coli
gcactgttaagcatgcgcaaatcgt

SEQ ID NO: 188914 - DNA, 25 bp, E. coli
gcactgttaagcttgcgcaaatcgt

SEQ ID NO: 188915 - DNA, 25 bp, E. coli
cgcactgttaaggatgcgcaaatcg

SEQ ID NO: 188916 - DNA, 25 bp, E. coli
cgcactgttaagcatgcgcaaatcg

SEQ ID NO: 188917 - DNA, 25 bp, E. coli
cggcgcactgttaagcatgcgcaaa

SEQ ID NO: 188918 - DNA, 25 bp, E. coli
cggcgcactgtttagcatgcgcaaa

SEQ ID NO: 188919 - DNA, 25 bp, E. coli
ggcgcactgttaagcatgcgcaaat

SEQ ID NO: 188920 - DNA, 25 bp, E. coli
ggcgcactgttatgcatgcgcaaat

SEQ ID NO: 188921 - DNA, 25 bp, E. coli
caaccaggcagaaaaaataatggga

SEQ ID NO: 188922 - DNA, 25 bp, E. coli
caaccaggcagataaaataatggga

SEQ ID NO: 188923 - DNA, 25 bp, E. coli
tcggcgttccagaatgctgcacaac

SEQ ID NO: 188924 - DNA, 25 bp, E. coli
tcggcgttccagtatgctgcacaac

SEQ ID NO: 188925 - DNA, 25 bp, E. coli
ccagaatgctgcacaaccaggcaga

SEQ ID NO: 188926 - DNA, 25 bp, E. coli
ccagaatgctgctcaaccaggcaga

SEQ ID NO: 188927 - DNA, 25 bp, E. coli
gaatgctgcacatccaggcagaaaa

SEQ ID NO: 188928 - DNA, 25 bp, E. coli
gaatgctgcacaaccaggcagaaaa

SEQ ID NO: 188929 - DNA, 25 bp, E. coli
gcagaaaaaataatgggaataaccg

SEQ ID NO: 188930 - DNA, 25 bp, E. coli
gcacaaccaggcagaaaaaataatg

SEQ ID NO: 188931 - DNA, 25 bp, E. coli
gcacaaccaggctgaaaaaataatg

SEQ ID NO: 188932 - DNA, 25 bp, E. coli
gcagaaaaaatattgggaataaccg

SEQ ID NO: 188933 - DNA, 25 bp, E. coli
cattaagtcggcgttccagaatgct

SEQ ID NO: 188934 - DNA, 25 bp, E. coli
cattaagtcggccttccagaatgct

SEQ ID NO: 188935 - DNA, 25 bp, E. coli
gttccagaatgctgcacaaccaggc

SEQ ID NO: 188936 - DNA, 25 bp, E. coli
gttccagaatgcagcacaaccaggc

SEQ ID NO: 188937 - DNA, 25 bp, E. coli
ggtgtgaagaaaattttgattgccg

SEQ ID NO: 188938 - DNA, 25 bp, E. coli
ggtgtgaagaaatttttgattgccg

SEQ ID NO: 188939 - DNA, 25 bp, E. coli
taagtcggcgttccagaatgctgca

SEQ ID NO: 188940 - DNA, 25 bp, E. coli
taatgggaataaccgatgacgagta

SEQ ID NO: 188941 - DNA, 25 bp, E. coli
taatgggaataagcgatgacgagta

SEQ ID NO: 188942 - DNA, 25 bp, E. coli
taagtcggcgttgcagaatgctgca

SEQ ID NO: 188943 - DNA, 25 bp, E. coli
caagatggcgtatctgccgcagttg

SEQ ID NO: 188944 - DNA, 25 bp, E. coli
caagatggcgtaactgccgcagttg

SEQ ID NO: 188945 - DNA, 25 bp, E. coli
aaccgctaccttcaaagtctgcgta

SEQ ID NO: 188946 - DNA, 25 bp, E. coli
accttgaaagtctgcgtaatgcccc

SEQ ID NO: 188947 - DNA, 25 bp, E. coli
accttgaaagtcagcgtaatgcccc

SEQ ID NO: 188948 - DNA, 25 bp, E. coli
aaccgctaccttgaaagtctgcgta

SEQ ID NO: 188949 - DNA, 25 bp, E. coli
tttcgtcagactaacggttaagcac

SEQ ID NO: 188950 - DNA, 25 bp, E. coli
tttcgtcagacttacggttaagcac

SEQ ID NO: 188951 - DNA, 25 bp, E. coli
tgaacgaagaccttattgcccgcgg

SEQ ID NO: 188952 - DNA, 25 bp, E. coli
tgaacgaagaccatattgcccgcgg

SEQ ID NO: 188953 - DNA, 25 bp, E. coli
gaagaccttattgcccgcggtttga

SEQ ID NO: 188954 - DNA, 25 bp, E. coli
gaagaccttattccccgcggtttga

SEQ ID NO: 188955 - DNA, 25 bp, E. coli
gaactgctattaatgcaagatggcg

SEQ ID NO: 188956 - DNA, 25 bp, E. coli
gacggattttgcagcgctgctgcgt

SEQ ID NO: 188957 - DNA, 25 bp, E. coli
gacggattttgctgcgctgctgcgt

SEQ ID NO: 188958 - DNA, 25 bp, E. coli
gaactgctattattgcaagatggcg

SEQ ID NO: 188959 - DNA, 25 bp, E. coli
cgctgctgcgtctgctcagtgaagg

SEQ ID NO: 188960 - DNA, 25 bp, E. coli
ccctggctgacgcattttgctgcgc

SEQ ID NO: 188961 - DNA, 25 bp, E. coli
ccctggctgacggattttgctgcgc

SEQ ID NO: 188962 - DNA, 25 bp, E. coli
cgctgctgcgtcagctcagtgaagg

SEQ ID NO: 188963 - DNA, 25 bp, E. coli
cattgactatacagatttcgtcaga

SEQ ID NO: 188964 - DNA, 25 bp, E. coli
cattgactatactgatttcgtcaga

SEQ ID NO: 188965 - DNA, 25 bp, E. coli
cagaaaaagcgctggatgatgtgaa

SEQ ID NO: 188966 - DNA, 25 bp, E. coli
cagaaaaagcgcaggatgatgtgaa

SEQ ID NO: 188967 - DNA, 25 bp, E. coli
cagttattactatcgggcgaagcag

SEQ ID NO: 188968 - DNA, 25 bp, E. coli
cagttattactaacgggcgaagcag

SEQ ID NO: 188969 - DNA, 25 bp, E. coli
agaggtgctccggtcctctggcgat

SEQ ID NO: 188970 - DNA, 25 bp, E. coli
agaggtgctccgctcctctggcgat

SEQ ID NO: 188971 - DNA, 25 bp, E. coli
aaacactggaagaggtgctccgctc

SEQ ID NO: 188972 - DNA, 25 bp, E. coli
aaacactggaagtggtgctccgctc

SEQ ID NO: 188973 - DNA, 25 bp, E. coli
tatgttgagctgaaagcgcgtgcag

SEQ ID NO: 188974 - DNA, 25 bp, E. coli
tagccaggcttctgacagttattac

SEQ ID NO: 188975 - DNA, 25 bp, E. coli
tagccaggcttcagacagttattac

SEQ ID NO: 188976 - DNA, 25 bp, E. coli
tatgttgagctgtaagcgcgtgcag

SEQ ID NO: 188977 - DNA, 25 bp, E. coli
tgactacgtccaggaaaaaccctgg

SEQ ID NO: 188978 - DNA, 25 bp, E. coli
tgactacgtccacgaaaaaccctgg

SEQ ID NO: 188979 - DNA, 25 bp, E. coli
gtttatcgtgctgatgactacgtcc

SEQ ID NO: 188980 - DNA, 25 bp, E. coli
gtttatcgtgctcatgactacgtcc

SEQ ID NO: 188981 - DNA, 25 bp, E. coli
gacctgacgctggttagtgaaacac

SEQ ID NO: 188982 - DNA, 25 bp, E. coli
gatgatgtgaaataacgggttagcc

SEQ ID NO: 188983 - DNA, 25 bp, E. coli
gatgatgtgaaaaaacgggttagcc

SEQ ID NO: 188984 - DNA, 25 bp, E. coli
gatcccgccgatcagaaatatgttg

SEQ ID NO: 188985 - DNA, 25 bp, E. coli
gacctgacgctgcttagtgaaacac

SEQ ID NO: 188986 - DNA, 25 bp, E. coli
gatcccgccgatgagaaatatgttg

SEQ ID NO: 188987 - DNA, 25 bp, E. coli
caatctgtatggtcctggtggcccg

SEQ ID NO: 188988 - DNA, 25 bp, E. coli
caatctgtatggacctggtggcccg

SEQ ID NO: 188989 - DNA, 25 bp, E. coli
tagcggaactgctcgtaaggctctt

SEQ ID NO: 188990 - DNA, 25 bp, E. coli
tagcggaactgcacgtaaggctctt

SEQ ID NO: 188991 - DNA, 25 bp, E. coli
tatccggagtattgacgacctgacc

SEQ ID NO: 188992 - DNA, 25 bp, E. coli
tatccggagtatagacgacctgacc

SEQ ID NO: 188993 - DNA, 25 bp, E. coli
tatagaaactgtcgccgcaatccga

SEQ ID NO: 188994 - DNA, 25 bp, E. coli
tatagaaactgtggccgcaatccga

SEQ ID NO: 188995 - DNA, 25 bp, E. coli
tgaacgttcattacggcccacagaa

SEQ ID NO: 188996 - DNA, 25 bp, E. coli
tgatgtcgtggatatagcgccagac

SEQ ID NO: 188997 - DNA, 25 bp, E. coli
tgatgtcgtggaaatagcgccagac

SEQ ID NO: 188998 - DNA, 25 bp, E. coli
tgaacgttcatttcggcccacagaa

SEQ ID NO: 188999 - DNA, 25 bp, E. coli
tctggataacctgggctgactgggc

SEQ ID NO: 189000 - DNA, 25 bp, E. coli
tctggataacctcggctgactgggc

SEQ ID NO: 189001 - DNA, 25 bp, E. coli
gctacaaaccgatgaagcggcgcct

SEQ ID NO: 189002 - DNA, 25 bp, E. coli
gctacaaaccgaagaagcggcgcct

SEQ ID NO: 189003 - DNA, 25 bp, E. coli
gaaacccgtcgaattgcagaatggc

SEQ ID NO: 189004 - DNA, 25 bp, E. coli
gaaacccgtcgatttgcagaatggc

SEQ ID NO: 189005 - DNA, 25 bp, E. coli
cattcgggaccataaagacagcttc

SEQ ID NO: 189006 - DNA, 25 bp, E. coli
cattcgggaccaaaaagacagcttc

SEQ ID NO: 189007 - DNA, 25 bp, E. coli
taatacatcagggactggcgtctgg

SEQ ID NO: 189008 - DNA, 25 bp, E. coli
taatacatcaggcactggcgtctgg

SEQ ID NO: 189009 - DNA, 25 bp, E. coli
aagatgggcattcaacttgaacaaa

SEQ ID NO: 189010 - DNA, 25 bp, E. coli
aagatgggcattgaacttgaacaaa

SEQ ID NO: 189011 - DNA, 25 bp, E. coli
atgggcattcaagttgaacaaaaag

SEQ ID NO: 189012 - DNA, 25 bp, E. coli
agatgggcattctacttgaacaaaa

SEQ ID NO: 189013 - DNA, 25 bp, E. coli
agatgggcattcaacttgaacaaaa

SEQ ID NO: 189014 - DNA, 25 bp, E. coli
atgggcattcaacttgaacaaaaag

SEQ ID NO: 189015 - DNA, 25 bp, E. coli
aaagatgggcatacaacttgaacaa

SEQ ID NO: 189016 - DNA, 25 bp, E. coli
aaaagatgggcattcaacttgaaca

SEQ ID NO: 189017 - DNA, 25 bp, E. coli
aaaaagatgggctttcaacttgaac

SEQ ID NO: 189018 - DNA, 25 bp, E. coli
aaaaagatgggcattcaacttgaac

SEQ ID NO: 189019 - DNA, 25 bp, E. coli
aaaagatgggcaatcaacttgaaca

SEQ ID NO: 189020 - DNA, 25 bp, E. coli
aaagatgggcattcaacttgaacaa

SEQ ID NO: 189021 - DNA, 25 bp, E. coli
tgggcattcaacatgaacaaaaagt

SEQ ID NO: 189022 - DNA, 25 bp, E. coli
ggcattcaacttcaacaaaaagttc

SEQ ID NO: 189023 - DNA, 25 bp, E. coli
gggcattcaacttgaacaaaaagtt

SEQ ID NO: 189024 - DNA, 25 bp, E. coli
ggcattcaacttgaacaaaaagttc

SEQ ID NO: 189025 - DNA, 25 bp, E. coli
gggcattcaactagaacaaaaagtt

SEQ ID NO: 189026 - DNA, 25 bp, E. coli
tgggcattcaacttgaacaaaaagt

SEQ ID NO: 189027 - DNA, 25 bp, E. coli
gagaaaaagatgcgcattcaacttg

SEQ ID NO: 189028 - DNA, 25 bp, E. coli
gatgggcattcatcttgaacaaaaa

SEQ ID NO: 189029 - DNA, 25 bp, E. coli
gatgggcattcaacttgaacaaaaa

SEQ ID NO: 189030 - DNA, 25 bp, E. coli
gagaaaaagatgggcattcaacttg

SEQ ID NO: 189031 - DNA, 25 bp, E. coli
aagaggttataggtctgacaccaga

SEQ ID NO: 189032 - DNA, 25 bp, E. coli
aagaggttatagctctgacaccaga

SEQ ID NO: 189033 - DNA, 25 bp, E. coli
caaagttgtgttatgcgcgatatgc

SEQ ID NO: 189034 - DNA, 25 bp, E. coli
caaagttgtgttttgcgcgatatgc

SEQ ID NO: 189035 - DNA, 25 bp, E. coli
tataccaacaaacattccgtatcgt

SEQ ID NO: 189036 - DNA, 25 bp, E. coli
tataccaacaaagattccgtatcgt

SEQ ID NO: 189037 - DNA, 25 bp, E. coli
tatgcgcgatatccagcatttccgc

SEQ ID NO: 189038 - DNA, 25 bp, E. coli
tatgcgcgatatgcagcatttccgc

SEQ ID NO: 189039 - DNA, 25 bp, E. coli
tataggtctgacaccagaacagatc

SEQ ID NO: 189040 - DNA, 25 bp, E. coli
tataggtctgactccagaacagatc

SEQ ID NO: 189041 - DNA, 25 bp, E. coli
tcctctataccatcaaagattccgt

SEQ ID NO: 189042 - DNA, 25 bp, E. coli
tcctctataccaacaaagattccgt

SEQ ID NO: 189043 - DNA, 25 bp, E. coli
ttaaagaggttaaaggtctgacacc

SEQ ID NO: 189044 - DNA, 25 bp, E. coli
ttaaagaggttataggtctgacacc

SEQ ID NO: 189045 - DNA, 25 bp, E. coli
ccaacaaagattgcgtatcgttggg

SEQ ID NO: 189046 - DNA, 25 bp, E. coli
ccaacaaagattccgtatcgttggg

SEQ ID NO: 189047 - DNA, 25 bp, E. coli
gctggaacaaagttgtgttatgcgc

SEQ ID NO: 189048 - DNA, 25 bp, E. coli
gctggaacaaagatgtgttatgcgc

SEQ ID NO: 189049 - DNA, 25 bp, E. coli
cggcggattcctctataccaacaaa

SEQ ID NO: 189050 - DNA, 25 bp, E. coli
cggcggattcctgtataccaacaaa

SEQ ID NO: 189051 - DNA, 25 bp, E. coli
gggcgtacgcgtggatgcgctggtt

SEQ ID NO: 189052 - DNA, 25 bp, E. coli
gggcgtacgcgtcgatgcgctggtt

SEQ ID NO: 189053 - DNA, 25 bp, E. coli
aaccggtgaagactcggatacatta

SEQ ID NO: 189054 - DNA, 25 bp, E. coli
cattacgtaagattgtccttgagga

SEQ ID NO: 189055 - DNA, 25 bp, E. coli
aagtcctttgttcaccgatccttca

SEQ ID NO: 189056 - DNA, 25 bp, E. coli
aagtcctttgttgaccgatccttca

SEQ ID NO: 189057 - DNA, 25 bp, E. coli
aaccggtgaagagtcggatacatta

SEQ ID NO: 189058 - DNA, 25 bp, E. coli
tgtccttgaggattgtttgcccaat

SEQ ID NO: 189059 - DNA, 25 bp, E. coli
tgtccttgaggaatgtttgcccaat

SEQ ID NO: 189060 - DNA, 25 bp, E. coli
tgaaagtcctttgttgaccgatcct

SEQ ID NO: 189061 - DNA, 25 bp, E. coli
tgaaagtcctttcttgaccgatcct

SEQ ID NO: 189062 - DNA, 25 bp, E. coli
tcggatacattaggtaagattgtcc

SEQ ID NO: 189063 - DNA, 25 bp, E. coli
tcggatacattacgtaagattgtcc

SEQ ID NO: 189064 - DNA, 25 bp, E. coli
ccttgaggaatgattgcccaatcag

SEQ ID NO: 189065 - DNA, 25 bp, E. coli
ccttgaggaatgtttgcccaatcag

SEQ ID NO: 189066 - DNA, 25 bp, E. coli
gcaaaatcaaaatccttcgccatgt

SEQ ID NO: 189067 - DNA, 25 bp, E. coli
gaagagtcggatacattacgtaaga

SEQ ID NO: 189068 - DNA, 25 bp, E. coli
gaatgtttgccctatcagcagcaaa

SEQ ID NO: 189069 - DNA, 25 bp, E. coli
gaatgtttgcccaatcagcagcaaa

SEQ ID NO: 189070 - DNA, 25 bp, E. coli
gaagagtcggattcattacgtaaga

SEQ ID NO: 189071 - DNA, 25 bp, E. coli
gcaaaatcaaaaaccttcgccatgt

SEQ ID NO: 189072 - DNA, 25 bp, E. coli
cattacgtaagaatgtccttgagga

SEQ ID NO: 189073 - DNA, 25 bp, E. coli
ggaatgtttgccgaatcagcagcaa

SEQ ID NO: 189074 - DNA, 25 bp, E. coli
ggaatgtttgcccaatcagcagcaa

SEQ ID NO: 189075 - DNA, 25 bp, E. coli
taccggaaagtaacgcatcactcgt

SEQ ID NO: 189076 - DNA, 25 bp, E. coli
taccggaaagtatcgcatcactcgt

SEQ ID NO: 189077 - DNA, 25 bp, E. coli
tttggcaaaagccatcgcgcgttaa

SEQ ID NO: 189078 - DNA, 25 bp, E. coli
tttggcaaaagcgatcgcgcgttaa

SEQ ID NO: 189079 - DNA, 25 bp, E. coli
tttactcgcgcacacgattaacggt

SEQ ID NO: 189080 - DNA, 25 bp, E. coli
tattgcccatcgtgctttttatccg

SEQ ID NO: 189081 - DNA, 25 bp, E. coli
tattgcccatcgagctttttatccg

SEQ ID NO: 189082 - DNA, 25 bp, E. coli
tttactcgcgcagacgattaacggt

SEQ ID NO: 189083 - DNA, 25 bp, E. coli
tgcttctctggagtgcgattaatcg

SEQ ID NO: 189084 - DNA, 25 bp, E. coli
tgacgctctacctgataaaaccgct

SEQ ID NO: 189085 - DNA, 25 bp, E. coli
tgacgctctaccagataaaaccgct

SEQ ID NO: 189086 - DNA, 25 bp, E. coli
tgcttctctggactgcgattaatcg

SEQ ID NO: 189087 - DNA, 25 bp, E. coli
tcagtcgctgtttaggccgacgatg

SEQ ID NO: 189088 - DNA, 25 bp, E. coli
tcagtcgctgttaaggccgacgatg

SEQ ID NO: 189089 - DNA, 25 bp, E. coli
ccgacgatgtttaggctttataagc

SEQ ID NO: 189090 - DNA, 25 bp, E. coli
ccgacgatgttttggctttataagc

SEQ ID NO: 189091 - DNA, 25 bp, E. coli
gttacagcgaatcacatcactcttg

SEQ ID NO: 189092 - DNA, 25 bp, E. coli
gataaaaccgctgtttcagtcgctg

SEQ ID NO: 189093 - DNA, 25 bp, E. coli
gataaaaccgctctttcagtcgctg

SEQ ID NO: 189094 - DNA, 25 bp, E. coli
gttacagcgaatgacatcactcttg

SEQ ID NO: 189095 - DNA, 25 bp, E. coli
tcactcttgctggactggcgctttc

SEQ ID NO: 189096 - DNA, 25 bp, E. coli
tcactcttgctgcactggcgctttc

SEQ ID NO: 189097 - DNA, 25 bp, E. coli
agcgtggaccgcttgctgcaactct

SEQ ID NO: 189098 - DNA, 25 bp, E. coli
agcgtggaccgcatgctgcaactct

SEQ ID NO: 189099 - DNA, 25 bp, E. coli
agctgttgcccgactcactggtgaa

SEQ ID NO: 189100 - DNA, 25 bp, E. coli
agctgttgcccgtctcactggtgaa

SEQ ID NO: 189101 - DNA, 25 bp, E. coli
ttgctgcaactcactcagggccagg

SEQ ID NO: 189102 - DNA, 25 bp, E. coli
ttgctgcaactctctcagggccagg

SEQ ID NO: 189103 - DNA, 25 bp, E. coli
tgcccgtctcactggtgaaaagaaa

SEQ ID NO: 189104 - DNA, 25 bp, E. coli
tgcccgtctcacaggtgaaaagaaa

SEQ ID NO: 189105 - DNA, 25 bp, E. coli
tctcactggtgaaaagaaaaaccac

SEQ ID NO: 189106 - DNA, 25 bp, E. coli
tctcactggtgataagaaaaaccac

SEQ ID NO: 189107 - DNA, 25 bp, E. coli
gccgattcattaatgcagctggcac

SEQ ID NO: 189108 - DNA, 25 bp, E. coli
gccgattcattattgcagctggcac

SEQ ID NO: 189109 - DNA, 25 bp, E. coli
gcgcgttggccgattcattaatgca

SEQ ID NO: 189110 - DNA, 25 bp, E. coli
gcgcgttggccgtttcattaatgca

SEQ ID NO: 189111 - DNA, 25 bp, E. coli
gcaactctctcagggccaggcggtg

SEQ ID NO: 189112 - DNA, 25 bp, E. coli
gcaactctctcacggccaggcggtg

SEQ ID NO: 189113 - DNA, 25 bp, E. coli
cggtgaagggcaatcagctgttgcc

SEQ ID NO: 189114 - DNA, 25 bp, E. coli
cggtgaagggcattcagctgttgcc

SEQ ID NO: 189115 - DNA, 25 bp, E. coli
gtttcccgactggaaagcgggcagt

SEQ ID NO: 189116 - DNA, 25 bp, E. coli
gtttcccgactgcaaagcgggcagt

SEQ ID NO: 189117 - DNA, 25 bp, E. coli
ggcaaaccagcgaggaccgcttgct

SEQ ID NO: 189118 - DNA, 25 bp, E. coli
ggcaaaccagcgtggaccgcttgct

SEQ ID NO: 189119 - DNA, 25 bp, E. coli
tactgaacccgggtaggctgcttga

SEQ ID NO: 189120 - DNA, 25 bp, E. coli
tactgaacccggctaggctgcttga

SEQ ID NO: 189121 - DNA, 25 bp, E. coli
accgcgcggctgctaacagtccgtg

SEQ ID NO: 189122 - DNA, 25 bp, E. coli
accgcgcggctggtaacagtccgtg

SEQ ID NO: 189123 - DNA, 25 bp, E. coli
ttgctggcctagatgaatgactgtc

SEQ ID NO: 189124 - DNA, 25 bp, E. coli
ttgctggcctagttgaatgactgtc

SEQ ID NO: 189125 - DNA, 25 bp, E. coli
tgcttgagccagtgagcgattgctg

SEQ ID NO: 189126 - DNA, 25 bp, E. coli
tgcttgagccagagagcgattgctg

SEQ ID NO: 189127 - DNA, 25 bp, E. coli
tgactgtccacgacagaacccggct

SEQ ID NO: 189128 - DNA, 25 bp, E. coli
tgactgtccacgtcagaacccggct

SEQ ID NO: 189129 - DNA, 25 bp, E. coli
gaagctgaccagtcagtcgccgctt

SEQ ID NO: 189130 - DNA, 25 bp, E. coli
gaagctgaccagacagtcgccgctt

SEQ ID NO: 189131 - DNA, 25 bp, E. coli
ccacccggagcatggccaaataggg

SEQ ID NO: 189132 - DNA, 25 bp, E. coli
ctccatagggcagggtgccaggtaa

SEQ ID NO: 189133 - DNA, 25 bp, E. coli
ccacccggagcaaggccaaataggg

SEQ ID NO: 189134 - DNA, 25 bp, E. coli
ctccatagggcacggtgccaggtaa

SEQ ID NO: 189135 - DNA, 25 bp, E. coli
gtggcacggtaatctccacccggag

SEQ ID NO: 189136 - DNA, 25 bp, E. coli
gtgcaacagagagcaaaccgccgat

SEQ ID NO: 189137 - DNA, 25 bp, E. coli
gtggcacggtaaactccacccggag

SEQ ID NO: 189138 - DNA, 25 bp, E. coli
gtgcaacagagaccaaaccgccgat

SEQ ID NO: 189139 - DNA, 25 bp, E. coli
ggttcataaggtacggcccgtactg

SEQ ID NO: 189140 - DNA, 25 bp, E. coli
ggttcataaggttcggcccgtactg

SEQ ID NO: 189141 - DNA, 25 bp, E. coli
catgttagcgattattcccagccgt

SEQ ID NO: 189142 - DNA, 25 bp, E. coli
catgttagcgataattcccagccgt

SEQ ID NO: 189143 - DNA, 25 bp, E. coli
tacatgagtatatcagtcagggcct

SEQ ID NO: 189144 - DNA, 25 bp, E. coli
tacatgagtataacagtcagggcct

SEQ ID NO: 189145 - DNA, 25 bp, E. coli
aaaatttcagcgctctgcggcagag

SEQ ID NO: 189146 - DNA, 25 bp, E. coli
aaaatttcagcggtctgcggcagag

SEQ ID NO: 189147 - DNA, 25 bp, E. coli
ttgagtccattcttggcgcgctgga

SEQ ID NO: 189148 - DNA, 25 bp, E. coli
ttgagtccattcatggcgcgctgga

SEQ ID NO: 189149 - DNA, 25 bp, E. coli
tttattcgcaaacgccagggtgtca

SEQ ID NO: 189150 - DNA, 25 bp, E. coli
tttattcgcaaaggccagggtgtca

SEQ ID NO: 189151 - DNA, 25 bp, E. coli
taatttgccgcgagggaaatccact

SEQ ID NO: 189152 - DNA, 25 bp, E. coli
taatttgccgcgtgggaaatccact

SEQ ID NO: 189153 - DNA, 25 bp, E. coli
gaaactgcgcgttatattccctgac

SEQ ID NO: 189154 - DNA, 25 bp, E. coli
gacaatcgctgctctggttgccaac

SEQ ID NO: 189155 - DNA, 25 bp, E. coli
gacaatcgctgcactggttgccaac

SEQ ID NO: 189156 - DNA, 25 bp, E. coli
gaaactgcgcgtaatattccctgac

SEQ ID NO: 189157 - DNA, 25 bp, E. coli
cgctggatatcgaaggaagctatga

SEQ ID NO: 189158 - DNA, 25 bp, E. coli
cgctggatatcgtaggaagctatga

SEQ ID NO: 189159 - DNA, 25 bp, E. coli
ggtgtcactccttccgcatttgcga

SEQ ID NO: 189160 - DNA, 25 bp, E. coli
ggtgtcactcctaccgcatttgcga

SEQ ID NO: 189161 - DNA, 25 bp, E. coli
gatcccatcctggacggagtaatag

SEQ ID NO: 189162 - DNA, 25 bp, E. coli
gatcccatcctgcacggagtaatag

SEQ ID NO: 189163 - DNA, 25 bp, E. coli
caggtttacttcagacaccgtggcc

SEQ ID NO: 189164 - DNA, 25 bp, E. coli
caggtttacttctgacaccgtggcc

SEQ ID NO: 189165 - DNA, 25 bp, E. coli
tttacctgcaaagcgtgctcgggcg

SEQ ID NO: 189166 - DNA, 25 bp, E. coli
tttacctgcaaaccgtgctcgggcg

SEQ ID NO: 189167 - DNA, 25 bp, E. coli
tgcagcgttgatgagcgttaatacc

SEQ ID NO: 189168 - DNA, 25 bp, E. coli
tgcagcgttgatcagcgttaatacc

SEQ ID NO: 189169 - DNA, 25 bp, E. coli
tgaacgcgtacaagcaggattgctg

SEQ ID NO: 189170 - DNA, 25 bp, E. coli
tgaacgcgtacatgcaggattgctg

SEQ ID NO: 189171 - DNA, 25 bp, E. coli
tccacaacgtttactgggtagaggg

SEQ ID NO: 189172 - DNA, 25 bp, E. coli
tccacaacgttttctgggtagaggg

SEQ ID NO: 189173 - DNA, 25 bp, E. coli
tcatacaaggtttcggcggtgcagc

SEQ ID NO: 189174 - DNA, 25 bp, E. coli
tcatacaaggttacggcggtgcagc

SEQ ID NO: 189175 - DNA, 25 bp, E. coli
tgccaaaagttcaggccgacggcct

SEQ ID NO: 189176 - DNA, 25 bp, E. coli
ccatctgggtagtgaacgcctatca

SEQ ID NO: 189177 - DNA, 25 bp, E. coli
ccatctgggtagagaacgcctatca

SEQ ID NO: 189178 - DNA, 25 bp, E. coli
tgccaaaagttctggccgacggcct

SEQ ID NO: 189179 - DNA, 25 bp, E. coli
cgttagcaacgaaggtgatggctcc

SEQ ID NO: 189180 - DNA, 25 bp, E. coli
cgttagcaacgatggtgatggctcc

SEQ ID NO: 189181 - DNA, 25 bp, E. coli
ggcaggctatttcattgaacgcgta

SEQ ID NO: 189182 - DNA, 25 bp, E. coli
ggcaggctatttgattgaacgcgta

SEQ ID NO: 189183 - DNA, 25 bp, E. coli
gatgaacgcgtttaccttcggcctg

SEQ ID NO: 189184 - DNA, 25 bp, E. coli
gatgaacgcgttaaccttcggcctg

SEQ ID NO: 189185 - DNA, 25 bp, E. coli
cataagccagctagactgcgagcgt

SEQ ID NO: 189186 - DNA, 25 bp, E. coli
catttaaagtggtacgcgagctggg

SEQ ID NO: 189187 - DNA, 25 bp, E. coli
cataagccagcttgactgcgagcgt

SEQ ID NO: 189188 - DNA, 25 bp, E. coli
taacttcgggagtaggcacgctgat

SEQ ID NO: 189189 - DNA, 25 bp, E. coli
tgaccgatagtgaaccagtaccgtg

SEQ ID NO: 189190 - DNA, 25 bp, E. coli
tgaccgatagtgtaccagtaccgtg

SEQ ID NO: 189191 - DNA, 25 bp, E. coli
tgaaaggccaatgaaaccgggagat

SEQ ID NO: 189192 - DNA, 25 bp, E. coli
tgaaaggccaatcaaaccgggagat

SEQ ID NO: 189193 - DNA, 25 bp, E. coli
ccaagagttcatttcgacggcggtg

SEQ ID NO: 189194 - DNA, 25 bp, E. coli
ccaagagttcatatcgacggcggtg

SEQ ID NO: 189195 - DNA, 25 bp, E. coli
gaagggccatcgctcaacggataaa

SEQ ID NO: 189196 - DNA, 25 bp, E. coli
gaagggccatcggtcaacggataaa

SEQ ID NO: 189197 - DNA, 25 bp, E. coli
catttaaagtggaacgcgagctggg

SEQ ID NO: 189198 - DNA, 25 bp, E. coli
taatagctcactcgtcgagtcggcc

SEQ ID NO: 189199 - DNA, 25 bp, E. coli
taatagctcactggtcgagtcggcc

SEQ ID NO: 189200 - DNA, 25 bp, E. coli
taagcacgaaacttgccccgagatg

SEQ ID NO: 189201 - DNA, 25 bp, E. coli
taagcacgaaacatgccccgagatg

SEQ ID NO: 189202 - DNA, 25 bp, E. coli
taacttcgggagaaggcacgctgat

SEQ ID NO: 189203 - DNA, 25 bp, E. coli
taacactaactggaggaccgaaccg

SEQ ID NO: 189204 - DNA, 25 bp, E. coli
taacactaactgcaggaccgaaccg

SEQ ID NO: 189205 - DNA, 25 bp, E. coli
ggtaagttccgacctgcacgaatgg

SEQ ID NO: 189206 - DNA, 25 bp, E. coli
ggtaagttccgagctgcacgaatgg

SEQ ID NO: 189207 - DNA, 25 bp, E. coli
cactttgagcaccactaaccatgat

SEQ ID NO: 189208 - DNA, 25 bp, E. coli
cactttgagcacgactaaccatgat

SEQ ID NO: 189209 - DNA, 25 bp, E. coli
taccgataacagttacccgtaacat

SEQ ID NO: 189210 - DNA, 25 bp, E. coli
acaaatttgaagtagctcacactta

SEQ ID NO: 189211 - DNA, 25 bp, E. coli
acaaatttgaagaagctcacactta

SEQ ID NO: 189212 - DNA, 25 bp, E. coli
taccgataacagatacccgtaacat

SEQ ID NO: 189213 - DNA, 25 bp, E. coli
tgtccggctggacaatgttaccgat

SEQ ID NO: 189214 - DNA, 25 bp, E. coli
tgtccggctggagaatgttaccgat

SEQ ID NO: 189215 - DNA, 25 bp, E. coli
tgcttctgatatagtccggctggac

SEQ ID NO: 189216 - DNA, 25 bp, E. coli
tgcttctgatattgtccggctggac

SEQ ID NO: 189217 - DNA, 25 bp, E. coli
ccatgatcaccagatttacgtcttg

SEQ ID NO: 189218 - DNA, 25 bp, E. coli
ccatgatcaccacatttacgtcttg

SEQ ID NO: 189219 - DNA, 25 bp, E. coli
gtagctcacacttatacacttaagg

SEQ ID NO: 189220 - DNA, 25 bp, E. coli
gtagctcacactaatacacttaagg

SEQ ID NO: 189221 - DNA, 25 bp, E. coli
gggcaccactttgagcacgactaac

SEQ ID NO: 189222 - DNA, 25 bp, E. coli
gggcaccactttcagcacgactaac

SEQ ID NO: 189223 - DNA, 25 bp, E. coli
ggctggacaatgataccgataacag

SEQ ID NO: 189224 - DNA, 25 bp, E. coli
ggctggacaatgttaccgataacag

SEQ ID NO: 189225 - DNA, 25 bp, E. coli
taattcttgtatagtgggggcacca

SEQ ID NO: 189226 - DNA, 25 bp, E. coli
taattcttgtattgtgggggcacca

SEQ ID NO: 189227 - DNA, 25 bp, E. coli
gagcacgactaaccatgatcaccac

SEQ ID NO: 189228 - DNA, 25 bp, E. coli
gagcacgactaagcatgatcaccac

SEQ ID NO: 189229 - DNA, 25 bp, E. coli
aagaaatcctccaggtaactcacgc

SEQ ID NO: 189230 - DNA, 25 bp, E. coli
aagaaatcctcctggtaactcacgc

SEQ ID NO: 189231 - DNA, 25 bp, E. coli
cagccgcattgttgaatttatcgaa

SEQ ID NO: 189232 - DNA, 25 bp, E. coli
cagccgcattgtagaatttatcgaa

SEQ ID NO: 189233 - DNA, 25 bp, E. coli
catatgttgcctcccactaaggcga

SEQ ID NO: 189234 - DNA, 25 bp, E. coli
caggtgctggcaaaacgtatgccgg

SEQ ID NO: 189235 - DNA, 25 bp, E. coli
catatgttgcctgccactaaggcga

SEQ ID NO: 189236 - DNA, 25 bp, E. coli
caggtgctggcataacgtatgccgg

SEQ ID NO: 189237 - DNA, 25 bp, E. coli
tgtgcgcgacctgccattggtgaca

SEQ ID NO: 189238 - DNA, 25 bp, E. coli
tgtgcgcgacctcccattggtgaca

SEQ ID NO: 189239 - DNA, 25 bp, E. coli
tcgtcgacaagcgaatgattcagta

SEQ ID NO: 189240 - DNA, 25 bp, E. coli
tcgtcgacaagccaatgattcagta

SEQ ID NO: 189241 - DNA, 25 bp, E. coli
gcagggatcaaagaaatcctcctgg

SEQ ID NO: 189242 - DNA, 25 bp, E. coli
gcagggatcaaacaaatcctcctgg

SEQ ID NO: 189243 - DNA, 25 bp, E. coli
gaaaaccacttcgacacctcttatg

SEQ ID NO: 189244 - DNA, 25 bp, E. coli
gaaaaccacttccacacctcttatg

SEQ ID NO: 189245 - DNA, 25 bp, E. coli
cgagattgtggctgcagggatcaaa

SEQ ID NO: 189246 - DNA, 25 bp, E. coli
cgagattgtggcagcagggatcaaa

SEQ ID NO: 189247 - DNA, 25 bp, E. coli
cgctggactcagacatcatggccgt

SEQ ID NO: 189248 - DNA, 25 bp, E. coli
cgctggactcagtcatcatggccgt

SEQ ID NO: 189249 - DNA, 25 bp, E. coli
ggatcagccgcagacgctggactca

SEQ ID NO: 189250 - DNA, 25 bp, E. coli
ggatcagccgcacacgctggactca

SEQ ID NO: 189251 - DNA, 25 bp, E. coli
cagtagctgaactggagggacagct

SEQ ID NO: 189252 - DNA, 25 bp, E. coli
cagtagctgaacaggagggacagct

SEQ ID NO: 189253 - DNA, 25 bp, E. coli
acaggagggacagctgatagaaaca

SEQ ID NO: 189254 - DNA, 25 bp, E. coli
acaggagggacacctgatagaaaca

SEQ ID NO: 189255 - DNA, 25 bp, E. coli
tagctgaacaggagggacagctgat

SEQ ID NO: 189256 - DNA, 25 bp, E. coli
tagctgaacaggtgggacagctgat

SEQ ID NO: 189257 - DNA, 25 bp, E. coli
tgaacaggagggacagctgatagaa

SEQ ID NO: 189258 - DNA, 25 bp, E. coli
tgaacaggagggtcagctgatagaa

SEQ ID NO: 189259 - DNA, 25 bp, E. coli
ccaccccgtcagaagctgaacagga

SEQ ID NO: 189260 - DNA, 25 bp, E. coli
ccaccccgtcagtagctgaacagga

SEQ ID NO: 189261 - DNA, 25 bp, E. coli
gtaccgggttgacaagcggtgtaag

SEQ ID NO: 189262 - DNA, 25 bp, E. coli
gtaccgggttgagaagcggtgtaag

SEQ ID NO: 189263 - DNA, 25 bp, E. coli
gacagctgatagaaacagaagccac

SEQ ID NO: 189264 - DNA, 25 bp, E. coli
gacagctgatagtaacagaagccac

SEQ ID NO: 189265 - DNA, 25 bp, E. coli
cccgtcagtagctgaacaggaggga

SEQ ID NO: 189266 - DNA, 25 bp, E. coli
cccgtcagtagcagaacaggaggga

SEQ ID NO: 189267 - DNA, 25 bp, E. coli
cgtcagtagctgaacaggagggaca

SEQ ID NO: 189268 - DNA, 25 bp, E. coli
cgtcagtagctgtacaggagggaca

SEQ ID NO: 189269 - DNA, 25 bp, E. coli
ggagggacagctgatagaaacagaa

SEQ ID NO: 189270 - DNA, 25 bp, E. coli
gggacagctgattgaaacagaagcc

SEQ ID NO: 189271 - DNA, 25 bp, E. coli
gggacagctgatagaaacagaagcc

SEQ ID NO: 189272 - DNA, 25 bp, E. coli
ggagggacagctcatagaaacagaa

SEQ ID NO: 189273 - DNA, 25 bp, E. coli
tacctgggctggctttggctttgca

SEQ ID NO: 189274 - DNA, 25 bp, E. coli
tacctgggctgggtttggctttgca

SEQ ID NO: 189275 - DNA, 25 bp, E. coli
aaactgccgttcgacctggcggaag

SEQ ID NO: 189276 - DNA, 25 bp, E. coli
aaactgccgttccacctggcggaag

SEQ ID NO: 189277 - DNA, 25 bp, E. coli
tatcgcgacattatcaaactgctgg

SEQ ID NO: 189278 - DNA, 25 bp, E. coli
tatcgcgacattttcaaactgctgg

SEQ ID NO: 189279 - DNA, 25 bp, E. coli
tattactccgcgcattacctgggct

SEQ ID NO: 189280 - DNA, 25 bp, E. coli
tattactccgcggattacctgggct

SEQ ID NO: 189281 - DNA, 25 bp, E. coli
ttatatccgttaattcaggcgctgg

SEQ ID NO: 189282 - DNA, 25 bp, E. coli
ttatatccgttatttcaggcgctgg

SEQ ID NO: 189283 - DNA, 25 bp, E. coli
tgttccgcctgacgccgtatgtgat

SEQ ID NO: 189284 - DNA, 25 bp, E. coli
tgttcgaaaacagcatggcccgtct

SEQ ID NO: 189285 - DNA, 25 bp, E. coli
tgttccgcctgaggccgtatgtgat

SEQ ID NO: 189286 - DNA, 25 bp, E. coli
tgttcgaaaacaccatggcccgtct

SEQ ID NO: 189287 - DNA, 25 bp, E. coli
gccatttctggtctggataccggta

SEQ ID NO: 189288 - DNA, 25 bp, E. coli
gccatttctggtgtggataccggta

SEQ ID NO: 189289 - DNA, 25 bp, E. coli
cggcagcggcttaggcgtcatgaaa

SEQ ID NO: 189290 - DNA, 25 bp, E. coli
cggcagcggctttggcgtcatgaaa

SEQ ID NO: 189291 - DNA, 25 bp, E. coli
gttcgtctccttgctggcggcgtga

SEQ ID NO: 189292 - DNA, 25 bp, E. coli
gttcgtctccttcctggcggcgtga

SEQ ID NO: 189293 - DNA, 25 bp, E. coli
tggcccgtctgcctcttgatattac

SEQ ID NO: 189294 - DNA, 25 bp, E. coli
tggcccgtctgcgtcttgatattac

SEQ ID NO: 189295 - DNA, 25 bp, E. coli
aactggcgagttcactgctatacgg

SEQ ID NO: 189296 - DNA, 25 bp, E. coli
cagcgatttggcaacgtcgtcagct

SEQ ID NO: 189297 - DNA, 25 bp, E. coli
cagcgatttggctacgtcgtcagct

SEQ ID NO: 189298 - DNA, 25 bp, E. coli
atctgggacgccgatcgcaaaggcc

SEQ ID NO: 189299 - DNA, 25 bp, E. coli
acctggaaccactggctcaacgggc

SEQ ID NO: 189300 - DNA, 25 bp, E. coli
atctgggacgcccatcgcaaaggcc

SEQ ID NO: 189301 - DNA, 25 bp, E. coli
acctggaaccacaggctcaacgggc

SEQ ID NO: 189302 - DNA, 25 bp, E. coli
aactggcgagttgactgctatacgg

SEQ ID NO: 189303 - DNA, 25 bp, E. coli
tgggacgcccatggcaaaggccatg

SEQ ID NO: 189304 - DNA, 25 bp, E. coli
tgggacgcccatcgcaaaggccatg

SEQ ID NO: 189305 - DNA, 25 bp, E. coli
tgaatacctggaaccactggctcaa

SEQ ID NO: 189306 - DNA, 25 bp, E. coli
tgaatacctggatccactggctcaa

SEQ ID NO: 189307 - DNA, 25 bp, E. coli
tcacctgccgccagtgaatacctgg

SEQ ID NO: 189308 - DNA, 25 bp, E. coli
cattgctatcacctgccgccagtga

SEQ ID NO: 189309 - DNA, 25 bp, E. coli
cattgctatcacgtgccgccagtga

SEQ ID NO: 189310 - DNA, 25 bp, E. coli
gatttggcaacgacgtcagcttcta

SEQ ID NO: 189311 - DNA, 25 bp, E. coli
gatttggcaacgtcgtcagcttcta

SEQ ID NO: 189312 - DNA, 25 bp, E. coli
tggcattgctatcacctgccgccag

SEQ ID NO: 189313 - DNA, 25 bp, E. coli
tggcattgctatgacctgccgccag

SEQ ID NO: 189314 - DNA, 25 bp, E. coli
tcacctgccgcctgtgaatacctgg

SEQ ID NO: 189315 - DNA, 25 bp, E. coli
gagttgactgctatacggttgccga

SEQ ID NO: 189316 - DNA, 25 bp, E. coli
gagttgactgctttacggttgccga

SEQ ID NO: 189317 - DNA, 25 bp, E. coli
cagtcgcagtttccgacaggtaagg

SEQ ID NO: 189318 - DNA, 25 bp, E. coli
cagtcgcagtttgcgacaggtaagg

SEQ ID NO: 189319 - DNA, 25 bp, E. coli
tacgccagcctgcaataaagcttcc

SEQ ID NO: 189320 - DNA, 25 bp, E. coli
tagggttattattacgccagcctgg

SEQ ID NO: 189321 - DNA, 25 bp, E. coli
tatcctagctgaagcgtttcagtcg

SEQ ID NO: 189322 - DNA, 25 bp, E. coli
tacgccagcctggaataaagcttcc

SEQ ID NO: 189323 - DNA, 25 bp, E. coli
tagggttattataacgccagcctgg

SEQ ID NO: 189324 - DNA, 25 bp, E. coli
tatcctagctgatgcgtttcagtcg

SEQ ID NO: 189325 - DNA, 25 bp, E. coli
tattccacgtttggcttatcctagc

SEQ ID NO: 189326 - DNA, 25 bp, E. coli
tattccacgtttcgcttatcctagc

SEQ ID NO: 189327 - DNA, 25 bp, E. coli
tcttcggctggacaaacattccttt

SEQ ID NO: 189328 - DNA, 25 bp, E. coli
tcttcggctggagaaacattccttt

SEQ ID NO: 189329 - DNA, 25 bp, E. coli
gcgtttcagtcgattaaatgttcga

SEQ ID NO: 189330 - DNA, 25 bp, E. coli
gcgtttcagtcgtttaaatgttcga

SEQ ID NO: 189331 - DNA, 25 bp, E. coli
gacaattaaccaatcagtcgcagtt

SEQ ID NO: 189332 - DNA, 25 bp, E. coli
gacaattaaccattcagtcgcagtt

SEQ ID NO: 189333 - DNA, 25 bp, E. coli
gataaaagtgtgatgtgagtcagat

SEQ ID NO: 189334 - DNA, 25 bp, E. coli
gataaaagtgtgttgtgagtcagat

SEQ ID NO: 189335 - DNA, 25 bp, E. coli
tggaataaagcttcccacaaaaggg

SEQ ID NO: 189336 - DNA, 25 bp, E. coli
tggaataaagctacccacaaaaggg

SEQ ID NO: 189337 - DNA, 25 bp, E. coli
gagtcagataaatgtcttcttcggc

SEQ ID NO: 189338 - DNA, 25 bp, E. coli
gagtcagataaaagtcttcttcggc

SEQ ID NO: 189339 - DNA, 25 bp, E. coli
atacagatggcggactcatcaccgg

SEQ ID NO: 189340 - DNA, 25 bp, E. coli
atacagatggcgcactcatcaccgg

SEQ ID NO: 189341 - DNA, 25 bp, E. coli
ttcccggatacagatggcgcactca

SEQ ID NO: 189342 - DNA, 25 bp, E. coli
ttcccggatacacatggcgcactca

SEQ ID NO: 189343 - DNA, 25 bp, E. coli
tggttcccggattcagatggcgcac

SEQ ID NO: 189344 - DNA, 25 bp, E. coli
tcccggatacagatggcgcactcat

SEQ ID NO: 189345 - DNA, 25 bp, E. coli
tcccggatacagttggcgcactcat

SEQ ID NO: 189346 - DNA, 25 bp, E. coli
ccggatacagatggcgcactcatca

SEQ ID NO: 189347 - DNA, 25 bp, E. coli
ccggatacagatcgcgcactcatca

SEQ ID NO: 189348 - DNA, 25 bp, E. coli
cccggatacagatggcgcactcatc

SEQ ID NO: 189349 - DNA, 25 bp, E. coli
cccggatacagaaggcgcactcatc

SEQ ID NO: 189350 - DNA, 25 bp, E. coli
cggatacagatggcgcactcatcac

SEQ ID NO: 189351 - DNA, 25 bp, E. coli
cggatacagatgccgcactcatcac

SEQ ID NO: 189352 - DNA, 25 bp, E. coli
gttcccggatactgatggcgcactc

SEQ ID NO: 189353 - DNA, 25 bp, E. coli
gttcccggatacagatggcgcactc

SEQ ID NO: 189354 - DNA, 25 bp, E. coli
gatacagatggcccactcatcaccg

SEQ ID NO: 189355 - DNA, 25 bp, E. coli
gatacagatggcgcactcatcaccg

SEQ ID NO: 189356 - DNA, 25 bp, E. coli
ggatacagatggcgcactcatcacc

SEQ ID NO: 189357 - DNA, 25 bp, E. coli
ggttcccggatacagatggcgcact

SEQ ID NO: 189358 - DNA, 25 bp, E. coli
ggttcccggatagagatggcgcact

SEQ ID NO: 189359 - DNA, 25 bp, E. coli
ggatacagatggggcactcatcacc

SEQ ID NO: 189360 - DNA, 25 bp, E. coli
tggttcccggatacagatggcgcac

SEQ ID NO: 189361 - DNA, 25 bp, E. coli
caagcacttcccgaggataaattga

SEQ ID NO: 189362 - DNA, 25 bp, E. coli
caagcacttccccaggataaattga

SEQ ID NO: 189363 - DNA, 25 bp, E. coli
cagttaatgaccatgatttcgtcct

SEQ ID NO: 189364 - DNA, 25 bp, E. coli
cagttaatgaccttgatttcgtcct

SEQ ID NO: 189365 - DNA, 25 bp, E. coli
agttaatgaccaagatttcgtcctt

SEQ ID NO: 189366 - DNA, 25 bp, E. coli
acgaacacaagctcttcccgaggat

SEQ ID NO: 189367 - DNA, 25 bp, E. coli
agttaatgaccatgatttcgtcctt

SEQ ID NO: 189368 - DNA, 25 bp, E. coli
acgaacacaagcacttcccgaggat

SEQ ID NO: 189369 - DNA, 25 bp, E. coli
aacacaagcacttcccgaggataaa

SEQ ID NO: 189370 - DNA, 25 bp, E. coli
aacacaagcactacccgaggataaa

SEQ ID NO: 189371 - DNA, 25 bp, E. coli
acacaagcacttcccgaggataaat

SEQ ID NO: 189372 - DNA, 25 bp, E. coli
acacaagcacttgccgaggataaat

SEQ ID NO: 189373 - DNA, 25 bp, E. coli
gcagttaatgaccatgatttcgtcc

SEQ ID NO: 189374 - DNA, 25 bp, E. coli
gcagttaatgacgatgatttcgtcc

SEQ ID NO: 189375 - DNA, 25 bp, E. coli
taatgaccatgatttcgtccttttt

SEQ ID NO: 189376 - DNA, 25 bp, E. coli
taatgaccatgaattcgtccttttt

SEQ ID NO: 189377 - DNA, 25 bp, E. coli
gaacacaagcacttcccgaggataa

SEQ ID NO: 189378 - DNA, 25 bp, E. coli
gaacacaagcacatcccgaggataa

SEQ ID NO: 189379 - DNA, 25 bp, E. coli
cgaacacaagcacttcccgaggata

SEQ ID NO: 189380 - DNA, 25 bp, E. coli
cgaacacaagcagttcccgaggata

SEQ ID NO: 189381 - DNA, 25 bp, E. coli
gttaatgaccatcatttcgtccttt

SEQ ID NO: 189382 - DNA, 25 bp, E. coli
gttaatgaccatgatttcgtccttt

SEQ ID NO: 189383 - DNA, 25 bp, E. coli
caggtatgcgcgtgacactttccca

SEQ ID NO: 189384 - DNA, 25 bp, E. coli
caggtatgcgcgagacactttccca

SEQ ID NO: 189385 - DNA, 25 bp, E. coli
aacattggtccgcatacccgtagga

SEQ ID NO: 189386 - DNA, 25 bp, E. coli
aaatccgcaggtagtgatcgatagc

SEQ ID NO: 189387 - DNA, 25 bp, E. coli
aacattggtccggatacccgtagga

SEQ ID NO: 189388 - DNA, 25 bp, E. coli
aaatccgcaggttgtgatcgatagc

SEQ ID NO: 189389 - DNA, 25 bp, E. coli
tatccaatgcgcacttgaaactggt

SEQ ID NO: 189390 - DNA, 25 bp, E. coli
tatccaatgcgctcttgaaactggt

SEQ ID NO: 189391 - DNA, 25 bp, E. coli
tatatgagggattcatttccagccg

SEQ ID NO: 189392 - DNA, 25 bp, E. coli
tatatgagggatacatttccagccg

SEQ ID NO: 189393 - DNA, 25 bp, E. coli
ttaatcatgcagtatcgcggagggc

SEQ ID NO: 189394 - DNA, 25 bp, E. coli
ttaatcatgcagaatcgcggagggc

SEQ ID NO: 189395 - DNA, 25 bp, E. coli
gataccgaaatgcaaagctttgcag

SEQ ID NO: 189396 - DNA, 25 bp, E. coli
gataccgaaatggaaagctttgcag

SEQ ID NO: 189397 - DNA, 25 bp, E. coli
gggcaagcagtcatcgagcggatat

SEQ ID NO: 189398 - DNA, 25 bp, E. coli
gggcaagcagtcttcgagcggatat

SEQ ID NO: 189399 - DNA, 25 bp, E. coli
ggctcgttactggaaaaggctcaaa

SEQ ID NO: 189400 - DNA, 25 bp, E. coli
ggctcgttactgcaaaaggctcaaa

SEQ ID NO: 189401 - DNA, 25 bp, E. coli
taacagtgaatctcggcacctcaac

SEQ ID NO: 189402 - DNA, 25 bp, E. coli
taacagtgaatcacggcacctcaac

SEQ ID NO: 189403 - DNA, 25 bp, E. coli
gagcgaatcgttccagcctatggat

SEQ ID NO: 189404 - DNA, 25 bp, E. coli
gagcgaatcgttgcagcctatggat

SEQ ID NO: 189405 - DNA, 25 bp, E. coli
atggcgtcgcatccgacaaccgatg

SEQ ID NO: 189406 - DNA, 25 bp, E. coli
atggcgtcgcatgcgacaaccgatg

SEQ ID NO: 189407 - DNA, 25 bp, E. coli
aaacgcccgttgtttgtattcgaca

SEQ ID NO: 189408 - DNA, 25 bp, E. coli
aaatgataacaatgacgaggacaac

SEQ ID NO: 189409 - DNA, 25 bp, E. coli
aaacgcccgttgattgtattcgaca

SEQ ID NO: 189410 - DNA, 25 bp, E. coli
aaatgataacaaagacgaggacaac

SEQ ID NO: 189411 - DNA, 25 bp, E. coli
tacgaggtgcacagaactgtaggtc

SEQ ID NO: 189412 - DNA, 25 bp, E. coli
tacgaggtgcactgaactgtaggtc

SEQ ID NO: 189413 - DNA, 25 bp, E. coli
tcaggcctacgacgtgcactgaact

SEQ ID NO: 189414 - DNA, 25 bp, E. coli
tcaggcctacgaggtgcactgaact

SEQ ID NO: 189415 - DNA, 25 bp, E. coli
gcgtcgcatccgtcaacaatctcga

SEQ ID NO: 189416 - DNA, 25 bp, E. coli
gcgtcgcatccgacaacaatctcga

SEQ ID NO: 189417 - DNA, 25 bp, E. coli
gacaacaatctcgaccctacaaatg

SEQ ID NO: 189418 - DNA, 25 bp, E. coli
gacaacaatctccaccctacaaatg

SEQ ID NO: 189419 - DNA, 25 bp, E. coli
cggataagacggatggcgtcgcatc

SEQ ID NO: 189420 - DNA, 25 bp, E. coli
cggataagacggttggcgtcgcatc

SEQ ID NO: 189421 - DNA, 25 bp, E. coli
gattgtattcgacagccgatgcctg

SEQ ID NO: 189422 - DNA, 25 bp, E. coli
gattgtattcgagagccgatgcctg

SEQ ID NO: 189423 - DNA, 25 bp, E. coli
gatgcgccgctgacgtgacttatca

SEQ ID NO: 189424 - DNA, 25 bp, E. coli
gatgcgccgctgtcgtgacttatca

SEQ ID NO: 189425 - DNA, 25 bp, E. coli
gaccctacaaatcataacaatgacg

SEQ ID NO: 189426 - DNA, 25 bp, E. coli
gaccctacaaatgataacaatgacg

SEQ ID NO: 189427 - DNA, 25 bp, E. coli
aattcctgcttattgtatttcttca

SEQ ID NO: 189428 - DNA, 25 bp, E. coli
aattcctgcttaatgtatttcttca

SEQ ID NO: 189429 - DNA, 25 bp, E. coli
cagttatatctcctccgatgacggt

SEQ ID NO: 189430 - DNA, 25 bp, E. coli
cagttatatctcgtccgatgacggt

SEQ ID NO: 189431 - DNA, 25 bp, E. coli
tacctggacaggacgttaatcagaa

SEQ ID NO: 189432 - DNA, 25 bp, E. coli
tacctggacaggtcgttaatcagaa

SEQ ID NO: 189433 - DNA, 25 bp, E. coli
tatctcctccgatgacggtaatcgg

SEQ ID NO: 189434 - DNA, 25 bp, E. coli
tatctcctccgaagacggtaatcgg

SEQ ID NO: 189435 - DNA, 25 bp, E. coli
tatttcttcatagtacctggacagg

SEQ ID NO: 189436 - DNA, 25 bp, E. coli
tatttcttcatactacctggacagg

SEQ ID NO: 189437 - DNA, 25 bp, E. coli
tgcacgaaaccactgcaacagctgt

SEQ ID NO: 189438 - DNA, 25 bp, E. coli
tgcacgaaaccagtgcaacagctgt

SEQ ID NO: 189439 - DNA, 25 bp, E. coli
gaattgcgagccagtaccacaccct

SEQ ID NO: 189440 - DNA, 25 bp, E. coli
gaattgcgagcctgtaccacaccct

SEQ ID NO: 189441 - DNA, 25 bp, E. coli
cgttaatcagaaatgcgagcctgta

SEQ ID NO: 189442 - DNA, 25 bp, E. coli
cgttaatcagaattgcgagcctgta

SEQ ID NO: 189443 - DNA, 25 bp, E. coli
gggagataatattaattcctgctta

SEQ ID NO: 189444 - DNA, 25 bp, E. coli
gggagataatataaattcctgctta

SEQ ID NO: 189445 - DNA, 25 bp, E. coli
ggacaggtcgttaatcagaattgcg

SEQ ID NO: 189446 - DNA, 25 bp, E. coli
ggacaggtcgtttatcagaattgcg

SEQ ID NO: 189447 - DNA, 25 bp, E. coli
tcagaattgcgaccctgtaccacac

SEQ ID NO: 189448 - DNA, 25 bp, E. coli
tcagaattgcgagcctgtaccacac

SEQ ID NO: 189449 - DNA, 25 bp, E. coli
cacatgccgcagcaagataaatcct

SEQ ID NO: 189450 - DNA, 25 bp, E. coli
cacatgccgcaggaagataaatcct

SEQ ID NO: 189451 - DNA, 25 bp, E. coli
tatagctgggttcgctttcgtaagg

SEQ ID NO: 189452 - DNA, 25 bp, E. coli
tatggtcgaagcagaatctggcctg

SEQ ID NO: 189453 - DNA, 25 bp, E. coli
tatgacatctatgcggctactgcgg

SEQ ID NO: 189454 - DNA, 25 bp, E. coli
tatggtcgaagctgaatctggcctg

SEQ ID NO: 189455 - DNA, 25 bp, E. coli
tatgacatctatccggctactgcgg

SEQ ID NO: 189456 - DNA, 25 bp, E. coli
tatagctgggttggctttcgtaagg

SEQ ID NO: 189457 - DNA, 25 bp, E. coli
tatctatatctaccgccacatgccg

SEQ ID NO: 189458 - DNA, 25 bp, E. coli
tatctatatctagcgccacatgccg

SEQ ID NO: 189459 - DNA, 25 bp, E. coli
ttctggctgccgcaaaatatttggg

SEQ ID NO: 189460 - DNA, 25 bp, E. coli
ttctggctgccggaaaatatttggg

SEQ ID NO: 189461 - DNA, 25 bp, E. coli
ttcgtaaggttgtgaagatggccct

SEQ ID NO: 189462 - DNA, 25 bp, E. coli
ttcgtaaggttgagaagatggccct

SEQ ID NO: 189463 - DNA, 25 bp, E. coli
gccctgttagtcagccaatgggtga

SEQ ID NO: 189464 - DNA, 25 bp, E. coli
gccctgttagtctgccaatgggtga

SEQ ID NO: 189465 - DNA, 25 bp, E. coli
ggcaaacatctacatcgcattctgg

SEQ ID NO: 189466 - DNA, 25 bp, E. coli
ggcaaacatctagatcgcattctgg

SEQ ID NO: 189467 - DNA, 25 bp, E. coli
tcagcggatgctcggtaaagaactc

SEQ ID NO: 189468 - DNA, 25 bp, E. coli
tcagcggatgctgggtaaagaactc

SEQ ID NO: 189469 - DNA, 25 bp, E. coli
gatggccctgatgacttttgttctg

SEQ ID NO: 189470 - DNA, 25 bp, E. coli
gatggccctgatcacttttgttctg

SEQ ID NO: 189471 - DNA, 25 bp, E. coli
aaagttgaaaatgcgtcgccagcat

SEQ ID NO: 189472 - DNA, 25 bp, E. coli
aaagttgaaaatccgtcgccagcat

SEQ ID NO: 189473 - DNA, 25 bp, E. coli
tattgaaccgcacgaaattgacagc

SEQ ID NO: 189474 - DNA, 25 bp, E. coli
tattgaaccgcaggaaattgacagc

SEQ ID NO: 189475 - DNA, 25 bp, E. coli
ttttcgtcatgaccagtcggcaggc

SEQ ID NO: 189476 - DNA, 25 bp, E. coli
ttttcgtcatgagcagtcggcaggc

SEQ ID NO: 189477 - DNA, 25 bp, E. coli
gaacttcgtcatgctttaaccaccg

SEQ ID NO: 189478 - DNA, 25 bp, E. coli
gaacttcgtcatcctttaaccaccg

SEQ ID NO: 189479 - DNA, 25 bp, E. coli
cattattgccatgcccgaagtcagt

SEQ ID NO: 189480 - DNA, 25 bp, E. coli
cattattgccatccccgaagtcagt

SEQ ID NO: 189481 - DNA, 25 bp, E. coli
gatatgtataaaccacgtcgtcgtc

SEQ ID NO: 189482 - DNA, 25 bp, E. coli
gatcttggcattccattggcacgcg

SEQ ID NO: 189483 - DNA, 25 bp, E. coli
gatatgtataaagcacgtcgtcgtc

SEQ ID NO: 189484 - DNA, 25 bp, E. coli
taatggcggcatctacagaggagac

SEQ ID NO: 189485 - DNA, 25 bp, E. coli
taatggcggcatgtacagaggagac

SEQ ID NO: 189486 - DNA, 25 bp, E. coli
gatgggcggcagttacacagtttat

SEQ ID NO: 189487 - DNA, 25 bp, E. coli
gatcttggcattgcattggcacgcg

SEQ ID NO: 189488 - DNA, 25 bp, E. coli
gagctggaccaaatgaatgcggcaa

SEQ ID NO: 189489 - DNA, 25 bp, E. coli
gatgggcggcagatacacagtttat

SEQ ID NO: 189490 - DNA, 25 bp, E. coli
gatgatcatgataagcggctccagc

SEQ ID NO: 189491 - DNA, 25 bp, E. coli
gagctggaccaattgaatgcggcaa

SEQ ID NO: 189492 - DNA, 25 bp, E. coli
gatgatcatgattagcggctccagc

SEQ ID NO: 189493 - DNA, 25 bp, E. coli
atcggttcagatcgtttacggcaac

SEQ ID NO: 189494 - DNA, 25 bp, E. coli
acgccaatgttgaagccgttgaatt

SEQ ID NO: 189495 - DNA, 25 bp, E. coli
atcggttcagatggtttacggcaac

SEQ ID NO: 189496 - DNA, 25 bp, E. coli
acgccaatgttgtagccgttgaatt

SEQ ID NO: 189497 - DNA, 25 bp, E. coli
aaaatgagtggctgattgccgtgga

SEQ ID NO: 189498 - DNA, 25 bp, E. coli
aaaatgagtggcagattgccgtgga

SEQ ID NO: 189499 - DNA, 25 bp, E. coli
ttgtctggaaactactggcaacgac

SEQ ID NO: 189500 - DNA, 25 bp, E. coli
ttcagatggtttacggcaacgccaa

SEQ ID NO: 189501 - DNA, 25 bp, E. coli
ttgtctggaaacaactggcaacgac

SEQ ID NO: 189502 - DNA, 25 bp, E. coli
ttcagatggttttcggcaacgccaa

SEQ ID NO: 189503 - DNA, 25 bp, E. coli
tgaaaacgccggagacatcgtagca

SEQ ID NO: 189504 - DNA, 25 bp, E. coli
tgaaaacgccggtgacatcgtagca

SEQ ID NO: 189505 - DNA, 25 bp, E. coli
gcccggtgaaaacgccggagacatc

SEQ ID NO: 189506 - DNA, 25 bp, E. coli
gcccggtgaaaaggccggagacatc

SEQ ID NO: 189507 - DNA, 25 bp, E. coli
gcaaacctgcgttgtctggaaacaa

SEQ ID NO: 189508 - DNA, 25 bp, E. coli
gcaaacctgcgtagtctggaaacaa

SEQ ID NO: 189509 - DNA, 25 bp, E. coli
cgtagcaaagctcgaaaaattagta

SEQ ID NO: 189510 - DNA, 25 bp, E. coli
ctggcaacgacagaggaggatttct

SEQ ID NO: 189511 - DNA, 25 bp, E. coli
ctggcaacgacacaggaggatttct

SEQ ID NO: 189512 - DNA, 25 bp, E. coli
cgtagcaaagctggaaaaattagta

SEQ ID NO: 189513 - DNA, 25 bp, E. coli
cggagacatcgtagcaaagctggaa

SEQ ID NO: 189514 - DNA, 25 bp, E. coli
cggagacatcgttgcaaagctggaa

SEQ ID NO: 189515 - DNA, 25 bp, E. coli
tacaggtgtggtcaataagactgca

SEQ ID NO: 189516 - DNA, 25 bp, E. coli
tacaggtgtggtgaataagactgca

SEQ ID NO: 189517 - DNA, 25 bp, E. coli
agctcatgccgtggtgaatgctgca

SEQ ID NO: 189518 - DNA, 25 bp, E. coli
agctcatgccgtcgtgaatgctgca

SEQ ID NO: 189519 - DNA, 25 bp, E. coli
tatcccctggcactgttacatgtaa

SEQ ID NO: 189520 - DNA, 25 bp, E. coli
tatcccctggcagtgttacatgtaa

SEQ ID NO: 189521 - DNA, 25 bp, E. coli
tataagagacaggttacaggtgtgg

SEQ ID NO: 189522 - DNA, 25 bp, E. coli
tataagagacagcttacaggtgtgg

SEQ ID NO: 189523 - DNA, 25 bp, E. coli
tggtacagggaattaacgcccgtgc

SEQ ID NO: 189524 - DNA, 25 bp, E. coli
tggtacagggaaataacgcccgtgc

SEQ ID NO: 189525 - DNA, 25 bp, E. coli
tgaatgctgcacaggcggtggtaca

SEQ ID NO: 189526 - DNA, 25 bp, E. coli
tgaatgctgcactggcggtggtaca

SEQ ID NO: 189527 - DNA, 25 bp, E. coli
tgccgcaggtgcagccactggagac

SEQ ID NO: 189528 - DNA, 25 bp, E. coli
tgccgcaggtgctgccactggagac

SEQ ID NO: 189529 - DNA, 25 bp, E. coli
gactgcaaatgtcgcagctcatgcc

SEQ ID NO: 189530 - DNA, 25 bp, E. coli
gactgcaaatgtggcagctcatgcc

SEQ ID NO: 189531 - DNA, 25 bp, E. coli
taacgcccgtgccagtgccgcaggt

SEQ ID NO: 189532 - DNA, 25 bp, E. coli
taacgcccgtgcgagtgccgcaggt

SEQ ID NO: 189533 - DNA, 25 bp, E. coli
gatgatagccacagagatgtgcgga

SEQ ID NO: 189534 - DNA, 25 bp, E. coli
gagatgtgcggaatatcccctggca

SEQ ID NO: 189535 - DNA, 25 bp, E. coli
gagatgtgcggattatcccctggca

SEQ ID NO: 189536 - DNA, 25 bp, E. coli
gatgatagccactgagatgtgcgga

SEQ ID NO: 189537 - DNA, 25 bp, E. coli
cagccaaaaatatgagatcgatgcc

SEQ ID NO: 189538 - DNA, 25 bp, E. coli
cagccaaaaataagagatcgatgcc

SEQ ID NO: 189539 - DNA, 25 bp, E. coli
atgaaaaagtcaccgcgcaggaatt

SEQ ID NO: 189540 - DNA, 25 bp, E. coli
atcaaaccttatacccctgcctggg

SEQ ID NO: 189541 - DNA, 25 bp, E. coli
atgaaaaagtcagcgcgcaggaatt

SEQ ID NO: 189542 - DNA, 25 bp, E. coli
atcaaaccttattcccctgcctggg

SEQ ID NO: 189543 - DNA, 25 bp, E. coli
acaagtacgtggacgcggcggcttt

SEQ ID NO: 189544 - DNA, 25 bp, E. coli
acaagtacgtggtcgcggcggcttt

SEQ ID NO: 189545 - DNA, 25 bp, E. coli
taccgcaggtgaactggtggtgcct

SEQ ID NO: 189546 - DNA, 25 bp, E. coli
taccgcaggtgatctggtggtgcct

SEQ ID NO: 189547 - DNA, 25 bp, E. coli
tcttatcaggctacaaccgtgtctc

SEQ ID NO: 189548 - DNA, 25 bp, E. coli
tcttatcaggcttcaaccgtgtctc

SEQ ID NO: 189549 - DNA, 25 bp, E. coli
cctggagcaggagttatgtcatgag

SEQ ID NO: 189550 - DNA, 25 bp, E. coli
cctggagcaggacttatgtcatgag

SEQ ID NO: 189551 - DNA, 25 bp, E. coli
gctctccctgaaagctgaagccgac

SEQ ID NO: 189552 - DNA, 25 bp, E. coli
gcgcaggaattgctctcaccgctcg

SEQ ID NO: 189553 - DNA, 25 bp, E. coli
gctctccctgaatgctgaagccgac

SEQ ID NO: 189554 - DNA, 25 bp, E. coli
gcgcaggaattggtctcaccgctcg

SEQ ID NO: 189555 - DNA, 25 bp, E. coli
ctggtggtgcctaacggttcgattg

SEQ ID NO: 189556 - DNA, 25 bp, E. coli
ctggtggtgccttacggttcgattg

SEQ ID NO: 189557 - DNA, 25 bp, E. coli
gatcgatgcctgtcacgtcttatca

SEQ ID NO: 189558 - DNA, 25 bp, E. coli
gatcgatgcctgacacgtcttatca

SEQ ID NO: 189559 - DNA, 25 bp, E. coli
taaaaccgttgttgggcattccagg

SEQ ID NO: 189560 - DNA, 25 bp, E. coli
taaaaccgttgtagggcattccagg

SEQ ID NO: 189561 - DNA, 25 bp, E. coli
acccaacgcaaggagcgcaagcatg

SEQ ID NO: 189562 - DNA, 25 bp, E. coli
actacttctcttccggcgtcgcggt

SEQ ID NO: 189563 - DNA, 25 bp, E. coli
actacttctcttgcggcgtcgcggt

SEQ ID NO: 189564 - DNA, 25 bp, E. coli
acccaacgcaagcagcgcaagcatg

SEQ ID NO: 189565 - DNA, 25 bp, E. coli
taccgaacgcgataaagtgattttc

SEQ ID NO: 189566 - DNA, 25 bp, E. coli
taccgaacgcgaaaaagtgattttc

SEQ ID NO: 189567 - DNA, 25 bp, E. coli
tttgtcggagccaacattttgcgcg

SEQ ID NO: 189568 - DNA, 25 bp, E. coli
tttgtcggagcctacattttgcgcg

SEQ ID NO: 189569 - DNA, 25 bp, E. coli
tgaacggatcgtatgggcaactgcc

SEQ ID NO: 189570 - DNA, 25 bp, E. coli
tgaacggatcgtttgggcaactgcc

SEQ ID NO: 189571 - DNA, 25 bp, E. coli
tgcgcgtctggcataacttcgaaga

SEQ ID NO: 189572 - DNA, 25 bp, E. coli
tgcgcgtctggcttaacttcgaaga

SEQ ID NO: 189573 - DNA, 25 bp, E. coli
gcctttctgggcacgtccgtaatcg

SEQ ID NO: 189574 - DNA, 25 bp, E. coli
gcctttctgggctcgtccgtaatcg

SEQ ID NO: 189575 - DNA, 25 bp, E. coli
ccggtatgaccaaagagctggcgca

SEQ ID NO: 189576 - DNA, 25 bp, E. coli
ccggtatgaccatagagctggcgca

SEQ ID NO: 189577 - DNA, 25 bp, E. coli
ggcgcaggaaggtgaaattaccgaa

SEQ ID NO: 189578 - DNA, 25 bp, E. coli
ggcgcaggaaggagaaattaccgaa

SEQ ID NO: 189579 - DNA, 25 bp, E. coli
taacttcgaagatcgtcgcaaccca

SEQ ID NO: 189580 - DNA, 25 bp, E. coli
taacttcgaagaacgtcgcaaccca

SEQ ID NO: 189581 - DNA, 25 bp, E. coli
caagaatctctaaccccagcgatgg

SEQ ID NO: 189582 - DNA, 25 bp, E. coli
caagaatctctatccccagcgatgg

SEQ ID NO: 189583 - DNA, 25 bp, E. coli
taccagcgtgagtgagacgtttagc

SEQ ID NO: 189584 - DNA, 25 bp, E. coli
taccagcgtgagagagacgtttagc

SEQ ID NO: 189585 - DNA, 25 bp, E. coli
tattgatataaagggagccggaacc

SEQ ID NO: 189586 - DNA, 25 bp, E. coli
tattgatataaacggagccggaacc

SEQ ID NO: 189587 - DNA, 25 bp, E. coli
tttcataacgatggaacagcaacgg

SEQ ID NO: 189588 - DNA, 25 bp, E. coli
tttcataacgatcgaacagcaacgg

SEQ ID NO: 189589 - DNA, 25 bp, E. coli
tgtaataatgcagtaccaggcccat

SEQ ID NO: 189590 - DNA, 25 bp, E. coli
tgtaataatgcactaccaggcccat

SEQ ID NO: 189591 - DNA, 25 bp, E. coli
tcatgaccaaagttccgggtgcggc

SEQ ID NO: 189592 - DNA, 25 bp, E. coli
tcatcgtctagtccgccttcggtca

SEQ ID NO: 189593 - DNA, 25 bp, E. coli
tcatcgtctagtgcgccttcggtca

SEQ ID NO: 189594 - DNA, 25 bp, E. coli
tcatgaccaaagatccgggtgcggc

SEQ ID NO: 189595 - DNA, 25 bp, E. coli
gaaccagctgatggcgttgtcgact

SEQ ID NO: 189596 - DNA, 25 bp, E. coli
gaaccagctgatcgcgttgtcgact

SEQ ID NO: 189597 - DNA, 25 bp, E. coli
cgcagtctgtagaggcggtcctgaa

SEQ ID NO: 189598 - DNA, 25 bp, E. coli
cgcagtctgtagtggcggtcctgaa

SEQ ID NO: 189599 - DNA, 25 bp, E. coli
cattcagggcagaactgagtgcgaa

SEQ ID NO: 189600 - DNA, 25 bp, E. coli
cattcagggcagtactgagtgcgaa

SEQ ID NO: 189601 - DNA, 25 bp, E. coli
taacttttccagaacgagtgcagct

SEQ ID NO: 189602 - DNA, 25 bp, E. coli
taacttttccagtacgagtgcagct

SEQ ID NO: 189603 - DNA, 25 bp, E. coli
aatcagtaaagatccacgggctgcc

SEQ ID NO: 189604 - DNA, 25 bp, E. coli
aatcagtaaagaaccacgggctgcc

SEQ ID NO: 189605 - DNA, 25 bp, E. coli
aataatgagcttcctggaaaccgcg

SEQ ID NO: 189606 - DNA, 25 bp, E. coli
aataatgagcttgctggaaaccgcg

SEQ ID NO: 189607 - DNA, 25 bp, E. coli
catggcttgaagtgcaggaaccgca

SEQ ID NO: 189608 - DNA, 25 bp, E. coli
catggcttgaagagcaggaaccgca

SEQ ID NO: 189609 - DNA, 25 bp, E. coli
taaaccgtccggtggtgcatgcaga

SEQ ID NO: 189610 - DNA, 25 bp, E. coli
taaaccgtccggaggtgcatgcaga

SEQ ID NO: 189611 - DNA, 25 bp, E. coli
tgagaagaagatgagtagccgcccc

SEQ ID NO: 189612 - DNA, 25 bp, E. coli
tgagaagaagatcagtagccgcccc

SEQ ID NO: 189613 - DNA, 25 bp, E. coli
tgccatagccgtgaagaaaatcgcg

SEQ ID NO: 189614 - DNA, 25 bp, E. coli
tgccatagccgtcaagaaaatcgcg

SEQ ID NO: 189615 - DNA, 25 bp, E. coli
gaattactggagtaaagccggcgca

SEQ ID NO: 189616 - DNA, 25 bp, E. coli
gaattactggagaaaagccggcgca

SEQ ID NO: 189617 - DNA, 25 bp, E. coli
gactaccctgaacatcctgaacacg

SEQ ID NO: 189618 - DNA, 25 bp, E. coli
gactaccctgaagatcctgaacacg

SEQ ID NO: 189619 - DNA, 25 bp, E. coli
cattgccctgaaagtgacgagccgc

SEQ ID NO: 189620 - DNA, 25 bp, E. coli
cattgccctgaatgtgacgagccgc

SEQ ID NO: 189621 - DNA, 25 bp, E. coli
ggacataaagcttaccggactctgg

SEQ ID NO: 189622 - DNA, 25 bp, E. coli
ggacataaagctaaccggactctgg

SEQ ID NO: 189623 - DNA, 25 bp, E. coli
gatgttgatgccgatatcgccgcgc

SEQ ID NO: 189624 - DNA, 25 bp, E. coli
gatgttgatgcccatatcgccgcgc

SEQ ID NO: 189625 - DNA, 25 bp, E. coli
cagtcgcatctccatcgtgaagagt

SEQ ID NO: 189626 - DNA, 25 bp, E. coli
cagagttctggaacgcgaggcgaaa

SEQ ID NO: 189627 - DNA, 25 bp, E. coli
cagagttctggatcgcgaggcgaaa

SEQ ID NO: 189628 - DNA, 25 bp, E. coli
cagtcgcatctcgatcgtgaagagt

SEQ ID NO: 189629 - DNA, 25 bp, E. coli
tacaacgaaccacacgtgtttgcgg

SEQ ID NO: 189630 - DNA, 25 bp, E. coli
tacaacgaaccagacgtgtttgcgg

SEQ ID NO: 189631 - DNA, 25 bp, E. coli
tataccgatcggcagcagaaacggc

SEQ ID NO: 189632 - DNA, 25 bp, E. coli
tataccgatcgggagcagaaacggc

SEQ ID NO: 189633 - DNA, 25 bp, E. coli
ttattacccaaaccgaaagcctggc

SEQ ID NO: 189634 - DNA, 25 bp, E. coli
ttattacccaaagcgaaagcctggc

SEQ ID NO: 189635 - DNA, 25 bp, E. coli
tgagaactatatcgaaacgctgacc

SEQ ID NO: 189636 - DNA, 25 bp, E. coli
tgagaactatatggaaacgctgacc

SEQ ID NO: 189637 - DNA, 25 bp, E. coli
tcccaccgggctagatgagaactat

SEQ ID NO: 189638 - DNA, 25 bp, E. coli
tcccaccgggcttgatgagaactat

SEQ ID NO: 189639 - DNA, 25 bp, E. coli
tctttacgcttcaggatcggctgga

SEQ ID NO: 189640 - DNA, 25 bp, E. coli
tctttacgcttctggatcggctgga

SEQ ID NO: 189641 - DNA, 25 bp, E. coli
cgtgaagagtaccttgccagagttc

SEQ ID NO: 189642 - DNA, 25 bp, E. coli
cgtgaagagtacgttgccagagttc

SEQ ID NO: 189643 - DNA, 25 bp, E. coli
ggcctttgatggatatcccaccggg

SEQ ID NO: 189644 - DNA, 25 bp, E. coli
ggcctttgatggttatcccaccggg

SEQ ID NO: 189645 - DNA, 25 bp, E. coli
taacccatgagtttctgcacctggc

SEQ ID NO: 189646 - DNA, 25 bp, E. coli
taacccatgagtatctgcacctggc

SEQ ID NO: 189647 - DNA, 25 bp, E. coli
tacgtaaaccagctgaaactgaccg

SEQ ID NO: 189648 - DNA, 25 bp, E. coli
tacgtaaaccaggtgaaactgaccg

SEQ ID NO: 189649 - DNA, 25 bp, E. coli
tacgtaaaacagctgaaactgaccg

SEQ ID NO: 189650 - DNA, 25 bp, E. coli
tacgtaaaacaggtgaaactgaccg

SEQ ID NO: 189651 - DNA, 25 bp, E. coli
tacgtacatcaggtaaaactgaccg

SEQ ID NO: 189652 - DNA, 25 bp, E. coli
tacgtacatcagctaaaactgaccg

SEQ ID NO: 189653 - DNA, 25 bp, E. coli
tatttattcatcataccctgtgcac

SEQ ID NO: 189654 - DNA, 25 bp, E. coli
tatttattcatcttaccctgtgcac

SEQ ID NO: 189655 - DNA, 25 bp, E. coli
tgtgcaccaaaagcaaaaactcact

SEQ ID NO: 189656 - DNA, 25 bp, E. coli
tgtgcaccaaaaccaaaaactcact

SEQ ID NO: 189657 - DNA, 25 bp, E. coli
tcttttgggtattgtgtcgtggaca

SEQ ID NO: 189658 - DNA, 25 bp, E. coli
tcttttgggtattgcgtcgtggaca

SEQ ID NO: 189659 - DNA, 25 bp, E. coli
tcttttgggtatagcgtcgtggaca

SEQ ID NO: 189660 - DNA, 25 bp, E. coli
tcttttgggtatagtgtcgtggaca

SEQ ID NO: 189661 - DNA, 25 bp, E. coli
gaataaagcgcagtcaacaatctga

SEQ ID NO: 189662 - DNA, 25 bp, E. coli
gaataaagcgcactcaacaatctga

SEQ ID NO: 189663 - DNA, 25 bp, E. coli
gaaactgatggctaccgcaaaaatg

SEQ ID NO: 189664 - DNA, 25 bp, E. coli
gaaactgatggcaaccgcaaaaatg

SEQ ID NO: 189665 - DNA, 25 bp, E. coli
ctcaacaatctgtaacccgccggaa

SEQ ID NO: 189666 - DNA, 25 bp, E. coli
ctcaacaatctgaaacccgccggaa

SEQ ID NO: 189667 - DNA, 25 bp, E. coli
tcactgacgcgggtttgaaactgat

SEQ ID NO: 189668 - DNA, 25 bp, E. coli
tcactgacgcggctttgaaactgat

SEQ ID NO: 189669 - DNA, 25 bp, E. coli
caacattaccggtaataacgtcgag

SEQ ID NO: 189670 - DNA, 25 bp, E. coli
caacattaccggaaataacgtcgag

SEQ ID NO: 189671 - DNA, 25 bp, E. coli
aaattcatgccaccgcggaaggtca

SEQ ID NO: 189672 - DNA, 25 bp, E. coli
aaattcatgccagcgcggaaggtca

SEQ ID NO: 189673 - DNA, 25 bp, E. coli
tattttgaccgattcaaccaggtct

SEQ ID NO: 189674 - DNA, 25 bp, E. coli
tattttgaccgaatcaaccaggtct

SEQ ID NO: 189675 - DNA, 25 bp, E. coli
tgtaaacggtggtgaaattcatgcc

SEQ ID NO: 189676 - DNA, 25 bp, E. coli
tgtaaacggtggagaaattcatgcc

SEQ ID NO: 189677 - DNA, 25 bp, E. coli
gaaggtcaggacatgtacgctgcca

SEQ ID NO: 189678 - DNA, 25 bp, E. coli
gaaggtcaggacttgtacgctgcca

SEQ ID NO: 189679 - DNA, 25 bp, E. coli
cttaattgataacctggcacgccag

SEQ ID NO: 189680 - DNA, 25 bp, E. coli
cttaattgataagctggcacgccag

SEQ ID NO: 189681 - DNA, 25 bp, E. coli
gttctgaaagtggagaaagtcaccc

SEQ ID NO: 189682 - DNA, 25 bp, E. coli
gttctgaaagtgcagaaagtcaccc

SEQ ID NO: 189683 - DNA, 25 bp, E. coli
taacgtcgagatgaccgaggcactg

SEQ ID NO: 189684 - DNA, 25 bp, E. coli
taacgtcgagatcaccgaggcactg

SEQ ID NO: 189685 - DNA, 25 bp, E. coli
gagaaagtcaccgacacctcagatg

SEQ ID NO: 189686 - DNA, 25 bp, E. coli
gatgcaacactggatgtaaacggtg

SEQ ID NO: 189687 - DNA, 25 bp, E. coli
gatgcaacactgcatgtaaacggtg

SEQ ID NO: 189688 - DNA, 25 bp, E. coli
gaggcactgcgccaatttgttacag

SEQ ID NO: 189689 - DNA, 25 bp, E. coli
gagaaagtcacccacacctcagatg

SEQ ID NO: 189690 - DNA, 25 bp, E. coli
gaggcactgcgcgaatttgttacag

SEQ ID NO: 189691 - DNA, 25 bp, E. coli
ttaatcatgaactagctccggcgcg

SEQ ID NO: 189692 - DNA, 25 bp, E. coli
ttaatcatgaacaagctccggcgcg

SEQ ID NO: 189693 - DNA, 25 bp, E. coli
tttacactggctggcaacgttgctg

SEQ ID NO: 189694 - DNA, 25 bp, E. coli
tttacactggctcgcaacgttgctg

SEQ ID NO: 189695 - DNA, 25 bp, E. coli
tgatttcgaaaatctggtagccagc

SEQ ID NO: 189696 - DNA, 25 bp, E. coli
tgatttcgaaaaactggtagccagc

SEQ ID NO: 189697 - DNA, 25 bp, E. coli
tgaaaacgcttgaagagccaccagc

SEQ ID NO: 189698 - DNA, 25 bp, E. coli
tgaaaacgcttgtagagccaccagc

SEQ ID NO: 189699 - DNA, 25 bp, E. coli
gaaaagctgaatcagcacgcacgct

SEQ ID NO: 189700 - DNA, 25 bp, E. coli
gaaaagctgaatgagcacgcacgct

SEQ ID NO: 189701 - DNA, 25 bp, E. coli
ctatcaggccggtagaggtcaccat

SEQ ID NO: 189702 - DNA, 25 bp, E. coli
ctatcaggccggaagaggtcaccat

SEQ ID NO: 189703 - DNA, 25 bp, E. coli
ggtcaccatgcgctactcattcagg

SEQ ID NO: 189704 - DNA, 25 bp, E. coli
ggtcaccatgcggtactcattcagg

SEQ ID NO: 189705 - DNA, 25 bp, E. coli
taactggcaggcacgtgaaacattg

SEQ ID NO: 189706 - DNA, 25 bp, E. coli
taactggcaggctcgtgaaacattg

SEQ ID NO: 189707 - DNA, 25 bp, E. coli
gatggtatccatcgttacgacctga

SEQ ID NO: 189708 - DNA, 25 bp, E. coli
gatgatgctttaatctacgccctga

SEQ ID NO: 189709 - DNA, 25 bp, E. coli
gatggtatccatggttacgacctga

SEQ ID NO: 189710 - DNA, 25 bp, E. coli
gatgatgctttattctacgccctga

SEQ ID NO: 189711 - DNA, 25 bp, E. coli
gacctggctttcacgcgaagtgaca

SEQ ID NO: 189712 - DNA, 25 bp, E. coli
gacctggctttctcgcgaagtgaca

SEQ ID NO: 189713 - DNA, 25 bp, E. coli
aagatgtgggaccttgaagtcctga

SEQ ID NO: 189714 - DNA, 25 bp, E. coli
aagatgtgggacgttgaagtcctga

SEQ ID NO: 189715 - DNA, 25 bp, E. coli
caggtagaggccgatgtaaagcgtt

SEQ ID NO: 189716 - DNA, 25 bp, E. coli
caggtagaggcccatgtaaagcgtt

SEQ ID NO: 189717 - DNA, 25 bp, E. coli
tagaggccgatgtaaagcgtttttt

SEQ ID NO: 189718 - DNA, 25 bp, E. coli
tagaggccgatgaaaagcgtttttt

SEQ ID NO: 189719 - DNA, 25 bp, E. coli
tataagatgtggcacgttgaagtcc

SEQ ID NO: 189720 - DNA, 25 bp, E. coli
tataagatgtgggacgttgaagtcc

SEQ ID NO: 189721 - DNA, 25 bp, E. coli
ttgaagtcctgaatctgtataagaa

SEQ ID NO: 189722 - DNA, 25 bp, E. coli
ttgaagtcctgattctgtataagaa

SEQ ID NO: 189723 - DNA, 25 bp, E. coli
gcgtttttttctttacttgactgag

SEQ ID NO: 189724 - DNA, 25 bp, E. coli
gcgtttttttctatacttgactgag

SEQ ID NO: 189725 - DNA, 25 bp, E. coli
gactgagtataagatgtgggacgtt

SEQ ID NO: 189726 - DNA, 25 bp, E. coli
gactgagtataacatgtgggacgtt

SEQ ID NO: 189727 - DNA, 25 bp, E. coli
cgctgagctacatcaggtagaggcc

SEQ ID NO: 189728 - DNA, 25 bp, E. coli
cgctgagctacaacaggtagaggcc

SEQ ID NO: 189729 - DNA, 25 bp, E. coli
cttgactgagtaaaagatgtgggac

SEQ ID NO: 189730 - DNA, 25 bp, E. coli
cttgactgagtataagatgtgggac

SEQ ID NO: 189731 - DNA, 25 bp, E. coli
gagctacatcagctagaggccgatg

SEQ ID NO: 189732 - DNA, 25 bp, E. coli
gagctacatcaggtagaggccgatg

SEQ ID NO: 189733 - DNA, 25 bp, E. coli
gacgttgaagtcctgattctgtata

SEQ ID NO: 189734 - DNA, 25 bp, E. coli
gacgttgaagtcgtgattctgtata

SEQ ID NO: 189735 - DNA, 25 bp, E. coli
cacagttgcgcggatataaactacc

SEQ ID NO: 189736 - DNA, 25 bp, E. coli
cacagttgcgcgcatataaactacc

SEQ ID NO: 189737 - DNA, 25 bp, E. coli
cagcaggcgggacaacaactgctaa

SEQ ID NO: 189738 - DNA, 25 bp, E. coli
cagcaggcgggagaacaactgctaa

SEQ ID NO: 189739 - DNA, 25 bp, E. coli
acttgcctgcttcgaccgcggatat

SEQ ID NO: 189740 - DNA, 25 bp, E. coli
acttgcctgcttggaccgcggatat

SEQ ID NO: 189741 - DNA, 25 bp, E. coli
tatggctcgctgcattgcatgggca

SEQ ID NO: 189742 - DNA, 25 bp, E. coli
tatggctcgctggattgcatgggca

SEQ ID NO: 189743 - DNA, 25 bp, E. coli
tatcaggacggtcctgctcctgggc

SEQ ID NO: 189744 - DNA, 25 bp, E. coli
tttccccggcgatgcactcaatcgt

SEQ ID NO: 189745 - DNA, 25 bp, E. coli
tatcaggacggtgctgctcctgggc

SEQ ID NO: 189746 - DNA, 25 bp, E. coli
tttccccggcgaagcactcaatcgt

SEQ ID NO: 189747 - DNA, 25 bp, E. coli
tgggcgcggcgcgtggacgccattt

SEQ ID NO: 189748 - DNA, 25 bp, E. coli
tgggcgcggcgcctggacgccattt

SEQ ID NO: 189749 - DNA, 25 bp, E. coli
gcatgggcagtgcagcaaaataatg

SEQ ID NO: 189750 - DNA, 25 bp, E. coli
gctttaaccccaatggactagcgca

SEQ ID NO: 189751 - DNA, 25 bp, E. coli
gcggatataaacaaccgttacgcac

SEQ ID NO: 189752 - DNA, 25 bp, E. coli
gctttaaccccattggactagcgca

SEQ ID NO: 189753 - DNA, 25 bp, E. coli
gcatgggcagtggagcaaaataatg

SEQ ID NO: 189754 - DNA, 25 bp, E. coli
gcggatataaactaccgttacgcac

SEQ ID NO: 189755 - DNA, 25 bp, E. coli
taaccccaatggtctagcgcaaagt

SEQ ID NO: 189756 - DNA, 25 bp, E. coli
taaccccaatggactagcgcaaagt

SEQ ID NO: 189757 - DNA, 25 bp, E. coli
cactcatcggtacctggattgtcga

SEQ ID NO: 189758 - DNA, 25 bp, E. coli
cactcatcggtagctggattgtcga

SEQ ID NO: 189759 - DNA, 25 bp, E. coli
tacattgaagatctcggtttgggcg

SEQ ID NO: 189760 - DNA, 25 bp, E. coli
tacattgaagatgtcggtttgggcg

SEQ ID NO: 189761 - DNA, 25 bp, E. coli
tagcgagctttacagtcgggaaccg

SEQ ID NO: 189762 - DNA, 25 bp, E. coli
tagcgagctttagagtcgggaaccg

SEQ ID NO: 189763 - DNA, 25 bp, E. coli
taccgtgctgtagttgcaggactgc

SEQ ID NO: 189764 - DNA, 25 bp, E. coli
taccgtgctgtacttgcaggactgc

SEQ ID NO: 189765 - DNA, 25 bp, E. coli
ttgagtaataaagggctaatgccgc

SEQ ID NO: 189766 - DNA, 25 bp, E. coli
ttgagtaataaacggctaatgccgc

SEQ ID NO: 189767 - DNA, 25 bp, E. coli
gcggcgtactgaccgatcttgatga

SEQ ID NO: 189768 - DNA, 25 bp, E. coli
gcagattgccgctggcgaaagctat

SEQ ID NO: 189769 - DNA, 25 bp, E. coli
gcggcgtactgagcgatcttgatga

SEQ ID NO: 189770 - DNA, 25 bp, E. coli
gcatttaagctgtatccgctggagt

SEQ ID NO: 189771 - DNA, 25 bp, E. coli
gcatttaagctgaatccgctggagt

SEQ ID NO: 189772 - DNA, 25 bp, E. coli
gcagattgccgcaggcgaaagctat

SEQ ID NO: 189773 - DNA, 25 bp, E. coli
cgctgatggtgaatacgccgatgaa

SEQ ID NO: 189774 - DNA, 25 bp, E. coli
cgctgatggtgattacgccgatgaa

SEQ ID NO: 189775 - DNA, 25 bp, E. coli
gtacgagtcggcttatttccagtgg

SEQ ID NO: 189776 - DNA, 25 bp, E. coli
gtacgagtcggcatatttccagtgg

SEQ ID NO: 189777 - DNA, 25 bp, E. coli
gatgaaccgatgttctaccaggcgt

SEQ ID NO: 189778 - DNA, 25 bp, E. coli
gatgaaccgatgatctaccaggcgt

SEQ ID NO: 189779 - DNA, 25 bp, E. coli
taaaggcgtccgttctgaagccctg

SEQ ID NO: 189780 - DNA, 25 bp, E. coli
taaaggcgtccgatctgaagccctg

SEQ ID NO: 189781 - DNA, 25 bp, E. coli
agttttgaaaacaagcgtgcagcgc

SEQ ID NO: 189782 - DNA, 25 bp, E. coli
agttttgaaaactagcgtgcagcgc

SEQ ID NO: 189783 - DNA, 25 bp, E. coli
ttccatgttccacacaggcagcgtg

SEQ ID NO: 189784 - DNA, 25 bp, E. coli
ttccatgttccagacaggcagcgtg

SEQ ID NO: 189785 - DNA, 25 bp, E. coli
tgtggacccgaaaaaagccgcagtg

SEQ ID NO: 189786 - DNA, 25 bp, E. coli
tgtggacccgaataaagccgcagtg

SEQ ID NO: 189787 - DNA, 25 bp, E. coli
tgaatatcaggaatacgcacaggac

SEQ ID NO: 189788 - DNA, 25 bp, E. coli
tgaatatcaggattacgcacaggac

SEQ ID NO: 189789 - DNA, 25 bp, E. coli
tcggccattgcggtactgacggaag

SEQ ID NO: 189790 - DNA, 25 bp, E. coli
tcggccattgcgctactgacggaag

SEQ ID NO: 189791 - DNA, 25 bp, E. coli
gaatacacctttgtggacggaggcg

SEQ ID NO: 189792 - DNA, 25 bp, E. coli
gaatacacctttctggacggaggcg

SEQ ID NO: 189793 - DNA, 25 bp, E. coli
gaaaatcgcatcttctgccggcgct

SEQ ID NO: 189794 - DNA, 25 bp, E. coli
gaaaatcgcatcatctgccggcgct

SEQ ID NO: 189795 - DNA, 25 bp, E. coli
ggtcatgaccaaagccgcagaggaa

SEQ ID NO: 189796 - DNA, 25 bp, E. coli
ggtcatgaccaatgccgcagaggaa

SEQ ID NO: 189797 - DNA, 25 bp, E. coli
ggctggaaatcagggcaacactggt

SEQ ID NO: 189798 - DNA, 25 bp, E. coli
ggctggaaatcacggcaacactggt

SEQ ID NO: 189799 - DNA, 25 bp, E. coli
tcacccatgatgtgaagggcacggc

SEQ ID NO: 189800 - DNA, 25 bp, E. coli
tcacccatgatgagaagggcacggc

SEQ ID NO: 189801 - DNA, 25 bp, E. coli
tattgaataccctttatgagttagc

SEQ ID NO: 189802 - DNA, 25 bp, E. coli
tattgaatacccattatgagttagc

SEQ ID NO: 189803 - DNA, 25 bp, E. coli
tgataccaatcagagaatacagctt

SEQ ID NO: 189804 - DNA, 25 bp, E. coli
tgataccaatcacagaatacagctt

SEQ ID NO: 189805 - DNA, 25 bp, E. coli
tgagttagccattaacgcgtccacg

SEQ ID NO: 189806 - DNA, 25 bp, E. coli
tgagttagccataaacgcgtccacg

SEQ ID NO: 189807 - DNA, 25 bp, E. coli
tcacaacagagcataacaaactgat

SEQ ID NO: 189808 - DNA, 25 bp, E. coli
tctattcacccgaaacaaaaatgtg

SEQ ID NO: 189809 - DNA, 25 bp, E. coli
tctattcacccgtaacaaaaatgtg

SEQ ID NO: 189810 - DNA, 25 bp, E. coli
ccaatattgaaatcacggcgtagca

SEQ ID NO: 189811 - DNA, 25 bp, E. coli
ccaatattgaaaacacggcgtagca

SEQ ID NO: 189812 - DNA, 25 bp, E. coli
gaaaatgtcacaggcagataaatcc

SEQ ID NO: 189813 - DNA, 25 bp, E. coli
gaaaatgtcacacgcagataaatcc

SEQ ID NO: 189814 - DNA, 25 bp, E. coli
cgcgtccacgaggttaataataatt

SEQ ID NO: 189815 - DNA, 25 bp, E. coli
cgcgtccacgagcttaataataatt

SEQ ID NO: 189816 - DNA, 25 bp, E. coli
gatatcacgccctttaattttgaaa

SEQ ID NO: 189817 - DNA, 25 bp, E. coli
gatatcacgcccattaattttgaaa

SEQ ID NO: 189818 - DNA, 25 bp, E. coli
tggatcaccaatattgaaagtcaga

SEQ ID NO: 189819 - DNA, 25 bp, E. coli
tggatcaccaattttgaaagtcaga

SEQ ID NO: 189820 - DNA, 25 bp, E. coli
tcaatattgttatgttcctcaccaa

SEQ ID NO: 189821 - DNA, 25 bp, E. coli
tcacaacagagcttaacaaactgat

SEQ ID NO: 189822 - DNA, 25 bp, E. coli
tcaatattgttaagttcctcaccaa

SEQ ID NO: 189823 - DNA, 25 bp, E. coli
aaacattggtgggaaagcgacgcgc

SEQ ID NO: 189824 - DNA, 25 bp, E. coli
aaacattggtggcaaagcgacgcgc

SEQ ID NO: 189825 - DNA, 25 bp, E. coli
aaagtgatgatgagctccctgcgcc

SEQ ID NO: 189826 - DNA, 25 bp, E. coli
aaagtgatgatgtgctccctgcgcc

SEQ ID NO: 189827 - DNA, 25 bp, E. coli
tgagtgacattaccgccattctgcc

SEQ ID NO: 189828 - DNA, 25 bp, E. coli
tgagtgacattagcgccattctgcc

SEQ ID NO: 189829 - DNA, 25 bp, E. coli
tccggacgatttctatgaagcctca

SEQ ID NO: 189830 - DNA, 25 bp, E. coli
tccggacgatttgtatgaagcctca

SEQ ID NO: 189831 - DNA, 25 bp, E. coli
tcagagcggcgtgaaatatcgtccg

SEQ ID NO: 189832 - DNA, 25 bp, E. coli
gcctggcgctatgtttacccgggaa

SEQ ID NO: 189833 - DNA, 25 bp, E. coli
gcctggcgctatctttacccgggaa

SEQ ID NO: 189834 - DNA, 25 bp, E. coli
gctgccgctgctgattaaaccgctg

SEQ ID NO: 189835 - DNA, 25 bp, E. coli
gctgccgctgctcattaaaccgctg

SEQ ID NO: 189836 - DNA, 25 bp, E. coli
cttgctgaaagccattccggacgat

SEQ ID NO: 189837 - DNA, 25 bp, E. coli
cttgctgaaagcgattccggacgat

SEQ ID NO: 189838 - DNA, 25 bp, E. coli
gatagtgaacctcaaagccacgcga

SEQ ID NO: 189839 - DNA, 25 bp, E. coli
gattcaactgtttaccaacggcggc

SEQ ID NO: 189840 - DNA, 25 bp, E. coli
gattcaactgttaaccaacggcggc

SEQ ID NO: 189841 - DNA, 25 bp, E. coli
gatagtgaacctgaaagccacgcga

SEQ ID NO: 189842 - DNA, 25 bp, E. coli
tcagagcggcgtcaaatatcgtccg

SEQ ID NO: 189843 - DNA, 25 bp, E. coli
gatcctctgcatcggcttgctgaaa

SEQ ID NO: 189844 - DNA, 25 bp, E. coli
gatcctctgcatgggcttgctgaaa

SEQ ID NO: 189845 - DNA, 25 bp, E. coli
tcaagaaattaataaaccaggcggg

SEQ ID NO: 189846 - DNA, 25 bp, E. coli
tcaggatgcctgtaaatcggcaccg

SEQ ID NO: 189847 - DNA, 25 bp, E. coli
tcaagaaattaaaaaaccaggcggg

SEQ ID NO: 189848 - DNA, 25 bp, E. coli
tcggctcgatttgcatcaggattag

SEQ ID NO: 189849 - DNA, 25 bp, E. coli
tcaggatgcctgaaaatcggcaccg

SEQ ID NO: 189850 - DNA, 25 bp, E. coli
tcggctcgatttccatcaggattag

SEQ ID NO: 189851 - DNA, 25 bp, E. coli
cctttaagacagatttgactggctg

SEQ ID NO: 189852 - DNA, 25 bp, E. coli
cctttaagacagttttgactggctg

SEQ ID NO: 189853 - DNA, 25 bp, E. coli
cctgtagttaagatgcgggtgctaa

SEQ ID NO: 189854 - DNA, 25 bp, E. coli
cctgtagttaagttgcgggtgctaa

SEQ ID NO: 189855 - DNA, 25 bp, E. coli
gcatcaggattagacatttatctct

SEQ ID NO: 189856 - DNA, 25 bp, E. coli
gcatcaggattacacatttatctct

SEQ ID NO: 189857 - DNA, 25 bp, E. coli
gactggctgtgaaaaaggttaaacc

SEQ ID NO: 189858 - DNA, 25 bp, E. coli
gactggctgtgataaaggttaaacc

SEQ ID NO: 189859 - DNA, 25 bp, E. coli
ccgcatctataataaggagttaaca

SEQ ID NO: 189860 - DNA, 25 bp, E. coli
ccgcatctataaaaaggagttaaca

SEQ ID NO: 189861 - DNA, 25 bp, E. coli
cgggtgctaagttaaatcaggatgc

SEQ ID NO: 189862 - DNA, 25 bp, E. coli
cgggtgctaagtaaaatcaggatgc

SEQ ID NO: 189863 - DNA, 25 bp, E. coli
gtaaagattaaataatcggctcgat

SEQ ID NO: 189864 - DNA, 25 bp, E. coli
gtaaagattaaaaaatcggctcgat

SEQ ID NO: 189865 - DNA, 25 bp, E. coli
gaggaattacctgccgcatctataa

SEQ ID NO: 189866 - DNA, 25 bp, E. coli
gaggaattacctcccgcatctataa

SEQ ID NO: 189867 - DNA, 25 bp, E. coli
taaaggctcgaaagctggtcatctg

SEQ ID NO: 189868 - DNA, 25 bp, E. coli
taaaggctcgaatgctggtcatctg

SEQ ID NO: 189869 - DNA, 25 bp, E. coli
tactaacgttatcatcgagggcaac

SEQ ID NO: 189870 - DNA, 25 bp, E. coli
tactaacgttatgatcgagggcaac

SEQ ID NO: 189871 - DNA, 25 bp, E. coli
tatgagcgtagtcatccttgccgca

SEQ ID NO: 189872 - DNA, 25 bp, E. coli
tatgagcgtagtgatccttgccgca

SEQ ID NO: 189873 - DNA, 25 bp, E. coli
tcagattcaggagatcaacaccggc

SEQ ID NO: 189874 - DNA, 25 bp, E. coli
ccttgccgggaatgcgatggttcag

SEQ ID NO: 189875 - DNA, 25 bp, E. coli
ccttgccgggaaagcgatggttcag

SEQ ID NO: 189876 - DNA, 25 bp, E. coli
gacattttaatggtctacggcgacg

SEQ ID NO: 189877 - DNA, 25 bp, E. coli
gaaagtgctgcatacccttgccggg

SEQ ID NO: 189878 - DNA, 25 bp, E. coli
gaaagtgctgcaaacccttgccggg

SEQ ID NO: 189879 - DNA, 25 bp, E. coli
gacattttaatgctctacggcgacg

SEQ ID NO: 189880 - DNA, 25 bp, E. coli
gacgtgccgctgatctctgtcgaaa

SEQ ID NO: 189881 - DNA, 25 bp, E. coli
ccggtaacagtacgcaaaggcgcga

SEQ ID NO: 189882 - DNA, 25 bp, E. coli
ccggtaacagtaggcaaaggcgcga

SEQ ID NO: 189883 - DNA, 25 bp, E. coli
gataacgttaacttcggcgcgggaa

SEQ ID NO: 189884 - DNA, 25 bp, E. coli
gataacgttaacatcggcgcgggaa

SEQ ID NO: 189885 - DNA, 25 bp, E. coli
tcaccgacattattgcgctggcgta

SEQ ID NO: 189886 - DNA, 25 bp, E. coli
tcaccgacattaatgcgctggcgta

SEQ ID NO: 189887 - DNA, 25 bp, E. coli
tcagattcaggacatcaacaccggc

SEQ ID NO: 189888 - DNA, 25 bp, E. coli
gacgtgccgctgttctctgtcgaaa

SEQ ID NO: 189889 - DNA, 25 bp, E. coli
catatgctccgacatttctcctgca

SEQ ID NO: 189890 - DNA, 25 bp, E. coli
catttcaaatctgcaagttattcgt

SEQ ID NO: 189891 - DNA, 25 bp, E. coli
catatgctccgagatttctcctgca

SEQ ID NO: 189892 - DNA, 25 bp, E. coli
catttcaaatctccaagttattcgt

SEQ ID NO: 189893 - DNA, 25 bp, E. coli
taaaagaagatgtacattgtgcacc

SEQ ID NO: 189894 - DNA, 25 bp, E. coli
taaaagaagatgaacattgtgcacc

SEQ ID NO: 189895 - DNA, 25 bp, E. coli
accgttattggtcttattatcgtca

SEQ ID NO: 189896 - DNA, 25 bp, E. coli
accgttattggtgttattatcgtca

SEQ ID NO: 189897 - DNA, 25 bp, E. coli
tgtttaaagacattaatgcatgcat

SEQ ID NO: 189898 - DNA, 25 bp, E. coli
tgtgaatataaaatctcataccggg

SEQ ID NO: 189899 - DNA, 25 bp, E. coli
tgtgaatataaattctcataccggg

SEQ ID NO: 189900 - DNA, 25 bp, E. coli
tgtttaaagacaataatgcatgcat

SEQ ID NO: 189901 - DNA, 25 bp, E. coli
tcctgcatttctatacgtcggcaca

SEQ ID NO: 189902 - DNA, 25 bp, E. coli
tcctgcatttctttacgtcggcaca

SEQ ID NO: 189903 - DNA, 25 bp, E. coli
tcataccgggaatttaaaagaagat

SEQ ID NO: 189904 - DNA, 25 bp, E. coli
tcattgataacaatcattcccgaag

SEQ ID NO: 189905 - DNA, 25 bp, E. coli
tcataccgggaaattaaaagaagat

SEQ ID NO: 189906 - DNA, 25 bp, E. coli
tcattgataacattcattcccgaag

SEQ ID NO: 189907 - DNA, 25 bp, E. coli
cattgtgcacctaccctacttaagt

SEQ ID NO: 189908 - DNA, 25 bp, E. coli
cattgtgcaccttccctacttaagt

SEQ ID NO: 189909 - DNA, 25 bp, E. coli
gtcggcacacttgcgttatcggtaa

SEQ ID NO: 189910 - DNA, 25 bp, E. coli
gtcggcacacttccgttatcggtaa

SEQ ID NO: 189911 - DNA, 25 bp, E. coli
caatactggctgtacgagtgatgcc

SEQ ID NO: 189912 - DNA, 25 bp, E. coli
caatactggctgaacgagtgatgcc

SEQ ID NO: 189913 - DNA, 25 bp, E. coli
catactatcgtttacgcaagccccg

SEQ ID NO: 189914 - DNA, 25 bp, E. coli
catactatcgttaacgcaagccccg

SEQ ID NO: 189915 - DNA, 25 bp, E. coli
actgactgtcaatagtgcgctggca

SEQ ID NO: 189916 - DNA, 25 bp, E. coli
actgactgtcaaaagtgcgctggca

SEQ ID NO: 189917 - DNA, 25 bp, E. coli
tattttggcccattactggctgaac

SEQ ID NO: 189918 - DNA, 25 bp, E. coli
tattttggcccaatactggctgaac

SEQ ID NO: 189919 - DNA, 25 bp, E. coli
tgtcctgggattgctggcacgctat

SEQ ID NO: 189920 - DNA, 25 bp, E. coli
tgtcctgggattcctggcacgctat

SEQ ID NO: 189921 - DNA, 25 bp, E. coli
tcccagaacaatagcaactatacat

SEQ ID NO: 189922 - DNA, 25 bp, E. coli
tcccagaacaattgcaactatacat

SEQ ID NO: 189923 - DNA, 25 bp, E. coli
gcttttgccattacactgactgtca

SEQ ID NO: 189924 - DNA, 25 bp, E. coli
gcttttgccatttcactgactgtca

SEQ ID NO: 189925 - DNA, 25 bp, E. coli
cgcaagccccgttattgccgttatg

SEQ ID NO: 189926 - DNA, 25 bp, E. coli
cgcaagccccgtaattgccgttatg

SEQ ID NO: 189927 - DNA, 25 bp, E. coli
ggcacgctatgcatcacaactaaat

SEQ ID NO: 189928 - DNA, 25 bp, E. coli
ggcacgctatgcttcacaactaaat

SEQ ID NO: 189929 - DNA, 25 bp, E. coli
taattgccgttaagctgggtggtga

SEQ ID NO: 189930 - DNA, 25 bp, E. coli
taattgccgttatgctgggtggtga

SEQ ID NO: 189931 - DNA, 25 bp, E. coli
gatgccgttatcgtttttcccagaa

SEQ ID NO: 189932 - DNA, 25 bp, E. coli
gatgccgttatcctttttcccagaa

SEQ ID NO: 189933 - DNA, 25 bp, E. coli
aagcgcccttgtggcgctttagttt

SEQ ID NO: 189934 - DNA, 25 bp, E. coli
aagcgcccttgtcgcgctttagttt

SEQ ID NO: 189935 - DNA, 25 bp, E. coli
tagagagaaagacaaagaccggaaa

SEQ ID NO: 189936 - DNA, 25 bp, E. coli
taccagcgggatagagagaaagaca

SEQ ID NO: 189937 - DNA, 25 bp, E. coli
taccagcgggattgagagaaagaca

SEQ ID NO: 189938 - DNA, 25 bp, E. coli
tagagagaaagagaaagaccggaaa

SEQ ID NO: 189939 - DNA, 25 bp, E. coli
tgctcgaatgaggtgtgttgacgtc

SEQ ID NO: 189940 - DNA, 25 bp, E. coli
tgctcgaatgagctgtgttgacgtc

SEQ ID NO: 189941 - DNA, 25 bp, E. coli
tccaccacgtgcacgaatgaggtgt

SEQ ID NO: 189942 - DNA, 25 bp, E. coli
tcctgtgtaccagcgggatagagag

SEQ ID NO: 189943 - DNA, 25 bp, E. coli
tccaccacgtgctcgaatgaggtgt

SEQ ID NO: 189944 - DNA, 25 bp, E. coli
tcctgtgtaccaccgggatagagag

SEQ ID NO: 189945 - DNA, 25 bp, E. coli
gaaaacaaactatagcgcccttgtg

SEQ ID NO: 189946 - DNA, 25 bp, E. coli
gaaaacaaactaaagcgcccttgtg

SEQ ID NO: 189947 - DNA, 25 bp, E. coli
gaaaccctcctgagtaccagcggga

SEQ ID NO: 189948 - DNA, 25 bp, E. coli
gaaaccctcctgtgtaccagcggga

SEQ ID NO: 189949 - DNA, 25 bp, E. coli
gaacctccaccaggtgctcgaatga

SEQ ID NO: 189950 - DNA, 25 bp, E. coli
gaacctccaccacgtgctcgaatga

SEQ ID NO: 189951 - DNA, 25 bp, E. coli
cgggatagagagtaagacaaagacc

SEQ ID NO: 189952 - DNA, 25 bp, E. coli
cgggatagagagaaagacaaagacc

SEQ ID NO: 189953 - DNA, 25 bp, E. coli
gggaaaccctcctgtgtaccagcgg

SEQ ID NO: 189954 - DNA, 25 bp, E. coli
gggaaaccctccagtgtaccagcgg

SEQ ID NO: 189955 - DNA, 25 bp, E. coli
agcagcttgcggagctcggcattca

SEQ ID NO: 189956 - DNA, 25 bp, E. coli
agcagcttgcggtgctcggcattca

SEQ ID NO: 189957 - DNA, 25 bp, E. coli
tgcacctctttaccctcgaacagga

SEQ ID NO: 189958 - DNA, 25 bp, E. coli
tgcacctctttagcctcgaacagga

SEQ ID NO: 189959 - DNA, 25 bp, E. coli
tgcttcacgttggaggaaagtacaa

SEQ ID NO: 189960 - DNA, 25 bp, E. coli
tgcttcacgttgcaggaaagtacaa

SEQ ID NO: 189961 - DNA, 25 bp, E. coli
tctcgttatagatgcgttttcccag

SEQ ID NO: 189962 - DNA, 25 bp, E. coli
tctcgttatagaagcgttttcccag

SEQ ID NO: 189963 - DNA, 25 bp, E. coli
gccactgcgcccaggcttctttgga

SEQ ID NO: 189964 - DNA, 25 bp, E. coli
gccactgcgccctggcttctttgga

SEQ ID NO: 189965 - DNA, 25 bp, E. coli
gcttctttggagatctcgttataga

SEQ ID NO: 189966 - DNA, 25 bp, E. coli
gcttctttggagttctcgttataga

SEQ ID NO: 189967 - DNA, 25 bp, E. coli
gaaagtacaaaaaatcgttctgctc

SEQ ID NO: 189968 - DNA, 25 bp, E. coli
gaaaatcctgaccttctgcttcacg

SEQ ID NO: 189969 - DNA, 25 bp, E. coli
gaaaatcctgacgttctgcttcacg

SEQ ID NO: 189970 - DNA, 25 bp, E. coli
gaaagtacaaaatatcgttctgctc

SEQ ID NO: 189971 - DNA, 25 bp, E. coli
cgaacaggaagtagaccatctcctg

SEQ ID NO: 189972 - DNA, 25 bp, E. coli
cgaacaggaagttgaccatctcctg

SEQ ID NO: 189973 - DNA, 25 bp, E. coli
cggtgctcggcaatcatcatgttga

SEQ ID NO: 189974 - DNA, 25 bp, E. coli
cggtgctcggcattcatcatgttga

SEQ ID NO: 189975 - DNA, 25 bp, E. coli
gggtacagctgaaaatcctgacctt

SEQ ID NO: 189976 - DNA, 25 bp, E. coli
gggtacagctgataatcctgacctt

SEQ ID NO: 189977 - DNA, 25 bp, E. coli
aatattaccaactggcaggcactgg

SEQ ID NO: 189978 - DNA, 25 bp, E. coli
caatgatgaccggtcgtcgtctcag

SEQ ID NO: 189979 - DNA, 25 bp, E. coli
caatgatgaccgctcgtcgtctcag

SEQ ID NO: 189980 - DNA, 25 bp, E. coli
aatattaccaacaggcaggcactgg

SEQ ID NO: 189981 - DNA, 25 bp, E. coli
cagcaatggcaaccatggtcgcgcc

SEQ ID NO: 189982 - DNA, 25 bp, E. coli
cagcaatggcaagcatggtcgcgcc

SEQ ID NO: 189983 - DNA, 25 bp, E. coli
actgcccgcagatatgcctacctgg

SEQ ID NO: 189984 - DNA, 25 bp, E. coli
actgcccgcagaaatgcctacctgg

SEQ ID NO: 189985 - DNA, 25 bp, E. coli
tgcagatgctttatcactgcctggc

SEQ ID NO: 189986 - DNA, 25 bp, E. coli
tgcagatgctttttcactgcctggc

SEQ ID NO: 189987 - DNA, 25 bp, E. coli
tcgtcgtctcagttcaggcagcaaa

SEQ ID NO: 189988 - DNA, 25 bp, E. coli
tcgtcgtctcagatcaggcagcaaa

SEQ ID NO: 189989 - DNA, 25 bp, E. coli
tctacctgagttatatcacccgcaa

SEQ ID NO: 189990 - DNA, 25 bp, E. coli
tctacctgagttttatcacccgcaa

SEQ ID NO: 189991 - DNA, 25 bp, E. coli
gcagcaagccatagcggtaaatgaa

SEQ ID NO: 189992 - DNA, 25 bp, E. coli
gcagcaagccattgcggtaaatgaa

SEQ ID NO: 189993 - DNA, 25 bp, E. coli
gacttagcgatgtgcagcaatggca

SEQ ID NO: 189994 - DNA, 25 bp, E. coli
gacttagcgatgagcagcaatggca

SEQ ID NO: 189995 - DNA, 25 bp, E. coli
cgggcgcgcgttcatgaaatttgca

SEQ ID NO: 189996 - DNA, 25 bp, E. coli
cgggcgcgcgttgatgaaatttgca

SEQ ID NO: 189997 - DNA, 25 bp, E. coli
ggcactggcgcctggacttagcgat

SEQ ID NO: 189998 - DNA, 25 bp, E. coli
ggcactggcgccaggacttagcgat

SEQ ID NO: 189999 - DNA, 25 bp, E. coli
tacggaacaggcagcgttggctgcc

SEQ ID NO: 190000 - DNA, 25 bp, E. coli
tacggaacaggctgcgttggctgcc

SEQ ID NO: 190001 - DNA, 25 bp, E. coli
ttcgcgttacggaacaggcagcgtt

SEQ ID NO: 190002 - DNA, 25 bp, E. coli
ttcgcgttacggtacaggcagcgtt

SEQ ID NO: 190003 - DNA, 25 bp, E. coli
tatttcgcgttacggaacaggcagc

SEQ ID NO: 190004 - DNA, 25 bp, E. coli
tatttcgcgttagggaacaggcagc

SEQ ID NO: 190005 - DNA, 25 bp, E. coli
cctggcgtggcctttatttcgcgtt

SEQ ID NO: 190006 - DNA, 25 bp, E. coli
cctggcgtggccattatttcgcgtt

SEQ ID NO: 190007 - DNA, 25 bp, E. coli
gcgttggctgcctggccgcaaaccg

SEQ ID NO: 190008 - DNA, 25 bp, E. coli
gcgttggctgccaggccgcaaaccg

SEQ ID NO: 190009 - DNA, 25 bp, E. coli
gcagcgttggctgcctggccgcaaa

SEQ ID NO: 190010 - DNA, 25 bp, E. coli
gcagcgttggctccctggccgcaaa

SEQ ID NO: 190011 - DNA, 25 bp, E. coli
cgatgcgccagggattaaacgacgt

SEQ ID NO: 190012 - DNA, 25 bp, E. coli
cgttacggaacaggcagcgttggct

SEQ ID NO: 190013 - DNA, 25 bp, E. coli
cgatgcgccaggcattaaacgacgt

SEQ ID NO: 190014 - DNA, 25 bp, E. coli
cgttacggaacacgcagcgttggct

SEQ ID NO: 190015 - DNA, 25 bp, E. coli
ggtcaccgcgatgcgccaggcatta

SEQ ID NO: 190016 - DNA, 25 bp, E. coli
ggtcaccgcgatccgccaggcatta

SEQ ID NO: 190017 - DNA, 25 bp, E. coli
tggccattatttcgcgttacggaac

SEQ ID NO: 190018 - DNA, 25 bp, E. coli
tggccattatttggcgttacggaac

SEQ ID NO: 190019 - DNA, 25 bp, E. coli
gatgtccctggcctggccattattt

SEQ ID NO: 190020 - DNA, 25 bp, E. coli
gatgtccctggcgtggccattattt

SEQ ID NO: 190021 - DNA, 25 bp, E. coli
taggattagcccagttagaacaagc

SEQ ID NO: 190022 - DNA, 25 bp, E. coli
taggattagccctgttagaacaagc

SEQ ID NO: 190023 - DNA, 25 bp, E. coli
tattggcatgaccttataggctaca

SEQ ID NO: 190024 - DNA, 25 bp, E. coli
tattggcatgacgttataggctaca

SEQ ID NO: 190025 - DNA, 25 bp, E. coli
tgtccacacgatgccaatgtactcg

SEQ ID NO: 190026 - DNA, 25 bp, E. coli
tgtccacacgatcccaatgtactcg

SEQ ID NO: 190027 - DNA, 25 bp, E. coli
tgtaattgaagaatgcgctgaagcc

SEQ ID NO: 190028 - DNA, 25 bp, E. coli
tgtaattgaagattgcgctgaagcc

SEQ ID NO: 190029 - DNA, 25 bp, E. coli
tctggactcaacgtggatttcatca

SEQ ID NO: 190030 - DNA, 25 bp, E. coli
tctggactcaacctggatttcatca

SEQ ID NO: 190031 - DNA, 25 bp, E. coli
tgacaaatatctccgctgctatagg

SEQ ID NO: 190032 - DNA, 25 bp, E. coli
tgacaaatatctgcgctgctatagg

SEQ ID NO: 190033 - DNA, 25 bp, E. coli
tccccagcctatcgaatgagcaagt

SEQ ID NO: 190034 - DNA, 25 bp, E. coli
tccccagcctatggaatgagcaagt

SEQ ID NO: 190035 - DNA, 25 bp, E. coli
ccaaggattagctgtacataggcaa

SEQ ID NO: 190036 - DNA, 25 bp, E. coli
ccaaggattagcagtacataggcaa

SEQ ID NO: 190037 - DNA, 25 bp, E. coli
gataaactcatccaaacaaggccag

SEQ ID NO: 190038 - DNA, 25 bp, E. coli
gataaactcatcgaaacaaggccag

SEQ ID NO: 190039 - DNA, 25 bp, E. coli
tcaaaagcaccctatagctgaggat

SEQ ID NO: 190040 - DNA, 25 bp, E. coli
tcaaaagcacccaatagctgaggat

SEQ ID NO: 190041 - DNA, 25 bp, E. coli
tcaattctaactaggaccgcagagg

SEQ ID NO: 190042 - DNA, 25 bp, E. coli
tcaattctaacttggaccgcagagg

SEQ ID NO: 190043 - DNA, 25 bp, E. coli
catttgtcctgcttagtcgcccgtg

SEQ ID NO: 190044 - DNA, 25 bp, E. coli
catttgtcctgcatagtcgcccgtg

SEQ ID NO: 190045 - DNA, 25 bp, E. coli
tatgcctaagcgaacggtgaaaaca

SEQ ID NO: 190046 - DNA, 25 bp, E. coli
tatgcctaagcgtacggtgaaaaca

SEQ ID NO: 190047 - DNA, 25 bp, E. coli
ttaaagagcaggcaactgttccggc

SEQ ID NO: 190048 - DNA, 25 bp, E. coli
ttaaagagcagggaactgttccggc

SEQ ID NO: 190049 - DNA, 25 bp, E. coli
tgatgctggacgtcttcacggagga

SEQ ID NO: 190050 - DNA, 25 bp, E. coli
tgatgctggacgacttcacggagga

SEQ ID NO: 190051 - DNA, 25 bp, E. coli
gctttgaactggcactgctcgggca

SEQ ID NO: 190052 - DNA, 25 bp, E. coli
gctttgaactgggactgctcgggca

SEQ ID NO: 190053 - DNA, 25 bp, E. coli
gaagtcaaaacggtgcgcagtgctg

SEQ ID NO: 190054 - DNA, 25 bp, E. coli
gaagtcaaaacgctgcgcagtgctg

SEQ ID NO: 190055 - DNA, 25 bp, E. coli
gacaccatgacgtatcgttatcgcg

SEQ ID NO: 190056 - DNA, 25 bp, E. coli
gacaccatgacgaatcgttatcgcg

SEQ ID NO: 190057 - DNA, 25 bp, E. coli
cgaaacgctttacccgcatggcgct

SEQ ID NO: 190058 - DNA, 25 bp, E. coli
cgaaacgctttagccgcatggcgct

SEQ ID NO: 190059 - DNA, 25 bp, E. coli
cgtggagcgaaaccagcctgatgct

SEQ ID NO: 190060 - DNA, 25 bp, E. coli
cgtggagcgaaagcagcctgatgct

SEQ ID NO: 190061 - DNA, 25 bp, E. coli
gtactggaataccagacgcgcttct

SEQ ID NO: 190062 - DNA, 25 bp, E. coli
gtactggaatacgagacgcgcttct

SEQ ID NO: 190063 - DNA, 25 bp, E. coli
ggaatttcctgacgcagacacactg

SEQ ID NO: 190064 - DNA, 25 bp, E. coli
ggaatttcctgaggcagacacactg

SEQ ID NO: 190065 - DNA, 25 bp, E. coli
aaggttttcgtcacagtagcgcagg

SEQ ID NO: 190066 - DNA, 25 bp, E. coli
aatgcattgctgtaagccatcgccg

SEQ ID NO: 190067 - DNA, 25 bp, E. coli
aaggttttcgtctcagtagcgcagg

SEQ ID NO: 190068 - DNA, 25 bp, E. coli
caactgagcggaaaagttcgggtcg

SEQ ID NO: 190069 - DNA, 25 bp, E. coli
aatgcattgctgaaagccatcgccg

SEQ ID NO: 190070 - DNA, 25 bp, E. coli
caactgagcggataagttcgggtcg

SEQ ID NO: 190071 - DNA, 25 bp, E. coli
caggagagcgtatcggcctgagcca

SEQ ID NO: 190072 - DNA, 25 bp, E. coli
catactggtgttcgcctgctggaca

SEQ ID NO: 190073 - DNA, 25 bp, E. coli
catactggtgttggcctgctggaca

SEQ ID NO: 190074 - DNA, 25 bp, E. coli
caggagagcgtaacggcctgagcca

SEQ ID NO: 190075 - DNA, 25 bp, E. coli
atcgtcatcgatccaggcccagtgg

SEQ ID NO: 190076 - DNA, 25 bp, E. coli
agtttgtcctgctcgatcgtccgca

SEQ ID NO: 190077 - DNA, 25 bp, E. coli
atcgtcatcgatgcaggcccagtgg

SEQ ID NO: 190078 - DNA, 25 bp, E. coli
agtttgtcctgcacgatcgtccgca

SEQ ID NO: 190079 - DNA, 25 bp, E. coli
aaaagttttagtggtgcaggagagc

SEQ ID NO: 190080 - DNA, 25 bp, E. coli
aaaagttttagtcgtgcaggagagc

SEQ ID NO: 190081 - DNA, 25 bp, E. coli
tgctggacagaagcacgcgtgaagt

SEQ ID NO: 190082 - DNA, 25 bp, E. coli
tgctggacagaaccacgcgtgaagt

SEQ ID NO: 190083 - DNA, 25 bp, E. coli
gcacgttgcgcgttaccgggcgtat

SEQ ID NO: 190084 - DNA, 25 bp, E. coli
gcacgttgcgcgataccgggcgtat

SEQ ID NO: 190085 - DNA, 25 bp, E. coli
cccagtgggcgaactgcaatgtgaa

SEQ ID NO: 190086 - DNA, 25 bp, E. coli
cccagtgggcgatctgcaatgtgaa

SEQ ID NO: 190087 - DNA, 25 bp, E. coli
cactggtgatgatgcagtgatccga

SEQ ID NO: 190088 - DNA, 25 bp, E. coli
cactggtgatgaagcagtgatccga

SEQ ID NO: 190089 - DNA, 25 bp, E. coli
catagtgcggttggcggtctcagct

SEQ ID NO: 190090 - DNA, 25 bp, E. coli
catagtgccatagtgccatagtgcg

SEQ ID NO: 190091 - DNA, 25 bp, E. coli
catagtgcggttcgcggtctcagct

SEQ ID NO: 190092 - DNA, 25 bp, E. coli
catagtgccatactgccatagtgcg

SEQ ID NO: 190093 - DNA, 25 bp, E. coli
tacctgcgaccgtgaatggctgtga

SEQ ID NO: 190094 - DNA, 25 bp, E. coli
tacctgcgaccgagaatggctgtga

SEQ ID NO: 190095 - DNA, 25 bp, E. coli
tatataaccaaattagacgtcaggg

SEQ ID NO: 190096 - DNA, 25 bp, E. coli
tatataaccaaaatagacgtcaggg

SEQ ID NO: 190097 - DNA, 25 bp, E. coli
tgattacaatcgctggcggtgccat

SEQ ID NO: 190098 - DNA, 25 bp, E. coli
tgattacaatcggtggcggtgccat

SEQ ID NO: 190099 - DNA, 25 bp, E. coli
tcgcaaaattgtcacggatgtctaa

SEQ ID NO: 190100 - DNA, 25 bp, E. coli
tcgcaaaattgtgacggatgtctaa

SEQ ID NO: 190101 - DNA, 25 bp, E. coli
gcggtgccatagtgccatagtgcca

SEQ ID NO: 190102 - DNA, 25 bp, E. coli
gcggtgccatagagccatagtgcca

SEQ ID NO: 190103 - DNA, 25 bp, E. coli
gaaaagcttgattcctgcgaccgag

SEQ ID NO: 190104 - DNA, 25 bp, E. coli
gaaaagcttgatacctgcgaccgag

SEQ ID NO: 190105 - DNA, 25 bp, E. coli
ggctgtgcctacgttacgttagttg

SEQ ID NO: 190106 - DNA, 25 bp, E. coli
ggctgtgcctaccttacgttagttg

SEQ ID NO: 190107 - DNA, 25 bp, E. coli
gatccgattggagtgtgtcataaca

SEQ ID NO: 190108 - DNA, 25 bp, E. coli
gatccgattggactgtgtcataaca

SEQ ID NO: 190109 - DNA, 25 bp, E. coli
taaagtggcgagactggtttcccgc

SEQ ID NO: 190110 - DNA, 25 bp, E. coli
taaagcctatcgtgcgctggattcg

SEQ ID NO: 190111 - DNA, 25 bp, E. coli
taaagcctatcgagcgctggattcg

SEQ ID NO: 190112 - DNA, 25 bp, E. coli
taaagtggcgagtctggtttcccgc

SEQ ID NO: 190113 - DNA, 25 bp, E. coli
tagtgcgctatcagcataaagtggc

SEQ ID NO: 190114 - DNA, 25 bp, E. coli
tagtgcgctatctgcataaagtggc

SEQ ID NO: 190115 - DNA, 25 bp, E. coli
tgttcccgatgtggtacaagaagct

SEQ ID NO: 190116 - DNA, 25 bp, E. coli
tgttcccgatgtcgtacaagaagct

SEQ ID NO: 190117 - DNA, 25 bp, E. coli
tgagcgagcagtaaacggaccaggt

SEQ ID NO: 190118 - DNA, 25 bp, E. coli
tgagcgagcagttaacggaccaggt

SEQ ID NO: 190119 - DNA, 25 bp, E. coli
tgaaaacttcgatagtggcggcgcg

SEQ ID NO: 190120 - DNA, 25 bp, E. coli
tgaaaacttcgaaagtggcggcgcg

SEQ ID NO: 190121 - DNA, 25 bp, E. coli
gcgttcacgtatcttccgagcgagg

SEQ ID NO: 190122 - DNA, 25 bp, E. coli
gcgttcacgtatgttccgagcgagg

SEQ ID NO: 190123 - DNA, 25 bp, E. coli
gaactattgagtccctcccggaaga

SEQ ID NO: 190124 - DNA, 25 bp, E. coli
gaactattgagtgcctcccggaaga

SEQ ID NO: 190125 - DNA, 25 bp, E. coli
cccggaagattttcgcatggcaata

SEQ ID NO: 190126 - DNA, 25 bp, E. coli
cccggaagatttacgcatggcaata

SEQ ID NO: 190127 - DNA, 25 bp, E. coli
gatagccgctatgatggattgtccg

SEQ ID NO: 190128 - DNA, 25 bp, E. coli
gatagccgctatcatggattgtccg

SEQ ID NO: 190129 - DNA, 25 bp, E. coli
tggcaataacctagcgggagctgga

SEQ ID NO: 190130 - DNA, 25 bp, E. coli
tggcaataaccttgcgggagctgga

SEQ ID NO: 190131 - DNA, 25 bp, E. coli
ctataaccgggggattgaggcacac

SEQ ID NO: 190132 - DNA, 25 bp, E. coli
ctataaccggggcattgaggcacac

SEQ ID NO: 190133 - DNA, 25 bp, E. coli
ttaacaacgtggcaacatgaaacgt

SEQ ID NO: 190134 - DNA, 25 bp, E. coli
ttaacaacgtgggaacatgaaacgt

SEQ ID NO: 190135 - DNA, 25 bp, E. coli
tgaggcacacgagcacatagcgatg

SEQ ID NO: 190136 - DNA, 25 bp, E. coli
tgcaaaagccagttgtaacgggggt

SEQ ID NO: 190137 - DNA, 25 bp, E. coli
tgcaaaagccagatgtaacgggggt

SEQ ID NO: 190138 - DNA, 25 bp, E. coli
tgaggcacacgaccacatagcgatg

SEQ ID NO: 190139 - DNA, 25 bp, E. coli
gtccgatattaacaacgtggcaaca

SEQ ID NO: 190140 - DNA, 25 bp, E. coli
gagagattctcctggaaagttaact

SEQ ID NO: 190141 - DNA, 25 bp, E. coli
gcacacgagcacatagcgatgcgga

SEQ ID NO: 190142 - DNA, 25 bp, E. coli
gagagattctccaggaaagttaact

SEQ ID NO: 190143 - DNA, 25 bp, E. coli
gcacacgagcacttagcgatgcgga

SEQ ID NO: 190144 - DNA, 25 bp, E. coli
gtccgatattaagaacgtggcaaca

SEQ ID NO: 190145 - DNA, 25 bp, E. coli
cgagcacatagccatgcggacaggt

SEQ ID NO: 190146 - DNA, 25 bp, E. coli
cgagcacatagcgatgcggacaggt

SEQ ID NO: 190147 - DNA, 25 bp, E. coli
gattctccaggaaagttaactgact

SEQ ID NO: 190148 - DNA, 25 bp, E. coli
gattgaggcacacgagcacatagcg

SEQ ID NO: 190149 - DNA, 25 bp, E. coli
gattgaggcacaggagcacatagcg

SEQ ID NO: 190150 - DNA, 25 bp, E. coli
gattctccaggatagttaactgact

SEQ ID NO: 190151 - DNA, 25 bp, E. coli
tggacaacgcagtaactatttttta

SEQ ID NO: 190152 - DNA, 25 bp, E. coli
tggacaacgcagaaactatttttta

SEQ ID NO: 190153 - DNA, 25 bp, E. coli
tacttgccattttggtcccgggctg

SEQ ID NO: 190154 - DNA, 25 bp, E. coli
tacttgccatttaggtcccgggctg

SEQ ID NO: 190155 - DNA, 25 bp, E. coli
tatcccatcagggtattttacttgc

SEQ ID NO: 190156 - DNA, 25 bp, E. coli
tatcccatcaggctattttacttgc

SEQ ID NO: 190157 - DNA, 25 bp, E. coli
ttccgtttctcttctcacgcgctag

SEQ ID NO: 190158 - DNA, 25 bp, E. coli
ttccgtttctctactcacgcgctag

SEQ ID NO: 190159 - DNA, 25 bp, E. coli
tgacactggttcgttggacttagag

SEQ ID NO: 190160 - DNA, 25 bp, E. coli
tgacactggttccttggacttagag

SEQ ID NO: 190161 - DNA, 25 bp, E. coli
tcccgggctgtgctcgaaattctca

SEQ ID NO: 190162 - DNA, 25 bp, E. coli
tcccgggctgtggtcgaaattctca

SEQ ID NO: 190163 - DNA, 25 bp, E. coli
tctcacgtacttaaatacgctccgg

SEQ ID NO: 190164 - DNA, 25 bp, E. coli
tctcacgtactttaatacgctccgg

SEQ ID NO: 190165 - DNA, 25 bp, E. coli
ccactgggaggcattcaggcgctgt

SEQ ID NO: 190166 - DNA, 25 bp, E. coli
ccactgggaggctttcaggcgctgt

SEQ ID NO: 190167 - DNA, 25 bp, E. coli
ggttttcctcatagtgtcagtggtg

SEQ ID NO: 190168 - DNA, 25 bp, E. coli
ggttttcctcattgtgtcagtggtg

SEQ ID NO: 190169 - DNA, 25 bp, E. coli
ggctgcgacaattacacctgatgag

SEQ ID NO: 190170 - DNA, 25 bp, E. coli
tggacttagagcgtatcccatcagg

SEQ ID NO: 190171 - DNA, 25 bp, E. coli
ggctgcgacaataacacctgatgag

SEQ ID NO: 190172 - DNA, 25 bp, E. coli
ggccgtgtccagtctggctgcgaca

SEQ ID NO: 190173 - DNA, 25 bp, E. coli
tggacttagagcctatcccatcagg

SEQ ID NO: 190174 - DNA, 25 bp, E. coli
ggccgtgtccagactggctgcgaca

SEQ ID NO: 190175 - DNA, 25 bp, E. coli
caatgggctgcaaagtcagaacggc

SEQ ID NO: 190176 - DNA, 25 bp, E. coli
aatacgctttatgagttgcgtgcgc

SEQ ID NO: 190177 - DNA, 25 bp, E. coli
caatgggctgcatagtcagaacggc

SEQ ID NO: 190178 - DNA, 25 bp, E. coli
aatacgctttatcagttgcgtgcgc

SEQ ID NO: 190179 - DNA, 25 bp, E. coli
atcctgagacgatgtgcagcgaaat

SEQ ID NO: 190180 - DNA, 25 bp, E. coli
atcctgagacgaagtgcagcgaaat

SEQ ID NO: 190181 - DNA, 25 bp, E. coli
tatcagttgcgtccgctgacggagc

SEQ ID NO: 190182 - DNA, 25 bp, E. coli
tatcagttgcgtgcgctgacggagc

SEQ ID NO: 190183 - DNA, 25 bp, E. coli
tgcccttcaataggctttatcagtt

SEQ ID NO: 190184 - DNA, 25 bp, E. coli
tgcccttcaatacgctttatcagtt

SEQ ID NO: 190185 - DNA, 25 bp, E. coli
gctgacggagcaacaacctgaactt

SEQ ID NO: 190186 - DNA, 25 bp, E. coli
gctgacggagcatcaacctgaactt

SEQ ID NO: 190187 - DNA, 25 bp, E. coli
gctgcatagtcacaacggctatgtc

SEQ ID NO: 190188 - DNA, 25 bp, E. coli
gctgcatagtcagaacggctatgtc

SEQ ID NO: 190189 - DNA, 25 bp, E. coli
gcactggcagcctacatcaccaatg

SEQ ID NO: 190190 - DNA, 25 bp, E. coli
gcactggcagccaacatcaccaatg

SEQ ID NO: 190191 - DNA, 25 bp, E. coli
cgctctgctgatcccggattacttc

SEQ ID NO: 190192 - DNA, 25 bp, E. coli
cgctctgctgatgccggattacttc

SEQ ID NO: 190193 - DNA, 25 bp, E. coli
ctttattaatccagagacgatgtgc

SEQ ID NO: 190194 - DNA, 25 bp, E. coli
ctttattaatcctgagacgatgtgc

SEQ ID NO: 190195 - DNA, 25 bp, E. coli
ggagcaacaacctgaacttattcca

SEQ ID NO: 190196 - DNA, 25 bp, E. coli
ggagcaacaaccagaacttattcca

SEQ ID NO: 190197 - DNA, 25 bp, E. coli
aatacggcgtgtattgcggttatac

SEQ ID NO: 190198 - DNA, 25 bp, E. coli
aatacggcgtgttttgcggttatac

SEQ ID NO: 190199 - DNA, 25 bp, E. coli
tacaaccgcgttaagcgagagctaa

SEQ ID NO: 190200 - DNA, 25 bp, E. coli
tacaaccgcgtttagcgagagctaa

SEQ ID NO: 190201 - DNA, 25 bp, E. coli
taccttccatcggagatggttccgt

SEQ ID NO: 190202 - DNA, 25 bp, E. coli
tagcgagagctaaacaagattattt

SEQ ID NO: 190203 - DNA, 25 bp, E. coli
taccttccatcgcagatggttccgt

SEQ ID NO: 190204 - DNA, 25 bp, E. coli
tagcgagagctatacaagattattt

SEQ ID NO: 190205 - DNA, 25 bp, E. coli
tatatgccggattaaatacggcgtg

SEQ ID NO: 190206 - DNA, 25 bp, E. coli
tatatgccggataaaatacggcgtg

SEQ ID NO: 190207 - DNA, 25 bp, E. coli
tgcggttatacatccgcgtttagcg

SEQ ID NO: 190208 - DNA, 25 bp, E. coli
tgcggttatacaaccgcgtttagcg

SEQ ID NO: 190209 - DNA, 25 bp, E. coli
cctattccatgagcaagcaaaaaca

SEQ ID NO: 190210 - DNA, 25 bp, E. coli
cctattccatgaccaagcaaaaaca

SEQ ID NO: 190211 - DNA, 25 bp, E. coli
gctaaacaagattatttacactgaa

SEQ ID NO: 190212 - DNA, 25 bp, E. coli
gctaaacaagataatttacactgaa

SEQ ID NO: 190213 - DNA, 25 bp, E. coli
gcaagcaaaaacaatatatgccgga

SEQ ID NO: 190214 - DNA, 25 bp, E. coli
gcaagcaaaaactatatatgccgga

SEQ ID NO: 190215 - DNA, 25 bp, E. coli
gacaacctccctattccatgagcaa

SEQ ID NO: 190216 - DNA, 25 bp, E. coli
gacaacctcccttttccatgagcaa

SEQ ID NO: 190217 - DNA, 25 bp, E. coli
gatggttccgtatgcgactcacagg

SEQ ID NO: 190218 - DNA, 25 bp, E. coli
gatggttccgtaagcgactcacagg

SEQ ID NO: 190219 - DNA, 25 bp, E. coli
aatttctgcggctgcggtgaagacc

SEQ ID NO: 190220 - DNA, 25 bp, E. coli
caagttctggaatacggcaagcggc

SEQ ID NO: 190221 - DNA, 25 bp, E. coli
aatttctgcggcagcggtgaagacc

SEQ ID NO: 190222 - DNA, 25 bp, E. coli
caagttctggaaaacggcaagcggc

SEQ ID NO: 190223 - DNA, 25 bp, E. coli
cacgaggtggttgctgaaatccaga

SEQ ID NO: 190224 - DNA, 25 bp, E. coli
cacgaggtggttcctgaaatccaga

SEQ ID NO: 190225 - DNA, 25 bp, E. coli
caaacaattcggtcgtaatccgtgg

SEQ ID NO: 190226 - DNA, 25 bp, E. coli
caaacaattcggacgtaatccgtgg

SEQ ID NO: 190227 - DNA, 25 bp, E. coli
cctaggcaaccctctggaggcgtaa

SEQ ID NO: 190228 - DNA, 25 bp, E. coli
cctaggcaacccactggaggcgtaa

SEQ ID NO: 190229 - DNA, 25 bp, E. coli
tacagcattcgcagcacgaggtggt

SEQ ID NO: 190230 - DNA, 25 bp, E. coli
tacagcattcgctgcacgaggtggt

SEQ ID NO: 190231 - DNA, 25 bp, E. coli
agaaaaactgctcgctctgggctac

SEQ ID NO: 190232 - DNA, 25 bp, E. coli
agaaaaactgctggctctgggctac

SEQ ID NO: 190233 - DNA, 25 bp, E. coli
tctcaacgccgtggatgacagcagt

SEQ ID NO: 190234 - DNA, 25 bp, E. coli
tctcaacgccgtcgatgacagcagt

SEQ ID NO: 190235 - DNA, 25 bp, E. coli
tggtcgttatgagagcctaggcaac

SEQ ID NO: 190236 - DNA, 25 bp, E. coli
ggtattcaccatcgcgaaccagaaa

SEQ ID NO: 190237 - DNA, 25 bp, E. coli
ggtattcaccatggcgaaccagaaa

SEQ ID NO: 190238 - DNA, 25 bp, E. coli
tggtcgttatgacagcctaggcaac

SEQ ID NO: 190239 - DNA, 25 bp, E. coli
gacgtgtgcagtctgtgctgctcaa

SEQ ID NO: 190240 - DNA, 25 bp, E. coli
gacgtgtgcagtgtgtgctgctcaa

SEQ ID NO: 190241 - DNA, 25 bp, E. coli
cagaccatcaaagaacggttttcca

SEQ ID NO: 190242 - DNA, 25 bp, E. coli
cagaccatcaaacaacggttttcca

SEQ ID NO: 190243 - DNA, 25 bp, E. coli
ttgaaccctgcaccttcaaagcgcg

SEQ ID NO: 190244 - DNA, 25 bp, E. coli
ttgaaccctgcagcttcaaagcgcg

SEQ ID NO: 190245 - DNA, 25 bp, E. coli
tgttcaacggtcaggtgcagcattt

SEQ ID NO: 190246 - DNA, 25 bp, E. coli
tgttcaacggtctggtgcagcattt

SEQ ID NO: 190247 - DNA, 25 bp, E. coli
tccatcgtgttcagcataaaagcca

SEQ ID NO: 190248 - DNA, 25 bp, E. coli
tcgacggaatcacaaccgtgggtac

SEQ ID NO: 190249 - DNA, 25 bp, E. coli
tcgacggaatcagaaccgtgggtac

SEQ ID NO: 190250 - DNA, 25 bp, E. coli
tccatcgtgttctgcataaaagcca

SEQ ID NO: 190251 - DNA, 25 bp, E. coli
tcggtcaggctgtcagcgtaatcag

SEQ ID NO: 190252 - DNA, 25 bp, E. coli
tcggtcaggctgacagcgtaatcag

SEQ ID NO: 190253 - DNA, 25 bp, E. coli
gcgtttgccggattggtcgcgccca

SEQ ID NO: 190254 - DNA, 25 bp, E. coli
gcgtttgccggaatggtcgcgccca

SEQ ID NO: 190255 - DNA, 25 bp, E. coli
gaaataagcgatatcgcgagcggca

SEQ ID NO: 190256 - DNA, 25 bp, E. coli
gaaataagcgatttcgcgagcggca

SEQ ID NO: 190257 - DNA, 25 bp, E. coli
gggtgcgcgggctcacttcgccttc

SEQ ID NO: 190258 - DNA, 25 bp, E. coli
gtcgcgcccagcagatcgcggtgac

SEQ ID NO: 190259 - DNA, 25 bp, E. coli
gtcgcgcccagctgatcgcggtgac

SEQ ID NO: 190260 - DNA, 25 bp, E. coli
gggtgcgcgggcacacttcgccttc

SEQ ID NO: 190261 - DNA, 25 bp, E. coli
tggaaaaagtaccttcaatagccat

SEQ ID NO: 190262 - DNA, 25 bp, E. coli
tggaaaaagtacgttcaatagccat

SEQ ID NO: 190263 - DNA, 25 bp, E. coli
caatgctaaaacaccgtcaggcgcg

SEQ ID NO: 190264 - DNA, 25 bp, E. coli
caatgctaaaactccgtcaggcgcg

SEQ ID NO: 190265 - DNA, 25 bp, E. coli
taaatacactcgagccgctttggct

SEQ ID NO: 190266 - DNA, 25 bp, E. coli
taaatacactcgtgccgctttggct

SEQ ID NO: 190267 - DNA, 25 bp, E. coli
tattgccgtgggatacaggtttgac

SEQ ID NO: 190268 - DNA, 25 bp, E. coli
tttggctcgcccaggaacacatgtc

SEQ ID NO: 190269 - DNA, 25 bp, E. coli
tattgccgtgggttacaggtttgac

SEQ ID NO: 190270 - DNA, 25 bp, E. coli
tatatggcctgatgccgctgtacct

SEQ ID NO: 190271 - DNA, 25 bp, E. coli
tatatggcctgaagccgctgtacct

SEQ ID NO: 190272 - DNA, 25 bp, E. coli
tttggctcgccctggaacacatgtc

SEQ ID NO: 190273 - DNA, 25 bp, E. coli
tcatttttgccgctggctgtgccgg

SEQ ID NO: 190274 - DNA, 25 bp, E. coli
tcatttttgccggtggctgtgccgg

SEQ ID NO: 190275 - DNA, 25 bp, E. coli
gcaggtaggcgttgtcagctcatcc

SEQ ID NO: 190276 - DNA, 25 bp, E. coli
gcaggtaggcgtagtcagctcatcc

SEQ ID NO: 190277 - DNA, 25 bp, E. coli
cgttattcatccacggtgccgctgg

SEQ ID NO: 190278 - DNA, 25 bp, E. coli
cgttattcatcctcggtgccgctgg

SEQ ID NO: 190279 - DNA, 25 bp, E. coli
cggcttggcgtgaatggctgcatta

SEQ ID NO: 190280 - DNA, 25 bp, E. coli
cggcttggcgtgtatggctgcatta

SEQ ID NO: 190281 - DNA, 25 bp, E. coli
ggctttacgctatatccggtggcga

SEQ ID NO: 190282 - DNA, 25 bp, E. coli
ggctttacgctaaatccggtggcga

SEQ ID NO: 190283 - DNA, 25 bp, E. coli
gatgaaccaggcgttactgttgagc

SEQ ID NO: 190284 - DNA, 25 bp, E. coli
gatgaaccaggccttactgttgagc

SEQ ID NO: 190285 - DNA, 25 bp, E. coli
aaccgatggcaatccattacctgcg

SEQ ID NO: 190286 - DNA, 25 bp, E. coli
cattacctgcgtttaccggaggaag

SEQ ID NO: 190287 - DNA, 25 bp, E. coli
tacaggtgagccaggttgaacccct

SEQ ID NO: 190288 - DNA, 25 bp, E. coli
tacaggtgagcctggttgaacccct

SEQ ID NO: 190289 - DNA, 25 bp, E. coli
aaccgatggcaaaccattacctgcg

SEQ ID NO: 190290 - DNA, 25 bp, E. coli
taccggaggaagtcacgtcattgtg

SEQ ID NO: 190291 - DNA, 25 bp, E. coli
taccggaggaagacacgtcattgtg

SEQ ID NO: 190292 - DNA, 25 bp, E. coli
tttaccggaggaagtcacgtcattg

SEQ ID NO: 190293 - DNA, 25 bp, E. coli
tttaccggaggatgtcacgtcattg

SEQ ID NO: 190294 - DNA, 25 bp, E. coli
tgagccaggttgaaccccttaccga

SEQ ID NO: 190295 - DNA, 25 bp, E. coli
tgagccaggttgtaccccttaccga

SEQ ID NO: 190296 - DNA, 25 bp, E. coli
tgagttcgccgcttgacacctcttg

SEQ ID NO: 190297 - DNA, 25 bp, E. coli
tgagttcgccgcatgacacctcttg

SEQ ID NO: 190298 - DNA, 25 bp, E. coli
gccgcatgacacgtcttgttatcag

SEQ ID NO: 190299 - DNA, 25 bp, E. coli
gccgcatgacacctcttgttatcag

SEQ ID NO: 190300 - DNA, 25 bp, E. coli
gcaaaccattacctgcgtttaccgg

SEQ ID NO: 190301 - DNA, 25 bp, E. coli
gcaaaccattacgtgcgtttaccgg

SEQ ID NO: 190302 - DNA, 25 bp, E. coli
cattacctgcgtataccggaggaag

SEQ ID NO: 190303 - DNA, 25 bp, E. coli
gttcgccgcatgacacctcttgtta

SEQ ID NO: 190304 - DNA, 25 bp, E. coli
gttcgccgcatgtcacctcttgtta

SEQ ID NO: 190305 - DNA, 25 bp, E. coli
gatggcaaaccattacctgcgttta

SEQ ID NO: 190306 - DNA, 25 bp, E. coli
gatggcaaaccaatacctgcgttta

SEQ ID NO: 190307 - DNA, 25 bp, E. coli
aatgttcagaggctatgtctccagc

SEQ ID NO: 190308 - DNA, 25 bp, E. coli
aatgttcagagggtatgtctccagc

SEQ ID NO: 190309 - DNA, 25 bp, E. coli
cacatacagcgtcaaaagagaagct

SEQ ID NO: 190310 - DNA, 25 bp, E. coli
cacatacagcgtgaaaagagaagct

SEQ ID NO: 190311 - DNA, 25 bp, E. coli
cattttgtgtcagagagattcgaga

SEQ ID NO: 190312 - DNA, 25 bp, E. coli
taaacgcacttcttcagctacaagc

SEQ ID NO: 190313 - DNA, 25 bp, E. coli
taaacgcacttcatcagctacaagc

SEQ ID NO: 190314 - DNA, 25 bp, E. coli
tatattgagtgcatggtaaacgcac

SEQ ID NO: 190315 - DNA, 25 bp, E. coli
tatattgagtgcttggtaaacgcac

SEQ ID NO: 190316 - DNA, 25 bp, E. coli
tacggagtacgagaacattcagaat

SEQ ID NO: 190317 - DNA, 25 bp, E. coli
tacggagtacgacaacattcagaat

SEQ ID NO: 190318 - DNA, 25 bp, E. coli
tctccagcagaactatataaatgcc

SEQ ID NO: 190319 - DNA, 25 bp, E. coli
tctccagcagaagtatataaatgcc

SEQ ID NO: 190320 - DNA, 25 bp, E. coli
ccagatgtaatccaatacggagtac

SEQ ID NO: 190321 - DNA, 25 bp, E. coli
ccagatgtaatcgaatacggagtac

SEQ ID NO: 190322 - DNA, 25 bp, E. coli
gaagaactgtgtctctctcatggag

SEQ ID NO: 190323 - DNA, 25 bp, E. coli
gaagaactgtgtgtctctcatggag

SEQ ID NO: 190324 - DNA, 25 bp, E. coli
cattttgtgtcacagagattcgaga

SEQ ID NO: 190325 - DNA, 25 bp, E. coli
ggctttgcgaaattcaacctcaaga

SEQ ID NO: 190326 - DNA, 25 bp, E. coli
ggctttgcgaaaatcaacctcaaga

SEQ ID NO: 190327 - DNA, 25 bp, E. coli
gacgttatatcagtggctttgcgaa

SEQ ID NO: 190328 - DNA, 25 bp, E. coli
gacgttatatcactggctttgcgaa

SEQ ID NO: 190329 - DNA, 25 bp, E. coli
caaaattattgagccgcgttcagcg

SEQ ID NO: 190330 - DNA, 25 bp, E. coli
caaaattattgacccgcgttcagcg

SEQ ID NO: 190331 - DNA, 25 bp, E. coli
taaaaagctggtatagtgccgtgcg

SEQ ID NO: 190332 - DNA, 25 bp, E. coli
taaaaagctggtttagtgccgtgcg

SEQ ID NO: 190333 - DNA, 25 bp, E. coli
aaagtgactttcaccgtcgcctggg

SEQ ID NO: 190334 - DNA, 25 bp, E. coli
aaaatggttcccgtgtcagcgagta

SEQ ID NO: 190335 - DNA, 25 bp, E. coli
aaagtgactttctccgtcgcctggg

SEQ ID NO: 190336 - DNA, 25 bp, E. coli
aaaatggttcccctgtcagcgagta

SEQ ID NO: 190337 - DNA, 25 bp, E. coli
tgctcggcgtgaagaaattgcgtcg

SEQ ID NO: 190338 - DNA, 25 bp, E. coli
tgctcggcgtgatgaaattgcgtcg

SEQ ID NO: 190339 - DNA, 25 bp, E. coli
gactattggcaacattaacgactgg

SEQ ID NO: 190340 - DNA, 25 bp, E. coli
gactattggcaagattaacgactgg

SEQ ID NO: 190341 - DNA, 25 bp, E. coli
gacttcgcagattcaccttaccgga

SEQ ID NO: 190342 - DNA, 25 bp, E. coli
gacttcgcagatacaccttaccgga

SEQ ID NO: 190343 - DNA, 25 bp, E. coli
taaccccagattacatagcagcgtg

SEQ ID NO: 190344 - DNA, 25 bp, E. coli
tcaactggagccgaaaaatggcgct

SEQ ID NO: 190345 - DNA, 25 bp, E. coli
taaccccagatttcatagcagcgtg

SEQ ID NO: 190346 - DNA, 25 bp, E. coli
tcaactggagcccaaaaatggcgct

SEQ ID NO: 190347 - DNA, 25 bp, E. coli
gatgtaacaaccgtggcatgccgag

SEQ ID NO: 190348 - DNA, 25 bp, E. coli
gagcaactagcggagcaaaagcctt

SEQ ID NO: 190349 - DNA, 25 bp, E. coli
gatgtaacaaccctggcatgccgag

SEQ ID NO: 190350 - DNA, 25 bp, E. coli
gagcaactagcgcagcaaaagcctt

SEQ ID NO: 190351 - DNA, 25 bp, E. coli
aagagcgtactgatccttggtgcgg

SEQ ID NO: 190352 - DNA, 25 bp, E. coli
caatatccaacgactgctggcttac

SEQ ID NO: 190353 - DNA, 25 bp, E. coli
aagagcgtactgttccttggtgcgg

SEQ ID NO: 190354 - DNA, 25 bp, E. coli
caatatccaacgtctgctggcttac

SEQ ID NO: 190355 - DNA, 25 bp, E. coli
gttcgggccgctgctcgccgtgggt

SEQ ID NO: 190356 - DNA, 25 bp, E. coli
gttcgggccgctcctcgccgtgggt

SEQ ID NO: 190357 - DNA, 25 bp, E. coli
atggcgaaagttaatggcgttactt

SEQ ID NO: 190358 - DNA, 25 bp, E. coli
atggcgaaagtttatggcgttactt

SEQ ID NO: 190359 - DNA, 25 bp, E. coli
tttatggcgttactttcctcggcgc

SEQ ID NO: 190360 - DNA, 25 bp, E. coli
tttatggcgttagtttcctcggcgc

SEQ ID NO: 190361 - DNA, 25 bp, E. coli
tcgtactgctggtactcggcatgat

SEQ ID NO: 190362 - DNA, 25 bp, E. coli
tcgtactgctggaactcggcatgat

SEQ ID NO: 190363 - DNA, 25 bp, E. coli
ccttggtctggttggtggtctgtac

SEQ ID NO: 190364 - DNA, 25 bp, E. coli
ccttggtctggtaggtggtctgtac

SEQ ID NO: 190365 - DNA, 25 bp, E. coli
gcatgatcaccggattcgtcggcgg

SEQ ID NO: 190366 - DNA, 25 bp, E. coli
gcatgatcaccgcattcgtcggcgg

SEQ ID NO: 190367 - DNA, 25 bp, E. coli
cgctgattgcccatggtctggttgg

SEQ ID NO: 190368 - DNA, 25 bp, E. coli
cgctgattgcccttggtctggttgg

SEQ ID NO: 190369 - DNA, 25 bp, E. coli
ggatcgtactgctggtactcggcat

SEQ ID NO: 190370 - DNA, 25 bp, E. coli
ggatcgtactgcaggtactcggcat

SEQ ID NO: 190371 - DNA, 25 bp, E. coli
gatggaacacaatatccaacgtctg

SEQ ID NO: 190372 - DNA, 25 bp, E. coli
gatggaacacaaaatccaacgtctg

SEQ ID NO: 190373 - DNA, 25 bp, E. coli
caaagatgtataccaccgaaagcgg

SEQ ID NO: 190374 - DNA, 25 bp, E. coli
cagcaatgggaaaaccgttacggca

SEQ ID NO: 190375 - DNA, 25 bp, E. coli
caaagatgtatagcaccgaaagcgg

SEQ ID NO: 190376 - DNA, 25 bp, E. coli
catcatcttcgtcctacatctcgta

SEQ ID NO: 190377 - DNA, 25 bp, E. coli
cagatgcattttagcttgaacggag

SEQ ID NO: 190378 - DNA, 25 bp, E. coli
catcatcttcgtgctacatctcgta

SEQ ID NO: 190379 - DNA, 25 bp, E. coli
cagcaatgggaataccgttacggca

SEQ ID NO: 190380 - DNA, 25 bp, E. coli
cagatgcatttttgcttgaacggag

SEQ ID NO: 190381 - DNA, 25 bp, E. coli
taaacgatgatgctagaaaaggcac

SEQ ID NO: 190382 - DNA, 25 bp, E. coli
taaacgatgatggtagaaaaggcac

SEQ ID NO: 190383 - DNA, 25 bp, E. coli
tatgcaagctcctataaatgtgatg

SEQ ID NO: 190384 - DNA, 25 bp, E. coli
tatgcaagctccaataaatgtgatg

SEQ ID NO: 190385 - DNA, 25 bp, E. coli
tgaacggagtgagttgggatctctc

SEQ ID NO: 190386 - DNA, 25 bp, E. coli
tgaacggagtgacttgggatctctc

SEQ ID NO: 190387 - DNA, 25 bp, E. coli
tcctccatcgattttgacggcaaac

SEQ ID NO: 190388 - DNA, 25 bp, E. coli
tcctccatcgatattgacggcaaac

SEQ ID NO: 190389 - DNA, 25 bp, E. coli
tcttcagcagggtcaaattggcagc

SEQ ID NO: 190390 - DNA, 25 bp, E. coli
tcttcagcagggacaaattggcagc

SEQ ID NO: 190391 - DNA, 25 bp, E. coli
gaaaaggcactttcaacatcagtga

SEQ ID NO: 190392 - DNA, 25 bp, E. coli
gaaaaggcacttacaacatcagtga

SEQ ID NO: 190393 - DNA, 25 bp, E. coli
cgaaagcgggaaggtctctgtatct

SEQ ID NO: 190394 - DNA, 25 bp, E. coli
cgaaagcgggaacgtctctgtatct

SEQ ID NO: 190395 - DNA, 25 bp, E. coli
cagaaccagattgatgcattgagct

SEQ ID NO: 190396 - DNA, 25 bp, E. coli
cagaaccagattcatgcattgagct

SEQ ID NO: 190397 - DNA, 25 bp, E. coli
taaaagcattggctacagaaaatac

SEQ ID NO: 190398 - DNA, 25 bp, E. coli
taaaagcattgggtacagaaaatac

SEQ ID NO: 190399 - DNA, 25 bp, E. coli
aaatacccataggtccatacccgga

SEQ ID NO: 190400 - DNA, 25 bp, E. coli
aaatacccatagctccatacccgga

SEQ ID NO: 190401 - DNA, 25 bp, E. coli
ttccataacgctgtagccaccagaa

SEQ ID NO: 190402 - DNA, 25 bp, E. coli
ttccataacgctctagccaccagaa

SEQ ID NO: 190403 - DNA, 25 bp, E. coli
tgaaaatgatgccaaagcgaacgac

SEQ ID NO: 190404 - DNA, 25 bp, E. coli
tgaaaatgatgcgaaagcgaacgac

SEQ ID NO: 190405 - DNA, 25 bp, E. coli
ccagaacagataatgcggaacgaca

SEQ ID NO: 190406 - DNA, 25 bp, E. coli
ccagaacagatattgcggaacgaca

SEQ ID NO: 190407 - DNA, 25 bp, E. coli
gaacgacaaagacaaacagaaccag

SEQ ID NO: 190408 - DNA, 25 bp, E. coli
gaacgacaaagagaaacagaaccag

SEQ ID NO: 190409 - DNA, 25 bp, E. coli
ccaaagcgaacgacaaggttgtagt

SEQ ID NO: 190410 - DNA, 25 bp, E. coli
ccaaagcgaacgtcaaggttgtagt

SEQ ID NO: 190411 - DNA, 25 bp, E. coli
gttaccaacgcttcgctcaaacata

SEQ ID NO: 190412 - DNA, 25 bp, E. coli
gttaccaacgctacgctcaaacata

SEQ ID NO: 190413 - DNA, 25 bp, E. coli
gggtaacattcaggcgcctggtagc

SEQ ID NO: 190414 - DNA, 25 bp, E. coli
gggtaacattcacgcgcctggtagc

SEQ ID NO: 190415 - DNA, 25 bp, E. coli
gatgagaagctgatgcaaaattccg

SEQ ID NO: 190416 - DNA, 25 bp, E. coli
gatgagaagctgttgcaaaattccg

SEQ ID NO: 190417 - DNA, 25 bp, E. coli
aatcttgacgatcgcagcgtggaag

SEQ ID NO: 190418 - DNA, 25 bp, E. coli
aatcttgacgatggcagcgtggaag

SEQ ID NO: 190419 - DNA, 25 bp, E. coli
tacgggcgagttcagggcgtaggat

SEQ ID NO: 190420 - DNA, 25 bp, E. coli
tacgggcgagttgagggcgtaggat

SEQ ID NO: 190421 - DNA, 25 bp, E. coli
acgatggcagcgaggaagtggttgc

SEQ ID NO: 190422 - DNA, 25 bp, E. coli
acgatggcagcgtggaagtggttgc

SEQ ID NO: 190423 - DNA, 25 bp, E. coli
aaaaatcttgacgatggcagcgtgg

SEQ ID NO: 190424 - DNA, 25 bp, E. coli
aaaaatcttgaccatggcagcgtgg

SEQ ID NO: 190425 - DNA, 25 bp, E. coli
ttgcctgggttttcgggcgagttca

SEQ ID NO: 190426 - DNA, 25 bp, E. coli
ttgcctgggtttacgggcgagttca

SEQ ID NO: 190427 - DNA, 25 bp, E. coli
ccaaaaatcttgacgatggcagcgt

SEQ ID NO: 190428 - DNA, 25 bp, E. coli
ccaaaaatcttgtcgatggcagcgt

SEQ ID NO: 190429 - DNA, 25 bp, E. coli
gcataattgcctgggtttacgggcg

SEQ ID NO: 190430 - DNA, 25 bp, E. coli
gcataattgcctcggtttacgggcg

SEQ ID NO: 190431 - DNA, 25 bp, E. coli
cgggtacgccaataatcttgacgat

SEQ ID NO: 190432 - DNA, 25 bp, E. coli
cgggtacgccaaaaatcttgacgat

SEQ ID NO: 190433 - DNA, 25 bp, E. coli
gtctgcataattgcctgggtttacg

SEQ ID NO: 190434 - DNA, 25 bp, E. coli
ggtacgccaaaattcttgacgatgg

SEQ ID NO: 190435 - DNA, 25 bp, E. coli
ggtacgccaaaaatcttgacgatgg

SEQ ID NO: 190436 - DNA, 25 bp, E. coli
gtctgcataattccctgggtttacg

SEQ ID NO: 190437 - DNA, 25 bp, E. coli
taattgcctgggtttacgggcgagt

SEQ ID NO: 190438 - DNA, 25 bp, E. coli
taattgcctgggattacgggcgagt

SEQ ID NO: 190439 - DNA, 25 bp, E. coli
catggatttgcaccagatgttgttg

SEQ ID NO: 190440 - DNA, 25 bp, E. coli
catggatttgcagcagatgttgttg

SEQ ID NO: 190441 - DNA, 25 bp, E. coli
agctaagatgaatgtcgagttcgac

SEQ ID NO: 190442 - DNA, 25 bp, E. coli
agctaagatgaaagtcgagttcgac

SEQ ID NO: 190443 - DNA, 25 bp, E. coli
tgtcaataaagtgaacgtaaagagt

SEQ ID NO: 190444 - DNA, 25 bp, E. coli
tgtacgaaggaaaaataatcgagct

SEQ ID NO: 190445 - DNA, 25 bp, E. coli
tgtttacatcgagtgtacgaaggaa

SEQ ID NO: 190446 - DNA, 25 bp, E. coli
tgtttacatcgactgtacgaaggaa

SEQ ID NO: 190447 - DNA, 25 bp, E. coli
tgtacgaaggaataataatcgagct

SEQ ID NO: 190448 - DNA, 25 bp, E. coli
tgtcaataaagtcaacgtaaagagt

SEQ ID NO: 190449 - DNA, 25 bp, E. coli
tcgcagattcatgaaatggtctata

SEQ ID NO: 190450 - DNA, 25 bp, E. coli
tcgcagattcatcaaatggtctata

SEQ ID NO: 190451 - DNA, 25 bp, E. coli
gcatgatattgtaaattcggactcg

SEQ ID NO: 190452 - DNA, 25 bp, E. coli
gcatgatattgttaattcggactcg

SEQ ID NO: 190453 - DNA, 25 bp, E. coli
gaaacgttagtcctttcctctattg

SEQ ID NO: 190454 - DNA, 25 bp, E. coli
gaaacgttagtcgtttcctctattg

SEQ ID NO: 190455 - DNA, 25 bp, E. coli
cgagttcgactcttggatttgcacc

SEQ ID NO: 190456 - DNA, 25 bp, E. coli
cgagttcgactcatggatttgcacc

SEQ ID NO: 190457 - DNA, 25 bp, E. coli
gattcactgagtaaactggttctta

SEQ ID NO: 190458 - DNA, 25 bp, E. coli
gttatatctcaccatctgtcaatga

SEQ ID NO: 190459 - DNA, 25 bp, E. coli
gattcactgagttaactggttctta

SEQ ID NO: 190460 - DNA, 25 bp, E. coli
gttatatctcacgatctgtcaatga

SEQ ID NO: 190461 - DNA, 25 bp, E. coli
aatgagtaatgctattaatccccgc

SEQ ID NO: 190462 - DNA, 25 bp, E. coli
aatgagtaatgcaattaatccccgc

SEQ ID NO: 190463 - DNA, 25 bp, E. coli
cacgtaaatgaatagagcgattggt

SEQ ID NO: 190464 - DNA, 25 bp, E. coli
cacgtaaatgaaaagagcgattggt

SEQ ID NO: 190465 - DNA, 25 bp, E. coli
catggcctacttatcattggctgcg

SEQ ID NO: 190466 - DNA, 25 bp, E. coli
catggcctacttttcattggctgcg

SEQ ID NO: 190467 - DNA, 25 bp, E. coli
agagcgattggttaatgagtaatgc

SEQ ID NO: 190468 - DNA, 25 bp, E. coli
agagcgattggtaaatgagtaatgc

SEQ ID NO: 190469 - DNA, 25 bp, E. coli
tattaatccccgcatggcctacttt

SEQ ID NO: 190470 - DNA, 25 bp, E. coli
tattaatccccggatggcctacttt

SEQ ID NO: 190471 - DNA, 25 bp, E. coli
tgttacataaaaagcacgtaaatga

SEQ ID NO: 190472 - DNA, 25 bp, E. coli
tgttacataaaatgcacgtaaatga

SEQ ID NO: 190473 - DNA, 25 bp, E. coli
tgaatatgggcaagactctgactga

SEQ ID NO: 190474 - DNA, 25 bp, E. coli
tgaatatgggcatgactctgactga

SEQ ID NO: 190475 - DNA, 25 bp, E. coli
tcattggctgcggtgttgaacctca

SEQ ID NO: 190476 - DNA, 25 bp, E. coli
tcattggctgcgctgttgaacctca

SEQ ID NO: 190477 - DNA, 25 bp, E. coli
gaacctcattgaatatgggcaagac

SEQ ID NO: 190478 - DNA, 25 bp, E. coli
gaacctcattgattatgggcaagac

SEQ ID NO: 190479 - DNA, 25 bp, E. coli
ggctgcggtgttcaacctcattgaa

SEQ ID NO: 190480 - DNA, 25 bp, E. coli
ggctgcggtgttgaacctcattgaa

SEQ ID NO: 190481 - DNA, 25 bp, E. coli
taatgctattaaaccccgcatggcc

SEQ ID NO: 190482 - DNA, 25 bp, E. coli
taatgctattaatccccgcatggcc

SEQ ID NO: 190483 - DNA, 25 bp, E. coli
caatttttaagcgacagacgcgtgg

SEQ ID NO: 190484 - DNA, 25 bp, E. coli
caatttttaagccacagacgcgtgg

SEQ ID NO: 190485 - DNA, 25 bp, E. coli
catattcaggtgatgtgcccgggct

SEQ ID NO: 190486 - DNA, 25 bp, E. coli
catattcaggtgttgtgcccgggct

SEQ ID NO: 190487 - DNA, 25 bp, E. coli
tagatcatattgaggtgctgccgct

SEQ ID NO: 190488 - DNA, 25 bp, E. coli
tagatcatattgtggtgctgccgct

SEQ ID NO: 190489 - DNA, 25 bp, E. coli
tgatgacctttcagtcgcgctttgg

SEQ ID NO: 190490 - DNA, 25 bp, E. coli
tgatgacctttctgtcgcgctttgg

SEQ ID NO: 190491 - DNA, 25 bp, E. coli
tccccagcgttatgcagatgaaggc

SEQ ID NO: 190492 - DNA, 25 bp, E. coli
tccccagcgttaagcagatgaaggc

SEQ ID NO: 190493 - DNA, 25 bp, E. coli
ccaaacatggcgtaccggatctgct

SEQ ID NO: 190494 - DNA, 25 bp, E. coli
gccatcactggatagcgccgtagat

SEQ ID NO: 190495 - DNA, 25 bp, E. coli
ccaaacatggcgaaccggatctgct

SEQ ID NO: 190496 - DNA, 25 bp, E. coli
gccatcactggaaagcgccgtagat

SEQ ID NO: 190497 - DNA, 25 bp, E. coli
gcgaagctgtatgcctctgtctgga

SEQ ID NO: 190498 - DNA, 25 bp, E. coli
gcgaagctgtatccctctgtctgga

SEQ ID NO: 190499 - DNA, 25 bp, E. coli
ggctgatgccttttaccgacgaaac

SEQ ID NO: 190500 - DNA, 25 bp, E. coli
ggctgatgccttataccgacgaaac

SEQ ID NO: 190501 - DNA, 25 bp, E. coli
gacgaaacgctgaaaatgctcggag

SEQ ID NO: 190502 - DNA, 25 bp, E. coli
gacgaaacgctgtaaatgctcggag

SEQ ID NO: 190503 - DNA, 25 bp, E. coli
gatgattacccgcaacgttgccgca

SEQ ID NO: 190504 - DNA, 25 bp, E. coli
gatgattacccggaacgttgccgca

SEQ ID NO: 190505 - DNA, 25 bp, E. coli
caacgttcgcggaatgctgggcttc

SEQ ID NO: 190506 - DNA, 25 bp, E. coli
caacgttcgcggtatgctgggcttc

SEQ ID NO: 190507 - DNA, 25 bp, E. coli
taaaactgcgcgacgtcgttatcgg

SEQ ID NO: 190508 - DNA, 25 bp, E. coli
taaaactgcgcgtcgtcgttatcgg

SEQ ID NO: 190509 - DNA, 25 bp, E. coli
tcgttatcggtatgggtgcctgcac

SEQ ID NO: 190510 - DNA, 25 bp, E. coli
tcgttatcggtaagggtgcctgcac

SEQ ID NO: 190511 - DNA, 25 bp, E. coli
tctccggacggcgaaatgttcgacg

SEQ ID NO: 190512 - DNA, 25 bp, E. coli
tctccggacggccaaatgttcgacg

SEQ ID NO: 190513 - DNA, 25 bp, E. coli
gaaactttccttgaagatgcccgtg

SEQ ID NO: 190514 - DNA, 25 bp, E. coli
gactttgccgctttcgctgacttcg

SEQ ID NO: 190515 - DNA, 25 bp, E. coli
gacccgctgcgtgcgaagtatattg

SEQ ID NO: 190516 - DNA, 25 bp, E. coli
gactttgccgctatcgctgacttcg

SEQ ID NO: 190517 - DNA, 25 bp, E. coli
gaaactttccttcaagatgcccgtg

SEQ ID NO: 190518 - DNA, 25 bp, E. coli
gacccgctgcgtccgaagtatattg

SEQ ID NO: 190519 - DNA, 25 bp, E. coli
ggtgcctgcaccgattccaaagtta

SEQ ID NO: 190520 - DNA, 25 bp, E. coli
ggtgcctgcacccattccaaagtta

SEQ ID NO: 190521 - DNA, 25 bp, E. coli
tggaatccgttctgctgggcgataa

SEQ ID NO: 190522 - DNA, 25 bp, E. coli
tggaatccgttcagctgggcgataa

SEQ ID NO: 190523 - DNA, 25 bp, E. coli
gacgtagttttgatgccaggcgacc

SEQ ID NO: 190524 - DNA, 25 bp, E. coli
gatgcccgtgaactgaacaacgttc

SEQ ID NO: 190525 - DNA, 25 bp, E. coli
gatgcccgtgaagtgaacaacgttc

SEQ ID NO: 190526 - DNA, 25 bp, E. coli
gacgtagttttgttgccaggcgacc

SEQ ID NO: 190527 - DNA, 25 bp, E. coli
tgcgtgagggagattcagatctgtt

SEQ ID NO: 190528 - DNA, 25 bp, E. coli
tgcgtgagggagtttcagatctgtt

SEQ ID NO: 190529 - DNA, 25 bp, E. coli
tcgttacttagctatgccccggctc

SEQ ID NO: 190530 - DNA, 25 bp, E. coli
tcgttacttagcaatgccccggctc

SEQ ID NO: 190531 - DNA, 25 bp, E. coli
ccttggaagagattgggtagcacgt

SEQ ID NO: 190532 - DNA, 25 bp, E. coli
gcccgtagtggccttttgttctcat

SEQ ID NO: 190533 - DNA, 25 bp, E. coli
gcccgtagtggcgttttgttctcat

SEQ ID NO: 190534 - DNA, 25 bp, E. coli
ccttggaagagaatgggtagcacgt

SEQ ID NO: 190535 - DNA, 25 bp, E. coli
gctaggttgggctgtctcagcaaac

SEQ ID NO: 190536 - DNA, 25 bp, E. coli
gctaggttgggcagtctcagcaaac

SEQ ID NO: 190537 - DNA, 25 bp, E. coli
cgttggcctcacacgttacttagca

SEQ ID NO: 190538 - DNA, 25 bp, E. coli
cgttggcctcactcgttacttagca

SEQ ID NO: 190539 - DNA, 25 bp, E. coli
cgtcggtagatgttttacggatgca

SEQ ID NO: 190540 - DNA, 25 bp, E. coli
cattacagatgcacctgagtctggg

SEQ ID NO: 190541 - DNA, 25 bp, E. coli
cgtcggtagatgatttacggatgca

SEQ ID NO: 190542 - DNA, 25 bp, E. coli
cattacagatgctcctgagtctggg

SEQ ID NO: 190543 - DNA, 25 bp, E. coli
gggtagcacgtaacaccccatcact

SEQ ID NO: 190544 - DNA, 25 bp, E. coli
ggtactctaccgttggcctcactcg

SEQ ID NO: 190545 - DNA, 25 bp, E. coli
gggtagcacgtatcaccccatcact

SEQ ID NO: 190546 - DNA, 25 bp, E. coli
ggtactctaccgatggcctcactcg

SEQ ID NO: 190547 - DNA, 25 bp, E. coli
ggctgtctcagcaaaccttggaaga

SEQ ID NO: 190548 - DNA, 25 bp, E. coli
ggctgtctcagctaaccttggaaga

SEQ ID NO: 190549 - DNA, 25 bp, E. coli
tacgctttcgcctgcagattggaga

SEQ ID NO: 190550 - DNA, 25 bp, E. coli
tacgctttcgccagcagattggaga

SEQ ID NO: 190551 - DNA, 25 bp, E. coli
ttaaggctgatgatcgggcactggc

SEQ ID NO: 190552 - DNA, 25 bp, E. coli
ttaaggctgatgttcgggcactggc

SEQ ID NO: 190553 - DNA, 25 bp, E. coli
tgattaagtgtctgccgcgtgagcc

SEQ ID NO: 190554 - DNA, 25 bp, E. coli
tgattaagtgtcagccgcgtgagcc

SEQ ID NO: 190555 - DNA, 25 bp, E. coli
tccctttcggacttgggtagcccgg

SEQ ID NO: 190556 - DNA, 25 bp, E. coli
tccctttcggacatgggtagcccgg

SEQ ID NO: 190557 - DNA, 25 bp, E. coli
gaaagagtagccattgcaatgccct

SEQ ID NO: 190558 - DNA, 25 bp, E. coli
gaaagagtagcctttgcaatgccct

SEQ ID NO: 190559 - DNA, 25 bp, E. coli
ccctgtttgccggtgaagtatcgcc

SEQ ID NO: 190560 - DNA, 25 bp, E. coli
ccctgtttgccgctgaagtatcgcc

SEQ ID NO: 190561 - DNA, 25 bp, E. coli
ggaccattattctggccgtgcgttc

SEQ ID NO: 190562 - DNA, 25 bp, E. coli
ggaccattattcaggccgtgcgttc

SEQ ID NO: 190563 - DNA, 25 bp, E. coli
gatcggcatcatcggtaaaactggg

SEQ ID NO: 190564 - DNA, 25 bp, E. coli
gatcggcatcatgggtaaaactggg

SEQ ID NO: 190565 - DNA, 25 bp, E. coli
gattggcgaagcataccggcataag

SEQ ID NO: 190566 - DNA, 25 bp, E. coli
gattggcgaagcttaccggcataag

SEQ ID NO: 190567 - DNA, 25 bp, E. coli
gatgagcattttaaccgtcaggtga

SEQ ID NO: 190568 - DNA, 25 bp, E. coli
gagaacactttatgaccatcgtgga

SEQ ID NO: 190569 - DNA, 25 bp, E. coli
gagaacactttaagaccatcgtgga

SEQ ID NO: 190570 - DNA, 25 bp, E. coli
gatgagcatttttaccgtcaggtga

SEQ ID NO: 190571 - DNA, 25 bp, E. coli
catttttgccatttctgcgcttgcg

SEQ ID NO: 190572 - DNA, 25 bp, E. coli
catatctgcgctagcggcgacttct

SEQ ID NO: 190573 - DNA, 25 bp, E. coli
catatctgcgcttgcggcgacttct

SEQ ID NO: 190574 - DNA, 25 bp, E. coli
catttttgccatatctgcgcttgcg

SEQ ID NO: 190575 - DNA, 25 bp, E. coli
aaaagttctgtaaggcatttttgcc

SEQ ID NO: 190576 - DNA, 25 bp, E. coli
aaaagttctgtatggcatttttgcc

SEQ ID NO: 190577 - DNA, 25 bp, E. coli
tcggcagcaacgtcggtttcggcgg

SEQ ID NO: 190578 - DNA, 25 bp, E. coli
tctgcgtgggctccacctgtacagg

SEQ ID NO: 190579 - DNA, 25 bp, E. coli
tctgcgtgggctgcacctgtacagg

SEQ ID NO: 190580 - DNA, 25 bp, E. coli
tcggcagcaacgacggtttcggcgg

SEQ ID NO: 190581 - DNA, 25 bp, E. coli
gcgaccagcgtcagcaccgtaagct

SEQ ID NO: 190582 - DNA, 25 bp, E. coli
gcgaccagcgtctgcaccgtaagct

SEQ ID NO: 190583 - DNA, 25 bp, E. coli
gcgtcagcaccgtaagctcggcggt

SEQ ID NO: 190584 - DNA, 25 bp, E. coli
gcgtcagcaccgaaagctcggcggt

SEQ ID NO: 190585 - DNA, 25 bp, E. coli
cggtggcggtgatggttctaatacc

SEQ ID NO: 190586 - DNA, 25 bp, E. coli
cggtggcggtgaaggttctaatacc

SEQ ID NO: 190587 - DNA, 25 bp, E. coli
ggcgacttctgcctgggctgcacct

SEQ ID NO: 190588 - DNA, 25 bp, E. coli
ggcgacttctgcgtgggctgcacct

SEQ ID NO: 190589 - DNA, 25 bp, E. coli
taagctcggcggtgggtgtcgcgct

SEQ ID NO: 190590 - DNA, 25 bp, E. coli
taagctcggcggagggtgtcgcgct

SEQ ID NO: 190591 - DNA, 25 bp, E. coli
gatggttctaattccgggaccacca

SEQ ID NO: 190592 - DNA, 25 bp, E. coli
gatggttctaataccgggaccacca

SEQ ID NO: 190593 - DNA, 25 bp, E. coli
taaacttcggttgccaatgcaggaa

SEQ ID NO: 190594 - DNA, 25 bp, E. coli
taaacttcggttcccaatgcaggaa

SEQ ID NO: 190595 - DNA, 25 bp, E. coli
tagtcatctgctgatccgtgccacg

SEQ ID NO: 190596 - DNA, 25 bp, E. coli
tagtcatctgctcatccgtgccacg

SEQ ID NO: 190597 - DNA, 25 bp, E. coli
tttttgatcctggaaccgctggtgg

SEQ ID NO: 190598 - DNA, 25 bp, E. coli
tttttgatcctgcaaccgctggtgg

SEQ ID NO: 190599 - DNA, 25 bp, E. coli
tgagccctaacatacccaggatggg

SEQ ID NO: 190600 - DNA, 25 bp, E. coli
tgagccctaacaaacccaggatggg

SEQ ID NO: 190601 - DNA, 25 bp, E. coli
tgaagtcactgacaatggcgacggc

SEQ ID NO: 190602 - DNA, 25 bp, E. coli
tgcacgctcgcataccggtggttta

SEQ ID NO: 190603 - DNA, 25 bp, E. coli
tgcacgctcgcaaaccggtggttta

SEQ ID NO: 190604 - DNA, 25 bp, E. coli
tgaagtcactgagaatggcgacggc

SEQ ID NO: 190605 - DNA, 25 bp, E. coli
tccaaaaagtgcgtatgagagaccg

SEQ ID NO: 190606 - DNA, 25 bp, E. coli
tccaaaaagtgcctatgagagaccg

SEQ ID NO: 190607 - DNA, 25 bp, E. coli
tcttgaagatgctcagcgtaccgaa

SEQ ID NO: 190608 - DNA, 25 bp, E. coli
tcttgaagatgcacagcgtaccgaa

SEQ ID NO: 190609 - DNA, 25 bp, E. coli
tcttatctggtccaacaagcgcaca

SEQ ID NO: 190610 - DNA, 25 bp, E. coli
tcttatctggtcgaacaagcgcaca

SEQ ID NO: 190611 - DNA, 25 bp, E. coli
gtaaaacgccttcagaccctgcagg

SEQ ID NO: 190612 - DNA, 25 bp, E. coli
gtaaaacgccttgagaccctgcagg

SEQ ID NO: 190613 - DNA, 25 bp, E. coli
taatttgcaccagaatacacgtcgc

SEQ ID NO: 190614 - DNA, 25 bp, E. coli
taatttgcaccacaatacacgtcgc

SEQ ID NO: 190615 - DNA, 25 bp, E. coli
caccgctggcctcaagactttaaca

SEQ ID NO: 190616 - DNA, 25 bp, E. coli
caccgctggcctgaagactttaaca

SEQ ID NO: 190617 - DNA, 25 bp, E. coli
agactttaacatatccagggatttg

SEQ ID NO: 190618 - DNA, 25 bp, E. coli
agactttaacatttccagggatttg

SEQ ID NO: 190619 - DNA, 25 bp, E. coli
tgaagactttaagatatccagggat

SEQ ID NO: 190620 - DNA, 25 bp, E. coli
tgaagactttaacatatccagggat

SEQ ID NO: 190621 - DNA, 25 bp, E. coli
cctgaagacttttacatatccaggg

SEQ ID NO: 190622 - DNA, 25 bp, E. coli
cctgaagactttaacatatccaggg

SEQ ID NO: 190623 - DNA, 25 bp, E. coli
gctggcctgaagtctttaacatatc

SEQ ID NO: 190624 - DNA, 25 bp, E. coli
gctggcctgaagactttaacatatc

SEQ ID NO: 190625 - DNA, 25 bp, E. coli
gaagactttaacatatccagggatt

SEQ ID NO: 190626 - DNA, 25 bp, E. coli
gaagactttaacttatccagggatt

SEQ ID NO: 190627 - DNA, 25 bp, E. coli
gactttaacataaccagggatttga

SEQ ID NO: 190628 - DNA, 25 bp, E. coli
gactttaacatatccagggatttga

SEQ ID NO: 190629 - DNA, 25 bp, E. coli
ccgctggcctgaagactttaacata

SEQ ID NO: 190630 - DNA, 25 bp, E. coli
cgctggcctgaagactttaacatat

SEQ ID NO: 190631 - DNA, 25 bp, E. coli
ccgctggcctgatgactttaacata

SEQ ID NO: 190632 - DNA, 25 bp, E. coli
cgctggcctgaacactttaacatat

SEQ ID NO: 190633 - DNA, 25 bp, E. coli
ctggcctgaagactttaacatatcc

SEQ ID NO: 190634 - DNA, 25 bp, E. coli
ctggcctgaagagtttaacatatcc

SEQ ID NO: 190635 - DNA, 25 bp, E. coli
ggcctgaagactataacatatccag

SEQ ID NO: 190636 - DNA, 25 bp, E. coli
ggcctgaagactttaacatatccag

SEQ ID NO: 190637 - DNA, 25 bp, E. coli
cagcagggccatcgtcagtggttca

SEQ ID NO: 190638 - DNA, 25 bp, E. coli
cagcagggccatggtcagtggttca

SEQ ID NO: 190639 - DNA, 25 bp, E. coli
taaacactatcgaaagcagcagggc

SEQ ID NO: 190640 - DNA, 25 bp, E. coli
taaacactatcgtaagcagcagggc

SEQ ID NO: 190641 - DNA, 25 bp, E. coli
agaccgttcgccaggaaaagctgga

SEQ ID NO: 190642 - DNA, 25 bp, E. coli
agaccgttcgcctggaaaagctgga

SEQ ID NO: 190643 - DNA, 25 bp, E. coli
aaaagctggacaacgcaactggcga

SEQ ID NO: 190644 - DNA, 25 bp, E. coli
aaaagctggacatcgcaactggcga

SEQ ID NO: 190645 - DNA, 25 bp, E. coli
tggtggtaaacatcaccgagtaagc

SEQ ID NO: 190646 - DNA, 25 bp, E. coli
tgtgaaaattactggcatcagcgcc

SEQ ID NO: 190647 - DNA, 25 bp, E. coli
tgtacgcggttttccaaagtggtgg

SEQ ID NO: 190648 - DNA, 25 bp, E. coli
tgtgaaaattacaggcatcagcgcc

SEQ ID NO: 190649 - DNA, 25 bp, E. coli
tgtacgcggtttaccaaagtggtgg

SEQ ID NO: 190650 - DNA, 25 bp, E. coli
tgaagttgttgcacacggtcgtggc

SEQ ID NO: 190651 - DNA, 25 bp, E. coli
tgaagttgttgctcacggtcgtggc

SEQ ID NO: 190652 - DNA, 25 bp, E. coli
gctgatgatcgcaaacggtgaagaa

SEQ ID NO: 190653 - DNA, 25 bp, E. coli
gctgatgatcgctaacggtgaagaa

SEQ ID NO: 190654 - DNA, 25 bp, E. coli
ccgagtaagcgaaggtcagaccgtt

SEQ ID NO: 190655 - DNA, 25 bp, E. coli
ccgagtaagcgatggtcagaccgtt

SEQ ID NO: 190656 - DNA, 25 bp, E. coli
cgttcctttcgtagatggcggcgta

SEQ ID NO: 190657 - DNA, 25 bp, E. coli
cgttcctttcgttgatggcggcgta

SEQ ID NO: 190658 - DNA, 25 bp, E. coli
tggtggtaaacaacaccgagtaagc

SEQ ID NO: 190659 - DNA, 25 bp, E. coli
cacgataacgatcgccatgaatgga

SEQ ID NO: 190660 - DNA, 25 bp, E. coli
cacagaccttgctcatacgtttggg

SEQ ID NO: 190661 - DNA, 25 bp, E. coli
cacagaccttgcacatacgtttggg

SEQ ID NO: 190662 - DNA, 25 bp, E. coli
cacgataacgatggccatgaatgga

SEQ ID NO: 190663 - DNA, 25 bp, E. coli
catacgtttgggttagctcttgaag

SEQ ID NO: 190664 - DNA, 25 bp, E. coli
catacgtttgggatagctcttgaag

SEQ ID NO: 190665 - DNA, 25 bp, E. coli
aactgctcggtatgtttttcctgtc

SEQ ID NO: 190666 - DNA, 25 bp, E. coli
aactgctcggtaagtttttcctgtc

SEQ ID NO: 190667 - DNA, 25 bp, E. coli
tgaatagcaatccagaactgctcgg

SEQ ID NO: 190668 - DNA, 25 bp, E. coli
tgaatagcaatcgagaactgctcgg

SEQ ID NO: 190669 - DNA, 25 bp, E. coli
ccatgaatggattctggagtgtgca

SEQ ID NO: 190670 - DNA, 25 bp, E. coli
ccatgaatggatactggagtgtgca

SEQ ID NO: 190671 - DNA, 25 bp, E. coli
gctcttgaagaggaaactgacgtgc

SEQ ID NO: 190672 - DNA, 25 bp, E. coli
gctcttgaagagcaaactgacgtgc

SEQ ID NO: 190673 - DNA, 25 bp, E. coli
gaatgagaaattacgcacagacctt

SEQ ID NO: 190674 - DNA, 25 bp, E. coli
gaatgagaaatttcgcacagacctt

SEQ ID NO: 190675 - DNA, 25 bp, E. coli
ctggagtgtgcaactcaatctgaaa

SEQ ID NO: 190676 - DNA, 25 bp, E. coli
ctggagtgtgcatctcaatctgaaa

SEQ ID NO: 190677 - DNA, 25 bp, E. coli
taattagatccttgtcttccagacc

SEQ ID NO: 190678 - DNA, 25 bp, E. coli
taattagatcctagtcttccagacc

SEQ ID NO: 190679 - DNA, 25 bp, E. coli
gacgtgctctctatccacgataacg

SEQ ID NO: 190680 - DNA, 25 bp, E. coli
gacgtgctctctttccacgataacg

SEQ ID NO: 190681 - DNA, 25 bp, E. coli
ttgtaacaaaggtaacgaactgcac

SEQ ID NO: 190682 - DNA, 25 bp, E. coli
ttgtaacaaaggaaacgaactgcac

SEQ ID NO: 190683 - DNA, 25 bp, E. coli
tgttgcagcacaaatgcagatgaat

SEQ ID NO: 190684 - DNA, 25 bp, E. coli
tgttgcagcacatatgcagatgaat

SEQ ID NO: 190685 - DNA, 25 bp, E. coli
tgcaaacaggcgtggaatgctgctg

SEQ ID NO: 190686 - DNA, 25 bp, E. coli
tgcagatgaatgtccttacgcggtt

SEQ ID NO: 190687 - DNA, 25 bp, E. coli
tgcagatgaatgaccttacgcggtt

SEQ ID NO: 190688 - DNA, 25 bp, E. coli
tgcaaacaggcgaggaatgctgctg

SEQ ID NO: 190689 - DNA, 25 bp, E. coli
gctgctgatgcattaagcctttctg

SEQ ID NO: 190690 - DNA, 25 bp, E. coli
gctgctgatgcaataagcctttctg

SEQ ID NO: 190691 - DNA, 25 bp, E. coli
gctcgccagattcttgcagcacata

SEQ ID NO: 190692 - DNA, 25 bp, E. coli
gctcgccagattgttgcagcacata

SEQ ID NO: 190693 - DNA, 25 bp, E. coli
cgctgcgtctcatgggagtgtgctt

SEQ ID NO: 190694 - DNA, 25 bp, E. coli
cgctgcgtctcaagggagtgtgctt

SEQ ID NO: 190695 - DNA, 25 bp, E. coli
ctcaggcagagaattgtaacaaagg

SEQ ID NO: 190696 - DNA, 25 bp, E. coli
ctcaggcagagatttgtaacaaagg

SEQ ID NO: 190697 - DNA, 25 bp, E. coli
ggagtgtgcttgtctgctcgccaga

SEQ ID NO: 190698 - DNA, 25 bp, E. coli
ggagtgtgcttgactgctcgccaga

SEQ ID NO: 190699 - DNA, 25 bp, E. coli
taagcctttctggactcaggcagag

SEQ ID NO: 190700 - DNA, 25 bp, E. coli
taagcctttctgcactcaggcagag

SEQ ID NO: 190701 - DNA, 25 bp, E. coli
gaccttacgcggatgcaaacaggcg

SEQ ID NO: 190702 - DNA, 25 bp, E. coli
gaccttacgcggttgcaaacaggcg

SEQ ID NO: 190703 - DNA, 25 bp, E. coli
caattggcacaattcagcacggtca

SEQ ID NO: 190704 - DNA, 25 bp, E. coli
caattggcacaaatcagcacggtca

SEQ ID NO: 190705 - DNA, 25 bp, E. coli
cacagtttcacctgggacggtacgt

SEQ ID NO: 190706 - DNA, 25 bp, E. coli
cacagtttcaccagggacggtacgt

SEQ ID NO: 190707 - DNA, 25 bp, E. coli
atacgctggatcacggcacttacgg

SEQ ID NO: 190708 - DNA, 25 bp, E. coli
accactgttcttgcgggaaccggca

SEQ ID NO: 190709 - DNA, 25 bp, E. coli
agcagtagttcggtcacgggcagca

SEQ ID NO: 190710 - DNA, 25 bp, E. coli
accactgttcttccgggaaccggca

SEQ ID NO: 190711 - DNA, 25 bp, E. coli
atacgctggatctcggcacttacgg

SEQ ID NO: 190712 - DNA, 25 bp, E. coli
agcagtagttcgctcacgggcagca

SEQ ID NO: 190713 - DNA, 25 bp, E. coli
tgtgaccacgaccacgccgtttggt

SEQ ID NO: 190714 - DNA, 25 bp, E. coli
tgtgaccacgacgacgccgtttggt

SEQ ID NO: 190715 - DNA, 25 bp, E. coli
tccaatggaaaagaacgagctgacg

SEQ ID NO: 190716 - DNA, 25 bp, E. coli
tccaatggaaaacaacgagctgacg

SEQ ID NO: 190717 - DNA, 25 bp, E. coli
gcaacgccgcagttttacaaagcag

SEQ ID NO: 190718 - DNA, 25 bp, E. coli
gcaacgccgcagatttacaaagcag

SEQ ID NO: 190719 - DNA, 25 bp, E. coli
cctcgacgaagtacggcagataatt

SEQ ID NO: 190720 - DNA, 25 bp, E. coli
cctcgacgaagttcggcagataatt

SEQ ID NO: 190721 - DNA, 25 bp, E. coli
gataacagccagacgttacaggcca

SEQ ID NO: 190722 - DNA, 25 bp, E. coli
gataacagccagtcgttacaggcca

SEQ ID NO: 190723 - DNA, 25 bp, E. coli
taacggtggtacacaactggttgcc

SEQ ID NO: 190724 - DNA, 25 bp, E. coli
taacggtggtactcaactggttgcc

SEQ ID NO: 190725 - DNA, 25 bp, E. coli
cagttgcgaaattccagcgatcagc

SEQ ID NO: 190726 - DNA, 25 bp, E. coli
cagttgcgaaataccagcgatcagc

SEQ ID NO: 190727 - DNA, 25 bp, E. coli
aactgaatggactctaccctctggc

SEQ ID NO: 190728 - DNA, 25 bp, E. coli
aactgaatggacactaccctctggc

SEQ ID NO: 190729 - DNA, 25 bp, E. coli
tagtgaccgtcaacgactatggcgt

SEQ ID NO: 190730 - DNA, 25 bp, E. coli
tagtgaccgtcatcgactatggcgt

SEQ ID NO: 190731 - DNA, 25 bp, E. coli
ttccatgagcatcagcagcagcgcg

SEQ ID NO: 190732 - DNA, 25 bp, E. coli
ttccatgagcatgagcagcagcgcg

SEQ ID NO: 190733 - DNA, 25 bp, E. coli
tgccagcgtggtaatgaccggaacc

SEQ ID NO: 190734 - DNA, 25 bp, E. coli
tgccagcgtggttatgaccggaacc

SEQ ID NO: 190735 - DNA, 25 bp, E. coli
gaatgtaccgttaatgccaaccccg

SEQ ID NO: 190736 - DNA, 25 bp, E. coli
gaatgtaccgtttatgccaaccccg

SEQ ID NO: 190737 - DNA, 25 bp, E. coli
gacatttcgcatggaagctgccgca

SEQ ID NO: 190738 - DNA, 25 bp, E. coli
gacatttcgcatcgaagctgccgca

SEQ ID NO: 190739 - DNA, 25 bp, E. coli
cccggtgcgcagatccatttagtga

SEQ ID NO: 190740 - DNA, 25 bp, E. coli
cccggtgcgcagttccatttagtga

SEQ ID NO: 190741 - DNA, 25 bp, E. coli
cattgaagtgaccaatcccacgggc

SEQ ID NO: 190742 - DNA, 25 bp, E. coli
cattgaagtgacgaatcccacgggc

SEQ ID NO: 190743 - DNA, 25 bp, E. coli
gattgtcggtaaatccagtgacgca

SEQ ID NO: 190744 - DNA, 25 bp, E. coli
gattgtcggtaattccagtgacgca

SEQ ID NO: 190745 - DNA, 25 bp, E. coli
taatttaccgcacgatcgcgagtct

SEQ ID NO: 190746 - DNA, 25 bp, E. coli
taatttaccgcaggatcgcgagtct

SEQ ID NO: 190747 - DNA, 25 bp, E. coli
cataccgcaatgatgagggaggcat

SEQ ID NO: 190748 - DNA, 25 bp, E. coli
cataccgcaatgttgagggaggcat

SEQ ID NO: 190749 - DNA, 25 bp, E. coli
tttgaaaaacgcctcgccgatgatg

SEQ ID NO: 190750 - DNA, 25 bp, E. coli
tttgaaaaacgcgtcgccgatgatg

SEQ ID NO: 190751 - DNA, 25 bp, E. coli
tttgaccaccattatagcgacagcg

SEQ ID NO: 190752 - DNA, 25 bp, E. coli
tttgaccaccataatagcgacagcg

SEQ ID NO: 190753 - DNA, 25 bp, E. coli
tgtgaagcgcatagccatcgcagcg

SEQ ID NO: 190754 - DNA, 25 bp, E. coli
tgtatgcaacatgatcaggaccgta

SEQ ID NO: 190755 - DNA, 25 bp, E. coli
tgtgcgcaacaaatatcgcccggct

SEQ ID NO: 190756 - DNA, 25 bp, E. coli
tgtgcgcaacaattatcgcccggct

SEQ ID NO: 190757 - DNA, 25 bp, E. coli
tgtgaagcgcattgccatcgcagcg

SEQ ID NO: 190758 - DNA, 25 bp, E. coli
tgggcgcggcttaaatgtatgcaac

SEQ ID NO: 190759 - DNA, 25 bp, E. coli
tgggcgcggctttaatgtatgcaac

SEQ ID NO: 190760 - DNA, 25 bp, E. coli
tgtatgcaacatcatcaggaccgta

SEQ ID NO: 190761 - DNA, 25 bp, E. coli
gaatctaactcgtataccgtaggga

SEQ ID NO: 190762 - DNA, 25 bp, E. coli
gaatctaactcgaataccgtaggga

SEQ ID NO: 190763 - DNA, 25 bp, E. coli
cgcaaagtctttgtggttcgccgga

SEQ ID NO: 190764 - DNA, 25 bp, E. coli
cgcaaagtctttctggttcgccgga

SEQ ID NO: 190765 - DNA, 25 bp, E. coli
tgtaaggaattagcgcagctagtgg

SEQ ID NO: 190766 - DNA, 25 bp, E. coli
tgtaaggaattaccgcagctagtgg

SEQ ID NO: 190767 - DNA, 25 bp, E. coli
taaccagtcggatacttctgtgcgc

SEQ ID NO: 190768 - DNA, 25 bp, E. coli
taaccagtcggaaacttctgtgcgc

SEQ ID NO: 190769 - DNA, 25 bp, E. coli
cagggaatgccgctatcaaaaaccg

SEQ ID NO: 190770 - DNA, 25 bp, E. coli
cagggaatgccggtatcaaaaaccg

SEQ ID NO: 190771 - DNA, 25 bp, E. coli
gcgataccccaaaaaccgggcggtg

SEQ ID NO: 190772 - DNA, 25 bp, E. coli
gcgataccccaataaccgggcggtg

SEQ ID NO: 190773 - DNA, 25 bp, E. coli
ttggcgataccccaataaccgggcg

SEQ ID NO: 190774 - DNA, 25 bp, E. coli
ttggcgatacccgaataaccgggcg

SEQ ID NO: 190775 - DNA, 25 bp, E. coli
tgtgctctaaccaactgagctacgt

SEQ ID NO: 190776 - DNA, 25 bp, E. coli
tgtgctctaacctactgagctacgt

SEQ ID NO: 190777 - DNA, 25 bp, E. coli
tgccggtatcaataaccggtgcctt

SEQ ID NO: 190778 - DNA, 25 bp, E. coli
tgccggtatcaaaaaccggtgcctt

SEQ ID NO: 190779 - DNA, 25 bp, E. coli
ccagattgtttcatcgatggctggg

SEQ ID NO: 190780 - DNA, 25 bp, E. coli
ccagattgtttcttcgatggctggg

SEQ ID NO: 190781 - DNA, 25 bp, E. coli
gctacgtagccagattgtttcttcg

SEQ ID NO: 190782 - DNA, 25 bp, E. coli
gctacgtagccacattgtttcttcg

SEQ ID NO: 190783 - DNA, 25 bp, E. coli
ggtacctggattcgaaccagggaat

SEQ ID NO: 190784 - DNA, 25 bp, E. coli
ggtacctggattggaaccagggaat

SEQ ID NO: 190785 - DNA, 25 bp, E. coli
gtgatgtgctctaaccaactgagct

SEQ ID NO: 190786 - DNA, 25 bp, E. coli
tggattcgaaccagggaatgccggt

SEQ ID NO: 190787 - DNA, 25 bp, E. coli
gtgatgtgctcttaccaactgagct

SEQ ID NO: 190788 - DNA, 25 bp, E. coli
tggattcgaacctgggaatgccggt

SEQ ID NO: 190789 - DNA, 25 bp, E. coli
taaccaactgagctacgtagccaga

SEQ ID NO: 190790 - DNA, 25 bp, E. coli
taaccaactgaggtacgtagccaga

SEQ ID NO: 190791 - DNA, 25 bp, E. coli
caacctgcatgatggccacatgaag

SEQ ID NO: 190792 - DNA, 25 bp, E. coli
caagcgcaaagtggatctggttttc

SEQ ID NO: 190793 - DNA, 25 bp, E. coli
caagcgcaaagtcgatctggttttc

SEQ ID NO: 190794 - DNA, 25 bp, E. coli
caaagtggatctggttttcgcgccc

SEQ ID NO: 190795 - DNA, 25 bp, E. coli
caacctgcatgaaggccacatgaag

SEQ ID NO: 190796 - DNA, 25 bp, E. coli
caaagtggatctcgttttcgcgccc

SEQ ID NO: 190797 - DNA, 25 bp, E. coli
catgggcaacctccatgatggccac

SEQ ID NO: 190798 - DNA, 25 bp, E. coli
catgggcaacctgcatgatggccac

SEQ ID NO: 190799 - DNA, 25 bp, E. coli
tacccacgcaccttgcaggaagact

SEQ ID NO: 190800 - DNA, 25 bp, E. coli
agtggatctggttttcgcgccctcg

SEQ ID NO: 190801 - DNA, 25 bp, E. coli
agtggatctggtattcgcgccctcg

SEQ ID NO: 190802 - DNA, 25 bp, E. coli
tacccacgcaccatgcaggaagact

SEQ ID NO: 190803 - DNA, 25 bp, E. coli
gctgaacaagcggaaagtggatctg

SEQ ID NO: 190804 - DNA, 25 bp, E. coli
gctgaacaagcgcaaagtggatctg

SEQ ID NO: 190805 - DNA, 25 bp, E. coli
gcaccttgcaggaagactgcgaaaa

SEQ ID NO: 190806 - DNA, 25 bp, E. coli
gcaccttgcaggtagactgcgaaaa

SEQ ID NO: 190807 - DNA, 25 bp, E. coli
ggtacctaccatgggcaacctgcat

SEQ ID NO: 190808 - DNA, 25 bp, E. coli
ggaggacctggctcggtacccacgc

SEQ ID NO: 190809 - DNA, 25 bp, E. coli
ggaggacctggcacggtacccacgc

SEQ ID NO: 190810 - DNA, 25 bp, E. coli
ggatctggttttcgcgccctcggta

SEQ ID NO: 190811 - DNA, 25 bp, E. coli
ggtacctaccatcggcaacctgcat

SEQ ID NO: 190812 - DNA, 25 bp, E. coli
ggatctggttttggcgccctcggta

SEQ ID NO: 190813 - DNA, 25 bp, E. coli
aaggccaaagcgatccgctggaaat

SEQ ID NO: 190814 - DNA, 25 bp, E. coli
aaggccaaagcgttccgctggaaat

SEQ ID NO: 190815 - DNA, 25 bp, E. coli
taccttgtgcgtcgatgcccgcagt

SEQ ID NO: 190816 - DNA, 25 bp, E. coli
taccttgtgcgtggatgcccgcagt

SEQ ID NO: 190817 - DNA, 25 bp, E. coli
ttacaaggccaatgcgatccgctgg

SEQ ID NO: 190818 - DNA, 25 bp, E. coli
ttactaccttgtgcgtcgatgcccg

SEQ ID NO: 190819 - DNA, 25 bp, E. coli
ttactaccttgtccgtcgatgcccg

SEQ ID NO: 190820 - DNA, 25 bp, E. coli
ttacaaggccaaagcgatccgctgg

SEQ ID NO: 190821 - DNA, 25 bp, E. coli
tgcacgatgagcagaccgaattaca

SEQ ID NO: 190822 - DNA, 25 bp, E. coli
tgcacgatgagctgaccgaattaca

SEQ ID NO: 190823 - DNA, 25 bp, E. coli
ccttgtgcgtcgttgcccgcagtca

SEQ ID NO: 190824 - DNA, 25 bp, E. coli
ccttgtgcgtcgatgcccgcagtca

SEQ ID NO: 190825 - DNA, 25 bp, E. coli
gctggcggtttcatttactaccttg

SEQ ID NO: 190826 - DNA, 25 bp, E. coli
gctggcggtttcttttactaccttg

SEQ ID NO: 190827 - DNA, 25 bp, E. coli
gaattacaaggcgaaagcgatccgc

SEQ ID NO: 190828 - DNA, 25 bp, E. coli
gaattacaaggccaaagcgatccgc

SEQ ID NO: 190829 - DNA, 25 bp, E. coli
cgggtgcacgatcagctgaccgaat

SEQ ID NO: 190830 - DNA, 25 bp, E. coli
cgggtgcacgatgagctgaccgaat

SEQ ID NO: 190831 - DNA, 25 bp, E. coli
gaccgaattacaaggccaaagcgat

SEQ ID NO: 190832 - DNA, 25 bp, E. coli
gatgagctgaccgaattacaaggcc

SEQ ID NO: 190833 - DNA, 25 bp, E. coli
gaccgaattacatggccaaagcgat

SEQ ID NO: 190834 - DNA, 25 bp, E. coli
gatgagctgacccaattacaaggcc

SEQ ID NO: 190835 - DNA, 25 bp, E. coli
caaactgtcggccttgtgcagtgaa

SEQ ID NO: 190836 - DNA, 25 bp, E. coli
caaactgtcggcgttgtgcagtgaa

SEQ ID NO: 190837 - DNA, 25 bp, E. coli
catgagagtggccagatttggcacc

SEQ ID NO: 190838 - DNA, 25 bp, E. coli
catgagagtggcgagatttggcacc

SEQ ID NO: 190839 - DNA, 25 bp, E. coli
taaatatccttgaaacactggcgcg

SEQ ID NO: 190840 - DNA, 25 bp, E. coli
taaatatccttgtaacactggcgcg

SEQ ID NO: 190841 - DNA, 25 bp, E. coli
caagccgacgaaggtgaataatttc

SEQ ID NO: 190842 - DNA, 25 bp, E. coli
caagccgacgaacgtgaataatttc

SEQ ID NO: 190843 - DNA, 25 bp, E. coli
tatttcgccaatccggaagcgcgca

SEQ ID NO: 190844 - DNA, 25 bp, E. coli
tatttcgccaatgcggaagcgcgca

SEQ ID NO: 190845 - DNA, 25 bp, E. coli
ttggcaccggatccagaaaaatctg

SEQ ID NO: 190846 - DNA, 25 bp, E. coli
ttggcaccggatgcagaaaaatctg

SEQ ID NO: 190847 - DNA, 25 bp, E. coli
tgcttccggcaagccgatttacggt

SEQ ID NO: 190848 - DNA, 25 bp, E. coli
tgcttccggcaacccgatttacggt

SEQ ID NO: 190849 - DNA, 25 bp, E. coli
gcctttgccgaggtggattacaaca

SEQ ID NO: 190850 - DNA, 25 bp, E. coli
gcctttgccgagctggattacaaca

SEQ ID NO: 190851 - DNA, 25 bp, E. coli
cgctaatgaagtcgccgatcacgcc

SEQ ID NO: 190852 - DNA, 25 bp, E. coli
cgctaatgaagtggccgatcacgcc

SEQ ID NO: 190853 - DNA, 25 bp, E. coli
gataatttgctgacggtgcgtacca

SEQ ID NO: 190854 - DNA, 25 bp, E. coli
gataatttgctgtcggtgcgtacca

SEQ ID NO: 190855 - DNA, 25 bp, E. coli
tcagcatcccgaaaaagcgcaggaa

SEQ ID NO: 190856 - DNA, 25 bp, E. coli
tcagcatcccgataaagcgcaggaa

SEQ ID NO: 190857 - DNA, 25 bp, E. coli
agtgctgctccacggcgcgaacttt

SEQ ID NO: 190858 - DNA, 25 bp, E. coli
agcgcacggcgtgatcactgcttct

SEQ ID NO: 190859 - DNA, 25 bp, E. coli
agtgctgctccagggcgcgaacttt

SEQ ID NO: 190860 - DNA, 25 bp, E. coli
agcgcacggcgtcatcactgcttct

SEQ ID NO: 190861 - DNA, 25 bp, E. coli
ttggcggtgacctttccggaagaaa

SEQ ID NO: 190862 - DNA, 25 bp, E. coli
ttggcggtgaccattccggaagaaa

SEQ ID NO: 190863 - DNA, 25 bp, E. coli
ttgatgaagcgaaagccaaagcgat

SEQ ID NO: 190864 - DNA, 25 bp, E. coli
ttgatgaagcgatagccaaagcgat

SEQ ID NO: 190865 - DNA, 25 bp, E. coli
ccatccgatggtgattgccgggcaa

SEQ ID NO: 190866 - DNA, 25 bp, E. coli
ccatccgatggtcattgccgggcaa

SEQ ID NO: 190867 - DNA, 25 bp, E. coli
gctgaatgagctgggctacgattgc

SEQ ID NO: 190868 - DNA, 25 bp, E. coli
gcttcggcggcgaagtgctgctcca

SEQ ID NO: 190869 - DNA, 25 bp, E. coli
gcttcggcggcgtagtgctgctcca

SEQ ID NO: 190870 - DNA, 25 bp, E. coli
gctgaatgagctcggctacgattgc

SEQ ID NO: 190871 - DNA, 25 bp, E. coli
cgacatcaaagtcgacgcggtgcgc

SEQ ID NO: 190872 - DNA, 25 bp, E. coli
cgacatcaaagtggacgcggtgcgc

SEQ ID NO: 190873 - DNA, 25 bp, E. coli
cattccggaagaaaaaggcagcttc

SEQ ID NO: 190874 - DNA, 25 bp, E. coli
cattccggaagataaaggcagcttc

SEQ ID NO: 190875 - DNA, 25 bp, E. coli
gatcactgcttcagcgggtaaccac

SEQ ID NO: 190876 - DNA, 25 bp, E. coli
gatcactgcttctgcgggtaaccac

SEQ ID NO: 190877 - DNA, 25 bp, E. coli
ggacgcccatctcgaccgcgtattt

SEQ ID NO: 190878 - DNA, 25 bp, E. coli
ggacgcccatctggaccgcgtattt

SEQ ID NO: 190879 - DNA, 25 bp, E. coli
caatgcctgggccttcaacaatcaa

SEQ ID NO: 190880 - DNA, 25 bp, E. coli
caatgcctgggcgttcaacaatcaa

SEQ ID NO: 190881 - DNA, 25 bp, E. coli
cagatctgggaagacgactggatga

SEQ ID NO: 190882 - DNA, 25 bp, E. coli
cagatctgggaacacgactggatga

SEQ ID NO: 190883 - DNA, 25 bp, E. coli
cattacggaatacatcgttgcgagc

SEQ ID NO: 190884 - DNA, 25 bp, E. coli
aaatgtttttccgtgccgatatcgc

SEQ ID NO: 190885 - DNA, 25 bp, E. coli
aaatgtttttccctgccgatatcgc

SEQ ID NO: 190886 - DNA, 25 bp, E. coli
tatccggcgccgtagcaatttgtgg

SEQ ID NO: 190887 - DNA, 25 bp, E. coli
tatccggcgccgaagcaatttgtgg

SEQ ID NO: 190888 - DNA, 25 bp, E. coli
tatttttcgtcgatatccggcgccg

SEQ ID NO: 190889 - DNA, 25 bp, E. coli
tatttttcgtcgttatccggcgccg

SEQ ID NO: 190890 - DNA, 25 bp, E. coli
ttgagaacccgcataagcagcccga

SEQ ID NO: 190891 - DNA, 25 bp, E. coli
ttgagaacccgcttaagcagcccga

SEQ ID NO: 190892 - DNA, 25 bp, E. coli
tcccggattttggtcggcagcgtct

SEQ ID NO: 190893 - DNA, 25 bp, E. coli
tcccggattttgctcggcagcgtct

SEQ ID NO: 190894 - DNA, 25 bp, E. coli
gaacagggcacagagtatcagatct

SEQ ID NO: 190895 - DNA, 25 bp, E. coli
gaacagggcacacagtatcagatct

SEQ ID NO: 190896 - DNA, 25 bp, E. coli
cattacggaatagatcgttgcgagc

SEQ ID NO: 190897 - DNA, 25 bp, E. coli
tcaatccatcctgaaagaacgcgcg

SEQ ID NO: 190898 - DNA, 25 bp, E. coli
tcaatccatcctcaaagaacgcgcg

SEQ ID NO: 190899 - DNA, 25 bp, E. coli
gacgcatcatcccaatcaccaggaa

SEQ ID NO: 190900 - DNA, 25 bp, E. coli
gacgcatcatccgaatcaccaggaa

SEQ ID NO: 190901 - DNA, 25 bp, E. coli
cagtgattgcccgttgcgtaacccg

SEQ ID NO: 190902 - DNA, 25 bp, E. coli
catacgttaagtccgaaagagtgga

SEQ ID NO: 190903 - DNA, 25 bp, E. coli
catacgttaagtgcgaaagagtgga

SEQ ID NO: 190904 - DNA, 25 bp, E. coli
cagtgattgccccttgcgtaacccg

SEQ ID NO: 190905 - DNA, 25 bp, E. coli
aaattgctcagcctattggcattcc

SEQ ID NO: 190906 - DNA, 25 bp, E. coli
aaattgctcagcgtattggcattcc

SEQ ID NO: 190907 - DNA, 25 bp, E. coli
tattggttgtggctgcctttcgcgc

SEQ ID NO: 190908 - DNA, 25 bp, E. coli
tatcggcgctgcttttctatgaaag

SEQ ID NO: 190909 - DNA, 25 bp, E. coli
tatcggcgctgcatttctatgaaag

SEQ ID NO: 190910 - DNA, 25 bp, E. coli
tattggttgtgggtgcctttcgcgc

SEQ ID NO: 190911 - DNA, 25 bp, E. coli
ttaggagaagaacgtaccggcgcac

SEQ ID NO: 190912 - DNA, 25 bp, E. coli
ttaggagaagaaggtaccggcgcac

SEQ ID NO: 190913 - DNA, 25 bp, E. coli
ccttagtggcgcagcgtgacgaact

SEQ ID NO: 190914 - DNA, 25 bp, E. coli
ccttagtggcgctgcgtgacgaact

SEQ ID NO: 190915 - DNA, 25 bp, E. coli
gaaacagctttcgtcccaatggcga

SEQ ID NO: 190916 - DNA, 25 bp, E. coli
gaaacagctttcctcccaatggcga

SEQ ID NO: 190917 - DNA, 25 bp, E. coli
gaaattaccccgcattaaagcgctg

SEQ ID NO: 190918 - DNA, 25 bp, E. coli
gaaattaccccggattaaagcgctg

SEQ ID NO: 190919 - DNA, 25 bp, E. coli
cgagaagagttgcatcggcgcattc

SEQ ID NO: 190920 - DNA, 25 bp, E. coli
cgagaagagttggatcggcgcattc

SEQ ID NO: 190921 - DNA, 25 bp, E. coli
gatcggcgcattcataccttagtgg

SEQ ID NO: 190922 - DNA, 25 bp, E. coli
gatcggcgcattgataccttagtgg

SEQ ID NO: 190923 - DNA, 25 bp, E. coli
caaatgctcaggtcgttgcagcgtt

SEQ ID NO: 190924 - DNA, 25 bp, E. coli
caaatgctcaggacgttgcagcgtt

SEQ ID NO: 190925 - DNA, 25 bp, E. coli
catactggttgtgttgttactgtta

SEQ ID NO: 190926 - DNA, 25 bp, E. coli
cattaacacataaccctggcccaaa

SEQ ID NO: 190927 - DNA, 25 bp, E. coli
cattaacacatatccctggcccaaa

SEQ ID NO: 190928 - DNA, 25 bp, E. coli
catactggttgtcttgttactgtta

SEQ ID NO: 190929 - DNA, 25 bp, E. coli
actgcttcagggtaagcgttgcgcg

SEQ ID NO: 190930 - DNA, 25 bp, E. coli
aaaaatcagcgtgaagaaggtttca

SEQ ID NO: 190931 - DNA, 25 bp, E. coli
aaaaatcagcgtcaagaaggtttca

SEQ ID NO: 190932 - DNA, 25 bp, E. coli
actgcttcagggaaagcgttgcgcg

SEQ ID NO: 190933 - DNA, 25 bp, E. coli
gcgtcaagaaggtttcattaacaca

SEQ ID NO: 190934 - DNA, 25 bp, E. coli
gcgtcaagaaggattcattaacaca

SEQ ID NO: 190935 - DNA, 25 bp, E. coli
gacttactaacatctcatcagaggg

SEQ ID NO: 190936 - DNA, 25 bp, E. coli
gacttactaacaactcatcagaggg

SEQ ID NO: 190937 - DNA, 25 bp, E. coli
cgctaaaaggtgcaaatgctcagga

SEQ ID NO: 190938 - DNA, 25 bp, E. coli
cgctaaaaggtggaaatgctcagga

SEQ ID NO: 190939 - DNA, 25 bp, E. coli
ggtttcattaactcatatccctggc

SEQ ID NO: 190940 - DNA, 25 bp, E. coli
ggtttcattaacacatatccctggc

SEQ ID NO: 190941 - DNA, 25 bp, E. coli
ggcaaaactgcttcagggaaagcgt

SEQ ID NO: 190942 - DNA, 25 bp, E. coli
ggcaaaactgctacagggaaagcgt

SEQ ID NO: 190943 - DNA, 25 bp, E. coli
gacgttgcagcgttttgcgtgaccg

SEQ ID NO: 190944 - DNA, 25 bp, E. coli
gacgttgcagcgatttgcgtgaccg

SEQ ID NO: 190945 - DNA, 25 bp, E. coli
caaggctcgacttgcaggcaggttt

SEQ ID NO: 190946 - DNA, 25 bp, E. coli
caaggctcgactagcaggcaggttt

SEQ ID NO: 190947 - DNA, 25 bp, E. coli
cagcgaaacatcatagagcaaagtt

SEQ ID NO: 190948 - DNA, 25 bp, E. coli
caaagttgcgctggcataaataagc

SEQ ID NO: 190949 - DNA, 25 bp, E. coli
caaaaagcctcgctgataaatcaga

SEQ ID NO: 190950 - DNA, 25 bp, E. coli
caaaaagcctcggtgataaatcaga

SEQ ID NO: 190951 - DNA, 25 bp, E. coli
cagcgaaacatcttagagcaaagtt

SEQ ID NO: 190952 - DNA, 25 bp, E. coli
caaagttgcgctcgcataaataagc

SEQ ID NO: 190953 - DNA, 25 bp, E. coli
catcttagagcatagttgcgctggc

SEQ ID NO: 190954 - DNA, 25 bp, E. coli
catcttagagcaaagttgcgctggc

SEQ ID NO: 190955 - DNA, 25 bp, E. coli
cataaataagcataaagcctcgctg

SEQ ID NO: 190956 - DNA, 25 bp, E. coli
cataaataagcaaaaagcctcgctg

SEQ ID NO: 190957 - DNA, 25 bp, E. coli
tcagacaaggctggacttgcaggca

SEQ ID NO: 190958 - DNA, 25 bp, E. coli
tcagacaaggctcgacttgcaggca

SEQ ID NO: 190959 - DNA, 25 bp, E. coli
gccggacaggcggttaacgccatat

SEQ ID NO: 190960 - DNA, 25 bp, E. coli
gccggacaggcgcttaacgccatat

SEQ ID NO: 190961 - DNA, 25 bp, E. coli
gacaggcggttatcgccatatccgg

SEQ ID NO: 190962 - DNA, 25 bp, E. coli
gacttgcaggcaggtttgccggaca

SEQ ID NO: 190963 - DNA, 25 bp, E. coli
gacaggcggttaacgccatatccgg

SEQ ID NO: 190964 - DNA, 25 bp, E. coli
gacttgcaggcacgtttgccggaca

SEQ ID NO: 190965 - DNA, 25 bp, E. coli
ctgataaatcagtcaaggctcgact

SEQ ID NO: 190966 - DNA, 25 bp, E. coli
ctgataaatcagacaaggctcgact

SEQ ID NO: 190967 - DNA, 25 bp, E. coli
aattcaactactgggacggtcgccg

SEQ ID NO: 190968 - DNA, 25 bp, E. coli
aatttctggttgtgctaccgcgagc

SEQ ID NO: 190969 - DNA, 25 bp, E. coli
aatttctggttgagctaccgcgagc

SEQ ID NO: 190970 - DNA, 25 bp, E. coli
aattcaactactcggacggtcgccg

SEQ ID NO: 190971 - DNA, 25 bp, E. coli
cactatctggctggttcgggaggca

SEQ ID NO: 190972 - DNA, 25 bp, E. coli
cactatctggctcgttcgggaggca

SEQ ID NO: 190973 - DNA, 25 bp, E. coli
tacaagtggaacctcggctggatgc

SEQ ID NO: 190974 - DNA, 25 bp, E. coli
tacaagtggaacgtcggctggatgc

SEQ ID NO: 190975 - DNA, 25 bp, E. coli
acttgtatgaactcagcgatccgcg

SEQ ID NO: 190976 - DNA, 25 bp, E. coli
acttgtatgaacacagcgatccgcg

SEQ ID NO: 190977 - DNA, 25 bp, E. coli
tgattgaaccgataaccgggcgcaa

SEQ ID NO: 190978 - DNA, 25 bp, E. coli
tgattgaaccgaaaaccgggcgcaa

SEQ ID NO: 190979 - DNA, 25 bp, E. coli
tggtggatgacaaagaacgctcggt

SEQ ID NO: 190980 - DNA, 25 bp, E. coli
tggtggatgacatagaacgctcggt

SEQ ID NO: 190981 - DNA, 25 bp, E. coli
tgaactggatttagacccgtacggc

SEQ ID NO: 190982 - DNA, 25 bp, E. coli
tgaactggattttgacccgtacggc

SEQ ID NO: 190983 - DNA, 25 bp, E. coli
gacaccctggactacatgaagctcg

SEQ ID NO: 190984 - DNA, 25 bp, E. coli
gaacgtgattctggactgggtgcca

SEQ ID NO: 190985 - DNA, 25 bp, E. coli
gaacgtgattctcgactgggtgcca

SEQ ID NO: 190986 - DNA, 25 bp, E. coli
gacaccctggacaacatgaagctcg

SEQ ID NO: 190987 - DNA, 25 bp, E. coli
gagtggatcccgtacgaatttggcg

SEQ ID NO: 190988 - DNA, 25 bp, E. coli
gagtggatcccgaacgaatttggcg

SEQ ID NO: 190989 - DNA, 25 bp, E. coli
cacaacccgcgctttgaagtgatgg

SEQ ID NO: 190990 - DNA, 25 bp, E. coli
cacaacccgcgcattgaagtgatgg

SEQ ID NO: 190991 - DNA, 25 bp, E. coli
ctaagtatcatggttcggcggcggt

SEQ ID NO: 190992 - DNA, 25 bp, E. coli
ctaagtatcatgcttcggcggcggt

SEQ ID NO: 190993 - DNA, 25 bp, E. coli
tacgttgcgctctcataatagcggg

SEQ ID NO: 190994 - DNA, 25 bp, E. coli
aaaaaagcgattgccgaagcggtgg

SEQ ID NO: 190995 - DNA, 25 bp, E. coli
aaaaaagcgattcccgaagcggtgg

SEQ ID NO: 190996 - DNA, 25 bp, E. coli
tagcgggatcattggcccttcagcg

SEQ ID NO: 190997 - DNA, 25 bp, E. coli
tagcgggatcataggcccttcagcg

SEQ ID NO: 190998 - DNA, 25 bp, E. coli
tacgttgcgctcacataatagcggg

SEQ ID NO: 190999 - DNA, 25 bp, E. coli
ttaatacggcgttcgagcagcgtga

SEQ ID NO: 191000 - DNA, 25 bp, E. coli
ttaatacggcgtacgagcagcgtga

SEQ ID NO: 191001 - DNA, 25 bp, E. coli
tgaaattggtaaggtggcacaggtc

SEQ ID NO: 191002 - DNA, 25 bp, E. coli
tgaaattggtaacgtggcacaggtc

SEQ ID NO: 191003 - DNA, 25 bp, E. coli
tgcggataatcaccaacagcctgcg

SEQ ID NO: 191004 - DNA, 25 bp, E. coli
tgcggataatcagcaacagcctgcg

SEQ ID NO: 191005 - DNA, 25 bp, E. coli
gaagcggtggcagactatattcctg

SEQ ID NO: 191006 - DNA, 25 bp, E. coli
gaagcggtggcacactatattcctg

SEQ ID NO: 191007 - DNA, 25 bp, E. coli
cgtaaattaagccagcaaggcctga

SEQ ID NO: 191008 - DNA, 25 bp, E. coli
cgtaaattaagcgagcaaggcctga

SEQ ID NO: 191009 - DNA, 25 bp, E. coli
gaggaattttcatgagccttaccga

SEQ ID NO: 191010 - DNA, 25 bp, E. coli
gaggaattttcaagagccttaccga

SEQ ID NO: 191011 - DNA, 25 bp, E. coli
aaaacgctctgttatatgacggcgg

SEQ ID NO: 191012 - DNA, 25 bp, E. coli
aaaacgctctgtaatatgacggcgg

SEQ ID NO: 191013 - DNA, 25 bp, E. coli
tgtgaaaggaacaacattattgccc

SEQ ID NO: 191014 - DNA, 25 bp, E. coli
tgtgaaaggaactacattattgccc

SEQ ID NO: 191015 - DNA, 25 bp, E. coli
tgaaccaggtcagaaaatataagct

SEQ ID NO: 191016 - DNA, 25 bp, E. coli
tgaaccaggtcacaaaatataagct

SEQ ID NO: 191017 - DNA, 25 bp, E. coli
tgcctgtctgaaatgaactcatgga

SEQ ID NO: 191018 - DNA, 25 bp, E. coli
tgcctgtctgaattgaactcatgga

SEQ ID NO: 191019 - DNA, 25 bp, E. coli
tcagaagcttaaccacgtaatcggt

SEQ ID NO: 191020 - DNA, 25 bp, E. coli
tcagaagcttaagcacgtaatcggt

SEQ ID NO: 191021 - DNA, 25 bp, E. coli
gcgagttcgggcttcatatcagtga

SEQ ID NO: 191022 - DNA, 25 bp, E. coli
gcttggaggaatagaaaaatgaccg

SEQ ID NO: 191023 - DNA, 25 bp, E. coli
gcatcctcttagcttcagaagctta

SEQ ID NO: 191024 - DNA, 25 bp, E. coli
gcgagttcgggcatcatatcagtga

SEQ ID NO: 191025 - DNA, 25 bp, E. coli
gcatcctcttaggttcagaagctta

SEQ ID NO: 191026 - DNA, 25 bp, E. coli
gcttggaggaattgaaaaatgaccg

SEQ ID NO: 191027 - DNA, 25 bp, E. coli
gacggcggtcacacttattagctag

SEQ ID NO: 191028 - DNA, 25 bp, E. coli
gaaaacggtcataccgggcttggag

SEQ ID NO: 191029 - DNA, 25 bp, E. coli
gaaaacggtcattccgggcttggag

SEQ ID NO: 191030 - DNA, 25 bp, E. coli
gacggcggtcactcttattagctag

SEQ ID NO: 191031 - DNA, 25 bp, E. coli
tcaaaagtgcaataccagcgagttc

SEQ ID NO: 191032 - DNA, 25 bp, E. coli
tcaaaagtgcaaaaccagcgagttc

SEQ ID NO: 191033 - DNA, 25 bp, E. coli
taccggaatttatgccagtaaagaa

SEQ ID NO: 191034 - DNA, 25 bp, E. coli
taccggaatttaagccagtaaagaa

SEQ ID NO: 191035 - DNA, 25 bp, E. coli
aaagtatcgctgaacctgaataacg

SEQ ID NO: 191036 - DNA, 25 bp, E. coli
aaagtatcgctgtacctgaataacg

SEQ ID NO: 191037 - DNA, 25 bp, E. coli
tatgccagtaaagaatcctgcctcc

SEQ ID NO: 191038 - DNA, 25 bp, E. coli
tatgccagtaaacaatcctgcctcc

SEQ ID NO: 191039 - DNA, 25 bp, E. coli
ttataacgggtgaatcacagaatgt

SEQ ID NO: 191040 - DNA, 25 bp, E. coli
ttataacgggtgtatcacagaatgt

SEQ ID NO: 191041 - DNA, 25 bp, E. coli
tgtacctgaatatcgaaacaccggc

SEQ ID NO: 191042 - DNA, 25 bp, E. coli
tgatgacggtttatcttataacggg

SEQ ID NO: 191043 - DNA, 25 bp, E. coli
tgtacctgaataacgaaacaccggc

SEQ ID NO: 191044 - DNA, 25 bp, E. coli
tgatgacggtttttcttataacggg

SEQ ID NO: 191045 - DNA, 25 bp, E. coli
tgcctccaggcatgagacgagcaaa

SEQ ID NO: 191046 - DNA, 25 bp, E. coli
tgcctccaggcaagagacgagcaaa

SEQ ID NO: 191047 - DNA, 25 bp, E. coli
ccaggcaagagaggagcaaaaaatt

SEQ ID NO: 191048 - DNA, 25 bp, E. coli
ccaggcaagagacgagcaaaaaatt

SEQ ID NO: 191049 - DNA, 25 bp, E. coli
gaataacgaaactccggctggataa

SEQ ID NO: 191050 - DNA, 25 bp, E. coli
gaataacgaaacaccggctggataa

SEQ ID NO: 191051 - DNA, 25 bp, E. coli
gtaaagaatcctgcctccaggcaag

SEQ ID NO: 191052 - DNA, 25 bp, E. coli
gtaaagaatcctccctccaggcaag

SEQ ID NO: 191053 - DNA, 25 bp, E. coli
gagcaaaaaattactggtgaatgcc

SEQ ID NO: 191054 - DNA, 25 bp, E. coli
gagcaaaaaatttctggtgaatgcc

SEQ ID NO: 191055 - DNA, 25 bp, E. coli
cagatgtattctaaaaaccgaggga

SEQ ID NO: 191056 - DNA, 25 bp, E. coli
cagggctcatattcttaaggaggtc

SEQ ID NO: 191057 - DNA, 25 bp, E. coli
cagggctcatatacttaaggaggtc

SEQ ID NO: 191058 - DNA, 25 bp, E. coli
cagatgtattcttaaaaccgaggga

SEQ ID NO: 191059 - DNA, 25 bp, E. coli
acaggcgctgatgtaatcggcgcaa

SEQ ID NO: 191060 - DNA, 25 bp, E. coli
acaggcgctgatctaatcggcgcaa

SEQ ID NO: 191061 - DNA, 25 bp, E. coli
tatacatgtgatttggaccatccga

SEQ ID NO: 191062 - DNA, 25 bp, E. coli
tatacatgtgatatggaccatccga

SEQ ID NO: 191063 - DNA, 25 bp, E. coli
ttacctccaagaaaagcgacgggag

SEQ ID NO: 191064 - DNA, 25 bp, E. coli
ttacctccaagataagcgacgggag

SEQ ID NO: 191065 - DNA, 25 bp, E. coli
gctacaaaatatgagacaggcgctg

SEQ ID NO: 191066 - DNA, 25 bp, E. coli
gctacaaaatatcagacaggcgctg

SEQ ID NO: 191067 - DNA, 25 bp, E. coli
gaaactgctatcctgaggaaactga

SEQ ID NO: 191068 - DNA, 25 bp, E. coli
gaaactgctatcgtgaggaaactga

SEQ ID NO: 191069 - DNA, 25 bp, E. coli
gatatatcttatacgggaaactgct

SEQ ID NO: 191070 - DNA, 25 bp, E. coli
gatatatcttattcgggaaactgct

SEQ ID NO: 191071 - DNA, 25 bp, E. coli
taataatcccaagttataacagggc

SEQ ID NO: 191072 - DNA, 25 bp, E. coli
taataatcccaacttataacagggc

SEQ ID NO: 191073 - DNA, 25 bp, E. coli
gatgactcttacgtcttacccggtg

SEQ ID NO: 191074 - DNA, 25 bp, E. coli
gaggtcataccaagttattttcagg

SEQ ID NO: 191075 - DNA, 25 bp, E. coli
gatgactcttacctcttacccggtg

SEQ ID NO: 191076 - DNA, 25 bp, E. coli
gaggtcataccatgttattttcagg

SEQ ID NO: 191077 - DNA, 25 bp, E. coli
taaacggtatgaagaagaaattgca

SEQ ID NO: 191078 - DNA, 25 bp, E. coli
tactcacagcacattgaataaacgg

SEQ ID NO: 191079 - DNA, 25 bp, E. coli
tactcacagcactttgaataaacgg

SEQ ID NO: 191080 - DNA, 25 bp, E. coli
taaaacatcgttatgcaaatacgga

SEQ ID NO: 191081 - DNA, 25 bp, E. coli
taaaacatcgttttgcaaatacgga

SEQ ID NO: 191082 - DNA, 25 bp, E. coli
tacagcctgattattgtgcgtgagg

SEQ ID NO: 191083 - DNA, 25 bp, E. coli
tacagcctgatttttgtgcgtgagg

SEQ ID NO: 191084 - DNA, 25 bp, E. coli
taaacggtatgatgaagaaattgca

SEQ ID NO: 191085 - DNA, 25 bp, E. coli
caaatacggaagtgaaagttactca

SEQ ID NO: 191086 - DNA, 25 bp, E. coli
caaatacggaagagaaagttactca

SEQ ID NO: 191087 - DNA, 25 bp, E. coli
tgatttctcctgcaggtgtgacgcc

SEQ ID NO: 191088 - DNA, 25 bp, E. coli
tgatttctcctggaggtgtgacgcc

SEQ ID NO: 191089 - DNA, 25 bp, E. coli
tgccgctgcctttcatcagcagatg

SEQ ID NO: 191090 - DNA, 25 bp, E. coli
tgccgctgccttacatcagcagatg

SEQ ID NO: 191091 - DNA, 25 bp, E. coli
gcacataatccagtattcacagcga

SEQ ID NO: 191092 - DNA, 25 bp, E. coli
gcacataatccactattcacagcga

SEQ ID NO: 191093 - DNA, 25 bp, E. coli
gataattattgtaattgccgctgcc

SEQ ID NO: 191094 - DNA, 25 bp, E. coli
gttattaagctgatttacagcctga

SEQ ID NO: 191095 - DNA, 25 bp, E. coli
gataattattgttattgccgctgcc

SEQ ID NO: 191096 - DNA, 25 bp, E. coli
gttattaagctgttttacagcctga

SEQ ID NO: 191097 - DNA, 25 bp, E. coli
gtgaggcggcgctcataatccagta

SEQ ID NO: 191098 - DNA, 25 bp, E. coli
gtgaggcggcgcacataatccagta

SEQ ID NO: 191099 - DNA, 25 bp, E. coli
catttaagcgcatgtggcgtgctca

SEQ ID NO: 191100 - DNA, 25 bp, E. coli
tagcgatttagatgcaataacggcg

SEQ ID NO: 191101 - DNA, 25 bp, E. coli
tagcgatttagaagcaataacggcg

SEQ ID NO: 191102 - DNA, 25 bp, E. coli
tttccgaacttcagctggcgcgagc

SEQ ID NO: 191103 - DNA, 25 bp, E. coli
tttccgaacttctgctggcgcgagc

SEQ ID NO: 191104 - DNA, 25 bp, E. coli
tttgattgcatcacggcctcgctga

SEQ ID NO: 191105 - DNA, 25 bp, E. coli
tttgattgcatctcggcctcgctga

SEQ ID NO: 191106 - DNA, 25 bp, E. coli
tttcaccatgattaacctgcgccag

SEQ ID NO: 191107 - DNA, 25 bp, E. coli
tttcaccatgataaacctgcgccag

SEQ ID NO: 191108 - DNA, 25 bp, E. coli
tgcgcgacagcaatggcagcaactt

SEQ ID NO: 191109 - DNA, 25 bp, E. coli
tgcgcgacagcattggcagcaactt

SEQ ID NO: 191110 - DNA, 25 bp, E. coli
cctcgctgaaagagcaaaaccgtct

SEQ ID NO: 191111 - DNA, 25 bp, E. coli
cctcgctgaaagtgcaaaaccgtct

SEQ ID NO: 191112 - DNA, 25 bp, E. coli
gaaaaattatgttatcgcccgcaaa

SEQ ID NO: 191113 - DNA, 25 bp, E. coli
gaaaaattatgtaatcgcccgcaaa

SEQ ID NO: 191114 - DNA, 25 bp, E. coli
catttaagcgcaagtggcgtgctca

SEQ ID NO: 191115 - DNA, 25 bp, E. coli
taacggcgttgcgaaaccatctgga

SEQ ID NO: 191116 - DNA, 25 bp, E. coli
taacatcagtcgcactacggtacgc

SEQ ID NO: 191117 - DNA, 25 bp, E. coli
tcagcgccctgaattgccgtagcga

SEQ ID NO: 191118 - DNA, 25 bp, E. coli
taacggcgttgccaaaccatctgga

SEQ ID NO: 191119 - DNA, 25 bp, E. coli
tcagcgccctgatttgccgtagcga

SEQ ID NO: 191120 - DNA, 25 bp, E. coli
taacatcagtcggactacggtacgc

SEQ ID NO: 191121 - DNA, 25 bp, E. coli
aattctgtggcatggtgtaaagcac

SEQ ID NO: 191122 - DNA, 25 bp, E. coli
aatcgctgttgttgagggtgcatgc

SEQ ID NO: 191123 - DNA, 25 bp, E. coli
aattctgtggcaaggtgtaaagcac

SEQ ID NO: 191124 - DNA, 25 bp, E. coli
aatcgctgttgtagagggtgcatgc

SEQ ID NO: 191125 - DNA, 25 bp, E. coli
cagcaatgatgaatttgatgacccg

SEQ ID NO: 191126 - DNA, 25 bp, E. coli
cagcaatgatgattttgatgacccg

SEQ ID NO: 191127 - DNA, 25 bp, E. coli
tagttattaaagctgcgtccgactg

SEQ ID NO: 191128 - DNA, 25 bp, E. coli
tagttattaaaggtgcgtccgactg

SEQ ID NO: 191129 - DNA, 25 bp, E. coli
tatattactgggaagccttaacgcc

SEQ ID NO: 191130 - DNA, 25 bp, E. coli
tatattactgggtagccttaacgcc

SEQ ID NO: 191131 - DNA, 25 bp, E. coli
tattgagggtgcttgctgcactcca

SEQ ID NO: 191132 - DNA, 25 bp, E. coli
tattgagggtgcatgctgcactcca

SEQ ID NO: 191133 - DNA, 25 bp, E. coli
tggttcaccggaggcaccttaagta

SEQ ID NO: 191134 - DNA, 25 bp, E. coli
tcaggtatcggctatcagtcattcg

SEQ ID NO: 191135 - DNA, 25 bp, E. coli
tcaggtatcggcaatcagtcattcg

SEQ ID NO: 191136 - DNA, 25 bp, E. coli
ggcggtcacgttaatctttccatca

SEQ ID NO: 191137 - DNA, 25 bp, E. coli
ggcggtcacgtttatctttccatca

SEQ ID NO: 191138 - DNA, 25 bp, E. coli
tggttcaccggacgcaccttaagta

SEQ ID NO: 191139 - DNA, 25 bp, E. coli
taagtacactgaaccataatcgctg

SEQ ID NO: 191140 - DNA, 25 bp, E. coli
taagtacactgatccataatcgctg

SEQ ID NO: 191141 - DNA, 25 bp, E. coli
taatgtacttaccaattggcggtca

SEQ ID NO: 191142 - DNA, 25 bp, E. coli
taatgtacttacgaattggcggtca

SEQ ID NO: 191143 - DNA, 25 bp, E. coli
tttttatcccagcaagcccaggacg

SEQ ID NO: 191144 - DNA, 25 bp, E. coli
ttctggcaaagcctcggtaaacgct

SEQ ID NO: 191145 - DNA, 25 bp, E. coli
ttctggcaaagcgtcggtaaacgct

SEQ ID NO: 191146 - DNA, 25 bp, E. coli
tttttatcccaggaagcccaggacg

SEQ ID NO: 191147 - DNA, 25 bp, E. coli
tgtttctcagtaacgatcacaccgg

SEQ ID NO: 191148 - DNA, 25 bp, E. coli
tgtttctcagtatcgatcacaccgg

SEQ ID NO: 191149 - DNA, 25 bp, E. coli
tgcagcttgccaccaaaacgggcgg

SEQ ID NO: 191150 - DNA, 25 bp, E. coli
tgcagcttgccagcaaaacgggcgg

SEQ ID NO: 191151 - DNA, 25 bp, E. coli
tcttttcgatggattttagccgcgc

SEQ ID NO: 191152 - DNA, 25 bp, E. coli
tcttttcgatggtttttagccgcgc

SEQ ID NO: 191153 - DNA, 25 bp, E. coli
gcggcaccgggcaaaaggcatttat

SEQ ID NO: 191154 - DNA, 25 bp, E. coli
gcggcaccgggctaaaggcatttat

SEQ ID NO: 191155 - DNA, 25 bp, E. coli
gaatgtctataacgcattgccgacg

SEQ ID NO: 191156 - DNA, 25 bp, E. coli
gaatgtctataaggcattgccgacg

SEQ ID NO: 191157 - DNA, 25 bp, E. coli
gaaaattatcaccatttccgcgtgg

SEQ ID NO: 191158 - DNA, 25 bp, E. coli
gaaaattatcacgatttccgcgtgg

SEQ ID NO: 191159 - DNA, 25 bp, E. coli
cgtgcgcgccatccgtaaaagtcgg

SEQ ID NO: 191160 - DNA, 25 bp, E. coli
cgtgcgcgccatgcgtaaaagtcgg

SEQ ID NO: 191161 - DNA, 25 bp, E. coli
gatccctggtactactatcgcgtcg

SEQ ID NO: 191162 - DNA, 25 bp, E. coli
gattgacgaacacggctattcaccg

SEQ ID NO: 191163 - DNA, 25 bp, E. coli
gattgacgaacagggctattcaccg

SEQ ID NO: 191164 - DNA, 25 bp, E. coli
gatccctggtacaactatcgcgtcg

SEQ ID NO: 191165 - DNA, 25 bp, E. coli
aaggcggtcaaccacaagaagcggc

SEQ ID NO: 191166 - DNA, 25 bp, E. coli
aaggcggtcaacgacaagaagcggc

SEQ ID NO: 191167 - DNA, 25 bp, E. coli
cccgatggtggtgcagtcgtcggaa

SEQ ID NO: 191168 - DNA, 25 bp, E. coli
cccgatggtggtccagtcgtcggaa

SEQ ID NO: 191169 - DNA, 25 bp, E. coli
cacccgttgccggaaagtcgtctgg

SEQ ID NO: 191170 - DNA, 25 bp, E. coli
cacccgttgccgcaaagtcgtctgg

SEQ ID NO: 191171 - DNA, 25 bp, E. coli
ccggacgtaaccagctcaccagtga

SEQ ID NO: 191172 - DNA, 25 bp, E. coli
ccggacgtaacctgctcaccagtga

SEQ ID NO: 191173 - DNA, 25 bp, E. coli
aaagtcgtctgggagatgcccgcaa

SEQ ID NO: 191174 - DNA, 25 bp, E. coli
aaagtcgtctggcagatgcccgcaa

SEQ ID NO: 191175 - DNA, 25 bp, E. coli
aggcgatcaatcctctgaaaaatgc

SEQ ID NO: 191176 - DNA, 25 bp, E. coli
aggcgatcaatcgtctgaaaaatgc

SEQ ID NO: 191177 - DNA, 25 bp, E. coli
tataattccggaggtaaccagctca

SEQ ID NO: 191178 - DNA, 25 bp, E. coli
tataattccggacgtaaccagctca

SEQ ID NO: 191179 - DNA, 25 bp, E. coli
gccatttcgctgttgagtagcgcca

SEQ ID NO: 191180 - DNA, 25 bp, E. coli
gccaatgaggcgttcaatcgtctga

SEQ ID NO: 191181 - DNA, 25 bp, E. coli
gccaatgaggcgatcaatcgtctga

SEQ ID NO: 191182 - DNA, 25 bp, E. coli
gccatttcgctgatgagtagcgcca

SEQ ID NO: 191183 - DNA, 25 bp, E. coli
ggacgactcgatgaggccatttcgc

SEQ ID NO: 191184 - DNA, 25 bp, E. coli
ggatgtataattccggacgtaacca

SEQ ID NO: 191185 - DNA, 25 bp, E. coli
ggacgactcgatcaggccatttcgc

SEQ ID NO: 191186 - DNA, 25 bp, E. coli
ggatgtataattgcggacgtaacca

SEQ ID NO: 191187 - DNA, 25 bp, E. coli
aatgtgttacgcgatgaaattgcca

SEQ ID NO: 191188 - DNA, 25 bp, E. coli
aatgtgttacgccatgaaattgcca

SEQ ID NO: 191189 - DNA, 25 bp, E. coli
taaatatgcaattacgcccactctg

SEQ ID NO: 191190 - DNA, 25 bp, E. coli
taaatatgcaataacgcccactctg

SEQ ID NO: 191191 - DNA, 25 bp, E. coli
aaatatgcaattacgcccactctga

SEQ ID NO: 191192 - DNA, 25 bp, E. coli
aaacattcattaaaagaattagtcg

SEQ ID NO: 191193 - DNA, 25 bp, E. coli
aaacattcattataagaattagtcg

SEQ ID NO: 191194 - DNA, 25 bp, E. coli
aaatatgcaatttcgcccactctga

SEQ ID NO: 191195 - DNA, 25 bp, E. coli
tattcttagcaataaagcggcaaag

SEQ ID NO: 191196 - DNA, 25 bp, E. coli
tattcttagcaaaaaagcggcaaag

SEQ ID NO: 191197 - DNA, 25 bp, E. coli
gccagtgcggcaagaaatgtgttac

SEQ ID NO: 191198 - DNA, 25 bp, E. coli
gccagtgcggcatgaaatgtgttac

SEQ ID NO: 191199 - DNA, 25 bp, E. coli
gcggcaaaggaatgattaaatatgc

SEQ ID NO: 191200 - DNA, 25 bp, E. coli
gcggcaaaggaaagattaaatatgc

SEQ ID NO: 191201 - DNA, 25 bp, E. coli
gaattagtcgttttcgtacagatga

SEQ ID NO: 191202 - DNA, 25 bp, E. coli
gaattagtcgttatcgtacagatga

SEQ ID NO: 191203 - DNA, 25 bp, E. coli
gaaattgccatgattgtctgctccc

SEQ ID NO: 191204 - DNA, 25 bp, E. coli
gaaattgccatgtttgtctgctccc

SEQ ID NO: 191205 - DNA, 25 bp, E. coli
ccgtcttgttatgggagcagtattc

SEQ ID NO: 191206 - DNA, 25 bp, E. coli
ccgtcttgttatcggagcagtattc

SEQ ID NO: 191207 - DNA, 25 bp, E. coli
gtattcaggaataaaaacattcatt

SEQ ID NO: 191208 - DNA, 25 bp, E. coli
gtattcaggaattaaaacattcatt

SEQ ID NO: 191209 - DNA, 25 bp, E. coli
caaaggtcgtggttcgtcatggcac

SEQ ID NO: 191210 - DNA, 25 bp, E. coli
caaaggtcgtggatcgtcatggcac

SEQ ID NO: 191211 - DNA, 25 bp, E. coli
cagtaatgcccgatgctttagagaa

SEQ ID NO: 191212 - DNA, 25 bp, E. coli
cagtaatgcccgttgctttagagaa

SEQ ID NO: 191213 - DNA, 25 bp, E. coli
agatcatggctgtcctgtgcgagcg

SEQ ID NO: 191214 - DNA, 25 bp, E. coli
agatcatggctgacctgtgcgagcg

SEQ ID NO: 191215 - DNA, 25 bp, E. coli
tgtgtagcccacagaatcctaccgg

SEQ ID NO: 191216 - DNA, 25 bp, E. coli
tgtgtagcccactgaatcctaccgg

SEQ ID NO: 191217 - DNA, 25 bp, E. coli
tgaccgtttcggcactgctgacctg

SEQ ID NO: 191218 - DNA, 25 bp, E. coli
tgaccgtttcgggactgctgacctg

SEQ ID NO: 191219 - DNA, 25 bp, E. coli
tccccttcggtactggcgttaactg

SEQ ID NO: 191220 - DNA, 25 bp, E. coli
tccccttcggtagtggcgttaactg

SEQ ID NO: 191221 - DNA, 25 bp, E. coli
tatacctacggtcaagaaggtcgtg

SEQ ID NO: 191222 - DNA, 25 bp, E. coli
tatacctacggtgaagaaggtcgtg

SEQ ID NO: 191223 - DNA, 25 bp, E. coli
gcgtttcctgaactcaactggcaga

SEQ ID NO: 191224 - DNA, 25 bp, E. coli
gcgtttcctgaagtcaactggcaga

SEQ ID NO: 191225 - DNA, 25 bp, E. coli
ggctgcccacgttcgaaactggaaa

SEQ ID NO: 191226 - DNA, 25 bp, E. coli
ggctgcccacgtacgaaactggaaa

SEQ ID NO: 191227 - DNA, 25 bp, E. coli
tcagacatggattttgccactgccc

SEQ ID NO: 191228 - DNA, 25 bp, E. coli
tcagacatggatattgccactgccc

SEQ ID NO: 191229 - DNA, 25 bp, E. coli
gagcagccgcattttccctggagta

SEQ ID NO: 191230 - DNA, 25 bp, E. coli
gagcagccgcatattccctggagta

SEQ ID NO: 191231 - DNA, 25 bp, E. coli
aagtgtattgcattgccggacgcca

SEQ ID NO: 191232 - DNA, 25 bp, E. coli
aagtgtattgcaatgccggacgcca

SEQ ID NO: 191233 - DNA, 25 bp, E. coli
cagtatcagcaagagcacgttcagg

SEQ ID NO: 191234 - DNA, 25 bp, E. coli
cagtatcagcaacagcacgttcagg

SEQ ID NO: 191235 - DNA, 25 bp, E. coli
tcccctgaaggaagtgaaagagcgc

SEQ ID NO: 191236 - DNA, 25 bp, E. coli
tcccctgaaggatgtgaaagagcgc

SEQ ID NO: 191237 - DNA, 25 bp, E. coli
tccttagcgagatgggatataccca

SEQ ID NO: 191238 - DNA, 25 bp, E. coli
tccttagcgagaagggatataccca

SEQ ID NO: 191239 - DNA, 25 bp, E. coli
gcctgaaagacatcgcaatgccgaa

SEQ ID NO: 191240 - DNA, 25 bp, E. coli
gcctgaaagacaacgcaatgccgaa

SEQ ID NO: 191241 - DNA, 25 bp, E. coli
cgcaatgccgaaggtcaaaggttaa

SEQ ID NO: 191242 - DNA, 25 bp, E. coli
cgcaatgccgaacgtcaaaggttaa

SEQ ID NO: 191243 - DNA, 25 bp, E. coli
ggataaaaacgacaccgtgaaagtg

SEQ ID NO: 191244 - DNA, 25 bp, E. coli
ggataaaaacgagaccgtgaaagtg

SEQ ID NO: 191245 - DNA, 25 bp, E. coli
gatatacccacgatgagaacgccgg

SEQ ID NO: 191246 - DNA, 25 bp, E. coli
gatatacccacgttgagaacgccgg

SEQ ID NO: 191247 - DNA, 25 bp, E. coli
gttttcgccgctcaacactggatcg

SEQ ID NO: 191248 - DNA, 25 bp, E. coli
gatcgatgttcgtgttccagagcag

SEQ ID NO: 191249 - DNA, 25 bp, E. coli
gttttcgccgctgaacactggatcg

SEQ ID NO: 191250 - DNA, 25 bp, E. coli
gatcgatgttcgagttccagagcag

SEQ ID NO: 191251 - DNA, 25 bp, E. coli
tggtgttttcactgcccgttttcgc

SEQ ID NO: 191252 - DNA, 25 bp, E. coli
tggtgttttcacagcccgttttcgc

SEQ ID NO: 191253 - DNA, 25 bp, E. coli
tactgacgatgctgaacgagcacga

SEQ ID NO: 191254 - DNA, 25 bp, E. coli
tactgacgatgcagaacgagcacga

SEQ ID NO: 191255 - DNA, 25 bp, E. coli
tttgacggctcctcgattggcggct

SEQ ID NO: 191256 - DNA, 25 bp, E. coli
tttgacggctccacgattggcggct

SEQ ID NO: 191257 - DNA, 25 bp, E. coli
tccgcatccggtagagtttgagctg

SEQ ID NO: 191258 - DNA, 25 bp, E. coli
tccgcatccggttgagtttgagctg

SEQ ID NO: 191259 - DNA, 25 bp, E. coli
tcttctccgaaaccacgtcgtatcg

SEQ ID NO: 191260 - DNA, 25 bp, E. coli
tctgcgtcgcgaagaagatgaccgc

SEQ ID NO: 191261 - DNA, 25 bp, E. coli
tcttctccgaaagcacgtcgtatcg

SEQ ID NO: 191262 - DNA, 25 bp, E. coli
tctgcgtcgcgatgaagatgaccgc

SEQ ID NO: 191263 - DNA, 25 bp, E. coli
gaagcgaaagagatcccacaggttg

SEQ ID NO: 191264 - DNA, 25 bp, E. coli
gaagcgaaagagttcccacaggttg

SEQ ID NO: 191265 - DNA, 25 bp, E. coli
gtaacaaaggtctccgtccggcagt

SEQ ID NO: 191266 - DNA, 25 bp, E. coli
ggcgaagccatggacaaaaacctgt

SEQ ID NO: 191267 - DNA, 25 bp, E. coli
ggctctctggaacaagcactgaacg

SEQ ID NO: 191268 - DNA, 25 bp, E. coli
ggctctctggaagaagcactgaacg

SEQ ID NO: 191269 - DNA, 25 bp, E. coli
ggcgaagccatgcacaaaaacctgt

SEQ ID NO: 191270 - DNA, 25 bp, E. coli
tcaagaacaagaaccatccgggcga

SEQ ID NO: 191271 - DNA, 25 bp, E. coli
tcaagaacaagatccatccgggcga

SEQ ID NO: 191272 - DNA, 25 bp, E. coli
gatctggaccgcgagttcctgaaag

SEQ ID NO: 191273 - DNA, 25 bp, E. coli
gtaacaaaggtcaccgtccggcagt

SEQ ID NO: 191274 - DNA, 25 bp, E. coli
gatctggaccgccagttcctgaaag

SEQ ID NO: 191275 - DNA, 25 bp, E. coli
aatataatctttcctgtatgaaata

SEQ ID NO: 191276 - DNA, 25 bp, E. coli
aatataatctttgctgtatgaaata

SEQ ID NO: 191277 - DNA, 25 bp, E. coli
tacagtttataggtatgaaaaaata

SEQ ID NO: 191278 - DNA, 25 bp, E. coli
tacagtttatagctatgaaaaaata

SEQ ID NO: 191279 - DNA, 25 bp, E. coli
ctgttacagtttataggtatgaaaa

SEQ ID NO: 191280 - DNA, 25 bp, E. coli
atggctctgttagagtttataggta

SEQ ID NO: 191281 - DNA, 25 bp, E. coli
ctgttacagtttttaggtatgaaaa

SEQ ID NO: 191282 - DNA, 25 bp, E. coli
atggctctgttacagtttataggta

SEQ ID NO: 191283 - DNA, 25 bp, E. coli
aaaaatataatctttcctgtatgaa

SEQ ID NO: 191284 - DNA, 25 bp, E. coli
aaaaatataatcattcctgtatgaa

SEQ ID NO: 191285 - DNA, 25 bp, E. coli
tctgttacagttaataggtatgaaa

SEQ ID NO: 191286 - DNA, 25 bp, E. coli
tctgttacagtttataggtatgaaa

SEQ ID NO: 191287 - DNA, 25 bp, E. coli
gctctgttacagtttataggtatga

SEQ ID NO: 191288 - DNA, 25 bp, E. coli
gctctgttacagattataggtatga

SEQ ID NO: 191289 - DNA, 25 bp, E. coli
gaaaaaatataaactttcctgtatg

SEQ ID NO: 191290 - DNA, 25 bp, E. coli
gaaaaaatataatctttcctgtatg

SEQ ID NO: 191291 - DNA, 25 bp, E. coli
ctctgttacagtatataggtatgaa

SEQ ID NO: 191292 - DNA, 25 bp, E. coli
ctctgttacagtttataggtatgaa

SEQ ID NO: 191293 - DNA, 25 bp, E. coli
ggctctgttacactttataggtatg

SEQ ID NO: 191294 - DNA, 25 bp, E. coli
ggctctgttacagtttataggtatg

SEQ ID NO: 191295 - DNA, 25 bp, E. coli
gtatgaaaaaatataatctttcctg

SEQ ID NO: 191296 - DNA, 25 bp, E. coli
gtatgaaaaaatttaatctttcctg

SEQ ID NO: 191297 - DNA, 25 bp, E. coli
taaatggacggccatgtatcatcgc

SEQ ID NO: 191298 - DNA, 25 bp, E. coli
taaatggacggcgatgtatcatcgc

SEQ ID NO: 191299 - DNA, 25 bp, E. coli
ggtaaccgtccctctcgaaggatgt

SEQ ID NO: 191300 - DNA, 25 bp, E. coli
ggtaaccgtcccactcgaaggatgt

SEQ ID NO: 191301 - DNA, 25 bp, E. coli
tatccggctaaatgggatgaggcca

SEQ ID NO: 191302 - DNA, 25 bp, E. coli
tatccggctaaaagggatgaggcca

SEQ ID NO: 191303 - DNA, 25 bp, E. coli
tatcatcgccgtgcatttttcgaca

SEQ ID NO: 191304 - DNA, 25 bp, E. coli
tatcatcgccgtccatttttcgaca

SEQ ID NO: 191305 - DNA, 25 bp, E. coli
ttccatgttaacgactttttcaggg

SEQ ID NO: 191306 - DNA, 25 bp, E. coli
ttccatgttaaccactttttcaggg

SEQ ID NO: 191307 - DNA, 25 bp, E. coli
tgtattcaggagtaaatggacggcg

SEQ ID NO: 191308 - DNA, 25 bp, E. coli
tgtattcaggagaaaatggacggcg

SEQ ID NO: 191309 - DNA, 25 bp, E. coli
ccatttacggaatttttgtctgcaa

SEQ ID NO: 191310 - DNA, 25 bp, E. coli
ccatttacggaaattttgtctgcaa

SEQ ID NO: 191311 - DNA, 25 bp, E. coli
gaaggagtaactttcatttgttcca

SEQ ID NO: 191312 - DNA, 25 bp, E. coli
gaaggagtaactatcatttgttcca

SEQ ID NO: 191313 - DNA, 25 bp, E. coli
cgaaggatgtttttcagtatccggc

SEQ ID NO: 191314 - DNA, 25 bp, E. coli
cgaaggatgtttatcagtatccggc

SEQ ID NO: 191315 - DNA, 25 bp, E. coli
gggatgaggccaaaagacataacaa

SEQ ID NO: 191316 - DNA, 25 bp, E. coli
gggatgaggccataagacataacaa

SEQ ID NO: 191317 - DNA, 25 bp, E. coli
taagacataacaattacagaaggag

SEQ ID NO: 191318 - DNA, 25 bp, E. coli
taagacataacatttacagaaggag

SEQ ID NO: 191319 - DNA, 25 bp, E. coli
cattgtccttgacattaccgaacgc

SEQ ID NO: 191320 - DNA, 25 bp, E. coli
cattgtccttgagattaccgaacgc

SEQ ID NO: 191321 - DNA, 25 bp, E. coli
tatgtgacacgagaaccaaagcgtg

SEQ ID NO: 191322 - DNA, 25 bp, E. coli
tatgtgacacgacaaccaaagcgtg

SEQ ID NO: 191323 - DNA, 25 bp, E. coli
tatggcagcgctcgatatctcggaa

SEQ ID NO: 191324 - DNA, 25 bp, E. coli
tatggcagcgctggatatctcggaa

SEQ ID NO: 191325 - DNA, 25 bp, E. coli
tatctcggaaaatgtccctggcaga

SEQ ID NO: 191326 - DNA, 25 bp, E. coli
tatctcggaaaaagtccctggcaga

SEQ ID NO: 191327 - DNA, 25 bp, E. coli
ttcaccttgggataaatattgccgc

SEQ ID NO: 191328 - DNA, 25 bp, E. coli
ttcaccttgggaaaaatattgccgc

SEQ ID NO: 191329 - DNA, 25 bp, E. coli
tgtcagtacctctcaccaggcggaa

SEQ ID NO: 191330 - DNA, 25 bp, E. coli
tgtcagtacctcacaccaggcggaa

SEQ ID NO: 191331 - DNA, 25 bp, E. coli
tgtaccaggtaatacagccatagtg

SEQ ID NO: 191332 - DNA, 25 bp, E. coli
tgattgctaacgcagcattgacccc

SEQ ID NO: 191333 - DNA, 25 bp, E. coli
tgtaccaggtaaaacagccatagtg

SEQ ID NO: 191334 - DNA, 25 bp, E. coli
tgattgctaacggagcattgacccc

SEQ ID NO: 191335 - DNA, 25 bp, E. coli
gaaaccctgcaaagatatcctggaa

SEQ ID NO: 191336 - DNA, 25 bp, E. coli
gaaaccctgcaatgatatcctggaa

SEQ ID NO: 191337 - DNA, 25 bp, E. coli
ggtagtttttatccgcgctgcagaa

SEQ ID NO: 191338 - DNA, 25 bp, E. coli
ggtagtttttatgcgcgctgcagaa

SEQ ID NO: 191339 - DNA, 25 bp, E. coli
tcactacagcggtagacgaaacgcc

SEQ ID NO: 191340 - DNA, 25 bp, E. coli
tcactacagcggaagacgaaacgcc

SEQ ID NO: 191341 - DNA, 25 bp, E. coli
atgctgcactgggatacgctgaagc

SEQ ID NO: 191342 - DNA, 25 bp, E. coli
atgctgcactggcatacgctgaagc

SEQ ID NO: 191343 - DNA, 25 bp, E. coli
tgcactgggatacgctgaagcgttg

SEQ ID NO: 191344 - DNA, 25 bp, E. coli
tgcactgggataggctgaagcgttg

SEQ ID NO: 191345 - DNA, 25 bp, E. coli
tgctgcactgggatacgctgaagcg

SEQ ID NO: 191346 - DNA, 25 bp, E. coli
tgctgccagtagaggctattggcat

SEQ ID NO: 191347 - DNA, 25 bp, E. coli
tgctgcactgggttacgctgaagcg

SEQ ID NO: 191348 - DNA, 25 bp, E. coli
tgctgccagtagtggctattggcat

SEQ ID NO: 191349 - DNA, 25 bp, E. coli
gccagtagtggcaattggcattggc

SEQ ID NO: 191350 - DNA, 25 bp, E. coli
gccagtagtggctattggcattggc

SEQ ID NO: 191351 - DNA, 25 bp, E. coli
gctgccagtagtggctattggcatt

SEQ ID NO: 191352 - DNA, 25 bp, E. coli
gctgcactgggatacgctgaagcgt

SEQ ID NO: 191353 - DNA, 25 bp, E. coli
gctgcactgggaaacgctgaagcgt

SEQ ID NO: 191354 - DNA, 25 bp, E. coli
gctgccagtagtcgctattggcatt

SEQ ID NO: 191355 - DNA, 25 bp, E. coli
gcactgggataccctgaagcgttga

SEQ ID NO: 191356 - DNA, 25 bp, E. coli
gcactgggatacgctgaagcgttga

SEQ ID NO: 191357 - DNA, 25 bp, E. coli
ctgcactgggattcgctgaagcgtt

SEQ ID NO: 191358 - DNA, 25 bp, E. coli
ctgccagtagtggctattggcattg

SEQ ID NO: 191359 - DNA, 25 bp, E. coli
ctgccagtagtgcctattggcattg

SEQ ID NO: 191360 - DNA, 25 bp, E. coli
ctgcactgggatacgctgaagcgtt

SEQ ID NO: 191361 - DNA, 25 bp, E. coli
gtgctgccagtactggctattggca

SEQ ID NO: 191362 - DNA, 25 bp, E. coli
gtgctgccagtagtggctattggca

SEQ ID NO: 191363 - DNA, 25 bp, E. coli
attacaatagtaacggcgcgggtgc

SEQ ID NO: 191364 - DNA, 25 bp, E. coli
attacaatagtatcggcgcgggtgc

SEQ ID NO: 191365 - DNA, 25 bp, E. coli
aaattgttcaaatgggtggcgcggc

SEQ ID NO: 191366 - DNA, 25 bp, E. coli
aaattgttcaaaagggtggcgcggc

SEQ ID NO: 191367 - DNA, 25 bp, E. coli
tacccggatattacgcgctgaagcg

SEQ ID NO: 191368 - DNA, 25 bp, E. coli
tatggttatcaacaatggccgcgct

SEQ ID NO: 191369 - DNA, 25 bp, E. coli
tacccggatatttcgcgctgaagcg

SEQ ID NO: 191370 - DNA, 25 bp, E. coli
tatccagctggtatatgggaccgcc

SEQ ID NO: 191371 - DNA, 25 bp, E. coli
tatccagctggtttatgggaccgcc

SEQ ID NO: 191372 - DNA, 25 bp, E. coli
tatggttatcaagaatggccgcgct

SEQ ID NO: 191373 - DNA, 25 bp, E. coli
ttatcaaacggcatgcgcgcggatg

SEQ ID NO: 191374 - DNA, 25 bp, E. coli
ttatcaaacggcttgcgcgcggatg

SEQ ID NO: 191375 - DNA, 25 bp, E. coli
tcagtcagctatggcaatggcgcag

SEQ ID NO: 191376 - DNA, 25 bp, E. coli
tctgggctggcagaatggttaacgt

SEQ ID NO: 191377 - DNA, 25 bp, E. coli
tctgggctggcacaatggttaacgt

SEQ ID NO: 191378 - DNA, 25 bp, E. coli
cctgcaaaacggtacgacgctggaa

SEQ ID NO: 191379 - DNA, 25 bp, E. coli
cctgcaaaacggaacgacgctggaa

SEQ ID NO: 191380 - DNA, 25 bp, E. coli
gaacggcggtaacctatcacatgga

SEQ ID NO: 191381 - DNA, 25 bp, E. coli
gaacggcggtaagctatcacatgga

SEQ ID NO: 191382 - DNA, 25 bp, E. coli
gatattggttttgatcgcggcggca

SEQ ID NO: 191383 - DNA, 25 bp, E. coli
gatattggttttcatcgcggcggca

SEQ ID NO: 191384 - DNA, 25 bp, E. coli
tcagtcagctatcgcaatggcgcag

SEQ ID NO: 191385 - DNA, 25 bp, E. coli
catctggtcgtaccctgaaagccga

SEQ ID NO: 191386 - DNA, 25 bp, E. coli
catctggtcgtagcctgaaagccga

SEQ ID NO: 191387 - DNA, 25 bp, E. coli
taacgatacttaagcaggcggctct

SEQ ID NO: 191388 - DNA, 25 bp, E. coli
actacgatgataactggaccttccg

SEQ ID NO: 191389 - DNA, 25 bp, E. coli
actacgatgatatctggaccttccg

SEQ ID NO: 191390 - DNA, 25 bp, E. coli
aaaattgaacgtttcgcaggcgatc

SEQ ID NO: 191391 - DNA, 25 bp, E. coli
aaaattgaacgtatcgcaggcgatc

SEQ ID NO: 191392 - DNA, 25 bp, E. coli
tatgcactgaccaaccgttctgaag

SEQ ID NO: 191393 - DNA, 25 bp, E. coli
tatgcactgacctaccgttctgaag

SEQ ID NO: 191394 - DNA, 25 bp, E. coli
gaaaattaacgaaggcccataccag

SEQ ID NO: 191395 - DNA, 25 bp, E. coli
gaaaattaacgatggcccataccag

SEQ ID NO: 191396 - DNA, 25 bp, E. coli
ctgaaagcgacctcaaccagtggcg

SEQ ID NO: 191397 - DNA, 25 bp, E. coli
ctgaaagcgaccacaaccagtggcg

SEQ ID NO: 191398 - DNA, 25 bp, E. coli
ggtatcgcctttgatgacagcccag

SEQ ID NO: 191399 - DNA, 25 bp, E. coli
ggtatcgcctttcatgacagcccag

SEQ ID NO: 191400 - DNA, 25 bp, E. coli
taacgatacttatgcaggcggctct

SEQ ID NO: 191401 - DNA, 25 bp, E. coli
taacatcgcgccaacggcatgggtt

SEQ ID NO: 191402 - DNA, 25 bp, E. coli
tcaaaggtaactacagcagcgatct

SEQ ID NO: 191403 - DNA, 25 bp, E. coli
tcaaaggtaacttcagcagcgatct

SEQ ID NO: 191404 - DNA, 25 bp, E. coli
taacatcgcgcctacggcatgggtt

SEQ ID NO: 191405 - DNA, 25 bp, E. coli
gatgtaaatatcagcggaacgtctc

SEQ ID NO: 191406 - DNA, 25 bp, E. coli
gatgtaaatatctgcggaacgtctc

SEQ ID NO: 191407 - DNA, 25 bp, E. coli
cagacaaatcaaagggctgtttaat

SEQ ID NO: 191408 - DNA, 25 bp, E. coli
catattcgtcaaggcgacctgatgg

SEQ ID NO: 191409 - DNA, 25 bp, E. coli
catattcgtcaacgcgacctgatgg

SEQ ID NO: 191410 - DNA, 25 bp, E. coli
cagacaaatcaatgggctgtttaat

SEQ ID NO: 191411 - DNA, 25 bp, E. coli
cacggtattgaaagcccctatccct

SEQ ID NO: 191412 - DNA, 25 bp, E. coli
cacggtattgaatgcccctatccct

SEQ ID NO: 191413 - DNA, 25 bp, E. coli
tatccctattcgctgtgttggctgg

SEQ ID NO: 191414 - DNA, 25 bp, E. coli
tatccctattcggtgtgttggctgg

SEQ ID NO: 191415 - DNA, 25 bp, E. coli
tgcagacatcatccgctttaccggg

SEQ ID NO: 191416 - DNA, 25 bp, E. coli
tgcagacatcatgcgctttaccggg

SEQ ID NO: 191417 - DNA, 25 bp, E. coli
cctgcttattaactagtggatacgc

SEQ ID NO: 191418 - DNA, 25 bp, E. coli
gccgcaatgcaatatcaccttgatg

SEQ ID NO: 191419 - DNA, 25 bp, E. coli
cctgcttattaagtagtggatacgc

SEQ ID NO: 191420 - DNA, 25 bp, E. coli
gccgcaatgcaaaatcaccttgatg

SEQ ID NO: 191421 - DNA, 25 bp, E. coli
gctggtagagcaaatggcctgctta

SEQ ID NO: 191422 - DNA, 25 bp, E. coli
gctggtagagcatatggcctgctta

SEQ ID NO: 191423 - DNA, 25 bp, E. coli
gactattgcggatagattgcggcag

SEQ ID NO: 191424 - DNA, 25 bp, E. coli
gactattgcggaaagattgcggcag

SEQ ID NO: 191425 - DNA, 25 bp, E. coli
gggctgtttaataacatactgcaaa

SEQ ID NO: 191426 - DNA, 25 bp, E. coli
gggctgtttaattacatactgcaaa

SEQ ID NO: 191427 - DNA, 25 bp, E. coli
ggctggattgttacgccgatcccaa

SEQ ID NO: 191428 - DNA, 25 bp, E. coli
ggctggattgtttcgccgatcccaa

SEQ ID NO: 191429 - DNA, 25 bp, E. coli
aagaagcctctggttattatcagtg

SEQ ID NO: 191430 - DNA, 25 bp, E. coli
aagaagcctctgcttattatcagtg

SEQ ID NO: 191431 - DNA, 25 bp, E. coli
caggtatatcgtgcgggtgtacagc

SEQ ID NO: 191432 - DNA, 25 bp, E. coli
caggtatatcgtccgggtgtacagc

SEQ ID NO: 191433 - DNA, 25 bp, E. coli
agcctctggttattatcagtgcctg

SEQ ID NO: 191434 - DNA, 25 bp, E. coli
agcctctggttaatatcagtgcctg

SEQ ID NO: 191435 - DNA, 25 bp, E. coli
tatcgtgcgggtctacagcaacgtc

SEQ ID NO: 191436 - DNA, 25 bp, E. coli
tatcgtgcgggtgtacagcaacgtc

SEQ ID NO: 191437 - DNA, 25 bp, E. coli
tatatcgtgcgggtgtacagcaacg

SEQ ID NO: 191438 - DNA, 25 bp, E. coli
tatatcgtgcggctgtacagcaacg

SEQ ID NO: 191439 - DNA, 25 bp, E. coli
tgaagaagcctcaggttattatcag

SEQ ID NO: 191440 - DNA, 25 bp, E. coli
tgaagaagcctctggttattatcag

SEQ ID NO: 191441 - DNA, 25 bp, E. coli
tctggttattatgagtgcctgtcag

SEQ ID NO: 191442 - DNA, 25 bp, E. coli
tctggttattatcagtgcctgtcag

SEQ ID NO: 191443 - DNA, 25 bp, E. coli
cctctggttattttcagtgcctgtc

SEQ ID NO: 191444 - DNA, 25 bp, E. coli
cctctggttattatcagtgcctgtc

SEQ ID NO: 191445 - DNA, 25 bp, E. coli
gacaggtatatcctgcgggtgtaca

SEQ ID NO: 191446 - DNA, 25 bp, E. coli
gaagcctctggttattatcagtgcc

SEQ ID NO: 191447 - DNA, 25 bp, E. coli
gacaggtatatcgtgcgggtgtaca

SEQ ID NO: 191448 - DNA, 25 bp, E. coli
gaagcctctggtaattatcagtgcc

SEQ ID NO: 191449 - DNA, 25 bp, E. coli
ctggttattatctgtgcctgtcagt

SEQ ID NO: 191450 - DNA, 25 bp, E. coli
ctggttattatcagtgcctgtcagt

SEQ ID NO: 191451 - DNA, 25 bp, E. coli
caagttattattttgcctgggcgaa

SEQ ID NO: 191452 - DNA, 25 bp, E. coli
caagttattattatgcctgggcgaa

SEQ ID NO: 191453 - DNA, 25 bp, E. coli
aaaatgcggttaatgaagcggaagc

SEQ ID NO: 191454 - DNA, 25 bp, E. coli
aaaatgcggttattgaagcggaagc

SEQ ID NO: 191455 - DNA, 25 bp, E. coli
ttgaagcggaaggaacgattggtcc

SEQ ID NO: 191456 - DNA, 25 bp, E. coli
ttgaagcggaagcaacgattggtcc

SEQ ID NO: 191457 - DNA, 25 bp, E. coli
tgccgactcggttgttgcaaaccag

SEQ ID NO: 191458 - DNA, 25 bp, E. coli
tgccgactcggtagttgcaaaccag

SEQ ID NO: 191459 - DNA, 25 bp, E. coli
ccggatgcgataaattaggttgtta

SEQ ID NO: 191460 - DNA, 25 bp, E. coli
ccggatgcgatatattaggttgtta

SEQ ID NO: 191461 - DNA, 25 bp, E. coli
gcccgcgcgtgaatgtagaacgtaa

SEQ ID NO: 191462 - DNA, 25 bp, E. coli
gcccgcgcgtgattgtagaacgtaa

SEQ ID NO: 191463 - DNA, 25 bp, E. coli
cggtagttgcaaaccaggcatattt

SEQ ID NO: 191464 - DNA, 25 bp, E. coli
cggtagttgcaatccaggcatattt

SEQ ID NO: 191465 - DNA, 25 bp, E. coli
gtcctggcacaataatcagcaatgg

SEQ ID NO: 191466 - DNA, 25 bp, E. coli
gtcctggcacaaaaatcagcaatgg

SEQ ID NO: 191467 - DNA, 25 bp, E. coli
ggaattatcgcttccggatgcgata

SEQ ID NO: 191468 - DNA, 25 bp, E. coli
ggaattatcgctaccggatgcgata

SEQ ID NO: 191469 - DNA, 25 bp, E. coli
taattatgcgttaattcgtcctggc

SEQ ID NO: 191470 - DNA, 25 bp, E. coli
tcagcaatggcgaaaaaattggttt

SEQ ID NO: 191471 - DNA, 25 bp, E. coli
tcagcaatggcgtaaaaattggttt

SEQ ID NO: 191472 - DNA, 25 bp, E. coli
taattatgcgtttattcgtcctggc

SEQ ID NO: 191473 - DNA, 25 bp, E. coli
cataacgccgatagcaaaaggagtt

SEQ ID NO: 191474 - DNA, 25 bp, E. coli
caggcatttatagtcttttgaatac

SEQ ID NO: 191475 - DNA, 25 bp, E. coli
cataacgccgattgcaaaaggagtt

SEQ ID NO: 191476 - DNA, 25 bp, E. coli
caggcatttatactcttttgaatac

SEQ ID NO: 191477 - DNA, 25 bp, E. coli
taaatcacctcgaattctgactcgc

SEQ ID NO: 191478 - DNA, 25 bp, E. coli
tacttgttacaaggataaggttata

SEQ ID NO: 191479 - DNA, 25 bp, E. coli
tacttgttacaacgataaggttata

SEQ ID NO: 191480 - DNA, 25 bp, E. coli
taaatcacctcgtattctgactcgc

SEQ ID NO: 191481 - DNA, 25 bp, E. coli
aacttatgtaacagtcacgcattat

SEQ ID NO: 191482 - DNA, 25 bp, E. coli
aacttatgtaactgtcacgcattat

SEQ ID NO: 191483 - DNA, 25 bp, E. coli
tttgactgggttgaacataacgccg

SEQ ID NO: 191484 - DNA, 25 bp, E. coli
tttgactgggttcaacataacgccg

SEQ ID NO: 191485 - DNA, 25 bp, E. coli
tctgcctgtatattctttaaagatg

SEQ ID NO: 191486 - DNA, 25 bp, E. coli
tctgcctgtataatctttaaagatg

SEQ ID NO: 191487 - DNA, 25 bp, E. coli
ccagatgaaaaatttgctcaaaatg

SEQ ID NO: 191488 - DNA, 25 bp, E. coli
ccagatgaaaaaattgctcaaaatg

SEQ ID NO: 191489 - DNA, 25 bp, E. coli
gcaaaaggagttatgttcaacaatt

SEQ ID NO: 191490 - DNA, 25 bp, E. coli
gcaaaaggagttttgttcaacaatt

SEQ ID NO: 191491 - DNA, 25 bp, E. coli
tggcgcagcaaactcaggcatttat

SEQ ID NO: 191492 - DNA, 25 bp, E. coli
tggcgcagcaaagtcaggcatttat

SEQ ID NO: 191493 - DNA, 25 bp, E. coli
taatgttcaatgtaatatttctgcc

SEQ ID NO: 191494 - DNA, 25 bp, E. coli
taatgttcaatgaaatatttctgcc

SEQ ID NO: 191495 - DNA, 25 bp, E. coli
cacatgagttgcaggacgcattgca

SEQ ID NO: 191496 - DNA, 25 bp, E. coli
cacatgagttgctggacgcattgca

SEQ ID NO: 191497 - DNA, 25 bp, E. coli
catgttgcggtggtcgatgccccct

SEQ ID NO: 191498 - DNA, 25 bp, E. coli
catgttgcggtgctcgatgccccct

SEQ ID NO: 191499 - DNA, 25 bp, E. coli
acatgagttgctggacgcattgcat

SEQ ID NO: 191500 - DNA, 25 bp, E. coli
acatgagttgctcgacgcattgcat

SEQ ID NO: 191501 - DNA, 25 bp, E. coli
tgttgcggtggtcgatgccccctca

SEQ ID NO: 191502 - DNA, 25 bp, E. coli
tgttgcggtggtggatgccccctca

SEQ ID NO: 191503 - DNA, 25 bp, E. coli
tgcggtggtcgaagccccctcacat

SEQ ID NO: 191504 - DNA, 25 bp, E. coli
tgcggtggtcgatgccccctcacat

SEQ ID NO: 191505 - DNA, 25 bp, E. coli
ccctcacatgagttgctggacgcat

SEQ ID NO: 191506 - DNA, 25 bp, E. coli
cctcacatgagttgctggacgcatt

SEQ ID NO: 191507 - DNA, 25 bp, E. coli
cctcacatgagtagctggacgcatt

SEQ ID NO: 191508 - DNA, 25 bp, E. coli
ccctcacatgagatgctggacgcat

SEQ ID NO: 191509 - DNA, 25 bp, E. coli
ctcacatgagttgctggacgcattg

SEQ ID NO: 191510 - DNA, 25 bp, E. coli
ctcacatgagttcctggacgcattg

SEQ ID NO: 191511 - DNA, 25 bp, E. coli
ggtcgatgccccgtcacatgagttg

SEQ ID NO: 191512 - DNA, 25 bp, E. coli
ggtcgatgccccctcacatgagttg

SEQ ID NO: 191513 - DNA, 25 bp, E. coli
tcacatgagttgctggacgcattgc

SEQ ID NO: 191514 - DNA, 25 bp, E. coli
tcacatgagttggtggacgcattgc

SEQ ID NO: 191515 - DNA, 25 bp, E. coli
gatgccccctcagatgagttgctgg

SEQ ID NO: 191516 - DNA, 25 bp, E. coli
gatgccccctcacatgagttgctgg

SEQ ID NO: 191517 - DNA, 25 bp, E. coli
catcgggaaagataattctcggcac

SEQ ID NO: 191518 - DNA, 25 bp, E. coli
caggcgaacatgtcctcactgaatg

SEQ ID NO: 191519 - DNA, 25 bp, E. coli
catcgggaaagaaaattctcggcac

SEQ ID NO: 191520 - DNA, 25 bp, E. coli
caggcgaacatgacctcactgaatg

SEQ ID NO: 191521 - DNA, 25 bp, E. coli
taactgctcaatcatgcgtgcatgg

SEQ ID NO: 191522 - DNA, 25 bp, E. coli
tactctgggaatatatggaccgtgg

SEQ ID NO: 191523 - DNA, 25 bp, E. coli
tactctgggaatttatggaccgtgg

SEQ ID NO: 191524 - DNA, 25 bp, E. coli
tagttataagggtacaggtggtgcc

SEQ ID NO: 191525 - DNA, 25 bp, E. coli
tagttataagggaacaggtggtgcc

SEQ ID NO: 191526 - DNA, 25 bp, E. coli
tttatcaacatgagacactcaaggg

SEQ ID NO: 191527 - DNA, 25 bp, E. coli
tttatcaacatgtgacactcaaggg

SEQ ID NO: 191528 - DNA, 25 bp, E. coli
tgcaggtcaacagtttgcgctcggt

SEQ ID NO: 191529 - DNA, 25 bp, E. coli
tgcaggtcaacactttgcgctcggt

SEQ ID NO: 191530 - DNA, 25 bp, E. coli
tcttattgcgcaagtgacgacatcg

SEQ ID NO: 191531 - DNA, 25 bp, E. coli
tcttattgcgcatgtgacgacatcg

SEQ ID NO: 191532 - DNA, 25 bp, E. coli
gcggtattccttctatggcagtgaa

SEQ ID NO: 191533 - DNA, 25 bp, E. coli
gcggtattccttgtatggcagtgaa

SEQ ID NO: 191534 - DNA, 25 bp, E. coli
gaagagtctgcactatcaggcgaac

SEQ ID NO: 191535 - DNA, 25 bp, E. coli
gaagagtctgcagtatcaggcgaac

SEQ ID NO: 191536 - DNA, 25 bp, E. coli
ggcactcgtttgttttcacaggcaa

SEQ ID NO: 191537 - DNA, 25 bp, E. coli
ggcactcgtttgatttcacaggcaa

SEQ ID NO: 191538 - DNA, 25 bp, E. coli
taactgctcaatgatgcgtgcatgg

SEQ ID NO: 191539 - DNA, 25 bp, E. coli
caagctctccggtgggatgaaacaa

SEQ ID NO: 191540 - DNA, 25 bp, E. coli
caagctctccggagggatgaaacaa

SEQ ID NO: 191541 - DNA, 25 bp, E. coli
cacgactgggattaggagcatagca

SEQ ID NO: 191542 - DNA, 25 bp, E. coli
cacgactgggataaggagcatagca

SEQ ID NO: 191543 - DNA, 25 bp, E. coli
tatcacgctgaagggcctggaaaaa

SEQ ID NO: 191544 - DNA, 25 bp, E. coli
tatcacgctgaacggcctggaaaaa

SEQ ID NO: 191545 - DNA, 25 bp, E. coli
tattgcgaccgcatcggcctggtgt

SEQ ID NO: 191546 - DNA, 25 bp, E. coli
tattgcgaccgcttcggcctggtgt

SEQ ID NO: 191547 - DNA, 25 bp, E. coli
tgatccgatcaaaaacgacggcgcg

SEQ ID NO: 191548 - DNA, 25 bp, E. coli
tgatccgatcaataacgacggcgcg

SEQ ID NO: 191549 - DNA, 25 bp, E. coli
ttaggttttaaacagcggctggcgc

SEQ ID NO: 191550 - DNA, 25 bp, E. coli
ttaggttttaaagagcggctggcgc

SEQ ID NO: 191551 - DNA, 25 bp, E. coli
gcatctcggctatatggcgcaaaaa

SEQ ID NO: 191552 - DNA, 25 bp, E. coli
gcatctcggctaaatggcgcaaaaa

SEQ ID NO: 191553 - DNA, 25 bp, E. coli
gaaaaacgctttgcgggcatggaca

SEQ ID NO: 191554 - DNA, 25 bp, E. coli
gaaaaacgctttccgggcatggaca

SEQ ID NO: 191555 - DNA, 25 bp, E. coli
gatattcgccatgccgacgggatgc

SEQ ID NO: 191556 - DNA, 25 bp, E. coli
gatattcgccatcccgacgggatgc

SEQ ID NO: 191557 - DNA, 25 bp, E. coli
ggattactgaaagccgacagcggca

SEQ ID NO: 191558 - DNA, 25 bp, E. coli
ggattactgaaacccgacagcggca

SEQ ID NO: 191559 - DNA, 25 bp, E. coli
gatggagaacctcaatctgtacgcg

SEQ ID NO: 191560 - DNA, 25 bp, E. coli
gatggagaacctgaatctgtacgcg

SEQ ID NO: 191561 - DNA, 25 bp, E. coli
caatgccggcgctggtattgcggaa

SEQ ID NO: 191562 - DNA, 25 bp, E. coli
caatgccggcgcaggtattgcggaa

SEQ ID NO: 191563 - DNA, 25 bp, E. coli
atgaaacgtgttccaatgccggcgc

SEQ ID NO: 191564 - DNA, 25 bp, E. coli
attgcggaaatcagccctgtccccg

SEQ ID NO: 191565 - DNA, 25 bp, E. coli
attgcggaaatctgccctgtccccg

SEQ ID NO: 191566 - DNA, 25 bp, E. coli
atgaaacgtgttgcaatgccggcgc

SEQ ID NO: 191567 - DNA, 25 bp, E. coli
acgtgttgcaatcccggcgctggta

SEQ ID NO: 191568 - DNA, 25 bp, E. coli
aaacgtgttgcattgccggcgctgg

SEQ ID NO: 191569 - DNA, 25 bp, E. coli
aaacgtgttgcaatgccggcgctgg

SEQ ID NO: 191570 - DNA, 25 bp, E. coli
acgtgttgcaatgccggcgctggta

SEQ ID NO: 191571 - DNA, 25 bp, E. coli
tggtattgcggatatcagccctgtc

SEQ ID NO: 191572 - DNA, 25 bp, E. coli
tgccggcgctggaattgcggaaatc

SEQ ID NO: 191573 - DNA, 25 bp, E. coli
tgccggcgctggtattgcggaaatc

SEQ ID NO: 191574 - DNA, 25 bp, E. coli
ccggcgctggtaatgcggaaatcag

SEQ ID NO: 191575 - DNA, 25 bp, E. coli
ccggcgctggtattgcggaaatcag

SEQ ID NO: 191576 - DNA, 25 bp, E. coli
gctggtattgcgcaaatcagccctg

SEQ ID NO: 191577 - DNA, 25 bp, E. coli
gctggtattgcggaaatcagccctg

SEQ ID NO: 191578 - DNA, 25 bp, E. coli
gaaacgtgttgcaatgccggcgctg

SEQ ID NO: 191579 - DNA, 25 bp, E. coli
gaaacgtgttgctatgccggcgctg

SEQ ID NO: 191580 - DNA, 25 bp, E. coli
gtattgcggaaatcagccctgtccc

SEQ ID NO: 191581 - DNA, 25 bp, E. coli
gtattgcggaaaacagccctgtccc

SEQ ID NO: 191582 - DNA, 25 bp, E. coli
tggtattgcggaaatcagccctgtc

SEQ ID NO: 191583 - DNA, 25 bp, E. coli
caatgagggttagagcatatgcgtc

SEQ ID NO: 191584 - DNA, 25 bp, E. coli
caatgagggttacagcatatgcgtc

SEQ ID NO: 191585 - DNA, 25 bp, E. coli
cataggatcaatcagggttagagca

SEQ ID NO: 191586 - DNA, 25 bp, E. coli
cagggaaatactagtgctggacgta

SEQ ID NO: 191587 - DNA, 25 bp, E. coli
cataggatcaatgagggttagagca

SEQ ID NO: 191588 - DNA, 25 bp, E. coli
cagggaaatacttgtgctggacgta

SEQ ID NO: 191589 - DNA, 25 bp, E. coli
tgtgctggacgtagcgtaaacgcct

SEQ ID NO: 191590 - DNA, 25 bp, E. coli
tgtgctggacgttgcgtaaacgcct

SEQ ID NO: 191591 - DNA, 25 bp, E. coli
tgatccgtccaacggttcggatttt

SEQ ID NO: 191592 - DNA, 25 bp, E. coli
tgatccgtccaagggttcggatttt

SEQ ID NO: 191593 - DNA, 25 bp, E. coli
tcggcaaacagagagggaaatactt

SEQ ID NO: 191594 - DNA, 25 bp, E. coli
tcggcaaacagacagggaaatactt

SEQ ID NO: 191595 - DNA, 25 bp, E. coli
gtaaacgcctgatccgtccaacggt

SEQ ID NO: 191596 - DNA, 25 bp, E. coli
gtaaacgcctgaaccgtccaacggt

SEQ ID NO: 191597 - DNA, 25 bp, E. coli
gcggacgggcaaacaagggtaacat

SEQ ID NO: 191598 - DNA, 25 bp, E. coli
gcggacgggcaatcaagggtaacat

SEQ ID NO: 191599 - DNA, 25 bp, E. coli
cgtccagtggcgcacgggcaaacaa

SEQ ID NO: 191600 - DNA, 25 bp, E. coli
cgtccagtggcggacgggcaaacaa

SEQ ID NO: 191601 - DNA, 25 bp, E. coli
ggcaaacaagggtaacataggatca

SEQ ID NO: 191602 - DNA, 25 bp, E. coli
ggcaaacaagggaaacataggatca

SEQ ID NO: 191603 - DNA, 25 bp, E. coli
gagcatatgcgtctgtcggcaaaca

SEQ ID NO: 191604 - DNA, 25 bp, E. coli
gagcatatgcgtgtgtcggcaaaca

SEQ ID NO: 191605 - DNA, 25 bp, E. coli
caaaggtgtcgcctggttgcagaac

SEQ ID NO: 191606 - DNA, 25 bp, E. coli
caaaggtgtcgcgtggttgcagaac

SEQ ID NO: 191607 - DNA, 25 bp, E. coli
tactgtgctgggaaccgctttcgga

SEQ ID NO: 191608 - DNA, 25 bp, E. coli
tactgtgctgggtaccgctttcgga

SEQ ID NO: 191609 - DNA, 25 bp, E. coli
acctgattcctaacgctaccgcggg

SEQ ID NO: 191610 - DNA, 25 bp, E. coli
acctgattcctatcgctaccgcggg

SEQ ID NO: 191611 - DNA, 25 bp, E. coli
aaacaggaagctcagcaactggcgc

SEQ ID NO: 191612 - DNA, 25 bp, E. coli
aaacaggaagctgagcaactggcgc

SEQ ID NO: 191613 - DNA, 25 bp, E. coli
tattatcgaagagatgcgtccgcag

SEQ ID NO: 191614 - DNA, 25 bp, E. coli
tatactcggcgattcttgcgcgcac

SEQ ID NO: 191615 - DNA, 25 bp, E. coli
tattatcgaagacatgcgtccgcag

SEQ ID NO: 191616 - DNA, 25 bp, E. coli
tatactcggcgaatcttgcgcgcac

SEQ ID NO: 191617 - DNA, 25 bp, E. coli
ttgagcgcgatataaccccgttagc

SEQ ID NO: 191618 - DNA, 25 bp, E. coli
tttttgccccgatgctggcgctggg

SEQ ID NO: 191619 - DNA, 25 bp, E. coli
ttgagcgcgataaaaccccgttagc

SEQ ID NO: 191620 - DNA, 25 bp, E. coli
tttttgccccgaagctggcgctggg

SEQ ID NO: 191621 - DNA, 25 bp, E. coli
gcctgcgacgcacacaactgattcg

SEQ ID NO: 191622 - DNA, 25 bp, E. coli
gcctgcgacgcagacaactgattcg

SEQ ID NO: 191623 - DNA, 25 bp, E. coli
ctggtgtttatcttcgtcgcgcggg

SEQ ID NO: 191624 - DNA, 25 bp, E. coli
ctggtgtttatcatcgtcgcgcggg

SEQ ID NO: 191625 - DNA, 25 bp, E. coli
gattattaccggacttggcgcaaca

SEQ ID NO: 191626 - DNA, 25 bp, E. coli
gattattaccggtcttggcgcaaca

SEQ ID NO: 191627 - DNA, 25 bp, E. coli
aaccgcgccgcttttgaagagatgc

SEQ ID NO: 191628 - DNA, 25 bp, E. coli
tagctggccgtaagccggtggtaac

SEQ ID NO: 191629 - DNA, 25 bp, E. coli
tagctggccgtatgccggtggtaac

SEQ ID NO: 191630 - DNA, 25 bp, E. coli
aaccgcgccgctattgaagagatgc

SEQ ID NO: 191631 - DNA, 25 bp, E. coli
tattaacattggctcaacggcaggt

SEQ ID NO: 191632 - DNA, 25 bp, E. coli
tattaacattgggtcaacggcaggt

SEQ ID NO: 191633 - DNA, 25 bp, E. coli
ttttagtaactggagcaacggcagg

SEQ ID NO: 191634 - DNA, 25 bp, E. coli
ttttagtaactgcagcaacggcagg

SEQ ID NO: 191635 - DNA, 25 bp, E. coli
tgatgccggttacccaaagctatgc

SEQ ID NO: 191636 - DNA, 25 bp, E. coli
tgatgccggttagccaaagctatgc

SEQ ID NO: 191637 - DNA, 25 bp, E. coli
gcctggtatataagacgcgcgccgt

SEQ ID NO: 191638 - DNA, 25 bp, E. coli
ccagaagatgtcagcgaagccgtct

SEQ ID NO: 191639 - DNA, 25 bp, E. coli
ccagaagatgtctgcgaagccgtct

SEQ ID NO: 191640 - DNA, 25 bp, E. coli
gcctggtatatatgacgcgcgccgt

SEQ ID NO: 191641 - DNA, 25 bp, E. coli
gattgataccaacaacaaaggcctg

SEQ ID NO: 191642 - DNA, 25 bp, E. coli
gattgataccaagaacaaaggcctg

SEQ ID NO: 191643 - DNA, 25 bp, E. coli
gtcaccgacatcgaaccgggtctgg

SEQ ID NO: 191644 - DNA, 25 bp, E. coli
gtcaccgacatccaaccgggtctgg

SEQ ID NO: 191645 - DNA, 25 bp, E. coli
taacgtttacggagcgacgaaagcg

SEQ ID NO: 191646 - DNA, 25 bp, E. coli
tcaataccctggaaatgatgccggt

SEQ ID NO: 191647 - DNA, 25 bp, E. coli
taacgtttacggtgcgacgaaagcg

SEQ ID NO: 191648 - DNA, 25 bp, E. coli
tcaataccctggtaatgatgccggt

SEQ ID NO: 191649 - DNA, 25 bp, E. coli
gaatttggtattcagaacggaccta

SEQ ID NO: 191650 - DNA, 25 bp, E. coli
gaatttggtattgagaacggaccta

SEQ ID NO: 191651 - DNA, 25 bp, E. coli
ttttggtttcatcacgccgaaagat

SEQ ID NO: 191652 - DNA, 25 bp, E. coli
ttttggtttcatgacgccgaaagat

SEQ ID NO: 191653 - DNA, 25 bp, E. coli
tttggtttcatctcgccgaaagatg

SEQ ID NO: 191654 - DNA, 25 bp, E. coli
tttggtttcatcacgccgaaagatg

SEQ ID NO: 191655 - DNA, 25 bp, E. coli
ttggtttcatcacgccgaaagatgg

SEQ ID NO: 191656 - DNA, 25 bp, E. coli
ttggtttcatcaggccgaaagatgg

SEQ ID NO: 191657 - DNA, 25 bp, E. coli
tttggtattgagtacggacctaaag

SEQ ID NO: 191658 - DNA, 25 bp, E. coli
tttggtattgagaacggacctaaag

SEQ ID NO: 191659 - DNA, 25 bp, E. coli
tgaaaaaggtttaggtttcatcacg

SEQ ID NO: 191660 - DNA, 25 bp, E. coli
tgaaaaaggttttggtttcatcacg

SEQ ID NO: 191661 - DNA, 25 bp, E. coli
ttggtattgagaacggacctaaagg

SEQ ID NO: 191662 - DNA, 25 bp, E. coli
ttggtattgagatcggacctaaagg

SEQ ID NO: 191663 - DNA, 25 bp, E. coli
gttttggtttcaacacgccgaaaga

SEQ ID NO: 191664 - DNA, 25 bp, E. coli
gttttggtttcatcacgccgaaaga

SEQ ID NO: 191665 - DNA, 25 bp, E. coli
ggttttggtttcatcacgccgaaag

SEQ ID NO: 191666 - DNA, 25 bp, E. coli
ggttttggtttcttcacgccgaaag

SEQ ID NO: 191667 - DNA, 25 bp, E. coli
cagtgaacgttcgatcctggttggg

SEQ ID NO: 191668 - DNA, 25 bp, E. coli
caccagggattcgttgttgccgagg

SEQ ID NO: 191669 - DNA, 25 bp, E. coli
caccagggattccttgttgccgagg

SEQ ID NO: 191670 - DNA, 25 bp, E. coli
cagtgaacgttccatcctggttggg

SEQ ID NO: 191671 - DNA, 25 bp, E. coli
catggcagtgaaggttccatcctgg

SEQ ID NO: 191672 - DNA, 25 bp, E. coli
catggcagtgaacgttccatcctgg

SEQ ID NO: 191673 - DNA, 25 bp, E. coli
cgcgcaccagtttcggttttaaatg

SEQ ID NO: 191674 - DNA, 25 bp, E. coli
catcggcgcgcagcagtttcggttt

SEQ ID NO: 191675 - DNA, 25 bp, E. coli
cgcgcaccagttacggttttaaatg

SEQ ID NO: 191676 - DNA, 25 bp, E. coli
catcggcgcgcaccagtttcggttt

SEQ ID NO: 191677 - DNA, 25 bp, E. coli
tatacgtcatggcagtgaacgttcc

SEQ ID NO: 191678 - DNA, 25 bp, E. coli
tatacgtcatgggagtgaacgttcc

SEQ ID NO: 191679 - DNA, 25 bp, E. coli
tgttgccgaggtggattttttgcat

SEQ ID NO: 191680 - DNA, 25 bp, E. coli
tgttgccgaggtcgattttttgcat

SEQ ID NO: 191681 - DNA, 25 bp, E. coli
tcggcgcgcacctgtttcggtttta

SEQ ID NO: 191682 - DNA, 25 bp, E. coli
tcggcgcgcaccagtttcggtttta

SEQ ID NO: 191683 - DNA, 25 bp, E. coli
ccagggattcgttgttgccgaggtc

SEQ ID NO: 191684 - DNA, 25 bp, E. coli
ccagggattcgtagttgccgaggtc

SEQ ID NO: 191685 - DNA, 25 bp, E. coli
gtgcttctccaagcatcggcgcgca

SEQ ID NO: 191686 - DNA, 25 bp, E. coli
gtgcttctccaaccatcggcgcgca

SEQ ID NO: 191687 - DNA, 25 bp, E. coli
ggattcgttgttgccgaggtcgatt

SEQ ID NO: 191688 - DNA, 25 bp, E. coli
ggattcgttgttcccgaggtcgatt

SEQ ID NO: 191689 - DNA, 25 bp, E. coli
cagtaacgtgcctaaagtgcgctta

SEQ ID NO: 191690 - DNA, 25 bp, E. coli
cagtaacgtgccaaaagtgcgctta

SEQ ID NO: 191691 - DNA, 25 bp, E. coli
tactttggcttaatcgacccggacg

SEQ ID NO: 191692 - DNA, 25 bp, E. coli
tactttggcttattcgacccggacg

SEQ ID NO: 191693 - DNA, 25 bp, E. coli
taaacgcagcggagatttactggcg

SEQ ID NO: 191694 - DNA, 25 bp, E. coli
tactggcgcgactgggttttgaaaa

SEQ ID NO: 191695 - DNA, 25 bp, E. coli
taaacgcagcggtgatttactggcg

SEQ ID NO: 191696 - DNA, 25 bp, E. coli
tactggcgcgacagggttttgaaaa

SEQ ID NO: 191697 - DNA, 25 bp, E. coli
tatatgccgcacaataaacgcagcg

SEQ ID NO: 191698 - DNA, 25 bp, E. coli
tatatgccgcactataaacgcagcg

SEQ ID NO: 191699 - DNA, 25 bp, E. coli
tgttatccatcacgctggcaggcca

SEQ ID NO: 191700 - DNA, 25 bp, E. coli
tgttatccatcaggctggcaggcca

SEQ ID NO: 191701 - DNA, 25 bp, E. coli
tgacggcattaactaccccagactg

SEQ ID NO: 191702 - DNA, 25 bp, E. coli
tgacggcattaagtaccccagactg

SEQ ID NO: 191703 - DNA, 25 bp, E. coli
tcgattgggcaataatggcagggca

SEQ ID NO: 191704 - DNA, 25 bp, E. coli
tgcgcgacgaaacccactgttatcc

SEQ ID NO: 191705 - DNA, 25 bp, E. coli
tgcgcgacgaaagccactgttatcc

SEQ ID NO: 191706 - DNA, 25 bp, E. coli
tcgattgggcaaaaatggcagggca

SEQ ID NO: 191707 - DNA, 25 bp, E. coli
gaatcgccatttgctcaagccctgg

SEQ ID NO: 191708 - DNA, 25 bp, E. coli
gaatcgccatttcctcaagccctgg

SEQ ID NO: 191709 - DNA, 25 bp, E. coli
ggacaatggcgcgatcacgtactga

SEQ ID NO: 191710 - DNA, 25 bp, E. coli
ggacaatggcgccatcacgtactga

SEQ ID NO: 191711 - DNA, 25 bp, E. coli
caagatagtttcctaatcgccaatg

SEQ ID NO: 191712 - DNA, 25 bp, E. coli
caagatagtttcgtaatcgccaatg

SEQ ID NO: 191713 - DNA, 25 bp, E. coli
tagaagtgacagagatttgcagggt

SEQ ID NO: 191714 - DNA, 25 bp, E. coli
tagaagtgacagtgatttgcagggt

SEQ ID NO: 191715 - DNA, 25 bp, E. coli
agaataatcctcctgctgtcgccga

SEQ ID NO: 191716 - DNA, 25 bp, E. coli
agaataatcctcgtgctgtcgccga

SEQ ID NO: 191717 - DNA, 25 bp, E. coli
tagagctgaaaaacacaggtttcct

SEQ ID NO: 191718 - DNA, 25 bp, E. coli
tagagctgaaaatcacaggtttcct

SEQ ID NO: 191719 - DNA, 25 bp, E. coli
tttaaaaaagcatcagcactctcgc

SEQ ID NO: 191720 - DNA, 25 bp, E. coli
ttagccgggctcatagctgcattcg

SEQ ID NO: 191721 - DNA, 25 bp, E. coli
tttaaaaaagcaacagcactctcgc

SEQ ID NO: 191722 - DNA, 25 bp, E. coli
ttagccgggctcttagctgcattcg

SEQ ID NO: 191723 - DNA, 25 bp, E. coli
tcccctttagaataccggaggcctg

SEQ ID NO: 191724 - DNA, 25 bp, E. coli
tcccctttagaaaaccggaggcctg

SEQ ID NO: 191725 - DNA, 25 bp, E. coli
tcatcatcaacaacccggcgaacat

SEQ ID NO: 191726 - DNA, 25 bp, E. coli
tcaggagtattcttaaaacaaggca

SEQ ID NO: 191727 - DNA, 25 bp, E. coli
tcatcatcaacatcccggcgaacat

SEQ ID NO: 191728 - DNA, 25 bp, E. coli
tcaggagtattcataaaacaaggca

SEQ ID NO: 191729 - DNA, 25 bp, E. coli
gcgaacatgaatttattagccgggc

SEQ ID NO: 191730 - DNA, 25 bp, E. coli
gcgaacatgaatatattagccgggc

SEQ ID NO: 191731 - DNA, 25 bp, E. coli
gtcgccgactatgcttaacgtttaa

SEQ ID NO: 191732 - DNA, 25 bp, E. coli
gtcgccgactatccttaacgtttaa

SEQ ID NO: 191733 - DNA, 25 bp, E. coli
caattagatgattctcaagggccgg

SEQ ID NO: 191734 - DNA, 25 bp, E. coli
caattagatgatactcaagggccgg

SEQ ID NO: 191735 - DNA, 25 bp, E. coli
caaatcagtgcccagctggtgcaga

SEQ ID NO: 191736 - DNA, 25 bp, E. coli
caaatcagtgccgagctggtgcaga

SEQ ID NO: 191737 - DNA, 25 bp, E. coli
cacacgtcgcggacattagcatgga

SEQ ID NO: 191738 - DNA, 25 bp, E. coli
cacacgtcgcggtcattagcatgga

SEQ ID NO: 191739 - DNA, 25 bp, E. coli
catcattatgggttgagctgcgaca

SEQ ID NO: 191740 - DNA, 25 bp, E. coli
catcattatgggatgagctgcgaca

SEQ ID NO: 191741 - DNA, 25 bp, E. coli
catgaagatgctttcagtctggcga

SEQ ID NO: 191742 - DNA, 25 bp, E. coli
catgaagatgctatcagtctggcga

SEQ ID NO: 191743 - DNA, 25 bp, E. coli
taaaggcgttctcgttgccctacgt

SEQ ID NO: 191744 - DNA, 25 bp, E. coli
taaaggcgttctggttgccctacgt

SEQ ID NO: 191745 - DNA, 25 bp, E. coli
tggtttaacgtccatcgccatgaag

SEQ ID NO: 191746 - DNA, 25 bp, E. coli
tcatcaatgccgtgcacgatggtcg

SEQ ID NO: 191747 - DNA, 25 bp, E. coli
tcatcaatgccgagcacgatggtcg

SEQ ID NO: 191748 - DNA, 25 bp, E. coli
gaagtttagtcgctatgtgccggaa

SEQ ID NO: 191749 - DNA, 25 bp, E. coli
gaagtttagtcggtatgtgccggaa

SEQ ID NO: 191750 - DNA, 25 bp, E. coli
cgatgatcgaaagcgtgcaagggca

SEQ ID NO: 191751 - DNA, 25 bp, E. coli
cgatgatcgaaaccgtgcaagggca

SEQ ID NO: 191752 - DNA, 25 bp, E. coli
tggtttaacgtcgatcgccatgaag

SEQ ID NO: 191753 - DNA, 25 bp, E. coli
taacgaagtcctcttcaatgaagcc

SEQ ID NO: 191754 - DNA, 25 bp, E. coli
taacgaagtcctgttcaatgaagcc

SEQ ID NO: 191755 - DNA, 25 bp, E. coli
aatttccaacgaccggtagcacaag

SEQ ID NO: 191756 - DNA, 25 bp, E. coli
caagtccagccgtcccttttcagat

SEQ ID NO: 191757 - DNA, 25 bp, E. coli
aatttccaacgagcggtagcacaag

SEQ ID NO: 191758 - DNA, 25 bp, E. coli
caagtccagccgacccttttcagat

SEQ ID NO: 191759 - DNA, 25 bp, E. coli
aaacagtgccagacaatttccaacg

SEQ ID NO: 191760 - DNA, 25 bp, E. coli
aaacagtgccagtcaatttccaacg

SEQ ID NO: 191761 - DNA, 25 bp, E. coli
ttattaaaattagcgggcgcgtcct

SEQ ID NO: 191762 - DNA, 25 bp, E. coli
ttattaaaattaccgggcgcgtcct

SEQ ID NO: 191763 - DNA, 25 bp, E. coli
tcatgccgggatccagtggatccca

SEQ ID NO: 191764 - DNA, 25 bp, E. coli
tcgggttgcatttaacggtattgag

SEQ ID NO: 191765 - DNA, 25 bp, E. coli
tcatgccgggatgcagtggatccca

SEQ ID NO: 191766 - DNA, 25 bp, E. coli
tcgggttgcattaaacggtattgag

SEQ ID NO: 191767 - DNA, 25 bp, E. coli
gcgcgtcctcgaatatggctgcaca

SEQ ID NO: 191768 - DNA, 25 bp, E. coli
gcgcgtcctcgattatggctgcaca

SEQ ID NO: 191769 - DNA, 25 bp, E. coli
gaagtcaactcacaagtccgtcaat

SEQ ID NO: 191770 - DNA, 25 bp, E. coli
gaagtcaactcagaagtccgtcaat

SEQ ID NO: 191771 - DNA, 25 bp, E. coli
gaacaatattttcccttactccgct

SEQ ID NO: 191772 - DNA, 25 bp, E. coli
gaacaatattttgccttactccgct

SEQ ID NO: 191773 - DNA, 25 bp, E. coli
cgcttaattttaccgtagatctcca

SEQ ID NO: 191774 - DNA, 25 bp, E. coli
cgcttaattttagcgtagatctcca

SEQ ID NO: 191775 - DNA, 25 bp, E. coli
tggctgcacagtctcatcggattcg

SEQ ID NO: 191776 - DNA, 25 bp, E. coli
tggctgcacagtgtcatcggattcg

SEQ ID NO: 191777 - DNA, 25 bp, E. coli
aactgcgggctaacatttcgaagca

SEQ ID NO: 191778 - DNA, 25 bp, E. coli
cactggccaactgcgggctatcatt

SEQ ID NO: 191779 - DNA, 25 bp, E. coli
cactggccaactccgggctatcatt

SEQ ID NO: 191780 - DNA, 25 bp, E. coli
atcaaaaggtctcgcagatgacgac

SEQ ID NO: 191781 - DNA, 25 bp, E. coli
atcaaaaggtctggcagatgacgac

SEQ ID NO: 191782 - DNA, 25 bp, E. coli
aactgcgggctatcatttcgaagca

SEQ ID NO: 191783 - DNA, 25 bp, E. coli
tacgccgaatatatctgcgacgcat

SEQ ID NO: 191784 - DNA, 25 bp, E. coli
tacgccgaatatttctgcgacgcat

SEQ ID NO: 191785 - DNA, 25 bp, E. coli
tatcatttcgaaccatcaaaaggtc

SEQ ID NO: 191786 - DNA, 25 bp, E. coli
tatcatttcgaagcatcaaaaggtc

SEQ ID NO: 191787 - DNA, 25 bp, E. coli
gccgaatatttctgcgacgcattgg

SEQ ID NO: 191788 - DNA, 25 bp, E. coli
ccaactgcgggcaatcatttcgaag

SEQ ID NO: 191789 - DNA, 25 bp, E. coli
gccgaatatttcagcgacgcattgg

SEQ ID NO: 191790 - DNA, 25 bp, E. coli
ccaactgcgggctatcatttcgaag

SEQ ID NO: 191791 - DNA, 25 bp, E. coli
gcgggctatcatatcgaagcatcaa

SEQ ID NO: 191792 - DNA, 25 bp, E. coli
gcatcaaaaggtctggcagatgacg

SEQ ID NO: 191793 - DNA, 25 bp, E. coli
gcatcaaaaggtgtggcagatgacg

SEQ ID NO: 191794 - DNA, 25 bp, E. coli
gcgggctatcatttcgaagcatcaa

SEQ ID NO: 191795 - DNA, 25 bp, E. coli
ccgaatatttctgcgacgcattggg

SEQ ID NO: 191796 - DNA, 25 bp, E. coli
ccgaatatttctccgacgcattggg

SEQ ID NO: 191797 - DNA, 25 bp, E. coli
gattacgccgaaaatttctgcgacg

SEQ ID NO: 191798 - DNA, 25 bp, E. coli
gattacgccgaatatttctgcgacg

SEQ ID NO: 191799 - DNA, 25 bp, E. coli
atcgtgttgctgcggtcgtcgcaga

SEQ ID NO: 191800 - DNA, 25 bp, E. coli
atcgtgttgctggggtcgtcgcaga

SEQ ID NO: 191801 - DNA, 25 bp, E. coli
atccaatggtcgtcaccgaaaccgc

SEQ ID NO: 191802 - DNA, 25 bp, E. coli
atccaatggtcgacaccgaaaccgc

SEQ ID NO: 191803 - DNA, 25 bp, E. coli
tgttgctgcggtcgtcgcagaaagt

SEQ ID NO: 191804 - DNA, 25 bp, E. coli
tgttgctgcggtggtcgcagaaagt

SEQ ID NO: 191805 - DNA, 25 bp, E. coli
tcgtgttgctgccgtcgtcgcagaa

SEQ ID NO: 191806 - DNA, 25 bp, E. coli
tcgtgttgctgcggtcgtcgcagaa

SEQ ID NO: 191807 - DNA, 25 bp, E. coli
cgatcgtgttgcagcggtcgtcgca

SEQ ID NO: 191808 - DNA, 25 bp, E. coli
cgatcgtgttgctgcggtcgtcgca

SEQ ID NO: 191809 - DNA, 25 bp, E. coli
cgtgttgctgcgctcgtcgcagaaa

SEQ ID NO: 191810 - DNA, 25 bp, E. coli
cgtgttgctgcggtcgtcgcagaaa

SEQ ID NO: 191811 - DNA, 25 bp, E. coli
gatcgtgttgctccggtcgtcgcag

SEQ ID NO: 191812 - DNA, 25 bp, E. coli
gatcgtgttgctgcggtcgtcgcag

SEQ ID NO: 191813 - DNA, 25 bp, E. coli
gtcaccgaaaccgcaaaatggtgac

SEQ ID NO: 191814 - DNA, 25 bp, E. coli
gtcaccgaaaccccaaaatggtgac

SEQ ID NO: 191815 - DNA, 25 bp, E. coli
gtgttgctgcggtcgtcgcagaaag

SEQ ID NO: 191816 - DNA, 25 bp, E. coli
gtgttgctgcggacgtcgcagaaag

SEQ ID NO: 191817 - DNA, 25 bp, E. coli
gatccaatggtcctcaccgaaaccg

SEQ ID NO: 191818 - DNA, 25 bp, E. coli
gatccaatggtcgtcaccgaaaccg

SEQ ID NO: 191819 - DNA, 25 bp, E. coli
catttttctattgctccaagcccgg

SEQ ID NO: 191820 - DNA, 25 bp, E. coli
catttttctattcctccaagcccgg

SEQ ID NO: 191821 - DNA, 25 bp, E. coli
aaccgattacgtgcttaagcttctg

SEQ ID NO: 191822 - DNA, 25 bp, E. coli
aaccgattacgtccttaagcttctg

SEQ ID NO: 191823 - DNA, 25 bp, E. coli
aactcgctggttttgcacttttgaa

SEQ ID NO: 191824 - DNA, 25 bp, E. coli
aactcgctggttatgcacttttgaa

SEQ ID NO: 191825 - DNA, 25 bp, E. coli
tacctctctctgattcaaaacaggg

SEQ ID NO: 191826 - DNA, 25 bp, E. coli
tacctctctctgtttcaaaacaggg

SEQ ID NO: 191827 - DNA, 25 bp, E. coli
ttctagctaataagtgtgaccgccg

SEQ ID NO: 191828 - DNA, 25 bp, E. coli
ttctagctaatatgtgtgaccgccg

SEQ ID NO: 191829 - DNA, 25 bp, E. coli
tgatggtagtcacataaagtcacct

SEQ ID NO: 191830 - DNA, 25 bp, E. coli
tgtgaccgccgtcatattacagagc

SEQ ID NO: 191831 - DNA, 25 bp, E. coli
tgtgaccgccgtgatattacagagc

SEQ ID NO: 191832 - DNA, 25 bp, E. coli
tgatggtagtcagataaagtcacct

SEQ ID NO: 191833 - DNA, 25 bp, E. coli
ccatgagttcatttcagacaggcaa

SEQ ID NO: 191834 - DNA, 25 bp, E. coli
ccatgagttcatatcagacaggcaa

SEQ ID NO: 191835 - DNA, 25 bp, E. coli
tccaagcccggaatgaccgttttcg

SEQ ID NO: 191836 - DNA, 25 bp, E. coli
tccaagcccggattgaccgttttcg

SEQ ID NO: 191837 - DNA, 25 bp, E. coli
taagcttctgaagctaagaggatgc

SEQ ID NO: 191838 - DNA, 25 bp, E. coli
tcactgatatgaagcccgaactcgc

SEQ ID NO: 191839 - DNA, 25 bp, E. coli
taagcttctgaacctaagaggatgc

SEQ ID NO: 191840 - DNA, 25 bp, E. coli
tcactgatatgatgcccgaactcgc

SEQ ID NO: 191841 - DNA, 25 bp, E. coli
catggattgataagccaccactcac

SEQ ID NO: 191842 - DNA, 25 bp, E. coli
catatacagagtaagtggctaaagc

SEQ ID NO: 191843 - DNA, 25 bp, E. coli
catggattgatatgccaccactcac

SEQ ID NO: 191844 - DNA, 25 bp, E. coli
catatacagagttagtggctaaagc

SEQ ID NO: 191845 - DNA, 25 bp, E. coli
tgtgaattcatgtaacaacctccgg

SEQ ID NO: 191846 - DNA, 25 bp, E. coli
tgatacagcctttccgactaagcca

SEQ ID NO: 191847 - DNA, 25 bp, E. coli
tgatacagccttaccgactaagcca

SEQ ID NO: 191848 - DNA, 25 bp, E. coli
tgtgaattcatgaaacaacctccgg

SEQ ID NO: 191849 - DNA, 25 bp, E. coli
tgaagcattagacgccattgatcca

SEQ ID NO: 191850 - DNA, 25 bp, E. coli
tgaagcattagaggccattgatcca

SEQ ID NO: 191851 - DNA, 25 bp, E. coli
gcaaaaactgaaaaacaagcacgta

SEQ ID NO: 191852 - DNA, 25 bp, E. coli
gaaatagaatgtggcctaaggaagg

SEQ ID NO: 191853 - DNA, 25 bp, E. coli
gcaaaaactgaataacaagcacgta

SEQ ID NO: 191854 - DNA, 25 bp, E. coli
gaaatagaatgtcgcctaaggaagg

SEQ ID NO: 191855 - DNA, 25 bp, E. coli
gaaagcattgcttgggagactgaat

SEQ ID NO: 191856 - DNA, 25 bp, E. coli
gaaagcattgctagggagactgaat

SEQ ID NO: 191857 - DNA, 25 bp, E. coli
cattgatccatctaaagcctctgat

SEQ ID NO: 191858 - DNA, 25 bp, E. coli
cattgatccatcaaaagcctctgat

SEQ ID NO: 191859 - DNA, 25 bp, E. coli
ggagactgaatgatactgaactgaa

SEQ ID NO: 191860 - DNA, 25 bp, E. coli
ggagactgaatgttactgaactgaa

SEQ ID NO: 191861 - DNA, 25 bp, E. coli
gatgataatggtatgcctgcatgga

SEQ ID NO: 191862 - DNA, 25 bp, E. coli
gatgataatggtttgcctgcatgga

SEQ ID NO: 191863 - DNA, 25 bp, E. coli
aatatgcaaaggtaatcgggatacc

SEQ ID NO: 191864 - DNA, 25 bp, E. coli
aatatgcaaaggaaatcgggatacc

SEQ ID NO: 191865 - DNA, 25 bp, E. coli
cataacgctaaaccggatatttggg

SEQ ID NO: 191866 - DNA, 25 bp, E. coli
cataacgctaaagcggatatttggg

SEQ ID NO: 191867 - DNA, 25 bp, E. coli
aaattaagtctatacgcagagagcg

SEQ ID NO: 191868 - DNA, 25 bp, E. coli
aaattaagtctaaacgcagagagcg

SEQ ID NO: 191869 - DNA, 25 bp, E. coli
tgtggagaatgctggacaacctgtt

SEQ ID NO: 191870 - DNA, 25 bp, E. coli
tgtggagaatgcaggacaacctgtt

SEQ ID NO: 191871 - DNA, 25 bp, E. coli
gccaacacaaaagaaactgcaggat

SEQ ID NO: 191872 - DNA, 25 bp, E. coli
gccaacacaaaacaaactgcaggat

SEQ ID NO: 191873 - DNA, 25 bp, E. coli
gcagagagcgccttcaggaaattct

SEQ ID NO: 191874 - DNA, 25 bp, E. coli
gcagagagcgccatcaggaaattct

SEQ ID NO: 191875 - DNA, 25 bp, E. coli
gaaatattacgtcttctgctgtggc

SEQ ID NO: 191876 - DNA, 25 bp, E. coli
gaaaaatttatggtacccatcgtcg

SEQ ID NO: 191877 - DNA, 25 bp, E. coli
gaaatattacgtgttctgctgtggc

SEQ ID NO: 191878 - DNA, 25 bp, E. coli
gaaaaatttatgctacccatcgtcg

SEQ ID NO: 191879 - DNA, 25 bp, E. coli
ctgcaggatgcttctaaaaaagggc

SEQ ID NO: 191880 - DNA, 25 bp, E. coli
ctgcaggatgctactaaaaaagggc

SEQ ID NO: 191881 - DNA, 25 bp, E. coli
gggtgaagacacaaaaagcgagaat

SEQ ID NO: 191882 - DNA, 25 bp, E. coli
gggtgaagacactaaaagcgagaat

SEQ ID NO: 191883 - DNA, 25 bp, E. coli
taatagccgtttcatgattgccaac

SEQ ID NO: 191884 - DNA, 25 bp, E. coli
taatagccgtttgatgattgccaac

SEQ ID NO: 191885 - DNA, 25 bp, E. coli
cacagttaacctatggtggtgcaca

SEQ ID NO: 191886 - DNA, 25 bp, E. coli
cacagttaacctttggtggtgcaca

SEQ ID NO: 191887 - DNA, 25 bp, E. coli
cataaacgggaatcgctggcgagga

SEQ ID NO: 191888 - DNA, 25 bp, E. coli
cataaacgggaaacgctggcgagga

SEQ ID NO: 191889 - DNA, 25 bp, E. coli
catatgcttgcctgtcgtcgtcgcg

SEQ ID NO: 191890 - DNA, 25 bp, E. coli
catatgcttgccagtcgtcgtcgcg

SEQ ID NO: 191891 - DNA, 25 bp, E. coli
tacggattttatcaccgcgcgtggt

SEQ ID NO: 191892 - DNA, 25 bp, E. coli
tacggattttatgaccgcgcgtggt

SEQ ID NO: 191893 - DNA, 25 bp, E. coli
aacaggccggaattgtcggtcgtgc

SEQ ID NO: 191894 - DNA, 25 bp, E. coli
aacaggccggaaatgtcggtcgtgc

SEQ ID NO: 191895 - DNA, 25 bp, E. coli
tagcgatggttcaggcaagtcaacg

SEQ ID NO: 191896 - DNA, 25 bp, E. coli
tagcgatggttctggcaagtcaacg

SEQ ID NO: 191897 - DNA, 25 bp, E. coli
tcgtgcagtgactaaattaccgttg

SEQ ID NO: 191898 - DNA, 25 bp, E. coli
tcgtgcagtgacaaaattaccgttg

SEQ ID NO: 191899 - DNA, 25 bp, E. coli
cgttgtcgaaaaatatggtgctgcc

SEQ ID NO: 191900 - DNA, 25 bp, E. coli
cgttgtcgaaaattatggtgctgcc

SEQ ID NO: 191901 - DNA, 25 bp, E. coli
tggtcgttttgtgtcatggctggca

SEQ ID NO: 191902 - DNA, 25 bp, E. coli
tggtcgttttgtctcatggctggca

SEQ ID NO: 191903 - DNA, 25 bp, E. coli
taattacagcgtatgtcgcccgtcg

SEQ ID NO: 191904 - DNA, 25 bp, E. coli
taattacagcgtttgtcgcccgtcg

SEQ ID NO: 191905 - DNA, 25 bp, E. coli
gaggaagattgcgataacgccacag

SEQ ID NO: 191906 - DNA, 25 bp, E. coli
gaggaagattgccataacgccacag

SEQ ID NO: 191907 - DNA, 25 bp, E. coli
taaaggcgcgaagaaaccagtcgcg

SEQ ID NO: 191908 - DNA, 25 bp, E. coli
taaaggcgcgaacaaaccagtcgcg

SEQ ID NO: 191909 - DNA, 25 bp, E. coli
aaaggcgcgaagaaaccagtcgcgg

SEQ ID NO: 191910 - DNA, 25 bp, E. coli
acagcggtcggctgtttaaaggcgc

SEQ ID NO: 191911 - DNA, 25 bp, E. coli
aaaggcgcgaagtaaccagtcgcgg

SEQ ID NO: 191912 - DNA, 25 bp, E. coli
acagcggtcggcagtttaaaggcgc

SEQ ID NO: 191913 - DNA, 25 bp, E. coli
tttaaaggcgcgtagaaaccagtcg

SEQ ID NO: 191914 - DNA, 25 bp, E. coli
ttaaaggcgcgatgaaaccagtcgc

SEQ ID NO: 191915 - DNA, 25 bp, E. coli
tttaaaggcgcgaagaaaccagtcg

SEQ ID NO: 191916 - DNA, 25 bp, E. coli
ttaaaggcgcgaagaaaccagtcgc

SEQ ID NO: 191917 - DNA, 25 bp, E. coli
tcgccggtgaaaacacgtccggcag

SEQ ID NO: 191918 - DNA, 25 bp, E. coli
tcgccggtgaaatcacgtccggcag

SEQ ID NO: 191919 - DNA, 25 bp, E. coli
tcggctgtttaaaggcgcgaagaaa

SEQ ID NO: 191920 - DNA, 25 bp, E. coli
tcggctgtttaatggcgcgaagaaa

SEQ ID NO: 191921 - DNA, 25 bp, E. coli
gcgaagaaaccactcgcgggtcgcc

SEQ ID NO: 191922 - DNA, 25 bp, E. coli
gcgaagaaaccagtcgcgggtcgcc

SEQ ID NO: 191923 - DNA, 25 bp, E. coli
cgaagaaaccagtcgcgggtcgccg

SEQ ID NO: 191924 - DNA, 25 bp, E. coli
cgaagaaaccagacgcgggtcgccg

SEQ ID NO: 191925 - DNA, 25 bp, E. coli
gtcggctgtttataggcgcgaagaa

SEQ ID NO: 191926 - DNA, 25 bp, E. coli
gtcggctgtttaaaggcgcgaagaa

SEQ ID NO: 191927 - DNA, 25 bp, E. coli
gtcgccggtgaaaacacgtccggca

SEQ ID NO: 191928 - DNA, 25 bp, E. coli
gtcgccggtgaatacacgtccggca

SEQ ID NO: 191929 - DNA, 25 bp, E. coli
cagcagataaaattcataaagttca

SEQ ID NO: 191930 - DNA, 25 bp, E. coli
catgatatggattatgatgatctac

SEQ ID NO: 191931 - DNA, 25 bp, E. coli
catgatatggataatgatgatctac

SEQ ID NO: 191932 - DNA, 25 bp, E. coli
cagcagataaaaatcataaagttca

SEQ ID NO: 191933 - DNA, 25 bp, E. coli
tattgagattataattaaccaccta

SEQ ID NO: 191934 - DNA, 25 bp, E. coli
tattgagattattattaaccaccta

SEQ ID NO: 191935 - DNA, 25 bp, E. coli
tgcggcagggtcataaaagtaagaa

SEQ ID NO: 191936 - DNA, 25 bp, E. coli
tgccatgcggcacggtcataaaagt

SEQ ID NO: 191937 - DNA, 25 bp, E. coli
tgcggcagggtcttaaaagtaagaa

SEQ ID NO: 191938 - DNA, 25 bp, E. coli
tgccatgcggcagggtcataaaagt

SEQ ID NO: 191939 - DNA, 25 bp, E. coli
gcagggtcataaaagtaagaagaat

SEQ ID NO: 191940 - DNA, 25 bp, E. coli
gcagggtcataatagtaagaagaat

SEQ ID NO: 191941 - DNA, 25 bp, E. coli
gtataaaaaaccgtgccatgcggca

SEQ ID NO: 191942 - DNA, 25 bp, E. coli
gtataaaaaaccctgccatgcggca

SEQ ID NO: 191943 - DNA, 25 bp, E. coli
ggattatttcattaccatgatatgg

SEQ ID NO: 191944 - DNA, 25 bp, E. coli
ggattatttcataaccatgatatgg

SEQ ID NO: 191945 - DNA, 25 bp, E. coli
taaccacctaatattacagcagata

SEQ ID NO: 191946 - DNA, 25 bp, E. coli
taaccacctaattttacagcagata

SEQ ID NO: 191947 - DNA, 25 bp, E. coli
gatggatattccaattttcaaatta

SEQ ID NO: 191948 - DNA, 25 bp, E. coli
gatgatctacaggtataaaaaaccc

SEQ ID NO: 191949 - DNA, 25 bp, E. coli
gatgatctacagctataaaaaaccc

SEQ ID NO: 191950 - DNA, 25 bp, E. coli
gatggatattcctattttcaaatta

SEQ ID NO: 191951 - DNA, 25 bp, E. coli
caacgcatgagattgccagcctggt

SEQ ID NO: 191952 - DNA, 25 bp, E. coli
caccgggcagtccttgatagtggat

SEQ ID NO: 191953 - DNA, 25 bp, E. coli
caaattacaccagcgggcagtcgtt

SEQ ID NO: 191954 - DNA, 25 bp, E. coli
caccgggcagtcgttgatagtggat

SEQ ID NO: 191955 - DNA, 25 bp, E. coli
caacgcatgagaatgccagcctggt

SEQ ID NO: 191956 - DNA, 25 bp, E. coli
caaattacaccaccgggcagtcgtt

SEQ ID NO: 191957 - DNA, 25 bp, E. coli
acgcatgagattgccagcctggtgg

SEQ ID NO: 191958 - DNA, 25 bp, E. coli
agcgcctacacagccgctaaacatg

SEQ ID NO: 191959 - DNA, 25 bp, E. coli
agcgcctacacacccgctaaacatg

SEQ ID NO: 191960 - DNA, 25 bp, E. coli
atggcggctttatgttggcgaatcc

SEQ ID NO: 191961 - DNA, 25 bp, E. coli
atggcggctttaagttggcgaatcc

SEQ ID NO: 191962 - DNA, 25 bp, E. coli
acgcatgagattcccagcctggtgg

SEQ ID NO: 191963 - DNA, 25 bp, E. coli
aacatacgccgctgccggatgccag

SEQ ID NO: 191964 - DNA, 25 bp, E. coli
aacatacgccgcagccggatgccag

SEQ ID NO: 191965 - DNA, 25 bp, E. coli
ttcggagggcgcaaattacaccacc

SEQ ID NO: 191966 - DNA, 25 bp, E. coli
ttcggagggcgctaattacaccacc

SEQ ID NO: 191967 - DNA, 25 bp, E. coli
tcgttgatagtgcatggcggcttta

SEQ ID NO: 191968 - DNA, 25 bp, E. coli
tcgttgatagtggatggcggcttta

SEQ ID NO: 191969 - DNA, 25 bp, E. coli
tcggtacatgaagatacgccgctgc

SEQ ID NO: 191970 - DNA, 25 bp, E. coli
tcggtacatgaacatacgccgctgc

SEQ ID NO: 191971 - DNA, 25 bp, E. coli
tggctttgttcggagggcgcaaatt

SEQ ID NO: 191972 - DNA, 25 bp, E. coli
tggctttgttcgcagggcgcaaatt

SEQ ID NO: 191973 - DNA, 25 bp, E. coli
caagagtgattgttacatggcgaaa

SEQ ID NO: 191974 - DNA, 25 bp, E. coli
caagagtgattgatacatggcgaaa

SEQ ID NO: 191975 - DNA, 25 bp, E. coli
caggtggaatatattgagactatcg

SEQ ID NO: 191976 - DNA, 25 bp, E. coli
caggtggaatattttgagactatcg

SEQ ID NO: 191977 - DNA, 25 bp, E. coli
tatacacagcatcaactttccccat

SEQ ID NO: 191978 - DNA, 25 bp, E. coli
tatacacagcatgaactttccccat

SEQ ID NO: 191979 - DNA, 25 bp, E. coli
ttttgaaaagaatgggaccgagtct

SEQ ID NO: 191980 - DNA, 25 bp, E. coli
tttttcctttatacgccagagagtt

SEQ ID NO: 191981 - DNA, 25 bp, E. coli
tttttcctttattcgccagagagtt

SEQ ID NO: 191982 - DNA, 25 bp, E. coli
ttttgaaaagaaagggaccgagtct

SEQ ID NO: 191983 - DNA, 25 bp, E. coli
gccagagagtttgcgaaatttgcca

SEQ ID NO: 191984 - DNA, 25 bp, E. coli
gccaaacatatctaacgtagccgag

SEQ ID NO: 191985 - DNA, 25 bp, E. coli
gccagagagtttccgaaatttgcca

SEQ ID NO: 191986 - DNA, 25 bp, E. coli
gccaaacatatcaaacgtagccgag

SEQ ID NO: 191987 - DNA, 25 bp, E. coli
gcaccgtgattctctgcaggtggaa

SEQ ID NO: 191988 - DNA, 25 bp, E. coli
gcaccgtgattcactgcaggtggaa

SEQ ID NO: 191989 - DNA, 25 bp, E. coli
cgttattgcgtctttgagcaccgtg

SEQ ID NO: 191990 - DNA, 25 bp, E. coli
cgttattgcgtcattgagcaccgtg

SEQ ID NO: 191991 - DNA, 25 bp, E. coli
tgggaccgagtcaacaaaacgattg

SEQ ID NO: 191992 - DNA, 25 bp, E. coli
tgggaccgagtctacaaaacgattg

SEQ ID NO: 191993 - DNA, 25 bp, E. coli
tcaaaggaacatcactatacacagc

SEQ ID NO: 191994 - DNA, 25 bp, E. coli
tcaaaggaacatgactatacacagc

SEQ ID NO: 191995 - DNA, 25 bp, E. coli
caactcagagtattgccaaagcagc

SEQ ID NO: 191996 - DNA, 25 bp, E. coli
caaagtcagataaagcaattgccgg

SEQ ID NO: 191997 - DNA, 25 bp, E. coli
caactcagagtaatgccaaagcagc

SEQ ID NO: 191998 - DNA, 25 bp, E. coli
caaagtcagatatagcaattgccgg

SEQ ID NO: 191999 - DNA, 25 bp, E. coli
tactataagaaaggcgcttcaaggg

SEQ ID NO: 192000 - DNA, 25 bp, E. coli
tactataagaaacgcgcttcaaggg

SEQ ID NO: 192001 - DNA, 25 bp, E. coli
tatcttgtaagaacacttggtcctg

SEQ ID NO: 192002 - DNA, 25 bp, E. coli
tatcttgtaagatcacttggtcctg

SEQ ID NO: 192003 - DNA, 25 bp, E. coli
tatagggccgggttatgataatgca

SEQ ID NO: 192004 - DNA, 25 bp, E. coli
tatctggctgtcgttcaaggtagca

SEQ ID NO: 192005 - DNA, 25 bp, E. coli
tatctggctgtccttcaaggtagca

SEQ ID NO: 192006 - DNA, 25 bp, E. coli
tatagggccgggatatgataatgca

SEQ ID NO: 192007 - DNA, 25 bp, E. coli
tatatctggaccaacgtccgtaggg

SEQ ID NO: 192008 - DNA, 25 bp, E. coli
tatatctggacctacgtccgtaggg

SEQ ID NO: 192009 - DNA, 25 bp, E. coli
gcactagctatcgttgttcatgaag

SEQ ID NO: 192010 - DNA, 25 bp, E. coli
gcactagctatccttgttcatgaag

SEQ ID NO: 192011 - DNA, 25 bp, E. coli
cggtttttgccaagcgactatgcta

SEQ ID NO: 192012 - DNA, 25 bp, E. coli
cggtttttgccatgcgactatgcta

SEQ ID NO: 192013 - DNA, 25 bp, E. coli
gttcctgaatattacaagcatgccg

SEQ ID NO: 192014 - DNA, 25 bp, E. coli
gttcctgaatataacaagcatgccg

SEQ ID NO: 192015 - DNA, 25 bp, E. coli
taatgtgcgtcgttctttagcagac

SEQ ID NO: 192016 - DNA, 25 bp, E. coli
taatgtgcgtcgatctttagcagac

SEQ ID NO: 192017 - DNA, 25 bp, E. coli
cagacatctacttgaagcagcaggg

SEQ ID NO: 192018 - DNA, 25 bp, E. coli
catgagtgctatctccgaataggga

SEQ ID NO: 192019 - DNA, 25 bp, E. coli
cagacatctactagaagcagcaggg

SEQ ID NO: 192020 - DNA, 25 bp, E. coli
catgagtgctatgtccgaataggga

SEQ ID NO: 192021 - DNA, 25 bp, E. coli
taaacacaaggaaggtgtcccctgc

SEQ ID NO: 192022 - DNA, 25 bp, E. coli
taaaaccacgagttcctggtgtgcc

SEQ ID NO: 192023 - DNA, 25 bp, E. coli
taaaaccacgagatcctggtgtgcc

SEQ ID NO: 192024 - DNA, 25 bp, E. coli
aaaatacgctctatgacggcgatgg

SEQ ID NO: 192025 - DNA, 25 bp, E. coli
aaaatacgctctttgacggcgatgg

SEQ ID NO: 192026 - DNA, 25 bp, E. coli
tagggaatcgaacctgcaaatcagg

SEQ ID NO: 192027 - DNA, 25 bp, E. coli
tagggaatcgaagctgcaaatcagg

SEQ ID NO: 192028 - DNA, 25 bp, E. coli
ccattggcgcggcttaagagcttat

SEQ ID NO: 192029 - DNA, 25 bp, E. coli
ccattggcgcgggttaagagcttat

SEQ ID NO: 192030 - DNA, 25 bp, E. coli
gatataaccatcttgctcgcccgtg

SEQ ID NO: 192031 - DNA, 25 bp, E. coli
gatataaccatcatgctcgcccgtg

SEQ ID NO: 192032 - DNA, 25 bp, E. coli
gataactttggcatttggcaggtcg

SEQ ID NO: 192033 - DNA, 25 bp, E. coli
gataactttggcttttggcaggtcg

SEQ ID NO: 192034 - DNA, 25 bp, E. coli
ggcaggtcgcctgacttaatccggt

SEQ ID NO: 192035 - DNA, 25 bp, E. coli
ggcaggtcgcctcacttaatccggt

SEQ ID NO: 192036 - DNA, 25 bp, E. coli
taaacacaaggatggtgtcccctgc

SEQ ID NO: 192037 - DNA, 25 bp, E. coli
taagaaactgacaggcctcatcgag

SEQ ID NO: 192038 - DNA, 25 bp, E. coli
taagaaactgactggcctcatcgag

SEQ ID NO: 192039 - DNA, 25 bp, E. coli
taaatcgctgaatgagcgcggagcc

SEQ ID NO: 192040 - DNA, 25 bp, E. coli
taaatcgctgaaagagcgcggagcc

SEQ ID NO: 192041 - DNA, 25 bp, E. coli
acttttatgaagtacgccctgcgcg

SEQ ID NO: 192042 - DNA, 25 bp, E. coli
acttttatgaagaacgccctgcgcg

SEQ ID NO: 192043 - DNA, 25 bp, E. coli
tatggcgcgacatcaataaagacgg

SEQ ID NO: 192044 - DNA, 25 bp, E. coli
tatggcgcgacaacaataaagacgg

SEQ ID NO: 192045 - DNA, 25 bp, E. coli
tatcgctggaaagcaaaagccgcgc

SEQ ID NO: 192046 - DNA, 25 bp, E. coli
tatcgctggaaaccaaaagccgcgc

SEQ ID NO: 192047 - DNA, 25 bp, E. coli
tgactttacccgtggacatcgccgt

SEQ ID NO: 192048 - DNA, 25 bp, E. coli
tgactttacccgaggacatcgccgt

SEQ ID NO: 192049 - DNA, 25 bp, E. coli
tgaaaagggcaagcgacagaactct

SEQ ID NO: 192050 - DNA, 25 bp, E. coli
tgaaaagggcaaccgacagaactct

SEQ ID NO: 192051 - DNA, 25 bp, E. coli
tcattaaggacagtcccgaagcggc

SEQ ID NO: 192052 - DNA, 25 bp, E. coli
tcattaaggacactcccgaagcggc

SEQ ID NO: 192053 - DNA, 25 bp, E. coli
gaaatcaccgttgagcaggaccgta

SEQ ID NO: 192054 - DNA, 25 bp, E. coli
gaactctggcgtcgtggaaatcacc

SEQ ID NO: 192055 - DNA, 25 bp, E. coli
gaactctggcgtggtggaaatcacc

SEQ ID NO: 192056 - DNA, 25 bp, E. coli
gaaatcaccgttcagcaggaccgta

SEQ ID NO: 192057 - DNA, 25 bp, E. coli
gtttgaaaacttgacccctgaggcg

SEQ ID NO: 192058 - DNA, 25 bp, E. coli
gtttgaaaacttcacccctgaggcg

SEQ ID NO: 192059 - DNA, 25 bp, E. coli
ggagaaagatccgtacgcggtaacg

SEQ ID NO: 192060 - DNA, 25 bp, E. coli
ggagaaagatccctacgcggtaacg

SEQ ID NO: 192061 - DNA, 25 bp, E. coli
aagcccggccgatatgaccatggaa

SEQ ID NO: 192062 - DNA, 25 bp, E. coli
cagacgcgaaaagagatcgaacaag

SEQ ID NO: 192063 - DNA, 25 bp, E. coli
cagacgcgaaaacagatcgaacaag

SEQ ID NO: 192064 - DNA, 25 bp, E. coli
agggcgttgtcggtattctggcttc

SEQ ID NO: 192065 - DNA, 25 bp, E. coli
agggcgttgtcgctattctggcttc

SEQ ID NO: 192066 - DNA, 25 bp, E. coli
agtggctggacccttcgctattgca

SEQ ID NO: 192067 - DNA, 25 bp, E. coli
agtggctggaccgttcgctattgca

SEQ ID NO: 192068 - DNA, 25 bp, E. coli
aaccgtgatgcacaaaaactcgccg

SEQ ID NO: 192069 - DNA, 25 bp, E. coli
aaccgtgatgcagaaaaactcgccg

SEQ ID NO: 192070 - DNA, 25 bp, E. coli
aagcccggccgaaatgaccatggaa

SEQ ID NO: 192071 - DNA, 25 bp, E. coli
tacgcagtgcgctagaactggaacg

SEQ ID NO: 192072 - DNA, 25 bp, E. coli
tacgcagtgcgcaagaactggaacg

SEQ ID NO: 192073 - DNA, 25 bp, E. coli
tgaccctgtgcgagaaactggagcg

SEQ ID NO: 192074 - DNA, 25 bp, E. coli
tgagcacgctcgctcgttgggcatc

SEQ ID NO: 192075 - DNA, 25 bp, E. coli
tgaccctgtgcgtgaaactggagcg

SEQ ID NO: 192076 - DNA, 25 bp, E. coli
tgagcacgctcggtcgttgggcatc

SEQ ID NO: 192077 - DNA, 25 bp, E. coli
tgcgctggagcgtttagacacactc

SEQ ID NO: 192078 - DNA, 25 bp, E. coli
tgcgctggagcgattagacacactc

SEQ ID NO: 192079 - DNA, 25 bp, E. coli
ccttcgctattggaaggcgaagtgg

SEQ ID NO: 192080 - DNA, 25 bp, E. coli
ccttcgctattgcaaggcgaagtgg

SEQ ID NO: 192081 - DNA, 25 bp, E. coli
gtattctggcttcgcgcatcaaaga

SEQ ID NO: 192082 - DNA, 25 bp, E. coli
gtattctggcttggcgcatcaaaga

SEQ ID NO: 192083 - DNA, 25 bp, E. coli
caagcgccattttgctgtacaaata

SEQ ID NO: 192084 - DNA, 25 bp, E. coli
caagcgccatttagctgtacaaata

SEQ ID NO: 192085 - DNA, 25 bp, E. coli
caaagattgctgcaaattatgcgga

SEQ ID NO: 192086 - DNA, 25 bp, E. coli
caaagattgctggaaattatgcgga

SEQ ID NO: 192087 - DNA, 25 bp, E. coli
tatgacctgttataacttcgcgaag

SEQ ID NO: 192088 - DNA, 25 bp, E. coli
tatgacctgttaaaacttcgcgaag

SEQ ID NO: 192089 - DNA, 25 bp, E. coli
tgtggtagcacacaataatgaaaag

SEQ ID NO: 192090 - DNA, 25 bp, E. coli
tgtggtagcacagaataatgaaaag

SEQ ID NO: 192091 - DNA, 25 bp, E. coli
gaaattccagacacttacctgattg

SEQ ID NO: 192092 - DNA, 25 bp, E. coli
gaaattccagactcttacctgattg

SEQ ID NO: 192093 - DNA, 25 bp, E. coli
cgttatagttttactgtggtagcac

SEQ ID NO: 192094 - DNA, 25 bp, E. coli
cgttatagtttttctgtggtagcac

SEQ ID NO: 192095 - DNA, 25 bp, E. coli
cttcgcgaagtgatagggcagtata

SEQ ID NO: 192096 - DNA, 25 bp, E. coli
cttcgcgaagtgttagggcagtata

SEQ ID NO: 192097 - DNA, 25 bp, E. coli
gggaaatagatgaacaagcgccatt

SEQ ID NO: 192098 - DNA, 25 bp, E. coli
gtgatatttatcatcctgcattggg

SEQ ID NO: 192099 - DNA, 25 bp, E. coli
gtgatatttatcttcctgcattggg

SEQ ID NO: 192100 - DNA, 25 bp, E. coli
gggaaatagatgtacaagcgccatt

SEQ ID NO: 192101 - DNA, 25 bp, E. coli
taaagggtacagagtgaaattccag

SEQ ID NO: 192102 - DNA, 25 bp, E. coli
taaagggtacagtgtgaaattccag

SEQ ID NO: 192103 - DNA, 25 bp, E. coli
gatgattctctattctcccgtgata

SEQ ID NO: 192104 - DNA, 25 bp, E. coli
gatgattctctaatctcccgtgata

SEQ ID NO: 192105 - DNA, 25 bp, E. coli
cactgcagcgtggtttaatgggttt

SEQ ID NO: 192106 - DNA, 25 bp, E. coli
cactgcagcgtgctttaatgggttt

SEQ ID NO: 192107 - DNA, 25 bp, E. coli
taccgctctgctgctcgctaagttg

SEQ ID NO: 192108 - DNA, 25 bp, E. coli
tagttatagagatatcacgggtacg

SEQ ID NO: 192109 - DNA, 25 bp, E. coli
taccgctctgctcctcgctaagttg

SEQ ID NO: 192110 - DNA, 25 bp, E. coli
tagttatagagaaatcacgggtacg

SEQ ID NO: 192111 - DNA, 25 bp, E. coli
taatgggtttctcacgatcgtaccg

SEQ ID NO: 192112 - DNA, 25 bp, E. coli
taatgggtttctgacgatcgtaccg

SEQ ID NO: 192113 - DNA, 25 bp, E. coli
gacccctgaacacaaacggtaatgg

SEQ ID NO: 192114 - DNA, 25 bp, E. coli
gacccctgaacagaaacggtaatgg

SEQ ID NO: 192115 - DNA, 25 bp, E. coli
cgaatgttgaacagatggcgacgtc

SEQ ID NO: 192116 - DNA, 25 bp, E. coli
cgaatgttgaactgatggcgacgtc

SEQ ID NO: 192117 - DNA, 25 bp, E. coli
cgatcggtcagtatcgttgtccgga

SEQ ID NO: 192118 - DNA, 25 bp, E. coli
cgatcggtcagtttcgttgtccgga

SEQ ID NO: 192119 - DNA, 25 bp, E. coli
gttgtccggataaagcgttcacgcc

SEQ ID NO: 192120 - DNA, 25 bp, E. coli
gatttaattgcagacgatcggtcag

SEQ ID NO: 192121 - DNA, 25 bp, E. coli
gttgtccggatatagcgttcacgcc

SEQ ID NO: 192122 - DNA, 25 bp, E. coli
gatttaattgcacacgatcggtcag

SEQ ID NO: 192123 - DNA, 25 bp, E. coli
tggctaacaatgacacgcactgcag

SEQ ID NO: 192124 - DNA, 25 bp, E. coli
tggctaacaatgtcacgcactgcag

SEQ ID NO: 192125 - DNA, 25 bp, E. coli
gatggcgacgtctcctgttcaacga

SEQ ID NO: 192126 - DNA, 25 bp, E. coli
gatggcgacgtcacctgttcaacga

SEQ ID NO: 192127 - DNA, 25 bp, E. coli
caatacgcttttccagagagcggct

SEQ ID NO: 192128 - DNA, 25 bp, E. coli
caatacgcttttgcagagagcggct

SEQ ID NO: 192129 - DNA, 25 bp, E. coli
cagagagcggctattaacaatgccc

SEQ ID NO: 192130 - DNA, 25 bp, E. coli
cagagagcggcttttaacaatgccc

SEQ ID NO: 192131 - DNA, 25 bp, E. coli
accgttgtttattcatgcgttgcga

SEQ ID NO: 192132 - DNA, 25 bp, E. coli
accgttgtttatacatgcgttgcga

SEQ ID NO: 192133 - DNA, 25 bp, E. coli
tcgtcatccggctgcgtattcaacc

SEQ ID NO: 192134 - DNA, 25 bp, E. coli
tcgtcatccggcagcgtattcaacc

SEQ ID NO: 192135 - DNA, 25 bp, E. coli
tcatgcgttgcgattaacaatacgc

SEQ ID NO: 192136 - DNA, 25 bp, E. coli
tcatgcgttgcgtttaacaatacgc

SEQ ID NO: 192137 - DNA, 25 bp, E. coli
gaacgccggatgaaacgttaagtcg

SEQ ID NO: 192138 - DNA, 25 bp, E. coli
gaacgccggatgtaacgttaagtcg

SEQ ID NO: 192139 - DNA, 25 bp, E. coli
gaaacgttaagtggtcatccggcag

SEQ ID NO: 192140 - DNA, 25 bp, E. coli
gaaacgttaagtcgtcatccggcag

SEQ ID NO: 192141 - DNA, 25 bp, E. coli
cccttgaaaccgttgtttattcatg

SEQ ID NO: 192142 - DNA, 25 bp, E. coli
cccttgaaaccgatgtttattcatg

SEQ ID NO: 192143 - DNA, 25 bp, E. coli
cgattaacaatacgcttttccagag

SEQ ID NO: 192144 - DNA, 25 bp, E. coli
cgttaagtcgtcttccggcagcgta

SEQ ID NO: 192145 - DNA, 25 bp, E. coli
cgttaagtcgtcatccggcagcgta

SEQ ID NO: 192146 - DNA, 25 bp, E. coli
cgattaacaataggcttttccagag

SEQ ID NO: 192147 - DNA, 25 bp, E. coli
ggcttttaacaaagccctaacctga

SEQ ID NO: 192148 - DNA, 25 bp, E. coli
ggcttttaacaatgccctaacctga

SEQ ID NO: 192149 - DNA, 25 bp, E. coli
tactgttcgcgatcttgaaagcaaa

SEQ ID NO: 192150 - DNA, 25 bp, E. coli
tactgttcgcgaacttgaaagcaaa

SEQ ID NO: 192151 - DNA, 25 bp, E. coli
cagttctgtataaccaaattcgtcg

SEQ ID NO: 192152 - DNA, 25 bp, E. coli
cagttctgtatatccaaattcgtcg

SEQ ID NO: 192153 - DNA, 25 bp, E. coli
aaatatcgccagatccacatccatg

SEQ ID NO: 192154 - DNA, 25 bp, E. coli
aaatatcgccagttccacatccatg

SEQ ID NO: 192155 - DNA, 25 bp, E. coli
tgcaagatcttgttctgcaactcca

SEQ ID NO: 192156 - DNA, 25 bp, E. coli
tgcaagatcttgatctgcaactcca

SEQ ID NO: 192157 - DNA, 25 bp, E. coli
tgccagcaaaacctatggatattgt

SEQ ID NO: 192158 - DNA, 25 bp, E. coli
tgccagcaaaacgtatggatattgt

SEQ ID NO: 192159 - DNA, 25 bp, E. coli
gctgccttcagttaccagcgcctgt

SEQ ID NO: 192160 - DNA, 25 bp, E. coli
gctgccttcagtaaccagcgcctgt

SEQ ID NO: 192161 - DNA, 25 bp, E. coli
gcaacgttaatgaaatatcgccagt

SEQ ID NO: 192162 - DNA, 25 bp, E. coli
gcaacgttaatgtaatatcgccagt

SEQ ID NO: 192163 - DNA, 25 bp, E. coli
gaaagcaaacgtgaagtgtcaggag

SEQ ID NO: 192164 - DNA, 25 bp, E. coli
gaaagcaaacgtcaagtgtcaggag

SEQ ID NO: 192165 - DNA, 25 bp, E. coli
tgtcacaggttgtggaacgcattct

SEQ ID NO: 192166 - DNA, 25 bp, E. coli
tgtcacaggttgaggaacgcattct

SEQ ID NO: 192167 - DNA, 25 bp, E. coli
taaccagcgcctcttaatcgccaat

SEQ ID NO: 192168 - DNA, 25 bp, E. coli
taaccagcgcctgttaatcgccaat

SEQ ID NO: 192169 - DNA, 25 bp, E. coli
taatcgccaatttctttgttgcaga

SEQ ID NO: 192170 - DNA, 25 bp, E. coli
taatcgccaattactttgttgcaga

SEQ ID NO: 192171 - DNA, 25 bp, E. coli
taaaaacagtgggtaggcctgataa

SEQ ID NO: 192172 - DNA, 25 bp, E. coli
taaaaacagtggctaggcctgataa

SEQ ID NO: 192173 - DNA, 25 bp, E. coli
agtgccggatgctccgcgcgacgca

SEQ ID NO: 192174 - DNA, 25 bp, E. coli
agtgccggatgcaccgcgcgacgca

SEQ ID NO: 192175 - DNA, 25 bp, E. coli
aaatccgccgcattctattcatctg

SEQ ID NO: 192176 - DNA, 25 bp, E. coli
aaatccgccgcaatctattcatctg

SEQ ID NO: 192177 - DNA, 25 bp, E. coli
tatatgaatgagtgcaaaaaggtgg

SEQ ID NO: 192178 - DNA, 25 bp, E. coli
tatatgaatgagagcaaaaaggtgg

SEQ ID NO: 192179 - DNA, 25 bp, E. coli
ttatcggtgtaataacagtgggtag

SEQ ID NO: 192180 - DNA, 25 bp, E. coli
ttatcggtgtaaaaacagtgggtag

SEQ ID NO: 192181 - DNA, 25 bp, E. coli
tcatctgaagataaaaagcaatcgt

SEQ ID NO: 192182 - DNA, 25 bp, E. coli
tcatctgaagattaaaagcaatcgt

SEQ ID NO: 192183 - DNA, 25 bp, E. coli
gcatcggcacacagtgccggatgca

SEQ ID NO: 192184 - DNA, 25 bp, E. coli
gcatcggcacactgtgccggatgca

SEQ ID NO: 192185 - DNA, 25 bp, E. coli
cgccgcattctattcatctgaagat

SEQ ID NO: 192186 - DNA, 25 bp, E. coli
cgccgcattctaatcatctgaagat

SEQ ID NO: 192187 - DNA, 25 bp, E. coli
gttcaggtccgtaggcatgataaaa

SEQ ID NO: 192188 - DNA, 25 bp, E. coli
gataaaaagcaaacgttttcgtggg

SEQ ID NO: 192189 - DNA, 25 bp, E. coli
gataaaaagcaatcgttttcgtggg

SEQ ID NO: 192190 - DNA, 25 bp, E. coli
gttcaggtccgttggcatgataaaa

SEQ ID NO: 192191 - DNA, 25 bp, E. coli
gtccgtaggcatcataaaacgcgtc

SEQ ID NO: 192192 - DNA, 25 bp, E. coli
gtccgtaggcatgataaaacgcgtc

SEQ ID NO: 192193 - DNA, 25 bp, E. coli
cactgggcgcaggacaggcctatat

SEQ ID NO: 192194 - DNA, 25 bp, E. coli
cactgggcgcagcacaggcctatat

SEQ ID NO: 192195 - DNA, 25 bp, E. coli
actgggcgcagcacaggcctatatg

SEQ ID NO: 192196 - DNA, 25 bp, E. coli
actgggcgcagctcaggcctatatg

SEQ ID NO: 192197 - DNA, 25 bp, E. coli
ttcctgctgttaacatgttgatcaa

SEQ ID NO: 192198 - DNA, 25 bp, E. coli
ttcctgctgttatcatgttgatcaa

SEQ ID NO: 192199 - DNA, 25 bp, E. coli
tcctgctgttatgatgttgatcaaa

SEQ ID NO: 192200 - DNA, 25 bp, E. coli
tcctgctgttatcatgttgatcaaa

SEQ ID NO: 192201 - DNA, 25 bp, E. coli
gcactgggcgcaccacaggcctata

SEQ ID NO: 192202 - DNA, 25 bp, E. coli
gcactgggcgcagcacaggcctata

SEQ ID NO: 192203 - DNA, 25 bp, E. coli
cgcatggcgcactgggcgcagcaca

SEQ ID NO: 192204 - DNA, 25 bp, E. coli
cgcactgggcgcagcacaggcctat

SEQ ID NO: 192205 - DNA, 25 bp, E. coli
cgcatggcgcacagggcgcagcaca

SEQ ID NO: 192206 - DNA, 25 bp, E. coli
cgcactgggcgctgcacaggcctat

SEQ ID NO: 192207 - DNA, 25 bp, E. coli
gtaattcctgctgttatcatgttga

SEQ ID NO: 192208 - DNA, 25 bp, E. coli
gtggtaattcctcctgttatcatgt

SEQ ID NO: 192209 - DNA, 25 bp, E. coli
gtaattcctgctcttatcatgttga

SEQ ID NO: 192210 - DNA, 25 bp, E. coli
ggtggtaattcctgctgttatcatg

SEQ ID NO: 192211 - DNA, 25 bp, E. coli
gtggtaattcctgctgttatcatgt

SEQ ID NO: 192212 - DNA, 25 bp, E. coli
ggtggtaattccagctgttatcatg

SEQ ID NO: 192213 - DNA, 25 bp, E. coli
taattcctgctgttatcatgttgat

SEQ ID NO: 192214 - DNA, 25 bp, E. coli
taattcctgctgatatcatgttgat

SEQ ID NO: 192215 - DNA, 25 bp, E. coli
cagaacgaaacaattttctggcgcg

SEQ ID NO: 192216 - DNA, 25 bp, E. coli
cagtaagcgggctgcatcaggtgaa

SEQ ID NO: 192217 - DNA, 25 bp, E. coli
cagtaagcgggcagcatcaggtgaa

SEQ ID NO: 192218 - DNA, 25 bp, E. coli
cagaacgaaacatttttctggcgcg

SEQ ID NO: 192219 - DNA, 25 bp, E. coli
tacggaaaagcagtaagcgggctgc

SEQ ID NO: 192220 - DNA, 25 bp, E. coli
agagcgcaggatccggaaccacaac

SEQ ID NO: 192221 - DNA, 25 bp, E. coli
agagcgcaggatgcggaaccacaac

SEQ ID NO: 192222 - DNA, 25 bp, E. coli
atttcccgcgccagactgagagagc

SEQ ID NO: 192223 - DNA, 25 bp, E. coli
agatacacacagtcatttcccgcgc

SEQ ID NO: 192224 - DNA, 25 bp, E. coli
atttcccgcgcctgactgagagagc

SEQ ID NO: 192225 - DNA, 25 bp, E. coli
agatacacacagacatttcccgcgc

SEQ ID NO: 192226 - DNA, 25 bp, E. coli
tacggaaaagcactaagcgggctgc

SEQ ID NO: 192227 - DNA, 25 bp, E. coli
gcctgactgagacagcgcaggatcc

SEQ ID NO: 192228 - DNA, 25 bp, E. coli
ccagccagaacgtaacaattttctg

SEQ ID NO: 192229 - DNA, 25 bp, E. coli
ccagccagaacgaaacaattttctg

SEQ ID NO: 192230 - DNA, 25 bp, E. coli
gcctgactgagagagcgcaggatcc

SEQ ID NO: 192231 - DNA, 25 bp, E. coli
gaaaagcagtaagcgggctgcatca

SEQ ID NO: 192232 - DNA, 25 bp, E. coli
gaaaagcagtaaccgggctgcatca

SEQ ID NO: 192233 - DNA, 25 bp, E. coli
ctgagagagcgcaggatccggaacc

SEQ ID NO: 192234 - DNA, 25 bp, E. coli
ctgagagagcgctggatccggaacc

SEQ ID NO: 192235 - DNA, 25 bp, E. coli
ggctgcatcaggagaagagtggtat

SEQ ID NO: 192236 - DNA, 25 bp, E. coli
ggctgcatcaggtgaagagtggtat

SEQ ID NO: 192237 - DNA, 25 bp, E. coli
ataacgtgtccagcagcaacgccag

SEQ ID NO: 192238 - DNA, 25 bp, E. coli
acgggcaaacatccagaagctgaaa

SEQ ID NO: 192239 - DNA, 25 bp, E. coli
ataacgtgtccaccagcaacgccag

SEQ ID NO: 192240 - DNA, 25 bp, E. coli
accagcaacgccagggcacgggcaa

SEQ ID NO: 192241 - DNA, 25 bp, E. coli
accagcaacgcctgggcacgggcaa

SEQ ID NO: 192242 - DNA, 25 bp, E. coli
aaaaccatgatttacggattcaggg

SEQ ID NO: 192243 - DNA, 25 bp, E. coli
aaaaccatgattaacggattcaggg

SEQ ID NO: 192244 - DNA, 25 bp, E. coli
acgggcaaacatgcagaagctgaaa

SEQ ID NO: 192245 - DNA, 25 bp, E. coli
aacatccagaagctgaaaaccatga

SEQ ID NO: 192246 - DNA, 25 bp, E. coli
aacatccagaaggtgaaaaccatga

SEQ ID NO: 192247 - DNA, 25 bp, E. coli
ttttctctggtacagaccgcgccgc

SEQ ID NO: 192248 - DNA, 25 bp, E. coli
ttttctctggtagagaccgcgccgc

SEQ ID NO: 192249 - DNA, 25 bp, E. coli
tgcgcggtgatatttaccgcgataa

SEQ ID NO: 192250 - DNA, 25 bp, E. coli
tgcgcggtgataattaccgcgataa

SEQ ID NO: 192251 - DNA, 25 bp, E. coli
cggtgatatttagcgcgataagtac

SEQ ID NO: 192252 - DNA, 25 bp, E. coli
cggtgatatttaccgcgataagtac

SEQ ID NO: 192253 - DNA, 25 bp, E. coli
ctctggtacagaccgcgccgcataa

SEQ ID NO: 192254 - DNA, 25 bp, E. coli
ctctggtacagagcgcgccgcataa

SEQ ID NO: 192255 - DNA, 25 bp, E. coli
gtacagaccgcgccgcataacgtgt

SEQ ID NO: 192256 - DNA, 25 bp, E. coli
gtacagaccgcggcgcataacgtgt

SEQ ID NO: 192257 - DNA, 25 bp, E. coli
ggcacgggcaaacatccagaagctg

SEQ ID NO: 192258 - DNA, 25 bp, E. coli
ggcacgggcaaagatccagaagctg

SEQ ID NO: 192259 - DNA, 25 bp, E. coli
cacggtcagaaattacactggcgat

SEQ ID NO: 192260 - DNA, 25 bp, E. coli
cacggtcagaaaatacactggcgat

SEQ ID NO: 192261 - DNA, 25 bp, E. coli
cagaaaatacactggcgataaagaa

SEQ ID NO: 192262 - DNA, 25 bp, E. coli
cagaaaatacacaggcgataaagaa

SEQ ID NO: 192263 - DNA, 25 bp, E. coli
tactgaactgtactcgcaacacggt

SEQ ID NO: 192264 - DNA, 25 bp, E. coli
tactgaactgtagtcgcaacacggt

SEQ ID NO: 192265 - DNA, 25 bp, E. coli
tatgaaaatcagtccgaggtagcca

SEQ ID NO: 192266 - DNA, 25 bp, E. coli
tagccagaatactgaactgtagtcg

SEQ ID NO: 192267 - DNA, 25 bp, E. coli
tatgaaaatcagaccgaggtagcca

SEQ ID NO: 192268 - DNA, 25 bp, E. coli
tagccagaatacagaactgtagtcg

SEQ ID NO: 192269 - DNA, 25 bp, E. coli
tgacgttcacagaaaaaaccattcc

SEQ ID NO: 192270 - DNA, 25 bp, E. coli
tgacgttcacagtaaaaaccattcc

SEQ ID NO: 192271 - DNA, 25 bp, E. coli
tcgcaacacggtcagaaaatacact

SEQ ID NO: 192272 - DNA, 25 bp, E. coli
tcgcaacacggtgagaaaatacact

SEQ ID NO: 192273 - DNA, 25 bp, E. coli
gaactgtagtcggaacacggtcaga

SEQ ID NO: 192274 - DNA, 25 bp, E. coli
gaactgtagtcgcaacacggtcaga

SEQ ID NO: 192275 - DNA, 25 bp, E. coli
gacatgctcgttgaggcatatgaaa

SEQ ID NO: 192276 - DNA, 25 bp, E. coli
gacatgctcgttcaggcatatgaaa

SEQ ID NO: 192277 - DNA, 25 bp, E. coli
cgttgaggcataagaaaatcagacc

SEQ ID NO: 192278 - DNA, 25 bp, E. coli
cgttgaggcatatgaaaatcagacc

SEQ ID NO: 192279 - DNA, 25 bp, E. coli
tcagaccgaggtagccagaatactg

SEQ ID NO: 192280 - DNA, 25 bp, E. coli
tcagaccgaggttgccagaatactg

SEQ ID NO: 192281 - DNA, 25 bp, E. coli
aatatcgacaacattcagcctggcg

SEQ ID NO: 192282 - DNA, 25 bp, E. coli
aatatcgacaactttcagcctggcg

SEQ ID NO: 192283 - DNA, 25 bp, E. coli
tatgcgccgaaagagacattacagg

SEQ ID NO: 192284 - DNA, 25 bp, E. coli
tatgcgccgaaacagacattacagg

SEQ ID NO: 192285 - DNA, 25 bp, E. coli
taccgggcatcgacgctattttgaa

SEQ ID NO: 192286 - DNA, 25 bp, E. coli
taccgggcatcgtcgctattttgaa

SEQ ID NO: 192287 - DNA, 25 bp, E. coli
tattatcgtgatcaaactgaccgtg

SEQ ID NO: 192288 - DNA, 25 bp, E. coli
tattatcgtgatgaaactgaccgtg

SEQ ID NO: 192289 - DNA, 25 bp, E. coli
ttgacttaccgcgtggagacagact

SEQ ID NO: 192290 - DNA, 25 bp, E. coli
ttgacttaccgcctggagacagact

SEQ ID NO: 192291 - DNA, 25 bp, E. coli
tccatcggtgacacattgacttacc

SEQ ID NO: 192292 - DNA, 25 bp, E. coli
tccatcggtgactcattgacttacc

SEQ ID NO: 192293 - DNA, 25 bp, E. coli
cctgcaagggcagcaaaaaattgaa

SEQ ID NO: 192294 - DNA, 25 bp, E. coli
cctgcaagggcaccaaaaaattgaa

SEQ ID NO: 192295 - DNA, 25 bp, E. coli
gaagtgcattactacctgcaagggc

SEQ ID NO: 192296 - DNA, 25 bp, E. coli
gaagtgcattacaacctgcaagggc

SEQ ID NO: 192297 - DNA, 25 bp, E. coli
cgaccgatgcgcaatttaccgggca

SEQ ID NO: 192298 - DNA, 25 bp, E. coli
cgaccgatgcgctatttaccgggca

SEQ ID NO: 192299 - DNA, 25 bp, E. coli
gataacttagaagagttccgccaga

SEQ ID NO: 192300 - DNA, 25 bp, E. coli
gataacttagaacagttccgccaga

SEQ ID NO: 192301 - DNA, 25 bp, E. coli
gaccgtgaatatataaaaggctgcg

SEQ ID NO: 192302 - DNA, 25 bp, E. coli
gaccgtgaatatttaaaaggctgcg

SEQ ID NO: 192303 - DNA, 25 bp, E. coli
agaaagcctctcgtgctacgccgtt

SEQ ID NO: 192304 - DNA, 25 bp, E. coli
agaaagcctctcctgctacgccgtt

SEQ ID NO: 192305 - DNA, 25 bp, E. coli
tatggtcgcgtgtagattgaagatc

SEQ ID NO: 192306 - DNA, 25 bp, E. coli
tatggtcgcgtgaagattgaagatc

SEQ ID NO: 192307 - DNA, 25 bp, E. coli
tttctgatggcctgtcaactgatgc

SEQ ID NO: 192308 - DNA, 25 bp, E. coli
tttggcgaaacgtatgctggagcag

SEQ ID NO: 192309 - DNA, 25 bp, E. coli
tttggcgaaacgaatgctggagcag

SEQ ID NO: 192310 - DNA, 25 bp, E. coli
tttctgatggccagtcaactgatgc

SEQ ID NO: 192311 - DNA, 25 bp, E. coli
gctggagcagaaagcatccggcatc

SEQ ID NO: 192312 - DNA, 25 bp, E. coli
gctggagcagaatgcatccggcatc

SEQ ID NO: 192313 - DNA, 25 bp, E. coli
ccgcctgtgtgcagaagctgttgaa

SEQ ID NO: 192314 - DNA, 25 bp, E. coli
ccgcctgtgtgctgaagctgttgaa

SEQ ID NO: 192315 - DNA, 25 bp, E. coli
cgccgtcagaaggaaagtgcgccac

SEQ ID NO: 192316 - DNA, 25 bp, E. coli
cgccgtcagaagcaaagtgcgccac

SEQ ID NO: 192317 - DNA, 25 bp, E. coli
cgtatggcgaccaccgttgaggccg

SEQ ID NO: 192318 - DNA, 25 bp, E. coli
cgtatggcgacctccgttgaggccg

SEQ ID NO: 192319 - DNA, 25 bp, E. coli
ggttgaagccgcagccgtcattgtg

SEQ ID NO: 192320 - DNA, 25 bp, E. coli
ggttgaagccgctgccgtcattgtg

SEQ ID NO: 192321 - DNA, 25 bp, E. coli
tggccgatcactgtcgttcgaaaga

SEQ ID NO: 192322 - DNA, 25 bp, E. coli
tggccgatcactctcgttcgaaaga

SEQ ID NO: 192323 - DNA, 25 bp, E. coli
gaggccgatcgcacctgtatctcta

SEQ ID NO: 192324 - DNA, 25 bp, E. coli
gaggccgatcgctcctgtatctcta

SEQ ID NO: 192325 - DNA, 25 bp, E. coli
cactaatgatggtaaatatgatggt

SEQ ID NO: 192326 - DNA, 25 bp, E. coli
caacagaaaataaccagatgatcac

SEQ ID NO: 192327 - DNA, 25 bp, E. coli
cactaatgatggaaaatatgatggt

SEQ ID NO: 192328 - DNA, 25 bp, E. coli
caacagaaaatatccagatgatcac

SEQ ID NO: 192329 - DNA, 25 bp, E. coli
ataaggtgtttaggctgatcaggta

SEQ ID NO: 192330 - DNA, 25 bp, E. coli
ataaggtgtttacgctgatcaggta

SEQ ID NO: 192331 - DNA, 25 bp, E. coli
tggtgttaaatgatgtattggctgg

SEQ ID NO: 192332 - DNA, 25 bp, E. coli
tggtgttaaatgttgtattggctgg

SEQ ID NO: 192333 - DNA, 25 bp, E. coli
tcaggaacacgtggtagagggaaga

SEQ ID NO: 192334 - DNA, 25 bp, E. coli
tcaggaacacgtcgtagagggaaga

SEQ ID NO: 192335 - DNA, 25 bp, E. coli
ccagatgatcacactaatgatggaa

SEQ ID NO: 192336 - DNA, 25 bp, E. coli
gccaaaaagcaatacgcccgcatat

SEQ ID NO: 192337 - DNA, 25 bp, E. coli
ccagatgatcactctaatgatggaa

SEQ ID NO: 192338 - DNA, 25 bp, E. coli
gccaaaaagcaaaacgcccgcatat

SEQ ID NO: 192339 - DNA, 25 bp, E. coli
gcatatgcgggcgttcaggaacacg

SEQ ID NO: 192340 - DNA, 25 bp, E. coli
gcatatgcgggccttcaggaacacg

SEQ ID NO: 192341 - DNA, 25 bp, E. coli
cgtacgcagaccgtaggccagataa

SEQ ID NO: 192342 - DNA, 25 bp, E. coli
cgtacgcagaccctaggccagataa

SEQ ID NO: 192343 - DNA, 25 bp, E. coli
ctgatcaggtaacaaggcgcgccaa

SEQ ID NO: 192344 - DNA, 25 bp, E. coli
ctgatcaggtaagaaggcgcgccaa

SEQ ID NO: 192345 - DNA, 25 bp, E. coli
gggattttgattgcgtacgcagacc

SEQ ID NO: 192346 - DNA, 25 bp, E. coli
gggattttgattccgtacgcagacc

SEQ ID NO: 192347 - DNA, 25 bp, E. coli
tatcgaaccgcgatatgttgatgcg

SEQ ID NO: 192348 - DNA, 25 bp, E. coli
tatcggtccgtactatgtggttggc

SEQ ID NO: 192349 - DNA, 25 bp, E. coli
tatcgaaccgcgttatgttgatgcg

SEQ ID NO: 192350 - DNA, 25 bp, E. coli
tatcggtccgtagtatgtggttggc

SEQ ID NO: 192351 - DNA, 25 bp, E. coli
ttttgacggccataacgacgcagga

SEQ ID NO: 192352 - DNA, 25 bp, E. coli
ttaaatacagaggtcgttcaggtcg

SEQ ID NO: 192353 - DNA, 25 bp, E. coli
ttttgacggccaaaacgacgcagga

SEQ ID NO: 192354 - DNA, 25 bp, E. coli
ttaaatacagagctcgttcaggtcg

SEQ ID NO: 192355 - DNA, 25 bp, E. coli
tgattgtgctggctgcaaccgacag

SEQ ID NO: 192356 - DNA, 25 bp, E. coli
tgatgccgatgaaaacgatccagtg

SEQ ID NO: 192357 - DNA, 25 bp, E. coli
tgattgtgctgggtgcaaccgacag

SEQ ID NO: 192358 - DNA, 25 bp, E. coli
tgatgccgatgataacgatccagtg

SEQ ID NO: 192359 - DNA, 25 bp, E. coli
tcgataacgaaaaagacatacaggc

SEQ ID NO: 192360 - DNA, 25 bp, E. coli
tcgataacgaaatagacatacaggc

SEQ ID NO: 192361 - DNA, 25 bp, E. coli
tcgtggaacaggacaaagactggcg

SEQ ID NO: 192362 - DNA, 25 bp, E. coli
tcgtggaacaggtcaaagactggcg

SEQ ID NO: 192363 - DNA, 25 bp, E. coli
gaagccgtggcgttttcatgccgac

SEQ ID NO: 192364 - DNA, 25 bp, E. coli
gaagccgtggcgatttcatgccgac

SEQ ID NO: 192365 - DNA, 25 bp, E. coli
gacagtaccagcgacattgaagcga

SEQ ID NO: 192366 - DNA, 25 bp, E. coli
gacagtaccagccacattgaagcga

SEQ ID NO: 192367 - DNA, 25 bp, E. coli
ccctggtattgccatgcctcatgcg

SEQ ID NO: 192368 - DNA, 25 bp, E. coli
ccctggtattgcgatgcctcatgcg

SEQ ID NO: 192369 - DNA, 25 bp, E. coli
aatagaacaagcgatgcttgacgcc

SEQ ID NO: 192370 - DNA, 25 bp, E. coli
aagcgatgcttgacgccggattgag

SEQ ID NO: 192371 - DNA, 25 bp, E. coli
caagcgatgcttgacgccggattga

SEQ ID NO: 192372 - DNA, 25 bp, E. coli
aagcgatgcttgtcgccggattgag

SEQ ID NO: 192373 - DNA, 25 bp, E. coli
caagcgatgcttcacgccggattga

SEQ ID NO: 192374 - DNA, 25 bp, E. coli
aatagaacaagccatgcttgacgcc

SEQ ID NO: 192375 - DNA, 25 bp, E. coli
attgagcgcggatgaagccagtgca

SEQ ID NO: 192376 - DNA, 25 bp, E. coli
attgagcgcggaagaagccagtgca

SEQ ID NO: 192377 - DNA, 25 bp, E. coli
tttcgctcaatagaacaagcgatgc

SEQ ID NO: 192378 - DNA, 25 bp, E. coli
tttcgctcaatacaacaagcgatgc

SEQ ID NO: 192379 - DNA, 25 bp, E. coli
tgcttgacgccgcattgagcgcgga

SEQ ID NO: 192380 - DNA, 25 bp, E. coli
tgcttgacgccggattgagcgcgga

SEQ ID NO: 192381 - DNA, 25 bp, E. coli
gcgttttcgctcaatagaacaagcg

SEQ ID NO: 192382 - DNA, 25 bp, E. coli
gcgttttcgctctatagaacaagcg

SEQ ID NO: 192383 - DNA, 25 bp, E. coli
cgctcaatagaagaagcgatgcttg

SEQ ID NO: 192384 - DNA, 25 bp, E. coli
cgctggcgttttggctcaatagaac

SEQ ID NO: 192385 - DNA, 25 bp, E. coli
cgctggcgttttcgctcaatagaac

SEQ ID NO: 192386 - DNA, 25 bp, E. coli
cgctcaatagaacaagcgatgcttg

SEQ ID NO: 192387 - DNA, 25 bp, E. coli
tggcgttttcgcacaatagaacaag

SEQ ID NO: 192388 - DNA, 25 bp, E. coli
tggcgttttcgctcaatagaacaag

SEQ ID NO: 192389 - DNA, 25 bp, E. coli
tcaatagaacaagcgatgcttgacg

SEQ ID NO: 192390 - DNA, 25 bp, E. coli
tcaatagaacaaccgatgcttgacg

SEQ ID NO: 192391 - DNA, 25 bp, E. coli
cattacaccgattgtaggtgccgaa

SEQ ID NO: 192392 - DNA, 25 bp, E. coli
tttaacggcacacgatgtggtggtt

SEQ ID NO: 192393 - DNA, 25 bp, E. coli
tacaccgattgttggtgccgaagtt

SEQ ID NO: 192394 - DNA, 25 bp, E. coli
tacaccgattgtaggtgccgaagtt

SEQ ID NO: 192395 - DNA, 25 bp, E. coli
accgctgagtttgccattacaccga

SEQ ID NO: 192396 - DNA, 25 bp, E. coli
accgctgagtttcccattacaccga

SEQ ID NO: 192397 - DNA, 25 bp, E. coli
acgccaccggatgtagcgcagagca

SEQ ID NO: 192398 - DNA, 25 bp, E. coli
accgattgtaggtgccgaagttgtt

SEQ ID NO: 192399 - DNA, 25 bp, E. coli
accgattgtaggagccgaagttgtt

SEQ ID NO: 192400 - DNA, 25 bp, E. coli
acgccaccggatctagcgcagagca

SEQ ID NO: 192401 - DNA, 25 bp, E. coli
tagcgcagagcaagcggaagcggcg

SEQ ID NO: 192402 - DNA, 25 bp, E. coli
tagcgcagagcatgcggaagcggcg

SEQ ID NO: 192403 - DNA, 25 bp, E. coli
taatttaacggctcaggatgtggtg

SEQ ID NO: 192404 - DNA, 25 bp, E. coli
taatttaacggcacaggatgtggtg

SEQ ID NO: 192405 - DNA, 25 bp, E. coli
ccaccggatgtaccgcagagcaagc

SEQ ID NO: 192406 - DNA, 25 bp, E. coli
ccaccggatgtagcgcagagcaagc

SEQ ID NO: 192407 - DNA, 25 bp, E. coli
gaaaaatattaatttaacggcacag

SEQ ID NO: 192408 - DNA, 25 bp, E. coli
gaaaaatattaaattaacggcacag

SEQ ID NO: 192409 - DNA, 25 bp, E. coli
cattacaccgatagtaggtgccgaa

SEQ ID NO: 192410 - DNA, 25 bp, E. coli
tttaacggcacaggatgtggtggtt

SEQ ID NO: 192411 - DNA, 25 bp, E. coli
gagtttgccattacaccgattgtag

SEQ ID NO: 192412 - DNA, 25 bp, E. coli
gagtttgccatttcaccgattgtag

SEQ ID NO: 192413 - DNA, 25 bp, E. coli
caggatgttgattacaaaaatgtaa

SEQ ID NO: 192414 - DNA, 25 bp, E. coli
caggatgttgataacaaaaatgtaa

SEQ ID NO: 192415 - DNA, 25 bp, E. coli
taaaggctggctattccaaacagga

SEQ ID NO: 192416 - DNA, 25 bp, E. coli
taaaggctggcttttccaaacagga

SEQ ID NO: 192417 - DNA, 25 bp, E. coli
aaatagttatcctttaaaggctggc

SEQ ID NO: 192418 - DNA, 25 bp, E. coli
aaatagttatccattaaaggctggc

SEQ ID NO: 192419 - DNA, 25 bp, E. coli
ttatccattaaacgctggctattcc

SEQ ID NO: 192420 - DNA, 25 bp, E. coli
ttatccattaaaggctggctattcc

SEQ ID NO: 192421 - DNA, 25 bp, E. coli
tcagaaatagttttccattaaaggc

SEQ ID NO: 192422 - DNA, 25 bp, E. coli
tccaaacaggatgttgattacaaaa

SEQ ID NO: 192423 - DNA, 25 bp, E. coli
tccaaacaggatcttgattacaaaa

SEQ ID NO: 192424 - DNA, 25 bp, E. coli
tcagaaatagttatccattaaaggc

SEQ ID NO: 192425 - DNA, 25 bp, E. coli
gctggctattccaaacaggatgttg

SEQ ID NO: 192426 - DNA, 25 bp, E. coli
gctggctattcctaacaggatgttg

SEQ ID NO: 192427 - DNA, 25 bp, E. coli
cattgcattgtcagaaatagttatc

SEQ ID NO: 192428 - DNA, 25 bp, E. coli
cattgcattgtctgaaatagttatc

SEQ ID NO: 192429 - DNA, 25 bp, E. coli
gattatactcatagcattgtcagaa

SEQ ID NO: 192430 - DNA, 25 bp, E. coli
gtggaagatggacttgattatactc

SEQ ID NO: 192431 - DNA, 25 bp, E. coli
gtggaagatggagttgattatactc

SEQ ID NO: 192432 - DNA, 25 bp, E. coli
gatggacttgattatactcattgca

SEQ ID NO: 192433 - DNA, 25 bp, E. coli
gattatactcattgcattgtcagaa

SEQ ID NO: 192434 - DNA, 25 bp, E. coli
gatggacttgataatactcattgca

SEQ ID NO: 192435 - DNA, 25 bp, E. coli
ttggcaccggctaccagtactggta

SEQ ID NO: 192436 - DNA, 25 bp, E. coli
ttggcaccggcttccagtactggta

SEQ ID NO: 192437 - DNA, 25 bp, E. coli
tctggatgttgggaccggctaccag

SEQ ID NO: 192438 - DNA, 25 bp, E. coli
tctggatgttggcaccggctaccag

SEQ ID NO: 192439 - DNA, 25 bp, E. coli
gcgtctggatgttggcaccggctac

SEQ ID NO: 192440 - DNA, 25 bp, E. coli
gcgtctggatgtaggcaccggctac

SEQ ID NO: 192441 - DNA, 25 bp, E. coli
cgtctggatgttggcaccggctacc

SEQ ID NO: 192442 - DNA, 25 bp, E. coli
ctggatgttggcaccggctaccagt

SEQ ID NO: 192443 - DNA, 25 bp, E. coli
cgtctggatgttcgcaccggctacc

SEQ ID NO: 192444 - DNA, 25 bp, E. coli
ctggatgttggctccggctaccagt

SEQ ID NO: 192445 - DNA, 25 bp, E. coli
gttggcaccggctaccagtactggt

SEQ ID NO: 192446 - DNA, 25 bp, E. coli
gttggcaccggcaaccagtactggt

SEQ ID NO: 192447 - DNA, 25 bp, E. coli
ggatgttggcaccggctaccagtac

SEQ ID NO: 192448 - DNA, 25 bp, E. coli
ggatgttggcacgggctaccagtac

SEQ ID NO: 192449 - DNA, 25 bp, E. coli
tggatgttggcaccggctaccagta

SEQ ID NO: 192450 - DNA, 25 bp, E. coli
tgttggcaccggctaccagtactgg

SEQ ID NO: 192451 - DNA, 25 bp, E. coli
tggcaccggctaccagtactggtac

SEQ ID NO: 192452 - DNA, 25 bp, E. coli
tgttggcaccgggtaccagtactgg

SEQ ID NO: 192453 - DNA, 25 bp, E. coli
tggatgttggcagcggctaccagta

SEQ ID NO: 192454 - DNA, 25 bp, E. coli
tggcaccggctagcagtactggtac

SEQ ID NO: 192455 - DNA, 25 bp, E. coli
gatgttggcaccggctaccagtact

SEQ ID NO: 192456 - DNA, 25 bp, E. coli
gatgttggcacccgctaccagtact

SEQ ID NO: 192457 - DNA, 25 bp, E. coli
taaagctatcgtgggtggtatcgcc

SEQ ID NO: 192458 - DNA, 25 bp, E. coli
taaagctatcgtcggtggtatcgcc

SEQ ID NO: 192459 - DNA, 25 bp, E. coli
tatgccagcgccagaaggttaccgc

SEQ ID NO: 192460 - DNA, 25 bp, E. coli
tatgccagcgcctgaaggttaccgc

SEQ ID NO: 192461 - DNA, 25 bp, E. coli
tataccctggattacgttcgcctgg

SEQ ID NO: 192462 - DNA, 25 bp, E. coli
tataccctggataacgttcgcctgg

SEQ ID NO: 192463 - DNA, 25 bp, E. coli
ttcgccgtaactttggtatgccagc

SEQ ID NO: 192464 - DNA, 25 bp, E. coli
ttcgccgtaactatggtatgccagc

SEQ ID NO: 192465 - DNA, 25 bp, E. coli
tgcgtgaaaaaaccgtagaactgac

SEQ ID NO: 192466 - DNA, 25 bp, E. coli
tgcgtgaaaaaagcgtagaactgac

SEQ ID NO: 192467 - DNA, 25 bp, E. coli
gcgaccgcgcgtatgcagacgataa

SEQ ID NO: 192468 - DNA, 25 bp, E. coli
gcgaccgcgcgtttgcagacgataa

SEQ ID NO: 192469 - DNA, 25 bp, E. coli
gaatttgacgaagtggctggcgacc

SEQ ID NO: 192470 - DNA, 25 bp, E. coli
gaagaagtgcatggtctgcgtgaaa

SEQ ID NO: 192471 - DNA, 25 bp, E. coli
gaatttgacgaactggctggcgacc

SEQ ID NO: 192472 - DNA, 25 bp, E. coli
gaagaagtgcatcgtctgcgtgaaa

SEQ ID NO: 192473 - DNA, 25 bp, E. coli
cattctgtggaagagcgccgacaaa

SEQ ID NO: 192474 - DNA, 25 bp, E. coli
cattctgtggaacagcgccgacaaa

SEQ ID NO: 192475 - DNA, 25 bp, E. coli
ggtcagtctgaagccattgcacgca

SEQ ID NO: 192476 - DNA, 25 bp, E. coli
ggtcagtctgaacccattgcacgca

SEQ ID NO: 192477 - DNA, 25 bp, E. coli
gatctcggtgcaaggcagattgcgc

SEQ ID NO: 192478 - DNA, 25 bp, E. coli
gatctcggtgcatggcagattgcgc

SEQ ID NO: 192479 - DNA, 25 bp, E. coli
agtttttgactcgcgtcagccgtcg

SEQ ID NO: 192480 - DNA, 25 bp, E. coli
agtttttgactcccgtcagccgtcg

SEQ ID NO: 192481 - DNA, 25 bp, E. coli
aagtttttgactcgcgtcagccgtc

SEQ ID NO: 192482 - DNA, 25 bp, E. coli
aagtttttgactggcgtcagccgtc

SEQ ID NO: 192483 - DNA, 25 bp, E. coli
ttttgactcgcgtcagccgtcgcgg

SEQ ID NO: 192484 - DNA, 25 bp, E. coli
tttttgactcgcctcagccgtcgcg

SEQ ID NO: 192485 - DNA, 25 bp, E. coli
tttttgactcgcgtcagccgtcgcg

SEQ ID NO: 192486 - DNA, 25 bp, E. coli
ttttgactcgcgacagccgtcgcgg

SEQ ID NO: 192487 - DNA, 25 bp, E. coli
gcgggcttcctctctggctggaact

SEQ ID NO: 192488 - DNA, 25 bp, E. coli
gcgggcttcctcactggctggaact

SEQ ID NO: 192489 - DNA, 25 bp, E. coli
ccgtttgcgggcatcctctctggct

SEQ ID NO: 192490 - DNA, 25 bp, E. coli
ggaccgtttgcgggcttcctctctg

SEQ ID NO: 192491 - DNA, 25 bp, E. coli
ccgtttgcgggcttcctctctggct

SEQ ID NO: 192492 - DNA, 25 bp, E. coli
ggaccgtttgcgcgcttcctctctg

SEQ ID NO: 192493 - DNA, 25 bp, E. coli
cgtttgcgggctacctctctggctg

SEQ ID NO: 192494 - DNA, 25 bp, E. coli
cgggcttcctctgtggctggaacta

SEQ ID NO: 192495 - DNA, 25 bp, E. coli
cgggcttcctctctggctggaacta

SEQ ID NO: 192496 - DNA, 25 bp, E. coli
cgtttgcgggcttcctctctggctg

SEQ ID NO: 192497 - DNA, 25 bp, E. coli
gggaccgtttgcgggcttcctctct

SEQ ID NO: 192498 - DNA, 25 bp, E. coli
gggaccgtttgccggcttcctctct

SEQ ID NO: 192499 - DNA, 25 bp, E. coli
tggggaccgtttgcgggcttcctct

SEQ ID NO: 192500 - DNA, 25 bp, E. coli
tggggaccgtttccgggcttcctct

SEQ ID NO: 192501 - DNA, 25 bp, E. coli
caacacggttgtggttcctcctacg

SEQ ID NO: 192502 - DNA, 25 bp, E. coli
caacacggttgtcgttcctcctacg

SEQ ID NO: 192503 - DNA, 25 bp, E. coli
cagttgccgcaaagtagcctgctta

SEQ ID NO: 192504 - DNA, 25 bp, E. coli
cagttgccgcaatgtagcctgctta

SEQ ID NO: 192505 - DNA, 25 bp, E. coli
ttttcaaaggtaagctcgggctgcc

SEQ ID NO: 192506 - DNA, 25 bp, E. coli
ttttcaaaggtatgctcgggctgcc

SEQ ID NO: 192507 - DNA, 25 bp, E. coli
tgcagtatccctttacccgtgagta

SEQ ID NO: 192508 - DNA, 25 bp, E. coli
tgcagtatccctatacccgtgagta

SEQ ID NO: 192509 - DNA, 25 bp, E. coli
ccagactggcgattacacgcggcgt

SEQ ID NO: 192510 - DNA, 25 bp, E. coli
ccagactggcgaatacacgcggcgt

SEQ ID NO: 192511 - DNA, 25 bp, E. coli
gctttgtggcgaccggatttatgac

SEQ ID NO: 192512 - DNA, 25 bp, E. coli
gctttgtggcgagcggatttatgac

SEQ ID NO: 192513 - DNA, 25 bp, E. coli
cgctctccggtgtgttgcactggca

SEQ ID NO: 192514 - DNA, 25 bp, E. coli
cgctctccggtgagttgcactggca

SEQ ID NO: 192515 - DNA, 25 bp, E. coli
cattaccgcctgagtatctgcaaga

SEQ ID NO: 192516 - DNA, 25 bp, E. coli
cattaccgcctgtgtatctgcaaga

SEQ ID NO: 192517 - DNA, 25 bp, E. coli
tggcatagccgacccgaattttaaa

SEQ ID NO: 192518 - DNA, 25 bp, E. coli
tggcatagccgagccgaattttaaa

SEQ ID NO: 192519 - DNA, 25 bp, E. coli
taacgcttcgtcgtctgctcagtaa

SEQ ID NO: 192520 - DNA, 25 bp, E. coli
taacgcttcgtcctctgctcagtaa

SEQ ID NO: 192521 - DNA, 25 bp, E. coli
gatgttttttatccgcagcagggcg

SEQ ID NO: 192522 - DNA, 25 bp, E. coli
gatgttttttatgcgcagcagggcg

SEQ ID NO: 192523 - DNA, 25 bp, E. coli
taaagtcatgatcgacgacctggcg

SEQ ID NO: 192524 - DNA, 25 bp, E. coli
taaagtcatgatggacgacctggcg

SEQ ID NO: 192525 - DNA, 25 bp, E. coli
taaaactgttgctgaaagccggcgg

SEQ ID NO: 192526 - DNA, 25 bp, E. coli
taaaacggccggaatggtgtcgcaa

SEQ ID NO: 192527 - DNA, 25 bp, E. coli
taaaactgttgcagaaagccggcgg

SEQ ID NO: 192528 - DNA, 25 bp, E. coli
taaaacggccggtatggtgtcgcaa

SEQ ID NO: 192529 - DNA, 25 bp, E. coli
tatgtgatggctcaacaggcgcgcc

SEQ ID NO: 192530 - DNA, 25 bp, E. coli
tatgtgatggctgaacaggcgcgcc

SEQ ID NO: 192531 - DNA, 25 bp, E. coli
tattgagggattaagcggataccgc

SEQ ID NO: 192532 - DNA, 25 bp, E. coli
tattgagggatttagcggataccgc

SEQ ID NO: 192533 - DNA, 25 bp, E. coli
ttaatccgcgaaggtgaaagctggc

SEQ ID NO: 192534 - DNA, 25 bp, E. coli
ttaatccgcgaacgtgaaagctggc

SEQ ID NO: 192535 - DNA, 25 bp, E. coli
tttactgactgagcatacgccgggc

SEQ ID NO: 192536 - DNA, 25 bp, E. coli
tttactgactgaccatacgccgggc

SEQ ID NO: 192537 - DNA, 25 bp, E. coli
tgttagccgaaggacaaacgcctct

SEQ ID NO: 192538 - DNA, 25 bp, E. coli
tgttagccgaagcacaaacgcctct

SEQ ID NO: 192539 - DNA, 25 bp, E. coli
tgagcacgaacttacccaactggcg

SEQ ID NO: 192540 - DNA, 25 bp, E. coli
tgagcacgaactaacccaactggcg

SEQ ID NO: 192541 - DNA, 25 bp, E. coli
gactttttcgaagtgggcggcgaca

SEQ ID NO: 192542 - DNA, 25 bp, E. coli
gactttttcgaactgggcggcgaca

SEQ ID NO: 192543 - DNA, 25 bp, E. coli
gattttaacttcacagcgccggtga

SEQ ID NO: 192544 - DNA, 25 bp, E. coli
gattttaacttctcagcgccggtga

SEQ ID NO: 192545 - DNA, 25 bp, E. coli
cacttcattttctgggtcagcaggt

SEQ ID NO: 192546 - DNA, 25 bp, E. coli
cacttcattttcagggtcagcaggt

SEQ ID NO: 192547 - DNA, 25 bp, E. coli
attttctgggtctgcaggtagaaac

SEQ ID NO: 192548 - DNA, 25 bp, E. coli
attttctgggtcagcaggtagaaac

SEQ ID NO: 192549 - DNA, 25 bp, E. coli
agtgccagattacatccatttaccg

SEQ ID NO: 192550 - DNA, 25 bp, E. coli
agtgccagattagatccatttaccg

SEQ ID NO: 192551 - DNA, 25 bp, E. coli
actggacgctgagcgccgtgcctga

SEQ ID NO: 192552 - DNA, 25 bp, E. coli
actggacgctgaccgccgtgcctga

SEQ ID NO: 192553 - DNA, 25 bp, E. coli
tttactgatctgctgcgaggcatta

SEQ ID NO: 192554 - DNA, 25 bp, E. coli
tttactgatctggtgcgaggcatta

SEQ ID NO: 192555 - DNA, 25 bp, E. coli
tcattttctgggtcagcaggtagaa

SEQ ID NO: 192556 - DNA, 25 bp, E. coli
tctgctgcgaggcattattcacgcc

SEQ ID NO: 192557 - DNA, 25 bp, E. coli
tcattttctgggacagcaggtagaa

SEQ ID NO: 192558 - DNA, 25 bp, E. coli
tctgctgcgagggattattcacgcc

SEQ ID NO: 192559 - DNA, 25 bp, E. coli
gcctgtactgggtcggcgacgttct

SEQ ID NO: 192560 - DNA, 25 bp, E. coli
gcctgtactgggacggcgacgttct

SEQ ID NO: 192561 - DNA, 25 bp, E. coli
gatctgctgcgacgcattattcacg

SEQ ID NO: 192562 - DNA, 25 bp, E. coli
gattacatccatttaccgctggcgc

SEQ ID NO: 192563 - DNA, 25 bp, E. coli
gatctgctgcgaggcattattcacg

SEQ ID NO: 192564 - DNA, 25 bp, E. coli
gattacatccatataccgctggcgc

SEQ ID NO: 192565 - DNA, 25 bp, E. coli
gatccgcgcccggtgttaatcgcgg

SEQ ID NO: 192566 - DNA, 25 bp, E. coli
gatccgcgcccgctgttaatcgcgg

SEQ ID NO: 192567 - DNA, 25 bp, E. coli
caataaagtcgtcaccgaaggcgca

SEQ ID NO: 192568 - DNA, 25 bp, E. coli
caataaagtcgtgaccgaaggcgca

SEQ ID NO: 192569 - DNA, 25 bp, E. coli
caacgactggctgggcgaatttata

SEQ ID NO: 192570 - DNA, 25 bp, E. coli
caacgactggctcggcgaatttata

SEQ ID NO: 192571 - DNA, 25 bp, E. coli
tacgatgatccgaaagtgattgctg

SEQ ID NO: 192572 - DNA, 25 bp, E. coli
tacgatgatccgtaagtgattgctg

SEQ ID NO: 192573 - DNA, 25 bp, E. coli
tgaaaacgttcagggcatggcggct

SEQ ID NO: 192574 - DNA, 25 bp, E. coli
tgaaaacgttcacggcatggcggct

SEQ ID NO: 192575 - DNA, 25 bp, E. coli
tgctggtcagcgaagacgaaatcag

SEQ ID NO: 192576 - DNA, 25 bp, E. coli
tgctggtcagcgtagacgaaatcag

SEQ ID NO: 192577 - DNA, 25 bp, E. coli
gcgtctctcaaatcaccggtttcgt

SEQ ID NO: 192578 - DNA, 25 bp, E. coli
gcgtctctcaaaacaccggtttcgt

SEQ ID NO: 192579 - DNA, 25 bp, E. coli
gaaattgtcgaaatggaaggccgta

SEQ ID NO: 192580 - DNA, 25 bp, E. coli
gaaattgtcgaattggaaggccgta

SEQ ID NO: 192581 - DNA, 25 bp, E. coli
gttgtgatgtctcccgcccgggtaa

SEQ ID NO: 192582 - DNA, 25 bp, E. coli
gttgtgatgtctgccgcccgggtaa

SEQ ID NO: 192583 - DNA, 25 bp, E. coli
tggcggcttcttaccactccggaga

SEQ ID NO: 192584 - DNA, 25 bp, E. coli
tggcggcttctttccactccggaga

SEQ ID NO: 192585 - DNA, 25 bp, E. coli
ggcaacgtgcgactactccgcagaa

SEQ ID NO: 192586 - DNA, 25 bp, E. coli
ggcaacgtgcgagtactccgcagaa

SEQ ID NO: 192587 - DNA, 25 bp, E. coli
gatgtcgataacctgattgtgccaa

SEQ ID NO: 192588 - DNA, 25 bp, E. coli
gatgtcgataacgtgattgtgccaa

SEQ ID NO: 192589 - DNA, 25 bp, E. coli
caaccgggatgggattgtccgcaag

SEQ ID NO: 192590 - DNA, 25 bp, E. coli
caaccgggatggcattgtccgcaag

SEQ ID NO: 192591 - DNA, 25 bp, E. coli
aactcaatgccatctggcgcggcag

SEQ ID NO: 192592 - DNA, 25 bp, E. coli
aactcaatgccaactggcgcggcag

SEQ ID NO: 192593 - DNA, 25 bp, E. coli
ttctgcactcgatatgccgcaagcg

SEQ ID NO: 192594 - DNA, 25 bp, E. coli
ttctgcactcgaaatgccgcaagcg

SEQ ID NO: 192595 - DNA, 25 bp, E. coli
tgtatgccggacagcactggcctga

SEQ ID NO: 192596 - DNA, 25 bp, E. coli
tgtatgccggactgcactggcctga

SEQ ID NO: 192597 - DNA, 25 bp, E. coli
gaagaatactcgacgataaagcgcg

SEQ ID NO: 192598 - DNA, 25 bp, E. coli
gaagaatactcgtcgataaagcgcg

SEQ ID NO: 192599 - DNA, 25 bp, E. coli
cccgccgtgtatctgttgatcgacg

SEQ ID NO: 192600 - DNA, 25 bp, E. coli
cccgccgtgtatgtgttgatcgacg

SEQ ID NO: 192601 - DNA, 25 bp, E. coli
ctggtgaagttaccgccgaaggtct

SEQ ID NO: 192602 - DNA, 25 bp, E. coli
ctggtgaagttagcgccgaaggtct

SEQ ID NO: 192603 - DNA, 25 bp, E. coli
gtatggatttttaccaccggcgatg

SEQ ID NO: 192604 - DNA, 25 bp, E. coli
gtatggattttttccaccggcgatg

SEQ ID NO: 192605 - DNA, 25 bp, E. coli
tggcagtggacgacacaactcaatg

SEQ ID NO: 192606 - DNA, 25 bp, E. coli
ggcaaccactttaccatgacaggag

SEQ ID NO: 192607 - DNA, 25 bp, E. coli
tggcagtggacgtcacaactcaatg

SEQ ID NO: 192608 - DNA, 25 bp, E. coli
ggcaaccacttttccatgacaggag

SEQ ID NO: 192609 - DNA, 25 bp, E. coli
tcactttctggtggcgtgatcccca

SEQ ID NO: 192610 - DNA, 25 bp, E. coli
tcactttctggtcgcgtgatcccca

SEQ ID NO: 192611 - DNA, 25 bp, E. coli
ctacccgcaacagccgggtgtggtg

SEQ ID NO: 192612 - DNA, 25 bp, E. coli
ctacccgcaacacccgggtgtggtg

SEQ ID NO: 192613 - DNA, 25 bp, E. coli
ttgcttccagccctttgaacgttga

SEQ ID NO: 192614 - DNA, 25 bp, E. coli
ttgcttccagccgtttgaacgttga

SEQ ID NO: 192615 - DNA, 25 bp, E. coli
tgtggtgctgatcaaagtgccgaaa

SEQ ID NO: 192616 - DNA, 25 bp, E. coli
tgtggtgctgatgaaagtgccgaaa

SEQ ID NO: 192617 - DNA, 25 bp, E. coli
tggtctgacgctccttgataaaaac

SEQ ID NO: 192618 - DNA, 25 bp, E. coli
tgacgctgcttgttaaaaacccgca

SEQ ID NO: 192619 - DNA, 25 bp, E. coli
tgacgctgcttgataaaaacccgca

SEQ ID NO: 192620 - DNA, 25 bp, E. coli
tccagccgtttgaacgttgaaacca

SEQ ID NO: 192621 - DNA, 25 bp, E. coli
tccagccgtttgtacgttgaaacca

SEQ ID NO: 192622 - DNA, 25 bp, E. coli
tctgacgctgctagataaaaacccg

SEQ ID NO: 192623 - DNA, 25 bp, E. coli
tctgacgctgcttgataaaaacccg

SEQ ID NO: 192624 - DNA, 25 bp, E. coli
gccgtttgaacgttgaaaccaacat

SEQ ID NO: 192625 - DNA, 25 bp, E. coli
gccgtttgaacgatgaaaccaacat

SEQ ID NO: 192626 - DNA, 25 bp, E. coli
gaacgttgaaacgaacatgccagag

SEQ ID NO: 192627 - DNA, 25 bp, E. coli
gaacgttgaaaccaacatgccagag

SEQ ID NO: 192628 - DNA, 25 bp, E. coli
gtttgaacgttgaaaccaacatgcc

SEQ ID NO: 192629 - DNA, 25 bp, E. coli
gtttgaacgttgtaaccaacatgcc

SEQ ID NO: 192630 - DNA, 25 bp, E. coli
gttattggtctgacgctgcttgata

SEQ ID NO: 192631 - DNA, 25 bp, E. coli
gttattggtctgtcgctgcttgata

SEQ ID NO: 192632 - DNA, 25 bp, E. coli
tggtctgacgctgcttgataaaaac

SEQ ID NO: 192633 - DNA, 25 bp, E. coli
aatatgttcctgctgagagcgcccg

SEQ ID NO: 192634 - DNA, 25 bp, E. coli
aatatgttcctggtgagagcgcccg

SEQ ID NO: 192635 - DNA, 25 bp, E. coli
cacaacgtttgtactgcggcgaggg

SEQ ID NO: 192636 - DNA, 25 bp, E. coli
cacaacgtttgttctgcggcgaggg

SEQ ID NO: 192637 - DNA, 25 bp, E. coli
tacttcgcgctgcaacgttgctgcc

SEQ ID NO: 192638 - DNA, 25 bp, E. coli
tacttcgcgctggaacgttgctgcc

SEQ ID NO: 192639 - DNA, 25 bp, E. coli
tagcgagacagaccaagattcaccg

SEQ ID NO: 192640 - DNA, 25 bp, E. coli
tagcgagacagagcaagattcaccg

SEQ ID NO: 192641 - DNA, 25 bp, E. coli
ttagaggccattgtcacccggatgc

SEQ ID NO: 192642 - DNA, 25 bp, E. coli
ttagaggccattctcacccggatgc

SEQ ID NO: 192643 - DNA, 25 bp, E. coli
tgatgaagaaaaagatgctgccgct

SEQ ID NO: 192644 - DNA, 25 bp, E. coli
tgatgaagaaaatgatgctgccgct

SEQ ID NO: 192645 - DNA, 25 bp, E. coli
tccgaaacaagacatgctggcccgt

SEQ ID NO: 192646 - DNA, 25 bp, E. coli
tccgaaacaagagatgctggcccgt

SEQ ID NO: 192647 - DNA, 25 bp, E. coli
tcttcaagcgcatagcatgggcgtg

SEQ ID NO: 192648 - DNA, 25 bp, E. coli
tcttcaagcgcaaagcatgggcgtg

SEQ ID NO: 192649 - DNA, 25 bp, E. coli
gaagatgtcgatcagccaacacctg

SEQ ID NO: 192650 - DNA, 25 bp, E. coli
gaagatgtcgatgagccaacacctg

SEQ ID NO: 192651 - DNA, 25 bp, E. coli
ggtttaaagcattacgccaggccta

SEQ ID NO: 192652 - DNA, 25 bp, E. coli
ggtttaaagcataacgccaggccta

SEQ ID NO: 192653 - DNA, 25 bp, E. coli
gatgtcgatcaattacgctggccgc

SEQ ID NO: 192654 - DNA, 25 bp, E. coli
gatgtcgatcaaatacgctggccgc

SEQ ID NO: 192655 - DNA, 25 bp, E. coli
cacgtgaagcgaaggtttgccttgc

SEQ ID NO: 192656 - DNA, 25 bp, E. coli
cacgtgaagcgatggtttgccttgc

SEQ ID NO: 192657 - DNA, 25 bp, E. coli
ctacagggacgtggcttgccgacca

SEQ ID NO: 192658 - DNA, 25 bp, E. coli
ctacagggacgtcgcttgccgacca

SEQ ID NO: 192659 - DNA, 25 bp, E. coli
taacaatactttgtggcgacgtgcg

SEQ ID NO: 192660 - DNA, 25 bp, E. coli
tactttctggcgacgtgcgccagtg

SEQ ID NO: 192661 - DNA, 25 bp, E. coli
taacaatactttctggcgacgtgcg

SEQ ID NO: 192662 - DNA, 25 bp, E. coli
tactttctggcgtcgtgcgccagtg

SEQ ID NO: 192663 - DNA, 25 bp, E. coli
tgagctttcgttttcagcatctcac

SEQ ID NO: 192664 - DNA, 25 bp, E. coli
tgagctttcgttatcagcatctcac

SEQ ID NO: 192665 - DNA, 25 bp, E. coli
tgccttgctacacggacgtcgcttg

SEQ ID NO: 192666 - DNA, 25 bp, E. coli
tgcgccagtgcacaaggatgagctt

SEQ ID NO: 192667 - DNA, 25 bp, E. coli
tgccttgctacagggacgtcgcttg

SEQ ID NO: 192668 - DNA, 25 bp, E. coli
tgcgccagtgcagaaggatgagctt

SEQ ID NO: 192669 - DNA, 25 bp, E. coli
gcccggtgtcctcccggtgtcgcaa

SEQ ID NO: 192670 - DNA, 25 bp, E. coli
gcccggtgtcctgccggtgtcgcaa

SEQ ID NO: 192671 - DNA, 25 bp, E. coli
gaaggatgagctatcgttttcagca

SEQ ID NO: 192672 - DNA, 25 bp, E. coli
gaaggatgagctttcgttttcagca

SEQ ID NO: 192673 - DNA, 25 bp, E. coli
tcagcatctcacgtgaagcgatggt

SEQ ID NO: 192674 - DNA, 25 bp, E. coli
tcagcatctcacctgaagcgatggt

SEQ ID NO: 192675 - DNA, 25 bp, E. coli
gatggtttgcctagctacagggacg

SEQ ID NO: 192676 - DNA, 25 bp, E. coli
gatggtttgccttgctacagggacg

SEQ ID NO: 192677 - DNA, 25 bp, E. coli
cagcaaataaaacatagccccttaa

SEQ ID NO: 192678 - DNA, 25 bp, E. coli
cagcaaataaaagatagccccttaa

SEQ ID NO: 192679 - DNA, 25 bp, E. coli
caccgttacagcgacttacaaaatt

SEQ ID NO: 192680 - DNA, 25 bp, E. coli
aaattaagtcatacgctcactgacg

SEQ ID NO: 192681 - DNA, 25 bp, E. coli
caccgttacagccacttacaaaatt

SEQ ID NO: 192682 - DNA, 25 bp, E. coli
aaatattcctgtttcgttcttaacg

SEQ ID NO: 192683 - DNA, 25 bp, E. coli
aaattaagtcattcgctcactgacg

SEQ ID NO: 192684 - DNA, 25 bp, E. coli
aaatattcctgtatcgttcttaacg

SEQ ID NO: 192685 - DNA, 25 bp, E. coli
tttaacccgggcgagagaattctgg

SEQ ID NO: 192686 - DNA, 25 bp, E. coli
tttaacccgggccagagaattctgg

SEQ ID NO: 192687 - DNA, 25 bp, E. coli
tcgttcttaacgagcagtctgctta

SEQ ID NO: 192688 - DNA, 25 bp, E. coli
tcgttcttaacgtgcagtctgctta

SEQ ID NO: 192689 - DNA, 25 bp, E. coli
tctgctaatgggttatattcaccgt

SEQ ID NO: 192690 - DNA, 25 bp, E. coli
tctgctaatgggatatattcaccgt

SEQ ID NO: 192691 - DNA, 25 bp, E. coli
gctcactgacgcgaattaaatattc

SEQ ID NO: 192692 - DNA, 25 bp, E. coli
gctcactgacgccaattaaatattc

SEQ ID NO: 192693 - DNA, 25 bp, E. coli
gaattctggcctacttaatgactct

SEQ ID NO: 192694 - DNA, 25 bp, E. coli
gaattctggccttcttaatgactct

SEQ ID NO: 192695 - DNA, 25 bp, E. coli
cgagcagtctgcatatattcatata

SEQ ID NO: 192696 - DNA, 25 bp, E. coli
cgagcagtctgcttatattcatata

SEQ ID NO: 192697 - DNA, 25 bp, E. coli
gggttatattcagcgttacagcgac

SEQ ID NO: 192698 - DNA, 25 bp, E. coli
gggttatattcaccgttacagcgac

SEQ ID NO: 192699 - DNA, 25 bp, E. coli
aagcgattgaaaccgcgagcatgat

SEQ ID NO: 192700 - DNA, 25 bp, E. coli
aagcgattgaaagcgcgagcatgat

SEQ ID NO: 192701 - DNA, 25 bp, E. coli
gtactggacaaggtattaaaacgca

SEQ ID NO: 192702 - DNA, 25 bp, E. coli
gtactggacaagctattaaaacgca

SEQ ID NO: 192703 - DNA, 25 bp, E. coli
aacgcaagtgcataaaagcgattga

SEQ ID NO: 192704 - DNA, 25 bp, E. coli
aacgcaagtgcaaaaaagcgattga

SEQ ID NO: 192705 - DNA, 25 bp, E. coli
gcattttatcggaactggacaaggt

SEQ ID NO: 192706 - DNA, 25 bp, E. coli
gcattttatcggtactggacaaggt

SEQ ID NO: 192707 - DNA, 25 bp, E. coli
gacaaggtattaaaacgcaagtgca

SEQ ID NO: 192708 - DNA, 25 bp, E. coli
gacaaggtattataacgcaagtgca

SEQ ID NO: 192709 - DNA, 25 bp, E. coli
gaaaaagtgaaatgcttgtaatgtg

SEQ ID NO: 192710 - DNA, 25 bp, E. coli
gaaaaagtgaaaagcttgtaatgtg

SEQ ID NO: 192711 - DNA, 25 bp, E. coli
ccgcgagcatgaaaagaaaaagtga

SEQ ID NO: 192712 - DNA, 25 bp, E. coli
ccgcgagcatgataagaaaaagtga

SEQ ID NO: 192713 - DNA, 25 bp, E. coli
gtggacttatacatttcaagccgca

SEQ ID NO: 192714 - DNA, 25 bp, E. coli
gattgaaaccgcgagcatgataaga

SEQ ID NO: 192715 - DNA, 25 bp, E. coli
gtggacttatacttttcaagccgca

SEQ ID NO: 192716 - DNA, 25 bp, E. coli
gattgaaaccgccagcatgataaga

SEQ ID NO: 192717 - DNA, 25 bp, E. coli
ggtggaatataatgtggacttatac

SEQ ID NO: 192718 - DNA, 25 bp, E. coli
ggtggaatataaagtggacttatac

SEQ ID NO: 192719 - DNA, 25 bp, E. coli
tcaagccgcattatatcggtactgg

SEQ ID NO: 192720 - DNA, 25 bp, E. coli
tcaagccgcattttatcggtactgg

SEQ ID NO: 192721 - DNA, 25 bp, E. coli
tactggatgttttttctggtcaaca

SEQ ID NO: 192722 - DNA, 25 bp, E. coli
tactggatgtttattctggtcaaca

SEQ ID NO: 192723 - DNA, 25 bp, E. coli
acatcatctttaggttcgtgctggg

SEQ ID NO: 192724 - DNA, 25 bp, E. coli
acatcatctttacgttcgtgctggg

SEQ ID NO: 192725 - DNA, 25 bp, E. coli
tgaaagtactaataaattatgtcgg

SEQ ID NO: 192726 - DNA, 25 bp, E. coli
tgaaagtactaaaaaattatgtcgg

SEQ ID NO: 192727 - DNA, 25 bp, E. coli
tcggctggcttattatcatcgtctt

SEQ ID NO: 192728 - DNA, 25 bp, E. coli
tcatcgtctttaactgccaggcggg

SEQ ID NO: 192729 - DNA, 25 bp, E. coli
tcatcgtctttatctgccaggcggg

SEQ ID NO: 192730 - DNA, 25 bp, E. coli
tcggctggcttaatatcatcgtctt

SEQ ID NO: 192731 - DNA, 25 bp, E. coli
gcgtggtgggcactgctattcttaa

SEQ ID NO: 192732 - DNA, 25 bp, E. coli
gcgtggtgggcagtgctattcttaa

SEQ ID NO: 192733 - DNA, 25 bp, E. coli
ggtacgccaggccaaaaccgctttg

SEQ ID NO: 192734 - DNA, 25 bp, E. coli
ggtacgccaggcgaaaaccgctttg

SEQ ID NO: 192735 - DNA, 25 bp, E. coli
tggataaaatgtaaggctggcaacg

SEQ ID NO: 192736 - DNA, 25 bp, E. coli
tggataaaatgttaggctggcaacg

SEQ ID NO: 192737 - DNA, 25 bp, E. coli
tggcgaaggcatcctgacgacaatc

SEQ ID NO: 192738 - DNA, 25 bp, E. coli
tggactggtatcagaaagtactaaa

SEQ ID NO: 192739 - DNA, 25 bp, E. coli
tggcgaaggcatgctgacgacaatc

SEQ ID NO: 192740 - DNA, 25 bp, E. coli
tggactggtatctgaaagtactaaa

SEQ ID NO: 192741 - DNA, 25 bp, E. coli
gacgacaatctacggtattctggtg

SEQ ID NO: 192742 - DNA, 25 bp, E. coli
gacgacaatctagggtattctggtg

SEQ ID NO: 192743 - DNA, 25 bp, E. coli
aatgaattagaaccgtggacgcctg

SEQ ID NO: 192744 - DNA, 25 bp, E. coli
aatacacagaaagccattaatgcgg

SEQ ID NO: 192745 - DNA, 25 bp, E. coli
aatgaagctatgtgttatcacaacg

SEQ ID NO: 192746 - DNA, 25 bp, E. coli
aatacacagaaacccattaatgcgg

SEQ ID NO: 192747 - DNA, 25 bp, E. coli
aatgaagctatgagttatcacaacg

SEQ ID NO: 192748 - DNA, 25 bp, E. coli
aatgaattagaagcgtggacgcctg

SEQ ID NO: 192749 - DNA, 25 bp, E. coli
cccaaattattggtggagggaggtt

SEQ ID NO: 192750 - DNA, 25 bp, E. coli
cccaaattattgctggagggaggtt

SEQ ID NO: 192751 - DNA, 25 bp, E. coli
aaattactggcgttgagaatgcggc

SEQ ID NO: 192752 - DNA, 25 bp, E. coli
aaattactggcgatgagaatgcggc

SEQ ID NO: 192753 - DNA, 25 bp, E. coli
tgaaggagccgagccaaattattgc

SEQ ID NO: 192754 - DNA, 25 bp, E. coli
tgaaggagccgacccaaattattgc

SEQ ID NO: 192755 - DNA, 25 bp, E. coli
ccagttgatgctccaaatgaagcta

SEQ ID NO: 192756 - DNA, 25 bp, E. coli
ccagttgatgctgcaaatgaagcta

SEQ ID NO: 192757 - DNA, 25 bp, E. coli
ggaggttgatccagttgatgctgca

SEQ ID NO: 192758 - DNA, 25 bp, E. coli
ggaggttgatcctgttgatgctgca

SEQ ID NO: 192759 - DNA, 25 bp, E. coli
taacgagtgggctagaaaattctct

SEQ ID NO: 192760 - DNA, 25 bp, E. coli
taatgcggaaaattataacgagtgg

SEQ ID NO: 192761 - DNA, 25 bp, E. coli
taacgagtgggcaagaaaattctct

SEQ ID NO: 192762 - DNA, 25 bp, E. coli
taatgcggaaaaatataacgagtgg

SEQ ID NO: 192763 - DNA, 25 bp, E. coli
gagaatgcggcaaaaaatgaattag

SEQ ID NO: 192764 - DNA, 25 bp, E. coli
gagaatgcggcataaaatgaattag

SEQ ID NO: 192765 - DNA, 25 bp, E. coli
cagaggcgtttaatttgtccggcaa

SEQ ID NO: 192766 - DNA, 25 bp, E. coli
cagaggcgtttattttgtccggcaa

SEQ ID NO: 192767 - DNA, 25 bp, E. coli
tattatcgatgaaatcagcgggcta

SEQ ID NO: 192768 - DNA, 25 bp, E. coli
tattatcgatgatatcagcgggcta

SEQ ID NO: 192769 - DNA, 25 bp, E. coli
tatacctgataattcttcccgcggc

SEQ ID NO: 192770 - DNA, 25 bp, E. coli
tatacctgataaatcttcccgcggc

SEQ ID NO: 192771 - DNA, 25 bp, E. coli
tgctgctcgcaaaataaaaacgccc

SEQ ID NO: 192772 - DNA, 25 bp, E. coli
tgctgctcgcaatataaaaacgccc

SEQ ID NO: 192773 - DNA, 25 bp, E. coli
tccctgcaaagatgagactaacatt

SEQ ID NO: 192774 - DNA, 25 bp, E. coli
tccctgcaaagaagagactaacatt

SEQ ID NO: 192775 - DNA, 25 bp, E. coli
gcggcgttcacgattaaaatcagga

SEQ ID NO: 192776 - DNA, 25 bp, E. coli
gcgggctattttacgatgctgctca

SEQ ID NO: 192777 - DNA, 25 bp, E. coli
gcggcgttcacgtttaaaatcagga

SEQ ID NO: 192778 - DNA, 25 bp, E. coli
gcgggctatttttcgatgctgctca

SEQ ID NO: 192779 - DNA, 25 bp, E. coli
gaacctcgcgaatgcttaacgccag

SEQ ID NO: 192780 - DNA, 25 bp, E. coli
gaacctcgcgaaagcttaacgccag

SEQ ID NO: 192781 - DNA, 25 bp, E. coli
cgctggcctcagcttgatagaaata

SEQ ID NO: 192782 - DNA, 25 bp, E. coli
cgctggcctcaggttgatagaaata

SEQ ID NO: 192783 - DNA, 25 bp, E. coli
gatatacacatgtcttgcctccctg

SEQ ID NO: 192784 - DNA, 25 bp, E. coli
gatatacacatgacttgcctccctg

SEQ ID NO: 192785 - DNA, 25 bp, E. coli
tgtttgggttcgtacgctggcctca

SEQ ID NO: 192786 - DNA, 25 bp, E. coli
tgtttgggttcgaacgctggcctca

SEQ ID NO: 192787 - DNA, 25 bp, E. coli
cagaatcaaaacgttttccgctgca

SEQ ID NO: 192788 - DNA, 25 bp, E. coli
cgattcacgtttaggtgcgaagtct

SEQ ID NO: 192789 - DNA, 25 bp, E. coli
cgattcacgttttggtgcgaagtct

SEQ ID NO: 192790 - DNA, 25 bp, E. coli
cagaatcaaaaccttttccgctgca

SEQ ID NO: 192791 - DNA, 25 bp, E. coli
tatccattaacaaaaactggatcga

SEQ ID NO: 192792 - DNA, 25 bp, E. coli
tatcgcagaatcaaaacgttttccg

SEQ ID NO: 192793 - DNA, 25 bp, E. coli
tatccattaacataaactggatcga

SEQ ID NO: 192794 - DNA, 25 bp, E. coli
tatcgcagaatctaaacgttttccg

SEQ ID NO: 192795 - DNA, 25 bp, E. coli
tccactatcgcacaatcaaaacgtt

SEQ ID NO: 192796 - DNA, 25 bp, E. coli
tccactatcgcagaatcaaaacgtt

SEQ ID NO: 192797 - DNA, 25 bp, E. coli
gaagtctatttccactatcgcagaa

SEQ ID NO: 192798 - DNA, 25 bp, E. coli
gaagtctatttcgactatcgcagaa

SEQ ID NO: 192799 - DNA, 25 bp, E. coli
taagaagcaagttacggatttaagg

SEQ ID NO: 192800 - DNA, 25 bp, E. coli
taagaagcaagtaacggatttaagg

SEQ ID NO: 192801 - DNA, 25 bp, E. coli
cgttttggtgcgaagtctatttcca

SEQ ID NO: 192802 - DNA, 25 bp, E. coli
cgttttggtgcgtagtctatttcca

SEQ ID NO: 192803 - DNA, 25 bp, E. coli
gatttaaggtcgcaactactcgatt

SEQ ID NO: 192804 - DNA, 25 bp, E. coli
gatttaaggtcggaactactcgatt

SEQ ID NO: 192805 - DNA, 25 bp, E. coli
ggatttatccattaacaaaaactgg

SEQ ID NO: 192806 - DNA, 25 bp, E. coli
ggatttatccataaacaaaaactgg

SEQ ID NO: 192807 - DNA, 25 bp, E. coli
tggataagaagcaagtaacggattt

SEQ ID NO: 192808 - DNA, 25 bp, E. coli
tggataagaagctagtaacggattt

SEQ ID NO: 192809 - DNA, 25 bp, E. coli
aagggcgctgctcgaacatctgatc

SEQ ID NO: 192810 - DNA, 25 bp, E. coli
caaccagggcgagcgttatctcaac

SEQ ID NO: 192811 - DNA, 25 bp, E. coli
aagggcgctgctggaacatctgatc

SEQ ID NO: 192812 - DNA, 25 bp, E. coli
caaccagggcgaccgttatctcaac

SEQ ID NO: 192813 - DNA, 25 bp, E. coli
caaaatggcggcctttgcgattacg

SEQ ID NO: 192814 - DNA, 25 bp, E. coli
caaaatggcggcgtttgcgattacg

SEQ ID NO: 192815 - DNA, 25 bp, E. coli
actatcagcgtctgggattgggaag

SEQ ID NO: 192816 - DNA, 25 bp, E. coli
actatcagcgtcagggattgggaag

SEQ ID NO: 192817 - DNA, 25 bp, E. coli
ttgcggtcgatcctgactatcagcg

SEQ ID NO: 192818 - DNA, 25 bp, E. coli
ttgcggtcgatcgtgactatcagcg

SEQ ID NO: 192819 - DNA, 25 bp, E. coli
taggctttaacgaggcgacgattcg

SEQ ID NO: 192820 - DNA, 25 bp, E. coli
tgcgattacgcaagtggtgctggat

SEQ ID NO: 192821 - DNA, 25 bp, E. coli
taggctttaacgtggcgacgattcg

SEQ ID NO: 192822 - DNA, 25 bp, E. coli
tgcgattacgcatgtggtgctggat

SEQ ID NO: 192823 - DNA, 25 bp, E. coli
gccattgccctgtacgaaagtttag

SEQ ID NO: 192824 - DNA, 25 bp, E. coli
gccattgccctgaacgaaagtttag

SEQ ID NO: 192825 - DNA, 25 bp, E. coli
gaacatctgatcgacgaactggaaa

SEQ ID NO: 192826 - DNA, 25 bp, E. coli
gaacatctgatccacgaactggaaa

SEQ ID NO: 192827 - DNA, 25 bp, E. coli
gttaacgcaaaagggcaaaatggcg

SEQ ID NO: 192828 - DNA, 25 bp, E. coli
gttaacgcaaaacggcaaaatggcg

SEQ ID NO: 192829 - DNA, 25 bp, E. coli
ggcttaccacattgaacaacgcgcc

SEQ ID NO: 192830 - DNA, 25 bp, E. coli
ggcttaccacatagaacaacgcgcc

SEQ ID NO: 192831 - DNA, 25 bp, E. coli
aagtctttcaccttgtgcagtggca

SEQ ID NO: 192832 - DNA, 25 bp, E. coli
aagtctttcaccatgtgcagtggca

SEQ ID NO: 192833 - DNA, 25 bp, E. coli
caaattccaccacgattcagagggt

SEQ ID NO: 192834 - DNA, 25 bp, E. coli
caaattccaccaggattcagagggt

SEQ ID NO: 192835 - DNA, 25 bp, E. coli
catgtatccggactggcaacccgat

SEQ ID NO: 192836 - DNA, 25 bp, E. coli
catgtatccggagtggcaacccgat

SEQ ID NO: 192837 - DNA, 25 bp, E. coli
tgtcttccagagatttgaccccgga

SEQ ID NO: 192838 - DNA, 25 bp, E. coli
tgtcttccagagttttgaccccgga

SEQ ID NO: 192839 - DNA, 25 bp, E. coli
tgcagtggcaacaaaaactggcgcg

SEQ ID NO: 192840 - DNA, 25 bp, E. coli
tgcagtggcaactaaaactggcgcg

SEQ ID NO: 192841 - DNA, 25 bp, E. coli
tcgttggtattgacgccctggtaca

SEQ ID NO: 192842 - DNA, 25 bp, E. coli
tcgttggtattgtcgccctggtaca

SEQ ID NO: 192843 - DNA, 25 bp, E. coli
gcggactgccgatacgagatgtgaa

SEQ ID NO: 192844 - DNA, 25 bp, E. coli
gcggactgccgaaacgagatgtgaa

SEQ ID NO: 192845 - DNA, 25 bp, E. coli
gcagcctgcaaatcggtcgtgccag

SEQ ID NO: 192846 - DNA, 25 bp, E. coli
gcagcctgcaaaacggtcgtgccag

SEQ ID NO: 192847 - DNA, 25 bp, E. coli
gacgatcaactctatcaggaaccgc

SEQ ID NO: 192848 - DNA, 25 bp, E. coli
gacgatcaactcaatcaggaaccgc

SEQ ID NO: 192849 - DNA, 25 bp, E. coli
cattcattgcctactggcaggcgga

SEQ ID NO: 192850 - DNA, 25 bp, E. coli
cattcattgccttctggcaggcgga

SEQ ID NO: 192851 - DNA, 25 bp, E. coli
ggtacacgatcagcaaaccgttctg

SEQ ID NO: 192852 - DNA, 25 bp, E. coli
ggtacacgatcaccaaaccgttctg

SEQ ID NO: 192853 - DNA, 25 bp, E. coli
cacggtctggaaccgcaagtgcctt

SEQ ID NO: 192854 - DNA, 25 bp, E. coli
cacggtctggaagcgcaagtgcctt

SEQ ID NO: 192855 - DNA, 25 bp, E. coli
caggcgcagtggtggaaacaactca

SEQ ID NO: 192856 - DNA, 25 bp, E. coli
caggcgcagtggaggaaacaactca

SEQ ID NO: 192857 - DNA, 25 bp, E. coli
tatgcaggccagctatcagatgctc

SEQ ID NO: 192858 - DNA, 25 bp, E. coli
tatgcaggccaggtatcagatgctc

SEQ ID NO: 192859 - DNA, 25 bp, E. coli
ttcatcccgggtgtgaaattgccgc

SEQ ID NO: 192860 - DNA, 25 bp, E. coli
ttcatcccgggtctgaaattgccgc

SEQ ID NO: 192861 - DNA, 25 bp, E. coli
tccaacggacgctaagtggttcaca

SEQ ID NO: 192862 - DNA, 25 bp, E. coli
tccaacggacgcaaagtggttcaca

SEQ ID NO: 192863 - DNA, 25 bp, E. coli
tcattactgatgctggacagccgcc

SEQ ID NO: 192864 - DNA, 25 bp, E. coli
tcattactgatggtggacagccgcc

SEQ ID NO: 192865 - DNA, 25 bp, E. coli
tcttatgagttgctcgccagacgcc

SEQ ID NO: 192866 - DNA, 25 bp, E. coli
tcttatgagttggtcgccagacgcc

SEQ ID NO: 192867 - DNA, 25 bp, E. coli
gcgccgccagcaacatgatgattga

SEQ ID NO: 192868 - DNA, 25 bp, E. coli
gcgccgccagcatcatgatgattga

SEQ ID NO: 192869 - DNA, 25 bp, E. coli
cattagatcaggaggattccgcgcg

SEQ ID NO: 192870 - DNA, 25 bp, E. coli
cattagatcaggtggattccgcgcg

SEQ ID NO: 192871 - DNA, 25 bp, E. coli
ggttcacaattagaggtcgcagcgt

SEQ ID NO: 192872 - DNA, 25 bp, E. coli
ggttcacaattacaggtcgcagcgt

SEQ ID NO: 192873 - DNA, 25 bp, E. coli
tggcagaaaccgcagcagtagagct

SEQ ID NO: 192874 - DNA, 25 bp, E. coli
tggcagaaaccggagcagtagagct

SEQ ID NO: 192875 - DNA, 25 bp, E. coli
cacacctaaaatgctatttctgcga

SEQ ID NO: 192876 - DNA, 25 bp, E. coli
cacggagttttttgtcaaatatgaa

SEQ ID NO: 192877 - DNA, 25 bp, E. coli
caaatatgaattactccagatacgt

SEQ ID NO: 192878 - DNA, 25 bp, E. coli
caaatatgaatttctccagatacgt

SEQ ID NO: 192879 - DNA, 25 bp, E. coli
cacacctaaaatcctatttctgcga

SEQ ID NO: 192880 - DNA, 25 bp, E. coli
cacggagtttttagtcaaatatgaa

SEQ ID NO: 192881 - DNA, 25 bp, E. coli
caggaatcacggtgttttttgtcaa

SEQ ID NO: 192882 - DNA, 25 bp, E. coli
caggaatcacggagttttttgtcaa

SEQ ID NO: 192883 - DNA, 25 bp, E. coli
tatttctgcgataatagcaaccgtt

SEQ ID NO: 192884 - DNA, 25 bp, E. coli
tatttctgcgattatagcaaccgtt

SEQ ID NO: 192885 - DNA, 25 bp, E. coli
tccagatacgtaaatctatgagcct

SEQ ID NO: 192886 - DNA, 25 bp, E. coli
tccagatacgtatatctatgagcct

SEQ ID NO: 192887 - DNA, 25 bp, E. coli
tctatgagccttgtcgcggttaaca

SEQ ID NO: 192888 - DNA, 25 bp, E. coli
tctatgagccttctcgcggttaaca

SEQ ID NO: 192889 - DNA, 25 bp, E. coli
gcaaccgtttcgagacaggaatcac

SEQ ID NO: 192890 - DNA, 25 bp, E. coli
gcaaccgtttcgtgacaggaatcac

SEQ ID NO: 192891 - DNA, 25 bp, E. coli
gagaacattttccacacctaaaatg

SEQ ID NO: 192892 - DNA, 25 bp, E. coli
gagaacattttcgacacctaaaatg

SEQ ID NO: 192893 - DNA, 25 bp, E. coli
cgtaaatctatgtgccttgtcgcgg

SEQ ID NO: 192894 - DNA, 25 bp, E. coli
cgtaaatctatgagccttgtcgcgg

SEQ ID NO: 192895 - DNA, 25 bp, E. coli
taatagcaaccgattcgtgacagga

SEQ ID NO: 192896 - DNA, 25 bp, E. coli
taatagcaaccgtttcgtgacagga

SEQ ID NO: 192897 - DNA, 25 bp, E. coli
aacggtcaatcatatcaaggcgctg

SEQ ID NO: 192898 - DNA, 25 bp, E. coli
aacggtcaatcaaatcaaggcgctg

SEQ ID NO: 192899 - DNA, 25 bp, E. coli
ttacgttgggaatgtgccgattggc

SEQ ID NO: 192900 - DNA, 25 bp, E. coli
ttacgttgggaaagtgccgattggc

SEQ ID NO: 192901 - DNA, 25 bp, E. coli
ttatcggctgcgaggtgaatggccc

SEQ ID NO: 192902 - DNA, 25 bp, E. coli
ttatcggctgcgtggtgaatggccc

SEQ ID NO: 192903 - DNA, 25 bp, E. coli
tgtctgaaggcaacggcgacacgct

SEQ ID NO: 192904 - DNA, 25 bp, E. coli
tgtctgaaggcatcggcgacacgct

SEQ ID NO: 192905 - DNA, 25 bp, E. coli
tgaggcgctggtatctacactcggc

SEQ ID NO: 192906 - DNA, 25 bp, E. coli
tgaaagtagcggaatacggcgtcga

SEQ ID NO: 192907 - DNA, 25 bp, E. coli
tgaggcgctggtttctacactcggc

SEQ ID NO: 192908 - DNA, 25 bp, E. coli
tgaaagtagcggtatacggcgtcga

SEQ ID NO: 192909 - DNA, 25 bp, E. coli
tctgcaagaaaactatggcgaaccg

SEQ ID NO: 192910 - DNA, 25 bp, E. coli
tctgcaagaaaagtatggcgaaccg

SEQ ID NO: 192911 - DNA, 25 bp, E. coli
gcattcgtgcgaaagccagtcagct

SEQ ID NO: 192912 - DNA, 25 bp, E. coli
gcattcgtgcgatagccagtcagct

SEQ ID NO: 192913 - DNA, 25 bp, E. coli
gattgtctgcgttttaaccctggca

SEQ ID NO: 192914 - DNA, 25 bp, E. coli
gattgtctgcgtattaaccctggca

SEQ ID NO: 192915 - DNA, 25 bp, E. coli
tcaaacagcaggataacgtgccgct

SEQ ID NO: 192916 - DNA, 25 bp, E. coli
taaccaggctccaattcaacgtaga

SEQ ID NO: 192917 - DNA, 25 bp, E. coli
taaccaggctcctattcaacgtaga

SEQ ID NO: 192918 - DNA, 25 bp, E. coli
tcaaacagcaggttaacgtgccgct

SEQ ID NO: 192919 - DNA, 25 bp, E. coli
cagatgtatcagttaggcggtgagc

SEQ ID NO: 192920 - DNA, 25 bp, E. coli
cagatgtatcagataggcggtgagc

SEQ ID NO: 192921 - DNA, 25 bp, E. coli
aaatctcgccgtcgatgggactggc

SEQ ID NO: 192922 - DNA, 25 bp, E. coli
aaatctcgccgtggatgggactggc

SEQ ID NO: 192923 - DNA, 25 bp, E. coli
tgtttggcgtcgaagctgcggcaca

SEQ ID NO: 192924 - DNA, 25 bp, E. coli
tgtttggcgtcgtagctgcggcaca

SEQ ID NO: 192925 - DNA, 25 bp, E. coli
gcggtgagccgtatatgcaacaaca

SEQ ID NO: 192926 - DNA, 25 bp, E. coli
gcggtgagccgtttatgcaacaaca

SEQ ID NO: 192927 - DNA, 25 bp, E. coli
gacggtttacctgaatatcgccgaa

SEQ ID NO: 192928 - DNA, 25 bp, E. coli
gacggtttacctcaatatcgccgaa

SEQ ID NO: 192929 - DNA, 25 bp, E. coli
ctctttttatgggatgggcgtagct

SEQ ID NO: 192930 - DNA, 25 bp, E. coli
cgtcaggcgtggattttacggcaga

SEQ ID NO: 192931 - DNA, 25 bp, E. coli
ctctttttatggcatgggcgtagct

SEQ ID NO: 192932 - DNA, 25 bp, E. coli
cgtcaggcgtggtttttacggcaga

SEQ ID NO: 192933 - DNA, 25 bp, E. coli
gttatttccacaaacccgcgagcaa

SEQ ID NO: 192934 - DNA, 25 bp, E. coli
gttatttccacatacccgcgagcaa

SEQ ID NO: 192935 - DNA, 25 bp, E. coli
gggtcagtatggttcaaatctcgcc

SEQ ID NO: 192936 - DNA, 25 bp, E. coli
gggtcagtatggatcaaatctcgcc

SEQ ID NO: 192937 - DNA, 25 bp, E. coli
gagcaaaaagcgtatcctgacggtt

SEQ ID NO: 192938 - DNA, 25 bp, E. coli
gagcaaaaagcgaatcctgacggtt

SEQ ID NO: 192939 - DNA, 25 bp, E. coli
gagcgcaatgaataccgtattcgcg

SEQ ID NO: 192940 - DNA, 25 bp, E. coli
gagcgcaatgaaaaccgtattcgcg

SEQ ID NO: 192941 - DNA, 25 bp, E. coli
caggtgatattgtcgatcgcttcca

SEQ ID NO: 192942 - DNA, 25 bp, E. coli
caggtgatattgacgatcgcttcca

SEQ ID NO: 192943 - DNA, 25 bp, E. coli
taaaaatcgtaatgagaacagcggt

SEQ ID NO: 192944 - DNA, 25 bp, E. coli
taaaaatcgtaaagagaacagcggt

SEQ ID NO: 192945 - DNA, 25 bp, E. coli
tatgtaagaacgaaccgcggttggc

SEQ ID NO: 192946 - DNA, 25 bp, E. coli
tatgtaagaacgtaccgcggttggc

SEQ ID NO: 192947 - DNA, 25 bp, E. coli
tatggtgtgcatatgagaaagccca

SEQ ID NO: 192948 - DNA, 25 bp, E. coli
tagcaggctgccagatacctttccg

SEQ ID NO: 192949 - DNA, 25 bp, E. coli
tagcaggctgcctgatacctttccg

SEQ ID NO: 192950 - DNA, 25 bp, E. coli
tatggtgtgcatttgagaaagccca

SEQ ID NO: 192951 - DNA, 25 bp, E. coli
tgagaaagcccaacgttacaggtga

SEQ ID NO: 192952 - DNA, 25 bp, E. coli
tgagaaagcccatcgttacaggtga

SEQ ID NO: 192953 - DNA, 25 bp, E. coli
tgatttccagccgttaccgatttta

SEQ ID NO: 192954 - DNA, 25 bp, E. coli
tgatttccagcccttaccgatttta

SEQ ID NO: 192955 - DNA, 25 bp, E. coli
gaacagcggtacttcgtatgtaaga

SEQ ID NO: 192956 - DNA, 25 bp, E. coli
gaacagcggtacatcgtatgtaaga

SEQ ID NO: 192957 - DNA, 25 bp, E. coli
gattaaaccactggttagcaggctg

SEQ ID NO: 192958 - DNA, 25 bp, E. coli
gtgtctcctgaacactatggtgtgc

SEQ ID NO: 192959 - DNA, 25 bp, E. coli
gattaaaccactcgttagcaggctg

SEQ ID NO: 192960 - DNA, 25 bp, E. coli
gtgtctcctgaagactatggtgtgc

SEQ ID NO: 192961 - DNA, 25 bp, E. coli
tggaattcttccctcgaccgatgga

SEQ ID NO: 192962 - DNA, 25 bp, E. coli
tggaattcttccgtcgaccgatgga

SEQ ID NO: 192963 - DNA, 25 bp, E. coli
tacaaaattaaaacattagagaatg

SEQ ID NO: 192964 - DNA, 25 bp, E. coli
tacaaaattaaatcattagagaatg

SEQ ID NO: 192965 - DNA, 25 bp, E. coli
taatttaatcggaggctttctcttt

SEQ ID NO: 192966 - DNA, 25 bp, E. coli
taatttaatcggtggctttctcttt

SEQ ID NO: 192967 - DNA, 25 bp, E. coli
tcttttttatttcttttggcaggtg

SEQ ID NO: 192968 - DNA, 25 bp, E. coli
tcttttttatttgttttggcaggtg

SEQ ID NO: 192969 - DNA, 25 bp, E. coli
gcgaaataatttaatcggaggcttt

SEQ ID NO: 192970 - DNA, 25 bp, E. coli
gcgaaataattttatcggaggcttt

SEQ ID NO: 192971 - DNA, 25 bp, E. coli
gcaggtgattaaatttttaacagca

SEQ ID NO: 192972 - DNA, 25 bp, E. coli
gcaggtgattaattttttaacagca

SEQ ID NO: 192973 - DNA, 25 bp, E. coli
gaatgatagtgatttattccgccct

SEQ ID NO: 192974 - DNA, 25 bp, E. coli
gaatgatagtgaattattccgccct

SEQ ID NO: 192975 - DNA, 25 bp, E. coli
cattagagaatgtaaaatgtccagc

SEQ ID NO: 192976 - DNA, 25 bp, E. coli
cattagagaatgaaaaatgtccagc

SEQ ID NO: 192977 - DNA, 25 bp, E. coli
ggaaccagtgtaccgaaataattta

SEQ ID NO: 192978 - DNA, 25 bp, E. coli
ggaaccagtgtagcgaaataattta

SEQ ID NO: 192979 - DNA, 25 bp, E. coli
taacccgtgtaaatcacaaaagtgg

SEQ ID NO: 192980 - DNA, 25 bp, E. coli
tcacaaaagtggaaccagtgtagcg

SEQ ID NO: 192981 - DNA, 25 bp, E. coli
tcacaaaagtggtaccagtgtagcg

SEQ ID NO: 192982 - DNA, 25 bp, E. coli
taacccgtgtaattcacaaaagtgg

SEQ ID NO: 192983 - DNA, 25 bp, E. coli
gagaatgaaaaaagtccagcataat

SEQ ID NO: 192984 - DNA, 25 bp, E. coli
gagaatgaaaaatgtccagcataat

SEQ ID NO: 192985 - DNA, 25 bp, E. coli
aattccagcccgatgtattcaagag

SEQ ID NO: 192986 - DNA, 25 bp, E. coli
aattccagcccgttgtattcaagag

SEQ ID NO: 192987 - DNA, 25 bp, E. coli
tagtggaacgctacatttgcgagac

SEQ ID NO: 192988 - DNA, 25 bp, E. coli
tacgccagatagttaaggcagagcc

SEQ ID NO: 192989 - DNA, 25 bp, E. coli
tacgccagatagataaggcagagcc

SEQ ID NO: 192990 - DNA, 25 bp, E. coli
tagtggaacgcttcatttgcgagac

SEQ ID NO: 192991 - DNA, 25 bp, E. coli
tattcagatgatggtcaacggcttg

SEQ ID NO: 192992 - DNA, 25 bp, E. coli
tattcagatgatcgtcaacggcttg

SEQ ID NO: 192993 - DNA, 25 bp, E. coli
ttaagtctgctttccaaccacgtcg

SEQ ID NO: 192994 - DNA, 25 bp, E. coli
ttaagtctgcttaccaaccacgtcg

SEQ ID NO: 192995 - DNA, 25 bp, E. coli
tgtcagtacgccagcagatttccga

SEQ ID NO: 192996 - DNA, 25 bp, E. coli
tgtcagtacgcctgcagatttccga

SEQ ID NO: 192997 - DNA, 25 bp, E. coli
tgtagatactcctggacacatggat

SEQ ID NO: 192998 - DNA, 25 bp, E. coli
tgtagatactccaggacacatggat

SEQ ID NO: 192999 - DNA, 25 bp, E. coli
tctgcaaaagatggagtacagtcac

SEQ ID NO: 193000 - DNA, 25 bp, E. coli
tctgcaaaagatcgagtacagtcac

SEQ ID NO: 193001 - DNA, 25 bp, E. coli
gaaagcttactatacagtagcggag

SEQ ID NO: 193002 - DNA, 25 bp, E. coli
gaaagcttactaaacagtagcggag

SEQ ID NO: 193003 - DNA, 25 bp, E. coli
gatactatgtttttggaacgccaga

SEQ ID NO: 193004 - DNA, 25 bp, E. coli
gatactatgtttatggaacgccaga

SEQ ID NO: 193005 - DNA, 25 bp, E. coli
gatttccgaatgcttgcgcctattg

SEQ ID NO: 193006 - DNA, 25 bp, E. coli
gatttccgaatggttgcgcctattg

SEQ ID NO: 193007 - DNA, 25 bp, E. coli
cacgccatattttgtcgcacgggat

SEQ ID NO: 193008 - DNA, 25 bp, E. coli
cacgccatatttagtcgcacgggat

SEQ ID NO: 193009 - DNA, 25 bp, E. coli
actggtggaccaggaaaactgtctc

SEQ ID NO: 193010 - DNA, 25 bp, E. coli
agttaggtcacctttaccgcttcgg

SEQ ID NO: 193011 - DNA, 25 bp, E. coli
agttaggtcaccattaccgcttcgg

SEQ ID NO: 193012 - DNA, 25 bp, E. coli
actggtggaccacgaaaactgtctc

SEQ ID NO: 193013 - DNA, 25 bp, E. coli
tttctgccgacggttcacagcgacg

SEQ ID NO: 193014 - DNA, 25 bp, E. coli
tttctgccgacgcttcacagcgacg

SEQ ID NO: 193015 - DNA, 25 bp, E. coli
tgaggacattccgtgcgccaaagtg

SEQ ID NO: 193016 - DNA, 25 bp, E. coli
tgaggacattccctgcgccaaagtg

SEQ ID NO: 193017 - DNA, 25 bp, E. coli
tgcgtgctggaagaaccggcaatca

SEQ ID NO: 193018 - DNA, 25 bp, E. coli
tgcgtgctggaacaaccggcaatca

SEQ ID NO: 193019 - DNA, 25 bp, E. coli
ccagtgcctgtgtgcgttgcggtca

SEQ ID NO: 193020 - DNA, 25 bp, E. coli
ccagtgcctgtgagcgttgcggtca

SEQ ID NO: 193021 - DNA, 25 bp, E. coli
gacaccttaaaactggcgacgctgg

SEQ ID NO: 193022 - DNA, 25 bp, E. coli
gacaccttaaaagtggcgacgctgg

SEQ ID NO: 193023 - DNA, 25 bp, E. coli
ggtcagcgaaacgtcaaaatggtcg

SEQ ID NO: 193024 - DNA, 25 bp, E. coli
ggtcagcgaaacctcaaaatggtcg

SEQ ID NO: 193025 - DNA, 25 bp, E. coli
ggagccataaacgagaacgcctttg

SEQ ID NO: 193026 - DNA, 25 bp, E. coli
ggagccataaaccagaacgcctttg

SEQ ID NO: 193027 - DNA, 25 bp, E. coli
gatgtttgttatggcgaatgcccga

SEQ ID NO: 193028 - DNA, 25 bp, E. coli
gatgtttgttatcgcgaatgcccga

SEQ ID NO: 193029 - DNA, 25 bp, E. coli
ataccactgagcctccggaagcggt

SEQ ID NO: 193030 - DNA, 25 bp, E. coli
ataccactgagcgtccggaagcggt

SEQ ID NO: 193031 - DNA, 25 bp, E. coli
tgtctggctgatgaaccacgcctgg

SEQ ID NO: 193032 - DNA, 25 bp, E. coli
tgtctggctgatcaaccacgcctgg

SEQ ID NO: 193033 - DNA, 25 bp, E. coli
tgactgtatttgctacgcgcccgga

SEQ ID NO: 193034 - DNA, 25 bp, E. coli
tgactgtatttggtacgcgcccgga

SEQ ID NO: 193035 - DNA, 25 bp, E. coli
tgccgagttcaaaccagacgtcgtg

SEQ ID NO: 193036 - DNA, 25 bp, E. coli
tgccgagttcaatccagacgtcgtg

SEQ ID NO: 193037 - DNA, 25 bp, E. coli
tctattcgccgtcgccggaagaggc

SEQ ID NO: 193038 - DNA, 25 bp, E. coli
tctattcgccgtggccggaagaggc

SEQ ID NO: 193039 - DNA, 25 bp, E. coli
cgactcaggcgggattcaggaagaa

SEQ ID NO: 193040 - DNA, 25 bp, E. coli
cgaattgtcgaggaagtgacgcgtc

SEQ ID NO: 193041 - DNA, 25 bp, E. coli
cgaattgtcgagcaagtgacgcgtc

SEQ ID NO: 193042 - DNA, 25 bp, E. coli
cgactcaggcggcattcaggaagaa

SEQ ID NO: 193043 - DNA, 25 bp, E. coli
cgtcactgcgcaccatcgggagatg

SEQ ID NO: 193044 - DNA, 25 bp, E. coli
cgtcactgcgcagcatcgggagatg

SEQ ID NO: 193045 - DNA, 25 bp, E. coli
ggcgctcgccgcatattcgaagaga

SEQ ID NO: 193046 - DNA, 25 bp, E. coli
ggcgctcgccgcttattcgaagaga

SEQ ID NO: 193047 - DNA, 25 bp, E. coli
taacccgtatggtgatggtcaggca

SEQ ID NO: 193048 - DNA, 25 bp, E. coli
tcaacataatgcagccaggacaggg

SEQ ID NO: 193049 - DNA, 25 bp, E. coli
taacccgtatggagatggtcaggca

SEQ ID NO: 193050 - DNA, 25 bp, E. coli
tcaacataatgctgccaggacaggg

SEQ ID NO: 193051 - DNA, 25 bp, E. coli
aatagtgcatcatcactctggcagg

SEQ ID NO: 193052 - DNA, 25 bp, E. coli
aatagtgcatcaacactctggcagg

SEQ ID NO: 193053 - DNA, 25 bp, E. coli
tgccgcaggtcactttcgccgatct

SEQ ID NO: 193054 - DNA, 25 bp, E. coli
tgccgcaggtcagtttcgccgatct

SEQ ID NO: 193055 - DNA, 25 bp, E. coli
gcgcttcagttcacgacgggcgaat

SEQ ID NO: 193056 - DNA, 25 bp, E. coli
gctgacacgggacgagttgcaaaaa

SEQ ID NO: 193057 - DNA, 25 bp, E. coli
gctgacacgggaggagttgcaaaaa

SEQ ID NO: 193058 - DNA, 25 bp, E. coli
gcgcttcagttctcgacgggcgaat

SEQ ID NO: 193059 - DNA, 25 bp, E. coli
gaaagtgatgcctcggtaatggcgc

SEQ ID NO: 193060 - DNA, 25 bp, E. coli
gaaagtgatgccacggtaatggcgc

SEQ ID NO: 193061 - DNA, 25 bp, E. coli
cgcaaattatgaccgtcgtgccgca

SEQ ID NO: 193062 - DNA, 25 bp, E. coli
cgcaaattatgagcgtcgtgccgca

SEQ ID NO: 193063 - DNA, 25 bp, E. coli
cgactgaagcgcgtgcacaaggttt

SEQ ID NO: 193064 - DNA, 25 bp, E. coli
cgactgaagcgcctgcacaaggttt

SEQ ID NO: 193065 - DNA, 25 bp, E. coli
gatttgatcggcataacgcttcccg

SEQ ID NO: 193066 - DNA, 25 bp, E. coli
gatttgatcggcttaacgcttcccg

SEQ ID NO: 193067 - DNA, 25 bp, E. coli
ggtattaaaggctccggcgaatgca

SEQ ID NO: 193068 - DNA, 25 bp, E. coli
ggtattaaaggcaccggcgaatgca

SEQ ID NO: 193069 - DNA, 25 bp, E. coli
gatggtggcaattcgcacagctgtg

SEQ ID NO: 193070 - DNA, 25 bp, E. coli
gatggtggcaatacgcacagctgtg

SEQ ID NO: 193071 - DNA, 25 bp, E. coli
gatgcttgaacaaccgcttcctgcg

SEQ ID NO: 193072 - DNA, 25 bp, E. coli
gatgcttgaacatccgcttcctgcg

SEQ ID NO: 193073 - DNA, 25 bp, E. coli
taaaacaatgtgtttacattgcggc

SEQ ID NO: 193074 - DNA, 25 bp, E. coli
taaaacaatgtgattacattgcggc

SEQ ID NO: 193075 - DNA, 25 bp, E. coli
tagatgcgataaatagttaatactc

SEQ ID NO: 193076 - DNA, 25 bp, E. coli
tagatgcgataattagttaatactc

SEQ ID NO: 193077 - DNA, 25 bp, E. coli
tttgtttccaagagatacagactct

SEQ ID NO: 193078 - DNA, 25 bp, E. coli
tttgtttccaagtgatacagactct

SEQ ID NO: 193079 - DNA, 25 bp, E. coli
tttggcaacctgattttaattgcat

SEQ ID NO: 193080 - DNA, 25 bp, E. coli
tttggcaacctgtttttaattgcat

SEQ ID NO: 193081 - DNA, 25 bp, E. coli
tctacattaattcatagatgcgata

SEQ ID NO: 193082 - DNA, 25 bp, E. coli
tctacattaattgatagatgcgata

SEQ ID NO: 193083 - DNA, 25 bp, E. coli
gcggcaacttttatgatgtgagaaa

SEQ ID NO: 193084 - DNA, 25 bp, E. coli
gcggcaacttttttgatgtgagaaa

SEQ ID NO: 193085 - DNA, 25 bp, E. coli
cattgcggcaacttttttgatgtga

SEQ ID NO: 193086 - DNA, 25 bp, E. coli
cattgcggcaacatttttgatgtga

SEQ ID NO: 193087 - DNA, 25 bp, E. coli
gatatcaacaattccatttacataa

SEQ ID NO: 193088 - DNA, 25 bp, E. coli
gatatcaacaataccatttacataa

SEQ ID NO: 193089 - DNA, 25 bp, E. coli
gatacagactcttaacaaccaaaaa

SEQ ID NO: 193090 - DNA, 25 bp, E. coli
gatacagactctaaacaaccaaaaa

SEQ ID NO: 193091 - DNA, 25 bp, E. coli
taattgcatttacaaagccgaaatc

SEQ ID NO: 193092 - DNA, 25 bp, E. coli
taattgcatttagaaagccgaaatc

SEQ ID NO: 193093 - DNA, 25 bp, E. coli
gatgtgagaaatatgtttccaagag

SEQ ID NO: 193094 - DNA, 25 bp, E. coli
gatgtgagaaatttgtttccaagag

SEQ ID NO: 193095 - DNA, 25 bp, E. coli
caatgatgtctaaggtgcacagcaa

SEQ ID NO: 193096 - DNA, 25 bp, E. coli
caatgatgtctatggtgcacagcaa

SEQ ID NO: 193097 - DNA, 25 bp, E. coli
cacgcttatatcttgttgaacctga

SEQ ID NO: 193098 - DNA, 25 bp, E. coli
cactggcgcaagtcattcgttcgaa

SEQ ID NO: 193099 - DNA, 25 bp, E. coli
cacgcttatatcatgttgaacctga

SEQ ID NO: 193100 - DNA, 25 bp, E. coli
cactggcgcaagacattcgttcgaa

SEQ ID NO: 193101 - DNA, 25 bp, E. coli
aacagtcaattgactcactggcgca

SEQ ID NO: 193102 - DNA, 25 bp, E. coli
aacagtcaattgtctcactggcgca

SEQ ID NO: 193103 - DNA, 25 bp, E. coli
tatgagcgagtttaatcatcagggc

SEQ ID NO: 193104 - DNA, 25 bp, E. coli
tatgagcgagttaaatcatcagggc

SEQ ID NO: 193105 - DNA, 25 bp, E. coli
tatctccgggaaagtaggtgacaat

SEQ ID NO: 193106 - DNA, 25 bp, E. coli
tatctccgggaatgtaggtgacaat

SEQ ID NO: 193107 - DNA, 25 bp, E. coli
tggtttgatcctactaacgcagtaa

SEQ ID NO: 193108 - DNA, 25 bp, E. coli
tcatcagggcaattaaccccagaac

SEQ ID NO: 193109 - DNA, 25 bp, E. coli
tcatcagggcaaataaccccagaac

SEQ ID NO: 193110 - DNA, 25 bp, E. coli
gcagtaaaaatcgtcatgccacgag

SEQ ID NO: 193111 - DNA, 25 bp, E. coli
gcagtaaaaatcctcatgccacgag

SEQ ID NO: 193112 - DNA, 25 bp, E. coli
gaaaaatgccggtccttacgaactg

SEQ ID NO: 193113 - DNA, 25 bp, E. coli
gaaaaatgccggaccttacgaactg

SEQ ID NO: 193114 - DNA, 25 bp, E. coli
ccccagaactgattgcacgcttata

SEQ ID NO: 193115 - DNA, 25 bp, E. coli
ccccagaactgaatgcacgcttata

SEQ ID NO: 193116 - DNA, 25 bp, E. coli
tggtttgatccttctaacgcagtaa

SEQ ID NO: 193117 - DNA, 25 bp, E. coli
aatatgttgcgtatgtactgatggg

SEQ ID NO: 193118 - DNA, 25 bp, E. coli
aatatgttgcgtttgtactgatggg

SEQ ID NO: 193119 - DNA, 25 bp, E. coli
caccggcgtttagtgtgcctgaatc

SEQ ID NO: 193120 - DNA, 25 bp, E. coli
caccggcgtttactgtgcctgaatc

SEQ ID NO: 193121 - DNA, 25 bp, E. coli
cagaacatgcgataaagatggattc

SEQ ID NO: 193122 - DNA, 25 bp, E. coli
cagaacatgcgaaaaagatggattc

SEQ ID NO: 193123 - DNA, 25 bp, E. coli
agccagtaatgatgaaaccgctccg

SEQ ID NO: 193124 - DNA, 25 bp, E. coli
agccagtaatgaagaaaccgctccg

SEQ ID NO: 193125 - DNA, 25 bp, E. coli
tattagctatgtgccacgcacggaa

SEQ ID NO: 193126 - DNA, 25 bp, E. coli
tattagctatgtcccacgcacggaa

SEQ ID NO: 193127 - DNA, 25 bp, E. coli
tgatgtctggatgctgcgtggcaaa

SEQ ID NO: 193128 - DNA, 25 bp, E. coli
tgatgtctggatcctgcgtggcaaa

SEQ ID NO: 193129 - DNA, 25 bp, E. coli
tgctgcgtggcaaatatgttgcgtt

SEQ ID NO: 193130 - DNA, 25 bp, E. coli
tgcgtttagtgaagccagtaatgaa

SEQ ID NO: 193131 - DNA, 25 bp, E. coli
tgcgtttagtgatgccagtaatgaa

SEQ ID NO: 193132 - DNA, 25 bp, E. coli
tgctgcgtggcatatatgttgcgtt

SEQ ID NO: 193133 - DNA, 25 bp, E. coli
gcaaaaccgccacattattagctat

SEQ ID NO: 193134 - DNA, 25 bp, E. coli
gcaaaaccgccagattattagctat

SEQ ID NO: 193135 - DNA, 25 bp, E. coli
gtcatttctgcgctcaccggcgttt

SEQ ID NO: 193136 - DNA, 25 bp, E. coli
gtcatttctgcggtcaccggcgttt

SEQ ID NO: 193137 - DNA, 25 bp, E. coli
gatggattcgtttcgtgatgtctgg

SEQ ID NO: 193138 - DNA, 25 bp, E. coli
gatggattcgttacgtgatgtctgg

SEQ ID NO: 193139 - DNA, 25 bp, E. coli
caatccgcgtttcttgttgcttgat

SEQ ID NO: 193140 - DNA, 25 bp, E. coli
caaccaggcgctgaagctcgctgat

SEQ ID NO: 193141 - DNA, 25 bp, E. coli
caatccgcgtttgttgttgcttgat

SEQ ID NO: 193142 - DNA, 25 bp, E. coli
caaccaggcgctcaagctcgctgat

SEQ ID NO: 193143 - DNA, 25 bp, E. coli
cttttttgccgatcgtgatcagttt

SEQ ID NO: 193144 - DNA, 25 bp, E. coli
cttttttgccgaacgtgatcagttt

SEQ ID NO: 193145 - DNA, 25 bp, E. coli
tttccacgtcttgatgagcgtcgtg

SEQ ID NO: 193146 - DNA, 25 bp, E. coli
tttccacgtcttcatgagcgtcgtg

SEQ ID NO: 193147 - DNA, 25 bp, E. coli
tcatgagcgtcgtgttcagcgggca

SEQ ID NO: 193148 - DNA, 25 bp, E. coli
tcgtgttcagcgggcaggcaccatg

SEQ ID NO: 193149 - DNA, 25 bp, E. coli
tcgtgttcagcgcgcaggcaccatg

SEQ ID NO: 193150 - DNA, 25 bp, E. coli
tcatgagcgtcgagttcagcgggca

SEQ ID NO: 193151 - DNA, 25 bp, E. coli
gaagctcgctgatcgcggctacgtg

SEQ ID NO: 193152 - DNA, 25 bp, E. coli
gaagctcgctgaacgcggctacgtg

SEQ ID NO: 193153 - DNA, 25 bp, E. coli
gaacgtgatcagattcaggagcgca

SEQ ID NO: 193154 - DNA, 25 bp, E. coli
gaacgtgatcagtttcaggagcgca

SEQ ID NO: 193155 - DNA, 25 bp, E. coli
cgctgaagctcggtgatcgcggcta

SEQ ID NO: 193156 - DNA, 25 bp, E. coli
cgctgaagctcgctgatcgcggcta

SEQ ID NO: 193157 - DNA, 25 bp, E. coli
ctgatgagcaatgcgcgtttgttgt

SEQ ID NO: 193158 - DNA, 25 bp, E. coli
cgtttgttgttggttgatgagccat

SEQ ID NO: 193159 - DNA, 25 bp, E. coli
cgtttgttgttgcttgatgagccat

SEQ ID NO: 193160 - DNA, 25 bp, E. coli
ctgatgagcaatccgcgtttgttgt

SEQ ID NO: 193161 - DNA, 25 bp, E. coli
caattgcccgagcaatgtgacgaga

SEQ ID NO: 193162 - DNA, 25 bp, E. coli
caagcagattctaagcaaggagggc

SEQ ID NO: 193163 - DNA, 25 bp, E. coli
caagcagattcttagcaaggagggc

SEQ ID NO: 193164 - DNA, 25 bp, E. coli
caattgcccgaggaatgtgacgaga

SEQ ID NO: 193165 - DNA, 25 bp, E. coli
cagtggcagcattgacgaaaccttc

SEQ ID NO: 193166 - DNA, 25 bp, E. coli
cagtggcagcatagacgaaaccttc

SEQ ID NO: 193167 - DNA, 25 bp, E. coli
tatcgccaagcagtccatccaaggt

SEQ ID NO: 193168 - DNA, 25 bp, E. coli
tatcgccaagcactccatccaaggt

SEQ ID NO: 193169 - DNA, 25 bp, E. coli
ttcgtgaaggaagtggccaaactgc

SEQ ID NO: 193170 - DNA, 25 bp, E. coli
ttttgaccaattgcgccaggaactg

SEQ ID NO: 193171 - DNA, 25 bp, E. coli
ttcgtgaaggaactggccaaactgc

SEQ ID NO: 193172 - DNA, 25 bp, E. coli
ttattacggtggcagtgacgacgct

SEQ ID NO: 193173 - DNA, 25 bp, E. coli
ttttgaccaattccgccaggaactg

SEQ ID NO: 193174 - DNA, 25 bp, E. coli
ttattacggtgggagtgacgacgct

SEQ ID NO: 193175 - DNA, 25 bp, E. coli
tgcaccgattgctaagacgctccgt

SEQ ID NO: 193176 - DNA, 25 bp, E. coli
tgcaccgattgcaaagacgctccgt

SEQ ID NO: 193177 - DNA, 25 bp, E. coli
tccaaaaggtgaagccacaggtgtc

SEQ ID NO: 193178 - DNA, 25 bp, E. coli
tccaaaaggtgatgccacaggtgtc

SEQ ID NO: 193179 - DNA, 25 bp, E. coli
tctgattcgattctagaagggccgc

SEQ ID NO: 193180 - DNA, 25 bp, E. coli
tctgattcgattgtagaagggccgc

SEQ ID NO: 193181 - DNA, 25 bp, E. coli
ggagataatctcgacgcgctgaagc

SEQ ID NO: 193182 - DNA, 25 bp, E. coli
ggagataatctccacgcgctgaagc

SEQ ID NO: 193183 - DNA, 25 bp, E. coli
caaaagctgcaggacggtaactgga

SEQ ID NO: 193184 - DNA, 25 bp, E. coli
caaaagctgcagcacggtaactgga

SEQ ID NO: 193185 - DNA, 25 bp, E. coli
catgaaatatctcgtggcagccgcc

SEQ ID NO: 193186 - DNA, 25 bp, E. coli
catgaaatatctggtggcagccgcc

SEQ ID NO: 193187 - DNA, 25 bp, E. coli
tacatgcgtggcctgaccaatatgg

SEQ ID NO: 193188 - DNA, 25 bp, E. coli
tacatgcgtggcgtgaccaatatgg

SEQ ID NO: 193189 - DNA, 25 bp, E. coli
taccgtcagatgcagatgaatgcgc

SEQ ID NO: 193190 - DNA, 25 bp, E. coli
taccgtcagatggagatgaatgcgc

SEQ ID NO: 193191 - DNA, 25 bp, E. coli
tttggtccgtatacgcagcaggtgc

SEQ ID NO: 193192 - DNA, 25 bp, E. coli
tttggtccgtattcgcagcaggtgc

SEQ ID NO: 193193 - DNA, 25 bp, E. coli
tgacttttccaaactggtgcgcggc

SEQ ID NO: 193194 - DNA, 25 bp, E. coli
tgacttttccaatctggtgcgcggc

SEQ ID NO: 193195 - DNA, 25 bp, E. coli
ccaatatggcgctggatgacagtgc

SEQ ID NO: 193196 - DNA, 25 bp, E. coli
ccaatatggcgcaggatgacagtgc

SEQ ID NO: 193197 - DNA, 25 bp, E. coli
gaaatatgaatagtccgtggccgag

SEQ ID NO: 193198 - DNA, 25 bp, E. coli
gaaatatgaatactccgtggccgag

SEQ ID NO: 193199 - DNA, 25 bp, E. coli
gatcctcaacatccacgagctgcgt

SEQ ID NO: 193200 - DNA, 25 bp, E. coli
ggtattcctgaaagatcgtctggcg

SEQ ID NO: 193201 - DNA, 25 bp, E. coli
ggtattcctgaatgatcgtctggcg

SEQ ID NO: 193202 - DNA, 25 bp, E. coli
taaccgcgtagatggcatgttgcgc

SEQ ID NO: 193203 - DNA, 25 bp, E. coli
taaccgcgtagaaggcatgttgcgc

SEQ ID NO: 193204 - DNA, 25 bp, E. coli
gatcctcaacatgcacgagctgcgt

SEQ ID NO: 193205 - DNA, 25 bp, E. coli
caaaactggattagcggaatgacga

SEQ ID NO: 193206 - DNA, 25 bp, E. coli
caaaactggatttgcggaatgacga

SEQ ID NO: 193207 - DNA, 25 bp, E. coli
taaagtgaaattaatttctgtgggc

SEQ ID NO: 193208 - DNA, 25 bp, E. coli
taaagtgaaatttatttctgtgggc

SEQ ID NO: 193209 - DNA, 25 bp, E. coli
ttgcggaatgaccaacgaagcagtc

SEQ ID NO: 193210 - DNA, 25 bp, E. coli
ttgcggaatgacgaacgaagcagtc

SEQ ID NO: 193211 - DNA, 25 bp, E. coli
tgacgaacgaagcagtcgcctgact

SEQ ID NO: 193212 - DNA, 25 bp, E. coli
tgacgaacgaaggagtcgcctgact

SEQ ID NO: 193213 - DNA, 25 bp, E. coli
gaagcgtctctcgtcaaaactggat

SEQ ID NO: 193214 - DNA, 25 bp, E. coli
gaagcgtctctcctcaaaactggat

SEQ ID NO: 193215 - DNA, 25 bp, E. coli
gaaacgaagcgtctctcctcaaaac

SEQ ID NO: 193216 - DNA, 25 bp, E. coli
gactgcttcgttcattaaagtgaaa

SEQ ID NO: 193217 - DNA, 25 bp, E. coli
gaaacgaagcgtgtctcctcaaaac

SEQ ID NO: 193218 - DNA, 25 bp, E. coli
gactgcttcgttgattaaagtgaaa

SEQ ID NO: 193219 - DNA, 25 bp, E. coli
gtcgcctgactgcttcgttcattaa

SEQ ID NO: 193220 - DNA, 25 bp, E. coli
gtcgcctgactggttcgttcattaa

SEQ ID NO: 193221 - DNA, 25 bp, E. coli
tggttatcttgatacgaagcgtctc

SEQ ID NO: 193222 - DNA, 25 bp, E. coli
tggttatcttgaaacgaagcgtctc

SEQ ID NO: 193223 - DNA, 25 bp, E. coli
gacccgctggttttcttgaaacgaa

SEQ ID NO: 193224 - DNA, 25 bp, E. coli
gagtggacccgctggttatcttgaa

SEQ ID NO: 193225 - DNA, 25 bp, E. coli
gacccgctggttatcttgaaacgaa

SEQ ID NO: 193226 - DNA, 25 bp, E. coli
gagtggacccgcaggttatcttgaa

SEQ ID NO: 193227 - DNA, 25 bp, E. coli
aagttctattagctggtgtgccgcg

SEQ ID NO: 193228 - DNA, 25 bp, E. coli
aagttctattaggtggtgtgccgcg

SEQ ID NO: 193229 - DNA, 25 bp, E. coli
cagatgcgtggagaagttctattag

SEQ ID NO: 193230 - DNA, 25 bp, E. coli
cagatgcgtggacaagttctattag

SEQ ID NO: 193231 - DNA, 25 bp, E. coli
agatgcgtggagtagttctattagc

SEQ ID NO: 193232 - DNA, 25 bp, E. coli
agaagttctatttgctggtgtgccg

SEQ ID NO: 193233 - DNA, 25 bp, E. coli
agttctattagctggtgtgccgcgc

SEQ ID NO: 193234 - DNA, 25 bp, E. coli
agaagttctattagctggtgtgccg

SEQ ID NO: 193235 - DNA, 25 bp, E. coli
agatgcgtggagaagttctattagc

SEQ ID NO: 193236 - DNA, 25 bp, E. coli
agttctattagcaggtgtgccgcgc

SEQ ID NO: 193237 - DNA, 25 bp, E. coli
tgcgtggagaagatctattagctgg

SEQ ID NO: 193238 - DNA, 25 bp, E. coli
tgcgtggagaagttctattagctgg

SEQ ID NO: 193239 - DNA, 25 bp, E. coli
gcgtggagaagtactattagctggt

SEQ ID NO: 193240 - DNA, 25 bp, E. coli
gcgtggagaagttctattagctggt

SEQ ID NO: 193241 - DNA, 25 bp, E. coli
gcagatgcgtggagaagttctatta

SEQ ID NO: 193242 - DNA, 25 bp, E. coli
gaagttctattagctggtgtgccgc

SEQ ID NO: 193243 - DNA, 25 bp, E. coli
gcagatgcgtggtgaagttctatta

SEQ ID NO: 193244 - DNA, 25 bp, E. coli
gaagttctattacctggtgtgccgc

SEQ ID NO: 193245 - DNA, 25 bp, E. coli
tggagaagttcttttagctggtgtg

SEQ ID NO: 193246 - DNA, 25 bp, E. coli
tggagaagttctattagctggtgtg

SEQ ID NO: 193247 - DNA, 25 bp, E. coli
gagaagttctattagctggtgtgcc

SEQ ID NO: 193248 - DNA, 25 bp, E. coli
gagaagttctataagctggtgtgcc

SEQ ID NO: 193249 - DNA, 25 bp, E. coli
cagcggcgggcaatatcaactttgt

SEQ ID NO: 193250 - DNA, 25 bp, E. coli
cagcggcgggcattatcaactttgt

SEQ ID NO: 193251 - DNA, 25 bp, E. coli
taacagcggcatctacagttgcgga

SEQ ID NO: 193252 - DNA, 25 bp, E. coli
tactgccggtgaagcgaagaatccg

SEQ ID NO: 193253 - DNA, 25 bp, E. coli
tactgccggtgatgcgaagaatccg

SEQ ID NO: 193254 - DNA, 25 bp, E. coli
tattgtggtggcgtcctaccagggc

SEQ ID NO: 193255 - DNA, 25 bp, E. coli
tattgtggtggcctcctaccagggc

SEQ ID NO: 193256 - DNA, 25 bp, E. coli
ttagcaatctcagagagcatggcgg

SEQ ID NO: 193257 - DNA, 25 bp, E. coli
ttagcaatctcacagagcatggcgg

SEQ ID NO: 193258 - DNA, 25 bp, E. coli
tgttggcctataacatcgccgggct

SEQ ID NO: 193259 - DNA, 25 bp, E. coli
tgttggcctatatcatcgccgggct

SEQ ID NO: 193260 - DNA, 25 bp, E. coli
gacatatcgaacacatcgccctggg

SEQ ID NO: 193261 - DNA, 25 bp, E. coli
gacatatcgaactcatcgccctggg

SEQ ID NO: 193262 - DNA, 25 bp, E. coli
cccgtggaatgatataggcagcaac

SEQ ID NO: 193263 - DNA, 25 bp, E. coli
cccgtggaatgaaataggcagcaac

SEQ ID NO: 193264 - DNA, 25 bp, E. coli
gataacaaaccagagctacagcgtg

SEQ ID NO: 193265 - DNA, 25 bp, E. coli
gataacaaaccacagctacagcgtg

SEQ ID NO: 193266 - DNA, 25 bp, E. coli
tggcgaaagtttcccgtcacggcgt

SEQ ID NO: 193267 - DNA, 25 bp, E. coli
tggcgaaagtttgccgtcacggcgt

SEQ ID NO: 193268 - DNA, 25 bp, E. coli
taacagcggcatgtacagttgcgga

SEQ ID NO: 193269 - DNA, 25 bp, E. coli
gagatggcgcagtggatacccgcat

SEQ ID NO: 193270 - DNA, 25 bp, E. coli
gagatggcgcagaggatacccgcat

SEQ ID NO: 193271 - DNA, 25 bp, E. coli
cgatttaacttctgaatatgatgca

SEQ ID NO: 193272 - DNA, 25 bp, E. coli
aattggccgcgatattacctttagc

SEQ ID NO: 193273 - DNA, 25 bp, E. coli
cgatttaacttcagaatatgatgca

SEQ ID NO: 193274 - DNA, 25 bp, E. coli
aattggccgcgaaattacctttagc

SEQ ID NO: 193275 - DNA, 25 bp, E. coli
acgaagatgggcctttaactgcggt

SEQ ID NO: 193276 - DNA, 25 bp, E. coli
acgaagatgggcgtttaactgcggt

SEQ ID NO: 193277 - DNA, 25 bp, E. coli
tgaatatgatgctgttttcatcggc

SEQ ID NO: 193278 - DNA, 25 bp, E. coli
tgaatatgatgcagttttcatcggc

SEQ ID NO: 193279 - DNA, 25 bp, E. coli
tgcgcccggtgtgattcaggctcta

SEQ ID NO: 193280 - DNA, 25 bp, E. coli
tgcgcccggtgtcattcaggctcta

SEQ ID NO: 193281 - DNA, 25 bp, E. coli
cgcaatgggaatcgactttcatctt

SEQ ID NO: 193282 - DNA, 25 bp, E. coli
ccggtgtcattcaggctctaccgtt

SEQ ID NO: 193283 - DNA, 25 bp, E. coli
cgcttgtgacgaagatgggcgttta

SEQ ID NO: 193284 - DNA, 25 bp, E. coli
cgcaatgggaatggactttcatctt

SEQ ID NO: 193285 - DNA, 25 bp, E. coli
cgcttgtgacgatgatgggcgttta

SEQ ID NO: 193286 - DNA, 25 bp, E. coli
cgcgatattaccattagcgatttaa

SEQ ID NO: 193287 - DNA, 25 bp, E. coli
ccggtgtcattctggctctaccgtt

SEQ ID NO: 193288 - DNA, 25 bp, E. coli
cgcgatattacctttagcgatttaa

SEQ ID NO: 193289 - DNA, 25 bp, E. coli
ctttcatcttaagtgtgaaattggc

SEQ ID NO: 193290 - DNA, 25 bp, E. coli
ctttcatcttaactgtgaaattggc

SEQ ID NO: 193291 - DNA, 25 bp, E. coli
ggaatcgactttcatcttaactgtg

SEQ ID NO: 193292 - DNA, 25 bp, E. coli
ggaatcgactttgatcttaactgtg

SEQ ID NO: 193293 - DNA, 25 bp, E. coli
cagcttccggcgctggtagctcatg

SEQ ID NO: 193294 - DNA, 25 bp, E. coli
cagcttccggcggtggtagctcatg

SEQ ID NO: 193295 - DNA, 25 bp, E. coli
tttgccgctgggctcgtggtctcca

SEQ ID NO: 193296 - DNA, 25 bp, E. coli
tttgccgctggggtcgtggtctcca

SEQ ID NO: 193297 - DNA, 25 bp, E. coli
ttttatgaagcacgccgtcaacaaa

SEQ ID NO: 193298 - DNA, 25 bp, E. coli
ttttatgaagcaggccgtcaacaaa

SEQ ID NO: 193299 - DNA, 25 bp, E. coli
tgaagcacgccgtcaacaaatgatg

SEQ ID NO: 193300 - DNA, 25 bp, E. coli
tgaagcacgccgacaacaaatgatg

SEQ ID NO: 193301 - DNA, 25 bp, E. coli
gcgtttttatgatgcacgccgtcaa

SEQ ID NO: 193302 - DNA, 25 bp, E. coli
gcttccggcgctcgtagctcatgcg

SEQ ID NO: 193303 - DNA, 25 bp, E. coli
gcgtttttatgaagcacgccgtcaa

SEQ ID NO: 193304 - DNA, 25 bp, E. coli
gcttccggcgctggtagctcatgcg

SEQ ID NO: 193305 - DNA, 25 bp, E. coli
gctggcagcggtctggggcggccat

SEQ ID NO: 193306 - DNA, 25 bp, E. coli
cgctggtagctcttgcgggcgtgct

SEQ ID NO: 193307 - DNA, 25 bp, E. coli
cgctggtagctcatgcgggcgtgct

SEQ ID NO: 193308 - DNA, 25 bp, E. coli
gctggcagcggtgtggggcggccat

SEQ ID NO: 193309 - DNA, 25 bp, E. coli
cttccggcgctgctagctcatgcgg

SEQ ID NO: 193310 - DNA, 25 bp, E. coli
cttccggcgctggtagctcatgcgg

SEQ ID NO: 193311 - DNA, 25 bp, E. coli
gtttttatgaagcacgccgtcaaca

SEQ ID NO: 193312 - DNA, 25 bp, E. coli
gtttttatgaaggacgccgtcaaca

SEQ ID NO: 193313 - DNA, 25 bp, E. coli
tggggtcgtggtctccagcgtcagc

SEQ ID NO: 193314 - DNA, 25 bp, E. coli
tggggtcgtggtgtccagcgtcagc

SEQ ID NO: 193315 - DNA, 25 bp, E. coli
cacgcgcaacgttaccgatgatgga

SEQ ID NO: 193316 - DNA, 25 bp, E. coli
cacgcgcaacgtaaccgatgatgga

SEQ ID NO: 193317 - DNA, 25 bp, E. coli
taacaccactgaggctattcggaca

SEQ ID NO: 193318 - DNA, 25 bp, E. coli
taacactagcgttgagatgacgagt

SEQ ID NO: 193319 - DNA, 25 bp, E. coli
taacaccactgacgctattcggaca

SEQ ID NO: 193320 - DNA, 25 bp, E. coli
tattcggacaggtttaacactagcg

SEQ ID NO: 193321 - DNA, 25 bp, E. coli
tatcatacctgtcattcaatgccgt

SEQ ID NO: 193322 - DNA, 25 bp, E. coli
tatcatacctgtgattcaatgccgt

SEQ ID NO: 193323 - DNA, 25 bp, E. coli
tattcggacaggattaacactagcg

SEQ ID NO: 193324 - DNA, 25 bp, E. coli
tgacgagtacgttagtctctgaccg

SEQ ID NO: 193325 - DNA, 25 bp, E. coli
tgacgagtacgtaagtctctgaccg

SEQ ID NO: 193326 - DNA, 25 bp, E. coli
tctgaccgtttgtcacgcgcaacgt

SEQ ID NO: 193327 - DNA, 25 bp, E. coli
tctgaccgtttgacacgcgcaacgt

SEQ ID NO: 193328 - DNA, 25 bp, E. coli
ccggctgcggtctattgtgggacat

SEQ ID NO: 193329 - DNA, 25 bp, E. coli
ccggctgcggtcaattgtgggacat

SEQ ID NO: 193330 - DNA, 25 bp, E. coli
cgatgatggaactataaaatcaacg

SEQ ID NO: 193331 - DNA, 25 bp, E. coli
cgatgatggaacaataaaatcaacg

SEQ ID NO: 193332 - DNA, 25 bp, E. coli
gtgggacatcgcctataatttgcat

SEQ ID NO: 193333 - DNA, 25 bp, E. coli
gtgggacatcgcgtataatttgcat

SEQ ID NO: 193334 - DNA, 25 bp, E. coli
taacactagcgtagagatgacgagt

SEQ ID NO: 193335 - DNA, 25 bp, E. coli
tcaatgccgtgcctaacaccactga

SEQ ID NO: 193336 - DNA, 25 bp, E. coli
tcaatgccgtgcgtaacaccactga

SEQ ID NO: 193337 - DNA, 25 bp, E. coli
cagccttttttgattgcggcgtaac

SEQ ID NO: 193338 - DNA, 25 bp, E. coli
cagccttttttgtttgcggcgtaac

SEQ ID NO: 193339 - DNA, 25 bp, E. coli
tatatccgcatgatttgtcagggaa

SEQ ID NO: 193340 - DNA, 25 bp, E. coli
tatatccgcatgttttgtcagggaa

SEQ ID NO: 193341 - DNA, 25 bp, E. coli
tcagggaaatggaattgaaaaagcc

SEQ ID NO: 193342 - DNA, 25 bp, E. coli
tcagggaaatggtattgaaaaagcc

SEQ ID NO: 193343 - DNA, 25 bp, E. coli
gcggcgtaacgataatgcaaacgat

SEQ ID NO: 193344 - DNA, 25 bp, E. coli
gcggcgtaacgaaaatgcaaacgat

SEQ ID NO: 193345 - DNA, 25 bp, E. coli
gcaggtgatcatcccagaaagccgg

SEQ ID NO: 193346 - DNA, 25 bp, E. coli
gcaggtgatcatgccagaaagccgg

SEQ ID NO: 193347 - DNA, 25 bp, E. coli
gaacagcctctgatttgtcagcctt

SEQ ID NO: 193348 - DNA, 25 bp, E. coli
gaaagccggaactgcctctgatttg

SEQ ID NO: 193349 - DNA, 25 bp, E. coli
gaaagccggaacagcctctgatttg

SEQ ID NO: 193350 - DNA, 25 bp, E. coli
gaacagcctctgttttgtcagcctt

SEQ ID NO: 193351 - DNA, 25 bp, E. coli
ctctcggttgagtgggcttagcaag

SEQ ID NO: 193352 - DNA, 25 bp, E. coli
ctctcggttgagagggcttagcaag

SEQ ID NO: 193353 - DNA, 25 bp, E. coli
ggaattgaaaaagccctctcggttg

SEQ ID NO: 193354 - DNA, 25 bp, E. coli
ggacttatttttaatgcaggtgatc

SEQ ID NO: 193355 - DNA, 25 bp, E. coli
ggcagcatcgcgctggacttatttt

SEQ ID NO: 193356 - DNA, 25 bp, E. coli
ggacttattttttatgcaggtgatc

SEQ ID NO: 193357 - DNA, 25 bp, E. coli
ggaattgaaaaacccctctcggttg

SEQ ID NO: 193358 - DNA, 25 bp, E. coli
ggcagcatcgcggtggacttatttt

SEQ ID NO: 193359 - DNA, 25 bp, E. coli
catgcacaatcaggagctttttcgg

SEQ ID NO: 193360 - DNA, 25 bp, E. coli
catgcacaatcacgagctttttcgg

SEQ ID NO: 193361 - DNA, 25 bp, E. coli
taaactcaggatcgaaaggcgctca

SEQ ID NO: 193362 - DNA, 25 bp, E. coli
taaaccgacagacaagacttattgc

SEQ ID NO: 193363 - DNA, 25 bp, E. coli
taaaccgacagagaagacttattgc

SEQ ID NO: 193364 - DNA, 25 bp, E. coli
taaactcaggatggaaaggcgctca

SEQ ID NO: 193365 - DNA, 25 bp, E. coli
ttttgttccagaccccgacagggtg

SEQ ID NO: 193366 - DNA, 25 bp, E. coli
ttttgttccagagcccgacagggtg

SEQ ID NO: 193367 - DNA, 25 bp, E. coli
tgaaagtaatatgcgcccagcaggc

SEQ ID NO: 193368 - DNA, 25 bp, E. coli
tgaaagtaatatccgcccagcaggc

SEQ ID NO: 193369 - DNA, 25 bp, E. coli
tctccttagatgacaaaagaacggc

SEQ ID NO: 193370 - DNA, 25 bp, E. coli
tctccttagatgtcaaaagaacggc

SEQ ID NO: 193371 - DNA, 25 bp, E. coli
gaaaaaacggcacgatgcactggaa

SEQ ID NO: 193372 - DNA, 25 bp, E. coli
gaaaaaacggcaggatgcactggaa

SEQ ID NO: 193373 - DNA, 25 bp, E. coli
ccttcatatcgtccaagagggaaag

SEQ ID NO: 193374 - DNA, 25 bp, E. coli
ccgacagggtgataactattgagct

SEQ ID NO: 193375 - DNA, 25 bp, E. coli
ccttcatatcgtgcaagagggaaag

SEQ ID NO: 193376 - DNA, 25 bp, E. coli
ccgacagggtgaaaactattgagct

SEQ ID NO: 193377 - DNA, 25 bp, E. coli
taatcgttgcatagtctgtcgcgcc

SEQ ID NO: 193378 - DNA, 25 bp, E. coli
taatcgttgcattgtctgtcgcgcc

SEQ ID NO: 193379 - DNA, 25 bp, E. coli
gatgtctggcgagtcattaaaccga

SEQ ID NO: 193380 - DNA, 25 bp, E. coli
gatgtctggcgactcattaaaccga

SEQ ID NO: 193381 - DNA, 25 bp, E. coli
actgccgccgctgaaaatgtgtatt

SEQ ID NO: 193382 - DNA, 25 bp, E. coli
agagggcattcttaccgggtcgcac

SEQ ID NO: 193383 - DNA, 25 bp, E. coli
agagggcattctaaccgggtcgcac

SEQ ID NO: 193384 - DNA, 25 bp, E. coli
actgccgccgctcaaaatgtgtatt

SEQ ID NO: 193385 - DNA, 25 bp, E. coli
tatctgctgggtcagaaagacggtc

SEQ ID NO: 193386 - DNA, 25 bp, E. coli
tatctgctgggtgagaaagacggtc

SEQ ID NO: 193387 - DNA, 25 bp, E. coli
tgggctggctgatacgcatctggca

SEQ ID NO: 193388 - DNA, 25 bp, E. coli
tgggctggctgaaacgcatctggca

SEQ ID NO: 193389 - DNA, 25 bp, E. coli
tgagaaaatcgatcgctcccacggt

SEQ ID NO: 193390 - DNA, 25 bp, E. coli
tgagaaaatcgaacgctcccacggt

SEQ ID NO: 193391 - DNA, 25 bp, E. coli
tccgcagatgtttgttcgccaccag

SEQ ID NO: 193392 - DNA, 25 bp, E. coli
tccgcagatgttagttcgccaccag

SEQ ID NO: 193393 - DNA, 25 bp, E. coli
tctttcaggcatcacgtcggcgttt

SEQ ID NO: 193394 - DNA, 25 bp, E. coli
tctttcaggcatgacgtcggcgttt

SEQ ID NO: 193395 - DNA, 25 bp, E. coli
cgccgagtggcctgattgagatcta

SEQ ID NO: 193396 - DNA, 25 bp, E. coli
cgccgagtggccagattgagatcta

SEQ ID NO: 193397 - DNA, 25 bp, E. coli
cgttttctggcacaactcggcggct

SEQ ID NO: 193398 - DNA, 25 bp, E. coli
cgttttctggcagaactcggcggct

SEQ ID NO: 193399 - DNA, 25 bp, E. coli
ggttaacccgcaaactgacgtgccg

SEQ ID NO: 193400 - DNA, 25 bp, E. coli
ggttaacccgcatactgacgtgccg

SEQ ID NO: 193401 - DNA, 25 bp, E. coli
gtaacgatctcgaccagtacggcaa

SEQ ID NO: 193402 - DNA, 25 bp, E. coli
gtaacgatctcgtccagtacggcaa

SEQ ID NO: 193403 - DNA, 25 bp, E. coli
cacaacactgttcacctcgggtatc

SEQ ID NO: 193404 - DNA, 25 bp, E. coli
cacaacactgttgacctcgggtatc

SEQ ID NO: 193405 - DNA, 25 bp, E. coli
cagttaatgcgtcatgcccttagcg

SEQ ID NO: 193406 - DNA, 25 bp, E. coli
cagttaatgcgtgatgcccttagcg

SEQ ID NO: 193407 - DNA, 25 bp, E. coli
attatatccctaatcgcgctcccgg

SEQ ID NO: 193408 - DNA, 25 bp, E. coli
attatatccctattcgcgctcccgg

SEQ ID NO: 193409 - DNA, 25 bp, E. coli
ttttgatattggtcggatggccgcc

SEQ ID NO: 193410 - DNA, 25 bp, E. coli
ttttgatattggacggatggccgcc

SEQ ID NO: 193411 - DNA, 25 bp, E. coli
tgaatgcacaaagttataccctcgg

SEQ ID NO: 193412 - DNA, 25 bp, E. coli
tgaatgcacaaacttataccctcgg

SEQ ID NO: 193413 - DNA, 25 bp, E. coli
gcccttagcgcatacccggatttag

SEQ ID NO: 193414 - DNA, 25 bp, E. coli
gcccttagcgcaaacccggatttag

SEQ ID NO: 193415 - DNA, 25 bp, E. coli
gaaaaatatcactccatcaggacgg

SEQ ID NO: 193416 - DNA, 25 bp, E. coli
gaaaaatatcacaccatcaggacgg

SEQ ID NO: 193417 - DNA, 25 bp, E. coli
cgctggctggcgaaacaaaaatgac

SEQ ID NO: 193418 - DNA, 25 bp, E. coli
cgctggctggcgtaacaaaaatgac

SEQ ID NO: 193419 - DNA, 25 bp, E. coli
ggttccaaagatgacacccgcgatg

SEQ ID NO: 193420 - DNA, 25 bp, E. coli
ggttccaaagatcacacccgcgatg

SEQ ID NO: 193421 - DNA, 25 bp, E. coli
gagtcgttatatgcgctcgccgaaa

SEQ ID NO: 193422 - DNA, 25 bp, E. coli
gatggccgcccatatgttgctgagc

SEQ ID NO: 193423 - DNA, 25 bp, E. coli
gagtcgttatatccgctcgccgaaa

SEQ ID NO: 193424 - DNA, 25 bp, E. coli
gatggccgcccaaatgttgctgagc

SEQ ID NO: 193425 - DNA, 25 bp, E. coli
caattcttggcgatggagttgtgca

SEQ ID NO: 193426 - DNA, 25 bp, E. coli
aattcttggcgaaggagttgtgcac

SEQ ID NO: 193427 - DNA, 25 bp, E. coli
caattcttggcgttggagttgtgca

SEQ ID NO: 193428 - DNA, 25 bp, E. coli
aattcttggcgatggagttgtgcac

SEQ ID NO: 193429 - DNA, 25 bp, E. coli
attcttggcgatggagttgtgcaca

SEQ ID NO: 193430 - DNA, 25 bp, E. coli
agccacaattcttggcgatggagtt

SEQ ID NO: 193431 - DNA, 25 bp, E. coli
agccacaattctaggcgatggagtt

SEQ ID NO: 193432 - DNA, 25 bp, E. coli
attcttggcgatcgagttgtgcaca

SEQ ID NO: 193433 - DNA, 25 bp, E. coli
acaattcttggcgatggagttgtgc

SEQ ID NO: 193434 - DNA, 25 bp, E. coli
acaattcttggccatggagttgtgc

SEQ ID NO: 193435 - DNA, 25 bp, E. coli
ttcttggcgatggagttgtgcacaa

SEQ ID NO: 193436 - DNA, 25 bp, E. coli
ttggcgatggagatgtgcacaatag

SEQ ID NO: 193437 - DNA, 25 bp, E. coli
ttcttggcgatgcagttgtgcacaa

SEQ ID NO: 193438 - DNA, 25 bp, E. coli
ttggcgatggagttgtgcacaatag

SEQ ID NO: 193439 - DNA, 25 bp, E. coli
tcttggcgatggtgttgtgcacaat

SEQ ID NO: 193440 - DNA, 25 bp, E. coli
tcttggcgatggagttgtgcacaat

SEQ ID NO: 193441 - DNA, 25 bp, E. coli
gccacaattcttcgcgatggagttg

SEQ ID NO: 193442 - DNA, 25 bp, E. coli
gccacaattcttggcgatggagttg

SEQ ID NO: 193443 - DNA, 25 bp, E. coli
cttggcgatggacttgtgcacaata

SEQ ID NO: 193444 - DNA, 25 bp, E. coli
cttggcgatggagttgtgcacaata

SEQ ID NO: 193445 - DNA, 25 bp, E. coli
tggcgatggagtagtgcacaatagc

SEQ ID NO: 193446 - DNA, 25 bp, E. coli
tggcgatggagttgtgcacaatagc

SEQ ID NO: 193447 - DNA, 25 bp, E. coli
caaccgttctttatggacaccatgg

SEQ ID NO: 193448 - DNA, 25 bp, E. coli
caaccgttctttttggacaccatgg

SEQ ID NO: 193449 - DNA, 25 bp, E. coli
tactgcgtgaacatcagcactggcg

SEQ ID NO: 193450 - DNA, 25 bp, E. coli
tactgcgtgaacttcagcactggcg

SEQ ID NO: 193451 - DNA, 25 bp, E. coli
tatggacaccatggaaccactggag

SEQ ID NO: 193452 - DNA, 25 bp, E. coli
tatggacaccatcgaaccactggag

SEQ ID NO: 193453 - DNA, 25 bp, E. coli
tgaccactcatgtccgcgttcgtct

SEQ ID NO: 193454 - DNA, 25 bp, E. coli
tgcagtgggtgctgatcccgcgaat

SEQ ID NO: 193455 - DNA, 25 bp, E. coli
tgaccactcatgaccgcgttcgtct

SEQ ID NO: 193456 - DNA, 25 bp, E. coli
tgcagtgggtgcagatcccgcgaat

SEQ ID NO: 193457 - DNA, 25 bp, E. coli
tcgtctccagttccaggcgcttgaa

SEQ ID NO: 193458 - DNA, 25 bp, E. coli
tcgtctccagttgcaggcgcttgaa

SEQ ID NO: 193459 - DNA, 25 bp, E. coli
tctttttgcggaagatgcgagctaa

SEQ ID NO: 193460 - DNA, 25 bp, E. coli
tctttttgcggatgatgcgagctaa

SEQ ID NO: 193461 - DNA, 25 bp, E. coli
tcagcactggcgaaacgatgaaccc

SEQ ID NO: 193462 - DNA, 25 bp, E. coli
cctattatgaaatggcgctggcgac

SEQ ID NO: 193463 - DNA, 25 bp, E. coli
cctattatgaaaaggcgctggcgac

SEQ ID NO: 193464 - DNA, 25 bp, E. coli
ggcgcttgaagcgttactgcgtgaa

SEQ ID NO: 193465 - DNA, 25 bp, E. coli
ggcgcttgaagccttactgcgtgaa

SEQ ID NO: 193466 - DNA, 25 bp, E. coli
tcagcactggcgtaacgatgaaccc

SEQ ID NO: 193467 - DNA, 25 bp, E. coli
gatcccgcgaatgcacgatttgtta

SEQ ID NO: 193468 - DNA, 25 bp, E. coli
gatcccgcgaatccacgatttgtta

SEQ ID NO: 193469 - DNA, 25 bp, E. coli
catgagtggaactgtcgttggcctg

SEQ ID NO: 193470 - DNA, 25 bp, E. coli
catgagtggaacagtcgttggcctg

SEQ ID NO: 193471 - DNA, 25 bp, E. coli
acattgcgccggaccatctgcacag

SEQ ID NO: 193472 - DNA, 25 bp, E. coli
acattgcgccggtccatctgcacag

SEQ ID NO: 193473 - DNA, 25 bp, E. coli
tgtcgttggcctgctctgctattac

SEQ ID NO: 193474 - DNA, 25 bp, E. coli
tgtcgttggcctcctctgctattac

SEQ ID NO: 193475 - DNA, 25 bp, E. coli
cctgatgagcgtacgtatgcgcccc

SEQ ID NO: 193476 - DNA, 25 bp, E. coli
ccggaccatctgcacagcgaaagct

SEQ ID NO: 193477 - DNA, 25 bp, E. coli
cctgatgagcgttcgtatgcgcccc

SEQ ID NO: 193478 - DNA, 25 bp, E. coli
ccggaccatctggacagcgaaagct

SEQ ID NO: 193479 - DNA, 25 bp, E. coli
gcgggagaaattcccccggatgcct

SEQ ID NO: 193480 - DNA, 25 bp, E. coli
gcgggagaaattgccccggatgcct

SEQ ID NO: 193481 - DNA, 25 bp, E. coli
gaatgtccgaacgtttgtgctggtg

SEQ ID NO: 193482 - DNA, 25 bp, E. coli
gaatgtccgaacctttgtgctggtg

SEQ ID NO: 193483 - DNA, 25 bp, E. coli
ccgaacgtttgtcctggtgaaagat

SEQ ID NO: 193484 - DNA, 25 bp, E. coli
ccgaacgtttgtgctggtgaaagat

SEQ ID NO: 193485 - DNA, 25 bp, E. coli
gtcgccctcattattggcaatactg

SEQ ID NO: 193486 - DNA, 25 bp, E. coli
gtcgccctcatttttggcaatactg

SEQ ID NO: 193487 - DNA, 25 bp, E. coli
ggcggcatcctgtcgcgggagaaat

SEQ ID NO: 193488 - DNA, 25 bp, E. coli
ggcggcatcctgacgcgggagaaat

SEQ ID NO: 193489 - DNA, 25 bp, E. coli
gatggcgtcgccctcattattggca

SEQ ID NO: 193490 - DNA, 25 bp, E. coli
gatggcgtcgccgtcattattggca

SEQ ID NO: 193491 - DNA, 25 bp, E. coli
aatcaacactgggacaattattgct

SEQ ID NO: 193492 - DNA, 25 bp, E. coli
aagctaaagatgtatttcgtcgccg

SEQ ID NO: 193493 - DNA, 25 bp, E. coli
aagctaaagatgaatttcgtcgccg

SEQ ID NO: 193494 - DNA, 25 bp, E. coli
aatcaacactggcacaattattgct

SEQ ID NO: 193495 - DNA, 25 bp, E. coli
cacaattattgcatgtagctggcaa

SEQ ID NO: 193496 - DNA, 25 bp, E. coli
cacaattattgcttgtagctggcaa

SEQ ID NO: 193497 - DNA, 25 bp, E. coli
cagagatgccaggtttaagcatttt

SEQ ID NO: 193498 - DNA, 25 bp, E. coli
cagagatgccagctttaagcatttt

SEQ ID NO: 193499 - DNA, 25 bp, E. coli
taaagagatttttaagctaaagatg

SEQ ID NO: 193500 - DNA, 25 bp, E. coli
taaagagattttaaagctaaagatg

SEQ ID NO: 193501 - DNA, 25 bp, E. coli
taacagagatgcgagctttaagcat

SEQ ID NO: 193502 - DNA, 25 bp, E. coli
tagctggcaatacttaatgggaggc

SEQ ID NO: 193503 - DNA, 25 bp, E. coli
tacccgtttaactgagatgccagct

SEQ ID NO: 193504 - DNA, 25 bp, E. coli
tagctggcaatagttaatgggaggc

SEQ ID NO: 193505 - DNA, 25 bp, E. coli
tacccgtttaacagagatgccagct

SEQ ID NO: 193506 - DNA, 25 bp, E. coli
ccgtttaacagacatgccagcttta

SEQ ID NO: 193507 - DNA, 25 bp, E. coli
ccgtttaacagagatgccagcttta

SEQ ID NO: 193508 - DNA, 25 bp, E. coli
ctggcaatagtttatgggaggcgat

SEQ ID NO: 193509 - DNA, 25 bp, E. coli
ctggcaatagttaatgggaggcgat

SEQ ID NO: 193510 - DNA, 25 bp, E. coli
gtcaggttacccgtttaacagagat

SEQ ID NO: 193511 - DNA, 25 bp, E. coli
gtcaggttacccctttaacagagat

SEQ ID NO: 193512 - DNA, 25 bp, E. coli
taacagagatgccagctttaagcat

SEQ ID NO: 193513 - DNA, 25 bp, E. coli
tacgacgaagaccaagatcaggaag

SEQ ID NO: 193514 - DNA, 25 bp, E. coli
tacgacgaagacgaagatcaggaag

SEQ ID NO: 193515 - DNA, 25 bp, E. coli
atgatgtcagcgatttcgatcgggc

SEQ ID NO: 193516 - DNA, 25 bp, E. coli
atgatgtcagcgttttcgatcgggc

SEQ ID NO: 193517 - DNA, 25 bp, E. coli
tatctgaaccaacaagggacgggtc

SEQ ID NO: 193518 - DNA, 25 bp, E. coli
tatctgaaccaagaagggacgggtc

SEQ ID NO: 193519 - DNA, 25 bp, E. coli
aaaatgcactctgccaccagcgatg

SEQ ID NO: 193520 - DNA, 25 bp, E. coli
aaaatgcactctcccaccagcgatg

SEQ ID NO: 193521 - DNA, 25 bp, E. coli
tatgtggcggtatcgatgacagctc

SEQ ID NO: 193522 - DNA, 25 bp, E. coli
tatgtggcggtaacgatgacagctc

SEQ ID NO: 193523 - DNA, 25 bp, E. coli
tttcggtcatgagctggcacaggca

SEQ ID NO: 193524 - DNA, 25 bp, E. coli
tttcggtcatgacctggcacaggca

SEQ ID NO: 193525 - DNA, 25 bp, E. coli
tacttcacgaccagacgaacgaagg

SEQ ID NO: 193526 - DNA, 25 bp, E. coli
tacttcacgacctgacgaacgaagg

SEQ ID NO: 193527 - DNA, 25 bp, E. coli
gaccgcgccagaagtacaaaaaccg

SEQ ID NO: 193528 - DNA, 25 bp, E. coli
gaccgcgccagatgtacaaaaaccg

SEQ ID NO: 193529 - DNA, 25 bp, E. coli
gttgccgcgctgttatgccacgaca

SEQ ID NO: 193530 - DNA, 25 bp, E. coli
gttgccgcgctgatatgccacgaca

SEQ ID NO: 193531 - DNA, 25 bp, E. coli
ggttgggtcaatgacttcctgcttg

SEQ ID NO: 193532 - DNA, 25 bp, E. coli
ggttgggtcaatcacttcctgcttg

SEQ ID NO: 193533 - DNA, 25 bp, E. coli
gatgccctgcagcatgacggcttcc

SEQ ID NO: 193534 - DNA, 25 bp, E. coli
gatgccctgcaggatgacggcttcc

SEQ ID NO: 193535 - DNA, 25 bp, E. coli
aacgcgcggcctatctggctgggct

SEQ ID NO: 193536 - DNA, 25 bp, E. coli
agcatttgcctagtggatggccgaa

SEQ ID NO: 193537 - DNA, 25 bp, E. coli
agcatttgcctactggatggccgaa

SEQ ID NO: 193538 - DNA, 25 bp, E. coli
aacgcgcggcctttctggctgggct

SEQ ID NO: 193539 - DNA, 25 bp, E. coli
ttagcatcaaggaaacataccaggc

SEQ ID NO: 193540 - DNA, 25 bp, E. coli
ttagcatcaaggtaacataccaggc

SEQ ID NO: 193541 - DNA, 25 bp, E. coli
tgacgacaccaaccagacggataag

SEQ ID NO: 193542 - DNA, 25 bp, E. coli
tgcaattacctcgatagcctgccag

SEQ ID NO: 193543 - DNA, 25 bp, E. coli
tgacgacaccaagcagacggataag

SEQ ID NO: 193544 - DNA, 25 bp, E. coli
tgcaattacctccatagcctgccag

SEQ ID NO: 193545 - DNA, 25 bp, E. coli
tcataaagcgcatcccagcatttgc

SEQ ID NO: 193546 - DNA, 25 bp, E. coli
tcataaagcgcaacccagcatttgc

SEQ ID NO: 193547 - DNA, 25 bp, E. coli
tcagcctagcggagttgaatgcaat

SEQ ID NO: 193548 - DNA, 25 bp, E. coli
tcagcctagcggtgttgaatgcaat

SEQ ID NO: 193549 - DNA, 25 bp, E. coli
tggccgaatggccagaggacaacct

SEQ ID NO: 193550 - DNA, 25 bp, E. coli
tggctgggctagcactcataaagcg

SEQ ID NO: 193551 - DNA, 25 bp, E. coli
tggctgggctaggactcataaagcg

SEQ ID NO: 193552 - DNA, 25 bp, E. coli
tggccgaatggcgagaggacaacct

SEQ ID NO: 193553 - DNA, 25 bp, E. coli
taagtttctatctgaagcccgccgc

SEQ ID NO: 193554 - DNA, 25 bp, E. coli
tcaagagtgaacaggaggcgtgcaa

SEQ ID NO: 193555 - DNA, 25 bp, E. coli
tcaagagtgaactggaggcgtgcaa

SEQ ID NO: 193556 - DNA, 25 bp, E. coli
taagtttctatcagaagcccgccgc

SEQ ID NO: 193557 - DNA, 25 bp, E. coli
tacggtccggaactgctgcgttttg

SEQ ID NO: 193558 - DNA, 25 bp, E. coli
tacggtccggaagtgctgcgttttg

SEQ ID NO: 193559 - DNA, 25 bp, E. coli
agttatcactgacctgattcgtaac

SEQ ID NO: 193560 - DNA, 25 bp, E. coli
gggaacagtacggtccggaactgct

SEQ ID NO: 193561 - DNA, 25 bp, E. coli
gggaacagtacgctccggaactgct

SEQ ID NO: 193562 - DNA, 25 bp, E. coli
agttatcactgagctgattcgtaac

SEQ ID NO: 193563 - DNA, 25 bp, E. coli
ttttgttgaccgtggcgagcgtccg

SEQ ID NO: 193564 - DNA, 25 bp, E. coli
ttttgttgaccgaggcgagcgtccg

SEQ ID NO: 193565 - DNA, 25 bp, E. coli
ttgaccgtggcgtgcgtccgttcgt

SEQ ID NO: 193566 - DNA, 25 bp, E. coli
ttgaccgtggcgagcgtccgttcgt

SEQ ID NO: 193567 - DNA, 25 bp, E. coli
ccagccgatttgaggcaagagagtg

SEQ ID NO: 193568 - DNA, 25 bp, E. coli
ccagccgatttgtggcaagagagtg

SEQ ID NO: 193569 - DNA, 25 bp, E. coli
gaagaagttatctctgacctgattc

SEQ ID NO: 193570 - DNA, 25 bp, E. coli
gaagaagttatcactgacctgattc

SEQ ID NO: 193571 - DNA, 25 bp, E. coli
gaactgctgcgtattgttgaccgtg

SEQ ID NO: 193572 - DNA, 25 bp, E. coli
gacacctctgacaatgcagcgaaca

SEQ ID NO: 193573 - DNA, 25 bp, E. coli
gaactgctgcgttttgttgaccgtg

SEQ ID NO: 193574 - DNA, 25 bp, E. coli
gacacctctgactatgcagcgaaca

SEQ ID NO: 193575 - DNA, 25 bp, E. coli
gtcttctccgacacctctgactatg

SEQ ID NO: 193576 - DNA, 25 bp, E. coli
gtcttctccgactcctctgactatg

SEQ ID NO: 193577 - DNA, 25 bp, E. coli
gtggttcagccacccgatttgtggc

SEQ ID NO: 193578 - DNA, 25 bp, E. coli
gtggttcagccagccgatttgtggc

SEQ ID NO: 193579 - DNA, 25 bp, E. coli
atcttcatgcacataaaaaagtttc

SEQ ID NO: 193580 - DNA, 25 bp, E. coli
atcttcatgcacttaaaaaagtttc

SEQ ID NO: 193581 - DNA, 25 bp, E. coli
actagcccgaatcgccagcgagctg

SEQ ID NO: 193582 - DNA, 25 bp, E. coli
actagcccgaatggccagcgagctg

SEQ ID NO: 193583 - DNA, 25 bp, E. coli
tatacatggtttttcaattaagcga

SEQ ID NO: 193584 - DNA, 25 bp, E. coli
tatacatggtttatcaattaagcga

SEQ ID NO: 193585 - DNA, 25 bp, E. coli
ttttacaaccgaacatgcgaacacg

SEQ ID NO: 193586 - DNA, 25 bp, E. coli
ttttacaaccgatcatgcgaacacg

SEQ ID NO: 193587 - DNA, 25 bp, E. coli
tgttgcgcaaggcaatttttacggc

SEQ ID NO: 193588 - DNA, 25 bp, E. coli
tgttgcgcaagggaatttttacggc

SEQ ID NO: 193589 - DNA, 25 bp, E. coli
tgagtggacactagcccgaatcgcc

SEQ ID NO: 193590 - DNA, 25 bp, E. coli
tgagtggacacttgcccgaatcgcc

SEQ ID NO: 193591 - DNA, 25 bp, E. coli
tcgagtagataagtgtgttgaaaat

SEQ ID NO: 193592 - DNA, 25 bp, E. coli
tcgagtagataactgtgttgaaaat

SEQ ID NO: 193593 - DNA, 25 bp, E. coli
gctgcttctgaacgttttacaaccg

SEQ ID NO: 193594 - DNA, 25 bp, E. coli
gctgcttctgaaggttttacaaccg

SEQ ID NO: 193595 - DNA, 25 bp, E. coli
gaagaagagacaacatattcacagt

SEQ ID NO: 193596 - DNA, 25 bp, E. coli
gaagaagagacatcatattcacagt

SEQ ID NO: 193597 - DNA, 25 bp, E. coli
gactcggcggcaagtattgttgcgc

SEQ ID NO: 193598 - DNA, 25 bp, E. coli
gactcggcggcatgtattgttgcgc

SEQ ID NO: 193599 - DNA, 25 bp, E. coli
gagtgtagaatgcaacgtgctttgc

SEQ ID NO: 193600 - DNA, 25 bp, E. coli
gagtgtagaatggaacgtgctttgc

SEQ ID NO: 193601 - DNA, 25 bp, E. coli
caacggcgaacagggagtgaattac

SEQ ID NO: 193602 - DNA, 25 bp, E. coli
caacggcgaacacggagtgaattac

SEQ ID NO: 193603 - DNA, 25 bp, E. coli
taggtgacgacaaaccagacctgtc

SEQ ID NO: 193604 - DNA, 25 bp, E. coli
taggtgacgacataccagacctgtc

SEQ ID NO: 193605 - DNA, 25 bp, E. coli
ttatggcgacgttatcgaaacgcag

SEQ ID NO: 193606 - DNA, 25 bp, E. coli
ttccatattaactatggcctggtgg

SEQ ID NO: 193607 - DNA, 25 bp, E. coli
ttccatattaacaatggcctggtgg

SEQ ID NO: 193608 - DNA, 25 bp, E. coli
ttatggcgacgtaatcgaaacgcag

SEQ ID NO: 193609 - DNA, 25 bp, E. coli
tgaattaccatcgtaacgtctggca

SEQ ID NO: 193610 - DNA, 25 bp, E. coli
tgaattaccatcctaacgtctggca

SEQ ID NO: 193611 - DNA, 25 bp, E. coli
tcgcggcggcagtgacaactgtgat

SEQ ID NO: 193612 - DNA, 25 bp, E. coli
tcgcggcggcagagacaactgtgat

SEQ ID NO: 193613 - DNA, 25 bp, E. coli
gaatctgccgctcaccattcacgaa

SEQ ID NO: 193614 - DNA, 25 bp, E. coli
gaatctgccgctgaccattcacgaa

SEQ ID NO: 193615 - DNA, 25 bp, E. coli
cgattttctgacgatcgatcgcggc

SEQ ID NO: 193616 - DNA, 25 bp, E. coli
cgattttctgaccatcgatcgcggc

SEQ ID NO: 193617 - DNA, 25 bp, E. coli
cattcacgaactcgaacgtcatccg

SEQ ID NO: 193618 - DNA, 25 bp, E. coli
cattcacgaactggaacgtcatccg

SEQ ID NO: 193619 - DNA, 25 bp, E. coli
gtattaccgttatgtcaggaagcct

SEQ ID NO: 193620 - DNA, 25 bp, E. coli
gtattaccgttaagtcaggaagcct

SEQ ID NO: 193621 - DNA, 25 bp, E. coli
tggcagcgcgtctccgattttctga

SEQ ID NO: 193622 - DNA, 25 bp, E. coli
tggcagcgcgtcaccgattttctga

SEQ ID NO: 193623 - DNA, 25 bp, E. coli
tacactgaaggtaacggtgatggct

SEQ ID NO: 193624 - DNA, 25 bp, E. coli
tacactgaaggttacggtgatggct

SEQ ID NO: 193625 - DNA, 25 bp, E. coli
taaaaatgcagaagtttgggccgca

SEQ ID NO: 193626 - DNA, 25 bp, E. coli
taaaaatgcagatgtttgggccgca

SEQ ID NO: 193627 - DNA, 25 bp, E. coli
taccgacactcatgttaatgcaggg

SEQ ID NO: 193628 - DNA, 25 bp, E. coli
tatgcgaaatctgatcgtaccgaca

SEQ ID NO: 193629 - DNA, 25 bp, E. coli
taccgacactcaagttaatgcaggg

SEQ ID NO: 193630 - DNA, 25 bp, E. coli
taccaaggcaaatacgatcgtagcg

SEQ ID NO: 193631 - DNA, 25 bp, E. coli
taccaaggcaaaaacgatcgtagcg

SEQ ID NO: 193632 - DNA, 25 bp, E. coli
tatgcgaaatctcatcgtaccgaca

SEQ ID NO: 193633 - DNA, 25 bp, E. coli
ttgggccgcaggtctgaaatatgac

SEQ ID NO: 193634 - DNA, 25 bp, E. coli
ttgggccgcaggactgaaatatgac

SEQ ID NO: 193635 - DNA, 25 bp, E. coli
tgacacttggactcaaaccgacgtg

SEQ ID NO: 193636 - DNA, 25 bp, E. coli
tgacacttggacacaaaccgacgtg

SEQ ID NO: 193637 - DNA, 25 bp, E. coli
tcatgactcaacgtgcaactggtgt

SEQ ID NO: 193638 - DNA, 25 bp, E. coli
tcatgactcaacctgcaactggtgt

SEQ ID NO: 193639 - DNA, 25 bp, E. coli
gcgatttcgataactacactgaagg

SEQ ID NO: 193640 - DNA, 25 bp, E. coli
gcgatttcgatatctacactgaagg

SEQ ID NO: 193641 - DNA, 25 bp, E. coli
gatcacttcgttgctaataaagccc

SEQ ID NO: 193642 - DNA, 25 bp, E. coli
gattcggtatcgctgcaacttatgc

SEQ ID NO: 193643 - DNA, 25 bp, E. coli
gattcggtatcggtgcaacttatgc

SEQ ID NO: 193644 - DNA, 25 bp, E. coli
gatcacttcgttcctaataaagccc

SEQ ID NO: 193645 - DNA, 25 bp, E. coli
tacaccaggtcgcagatgttccaca

SEQ ID NO: 193646 - DNA, 25 bp, E. coli
tacaccaggtcggagatgttccaca

SEQ ID NO: 193647 - DNA, 25 bp, E. coli
aaaagactgagaaacccgcgcgtac

SEQ ID NO: 193648 - DNA, 25 bp, E. coli
aaaagactgagatacccgcgcgtac

SEQ ID NO: 193649 - DNA, 25 bp, E. coli
aaagctttgcagttactgcggcggc

SEQ ID NO: 193650 - DNA, 25 bp, E. coli
aaagctttgcagatactgcggcggc

SEQ ID NO: 193651 - DNA, 25 bp, E. coli
tattacgggagctaggtatagcggc

SEQ ID NO: 193652 - DNA, 25 bp, E. coli
tattacgggagcaaggtatagcggc

SEQ ID NO: 193653 - DNA, 25 bp, E. coli
tttaccctggctggcagacaacgat

SEQ ID NO: 193654 - DNA, 25 bp, E. coli
tttaccctggctcgcagacaacgat

SEQ ID NO: 193655 - DNA, 25 bp, E. coli
tctgcaacgatactggcattagccg

SEQ ID NO: 193656 - DNA, 25 bp, E. coli
tctgcaacgatagtggcattagccg

SEQ ID NO: 193657 - DNA, 25 bp, E. coli
gcctgactccctttgctgaagaaga

SEQ ID NO: 193658 - DNA, 25 bp, E. coli
gcctgactccctatgctgaagaaga

SEQ ID NO: 193659 - DNA, 25 bp, E. coli
gaaactgtcatcatctggtggcaaa

SEQ ID NO: 193660 - DNA, 25 bp, E. coli
gaaatacccgaactggcccatgaga

SEQ ID NO: 193661 - DNA, 25 bp, E. coli
gaaatacccgaagtggcccatgaga

SEQ ID NO: 193662 - DNA, 25 bp, E. coli
gaaactgtcatcttctggtggcaaa

SEQ ID NO: 193663 - DNA, 25 bp, E. coli
ccagttggtcaggtacggtattacg

SEQ ID NO: 193664 - DNA, 25 bp, E. coli
ccagttggtcagctacggtattacg

SEQ ID NO: 193665 - DNA, 25 bp, E. coli
gatgcctcagcatagaaagtcctgg

SEQ ID NO: 193666 - DNA, 25 bp, E. coli
gatgcctcagcaaagaaagtcctgg

SEQ ID NO: 193667 - DNA, 25 bp, E. coli
caatgttgaaattatgaaagcggca

SEQ ID NO: 193668 - DNA, 25 bp, E. coli
caatgttgaaataatgaaagcggca

SEQ ID NO: 193669 - DNA, 25 bp, E. coli
tatatgcccgtttattgcatcgcga

SEQ ID NO: 193670 - DNA, 25 bp, E. coli
tatatgcccgttaattgcatcgcga

SEQ ID NO: 193671 - DNA, 25 bp, E. coli
ttgcggaggcaaacacataatcgtg

SEQ ID NO: 193672 - DNA, 25 bp, E. coli
ttgcggaggcaatcacataatcgtg

SEQ ID NO: 193673 - DNA, 25 bp, E. coli
tctggatagcgcacttttgatcggc

SEQ ID NO: 193674 - DNA, 25 bp, E. coli
tctggatagcgctcttttgatcggc

SEQ ID NO: 193675 - DNA, 25 bp, E. coli
ccacgaaaatgacaagagaacctga

SEQ ID NO: 193676 - DNA, 25 bp, E. coli
ccacgaaaatgagaagagaacctga

SEQ ID NO: 193677 - DNA, 25 bp, E. coli
gcatcgcgaaatttgagaagacata

SEQ ID NO: 193678 - DNA, 25 bp, E. coli
gcatcgcgaaatatgagaagacata

SEQ ID NO: 193679 - DNA, 25 bp, E. coli
gaacctgacaatggaattatctgta

SEQ ID NO: 193680 - DNA, 25 bp, E. coli
gaacctgacaatcgaattatctgta

SEQ ID NO: 193681 - DNA, 25 bp, E. coli
cattaatcattcaggcatgtcgcac

SEQ ID NO: 193682 - DNA, 25 bp, E. coli
cattaatcattctggcatgtcgcac

SEQ ID NO: 193683 - DNA, 25 bp, E. coli
gggcaataatttgaactcagtcgca

SEQ ID NO: 193684 - DNA, 25 bp, E. coli
ggtcatgctaccaaatatatgcccg

SEQ ID NO: 193685 - DNA, 25 bp, E. coli
gggcaataatttcaactcagtcgca

SEQ ID NO: 193686 - DNA, 25 bp, E. coli
ggtcatgctacctaatatatgcccg

SEQ ID NO: 193687 - DNA, 25 bp, E. coli
ggcatgtcgcacactcgcatttaat

SEQ ID NO: 193688 - DNA, 25 bp, E. coli
ggcatgtcgcactctcgcatttaat

SEQ ID NO: 193689 - DNA, 25 bp, E. coli
catccgtcaggatggcctttcgcat

SEQ ID NO: 193690 - DNA, 25 bp, E. coli
catccgtcaggaaggcctttcgcat

SEQ ID NO: 193691 - DNA, 25 bp, E. coli
tatgtgggagtataagacgcgcagc

SEQ ID NO: 193692 - DNA, 25 bp, E. coli
tagttagcaggaaaatggttattga

SEQ ID NO: 193693 - DNA, 25 bp, E. coli
tatgtgggagtaaaagacgcgcagc

SEQ ID NO: 193694 - DNA, 25 bp, E. coli
tagttagcaggataatggttattga

SEQ ID NO: 193695 - DNA, 25 bp, E. coli
tttctggtaaggaggacacgtatgg

SEQ ID NO: 193696 - DNA, 25 bp, E. coli
tatcattatgcatccttaaccatga

SEQ ID NO: 193697 - DNA, 25 bp, E. coli
tatcattatgcaaccttaaccatga

SEQ ID NO: 193698 - DNA, 25 bp, E. coli
tttctggtaaggtggacacgtatgg

SEQ ID NO: 193699 - DNA, 25 bp, E. coli
ttttctgcgccaatgcaaaaaggcc

SEQ ID NO: 193700 - DNA, 25 bp, E. coli
ttttctgcgccattgcaaaaaggcc

SEQ ID NO: 193701 - DNA, 25 bp, E. coli
tgcaaaaaggccttccgtcaggatg

SEQ ID NO: 193702 - DNA, 25 bp, E. coli
tgcaaaaaggccatccgtcaggatg

SEQ ID NO: 193703 - DNA, 25 bp, E. coli
tcaggatggcctatcgcataatttg

SEQ ID NO: 193704 - DNA, 25 bp, E. coli
tctggcatatgtcggagtataagac

SEQ ID NO: 193705 - DNA, 25 bp, E. coli
tcaggatggcctttcgcataatttg

SEQ ID NO: 193706 - DNA, 25 bp, E. coli
tctggcatatgtgggagtataagac

SEQ ID NO: 193707 - DNA, 25 bp, E. coli
taaccatgaatttagttagcaggaa

SEQ ID NO: 193708 - DNA, 25 bp, E. coli
taaccatgaattaagttagcaggaa

SEQ ID NO: 193709 - DNA, 25 bp, E. coli
gaggagcttaagcataaatttctgg

SEQ ID NO: 193710 - DNA, 25 bp, E. coli
gaggagcttaaggataaatttctgg

SEQ ID NO: 193711 - DNA, 25 bp, E. coli
aataaccataaaggataagcgcaga

SEQ ID NO: 193712 - DNA, 25 bp, E. coli
aataaccataaacgataagcgcaga

SEQ ID NO: 193713 - DNA, 25 bp, E. coli
aaaattgttctacaatctgcgcaag

SEQ ID NO: 193714 - DNA, 25 bp, E. coli
aaaaagcctcgtgggtgaatccgca

SEQ ID NO: 193715 - DNA, 25 bp, E. coli
aaaattgttctagaatctgcgcaag

SEQ ID NO: 193716 - DNA, 25 bp, E. coli
aaaaagcctcgtcggtgaatccgca

SEQ ID NO: 193717 - DNA, 25 bp, E. coli
tgaatccgcacgaggcctgaaagtg

SEQ ID NO: 193718 - DNA, 25 bp, E. coli
tgaatccgcacgtggcctgaaagtg

SEQ ID NO: 193719 - DNA, 25 bp, E. coli
tctgcgcaagatgatgttaccggta

SEQ ID NO: 193720 - DNA, 25 bp, E. coli
tctgcgcaagatcatgttaccggta

SEQ ID NO: 193721 - DNA, 25 bp, E. coli
tcagaggatttaagactgaaacgcc

SEQ ID NO: 193722 - DNA, 25 bp, E. coli
tcatgttaccggaaaaataaccata

SEQ ID NO: 193723 - DNA, 25 bp, E. coli
tcagaggatttatgactgaaacgcc

SEQ ID NO: 193724 - DNA, 25 bp, E. coli
tcatgttaccggtaaaataaccata

SEQ ID NO: 193725 - DNA, 25 bp, E. coli
gactgaaacgcctgtaaccggagct

SEQ ID NO: 193726 - DNA, 25 bp, E. coli
gactgaaacgccagtaaccggagct

SEQ ID NO: 193727 - DNA, 25 bp, E. coli
cgaggcctgaaagtgtaaaaattgt

SEQ ID NO: 193728 - DNA, 25 bp, E. coli
cgaggcctgaaactgtaaaaattgt

SEQ ID NO: 193729 - DNA, 25 bp, E. coli
gggcaaaaacgtttcagtcagtgta

SEQ ID NO: 193730 - DNA, 25 bp, E. coli
gggcaaaaacgtatcagtcagtgta

SEQ ID NO: 193731 - DNA, 25 bp, E. coli
taaccggagctcttagggcaaaaac

SEQ ID NO: 193732 - DNA, 25 bp, E. coli
taaccggagctcatagggcaaaaac

SEQ ID NO: 193733 - DNA, 25 bp, E. coli
aattgttgttgatgctggtgacggc

SEQ ID NO: 193734 - DNA, 25 bp, E. coli
aattgttgttgaagctggtgacggc

SEQ ID NO: 193735 - DNA, 25 bp, E. coli
cacgttattaggcattatggcgcac

SEQ ID NO: 193736 - DNA, 25 bp, E. coli
cacgttattagggattatggcgcac

SEQ ID NO: 193737 - DNA, 25 bp, E. coli
cacagctggcgatcgacacgttatt

SEQ ID NO: 193738 - DNA, 25 bp, E. coli
cacagctggcgaacgacacgttatt

SEQ ID NO: 193739 - DNA, 25 bp, E. coli
cattctatgcggtgattgccgttac

SEQ ID NO: 193740 - DNA, 25 bp, E. coli
cattctatgcggagattgccgttac

SEQ ID NO: 193741 - DNA, 25 bp, E. coli
acggcattgacgtttggtgtagcga

SEQ ID NO: 193742 - DNA, 25 bp, E. coli
acggcattgacgattggtgtagcga

SEQ ID NO: 193743 - DNA, 25 bp, E. coli
tctggtatggctggagaagcgtcca

SEQ ID NO: 193744 - DNA, 25 bp, E. coli
tctggtatggctcgagaagcgtcca

SEQ ID NO: 193745 - DNA, 25 bp, E. coli
cgtttgtagtctggcgtcgtatgtc

SEQ ID NO: 193746 - DNA, 25 bp, E. coli
cgtttgtagtctcgcgtcgtatgtc

SEQ ID NO: 193747 - DNA, 25 bp, E. coli
ctattttgttctggcaatggcgcaa

SEQ ID NO: 193748 - DNA, 25 bp, E. coli
ctattttgttctcgcaatggcgcaa

SEQ ID NO: 193749 - DNA, 25 bp, E. coli
gatttgatggcttacctgttcggtg

SEQ ID NO: 193750 - DNA, 25 bp, E. coli
gatttgatggctaacctgttcggtg

SEQ ID NO: 193751 - DNA, 25 bp, E. coli
ggcagtgacgccagaagatctcatc

SEQ ID NO: 193752 - DNA, 25 bp, E. coli
tggttagccgggttcatgctcgcct

SEQ ID NO: 193753 - DNA, 25 bp, E. coli
ggcagtgacgcctgaagatctcatc

SEQ ID NO: 193754 - DNA, 25 bp, E. coli
tggttagccgggatcatgctcgcct

SEQ ID NO: 193755 - DNA, 25 bp, E. coli
agtgtgcagcgccatcccaattcgc

SEQ ID NO: 193756 - DNA, 25 bp, E. coli
agtgtgcagcgcgatcccaattcgc

SEQ ID NO: 193757 - DNA, 25 bp, E. coli
atatcgatctcttttatacgccggg

SEQ ID NO: 193758 - DNA, 25 bp, E. coli
atatcgatctctattatacgccggg

SEQ ID NO: 193759 - DNA, 25 bp, E. coli
aaaccgcttgtgcattgcctgtgcc

SEQ ID NO: 193760 - DNA, 25 bp, E. coli
aaaccgcttgtggattgcctgtgcc

SEQ ID NO: 193761 - DNA, 25 bp, E. coli
tatgcgctgcgctcgaatatcgatc

SEQ ID NO: 193762 - DNA, 25 bp, E. coli
tatgcgctgcgcacgaatatcgatc

SEQ ID NO: 193763 - DNA, 25 bp, E. coli
tatcggtctggtcctatatgcgctg

SEQ ID NO: 193764 - DNA, 25 bp, E. coli
tatcggtctggtgctatatgcgctg

SEQ ID NO: 193765 - DNA, 25 bp, E. coli
tgtctcttacgaaggcattttgccg

SEQ ID NO: 193766 - DNA, 25 bp, E. coli
tgtctcttacgatggcattttgccg

SEQ ID NO: 193767 - DNA, 25 bp, E. coli
tgtttataaggacccagcatcatga

SEQ ID NO: 193768 - DNA, 25 bp, E. coli
tgtttataaggagccagcatcatga

SEQ ID NO: 193769 - DNA, 25 bp, E. coli
tcgcccggcgagtgtttataaggac

SEQ ID NO: 193770 - DNA, 25 bp, E. coli
tcgcccggcgagagtttataaggac

SEQ ID NO: 193771 - DNA, 25 bp, E. coli
tctacggcaagcctgaaactcagca

SEQ ID NO: 193772 - DNA, 25 bp, E. coli
tctacggcaagcgtgaaactcagca

SEQ ID NO: 193773 - DNA, 25 bp, E. coli
gaatattcgccgtaaaaaccgcttg

SEQ ID NO: 193774 - DNA, 25 bp, E. coli
gaatattcgccgaaaaaaccgcttg

SEQ ID NO: 193775 - DNA, 25 bp, E. coli
gaaagcgatggatgctaaccaccgt

SEQ ID NO: 193776 - DNA, 25 bp, E. coli
gaaagcgatggaagctaaccaccgt

SEQ ID NO: 193777 - DNA, 25 bp, E. coli
tacaactcgtatcgtgactggcgtc

SEQ ID NO: 193778 - DNA, 25 bp, E. coli
tacaactcgtatggtgactggcgtc

SEQ ID NO: 193779 - DNA, 25 bp, E. coli
aaagtcggcattcgccctggctcta

SEQ ID NO: 193780 - DNA, 25 bp, E. coli
aaagtcggcattggccctggctcta

SEQ ID NO: 193781 - DNA, 25 bp, E. coli
aactcgtatcgtgactggcgtcggt

SEQ ID NO: 193782 - DNA, 25 bp, E. coli
aactcgtatcgtcactggcgtcggt

SEQ ID NO: 193783 - DNA, 25 bp, E. coli
taccgctgttgcagacgcagtagaa

SEQ ID NO: 193784 - DNA, 25 bp, E. coli
taccgctgttgctgacgcagtagaa

SEQ ID NO: 193785 - DNA, 25 bp, E. coli
tgtactgcaacgaatccgtgaaacc

SEQ ID NO: 193786 - DNA, 25 bp, E. coli
tgtactgcaacgtatccgtgaaacc

SEQ ID NO: 193787 - DNA, 25 bp, E. coli
gcagattaccgctgttgctgacgca

SEQ ID NO: 193788 - DNA, 25 bp, E. coli
gcagattaccgcagttgctgacgca

SEQ ID NO: 193789 - DNA, 25 bp, E. coli
ctctatctgtactactcgtatcgtg

SEQ ID NO: 193790 - DNA, 25 bp, E. coli
cggtcactcagatggtgtactgcaa

SEQ ID NO: 193791 - DNA, 25 bp, E. coli
cggtcactcagaaggtgtactgcaa

SEQ ID NO: 193792 - DNA, 25 bp, E. coli
ctctatctgtacaactcgtatcgtg

SEQ ID NO: 193793 - DNA, 25 bp, E. coli
gttaaagtcggcattggccctggct

SEQ ID NO: 193794 - DNA, 25 bp, E. coli
gttaaagtcggctttggccctggct

SEQ ID NO: 193795 - DNA, 25 bp, E. coli
tggccctggctctatctgtacaact

SEQ ID NO: 193796 - DNA, 25 bp, E. coli
tggccctggctcaatctgtacaact

SEQ ID NO: 193797 - DNA, 25 bp, E. coli
tcagaaggtgtagtgcaacgtatcc

SEQ ID NO: 193798 - DNA, 25 bp, E. coli
tcagaaggtgtactgcaacgtatcc

SEQ ID NO: 193799 - DNA, 25 bp, E. coli
cacattgcccgaggcattagcggca

SEQ ID NO: 193800 - DNA, 25 bp, E. coli
cacattgcccgacgcattagcggca

SEQ ID NO: 193801 - DNA, 25 bp, E. coli
actggtacgccggatgcgcttgctg

SEQ ID NO: 193802 - DNA, 25 bp, E. coli
actggtacgccgcatgcgcttgctg

SEQ ID NO: 193803 - DNA, 25 bp, E. coli
tatctggggattacgcagcggtgcc

SEQ ID NO: 193804 - DNA, 25 bp, E. coli
tatctggggatttcgcagcggtgcc

SEQ ID NO: 193805 - DNA, 25 bp, E. coli
ttaccgctgcgggaacagcgcttgc

SEQ ID NO: 193806 - DNA, 25 bp, E. coli
ttaccgctgcggcaacagcgcttgc

SEQ ID NO: 193807 - DNA, 25 bp, E. coli
tgccgggccgatttcctttattgct

SEQ ID NO: 193808 - DNA, 25 bp, E. coli
tgccgggccgatatcctttattgct

SEQ ID NO: 193809 - DNA, 25 bp, E. coli
tccgcctgtgtgcttgcaggtatct

SEQ ID NO: 193810 - DNA, 25 bp, E. coli
tccgcctgtgtggttgcaggtatct

SEQ ID NO: 193811 - DNA, 25 bp, E. coli
gcagtggtgctttccgctgcggcaa

SEQ ID NO: 193812 - DNA, 25 bp, E. coli
gcaacagcgcttcccgggccgattt

SEQ ID NO: 193813 - DNA, 25 bp, E. coli
gcaacagcgcttgccgggccgattt

SEQ ID NO: 193814 - DNA, 25 bp, E. coli
gcagtggtgcttaccgctgcggcaa

SEQ ID NO: 193815 - DNA, 25 bp, E. coli
ccgccttactggtacgccggatgcg

SEQ ID NO: 193816 - DNA, 25 bp, E. coli
ccgccttactggaacgccggatgcg

SEQ ID NO: 193817 - DNA, 25 bp, E. coli
gattactcatcagctgtttgctgct

SEQ ID NO: 193818 - DNA, 25 bp, E. coli
gattactcatcacctgtttgctgct

SEQ ID NO: 193819 - DNA, 25 bp, E. coli
taatgatgctggttgcagtggtgct

SEQ ID NO: 193820 - DNA, 25 bp, E. coli
taatgatgctggatgcagtggtgct

SEQ ID NO: 193821 - DNA, 25 bp, E. coli
caggtggtgaaagatccgcttggca

SEQ ID NO: 193822 - DNA, 25 bp, E. coli
caggtggtgaaacatccgcttggca

SEQ ID NO: 193823 - DNA, 25 bp, E. coli
tacttccgggtaagcaggcggcttt

SEQ ID NO: 193824 - DNA, 25 bp, E. coli
tataaccaggagcagtttgacgtcg

SEQ ID NO: 193825 - DNA, 25 bp, E. coli
tacttccgggtatgcaggcggcttt

SEQ ID NO: 193826 - DNA, 25 bp, E. coli
tactgtgtaacgtatgcccaacctg

SEQ ID NO: 193827 - DNA, 25 bp, E. coli
tactgtgtaacgaatgcccaacctg

SEQ ID NO: 193828 - DNA, 25 bp, E. coli
tataaccaggaggagtttgacgtcg

SEQ ID NO: 193829 - DNA, 25 bp, E. coli
taccaatattgaagcgacgcaggct

SEQ ID NO: 193830 - DNA, 25 bp, E. coli
taccaatattgatgcgacgcaggct

SEQ ID NO: 193831 - DNA, 25 bp, E. coli
tgaacgcctgaaaaaagtggtcgca

SEQ ID NO: 193832 - DNA, 25 bp, E. coli
tgaacgcctgaataaagtggtcgca

SEQ ID NO: 193833 - DNA, 25 bp, E. coli
tcatattgaacgagaggcgcgacgc

SEQ ID NO: 193834 - DNA, 25 bp, E. coli
tcatattgaacgtgaggcgcgacgc

SEQ ID NO: 193835 - DNA, 25 bp, E. coli
gcttatctgaaacgcgtctggacca

SEQ ID NO: 193836 - DNA, 25 bp, E. coli
gcttatctgaaaggcgtctggacca

SEQ ID NO: 193837 - DNA, 25 bp, E. coli
gcacccgcgaaaccattgagcacgt

SEQ ID NO: 193838 - DNA, 25 bp, E. coli
gcacccgcgaaagcattgagcacgt

SEQ ID NO: 193839 - DNA, 25 bp, E. coli
gaacaaaagcaattcacggtgcgcg

SEQ ID NO: 193840 - DNA, 25 bp, E. coli
gaacaaaagcaaatcacggtgcgcg

SEQ ID NO: 193841 - DNA, 25 bp, E. coli
taacgccttcggtaacgcgagtggc

SEQ ID NO: 193842 - DNA, 25 bp, E. coli
taacgccttcggaaacgcgagtggc

SEQ ID NO: 193843 - DNA, 25 bp, E. coli
caaaacttgcagtgcgactgttcga

SEQ ID NO: 193844 - DNA, 25 bp, E. coli
caaaacttgcagagcgactgttcga

SEQ ID NO: 193845 - DNA, 25 bp, E. coli
catcagtacggcagaaagcgaggta

SEQ ID NO: 193846 - DNA, 25 bp, E. coli
catcagggttaattgcaggtgcaga

SEQ ID NO: 193847 - DNA, 25 bp, E. coli
catcagggttaaatgcaggtgcaga

SEQ ID NO: 193848 - DNA, 25 bp, E. coli
catcagtacggctgaaagcgaggta

SEQ ID NO: 193849 - DNA, 25 bp, E. coli
acacttatagcgcatgtgggcggca

SEQ ID NO: 193850 - DNA, 25 bp, E. coli
acacttatagcggatgtgggcggca

SEQ ID NO: 193851 - DNA, 25 bp, E. coli
tataccggctctaagcggagtgcgt

SEQ ID NO: 193852 - DNA, 25 bp, E. coli
tataccggctcttagcggagtgcgt

SEQ ID NO: 193853 - DNA, 25 bp, E. coli
tattgattctgctgatggacttccg

SEQ ID NO: 193854 - DNA, 25 bp, E. coli
tattgattctgcagatggacttccg

SEQ ID NO: 193855 - DNA, 25 bp, E. coli
tgtcctggcaggaataaaaactctt

SEQ ID NO: 193856 - DNA, 25 bp, E. coli
tgtgcattaaaagagacatccggtg

SEQ ID NO: 193857 - DNA, 25 bp, E. coli
tgtcctggcaggtataaaaactctt

SEQ ID NO: 193858 - DNA, 25 bp, E. coli
tgtgcattaaaacagacatccggtg

SEQ ID NO: 193859 - DNA, 25 bp, E. coli
tcttattcagagaggtgtcctggca

SEQ ID NO: 193860 - DNA, 25 bp, E. coli
tcttattcagagtggtgtcctggca

SEQ ID NO: 193861 - DNA, 25 bp, E. coli
gaaatgcaagtagcctgtaaccagg

SEQ ID NO: 193862 - DNA, 25 bp, E. coli
gaaatgcaagtaccctgtaaccagg

SEQ ID NO: 193863 - DNA, 25 bp, E. coli
gagcttgtcacaatacccagggttt

SEQ ID NO: 193864 - DNA, 25 bp, E. coli
gagcttgtcacattacccagggttt

SEQ ID NO: 193865 - DNA, 25 bp, E. coli
aatattcgtgatcccggaataaacc

SEQ ID NO: 193866 - DNA, 25 bp, E. coli
aatattcgtgatgccggaataaacc

SEQ ID NO: 193867 - DNA, 25 bp, E. coli
cagagatgcagtaaaatgaaaaagg

SEQ ID NO: 193868 - DNA, 25 bp, E. coli
cagagatgcagttaaatgaaaaagg

SEQ ID NO: 193869 - DNA, 25 bp, E. coli
attattttgccgaactggtattagg

SEQ ID NO: 193870 - DNA, 25 bp, E. coli
attattttgccgtactggtattagg

SEQ ID NO: 193871 - DNA, 25 bp, E. coli
tacccaggaagaatacagcgaataa

SEQ ID NO: 193872 - DNA, 25 bp, E. coli
tacccaggaagattacagcgaataa

SEQ ID NO: 193873 - DNA, 25 bp, E. coli
tcttcttaagctagtttggtgcagt

SEQ ID NO: 193874 - DNA, 25 bp, E. coli
tcttatcaaaagtccgttcgggaca

SEQ ID NO: 193875 - DNA, 25 bp, E. coli
tcttatcaaaagaccgttcgggaca

SEQ ID NO: 193876 - DNA, 25 bp, E. coli
tcttcttaagcttgtttggtgcagt

SEQ ID NO: 193877 - DNA, 25 bp, E. coli
gaaacacaggttacccaggaagaat

SEQ ID NO: 193878 - DNA, 25 bp, E. coli
gaaacacaggtttcccaggaagaat

SEQ ID NO: 193879 - DNA, 25 bp, E. coli
ctatggaatgcagagatgcagttaa

SEQ ID NO: 193880 - DNA, 25 bp, E. coli
cgttcgggacaactatgaaggcata

SEQ ID NO: 193881 - DNA, 25 bp, E. coli
ctatggaatgcacagatgcagttaa

SEQ ID NO: 193882 - DNA, 25 bp, E. coli
cgttcgggacaagtatgaaggcata

SEQ ID NO: 193883 - DNA, 25 bp, E. coli
tggacaacaaaatatcaacctattc

SEQ ID NO: 193884 - DNA, 25 bp, E. coli
tggacaacaaaaaatcaacctattc

SEQ ID NO: 193885 - DNA, 25 bp, E. coli
gatgccggaatatacccaccaaaag

SEQ ID NO: 193886 - DNA, 25 bp, E. coli
gatgccggaataaacccaccaaaag

SEQ ID NO: 193887 - DNA, 25 bp, E. coli
aaggatgatgcctcacgtttgtgca

SEQ ID NO: 193888 - DNA, 25 bp, E. coli
aaggatgatgccacacgtttgtgca

SEQ ID NO: 193889 - DNA, 25 bp, E. coli
cactgcagccgattagccaaaagga

SEQ ID NO: 193890 - DNA, 25 bp, E. coli
cactgcagccgaatagccaaaagga

SEQ ID NO: 193891 - DNA, 25 bp, E. coli
tagccaaaaggatgatgccacacgt

SEQ ID NO: 193892 - DNA, 25 bp, E. coli
tatcgccaaagctgaacatgcgcgg

SEQ ID NO: 193893 - DNA, 25 bp, E. coli
tagccaaaaggaagatgccacacgt

SEQ ID NO: 193894 - DNA, 25 bp, E. coli
taccgtatcgccaaagctgaacatg

SEQ ID NO: 193895 - DNA, 25 bp, E. coli
taccgtatcgcctaagctgaacatg

SEQ ID NO: 193896 - DNA, 25 bp, E. coli
tatcgccaaagcagaacatgcgcgg

SEQ ID NO: 193897 - DNA, 25 bp, E. coli
tgtgcattgaaacctgcattgcgcg

SEQ ID NO: 193898 - DNA, 25 bp, E. coli
tgtgcattgaaagctgcattgcgcg

SEQ ID NO: 193899 - DNA, 25 bp, E. coli
tgccacacgtttgtgcattgaaacc

SEQ ID NO: 193900 - DNA, 25 bp, E. coli
tgccacacgtttctgcattgaaacc

SEQ ID NO: 193901 - DNA, 25 bp, E. coli
ccaacgaaatcatgcatccagtggg

SEQ ID NO: 193902 - DNA, 25 bp, E. coli
ccaaagctgaacttgcgcggcggct

SEQ ID NO: 193903 - DNA, 25 bp, E. coli
ccaacgaaatcaagcatccagtggg

SEQ ID NO: 193904 - DNA, 25 bp, E. coli
ccaaagctgaacatgcgcggcggct

SEQ ID NO: 193905 - DNA, 25 bp, E. coli
ccgattagccaataggatgatgcca

SEQ ID NO: 193906 - DNA, 25 bp, E. coli
ccgattagccaaaaggatgatgcca

SEQ ID NO: 193907 - DNA, 25 bp, E. coli
cattgcactgcagccgattagccaa

SEQ ID NO: 193908 - DNA, 25 bp, E. coli
cattgcactgcacccgattagccaa

SEQ ID NO: 193909 - DNA, 25 bp, E. coli
cagcctgaaggattgtattgcgttt

SEQ ID NO: 193910 - DNA, 25 bp, E. coli
cagcctgaaggaatgtattgcgttt

SEQ ID NO: 193911 - DNA, 25 bp, E. coli
attatgggcagtccgcaccagcgtc

SEQ ID NO: 193912 - DNA, 25 bp, E. coli
attatgggcagtgcgcaccagcgtc

SEQ ID NO: 193913 - DNA, 25 bp, E. coli
tattgcgtttggtgacgggatgaac

SEQ ID NO: 193914 - DNA, 25 bp, E. coli
tattgcgtttggagacgggatgaac

SEQ ID NO: 193915 - DNA, 25 bp, E. coli
tggtgacgggatcaacgatgccgaa

SEQ ID NO: 193916 - DNA, 25 bp, E. coli
tggtgacgggatgaacgatgccgaa

SEQ ID NO: 193917 - DNA, 25 bp, E. coli
tgcattatgggctgtgcgcaccagc

SEQ ID NO: 193918 - DNA, 25 bp, E. coli
tgcattatgggcagtgcgcaccagc

SEQ ID NO: 193919 - DNA, 25 bp, E. coli
tgaaagaccttcttcccgagctgga

SEQ ID NO: 193920 - DNA, 25 bp, E. coli
tgaaagaccttcatcccgagctgga

SEQ ID NO: 193921 - DNA, 25 bp, E. coli
ccttcatcccgagctggaagtgatt

SEQ ID NO: 193922 - DNA, 25 bp, E. coli
ccttcatcccgacctggaagtgatt

SEQ ID NO: 193923 - DNA, 25 bp, E. coli
gcaccagcgtctgaaagaccttcat

SEQ ID NO: 193924 - DNA, 25 bp, E. coli
gcaccagcgtctcaaagaccttcat

SEQ ID NO: 193925 - DNA, 25 bp, E. coli
gattggtactaaagccgacgacgcg

SEQ ID NO: 193926 - DNA, 25 bp, E. coli
gattggtactaatgccgacgacgcg

SEQ ID NO: 193927 - DNA, 25 bp, E. coli
ggtactaatgccgacgacgcggtgc

SEQ ID NO: 193928 - DNA, 25 bp, E. coli
ggtactaatgcccacgacgcggtgc

SEQ ID NO: 193929 - DNA, 25 bp, E. coli
taatgccgacgacgcggtgccgcat

SEQ ID NO: 193930 - DNA, 25 bp, E. coli
taatgccgacgaggcggtgccgcat

SEQ ID NO: 193931 - DNA, 25 bp, E. coli
cacgctacagtctggctattcgcca

SEQ ID NO: 193932 - DNA, 25 bp, E. coli
cacgctacagtcaggctattcgcca

SEQ ID NO: 193933 - DNA, 25 bp, E. coli
cagtctggctatacgccaggaagtc

SEQ ID NO: 193934 - DNA, 25 bp, E. coli
cagtctggctattcgccaggaagtc

SEQ ID NO: 193935 - DNA, 25 bp, E. coli
acggcactttcggtttgcgtgtaca

SEQ ID NO: 193936 - DNA, 25 bp, E. coli
acggcactttcgctttgcgtgtaca

SEQ ID NO: 193937 - DNA, 25 bp, E. coli
ttcagtgccacacgctacagtctgg

SEQ ID NO: 193938 - DNA, 25 bp, E. coli
ttcagtgccacaggctacagtctgg

SEQ ID NO: 193939 - DNA, 25 bp, E. coli
tggtctggaagatgagcatctcaac

SEQ ID NO: 193940 - DNA, 25 bp, E. coli
tggtctggaagaagagcatctcaac

SEQ ID NO: 193941 - DNA, 25 bp, E. coli
tgcctgtggtttagccatacagctt

SEQ ID NO: 193942 - DNA, 25 bp, E. coli
tgcctgtggttttgccatacagctt

SEQ ID NO: 193943 - DNA, 25 bp, E. coli
gctttgcgtgtagatttcagtgcca

SEQ ID NO: 193944 - DNA, 25 bp, E. coli
gctttgcgtgtacatttcagtgcca

SEQ ID NO: 193945 - DNA, 25 bp, E. coli
gcactgcctgtgcttttgccataca

SEQ ID NO: 193946 - DNA, 25 bp, E. coli
gcactgcctgtggttttgccataca

SEQ ID NO: 193947 - DNA, 25 bp, E. coli
gaaccattttgcagggttggcactg

SEQ ID NO: 193948 - DNA, 25 bp, E. coli
gaaccattttgctgggttggcactg

SEQ ID NO: 193949 - DNA, 25 bp, E. coli
ggcgaaccattttgctgggttggca

SEQ ID NO: 193950 - DNA, 25 bp, E. coli
ggcgaaccatttagctgggttggca

SEQ ID NO: 193951 - DNA, 25 bp, E. coli
ggcactggctgtttctggtctggaa

SEQ ID NO: 193952 - DNA, 25 bp, E. coli
ggcactggctgtatctggtctggaa

SEQ ID NO: 193953 - DNA, 25 bp, E. coli
aaaagtctgactcgctatgtgctgc

SEQ ID NO: 193954 - DNA, 25 bp, E. coli
actgggcttataaatgcgtcacgaa

SEQ ID NO: 193955 - DNA, 25 bp, E. coli
aaaagtctgactggctatgtgctgc

SEQ ID NO: 193956 - DNA, 25 bp, E. coli
actgggcttatatatgcgtcacgaa

SEQ ID NO: 193957 - DNA, 25 bp, E. coli
tatgtcaagcaggtcgctatttcag

SEQ ID NO: 193958 - DNA, 25 bp, E. coli
tatgtcaagcagctcgctatttcag

SEQ ID NO: 193959 - DNA, 25 bp, E. coli
tattgtcgattcgtctggcataacg

SEQ ID NO: 193960 - DNA, 25 bp, E. coli
tattgtcgattcctctggcataacg

SEQ ID NO: 193961 - DNA, 25 bp, E. coli
ttacgctggtgtcggtattggcaac

SEQ ID NO: 193962 - DNA, 25 bp, E. coli
ttacgctggtgtgggtattggcaac

SEQ ID NO: 193963 - DNA, 25 bp, E. coli
ttttgatctcaacgcgtactgggct

SEQ ID NO: 193964 - DNA, 25 bp, E. coli
ttttgatctcaaggcgtactgggct

SEQ ID NO: 193965 - DNA, 25 bp, E. coli
tgttaacctgcttactatcagcccg

SEQ ID NO: 193966 - DNA, 25 bp, E. coli
tgttaacctgctaactatcagcccg

SEQ ID NO: 193967 - DNA, 25 bp, E. coli
tcagcccgttgcgtaacagtgattc

SEQ ID NO: 193968 - DNA, 25 bp, E. coli
cctgatttcgttacttgggccgttg

SEQ ID NO: 193969 - DNA, 25 bp, E. coli
cctgatttcgtttcttgggccgttg

SEQ ID NO: 193970 - DNA, 25 bp, E. coli
gctttcggtgtggatctcaacggtt

SEQ ID NO: 193971 - DNA, 25 bp, E. coli
gctttcggtgtgcatctcaacggtt

SEQ ID NO: 193972 - DNA, 25 bp, E. coli
tcagcccgttgcctaacagtgattc

SEQ ID NO: 193973 - DNA, 25 bp, E. coli
gatgatccgcacgagttatgtcaag

SEQ ID NO: 193974 - DNA, 25 bp, E. coli
gatgatccgcaccagttatgtcaag

SEQ ID NO: 193975 - DNA, 25 bp, E. coli
aaccgttcgatagcagcctgctgga

SEQ ID NO: 193976 - DNA, 25 bp, E. coli
aataaattctcccttggcgacagcc

SEQ ID NO: 193977 - DNA, 25 bp, E. coli
aataaattctccgttggcgacagcc

SEQ ID NO: 193978 - DNA, 25 bp, E. coli
aaccgttcgataccagcctgctgga

SEQ ID NO: 193979 - DNA, 25 bp, E. coli
cagatgctgtttttgcgggccagcc

SEQ ID NO: 193980 - DNA, 25 bp, E. coli
catgaactcgaatgatctgcgcgcc

SEQ ID NO: 193981 - DNA, 25 bp, E. coli
cagatgctgtttatgcgggccagcc

SEQ ID NO: 193982 - DNA, 25 bp, E. coli
catgaactcgaaagatctgcgcgcc

SEQ ID NO: 193983 - DNA, 25 bp, E. coli
tacacaagtacgtgccgattccggt

SEQ ID NO: 193984 - DNA, 25 bp, E. coli
tacacaagtacgagccgattccggt

SEQ ID NO: 193985 - DNA, 25 bp, E. coli
tatgaccgcgttagaagatgagcac

SEQ ID NO: 193986 - DNA, 25 bp, E. coli
tatccgtgacctgaaaccggtggtg

SEQ ID NO: 193987 - DNA, 25 bp, E. coli
tatgaccgcgtttgaagatgagcac

SEQ ID NO: 193988 - DNA, 25 bp, E. coli
tatccgtgacctcaaaccggtggtg

SEQ ID NO: 193989 - DNA, 25 bp, E. coli
tgaagagatccgcaatcaggtgccg

SEQ ID NO: 193990 - DNA, 25 bp, E. coli
tgaagagatccggaatcaggtgccg

SEQ ID NO: 193991 - DNA, 25 bp, E. coli
tctggcgcatcgaggctataccgaa

SEQ ID NO: 193992 - DNA, 25 bp, E. coli
tctggcgcatcgtggctataccgaa

SEQ ID NO: 193993 - DNA, 25 bp, E. coli
ctgattatgtcccatccagggctga

SEQ ID NO: 193994 - DNA, 25 bp, E. coli
ctgattatgtccgatccagggctga

SEQ ID NO: 193995 - DNA, 25 bp, E. coli
gatggttatactgtgtggctcccgg

SEQ ID NO: 193996 - DNA, 25 bp, E. coli
gatggttatactctgtggctcccgg

SEQ ID NO: 193997 - DNA, 25 bp, E. coli
atgactttctggcacgacctggcgg

SEQ ID NO: 193998 - DNA, 25 bp, E. coli
atgactttctgggacgacctggcgg

SEQ ID NO: 193999 - DNA, 25 bp, E. coli
tattaccgcagccattgtcggctgg

SEQ ID NO: 194000 - DNA, 25 bp, E. coli
tattaccgcagcgattgtcggctgg

SEQ ID NO: 194001 - DNA, 25 bp, E. coli
ttaccgcagcgattgtcggctggtg

SEQ ID NO: 194002 - DNA, 25 bp, E. coli
ttaccgcagcgaatgtcggctggtg

SEQ ID NO: 194003 - DNA, 25 bp, E. coli
tgccatgactttctggcacgacctg

SEQ ID NO: 194004 - DNA, 25 bp, E. coli
tcggctggtggcgtaaccggaagta

SEQ ID NO: 194005 - DNA, 25 bp, E. coli
tgccatgactttgtggcacgacctg

SEQ ID NO: 194006 - DNA, 25 bp, E. coli
tcggctggtggcctaaccggaagta

SEQ ID NO: 194007 - DNA, 25 bp, E. coli
tctggcacgaccaggcggcaccgat

SEQ ID NO: 194008 - DNA, 25 bp, E. coli
tctggcacgacctggcggcaccgat

SEQ ID NO: 194009 - DNA, 25 bp, E. coli
gactttctggcacgacctggcggca

SEQ ID NO: 194010 - DNA, 25 bp, E. coli
gactttctggcaggacctggcggca

SEQ ID NO: 194011 - DNA, 25 bp, E. coli
cgcagtttgccatgactttctggca

SEQ ID NO: 194012 - DNA, 25 bp, E. coli
cgcagtttgccaagactttctggca

SEQ ID NO: 194013 - DNA, 25 bp, E. coli
cggcaccgatccaggcgggaattat

SEQ ID NO: 194014 - DNA, 25 bp, E. coli
cggcaccgatcctggcgggaattat

SEQ ID NO: 194015 - DNA, 25 bp, E. coli
ggcaccgatcctcgcgggaattatt

SEQ ID NO: 194016 - DNA, 25 bp, E. coli
ggcaccgatcctggcgggaattatt

SEQ ID NO: 194017 - DNA, 25 bp, E. coli
gatcctggcgggtattattaccgca

SEQ ID NO: 194018 - DNA, 25 bp, E. coli
gatcctggcgggaattattaccgca

SEQ ID NO: 194019 - DNA, 25 bp, E. coli
caatcatcaacagcccaagcatggg

SEQ ID NO: 194020 - DNA, 25 bp, E. coli
caatcatcaacaccccaagcatggg

SEQ ID NO: 194021 - DNA, 25 bp, E. coli
tacagatggatgacacgggtactac

SEQ ID NO: 194022 - DNA, 25 bp, E. coli
tacagatggatgtcacgggtactac

SEQ ID NO: 194023 - DNA, 25 bp, E. coli
ttatcgcaagcgtctggaagagggc

SEQ ID NO: 194024 - DNA, 25 bp, E. coli
ttatcgcaagcgactggaagagggc

SEQ ID NO: 194025 - DNA, 25 bp, E. coli
tgtctactgcagtggtatccgcgca

SEQ ID NO: 194026 - DNA, 25 bp, E. coli
tggtactggcaagatctctctggcg

SEQ ID NO: 194027 - DNA, 25 bp, E. coli
tggtactggcaacatctctctggcg

SEQ ID NO: 194028 - DNA, 25 bp, E. coli
tgtctactgcagaggtatccgcgca

SEQ ID NO: 194029 - DNA, 25 bp, E. coli
tgcaaccgcaaatgcactgatgccg

SEQ ID NO: 194030 - DNA, 25 bp, E. coli
tgcaaccgcaaaagcactgatgccg

SEQ ID NO: 194031 - DNA, 25 bp, E. coli
tcagacagaaaagctgctgcgccgt

SEQ ID NO: 194032 - DNA, 25 bp, E. coli
gactggatcaaacataccgctggtg

SEQ ID NO: 194033 - DNA, 25 bp, E. coli
gactggatcaaagataccgctggtg

SEQ ID NO: 194034 - DNA, 25 bp, E. coli
cgatggctctggcactgaacgtttc

SEQ ID NO: 194035 - DNA, 25 bp, E. coli
cgatggctctgggactgaacgtttc

SEQ ID NO: 194036 - DNA, 25 bp, E. coli
gattcagggtcaaccgtggctgctg

SEQ ID NO: 194037 - DNA, 25 bp, E. coli
gattcagggtcatccgtggctgctg

SEQ ID NO: 194038 - DNA, 25 bp, E. coli
tcaaatccggtgcaaaaacgtccgt

SEQ ID NO: 194039 - DNA, 25 bp, E. coli
tcaaatccggtggaaaaacgtccgt

SEQ ID NO: 194040 - DNA, 25 bp, E. coli
tcagacagaaaacctgctgcgccgt

SEQ ID NO: 194041 - DNA, 25 bp, E. coli
taacaattcagcctgggcgcaacat

SEQ ID NO: 194042 - DNA, 25 bp, E. coli
taaagtgttggaaggcgctctccac

SEQ ID NO: 194043 - DNA, 25 bp, E. coli
taacaattcagcgtgggcgcaacat

SEQ ID NO: 194044 - DNA, 25 bp, E. coli
taaagtgttggatggcgctctccac

SEQ ID NO: 194045 - DNA, 25 bp, E. coli
tttgctgattgcgatacggacaccg

SEQ ID NO: 194046 - DNA, 25 bp, E. coli
tttgctgattgccatacggacaccg

SEQ ID NO: 194047 - DNA, 25 bp, E. coli
tgaatacggtattgccatcggctcc

SEQ ID NO: 194048 - DNA, 25 bp, E. coli
tgcaagaacacaaaacgcttcccgg

SEQ ID NO: 194049 - DNA, 25 bp, E. coli
tgaatacggtatagccatcggctcc

SEQ ID NO: 194050 - DNA, 25 bp, E. coli
tgcaagaacacataacgcttcccgg

SEQ ID NO: 194051 - DNA, 25 bp, E. coli
gaaagcatcgatgaactggcgacgc

SEQ ID NO: 194052 - DNA, 25 bp, E. coli
gaaagcatcgatcaactggcgacgc

SEQ ID NO: 194053 - DNA, 25 bp, E. coli
gatcaaaaagggtgaacgcagcgcc

SEQ ID NO: 194054 - DNA, 25 bp, E. coli
gttaaccccgaaaacagctttgctg

SEQ ID NO: 194055 - DNA, 25 bp, E. coli
gatcaaaaagggagaacgcagcgcc

SEQ ID NO: 194056 - DNA, 25 bp, E. coli
gttaaccccgaatacagctttgctg

SEQ ID NO: 194057 - DNA, 25 bp, E. coli
tagtaagcccggattttcagccaag

SEQ ID NO: 194058 - DNA, 25 bp, E. coli
tagtaagcccggtttttcagccaag

SEQ ID NO: 194059 - DNA, 25 bp, E. coli
taaccgaaggccctaacagtgggat

SEQ ID NO: 194060 - DNA, 25 bp, E. coli
taacatgaacggaaaggccgacgtc

SEQ ID NO: 194061 - DNA, 25 bp, E. coli
taacatgaacggtaaggccgacgtc

SEQ ID NO: 194062 - DNA, 25 bp, E. coli
taaccgaaggccgtaacagtgggat

SEQ ID NO: 194063 - DNA, 25 bp, E. coli
tacgacacgtttgattaagattttc

SEQ ID NO: 194064 - DNA, 25 bp, E. coli
tacgacacgtttcattaagattttc

SEQ ID NO: 194065 - DNA, 25 bp, E. coli
aaattcacatttaatctgctgggcg

SEQ ID NO: 194066 - DNA, 25 bp, E. coli
aaagaaattcataaatacgacacgt

SEQ ID NO: 194067 - DNA, 25 bp, E. coli
aaattcacattttatctgctgggcg

SEQ ID NO: 194068 - DNA, 25 bp, E. coli
aaagaaattcattaatacgacacgt

SEQ ID NO: 194069 - DNA, 25 bp, E. coli
tgtcgttaataataatgacaggcga

SEQ ID NO: 194070 - DNA, 25 bp, E. coli
tgtcgttaataaaaatgacaggcga

SEQ ID NO: 194071 - DNA, 25 bp, E. coli
tgaagggtaaaaccggtgtcaagct

SEQ ID NO: 194072 - DNA, 25 bp, E. coli
tgaagggtaaaagcggtgtcaagct

SEQ ID NO: 194073 - DNA, 25 bp, E. coli
ccacctatagtcattgtcgttaata

SEQ ID NO: 194074 - DNA, 25 bp, E. coli
ccacctatagtctttgtcgttaata

SEQ ID NO: 194075 - DNA, 25 bp, E. coli
taagattttcctcaggtaaccacct

SEQ ID NO: 194076 - DNA, 25 bp, E. coli
taagattttcctgaggtaaccacct

SEQ ID NO: 194077 - DNA, 25 bp, E. coli
gtatccgcctgattaaattcacatt

SEQ ID NO: 194078 - DNA, 25 bp, E. coli
gggtaaaagcggtgtcaagctagta

SEQ ID NO: 194079 - DNA, 25 bp, E. coli
ggtaaccacctaaagtcattgtcgt

SEQ ID NO: 194080 - DNA, 25 bp, E. coli
gggtaaaagcggagtcaagctagta

SEQ ID NO: 194081 - DNA, 25 bp, E. coli
ggtaaccacctatagtcattgtcgt

SEQ ID NO: 194082 - DNA, 25 bp, E. coli
gtatccgcctgaataaattcacatt

SEQ ID NO: 194083 - DNA, 25 bp, E. coli
taataaaaatgagaggcgatagggt

SEQ ID NO: 194084 - DNA, 25 bp, E. coli
taataaaaatgacaggcgatagggt

SEQ ID NO: 194085 - DNA, 25 bp, E. coli
caaccaatgtatgtagaacaatgcc

SEQ ID NO: 194086 - DNA, 25 bp, E. coli
caaccaatgtatctagaacaatgcc

SEQ ID NO: 194087 - DNA, 25 bp, E. coli
cgtatcaggaagtgttaagggtaca

SEQ ID NO: 194088 - DNA, 25 bp, E. coli
cgtatcaggaagagttaagggtaca

SEQ ID NO: 194089 - DNA, 25 bp, E. coli
tttcatgactaaggccatttcaagg

SEQ ID NO: 194090 - DNA, 25 bp, E. coli
tttcatgactaacgccatttcaagg

SEQ ID NO: 194091 - DNA, 25 bp, E. coli
tcgatggcggtctatatttcatgac

SEQ ID NO: 194092 - DNA, 25 bp, E. coli
tcgatggcggtcaatatttcatgac

SEQ ID NO: 194093 - DNA, 25 bp, E. coli
ccatttcaaggatgaagtgcggtgg

SEQ ID NO: 194094 - DNA, 25 bp, E. coli
ccatttcaaggaagaagtgcggtgg

SEQ ID NO: 194095 - DNA, 25 bp, E. coli
gaacaatgccgttgagtaaggatga

SEQ ID NO: 194096 - DNA, 25 bp, E. coli
gaactattctctgttcgctcactga

SEQ ID NO: 194097 - DNA, 25 bp, E. coli
gaactattctctcttcgctcactga

SEQ ID NO: 194098 - DNA, 25 bp, E. coli
gaacaatgccgtagagtaaggatga

SEQ ID NO: 194099 - DNA, 25 bp, E. coli
ggttaattactcaaatcactgaact

SEQ ID NO: 194100 - DNA, 25 bp, E. coli
ggttaattactctaatcactgaact

SEQ ID NO: 194101 - DNA, 25 bp, E. coli
gataagtgagtaccacaaccaatgt

SEQ ID NO: 194102 - DNA, 25 bp, E. coli
gataagtgagtagcacaaccaatgt

SEQ ID NO: 194103 - DNA, 25 bp, E. coli
taagtaattaacgataaagccagag

SEQ ID NO: 194104 - DNA, 25 bp, E. coli
taaggatgaaatgtctctgccacgc

SEQ ID NO: 194105 - DNA, 25 bp, E. coli
taaggatgaaatctctctgccacgc

SEQ ID NO: 194106 - DNA, 25 bp, E. coli
taagtaattaaccataaagccagag

SEQ ID NO: 194107 - DNA, 25 bp, E. coli
tacgacaatgacgatctggccacag

SEQ ID NO: 194108 - DNA, 25 bp, E. coli
aactctgattgaaagcctgctggcc

SEQ ID NO: 194109 - DNA, 25 bp, E. coli
aactctgattgatagcctgctggcc

SEQ ID NO: 194110 - DNA, 25 bp, E. coli
tatgctcgatccagtaaaagtgacc

SEQ ID NO: 194111 - DNA, 25 bp, E. coli
tacgacaatgaccatctggccacag

SEQ ID NO: 194112 - DNA, 25 bp, E. coli
tatgctcgatcctgtaaaagtgacc

SEQ ID NO: 194113 - DNA, 25 bp, E. coli
tccgtaaagccgtggtcagcgtcaa

SEQ ID NO: 194114 - DNA, 25 bp, E. coli
tccgtaaagccgaggtcagcgtcaa

SEQ ID NO: 194115 - DNA, 25 bp, E. coli
tcatgtgaagaatagcgatcgcgcg

SEQ ID NO: 194116 - DNA, 25 bp, E. coli
tcatgtgaagaaaagcgatcgcgcg

SEQ ID NO: 194117 - DNA, 25 bp, E. coli
tctttggcgaaatcatgatgcgcgc

SEQ ID NO: 194118 - DNA, 25 bp, E. coli
tctttggcgaaaacatgatgcgcgc

SEQ ID NO: 194119 - DNA, 25 bp, E. coli
cattcctgtactgatgccgggcgaa

SEQ ID NO: 194120 - DNA, 25 bp, E. coli
cattcctgtactcatgccgggcgaa

SEQ ID NO: 194121 - DNA, 25 bp, E. coli
gatacagttttgtagaggcacccgt

SEQ ID NO: 194122 - DNA, 25 bp, E. coli
gatacagttttgaagaggcacccgt

SEQ ID NO: 194123 - DNA, 25 bp, E. coli
ggattatctgatgcacgccggaccg

SEQ ID NO: 194124 - DNA, 25 bp, E. coli
ggattatctgatccacgccggaccg

SEQ ID NO: 194125 - DNA, 25 bp, E. coli
ggtcgaaccgtaatgtggcccaggc

SEQ ID NO: 194126 - DNA, 25 bp, E. coli
ggtcgaaccgtattgtggcccaggc

SEQ ID NO: 194127 - DNA, 25 bp, E. coli
gacggtgactataactgggactgcc

SEQ ID NO: 194128 - DNA, 25 bp, E. coli
gacggtgactattactgggactgcc

SEQ ID NO: 194129 - DNA, 25 bp, E. coli
caatcataatcacgatgatgtgcat

SEQ ID NO: 194130 - DNA, 25 bp, E. coli
caatcataatcaggatgatgtgcat

SEQ ID NO: 194131 - DNA, 25 bp, E. coli
caaaaaaccaacttccagcttgctt

SEQ ID NO: 194132 - DNA, 25 bp, E. coli
caaaaaaccaacatccagcttgctt

SEQ ID NO: 194133 - DNA, 25 bp, E. coli
taaactcactacaacgcacctgaaa

SEQ ID NO: 194134 - DNA, 25 bp, E. coli
taaactcactactacgcacctgaaa

SEQ ID NO: 194135 - DNA, 25 bp, E. coli
tatcaagtcacaatcaacaacagta

SEQ ID NO: 194136 - DNA, 25 bp, E. coli
tatcaagtcacattcaacaacagta

SEQ ID NO: 194137 - DNA, 25 bp, E. coli
tattatggttgattaagccactcga

SEQ ID NO: 194138 - DNA, 25 bp, E. coli
tatctggtgctacggaagtgtccac

SEQ ID NO: 194139 - DNA, 25 bp, E. coli
tatctggtgctagggaagtgtccac

SEQ ID NO: 194140 - DNA, 25 bp, E. coli
tattatggttgaataagccactcga

SEQ ID NO: 194141 - DNA, 25 bp, E. coli
gcacctgaaacctcttgctatatat

SEQ ID NO: 194142 - DNA, 25 bp, E. coli
gctatatatatgacaaccgtttgaa

SEQ ID NO: 194143 - DNA, 25 bp, E. coli
gctatatatatgtcaaccgtttgaa

SEQ ID NO: 194144 - DNA, 25 bp, E. coli
gaataagccactcgatatctggtgc

SEQ ID NO: 194145 - DNA, 25 bp, E. coli
gcacctgaaaccacttgctatatat

SEQ ID NO: 194146 - DNA, 25 bp, E. coli
gaagtgtccacagggtttagcagca

SEQ ID NO: 194147 - DNA, 25 bp, E. coli
gaagtgtccacacggtttagcagca

SEQ ID NO: 194148 - DNA, 25 bp, E. coli
gaataagccactggatatctggtgc

SEQ ID NO: 194149 - DNA, 25 bp, E. coli
gggcgcaaaagcataacatcaaaca

SEQ ID NO: 194150 - DNA, 25 bp, E. coli
gggcgcaaaagcttaacatcaaaca

SEQ ID NO: 194151 - DNA, 25 bp, E. coli
aaccgcgccacagattatggtcgta

SEQ ID NO: 194152 - DNA, 25 bp, E. coli
agagttgctgtcaccgatggcggac

SEQ ID NO: 194153 - DNA, 25 bp, E. coli
agagggttccatgcgttttgcggca

SEQ ID NO: 194154 - DNA, 25 bp, E. coli
agagggttccatccgttttgcggca

SEQ ID NO: 194155 - DNA, 25 bp, E. coli
agagttgctgtctccgatggcggac

SEQ ID NO: 194156 - DNA, 25 bp, E. coli
aaccgcgccacacattatggtcgta

SEQ ID NO: 194157 - DNA, 25 bp, E. coli
ttgctgtcaccgttggcggacaaat

SEQ ID NO: 194158 - DNA, 25 bp, E. coli
ttgctgtcaccgatggcggacaaat

SEQ ID NO: 194159 - DNA, 25 bp, E. coli
tccgttttgcgggagaacaaccaga

SEQ ID NO: 194160 - DNA, 25 bp, E. coli
tccgttttgcggcagaacaaccaga

SEQ ID NO: 194161 - DNA, 25 bp, E. coli
tcacggcggaagagttgctgtcacc

SEQ ID NO: 194162 - DNA, 25 bp, E. coli
tcacggcggaagtgttgctgtcacc

SEQ ID NO: 194163 - DNA, 25 bp, E. coli
gcggcagaacaagcagaaaacggta

SEQ ID NO: 194164 - DNA, 25 bp, E. coli
gcggcagaacaaccagaaaacggta

SEQ ID NO: 194165 - DNA, 25 bp, E. coli
ccgtcacggcggtagagttgctgtc

SEQ ID NO: 194166 - DNA, 25 bp, E. coli
ccgtcacggcggaagagttgctgtc

SEQ ID NO: 194167 - DNA, 25 bp, E. coli
cggaagagttgcagtcaccgatggc

SEQ ID NO: 194168 - DNA, 25 bp, E. coli
cggaagagttgctgtcaccgatggc

SEQ ID NO: 194169 - DNA, 25 bp, E. coli
gtaaaaccgcgccacacattatggt

SEQ ID NO: 194170 - DNA, 25 bp, E. coli
gggttccatccgttttgcggcagaa

SEQ ID NO: 194171 - DNA, 25 bp, E. coli
gggttccatccgatttgcggcagaa

SEQ ID NO: 194172 - DNA, 25 bp, E. coli
gtaaaaccgcgcgacacattatggt

SEQ ID NO: 194173 - DNA, 25 bp, E. coli
aatttagtccgcaacaggcaactga

SEQ ID NO: 194174 - DNA, 25 bp, E. coli
aatttagtccgctacaggcaactga

SEQ ID NO: 194175 - DNA, 25 bp, E. coli
caaatgctggcgttacttcgtgaac

SEQ ID NO: 194176 - DNA, 25 bp, E. coli
caaatgctggcgatacttcgtgaac

SEQ ID NO: 194177 - DNA, 25 bp, E. coli
tactggcctcgctggcaattctggc

SEQ ID NO: 194178 - DNA, 25 bp, E. coli
tactggcctcgcaggcaattctggc

SEQ ID NO: 194179 - DNA, 25 bp, E. coli
taactattgatgtcgcggtcagcga

SEQ ID NO: 194180 - DNA, 25 bp, E. coli
ttttttctccgtgagggcggctgcg

SEQ ID NO: 194181 - DNA, 25 bp, E. coli
ttttttctccgtcagggcggctgcg

SEQ ID NO: 194182 - DNA, 25 bp, E. coli
tctggctgccggaggactgattcat

SEQ ID NO: 194183 - DNA, 25 bp, E. coli
tcatcgtgccggatgtgcggaaacc

SEQ ID NO: 194184 - DNA, 25 bp, E. coli
tcatcgtgccggttgtgcggaaacc

SEQ ID NO: 194185 - DNA, 25 bp, E. coli
tctggctgccggtggactgattcat

SEQ ID NO: 194186 - DNA, 25 bp, E. coli
gacaatcaggacaggtcaggcgcaa

SEQ ID NO: 194187 - DNA, 25 bp, E. coli
gacaatcaggactggtcaggcgcaa

SEQ ID NO: 194188 - DNA, 25 bp, E. coli
taatgccgcagcacttcatcaggga

SEQ ID NO: 194189 - DNA, 25 bp, E. coli
tcagcgacggttcacaagcgaacgc

SEQ ID NO: 194190 - DNA, 25 bp, E. coli
taatgccgcagctcttcatcaggga

SEQ ID NO: 194191 - DNA, 25 bp, E. coli
tcaaaaattaccacgactgcggcat

SEQ ID NO: 194192 - DNA, 25 bp, E. coli
taactattgatgacgcggtcagcga

SEQ ID NO: 194193 - DNA, 25 bp, E. coli
tcaaaaattacctcgactgcggcat

SEQ ID NO: 194194 - DNA, 25 bp, E. coli
tcagcgacggttgacaagcgaacgc

SEQ ID NO: 194195 - DNA, 25 bp, E. coli
cagcttaagtcaggagcacggcgtc

SEQ ID NO: 194196 - DNA, 25 bp, E. coli
cagcttaagtcacgagcacggcgtc

SEQ ID NO: 194197 - DNA, 25 bp, E. coli
catgaaaatccacgtggcggcaggc

SEQ ID NO: 194198 - DNA, 25 bp, E. coli
catgaaaatccaggtggcggcaggc

SEQ ID NO: 194199 - DNA, 25 bp, E. coli
agcataatctgcaaaccgttctcgg

SEQ ID NO: 194200 - DNA, 25 bp, E. coli
agcataatctgctaaccgttctcgg

SEQ ID NO: 194201 - DNA, 25 bp, E. coli
tttgtcgcacaacgtaaagcccagc

SEQ ID NO: 194202 - DNA, 25 bp, E. coli
tttgtcgcacaaggtaaagcccagc

SEQ ID NO: 194203 - DNA, 25 bp, E. coli
tcattcctgggaaatcgacgggcga

SEQ ID NO: 194204 - DNA, 25 bp, E. coli
tcattcctgggatatcgacgggcga

SEQ ID NO: 194205 - DNA, 25 bp, E. coli
gctttatacctggtggatacgggaa

SEQ ID NO: 194206 - DNA, 25 bp, E. coli
gctttatacctgctggatacgggaa

SEQ ID NO: 194207 - DNA, 25 bp, E. coli
gcagatctatcagcgcaatttggcg

SEQ ID NO: 194208 - DNA, 25 bp, E. coli
gcagatctatcaccgcaatttggcg

SEQ ID NO: 194209 - DNA, 25 bp, E. coli
gaaatctgtatttcgcgcccgaaag

SEQ ID NO: 194210 - DNA, 25 bp, E. coli
gaaatctgtattacgcgcccgaaag

SEQ ID NO: 194211 - DNA, 25 bp, E. coli
gggatttattatcccggacgcgcgc

SEQ ID NO: 194212 - DNA, 25 bp, E. coli
gggatttattatgccggacgcgcgc

SEQ ID NO: 194213 - DNA, 25 bp, E. coli
taagccgggtggagcagcataatct

SEQ ID NO: 194214 - DNA, 25 bp, E. coli
taagccgggtggtgcagcataatct

SEQ ID NO: 194215 - DNA, 25 bp, E. coli
taatgtgccgtccacgcaaatggcg

SEQ ID NO: 194216 - DNA, 25 bp, E. coli
taatgtgccgtcgacgcaaatggcg

SEQ ID NO: 194217 - DNA, 25 bp, E. coli
attcgtgtaggtactccggcgatta

SEQ ID NO: 194218 - DNA, 25 bp, E. coli
attcgtgtaggttctccggcgatta

SEQ ID NO: 194219 - DNA, 25 bp, E. coli
tattcgtgtaggaactccggcgatt

SEQ ID NO: 194220 - DNA, 25 bp, E. coli
tattcgtgtaggtactccggcgatt

SEQ ID NO: 194221 - DNA, 25 bp, E. coli
ttaaagaagccgtagcgaaagaact

SEQ ID NO: 194222 - DNA, 25 bp, E. coli
ttcgtgtaggtactccggcgattac

SEQ ID NO: 194223 - DNA, 25 bp, E. coli
ttcgtgtaggtagtccggcgattac

SEQ ID NO: 194224 - DNA, 25 bp, E. coli
ttaaagaagccgaagcgaaagaact

SEQ ID NO: 194225 - DNA, 25 bp, E. coli
tcgtgtaggtactccggcgattacc

SEQ ID NO: 194226 - DNA, 25 bp, E. coli
tgtaggtactccggcgattacccgt

SEQ ID NO: 194227 - DNA, 25 bp, E. coli
tgtaggtactcccgcgattacccgt

SEQ ID NO: 194228 - DNA, 25 bp, E. coli
tcgtgtaggtacaccggcgattacc

SEQ ID NO: 194229 - DNA, 25 bp, E. coli
cggtattcgtgttggtactccggcg

SEQ ID NO: 194230 - DNA, 25 bp, E. coli
cggtattcgtgtaggtactccggcg

SEQ ID NO: 194231 - DNA, 25 bp, E. coli
gtattcgtgtagctactccggcgat

SEQ ID NO: 194232 - DNA, 25 bp, E. coli
gtattcgtgtaggtactccggcgat

SEQ ID NO: 194233 - DNA, 25 bp, E. coli
ggtattcgtgtaggtactccggcga

SEQ ID NO: 194234 - DNA, 25 bp, E. coli
taggtactccggggattacccgtcg

SEQ ID NO: 194235 - DNA, 25 bp, E. coli
taggtactccggcgattacccgtcg

SEQ ID NO: 194236 - DNA, 25 bp, E. coli
ggtattcgtgtacgtactccggcga

SEQ ID NO: 194237 - DNA, 25 bp, E. coli
ggctttaaagaacccgaagcgaaag

SEQ ID NO: 194238 - DNA, 25 bp, E. coli
ggctttaaagaagccgaagcgaaag

SEQ ID NO: 194239 - DNA, 25 bp, E. coli
aatacgcgcatatcgcagcggcggt

SEQ ID NO: 194240 - DNA, 25 bp, E. coli
aatacgcgcataacgcagcggcggt

SEQ ID NO: 194241 - DNA, 25 bp, E. coli
atacgcgcatatcgcagcggcggta

SEQ ID NO: 194242 - DNA, 25 bp, E. coli
atacgcgcatatggcagcggcggta

SEQ ID NO: 194243 - DNA, 25 bp, E. coli
acgcgcatatcgcagcggcggtatt

SEQ ID NO: 194244 - DNA, 25 bp, E. coli
aaatacgcgcatttcgcagcggcgg

SEQ ID NO: 194245 - DNA, 25 bp, E. coli
acgcgcatatcggagcggcggtatt

SEQ ID NO: 194246 - DNA, 25 bp, E. coli
aaaatacgcgcaaatcgcagcggcg

SEQ ID NO: 194247 - DNA, 25 bp, E. coli
aaaatacgcgcatatcgcagcggcg

SEQ ID NO: 194248 - DNA, 25 bp, E. coli
aaatacgcgcatatcgcagcggcgg

SEQ ID NO: 194249 - DNA, 25 bp, E. coli
tacgcgcatatcccagcggcggtat

SEQ ID NO: 194250 - DNA, 25 bp, E. coli
tacgcgcatatcgcagcggcggtat

SEQ ID NO: 194251 - DNA, 25 bp, E. coli
tgaaaatacgcggatatcgcagcgg

SEQ ID NO: 194252 - DNA, 25 bp, E. coli
tgaaaatacgcgcatatcgcagcgg

SEQ ID NO: 194253 - DNA, 25 bp, E. coli
gcgcatatcgcaccggcggtattat

SEQ ID NO: 194254 - DNA, 25 bp, E. coli
gcgcatatcgcagcggcggtattat

SEQ ID NO: 194255 - DNA, 25 bp, E. coli
gaaaatacgcgcttatcgcagcggc

SEQ ID NO: 194256 - DNA, 25 bp, E. coli
gaaaatacgcgcatatcgcagcggc

SEQ ID NO: 194257 - DNA, 25 bp, E. coli
cgcgcatatcgcagcggcggtatta

SEQ ID NO: 194258 - DNA, 25 bp, E. coli
cgcgcatatcgctgcggcggtatta

SEQ ID NO: 194259 - DNA, 25 bp, E. coli
caatataccggcgatgaaagccgca

SEQ ID NO: 194260 - DNA, 25 bp, E. coli
caatataccggccatgaaagccgca

SEQ ID NO: 194261 - DNA, 25 bp, E. coli
caacacagggcgtggagatcaggat

SEQ ID NO: 194262 - DNA, 25 bp, E. coli
cagcgatggccgtgtggtagataaa

SEQ ID NO: 194263 - DNA, 25 bp, E. coli
cagcgatggccgagtggtagataaa

SEQ ID NO: 194264 - DNA, 25 bp, E. coli
caacacagggcgaggagatcaggat

SEQ ID NO: 194265 - DNA, 25 bp, E. coli
taaaagcgtacctggcaacacaggg

SEQ ID NO: 194266 - DNA, 25 bp, E. coli
taaaagcgtaccaggcaacacaggg

SEQ ID NO: 194267 - DNA, 25 bp, E. coli
tgttctacgataacaccgcttccag

SEQ ID NO: 194268 - DNA, 25 bp, E. coli
tgttctacgatatcaccgcttccag

SEQ ID NO: 194269 - DNA, 25 bp, E. coli
tctcgcgtggcggaagtgatcgaca

SEQ ID NO: 194270 - DNA, 25 bp, E. coli
tctcgcgtggcgcaagtgatcgaca

SEQ ID NO: 194271 - DNA, 25 bp, E. coli
gaagtttgccacctcccgctgattg

SEQ ID NO: 194272 - DNA, 25 bp, E. coli
gaagtttgccacgtcccgctgattg

SEQ ID NO: 194273 - DNA, 25 bp, E. coli
gaaaattctttcctttggcgcggat

SEQ ID NO: 194274 - DNA, 25 bp, E. coli
gaaaattctttcgtttggcgcggat

SEQ ID NO: 194275 - DNA, 25 bp, E. coli
gattaagtctctggaagatgccgcg

SEQ ID NO: 194276 - DNA, 25 bp, E. coli
gattaagtctctcgaagatgccgcg

SEQ ID NO: 194277 - DNA, 25 bp, E. coli
ggcagcttccgtattccacaaacaa

SEQ ID NO: 194278 - DNA, 25 bp, E. coli
ggcgtacagtttcgcaaccatgaaa

SEQ ID NO: 194279 - DNA, 25 bp, E. coli
ggcagcttccgttttccacaaacaa

SEQ ID NO: 194280 - DNA, 25 bp, E. coli
ggcgtacagtttggcaaccatgaaa

SEQ ID NO: 194281 - DNA, 25 bp, E. coli
actcctggattacgcccggtcgtgg

SEQ ID NO: 194282 - DNA, 25 bp, E. coli
actcctggattaggcccggtcgtgg

SEQ ID NO: 194283 - DNA, 25 bp, E. coli
aactcctggattacgcccggtcgtg

SEQ ID NO: 194284 - DNA, 25 bp, E. coli
aactcctggatttcgcccggtcgtg

SEQ ID NO: 194285 - DNA, 25 bp, E. coli
tatagtgcaggtcgcctgggaatcc

SEQ ID NO: 194286 - DNA, 25 bp, E. coli
tatagtgcaggtggcctgggaatcc

SEQ ID NO: 194287 - DNA, 25 bp, E. coli
tgaagctcgtgatctggttaacgac

SEQ ID NO: 194288 - DNA, 25 bp, E. coli
tgaagctcgtgaactggttaacgac

SEQ ID NO: 194289 - DNA, 25 bp, E. coli
tcattaatgccgatcgtaagccgtc

SEQ ID NO: 194290 - DNA, 25 bp, E. coli
tcattaatgccgttcgtaagccgtc

SEQ ID NO: 194291 - DNA, 25 bp, E. coli
cgtaagccgtcttgatgcagaaaat

SEQ ID NO: 194292 - DNA, 25 bp, E. coli
cgtaagccgtctagatgcagaaaat

SEQ ID NO: 194293 - DNA, 25 bp, E. coli
gatcgtaagccgacttgatgcagaa

SEQ ID NO: 194294 - DNA, 25 bp, E. coli
tcgtgaactggtaaacgaccaggga

SEQ ID NO: 194295 - DNA, 25 bp, E. coli
tcgtgaactggttaacgaccaggga

SEQ ID NO: 194296 - DNA, 25 bp, E. coli
gatcgtaagccgtcttgatgcagaa

SEQ ID NO: 194297 - DNA, 25 bp, E. coli
ggtcgtggcgggaagctgaacctga

SEQ ID NO: 194298 - DNA, 25 bp, E. coli
ggtcgtggcgggtagctgaacctga

SEQ ID NO: 194299 - DNA, 25 bp, E. coli
tgggaatccccgaactcctggatta

SEQ ID NO: 194300 - DNA, 25 bp, E. coli
tgggaatccccgtactcctggatta

SEQ ID NO: 194301 - DNA, 25 bp, E. coli
taatgccgatcgaaagccgtcttga

SEQ ID NO: 194302 - DNA, 25 bp, E. coli
taatgccgatcgtaagccgtcttga

SEQ ID NO: 194303 - DNA, 25 bp, E. coli
ctcaaaatcaatgccgcccgggtag

SEQ ID NO: 194304 - DNA, 25 bp, E. coli
ctcaaaatcaatcccgcccgggtag

SEQ ID NO: 194305 - DNA, 25 bp, E. coli
tattcaatcggacaacccgaagcgt

SEQ ID NO: 194306 - DNA, 25 bp, E. coli
tattcaatcggagaacccgaagcgt

SEQ ID NO: 194307 - DNA, 25 bp, E. coli
tgattttcgtctcacaccgacagga

SEQ ID NO: 194308 - DNA, 25 bp, E. coli
tgtttttcgttaacccagcggcaaa

SEQ ID NO: 194309 - DNA, 25 bp, E. coli
tgtgtagcagcatcgccagagtact

SEQ ID NO: 194310 - DNA, 25 bp, E. coli
tgattttcgtctgacaccgacagga

SEQ ID NO: 194311 - DNA, 25 bp, E. coli
tgtaaaaacgggacagatctgccag

SEQ ID NO: 194312 - DNA, 25 bp, E. coli
tgtaaaaacgggtcagatctgccag

SEQ ID NO: 194313 - DNA, 25 bp, E. coli
tgtttttcgttatcccagcggcaaa

SEQ ID NO: 194314 - DNA, 25 bp, E. coli
tgtgtagcagcaacgccagagtact

SEQ ID NO: 194315 - DNA, 25 bp, E. coli
tccaacagggctatgacgctggcgt

SEQ ID NO: 194316 - DNA, 25 bp, E. coli
tccaacagggctttgacgctggcgt

SEQ ID NO: 194317 - DNA, 25 bp, E. coli
gatatgatcagcgtggcgatcggcc

SEQ ID NO: 194318 - DNA, 25 bp, E. coli
gattgcgcccaggtttcgacgaaat

SEQ ID NO: 194319 - DNA, 25 bp, E. coli
gattgcgcccagctttcgacgaaat

SEQ ID NO: 194320 - DNA, 25 bp, E. coli
gatatgatcagcctggcgatcggcc

SEQ ID NO: 194321 - DNA, 25 bp, E. coli
taatcaaagctttcgtgcagcgggc

SEQ ID NO: 194322 - DNA, 25 bp, E. coli
taatcaaagcttacgtgcagcgggc

SEQ ID NO: 194323 - DNA, 25 bp, E. coli
gatcggcccgcctgtgaaattatgt

SEQ ID NO: 194324 - DNA, 25 bp, E. coli
gatcggcccgccagtgaaattatgt

SEQ ID NO: 194325 - DNA, 25 bp, E. coli
aatgttaactatgtattcctcgcgg

SEQ ID NO: 194326 - DNA, 25 bp, E. coli
caatctttagggactttctctgcta

SEQ ID NO: 194327 - DNA, 25 bp, E. coli
aatgttaactatctattcctcgcgg

SEQ ID NO: 194328 - DNA, 25 bp, E. coli
caatctttagggtctttctctgcta

SEQ ID NO: 194329 - DNA, 25 bp, E. coli
aactccatgaattcggtggtatgtc

SEQ ID NO: 194330 - DNA, 25 bp, E. coli
aactccatgaatacggtggtatgtc

SEQ ID NO: 194331 - DNA, 25 bp, E. coli
tattcctcgcggaaaataatatgag

SEQ ID NO: 194332 - DNA, 25 bp, E. coli
tattttcccatccaacatgaggtgt

SEQ ID NO: 194333 - DNA, 25 bp, E. coli
tattcctcgcggtaaataatatgag

SEQ ID NO: 194334 - DNA, 25 bp, E. coli
tattttcccatcgaacatgaggtgt

SEQ ID NO: 194335 - DNA, 25 bp, E. coli
tgtagaggcatgttctgatgacgcc

SEQ ID NO: 194336 - DNA, 25 bp, E. coli
tgtagaggcatgatctgatgacgcc

SEQ ID NO: 194337 - DNA, 25 bp, E. coli
gctttgaggctgaatgatttgtgca

SEQ ID NO: 194338 - DNA, 25 bp, E. coli
gctttgaggctgtatgatttgtgca

SEQ ID NO: 194339 - DNA, 25 bp, E. coli
ctctgctatgagttaagaaatttca

SEQ ID NO: 194340 - DNA, 25 bp, E. coli
ctctgctatgagataagaaatttca

SEQ ID NO: 194341 - DNA, 25 bp, E. coli
ggtatgtctttttaatcctgccagt

SEQ ID NO: 194342 - DNA, 25 bp, E. coli
ggttttcttaatcgattgtagaggc

SEQ ID NO: 194343 - DNA, 25 bp, E. coli
ggtatgtcttttaaatcctgccagt

SEQ ID NO: 194344 - DNA, 25 bp, E. coli
ggttttcttaatggattgtagaggc

SEQ ID NO: 194345 - DNA, 25 bp, E. coli
gatgacgcctcttcaatctttaggg

SEQ ID NO: 194346 - DNA, 25 bp, E. coli
gatgacgcctctacaatctttaggg

SEQ ID NO: 194347 - DNA, 25 bp, E. coli
catttgtcgttaaggccagaatcgg

SEQ ID NO: 194348 - DNA, 25 bp, E. coli
catccaggttaagtttgagcaagca

SEQ ID NO: 194349 - DNA, 25 bp, E. coli
catccaggttaactttgagcaagca

SEQ ID NO: 194350 - DNA, 25 bp, E. coli
catttgtcgttatggccagaatcgg

SEQ ID NO: 194351 - DNA, 25 bp, E. coli
tatgctagcctcaagtgttactgac

SEQ ID NO: 194352 - DNA, 25 bp, E. coli
tagtatcaacggcaaacatttgtcg

SEQ ID NO: 194353 - DNA, 25 bp, E. coli
tatgctagcctctagtgttactgac

SEQ ID NO: 194354 - DNA, 25 bp, E. coli
tagtatcaacgggaaacatttgtcg

SEQ ID NO: 194355 - DNA, 25 bp, E. coli
tatatttattgtttgcccggcaggc

SEQ ID NO: 194356 - DNA, 25 bp, E. coli
tatatttattgtatgcccggcaggc

SEQ ID NO: 194357 - DNA, 25 bp, E. coli
ttttcactggaaaccgcatggtacc

SEQ ID NO: 194358 - DNA, 25 bp, E. coli
ttttcactggaatccgcatggtacc

SEQ ID NO: 194359 - DNA, 25 bp, E. coli
tggtacctcatatctgctgttgcag

SEQ ID NO: 194360 - DNA, 25 bp, E. coli
tggtacctcataactgctgttgcag

SEQ ID NO: 194361 - DNA, 25 bp, E. coli
tcttcactgagaccaacaggtatct

SEQ ID NO: 194362 - DNA, 25 bp, E. coli
tcttcactgagagcaacaggtatct

SEQ ID NO: 194363 - DNA, 25 bp, E. coli
gaatccgctgatgtgatgcctaaag

SEQ ID NO: 194364 - DNA, 25 bp, E. coli
gaatccgctgatctgatgcctaaag

SEQ ID NO: 194365 - DNA, 25 bp, E. coli
gatttacttcgcaatgtaccgcttg

SEQ ID NO: 194366 - DNA, 25 bp, E. coli
gatttacttcgctatgtaccgcttg

SEQ ID NO: 194367 - DNA, 25 bp, E. coli
ggttcatacaagctgaatccgctga

SEQ ID NO: 194368 - DNA, 25 bp, E. coli
ggttcatacaaggtgaatccgctga

SEQ ID NO: 194369 - DNA, 25 bp, E. coli
cactatcaccactaaagcttgcgag

SEQ ID NO: 194370 - DNA, 25 bp, E. coli
cactatcaccacaaaagcttgcgag

SEQ ID NO: 194371 - DNA, 25 bp, E. coli
caaagcgaccgtagagatggacagt

SEQ ID NO: 194372 - DNA, 25 bp, E. coli
caaagcgaccgttgagatggacagt

SEQ ID NO: 194373 - DNA, 25 bp, E. coli
cagtcggtacggtgttgagcaagaa

SEQ ID NO: 194374 - DNA, 25 bp, E. coli
cagtcggtacggagttgagcaagaa

SEQ ID NO: 194375 - DNA, 25 bp, E. coli
agcaagttcccataggctccagcgg

SEQ ID NO: 194376 - DNA, 25 bp, E. coli
agcaagttcccaaaggctccagcgg

SEQ ID NO: 194377 - DNA, 25 bp, E. coli
tagaggacgatataggaacgcagca

SEQ ID NO: 194378 - DNA, 25 bp, E. coli
tatgtggtcgtcaacactcaggcca

SEQ ID NO: 194379 - DNA, 25 bp, E. coli
tatgtggtcgtctacactcaggcca

SEQ ID NO: 194380 - DNA, 25 bp, E. coli
tagaggacgataaaggaacgcagca

SEQ ID NO: 194381 - DNA, 25 bp, E. coli
tgaatgggcgattgatggcgaaacc

SEQ ID NO: 194382 - DNA, 25 bp, E. coli
tgaatgggcgatagatggcgaaacc

SEQ ID NO: 194383 - DNA, 25 bp, E. coli
tgcgatgggatatccaaagcgaccg

SEQ ID NO: 194384 - DNA, 25 bp, E. coli
tcgatatgggaacaatgacgctgca

SEQ ID NO: 194385 - DNA, 25 bp, E. coli
tcgatatgggaagaatgacgctgca

SEQ ID NO: 194386 - DNA, 25 bp, E. coli
tgcgatgggataaccaaagcgaccg

SEQ ID NO: 194387 - DNA, 25 bp, E. coli
gatgattccatgattgcccttgagg

SEQ ID NO: 194388 - DNA, 25 bp, E. coli
gatggacagtcagtcggacagcgat

SEQ ID NO: 194389 - DNA, 25 bp, E. coli
gatggacagtcactcggacagcgat

SEQ ID NO: 194390 - DNA, 25 bp, E. coli
gatgattccatgtttgcccttgagg

SEQ ID NO: 194391 - DNA, 25 bp, E. coli
aataaccttagctttcatcgccgtg

SEQ ID NO: 194392 - DNA, 25 bp, E. coli
caatttccagaggtcaatcatcagg

SEQ ID NO: 194393 - DNA, 25 bp, E. coli
aataaccttagcattcatcgccgtg

SEQ ID NO: 194394 - DNA, 25 bp, E. coli
caatttccagagctcaatcatcagg

SEQ ID NO: 194395 - DNA, 25 bp, E. coli
catgggttagtagtattgctccgaa

SEQ ID NO: 194396 - DNA, 25 bp, E. coli
catgggttagtactattgctccgaa

SEQ ID NO: 194397 - DNA, 25 bp, E. coli
tactaactcagatcatgccatgggt

SEQ ID NO: 194398 - DNA, 25 bp, E. coli
tactaactcagaacatgccatgggt

SEQ ID NO: 194399 - DNA, 25 bp, E. coli
tatacttgatggcaatagtgccaac

SEQ ID NO: 194400 - DNA, 25 bp, E. coli
tatacttgatgggaatagtgccaac

SEQ ID NO: 194401 - DNA, 25 bp, E. coli
tgctccgaacagttccagaatcggt

SEQ ID NO: 194402 - DNA, 25 bp, E. coli
tgctccgaacagatccagaatcggt

SEQ ID NO: 194403 - DNA, 25 bp, E. coli
tgaagccatcaaagcggaatctgtt

SEQ ID NO: 194404 - DNA, 25 bp, E. coli
tgaagccatcaatgcggaatctgtt

SEQ ID NO: 194405 - DNA, 25 bp, E. coli
tctactttactggtggaggaagcca

SEQ ID NO: 194406 - DNA, 25 bp, E. coli
tctactttactgctggaggaagcca

SEQ ID NO: 194407 - DNA, 25 bp, E. coli
gccgtgcttacgtttatactcctga

SEQ ID NO: 194408 - DNA, 25 bp, E. coli
gccgtgcttacgattatactcctga

SEQ ID NO: 194409 - DNA, 25 bp, E. coli
gttgataactcttaaccagcatgga

SEQ ID NO: 194410 - DNA, 25 bp, E. coli
gttgataactctaaaccagcatgga

SEQ ID NO: 194411 - DNA, 25 bp, E. coli
gagactttctctcctgcactctgga

SEQ ID NO: 194412 - DNA, 25 bp, E. coli
gagactttctctgctgcactctgga

SEQ ID NO: 194413 - DNA, 25 bp, E. coli
caacgattatggagacaaccggaat

SEQ ID NO: 194414 - DNA, 25 bp, E. coli
caacgattatggtgacaaccggaat

SEQ ID NO: 194415 - DNA, 25 bp, E. coli
caactctgggcggtgacctattcaa

SEQ ID NO: 194416 - DNA, 25 bp, E. coli
caactctgggcgctgacctattcaa

SEQ ID NO: 194417 - DNA, 25 bp, E. coli
tctggctacctttcctgctgggcga

SEQ ID NO: 194418 - DNA, 25 bp, E. coli
tctggctaccttacctgctgggcga

SEQ ID NO: 194419 - DNA, 25 bp, E. coli
gcctttctgatgtagagcgccacta

SEQ ID NO: 194420 - DNA, 25 bp, E. coli
gcctttctgatgaagagcgccacta

SEQ ID NO: 194421 - DNA, 25 bp, E. coli
gcgatgcttgctccaccgttgattg

SEQ ID NO: 194422 - DNA, 25 bp, E. coli
gcgatgcttgctgcaccgttgattg

SEQ ID NO: 194423 - DNA, 25 bp, E. coli
gcatcaacatggttcccggcaaaag

SEQ ID NO: 194424 - DNA, 25 bp, E. coli
gcatcaacatggatcccggcaaaag

SEQ ID NO: 194425 - DNA, 25 bp, E. coli
gaagcatcggcaattcctgcgggtg

SEQ ID NO: 194426 - DNA, 25 bp, E. coli
gaagcatcggcatttcctgcgggtg

SEQ ID NO: 194427 - DNA, 25 bp, E. coli
gaaacgctgcattttagcctgaaag

SEQ ID NO: 194428 - DNA, 25 bp, E. coli
gaaacgctgcatattagcctgaaag

SEQ ID NO: 194429 - DNA, 25 bp, E. coli
cgaagttcttccacgatcgcggcgt

SEQ ID NO: 194430 - DNA, 25 bp, E. coli
cgaagttcttcctcgatcgcggcgt

SEQ ID NO: 194431 - DNA, 25 bp, E. coli
gattgtcagtgctttccagttggcc

SEQ ID NO: 194432 - DNA, 25 bp, E. coli
gattgtcagtgcattccagttggcc

SEQ ID NO: 194433 - DNA, 25 bp, E. coli
tcaaaaaagacgaagtagctaccgc

SEQ ID NO: 194434 - DNA, 25 bp, E. coli
tcaaaaaagacgtagtagctaccgc

SEQ ID NO: 194435 - DNA, 25 bp, E. coli
aggaggcccgacatctggaggcatt

SEQ ID NO: 194436 - DNA, 25 bp, E. coli
aggcccgacatctggaggcattcct

SEQ ID NO: 194437 - DNA, 25 bp, E. coli
aggaggcccgacttctggaggcatt

SEQ ID NO: 194438 - DNA, 25 bp, E. coli
aggcccgacatcaggaggcattcct

SEQ ID NO: 194439 - DNA, 25 bp, E. coli
gcccgacatctgcaggcattcctgg

SEQ ID NO: 194440 - DNA, 25 bp, E. coli
gcccgacatctggaggcattcctgg

SEQ ID NO: 194441 - DNA, 25 bp, E. coli
gacatctggagggattcctggcaga

SEQ ID NO: 194442 - DNA, 25 bp, E. coli
gacatctggaggcattcctggcaga

SEQ ID NO: 194443 - DNA, 25 bp, E. coli
ccgacatctggacgcattcctggca

SEQ ID NO: 194444 - DNA, 25 bp, E. coli
cccgacatctggaggcattcctggc

SEQ ID NO: 194445 - DNA, 25 bp, E. coli
cccgacatctggtggcattcctggc

SEQ ID NO: 194446 - DNA, 25 bp, E. coli
ccgacatctggaggcattcctggca

SEQ ID NO: 194447 - DNA, 25 bp, E. coli
cgggtattcgcagcgtatggcggcg

SEQ ID NO: 194448 - DNA, 25 bp, E. coli
cgggtattcgcaccgtatggcggcg

SEQ ID NO: 194449 - DNA, 25 bp, E. coli
ggaggcccgacaactggaggcattc

SEQ ID NO: 194450 - DNA, 25 bp, E. coli
ggtattcgcagcgtatggcggcggg

SEQ ID NO: 194451 - DNA, 25 bp, E. coli
ggtattcgcagcctatggcggcggg

SEQ ID NO: 194452 - DNA, 25 bp, E. coli
ggaggcccgacatctggaggcattc

SEQ ID NO: 194453 - DNA, 25 bp, E. coli
ggcccgacatctggaggcattcctg

SEQ ID NO: 194454 - DNA, 25 bp, E. coli
ggcccgacatctcgaggcattcctg

SEQ ID NO: 194455 - DNA, 25 bp, E. coli
gaggcccgacatgtggaggcattcc

SEQ ID NO: 194456 - DNA, 25 bp, E. coli
gaggcccgacatctggaggcattcc

SEQ ID NO: 194457 - DNA, 25 bp, E. coli
cacttttaggccactggaggtgcac

SEQ ID NO: 194458 - DNA, 25 bp, E. coli
cacttttaggcctctggaggtgcac

SEQ ID NO: 194459 - DNA, 25 bp, E. coli
ttttaggccactcgaggtgcactgt

SEQ ID NO: 194460 - DNA, 25 bp, E. coli
ttttaggccactggaggtgcactgt

SEQ ID NO: 194461 - DNA, 25 bp, E. coli
ttaggccactggtggtgcactgtga

SEQ ID NO: 194462 - DNA, 25 bp, E. coli
ttaggccactggaggtgcactgtga

SEQ ID NO: 194463 - DNA, 25 bp, E. coli
ttttgcgaaatcattgcagccagaa

SEQ ID NO: 194464 - DNA, 25 bp, E. coli
ttttgcgaaatctttgcagccagaa

SEQ ID NO: 194465 - DNA, 25 bp, E. coli
tccggtatcacttttaggccactgg

SEQ ID NO: 194466 - DNA, 25 bp, E. coli
tccggtatcactattaggccactgg

SEQ ID NO: 194467 - DNA, 25 bp, E. coli
tctacccttccgctatcacttttag

SEQ ID NO: 194468 - DNA, 25 bp, E. coli
tctacccttccggtatcacttttag

SEQ ID NO: 194469 - DNA, 25 bp, E. coli
ccactggaggtggactgtgagtgca

SEQ ID NO: 194470 - DNA, 25 bp, E. coli
ccactggaggtgcactgtgagtgca

SEQ ID NO: 194471 - DNA, 25 bp, E. coli
cccgcagattttagcgaaatctttg

SEQ ID NO: 194472 - DNA, 25 bp, E. coli
cccgcagatttttgcgaaatctttg

SEQ ID NO: 194473 - DNA, 25 bp, E. coli
gatttttgcgaattctttgcagcca

SEQ ID NO: 194474 - DNA, 25 bp, E. coli
gatttttgcgaaatctttgcagcca

SEQ ID NO: 194475 - DNA, 25 bp, E. coli
ggtatcacttttaggccactggagg

SEQ ID NO: 194476 - DNA, 25 bp, E. coli
tggcttttgccaattttatactttt

SEQ ID NO: 194477 - DNA, 25 bp, E. coli
ggtatcactttttggccactggagg

SEQ ID NO: 194478 - DNA, 25 bp, E. coli
tggcttttgccatttttatactttt

SEQ ID NO: 194479 - DNA, 25 bp, E. coli
tatggcctcgatgcacaggaagaac

SEQ ID NO: 194480 - DNA, 25 bp, E. coli
tatggcctcgatccacaggaagaac

SEQ ID NO: 194481 - DNA, 25 bp, E. coli
tatatcgtgcatggatcccgaggca

SEQ ID NO: 194482 - DNA, 25 bp, E. coli
tatatcgtgcatcgatcccgaggca

SEQ ID NO: 194483 - DNA, 25 bp, E. coli
ttatgcgagcaaaaccttccatgcg

SEQ ID NO: 194484 - DNA, 25 bp, E. coli
ttatgcgagcaataccttccatgcg

SEQ ID NO: 194485 - DNA, 25 bp, E. coli
tgagctgggcatcgaatccgccaaa

SEQ ID NO: 194486 - DNA, 25 bp, E. coli
tgagctgggcatggaatccgccaaa

SEQ ID NO: 194487 - DNA, 25 bp, E. coli
tgacactgtcacaagcgcgagagct

SEQ ID NO: 194488 - DNA, 25 bp, E. coli
tgacactgtcactagcgcgagagct

SEQ ID NO: 194489 - DNA, 25 bp, E. coli
tagatttggcacagttacggcccgg

SEQ ID NO: 194490 - DNA, 25 bp, E. coli
tagatttggcactgttacggcccgg

SEQ ID NO: 194491 - DNA, 25 bp, E. coli
gaagaacgtctgaaaaatggcgagc

SEQ ID NO: 194492 - DNA, 25 bp, E. coli
gaagaacgtctgtaaaatggcgagc

SEQ ID NO: 194493 - DNA, 25 bp, E. coli
cgatggtgaaaatccggttccggca

SEQ ID NO: 194494 - DNA, 25 bp, E. coli
cgatggtgaaaaaccggttccggca

SEQ ID NO: 194495 - DNA, 25 bp, E. coli
gataaaccctttaccgtgacactgt

SEQ ID NO: 194496 - DNA, 25 bp, E. coli
gataaacccttttccgtgacactgt

SEQ ID NO: 194497 - DNA, 25 bp, E. coli
gatggcgtacttacccgcgtggaag

SEQ ID NO: 194498 - DNA, 25 bp, E. coli
gagcgcagtcgaccgattatttcca

SEQ ID NO: 194499 - DNA, 25 bp, E. coli
gagcgcagtcgagcgattatttcca

SEQ ID NO: 194500 - DNA, 25 bp, E. coli
gatggcgtactttcccgcgtggaag

SEQ ID NO: 194501 - DNA, 25 bp, E. coli
aatgtgatgtcctgcgccgttctgc

SEQ ID NO: 194502 - DNA, 25 bp, E. coli
aacgcgcactatgtcaactcttgag

SEQ ID NO: 194503 - DNA, 25 bp, E. coli
aacgcgcactatctcaactcttgag

SEQ ID NO: 194504 - DNA, 25 bp, E. coli
aatgtgatgtccagcgccgttctgc

SEQ ID NO: 194505 - DNA, 25 bp, E. coli
ttcgcataagcggaatgtgatgtcc

SEQ ID NO: 194506 - DNA, 25 bp, E. coli
ttcgcataagcgcaatgtgatgtcc

SEQ ID NO: 194507 - DNA, 25 bp, E. coli
tcatcctccacataatgataaaggc

SEQ ID NO: 194508 - DNA, 25 bp, E. coli
tcatttatatttacggtcgctaacc

SEQ ID NO: 194509 - DNA, 25 bp, E. coli
tcatttatattttcggtcgctaacc

SEQ ID NO: 194510 - DNA, 25 bp, E. coli
tcatcctccacaaaatgataaaggc

SEQ ID NO: 194511 - DNA, 25 bp, E. coli
gctaacctaaaagcaaacgcgcact

SEQ ID NO: 194512 - DNA, 25 bp, E. coli
gctaacctaaaaccaaacgcgcact

SEQ ID NO: 194513 - DNA, 25 bp, E. coli
gaatttgtcatttcgcccttaacct

SEQ ID NO: 194514 - DNA, 25 bp, E. coli
gaatttgtcattacgcccttaacct

SEQ ID NO: 194515 - DNA, 25 bp, E. coli
ctctcccttccacggtgagggctgg

SEQ ID NO: 194516 - DNA, 25 bp, E. coli
ctctcccttccagggtgagggctgg

SEQ ID NO: 194517 - DNA, 25 bp, E. coli
ggttaatgttcgcaccagtgctggc

SEQ ID NO: 194518 - DNA, 25 bp, E. coli
ggttaatgttcggaccagtgctggc

SEQ ID NO: 194519 - DNA, 25 bp, E. coli
gagaagcattattgatggattcgca

SEQ ID NO: 194520 - DNA, 25 bp, E. coli
gaggtaacgcaaactgcaactcggg

SEQ ID NO: 194521 - DNA, 25 bp, E. coli
gaggtaacgcaatctgcaactcggg

SEQ ID NO: 194522 - DNA, 25 bp, E. coli
gagaagcattatagatggattcgca

SEQ ID NO: 194523 - DNA, 25 bp, E. coli
caatcgatcgtgctaaatggcggag

SEQ ID NO: 194524 - DNA, 25 bp, E. coli
caatcgatcgtggtaaatggcggag

SEQ ID NO: 194525 - DNA, 25 bp, E. coli
caatgacggtctgcaaatcagcggc

SEQ ID NO: 194526 - DNA, 25 bp, E. coli
caatgacggtctccaaatcagcggc

SEQ ID NO: 194527 - DNA, 25 bp, E. coli
aacattgccgcccataaaacgctgg

SEQ ID NO: 194528 - DNA, 25 bp, E. coli
actatgcagaagcttatggcggcgc

SEQ ID NO: 194529 - DNA, 25 bp, E. coli
actatgcagaaggttatggcggcgc

SEQ ID NO: 194530 - DNA, 25 bp, E. coli
aacattgccgccgataaaacgctgg

SEQ ID NO: 194531 - DNA, 25 bp, E. coli
ttgacgcagcagcatacgaaccagg

SEQ ID NO: 194532 - DNA, 25 bp, E. coli
ttgacgcagcaggatacgaaccagg

SEQ ID NO: 194533 - DNA, 25 bp, E. coli
ttgatgaaaataacagcgcctcggg

SEQ ID NO: 194534 - DNA, 25 bp, E. coli
ttgatgaaaatatcagcgcctcggg

SEQ ID NO: 194535 - DNA, 25 bp, E. coli
tgtttccgaacaagacgatggcgtg

SEQ ID NO: 194536 - DNA, 25 bp, E. coli
tgatttacatattggcggcagcgat

SEQ ID NO: 194537 - DNA, 25 bp, E. coli
tgtttccgaacatgacgatggcgtg

SEQ ID NO: 194538 - DNA, 25 bp, E. coli
tgatttacatataggcggcagcgat

SEQ ID NO: 194539 - DNA, 25 bp, E. coli
gacaataatgcgattaccggcgaga

SEQ ID NO: 194540 - DNA, 25 bp, E. coli
gacaataatgcgtttaccggcgaga

SEQ ID NO: 194541 - DNA, 25 bp, E. coli
cattttgaatatcgacgcaggcggc

SEQ ID NO: 194542 - DNA, 25 bp, E. coli
cattttgaatatggacgcaggcggc

SEQ ID NO: 194543 - DNA, 25 bp, E. coli
gatatcaaagcgtactgtcaggcca

SEQ ID NO: 194544 - DNA, 25 bp, E. coli
gatatcaaagcgaactgtcaggcca

SEQ ID NO: 194545 - DNA, 25 bp, E. coli
caccagtagcccaatcaggaaaata

SEQ ID NO: 194546 - DNA, 25 bp, E. coli
caccagtagccctatcaggaaaata

SEQ ID NO: 194547 - DNA, 25 bp, E. coli
caggagcgcaactggatgagagact

SEQ ID NO: 194548 - DNA, 25 bp, E. coli
caggagcgcaacaggatgagagact

SEQ ID NO: 194549 - DNA, 25 bp, E. coli
acgaagccctttcccgttatccata

SEQ ID NO: 194550 - DNA, 25 bp, E. coli
acgaagccctttgccgttatccata

SEQ ID NO: 194551 - DNA, 25 bp, E. coli
tatcatcttaaatacgccagtcacc

SEQ ID NO: 194552 - DNA, 25 bp, E. coli
tatcatcttaaaaacgccagtcacc

SEQ ID NO: 194553 - DNA, 25 bp, E. coli
tgaagcaatgcagatgacaggagcg

SEQ ID NO: 194554 - DNA, 25 bp, E. coli
tgaagcaatgcacatgacaggagcg

SEQ ID NO: 194555 - DNA, 25 bp, E. coli
tctcgttattttgggacctgatgac

SEQ ID NO: 194556 - DNA, 25 bp, E. coli
tctcgttattttcggacctgatgac

SEQ ID NO: 194557 - DNA, 25 bp, E. coli
gcgttcctttatatgtgagtgctga

SEQ ID NO: 194558 - DNA, 25 bp, E. coli
gctctttatcaaaaggccgcacggt

SEQ ID NO: 194559 - DNA, 25 bp, E. coli
gctctttatcaataggccgcacggt

SEQ ID NO: 194560 - DNA, 25 bp, E. coli
gcgttcctttatttgtgagtgctga

SEQ ID NO: 194561 - DNA, 25 bp, E. coli
ccgcacggttgtatggtggcgtcaa

SEQ ID NO: 194562 - DNA, 25 bp, E. coli
ccgcacggttgtttggtggcgtcaa

SEQ ID NO: 194563 - DNA, 25 bp, E. coli
ctccttgcgccactgattatatgaa

SEQ ID NO: 194564 - DNA, 25 bp, E. coli
ctccttgcgccagtgattatatgaa

SEQ ID NO: 194565 - DNA, 25 bp, E. coli
ggaaaataatcaatacagcccagag

SEQ ID NO: 194566 - DNA, 25 bp, E. coli
ggaaaataatcattacagcccagag

SEQ ID NO: 194567 - DNA, 25 bp, E. coli
aatcgtcctgaaaagagaaagtccg

SEQ ID NO: 194568 - DNA, 25 bp, E. coli
caaggaaactctcactgctgcacga

SEQ ID NO: 194569 - DNA, 25 bp, E. coli
caaggaaactctgactgctgcacga

SEQ ID NO: 194570 - DNA, 25 bp, E. coli
caacgcctacttaacggagactgat

SEQ ID NO: 194571 - DNA, 25 bp, E. coli
caacgcctactttacggagactgat

SEQ ID NO: 194572 - DNA, 25 bp, E. coli
aatcgtcctgaatagagaaagtccg

SEQ ID NO: 194573 - DNA, 25 bp, E. coli
cacgttgcacgggaagaacttcagg

SEQ ID NO: 194574 - DNA, 25 bp, E. coli
cacgttgcacggcaagaacttcagg

SEQ ID NO: 194575 - DNA, 25 bp, E. coli
tagtacacaccttcgatacgctgga

SEQ ID NO: 194576 - DNA, 25 bp, E. coli
tagtacacacctacgatacgctgga

SEQ ID NO: 194577 - DNA, 25 bp, E. coli
ttcacaaactggaacgcgacactga

SEQ ID NO: 194578 - DNA, 25 bp, E. coli
ttcacaaactggtacgcgacactga

SEQ ID NO: 194579 - DNA, 25 bp, E. coli
tctgcaaccgattcgaaaaaggcgg

SEQ ID NO: 194580 - DNA, 25 bp, E. coli
tctgcaaccgatacgaaaaaggcgg

SEQ ID NO: 194581 - DNA, 25 bp, E. coli
ccggtttctggtcaggagctgccca

SEQ ID NO: 194582 - DNA, 25 bp, E. coli
ccggtttctggtgaggagctgccca

SEQ ID NO: 194583 - DNA, 25 bp, E. coli
cgtgcaggagaatccagccagtact

SEQ ID NO: 194584 - DNA, 25 bp, E. coli
cgtgcaggagaaaccagccagtact

SEQ ID NO: 194585 - DNA, 25 bp, E. coli
ggcattacatatagcacgggcggaa

SEQ ID NO: 194586 - DNA, 25 bp, E. coli
ggcattacatattgcacgggcggaa

SEQ ID NO: 194587 - DNA, 25 bp, E. coli
taaccgcgaactgtctgctaagcag

SEQ ID NO: 194588 - DNA, 25 bp, E. coli
taaccgcgaactctctgctaagcag

SEQ ID NO: 194589 - DNA, 25 bp, E. coli
cccacggttggctggcggtatttgt

SEQ ID NO: 194590 - DNA, 25 bp, E. coli
cccacggttggcaggcggtatttgt

SEQ ID NO: 194591 - DNA, 25 bp, E. coli
aagacttgggtatgcgcaaacctga

SEQ ID NO: 194592 - DNA, 25 bp, E. coli
aagacttgggtaagcgcaaacctga

SEQ ID NO: 194593 - DNA, 25 bp, E. coli
tatgagcagttcacccacggttggc

SEQ ID NO: 194594 - DNA, 25 bp, E. coli
tatgagcagttctcccacggttggc

SEQ ID NO: 194595 - DNA, 25 bp, E. coli
tatttgttgcgctacgaccggaagt

SEQ ID NO: 194596 - DNA, 25 bp, E. coli
tatctgtcgcaacacttgggtatgc

SEQ ID NO: 194597 - DNA, 25 bp, E. coli
tatctgtcgcaagacttgggtatgc

SEQ ID NO: 194598 - DNA, 25 bp, E. coli
tatttgttgcgcaacgaccggaagt

SEQ ID NO: 194599 - DNA, 25 bp, E. coli
tgagatggccctgccgctaagctat

SEQ ID NO: 194600 - DNA, 25 bp, E. coli
tgagatggccctcccgctaagctat

SEQ ID NO: 194601 - DNA, 25 bp, E. coli
ccacatgggcgacgcgtttcatcag

SEQ ID NO: 194602 - DNA, 25 bp, E. coli
gccgctaagctaagagcagttctcc

SEQ ID NO: 194603 - DNA, 25 bp, E. coli
gccgctaagctatgagcagttctcc

SEQ ID NO: 194604 - DNA, 25 bp, E. coli
ccacatgggcgaggcgtttcatcag

SEQ ID NO: 194605 - DNA, 25 bp, E. coli
ggagctaatcggctaggcattacta

SEQ ID NO: 194606 - DNA, 25 bp, E. coli
ggagctaatcgggtaggcattacta

SEQ ID NO: 194607 - DNA, 25 bp, E. coli
ggctaggcattagtagtattctggt

SEQ ID NO: 194608 - DNA, 25 bp, E. coli
ggctaggcattactagtattctggt

SEQ ID NO: 194609 - DNA, 25 bp, E. coli
taagaagagtttgcacatgggcgag

SEQ ID NO: 194610 - DNA, 25 bp, E. coli
taagaagagtttccacatgggcgag

SEQ ID NO: 194611 - DNA, 25 bp, E. coli
caattacaatgatgacgtcctgcgt

SEQ ID NO: 194612 - DNA, 25 bp, E. coli
caattacaatgaagacgtcctgcgt

SEQ ID NO: 194613 - DNA, 25 bp, E. coli
catgagcgttatctggcggaagaac

SEQ ID NO: 194614 - DNA, 25 bp, E. coli
catgagcgttatgtggcggaagaac

SEQ ID NO: 194615 - DNA, 25 bp, E. coli
tagccgttgacagcgaagtcaccgt

SEQ ID NO: 194616 - DNA, 25 bp, E. coli
tagccgttgacaccgaagtcaccgt

SEQ ID NO: 194617 - DNA, 25 bp, E. coli
ccattctcgaaatctgcggcaggaa

SEQ ID NO: 194618 - DNA, 25 bp, E. coli
ccattctcgaaaactgcggcaggaa

SEQ ID NO: 194619 - DNA, 25 bp, E. coli
gctgaacgcgtagataaagatgccg

SEQ ID NO: 194620 - DNA, 25 bp, E. coli
gcgtccgcgcacaaacctgattggt

SEQ ID NO: 194621 - DNA, 25 bp, E. coli
gctgaacgcgtacataaagatgccg

SEQ ID NO: 194622 - DNA, 25 bp, E. coli
gcgtccgcgcactaacctgattggt

SEQ ID NO: 194623 - DNA, 25 bp, E. coli
gaagatccagacacttacccgatgg

SEQ ID NO: 194624 - DNA, 25 bp, E. coli
gaagatccagactcttacccgatgg

SEQ ID NO: 194625 - DNA, 25 bp, E. coli
cgcgtaacgatcagggcaaagtgga

SEQ ID NO: 194626 - DNA, 25 bp, E. coli
cgcgtaacgatctgggcaaagtgga

SEQ ID NO: 194627 - DNA, 25 bp, E. coli
gtacccgccgagattcaaaagctgg

SEQ ID NO: 194628 - DNA, 25 bp, E. coli
gatcattggtggctcccagcgtgaa

SEQ ID NO: 194629 - DNA, 25 bp, E. coli
gatcattggtgggtcccagcgtgaa

SEQ ID NO: 194630 - DNA, 25 bp, E. coli
gtacccgccgagtttcaaaagctgg

SEQ ID NO: 194631 - DNA, 25 bp, E. coli
ggaagtggcgttagctaacctgaac

SEQ ID NO: 194632 - DNA, 25 bp, E. coli
ggaagtggcgtttgctaacctgaac

SEQ ID NO: 194633 - DNA, 25 bp, E. coli
cagcgaccatctttgcacatggtgt

SEQ ID NO: 194634 - DNA, 25 bp, E. coli
cagcgaccatctatgcacatggtgt

SEQ ID NO: 194635 - DNA, 25 bp, E. coli
acatggtgttctagtgctcttcatc

SEQ ID NO: 194636 - DNA, 25 bp, E. coli
acatggtgttcttgtgctcttcatc

SEQ ID NO: 194637 - DNA, 25 bp, E. coli
tatttggcgcgacattttcacgggc

SEQ ID NO: 194638 - DNA, 25 bp, E. coli
tatttggcgcgagattttcacgggc

SEQ ID NO: 194639 - DNA, 25 bp, E. coli
tttgcgctccgctatcggcagccag

SEQ ID NO: 194640 - DNA, 25 bp, E. coli
tttgcgctccgcaatcggcagccag

SEQ ID NO: 194641 - DNA, 25 bp, E. coli
ttactgcgtggttccgtcggttttg

SEQ ID NO: 194642 - DNA, 25 bp, E. coli
ttactgcgtggtaccgtcggttttg

SEQ ID NO: 194643 - DNA, 25 bp, E. coli
tcattgttcattgaagaaccatccg

SEQ ID NO: 194644 - DNA, 25 bp, E. coli
tcattgttcattcaagaaccatccg

SEQ ID NO: 194645 - DNA, 25 bp, E. coli
ccgtcggttttgctatcgacatcat

SEQ ID NO: 194646 - DNA, 25 bp, E. coli
ccgtcggttttggtatcgacatcat

SEQ ID NO: 194647 - DNA, 25 bp, E. coli
gctgcggcgtttccctggccgttat

SEQ ID NO: 194648 - DNA, 25 bp, E. coli
gctgcggcgtttgcctggccgttat

SEQ ID NO: 194649 - DNA, 25 bp, E. coli
ctggcaaggcttagagtggcagtca

SEQ ID NO: 194650 - DNA, 25 bp, E. coli
ctggcaaggctttgagtggcagtca

SEQ ID NO: 194651 - DNA, 25 bp, E. coli
gttattgtcgaccttatttggcgcg

SEQ ID NO: 194652 - DNA, 25 bp, E. coli
gttattgtcgacgttatttggcgcg

SEQ ID NO: 194653 - DNA, 25 bp, E. coli
tggcccgcatcagctgcggcgtttg

SEQ ID NO: 194654 - DNA, 25 bp, E. coli
tggcccgcatcacctgcggcgtttg

SEQ ID NO: 194655 - DNA, 25 bp, E. coli
aacctgcaaaaactgtcattattct

SEQ ID NO: 194656 - DNA, 25 bp, E. coli
caacctgcaaaaagtgtcattattc

SEQ ID NO: 194657 - DNA, 25 bp, E. coli
caacctgcaaaatgtgtcattattc

SEQ ID NO: 194658 - DNA, 25 bp, E. coli
caccgggcgagctggcttcctggct

SEQ ID NO: 194659 - DNA, 25 bp, E. coli
caccgggcgagcaggcttcctggct

SEQ ID NO: 194660 - DNA, 25 bp, E. coli
atgacaccgggcgagctggcttcct

SEQ ID NO: 194661 - DNA, 25 bp, E. coli
accgggcgagctcgcttcctggctt

SEQ ID NO: 194662 - DNA, 25 bp, E. coli
atgacaccgggccagctggcttcct

SEQ ID NO: 194663 - DNA, 25 bp, E. coli
accgggcgagctggcttcctggctt

SEQ ID NO: 194664 - DNA, 25 bp, E. coli
aaaaagtgtcattattctcgtgagc

SEQ ID NO: 194665 - DNA, 25 bp, E. coli
aaaaagtgtcataattctcgtgagc

SEQ ID NO: 194666 - DNA, 25 bp, E. coli
aacctgcaaaaagtgtcattattct

SEQ ID NO: 194667 - DNA, 25 bp, E. coli
tgcaaaaagtgtcattattctcgtg

SEQ ID NO: 194668 - DNA, 25 bp, E. coli
tgcaaaaagtgtgattattctcgtg

SEQ ID NO: 194669 - DNA, 25 bp, E. coli
tgacaccgggcgtgctggcttcctg

SEQ ID NO: 194670 - DNA, 25 bp, E. coli
tgacaccgggcgagctggcttcctg

SEQ ID NO: 194671 - DNA, 25 bp, E. coli
cctgcaaaaagtctcattattctcg

SEQ ID NO: 194672 - DNA, 25 bp, E. coli
gcgatttttatgtaggtgggtcatc

SEQ ID NO: 194673 - DNA, 25 bp, E. coli
gcgatttttatgaaggtgggtcatc

SEQ ID NO: 194674 - DNA, 25 bp, E. coli
cctgcaaaaagtgtcattattctcg

SEQ ID NO: 194675 - DNA, 25 bp, E. coli
cgatttttatgatggtgggtcatca

SEQ ID NO: 194676 - DNA, 25 bp, E. coli
cgatttttatgaaggtgggtcatca

SEQ ID NO: 194677 - DNA, 25 bp, E. coli
cagaccctttttttaatgatgatgg

SEQ ID NO: 194678 - DNA, 25 bp, E. coli
caggcagcttagtaattcacaggta

SEQ ID NO: 194679 - DNA, 25 bp, E. coli
cagaccctttttataatgatgatgg

SEQ ID NO: 194680 - DNA, 25 bp, E. coli
caggcagcttagaaattcacaggta

SEQ ID NO: 194681 - DNA, 25 bp, E. coli
attcacaggtaagatactccacccg

SEQ ID NO: 194682 - DNA, 25 bp, E. coli
taatctcgaaagtggttacggactt

SEQ ID NO: 194683 - DNA, 25 bp, E. coli
taatctcgaaagaggttacggactt

SEQ ID NO: 194684 - DNA, 25 bp, E. coli
attcacaggtaacatactccacccg

SEQ ID NO: 194685 - DNA, 25 bp, E. coli
taggttggtcaagtccgtaatctcg

SEQ ID NO: 194686 - DNA, 25 bp, E. coli
taggttggtcaactccgtaatctcg

SEQ ID NO: 194687 - DNA, 25 bp, E. coli
tgcgaaaaaaaagctcgcactttcg

SEQ ID NO: 194688 - DNA, 25 bp, E. coli
tgcgaaaaaaaacctcgcactttcg

SEQ ID NO: 194689 - DNA, 25 bp, E. coli
tctgattgttaggtaggttggtcaa

SEQ ID NO: 194690 - DNA, 25 bp, E. coli
tctgattgttagctaggttggtcaa

SEQ ID NO: 194691 - DNA, 25 bp, E. coli
gataattagtgcagcgggaaggtaa

SEQ ID NO: 194692 - DNA, 25 bp, E. coli
gataattagtgctgcgggaaggtaa

SEQ ID NO: 194693 - DNA, 25 bp, E. coli
gataaaaaagggtgctgcaggagaa

SEQ ID NO: 194694 - DNA, 25 bp, E. coli
gataaaaaagggagctgcaggagaa

SEQ ID NO: 194695 - DNA, 25 bp, E. coli
tcaagtccgtaaactcgaaagaggt

SEQ ID NO: 194696 - DNA, 25 bp, E. coli
taatgatgatggaaagttgttgata

SEQ ID NO: 194697 - DNA, 25 bp, E. coli
taatgatgatggtaagttgttgata

SEQ ID NO: 194698 - DNA, 25 bp, E. coli
tcaagtccgtaatctcgaaagaggt

SEQ ID NO: 194699 - DNA, 25 bp, E. coli
cacactgacgtatttgcgatgacca

SEQ ID NO: 194700 - DNA, 25 bp, E. coli
cagcgagcgacgtgaacagatcatt

SEQ ID NO: 194701 - DNA, 25 bp, E. coli
cagcgagcgacgagaacagatcatt

SEQ ID NO: 194702 - DNA, 25 bp, E. coli
cacactgacgtaattgcgatgacca

SEQ ID NO: 194703 - DNA, 25 bp, E. coli
tgcgaagttgcgcaacggatcatcg

SEQ ID NO: 194704 - DNA, 25 bp, E. coli
tgcgaagttgcggaacggatcatcg

SEQ ID NO: 194705 - DNA, 25 bp, E. coli
tgacgatccgcaacgatctggcgtt

SEQ ID NO: 194706 - DNA, 25 bp, E. coli
tgacgatccgcatcgatctggcgtt

SEQ ID NO: 194707 - DNA, 25 bp, E. coli
tcgtctgatgcggaagcacactgac

SEQ ID NO: 194708 - DNA, 25 bp, E. coli
tcgtctgatgcgcaagcacactgac

SEQ ID NO: 194709 - DNA, 25 bp, E. coli
gccgtcagtcgacccatcagtggaa

SEQ ID NO: 194710 - DNA, 25 bp, E. coli
gccgtcagtcgagccatcagtggaa

SEQ ID NO: 194711 - DNA, 25 bp, E. coli
cgatgaccaacgctatgaacgtggc

SEQ ID NO: 194712 - DNA, 25 bp, E. coli
cgatgaccaacggtatgaacgtggc

SEQ ID NO: 194713 - DNA, 25 bp, E. coli
gatcaggctgaggaatcgctgcaaa

SEQ ID NO: 194714 - DNA, 25 bp, E. coli
gatcatcgtggtgaccgattccagt

SEQ ID NO: 194715 - DNA, 25 bp, E. coli
gatcatcgtggtcaccgattccagt

SEQ ID NO: 194716 - DNA, 25 bp, E. coli
gatcaggctgagcaatcgctgcaaa

SEQ ID NO: 194717 - DNA, 25 bp, E. coli
ggaccaccacttttgagattgctcg

SEQ ID NO: 194718 - DNA, 25 bp, E. coli
ggaccaccacttatgagattgctcg

SEQ ID NO: 194719 - DNA, 25 bp, E. coli
gagtaataccgacgcttcaggtgag

SEQ ID NO: 194720 - DNA, 25 bp, E. coli
gagtaataccgaggcttcaggtgag

SEQ ID NO: 194721 - DNA, 25 bp, E. coli
atttctgatgcgctagcggcaacgg

SEQ ID NO: 194722 - DNA, 25 bp, E. coli
atttctgatgcggtagcggcaacgg

SEQ ID NO: 194723 - DNA, 25 bp, E. coli
tatttcatgatcctgcgtccacagc

SEQ ID NO: 194724 - DNA, 25 bp, E. coli
tatttcatgatcgtgcgtccacagc

SEQ ID NO: 194725 - DNA, 25 bp, E. coli
tattaaacgtgacttcgtagctgcc

SEQ ID NO: 194726 - DNA, 25 bp, E. coli
tattaaacgtgagttcgtagctgcc

SEQ ID NO: 194727 - DNA, 25 bp, E. coli
tgatgctggtggtattcggtctgat

SEQ ID NO: 194728 - DNA, 25 bp, E. coli
tgatgctggtggaattcggtctgat

SEQ ID NO: 194729 - DNA, 25 bp, E. coli
tgccgaaaggcagcatgaaggcgct

SEQ ID NO: 194730 - DNA, 25 bp, E. coli
tgccgaaaggcaccatgaaggcgct

SEQ ID NO: 194731 - DNA, 25 bp, E. coli
gcggaaaacggctacattgctatcg

SEQ ID NO: 194732 - DNA, 25 bp, E. coli
gcggaaaacggcaacattgctatcg

SEQ ID NO: 194733 - DNA, 25 bp, E. coli
gaagcgcaccaaagaacacaaaaag

SEQ ID NO: 194734 - DNA, 25 bp, E. coli
gaagcgcaccaatgaacacaaaaag

SEQ ID NO: 194735 - DNA, 25 bp, E. coli
gaacacaaaaagctgatggactcca

SEQ ID NO: 194736 - DNA, 25 bp, E. coli
gaacacaaaaaggtgatggactcca

SEQ ID NO: 194737 - DNA, 25 bp, E. coli
cccgatgtctttgattttgatgctg

SEQ ID NO: 194738 - DNA, 25 bp, E. coli
cccgatgtctttcattttgatgctg

SEQ ID NO: 194739 - DNA, 25 bp, E. coli
cggcgcaaggtagcccgatgtcttt

SEQ ID NO: 194740 - DNA, 25 bp, E. coli
ctgaatgacaccactgaagtagtta

SEQ ID NO: 194741 - DNA, 25 bp, E. coli
ctgaatgacacctctgaagtagtta

SEQ ID NO: 194742 - DNA, 25 bp, E. coli
cggcgcaaggtaccccgatgtcttt

SEQ ID NO: 194743 - DNA, 25 bp, E. coli
caaaacatccgtacatgatgtacag

SEQ ID NO: 194744 - DNA, 25 bp, E. coli
caaaacatccgttcatgatgtacag

SEQ ID NO: 194745 - DNA, 25 bp, E. coli
agttcatccacattatagctgctct

SEQ ID NO: 194746 - DNA, 25 bp, E. coli
agctgctcttctcgcatttttgccg

SEQ ID NO: 194747 - DNA, 25 bp, E. coli
agctgctcttctggcatttttgccg

SEQ ID NO: 194748 - DNA, 25 bp, E. coli
agttcatccacaatatagctgctct

SEQ ID NO: 194749 - DNA, 25 bp, E. coli
tagcctgctctttccggaatgtgcc

SEQ ID NO: 194750 - DNA, 25 bp, E. coli
tagcctgctcttaccggaatgtgcc

SEQ ID NO: 194751 - DNA, 25 bp, E. coli
tttaaaaatgcgaacaaaacatccg

SEQ ID NO: 194752 - DNA, 25 bp, E. coli
tttaaaaatgcgtacaaaacatccg

SEQ ID NO: 194753 - DNA, 25 bp, E. coli
tgccagggactgctgtcagaaagcc

SEQ ID NO: 194754 - DNA, 25 bp, E. coli
tgccagggactggtgtcagaaagcc

SEQ ID NO: 194755 - DNA, 25 bp, E. coli
gaaagcctccggttagcctgctctt

SEQ ID NO: 194756 - DNA, 25 bp, E. coli
gaaagcctccggatagcctgctctt

SEQ ID NO: 194757 - DNA, 25 bp, E. coli
gaaaaaccggaatttcagtctctgt

SEQ ID NO: 194758 - DNA, 25 bp, E. coli
gaaaaaccggaaattcagtctctgt

SEQ ID NO: 194759 - DNA, 25 bp, E. coli
ggaatgtgccggttatgaaaaaccg

SEQ ID NO: 194760 - DNA, 25 bp, E. coli
tggtgtcagaaagcctccggttagc

SEQ ID NO: 194761 - DNA, 25 bp, E. coli
ggaatgtgccggatatgaaaaaccg

SEQ ID NO: 194762 - DNA, 25 bp, E. coli
tggtgtcagaaaccctccggttagc

SEQ ID NO: 194763 - DNA, 25 bp, E. coli
gatgtacagattaaactgccaggga

SEQ ID NO: 194764 - DNA, 25 bp, E. coli
gatgtacagatttaactgccaggga

SEQ ID NO: 194765 - DNA, 25 bp, E. coli
caaaaagagatgactgaacgcgagc

SEQ ID NO: 194766 - DNA, 25 bp, E. coli
caaaaagagatgtctgaacgcgagc

SEQ ID NO: 194767 - DNA, 25 bp, E. coli
agcaggcttatataccggatcctga

SEQ ID NO: 194768 - DNA, 25 bp, E. coli
agcaggcttataaaccggatcctga

SEQ ID NO: 194769 - DNA, 25 bp, E. coli
agcaaatacgtccacgcgcggcagg

SEQ ID NO: 194770 - DNA, 25 bp, E. coli
agcaaatacgtcgacgcgcggcagg

SEQ ID NO: 194771 - DNA, 25 bp, E. coli
aacactgctggaacgggcgcggatt

SEQ ID NO: 194772 - DNA, 25 bp, E. coli
aacactgctggatcgggcgcggatt

SEQ ID NO: 194773 - DNA, 25 bp, E. coli
ttagctggtcaggaaatacgtcgac

SEQ ID NO: 194774 - DNA, 25 bp, E. coli
ttagctggtcagcaaatacgtcgac

SEQ ID NO: 194775 - DNA, 25 bp, E. coli
ttaaaacactgcaggatcgggcgcg

SEQ ID NO: 194776 - DNA, 25 bp, E. coli
ttaaaacactgctggatcgggcgcg

SEQ ID NO: 194777 - DNA, 25 bp, E. coli
tgaggctgaagccaaaaaagcccgc

SEQ ID NO: 194778 - DNA, 25 bp, E. coli
tgactgaacgcgtgcagcgtgaact

SEQ ID NO: 194779 - DNA, 25 bp, E. coli
tgaggctgaagcgaaaaaagcccgc

SEQ ID NO: 194780 - DNA, 25 bp, E. coli
tgactgaacgcgagcagcgtgaact

SEQ ID NO: 194781 - DNA, 25 bp, E. coli
gcgagcagcgtgaacttaaaacact

SEQ ID NO: 194782 - DNA, 25 bp, E. coli
gcgagcagcgtgtacttaaaacact

SEQ ID NO: 194783 - DNA, 25 bp, E. coli
gaaaaagcaggcttataaaccggat

SEQ ID NO: 194784 - DNA, 25 bp, E. coli
gaaaaagcaggcatataaaccggat

SEQ ID NO: 194785 - DNA, 25 bp, E. coli
ccgtattacccataaagagatgact

SEQ ID NO: 194786 - DNA, 25 bp, E. coli
ccgtattacccaaaaagagatgact

SEQ ID NO: 194787 - DNA, 25 bp, E. coli
caaccgcagtgagtgagtctgcaaa

SEQ ID NO: 194788 - DNA, 25 bp, E. coli
caaccgcagtgactgagtctgcaaa

SEQ ID NO: 194789 - DNA, 25 bp, E. coli
cttgatgacgtggtttacgacccca

SEQ ID NO: 194790 - DNA, 25 bp, E. coli
cttgatgacgtgctttacgacccca

SEQ ID NO: 194791 - DNA, 25 bp, E. coli
tacgtcttgtcctgccatatcgcga

SEQ ID NO: 194792 - DNA, 25 bp, E. coli
tacgtcttgtccagccatatcgcga

SEQ ID NO: 194793 - DNA, 25 bp, E. coli
tattacagactcacaaccacatgat

SEQ ID NO: 194794 - DNA, 25 bp, E. coli
tattacagactctcaaccacatgat

SEQ ID NO: 194795 - DNA, 25 bp, E. coli
ttttttgatgaaagccttggctgcg

SEQ ID NO: 194796 - DNA, 25 bp, E. coli
ttttttgatgaatgccttggctgcg

SEQ ID NO: 194797 - DNA, 25 bp, E. coli
tgataaagagaagattcaggcacgt

SEQ ID NO: 194798 - DNA, 25 bp, E. coli
tgataaagagaacattcaggcacgt

SEQ ID NO: 194799 - DNA, 25 bp, E. coli
gaaattgggcagatgaaaccagacg

SEQ ID NO: 194800 - DNA, 25 bp, E. coli
gaaattgggcagttgaaaccagacg

SEQ ID NO: 194801 - DNA, 25 bp, E. coli
gaccccatttagtagtcaaccgcag

SEQ ID NO: 194802 - DNA, 25 bp, E. coli
gacgtttcgcccgtattacagactc

SEQ ID NO: 194803 - DNA, 25 bp, E. coli
gacgtttcgcccctattacagactc

SEQ ID NO: 194804 - DNA, 25 bp, E. coli
cgcgaaatttctgcgcaaaagcaca

SEQ ID NO: 194805 - DNA, 25 bp, E. coli
cgcgaaatttctccgcaaaagcaca

SEQ ID NO: 194806 - DNA, 25 bp, E. coli
ggatgaataccctctagtttactgc

SEQ ID NO: 194807 - DNA, 25 bp, E. coli
ggatgaatacccactagtttactgc

SEQ ID NO: 194808 - DNA, 25 bp, E. coli
gaccccatttagaagtcaaccgcag

SEQ ID NO: 194809 - DNA, 25 bp, E. coli
taaaatcgagatatcccgcctggac

SEQ ID NO: 194810 - DNA, 25 bp, E. coli
taaaatcgagatttcccgcctggac

SEQ ID NO: 194811 - DNA, 25 bp, E. coli
aaatatttccctggatcagctgcag

SEQ ID NO: 194812 - DNA, 25 bp, E. coli
aaatatttccctcgatcagctgcag

SEQ ID NO: 194813 - DNA, 25 bp, E. coli
aacaattaccgcatcgcgttacgga

SEQ ID NO: 194814 - DNA, 25 bp, E. coli
aacaattaccgcttcgcgttacgga

SEQ ID NO: 194815 - DNA, 25 bp, E. coli
tttaaacacagccagacccattgcg

SEQ ID NO: 194816 - DNA, 25 bp, E. coli
tttaaacacagcgagacccattgcg

SEQ ID NO: 194817 - DNA, 25 bp, E. coli
tcgcgacggcaaaatagtgaataaa

SEQ ID NO: 194818 - DNA, 25 bp, E. coli
tcgcgacggcaatatagtgaataaa

SEQ ID NO: 194819 - DNA, 25 bp, E. coli
gcagcacctgaatagacggccatta

SEQ ID NO: 194820 - DNA, 25 bp, E. coli
gcagcacctgaaaagacggccatta

SEQ ID NO: 194821 - DNA, 25 bp, E. coli
gacttgtgcagaaatcctccagcct

SEQ ID NO: 194822 - DNA, 25 bp, E. coli
gacttgtgcagatatcctccagcct

SEQ ID NO: 194823 - DNA, 25 bp, E. coli
cgctgcttgatgaaaatggctggca

SEQ ID NO: 194824 - DNA, 25 bp, E. coli
cgctgcttgatgtaaatggctggca

SEQ ID NO: 194825 - DNA, 25 bp, E. coli
gatttacattgcaaaacgcagagtg

SEQ ID NO: 194826 - DNA, 25 bp, E. coli
gatttacattgctaaacgcagagtg

SEQ ID NO: 194827 - DNA, 25 bp, E. coli
ggaagtatcaacactatcagcgcca

SEQ ID NO: 194828 - DNA, 25 bp, E. coli
ggaagtatcaactctatcagcgcca

SEQ ID NO: 194829 - DNA, 25 bp, E. coli
gagttcttaatgatggtgcagcacc

SEQ ID NO: 194830 - DNA, 25 bp, E. coli
gagttcttaatgttggtgcagcacc

SEQ ID NO: 194831 - DNA, 25 bp, E. coli
cacagttgttggcttccgttttcag

SEQ ID NO: 194832 - DNA, 25 bp, E. coli
cacagttgttgggttccgttttcag

SEQ ID NO: 194833 - DNA, 25 bp, E. coli
cagtcgtggcacaaattctggttcc

SEQ ID NO: 194834 - DNA, 25 bp, E. coli
cagtcgtggcactaattctggttcc

SEQ ID NO: 194835 - DNA, 25 bp, E. coli
agctactttattggcggtgccgccg

SEQ ID NO: 194836 - DNA, 25 bp, E. coli
agctactttattcgcggtgccgccg

SEQ ID NO: 194837 - DNA, 25 bp, E. coli
ttaacttactggactggtggcgagg

SEQ ID NO: 194838 - DNA, 25 bp, E. coli
ttaacttactggtctggtggcgagg

SEQ ID NO: 194839 - DNA, 25 bp, E. coli
tgctgggctgccagacctttgccaa

SEQ ID NO: 194840 - DNA, 25 bp, E. coli
tgctgggctgcctgacctttgccaa

SEQ ID NO: 194841 - DNA, 25 bp, E. coli
gcattatggcgtggtctgccacaaa

SEQ ID NO: 194842 - DNA, 25 bp, E. coli
gcattatggcgtcgtctgccacaaa

SEQ ID NO: 194843 - DNA, 25 bp, E. coli
gtttggtcacacttccgtactggcg

SEQ ID NO: 194844 - DNA, 25 bp, E. coli
gtttggtcacacatccgtactggcg

SEQ ID NO: 194845 - DNA, 25 bp, E. coli
ggttttcatcgtcaggaagccgcaa

SEQ ID NO: 194846 - DNA, 25 bp, E. coli
ggttttcatcgtgaggaagccgcaa

SEQ ID NO: 194847 - DNA, 25 bp, E. coli
tggcgcgacgattgccctggttaac

SEQ ID NO: 194848 - DNA, 25 bp, E. coli
tggcgcgacgatagccctggttaac

SEQ ID NO: 194849 - DNA, 25 bp, E. coli
ggcgtgcatatcactaaccagacgg

SEQ ID NO: 194850 - DNA, 25 bp, E. coli
ggcgtgcatatctctaaccagacgg

SEQ ID NO: 194851 - DNA, 25 bp, E. coli
ggtgccgccggtacgctaatttcag

SEQ ID NO: 194852 - DNA, 25 bp, E. coli
ggtgccgccggttcgctaatttcag

SEQ ID NO: 194853 - DNA, 25 bp, E. coli
caatattttcttcccgacagctggt

SEQ ID NO: 194854 - DNA, 25 bp, E. coli
caatattttcttgccgacagctggt

SEQ ID NO: 194855 - DNA, 25 bp, E. coli
taaagaaggtgatgtaacgctggcg

SEQ ID NO: 194856 - DNA, 25 bp, E. coli
taaagaaggtgaagtaacgctggcg

SEQ ID NO: 194857 - DNA, 25 bp, E. coli
tttgatttacgccaacggcgtgggc

SEQ ID NO: 194858 - DNA, 25 bp, E. coli
tttgatttacgcgaacggcgtgggc

SEQ ID NO: 194859 - DNA, 25 bp, E. coli
ttagaaaacgccacggaagatctgg

SEQ ID NO: 194860 - DNA, 25 bp, E. coli
ttagaaaacgcctcggaagatctgg

SEQ ID NO: 194861 - DNA, 25 bp, E. coli
ccagtatttaaacgcagcagaggcc

SEQ ID NO: 194862 - DNA, 25 bp, E. coli
ccagtatttaaaggcagcagaggcc

SEQ ID NO: 194863 - DNA, 25 bp, E. coli
gccgtcgatgccgaaatgctgcttg

SEQ ID NO: 194864 - DNA, 25 bp, E. coli
gccgtcgatgcccaaatgctgcttg

SEQ ID NO: 194865 - DNA, 25 bp, E. coli
gaatattgggcagagaaagccgccg

SEQ ID NO: 194866 - DNA, 25 bp, E. coli
gaagatctggagtacgactctgccg

SEQ ID NO: 194867 - DNA, 25 bp, E. coli
gaatattgggcacagaaagccgccg

SEQ ID NO: 194868 - DNA, 25 bp, E. coli
gaagatctggagaacgactctgccg

SEQ ID NO: 194869 - DNA, 25 bp, E. coli
cgtgggcattaaggccgacgatgac

SEQ ID NO: 194870 - DNA, 25 bp, E. coli
cgtgggcattaacgccgacgatgac

SEQ ID NO: 194871 - DNA, 25 bp, E. coli
ggtcagtctggagtatccacaagca

SEQ ID NO: 194872 - DNA, 25 bp, E. coli
ggtcagtctggactatccacaagca

SEQ ID NO: 194873 - DNA, 25 bp, E. coli
taacgctggcgcttattctggtaaa

SEQ ID NO: 194874 - DNA, 25 bp, E. coli
taacgctggcgcatattctggtaaa

SEQ ID NO: 194875 - DNA, 25 bp, E. coli
caacgatggctctgtagggacattc

SEQ ID NO: 194876 - DNA, 25 bp, E. coli
caacgatggctcagtagggacattc

SEQ ID NO: 194877 - DNA, 25 bp, E. coli
caattatttctttggcgacaacggg

SEQ ID NO: 194878 - DNA, 25 bp, E. coli
caattatttcttaggcgacaacggg

SEQ ID NO: 194879 - DNA, 25 bp, E. coli
caaagagccgcattgcatgaacgtc

SEQ ID NO: 194880 - DNA, 25 bp, E. coli
caaagagccgcaatgcatgaacgtc

SEQ ID NO: 194881 - DNA, 25 bp, E. coli
tatggcgatctcaactataccgcgg

SEQ ID NO: 194882 - DNA, 25 bp, E. coli
tatggcgatctctactataccgcgg

SEQ ID NO: 194883 - DNA, 25 bp, E. coli
tcttgcgtatatcaggaaaaggcct

SEQ ID NO: 194884 - DNA, 25 bp, E. coli
tcttgcgtatatgaggaaaaggcct

SEQ ID NO: 194885 - DNA, 25 bp, E. coli
gccaccgctgtgaaatctcttgtac

SEQ ID NO: 194886 - DNA, 25 bp, E. coli
gccaccgctgtgtaatctcttgtac

SEQ ID NO: 194887 - DNA, 25 bp, E. coli
gaacccggttgaacgtccactatta

SEQ ID NO: 194888 - DNA, 25 bp, E. coli
gaacccggttgatcgtccactatta

SEQ ID NO: 194889 - DNA, 25 bp, E. coli
gaaagaaggctgaattaccgtcgat

SEQ ID NO: 194890 - DNA, 25 bp, E. coli
gaaagaaggctgtattaccgtcgat

SEQ ID NO: 194891 - DNA, 25 bp, E. coli
cgattggtgcgaatacctggcagca

SEQ ID NO: 194892 - DNA, 25 bp, E. coli
cgattggtgcgattacctggcagca

SEQ ID NO: 194893 - DNA, 25 bp, E. coli
ggatgatggccaccgtaaataccga

SEQ ID NO: 194894 - DNA, 25 bp, E. coli
ggatgatggccagcgtaaataccga

SEQ ID NO: 194895 - DNA, 25 bp, E. coli
ggacacctgccgtcaatgcaaagag

SEQ ID NO: 194896 - DNA, 25 bp, E. coli
ggacacctgccgacaatgcaaagag

SEQ ID NO: 194897 - DNA, 25 bp, E. coli
taaagagccggaactggactgtgct

SEQ ID NO: 194898 - DNA, 25 bp, E. coli
taaagagccggatctggactgtgct

SEQ ID NO: 194899 - DNA, 25 bp, E. coli
agatgggactcattgcactagcgcg

SEQ ID NO: 194900 - DNA, 25 bp, E. coli
agatgggactcaatgcactagcgcg

SEQ ID NO: 194901 - DNA, 25 bp, E. coli
aaaaatgattgatgaccttacggcg

SEQ ID NO: 194902 - DNA, 25 bp, E. coli
aaaaatgattgaagaccttacggcg

SEQ ID NO: 194903 - DNA, 25 bp, E. coli
tgaaaatagcctccgtaaagagccg

SEQ ID NO: 194904 - DNA, 25 bp, E. coli
tgaaatgagcactatccagagcaat

SEQ ID NO: 194905 - DNA, 25 bp, E. coli
tgaaatgagcacaatccagagcaat

SEQ ID NO: 194906 - DNA, 25 bp, E. coli
tgaaaatagcctgcgtaaagagccg

SEQ ID NO: 194907 - DNA, 25 bp, E. coli
tcttgaagaggaagttcgtgcgcaa

SEQ ID NO: 194908 - DNA, 25 bp, E. coli
tcttgaagaggatgttcgtgcgcaa

SEQ ID NO: 194909 - DNA, 25 bp, E. coli
gaagaatctccttttggcagcgatg

SEQ ID NO: 194910 - DNA, 25 bp, E. coli
gaagaatctcctattggcagcgatg

SEQ ID NO: 194911 - DNA, 25 bp, E. coli
cgatgaaggtgcagatgctctaaac

SEQ ID NO: 194912 - DNA, 25 bp, E. coli
cgatgaaggtgctgatgctctaaac

SEQ ID NO: 194913 - DNA, 25 bp, E. coli
cgtgcgcaattagtagtcgatgaaa

SEQ ID NO: 194914 - DNA, 25 bp, E. coli
cgtgcgcaattactagtcgatgaaa

SEQ ID NO: 194915 - DNA, 25 bp, E. coli
gattacctacgcaactgcattcggt

SEQ ID NO: 194916 - DNA, 25 bp, E. coli
gattacctacgctactgcattcggt

SEQ ID NO: 194917 - DNA, 25 bp, E. coli
ggtaaattccagtcaaaagagttcg

SEQ ID NO: 194918 - DNA, 25 bp, E. coli
ggtaaattccagacaaaagagttcg

SEQ ID NO: 194919 - DNA, 25 bp, E. coli
caaaatacccgaaaggagagcacgt

SEQ ID NO: 194920 - DNA, 25 bp, E. coli
caaaatacccgataggagagcacgt

SEQ ID NO: 194921 - DNA, 25 bp, E. coli
tattccgcgcaggatgcctgggtgc

SEQ ID NO: 194922 - DNA, 25 bp, E. coli
tattccacaaaatgcagataggtcg

SEQ ID NO: 194923 - DNA, 25 bp, E. coli
tattccacaaaaagcagataggtcg

SEQ ID NO: 194924 - DNA, 25 bp, E. coli
tattccgcgcagcatgcctgggtgc

SEQ ID NO: 194925 - DNA, 25 bp, E. coli
tgggtgccctatgtcagcctgacgg

SEQ ID NO: 194926 - DNA, 25 bp, E. coli
tgggtgccctatctcagcctgacgg

SEQ ID NO: 194927 - DNA, 25 bp, E. coli
tgcgctgggcgtactctattatgac

SEQ ID NO: 194928 - DNA, 25 bp, E. coli
tgcgctgggcgttctctattatgac

SEQ ID NO: 194929 - DNA, 25 bp, E. coli
gcatttcagagactgagtcccgtcg

SEQ ID NO: 194930 - DNA, 25 bp, E. coli
gcatttcagagagtgagtcccgtcg

SEQ ID NO: 194931 - DNA, 25 bp, E. coli
gcagctgcggacgttctggataaca

SEQ ID NO: 194932 - DNA, 25 bp, E. coli
gcagctgcggaccttctggataaca

SEQ ID NO: 194933 - DNA, 25 bp, E. coli
ccgtcgtagcggactggcaagttat

SEQ ID NO: 194934 - DNA, 25 bp, E. coli
ccgtcgtagcggtctggcaagttat

SEQ ID NO: 194935 - DNA, 25 bp, E. coli
ggttgcctggtatcaccacgagcgt

SEQ ID NO: 194936 - DNA, 25 bp, E. coli
ggttgcctggtaacaccacgagcgt

SEQ ID NO: 194937 - DNA, 25 bp, E. coli
ggaaccgtgaaaccctctgcagctg

SEQ ID NO: 194938 - DNA, 25 bp, E. coli
ggaaccgtgaaagcctctgcagctg

SEQ ID NO: 194939 - DNA, 25 bp, E. coli
gagattaccgactgcccgatgattg

SEQ ID NO: 194940 - DNA, 25 bp, E. coli
gagattaccgacagcccgatgattg

SEQ ID NO: 194941 - DNA, 25 bp, E. coli
taaagcgatcaacgactttggcggc

SEQ ID NO: 194942 - DNA, 25 bp, E. coli
taaagcgatcaaggactttggcggc

SEQ ID NO: 194943 - DNA, 25 bp, E. coli
tgatgtataccggtgcaacagccct

SEQ ID NO: 194944 - DNA, 25 bp, E. coli
tgatgtataccgctgcaacagccct

SEQ ID NO: 194945 - DNA, 25 bp, E. coli
tcccagccagatcaaagtgccgttt

SEQ ID NO: 194946 - DNA, 25 bp, E. coli
tcccagccagatgaaagtgccgttt

SEQ ID NO: 194947 - DNA, 25 bp, E. coli
tcagaactggttggatacgggcgat

SEQ ID NO: 194948 - DNA, 25 bp, E. coli
tcagaactggttcgatacgggcgat

SEQ ID NO: 194949 - DNA, 25 bp, E. coli
ccaggcaagctttggcgtaaccagt

SEQ ID NO: 194950 - DNA, 25 bp, E. coli
ccaggcaagcttaggcgtaaccagt

SEQ ID NO: 194951 - DNA, 25 bp, E. coli
gaagtgccgcctaagccgaaagatg

SEQ ID NO: 194952 - DNA, 25 bp, E. coli
gaagtgccgccttagccgaaagatg

SEQ ID NO: 194953 - DNA, 25 bp, E. coli
cgtgtcatccggtaaagtggtcttt

SEQ ID NO: 194954 - DNA, 25 bp, E. coli
cgtgtcatccggaaaagtggtcttt

SEQ ID NO: 194955 - DNA, 25 bp, E. coli
ggtttaacgtgcaggaagtgccgcc

SEQ ID NO: 194956 - DNA, 25 bp, E. coli
ggtttaacgtgctggaagtgccgcc

SEQ ID NO: 194957 - DNA, 25 bp, E. coli
taatgaggtcaacctggaaagcggc

SEQ ID NO: 194958 - DNA, 25 bp, E. coli
taaccagtctgccaggaagcgtgtc

SEQ ID NO: 194959 - DNA, 25 bp, E. coli
taatgaggtcaagctggaaagcggc

SEQ ID NO: 194960 - DNA, 25 bp, E. coli
taaccagtctgcgaggaagcgtgtc

SEQ ID NO: 194961 - DNA, 25 bp, E. coli
gatgctgaggctcacaaaaacttgt

SEQ ID NO: 194962 - DNA, 25 bp, E. coli
gatgctgaggctgacaaaaacttgt

SEQ ID NO: 194963 - DNA, 25 bp, E. coli
aattcagggcgcagattcattcagc

SEQ ID NO: 194964 - DNA, 25 bp, E. coli
aattgcgttggcgtatattagcatg

SEQ ID NO: 194965 - DNA, 25 bp, E. coli
aattcagggcgctgattcattcagc

SEQ ID NO: 194966 - DNA, 25 bp, E. coli
aattgcgttggcctatattagcatg

SEQ ID NO: 194967 - DNA, 25 bp, E. coli
tatcttactgaaggccacactggcg

SEQ ID NO: 194968 - DNA, 25 bp, E. coli
tatcttactgaacgccacactggcg

SEQ ID NO: 194969 - DNA, 25 bp, E. coli
tattagcatggaatgcgaagcggct

SEQ ID NO: 194970 - DNA, 25 bp, E. coli
tattagcatggattgcgaagcggct

SEQ ID NO: 194971 - DNA, 25 bp, E. coli
tgttttttaccacaattcagggcgc

SEQ ID NO: 194972 - DNA, 25 bp, E. coli
tgtaatcacattaggtatcaacggc

SEQ ID NO: 194973 - DNA, 25 bp, E. coli
tgtaatcacatttggtatcaacggc

SEQ ID NO: 194974 - DNA, 25 bp, E. coli
tgttttttaccagaattcagggcgc

SEQ ID NO: 194975 - DNA, 25 bp, E. coli
tcagcgcacctaaacgatagtaaag

SEQ ID NO: 194976 - DNA, 25 bp, E. coli
gccacactggcgaaaaatgtgttcg

SEQ ID NO: 194977 - DNA, 25 bp, E. coli
gccacactggcgtaaaatgtgttcg

SEQ ID NO: 194978 - DNA, 25 bp, E. coli
cgatagacgcagtgtcaggaggaac

SEQ ID NO: 194979 - DNA, 25 bp, E. coli
cgaagcggctttttcttactgaacg

SEQ ID NO: 194980 - DNA, 25 bp, E. coli
cgatagacgcagagtcaggaggaac

SEQ ID NO: 194981 - DNA, 25 bp, E. coli
cgaagcggctttatcttactgaacg

SEQ ID NO: 194982 - DNA, 25 bp, E. coli
ggtatcaacggctatatgaattgcg

SEQ ID NO: 194983 - DNA, 25 bp, E. coli
ggtatcaacggcaatatgaattgcg

SEQ ID NO: 194984 - DNA, 25 bp, E. coli
tcagcgcacctatacgatagtaaag

SEQ ID NO: 194985 - DNA, 25 bp, E. coli
caattacgtgatgaacggcagggca

SEQ ID NO: 194986 - DNA, 25 bp, E. coli
caattacgtgatcaacggcagggca

SEQ ID NO: 194987 - DNA, 25 bp, E. coli
cagatgcagccagcgctatggatgt

SEQ ID NO: 194988 - DNA, 25 bp, E. coli
cagatgcagccaccgctatggatgt

SEQ ID NO: 194989 - DNA, 25 bp, E. coli
tgacgcgatgggagaaacaattacg

SEQ ID NO: 194990 - DNA, 25 bp, E. coli
tgacgcgatgggtgaaacaattacg

SEQ ID NO: 194991 - DNA, 25 bp, E. coli
tccgtgagctcacgaaaaagctaca

SEQ ID NO: 194992 - DNA, 25 bp, E. coli
tccgtgagctcaggaaaaagctaca

SEQ ID NO: 194993 - DNA, 25 bp, E. coli
cctttccacaatgacgcgatgggtg

SEQ ID NO: 194994 - DNA, 25 bp, E. coli
cctttccacaatcacgcgatgggtg

SEQ ID NO: 194995 - DNA, 25 bp, E. coli
gcggaggtttttagaatgagacgaa

SEQ ID NO: 194996 - DNA, 25 bp, E. coli
gcggaggttttttgaatgagacgaa

SEQ ID NO: 194997 - DNA, 25 bp, E. coli
gcgctatggatgtcggcctttccac

SEQ ID NO: 194998 - DNA, 25 bp, E. coli
gcgctatggatgacggcctttccac

SEQ ID NO: 194999 - DNA, 25 bp, E. coli
gaacaacacaggagtcataatgaaa

SEQ ID NO: 195000 - DNA, 25 bp, E. coli
gaactacaccgtggcagatgcagcc

SEQ ID NO: 195001 - DNA, 25 bp, E. coli
gaactacaccgtcgcagatgcagcc

SEQ ID NO: 195002 - DNA, 25 bp, E. coli
gaacaacacaggtgtcataatgaaa

SEQ ID NO: 195003 - DNA, 25 bp, E. coli
ggaacaaattgaaatccgtgagctc

SEQ ID NO: 195004 - DNA, 25 bp, E. coli
ggaacaaattgatatccgtgagctc

SEQ ID NO: 195005 - DNA, 25 bp, E. coli
tggtcgttgacctgaactacaccgt

SEQ ID NO: 195006 - DNA, 25 bp, E. coli
tggtcgttgaccagaactacaccgt

SEQ ID NO: 195007 - DNA, 25 bp, E. coli
caatgagcagtgtatcgtcggtaac

SEQ ID NO: 195008 - DNA, 25 bp, E. coli
aattcgcttatctgtttcctgccag

SEQ ID NO: 195009 - DNA, 25 bp, E. coli
aattcgcttatcagtttcctgccag

SEQ ID NO: 195010 - DNA, 25 bp, E. coli
caatgagcagtgaatcgtcggtaac

SEQ ID NO: 195011 - DNA, 25 bp, E. coli
cagacggtgctcctctgtaatgcgt

SEQ ID NO: 195012 - DNA, 25 bp, E. coli
catgattcctcacaccagattagtt

SEQ ID NO: 195013 - DNA, 25 bp, E. coli
cagacggtgctcgtctgtaatgcgt

SEQ ID NO: 195014 - DNA, 25 bp, E. coli
catgattcctcagaccagattagtt

SEQ ID NO: 195015 - DNA, 25 bp, E. coli
tctggcttccccttaccttcaaatg

SEQ ID NO: 195016 - DNA, 25 bp, E. coli
tctggcttccccataccttcaaatg

SEQ ID NO: 195017 - DNA, 25 bp, E. coli
cctctgtaatgcgtcgggaccagaa

SEQ ID NO: 195018 - DNA, 25 bp, E. coli
cctctgtaatgcctcgggaccagaa

SEQ ID NO: 195019 - DNA, 25 bp, E. coli
gcagtgaatcgtcggtaaccgcgta

SEQ ID NO: 195020 - DNA, 25 bp, E. coli
gcagtgaatcgtgggtaaccgcgta

SEQ ID NO: 195021 - DNA, 25 bp, E. coli
ctgtttcctgcctgtacagataatc

SEQ ID NO: 195022 - DNA, 25 bp, E. coli
ctgtttcctgccagtacagataatc

SEQ ID NO: 195023 - DNA, 25 bp, E. coli
gataacgacatgctgcaatgagcag

SEQ ID NO: 195024 - DNA, 25 bp, E. coli
gataacgacatggtgcaatgagcag

SEQ ID NO: 195025 - DNA, 25 bp, E. coli
taaccgcgtataccagacggtgctc

SEQ ID NO: 195026 - DNA, 25 bp, E. coli
tcaataatgatatcgacatgctgca

SEQ ID NO: 195027 - DNA, 25 bp, E. coli
taaccgcgtatagcagacggtgctc

SEQ ID NO: 195028 - DNA, 25 bp, E. coli
tcaataatgataacgacatgctgca

SEQ ID NO: 195029 - DNA, 25 bp, E. coli
cacatctgcaaatggtggcggcgct

SEQ ID NO: 195030 - DNA, 25 bp, E. coli
cacatctgcaaaaggtggcggcgct

SEQ ID NO: 195031 - DNA, 25 bp, E. coli
aaaatattctgcaaagcggcgaacg

SEQ ID NO: 195032 - DNA, 25 bp, E. coli
aaaatattctgctaagcggcgaacg

SEQ ID NO: 195033 - DNA, 25 bp, E. coli
tgtgagtcaggatggcaaaccgtcg

SEQ ID NO: 195034 - DNA, 25 bp, E. coli
tgtgagtcaggaaggcaaaccgtcg

SEQ ID NO: 195035 - DNA, 25 bp, E. coli
tgtttgcaaaaggtgcgtaacgcgc

SEQ ID NO: 195036 - DNA, 25 bp, E. coli
tgtttgcaaaagctgcgtaacgcgc

SEQ ID NO: 195037 - DNA, 25 bp, E. coli
tgcctttgacgatcgctacggtgac

SEQ ID NO: 195038 - DNA, 25 bp, E. coli
tgcctttgacgaacgctacggtgac

SEQ ID NO: 195039 - DNA, 25 bp, E. coli
cctgaatataaagtcgaagcgggtg

SEQ ID NO: 195040 - DNA, 25 bp, E. coli
cctgaatataaactcgaagcgggtg

SEQ ID NO: 195041 - DNA, 25 bp, E. coli
gctcactgaagctggcacgggatta

SEQ ID NO: 195042 - DNA, 25 bp, E. coli
gctgaataaaccatccggtacggcg

SEQ ID NO: 195043 - DNA, 25 bp, E. coli
gctgaataaaccttccggtacggcg

SEQ ID NO: 195044 - DNA, 25 bp, E. coli
gctcactgaagcaggcacgggatta

SEQ ID NO: 195045 - DNA, 25 bp, E. coli
gaactggttcatcgtcttgaccggg

SEQ ID NO: 195046 - DNA, 25 bp, E. coli
gaactggttcatggtcttgaccggg

SEQ ID NO: 195047 - DNA, 25 bp, E. coli
ggaagaacgctaagcatttgccacc

SEQ ID NO: 195048 - DNA, 25 bp, E. coli
ggaagaacgctatgcatttgccacc

SEQ ID NO: 195049 - DNA, 25 bp, E. coli
gatgcaaaaagattacctggcgctg

SEQ ID NO: 195050 - DNA, 25 bp, E. coli
gatgcaaaaagaatacctggcgctg

SEQ ID NO: 195051 - DNA, 25 bp, E. coli
aagtgaaacccggtatggatgtggc

SEQ ID NO: 195052 - DNA, 25 bp, E. coli
aagtgaaacccgctatggatgtggc

SEQ ID NO: 195053 - DNA, 25 bp, E. coli
cagcgagcgcctgccgggctgaatg

SEQ ID NO: 195054 - DNA, 25 bp, E. coli
cagcgagcgcctcccgggctgaatg

SEQ ID NO: 195055 - DNA, 25 bp, E. coli
aggtgcgctttgctgatggctattc

SEQ ID NO: 195056 - DNA, 25 bp, E. coli
aggtgcgctttggtgatggctattc

SEQ ID NO: 195057 - DNA, 25 bp, E. coli
aaaggtgcgcttaggtgatggctat

SEQ ID NO: 195058 - DNA, 25 bp, E. coli
aaacccggtatgcatgtggcttcgg

SEQ ID NO: 195059 - DNA, 25 bp, E. coli
aaaggtgcgctttggtgatggctat

SEQ ID NO: 195060 - DNA, 25 bp, E. coli
aaaacgtacagcctgacgctttctg

SEQ ID NO: 195061 - DNA, 25 bp, E. coli
aaacccggtatggatgtggcttcgg

SEQ ID NO: 195062 - DNA, 25 bp, E. coli
aaaacgtacagcgtgacgctttctg

SEQ ID NO: 195063 - DNA, 25 bp, E. coli
tgtggacgccgccttatgagtggcg

SEQ ID NO: 195064 - DNA, 25 bp, E. coli
tgtggacgccgcgttatgagtggcg

SEQ ID NO: 195065 - DNA, 25 bp, E. coli
tgaaacccggtaaggatgtggcttc

SEQ ID NO: 195066 - DNA, 25 bp, E. coli
tgaaacccggtatggatgtggcttc

SEQ ID NO: 195067 - DNA, 25 bp, E. coli
tccgctggaaagtgaaacccggtat

SEQ ID NO: 195068 - DNA, 25 bp, E. coli
tccgctggaaagagaaacccggtat

SEQ ID NO: 195069 - DNA, 25 bp, E. coli
cctttctgtggaggccgccttatga

SEQ ID NO: 195070 - DNA, 25 bp, E. coli
cctttctgtggacgccgccttatga

SEQ ID NO: 195071 - DNA, 25 bp, E. coli
gctggaaagtgaaacccggtatgga

SEQ ID NO: 195072 - DNA, 25 bp, E. coli
gctggaaagtgatacccggtatgga

SEQ ID NO: 195073 - DNA, 25 bp, E. coli
tattacattgcatcatttacgcgca

SEQ ID NO: 195074 - DNA, 25 bp, E. coli
tattacattgcaacatttacgcgca

SEQ ID NO: 195075 - DNA, 25 bp, E. coli
tttagcgtcttctagagccagcgcc

SEQ ID NO: 195076 - DNA, 25 bp, E. coli
tttagcgtcttcaagagccagcgcc

SEQ ID NO: 195077 - DNA, 25 bp, E. coli
tctatggaaatatgacggtgttcac

SEQ ID NO: 195078 - DNA, 25 bp, E. coli
tctatggaaataagacggtgttcac

SEQ ID NO: 195079 - DNA, 25 bp, E. coli
tctttgtagcactttcacggtagcg

SEQ ID NO: 195080 - DNA, 25 bp, E. coli
tctttgtagcacattcacggtagcg

SEQ ID NO: 195081 - DNA, 25 bp, E. coli
gccaggtcgatatagtttccatcag

SEQ ID NO: 195082 - DNA, 25 bp, E. coli
gccaggtcgataaagtttccatcag

SEQ ID NO: 195083 - DNA, 25 bp, E. coli
gcaatctatttggaaccccgccata

SEQ ID NO: 195084 - DNA, 25 bp, E. coli
gcaatctatttgcaaccccgccata

SEQ ID NO: 195085 - DNA, 25 bp, E. coli
gacagaacttattgacggcagtggc

SEQ ID NO: 195086 - DNA, 25 bp, E. coli
gaaagaagatttagtgccaggtcga

SEQ ID NO: 195087 - DNA, 25 bp, E. coli
gaaagaagattttgtgccaggtcga

SEQ ID NO: 195088 - DNA, 25 bp, E. coli
gacagaacttatagacggcagtggc

SEQ ID NO: 195089 - DNA, 25 bp, E. coli
cggcagtggcagctgtcataaaaaa

SEQ ID NO: 195090 - DNA, 25 bp, E. coli
cggcagtggcaggtgtcataaaaaa

SEQ ID NO: 195091 - DNA, 25 bp, E. coli
tagtttgaatggaaagatgcctgca

SEQ ID NO: 195092 - DNA, 25 bp, E. coli
tagtttgaatggtaagatgcctgca

SEQ ID NO: 195093 - DNA, 25 bp, E. coli
gatgcctgcagacacataaagacac

SEQ ID NO: 195094 - DNA, 25 bp, E. coli
gatgcctgcagagacataaagacac

SEQ ID NO: 195095 - DNA, 25 bp, E. coli
aatcactctggcgtgactggtactc

SEQ ID NO: 195096 - DNA, 25 bp, E. coli
aatcactctggcctgactggtactc

SEQ ID NO: 195097 - DNA, 25 bp, E. coli
caaagaaggtcacgggcaactgacg

SEQ ID NO: 195098 - DNA, 25 bp, E. coli
cactctggcgtgactggtactcgtt

SEQ ID NO: 195099 - DNA, 25 bp, E. coli
caaagaaggtcaggggcaactgacg

SEQ ID NO: 195100 - DNA, 25 bp, E. coli
cactctggcgtgtctggtactcgtt

SEQ ID NO: 195101 - DNA, 25 bp, E. coli
cttccctgatcgattcgcccgtaat

SEQ ID NO: 195102 - DNA, 25 bp, E. coli
cttccctgatcgtttcgcccgtaat

SEQ ID NO: 195103 - DNA, 25 bp, E. coli
actctggcgtgagtggtactcgttt

SEQ ID NO: 195104 - DNA, 25 bp, E. coli
actctggcgtgactggtactcgttt

SEQ ID NO: 195105 - DNA, 25 bp, E. coli
tcacgggcaactcacggacgggatt

SEQ ID NO: 195106 - DNA, 25 bp, E. coli
tcacgggcaactgacggacgggatt

SEQ ID NO: 195107 - DNA, 25 bp, E. coli
tcggcggcgttatagtttcaaattg

SEQ ID NO: 195108 - DNA, 25 bp, E. coli
tcggcggcgttaaagtttcaaattg

SEQ ID NO: 195109 - DNA, 25 bp, E. coli
cctcggcggcgttatagtttcaaat

SEQ ID NO: 195110 - DNA, 25 bp, E. coli
cctcggcggcgtaatagtttcaaat

SEQ ID NO: 195111 - DNA, 25 bp, E. coli
ccgaatcactctcgcgtgactggta

SEQ ID NO: 195112 - DNA, 25 bp, E. coli
gcaaccccgaatgactctggcgtga

SEQ ID NO: 195113 - DNA, 25 bp, E. coli
gcaaccccgaatcactctggcgtga

SEQ ID NO: 195114 - DNA, 25 bp, E. coli
ccctgatcgtttcgcccgtaatctt

SEQ ID NO: 195115 - DNA, 25 bp, E. coli
ccctgatcgtttggcccgtaatctt

SEQ ID NO: 195116 - DNA, 25 bp, E. coli
ccgaatcactctggcgtgactggta

SEQ ID NO: 195117 - DNA, 25 bp, E. coli
caaaaaagtcatgaaaaccggcacg

SEQ ID NO: 195118 - DNA, 25 bp, E. coli
caaaaaagtcatcaaaaccggcacg

SEQ ID NO: 195119 - DNA, 25 bp, E. coli
tacgccattgcggtgcttaagcaca

SEQ ID NO: 195120 - DNA, 25 bp, E. coli
tacgccattgcgctgcttaagcaca

SEQ ID NO: 195121 - DNA, 25 bp, E. coli
tttcgccgtccacaaagagatcgac

SEQ ID NO: 195122 - DNA, 25 bp, E. coli
tttcgccgtccagaaagagatcgac

SEQ ID NO: 195123 - DNA, 25 bp, E. coli
tgccgcgtctgctatcgtcctttcg

SEQ ID NO: 195124 - DNA, 25 bp, E. coli
tgccgcgtctgcaatcgtcctttcg

SEQ ID NO: 195125 - DNA, 25 bp, E. coli
gaagacttcctgcaacagtcccgct

SEQ ID NO: 195126 - DNA, 25 bp, E. coli
gaagacttcctggaacagtcccgct

SEQ ID NO: 195127 - DNA, 25 bp, E. coli
taaaaacttccgaggtaagccagag

SEQ ID NO: 195128 - DNA, 25 bp, E. coli
gaaaaccaccgccaaagctttgaga

SEQ ID NO: 195129 - DNA, 25 bp, E. coli
gaactgactcgccatatgaaagagg

SEQ ID NO: 195130 - DNA, 25 bp, E. coli
gacttgcccggattgtaagcgccag

SEQ ID NO: 195131 - DNA, 25 bp, E. coli
taaaaacttccgtggtaagccagag

SEQ ID NO: 195132 - DNA, 25 bp, E. coli
gaactgactcgcgatatgaaagagg

SEQ ID NO: 195133 - DNA, 25 bp, E. coli
gaaaaccaccgcgaaagctttgaga

SEQ ID NO: 195134 - DNA, 25 bp, E. coli
gacttgcccggaatgtaagcgccag

SEQ ID NO: 195135 - DNA, 25 bp, E. coli
tggtgccgtccgaccgtattgaact

SEQ ID NO: 195136 - DNA, 25 bp, E. coli
tggtgccgtccgtccgtattgaact

SEQ ID NO: 195137 - DNA, 25 bp, E. coli
taagcgccagaaatgcctggtgccg

SEQ ID NO: 195138 - DNA, 25 bp, E. coli
taagcgccagaattgcctggtgccg

SEQ ID NO: 195139 - DNA, 25 bp, E. coli
aacccatatgtgacgaatcctgccc

SEQ ID NO: 195140 - DNA, 25 bp, E. coli
cactggttatctggctaatccggag

SEQ ID NO: 195141 - DNA, 25 bp, E. coli
cactggttatctcgctaatccggag

SEQ ID NO: 195142 - DNA, 25 bp, E. coli
taaaacctgcgatctggcgtgcaaa

SEQ ID NO: 195143 - DNA, 25 bp, E. coli
taaaacctgcgaactggcgtgcaaa

SEQ ID NO: 195144 - DNA, 25 bp, E. coli
aacccatatgtgtcgaatcctgccc

SEQ ID NO: 195145 - DNA, 25 bp, E. coli
tgtaaccattgcgatgaccccgcat

SEQ ID NO: 195146 - DNA, 25 bp, E. coli
tgtaaccattgccatgaccccgcat

SEQ ID NO: 195147 - DNA, 25 bp, E. coli
tgaagatgtttgaatcggctgccgc

SEQ ID NO: 195148 - DNA, 25 bp, E. coli
tgaagatgtttgtatcggctgccgc

SEQ ID NO: 195149 - DNA, 25 bp, E. coli
tgcgtgcacttgtgttcggtccaat

SEQ ID NO: 195150 - DNA, 25 bp, E. coli
tgcgtgcacttgagttcggtccaat

SEQ ID NO: 195151 - DNA, 25 bp, E. coli
gctgtactggctgtaaaacctgcga

SEQ ID NO: 195152 - DNA, 25 bp, E. coli
gctgtactggctctaaaacctgcga

SEQ ID NO: 195153 - DNA, 25 bp, E. coli
gcatgtacaaaactctgccccagcg

SEQ ID NO: 195154 - DNA, 25 bp, E. coli
gcatgtacaaaagtctgccccagcg

SEQ ID NO: 195155 - DNA, 25 bp, E. coli
ggcgcgccacagaacaatgctgaaa

SEQ ID NO: 195156 - DNA, 25 bp, E. coli
ggcgcgccacagtacaatgctgaaa

SEQ ID NO: 195157 - DNA, 25 bp, E. coli
gatggttgttattcgcgcgtcgccg

SEQ ID NO: 195158 - DNA, 25 bp, E. coli
gattttaaagatgttggcccggaag

SEQ ID NO: 195159 - DNA, 25 bp, E. coli
gatggttgttatacgcgcgtcgccg

SEQ ID NO: 195160 - DNA, 25 bp, E. coli
gattttaaagatcttggcccggaag

SEQ ID NO: 195161 - DNA, 25 bp, E. coli
agttaaactccacgcttgccgatag

SEQ ID NO: 195162 - DNA, 25 bp, E. coli
agttaaactccaggcttgccgatag

SEQ ID NO: 195163 - DNA, 25 bp, E. coli
aaactccacgcttgccgatagccaa

SEQ ID NO: 195164 - DNA, 25 bp, E. coli
aaactccacgctagccgatagccaa

SEQ ID NO: 195165 - DNA, 25 bp, E. coli
tagccaaccgcagaatcatgtattg

SEQ ID NO: 195166 - DNA, 25 bp, E. coli
tagccaaccgcacaatcatgtattg

SEQ ID NO: 195167 - DNA, 25 bp, E. coli
tattgtgtccggtgcgactgaccac

SEQ ID NO: 195168 - DNA, 25 bp, E. coli
tattgtgtccggagcgactgaccac

SEQ ID NO: 195169 - DNA, 25 bp, E. coli
gccgatagccaagcgcagaatcatg

SEQ ID NO: 195170 - DNA, 25 bp, E. coli
gccgatagccaaccgcagaatcatg

SEQ ID NO: 195171 - DNA, 25 bp, E. coli
gaatcatgtattctgtccggtgcga

SEQ ID NO: 195172 - DNA, 25 bp, E. coli
gaatcatgtattgtgtccggtgcga

SEQ ID NO: 195173 - DNA, 25 bp, E. coli
gaccacgcctgacagactaagtaag

SEQ ID NO: 195174 - DNA, 25 bp, E. coli
gactgaccacgcgtgacagactaag

SEQ ID NO: 195175 - DNA, 25 bp, E. coli
gaccacgcctgagagactaagtaag

SEQ ID NO: 195176 - DNA, 25 bp, E. coli
gactgaccacgcctgacagactaag

SEQ ID NO: 195177 - DNA, 25 bp, E. coli
cgcctgacagacaaagtaagatggg

SEQ ID NO: 195178 - DNA, 25 bp, E. coli
cgcctgacagactaagtaagatggg

SEQ ID NO: 195179 - DNA, 25 bp, E. coli
gtgatgtgcttaatgatgctcaagt

SEQ ID NO: 195180 - DNA, 25 bp, E. coli
gtgatgtgcttattgatgctcaagt

SEQ ID NO: 195181 - DNA, 25 bp, E. coli
taatgatgctcaagttaaactccac

SEQ ID NO: 195182 - DNA, 25 bp, E. coli
taatgatgctcatgttaaactccac

SEQ ID NO: 195183 - DNA, 25 bp, E. coli
ccttccctcggtcagtgaggaccgt

SEQ ID NO: 195184 - DNA, 25 bp, E. coli
ccttccctcggtgagtgaggaccgt

SEQ ID NO: 195185 - DNA, 25 bp, E. coli
tacaggccttccctcggtgagtgag

SEQ ID NO: 195186 - DNA, 25 bp, E. coli
tacaggccttccgtcggtgagtgag

SEQ ID NO: 195187 - DNA, 25 bp, E. coli
tccctcggtgagtgaggaccgtcag

SEQ ID NO: 195188 - DNA, 25 bp, E. coli
tccctcggtgagagaggaccgtcag

SEQ ID NO: 195189 - DNA, 25 bp, E. coli
ccgtcagcacggagcgatgcggaca

SEQ ID NO: 195190 - DNA, 25 bp, E. coli
ccgtcagcacggtgcgatgcggaca

SEQ ID NO: 195191 - DNA, 25 bp, E. coli
gagacgttctccgtgaaagttaact

SEQ ID NO: 195192 - DNA, 25 bp, E. coli
gagacgttctccctgaaagttaact

SEQ ID NO: 195193 - DNA, 25 bp, E. coli
cgttctccgtgatagttaactgact

SEQ ID NO: 195194 - DNA, 25 bp, E. coli
cgttctccgtgaaagttaactgact

SEQ ID NO: 195195 - DNA, 25 bp, E. coli
cgatattaacaatgcagcaacatta

SEQ ID NO: 195196 - DNA, 25 bp, E. coli
cgatattaacaaagcagcaacatta

SEQ ID NO: 195197 - DNA, 25 bp, E. coli
ctcggtgagtgaggaccgtcagcac

SEQ ID NO: 195198 - DNA, 25 bp, E. coli
ctcggtgagtgacgaccgtcagcac

SEQ ID NO: 195199 - DNA, 25 bp, E. coli
gtccgatattaacaaagcagcaaca

SEQ ID NO: 195200 - DNA, 25 bp, E. coli
gggttacaggccatccctcggtgag

SEQ ID NO: 195201 - DNA, 25 bp, E. coli
gtccgatattaagaaagcagcaaca

SEQ ID NO: 195202 - DNA, 25 bp, E. coli
gggttacaggccttccctcggtgag

SEQ ID NO: 195203 - DNA, 25 bp, E. coli
tggacaccacagaaactatttttca

SEQ ID NO: 195204 - DNA, 25 bp, E. coli
tggacaccacagtaactatttttca

SEQ ID NO: 195205 - DNA, 25 bp, E. coli
cacgcacgtgatggtaaagtcggtt

SEQ ID NO: 195206 - DNA, 25 bp, E. coli
cacgcacgtgatcgtaaagtcggtt

SEQ ID NO: 195207 - DNA, 25 bp, E. coli
acgtgagccgcctgcacgcacgtga

SEQ ID NO: 195208 - DNA, 25 bp, E. coli
acgtgagccgccagcacgcacgtga

SEQ ID NO: 195209 - DNA, 25 bp, E. coli
tttggcctgacgctgctgccgcgtc

SEQ ID NO: 195210 - DNA, 25 bp, E. coli
tttggcctgacggtgctgccgcgtc

SEQ ID NO: 195211 - DNA, 25 bp, E. coli
tgggctacacacgtgcgtatcaggg

SEQ ID NO: 195212 - DNA, 25 bp, E. coli
tgggctacacacctgcgtatcaggg

SEQ ID NO: 195213 - DNA, 25 bp, E. coli
gaactaaaattctccagcgtttttg

SEQ ID NO: 195214 - DNA, 25 bp, E. coli
gacccgttttgtgctcgaatttatg

SEQ ID NO: 195215 - DNA, 25 bp, E. coli
gacccgttttgtcctcgaatttatg

SEQ ID NO: 195216 - DNA, 25 bp, E. coli
gaactaaaattcaccagcgtttttg

SEQ ID NO: 195217 - DNA, 25 bp, E. coli
gcgtttttgtgacccacgatcagga

SEQ ID NO: 195218 - DNA, 25 bp, E. coli
gcgtttttgtgagccacgatcagga

SEQ ID NO: 195219 - DNA, 25 bp, E. coli
gaatttatgggccaagtgaaccgcc

SEQ ID NO: 195220 - DNA, 25 bp, E. coli
gaatttatgggcgaagtgaaccgcc

SEQ ID NO: 195221 - DNA, 25 bp, E. coli
ccagcttgcccaactggcggatcgt

SEQ ID NO: 195222 - DNA, 25 bp, E. coli
ccagcttgcccatctggcggatcgt

SEQ ID NO: 195223 - DNA, 25 bp, E. coli
ctgatcgtgtagatgtgatgagcca

SEQ ID NO: 195224 - DNA, 25 bp, E. coli
ctgatcgtgtagttgtgatgagcca

SEQ ID NO: 195225 - DNA, 25 bp, E. coli
ggaaatggtccagcttgcccatctg

SEQ ID NO: 195226 - DNA, 25 bp, E. coli
ggaaatggtccaccttgcccatctg

SEQ ID NO: 195227 - DNA, 25 bp, E. coli
ttgttccgtttctcattatgttgcg

SEQ ID NO: 195228 - DNA, 25 bp, E. coli
tatgttgcgcgaaggacttgaagcc

SEQ ID NO: 195229 - DNA, 25 bp, E. coli
ttgttccgtttcacattatgttgcg

SEQ ID NO: 195230 - DNA, 25 bp, E. coli
tatgttgcgcgatggacttgaagcc

SEQ ID NO: 195231 - DNA, 25 bp, E. coli
tgttgcgcgaagcacttgaagccgc

SEQ ID NO: 195232 - DNA, 25 bp, E. coli
tgttgcgcgaaggacttgaagccgc

SEQ ID NO: 195233 - DNA, 25 bp, E. coli
tctcattatgttccgcgaaggactt

SEQ ID NO: 195234 - DNA, 25 bp, E. coli
tctcattatgttgcgcgaaggactt

SEQ ID NO: 195235 - DNA, 25 bp, E. coli
gaagccgcgctgattgtcagtttga

SEQ ID NO: 195236 - DNA, 25 bp, E. coli
gaagccgcgctgtttgtcagtttga

SEQ ID NO: 195237 - DNA, 25 bp, E. coli
cgctgattgtcagtttgattgccag

SEQ ID NO: 195238 - DNA, 25 bp, E. coli
cgctgattgtcactttgattgccag

SEQ ID NO: 195239 - DNA, 25 bp, E. coli
cgaaggacttgaagccgcgctgatt

SEQ ID NO: 195240 - DNA, 25 bp, E. coli
ccgtttctcattatgttgcgcgaag

SEQ ID NO: 195241 - DNA, 25 bp, E. coli
cgaaggacttgatgccgcgctgatt

SEQ ID NO: 195242 - DNA, 25 bp, E. coli
ccgtttctcattttgttgcgcgaag

SEQ ID NO: 195243 - DNA, 25 bp, E. coli
cttgaagccgcggtgattgtcagtt

SEQ ID NO: 195244 - DNA, 25 bp, E. coli
cttgaagccgcgctgattgtcagtt

SEQ ID NO: 195245 - DNA, 25 bp, E. coli
gattgtcagtttgattgccagctat

SEQ ID NO: 195246 - DNA, 25 bp, E. coli
gattgtcagtttcattgccagctat

SEQ ID NO: 195247 - DNA, 25 bp, E. coli
gtcagtttgattcccagctatctta

SEQ ID NO: 195248 - DNA, 25 bp, E. coli
gtcagtttgattgccagctatctta

SEQ ID NO: 195249 - DNA, 25 bp, E. coli
caaggcaccagcattagtaacgaag

SEQ ID NO: 195250 - DNA, 25 bp, E. coli
caaggcaccagctttagtaacgaag

SEQ ID NO: 195251 - DNA, 25 bp, E. coli
taaatccttcggcatgacctgtgcc

SEQ ID NO: 195252 - DNA, 25 bp, E. coli
taaatccttcgggatgacctgtgcc

SEQ ID NO: 195253 - DNA, 25 bp, E. coli
tagtgattgccgtcgctgcggcgaa

SEQ ID NO: 195254 - DNA, 25 bp, E. coli
tagtgattgccgacgctgcggcgaa

SEQ ID NO: 195255 - DNA, 25 bp, E. coli
tattacggaattagtcggcactgcg

SEQ ID NO: 195256 - DNA, 25 bp, E. coli
tattacggaatttgtcggcactgcg

SEQ ID NO: 195257 - DNA, 25 bp, E. coli
ttatttctattgagctggcccgcga

SEQ ID NO: 195258 - DNA, 25 bp, E. coli
ttgaattccagtacaccgctcgtgc

SEQ ID NO: 195259 - DNA, 25 bp, E. coli
ttatttctattgtgctggcccgcga

SEQ ID NO: 195260 - DNA, 25 bp, E. coli
ttgaattccagttcaccgctcgtgc

SEQ ID NO: 195261 - DNA, 25 bp, E. coli
tgattccggtgcagtacgtcaggcg

SEQ ID NO: 195262 - DNA, 25 bp, E. coli
tgattccggtgctgtacgtcaggcg

SEQ ID NO: 195263 - DNA, 25 bp, E. coli
tctgaaattgaacgcaccatgggtg

SEQ ID NO: 195264 - DNA, 25 bp, E. coli
tctgaaattgaaggcaccatgggtg

SEQ ID NO: 195265 - DNA, 25 bp, E. coli
gctctatcggtattcttggcgcacg

SEQ ID NO: 195266 - DNA, 25 bp, E. coli
gctctatcggtaatcttggcgcacg

SEQ ID NO: 195267 - DNA, 25 bp, E. coli
gaaatccgccgtcattgacccggtg

SEQ ID NO: 195268 - DNA, 25 bp, E. coli
gaaattaaatccaccacgacgccat

SEQ ID NO: 195269 - DNA, 25 bp, E. coli
gaaatccgccgtgattgacccggtg

SEQ ID NO: 195270 - DNA, 25 bp, E. coli
gaaattaaatcctccacgacgccat

SEQ ID NO: 195271 - DNA, 25 bp, E. coli
caagaactttaacatcgcgcagaac

SEQ ID NO: 195272 - DNA, 25 bp, E. coli
caagaactttaagatcgcgcagaac

SEQ ID NO: 195273 - DNA, 25 bp, E. coli
tacctgattggtcacagctttgcca

SEQ ID NO: 195274 - DNA, 25 bp, E. coli
tacctgattggtgacagctttgcca

SEQ ID NO: 195275 - DNA, 25 bp, E. coli
ttgtacctaaaaaagcgattggcgc

SEQ ID NO: 195276 - DNA, 25 bp, E. coli
ttgtacctaaaatagcgattggcgc

SEQ ID NO: 195277 - DNA, 25 bp, E. coli
tgcggcgcaaaatgtggttcaaacc

SEQ ID NO: 195278 - DNA, 25 bp, E. coli
tgcggcgcaaaaagtggttcaaacc

SEQ ID NO: 195279 - DNA, 25 bp, E. coli
gaatctaccgatatgaccaagtggc

SEQ ID NO: 195280 - DNA, 25 bp, E. coli
gaatctaccgatttgaccaagtggc

SEQ ID NO: 195281 - DNA, 25 bp, E. coli
gactccccggaatcttatggcctcg

SEQ ID NO: 195282 - DNA, 25 bp, E. coli
gactccccggaaacttatggcctcg

SEQ ID NO: 195283 - DNA, 25 bp, E. coli
gaaaaacaaagtgatctggctgctg

SEQ ID NO: 195284 - DNA, 25 bp, E. coli
gaaaaacaaagtcatctggctgctg

SEQ ID NO: 195285 - DNA, 25 bp, E. coli
cgttcatgcaatgctacctggtggt

SEQ ID NO: 195286 - DNA, 25 bp, E. coli
cgttcatgcaatcctacctggtggt

SEQ ID NO: 195287 - DNA, 25 bp, E. coli
ggtttcctggtcattggcccgcaat

SEQ ID NO: 195288 - DNA, 25 bp, E. coli
ggtttcctggtctttggcccgcaat

SEQ ID NO: 195289 - DNA, 25 bp, E. coli
tggaagaacgcataatccgccgcga

SEQ ID NO: 195290 - DNA, 25 bp, E. coli
tggaagaacgcaaaatccgccgcga

SEQ ID NO: 195291 - DNA, 25 bp, E. coli
gacctacgggttgagcatgacgcag

SEQ ID NO: 195292 - DNA, 25 bp, E. coli
gacctacgggttcagcatgacgcag

SEQ ID NO: 195293 - DNA, 25 bp, E. coli
caatagagggcggaaagctggaact

SEQ ID NO: 195294 - DNA, 25 bp, E. coli
caatagagggcgcaaagctggaact

SEQ ID NO: 195295 - DNA, 25 bp, E. coli
cagaagaagtactgctgggcagtcc

SEQ ID NO: 195296 - DNA, 25 bp, E. coli
cagaagaagtacagctgggcagtcc

SEQ ID NO: 195297 - DNA, 25 bp, E. coli
taaactgatcgaggtgaaaagcccg

SEQ ID NO: 195298 - DNA, 25 bp, E. coli
tacacgcagatgatgaacaacacgg

SEQ ID NO: 195299 - DNA, 25 bp, E. coli
taaactgatcgacgtgaaaagcccg

SEQ ID NO: 195300 - DNA, 25 bp, E. coli
tacacgcagatgttgaacaacacgg

SEQ ID NO: 195301 - DNA, 25 bp, E. coli
aaaatatcatgaaaacccggcgcgg

SEQ ID NO: 195302 - DNA, 25 bp, E. coli
aaaatatcatgataacccggcgcgg

SEQ ID NO: 195303 - DNA, 25 bp, E. coli
ttcaggagatgatcaacagcccgga

SEQ ID NO: 195304 - DNA, 25 bp, E. coli
ttcaggagatgaacaacagcccgga

SEQ ID NO: 195305 - DNA, 25 bp, E. coli
cgcacgctgggctttatgaccgaaa

SEQ ID NO: 195306 - DNA, 25 bp, E. coli
cgcacgctgggcattatgaccgaaa

SEQ ID NO: 195307 - DNA, 25 bp, E. coli
gatttacaacgtgaacacccgcgtg

SEQ ID NO: 195308 - DNA, 25 bp, E. coli
gatttacaacgtcaacacccgcgtg

SEQ ID NO: 195309 - DNA, 25 bp, E. coli
ggtaaaaatgtggtccatgcggaca

SEQ ID NO: 195310 - DNA, 25 bp, E. coli
ggtaaaaatgtgctccatgcggaca

SEQ ID NO: 195311 - DNA, 25 bp, E. coli
tcaaaagaggcggtggcatacttcc

SEQ ID NO: 195312 - DNA, 25 bp, E. coli
tcaaaagaggcgctggcatacttcc

SEQ ID NO: 195313 - DNA, 25 bp, E. coli
gaccaggcgctgttccgtaaactga

SEQ ID NO: 195314 - DNA, 25 bp, E. coli
gaccaggcgctgatccgtaaactga

SEQ ID NO: 195315 - DNA, 25 bp, E. coli
aatttttgccgcaaggtgctaagcc

SEQ ID NO: 195316 - DNA, 25 bp, E. coli
aatttttgccgctaggtgctaagcc

SEQ ID NO: 195317 - DNA, 25 bp, E. coli
catacgacctgttggccttacgagc

SEQ ID NO: 195318 - DNA, 25 bp, E. coli
catacgacctgtaggccttacgagc

SEQ ID NO: 195319 - DNA, 25 bp, E. coli
ttgccgcaaggtcctaagccgcgag

SEQ ID NO: 195320 - DNA, 25 bp, E. coli
ttgccgcaaggtgctaagccgcgag

SEQ ID NO: 195321 - DNA, 25 bp, E. coli
tgcggcatacgagctgttggcctta

SEQ ID NO: 195322 - DNA, 25 bp, E. coli
tgcggcatacgacctgttggcctta

SEQ ID NO: 195323 - DNA, 25 bp, E. coli
gcattattgagcaggtactgaagaa

SEQ ID NO: 195324 - DNA, 25 bp, E. coli
gcattattgagctggtactgaagaa

SEQ ID NO: 195325 - DNA, 25 bp, E. coli
gaacgcattattgagcaggtactga

SEQ ID NO: 195326 - DNA, 25 bp, E. coli
gaacgcattattcagcaggtactga

SEQ ID NO: 195327 - DNA, 25 bp, E. coli
cgacagcccgatcgaacgcattatt

SEQ ID NO: 195328 - DNA, 25 bp, E. coli
cccgatggaacgcattattgagcag

SEQ ID NO: 195329 - DNA, 25 bp, E. coli
cgacagcccgatggaacgcattatt

SEQ ID NO: 195330 - DNA, 25 bp, E. coli
cgacctgttggccttacgagccgaa

SEQ ID NO: 195331 - DNA, 25 bp, E. coli
cccgatggaacggattattgagcag

SEQ ID NO: 195332 - DNA, 25 bp, E. coli
cgacctgttggcgttacgagccgaa

SEQ ID NO: 195333 - DNA, 25 bp, E. coli
ctggcgatcccgtaacggctgacca

SEQ ID NO: 195334 - DNA, 25 bp, E. coli
ctggcgatcccgaaacggctgacca

SEQ ID NO: 195335 - DNA, 25 bp, E. coli
ggctgaccacgcaaacccgcgatat

SEQ ID NO: 195336 - DNA, 25 bp, E. coli
ggctgaccacgctaacccgcgatat

SEQ ID NO: 195337 - DNA, 25 bp, E. coli
taaatggcatctacagcgtcatccg

SEQ ID NO: 195338 - DNA, 25 bp, E. coli
taaatggcatcttcagcgtcatccg

SEQ ID NO: 195339 - DNA, 25 bp, E. coli
aacaagagattttcgctattccccg

SEQ ID NO: 195340 - DNA, 25 bp, E. coli
aacaagagatttacgctattccccg

SEQ ID NO: 195341 - DNA, 25 bp, E. coli
tgtaccgtggcctaatagagaaagg

SEQ ID NO: 195342 - DNA, 25 bp, E. coli
tgtaccgtggccaaatagagaaagg

SEQ ID NO: 195343 - DNA, 25 bp, E. coli
tctctatgagaatggagggcatggt

SEQ ID NO: 195344 - DNA, 25 bp, E. coli
tctctatgagaaaggagggcatggt

SEQ ID NO: 195345 - DNA, 25 bp, E. coli
gaaaacagtctgctcatgtaccgtg

SEQ ID NO: 195346 - DNA, 25 bp, E. coli
gaaaacagtctggtcatgtaccgtg

SEQ ID NO: 195347 - DNA, 25 bp, E. coli
gattaccatcgccagttgagggaga

SEQ ID NO: 195348 - DNA, 25 bp, E. coli
gattaccatcgcgagttgagggaga

SEQ ID NO: 195349 - DNA, 25 bp, E. coli
ggttttagtattgagtgggccacag

SEQ ID NO: 195350 - DNA, 25 bp, E. coli
ggttttagtattcagtgggccacag

SEQ ID NO: 195351 - DNA, 25 bp, E. coli
ggccacagatcttcctgttggagga

SEQ ID NO: 195352 - DNA, 25 bp, E. coli
ggccacagatctacctgttggagga

SEQ ID NO: 195353 - DNA, 25 bp, E. coli
taaggaaggtacagctcttgctcca

SEQ ID NO: 195354 - DNA, 25 bp, E. coli
taaggaaggtactgctcttgctcca

SEQ ID NO: 195355 - DNA, 25 bp, E. coli
gagtaaatctctttcaggccgtatt

SEQ ID NO: 195356 - DNA, 25 bp, E. coli
gagtaaatctctatcaggccgtatt

SEQ ID NO: 195357 - DNA, 25 bp, E. coli
gatgtgacacatccaggctccagga

SEQ ID NO: 195358 - DNA, 25 bp, E. coli
gatgtgacacatgcaggctccagga

SEQ ID NO: 195359 - DNA, 25 bp, E. coli
aattttgtgttgtgtcataccgacc

SEQ ID NO: 195360 - DNA, 25 bp, E. coli
aattttgtgttgagtcataccgacc

SEQ ID NO: 195361 - DNA, 25 bp, E. coli
tttgtgttgagtgataccgacctga

SEQ ID NO: 195362 - DNA, 25 bp, E. coli
tttgtgttgagtcataccgacctga

SEQ ID NO: 195363 - DNA, 25 bp, E. coli
ttttgtgttgagacataccgacctg

SEQ ID NO: 195364 - DNA, 25 bp, E. coli
ttttgtgttgagtcataccgacctg

SEQ ID NO: 195365 - DNA, 25 bp, E. coli
tgtgttgagtcaaaccgacctgatg

SEQ ID NO: 195366 - DNA, 25 bp, E. coli
tgtgttgagtcataccgacctgatg

SEQ ID NO: 195367 - DNA, 25 bp, E. coli
ccgtcgctgcgtaattttgtgttga

SEQ ID NO: 195368 - DNA, 25 bp, E. coli
ccgtcgctgcgttattttgtgttga

SEQ ID NO: 195369 - DNA, 25 bp, E. coli
gctgcgtaattttgtgttgagtcat

SEQ ID NO: 195370 - DNA, 25 bp, E. coli
gctgcgtaatttagtgttgagtcat

SEQ ID NO: 195371 - DNA, 25 bp, E. coli
gcgtaattttgtcttgagtcatacc

SEQ ID NO: 195372 - DNA, 25 bp, E. coli
gcgtaattttgtgttgagtcatacc

SEQ ID NO: 195373 - DNA, 25 bp, E. coli
cgtaattttgtgttgagtcataccg

SEQ ID NO: 195374 - DNA, 25 bp, E. coli
cgtaattttgtgatgagtcataccg

SEQ ID NO: 195375 - DNA, 25 bp, E. coli
cgctgcgtaattatgtgttgagtca

SEQ ID NO: 195376 - DNA, 25 bp, E. coli
cgctgcgtaattttgtgttgagtca

SEQ ID NO: 195377 - DNA, 25 bp, E. coli
cgtcgctgcgtatttttgtgttgag

SEQ ID NO: 195378 - DNA, 25 bp, E. coli
cgtcgctgcgtaattttgtgttgag

SEQ ID NO: 195379 - DNA, 25 bp, E. coli
taattttgtgttcagtcataccgac

SEQ ID NO: 195380 - DNA, 25 bp, E. coli
taattttgtgttgagtcataccgac

SEQ ID NO: 195381 - DNA, 25 bp, E. coli
caccttcgccccagagaaaatttat

SEQ ID NO: 195382 - DNA, 25 bp, E. coli
caccttcgcccctgagaaaatttat

SEQ ID NO: 195383 - DNA, 25 bp, E. coli
agacggcggcttccaggcacacctt

SEQ ID NO: 195384 - DNA, 25 bp, E. coli
agacggcggcttgcaggcacacctt

SEQ ID NO: 195385 - DNA, 25 bp, E. coli
tatcttctggagtatagtcaaggag

SEQ ID NO: 195386 - DNA, 25 bp, E. coli
tattcaggttgtcagctaccgcgca

SEQ ID NO: 195387 - DNA, 25 bp, E. coli
tattcaggttgtgagctaccgcgca

SEQ ID NO: 195388 - DNA, 25 bp, E. coli
tatcttctggagaatagtcaaggag

SEQ ID NO: 195389 - DNA, 25 bp, E. coli
tccttgtttaaccatagacggcggc

SEQ ID NO: 195390 - DNA, 25 bp, E. coli
tccttgtttaacgatagacggcggc

SEQ ID NO: 195391 - DNA, 25 bp, E. coli
tcatattacccaatctaagaggaat

SEQ ID NO: 195392 - DNA, 25 bp, E. coli
tcatattacccattctaagaggaat

SEQ ID NO: 195393 - DNA, 25 bp, E. coli
gccgtctgtaagcttatcttctgga

SEQ ID NO: 195394 - DNA, 25 bp, E. coli
gccgtgccgtaaaaatatctccttg

SEQ ID NO: 195395 - DNA, 25 bp, E. coli
gccgtgccgtaataatatctccttg

SEQ ID NO: 195396 - DNA, 25 bp, E. coli
gccgtctgtaaggttatcttctgga

SEQ ID NO: 195397 - DNA, 25 bp, E. coli
gctaccgcgcattatgccgtctgta

SEQ ID NO: 195398 - DNA, 25 bp, E. coli
gctaccgcgcataatgccgtctgta

SEQ ID NO: 195399 - DNA, 25 bp, E. coli
taattaattgttcagccgccgtgcc

SEQ ID NO: 195400 - DNA, 25 bp, E. coli
tcaaggagttaggaaatatgactgc

SEQ ID NO: 195401 - DNA, 25 bp, E. coli
taattaattgttgagccgccgtgcc

SEQ ID NO: 195402 - DNA, 25 bp, E. coli
tcaaggagttagcaaatatgactgc

SEQ ID NO: 195403 - DNA, 25 bp, E. coli
catctgcatttggtcacggcggaca

SEQ ID NO: 195404 - DNA, 25 bp, E. coli
cagacagcgtggcagaaaatccata

SEQ ID NO: 195405 - DNA, 25 bp, E. coli
cagacagcgtgggagaaaatccata

SEQ ID NO: 195406 - DNA, 25 bp, E. coli
catctgcatttgctcacggcggaca

SEQ ID NO: 195407 - DNA, 25 bp, E. coli
aaaatgccgcgcctttgaccagcga

SEQ ID NO: 195408 - DNA, 25 bp, E. coli
aaaatgccgcgcgtttgaccagcga

SEQ ID NO: 195409 - DNA, 25 bp, E. coli
tagcagcaaaattaacgcggtcgcc

SEQ ID NO: 195410 - DNA, 25 bp, E. coli
tagcagcaaaataaacgcggtcgcc

SEQ ID NO: 195411 - DNA, 25 bp, E. coli
tttgaccagcgaacaacagacagcg

SEQ ID NO: 195412 - DNA, 25 bp, E. coli
ttttacgctcaatgcagcgcactgc

SEQ ID NO: 195413 - DNA, 25 bp, E. coli
tttgaccagcgatcaacagacagcg

SEQ ID NO: 195414 - DNA, 25 bp, E. coli
ttttacgctcaaagcagcgcactgc

SEQ ID NO: 195415 - DNA, 25 bp, E. coli
tcatatgggtatcggccactggtaa

SEQ ID NO: 195416 - DNA, 25 bp, E. coli
tcatatgggtatgggccactggtaa

SEQ ID NO: 195417 - DNA, 25 bp, E. coli
gctttcagcaatggcgatgggatcg

SEQ ID NO: 195418 - DNA, 25 bp, E. coli
gctttcagcaatcgcgatgggatcg

SEQ ID NO: 195419 - DNA, 25 bp, E. coli
gaatacaatgccctgttagccgcga

SEQ ID NO: 195420 - DNA, 25 bp, E. coli
gaatacaatgccgtgttagccgcga

SEQ ID NO: 195421 - DNA, 25 bp, E. coli
gaaacggaacaccaaaattgccctg

SEQ ID NO: 195422 - DNA, 25 bp, E. coli
gaaacggaacacgaaaattgccctg

SEQ ID NO: 195423 - DNA, 25 bp, E. coli
cgcggtcgccaatgagatggagaat

SEQ ID NO: 195424 - DNA, 25 bp, E. coli
cgcggtcgccaaagagatggagaat

SEQ ID NO: 195425 - DNA, 25 bp, E. coli
caaatacctgatggactacgaaaat

SEQ ID NO: 195426 - DNA, 25 bp, E. coli
cagacatggtggcactactgcatca

SEQ ID NO: 195427 - DNA, 25 bp, E. coli
caaatacctgatcgactacgaaaat

SEQ ID NO: 195428 - DNA, 25 bp, E. coli
cagacatggtgggactactgcatca

SEQ ID NO: 195429 - DNA, 25 bp, E. coli
taccgaccggatttggctggttagg

SEQ ID NO: 195430 - DNA, 25 bp, E. coli
taccgaccggatatggctggttagg

SEQ ID NO: 195431 - DNA, 25 bp, E. coli
cactttaagtcacaaccgttggctg

SEQ ID NO: 195432 - DNA, 25 bp, E. coli
cactttaagtcagaaccgttggctg

SEQ ID NO: 195433 - DNA, 25 bp, E. coli
tagcgccaggccaggctccggcagt

SEQ ID NO: 195434 - DNA, 25 bp, E. coli
tagcgccaggcctggctccggcagt

SEQ ID NO: 195435 - DNA, 25 bp, E. coli
tgtttatgacgttacgcatgacaaa

SEQ ID NO: 195436 - DNA, 25 bp, E. coli
tgtttatgacgtaacgcatgacaaa

SEQ ID NO: 195437 - DNA, 25 bp, E. coli
tgacgtaacgcatgacaaaaaatgg

SEQ ID NO: 195438 - DNA, 25 bp, E. coli
tgacgtaacgcaagacaaaaaatgg

SEQ ID NO: 195439 - DNA, 25 bp, E. coli
gctccggcagttgcggcgggtctgc

SEQ ID NO: 195440 - DNA, 25 bp, E. coli
gctccggcagttccggcgggtctgc

SEQ ID NO: 195441 - DNA, 25 bp, E. coli
gtgggactactgcatcaaatacctg

SEQ ID NO: 195442 - DNA, 25 bp, E. coli
gtgggactactggatcaaatacctg

SEQ ID NO: 195443 - DNA, 25 bp, E. coli
tccgtagtaccgaccggatttggct

SEQ ID NO: 195444 - DNA, 25 bp, E. coli
tccgtagtaccgtccggatttggct

SEQ ID NO: 195445 - DNA, 25 bp, E. coli
taacactttaagacacaaccgttgg

SEQ ID NO: 195446 - DNA, 25 bp, E. coli
taacactttaagtcacaaccgttgg

SEQ ID NO: 195447 - DNA, 25 bp, E. coli
cagtacgcgtaatctccaggaaggt

SEQ ID NO: 195448 - DNA, 25 bp, E. coli
catttgtgatcctgctttccggcgg

SEQ ID NO: 195449 - DNA, 25 bp, E. coli
catttgtgatccagctttccggcgg

SEQ ID NO: 195450 - DNA, 25 bp, E. coli
cagtacgcgtaaactccaggaaggt

SEQ ID NO: 195451 - DNA, 25 bp, E. coli
tatctcccgcagtcaccggttgaag

SEQ ID NO: 195452 - DNA, 25 bp, E. coli
tatctcccgcagacaccggttgaag

SEQ ID NO: 195453 - DNA, 25 bp, E. coli
tgatgttcctgatcgccactgtcgg

SEQ ID NO: 195454 - DNA, 25 bp, E. coli
tgatgttcctgaacgccactgtcgg

SEQ ID NO: 195455 - DNA, 25 bp, E. coli
tctgatgtcgttcccagccggtaaa

SEQ ID NO: 195456 - DNA, 25 bp, E. coli
tctgatgtcgttgccagccggtaaa

SEQ ID NO: 195457 - DNA, 25 bp, E. coli
gcttattcaccgatccgcttggcga

SEQ ID NO: 195458 - DNA, 25 bp, E. coli
gcttattcaccgttccgcttggcga

SEQ ID NO: 195459 - DNA, 25 bp, E. coli
gcatatggatgctgtggcctacacc

SEQ ID NO: 195460 - DNA, 25 bp, E. coli
gcatatggatgcagtggcctacacc

SEQ ID NO: 195461 - DNA, 25 bp, E. coli
ggaaaaccggaaaacagcacgctct

SEQ ID NO: 195462 - DNA, 25 bp, E. coli
ggaaaaccggaatacagcacgctct

SEQ ID NO: 195463 - DNA, 25 bp, E. coli
tggatctcatacacccctggcgtag

SEQ ID NO: 195464 - DNA, 25 bp, E. coli
tggatctcatactcccctggcgtag

SEQ ID NO: 195465 - DNA, 25 bp, E. coli
taatcaacgtccgacaggtgctgga

SEQ ID NO: 195466 - DNA, 25 bp, E. coli
taatcaacgtcccacaggtgctgga

SEQ ID NO: 195467 - DNA, 25 bp, E. coli
gatggttcattttcccgcaactgga

SEQ ID NO: 195468 - DNA, 25 bp, E. coli
gatggttcatttacccgcaactgga

SEQ ID NO: 195469 - DNA, 25 bp, E. coli
caacctgccgtggacgctgaaatca

SEQ ID NO: 195470 - DNA, 25 bp, E. coli
caacctgccgtgcacgctgaaatca

SEQ ID NO: 195471 - DNA, 25 bp, E. coli
taggccaccagcatcatctgaacgt

SEQ ID NO: 195472 - DNA, 25 bp, E. coli
taggccaccagcttcatctgaacgt

SEQ ID NO: 195473 - DNA, 25 bp, E. coli
tcttttgcattagagggcgcacacc

SEQ ID NO: 195474 - DNA, 25 bp, E. coli
tcttttgcattacagggcgcacacc

SEQ ID NO: 195475 - DNA, 25 bp, E. coli
gcacatctggcgcaatccattcgcg

SEQ ID NO: 195476 - DNA, 25 bp, E. coli
gcacatctggcggaatccattcgcg

SEQ ID NO: 195477 - DNA, 25 bp, E. coli
tcgtaaactggaagaactggacctc

SEQ ID NO: 195478 - DNA, 25 bp, E. coli
tcgtaaactggatgaactggacctc

SEQ ID NO: 195479 - DNA, 25 bp, E. coli
gaatcgtattatcgccgtaggccac

SEQ ID NO: 195480 - DNA, 25 bp, E. coli
gaatcgtattatggccgtaggccac

SEQ ID NO: 195481 - DNA, 25 bp, E. coli
cctactttaacgagggtgatatcgc

SEQ ID NO: 195482 - DNA, 25 bp, E. coli
cctactttaacgtgggtgatatcgc

SEQ ID NO: 195483 - DNA, 25 bp, E. coli
ggtattcagaccttccctgaccgta

SEQ ID NO: 195484 - DNA, 25 bp, E. coli
gggcgcacaccttctctcgtggaaa

SEQ ID NO: 195485 - DNA, 25 bp, E. coli
ggtattcagaccatccctgaccgta

SEQ ID NO: 195486 - DNA, 25 bp, E. coli
gggcgcacacctactctcgtggaaa

SEQ ID NO: 195487 - DNA, 25 bp, E. coli
gtcgatcatccccaggtaaaagcct

SEQ ID NO: 195488 - DNA, 25 bp, E. coli
gaccgtaccgatggcgtgtatctga

SEQ ID NO: 195489 - DNA, 25 bp, E. coli
gaccgtaccgatcgcgtgtatctga

SEQ ID NO: 195490 - DNA, 25 bp, E. coli
gtcgatcatcccgaggtaaaagcct

SEQ ID NO: 195491 - DNA, 25 bp, E. coli
cagtcgtgactatttttccttgcgg

SEQ ID NO: 195492 - DNA, 25 bp, E. coli
cagtcgtgactaattttccttgcgg

SEQ ID NO: 195493 - DNA, 25 bp, E. coli
taaatttaggataaatcctggaact

SEQ ID NO: 195494 - DNA, 25 bp, E. coli
taaatttaggattaatcctggaact

SEQ ID NO: 195495 - DNA, 25 bp, E. coli
cagccaatgcttacagtcgtgacta

SEQ ID NO: 195496 - DNA, 25 bp, E. coli
cagccaatgctttcagtcgtgacta

SEQ ID NO: 195497 - DNA, 25 bp, E. coli
tatgcctgacggtgttcacacttgt

SEQ ID NO: 195498 - DNA, 25 bp, E. coli
tatgcctgacggagttcacacttgt

SEQ ID NO: 195499 - DNA, 25 bp, E. coli
tttccttgcggaggcttgtctgaag

SEQ ID NO: 195500 - DNA, 25 bp, E. coli
tttccttgcggacgcttgtctgaag

SEQ ID NO: 195501 - DNA, 25 bp, E. coli
ttgtcgctgacataaaagattaaac

SEQ ID NO: 195502 - DNA, 25 bp, E. coli
ttgtcgctgacaaaaaagattaaac

SEQ ID NO: 195503 - DNA, 25 bp, E. coli
ttttttgtcgccgagccaatgcttt

SEQ ID NO: 195504 - DNA, 25 bp, E. coli
ttttttgtcgcccagccaatgcttt

SEQ ID NO: 195505 - DNA, 25 bp, E. coli
tcttctgtaaatagtcgctgacaaa

SEQ ID NO: 195506 - DNA, 25 bp, E. coli
tcttctgtaaattgtcgctgacaaa

SEQ ID NO: 195507 - DNA, 25 bp, E. coli
gactaattttccttgcggaggcttg

SEQ ID NO: 195508 - DNA, 25 bp, E. coli
gactaattttccatgcggaggcttg

SEQ ID NO: 195509 - DNA, 25 bp, E. coli
ggagttcacacttgtaagttttcaa

SEQ ID NO: 195510 - DNA, 25 bp, E. coli
ggcttgtctgaaccggtttccgcga

SEQ ID NO: 195511 - DNA, 25 bp, E. coli
ggagttcacactagtaagttttcaa

SEQ ID NO: 195512 - DNA, 25 bp, E. coli
ggcttgtctgaagcggtttccgcga

SEQ ID NO: 195513 - DNA, 25 bp, E. coli
caatagcgcttttgactgcccgggt

SEQ ID NO: 195514 - DNA, 25 bp, E. coli
caatagcgctttagactgcccgggt

SEQ ID NO: 195515 - DNA, 25 bp, E. coli
catccggcaggctatcagttcgtgg

SEQ ID NO: 195516 - DNA, 25 bp, E. coli
catccggcaggcaatcagttcgtgg

SEQ ID NO: 195517 - DNA, 25 bp, E. coli
aaactactggaagctgatgcgcctc

SEQ ID NO: 195518 - DNA, 25 bp, E. coli
aaactactggaacctgatgcgcctc

SEQ ID NO: 195519 - DNA, 25 bp, E. coli
tcgagcattgcgtatcacggaaaga

SEQ ID NO: 195520 - DNA, 25 bp, E. coli
tcgagcattgcgaatcacggaaaga

SEQ ID NO: 195521 - DNA, 25 bp, E. coli
tctttaaatttgtacccggtgagca

SEQ ID NO: 195522 - DNA, 25 bp, E. coli
tctgattcatgaaggtgcgccatgc

SEQ ID NO: 195523 - DNA, 25 bp, E. coli
tcagggaggtgactttttccgtcgc

SEQ ID NO: 195524 - DNA, 25 bp, E. coli
tctttaaatttgaacccggtgagca

SEQ ID NO: 195525 - DNA, 25 bp, E. coli
tctgattcatgatggtgcgccatgc

SEQ ID NO: 195526 - DNA, 25 bp, E. coli
tcagggaggtgagtttttccgtcgc

SEQ ID NO: 195527 - DNA, 25 bp, E. coli
gcgcctctggcgcaagtactgcctt

SEQ ID NO: 195528 - DNA, 25 bp, E. coli
gcgcctctggcggaagtactgcctt

SEQ ID NO: 195529 - DNA, 25 bp, E. coli
gccgacgttgcaatgggtgatcttc

SEQ ID NO: 195530 - DNA, 25 bp, E. coli
gccgacgttgcattgggtgatcttc

SEQ ID NO: 195531 - DNA, 25 bp, E. coli
gctccgacttgtgtaatgccgacgt

SEQ ID NO: 195532 - DNA, 25 bp, E. coli
gctccgacttgtctaatgccgacgt

SEQ ID NO: 195533 - DNA, 25 bp, E. coli
tggttaacggtattaatgcccgcaa

SEQ ID NO: 195534 - DNA, 25 bp, E. coli
tggttaacggtaataatgcccgcaa

SEQ ID NO: 195535 - DNA, 25 bp, E. coli
catgctgcgggtagaattcagtgcc

SEQ ID NO: 195536 - DNA, 25 bp, E. coli
catgctgcgggttgaattcagtgcc

SEQ ID NO: 195537 - DNA, 25 bp, E. coli
attcagtgccgagtttaagcaggtg

SEQ ID NO: 195538 - DNA, 25 bp, E. coli
attcagtgccgactttaagcaggtg

SEQ ID NO: 195539 - DNA, 25 bp, E. coli
tgtggacaccgcgttatgcctggcg

SEQ ID NO: 195540 - DNA, 25 bp, E. coli
tgtgccgcctggacatcacgggttc

SEQ ID NO: 195541 - DNA, 25 bp, E. coli
tgtgccgcctggtcatcacgggttc

SEQ ID NO: 195542 - DNA, 25 bp, E. coli
tgtggacaccgccttatgcctggcg

SEQ ID NO: 195543 - DNA, 25 bp, E. coli
gaattcagtgccgagtttaagcagg

SEQ ID NO: 195544 - DNA, 25 bp, E. coli
gaattcagtgcccagtttaagcagg

SEQ ID NO: 195545 - DNA, 25 bp, E. coli
gacaccgccttatgcctggcggcag

SEQ ID NO: 195546 - DNA, 25 bp, E. coli
gacaccgccttaagcctggcggcag

SEQ ID NO: 195547 - DNA, 25 bp, E. coli
cgcctggtcatctcgggttcgcatg

SEQ ID NO: 195548 - DNA, 25 bp, E. coli
cgtttctgtggacaccgccttatgc

SEQ ID NO: 195549 - DNA, 25 bp, E. coli
cgtttctgtggagaccgccttatgc

SEQ ID NO: 195550 - DNA, 25 bp, E. coli
cgcctggtcatcacgggttcgcatg

SEQ ID NO: 195551 - DNA, 25 bp, E. coli
gtcatcacgggttcgcatgctgcgg

SEQ ID NO: 195552 - DNA, 25 bp, E. coli
gtcatcacgggtacgcatgctgcgg

SEQ ID NO: 195553 - DNA, 25 bp, E. coli
tggctggaaggcctttctgtggaca

SEQ ID NO: 195554 - DNA, 25 bp, E. coli
tggctggaaggcgtttctgtggaca

SEQ ID NO: 195555 - DNA, 25 bp, E. coli
gacctgtgccgcgtggtcatcacgg

SEQ ID NO: 195556 - DNA, 25 bp, E. coli
gacctgtgccgcctggtcatcacgg

SEQ ID NO: 195557 - DNA, 25 bp, E. coli
aacgcagagttccaactggatgatc

SEQ ID NO: 195558 - DNA, 25 bp, E. coli
aacgcagagttcgaactggatgatc

SEQ ID NO: 195559 - DNA, 25 bp, E. coli
caccggaagagtctgaacgactgga

SEQ ID NO: 195560 - DNA, 25 bp, E. coli
caccggaagagtgtgaacgactgga

SEQ ID NO: 195561 - DNA, 25 bp, E. coli
tacaccggaagactgtgaacgactg

SEQ ID NO: 195562 - DNA, 25 bp, E. coli
tacaccggaagagtgtgaacgactg

SEQ ID NO: 195563 - DNA, 25 bp, E. coli
tatggctggaaatacttgctgatta

SEQ ID NO: 195564 - DNA, 25 bp, E. coli
tatggctggaaaaacttgctgatta

SEQ ID NO: 195565 - DNA, 25 bp, E. coli
tttatacaccggaagagtgtgaacg

SEQ ID NO: 195566 - DNA, 25 bp, E. coli
tttatacaccggtagagtgtgaacg

SEQ ID NO: 195567 - DNA, 25 bp, E. coli
tcgaactggatgttctgaaatgggt

SEQ ID NO: 195568 - DNA, 25 bp, E. coli
tcgaactggatgatctgaaatgggt

SEQ ID NO: 195569 - DNA, 25 bp, E. coli
cctgctatggctggaaaaacttgct

SEQ ID NO: 195570 - DNA, 25 bp, E. coli
cctgctatggctcgaaaaacttgct

SEQ ID NO: 195571 - DNA, 25 bp, E. coli
ctgattatcaggaagggttggcaga

SEQ ID NO: 195572 - DNA, 25 bp, E. coli
ctgattatcaggtagggttggcaga

SEQ ID NO: 195573 - DNA, 25 bp, E. coli
gattcaggtgctcaaccttgaaact

SEQ ID NO: 195574 - DNA, 25 bp, E. coli
gattcaggtgctgaaccttgaaact

SEQ ID NO: 195575 - DNA, 25 bp, E. coli
ggataacgcagacttcgaactggat

SEQ ID NO: 195576 - DNA, 25 bp, E. coli
ggataacgcagagttcgaactggat

SEQ ID NO: 195577 - DNA, 25 bp, E. coli
gatgatctgaaatgggtgatcctga

SEQ ID NO: 195578 - DNA, 25 bp, E. coli
gatgatctgaaaagggtgatcctga

SEQ ID NO: 195579 - DNA, 25 bp, E. coli
aatccgccatcggaaatcgtatcag

SEQ ID NO: 195580 - DNA, 25 bp, E. coli
aatccgccatcgcaaatcgtatcag

SEQ ID NO: 195581 - DNA, 25 bp, E. coli
cagcggtaaagcgtgccggaatccg

SEQ ID NO: 195582 - DNA, 25 bp, E. coli
caaatcgtatcactcgagacacact

SEQ ID NO: 195583 - DNA, 25 bp, E. coli
cagcggtaaagcctgccggaatccg

SEQ ID NO: 195584 - DNA, 25 bp, E. coli
caaatcgtatcagtcgagacacact

SEQ ID NO: 195585 - DNA, 25 bp, E. coli
cagaaaataataatgcgcaggtaac

SEQ ID NO: 195586 - DNA, 25 bp, E. coli
cagaaaataatattgcgcaggtaac

SEQ ID NO: 195587 - DNA, 25 bp, E. coli
tcaggtgtacggcaaatggatgtca

SEQ ID NO: 195588 - DNA, 25 bp, E. coli
tcggcagaacagagaaacaaaaatg

SEQ ID NO: 195589 - DNA, 25 bp, E. coli
tcggcagaacagtgaaacaaaaatg

SEQ ID NO: 195590 - DNA, 25 bp, E. coli
tcaggtgtacgggaaatggatgtca

SEQ ID NO: 195591 - DNA, 25 bp, E. coli
cgcaggtaacgcagttaaatacaca

SEQ ID NO: 195592 - DNA, 25 bp, E. coli
cgcaggtaacgctgttaaatacaca

SEQ ID NO: 195593 - DNA, 25 bp, E. coli
gtgattcacctttttaagcccgcaa

SEQ ID NO: 195594 - DNA, 25 bp, E. coli
gtgattcaccttattaagcccgcaa

SEQ ID NO: 195595 - DNA, 25 bp, E. coli
tggtcgttaacagcaggagctaacc

SEQ ID NO: 195596 - DNA, 25 bp, E. coli
tggtcgttaacaccaggagctaacc

SEQ ID NO: 195597 - DNA, 25 bp, E. coli
gatgttcacctctgagaattcggca

SEQ ID NO: 195598 - DNA, 25 bp, E. coli
gagctaacccggcattcattgcaaa

SEQ ID NO: 195599 - DNA, 25 bp, E. coli
gatgttcacctcagagaattcggca

SEQ ID NO: 195600 - DNA, 25 bp, E. coli
gagctaacccgggattcattgcaaa

SEQ ID NO: 195601 - DNA, 25 bp, E. coli
agccggagcatttcgaggcgttgtt

SEQ ID NO: 195602 - DNA, 25 bp, E. coli
agccggagcattacgaggcgttgtt

SEQ ID NO: 195603 - DNA, 25 bp, E. coli
aacagattatgcgttgggccgggcc

SEQ ID NO: 195604 - DNA, 25 bp, E. coli
aaagcggctggaaaaatgtgtgttc

SEQ ID NO: 195605 - DNA, 25 bp, E. coli
aacagattatgccttgggccgggcc

SEQ ID NO: 195606 - DNA, 25 bp, E. coli
aaagcggctggataaatgtgtgttc

SEQ ID NO: 195607 - DNA, 25 bp, E. coli
taccagcctgcatagcgtgaagaga

SEQ ID NO: 195608 - DNA, 25 bp, E. coli
taccagcctgcaaagcgtgaagaga

SEQ ID NO: 195609 - DNA, 25 bp, E. coli
ttatcaagcgaaatgcccgcaggcg

SEQ ID NO: 195610 - DNA, 25 bp, E. coli
ttatcaagcgaattgcccgcaggcg

SEQ ID NO: 195611 - DNA, 25 bp, E. coli
tgtccggtgcacagttaccagcctg

SEQ ID NO: 195612 - DNA, 25 bp, E. coli
tgtccggcaagcgtatctctcgtga

SEQ ID NO: 195613 - DNA, 25 bp, E. coli
tgtgttcggcgaagagaaaccagcc

SEQ ID NO: 195614 - DNA, 25 bp, E. coli
tgtccggcaagcctatctctcgtga

SEQ ID NO: 195615 - DNA, 25 bp, E. coli
tgtgttcggcgatgagaaaccagcc

SEQ ID NO: 195616 - DNA, 25 bp, E. coli
tgtccggtgcactgttaccagcctg

SEQ ID NO: 195617 - DNA, 25 bp, E. coli
ccgagaatgctgaggcgtcatccga

SEQ ID NO: 195618 - DNA, 25 bp, E. coli
gaaaccagcctgaaagcagtgtccg

SEQ ID NO: 195619 - DNA, 25 bp, E. coli
gaaaccagcctgtaagcagtgtccg

SEQ ID NO: 195620 - DNA, 25 bp, E. coli
ccgagaatgctgtggcgtcatccga

SEQ ID NO: 195621 - DNA, 25 bp, E. coli
gtcatccgatctaaaccgtgcgtca

SEQ ID NO: 195622 - DNA, 25 bp, E. coli
gtcatccgatcttaaccgtgcgtca

SEQ ID NO: 195623 - DNA, 25 bp, E. coli
taacgtagtatctggtgtgttcgat

SEQ ID NO: 195624 - DNA, 25 bp, E. coli
taacgtagtatcaggtgtgttcgat

SEQ ID NO: 195625 - DNA, 25 bp, E. coli
caacatcgctgagcataacggtaac

SEQ ID NO: 195626 - DNA, 25 bp, E. coli
cagctctgtagagaatgttgttgct

SEQ ID NO: 195627 - DNA, 25 bp, E. coli
caacatcgctgaccataacggtaac

SEQ ID NO: 195628 - DNA, 25 bp, E. coli
cagctctgtagacaatgttgttgct

SEQ ID NO: 195629 - DNA, 25 bp, E. coli
catagcagcgataacgttctgaacg

SEQ ID NO: 195630 - DNA, 25 bp, E. coli
catagcagcgattacgttctgaacg

SEQ ID NO: 195631 - DNA, 25 bp, E. coli
taacggtaacgttgtatctggtgtg

SEQ ID NO: 195632 - DNA, 25 bp, E. coli
gaccgtacctggcatacttccaagt

SEQ ID NO: 195633 - DNA, 25 bp, E. coli
gaccgtacctgggatacttccaagt

SEQ ID NO: 195634 - DNA, 25 bp, E. coli
tccatagcagcgtttacgttctgaa

SEQ ID NO: 195635 - DNA, 25 bp, E. coli
tccatagcagcgattacgttctgaa

SEQ ID NO: 195636 - DNA, 25 bp, E. coli
tctaactacggtaacggtattgttg

SEQ ID NO: 195637 - DNA, 25 bp, E. coli
tctaactacggttacggtattgttg

SEQ ID NO: 195638 - DNA, 25 bp, E. coli
cgctgaccataacggtaacgtagta

SEQ ID NO: 195639 - DNA, 25 bp, E. coli
cgctgaccataagggtaacgtagta

SEQ ID NO: 195640 - DNA, 25 bp, E. coli
ctctgtagacaaagttgttgctgca

SEQ ID NO: 195641 - DNA, 25 bp, E. coli
ctctgtagacaatgttgttgctgca

SEQ ID NO: 195642 - DNA, 25 bp, E. coli
gggatacttccaagtctaactacgg

SEQ ID NO: 195643 - DNA, 25 bp, E. coli
gggatacttccatgtctaactacgg

SEQ ID NO: 195644 - DNA, 25 bp, E. coli
taacggtaacgtagtatctggtgtg

SEQ ID NO: 195645 - DNA, 25 bp, E. coli
cagtatgaagttctagatggacaac

SEQ ID NO: 195646 - DNA, 25 bp, E. coli
cagtatgaagttgtagatggacaac

SEQ ID NO: 195647 - DNA, 25 bp, E. coli
tacagttggacgctagataatgcag

SEQ ID NO: 195648 - DNA, 25 bp, E. coli
tacagttggacggtagataatgcag

SEQ ID NO: 195649 - DNA, 25 bp, E. coli
agtttattattcgttcttatcagcg

SEQ ID NO: 195650 - DNA, 25 bp, E. coli
agtttattattccttcttatcagcg

SEQ ID NO: 195651 - DNA, 25 bp, E. coli
ttataaaagctcacaatcagaagag

SEQ ID NO: 195652 - DNA, 25 bp, E. coli
ttataaaagctctcaatcagaagag

SEQ ID NO: 195653 - DNA, 25 bp, E. coli
tgtatcaataaacggcaaaatcagt

SEQ ID NO: 195654 - DNA, 25 bp, E. coli
tgtatcaataaagggcaaaatcagt

SEQ ID NO: 195655 - DNA, 25 bp, E. coli
tcttatcagcgtgcttacagttgga

SEQ ID NO: 195656 - DNA, 25 bp, E. coli
tcttatcagcgtccttacagttgga

SEQ ID NO: 195657 - DNA, 25 bp, E. coli
gaagctaaagaaagtaaggtgcagg

SEQ ID NO: 195658 - DNA, 25 bp, E. coli
gaagctaaagaatgtaaggtgcagg

SEQ ID NO: 195659 - DNA, 25 bp, E. coli
gataatgcagagcaactcattgatg

SEQ ID NO: 195660 - DNA, 25 bp, E. coli
gataatgcagaggaactcattgatg

SEQ ID NO: 195661 - DNA, 25 bp, E. coli
ggtgcaggatatgcttactgaaaac

SEQ ID NO: 195662 - DNA, 25 bp, E. coli
ggtgcaggatatccttactgaaaac

SEQ ID NO: 195663 - DNA, 25 bp, E. coli
taagcattattgactccgagctaaa

SEQ ID NO: 195664 - DNA, 25 bp, E. coli
taagcattattgtctccgagctaaa

SEQ ID NO: 195665 - DNA, 25 bp, E. coli
gatggacaacaaggtcttacaacgt

SEQ ID NO: 195666 - DNA, 25 bp, E. coli
gatggacaacaacgtcttacaacgt

SEQ ID NO: 195667 - DNA, 25 bp, E. coli
taaaccgctggatgtggtgcgtacc

SEQ ID NO: 195668 - DNA, 25 bp, E. coli
taaaccgctggaagtggtgcgtacc

SEQ ID NO: 195669 - DNA, 25 bp, E. coli
tgatcaccaatatcggcaaaggcga

SEQ ID NO: 195670 - DNA, 25 bp, E. coli
tgatcaccaataacggcaaaggcga

SEQ ID NO: 195671 - DNA, 25 bp, E. coli
tgacgtcggtccatacgagcagtcg

SEQ ID NO: 195672 - DNA, 25 bp, E. coli
tgacgtcggtccttacgagcagtcg

SEQ ID NO: 195673 - DNA, 25 bp, E. coli
tcctggtataaagacgaagcgccgc

SEQ ID NO: 195674 - DNA, 25 bp, E. coli
tcccgggcggctacattgagaatgc

SEQ ID NO: 195675 - DNA, 25 bp, E. coli
tcctggtataaacacgaagcgccgc

SEQ ID NO: 195676 - DNA, 25 bp, E. coli
tcccgggcggcttcattgagaatgc

SEQ ID NO: 195677 - DNA, 25 bp, E. coli
gaaagcgcgaaggactcctggtata

SEQ ID NO: 195678 - DNA, 25 bp, E. coli
gaaagcgcgaagcactcctggtata

SEQ ID NO: 195679 - DNA, 25 bp, E. coli
gaaactgactggcaacacgctggaa

SEQ ID NO: 195680 - DNA, 25 bp, E. coli
gaaactgactgggaacacgctggaa

SEQ ID NO: 195681 - DNA, 25 bp, E. coli
cgtaacatcattgtggctgcgcaca

SEQ ID NO: 195682 - DNA, 25 bp, E. coli
cgtaacatcattctggctgcgcaca

SEQ ID NO: 195683 - DNA, 25 bp, E. coli
gtatgtactaccactcacgcgctgt

SEQ ID NO: 195684 - DNA, 25 bp, E. coli
gtgaactacctgagcgtgccggaat

SEQ ID NO: 195685 - DNA, 25 bp, E. coli
gtgaactacctgtgcgtgccggaat

SEQ ID NO: 195686 - DNA, 25 bp, E. coli
gtatgtactacctctcacgcgctgt

SEQ ID NO: 195687 - DNA, 25 bp, E. coli
tcaaagatctggttgccagcggtca

SEQ ID NO: 195688 - DNA, 25 bp, E. coli
tcaaagatctggatgccagcggtca

SEQ ID NO: 195689 - DNA, 25 bp, E. coli
aatgatattgcgatttgggataacc

SEQ ID NO: 195690 - DNA, 25 bp, E. coli
aatgatattgcgttttgggataacc

SEQ ID NO: 195691 - DNA, 25 bp, E. coli
atccggtggtgcgaacgcatccggt

SEQ ID NO: 195692 - DNA, 25 bp, E. coli
atccggtggtgccaacgcatccggt

SEQ ID NO: 195693 - DNA, 25 bp, E. coli
aaaccggagtttcaggtgcgctggc

SEQ ID NO: 195694 - DNA, 25 bp, E. coli
aaaccggagtttgaggtgcgctggc

SEQ ID NO: 195695 - DNA, 25 bp, E. coli
tatgaggcgctcactgttcccttcc

SEQ ID NO: 195696 - DNA, 25 bp, E. coli
tatgaggcgctctctgttcccttcc

SEQ ID NO: 195697 - DNA, 25 bp, E. coli
tgctacatccggtggtgcgaacgca

SEQ ID NO: 195698 - DNA, 25 bp, E. coli
tgctacatccggaggtgcgaacgca

SEQ ID NO: 195699 - DNA, 25 bp, E. coli
gcgagaaagagagcgaagccttgtt

SEQ ID NO: 195700 - DNA, 25 bp, E. coli
gcgagaaagagaccgaagccttgtt

SEQ ID NO: 195701 - DNA, 25 bp, E. coli
gcaacgcgcgctcgcccagcgtttt

SEQ ID NO: 195702 - DNA, 25 bp, E. coli
gcaacgcgcgctggcccagcgtttt

SEQ ID NO: 195703 - DNA, 25 bp, E. coli
ccgttgctacatccggtggtgcgaa

SEQ ID NO: 195704 - DNA, 25 bp, E. coli
cgcgcccgttaaccgataatcagtt

SEQ ID NO: 195705 - DNA, 25 bp, E. coli
ccgttgctacatgcggtggtgcgaa

SEQ ID NO: 195706 - DNA, 25 bp, E. coli
cgcgcccgttaagcgataatcagtt

SEQ ID NO: 195707 - DNA, 25 bp, E. coli
cgttaagcgataatcagtttgaaca

SEQ ID NO: 195708 - DNA, 25 bp, E. coli
cgttaagcgatattcagtttgaaca

SEQ ID NO: 195709 - DNA, 25 bp, E. coli
tggatacccatatcgataatccgcc

SEQ ID NO: 195710 - DNA, 25 bp, E. coli
tggatacccataacgataatccgcc

SEQ ID NO: 195711 - DNA, 25 bp, E. coli
caagcgtgctttgtgcgaaggcgaa

SEQ ID NO: 195712 - DNA, 25 bp, E. coli
caagcgtgctttctgcgaaggcgaa

SEQ ID NO: 195713 - DNA, 25 bp, E. coli
catggctggagaaggaagaaccgca

SEQ ID NO: 195714 - DNA, 25 bp, E. coli
catcagtcttgaacacagcgtcgga

SEQ ID NO: 195715 - DNA, 25 bp, E. coli
catcagtcttgatcacagcgtcgga

SEQ ID NO: 195716 - DNA, 25 bp, E. coli
catggctggagatggaagaaccgca

SEQ ID NO: 195717 - DNA, 25 bp, E. coli
tagtgaaaatcaagccgacggcaac

SEQ ID NO: 195718 - DNA, 25 bp, E. coli
tagtgaaaatcatgccgacggcaac

SEQ ID NO: 195719 - DNA, 25 bp, E. coli
tgttttactgcctgcaacgcgggat

SEQ ID NO: 195720 - DNA, 25 bp, E. coli
tgtcatggacgcaatcagaaaccgg

SEQ ID NO: 195721 - DNA, 25 bp, E. coli
tgttttactgccagcaacgcgggat

SEQ ID NO: 195722 - DNA, 25 bp, E. coli
tgtcatggacgctatcagaaaccgg

SEQ ID NO: 195723 - DNA, 25 bp, E. coli
tcgaaagggatctctgccggacata

SEQ ID NO: 195724 - DNA, 25 bp, E. coli
tcgaaagggatcactgccggacata

SEQ ID NO: 195725 - DNA, 25 bp, E. coli
gaaggattcttctcccagttagcca

SEQ ID NO: 195726 - DNA, 25 bp, E. coli
gaaggattcttcacccagttagcca

SEQ ID NO: 195727 - DNA, 25 bp, E. coli
gaactggtgcgttaatatctcggca

SEQ ID NO: 195728 - DNA, 25 bp, E. coli
gaactggtgcgtaaatatctcggca

SEQ ID NO: 195729 - DNA, 25 bp, E. coli
ccggcggcccgctgaattataaaga

SEQ ID NO: 195730 - DNA, 25 bp, E. coli
ccggcggcccgcagaattataaaga

SEQ ID NO: 195731 - DNA, 25 bp, E. coli
gacgatgtcaaaacctggaccggcg

SEQ ID NO: 195732 - DNA, 25 bp, E. coli
gacgatgtcaaatcctggaccggcg

SEQ ID NO: 195733 - DNA, 25 bp, E. coli
catattcacttaagtatgcgcggat

SEQ ID NO: 195734 - DNA, 25 bp, E. coli
catattcacttatgtatgcgcggat

SEQ ID NO: 195735 - DNA, 25 bp, E. coli
tttagccagagatgtcgttatacca

SEQ ID NO: 195736 - DNA, 25 bp, E. coli
tttagccagagaagtcgttatacca

SEQ ID NO: 195737 - DNA, 25 bp, E. coli
ttcgggccctacatcgcaaaaaaca

SEQ ID NO: 195738 - DNA, 25 bp, E. coli
ttcgggccctacttcgcaaaaaaca

SEQ ID NO: 195739 - DNA, 25 bp, E. coli
tccagaactgccacgtattacggtc

SEQ ID NO: 195740 - DNA, 25 bp, E. coli
tccagaactgcctcgtattacggtc

SEQ ID NO: 195741 - DNA, 25 bp, E. coli
tctggtcttgatataacgggtagct

SEQ ID NO: 195742 - DNA, 25 bp, E. coli
tctggtcttgatttaacgggtagct

SEQ ID NO: 195743 - DNA, 25 bp, E. coli
gctgatctctgtaccgttgtctaaa

SEQ ID NO: 195744 - DNA, 25 bp, E. coli
gctgtcaatggtactgcgcaatatc

SEQ ID NO: 195745 - DNA, 25 bp, E. coli
gctgatctctgttccgttgtctaaa

SEQ ID NO: 195746 - DNA, 25 bp, E. coli
gctgtcaatggttctgcgcaatatc

SEQ ID NO: 195747 - DNA, 25 bp, E. coli
gaataaaaatcccatgccctcggaa

SEQ ID NO: 195748 - DNA, 25 bp, E. coli
gaataaaaatccgatgccctcggaa

SEQ ID NO: 195749 - DNA, 25 bp, E. coli
tgtctaaaaaaggtcgtctggttgg

SEQ ID NO: 195750 - DNA, 25 bp, E. coli
tgtctaaaaaagctcgtctggttgg

SEQ ID NO: 195751 - DNA, 25 bp, E. coli
gacgtttatgaacacgcttccaaag

SEQ ID NO: 195752 - DNA, 25 bp, E. coli
gacgtttatgaagacgcttccaaag

SEQ ID NO: 195753 - DNA, 25 bp, E. coli
tcaagacatcagtgcagaagaatca

SEQ ID NO: 195754 - DNA, 25 bp, E. coli
tcaagacatcagagcagaagaatca

SEQ ID NO: 195755 - DNA, 25 bp, E. coli
caatgtgccggtcaatttaagccaa

SEQ ID NO: 195756 - DNA, 25 bp, E. coli
caatgtgccggtgaatttaagccaa

SEQ ID NO: 195757 - DNA, 25 bp, E. coli
acaaacagcggaatgcgcaggcgca

SEQ ID NO: 195758 - DNA, 25 bp, E. coli
acaaacagcggattgcgcaggcgca

SEQ ID NO: 195759 - DNA, 25 bp, E. coli
tttgggaaataagcgagaaagccga

SEQ ID NO: 195760 - DNA, 25 bp, E. coli
tttgggaaataaccgagaaagccga

SEQ ID NO: 195761 - DNA, 25 bp, E. coli
tattacgtcgaaacaaaagatggcg

SEQ ID NO: 195762 - DNA, 25 bp, E. coli
tattacgtcgaatcaaaagatggcg

SEQ ID NO: 195763 - DNA, 25 bp, E. coli
tgcgcgccggacaaagaactctgtt

SEQ ID NO: 195764 - DNA, 25 bp, E. coli
tgcgcgccggactaagaactctgtt

SEQ ID NO: 195765 - DNA, 25 bp, E. coli
gctttaacagccacaccatcgagta

SEQ ID NO: 195766 - DNA, 25 bp, E. coli
gctttaacagcctcaccatcgagta

SEQ ID NO: 195767 - DNA, 25 bp, E. coli
gaaagccgattagatcgcacagcgg

SEQ ID NO: 195768 - DNA, 25 bp, E. coli
gaaagccgattacatcgcacagcgg

SEQ ID NO: 195769 - DNA, 25 bp, E. coli
gattgatggcaaggtcaacatccgc

SEQ ID NO: 195770 - DNA, 25 bp, E. coli
gatcacgttatccaaagcgcgcctg

SEQ ID NO: 195771 - DNA, 25 bp, E. coli
gatcacgttatcgaaagcgcgcctg

SEQ ID NO: 195772 - DNA, 25 bp, E. coli
gattgatggcaacgtcaacatccgc

SEQ ID NO: 195773 - DNA, 25 bp, E. coli
tggcacatctacagcaattcgctgg

SEQ ID NO: 195774 - DNA, 25 bp, E. coli
tggcacatctactgcaattcgctgg

SEQ ID NO: 195775 - DNA, 25 bp, E. coli
tcaccctggcggttggctttaacag

SEQ ID NO: 195776 - DNA, 25 bp, E. coli
tcaccctggcggatggctttaacag

SEQ ID NO: 195777 - DNA, 25 bp, E. coli
caacagccgtttctggctatgcgca

SEQ ID NO: 195778 - DNA, 25 bp, E. coli
caacagccgtttgtggctatgcgca

SEQ ID NO: 195779 - DNA, 25 bp, E. coli
tatcagactgaaccggagcgttttc

SEQ ID NO: 195780 - DNA, 25 bp, E. coli
tatcagactgaagcggagcgttttc

SEQ ID NO: 195781 - DNA, 25 bp, E. coli
tttgagcgggcaaccttcgaacagg

SEQ ID NO: 195782 - DNA, 25 bp, E. coli
tttgagcgggcatccttcgaacagg

SEQ ID NO: 195783 - DNA, 25 bp, E. coli
tattgctgagcctttccgccaggaa

SEQ ID NO: 195784 - DNA, 25 bp, E. coli
tattgctgagccattccgccaggaa

SEQ ID NO: 195785 - DNA, 25 bp, E. coli
tattgtcgacgccaattgcggcgag

SEQ ID NO: 195786 - DNA, 25 bp, E. coli
tatacagtctgccagagaaagcggc

SEQ ID NO: 195787 - DNA, 25 bp, E. coli
tatacagtctgcgagagaaagcggc

SEQ ID NO: 195788 - DNA, 25 bp, E. coli
tattgtcgacgcgaattgcggcgag

SEQ ID NO: 195789 - DNA, 25 bp, E. coli
gcaatcttcattgcgccaggcctgg

SEQ ID NO: 195790 - DNA, 25 bp, E. coli
gcaatcttcattccgccaggcctgg

SEQ ID NO: 195791 - DNA, 25 bp, E. coli
cgatgtctcggatttaatggcggcg

SEQ ID NO: 195792 - DNA, 25 bp, E. coli
cgatgtctcggaattaatggcggcg

SEQ ID NO: 195793 - DNA, 25 bp, E. coli
gttaaatcgcattccaatcacgggc

SEQ ID NO: 195794 - DNA, 25 bp, E. coli
gttaaatcgcataccaatcacgggc

SEQ ID NO: 195795 - DNA, 25 bp, E. coli
gatcgtaaatattgccagcagccag

SEQ ID NO: 195796 - DNA, 25 bp, E. coli
gatcgtaaatatagccagcagccag

SEQ ID NO: 195797 - DNA, 25 bp, E. coli
ggattaccggtactaacaacagccg

SEQ ID NO: 195798 - DNA, 25 bp, E. coli
ggattaccggtagtaacaacagccg

SEQ ID NO: 195799 - DNA, 25 bp, E. coli
taggcaataaagatctggaccgcgt

SEQ ID NO: 195800 - DNA, 25 bp, E. coli
taggcaataaagttctggaccgcgt

SEQ ID NO: 195801 - DNA, 25 bp, E. coli
tatcgactgtctcggcatgcgcgaa

SEQ ID NO: 195802 - DNA, 25 bp, E. coli
tatcgactgtctgggcatgcgcgaa

SEQ ID NO: 195803 - DNA, 25 bp, E. coli
tgatggcccacgttatcaaccaacg

SEQ ID NO: 195804 - DNA, 25 bp, E. coli
tgatggcccacgatatcaaccaacg

SEQ ID NO: 195805 - DNA, 25 bp, E. coli
tgccattgaaactggcgctgacgcg

SEQ ID NO: 195806 - DNA, 25 bp, E. coli
tgccattgaaacaggcgctgacgcg

SEQ ID NO: 195807 - DNA, 25 bp, E. coli
cctgctctatgtcggcggtaacctg

SEQ ID NO: 195808 - DNA, 25 bp, E. coli
cctgctctatgtgggcggtaacctg

SEQ ID NO: 195809 - DNA, 25 bp, E. coli
gaaaacatgactacgctgacgtgga

SEQ ID NO: 195810 - DNA, 25 bp, E. coli
gaaaacatgacttcgctgacgtgga

SEQ ID NO: 195811 - DNA, 25 bp, E. coli
gacttagaagatctttgccagctga

SEQ ID NO: 195812 - DNA, 25 bp, E. coli
gacttagaagatgtttgccagctga

SEQ ID NO: 195813 - DNA, 25 bp, E. coli
gtttttagcaaccacgacttcagag

SEQ ID NO: 195814 - DNA, 25 bp, E. coli
gtttttagcaacgacgacttcagag

SEQ ID NO: 195815 - DNA, 25 bp, E. coli
gatttgatcgcgactttgccccaag

SEQ ID NO: 195816 - DNA, 25 bp, E. coli
gatttgatcgcgtctttgccccaag

SEQ ID NO: 195817 - DNA, 25 bp, E. coli
taatctgggcgtaatggtcagccag

SEQ ID NO: 195818 - DNA, 25 bp, E. coli
taacctggtggtcggaaaacatgac

SEQ ID NO: 195819 - DNA, 25 bp, E. coli
taacctggtggtgggaaaacatgac

SEQ ID NO: 195820 - DNA, 25 bp, E. coli
taatctgggcgttatggtcagccag

SEQ ID NO: 195821 - DNA, 25 bp, E. coli
catcatatacataaactctggagga

SEQ ID NO: 195822 - DNA, 25 bp, E. coli
cagatcgcatcaggttatgtttcgt

SEQ ID NO: 195823 - DNA, 25 bp, E. coli
cagatcgcatcacgttatgtttcgt

SEQ ID NO: 195824 - DNA, 25 bp, E. coli
catcatatacattaactctggagga

SEQ ID NO: 195825 - DNA, 25 bp, E. coli
aaagccatgctcacgtttcctaaga

SEQ ID NO: 195826 - DNA, 25 bp, E. coli
aaagccatgctctcgtttcctaaga

SEQ ID NO: 195827 - DNA, 25 bp, E. coli
tatgtttcgtttgtcatcaacctca

SEQ ID NO: 195828 - DNA, 25 bp, E. coli
tatgtttcgtttctcatcaacctca

SEQ ID NO: 195829 - DNA, 25 bp, E. coli
tacgcgttatccctgccggatgtgg

SEQ ID NO: 195830 - DNA, 25 bp, E. coli
tacgcgttatccgtgccggatgtgg

SEQ ID NO: 195831 - DNA, 25 bp, E. coli
ttcatattgccgacaaagtacgcgt

SEQ ID NO: 195832 - DNA, 25 bp, E. coli
ttcatattgccgtcaaagtacgcgt

SEQ ID NO: 195833 - DNA, 25 bp, E. coli
tcctaagagttgatgcattttgcta

SEQ ID NO: 195834 - DNA, 25 bp, E. coli
tcctaagagttgttgcattttgcta

SEQ ID NO: 195835 - DNA, 25 bp, E. coli
cctatccggcattcacagatcgcat

SEQ ID NO: 195836 - DNA, 25 bp, E. coli
cctatccggcatacacagatcgcat

SEQ ID NO: 195837 - DNA, 25 bp, E. coli
gacaaagtacgccttatccctgccg

SEQ ID NO: 195838 - DNA, 25 bp, E. coli
gacaaagtacgcgttatccctgccg

SEQ ID NO: 195839 - DNA, 25 bp, E. coli
tcaataagatagataagtagaactg

SEQ ID NO: 195840 - DNA, 25 bp, E. coli
tcaataagatagttaagtagaactg

SEQ ID NO: 195841 - DNA, 25 bp, E. coli
taagtagaactgtgaaagccatgct

SEQ ID NO: 195842 - DNA, 25 bp, E. coli
taagtagaactgagaaagccatgct

SEQ ID NO: 195843 - DNA, 25 bp, E. coli
cagtcggcgctgaaatctgtctgca

SEQ ID NO: 195844 - DNA, 25 bp, E. coli
cagtcggcgctgtaatctgtctgca

SEQ ID NO: 195845 - DNA, 25 bp, E. coli
catgtcaagtcgctgcaaggaagcc

SEQ ID NO: 195846 - DNA, 25 bp, E. coli
catgtcaagtcggtgcaaggaagcc

SEQ ID NO: 195847 - DNA, 25 bp, E. coli
tatgaggtgctctatctgcctgcgc

SEQ ID NO: 195848 - DNA, 25 bp, E. coli
tatgaggtgctcaatctgcctgcgc

SEQ ID NO: 195849 - DNA, 25 bp, E. coli
ttttcggtaaacgtgcagcccatgt

SEQ ID NO: 195850 - DNA, 25 bp, E. coli
ttttcggtaaacctgcagcccatgt

SEQ ID NO: 195851 - DNA, 25 bp, E. coli
ttatcgcaactgctggaccgggtca

SEQ ID NO: 195852 - DNA, 25 bp, E. coli
ttatcgcaactggtggaccgggtca

SEQ ID NO: 195853 - DNA, 25 bp, E. coli
tgaagtgttggcacaatccgtcgcg

SEQ ID NO: 195854 - DNA, 25 bp, E. coli
tgaagtgttggctcaatccgtcgcg

SEQ ID NO: 195855 - DNA, 25 bp, E. coli
tcgcgataatctcgcctgtgaaact

SEQ ID NO: 195856 - DNA, 25 bp, E. coli
tcgcgataatctggcctgtgaaact

SEQ ID NO: 195857 - DNA, 25 bp, E. coli
ccagagatgaaaaccagcggcgtaa

SEQ ID NO: 195858 - DNA, 25 bp, E. coli
ccagagatgaaatccagcggcgtaa

SEQ ID NO: 195859 - DNA, 25 bp, E. coli
cggaaacgctgaactgccttgaggc

SEQ ID NO: 195860 - DNA, 25 bp, E. coli
cggaaacgctgatctgccttgaggc

SEQ ID NO: 195861 - DNA, 25 bp, E. coli
ggtaaatttttcacacagcgccagc

SEQ ID NO: 195862 - DNA, 25 bp, E. coli
ggtaaatttttctcacagcgccagc

SEQ ID NO: 195863 - DNA, 25 bp, E. coli
gaggatatctcctcgctgccggaaa

SEQ ID NO: 195864 - DNA, 25 bp, E. coli
gaggatatctccacgctgccggaaa

SEQ ID NO: 195865 - DNA, 25 bp, E. coli
caggagtctgttatctttgccgaaa

SEQ ID NO: 195866 - DNA, 25 bp, E. coli
caggagtctgttttctttgccgaaa

SEQ ID NO: 195867 - DNA, 25 bp, E. coli
taaatgttgcctatggtgtcgatgc

SEQ ID NO: 195868 - DNA, 25 bp, E. coli
taaatgttgcctttggtgtcgatgc

SEQ ID NO: 195869 - DNA, 25 bp, E. coli
taaaccgtggcagaaatgggcaatt

SEQ ID NO: 195870 - DNA, 25 bp, E. coli
taaaccgtggcacaaatgggcaatt

SEQ ID NO: 195871 - DNA, 25 bp, E. coli
tacacaggtctggtcaagagcaatg

SEQ ID NO: 195872 - DNA, 25 bp, E. coli
tacacaggtctgctcaagagcaatg

SEQ ID NO: 195873 - DNA, 25 bp, E. coli
tatacaggtgcatctaaaccgtggc

SEQ ID NO: 195874 - DNA, 25 bp, E. coli
tatacaggtgcaactaaaccgtggc

SEQ ID NO: 195875 - DNA, 25 bp, E. coli
tctgggtttaaatggagcggttgct

SEQ ID NO: 195876 - DNA, 25 bp, E. coli
tccagtgcttgccttgtacacaggt

SEQ ID NO: 195877 - DNA, 25 bp, E. coli
tctgggtttaaaaggagcggttgct

SEQ ID NO: 195878 - DNA, 25 bp, E. coli
tccagtgcttgcgttgtacacaggt

SEQ ID NO: 195879 - DNA, 25 bp, E. coli
tctcaggaattatagcaggagtctg

SEQ ID NO: 195880 - DNA, 25 bp, E. coli
tctcaggaattaaagcaggagtctg

SEQ ID NO: 195881 - DNA, 25 bp, E. coli
gaaagatgactcaccacgagatgcg

SEQ ID NO: 195882 - DNA, 25 bp, E. coli
gacattatttttgcctcgtgagtac

SEQ ID NO: 195883 - DNA, 25 bp, E. coli
gaaagatgactctccacgagatgcg

SEQ ID NO: 195884 - DNA, 25 bp, E. coli
gacattatttttccctcgtgagtac

SEQ ID NO: 195885 - DNA, 25 bp, E. coli
tacttgggcagtactttaattccgg

SEQ ID NO: 195886 - DNA, 25 bp, E. coli
tacttgggcagttctttaattccgg

SEQ ID NO: 195887 - DNA, 25 bp, E. coli
aaatagctaccctctccggcatgaa

SEQ ID NO: 195888 - DNA, 25 bp, E. coli
aaatagctacccactccggcatgaa

SEQ ID NO: 195889 - DNA, 25 bp, E. coli
tacctacacattactcaggcattgc

SEQ ID NO: 195890 - DNA, 25 bp, E. coli
tacctacacatttctcaggcattgc

SEQ ID NO: 195891 - DNA, 25 bp, E. coli
tgatagcctttgaagacctctcaaa

SEQ ID NO: 195892 - DNA, 25 bp, E. coli
tgatagcctttgtagacctctcaaa

SEQ ID NO: 195893 - DNA, 25 bp, E. coli
tgcgttgaaataaaggcttctcccg

SEQ ID NO: 195894 - DNA, 25 bp, E. coli
tgcgttgaaatataggcttctcccg

SEQ ID NO: 195895 - DNA, 25 bp, E. coli
tcttgtttgctcgagactctcaggc

SEQ ID NO: 195896 - DNA, 25 bp, E. coli
tcttgtttgctccagactctcaggc

SEQ ID NO: 195897 - DNA, 25 bp, E. coli
gcttctcccgcaaaagtattacagg

SEQ ID NO: 195898 - DNA, 25 bp, E. coli
gcttctcccgcataagtattacagg

SEQ ID NO: 195899 - DNA, 25 bp, E. coli
gacatgctagttatacgattaccgt

SEQ ID NO: 195900 - DNA, 25 bp, E. coli
gacatgctagttttacgattaccgt

SEQ ID NO: 195901 - DNA, 25 bp, E. coli
cgatttagctttatgctctgaggct

SEQ ID NO: 195902 - DNA, 25 bp, E. coli
cgatttagctttttgctctgaggct

SEQ ID NO: 195903 - DNA, 25 bp, E. coli
gtcataatgtttatggtacaaccga

SEQ ID NO: 195904 - DNA, 25 bp, E. coli
gtcataatgtttttggtacaaccga

SEQ ID NO: 195905 - DNA, 25 bp, E. coli
ggcatgaatttatcagctagaacgg

SEQ ID NO: 195906 - DNA, 25 bp, E. coli
ggcatgaatttaacagctagaacgg

SEQ ID NO: 195907 - DNA, 25 bp, E. coli
gatggtgatttgactgtctccggcc

SEQ ID NO: 195908 - DNA, 25 bp, E. coli
gatggtgatttgtctgtctccggcc

SEQ ID NO: 195909 - DNA, 25 bp, E. coli
aatcatttactgcatgcgcggttac

SEQ ID NO: 195910 - DNA, 25 bp, E. coli
aatcatttactggatgcgcggttac

SEQ ID NO: 195911 - DNA, 25 bp, E. coli
cagaaaatcattaactggatgcgcg

SEQ ID NO: 195912 - DNA, 25 bp, E. coli
cagaaaatcatttactggatgcgcg

SEQ ID NO: 195913 - DNA, 25 bp, E. coli
attaacgcaccttatctgcctgggt

SEQ ID NO: 195914 - DNA, 25 bp, E. coli
accttatctgcctgggtgatgatga

SEQ ID NO: 195915 - DNA, 25 bp, E. coli
attaacgcacctaatctgcctgggt

SEQ ID NO: 195916 - DNA, 25 bp, E. coli
accttatctgccagggtgatgatga

SEQ ID NO: 195917 - DNA, 25 bp, E. coli
tatctgcctgggtgatgatgagccg

SEQ ID NO: 195918 - DNA, 25 bp, E. coli
tatctgcctgggagatgatgagccg

SEQ ID NO: 195919 - DNA, 25 bp, E. coli
tcatttactggaagcgcggttacgt

SEQ ID NO: 195920 - DNA, 25 bp, E. coli
tctgcctgggtgttgatgagccgca

SEQ ID NO: 195921 - DNA, 25 bp, E. coli
tcatttactggatgcgcggttacgt

SEQ ID NO: 195922 - DNA, 25 bp, E. coli
tctgcctgggtgatgatgagccgca

SEQ ID NO: 195923 - DNA, 25 bp, E. coli
gaaaatcatttagtggatgcgcggt

SEQ ID NO: 195924 - DNA, 25 bp, E. coli
gaaaatcatttactggatgcgcggt

SEQ ID NO: 195925 - DNA, 25 bp, E. coli
cgcaccttatctccctgggtgatga

SEQ ID NO: 195926 - DNA, 25 bp, E. coli
cgcaccttatctgcctgggtgatga

SEQ ID NO: 195927 - DNA, 25 bp, E. coli
gggtgatgatgacccgcaggtgacg

SEQ ID NO: 195928 - DNA, 25 bp, E. coli
gggtgatgatgagccgcaggtgacg

SEQ ID NO: 195929 - DNA, 25 bp, E. coli
taacgcaccttaactgcctgggtga

SEQ ID NO: 195930 - DNA, 25 bp, E. coli
taacgcaccttatctgcctgggtga

SEQ ID NO: 195931 - DNA, 25 bp, E. coli
caacggataactgtgcccgctgggt

SEQ ID NO: 195932 - DNA, 25 bp, E. coli
caacggataactctgcccgctgggt

SEQ ID NO: 195933 - DNA, 25 bp, E. coli
tattgttcaggccaggttcagagct

SEQ ID NO: 195934 - DNA, 25 bp, E. coli
tattgttcaggcgaggttcagagct

SEQ ID NO: 195935 - DNA, 25 bp, E. coli
tgttgtgccatcagtcacccgggaa

SEQ ID NO: 195936 - DNA, 25 bp, E. coli
tgttgtgccatctgtcacccgggaa

SEQ ID NO: 195937 - DNA, 25 bp, E. coli
tccgcaatgaggcagtgatccgtcg

SEQ ID NO: 195938 - DNA, 25 bp, E. coli
tccgcaatgagggagtgatccgtcg

SEQ ID NO: 195939 - DNA, 25 bp, E. coli
gctggagcctgagccggaacgttat

SEQ ID NO: 195940 - DNA, 25 bp, E. coli
gctggagcctgacccggaacgttat

SEQ ID NO: 195941 - DNA, 25 bp, E. coli
cgctgaaagtggatccggagtcgcc

SEQ ID NO: 195942 - DNA, 25 bp, E. coli
cgctgaaagtggttccggagtcgcc

SEQ ID NO: 195943 - DNA, 25 bp, E. coli
gtgagagcactactgacccctgaaa

SEQ ID NO: 195944 - DNA, 25 bp, E. coli
gtgagagcactagtgacccctgaaa

SEQ ID NO: 195945 - DNA, 25 bp, E. coli
taatgaaaagtacacgcgctgggtt

SEQ ID NO: 195946 - DNA, 25 bp, E. coli
taatgaaaagtagacgcgctgggtt

SEQ ID NO: 195947 - DNA, 25 bp, E. coli
gagattaccgaaccctgttgtgcca

SEQ ID NO: 195948 - DNA, 25 bp, E. coli
gatgccttaccgcaaagtgcagccc

SEQ ID NO: 195949 - DNA, 25 bp, E. coli
gagattaccgaagcctgttgtgcca

SEQ ID NO: 195950 - DNA, 25 bp, E. coli
gagaacatgaccacaatgcggcacg

SEQ ID NO: 195951 - DNA, 25 bp, E. coli
gatgccttaccggaaagtgcagccc

SEQ ID NO: 195952 - DNA, 25 bp, E. coli
gagaacatgacctcaatgcggcacg

SEQ ID NO: 195953 - DNA, 25 bp, E. coli
aagtgatgattccactgaagtcgga

SEQ ID NO: 195954 - DNA, 25 bp, E. coli
aagtgatgattcgactgaagtcgga

SEQ ID NO: 195955 - DNA, 25 bp, E. coli
tacgtgcaaaggaattaggtttggg

SEQ ID NO: 195956 - DNA, 25 bp, E. coli
tacgtgcaaaggtattaggtttggg

SEQ ID NO: 195957 - DNA, 25 bp, E. coli
tattccatgctgtatgggccattga

SEQ ID NO: 195958 - DNA, 25 bp, E. coli
tattccatgctgaatgggccattga

SEQ ID NO: 195959 - DNA, 25 bp, E. coli
tcgagataaccaaccggagaaagtt

SEQ ID NO: 195960 - DNA, 25 bp, E. coli
tccgatgggcgcatggttagtacat

SEQ ID NO: 195961 - DNA, 25 bp, E. coli
tcgagataaccatccggagaaagtt

SEQ ID NO: 195962 - DNA, 25 bp, E. coli
tccgatgggcgcttggttagtacat

SEQ ID NO: 195963 - DNA, 25 bp, E. coli
tccggtgaccgggaatgccaatggt

SEQ ID NO: 195964 - DNA, 25 bp, E. coli
tccggtgaccggcaatgccaatggt

SEQ ID NO: 195965 - DNA, 25 bp, E. coli
gaatgccaatggtccgatgggcgca

SEQ ID NO: 195966 - DNA, 25 bp, E. coli
gaatgccaatggaccgatgggcgca

SEQ ID NO: 195967 - DNA, 25 bp, E. coli
gaaagttaccatttccggcacggcg

SEQ ID NO: 195968 - DNA, 25 bp, E. coli
gaaagttaccatatccggcacggcg

SEQ ID NO: 195969 - DNA, 25 bp, E. coli
ggtgtaattgatctgacggtgacaa

SEQ ID NO: 195970 - DNA, 25 bp, E. coli
ggcacggcggtgattctattccatg

SEQ ID NO: 195971 - DNA, 25 bp, E. coli
ggcacggcggtgtttctattccatg

SEQ ID NO: 195972 - DNA, 25 bp, E. coli
ggtgtaattgatgtgacggtgacaa

SEQ ID NO: 195973 - DNA, 25 bp, E. coli
gaccttgctgcggtgaccgcaatca

SEQ ID NO: 195974 - DNA, 25 bp, E. coli
gaccttgctgcgctgaccgcaatca

SEQ ID NO: 195975 - DNA, 25 bp, E. coli
caccatgcgggcaatccaaaaagcc

SEQ ID NO: 195976 - DNA, 25 bp, E. coli
caccatgcgggctatccaaaaagcc

SEQ ID NO: 195977 - DNA, 25 bp, E. coli
cagacccggtcaccatgcgggcaat

SEQ ID NO: 195978 - DNA, 25 bp, E. coli
catgcgggcaatgcaaaaagccatc

SEQ ID NO: 195979 - DNA, 25 bp, E. coli
catgcgggcaatccaaaaagccatc

SEQ ID NO: 195980 - DNA, 25 bp, E. coli
cagacccggtcagcatgcgggcaat

SEQ ID NO: 195981 - DNA, 25 bp, E. coli
aaacaaattctgcatgttctcgatg

SEQ ID NO: 195982 - DNA, 25 bp, E. coli
aaacaaattctggatgttctcgatg

SEQ ID NO: 195983 - DNA, 25 bp, E. coli
tctgatgtggttccttgccagttgg

SEQ ID NO: 195984 - DNA, 25 bp, E. coli
tctgatgtggttgcttgccagttgg

SEQ ID NO: 195985 - DNA, 25 bp, E. coli
gccagttggttaacaaacaaattct

SEQ ID NO: 195986 - DNA, 25 bp, E. coli
gccagttggttatcaaacaaattct

SEQ ID NO: 195987 - DNA, 25 bp, E. coli
gcgggcaatccaaaaagccatcgcg

SEQ ID NO: 195988 - DNA, 25 bp, E. coli
gcttgccagttgcttatcaaacaaa

SEQ ID NO: 195989 - DNA, 25 bp, E. coli
gcttgccagttggttatcaaacaaa

SEQ ID NO: 195990 - DNA, 25 bp, E. coli
gcgggcaatccataaagccatcgcg

SEQ ID NO: 195991 - DNA, 25 bp, E. coli
ggttgcttgccacttggttatcaaa

SEQ ID NO: 195992 - DNA, 25 bp, E. coli
ggtttctgatgtcgttgcttgccag

SEQ ID NO: 195993 - DNA, 25 bp, E. coli
ggtttctgatgtggttgcttgccag

SEQ ID NO: 195994 - DNA, 25 bp, E. coli
ggttgcttgccagttggttatcaaa

SEQ ID NO: 195995 - DNA, 25 bp, E. coli
tggttatcaaacaaattctggatgt

SEQ ID NO: 195996 - DNA, 25 bp, E. coli
tggttatcaaactaattctggatgt

SEQ ID NO: 195997 - DNA, 25 bp, E. coli
caatatattcatcacctcgactatc

SEQ ID NO: 195998 - DNA, 25 bp, E. coli
caatctggtggctcaatcgctggcg

SEQ ID NO: 195999 - DNA, 25 bp, E. coli
caatatattcatgacctcgactatc

SEQ ID NO: 196000 - DNA, 25 bp, E. coli
caatctggtggcacaatcgctggcg

SEQ ID NO: 196001 - DNA, 25 bp, E. coli
tatgggcgggttttcgtcgtccacg

SEQ ID NO: 196002 - DNA, 25 bp, E. coli
tatgggcgggttatcgtcgtccacg

SEQ ID NO: 196003 - DNA, 25 bp, E. coli
tgcacctcaaacctgtacttacggc

SEQ ID NO: 196004 - DNA, 25 bp, E. coli
tgcacctcaaacgtgtacttacggc

SEQ ID NO: 196005 - DNA, 25 bp, E. coli
tcaggccgtaaggtgttactggttc

SEQ ID NO: 196006 - DNA, 25 bp, E. coli
tcaggccgtaagctgttactggttc

SEQ ID NO: 196007 - DNA, 25 bp, E. coli
gctttgcaatattttcatgacctcg

SEQ ID NO: 196008 - DNA, 25 bp, E. coli
gctgttactggttcgccagcgggaa

SEQ ID NO: 196009 - DNA, 25 bp, E. coli
gctgttactggtacgccagcgggaa

SEQ ID NO: 196010 - DNA, 25 bp, E. coli
gcattttgtcctccacctcaaacgt

SEQ ID NO: 196011 - DNA, 25 bp, E. coli
gcattttgtcctgcacctcaaacgt

SEQ ID NO: 196012 - DNA, 25 bp, E. coli
gctttgcaatatattcatgacctcg

SEQ ID NO: 196013 - DNA, 25 bp, E. coli
gggcaatctggtggctcaatcgctg

SEQ ID NO: 196014 - DNA, 25 bp, E. coli
gggcaatctggtcgctcaatcgctg

SEQ ID NO: 196015 - DNA, 25 bp, E. coli
taagctgttactcgttcgccagcgg

SEQ ID NO: 196016 - DNA, 25 bp, E. coli
tatcgtcgtccacggggcaatctgg

SEQ ID NO: 196017 - DNA, 25 bp, E. coli
tatcgtcgtccagggggcaatctgg

SEQ ID NO: 196018 - DNA, 25 bp, E. coli
taagctgttactggttcgccagcgg

SEQ ID NO: 196019 - DNA, 25 bp, E. coli
aagtggactgccagcagatgcgtcc

SEQ ID NO: 196020 - DNA, 25 bp, E. coli
aagtggactgcctgcagatgcgtcc

SEQ ID NO: 196021 - DNA, 25 bp, E. coli
cataaaaggaagtacagaatgcatg

SEQ ID NO: 196022 - DNA, 25 bp, E. coli
cataaaaggaagaacagaatgcatg

SEQ ID NO: 196023 - DNA, 25 bp, E. coli
tacgttcataaaaggaagtacagaa

SEQ ID NO: 196024 - DNA, 25 bp, E. coli
tacgttcataaatggaagtacagaa

SEQ ID NO: 196025 - DNA, 25 bp, E. coli
agtgtgaagtggactgccagcagat

SEQ ID NO: 196026 - DNA, 25 bp, E. coli
agtgtgaagtggtctgccagcagat

SEQ ID NO: 196027 - DNA, 25 bp, E. coli
tacgctcagtaatacgttcataaaa

SEQ ID NO: 196028 - DNA, 25 bp, E. coli
tacgctcagtaaaacgttcataaaa

SEQ ID NO: 196029 - DNA, 25 bp, E. coli
tgtgaagtggacagccagcagatgc

SEQ ID NO: 196030 - DNA, 25 bp, E. coli
tgtgaagtggactgccagcagatgc

SEQ ID NO: 196031 - DNA, 25 bp, E. coli
tcagtaatacgtacataaaaggaag

SEQ ID NO: 196032 - DNA, 25 bp, E. coli
tcagtaatacgttcataaaaggaag

SEQ ID NO: 196033 - DNA, 25 bp, E. coli
gctcagtaatacgttcataaaagga

SEQ ID NO: 196034 - DNA, 25 bp, E. coli
gctcagtaataccttcataaaagga

SEQ ID NO: 196035 - DNA, 25 bp, E. coli
gactgccagcagatgcgtccagtgg

SEQ ID NO: 196036 - DNA, 25 bp, E. coli
gactgccagcagttgcgtccagtgg

SEQ ID NO: 196037 - DNA, 25 bp, E. coli
ctgccagcagatgcgtccagtggtc

SEQ ID NO: 196038 - DNA, 25 bp, E. coli
ctgccagcagatccgtccagtggtc

SEQ ID NO: 196039 - DNA, 25 bp, E. coli
tggactgccagctgatgcgtccagt

SEQ ID NO: 196040 - DNA, 25 bp, E. coli
tggactgccagcagatgcgtccagt

SEQ ID NO: 196041 - DNA, 25 bp, E. coli
gactgctatcctcaatttaccttcc

SEQ ID NO: 196042 - DNA, 25 bp, E. coli
aataacaataaataataaatcacag

SEQ ID NO: 196043 - DNA, 25 bp, E. coli
aataacaataaaaaataaatcacag

SEQ ID NO: 196044 - DNA, 25 bp, E. coli
gactgctatcctgaatttaccttcc

SEQ ID NO: 196045 - DNA, 25 bp, E. coli
cagaaaaacaacaaaacaacacaca

SEQ ID NO: 196046 - DNA, 25 bp, E. coli
cagaaaaacaactaaacaacacaca

SEQ ID NO: 196047 - DNA, 25 bp, E. coli
taaatcacagaataacaacaaaaca

SEQ ID NO: 196048 - DNA, 25 bp, E. coli
tacagactgctaacctgaatttacc

SEQ ID NO: 196049 - DNA, 25 bp, E. coli
taaatcacagaaaaacaacaaaaca

SEQ ID NO: 196050 - DNA, 25 bp, E. coli
tacagactgctatcctgaatttacc

SEQ ID NO: 196051 - DNA, 25 bp, E. coli
taccttcctttattgaaataacaat

SEQ ID NO: 196052 - DNA, 25 bp, E. coli
taccttcctttaatgaaataacaat

SEQ ID NO: 196053 - DNA, 25 bp, E. coli
tcctgaatttaccttcctttaatga

SEQ ID NO: 196054 - DNA, 25 bp, E. coli
tcctgaatttacgttcctttaatga

SEQ ID NO: 196055 - DNA, 25 bp, E. coli
cctccgattatcaacagactgctat

SEQ ID NO: 196056 - DNA, 25 bp, E. coli
cctccgattatctacagactgctat

SEQ ID NO: 196057 - DNA, 25 bp, E. coli
gattatctacagtctgctatcctga

SEQ ID NO: 196058 - DNA, 25 bp, E. coli
gattatctacagactgctatcctga

SEQ ID NO: 196059 - DNA, 25 bp, E. coli
gtgacctccgattatctacagactg

SEQ ID NO: 196060 - DNA, 25 bp, E. coli
gtgacctccgataatctacagactg

SEQ ID NO: 196061 - DNA, 25 bp, E. coli
gacctccgattaactacagactgct

SEQ ID NO: 196062 - DNA, 25 bp, E. coli
gacctccgattatctacagactgct

SEQ ID NO: 196063 - DNA, 25 bp, E. coli
aaaggcgaggccagtatcatgtcac

SEQ ID NO: 196064 - DNA, 25 bp, E. coli
aaaggcgaggcctgtatcatgtcac

SEQ ID NO: 196065 - DNA, 25 bp, E. coli
tctggatctgcgagacagcgggcaa

SEQ ID NO: 196066 - DNA, 25 bp, E. coli
tctggatctgcgtgacagcgggcaa

SEQ ID NO: 196067 - DNA, 25 bp, E. coli
gccgtcgcggtaactgccatgataa

SEQ ID NO: 196068 - DNA, 25 bp, E. coli
gccgtcgcggtatctgccatgataa

SEQ ID NO: 196069 - DNA, 25 bp, E. coli
gaataaaggctcaggtcggataccg

SEQ ID NO: 196070 - DNA, 25 bp, E. coli
gaataaaggctctggtcggataccg

SEQ ID NO: 196071 - DNA, 25 bp, E. coli
gacattgtcctgaacgcactgctga

SEQ ID NO: 196072 - DNA, 25 bp, E. coli
gacattgtcctgtacgcactgctga

SEQ ID NO: 196073 - DNA, 25 bp, E. coli
cgtaatcccgaaaaacaggtgctgg

SEQ ID NO: 196074 - DNA, 25 bp, E. coli
cgtaatcccgaataacaggtgctgg

SEQ ID NO: 196075 - DNA, 25 bp, E. coli
gttcctgaaatcacacggcctggag

SEQ ID NO: 196076 - DNA, 25 bp, E. coli
gttcctgaaatctcacggcctggag

SEQ ID NO: 196077 - DNA, 25 bp, E. coli
ggttcattcggatcagggcagtcag

SEQ ID NO: 196078 - DNA, 25 bp, E. coli
ggttcattcggaacagggcagtcag

SEQ ID NO: 196079 - DNA, 25 bp, E. coli
ggcagtcagtacacaagccatgagt

SEQ ID NO: 196080 - DNA, 25 bp, E. coli
ggctggtccatgcaatcccggatga

SEQ ID NO: 196081 - DNA, 25 bp, E. coli
ggcagtcagtactcaagccatgagt

SEQ ID NO: 196082 - DNA, 25 bp, E. coli
ggctggtccatggaatcccggatga

SEQ ID NO: 196083 - DNA, 25 bp, E. coli
taagcgtcggcatggttctagcgaa

SEQ ID NO: 196084 - DNA, 25 bp, E. coli
taagcgtcggcaaggttctagcgaa

SEQ ID NO: 196085 - DNA, 25 bp, E. coli
cacctggtgcaacagctggaaatca

SEQ ID NO: 196086 - DNA, 25 bp, E. coli
cacctggtgcaagagctggaaatca

SEQ ID NO: 196087 - DNA, 25 bp, E. coli
tactcagttttcaaaccagggcacg

SEQ ID NO: 196088 - DNA, 25 bp, E. coli
tactcagttttctaaccagggcacg

SEQ ID NO: 196089 - DNA, 25 bp, E. coli
actcattgtgtctggcggcattgcg

SEQ ID NO: 196090 - DNA, 25 bp, E. coli
actcattgtgtcaggcggcattgcg

SEQ ID NO: 196091 - DNA, 25 bp, E. coli
tatccgccaccagaaaaaacttgag

SEQ ID NO: 196092 - DNA, 25 bp, E. coli
tatccgccaccacaaaaaacttgag

SEQ ID NO: 196093 - DNA, 25 bp, E. coli
tgagatgctcgatgcacacctggtg

SEQ ID NO: 196094 - DNA, 25 bp, E. coli
tgagatgctcgaagcacacctggtg

SEQ ID NO: 196095 - DNA, 25 bp, E. coli
tgcgcgatctgagcagcaaactggt

SEQ ID NO: 196096 - DNA, 25 bp, E. coli
tgcgcgatctgaccagcaaactggt

SEQ ID NO: 196097 - DNA, 25 bp, E. coli
gacagtattcttgagctggcacagc

SEQ ID NO: 196098 - DNA, 25 bp, E. coli
gacagtattcttcagctggcacagc

SEQ ID NO: 196099 - DNA, 25 bp, E. coli
gtatcgatctttcccgtctggcgca

SEQ ID NO: 196100 - DNA, 25 bp, E. coli
gtatcgatctttgccgtctggcgca

SEQ ID NO: 196101 - DNA, 25 bp, E. coli
tggttgaaactgtagcctggcacta

SEQ ID NO: 196102 - DNA, 25 bp, E. coli
tggttgaaactgaagcctggcacta

SEQ ID NO: 196103 - DNA, 25 bp, E. coli
tcaaataaagcacaccaacgcgggc

SEQ ID NO: 196104 - DNA, 25 bp, E. coli
tcaaataaagcagaccaacgcgggc

SEQ ID NO: 196105 - DNA, 25 bp, E. coli
gatgtaaaagagttgccgctcggcg

SEQ ID NO: 196106 - DNA, 25 bp, E. coli
gatgtaaaagagatgccgctcggcg

SEQ ID NO: 196107 - DNA, 25 bp, E. coli
acgcgcataattttcggctgtcacg

SEQ ID NO: 196108 - DNA, 25 bp, E. coli
acgcgcataattatcggctgtcacg

SEQ ID NO: 196109 - DNA, 25 bp, E. coli
aacaacacgcgcataattttcggct

SEQ ID NO: 196110 - DNA, 25 bp, E. coli
aacaacacgcgcttaattttcggct

SEQ ID NO: 196111 - DNA, 25 bp, E. coli
tttctcccgatgcagttcaacgcgg

SEQ ID NO: 196112 - DNA, 25 bp, E. coli
ttattttttctttctcccgatgcag

SEQ ID NO: 196113 - DNA, 25 bp, E. coli
tttctcccgatggagttcaacgcgg

SEQ ID NO: 196114 - DNA, 25 bp, E. coli
ttattttttcttactcccgatgcag

SEQ ID NO: 196115 - DNA, 25 bp, E. coli
tgattccagataggcggcggattaa

SEQ ID NO: 196116 - DNA, 25 bp, E. coli
tgattccagatacgcggcggattaa

SEQ ID NO: 196117 - DNA, 25 bp, E. coli
tgctggctgattccagatacgcggc

SEQ ID NO: 196118 - DNA, 25 bp, E. coli
tgctggctgattgcagatacgcggc

SEQ ID NO: 196119 - DNA, 25 bp, E. coli
gctggataccatgacggcacatcac

SEQ ID NO: 196120 - DNA, 25 bp, E. coli
gctggataccatcacggcacatcac

SEQ ID NO: 196121 - DNA, 25 bp, E. coli
ggctgattccagatacgcggcggat

SEQ ID NO: 196122 - DNA, 25 bp, E. coli
ggctgattccagttacgcggcggat

SEQ ID NO: 196123 - DNA, 25 bp, E. coli
taagctggatacgatcacggcacat

SEQ ID NO: 196124 - DNA, 25 bp, E. coli
tcagcaacaacaggcgcataatttt

SEQ ID NO: 196125 - DNA, 25 bp, E. coli
tcagcaacaacacgcgcataatttt

SEQ ID NO: 196126 - DNA, 25 bp, E. coli
taagctggataccatcacggcacat

SEQ ID NO: 196127 - DNA, 25 bp, E. coli
gatgcagttcaacgcggcgattgta

SEQ ID NO: 196128 - DNA, 25 bp, E. coli
gatgcagttcaaggcggcgattgta

SEQ ID NO: 196129 - DNA, 25 bp, E. coli
caaaagcaagatcaagagtatcgcc

SEQ ID NO: 196130 - DNA, 25 bp, E. coli
caaaagcaagatgaagagtatcgcc

SEQ ID NO: 196131 - DNA, 25 bp, E. coli
aaagcaagatgatgagtatcgccag

SEQ ID NO: 196132 - DNA, 25 bp, E. coli
aaagcaagatgaagagtatcgccag

SEQ ID NO: 196133 - DNA, 25 bp, E. coli
ttttgagcgtctcccgcaccagata

SEQ ID NO: 196134 - DNA, 25 bp, E. coli
ttttgagcgtctgccgcaccagata

SEQ ID NO: 196135 - DNA, 25 bp, E. coli
tgacagaagaagttcaaaagcaaga

SEQ ID NO: 196136 - DNA, 25 bp, E. coli
tgacagaagaagatcaaaagcaaga

SEQ ID NO: 196137 - DNA, 25 bp, E. coli
tcccgcaccagatatcttatgatta

SEQ ID NO: 196138 - DNA, 25 bp, E. coli
tcccgcaccagaaatcttatgatta

SEQ ID NO: 196139 - DNA, 25 bp, E. coli
gcgtctcccgcagcagatatcttat

SEQ ID NO: 196140 - DNA, 25 bp, E. coli
gcgtctcccgcaccagatatcttat

SEQ ID NO: 196141 - DNA, 25 bp, E. coli
gcaccagatatcttatgattatcac

SEQ ID NO: 196142 - DNA, 25 bp, E. coli
gcaccagatatcatatgattatcac

SEQ ID NO: 196143 - DNA, 25 bp, E. coli
gaagaagatcaaaagcaagatgaag

SEQ ID NO: 196144 - DNA, 25 bp, E. coli
gaagaagatcaatagcaagatgaag

SEQ ID NO: 196145 - DNA, 25 bp, E. coli
gtatcgccagctcgcttttgagcgt

SEQ ID NO: 196146 - DNA, 25 bp, E. coli
gtctcccgcaccagatatcttatga

SEQ ID NO: 196147 - DNA, 25 bp, E. coli
gtatcgccagctggcttttgagcgt

SEQ ID NO: 196148 - DNA, 25 bp, E. coli
gtctcccgcacctgatatcttatga

SEQ ID NO: 196149 - DNA, 25 bp, E. coli
gagtatcgccaggtggcttttgagc

SEQ ID NO: 196150 - DNA, 25 bp, E. coli
gagtatcgccagctggcttttgagc

SEQ ID NO: 196151 - DNA, 25 bp, E. coli
aattgttagtcagaaccgagcgcgc

SEQ ID NO: 196152 - DNA, 25 bp, E. coli
aattgttagtcacaaccgagcgcgc

SEQ ID NO: 196153 - DNA, 25 bp, E. coli
caacaactttatcagcgcaatggcc

SEQ ID NO: 196154 - DNA, 25 bp, E. coli
caacaactttatgagcgcaatggcc

SEQ ID NO: 196155 - DNA, 25 bp, E. coli
taaagtgctcaaattgccggcaggc

SEQ ID NO: 196156 - DNA, 25 bp, E. coli
taaagtgctcaatttgccggcaggc

SEQ ID NO: 196157 - DNA, 25 bp, E. coli
atggcgcggatcacaccctgaagaa

SEQ ID NO: 196158 - DNA, 25 bp, E. coli
atggcgcggatctcaccctgaagaa

SEQ ID NO: 196159 - DNA, 25 bp, E. coli
tcagttggcttatgccgcctggcaa

SEQ ID NO: 196160 - DNA, 25 bp, E. coli
gcttttcggttatggactgctgcaa

SEQ ID NO: 196161 - DNA, 25 bp, E. coli
gcttttcggttaaggactgctgcaa

SEQ ID NO: 196162 - DNA, 25 bp, E. coli
gaaccggtgatcatgcagcgtctgc

SEQ ID NO: 196163 - DNA, 25 bp, E. coli
gaaccggtgatcttgcagcgtctgc

SEQ ID NO: 196164 - DNA, 25 bp, E. coli
gacatcactcggcattcagctcgct

SEQ ID NO: 196165 - DNA, 25 bp, E. coli
gacatcactcgggattcagctcgct

SEQ ID NO: 196166 - DNA, 25 bp, E. coli
cgagcgcgccgtattaatgaaagca

SEQ ID NO: 196167 - DNA, 25 bp, E. coli
cgagcgcgccgttttaatgaaagca

SEQ ID NO: 196168 - DNA, 25 bp, E. coli
ggatttttccatacgctggcggtgc

SEQ ID NO: 196169 - DNA, 25 bp, E. coli
ggatttttccattcgctggcggtgc

SEQ ID NO: 196170 - DNA, 25 bp, E. coli
ggcgcaggcgttttctcatggctaa

SEQ ID NO: 196171 - DNA, 25 bp, E. coli
ggcgcaggcgttatctcatggctaa

SEQ ID NO: 196172 - DNA, 25 bp, E. coli
tcagttggcttaagccgcctggcaa

SEQ ID NO: 196173 - DNA, 25 bp, E. coli
cactggcggcattgcggcaaggcaa

SEQ ID NO: 196174 - DNA, 25 bp, E. coli
cagaggtttatttgagcgtactgga

SEQ ID NO: 196175 - DNA, 25 bp, E. coli
cactggcggcatagcggcaaggcaa

SEQ ID NO: 196176 - DNA, 25 bp, E. coli
cagaggtttattagagcgtactgga

SEQ ID NO: 196177 - DNA, 25 bp, E. coli
atagcgcggcggttaccttctctgc

SEQ ID NO: 196178 - DNA, 25 bp, E. coli
atagcgcggcggataccttctctgc

SEQ ID NO: 196179 - DNA, 25 bp, E. coli
taccttctctgcttggctgctggcg

SEQ ID NO: 196180 - DNA, 25 bp, E. coli
taccttctctgcatggctgctggcg

SEQ ID NO: 196181 - DNA, 25 bp, E. coli
tttgcccagctaaacacccaggtag

SEQ ID NO: 196182 - DNA, 25 bp, E. coli
tttgcgctgtcaccactgtgacagc

SEQ ID NO: 196183 - DNA, 25 bp, E. coli
tttgcccagctatacacccaggtag

SEQ ID NO: 196184 - DNA, 25 bp, E. coli
tttgcgctgtcagcactgtgacagc

SEQ ID NO: 196185 - DNA, 25 bp, E. coli
tcggcagagcgtattgcccagctat

SEQ ID NO: 196186 - DNA, 25 bp, E. coli
tcggcagagcgttttgcccagctat

SEQ ID NO: 196187 - DNA, 25 bp, E. coli
gcatcatccggatcacccgctattg

SEQ ID NO: 196188 - DNA, 25 bp, E. coli
gcatcatccggaacacccgctattg

SEQ ID NO: 196189 - DNA, 25 bp, E. coli
gcccgctggcagacgacaaattgtg

SEQ ID NO: 196190 - DNA, 25 bp, E. coli
gcccgctggcagtcgacaaattgtg

SEQ ID NO: 196191 - DNA, 25 bp, E. coli
ctatacacccaggtagcaggccgtg

SEQ ID NO: 196192 - DNA, 25 bp, E. coli
ctatacacccagctagcaggccgtg

SEQ ID NO: 196193 - DNA, 25 bp, E. coli
ggaacacccgctattgcaaacgttg

SEQ ID NO: 196194 - DNA, 25 bp, E. coli
ggaacacccgcttttgcaaacgttg

SEQ ID NO: 196195 - DNA, 25 bp, E. coli
caccattgagtacgatggtatgacg

SEQ ID NO: 196196 - DNA, 25 bp, E. coli
caccattgagtaggatggtatgacg

SEQ ID NO: 196197 - DNA, 25 bp, E. coli
attgtcactaaacagggcgataccc

SEQ ID NO: 196198 - DNA, 25 bp, E. coli
attgtcactaaagagggcgataccc

SEQ ID NO: 196199 - DNA, 25 bp, E. coli
aaacgtgagctgtacgaggttgagc

SEQ ID NO: 196200 - DNA, 25 bp, E. coli
aaacgtgagctgaacgaggttgagc

SEQ ID NO: 196201 - DNA, 25 bp, E. coli
tgacattgatgtctgatgatctcac

SEQ ID NO: 196202 - DNA, 25 bp, E. coli
tgacattgatgtgtgatgatctcac

SEQ ID NO: 196203 - DNA, 25 bp, E. coli
tgagcgtgacggaaacaccattgag

SEQ ID NO: 196204 - DNA, 25 bp, E. coli
tgagcgtgacggtaacaccattgag

SEQ ID NO: 196205 - DNA, 25 bp, E. coli
cgggctgtgccgaagtcgaaaacta

SEQ ID NO: 196206 - DNA, 25 bp, E. coli
cgggctgtgccgtagtcgaaaacta

SEQ ID NO: 196207 - DNA, 25 bp, E. coli
gtcgaaaactattacaatgtcgtga

SEQ ID NO: 196208 - DNA, 25 bp, E. coli
gtcgaaaactataacaatgtcgtga

SEQ ID NO: 196209 - DNA, 25 bp, E. coli
tggcagaccaaagggccgcaacgtg

SEQ ID NO: 196210 - DNA, 25 bp, E. coli
tggcagaccaaacggccgcaacgtg

SEQ ID NO: 196211 - DNA, 25 bp, E. coli
taacgttaccgttaaacgtgagctg

SEQ ID NO: 196212 - DNA, 25 bp, E. coli
taacgttaccgtaaaacgtgagctg

SEQ ID NO: 196213 - DNA, 25 bp, E. coli
ggataaagcgccgttaccgacgcca

SEQ ID NO: 196214 - DNA, 25 bp, E. coli
gatgatctcacttacgttaccgtaa

SEQ ID NO: 196215 - DNA, 25 bp, E. coli
ggataaagcgcccttaccgacgcca

SEQ ID NO: 196216 - DNA, 25 bp, E. coli
gatgatctcactaacgttaccgtaa

SEQ ID NO: 196217 - DNA, 25 bp, E. coli
taccgtcggctgctggaaaaacagt

SEQ ID NO: 196218 - DNA, 25 bp, E. coli
taccgtcggctggtggaaaaacagt

SEQ ID NO: 196219 - DNA, 25 bp, E. coli
ttgataccgggaagcgaagccgcct

SEQ ID NO: 196220 - DNA, 25 bp, E. coli
ttgataccgggatgcgaagccgcct

SEQ ID NO: 196221 - DNA, 25 bp, E. coli
ttatgagctttctggcccacaaggc

SEQ ID NO: 196222 - DNA, 25 bp, E. coli
ttatgagctttcaggcccacaaggc

SEQ ID NO: 196223 - DNA, 25 bp, E. coli
tgctattttccagcgagatcgtccg

SEQ ID NO: 196224 - DNA, 25 bp, E. coli
tgctattttccaccgagatcgtccg

SEQ ID NO: 196225 - DNA, 25 bp, E. coli
tgagcgccggtctgcttaaacgtgg

SEQ ID NO: 196226 - DNA, 25 bp, E. coli
tgagcgccggtcagcttaaacgtgg

SEQ ID NO: 196227 - DNA, 25 bp, E. coli
gccagaactggcgacactagggata

SEQ ID NO: 196228 - DNA, 25 bp, E. coli
gccagaactggccacactagggata

SEQ ID NO: 196229 - DNA, 25 bp, E. coli
gaaaaacagttgctcacctatcgcc

SEQ ID NO: 196230 - DNA, 25 bp, E. coli
gaaaaacagttggtcacctatcgcc

SEQ ID NO: 196231 - DNA, 25 bp, E. coli
cgcaacgatgcggagatggaaacct

SEQ ID NO: 196232 - DNA, 25 bp, E. coli
cgcaacgatgcgcagatggaaacct

SEQ ID NO: 196233 - DNA, 25 bp, E. coli
gatcttgccagtagttttcgcgcca

SEQ ID NO: 196234 - DNA, 25 bp, E. coli
gatcttgccagttgttttcgcgcca

SEQ ID NO: 196235 - DNA, 25 bp, E. coli
gatggaaaccttgcgcaccatggtg

SEQ ID NO: 196236 - DNA, 25 bp, E. coli
gatggaaaccttccgcaccatggtg

SEQ ID NO: 196237 - DNA, 25 bp, E. coli
gatacttccggcacaatgggcggct

SEQ ID NO: 196238 - DNA, 25 bp, E. coli
gatacttccggctcaatgggcggct

SEQ ID NO: 196239 - DNA, 25 bp, E. coli
cacaatcgggccacgcgggcgtcag

SEQ ID NO: 196240 - DNA, 25 bp, E. coli
cacaatcgggcctcgcgggcgtcag

SEQ ID NO: 196241 - DNA, 25 bp, E. coli
catggtacgtatggcctgggcgcaa

SEQ ID NO: 196242 - DNA, 25 bp, E. coli
catggtacgtatcgcctgggcgcaa

SEQ ID NO: 196243 - DNA, 25 bp, E. coli
tttgtgcaggacagcataagtgcgc

SEQ ID NO: 196244 - DNA, 25 bp, E. coli
tttgtgcaggactgcataagtgcgc

SEQ ID NO: 196245 - DNA, 25 bp, E. coli
ttccgtcggcgcatcatggtacgta

SEQ ID NO: 196246 - DNA, 25 bp, E. coli
ttttgtacgaagtggatgcgcggct

SEQ ID NO: 196247 - DNA, 25 bp, E. coli
ttccgtcggcgcttcatggtacgta

SEQ ID NO: 196248 - DNA, 25 bp, E. coli
ttttgtacgaagaggatgcgcggct

SEQ ID NO: 196249 - DNA, 25 bp, E. coli
tgcggctgttccctcggcgcatcat

SEQ ID NO: 196250 - DNA, 25 bp, E. coli
tgcggctgttccgtcggcgcatcat

SEQ ID NO: 196251 - DNA, 25 bp, E. coli
gacagcataagtccgcatccagagt

SEQ ID NO: 196252 - DNA, 25 bp, E. coli
gacagcataagtgcgcatccagagt

SEQ ID NO: 196253 - DNA, 25 bp, E. coli
gataagcgcacattcgggccacgcg

SEQ ID NO: 196254 - DNA, 25 bp, E. coli
gataagcgcacaatcgggccacgcg

SEQ ID NO: 196255 - DNA, 25 bp, E. coli
gttacctccacacaagcatttgccg

SEQ ID NO: 196256 - DNA, 25 bp, E. coli
gttacctccacagaagcatttgccg

SEQ ID NO: 196257 - DNA, 25 bp, E. coli
ggcgggaatgctcgttacctccaca

SEQ ID NO: 196258 - DNA, 25 bp, E. coli
ggaatgctggttacctccacagaag

SEQ ID NO: 196259 - DNA, 25 bp, E. coli
ggaatgctggtttcctccacagaag

SEQ ID NO: 196260 - DNA, 25 bp, E. coli
ggcgggaatgctggttacctccaca

SEQ ID NO: 196261 - DNA, 25 bp, E. coli
gcgacaaccgactcgtaaccacggt

SEQ ID NO: 196262 - DNA, 25 bp, E. coli
gcgacaaccgacacgtaaccacggt

SEQ ID NO: 196263 - DNA, 25 bp, E. coli
taaacagcttggtttgaaagacttc

SEQ ID NO: 196264 - DNA, 25 bp, E. coli
taaacagcttggattgaaagacttc

SEQ ID NO: 196265 - DNA, 25 bp, E. coli
tatgatgttattgttggcggcgaac

SEQ ID NO: 196266 - DNA, 25 bp, E. coli
tatgatgttattcttggcggcgaac

SEQ ID NO: 196267 - DNA, 25 bp, E. coli
tatcagcttctttcacgctggtggg

SEQ ID NO: 196268 - DNA, 25 bp, E. coli
tatcagcttcttacacgctggtggg

SEQ ID NO: 196269 - DNA, 25 bp, E. coli
tcagcgtaaagccttcctcgatatg

SEQ ID NO: 196270 - DNA, 25 bp, E. coli
cctcgatatgttggcgtggtcagaa

SEQ ID NO: 196271 - DNA, 25 bp, E. coli
cctcgatatgttcgcgtggtcagaa

SEQ ID NO: 196272 - DNA, 25 bp, E. coli
gctggtgggatggttaccgtaaaca

SEQ ID NO: 196273 - DNA, 25 bp, E. coli
gctggtgggatgcttaccgtaaaca

SEQ ID NO: 196274 - DNA, 25 bp, E. coli
gcaaaatcttaaacctcagcgtaaa

SEQ ID NO: 196275 - DNA, 25 bp, E. coli
gcaaaatcttaatcctcagcgtaaa

SEQ ID NO: 196276 - DNA, 25 bp, E. coli
cccaaaagccaggacgcagtggcat

SEQ ID NO: 196277 - DNA, 25 bp, E. coli
cccaaaagccagcacgcagtggcat

SEQ ID NO: 196278 - DNA, 25 bp, E. coli
ggcggcgaactgattactgattact

SEQ ID NO: 196279 - DNA, 25 bp, E. coli
ggcggcgaactgtttactgattact

SEQ ID NO: 196280 - DNA, 25 bp, E. coli
tcagcgtaaagcgttcctcgatatg

SEQ ID NO: 196281 - DNA, 25 bp, E. coli
tcagaaggaacgcataacgggcgac

SEQ ID NO: 196282 - DNA, 25 bp, E. coli
tcagaaggaacggataacgggcgac

SEQ ID NO: 196283 - DNA, 25 bp, E. coli
cactactgtgtaccaggacagtcat

SEQ ID NO: 196284 - DNA, 25 bp, E. coli
cactactgtgtagcaggacagtcat

SEQ ID NO: 196285 - DNA, 25 bp, E. coli
tacgtttgctccatataattgacac

SEQ ID NO: 196286 - DNA, 25 bp, E. coli
tacgtttgctccttataattgacac

SEQ ID NO: 196287 - DNA, 25 bp, E. coli
tataattgacacaactgtgtaccag

SEQ ID NO: 196288 - DNA, 25 bp, E. coli
tataattgacactactgtgtaccag

SEQ ID NO: 196289 - DNA, 25 bp, E. coli
tgtgtaccaggagagtcataacaga

SEQ ID NO: 196290 - DNA, 25 bp, E. coli
tgatatcaagattgatttaatctag

SEQ ID NO: 196291 - DNA, 25 bp, E. coli
tgtgtaccaggacagtcataacaga

SEQ ID NO: 196292 - DNA, 25 bp, E. coli
tgatatcaagatagatttaatctag

SEQ ID NO: 196293 - DNA, 25 bp, E. coli
tgacactactgtgtaccaggacagt

SEQ ID NO: 196294 - DNA, 25 bp, E. coli
tgacactactgtctaccaggacagt

SEQ ID NO: 196295 - DNA, 25 bp, E. coli
gactaaaagaggaaatgatgaacat

SEQ ID NO: 196296 - DNA, 25 bp, E. coli
gactaaaagaggtaatgatgaacat

SEQ ID NO: 196297 - DNA, 25 bp, E. coli
gctccatataattgacactactgtg

SEQ ID NO: 196298 - DNA, 25 bp, E. coli
gctccatataatagacactactgtg

SEQ ID NO: 196299 - DNA, 25 bp, E. coli
gtaccaggacagtcataacagacta

SEQ ID NO: 196300 - DNA, 25 bp, E. coli
gtaccaggacagacataacagacta

SEQ ID NO: 196301 - DNA, 25 bp, E. coli
taattgacactagtgtgtaccagga

SEQ ID NO: 196302 - DNA, 25 bp, E. coli
taattgacactactgtgtaccagga

SEQ ID NO: 196303 - DNA, 25 bp, E. coli
gaggaaatgatgtacattgaagagt

SEQ ID NO: 196304 - DNA, 25 bp, E. coli
gaggaaatgatgaacattgaagagt

SEQ ID NO: 196305 - DNA, 25 bp, E. coli
aagcccccatcacctccggcgtgga

SEQ ID NO: 196306 - DNA, 25 bp, E. coli
caactgtccaggctccttgcgtaaa

SEQ ID NO: 196307 - DNA, 25 bp, E. coli
aagcccccatcagctccggcgtgga

SEQ ID NO: 196308 - DNA, 25 bp, E. coli
caactgtccagggtccttgcgtaaa

SEQ ID NO: 196309 - DNA, 25 bp, E. coli
actgtccaggctgcttgcgtaaagc

SEQ ID NO: 196310 - DNA, 25 bp, E. coli
actgtccaggctccttgcgtaaagc

SEQ ID NO: 196311 - DNA, 25 bp, E. coli
aactgtccaggctccttgcgtaaag

SEQ ID NO: 196312 - DNA, 25 bp, E. coli
aactgtccaggcaccttgcgtaaag

SEQ ID NO: 196313 - DNA, 25 bp, E. coli
tgtccaggctccttgcgtaaagccc

SEQ ID NO: 196314 - DNA, 25 bp, E. coli
tgtccaggctccatgcgtaaagccc

SEQ ID NO: 196315 - DNA, 25 bp, E. coli
tgcgcatcaacggcaactgtccagg

SEQ ID NO: 196316 - DNA, 25 bp, E. coli
tgcgcatcaacgccaactgtccagg

SEQ ID NO: 196317 - DNA, 25 bp, E. coli
gcgcctgcgcatcaacgccaactgt

SEQ ID NO: 196318 - DNA, 25 bp, E. coli
gcgcctgcgcatgaacgccaactgt

SEQ ID NO: 196319 - DNA, 25 bp, E. coli
ctgtccaggctccttgcgtaaagcc

SEQ ID NO: 196320 - DNA, 25 bp, E. coli
ctgtccaggctcgttgcgtaaagcc

SEQ ID NO: 196321 - DNA, 25 bp, E. coli
gtccccgactgggagaagccgctga

SEQ ID NO: 196322 - DNA, 25 bp, E. coli
gtccaggctccttgcgtaaagcccc

SEQ ID NO: 196323 - DNA, 25 bp, E. coli
gtccaggctcctagcgtaaagcccc

SEQ ID NO: 196324 - DNA, 25 bp, E. coli
ggctccttgcgtaaagcccccatca

SEQ ID NO: 196325 - DNA, 25 bp, E. coli
ggctccttgcgttaagcccccatca

SEQ ID NO: 196326 - DNA, 25 bp, E. coli
gtccccgactggcagaagccgctga

SEQ ID NO: 196327 - DNA, 25 bp, E. coli
caaaggtagaccggattctggcgct

SEQ ID NO: 196328 - DNA, 25 bp, E. coli
caaaggtagacccgattctggcgct

SEQ ID NO: 196329 - DNA, 25 bp, E. coli
accgataccggcaatctgttcccgg

SEQ ID NO: 196330 - DNA, 25 bp, E. coli
actgccaaaggtagaccggattctg

SEQ ID NO: 196331 - DNA, 25 bp, E. coli
acgaactgccaaaggtagaccggat

SEQ ID NO: 196332 - DNA, 25 bp, E. coli
accgataccggctatctgttcccgg

SEQ ID NO: 196333 - DNA, 25 bp, E. coli
acgaactgccaatggtagaccggat

SEQ ID NO: 196334 - DNA, 25 bp, E. coli
actgccaaaggttgaccggattctg

SEQ ID NO: 196335 - DNA, 25 bp, E. coli
tgccaaaggtagaccggattctggc

SEQ ID NO: 196336 - DNA, 25 bp, E. coli
tcctcaccgataccggctatctgtt

SEQ ID NO: 196337 - DNA, 25 bp, E. coli
tcctcaccgatagcggctatctgtt

SEQ ID NO: 196338 - DNA, 25 bp, E. coli
tgccaaaggtagtccggattctggc

SEQ ID NO: 196339 - DNA, 25 bp, E. coli
gaactgccaaagctagaccggattc

SEQ ID NO: 196340 - DNA, 25 bp, E. coli
gaactgccaaaggtagaccggattc

SEQ ID NO: 196341 - DNA, 25 bp, E. coli
cgaactgccaaacgtagaccggatt

SEQ ID NO: 196342 - DNA, 25 bp, E. coli
cgaactgccaaaggtagaccggatt

SEQ ID NO: 196343 - DNA, 25 bp, E. coli
cgataccggctaactgttcccggaa

SEQ ID NO: 196344 - DNA, 25 bp, E. coli
cgataccggctatctgttcccggaa

SEQ ID NO: 196345 - DNA, 25 bp, E. coli
gataccggctatgtgttcccggaaa

SEQ ID NO: 196346 - DNA, 25 bp, E. coli
gataccggctatctgttcccggaaa

SEQ ID NO: 196347 - DNA, 25 bp, E. coli
gatcctcaccgataccggctatctg

SEQ ID NO: 196348 - DNA, 25 bp, E. coli
gatcctcaccgaaaccggctatctg

SEQ ID NO: 196349 - DNA, 25 bp, E. coli
caatctatatttgcccaacaatggg

SEQ ID NO: 196350 - DNA, 25 bp, E. coli
caatctatatttccccaacaatggg

SEQ ID NO: 196351 - DNA, 25 bp, E. coli
caacaatggggggacgaatgctgta

SEQ ID NO: 196352 - DNA, 25 bp, E. coli
caacaatgggggcacgaatgctgta

SEQ ID NO: 196353 - DNA, 25 bp, E. coli
agtaaaacaatctgcgatctcaaag

SEQ ID NO: 196354 - DNA, 25 bp, E. coli
agtaaaacaatcagcgatctcaaag

SEQ ID NO: 196355 - DNA, 25 bp, E. coli
aactttcgtgctgtggcccaatcta

SEQ ID NO: 196356 - DNA, 25 bp, E. coli
aactttcgtgctctggcccaatcta

SEQ ID NO: 196357 - DNA, 25 bp, E. coli
tattaactttcgtgctctggcccaa

SEQ ID NO: 196358 - DNA, 25 bp, E. coli
tattaactttcgagctctggcccaa

SEQ ID NO: 196359 - DNA, 25 bp, E. coli
tgtcgtgctgttcgaggagctgtgc

SEQ ID NO: 196360 - DNA, 25 bp, E. coli
tgtcgtgctgttggaggagctgtgc

SEQ ID NO: 196361 - DNA, 25 bp, E. coli
tgctctggcccattctatatttgcc

SEQ ID NO: 196362 - DNA, 25 bp, E. coli
tgctctggcccaatctatatttgcc

SEQ ID NO: 196363 - DNA, 25 bp, E. coli
tctgcgatctcatagttattgtgtg

SEQ ID NO: 196364 - DNA, 25 bp, E. coli
tctgcgatctcaaagttattgtgtg

SEQ ID NO: 196365 - DNA, 25 bp, E. coli
ctgtgcgaacgtggtattaactttc

SEQ ID NO: 196366 - DNA, 25 bp, E. coli
ctgtgcgaacgtcgtattaactttc

SEQ ID NO: 196367 - DNA, 25 bp, E. coli
ggagctgtgcgatcgtggtattaac

SEQ ID NO: 196368 - DNA, 25 bp, E. coli
ggagctgtgcgaacgtggtattaac

SEQ ID NO: 196369 - DNA, 25 bp, E. coli
ggacgaatgctgtaaaagtaaaaca

SEQ ID NO: 196370 - DNA, 25 bp, E. coli
ggacgaatgctgaaaaagtaaaaca

SEQ ID NO: 196371 - DNA, 25 bp, E. coli
aaaaacgcccgtttgtgctggttgg

SEQ ID NO: 196372 - DNA, 25 bp, E. coli
aaaaacgcccgtatgtgctggttgg

SEQ ID NO: 196373 - DNA, 25 bp, E. coli
tataagcatgaacgtcgcctggtgg

SEQ ID NO: 196374 - DNA, 25 bp, E. coli
tataagcatgaaggtcgcctggtgg

SEQ ID NO: 196375 - DNA, 25 bp, E. coli
tgtctgtagaagatactcaaccgct

SEQ ID NO: 196376 - DNA, 25 bp, E. coli
tgtctgtagaagttactcaaccgct

SEQ ID NO: 196377 - DNA, 25 bp, E. coli
tgagctgcgtaagcgtctgctgaac

SEQ ID NO: 196378 - DNA, 25 bp, E. coli
tgagctgcgtaaccgtctgctgaac

SEQ ID NO: 196379 - DNA, 25 bp, E. coli
tcgttgtcgggatgttgctgacgcc

SEQ ID NO: 196380 - DNA, 25 bp, E. coli
tcgttgtcgggaagttgctgacgcc

SEQ ID NO: 196381 - DNA, 25 bp, E. coli
tcagcgccggtgattctctatcagg

SEQ ID NO: 196382 - DNA, 25 bp, E. coli
gatcaagcagttcccgcaaggttca

SEQ ID NO: 196383 - DNA, 25 bp, E. coli
gatcaagcagttgccgcaaggttca

SEQ ID NO: 196384 - DNA, 25 bp, E. coli
ggattacctcgccagaagacttacg

SEQ ID NO: 196385 - DNA, 25 bp, E. coli
ggattacctcgcgagaagacttacg

SEQ ID NO: 196386 - DNA, 25 bp, E. coli
ggttcaacgatgttcgccaccgacg

SEQ ID NO: 196387 - DNA, 25 bp, E. coli
ggtatccgcgccattgatcaagcag

SEQ ID NO: 196388 - DNA, 25 bp, E. coli
ggttcaacgatgatcgccaccgacg

SEQ ID NO: 196389 - DNA, 25 bp, E. coli
ggtatccgcgcctttgatcaagcag

SEQ ID NO: 196390 - DNA, 25 bp, E. coli
tcagcgccggtgtttctctatcagg

SEQ ID NO: 196391 - DNA, 25 bp, E. coli
gatgtcttctcgcaaacgctgttgg

SEQ ID NO: 196392 - DNA, 25 bp, E. coli
gatgtcttctcggaaacgctgttgg

SEQ ID NO: 196393 - DNA, 25 bp, E. coli
tacgatacgctaattggcgaagtgg

SEQ ID NO: 196394 - DNA, 25 bp, E. coli
tacgatacgctatttggcgaagtgg

SEQ ID NO: 196395 - DNA, 25 bp, E. coli
atggagtgtcgcgtgctacctgcaa

SEQ ID NO: 196396 - DNA, 25 bp, E. coli
atggagtgtcgcctgctacctgcaa

SEQ ID NO: 196397 - DNA, 25 bp, E. coli
tacctgcaacttccgcgcaagaaaa

SEQ ID NO: 196398 - DNA, 25 bp, E. coli
taccagtggtaaccgagttacggcg

SEQ ID NO: 196399 - DNA, 25 bp, E. coli
tatggcagcagcctggtcgatgccc

SEQ ID NO: 196400 - DNA, 25 bp, E. coli
tatggcagcagcgtggtcgatgccc

SEQ ID NO: 196401 - DNA, 25 bp, E. coli
tacctgcaacttgcgcgcaagaaaa

SEQ ID NO: 196402 - DNA, 25 bp, E. coli
taccagtggtaagcgagttacggcg

SEQ ID NO: 196403 - DNA, 25 bp, E. coli
tcattcccgtcgtattacaccatgc

SEQ ID NO: 196404 - DNA, 25 bp, E. coli
tcattcccgtcgaattacaccatgc

SEQ ID NO: 196405 - DNA, 25 bp, E. coli
cccggtgcttggtttgccgctggtc

SEQ ID NO: 196406 - DNA, 25 bp, E. coli
cccggtgcttggattgccgctggtc

SEQ ID NO: 196407 - DNA, 25 bp, E. coli
cgtagagtttgaaccgccacgcgtg

SEQ ID NO: 196408 - DNA, 25 bp, E. coli
cgtagagtttgatccgccacgcgtg

SEQ ID NO: 196409 - DNA, 25 bp, E. coli
gtgagccaattcattcccgtcgaat

SEQ ID NO: 196410 - DNA, 25 bp, E. coli
gtgagccaattctttcccgtcgaat

SEQ ID NO: 196411 - DNA, 25 bp, E. coli
tcgatgcccgtacagtttgaaccgc

SEQ ID NO: 196412 - DNA, 25 bp, E. coli
tggcacgtttgtaaccagtggtaag

SEQ ID NO: 196413 - DNA, 25 bp, E. coli
tcgatgcccgtagagtttgaaccgc

SEQ ID NO: 196414 - DNA, 25 bp, E. coli
tggcacgtttgttaccagtggtaag

SEQ ID NO: 196415 - DNA, 25 bp, E. coli
aacccgcgtctgattgatgtcacga

SEQ ID NO: 196416 - DNA, 25 bp, E. coli
catggcgatgcgagattcaggaacc

SEQ ID NO: 196417 - DNA, 25 bp, E. coli
catggcgatgcgtgattcaggaacc

SEQ ID NO: 196418 - DNA, 25 bp, E. coli
taaacttgccgaaaaagcaccggaa

SEQ ID NO: 196419 - DNA, 25 bp, E. coli
taaacttgccgataaagcaccggaa

SEQ ID NO: 196420 - DNA, 25 bp, E. coli
aacccgcgtctgtttgatgtcacga

SEQ ID NO: 196421 - DNA, 25 bp, E. coli
tatggtagcggctcaaaaaggcccg

SEQ ID NO: 196422 - DNA, 25 bp, E. coli
tatggtagcggcacaaaaaggcccg

SEQ ID NO: 196423 - DNA, 25 bp, E. coli
tgtcagtgaaatggatacccgcgcg

SEQ ID NO: 196424 - DNA, 25 bp, E. coli
tgtcagtgaaatcgatacccgcgcg

SEQ ID NO: 196425 - DNA, 25 bp, E. coli
tccacgatatgacaatgcctgagcg

SEQ ID NO: 196426 - DNA, 25 bp, E. coli
tccacgatatgagaatgcctgagcg

SEQ ID NO: 196427 - DNA, 25 bp, E. coli
tctgaagcccttgccgaagcgattg

SEQ ID NO: 196428 - DNA, 25 bp, E. coli
tctgaagcccttcccgaagcgattg

SEQ ID NO: 196429 - DNA, 25 bp, E. coli
gaaccgttctcgactggaaaagcct

SEQ ID NO: 196430 - DNA, 25 bp, E. coli
gaagtatctgccgacagcgatgctg

SEQ ID NO: 196431 - DNA, 25 bp, E. coli
gaagtatctgcccacagcgatgctg

SEQ ID NO: 196432 - DNA, 25 bp, E. coli
gaaccgttctcgtctggaaaagcct

SEQ ID NO: 196433 - DNA, 25 bp, E. coli
gaaaagcctgcaactgaatggcccg

SEQ ID NO: 196434 - DNA, 25 bp, E. coli
gaaaagcctgcatctgaatggcccg

SEQ ID NO: 196435 - DNA, 25 bp, E. coli
ggtacgctcgacaaactggaatcca

SEQ ID NO: 196436 - DNA, 25 bp, E. coli
ggtacgctcgactaactggaatcca

SEQ ID NO: 196437 - DNA, 25 bp, E. coli
caccttcgataatttgtttatgggc

SEQ ID NO: 196438 - DNA, 25 bp, E. coli
caccttcgataaattgtttatgggc

SEQ ID NO: 196439 - DNA, 25 bp, E. coli
taaattgtttatgggcaccgacggc

SEQ ID NO: 196440 - DNA, 25 bp, E. coli
taaattgtttatcggcaccgacggc

SEQ ID NO: 196441 - DNA, 25 bp, E. coli
ataaattgtttatgggcaccgacgg

SEQ ID NO: 196442 - DNA, 25 bp, E. coli
ataaattgtttaagggcaccgacgg

SEQ ID NO: 196443 - DNA, 25 bp, E. coli
ttgtttatgggctccgacggcatcg

SEQ ID NO: 196444 - DNA, 25 bp, E. coli
ttcgataaattgattatgggcaccg

SEQ ID NO: 196445 - DNA, 25 bp, E. coli
ttcgataaattgtttatgggcaccg

SEQ ID NO: 196446 - DNA, 25 bp, E. coli
ttgtttatgggcaccgacggcatcg

SEQ ID NO: 196447 - DNA, 25 bp, E. coli
tgtttatgggcagcgacggcatcga

SEQ ID NO: 196448 - DNA, 25 bp, E. coli
tgtttatgggcaccgacggcatcga

SEQ ID NO: 196449 - DNA, 25 bp, E. coli
ccttcgataaatagtttatgggcac

SEQ ID NO: 196450 - DNA, 25 bp, E. coli
ccttcgataaattgtttatgggcac

SEQ ID NO: 196451 - DNA, 25 bp, E. coli
gcatttcaccttcgataaattgttt

SEQ ID NO: 196452 - DNA, 25 bp, E. coli
gcatttcaccttggataaattgttt

SEQ ID NO: 196453 - DNA, 25 bp, E. coli
cgataaattgtttatgggcaccgac

SEQ ID NO: 196454 - DNA, 25 bp, E. coli
cgataaattgttaatgggcaccgac

SEQ ID NO: 196455 - DNA, 25 bp, E. coli
gtttatgggcacggacggcatcgat

SEQ ID NO: 196456 - DNA, 25 bp, E. coli
gataaattgtttttgggcaccgacg

SEQ ID NO: 196457 - DNA, 25 bp, E. coli
gtttatgggcaccgacggcatcgat

SEQ ID NO: 196458 - DNA, 25 bp, E. coli
gataaattgtttatgggcaccgacg

SEQ ID NO: 196459 - DNA, 25 bp, E. coli
aaggaagccattgcgctttatgagc

SEQ ID NO: 196460 - DNA, 25 bp, E. coli
aaggaagccattccgctttatgagc

SEQ ID NO: 196461 - DNA, 25 bp, E. coli
catttgggctttgagcatatcgact

SEQ ID NO: 196462 - DNA, 25 bp, E. coli
cttttttaaaggaagccattgcgct

SEQ ID NO: 196463 - DNA, 25 bp, E. coli
catttgggctttcagcatatcgact

SEQ ID NO: 196464 - DNA, 25 bp, E. coli
cttttttaaaggtagccattgcgct

SEQ ID NO: 196465 - DNA, 25 bp, E. coli
ttgggctttgagcatatcgactatg

SEQ ID NO: 196466 - DNA, 25 bp, E. coli
ttgggctttgaggatatcgactatg

SEQ ID NO: 196467 - DNA, 25 bp, E. coli
gcttttttaaaggaagccattgcgc

SEQ ID NO: 196468 - DNA, 25 bp, E. coli
gctttgagcatatcgactatgcgct

SEQ ID NO: 196469 - DNA, 25 bp, E. coli
gctttgagcataacgactatgcgct

SEQ ID NO: 196470 - DNA, 25 bp, E. coli
gcttttttaaagcaagccattgcgc

SEQ ID NO: 196471 - DNA, 25 bp, E. coli
gaagccattgcgctttatgagcatt

SEQ ID NO: 196472 - DNA, 25 bp, E. coli
gaagccattgcggtttatgagcatt

SEQ ID NO: 196473 - DNA, 25 bp, E. coli
cgctttatgagcatttgggctttga

SEQ ID NO: 196474 - DNA, 25 bp, E. coli
cgctttatgagcttttgggctttga

SEQ ID NO: 196475 - DNA, 25 bp, E. coli
cattgcgctttatgagcatttgggc

SEQ ID NO: 196476 - DNA, 25 bp, E. coli
cattgcgctttaagagcatttgggc

SEQ ID NO: 196477 - DNA, 25 bp, E. coli
gagcatatcgactatgcgcttggct

SEQ ID NO: 196478 - DNA, 25 bp, E. coli
gagcatatcgacaatgcgcttggct

SEQ ID NO: 196479 - DNA, 25 bp, E. coli
gagcatttgggctttgagcatatcg

SEQ ID NO: 196480 - DNA, 25 bp, E. coli
gagcatttgggcattgagcatatcg

SEQ ID NO: 196481 - DNA, 25 bp, E. coli
aatttcgccgtcaacatccagtggg

SEQ ID NO: 196482 - DNA, 25 bp, E. coli
aatttcgccgtctacatccagtggg

SEQ ID NO: 196483 - DNA, 25 bp, E. coli
cactagctggcttgagtcgcagggc

SEQ ID NO: 196484 - DNA, 25 bp, E. coli
cactagctggctagagtcgcagggc

SEQ ID NO: 196485 - DNA, 25 bp, E. coli
tagcagttgcctatgattccaggcg

SEQ ID NO: 196486 - DNA, 25 bp, E. coli
tagcagttgcctttgattccaggcg

SEQ ID NO: 196487 - DNA, 25 bp, E. coli
tattctgcaggatctgaaccgccgg

SEQ ID NO: 196488 - DNA, 25 bp, E. coli
tattctgcaggaactgaaccgccgg

SEQ ID NO: 196489 - DNA, 25 bp, E. coli
tttgcaggaacgaaagctctggcga

SEQ ID NO: 196490 - DNA, 25 bp, E. coli
tttgcaggaacgtaagctctggcga

SEQ ID NO: 196491 - DNA, 25 bp, E. coli
tctggcgatatcatcgcagccgacg

SEQ ID NO: 196492 - DNA, 25 bp, E. coli
tctggcgatatcttcgcagccgacg

SEQ ID NO: 196493 - DNA, 25 bp, E. coli
gctggaccgtgctgcgtttctggaa

SEQ ID NO: 196494 - DNA, 25 bp, E. coli
gctggaccgtgcagcgtttctggaa

SEQ ID NO: 196495 - DNA, 25 bp, E. coli
gcagccgacgttatagtgatttcaa

SEQ ID NO: 196496 - DNA, 25 bp, E. coli
gcagccgacgttttagtgatttcaa

SEQ ID NO: 196497 - DNA, 25 bp, E. coli
gattttgcttgcagctcggcgcgtg

SEQ ID NO: 196498 - DNA, 25 bp, E. coli
gattttgcttgctgctcggcgcgtg

SEQ ID NO: 196499 - DNA, 25 bp, E. coli
tcaaatgcgcgtgatttaagacgca

SEQ ID NO: 196500 - DNA, 25 bp, E. coli
taagacgcaatcacactttgcagga

SEQ ID NO: 196501 - DNA, 25 bp, E. coli
taagacgcaatctcactttgcagga

SEQ ID NO: 196502 - DNA, 25 bp, E. coli
tcaaatgcgcgtcatttaagacgca

SEQ ID NO: 196503 - DNA, 25 bp, E. coli
caactggtcggcaaatcagcaggga

SEQ ID NO: 196504 - DNA, 25 bp, E. coli
caactggtcggctaatcagcaggga

SEQ ID NO: 196505 - DNA, 25 bp, E. coli
ttatgtcaataatcaggcttcggcc

SEQ ID NO: 196506 - DNA, 25 bp, E. coli
ttatgtcaataaacaggcttcggcc

SEQ ID NO: 196507 - DNA, 25 bp, E. coli
tcgaaacggatgatagccgcacgcg

SEQ ID NO: 196508 - DNA, 25 bp, E. coli
tcgaaacggatgttagccgcacgcg

SEQ ID NO: 196509 - DNA, 25 bp, E. coli
tcagtctggtctttagcgcctcgga

SEQ ID NO: 196510 - DNA, 25 bp, E. coli
tcatcgctttggtgagcacacgccg

SEQ ID NO: 196511 - DNA, 25 bp, E. coli
tcatcgctttggagagcacacgccg

SEQ ID NO: 196512 - DNA, 25 bp, E. coli
tcagtctggtctatagcgcctcgga

SEQ ID NO: 196513 - DNA, 25 bp, E. coli
gcgagtgtcatagcgaagttagcca

SEQ ID NO: 196514 - DNA, 25 bp, E. coli
gcgagtgtcataccgaagttagcca

SEQ ID NO: 196515 - DNA, 25 bp, E. coli
gaatatgcgctttaacccgcaggga

SEQ ID NO: 196516 - DNA, 25 bp, E. coli
gaatatgcgcttaaacccgcaggga

SEQ ID NO: 196517 - DNA, 25 bp, E. coli
gacatcggcgtatcaggcgtcatcg

SEQ ID NO: 196518 - DNA, 25 bp, E. coli
gacatcggcgtaacaggcgtcatcg

SEQ ID NO: 196519 - DNA, 25 bp, E. coli
ctatagcgcgctcggaagtcggtac

SEQ ID NO: 196520 - DNA, 25 bp, E. coli
ctatagcgcgctgggaagtcggtac

SEQ ID NO: 196521 - DNA, 25 bp, E. coli
gattccagtcgaggcgtttgcacga

SEQ ID NO: 196522 - DNA, 25 bp, E. coli
gattccagtcgacgcgtttgcacga

SEQ ID NO: 196523 - DNA, 25 bp, E. coli
ggtaagcactatgtgaacgcctggg

SEQ ID NO: 196524 - DNA, 25 bp, E. coli
ggtaagcactatctgaacgcctggg

SEQ ID NO: 196525 - DNA, 25 bp, E. coli
cacgcccctattagcaatataaagg

SEQ ID NO: 196526 - DNA, 25 bp, E. coli
cacgcccctatttgcaatataaagg

SEQ ID NO: 196527 - DNA, 25 bp, E. coli
caaaacaattgaagatgtcatccag

SEQ ID NO: 196528 - DNA, 25 bp, E. coli
caaaacaattgatgatgtcatccag

SEQ ID NO: 196529 - DNA, 25 bp, E. coli
cattgattttaggtgttcggatacc

SEQ ID NO: 196530 - DNA, 25 bp, E. coli
cattgattttagctgttcggatacc

SEQ ID NO: 196531 - DNA, 25 bp, E. coli
tatctggaaggcagaaggaggtcct

SEQ ID NO: 196532 - DNA, 25 bp, E. coli
tatctggaaggctgaaggaggtcct

SEQ ID NO: 196533 - DNA, 25 bp, E. coli
tataagctttctttatctggaaggc

SEQ ID NO: 196534 - DNA, 25 bp, E. coli
tataagctttctatatctggaaggc

SEQ ID NO: 196535 - DNA, 25 bp, E. coli
gaaggaggtcctgctgatgttttta

SEQ ID NO: 196536 - DNA, 25 bp, E. coli
gaaggaggtcctcctgatgttttta

SEQ ID NO: 196537 - DNA, 25 bp, E. coli
gaaacctttgattttctcagggata

SEQ ID NO: 196538 - DNA, 25 bp, E. coli
gaaacctttgatattctcagggata

SEQ ID NO: 196539 - DNA, 25 bp, E. coli
gcgtttcaataaaaactgtttcgag

SEQ ID NO: 196540 - DNA, 25 bp, E. coli
gcgtttcaataataactgtttcgag

SEQ ID NO: 196541 - DNA, 25 bp, E. coli
gatattgctaataacctcggcgttt

SEQ ID NO: 196542 - DNA, 25 bp, E. coli
gatattgctaattacctcggcgttt

SEQ ID NO: 196543 - DNA, 25 bp, E. coli
gggatattatcctcgcccctatttg

SEQ ID NO: 196544 - DNA, 25 bp, E. coli
gggatattatccacgcccctatttg

SEQ ID NO: 196545 - DNA, 25 bp, E. coli
taatatcatcccctaaaacgtcaga

SEQ ID NO: 196546 - DNA, 25 bp, E. coli
taatatcatcccgtaaaacgtcaga

SEQ ID NO: 196547 - DNA, 25 bp, E. coli
aatcgatgaaaaaaccaaccgtctg

SEQ ID NO: 196548 - DNA, 25 bp, E. coli
aatcgatgaaaataccaaccgtctg

SEQ ID NO: 196549 - DNA, 25 bp, E. coli
agcgtccggcaattcgatgaaaaaa

SEQ ID NO: 196550 - DNA, 25 bp, E. coli
agcgtccggcaaatcgatgaaaaaa

SEQ ID NO: 196551 - DNA, 25 bp, E. coli
tattgatgtgaagaagtgcactaag

SEQ ID NO: 196552 - DNA, 25 bp, E. coli
tattgatgtgaacaagtgcactaag

SEQ ID NO: 196553 - DNA, 25 bp, E. coli
ttgttagcgtggtcgatcctggtgt

SEQ ID NO: 196554 - DNA, 25 bp, E. coli
ttgttagcgtggacgatcctggtgt

SEQ ID NO: 196555 - DNA, 25 bp, E. coli
tgatgtgaagaagtgcactaagtaa

SEQ ID NO: 196556 - DNA, 25 bp, E. coli
tgatgtgaagaactgcactaagtaa

SEQ ID NO: 196557 - DNA, 25 bp, E. coli
tggtgttggtactgaccgtaaatcg

SEQ ID NO: 196558 - DNA, 25 bp, E. coli
tggtgttggtacagaccgtaaatcg

SEQ ID NO: 196559 - DNA, 25 bp, E. coli
ccgcaaggttcggtgtttgttagcg

SEQ ID NO: 196560 - DNA, 25 bp, E. coli
ccgcaaggttcgctgtttgttagcg

SEQ ID NO: 196561 - DNA, 25 bp, E. coli
gatcctggtgttcgtacagaccgta

SEQ ID NO: 196562 - DNA, 25 bp, E. coli
gtacagaccgtaaatcggtagtgct

SEQ ID NO: 196563 - DNA, 25 bp, E. coli
gtacagaccgtatatcggtagtgct

SEQ ID NO: 196564 - DNA, 25 bp, E. coli
ggcaaatcgatgaaaaaaccaaccg

SEQ ID NO: 196565 - DNA, 25 bp, E. coli
ggcaaatcgatgtaaaaaccaaccg

SEQ ID NO: 196566 - DNA, 25 bp, E. coli
gatgaaaaaacctaccgtctgaaag

SEQ ID NO: 196567 - DNA, 25 bp, E. coli
gatgaaaaaaccaaccgtctgaaag

SEQ ID NO: 196568 - DNA, 25 bp, E. coli
gatcctggtgttggtacagaccgta

SEQ ID NO: 196569 - DNA, 25 bp, E. coli
catgatgccggtgatgcagcatcct

SEQ ID NO: 196570 - DNA, 25 bp, E. coli
catgatgccggtcatgcagcatcct

SEQ ID NO: 196571 - DNA, 25 bp, E. coli
tgttcacctctgttaacggtccgga

SEQ ID NO: 196572 - DNA, 25 bp, E. coli
tgttcacctctgataacggtccgga

SEQ ID NO: 196573 - DNA, 25 bp, E. coli
tgagcccggctccttctgaatacat

SEQ ID NO: 196574 - DNA, 25 bp, E. coli
tgagcccggctcgttctgaatacat

SEQ ID NO: 196575 - DNA, 25 bp, E. coli
tccgatatgtattccgaatggcgtg

SEQ ID NO: 196576 - DNA, 25 bp, E. coli
tccgcggtgcgaaaggttctacatg

SEQ ID NO: 196577 - DNA, 25 bp, E. coli
tccgcggtgcgataggttctacatg

SEQ ID NO: 196578 - DNA, 25 bp, E. coli
tccgatatgtataccgaatggcgtg

SEQ ID NO: 196579 - DNA, 25 bp, E. coli
tctgaatacatccaaaaactgccgt

SEQ ID NO: 196580 - DNA, 25 bp, E. coli
tctgaatacatcgaaaaactgccgt

SEQ ID NO: 196581 - DNA, 25 bp, E. coli
gcagcatcctgctcaagacaaagaa

SEQ ID NO: 196582 - DNA, 25 bp, E. coli
gcagcatcctgcacaagacaaagaa

SEQ ID NO: 196583 - DNA, 25 bp, E. coli
cgtgtgccaaccttcgtttactgga

SEQ ID NO: 196584 - DNA, 25 bp, E. coli
cgtgtgccaaccatcgtttactgga

SEQ ID NO: 196585 - DNA, 25 bp, E. coli
ggtgaacaggaagccattgccgaca

SEQ ID NO: 196586 - DNA, 25 bp, E. coli
ggtgaacaggaacccattgccgaca

SEQ ID NO: 196587 - DNA, 25 bp, E. coli
tggagatgaacgttatcttcgccaa

SEQ ID NO: 196588 - DNA, 25 bp, E. coli
tggagatgaacgatatcttcgccaa

SEQ ID NO: 196589 - DNA, 25 bp, E. coli
gatgttcatgtctacccggaagtcg

SEQ ID NO: 196590 - DNA, 25 bp, E. coli
gatgttcatgtcaacccggaagtcg

SEQ ID NO: 196591 - DNA, 25 bp, E. coli
aacggcctgcgccaagtcgaagtta

SEQ ID NO: 196592 - DNA, 25 bp, E. coli
caggcgcgcgaatcaaaatacatca

SEQ ID NO: 196593 - DNA, 25 bp, E. coli
caggcgcgcgaaacaaaatacatca

SEQ ID NO: 196594 - DNA, 25 bp, E. coli
catagctatgcacaaatccggccgt

SEQ ID NO: 196595 - DNA, 25 bp, E. coli
catagctatgcagaaatccggccgt

SEQ ID NO: 196596 - DNA, 25 bp, E. coli
aacggcctgcgcgaagtcgaagtta

SEQ ID NO: 196597 - DNA, 25 bp, E. coli
taccctgcgtcgactggatttcggc

SEQ ID NO: 196598 - DNA, 25 bp, E. coli
taccctgcgtcgtctggatttcggc

SEQ ID NO: 196599 - DNA, 25 bp, E. coli
gacgacgacattcccggtctggtaa

SEQ ID NO: 196600 - DNA, 25 bp, E. coli
gacgacgacattgccggtctggtaa

SEQ ID NO: 196601 - DNA, 25 bp, E. coli
cgtattcagggtctgatccaggcgc

SEQ ID NO: 196602 - DNA, 25 bp, E. coli
cgtattcagggtgtgatccaggcgc

SEQ ID NO: 196603 - DNA, 25 bp, E. coli
ctggtcctgccgattgagaagatga

SEQ ID NO: 196604 - DNA, 25 bp, E. coli
ctggtcctgccgtttgagaagatga

SEQ ID NO: 196605 - DNA, 25 bp, E. coli
gattatcggcgataacgtgctggaa

SEQ ID NO: 196606 - DNA, 25 bp, E. coli
gattgatattctgcgcgtgcgtgac

SEQ ID NO: 196607 - DNA, 25 bp, E. coli
gattgatattctccgcgtgcgtgac

SEQ ID NO: 196608 - DNA, 25 bp, E. coli
gatttgcgatctggtttccaccggt

SEQ ID NO: 196609 - DNA, 25 bp, E. coli
gatttgcgatctcgtttccaccggt

SEQ ID NO: 196610 - DNA, 25 bp, E. coli
gattatcggcgaaaacgtgctggaa

SEQ ID NO: 196611 - DNA, 25 bp, E. coli
tggaagaagagctgcttaaccgccg

SEQ ID NO: 196612 - DNA, 25 bp, E. coli
tggaagaagagcagcttaaccgccg

SEQ ID NO: 196613 - DNA, 25 bp, E. coli
caacgaaggcaatctagtaatagct

SEQ ID NO: 196614 - DNA, 25 bp, E. coli
caacgaaggcaaactagtaatagct

SEQ ID NO: 196615 - DNA, 25 bp, E. coli
caaactagtaattgctgttgaacgc

SEQ ID NO: 196616 - DNA, 25 bp, E. coli
caaactagtaatagctgttgaacgc

SEQ ID NO: 196617 - DNA, 25 bp, E. coli
agtaatagctgtagaacgcaacgcg

SEQ ID NO: 196618 - DNA, 25 bp, E. coli
agtaatagctgttgaacgcaacgcg

SEQ ID NO: 196619 - DNA, 25 bp, E. coli
actagtaatagctgttgaacgcaac

SEQ ID NO: 196620 - DNA, 25 bp, E. coli
aactagtaataggtgttgaacgcaa

SEQ ID NO: 196621 - DNA, 25 bp, E. coli
aacgaaggcaaactagtaatagctg

SEQ ID NO: 196622 - DNA, 25 bp, E. coli
actagtaatagcagttgaacgcaac

SEQ ID NO: 196623 - DNA, 25 bp, E. coli
aacgaaggcaaagtagtaatagctg

SEQ ID NO: 196624 - DNA, 25 bp, E. coli
aactagtaatagctgttgaacgcaa

SEQ ID NO: 196625 - DNA, 25 bp, E. coli
tagtaatagctgttgaacgcaacgc

SEQ ID NO: 196626 - DNA, 25 bp, E. coli
tagtaatagctgatgaacgcaacgc

SEQ ID NO: 196627 - DNA, 25 bp, E. coli
gaaggcaaactactaatagctgttg

SEQ ID NO: 196628 - DNA, 25 bp, E. coli
gaaggcaaactagtaatagctgttg

SEQ ID NO: 196629 - DNA, 25 bp, E. coli
cgaaggcaaacttgtaatagctgtt

SEQ ID NO: 196630 - DNA, 25 bp, E. coli
cgaaggcaaactagtaatagctgtt

SEQ ID NO: 196631 - DNA, 25 bp, E. coli
ctagtaatagctcttgaacgcaacg

SEQ ID NO: 196632 - DNA, 25 bp, E. coli
ctagtaatagctgttgaacgcaacg

SEQ ID NO: 196633 - DNA, 25 bp, E. coli
ggcaaactagtattagctgttgaac

SEQ ID NO: 196634 - DNA, 25 bp, E. coli
ggcaaactagtaatagctgttgaac

SEQ ID NO: 196635 - DNA, 25 bp, E. coli
aagccttgaaagtcggtatgcctga

SEQ ID NO: 196636 - DNA, 25 bp, E. coli
aagccttgaaagacggtatgcctga

SEQ ID NO: 196637 - DNA, 25 bp, E. coli
catgaattgacgcatgcccgtgagc

SEQ ID NO: 196638 - DNA, 25 bp, E. coli
catgaattgacggatgcccgtgagc

SEQ ID NO: 196639 - DNA, 25 bp, E. coli
ttgagacacgtttcgttggccccgg

SEQ ID NO: 196640 - DNA, 25 bp, E. coli
ttgagacacgttacgttggccccgg

SEQ ID NO: 196641 - DNA, 25 bp, E. coli
tgaacaagataagcgtaagcgcgcg

SEQ ID NO: 196642 - DNA, 25 bp, E. coli
tgaacaagataaccgtaagcgcgcg

SEQ ID NO: 196643 - DNA, 25 bp, E. coli
tgaccagcccggtataccatatgaa

SEQ ID NO: 196644 - DNA, 25 bp, E. coli
tgaccagcccggaataccatatgaa

SEQ ID NO: 196645 - DNA, 25 bp, E. coli
tcctaacttattaaaacgcgcggcg

SEQ ID NO: 196646 - DNA, 25 bp, E. coli
tcctaacttatttaaacgcgcggcg

SEQ ID NO: 196647 - DNA, 25 bp, E. coli
tctttgccgatcgtggagtgctgga

SEQ ID NO: 196648 - DNA, 25 bp, E. coli
tctttgccgatcctggagtgctgga

SEQ ID NO: 196649 - DNA, 25 bp, E. coli
tctgccgacaaaacgcaactgcggg

SEQ ID NO: 196650 - DNA, 25 bp, E. coli
tctgccgacaaatcgcaactgcggg

SEQ ID NO: 196651 - DNA, 25 bp, E. coli
ccttgtatgagcgaggcgacggtaa

SEQ ID NO: 196652 - DNA, 25 bp, E. coli
ccttgtatgagccaggcgacggtaa

SEQ ID NO: 196653 - DNA, 25 bp, E. coli
gaagatcatcgggtcgctgaacgct

SEQ ID NO: 196654 - DNA, 25 bp, E. coli
gaagatcatcggctcgctgaacgct

SEQ ID NO: 196655 - DNA, 25 bp, E. coli
cgcctttagcgttgaccgggcataa

SEQ ID NO: 196656 - DNA, 25 bp, E. coli
cgcctttagcgtagaccgggcataa

SEQ ID NO: 196657 - DNA, 25 bp, E. coli
caggctgaggtgttgcccttacaaa

SEQ ID NO: 196658 - DNA, 25 bp, E. coli
caggctgaggtgatgcccttacaaa

SEQ ID NO: 196659 - DNA, 25 bp, E. coli
tacaaatgcaacaacgacatggatt

SEQ ID NO: 196660 - DNA, 25 bp, E. coli
tacaaatgcaactacgacatggatt

SEQ ID NO: 196661 - DNA, 25 bp, E. coli
caaccttcgtaacacaactttgtga

SEQ ID NO: 196662 - DNA, 25 bp, E. coli
caaccttcgtaagacaactttgtga

SEQ ID NO: 196663 - DNA, 25 bp, E. coli
tttgtgaactttccaccgccagcgg

SEQ ID NO: 196664 - DNA, 25 bp, E. coli
tttgtgaactttgcaccgccagcgg

SEQ ID NO: 196665 - DNA, 25 bp, E. coli
tgccgattcggctaatgcgtttcca

SEQ ID NO: 196666 - DNA, 25 bp, E. coli
tgccgattcggcaaatgcgtttcca

SEQ ID NO: 196667 - DNA, 25 bp, E. coli
ccaggtgaccgtctaatctgaacta

SEQ ID NO: 196668 - DNA, 25 bp, E. coli
gccagcggcgattaaaagtaaaatg

SEQ ID NO: 196669 - DNA, 25 bp, E. coli
ccaggtgaccgtgtaatctgaacta

SEQ ID NO: 196670 - DNA, 25 bp, E. coli
gccagcggcgataaaaagtaaaatg

SEQ ID NO: 196671 - DNA, 25 bp, E. coli
gatgtaaggtaaccaatttttgccg

SEQ ID NO: 196672 - DNA, 25 bp, E. coli
gatgtaaggtaagcaatttttgccg

SEQ ID NO: 196673 - DNA, 25 bp, E. coli
gacatggattacaacaccctcataa

SEQ ID NO: 196674 - DNA, 25 bp, E. coli
gacatggattactacaccctcataa

SEQ ID NO: 196675 - DNA, 25 bp, E. coli
ctcataaacaaacggcaatcacctg

SEQ ID NO: 196676 - DNA, 25 bp, E. coli
ctcataaacaaagggcaatcacctg

SEQ ID NO: 196677 - DNA, 25 bp, E. coli
ggtatcttcagtccctgcctgcagg

SEQ ID NO: 196678 - DNA, 25 bp, E. coli
ggtatcttcagtgcctgcctgcagg

SEQ ID NO: 196679 - DNA, 25 bp, E. coli
atcctcgaggcgaagctcccgcgta

SEQ ID NO: 196680 - DNA, 25 bp, E. coli
atcctcgaggcgtagctcccgcgta

SEQ ID NO: 196681 - DNA, 25 bp, E. coli
tgccgaccatatcggggtgtatctg

SEQ ID NO: 196682 - DNA, 25 bp, E. coli
tgccgaccatatgggggtgtatctg

SEQ ID NO: 196683 - DNA, 25 bp, E. coli
tctgggcgacggacagtttattgag

SEQ ID NO: 196684 - DNA, 25 bp, E. coli
tctgggcgacggtcagtttattgag

SEQ ID NO: 196685 - DNA, 25 bp, E. coli
gcaggatcactttttaggcgcgcgc

SEQ ID NO: 196686 - DNA, 25 bp, E. coli
gaagctcccgcgtacggctaatgag

SEQ ID NO: 196687 - DNA, 25 bp, E. coli
gaagctcccgcgaacggctaatgag

SEQ ID NO: 196688 - DNA, 25 bp, E. coli
gcaggatcacttattaggcgcgcgc

SEQ ID NO: 196689 - DNA, 25 bp, E. coli
cccgcgtacggctaatgagatgtat

SEQ ID NO: 196690 - DNA, 25 bp, E. coli
cccgcgtacggcaaatgagatgtat

SEQ ID NO: 196691 - DNA, 25 bp, E. coli
cgtacggctaatcagatgtatcact

SEQ ID NO: 196692 - DNA, 25 bp, E. coli
cgtacggctaatgagatgtatcact

SEQ ID NO: 196693 - DNA, 25 bp, E. coli
gatcactttttacgcgcgcgccgga

SEQ ID NO: 196694 - DNA, 25 bp, E. coli
gtgtatctgggcgacggtcagttta

SEQ ID NO: 196695 - DNA, 25 bp, E. coli
gatcactttttaggcgcgcgccgga

SEQ ID NO: 196696 - DNA, 25 bp, E. coli
gtgtatctgggccacggtcagttta

SEQ ID NO: 196697 - DNA, 25 bp, E. coli
gggcgacggtcagtttattgagtca

SEQ ID NO: 196698 - DNA, 25 bp, E. coli
gggcgacggtcactttattgagtca

SEQ ID NO: 196699 - DNA, 25 bp, E. coli
taatgagatgtaacactaccatcgg

SEQ ID NO: 196700 - DNA, 25 bp, E. coli
taatgagatgtatcactaccatcgg

SEQ ID NO: 196701 - DNA, 25 bp, E. coli
aattctatcggctccttagcggctg

SEQ ID NO: 196702 - DNA, 25 bp, E. coli
aattctatcggcaccttagcggctg

SEQ ID NO: 196703 - DNA, 25 bp, E. coli
cagggacttggttgtgtcgctcaaa

SEQ ID NO: 196704 - DNA, 25 bp, E. coli
cagggacttggtagtgtcgctcaaa

SEQ ID NO: 196705 - DNA, 25 bp, E. coli
tatgaagtgggcagacgaagaccag

SEQ ID NO: 196706 - DNA, 25 bp, E. coli
tatcggtgggcaaaactcaaatgcg

SEQ ID NO: 196707 - DNA, 25 bp, E. coli
tatgaagtgggctgacgaagaccag

SEQ ID NO: 196708 - DNA, 25 bp, E. coli
tatcggtgggcataactcaaatgcg

SEQ ID NO: 196709 - DNA, 25 bp, E. coli
tatcaccttgggatggctgctctcg

SEQ ID NO: 196710 - DNA, 25 bp, E. coli
tatcaccttgggttggctgctctcg

SEQ ID NO: 196711 - DNA, 25 bp, E. coli
tccaaaaagaatatgcggcagccat

SEQ ID NO: 196712 - DNA, 25 bp, E. coli
tccaaaaagaatttgcggcagccat

SEQ ID NO: 196713 - DNA, 25 bp, E. coli
tctcaagccgcaaagcaacaggaag

SEQ ID NO: 196714 - DNA, 25 bp, E. coli
tctcaagccgcatagcaacaggaag

SEQ ID NO: 196715 - DNA, 25 bp, E. coli
gctgcaaaacaacgccaaggaactg

SEQ ID NO: 196716 - DNA, 25 bp, E. coli
gctgcaaaacaaggccaaggaactg

SEQ ID NO: 196717 - DNA, 25 bp, E. coli
gcaacaaggaatgaactcaggcggt

SEQ ID NO: 196718 - DNA, 25 bp, E. coli
gcaacaaggaatcaactcaggcggt

SEQ ID NO: 196719 - DNA, 25 bp, E. coli
ggtcgcaataacttcggccttcagg

SEQ ID NO: 196720 - DNA, 25 bp, E. coli
ggtcgcaataacatcggccttcagg

SEQ ID NO: 196721 - DNA, 25 bp, E. coli
gatgtatcagcacaatccttcaggg

SEQ ID NO: 196722 - DNA, 25 bp, E. coli
gatgtatcagcagaatccttcaggg

SEQ ID NO: 196723 - DNA, 25 bp, E. coli
caaccgctgttgcaggctatcgacc

SEQ ID NO: 196724 - DNA, 25 bp, E. coli
aagactacggcggtcaactggtagc

SEQ ID NO: 196725 - DNA, 25 bp, E. coli
aagactacggcgctcaactggtagc

SEQ ID NO: 196726 - DNA, 25 bp, E. coli
caaccgctgttggaggctatcgacc

SEQ ID NO: 196727 - DNA, 25 bp, E. coli
tacggttcgctgtatccgcgtaaaa

SEQ ID NO: 196728 - DNA, 25 bp, E. coli
tacggttcgctgaatccgcgtaaaa

SEQ ID NO: 196729 - DNA, 25 bp, E. coli
ttgcagccgcaggtaaaagactacg

SEQ ID NO: 196730 - DNA, 25 bp, E. coli
ttgcagccgcagctaaaagactacg

SEQ ID NO: 196731 - DNA, 25 bp, E. coli
tgatcaggatgaaaatccgcagcgt

SEQ ID NO: 196732 - DNA, 25 bp, E. coli
tgatcaggatgataatccgcagcgt

SEQ ID NO: 196733 - DNA, 25 bp, E. coli
gcttaagcaaagaacagcgtcggga

SEQ ID NO: 196734 - DNA, 25 bp, E. coli
gcttaagcaaagtacagcgtcggga

SEQ ID NO: 196735 - DNA, 25 bp, E. coli
gctatccgcatatgttctccggcgg

SEQ ID NO: 196736 - DNA, 25 bp, E. coli
gctatccgcataagttctccggcgg

SEQ ID NO: 196737 - DNA, 25 bp, E. coli
gaaaaagccctgtcgatgatggcga

SEQ ID NO: 196738 - DNA, 25 bp, E. coli
gaaaaagccctgacgatgatggcga

SEQ ID NO: 196739 - DNA, 25 bp, E. coli
cgaaagtcggcctgaaaaccgagca

SEQ ID NO: 196740 - DNA, 25 bp, E. coli
cgaaagtcggccagaaaaccgagca

SEQ ID NO: 196741 - DNA, 25 bp, E. coli
cctgaaaaaacaatatccggtgaag

SEQ ID NO: 196742 - DNA, 25 bp, E. coli
cctgaaaaaacattatccggtgaag

SEQ ID NO: 196743 - DNA, 25 bp, E. coli
taaccttgaacgtggcaaaacgctg

SEQ ID NO: 196744 - DNA, 25 bp, E. coli
taaccttgaacgaggcaaaacgctg

SEQ ID NO: 196745 - DNA, 25 bp, E. coli
cagtttctggacgaaagcggcgtaa

SEQ ID NO: 196746 - DNA, 25 bp, E. coli
cagtttctggaccaaagcggcgtaa

SEQ ID NO: 196747 - DNA, 25 bp, E. coli
aaaaatccgcatggtttacgcgccg

SEQ ID NO: 196748 - DNA, 25 bp, E. coli
aactgttcattgtgcaggcgcgtcc

SEQ ID NO: 196749 - DNA, 25 bp, E. coli
aaaaatccgcatcgtttacgcgccg

SEQ ID NO: 196750 - DNA, 25 bp, E. coli
aactgttcattgagcaggcgcgtcc

SEQ ID NO: 196751 - DNA, 25 bp, E. coli
tttgacgatcaggaaccgcagttgc

SEQ ID NO: 196752 - DNA, 25 bp, E. coli
tttgacgatcagcaaccgcagttgc

SEQ ID NO: 196753 - DNA, 25 bp, E. coli
tgaccaacgaagaagtgcaggaact

SEQ ID NO: 196754 - DNA, 25 bp, E. coli
tgaccaacgaagtagtgcaggaact

SEQ ID NO: 196755 - DNA, 25 bp, E. coli
gaatttagcgtgaaaagctccagcg

SEQ ID NO: 196756 - DNA, 25 bp, E. coli
gaatttagcgtgtaaagctccagcg

SEQ ID NO: 196757 - DNA, 25 bp, E. coli
gcaaacctggttaagcctggctgaa

SEQ ID NO: 196758 - DNA, 25 bp, E. coli
gcaaacctggtttagcctggctgaa

SEQ ID NO: 196759 - DNA, 25 bp, E. coli
gttaaaatcgaacacgtaccgcagg

SEQ ID NO: 196760 - DNA, 25 bp, E. coli
gttaaaatcgaagacgtaccgcagg

SEQ ID NO: 196761 - DNA, 25 bp, E. coli
cattcacagggttagattatcgccg

SEQ ID NO: 196762 - DNA, 25 bp, E. coli
cattcacagggtaagattatcgccg

SEQ ID NO: 196763 - DNA, 25 bp, E. coli
gatcgatagcctctctctgaacccg

SEQ ID NO: 196764 - DNA, 25 bp, E. coli
ggcaaaaatgcctccctgggtgaaa

SEQ ID NO: 196765 - DNA, 25 bp, E. coli
ggcaaaaatgccaccctgggtgaaa

SEQ ID NO: 196766 - DNA, 25 bp, E. coli
gatcgatagcctgtctctgaacccg

SEQ ID NO: 196767 - DNA, 25 bp, E. coli
catttgcatggtttgccgcgctggc

SEQ ID NO: 196768 - DNA, 25 bp, E. coli
tatggtccgcaataaccgctgaagc

SEQ ID NO: 196769 - DNA, 25 bp, E. coli
tatggtccgcaaaaaccgctgaagc

SEQ ID NO: 196770 - DNA, 25 bp, E. coli
ttcttcccggtggaaaaagccaacg

SEQ ID NO: 196771 - DNA, 25 bp, E. coli
ttaagtatgacgttagatcgccgcc

SEQ ID NO: 196772 - DNA, 25 bp, E. coli
ttaagtatgacgatagatcgccgcc

SEQ ID NO: 196773 - DNA, 25 bp, E. coli
ttcttcccggtgcaaaaagccaacg

SEQ ID NO: 196774 - DNA, 25 bp, E. coli
tcaggaatccgctgccactaagcgt

SEQ ID NO: 196775 - DNA, 25 bp, E. coli
tcaggaatccgcagccactaagcgt

SEQ ID NO: 196776 - DNA, 25 bp, E. coli
gccgcagctcggcacctattattat

SEQ ID NO: 196777 - DNA, 25 bp, E. coli
gccgcagctcgggacctattattat

SEQ ID NO: 196778 - DNA, 25 bp, E. coli
cggaaatctgatgggcaatggcgct

SEQ ID NO: 196779 - DNA, 25 bp, E. coli
catttgcatggtatgccgcgctggc

SEQ ID NO: 196780 - DNA, 25 bp, E. coli
cggaaatctgatcggcaatggcgct

SEQ ID NO: 196781 - DNA, 25 bp, E. coli
gatcgccgcctgatgaccgaaaaag

SEQ ID NO: 196782 - DNA, 25 bp, E. coli
gatcgccgcctgttgaccgaaaaag

SEQ ID NO: 196783 - DNA, 25 bp, E. coli
gtatctggacttttaccctgcgcga

SEQ ID NO: 196784 - DNA, 25 bp, E. coli
gtatctggacttataccctgcgcga

SEQ ID NO: 196785 - DNA, 25 bp, E. coli
gggataacgccataacggtactgca

SEQ ID NO: 196786 - DNA, 25 bp, E. coli
gggataacgccaaaacggtactgca

SEQ ID NO: 196787 - DNA, 25 bp, E. coli
tggcccaggcatcgacggaaaatac

SEQ ID NO: 196788 - DNA, 25 bp, E. coli
tggcccaggcatggacggaaaatac

SEQ ID NO: 196789 - DNA, 25 bp, E. coli
caacgcggtaaactagttattcacg

SEQ ID NO: 196790 - DNA, 25 bp, E. coli
caaatcacggcttttggttaaccaa

SEQ ID NO: 196791 - DNA, 25 bp, E. coli
caacgcggtaaagtagttattcacg

SEQ ID NO: 196792 - DNA, 25 bp, E. coli
caaatcacggctattggttaaccaa

SEQ ID NO: 196793 - DNA, 25 bp, E. coli
ataggcgctcacgtgacaacgcggt

SEQ ID NO: 196794 - DNA, 25 bp, E. coli
agtgtgccttcgcactattcaacag

SEQ ID NO: 196795 - DNA, 25 bp, E. coli
agtgtgccttcggactattcaacag

SEQ ID NO: 196796 - DNA, 25 bp, E. coli
ataggcgctcacctgacaacgcggt

SEQ ID NO: 196797 - DNA, 25 bp, E. coli
aaataactggcagccaaatcacggc

SEQ ID NO: 196798 - DNA, 25 bp, E. coli
aaataactggcacccaaatcacggc

SEQ ID NO: 196799 - DNA, 25 bp, E. coli
taccgggataaactcatcaacgtct

SEQ ID NO: 196800 - DNA, 25 bp, E. coli
taccgggataaagtcatcaacgtct

SEQ ID NO: 196801 - DNA, 25 bp, E. coli
tattcaacagcattgataggcgctc

SEQ ID NO: 196802 - DNA, 25 bp, E. coli
tattcaacagcaatgataggcgctc

SEQ ID NO: 196803 - DNA, 25 bp, E. coli
gaaaagtatacgtatagagtgtgcc

SEQ ID NO: 196804 - DNA, 25 bp, E. coli
gaaaagtatacgaatagagtgtgcc

SEQ ID NO: 196805 - DNA, 25 bp, E. coli
ggttaaccaatttcagagtgaaaag

SEQ ID NO: 196806 - DNA, 25 bp, E. coli
ggttaaccaattacagagtgaaaag

SEQ ID NO: 196807 - DNA, 25 bp, E. coli
tcaacgtctctggtaaataactggc

SEQ ID NO: 196808 - DNA, 25 bp, E. coli
tcaacgtctctgctaaataactggc

SEQ ID NO: 196809 - DNA, 25 bp, E. coli
gaccggtaaacaaccgtgcgtgttg

SEQ ID NO: 196810 - DNA, 25 bp, E. coli
gaccggtaaacatccgtgcgtgttg

SEQ ID NO: 196811 - DNA, 25 bp, E. coli
aattttgcgcaacggcagtgaatac

SEQ ID NO: 196812 - DNA, 25 bp, E. coli
aattttgcgcaagggcagtgaatac

SEQ ID NO: 196813 - DNA, 25 bp, E. coli
tatgccttcatttatgtgcgcctga

SEQ ID NO: 196814 - DNA, 25 bp, E. coli
tatgccttcattaatgtgcgcctga

SEQ ID NO: 196815 - DNA, 25 bp, E. coli
tttccgctcaacacataacatattg

SEQ ID NO: 196816 - DNA, 25 bp, E. coli
tttccgctcaactcataacatattg

SEQ ID NO: 196817 - DNA, 25 bp, E. coli
tattagcactgaatacaattatacc

SEQ ID NO: 196818 - DNA, 25 bp, E. coli
tattattctgtgtcatgatgcttcc

SEQ ID NO: 196819 - DNA, 25 bp, E. coli
tattattctgtgacatgatgcttcc

SEQ ID NO: 196820 - DNA, 25 bp, E. coli
tattagcactgattacaattatacc

SEQ ID NO: 196821 - DNA, 25 bp, E. coli
tgtttatattttttgggccggcatg

SEQ ID NO: 196822 - DNA, 25 bp, E. coli
tgtcatgatgcttccgttattagcc

SEQ ID NO: 196823 - DNA, 25 bp, E. coli
tgtcatgatgctaccgttattagcc

SEQ ID NO: 196824 - DNA, 25 bp, E. coli
tgtttatattttatgggccggcatg

SEQ ID NO: 196825 - DNA, 25 bp, E. coli
tcatagaatagtttccaaatgtgct

SEQ ID NO: 196826 - DNA, 25 bp, E. coli
tcatagaatagtatccaaatgtgct

SEQ ID NO: 196827 - DNA, 25 bp, E. coli
gccgtttggcgcaacaatcattgat

SEQ ID NO: 196828 - DNA, 25 bp, E. coli
gccgtttggcgctacaatcattgat

SEQ ID NO: 196829 - DNA, 25 bp, E. coli
gcgcctgatcactccagccgtttgg

SEQ ID NO: 196830 - DNA, 25 bp, E. coli
gcgcctgatcacaccagccgtttgg

SEQ ID NO: 196831 - DNA, 25 bp, E. coli
ggcagtgaatacaggaaaaatcgtt

SEQ ID NO: 196832 - DNA, 25 bp, E. coli
ggcagtgaatactggaaaaatcgtt

SEQ ID NO: 196833 - DNA, 25 bp, E. coli
cagttaaaacgcttcaatgcggatg

SEQ ID NO: 196834 - DNA, 25 bp, E. coli
cagttaaaacgcatcaatgcggatg

SEQ ID NO: 196835 - DNA, 25 bp, E. coli
atcgccagaaaaagctgaagcgttt

SEQ ID NO: 196836 - DNA, 25 bp, E. coli
atcgccagaaaatgctgaagcgttt

SEQ ID NO: 196837 - DNA, 25 bp, E. coli
tagtgatggcgaaagcgtggcggct

SEQ ID NO: 196838 - DNA, 25 bp, E. coli
tagtgatggcgatagcgtggcggct

SEQ ID NO: 196839 - DNA, 25 bp, E. coli
tgggcatcgcttagtggcgaccagt

SEQ ID NO: 196840 - DNA, 25 bp, E. coli
tgggcatcgctttgtggcgaccagt

SEQ ID NO: 196841 - DNA, 25 bp, E. coli
ccatgttgcaggtggatgcgccgta

SEQ ID NO: 196842 - DNA, 25 bp, E. coli
gccatggtcgcaaccggtgtgacta

SEQ ID NO: 196843 - DNA, 25 bp, E. coli
ccatgttgcaggaggatgcgccgta

SEQ ID NO: 196844 - DNA, 25 bp, E. coli
gccatggtcgcatccggtgtgacta

SEQ ID NO: 196845 - DNA, 25 bp, E. coli
gcttagtggcgagcagttaaccggt

SEQ ID NO: 196846 - DNA, 25 bp, E. coli
gcttagtggcgaccagttaaccggt

SEQ ID NO: 196847 - DNA, 25 bp, E. coli
gcacactaccatgttgcaggtggat

SEQ ID NO: 196848 - DNA, 25 bp, E. coli
gcacactaccatcttgcaggtggat

SEQ ID NO: 196849 - DNA, 25 bp, E. coli
gacatgcccgtcagtgatgccagtg

SEQ ID NO: 196850 - DNA, 25 bp, E. coli
gacatgcccgtctgtgatgccagtg

SEQ ID NO: 196851 - DNA, 25 bp, E. coli
tggcggctgcgcaatcgcaactggc

SEQ ID NO: 196852 - DNA, 25 bp, E. coli
tggcggctgcgctatcgcaactggc

SEQ ID NO: 196853 - DNA, 25 bp, E. coli
gatgccagtgtgtcggcgctgaaaa

SEQ ID NO: 196854 - DNA, 25 bp, E. coli
gatgccagtgtgacggcgctgaaaa

SEQ ID NO: 196855 - DNA, 25 bp, E. coli
cagactgcgttcaagggcgttaatc

SEQ ID NO: 196856 - DNA, 25 bp, E. coli
cagactgcgttctagggcgttaatc

SEQ ID NO: 196857 - DNA, 25 bp, E. coli
tgaacgtttactgctgcggacctgg

SEQ ID NO: 196858 - DNA, 25 bp, E. coli
tgaacgtttactcctgcggacctgg

SEQ ID NO: 196859 - DNA, 25 bp, E. coli
tccggatgtgacagggcagtatacc

SEQ ID NO: 196860 - DNA, 25 bp, E. coli
tccggatgtgactgggcagtatacc

SEQ ID NO: 196861 - DNA, 25 bp, E. coli
tctggatatcaaacatgacctggtg

SEQ ID NO: 196862 - DNA, 25 bp, E. coli
tctggatatcaatcatgacctggtg

SEQ ID NO: 196863 - DNA, 25 bp, E. coli
tcatggcctatgaggcggtgaaacc

SEQ ID NO: 196864 - DNA, 25 bp, E. coli
tcatggcctatgtggcggtgaaacc

SEQ ID NO: 196865 - DNA, 25 bp, E. coli
gctgagctggctccggatatccgcc

SEQ ID NO: 196866 - DNA, 25 bp, E. coli
gctgagctggctgcggatatccgcc

SEQ ID NO: 196867 - DNA, 25 bp, E. coli
gcagtatacccgacctgtgcttgaa

SEQ ID NO: 196868 - DNA, 25 bp, E. coli
gcagtatacccgtcctgtgcttgaa

SEQ ID NO: 196869 - DNA, 25 bp, E. coli
gaaaatcgctctcctgatcagctca

SEQ ID NO: 196870 - DNA, 25 bp, E. coli
gaaaatcgctctgctgatcagctca

SEQ ID NO: 196871 - DNA, 25 bp, E. coli
gatcagctcagttaatacggtgcgg

SEQ ID NO: 196872 - DNA, 25 bp, E. coli
gatcagctcagtaaatacggtgcgg

SEQ ID NO: 196873 - DNA, 25 bp, E. coli
gggaattattgtggagcctcagcca

SEQ ID NO: 196874 - DNA, 25 bp, E. coli
gggaattattgtcgagcctcagcca

SEQ ID NO: 196875 - DNA, 25 bp, E. coli
gagcaggcccgtattctggatatca

SEQ ID NO: 196876 - DNA, 25 bp, E. coli
gagcaggcccgttttctggatatca

SEQ ID NO: 196877 - DNA, 25 bp, E. coli
tacgtccgatacaaaaaggatgctg

SEQ ID NO: 196878 - DNA, 25 bp, E. coli
acgtccgatacaaaaaggatgctgg

SEQ ID NO: 196879 - DNA, 25 bp, E. coli
acgtccgatacataaaggatgctgg

SEQ ID NO: 196880 - DNA, 25 bp, E. coli
tacgtccgatactaaaaggatgctg

SEQ ID NO: 196881 - DNA, 25 bp, E. coli
tttacgtccgatacaaaaaggatgc

SEQ ID NO: 196882 - DNA, 25 bp, E. coli
ttacgtccgatagaaaaaggatgct

SEQ ID NO: 196883 - DNA, 25 bp, E. coli
ttacgtccgatacaaaaaggatgct

SEQ ID NO: 196884 - DNA, 25 bp, E. coli
tttacgtccgattcaaaaaggatgc

SEQ ID NO: 196885 - DNA, 25 bp, E. coli
tccgatacaaaatggatgctggcaa

SEQ ID NO: 196886 - DNA, 25 bp, E. coli
tccgatacaaaaaggatgctggcaa

SEQ ID NO: 196887 - DNA, 25 bp, E. coli
ccgatacaaaaaggatgctggcaat

SEQ ID NO: 196888 - DNA, 25 bp, E. coli
cgatacaaaaagcatgctggcaatg

SEQ ID NO: 196889 - DNA, 25 bp, E. coli
cgatacaaaaaggatgctggcaatg

SEQ ID NO: 196890 - DNA, 25 bp, E. coli
ccgatacaaaaacgatgctggcaat

SEQ ID NO: 196891 - DNA, 25 bp, E. coli
cgtccgatacaaaaaggatgctggc

SEQ ID NO: 196892 - DNA, 25 bp, E. coli
cgtccgatacaataaggatgctggc

SEQ ID NO: 196893 - DNA, 25 bp, E. coli
gtttacgtccgatacaaaaaggatg

SEQ ID NO: 196894 - DNA, 25 bp, E. coli
gtttacgtccgaaacaaaaaggatg

SEQ ID NO: 196895 - DNA, 25 bp, E. coli
gatacaaaaaggttgctggcaatga

SEQ ID NO: 196896 - DNA, 25 bp, E. coli
gatacaaaaaggatgctggcaatga

SEQ ID NO: 196897 - DNA, 25 bp, E. coli
gtccgatacaaataggatgctggca

SEQ ID NO: 196898 - DNA, 25 bp, E. coli
gtccgatacaaaaaggatgctggca

SEQ ID NO: 196899 - DNA, 25 bp, E. coli
aattcttggtgacggcgttgtgcac

SEQ ID NO: 196900 - DNA, 25 bp, E. coli
aattcttggtgagggcgttgtgcac

SEQ ID NO: 196901 - DNA, 25 bp, E. coli
caattcttggtgtcggcgttgtgca

SEQ ID NO: 196902 - DNA, 25 bp, E. coli
caattcttggtgacggcgttgtgca

SEQ ID NO: 196903 - DNA, 25 bp, E. coli
cacaattcttggtgacggcgttgtg

SEQ ID NO: 196904 - DNA, 25 bp, E. coli
cacaattcttggagacggcgttgtg

SEQ ID NO: 196905 - DNA, 25 bp, E. coli
attcttggtgaccgcgttgtgcaca

SEQ ID NO: 196906 - DNA, 25 bp, E. coli
agccacaattcttggtgacggcgtt

SEQ ID NO: 196907 - DNA, 25 bp, E. coli
agccacaattctaggtgacggcgtt

SEQ ID NO: 196908 - DNA, 25 bp, E. coli
attcttggtgacggcgttgtgcaca

SEQ ID NO: 196909 - DNA, 25 bp, E. coli
acaattcttggtcacggcgttgtgc

SEQ ID NO: 196910 - DNA, 25 bp, E. coli
acaattcttggtgacggcgttgtgc

SEQ ID NO: 196911 - DNA, 25 bp, E. coli
ttggtgacggcgttgtgcacaatag

SEQ ID NO: 196912 - DNA, 25 bp, E. coli
ttggtgacggcgatgtgcacaatag

SEQ ID NO: 196913 - DNA, 25 bp, E. coli
tggtgacggcgtagtgcacaatagc

SEQ ID NO: 196914 - DNA, 25 bp, E. coli
ccacaattcttggtgacggcgttgt

SEQ ID NO: 196915 - DNA, 25 bp, E. coli
gccacaattcttggtgacggcgttg

SEQ ID NO: 196916 - DNA, 25 bp, E. coli
gccacaattcttcgtgacggcgttg

SEQ ID NO: 196917 - DNA, 25 bp, E. coli
ccacaattcttgctgacggcgttgt

SEQ ID NO: 196918 - DNA, 25 bp, E. coli
cttggtgacggcgttgtgcacaata

SEQ ID NO: 196919 - DNA, 25 bp, E. coli
cttggtgacggccttgtgcacaata

SEQ ID NO: 196920 - DNA, 25 bp, E. coli
tggtgacggcgttgtgcacaatagc

SEQ ID NO: 196921 - DNA, 25 bp, E. coli
tacaccgggctgctattgttggcga

SEQ ID NO: 196922 - DNA, 25 bp, E. coli
tactggtgctggctgtatggccaca

SEQ ID NO: 196923 - DNA, 25 bp, E. coli
tactggtgctgggtgtatggccaca

SEQ ID NO: 196924 - DNA, 25 bp, E. coli
tacaccgggctggtattgttggcga

SEQ ID NO: 196925 - DNA, 25 bp, E. coli
tatcggtaagttctacgtgctggcg

SEQ ID NO: 196926 - DNA, 25 bp, E. coli
tatgcgcagtctcgcgacctgtcgt

SEQ ID NO: 196927 - DNA, 25 bp, E. coli
tatgcgcagtctggcgacctgtcgt

SEQ ID NO: 196928 - DNA, 25 bp, E. coli
taccgcggtctgatctggcatcgtc

SEQ ID NO: 196929 - DNA, 25 bp, E. coli
tacccgtggcttgaaggctataacg

SEQ ID NO: 196930 - DNA, 25 bp, E. coli
tatcggtaagttgtacgtgctggcg

SEQ ID NO: 196931 - DNA, 25 bp, E. coli
tacccgtggcttcaaggctataacg

SEQ ID NO: 196932 - DNA, 25 bp, E. coli
tatcgtggcccggatgctgattccc

SEQ ID NO: 196933 - DNA, 25 bp, E. coli
taccgcggtctgttctggcatcgtc

SEQ ID NO: 196934 - DNA, 25 bp, E. coli
tatcgtggcccgcatgctgattccc

SEQ ID NO: 196935 - DNA, 25 bp, E. coli
ttcggtaacctgatggcgctgagcc

SEQ ID NO: 196936 - DNA, 25 bp, E. coli
ttcggtaacctgttggcgctgagcc

SEQ ID NO: 196937 - DNA, 25 bp, E. coli
tgtggacgccagtcgtataccaggg

SEQ ID NO: 196938 - DNA, 25 bp, E. coli
tgtggacgccagacgtataccaggg

SEQ ID NO: 196939 - DNA, 25 bp, E. coli
gcctgatgtccaccccgtatcgtgg

SEQ ID NO: 196940 - DNA, 25 bp, E. coli
gcctgatgtccagcccgtatcgtgg

SEQ ID NO: 196941 - DNA, 25 bp, E. coli
ggtttccactttgctggcgacggcg

SEQ ID NO: 196942 - DNA, 25 bp, E. coli
ggtttccactttcctggcgacggcg

SEQ ID NO: 196943 - DNA, 25 bp, E. coli
aaccggaaccgaagcagcgccgtat

SEQ ID NO: 196944 - DNA, 25 bp, E. coli
tacccacctgttttataactatcag

SEQ ID NO: 196945 - DNA, 25 bp, E. coli
tacccacctgttatataactatcag

SEQ ID NO: 196946 - DNA, 25 bp, E. coli
aaccggaaccgatgcagcgccgtat

SEQ ID NO: 196947 - DNA, 25 bp, E. coli
tagcgcttgcggtaaaaggtattcc

SEQ ID NO: 196948 - DNA, 25 bp, E. coli
tagcgcttgcggaaaaaggtattcc

SEQ ID NO: 196949 - DNA, 25 bp, E. coli
tgatgccgctatgcgtcagcttaac

SEQ ID NO: 196950 - DNA, 25 bp, E. coli
tgatgccgctatccgtcagcttaac

SEQ ID NO: 196951 - DNA, 25 bp, E. coli
tgaatgggctacaaatagcgcttgc

SEQ ID NO: 196952 - DNA, 25 bp, E. coli
tgaatgggctactaatagcgcttgc

SEQ ID NO: 196953 - DNA, 25 bp, E. coli
cctgataacgtaacacccctcgttg

SEQ ID NO: 196954 - DNA, 25 bp, E. coli
gcgcgagttttaccgtcacctgata

SEQ ID NO: 196955 - DNA, 25 bp, E. coli
gcgcgagttttagcgtcacctgata

SEQ ID NO: 196956 - DNA, 25 bp, E. coli
cgagaaatttgatcatgagggcgag

SEQ ID NO: 196957 - DNA, 25 bp, E. coli
cgagaaatttgaacatgagggcgag

SEQ ID NO: 196958 - DNA, 25 bp, E. coli
cctgataacgtatcacccctcgttg

SEQ ID NO: 196959 - DNA, 25 bp, E. coli
gtgggccgcttctaccggaaccgat

SEQ ID NO: 196960 - DNA, 25 bp, E. coli
gtgggccgcttcaaccggaaccgat

SEQ ID NO: 196961 - DNA, 25 bp, E. coli
ggatacccgattgttgatgccgcta

SEQ ID NO: 196962 - DNA, 25 bp, E. coli
ggatacccgattcttgatgccgcta

SEQ ID NO: 196963 - DNA, 25 bp, E. coli
tggaagttgaaagagcgctgcgtaa

SEQ ID NO: 196964 - DNA, 25 bp, E. coli
tggaagttgaaacagcgctgcgtaa

SEQ ID NO: 196965 - DNA, 25 bp, E. coli
tactccattaaaagaaagaaacaag

SEQ ID NO: 196966 - DNA, 25 bp, E. coli
tactccattaaatgaaagaaacaag

SEQ ID NO: 196967 - DNA, 25 bp, E. coli
aacattactatttatactggccaca

SEQ ID NO: 196968 - DNA, 25 bp, E. coli
aacattactattaatactggccaca

SEQ ID NO: 196969 - DNA, 25 bp, E. coli
tattcagtacaaacagacgaattcg

SEQ ID NO: 196970 - DNA, 25 bp, E. coli
tatttttccactcctataccggaag

SEQ ID NO: 196971 - DNA, 25 bp, E. coli
tatttttccactgctataccggaag

SEQ ID NO: 196972 - DNA, 25 bp, E. coli
tattcagtacaatcagacgaattcg

SEQ ID NO: 196973 - DNA, 25 bp, E. coli
tgtagatttagcattcgatatcgaa

SEQ ID NO: 196974 - DNA, 25 bp, E. coli
tgtagatttagctttcgatatcgaa

SEQ ID NO: 196975 - DNA, 25 bp, E. coli
tcgatatcgaaagtgactcaatgac

SEQ ID NO: 196976 - DNA, 25 bp, E. coli
tcgatatcgaaactgactcaatgac

SEQ ID NO: 196977 - DNA, 25 bp, E. coli
tcaaaccacttacacgcaataccgt

SEQ ID NO: 196978 - DNA, 25 bp, E. coli
tcaaaccacttagacgcaataccgt

SEQ ID NO: 196979 - DNA, 25 bp, E. coli
gctataccggaacatatacgtagat

SEQ ID NO: 196980 - DNA, 25 bp, E. coli
gctataccggaagatatacgtagat

SEQ ID NO: 196981 - DNA, 25 bp, E. coli
gactcaatgacagctaagaatgata

SEQ ID NO: 196982 - DNA, 25 bp, E. coli
gacgaattcgatgatcaaaccactt

SEQ ID NO: 196983 - DNA, 25 bp, E. coli
gactcaatgacacctaagaatgata

SEQ ID NO: 196984 - DNA, 25 bp, E. coli
gacgaattcgatcatcaaaccactt

SEQ ID NO: 196985 - DNA, 25 bp, E. coli
tggccacatttagatattcagtaca

SEQ ID NO: 196986 - DNA, 25 bp, E. coli
tggccacatttacatattcagtaca

SEQ ID NO: 196987 - DNA, 25 bp, E. coli
catcgaagtggtcgcgctggatcac

SEQ ID NO: 196988 - DNA, 25 bp, E. coli
catcgaagtggtggcgctggatcac

SEQ ID NO: 196989 - DNA, 25 bp, E. coli
taacgtcaagctcgtcagagtcgct

SEQ ID NO: 196990 - DNA, 25 bp, E. coli
aaagaaatcgatgcgtccagcccgt

SEQ ID NO: 196991 - DNA, 25 bp, E. coli
acggcggcgcggttatcaaaggttc

SEQ ID NO: 196992 - DNA, 25 bp, E. coli
aaagaaatcgatccgtccagcccgt

SEQ ID NO: 196993 - DNA, 25 bp, E. coli
acggcggcgcggatatcaaaggttc

SEQ ID NO: 196994 - DNA, 25 bp, E. coli
tccgactcgtggaatgagcgtcctt

SEQ ID NO: 196995 - DNA, 25 bp, E. coli
tccgactcgtggtatgagcgtcctt

SEQ ID NO: 196996 - DNA, 25 bp, E. coli
tctctggctgaaagatgacggcggc

SEQ ID NO: 196997 - DNA, 25 bp, E. coli
tctctggctgaatgatgacggcggc

SEQ ID NO: 196998 - DNA, 25 bp, E. coli
tctctacaaagctgtgaccaccgga

SEQ ID NO: 196999 - DNA, 25 bp, E. coli
tctctacaaagcagtgaccaccgga

SEQ ID NO: 197000 - DNA, 25 bp, E. coli
gttccgctacgagaaaatcacctgg

SEQ ID NO: 197001 - DNA, 25 bp, E. coli
gttccgctacgacaaaatcacctgg

SEQ ID NO: 197002 - DNA, 25 bp, E. coli
tcacctggacttacaaagacggcaa

SEQ ID NO: 197003 - DNA, 25 bp, E. coli
tcacctggactttcaaagacggcaa

SEQ ID NO: 197004 - DNA, 25 bp, E. coli
tcaacgatgccgctcaggaagtgga

SEQ ID NO: 197005 - DNA, 25 bp, E. coli
taacgtcaagctggtcagagtcgct

SEQ ID NO: 197006 - DNA, 25 bp, E. coli
tcaacgatgccggtcaggaagtgga

SEQ ID NO: 197007 - DNA, 25 bp, E. coli
gagagaagcataaccacctggaacg

SEQ ID NO: 197008 - DNA, 25 bp, E. coli
gagagaagcatatccacctggaacg

SEQ ID NO: 197009 - DNA, 25 bp, E. coli
cactgcgtaggcatgactgatctcg

SEQ ID NO: 197010 - DNA, 25 bp, E. coli
cactgcgtaggcttgactgatctcg

SEQ ID NO: 197011 - DNA, 25 bp, E. coli
agcccgtgaagtggctgatctgttg

SEQ ID NO: 197012 - DNA, 25 bp, E. coli
agcccgtgaagtcgctgatctgttg

SEQ ID NO: 197013 - DNA, 25 bp, E. coli
tatggccgctggtttcatgcagtgg

SEQ ID NO: 197014 - DNA, 25 bp, E. coli
tatgatcgccaatgcgggcgatgtg

SEQ ID NO: 197015 - DNA, 25 bp, E. coli
tatggccgctggattcatgcagtgg

SEQ ID NO: 197016 - DNA, 25 bp, E. coli
tatgatcgccaaagcgggcgatgtg

SEQ ID NO: 197017 - DNA, 25 bp, E. coli
tcgcccaactgcgggaaggtcagtt

SEQ ID NO: 197018 - DNA, 25 bp, E. coli
tcgcccaactgccggaaggtcagtt

SEQ ID NO: 197019 - DNA, 25 bp, E. coli
ccatgaaggcgaaactatgatcgcc

SEQ ID NO: 197020 - DNA, 25 bp, E. coli
ccatgaaggcgatactatgatcgcc

SEQ ID NO: 197021 - DNA, 25 bp, E. coli
gcatgttcgccatgaaggcgaaact

SEQ ID NO: 197022 - DNA, 25 bp, E. coli
gcatgttcgccaagaaggcgaaact

SEQ ID NO: 197023 - DNA, 25 bp, E. coli
cgaaactatgatggccaaagcgggc

SEQ ID NO: 197024 - DNA, 25 bp, E. coli
cgaaactatgatcgccaaagcgggc

SEQ ID NO: 197025 - DNA, 25 bp, E. coli
cggcagcagtatggccgctggtttc

SEQ ID NO: 197026 - DNA, 25 bp, E. coli
cggcagcagtatcgccgctggtttc

SEQ ID NO: 197027 - DNA, 25 bp, E. coli
gtttcgacggcggacaaccgcactg

SEQ ID NO: 197028 - DNA, 25 bp, E. coli
gtttcgacggcgcacaaccgcactg

SEQ ID NO: 197029 - DNA, 25 bp, E. coli
ggctgatctgttgggttttaccatc

SEQ ID NO: 197030 - DNA, 25 bp, E. coli
ggctgatctgttcggttttaccatc

SEQ ID NO: 197031 - DNA, 25 bp, E. coli
caggactggacaatcactaaggtga

SEQ ID NO: 197032 - DNA, 25 bp, E. coli
caggactggacattcactaaggtga

SEQ ID NO: 197033 - DNA, 25 bp, E. coli
tagacgagcaggactggacaatcac

SEQ ID NO: 197034 - DNA, 25 bp, E. coli
tagcggcttcacgacgtcattagag

SEQ ID NO: 197035 - DNA, 25 bp, E. coli
tagacgagcaggtctggacaatcac

SEQ ID NO: 197036 - DNA, 25 bp, E. coli
acgtcattagagcttgaggtcaggc

SEQ ID NO: 197037 - DNA, 25 bp, E. coli
acgtcattagaggttgaggtcaggc

SEQ ID NO: 197038 - DNA, 25 bp, E. coli
tagcggcttcaccacgtcattagag

SEQ ID NO: 197039 - DNA, 25 bp, E. coli
tgtctggctttatgcgcgtcataga

SEQ ID NO: 197040 - DNA, 25 bp, E. coli
tgtctggctttaagcgcgtcataga

SEQ ID NO: 197041 - DNA, 25 bp, E. coli
tcactaaggtgacacattttctgaa

SEQ ID NO: 197042 - DNA, 25 bp, E. coli
tcactaaggtgagacattttctgaa

SEQ ID NO: 197043 - DNA, 25 bp, E. coli
gaataatagcgggttcacgacgtca

SEQ ID NO: 197044 - DNA, 25 bp, E. coli
gaataatagcggcttcacgacgtca

SEQ ID NO: 197045 - DNA, 25 bp, E. coli
gacacattttctcaataatagcggc

SEQ ID NO: 197046 - DNA, 25 bp, E. coli
gacacattttctgaataatagcggc

SEQ ID NO: 197047 - DNA, 25 bp, E. coli
ggtacgaaacagtagataatgagtg

SEQ ID NO: 197048 - DNA, 25 bp, E. coli
ggtacgaaacagaagataatgagtg

SEQ ID NO: 197049 - DNA, 25 bp, E. coli
taagcgcgtcatagacgagcaggac

SEQ ID NO: 197050 - DNA, 25 bp, E. coli
taagcgcgtcattgacgagcaggac

SEQ ID NO: 197051 - DNA, 25 bp, E. coli
gagcttgaggtctggctttctgatg

SEQ ID NO: 197052 - DNA, 25 bp, E. coli
gagcttgaggtcaggctttctgatg

SEQ ID NO: 197053 - DNA, 25 bp, E. coli
caatgcacgcagtggttaacaatca

SEQ ID NO: 197054 - DNA, 25 bp, E. coli
caatagaaatatagattattggacg

SEQ ID NO: 197055 - DNA, 25 bp, E. coli
caatagaaatattgattattggacg

SEQ ID NO: 197056 - DNA, 25 bp, E. coli
aatgcacgcagtcgttaacaatcac

SEQ ID NO: 197057 - DNA, 25 bp, E. coli
caatgcacgcagaggttaacaatca

SEQ ID NO: 197058 - DNA, 25 bp, E. coli
aatgcacgcagtggttaacaatcac

SEQ ID NO: 197059 - DNA, 25 bp, E. coli
cacgcagtggttaacaatcacaata

SEQ ID NO: 197060 - DNA, 25 bp, E. coli
cacgcagtggtttacaatcacaata

SEQ ID NO: 197061 - DNA, 25 bp, E. coli
cagtggttaacaatcacaatagaaa

SEQ ID NO: 197062 - DNA, 25 bp, E. coli
cagtggttaacattcacaatagaaa

SEQ ID NO: 197063 - DNA, 25 bp, E. coli
tgcacgcagtggataacaatcacaa

SEQ ID NO: 197064 - DNA, 25 bp, E. coli
tgcacgcagtggttaacaatcacaa

SEQ ID NO: 197065 - DNA, 25 bp, E. coli
gcagtggttaactatcacaatagaa

SEQ ID NO: 197066 - DNA, 25 bp, E. coli
gcacgcagtggttaacaatcacaat

SEQ ID NO: 197067 - DNA, 25 bp, E. coli
gcacgcagtggtaaacaatcacaat

SEQ ID NO: 197068 - DNA, 25 bp, E. coli
gcagtggttaacaatcacaatagaa

SEQ ID NO: 197069 - DNA, 25 bp, E. coli
gaaatattgattattggacggtaaa

SEQ ID NO: 197070 - DNA, 25 bp, E. coli
gaaatattgatttttggacggtaaa

SEQ ID NO: 197071 - DNA, 25 bp, E. coli
cgcagtggttaacaatcacaataga

SEQ ID NO: 197072 - DNA, 25 bp, E. coli
cgcagtggttaagaatcacaataga

SEQ ID NO: 197073 - DNA, 25 bp, E. coli
ggttaacaatcagaatagaaatatt

SEQ ID NO: 197074 - DNA, 25 bp, E. coli
ggttaacaatcacaatagaaatatt

SEQ ID NO: 197075 - DNA, 25 bp, E. coli
caatctggggccagcaaatgctggc

SEQ ID NO: 197076 - DNA, 25 bp, E. coli
aatctggggccaccaaatgctggcc

SEQ ID NO: 197077 - DNA, 25 bp, E. coli
caatctggggcctgcaaatgctggc

SEQ ID NO: 197078 - DNA, 25 bp, E. coli
aatctggggccagcaaatgctggcc

SEQ ID NO: 197079 - DNA, 25 bp, E. coli
atctggggccagcaaatgctggcct

SEQ ID NO: 197080 - DNA, 25 bp, E. coli
atctggggccaggaaatgctggcct

SEQ ID NO: 197081 - DNA, 25 bp, E. coli
actttgttatcaatctggggccagc

SEQ ID NO: 197082 - DNA, 25 bp, E. coli
actttgttatcattctggggccagc

SEQ ID NO: 197083 - DNA, 25 bp, E. coli
tttgttatcaatctggggccagcaa

SEQ ID NO: 197084 - DNA, 25 bp, E. coli
tttgttatcaatgtggggccagcaa

SEQ ID NO: 197085 - DNA, 25 bp, E. coli
ttgttatcaatctggggccagcaaa

SEQ ID NO: 197086 - DNA, 25 bp, E. coli
ttgttatcaatcaggggccagcaaa

SEQ ID NO: 197087 - DNA, 25 bp, E. coli
tgttatcaatctcgggccagcaaat

SEQ ID NO: 197088 - DNA, 25 bp, E. coli
tgttatcaatctggggccagcaaat

SEQ ID NO: 197089 - DNA, 25 bp, E. coli
tctggggccagctaatgctggcctg

SEQ ID NO: 197090 - DNA, 25 bp, E. coli
tctggggccagcaaatgctggcctg

SEQ ID NO: 197091 - DNA, 25 bp, E. coli
ctttgttatcaatctggggccagca

SEQ ID NO: 197092 - DNA, 25 bp, E. coli
ctggggccagcatatgctggcctga

SEQ ID NO: 197093 - DNA, 25 bp, E. coli
ctggggccagcaaatgctggcctga

SEQ ID NO: 197094 - DNA, 25 bp, E. coli
ctttgttatcaaactggggccagca

SEQ ID NO: 197095 - DNA, 25 bp, E. coli
tcaatctggggccagcaaatgctgg

SEQ ID NO: 197096 - DNA, 25 bp, E. coli
tcaatctggggcgagcaaatgctgg

SEQ ID NO: 197097 - DNA, 25 bp, E. coli
aattttaaacacagacacacccgat

SEQ ID NO: 197098 - DNA, 25 bp, E. coli
aatgagtgagatagtcgctggaacc

SEQ ID NO: 197099 - DNA, 25 bp, E. coli
aattttaaacactgacacacccgat

SEQ ID NO: 197100 - DNA, 25 bp, E. coli
aatgagtgagattgtcgctggaacc

SEQ ID NO: 197101 - DNA, 25 bp, E. coli
tattgacaacaattcgtctctctag

SEQ ID NO: 197102 - DNA, 25 bp, E. coli
tattgacaacaaatcgtctctctag

SEQ ID NO: 197103 - DNA, 25 bp, E. coli
tgggcacatgaactctattgacaac

SEQ ID NO: 197104 - DNA, 25 bp, E. coli
tgggcacatgaagtctattgacaac

SEQ ID NO: 197105 - DNA, 25 bp, E. coli
tctgcttcggatatagacagtttct

SEQ ID NO: 197106 - DNA, 25 bp, E. coli
tctgcttcggatttagacagtttct

SEQ ID NO: 197107 - DNA, 25 bp, E. coli
ccagttattacgtcagactcaggat

SEQ ID NO: 197108 - DNA, 25 bp, E. coli
ccagttattacgacagactcaggat

SEQ ID NO: 197109 - DNA, 25 bp, E. coli
gacacacccgattattctgcttcgg

SEQ ID NO: 197110 - DNA, 25 bp, E. coli
gacacacccgataattctgcttcgg

SEQ ID NO: 197111 - DNA, 25 bp, E. coli
cgtcagactcagcataaccaatttt

SEQ ID NO: 197112 - DNA, 25 bp, E. coli
cgtcagactcaggataaccaatttt

SEQ ID NO: 197113 - DNA, 25 bp, E. coli
gattgtcgctggaaccattctccag

SEQ ID NO: 197114 - DNA, 25 bp, E. coli
gattgtcgctggtaccattctccag

SEQ ID NO: 197115 - DNA, 25 bp, E. coli
gggaaaaagaatgggcacatgaagt

SEQ ID NO: 197116 - DNA, 25 bp, E. coli
gggaaaaagaatcggcacatgaagt

SEQ ID NO: 197117 - DNA, 25 bp, E. coli
ggaaccattctccagttattacgtc

SEQ ID NO: 197118 - DNA, 25 bp, E. coli
ggaaccattctcgagttattacgtc

SEQ ID NO: 197119 - DNA, 25 bp, E. coli
aatacctggtgttatcgattgcagc

SEQ ID NO: 197120 - DNA, 25 bp, E. coli
aatacctggtgtaatcgattgcagc

SEQ ID NO: 197121 - DNA, 25 bp, E. coli
gcactgttgctatccaatgatgtca

SEQ ID NO: 197122 - DNA, 25 bp, E. coli
gaagctaatcagttgcaagcactgt

SEQ ID NO: 197123 - DNA, 25 bp, E. coli
gcactgttgctaaccaatgatgtca

SEQ ID NO: 197124 - DNA, 25 bp, E. coli
gaagctaatcagatgcaagcactgt

SEQ ID NO: 197125 - DNA, 25 bp, E. coli
gaacaagacatccaaaggttgctaa

SEQ ID NO: 197126 - DNA, 25 bp, E. coli
gaacaagacatcgaaaggttgctaa

SEQ ID NO: 197127 - DNA, 25 bp, E. coli
gttttagtcatcagctcgccagagg

SEQ ID NO: 197128 - DNA, 25 bp, E. coli
gttattttcccacctagccagttag

SEQ ID NO: 197129 - DNA, 25 bp, E. coli
gttatcaagtcatcctcaggacagg

SEQ ID NO: 197130 - DNA, 25 bp, E. coli
gttattttcccagctagccagttag

SEQ ID NO: 197131 - DNA, 25 bp, E. coli
gttttagtcatctgctcgccagagg

SEQ ID NO: 197132 - DNA, 25 bp, E. coli
gttatcaagtcaacctcaggacagg

SEQ ID NO: 197133 - DNA, 25 bp, E. coli
gtggcatcgccaacacaagaaaatg

SEQ ID NO: 197134 - DNA, 25 bp, E. coli
gtggcatcgccatcacaagaaaatg

SEQ ID NO: 197135 - DNA, 25 bp, E. coli
ggcttcccgaaatagaaatttgcag

SEQ ID NO: 197136 - DNA, 25 bp, E. coli
ggcttcccgaaaaagaaatttgcag

SEQ ID NO: 197137 - DNA, 25 bp, E. coli
gaggttaacttagcaccatcggtca

SEQ ID NO: 197138 - DNA, 25 bp, E. coli
gaggattttgttggcgcaataacga

SEQ ID NO: 197139 - DNA, 25 bp, E. coli
gaggattttgttcgcgcaataacga

SEQ ID NO: 197140 - DNA, 25 bp, E. coli
gaggttaacttaccaccatcggtca

SEQ ID NO: 197141 - DNA, 25 bp, E. coli
catatcgttaattattaaagggagt

SEQ ID NO: 197142 - DNA, 25 bp, E. coli
catatcgttaataattaaagggagt

SEQ ID NO: 197143 - DNA, 25 bp, E. coli
taaagggagtaacgtattatgtcag

SEQ ID NO: 197144 - DNA, 25 bp, E. coli
taaagggagtaaggtattatgtcag

SEQ ID NO: 197145 - DNA, 25 bp, E. coli
taaagaaaatggttttaatcatgtc

SEQ ID NO: 197146 - DNA, 25 bp, E. coli
taaagaaaatggatttaatcatgtc

SEQ ID NO: 197147 - DNA, 25 bp, E. coli
ttaaagaaaaatgcgaaacatatcg

SEQ ID NO: 197148 - DNA, 25 bp, E. coli
ttaaagaaaaatccgaaacatatcg

SEQ ID NO: 197149 - DNA, 25 bp, E. coli
ttgttaattattgcagatcctgcca

SEQ ID NO: 197150 - DNA, 25 bp, E. coli
ttgttaattattccagatcctgcca

SEQ ID NO: 197151 - DNA, 25 bp, E. coli
tgtcagaagaaattaaagaaaatgg

SEQ ID NO: 197152 - DNA, 25 bp, E. coli
tgtcagaagaaaataaagaaaatgg

SEQ ID NO: 197153 - DNA, 25 bp, E. coli
gcattctctgtgaagtggataattg

SEQ ID NO: 197154 - DNA, 25 bp, E. coli
gcattctctgtgtagtggataattg

SEQ ID NO: 197155 - DNA, 25 bp, E. coli
ctctgtgaagtggataattgttaat

SEQ ID NO: 197156 - DNA, 25 bp, E. coli
ctctgtgaagtgcataattgttaat

SEQ ID NO: 197157 - DNA, 25 bp, E. coli
gatttaatcatgtcaaaacattcac

SEQ ID NO: 197158 - DNA, 25 bp, E. coli
tgtcaaaacattcaccaaaattata

SEQ ID NO: 197159 - DNA, 25 bp, E. coli
gatttaatcatgacaaaacattcac

SEQ ID NO: 197160 - DNA, 25 bp, E. coli
tgtcaaaacattgaccaaaattata

SEQ ID NO: 197161 - DNA, 25 bp, E. coli
gagtaacgtattttgtcagaagaaa

SEQ ID NO: 197162 - DNA, 25 bp, E. coli
gagtaacgtattatgtcagaagaaa

SEQ ID NO: 197163 - DNA, 25 bp, E. coli
aatcagagctttattatctgcgacg

SEQ ID NO: 197164 - DNA, 25 bp, E. coli
cacacgttagttatgagcgatttct

SEQ ID NO: 197165 - DNA, 25 bp, E. coli
aatcagagcttttttatctgcgacg

SEQ ID NO: 197166 - DNA, 25 bp, E. coli
cacacgttagttttgagcgatttct

SEQ ID NO: 197167 - DNA, 25 bp, E. coli
caaagtagcagttaaacctataacg

SEQ ID NO: 197168 - DNA, 25 bp, E. coli
caaagtagcagtaaaacctataacg

SEQ ID NO: 197169 - DNA, 25 bp, E. coli
cagtacacaatagttcacacgttag

SEQ ID NO: 197170 - DNA, 25 bp, E. coli
cagtacacaatacttcacacgttag

SEQ ID NO: 197171 - DNA, 25 bp, E. coli
taaattaacgccctccagtacacaa

SEQ ID NO: 197172 - DNA, 25 bp, E. coli
taacatattaacatcgctctccact

SEQ ID NO: 197173 - DNA, 25 bp, E. coli
taaattaacgccgtccagtacacaa

SEQ ID NO: 197174 - DNA, 25 bp, E. coli
taataaatacccagtggtttaacat

SEQ ID NO: 197175 - DNA, 25 bp, E. coli
taataaataccctgtggtttaacat

SEQ ID NO: 197176 - DNA, 25 bp, E. coli
ttatttttatttaagagagatcgcg

SEQ ID NO: 197177 - DNA, 25 bp, E. coli
ttatttttattttagagagatcgcg

SEQ ID NO: 197178 - DNA, 25 bp, E. coli
tgagcgatttctgatagtgcctggt

SEQ ID NO: 197179 - DNA, 25 bp, E. coli
tgagcgatttctcatagtgcctggt

SEQ ID NO: 197180 - DNA, 25 bp, E. coli
gatagtgcctggattaatcagagct

SEQ ID NO: 197181 - DNA, 25 bp, E. coli
gatagtgcctggtttaatcagagct

SEQ ID NO: 197182 - DNA, 25 bp, E. coli
taacatattaacttcgctctccact

SEQ ID NO: 197183 - DNA, 25 bp, E. coli
taaggagagcgaaataatatcaaag

SEQ ID NO: 197184 - DNA, 25 bp, E. coli
taaggagagcgatataatatcaaag

SEQ ID NO: 197185 - DNA, 25 bp, E. coli
taaaaaacgtgaaggtcatgcgctg

SEQ ID NO: 197186 - DNA, 25 bp, E. coli
taaaaaacgtgatggtcatgcgctg

SEQ ID NO: 197187 - DNA, 25 bp, E. coli
aaaaacgtgatggtcatgcgctgag

SEQ ID NO: 197188 - DNA, 25 bp, E. coli
aaaaacgtgatgctcatgcgctgag

SEQ ID NO: 197189 - DNA, 25 bp, E. coli
aaaaaacgtgatggtcatgcgctga

SEQ ID NO: 197190 - DNA, 25 bp, E. coli
aaaaaacgtgatcgtcatgcgctga

SEQ ID NO: 197191 - DNA, 25 bp, E. coli
ttcgtaaaaaacgtgatggtcatgc

SEQ ID NO: 197192 - DNA, 25 bp, E. coli
ttattcgtaaaaaacgtgatggtca

SEQ ID NO: 197193 - DNA, 25 bp, E. coli
ttattcgtaaaatacgtgatggtca

SEQ ID NO: 197194 - DNA, 25 bp, E. coli
ttcgtaaaaaacctgatggtcatgc

SEQ ID NO: 197195 - DNA, 25 bp, E. coli
ttcgcgacaacactatctccgaagg

SEQ ID NO: 197196 - DNA, 25 bp, E. coli
ttcgcgacaacagtatctccgaagg

SEQ ID NO: 197197 - DNA, 25 bp, E. coli
tgtttctcgcactagaaattattcg

SEQ ID NO: 197198 - DNA, 25 bp, E. coli
tgtttctcgcacaagaaattattcg

SEQ ID NO: 197199 - DNA, 25 bp, E. coli
tctcgcacaagaaattattcgtaaa

SEQ ID NO: 197200 - DNA, 25 bp, E. coli
tctcgcacaagatattattcgtaaa

SEQ ID NO: 197201 - DNA, 25 bp, E. coli
gaagaaattcgtttctttatcaacg

SEQ ID NO: 197202 - DNA, 25 bp, E. coli
gaagaaattcgtatctttatcaacg

SEQ ID NO: 197203 - DNA, 25 bp, E. coli
gaaattattcgttaaaaacgtgatg

SEQ ID NO: 197204 - DNA, 25 bp, E. coli
gaaattattcgtaaaaaacgtgatg

SEQ ID NO: 197205 - DNA, 25 bp, E. coli
cgtaaaaaacgtgatggtcatgcgc

SEQ ID NO: 197206 - DNA, 25 bp, E. coli
cgtaaaaaacgtcatggtcatgcgc

SEQ ID NO: 197207 - DNA, 25 bp, E. coli
agtaatacgccacgcagaaacacgg

SEQ ID NO: 197208 - DNA, 25 bp, E. coli
agtaatacgccaggcagaaacacgg

SEQ ID NO: 197209 - DNA, 25 bp, E. coli
agtgagatagtattacgccacgcag

SEQ ID NO: 197210 - DNA, 25 bp, E. coli
agtgagatagtaatacgccacgcag

SEQ ID NO: 197211 - DNA, 25 bp, E. coli
tatgtcgatgcatattatatggcgc

SEQ ID NO: 197212 - DNA, 25 bp, E. coli
tatgtcgatgcaaattatatggcgc

SEQ ID NO: 197213 - DNA, 25 bp, E. coli
tcgactctcgttggaagaaccgcgg

SEQ ID NO: 197214 - DNA, 25 bp, E. coli
tcgactctcgttcgaagaaccgcgg

SEQ ID NO: 197215 - DNA, 25 bp, E. coli
tctcgttggaagtaccgcggcgtcg

SEQ ID NO: 197216 - DNA, 25 bp, E. coli
tctcgttggaagaaccgcggcgtcg

SEQ ID NO: 197217 - DNA, 25 bp, E. coli
gcgggtagatcgcattgaactaacc

SEQ ID NO: 197218 - DNA, 25 bp, E. coli
gcgggtagatcggattgaactaacc

SEQ ID NO: 197219 - DNA, 25 bp, E. coli
cgatgcatattaaatggcgcgggtg

SEQ ID NO: 197220 - DNA, 25 bp, E. coli
cgatgcatattatatggcgcgggtg

SEQ ID NO: 197221 - DNA, 25 bp, E. coli
gtttgtcgataacgccccggcaatt

SEQ ID NO: 197222 - DNA, 25 bp, E. coli
gtttgtcgataaggccccggcaatt

SEQ ID NO: 197223 - DNA, 25 bp, E. coli
ggtatctgtgtccactctcgttgga

SEQ ID NO: 197224 - DNA, 25 bp, E. coli
ggtatctgtgtcgactctcgttgga

SEQ ID NO: 197225 - DNA, 25 bp, E. coli
tgaactaaccgtctttgtcgataac

SEQ ID NO: 197226 - DNA, 25 bp, E. coli
tgaactaaccgtgtttgtcgataac

SEQ ID NO: 197227 - DNA, 25 bp, E. coli
gatcgcattgaagtaaccgtgtttg

SEQ ID NO: 197228 - DNA, 25 bp, E. coli
gatcgcattgaactaaccgtgtttg

SEQ ID NO: 197229 - DNA, 25 bp, E. coli
caagcgaggcagatgtaatgatagc

SEQ ID NO: 197230 - DNA, 25 bp, E. coli
caagcgaggcagttgtaatgatagc

SEQ ID NO: 197231 - DNA, 25 bp, E. coli
cagagggctatttcttgcgcaacag

SEQ ID NO: 197232 - DNA, 25 bp, E. coli
cagagggctattacttgcgcaacag

SEQ ID NO: 197233 - DNA, 25 bp, E. coli
taaattcagttgtgcaatagccagg

SEQ ID NO: 197234 - DNA, 25 bp, E. coli
taaattcagttgagcaatagccagg

SEQ ID NO: 197235 - DNA, 25 bp, E. coli
tagaacagtcgctataagagcatgg

SEQ ID NO: 197236 - DNA, 25 bp, E. coli
tatcgtaggctgacgacctttcagt

SEQ ID NO: 197237 - DNA, 25 bp, E. coli
tagttaccagcactcatttacccgc

SEQ ID NO: 197238 - DNA, 25 bp, E. coli
tagaacagtcgcaataagagcatgg

SEQ ID NO: 197239 - DNA, 25 bp, E. coli
tatgcaaggcttggtaagggagaac

SEQ ID NO: 197240 - DNA, 25 bp, E. coli
tagttaccagcagtcatttacccgc

SEQ ID NO: 197241 - DNA, 25 bp, E. coli
tatgcaaggcttcgtaagggagaac

SEQ ID NO: 197242 - DNA, 25 bp, E. coli
tatctcctggaggtcaacagagggc

SEQ ID NO: 197243 - DNA, 25 bp, E. coli
tatcgtaggctgtcgacctttcagt

SEQ ID NO: 197244 - DNA, 25 bp, E. coli
tatctcctggagctcaacagagggc

SEQ ID NO: 197245 - DNA, 25 bp, E. coli
tttcatatcattgagggcctgtggc

SEQ ID NO: 197246 - DNA, 25 bp, E. coli
tttcatatcattcagggcctgtggc

SEQ ID NO: 197247 - DNA, 25 bp, E. coli
gatagctcagaaggattatgcaagg

SEQ ID NO: 197248 - DNA, 25 bp, E. coli
gatagctcagaacgattatgcaagg

SEQ ID NO: 197249 - DNA, 25 bp, E. coli
gggagaacgcatttacccacttctg

SEQ ID NO: 197250 - DNA, 25 bp, E. coli
gggagaacgcatatacccacttctg

SEQ ID NO: 197251 - DNA, 25 bp, E. coli
caaatgcgcgcacagatcagcaagc

SEQ ID NO: 197252 - DNA, 25 bp, E. coli
caaatgcgcgcagagatcagcaagc

SEQ ID NO: 197253 - DNA, 25 bp, E. coli
caaattctcggcgtgcgtgagtacc

SEQ ID NO: 197254 - DNA, 25 bp, E. coli
caaattctcggcctgcgtgagtacc

SEQ ID NO: 197255 - DNA, 25 bp, E. coli
caggtgcatgtgctgaaggacttca

SEQ ID NO: 197256 - DNA, 25 bp, E. coli
caggtgcatgtggtgaaggacttca

SEQ ID NO: 197257 - DNA, 25 bp, E. coli
caggaaagtttggataagcccatcg

SEQ ID NO: 197258 - DNA, 25 bp, E. coli
caggaaagtttgcataagcccatcg

SEQ ID NO: 197259 - DNA, 25 bp, E. coli
atttatgctctagaccacggttggg

SEQ ID NO: 197260 - DNA, 25 bp, E. coli
atttatgctctacaccacggttggg

SEQ ID NO: 197261 - DNA, 25 bp, E. coli
ttttattcgcggcacgatcgatggc

SEQ ID NO: 197262 - DNA, 25 bp, E. coli
ttttattcgcgggacgatcgatggc

SEQ ID NO: 197263 - DNA, 25 bp, E. coli
ccggatttattgcatcaccagcgat

SEQ ID NO: 197264 - DNA, 25 bp, E. coli
ccggatttattggatcaccagcgat

SEQ ID NO: 197265 - DNA, 25 bp, E. coli
gaagatattcatccggacgcgcaag

SEQ ID NO: 197266 - DNA, 25 bp, E. coli
gaatgaatgacgttccagccaaagc

SEQ ID NO: 197267 - DNA, 25 bp, E. coli
gaatgaatgacgatccagccaaagc

SEQ ID NO: 197268 - DNA, 25 bp, E. coli
gaagatattcatgcggacgcgcaag

SEQ ID NO: 197269 - DNA, 25 bp, E. coli
gaaattagcggttctgaaaacacag

SEQ ID NO: 197270 - DNA, 25 bp, E. coli
gaaattagcggtactgaaaacacag

SEQ ID NO: 197271 - DNA, 25 bp, E. coli
gatctgttgatccacggcaaacgaa

SEQ ID NO: 197272 - DNA, 25 bp, E. coli
gatctgttgatcgacggcaaacgaa

SEQ ID NO: 197273 - DNA, 25 bp, E. coli
aatgggttttcttcggtctggctgc

SEQ ID NO: 197274 - DNA, 25 bp, E. coli
aatccaaatccaaagcgttctgacg

SEQ ID NO: 197275 - DNA, 25 bp, E. coli
aatccaaatccatagcgttctgacg

SEQ ID NO: 197276 - DNA, 25 bp, E. coli
aatgggttttctacggtctggctgc

SEQ ID NO: 197277 - DNA, 25 bp, E. coli
atctgaaaatccacgtacctgcggg

SEQ ID NO: 197278 - DNA, 25 bp, E. coli
attgcgccggtgttgatcctgctgg

SEQ ID NO: 197279 - DNA, 25 bp, E. coli
atctgaaaatcctcgtacctgcggg

SEQ ID NO: 197280 - DNA, 25 bp, E. coli
attgcgccggtgatgatcctgctgg

SEQ ID NO: 197281 - DNA, 25 bp, E. coli
tctggctgctatcctgacagttgtc

SEQ ID NO: 197282 - DNA, 25 bp, E. coli
tctgccgctgtgctgtggtttacac

SEQ ID NO: 197283 - DNA, 25 bp, E. coli
tctgccgctgtggtgtggtttacac

SEQ ID NO: 197284 - DNA, 25 bp, E. coli
tctggctgctatgctgacagttgtc

SEQ ID NO: 197285 - DNA, 25 bp, E. coli
gcgttcgcgcagagcttcattggtc

SEQ ID NO: 197286 - DNA, 25 bp, E. coli
gcgttcgcgcagtgcttcattggtc

SEQ ID NO: 197287 - DNA, 25 bp, E. coli
cgttctgacgaaccggtattctggg

SEQ ID NO: 197288 - DNA, 25 bp, E. coli
cgttctgacgaagcggtattctggg

SEQ ID NO: 197289 - DNA, 25 bp, E. coli
gttcctgatgatggttctgccgctg

SEQ ID NO: 197290 - DNA, 25 bp, E. coli
gttcctgatgatcgttctgccgctg

SEQ ID NO: 197291 - DNA, 25 bp, E. coli
ggtttacaccgtatgcaccacgcga

SEQ ID NO: 197292 - DNA, 25 bp, E. coli
ggtttacaccgtttgcaccacgcga

SEQ ID NO: 197293 - DNA, 25 bp, E. coli
ggtcgcgtattcgtgttcctgatga

SEQ ID NO: 197294 - DNA, 25 bp, E. coli
ggtcgcgtattcctgttcctgatga

SEQ ID NO: 197295 - DNA, 25 bp, E. coli
catttagtaacacatatctggctac

SEQ ID NO: 197296 - DNA, 25 bp, E. coli
catttagtaacagatatctggctac

SEQ ID NO: 197297 - DNA, 25 bp, E. coli
taccaatgtgtgcatgtgaggaaca

SEQ ID NO: 197298 - DNA, 25 bp, E. coli
taccaatgtgtggatgtgaggaaca

SEQ ID NO: 197299 - DNA, 25 bp, E. coli
tattctttcaatgagcacttcaccc

SEQ ID NO: 197300 - DNA, 25 bp, E. coli
tattctttcaatcagcacttcaccc

SEQ ID NO: 197301 - DNA, 25 bp, E. coli
tgaagggttgaaacatgacatacgt

SEQ ID NO: 197302 - DNA, 25 bp, E. coli
tgaagggttgaatcatgacatacgt

SEQ ID NO: 197303 - DNA, 25 bp, E. coli
tagattcacgatgtgaagggttgaa

SEQ ID NO: 197304 - DNA, 25 bp, E. coli
tctggctacttaatccccattctgc

SEQ ID NO: 197305 - DNA, 25 bp, E. coli
tctggctacttattccccattctgc

SEQ ID NO: 197306 - DNA, 25 bp, E. coli
tagattcacgatctgaagggttgaa

SEQ ID NO: 197307 - DNA, 25 bp, E. coli
gacatacgttcatagattaaccccg

SEQ ID NO: 197308 - DNA, 25 bp, E. coli
gacatacgttcaaagattaaccccg

SEQ ID NO: 197309 - DNA, 25 bp, E. coli
ccgcggttacgctttcttatctatt

SEQ ID NO: 197310 - DNA, 25 bp, E. coli
ccgcggttacgcattcttatctatt

SEQ ID NO: 197311 - DNA, 25 bp, E. coli
ggctattgcgccatacctcgtgttt

SEQ ID NO: 197312 - DNA, 25 bp, E. coli
ggctattgcgccttacctcgtgttt

SEQ ID NO: 197313 - DNA, 25 bp, E. coli
taattctaataactggctattgcgc

SEQ ID NO: 197314 - DNA, 25 bp, E. coli
taattctaataagtggctattgcgc

SEQ ID NO: 197315 - DNA, 25 bp, E. coli
taatatgtaaccctttagattcacg

SEQ ID NO: 197316 - DNA, 25 bp, E. coli
taatatgtaaccgtttagattcacg

SEQ ID NO: 197317 - DNA, 25 bp, E. coli
caactcaggtaggtgatgcttcggg

SEQ ID NO: 197318 - DNA, 25 bp, E. coli
caactcaggtagctgatgcttcggg

SEQ ID NO: 197319 - DNA, 25 bp, E. coli
catctttctgttcgctgcgtgcgta

SEQ ID NO: 197320 - DNA, 25 bp, E. coli
catctttctgttggctgcgtgcgta

SEQ ID NO: 197321 - DNA, 25 bp, E. coli
aactcaggtaggagatgcttcgggt

SEQ ID NO: 197322 - DNA, 25 bp, E. coli
aactcaggtaggtgatgcttcgggt

SEQ ID NO: 197323 - DNA, 25 bp, E. coli
tgcgaaattgctgaacggcattccg

SEQ ID NO: 197324 - DNA, 25 bp, E. coli
tgcgaaattgctcaacggcattccg

SEQ ID NO: 197325 - DNA, 25 bp, E. coli
tctttctgttggctgcgtgcgtaat

SEQ ID NO: 197326 - DNA, 25 bp, E. coli
tctttctgttgggtgcgtgcgtaat

SEQ ID NO: 197327 - DNA, 25 bp, E. coli
tctgcgtccactggcagcagaagaa

SEQ ID NO: 197328 - DNA, 25 bp, E. coli
tctgttggctgcctgcgtaatgact

SEQ ID NO: 197329 - DNA, 25 bp, E. coli
tctgttggctgcgtgcgtaatgact

SEQ ID NO: 197330 - DNA, 25 bp, E. coli
tctgcgtccactcgcagcagaagaa

SEQ ID NO: 197331 - DNA, 25 bp, E. coli
gcgaaattgctcaacggcattccga

SEQ ID NO: 197332 - DNA, 25 bp, E. coli
gcgaaattgctctacggcattccga

SEQ ID NO: 197333 - DNA, 25 bp, E. coli
gaaattgctcaacggcattccgatt

SEQ ID NO: 197334 - DNA, 25 bp, E. coli
gaaattgctcaagggcattccgatt

SEQ ID NO: 197335 - DNA, 25 bp, E. coli
cccaactcaggtaggtgatgcttcg

SEQ ID NO: 197336 - DNA, 25 bp, E. coli
cccaactcaggttggtgatgcttcg

SEQ ID NO: 197337 - DNA, 25 bp, E. coli
ctgttggctgcgtgcgtaatgacta

SEQ ID NO: 197338 - DNA, 25 bp, E. coli
ctgttggctgcgagcgtaatgacta

SEQ ID NO: 197339 - DNA, 25 bp, E. coli
caatcacagtttgttttcgcgagca

SEQ ID NO: 197340 - DNA, 25 bp, E. coli
caactgctggcaaaagcggtatcta

SEQ ID NO: 197341 - DNA, 25 bp, E. coli
caatcacagtttcttttcgcgagca

SEQ ID NO: 197342 - DNA, 25 bp, E. coli
caactgctggcataagcggtatcta

SEQ ID NO: 197343 - DNA, 25 bp, E. coli
tacaatcaattagctgcgccgatgc

SEQ ID NO: 197344 - DNA, 25 bp, E. coli
tacaccggaaagtcagcaactgctg

SEQ ID NO: 197345 - DNA, 25 bp, E. coli
tacaccggaaagacagcaactgctg

SEQ ID NO: 197346 - DNA, 25 bp, E. coli
tacaatcaattacctgcgccgatgc

SEQ ID NO: 197347 - DNA, 25 bp, E. coli
tatcgccaggcctgtaaagggacac

SEQ ID NO: 197348 - DNA, 25 bp, E. coli
tatcgccaggccagtaaagggacac

SEQ ID NO: 197349 - DNA, 25 bp, E. coli
tccgacccggaaatgtacaatcaat

SEQ ID NO: 197350 - DNA, 25 bp, E. coli
tccgacccggaattgtacaatcaat

SEQ ID NO: 197351 - DNA, 25 bp, E. coli
cctacggtgagttaagcgaacatat

SEQ ID NO: 197352 - DNA, 25 bp, E. coli
cctcaagtgaggacgatgtgctgtt

SEQ ID NO: 197353 - DNA, 25 bp, E. coli
cctacggtgagtaaagcgaacatat

SEQ ID NO: 197354 - DNA, 25 bp, E. coli
cctcaagtgaggtcgatgtgctgtt

SEQ ID NO: 197355 - DNA, 25 bp, E. coli
gctgttagttccacttacgggagat

SEQ ID NO: 197356 - DNA, 25 bp, E. coli
gctgttagttcctcttacgggagat

SEQ ID NO: 197357 - DNA, 25 bp, E. coli
gacaagacgttttttgcctacggtg

SEQ ID NO: 197358 - DNA, 25 bp, E. coli
gacaagacgtttattgcctacggtg

SEQ ID NO: 197359 - DNA, 25 bp, E. coli
gatttgcggtaatcacaatcacagt

SEQ ID NO: 197360 - DNA, 25 bp, E. coli
gatttgcggtaaacacaatcacagt

SEQ ID NO: 197361 - DNA, 25 bp, E. coli
catgacggaggaagacgtaatgctg

SEQ ID NO: 197362 - DNA, 25 bp, E. coli
catgacggaggatgacgtaatgctg

SEQ ID NO: 197363 - DNA, 25 bp, E. coli
tgctcagcctgtttttcagcgatcc

SEQ ID NO: 197364 - DNA, 25 bp, E. coli
tgacgaagagccagaagatgatgtg

SEQ ID NO: 197365 - DNA, 25 bp, E. coli
tgacgaagagcctgaagatgatgtg

SEQ ID NO: 197366 - DNA, 25 bp, E. coli
tgctcagcctgtatttcagcgatcc

SEQ ID NO: 197367 - DNA, 25 bp, E. coli
tgccgactggcagcgcttttacagt

SEQ ID NO: 197368 - DNA, 25 bp, E. coli
tgccgactggcaccgcttttacagt

SEQ ID NO: 197369 - DNA, 25 bp, E. coli
cctgaagatgatgtgctgatgcaga

SEQ ID NO: 197370 - DNA, 25 bp, E. coli
cctgaagatgatctgctgatgcaga

SEQ ID NO: 197371 - DNA, 25 bp, E. coli
gacggtgagctgtgttttgccctga

SEQ ID NO: 197372 - DNA, 25 bp, E. coli
gacggtgagctgagttttgccctga

SEQ ID NO: 197373 - DNA, 25 bp, E. coli
gacgtaatgctgttgacagtatcag

SEQ ID NO: 197374 - DNA, 25 bp, E. coli
gacgtaatgctgatgacagtatcag

SEQ ID NO: 197375 - DNA, 25 bp, E. coli
gacagtatcagaagggatcgcagga

SEQ ID NO: 197376 - DNA, 25 bp, E. coli
gacagtatcagatgggatcgcagga

SEQ ID NO: 197377 - DNA, 25 bp, E. coli
cattattttcatgatgttctgctgg

SEQ ID NO: 197378 - DNA, 25 bp, E. coli
cattattttcatcatgttctgctgg

SEQ ID NO: 197379 - DNA, 25 bp, E. coli
gttctgctggatatgcacttttccg

SEQ ID NO: 197380 - DNA, 25 bp, E. coli
gttctgctggatttgcacttttccg

SEQ ID NO: 197381 - DNA, 25 bp, E. coli
ggcaccgctttttcagtacccatta

SEQ ID NO: 197382 - DNA, 25 bp, E. coli
ggcaccgcttttacagtacccatta

SEQ ID NO: 197383 - DNA, 25 bp, E. coli
caagggctcgctggcatttgatggc

SEQ ID NO: 197384 - DNA, 25 bp, E. coli
caagggctcgctcgcatttgatggc

SEQ ID NO: 197385 - DNA, 25 bp, E. coli
tactgtccggcatagacgtacacga

SEQ ID NO: 197386 - DNA, 25 bp, E. coli
tactgtccggcaaagacgtacacga

SEQ ID NO: 197387 - DNA, 25 bp, E. coli
aaaaggctgtaaccaagcgctggca

SEQ ID NO: 197388 - DNA, 25 bp, E. coli
aaaaggctgtaagcaagcgctggca

SEQ ID NO: 197389 - DNA, 25 bp, E. coli
aacacggttatcacgctcggtagca

SEQ ID NO: 197390 - DNA, 25 bp, E. coli
aacacggttatctcgctcggtagca

SEQ ID NO: 197391 - DNA, 25 bp, E. coli
tatcccggtgccaacatgacaatgt

SEQ ID NO: 197392 - DNA, 25 bp, E. coli
tatcccggtgcctacatgacaatgt

SEQ ID NO: 197393 - DNA, 25 bp, E. coli
ttttaacggcgcactggcatcagga

SEQ ID NO: 197394 - DNA, 25 bp, E. coli
ttttaacggcgctctggcatcagga

SEQ ID NO: 197395 - DNA, 25 bp, E. coli
tgcagaagctatgcacaataaaggg

SEQ ID NO: 197396 - DNA, 25 bp, E. coli
tgcagaagctatccacaataaaggg

SEQ ID NO: 197397 - DNA, 25 bp, E. coli
tcgttaaaaatacggcaggagccgg

SEQ ID NO: 197398 - DNA, 25 bp, E. coli
tcgttaaaaatagggcaggagccgg

SEQ ID NO: 197399 - DNA, 25 bp, E. coli
tcatcagttattagccgaggcttcc

SEQ ID NO: 197400 - DNA, 25 bp, E. coli
tcatcagttatttgccgaggcttcc

SEQ ID NO: 197401 - DNA, 25 bp, E. coli
gaaaattatgatacagcccagggaa

SEQ ID NO: 197402 - DNA, 25 bp, E. coli
gaaaattatgattcagcccagggaa

SEQ ID NO: 197403 - DNA, 25 bp, E. coli
ccctagcggtggagacaagcaatgc

SEQ ID NO: 197404 - DNA, 25 bp, E. coli
ccctagcggtggtgacaagcaatgc

SEQ ID NO: 197405 - DNA, 25 bp, E. coli
caagaagtttccttagcacatatca

SEQ ID NO: 197406 - DNA, 25 bp, E. coli
caagaagtttccatagcacatatca

SEQ ID NO: 197407 - DNA, 25 bp, E. coli
catatcaatgatctgctggagtcca

SEQ ID NO: 197408 - DNA, 25 bp, E. coli
catatcaatgatgtgctggagtcca

SEQ ID NO: 197409 - DNA, 25 bp, E. coli
aaaattatattgtaactaatgctga

SEQ ID NO: 197410 - DNA, 25 bp, E. coli
aaaattatattgaaactaatgctga

SEQ ID NO: 197411 - DNA, 25 bp, E. coli
tatcaatgatgtcctggagtccaaa

SEQ ID NO: 197412 - DNA, 25 bp, E. coli
tatcaatgatgtgctggagtccaaa

SEQ ID NO: 197413 - DNA, 25 bp, E. coli
tgagcgataaacaagaagtttcctt

SEQ ID NO: 197414 - DNA, 25 bp, E. coli
tgagcgataaactagaagtttcctt

SEQ ID NO: 197415 - DNA, 25 bp, E. coli
gctggagtccaaaaattatattgaa

SEQ ID NO: 197416 - DNA, 25 bp, E. coli
gctggagtccaataattatattgaa

SEQ ID NO: 197417 - DNA, 25 bp, E. coli
gaagtttccttagcacatatcaatg

SEQ ID NO: 197418 - DNA, 25 bp, E. coli
gaagtttccttaccacatatcaatg

SEQ ID NO: 197419 - DNA, 25 bp, E. coli
gataaacaagaactttccttagcac

SEQ ID NO: 197420 - DNA, 25 bp, E. coli
gataaacaagaagtttccttagcac

SEQ ID NO: 197421 - DNA, 25 bp, E. coli
gtttccttagcacatatcaatgatg

SEQ ID NO: 197422 - DNA, 25 bp, E. coli
gtttccttagcagatatcaatgatg

SEQ ID NO: 197423 - DNA, 25 bp, E. coli
tcaatgatgtgcaggagtccaaaaa

SEQ ID NO: 197424 - DNA, 25 bp, E. coli
tcaatgatgtgctggagtccaaaaa

SEQ ID NO: 197425 - DNA, 25 bp, E. coli
gatgtgctggagtccaaaaattata

SEQ ID NO: 197426 - DNA, 25 bp, E. coli
gatgtgctggagaccaaaaattata

SEQ ID NO: 197427 - DNA, 25 bp, E. coli
aagaagagcgcacctttacctttcg

SEQ ID NO: 197428 - DNA, 25 bp, E. coli
aagaagagcgcagctttacctttcg

SEQ ID NO: 197429 - DNA, 25 bp, E. coli
cagccacgccatgttttgctggtgg

SEQ ID NO: 197430 - DNA, 25 bp, E. coli
cagccacgccatcttttgctggtgg

SEQ ID NO: 197431 - DNA, 25 bp, E. coli
ataagtcaggcggagcaccagccac

SEQ ID NO: 197432 - DNA, 25 bp, E. coli
agaagaagagcggacctttaccttt

SEQ ID NO: 197433 - DNA, 25 bp, E. coli
ataagtcaggcgcagcaccagccac

SEQ ID NO: 197434 - DNA, 25 bp, E. coli
acgccatgttttgctggtggatcgc

SEQ ID NO: 197435 - DNA, 25 bp, E. coli
agaagaagagcgcacctttaccttt

SEQ ID NO: 197436 - DNA, 25 bp, E. coli
acgccatgttttcctggtggatcgc

SEQ ID NO: 197437 - DNA, 25 bp, E. coli
tgctggtggtggtagggccgctgcc

SEQ ID NO: 197438 - DNA, 25 bp, E. coli
tgctggtggtggaagggccgctgcc

SEQ ID NO: 197439 - DNA, 25 bp, E. coli
gccgccggggtgaattcagaccatc

SEQ ID NO: 197440 - DNA, 25 bp, E. coli
gccgccggggtgtattcagaccatc

SEQ ID NO: 197441 - DNA, 25 bp, E. coli
gcagcaccagcctcgccatgttttg

SEQ ID NO: 197442 - DNA, 25 bp, E. coli
gcagcaccagccacgccatgttttg

SEQ ID NO: 197443 - DNA, 25 bp, E. coli
cggagcgcgcggaggcaaaatcatt

SEQ ID NO: 197444 - DNA, 25 bp, E. coli
cggagcgcgcggtggcaaaatcatt

SEQ ID NO: 197445 - DNA, 25 bp, E. coli
gatttgcctcgcacagcgtggcggc

SEQ ID NO: 197446 - DNA, 25 bp, E. coli
gatttgcctcgctcagcgtggcggc

SEQ ID NO: 197447 - DNA, 25 bp, E. coli
gtggcaaaatcaatccctataaaaa

SEQ ID NO: 197448 - DNA, 25 bp, E. coli
gtggcaaaatcattccctataaaaa

SEQ ID NO: 197449 - DNA, 25 bp, E. coli
taaagagttaaaggccgcccgagat

SEQ ID NO: 197450 - DNA, 25 bp, E. coli
tacaaagccaaatcagtatcagtct

SEQ ID NO: 197451 - DNA, 25 bp, E. coli
tagagaagggcgcttattacatttt

SEQ ID NO: 197452 - DNA, 25 bp, E. coli
tacatttttaactgtccagaacatg

SEQ ID NO: 197453 - DNA, 25 bp, E. coli
taaagagttaaacgccgcccgagat

SEQ ID NO: 197454 - DNA, 25 bp, E. coli
tacatttttaacagtccagaacatg

SEQ ID NO: 197455 - DNA, 25 bp, E. coli
tacaaagccaaaacagtatcagtct

SEQ ID NO: 197456 - DNA, 25 bp, E. coli
tagagaagggcggttattacatttt

SEQ ID NO: 197457 - DNA, 25 bp, E. coli
acttgacagtatgattacaaagcca

SEQ ID NO: 197458 - DNA, 25 bp, E. coli
actgtccagaacatgttgaatttca

SEQ ID NO: 197459 - DNA, 25 bp, E. coli
actgtccagaacttgttgaatttca

SEQ ID NO: 197460 - DNA, 25 bp, E. coli
acttgacagtatcattacaaagcca

SEQ ID NO: 197461 - DNA, 25 bp, E. coli
tgaataaagagttaaacgccgcccg

SEQ ID NO: 197462 - DNA, 25 bp, E. coli
tgaataaagagtaaaacgccgcccg

SEQ ID NO: 197463 - DNA, 25 bp, E. coli
tctttctggcttattagagaagggc

SEQ ID NO: 197464 - DNA, 25 bp, E. coli
tcagtctgattttctgaataaagag

SEQ ID NO: 197465 - DNA, 25 bp, E. coli
tcagtctgatttactgaataaagag

SEQ ID NO: 197466 - DNA, 25 bp, E. coli
tctttctggctttttagagaagggc

SEQ ID NO: 197467 - DNA, 25 bp, E. coli
gccctgcctgtatcgctctttctgg

SEQ ID NO: 197468 - DNA, 25 bp, E. coli
gccctgcctgtaacgctctttctgg

SEQ ID NO: 197469 - DNA, 25 bp, E. coli
gaatttcatatatcaaaacttgaca

SEQ ID NO: 197470 - DNA, 25 bp, E. coli
gaatttcatataacaaaacttgaca

SEQ ID NO: 197471 - DNA, 25 bp, E. coli
agcagttcgctgacccggttgaccg

SEQ ID NO: 197472 - DNA, 25 bp, E. coli
agcagttcgctgtcccggttgaccg

SEQ ID NO: 197473 - DNA, 25 bp, E. coli
tattcagctggcagtgctatgcgcc

SEQ ID NO: 197474 - DNA, 25 bp, E. coli
tattcagctggctgtgctatgcgcc

SEQ ID NO: 197475 - DNA, 25 bp, E. coli
ttgaccggccagtctgctatgacgc

SEQ ID NO: 197476 - DNA, 25 bp, E. coli
ttgaccggccagactgctatgacgc

SEQ ID NO: 197477 - DNA, 25 bp, E. coli
tgcgccacggaagcagttcgctgac

SEQ ID NO: 197478 - DNA, 25 bp, E. coli
tcgctgacccggttgaccggccagt

SEQ ID NO: 197479 - DNA, 25 bp, E. coli
tgcgccacggaaccagttcgctgac

SEQ ID NO: 197480 - DNA, 25 bp, E. coli
tcgctgacccggatgaccggccagt

SEQ ID NO: 197481 - DNA, 25 bp, E. coli
gaagcagttcgcagacccggttgac

SEQ ID NO: 197482 - DNA, 25 bp, E. coli
gaagcagttcgctgacccggttgac

SEQ ID NO: 197483 - DNA, 25 bp, E. coli
gaccggccagtctgctatgacgcca

SEQ ID NO: 197484 - DNA, 25 bp, E. coli
cggttgaccggcgagtctgctatga

SEQ ID NO: 197485 - DNA, 25 bp, E. coli
cggttgaccggccagtctgctatga

SEQ ID NO: 197486 - DNA, 25 bp, E. coli
gtagctttctggatccacgtcattc

SEQ ID NO: 197487 - DNA, 25 bp, E. coli
gtagctttctggttccacgtcattc

SEQ ID NO: 197488 - DNA, 25 bp, E. coli
tggatccacgtctttcagtttgcac

SEQ ID NO: 197489 - DNA, 25 bp, E. coli
tggatccacgtcattcagtttgcac

SEQ ID NO: 197490 - DNA, 25 bp, E. coli
tcagctggcagtcctatgcgccacg

SEQ ID NO: 197491 - DNA, 25 bp, E. coli
tcagctggcagtgctatgcgccacg

SEQ ID NO: 197492 - DNA, 25 bp, E. coli
gaccggccagtcagctatgacgcca

SEQ ID NO: 197493 - DNA, 25 bp, E. coli
cagtatgctcggcaacggaacgtcg

SEQ ID NO: 197494 - DNA, 25 bp, E. coli
cagtatgctcgggaacggaacgtcg

SEQ ID NO: 197495 - DNA, 25 bp, E. coli
catgctggcggatggcgagttttca

SEQ ID NO: 197496 - DNA, 25 bp, E. coli
catgctggcggaaggcgagttttca

SEQ ID NO: 197497 - DNA, 25 bp, E. coli
aaatcgcgcaactacccatgagctg

SEQ ID NO: 197498 - DNA, 25 bp, E. coli
aaatcgcgcaacaacccatgagctg

SEQ ID NO: 197499 - DNA, 25 bp, E. coli
tgtgttgacggcacacctctggaca

SEQ ID NO: 197500 - DNA, 25 bp, E. coli
tgtgttgacggctcacctctggaca

SEQ ID NO: 197501 - DNA, 25 bp, E. coli
gccagcttagcgagccgggaaatct

SEQ ID NO: 197502 - DNA, 25 bp, E. coli
gccagcttagcgtgccgggaaatct

SEQ ID NO: 197503 - DNA, 25 bp, E. coli
gcacctttatgggaacgacctcgct

SEQ ID NO: 197504 - DNA, 25 bp, E. coli
gcacctttatggcaacgacctcgct

SEQ ID NO: 197505 - DNA, 25 bp, E. coli
gattattaatccacgcgatggcgtg

SEQ ID NO: 197506 - DNA, 25 bp, E. coli
gattattaatcctcgcgatggcgtg

SEQ ID NO: 197507 - DNA, 25 bp, E. coli
ggcgctgctcatcccgtcgaataaa

SEQ ID NO: 197508 - DNA, 25 bp, E. coli
ggcgctgctcatgccgtcgaataaa

SEQ ID NO: 197509 - DNA, 25 bp, E. coli
tcacaaacgttgtggcaaggtgccg

SEQ ID NO: 197510 - DNA, 25 bp, E. coli
tcacaaacgttgaggcaaggtgccg

SEQ ID NO: 197511 - DNA, 25 bp, E. coli
gagcattaccttccctgaccgcgaa

SEQ ID NO: 197512 - DNA, 25 bp, E. coli
gagcattaccttgcctgaccgcgaa

SEQ ID NO: 197513 - DNA, 25 bp, E. coli
gatcgccagtggtaactatgccggg

SEQ ID NO: 197514 - DNA, 25 bp, E. coli
gatcgccagtggaaactatgccggg

SEQ ID NO: 197515 - DNA, 25 bp, E. coli
cactggaaatggcatgggaaacccg

SEQ ID NO: 197516 - DNA, 25 bp, E. coli
cactggaaatgggatgggaaacccg

SEQ ID NO: 197517 - DNA, 25 bp, E. coli
cattctatttcaggaaggagtgtcc

SEQ ID NO: 197518 - DNA, 25 bp, E. coli
cattatacgagctggcagttccggc

SEQ ID NO: 197519 - DNA, 25 bp, E. coli
cattctatttcacgaaggagtgtcc

SEQ ID NO: 197520 - DNA, 25 bp, E. coli
cattatacgagcaggcagttccggc

SEQ ID NO: 197521 - DNA, 25 bp, E. coli
tactgtggcgattccggatcaggca

SEQ ID NO: 197522 - DNA, 25 bp, E. coli
tactgtggcgataccggatcaggca

SEQ ID NO: 197523 - DNA, 25 bp, E. coli
gtccgttaaactgaggctacctcag

SEQ ID NO: 197524 - DNA, 25 bp, E. coli
gtccgttaaactcaggctacctcag

SEQ ID NO: 197525 - DNA, 25 bp, E. coli
tataaacgtggtcgtcatgaacatg

SEQ ID NO: 197526 - DNA, 25 bp, E. coli
tataaacgtggtggtcatgaacatg

SEQ ID NO: 197527 - DNA, 25 bp, E. coli
tgttccaagcgaacaaggcagtcat

SEQ ID NO: 197528 - DNA, 25 bp, E. coli
tgttcgcaagaaaaccagtgggctg

SEQ ID NO: 197529 - DNA, 25 bp, E. coli
tgttcgcaagaataccagtgggctg

SEQ ID NO: 197530 - DNA, 25 bp, E. coli
tgttccaagcgatcaaggcagtcat

SEQ ID NO: 197531 - DNA, 25 bp, E. coli
tgacctatatctcgacgggtaagcg

SEQ ID NO: 197532 - DNA, 25 bp, E. coli
tgacctatatctggacgggtaagcg

SEQ ID NO: 197533 - DNA, 25 bp, E. coli
ccttgaaaggcacttcgccgtgacc

SEQ ID NO: 197534 - DNA, 25 bp, E. coli
ccttgaaaggcagttcgccgtgacc

SEQ ID NO: 197535 - DNA, 25 bp, E. coli
cgtgaccgagcctaatcaggtgtgg

SEQ ID NO: 197536 - DNA, 25 bp, E. coli
cgtgaccgagccaaatcaggtgtgg

SEQ ID NO: 197537 - DNA, 25 bp, E. coli
catgcctggaatgcgattcactaga

SEQ ID NO: 197538 - DNA, 25 bp, E. coli
catgcctggaatccgattcactaga

SEQ ID NO: 197539 - DNA, 25 bp, E. coli
tacgctccagtacatggcgatggct

SEQ ID NO: 197540 - DNA, 25 bp, E. coli
tatccttgccggctagaggttcaga

SEQ ID NO: 197541 - DNA, 25 bp, E. coli
tatccttgccgggtagaggttcaga

SEQ ID NO: 197542 - DNA, 25 bp, E. coli
tacgctccagtagatggcgatggct

SEQ ID NO: 197543 - DNA, 25 bp, E. coli
tgaaaatatgagtatccagccagaa

SEQ ID NO: 197544 - DNA, 25 bp, E. coli
tgcggttgtatatagaaatcagacg

SEQ ID NO: 197545 - DNA, 25 bp, E. coli
tgcggttgtataaagaaatcagacg

SEQ ID NO: 197546 - DNA, 25 bp, E. coli
tgaaaatatgagaatccagccagaa

SEQ ID NO: 197547 - DNA, 25 bp, E. coli
gctgaagactacattccatgcctgg

SEQ ID NO: 197548 - DNA, 25 bp, E. coli
gctgggcagccataagacgcaaaag

SEQ ID NO: 197549 - DNA, 25 bp, E. coli
gctgaagactactttccatgcctgg

SEQ ID NO: 197550 - DNA, 25 bp, E. coli
gctgggcagccaaaagacgcaaaag

SEQ ID NO: 197551 - DNA, 25 bp, E. coli
gaaatcagacgtgaacaagctgaag

SEQ ID NO: 197552 - DNA, 25 bp, E. coli
gaaatcagacgtcaacaagctgaag

SEQ ID NO: 197553 - DNA, 25 bp, E. coli
ggctattgtctgttaagggccatac

SEQ ID NO: 197554 - DNA, 25 bp, E. coli
ggctattgtctgataagggccatac

SEQ ID NO: 197555 - DNA, 25 bp, E. coli
ggccatactggttttaaaagaacat

SEQ ID NO: 197556 - DNA, 25 bp, E. coli
ggccatactggtattaaaagaacat

SEQ ID NO: 197557 - DNA, 25 bp, E. coli
gacgcaaaagcatgtatacgaagag

SEQ ID NO: 197558 - DNA, 25 bp, E. coli
gacgcaaaagcaagtatacgaagag

SEQ ID NO: 197559 - DNA, 25 bp, E. coli
aatattatctgaactctgcggcgag

SEQ ID NO: 197560 - DNA, 25 bp, E. coli
aatattatctgatctctgcggcgag

SEQ ID NO: 197561 - DNA, 25 bp, E. coli
catgggcgatatgaccaaacacggt

SEQ ID NO: 197562 - DNA, 25 bp, E. coli
catgggcgatatcaccaaacacggt

SEQ ID NO: 197563 - DNA, 25 bp, E. coli
taggtacgcgtgaaatcgaccaggg

SEQ ID NO: 197564 - DNA, 25 bp, E. coli
taggtacgcgtgtaatcgaccaggg

SEQ ID NO: 197565 - DNA, 25 bp, E. coli
tattcgtgcggtatcggcggctaaa

SEQ ID NO: 197566 - DNA, 25 bp, E. coli
tattccaggactgattgaaggcgct

SEQ ID NO: 197567 - DNA, 25 bp, E. coli
tattccaggactcattgaaggcgct

SEQ ID NO: 197568 - DNA, 25 bp, E. coli
tattcgtgcggtttcggcggctaaa

SEQ ID NO: 197569 - DNA, 25 bp, E. coli
tttatcattgaaaacccggtcgtgc

SEQ ID NO: 197570 - DNA, 25 bp, E. coli
tttatcattgaatacccggtcgtgc

SEQ ID NO: 197571 - DNA, 25 bp, E. coli
tgaagcacctggaacgttgccgcgt

SEQ ID NO: 197572 - DNA, 25 bp, E. coli
tgaaaaatctttccgtgcagagcgc

SEQ ID NO: 197573 - DNA, 25 bp, E. coli
tgaagcacctggtacgttgccgcgt

SEQ ID NO: 197574 - DNA, 25 bp, E. coli
tgaaaaatctttgcgtgcagagcgc

SEQ ID NO: 197575 - DNA, 25 bp, E. coli
gactgggcgtgaaagatctctgctg

SEQ ID NO: 197576 - DNA, 25 bp, E. coli
gatatcgatccgattgacggcaccg

SEQ ID NO: 197577 - DNA, 25 bp, E. coli
gatatcgatccgtttgacggcaccg

SEQ ID NO: 197578 - DNA, 25 bp, E. coli
taatggttgcgtgagcttccgccgc

SEQ ID NO: 197579 - DNA, 25 bp, E. coli
taatggttgcgtcagcttccgccgc

SEQ ID NO: 197580 - DNA, 25 bp, E. coli
gactgggcgtgatagatctctgctg

SEQ ID NO: 197581 - DNA, 25 bp, E. coli
caactctccctgaaaatttggaagt

SEQ ID NO: 197582 - DNA, 25 bp, E. coli
caactctccctgtaaatttggaagt

SEQ ID NO: 197583 - DNA, 25 bp, E. coli
taaaatcattatgaacaatctggtg

SEQ ID NO: 197584 - DNA, 25 bp, E. coli
taaaatcattatcaacaatctggtg

SEQ ID NO: 197585 - DNA, 25 bp, E. coli
taattgccaggctctatccaaatgt

SEQ ID NO: 197586 - DNA, 25 bp, E. coli
taattgccaggcactatccaaatgt

SEQ ID NO: 197587 - DNA, 25 bp, E. coli
tccaaatgtatttgcagacaggtaa

SEQ ID NO: 197588 - DNA, 25 bp, E. coli
tgccaggcactaaccaaatgtatta

SEQ ID NO: 197589 - DNA, 25 bp, E. coli
tgccaggcactatccaaatgtatta

SEQ ID NO: 197590 - DNA, 25 bp, E. coli
tccaaatgtattagcagacaggtaa

SEQ ID NO: 197591 - DNA, 25 bp, E. coli
gctggaattataaaaccaactctcc

SEQ ID NO: 197592 - DNA, 25 bp, E. coli
gctaaatgacattattgccaggcac

SEQ ID NO: 197593 - DNA, 25 bp, E. coli
gctggaattatataaccaactctcc

SEQ ID NO: 197594 - DNA, 25 bp, E. coli
gcgctatgaagaggaaatgttcagc

SEQ ID NO: 197595 - DNA, 25 bp, E. coli
gcgctatgaagacgaaatgttcagc

SEQ ID NO: 197596 - DNA, 25 bp, E. coli
gctaaatgacataattgccaggcac

SEQ ID NO: 197597 - DNA, 25 bp, E. coli
gaattataaaacgaactctccctgt

SEQ ID NO: 197598 - DNA, 25 bp, E. coli
gaattataaaaccaactctccctgt

SEQ ID NO: 197599 - DNA, 25 bp, E. coli
ctggttgacagggtaaatgacataa

SEQ ID NO: 197600 - DNA, 25 bp, E. coli
ctggttgacaggctaaatgacataa

SEQ ID NO: 197601 - DNA, 25 bp, E. coli
ggcactatccaattgtattagcaga

SEQ ID NO: 197602 - DNA, 25 bp, E. coli
ggcactatccaaatgtattagcaga

SEQ ID NO: 197603 - DNA, 25 bp, E. coli
aataacattactcgactggtgccgg

SEQ ID NO: 197604 - DNA, 25 bp, E. coli
aataacattactggactggtgccgg

SEQ ID NO: 197605 - DNA, 25 bp, E. coli
aaaagctggagctggcattccgacg

SEQ ID NO: 197606 - DNA, 25 bp, E. coli
aaaagctggagcaggcattccgacg

SEQ ID NO: 197607 - DNA, 25 bp, E. coli
tgaacgctcattgctgacgctggac

SEQ ID NO: 197608 - DNA, 25 bp, E. coli
tgaacgctcattcctgacgctggac

SEQ ID NO: 197609 - DNA, 25 bp, E. coli
tgctgaccgggatagaatcaacgcc

SEQ ID NO: 197610 - DNA, 25 bp, E. coli
tgctgaccgggaaagaatcaacgcc

SEQ ID NO: 197611 - DNA, 25 bp, E. coli
cctggaagaggcaactgacgtggaa

SEQ ID NO: 197612 - DNA, 25 bp, E. coli
cctggaagaggctactgacgtggaa

SEQ ID NO: 197613 - DNA, 25 bp, E. coli
gaacaggcccttgaccggaatattg

SEQ ID NO: 197614 - DNA, 25 bp, E. coli
gaacaggcccttcaccggaatattg

SEQ ID NO: 197615 - DNA, 25 bp, E. coli
gcacttaaagggatgttcgccgacc

SEQ ID NO: 197616 - DNA, 25 bp, E. coli
gcacttaaagggttgttcgccgacc

SEQ ID NO: 197617 - DNA, 25 bp, E. coli
gatattctgacctaccagcgtcggg

SEQ ID NO: 197618 - DNA, 25 bp, E. coli
gatattctgaccaaccagcgtcggg

SEQ ID NO: 197619 - DNA, 25 bp, E. coli
gggcccgcgcacattcagtaactaa

SEQ ID NO: 197620 - DNA, 25 bp, E. coli
gggcccgcgcactttcagtaactaa

SEQ ID NO: 197621 - DNA, 25 bp, E. coli
ggctgagacagcaccaaaacttcgt

SEQ ID NO: 197622 - DNA, 25 bp, E. coli
ggctgagacagctccaaaacttcgt

SEQ ID NO: 197623 - DNA, 25 bp, E. coli
gatgaagaacccagcaatgacgcgg

SEQ ID NO: 197624 - DNA, 25 bp, E. coli
gatgaagaaccctgcaatgacgcgg

SEQ ID NO: 197625 - DNA, 25 bp, E. coli
aacgctacgcgcaggatcatttcca

SEQ ID NO: 197626 - DNA, 25 bp, E. coli
tacaacactggcaggcacagttcga

SEQ ID NO: 197627 - DNA, 25 bp, E. coli
tacaacactggctggcacagttcga

SEQ ID NO: 197628 - DNA, 25 bp, E. coli
aacgctacgcgctggatcatttcca

SEQ ID NO: 197629 - DNA, 25 bp, E. coli
tttagtcgagtttatggcgaagctc

SEQ ID NO: 197630 - DNA, 25 bp, E. coli
tttagtcgagttaatggcgaagctc

SEQ ID NO: 197631 - DNA, 25 bp, E. coli
tgagcctggcgaaaaatcatccgca

SEQ ID NO: 197632 - DNA, 25 bp, E. coli
tgagcctggcgataaatcatccgca

SEQ ID NO: 197633 - DNA, 25 bp, E. coli
gcatcgcccgctagatgataaacgc

SEQ ID NO: 197634 - DNA, 25 bp, E. coli
gcatcgcccgcttgatgataaacgc

SEQ ID NO: 197635 - DNA, 25 bp, E. coli
gcttgatgataatcgctacgcgctg

SEQ ID NO: 197636 - DNA, 25 bp, E. coli
gctcacagtttctgcgcgcaaatcg

SEQ ID NO: 197637 - DNA, 25 bp, E. coli
gcttgatgataaacgctacgcgctg

SEQ ID NO: 197638 - DNA, 25 bp, E. coli
gctcacagtttcagcgcgcaaatcg

SEQ ID NO: 197639 - DNA, 25 bp, E. coli
gttcttcaatccaggcggcagaaga

SEQ ID NO: 197640 - DNA, 25 bp, E. coli
gttcttcaatcctggcggcagaaga

SEQ ID NO: 197641 - DNA, 25 bp, E. coli
cgcgtcgcctgcaccgtgaagagtt

SEQ ID NO: 197642 - DNA, 25 bp, E. coli
cgcgtcgcctgctccgtgaagagtt

SEQ ID NO: 197643 - DNA, 25 bp, E. coli
gatatgctggtgtttttaaccgcct

SEQ ID NO: 197644 - DNA, 25 bp, E. coli
gatatgctggtgattttaaccgcct

SEQ ID NO: 197645 - DNA, 25 bp, E. coli
gaggccgtttgtgatgccattgccg

SEQ ID NO: 197646 - DNA, 25 bp, E. coli
gaggccgtttgtcatgccattgccg

SEQ ID NO: 197647 - DNA, 25 bp, E. coli
caatcacagtgcattaaccgttcaa

SEQ ID NO: 197648 - DNA, 25 bp, E. coli
caatcacagtgctttaaccgttcaa

SEQ ID NO: 197649 - DNA, 25 bp, E. coli
caatgccaccttgaaatggtggacc

SEQ ID NO: 197650 - DNA, 25 bp, E. coli
caattgtctttggaagcctgttgag

SEQ ID NO: 197651 - DNA, 25 bp, E. coli
caatgccaccttcaaatggtggacc

SEQ ID NO: 197652 - DNA, 25 bp, E. coli
caattgtctttgcaagcctgttgag

SEQ ID NO: 197653 - DNA, 25 bp, E. coli
acagcgatggccctcgtggtcctgc

SEQ ID NO: 197654 - DNA, 25 bp, E. coli
acagcgatggccgtcgtggtcctgc

SEQ ID NO: 197655 - DNA, 25 bp, E. coli
taccttcagcctcttagcaattgtc

SEQ ID NO: 197656 - DNA, 25 bp, E. coli
taccttcagcctgttagcaattgtc

SEQ ID NO: 197657 - DNA, 25 bp, E. coli
gcctgttgagtggttgtgttcccca

SEQ ID NO: 197658 - DNA, 25 bp, E. coli
gcctgttgagtgcttgtgttcccca

SEQ ID NO: 197659 - DNA, 25 bp, E. coli
gcagcttttatgtgataacaatcac

SEQ ID NO: 197660 - DNA, 25 bp, E. coli
taaccgttcaagagtttgtcatgaa

SEQ ID NO: 197661 - DNA, 25 bp, E. coli
gcagcttttatgagataacaatcac

SEQ ID NO: 197662 - DNA, 25 bp, E. coli
taaccgttcaagtgtttgtcatgaa

SEQ ID NO: 197663 - DNA, 25 bp, E. coli
ggtggaccaaatcacggcagtcatg

SEQ ID NO: 197664 - DNA, 25 bp, E. coli
ggtcctgcgccctcaggtaagccaa

SEQ ID NO: 197665 - DNA, 25 bp, E. coli
ggtcctgcgcccacaggtaagccaa

SEQ ID NO: 197666 - DNA, 25 bp, E. coli
ggtggaccaaatgacggcagtcatg

SEQ ID NO: 197667 - DNA, 25 bp, E. coli
gagtgcttgtgttccccaccatcat

SEQ ID NO: 197668 - DNA, 25 bp, E. coli
gagtgcttgtgtaccccaccatcat

SEQ ID NO: 197669 - DNA, 25 bp, E. coli
cacagtgacagagttattctcgcta

SEQ ID NO: 197670 - DNA, 25 bp, E. coli
cacagtgacagacttattctcgcta

SEQ ID NO: 197671 - DNA, 25 bp, E. coli
caggttgaatgtcctcgttgccaga

SEQ ID NO: 197672 - DNA, 25 bp, E. coli
caggttgaatgtgctcgttgccaga

SEQ ID NO: 197673 - DNA, 25 bp, E. coli
taaaattacgtgtgagcgcgctgtc

SEQ ID NO: 197674 - DNA, 25 bp, E. coli
taaaattacgtgagagcgcgctgtc

SEQ ID NO: 197675 - DNA, 25 bp, E. coli
tatttcagtacatcgcttgggcgcc

SEQ ID NO: 197676 - DNA, 25 bp, E. coli
tatctggtcagtcgtcattcccgta

SEQ ID NO: 197677 - DNA, 25 bp, E. coli
tatttcagtacaacgcttgggcgcc

SEQ ID NO: 197678 - DNA, 25 bp, E. coli
tatctggtcagtggtcattcccgta

SEQ ID NO: 197679 - DNA, 25 bp, E. coli
tgtcatccggctgcatgtctgaaga

SEQ ID NO: 197680 - DNA, 25 bp, E. coli
tgtcatccggctccatgtctgaaga

SEQ ID NO: 197681 - DNA, 25 bp, E. coli
tctcgctatgaaggattatctggtc

SEQ ID NO: 197682 - DNA, 25 bp, E. coli
tctcgctatgaacgattatctggtc

SEQ ID NO: 197683 - DNA, 25 bp, E. coli
gcttgggcgccttaccaggttgaat

SEQ ID NO: 197684 - DNA, 25 bp, E. coli
gcttgggcgcctaaccaggttgaat

SEQ ID NO: 197685 - DNA, 25 bp, E. coli
gcacagcatgaacttattacccggg

SEQ ID NO: 197686 - DNA, 25 bp, E. coli
gcacagcatgaagttattacccggg

SEQ ID NO: 197687 - DNA, 25 bp, E. coli
cattcccgtaaagatgtctgcgaga

SEQ ID NO: 197688 - DNA, 25 bp, E. coli
cattcccgtaaacatgtctgcgaga

SEQ ID NO: 197689 - DNA, 25 bp, E. coli
ggtatttcctctattcacagtgaca

SEQ ID NO: 197690 - DNA, 25 bp, E. coli
ggtatttcctcttttcacagtgaca

SEQ ID NO: 197691 - DNA, 25 bp, E. coli
aagtcgcgccgtatgcattgtctcg

SEQ ID NO: 197692 - DNA, 25 bp, E. coli
aagtcgcgccgtttgcattgtctcg

SEQ ID NO: 197693 - DNA, 25 bp, E. coli
tacgggcatcaggtgattatttctg

SEQ ID NO: 197694 - DNA, 25 bp, E. coli
tacgggcatcagctgattatttctg

SEQ ID NO: 197695 - DNA, 25 bp, E. coli
ttgctatcgcactgcttgctggatt

SEQ ID NO: 197696 - DNA, 25 bp, E. coli
ttgctatcgcacagcttgctggatt

SEQ ID NO: 197697 - DNA, 25 bp, E. coli
gctggtgtttgcctttgttgtcccg

SEQ ID NO: 197698 - DNA, 25 bp, E. coli
gctggtgtttgcgtttgttgtcccg

SEQ ID NO: 197699 - DNA, 25 bp, E. coli
gcttgctggattgggtaaccactgg

SEQ ID NO: 197700 - DNA, 25 bp, E. coli
gctgctggctgtttttaaccgtctc

SEQ ID NO: 197701 - DNA, 25 bp, E. coli
gcttgctggattcggtaaccactgg

SEQ ID NO: 197702 - DNA, 25 bp, E. coli
gctgctggctgtatttaaccgtctc

SEQ ID NO: 197703 - DNA, 25 bp, E. coli
cgctttttcgctccctggcaggtga

SEQ ID NO: 197704 - DNA, 25 bp, E. coli
cgctttttcgctgcctggcaggtga

SEQ ID NO: 197705 - DNA, 25 bp, E. coli
cgtttgcattgtctcgttacaccac

SEQ ID NO: 197706 - DNA, 25 bp, E. coli
cgtttgcattgtgtcgttacaccac

SEQ ID NO: 197707 - DNA, 25 bp, E. coli
gggctgattcgcagctggctgtttt

SEQ ID NO: 197708 - DNA, 25 bp, E. coli
gggctgattcgctgctggctgtttt

SEQ ID NO: 197709 - DNA, 25 bp, E. coli
tggccgtggtcagatgaacgctttt

SEQ ID NO: 197710 - DNA, 25 bp, E. coli
tggccgtggtcacatgaacgctttt

SEQ ID NO: 197711 - DNA, 25 bp, E. coli
gatgaacgctttatcgctccctggc

SEQ ID NO: 197712 - DNA, 25 bp, E. coli
gatgaacgctttttcgctccctggc

SEQ ID NO: 197713 - DNA, 25 bp, E. coli
caatcatggaaaaggcttacgaaga

SEQ ID NO: 197714 - DNA, 25 bp, E. coli
caatcatggaaatggcttacgaaga

SEQ ID NO: 197715 - DNA, 25 bp, E. coli
cacaatcatggataaggcttacgaa

SEQ ID NO: 197716 - DNA, 25 bp, E. coli
cacaatcatggaaaaggcttacgaa

SEQ ID NO: 197717 - DNA, 25 bp, E. coli
catggaaaaggcatacgaagaatac

SEQ ID NO: 197718 - DNA, 25 bp, E. coli
catggaaaaggcttacgaagaatac

SEQ ID NO: 197719 - DNA, 25 bp, E. coli
tacttcgaaggccttgccgaaggcg

SEQ ID NO: 197720 - DNA, 25 bp, E. coli
tacttcgaaggcgttgccgaaggcg

SEQ ID NO: 197721 - DNA, 25 bp, E. coli
agaatacttcgaaggccttgccgaa

SEQ ID NO: 197722 - DNA, 25 bp, E. coli
agaatacttcgatggccttgccgaa

SEQ ID NO: 197723 - DNA, 25 bp, E. coli
acttcgaaggccatgccgaaggcga

SEQ ID NO: 197724 - DNA, 25 bp, E. coli
acttcgaaggccttgccgaaggcga

SEQ ID NO: 197725 - DNA, 25 bp, E. coli
gcgctttccagtacggcaaaatcta

SEQ ID NO: 197726 - DNA, 25 bp, E. coli
gcgctttccagttcggcaaaatcta

SEQ ID NO: 197727 - DNA, 25 bp, E. coli
gaagaatacttccaaggccttgccg

SEQ ID NO: 197728 - DNA, 25 bp, E. coli
gaaaaggcttacgaagaatacttcg

SEQ ID NO: 197729 - DNA, 25 bp, E. coli
gaagaatacttcgaaggccttgccg

SEQ ID NO: 197730 - DNA, 25 bp, E. coli
gaaaaggcttaccaagaatacttcg

SEQ ID NO: 197731 - DNA, 25 bp, E. coli
gacacaatcatggaaaaggcttacg

SEQ ID NO: 197732 - DNA, 25 bp, E. coli
gacacaatcatgcaaaaggcttacg

SEQ ID NO: 197733 - DNA, 25 bp, E. coli
cgctttccagttcggcaaaatctaa

SEQ ID NO: 197734 - DNA, 25 bp, E. coli
cgctttccagttgggcaaaatctaa

SEQ ID NO: 197735 - DNA, 25 bp, E. coli
caatccaggtgaagtaagcagagta

SEQ ID NO: 197736 - DNA, 25 bp, E. coli
caatccaggtgatgtaagcagagta

SEQ ID NO: 197737 - DNA, 25 bp, E. coli
catttacgtaatggattgcgttcac

SEQ ID NO: 197738 - DNA, 25 bp, E. coli
cagaggagcctaatataaaaatcat

SEQ ID NO: 197739 - DNA, 25 bp, E. coli
catttacgtaatcgattgcgttcac

SEQ ID NO: 197740 - DNA, 25 bp, E. coli
cagaggagcctattataaaaatcat

SEQ ID NO: 197741 - DNA, 25 bp, E. coli
taaatatttcgtttacagaggagcc

SEQ ID NO: 197742 - DNA, 25 bp, E. coli
taaatatttcgtatacagaggagcc

SEQ ID NO: 197743 - DNA, 25 bp, E. coli
tgttgcgggacgcacaaaatcgtcc

SEQ ID NO: 197744 - DNA, 25 bp, E. coli
tgttgcgggacggacaaaatcgtcc

SEQ ID NO: 197745 - DNA, 25 bp, E. coli
tgcaaacttttactatcaatccagg

SEQ ID NO: 197746 - DNA, 25 bp, E. coli
tgcaaacttttagtatcaatccagg

SEQ ID NO: 197747 - DNA, 25 bp, E. coli
tcattgctcacataaatatgtttcg

SEQ ID NO: 197748 - DNA, 25 bp, E. coli
tcattgctcacaaaaatatgtttcg

SEQ ID NO: 197749 - DNA, 25 bp, E. coli
gtaagcagagtaacaaaatgacggg

SEQ ID NO: 197750 - DNA, 25 bp, E. coli
gtaagcagagtatcaaaatgacggg

SEQ ID NO: 197751 - DNA, 25 bp, E. coli
ggattgtactgagtttcgcccttgt

SEQ ID NO: 197752 - DNA, 25 bp, E. coli
ggattgtactgactttcgcccttgt

SEQ ID NO: 197753 - DNA, 25 bp, E. coli
ggcgcaaattgcctttctaaatatt

SEQ ID NO: 197754 - DNA, 25 bp, E. coli
ggcgcaaattgcgtttctaaatatt

SEQ ID NO: 197755 - DNA, 25 bp, E. coli
tcacgtttacactcattcgggcggg

SEQ ID NO: 197756 - DNA, 25 bp, E. coli
tcacgtttacacacattcgggcggg

SEQ ID NO: 197757 - DNA, 25 bp, E. coli
cactattctggtcagtgaagaaccg

SEQ ID NO: 197758 - DNA, 25 bp, E. coli
cactattctggtgagtgaagaaccg

SEQ ID NO: 197759 - DNA, 25 bp, E. coli
tacccggaaagtcatcctgaaggcg

SEQ ID NO: 197760 - DNA, 25 bp, E. coli
tacccggaaagtgatcctgaaggcg

SEQ ID NO: 197761 - DNA, 25 bp, E. coli
tacccgcgacataaacggtatgaag

SEQ ID NO: 197762 - DNA, 25 bp, E. coli
taccgctgcgctgtggaaagaaatg

SEQ ID NO: 197763 - DNA, 25 bp, E. coli
tatttgcgtacatacctacccggaa

SEQ ID NO: 197764 - DNA, 25 bp, E. coli
tacccgcgacattaacggtatgaag

SEQ ID NO: 197765 - DNA, 25 bp, E. coli
taccgctgcgctctggaaagaaatg

SEQ ID NO: 197766 - DNA, 25 bp, E. coli
tattgaagtctctacctgcggcgtg

SEQ ID NO: 197767 - DNA, 25 bp, E. coli
tattgaagtctcaacctgcggcgtg

SEQ ID NO: 197768 - DNA, 25 bp, E. coli
tatttgcgtacaaacctacccggaa

SEQ ID NO: 197769 - DNA, 25 bp, E. coli
tctataatgccaaccgtctgaccga

SEQ ID NO: 197770 - DNA, 25 bp, E. coli
tctataatgccatccgtctgaccga

SEQ ID NO: 197771 - DNA, 25 bp, E. coli
gaattacctgatccaccagcttgag

SEQ ID NO: 197772 - DNA, 25 bp, E. coli
gaattacctgatgcaccagcttgag

SEQ ID NO: 197773 - DNA, 25 bp, E. coli
ggcccactgccagaaacggtcgttg

SEQ ID NO: 197774 - DNA, 25 bp, E. coli
ggcccactgccacaaacggtcgttg

SEQ ID NO: 197775 - DNA, 25 bp, E. coli
ggtttatgtaccatccgcgccgata

SEQ ID NO: 197776 - DNA, 25 bp, E. coli
ggtttatgtaccttccgcgccgata

SEQ ID NO: 197777 - DNA, 25 bp, E. coli
tacatgttccactccaaaccggaag

SEQ ID NO: 197778 - DNA, 25 bp, E. coli
tacatgttccacaccaaaccggaag

SEQ ID NO: 197779 - DNA, 25 bp, E. coli
gaatagttcactaatttactacata

SEQ ID NO: 197780 - DNA, 25 bp, E. coli
gaatagttcacttatttactacata

SEQ ID NO: 197781 - DNA, 25 bp, E. coli
cagttgaacattttaatctgaatag

SEQ ID NO: 197782 - DNA, 25 bp, E. coli
cagttgaacattataatctgaatag

SEQ ID NO: 197783 - DNA, 25 bp, E. coli
taccaatgaaatgattctcctgcag

SEQ ID NO: 197784 - DNA, 25 bp, E. coli
acctattaacaatccggtgctgaga

SEQ ID NO: 197785 - DNA, 25 bp, E. coli
acctattaacaaaccggtgctgaga

SEQ ID NO: 197786 - DNA, 25 bp, E. coli
taccaatgaaatcattctcctgcag

SEQ ID NO: 197787 - DNA, 25 bp, E. coli
tattcatcctcaacgagtaagcttg

SEQ ID NO: 197788 - DNA, 25 bp, E. coli
tattcatcctcatcgagtaagcttg

SEQ ID NO: 197789 - DNA, 25 bp, E. coli
tgaaatgattctcctgcagtataat

SEQ ID NO: 197790 - DNA, 25 bp, E. coli
tgaaatgattctgctgcagtataat

SEQ ID NO: 197791 - DNA, 25 bp, E. coli
tgcagtataatctttcagttgaaca

SEQ ID NO: 197792 - DNA, 25 bp, E. coli
tgcagtataatcattcagttgaaca

SEQ ID NO: 197793 - DNA, 25 bp, E. coli
gctccaattagtaatattcatcctc

SEQ ID NO: 197794 - DNA, 25 bp, E. coli
gctccaattagttatattcatcctc

SEQ ID NO: 197795 - DNA, 25 bp, E. coli
ccctaagaaagaatatatatgctcc

SEQ ID NO: 197796 - DNA, 25 bp, E. coli
cgagtaagcttgaataatacaccta

SEQ ID NO: 197797 - DNA, 25 bp, E. coli
cgagtaagcttgtataatacaccta

SEQ ID NO: 197798 - DNA, 25 bp, E. coli
ccctaagaaagattatatatgctcc

SEQ ID NO: 197799 - DNA, 25 bp, E. coli
cggtgctgagatctattaccaatga

SEQ ID NO: 197800 - DNA, 25 bp, E. coli
cggtgctgagatgtattaccaatga

SEQ ID NO: 197801 - DNA, 25 bp, E. coli
aaccgtgcttgtacaggatctggcg

SEQ ID NO: 197802 - DNA, 25 bp, E. coli
aaccgtgcttgttcaggatctggcg

SEQ ID NO: 197803 - DNA, 25 bp, E. coli
agtatttgctgcgtcggaagcgaca

SEQ ID NO: 197804 - DNA, 25 bp, E. coli
agtatttgctgcctcggaagcgaca

SEQ ID NO: 197805 - DNA, 25 bp, E. coli
aaaaacagaataccgcaggcggcag

SEQ ID NO: 197806 - DNA, 25 bp, E. coli
aaaaacagaatagcgcaggcggcag

SEQ ID NO: 197807 - DNA, 25 bp, E. coli
ttagtgaatgaagagggaaccgtgc

SEQ ID NO: 197808 - DNA, 25 bp, E. coli
ttagtgaatgaacagggaaccgtgc

SEQ ID NO: 197809 - DNA, 25 bp, E. coli
ttcgagcgaaggtataagatcatcc

SEQ ID NO: 197810 - DNA, 25 bp, E. coli
ttacgcgctttcttggcggtgcggc

SEQ ID NO: 197811 - DNA, 25 bp, E. coli
ttacgcgctttcatggcggtgcggc

SEQ ID NO: 197812 - DNA, 25 bp, E. coli
ttcgagcgaaggaataagatcatcc

SEQ ID NO: 197813 - DNA, 25 bp, E. coli
tctcgaacaaaaaggcgtggttacg

SEQ ID NO: 197814 - DNA, 25 bp, E. coli
tcgggtttaaagtgcgatttcagct

SEQ ID NO: 197815 - DNA, 25 bp, E. coli
tcgggtttaaagagcgatttcagct

SEQ ID NO: 197816 - DNA, 25 bp, E. coli
tctcgaacaaaatggcgtggttacg

SEQ ID NO: 197817 - DNA, 25 bp, E. coli
tgccgatttgcgctttctcgaacaa

SEQ ID NO: 197818 - DNA, 25 bp, E. coli
tgccgatttgcggtttctcgaacaa

SEQ ID NO: 197819 - DNA, 25 bp, E. coli
gcagtcaaaatgttccacgaaggga

SEQ ID NO: 197820 - DNA, 25 bp, E. coli
gcagtcaaaatgatccacgaaggga

SEQ ID NO: 197821 - DNA, 25 bp, E. coli
ggaagcgacaatccgtgccgatttg

SEQ ID NO: 197822 - DNA, 25 bp, E. coli
ggaagcgacaatgcgtgccgatttg

SEQ ID NO: 197823 - DNA, 25 bp, E. coli
caaccgcaactgatgcttgatatgg

SEQ ID NO: 197824 - DNA, 25 bp, E. coli
caaccgcaactgttgcttgatatgg

SEQ ID NO: 197825 - DNA, 25 bp, E. coli
tatccgcagtgggtgcataacctgc

SEQ ID NO: 197826 - DNA, 25 bp, E. coli
tatccgcagtggctgcataacctgc

SEQ ID NO: 197827 - DNA, 25 bp, E. coli
tgatatggaacaagcgcgtggactg

SEQ ID NO: 197828 - DNA, 25 bp, E. coli
tgatatggaacatgcgcgtggactg

SEQ ID NO: 197829 - DNA, 25 bp, E. coli
tgatgcttgatatggaacaagcgcg

SEQ ID NO: 197830 - DNA, 25 bp, E. coli
tgatgcttgataaggaacaagcgcg

SEQ ID NO: 197831 - DNA, 25 bp, E. coli
ccggcacaaccggaactgatgcttg

SEQ ID NO: 197832 - DNA, 25 bp, E. coli
ccggcacaaccgcaactgatgcttg

SEQ ID NO: 197833 - DNA, 25 bp, E. coli
gcgctccaaaattttaccttatcag

SEQ ID NO: 197834 - DNA, 25 bp, E. coli
gcgctccaaaatattaccttatcag

SEQ ID NO: 197835 - DNA, 25 bp, E. coli
gcagtggctgcataacctgcaacaa

SEQ ID NO: 197836 - DNA, 25 bp, E. coli
gcagtggctgcaaaacctgcaacaa

SEQ ID NO: 197837 - DNA, 25 bp, E. coli
gaacagctggtaaatccgcagtggc

SEQ ID NO: 197838 - DNA, 25 bp, E. coli
gaacagctggtatatccgcagtggc

SEQ ID NO: 197839 - DNA, 25 bp, E. coli
cgcaactgatgcatgatatggaaca

SEQ ID NO: 197840 - DNA, 25 bp, E. coli
cgcaactgatgcttgatatggaaca

SEQ ID NO: 197841 - DNA, 25 bp, E. coli
ctggtatatccgcagtggctgcata

SEQ ID NO: 197842 - DNA, 25 bp, E. coli
ctttgaacagctggtatatccgcag

SEQ ID NO: 197843 - DNA, 25 bp, E. coli
ctttgaacagctcgtatatccgcag

SEQ ID NO: 197844 - DNA, 25 bp, E. coli
ctggtatatccggagtggctgcata

SEQ ID NO: 197845 - DNA, 25 bp, E. coli
cagctggctgctagaaaaacttcgg

SEQ ID NO: 197846 - DNA, 25 bp, E. coli
cagctggctgcttgaaaaacttcgg

SEQ ID NO: 197847 - DNA, 25 bp, E. coli
cagtaataacgtcgcctggcttccc

SEQ ID NO: 197848 - DNA, 25 bp, E. coli
cagtaataacgtggcctggcttccc

SEQ ID NO: 197849 - DNA, 25 bp, E. coli
caccccggttgagaaagggctggca

SEQ ID NO: 197850 - DNA, 25 bp, E. coli
caccccggttgacaaagggctggca

SEQ ID NO: 197851 - DNA, 25 bp, E. coli
aactgtgcagctggtttggcatccc

SEQ ID NO: 197852 - DNA, 25 bp, E. coli
aactgtgcagctcgtttggcatccc

SEQ ID NO: 197853 - DNA, 25 bp, E. coli
ttggcatcccgcctcagagtcagtt

SEQ ID NO: 197854 - DNA, 25 bp, E. coli
ttggcatcccgcgtcagagtcagtt

SEQ ID NO: 197855 - DNA, 25 bp, E. coli
tgttctgagcgagcttgacgacacg

SEQ ID NO: 197856 - DNA, 25 bp, E. coli
tgttctgagcgaccttgacgacacg

SEQ ID NO: 197857 - DNA, 25 bp, E. coli
tccctaccaggataagctgacatcg

SEQ ID NO: 197858 - DNA, 25 bp, E. coli
tccctaccaggaaaagctgacatcg

SEQ ID NO: 197859 - DNA, 25 bp, E. coli
ccgtaattggttagggcgacagcct

SEQ ID NO: 197860 - DNA, 25 bp, E. coli
cctgggcaaggcagaacttcgaata

SEQ ID NO: 197861 - DNA, 25 bp, E. coli
cctgggcaaggctgaacttcgaata

SEQ ID NO: 197862 - DNA, 25 bp, E. coli
ccgtaattggtttgggcgacagcct

SEQ ID NO: 197863 - DNA, 25 bp, E. coli
cgtaaaatggtgcacgagctggccc

SEQ ID NO: 197864 - DNA, 25 bp, E. coli
cgtaaaatggtggacgagctggccc

SEQ ID NO: 197865 - DNA, 25 bp, E. coli
tggagcaggctgaactcatacccgt

SEQ ID NO: 197866 - DNA, 25 bp, E. coli
tggagcaggctgtactcatacccgt

SEQ ID NO: 197867 - DNA, 25 bp, E. coli
catggcaaccgtattgcgcgataaa

SEQ ID NO: 197868 - DNA, 25 bp, E. coli
catggcaaccgttttgcgcgataaa

SEQ ID NO: 197869 - DNA, 25 bp, E. coli
attttacggcgcaaaccgactgctg

SEQ ID NO: 197870 - DNA, 25 bp, E. coli
attttacggcgctaaccgactgctg

SEQ ID NO: 197871 - DNA, 25 bp, E. coli
tttacggcgctatccgactgctgcc

SEQ ID NO: 197872 - DNA, 25 bp, E. coli
tttacggcgctaaccgactgctgcc

SEQ ID NO: 197873 - DNA, 25 bp, E. coli
tgaggagatcatcgcaaccgttttg

SEQ ID NO: 197874 - DNA, 25 bp, E. coli
tgaggagatcatggcaaccgttttg

SEQ ID NO: 197875 - DNA, 25 bp, E. coli
gagatcatggcaaccgttttgcgcg

SEQ ID NO: 197876 - DNA, 25 bp, E. coli
gagatcatggcatccgttttgcgcg

SEQ ID NO: 197877 - DNA, 25 bp, E. coli
cgactctgtctggaaggctgtaagc

SEQ ID NO: 197878 - DNA, 25 bp, E. coli
cccacgactctgactggaaggctgt

SEQ ID NO: 197879 - DNA, 25 bp, E. coli
cccacgactctgtctggaaggctgt

SEQ ID NO: 197880 - DNA, 25 bp, E. coli
cgactctgtctgcaaggctgtaagc

SEQ ID NO: 197881 - DNA, 25 bp, E. coli
cggagcattttagggcgctaaccga

SEQ ID NO: 197882 - DNA, 25 bp, E. coli
ctctgtctggaacgctgtaagctgt

SEQ ID NO: 197883 - DNA, 25 bp, E. coli
cggagcattttacggcgctaaccga

SEQ ID NO: 197884 - DNA, 25 bp, E. coli
ctctgtctggaaggctgtaagctgt

SEQ ID NO: 197885 - DNA, 25 bp, E. coli
ggcaaccgttttgcgcgataaaccg

SEQ ID NO: 197886 - DNA, 25 bp, E. coli
ggcaaccgttttccgcgataaaccg

SEQ ID NO: 197887 - DNA, 25 bp, E. coli
taaccccggagcattttacggcgct

SEQ ID NO: 197888 - DNA, 25 bp, E. coli
taaccccggagctttttacggcgct

SEQ ID NO: 197889 - DNA, 25 bp, E. coli
aatggtcgtcctttccctgtagatg

SEQ ID NO: 197890 - DNA, 25 bp, E. coli
aatggtcgtcctatccctgtagatg

SEQ ID NO: 197891 - DNA, 25 bp, E. coli
tacgcaggcccctcaaggtttgatt

SEQ ID NO: 197892 - DNA, 25 bp, E. coli
taaagctcatctctgtgggcactgg

SEQ ID NO: 197893 - DNA, 25 bp, E. coli
taaagctcatctgtgtgggcactgg

SEQ ID NO: 197894 - DNA, 25 bp, E. coli
tacgcaggccccacaaggtttgatt

SEQ ID NO: 197895 - DNA, 25 bp, E. coli
taccgcatggagaaatgatgaagca

SEQ ID NO: 197896 - DNA, 25 bp, E. coli
taccgcatggagtaatgatgaagca

SEQ ID NO: 197897 - DNA, 25 bp, E. coli
ttatttaacgatcccacacctgcag

SEQ ID NO: 197898 - DNA, 25 bp, E. coli
ttatttaacgatgccacacctgcag

SEQ ID NO: 197899 - DNA, 25 bp, E. coli
tgtgccagcctgcttcaacacaagg

SEQ ID NO: 197900 - DNA, 25 bp, E. coli
tgtgccagcctggttcaacacaagg

SEQ ID NO: 197901 - DNA, 25 bp, E. coli
tgaagtggaacagcatacgcaggcc

SEQ ID NO: 197902 - DNA, 25 bp, E. coli
tgaagtggaacaccatacgcaggcc

SEQ ID NO: 197903 - DNA, 25 bp, E. coli
gaataacactgtggctgatggtcca

SEQ ID NO: 197904 - DNA, 25 bp, E. coli
gaataacactgtcgctgatggtcca

SEQ ID NO: 197905 - DNA, 25 bp, E. coli
gattgaataatcaacgtggcccggt

SEQ ID NO: 197906 - DNA, 25 bp, E. coli
gattgaataatctacgtggcccggt

SEQ ID NO: 197907 - DNA, 25 bp, E. coli
gttaccgcagtataagcagcagtgg

SEQ ID NO: 197908 - DNA, 25 bp, E. coli
gttaccgcagtaaaagcagcagtgg

SEQ ID NO: 197909 - DNA, 25 bp, E. coli
tggttacacactaaacgagctgccg

SEQ ID NO: 197910 - DNA, 25 bp, E. coli
tggttacacacttaacgagctgccg

SEQ ID NO: 197911 - DNA, 25 bp, E. coli
caagcctttgcggtgtatgagtcgg

SEQ ID NO: 197912 - DNA, 25 bp, E. coli
caagcctttgcgctgtatgagtcgg

SEQ ID NO: 197913 - DNA, 25 bp, E. coli
cataacgcttgtcggcgattcggcc

SEQ ID NO: 197914 - DNA, 25 bp, E. coli
cataacgcttgtgggcgattcggcc

SEQ ID NO: 197915 - DNA, 25 bp, E. coli
taccatgatggatgcggtgaacgcc

SEQ ID NO: 197916 - DNA, 25 bp, E. coli
tatgagtcggtaggaattccgcgca

SEQ ID NO: 197917 - DNA, 25 bp, E. coli
tatgagtcggtacgaattccgcgca

SEQ ID NO: 197918 - DNA, 25 bp, E. coli
taccatgatggaagcggtgaacgcc

SEQ ID NO: 197919 - DNA, 25 bp, E. coli
ttcgcgagacggaagacgatgtcac

SEQ ID NO: 197920 - DNA, 25 bp, E. coli
ttcgcgagacggtagacgatgtcac

SEQ ID NO: 197921 - DNA, 25 bp, E. coli
tgtgcattgaaagcgggcaggcctt

SEQ ID NO: 197922 - DNA, 25 bp, E. coli
tgtgcattgaaaccgggcaggcctt

SEQ ID NO: 197923 - DNA, 25 bp, E. coli
tgacgatcgcggcaatagctggacc

SEQ ID NO: 197924 - DNA, 25 bp, E. coli
tgacgatcgcgggaatagctggacc

SEQ ID NO: 197925 - DNA, 25 bp, E. coli
tgcgcggcggcatgcagtataacct

SEQ ID NO: 197926 - DNA, 25 bp, E. coli
tgcgcggcggcaagcagtataacct

SEQ ID NO: 197927 - DNA, 25 bp, E. coli
ccgtccgcgccagatgttggataaa

SEQ ID NO: 197928 - DNA, 25 bp, E. coli
ccgtccgcgccacatgttggataaa

SEQ ID NO: 197929 - DNA, 25 bp, E. coli
gataaaccgactacatggcgacgct

SEQ ID NO: 197930 - DNA, 25 bp, E. coli
gataaaccgacttcatggcgacgct

SEQ ID NO: 197931 - DNA, 25 bp, E. coli
ggtactgacgcatccggacgtggaa

SEQ ID NO: 197932 - DNA, 25 bp, E. coli
ggtactgacgcaaccggacgtggaa

SEQ ID NO: 197933 - DNA, 25 bp, E. coli
caactgagcgatctcgttgcgctgg

SEQ ID NO: 197934 - DNA, 25 bp, E. coli
caacgaccagagagtgacgtaattc

SEQ ID NO: 197935 - DNA, 25 bp, E. coli
caactgagcgatgtcgttgcgctgg

SEQ ID NO: 197936 - DNA, 25 bp, E. coli
caacgaccagagtgtgacgtaattc

SEQ ID NO: 197937 - DNA, 25 bp, E. coli
tacaagaacatcctgcaatcgcgcg

SEQ ID NO: 197938 - DNA, 25 bp, E. coli
tacaagaacatcgtgcaatcgcgcg

SEQ ID NO: 197939 - DNA, 25 bp, E. coli
aacgtaccgcaacgttgtcggcgag

SEQ ID NO: 197940 - DNA, 25 bp, E. coli
aacgtaccgcaaggttgtcggcgag

SEQ ID NO: 197941 - DNA, 25 bp, E. coli
tacgccagaagcgattgatgcactg

SEQ ID NO: 197942 - DNA, 25 bp, E. coli
tacgccagaagccattgatgcactg

SEQ ID NO: 197943 - DNA, 25 bp, E. coli
tgtcggcgagtctggttcattaacc

SEQ ID NO: 197944 - DNA, 25 bp, E. coli
tgtcggcgagtcaggttcattaacc

SEQ ID NO: 197945 - DNA, 25 bp, E. coli
gaaaagtgcagggatttacgccaga

SEQ ID NO: 197946 - DNA, 25 bp, E. coli
gaaaagtgcaggcatttacgccaga

SEQ ID NO: 197947 - DNA, 25 bp, E. coli
gaaaatgtccatggctggtcgcagt

SEQ ID NO: 197948 - DNA, 25 bp, E. coli
gaaaatgtccatcgctggtcgcagt

SEQ ID NO: 197949 - DNA, 25 bp, E. coli
cgttaaaagcgcgtgatgagcacga

SEQ ID NO: 197950 - DNA, 25 bp, E. coli
cgttaaaagcgcctgatgagcacga

SEQ ID NO: 197951 - DNA, 25 bp, E. coli
ctggctgggcgaaatacaagaacat

SEQ ID NO: 197952 - DNA, 25 bp, E. coli
ctggctgggcgatatacaagaacat

SEQ ID NO: 197953 - DNA, 25 bp, E. coli
ggttttctgtcgagatcccgccatg

SEQ ID NO: 197954 - DNA, 25 bp, E. coli
ggttttctgtcgtgatcccgccatg

SEQ ID NO: 197955 - DNA, 25 bp, E. coli
caatcggatttgtcggattgagcca

SEQ ID NO: 197956 - DNA, 25 bp, E. coli
caatcggatttgacggattgagcca

SEQ ID NO: 197957 - DNA, 25 bp, E. coli
cacaagtcgtatgttcgttgcgcag

SEQ ID NO: 197958 - DNA, 25 bp, E. coli
cacaagtcgtatcttcgttgcgcag

SEQ ID NO: 197959 - DNA, 25 bp, E. coli
caggtagcgcgggtcaatcggattt

SEQ ID NO: 197960 - DNA, 25 bp, E. coli
caggtagcgcggctcaatcggattt

SEQ ID NO: 197961 - DNA, 25 bp, E. coli
accccagaagttcaaacaaacagca

SEQ ID NO: 197962 - DNA, 25 bp, E. coli
accccagaagttgaaacaaacagca

SEQ ID NO: 197963 - DNA, 25 bp, E. coli
tagcgcggctcaatcggatttgtcg

SEQ ID NO: 197964 - DNA, 25 bp, E. coli
tagcgcggctcattcggatttgtcg

SEQ ID NO: 197965 - DNA, 25 bp, E. coli
tgagccaataataaacaacgaaata

SEQ ID NO: 197966 - DNA, 25 bp, E. coli
tgagccaataattaacaacgaaata

SEQ ID NO: 197967 - DNA, 25 bp, E. coli
tcgtatcttcgttgcgcaggtagcg

SEQ ID NO: 197968 - DNA, 25 bp, E. coli
tcgtatcttcgtagcgcaggtagcg

SEQ ID NO: 197969 - DNA, 25 bp, E. coli
cgttgcgcaggtagcgcggctcaat

SEQ ID NO: 197970 - DNA, 25 bp, E. coli
cgttgcgcaggttgcgcggctcaat

SEQ ID NO: 197971 - DNA, 25 bp, E. coli
cggatttgtcggattgagccaataa

SEQ ID NO: 197972 - DNA, 25 bp, E. coli
cggatttgtcggtttgagccaataa

SEQ ID NO: 197973 - DNA, 25 bp, E. coli
gttcaaacaaacagcacaagtcgta

SEQ ID NO: 197974 - DNA, 25 bp, E. coli
gttcaaacaaactgcacaagtcgta

SEQ ID NO: 197975 - DNA, 25 bp, E. coli
ggattgagccaaaaataaacaacga

SEQ ID NO: 197976 - DNA, 25 bp, E. coli
ggattgagccaataataaacaacga

SEQ ID NO: 197977 - DNA, 25 bp, E. coli
caggcactgtatcgaaagctgcatc

SEQ ID NO: 197978 - DNA, 25 bp, E. coli
cttactctgggattttgtagcggac

SEQ ID NO: 197979 - DNA, 25 bp, E. coli
cttactctgggaatttgtagcggac

SEQ ID NO: 197980 - DNA, 25 bp, E. coli
caggcactgtatggaaagctgcatc

SEQ ID NO: 197981 - DNA, 25 bp, E. coli
tgtagcggacgtatccggagcaagt

SEQ ID NO: 197982 - DNA, 25 bp, E. coli
tgtagcggacgtttccggagcaagt

SEQ ID NO: 197983 - DNA, 25 bp, E. coli
tcgccctgatgtcgattctgctgat

SEQ ID NO: 197984 - DNA, 25 bp, E. coli
tcgccctgatgtggattctgctgat

SEQ ID NO: 197985 - DNA, 25 bp, E. coli
gctgtcatggacgtcactgaaagaa

SEQ ID NO: 197986 - DNA, 25 bp, E. coli
gctgtcatggacctcactgaaagaa

SEQ ID NO: 197987 - DNA, 25 bp, E. coli
gaaagaatccctaacgcaggcactg

SEQ ID NO: 197988 - DNA, 25 bp, E. coli
gaaagaatcccttacgcaggcactg

SEQ ID NO: 197989 - DNA, 25 bp, E. coli
cattaactctcggtggctggcttgg

SEQ ID NO: 197990 - DNA, 25 bp, E. coli
cattaactctcgctggctggcttgg

SEQ ID NO: 197991 - DNA, 25 bp, E. coli
gattaatgctgttactgtcgcaggc

SEQ ID NO: 197992 - DNA, 25 bp, E. coli
gattaatgctgtaactgtcgcaggc

SEQ ID NO: 197993 - DNA, 25 bp, E. coli
ggtgcaaaaagtggcctatattctg

SEQ ID NO: 197994 - DNA, 25 bp, E. coli
ggtgcaaaaagtcgcctatattctg

SEQ ID NO: 197995 - DNA, 25 bp, E. coli
tggttacgctgtagccaccggatta

SEQ ID NO: 197996 - DNA, 25 bp, E. coli
tggttacgctgttgccaccggatta

SEQ ID NO: 197997 - DNA, 25 bp, E. coli
gagcaagtttttgccgctgtcatgg

SEQ ID NO: 197998 - DNA, 25 bp, E. coli
gagcaagtttttcccgctgtcatgg

SEQ ID NO: 197999 - DNA, 25 bp, E. coli
caatggaattgatcaccctgggcgc

SEQ ID NO: 198000 - DNA, 25 bp, E. coli
aaggcatgctgccattctcaaccga

SEQ ID NO: 198001 - DNA, 25 bp, E. coli
aaggcatgctgcgattctcaaccga

SEQ ID NO: 198002 - DNA, 25 bp, E. coli
caatggaattgaacaccctgggcgc

SEQ ID NO: 198003 - DNA, 25 bp, E. coli
cagatgctggaaagcgaaacacagt

SEQ ID NO: 198004 - DNA, 25 bp, E. coli
cagatgctggaatgcgaaacacagt

SEQ ID NO: 198005 - DNA, 25 bp, E. coli
taccgtttataccttgaacagtgcc

SEQ ID NO: 198006 - DNA, 25 bp, E. coli
taccgtttatacgttgaacagtgcc

SEQ ID NO: 198007 - DNA, 25 bp, E. coli
tgccgatattatgccacaactgctg

SEQ ID NO: 198008 - DNA, 25 bp, E. coli
tgccgatattatcccacaactgctg

SEQ ID NO: 198009 - DNA, 25 bp, E. coli
tgctggatgaactgagagtacaggc

SEQ ID NO: 198010 - DNA, 25 bp, E. coli
tgctggatgaacagagagtacaggc

SEQ ID NO: 198011 - DNA, 25 bp, E. coli
cctgggcgctcgtttgcagatgctg

SEQ ID NO: 198012 - DNA, 25 bp, E. coli
cctgggcgctcgattgcagatgctg

SEQ ID NO: 198013 - DNA, 25 bp, E. coli
gcattaacccgtccctggacattgg

SEQ ID NO: 198014 - DNA, 25 bp, E. coli
gcattaacccgtgcctggacattgg

SEQ ID NO: 198015 - DNA, 25 bp, E. coli
gtaaactttcccagaatcctgccga

SEQ ID NO: 198016 - DNA, 25 bp, E. coli
gtaaactttccctgaatcctgccga

SEQ ID NO: 198017 - DNA, 25 bp, E. coli
gaagcgcgggattttcagctggcaa

SEQ ID NO: 198018 - DNA, 25 bp, E. coli
gaagcgcgggatattcagctggcaa

SEQ ID NO: 198019 - DNA, 25 bp, E. coli
cgtcgatgcggtgatcaaagcctac

SEQ ID NO: 198020 - DNA, 25 bp, E. coli
cgtcgatgcggtcatcaaagcctac

SEQ ID NO: 198021 - DNA, 25 bp, E. coli
cacatggtcaagtgaatgaggcgat

SEQ ID NO: 198022 - DNA, 25 bp, E. coli
cacatggtcaagagaatgaggcgat

SEQ ID NO: 198023 - DNA, 25 bp, E. coli
taaattgttcggagataaggagcct

SEQ ID NO: 198024 - DNA, 25 bp, E. coli
taaattgttcggtgataaggagcct

SEQ ID NO: 198025 - DNA, 25 bp, E. coli
aaaaagcatcagttattagcgcggg

SEQ ID NO: 198026 - DNA, 25 bp, E. coli
aaaaagcatcagatattagcgcggg

SEQ ID NO: 198027 - DNA, 25 bp, E. coli
tgctgaaagcttggtatccccgttt

SEQ ID NO: 198028 - DNA, 25 bp, E. coli
tgctgaaagcttcgtatccccgttt

SEQ ID NO: 198029 - DNA, 25 bp, E. coli
tcttctgatgctgaacaaatcgctg

SEQ ID NO: 198030 - DNA, 25 bp, E. coli
tcttctgatgctcaacaaatcgctg

SEQ ID NO: 198031 - DNA, 25 bp, E. coli
gaattaggtctgtttacccggaggg

SEQ ID NO: 198032 - DNA, 25 bp, E. coli
gaattaggtctgattacccggaggg

SEQ ID NO: 198033 - DNA, 25 bp, E. coli
gattgaagcacttagagatcctgtc

SEQ ID NO: 198034 - DNA, 25 bp, E. coli
gattgaagcactaagagatcctgtc

SEQ ID NO: 198035 - DNA, 25 bp, E. coli
gtcgaatccttttagcaacgtgccg

SEQ ID NO: 198036 - DNA, 25 bp, E. coli
gtcgaatcctttaagcaacgtgccg

SEQ ID NO: 198037 - DNA, 25 bp, E. coli
gatgaagttgtttcccaggtcgaat

SEQ ID NO: 198038 - DNA, 25 bp, E. coli
gagcagaatgctatctccgaattag

SEQ ID NO: 198039 - DNA, 25 bp, E. coli
gatgaagttgttacccaggtcgaat

SEQ ID NO: 198040 - DNA, 25 bp, E. coli
gagcagaatgctttctccgaattag

SEQ ID NO: 198041 - DNA, 25 bp, E. coli
gagcgttccttggaggtatgccata

SEQ ID NO: 198042 - DNA, 25 bp, E. coli
gagcgttccttgcaggtatgccata

SEQ ID NO: 198043 - DNA, 25 bp, E. coli
caactggcaagcaaccacatcagaa

SEQ ID NO: 198044 - DNA, 25 bp, E. coli
caactggcaagctaccacatcagaa

SEQ ID NO: 198045 - DNA, 25 bp, E. coli
catccagaatttctttgataaccaa

SEQ ID NO: 198046 - DNA, 25 bp, E. coli
catcgagaacatccagaatttgttt

SEQ ID NO: 198047 - DNA, 25 bp, E. coli
catcgagaacatgcagaatttgttt

SEQ ID NO: 198048 - DNA, 25 bp, E. coli
catccagaatttgtttgataaccaa

SEQ ID NO: 198049 - DNA, 25 bp, E. coli
ttgcccgcatggagaccgggtctgc

SEQ ID NO: 198050 - DNA, 25 bp, E. coli
ttgcccgcatggtgaccgggtctgc

SEQ ID NO: 198051 - DNA, 25 bp, E. coli
tgtttgataaccaactggcaagcaa

SEQ ID NO: 198052 - DNA, 25 bp, E. coli
tgtttgataacctactggcaagcaa

SEQ ID NO: 198053 - DNA, 25 bp, E. coli
gctttttggattgcccgcatggtga

SEQ ID NO: 198054 - DNA, 25 bp, E. coli
gcgatggctttttggattgcccgca

SEQ ID NO: 198055 - DNA, 25 bp, E. coli
gcgatggcttttaggattgcccgca

SEQ ID NO: 198056 - DNA, 25 bp, E. coli
gctttttggattccccgcatggtga

SEQ ID NO: 198057 - DNA, 25 bp, E. coli
gaatttgtttgaaaaccaactggca

SEQ ID NO: 198058 - DNA, 25 bp, E. coli
gaatttgtttgataaccaactggca

SEQ ID NO: 198059 - DNA, 25 bp, E. coli
gattgcccgcatcgtgaccgggtct

SEQ ID NO: 198060 - DNA, 25 bp, E. coli
gattgcccgcatggtgaccgggtct

SEQ ID NO: 198061 - DNA, 25 bp, E. coli
tgataaccaactcgcaagcaaccac

SEQ ID NO: 198062 - DNA, 25 bp, E. coli
tgataaccaactggcaagcaaccac

SEQ ID NO: 198063 - DNA, 25 bp, E. coli
tggcaagcaacctcatcagaaacca

SEQ ID NO: 198064 - DNA, 25 bp, E. coli
tggcaagcaaccacatcagaaacca

SEQ ID NO: 198065 - DNA, 25 bp, E. coli
caattatcatgcaggcgcagagcct

SEQ ID NO: 198066 - DNA, 25 bp, E. coli
caattatcatgctggcgcagagcct

SEQ ID NO: 198067 - DNA, 25 bp, E. coli
tactgcgtatccagcaaccggatgg

SEQ ID NO: 198068 - DNA, 25 bp, E. coli
tactgcgtatcctgcaaccggatgg

SEQ ID NO: 198069 - DNA, 25 bp, E. coli
aaatgcgatgcgcttcccggtgtcg

SEQ ID NO: 198070 - DNA, 25 bp, E. coli
aaatgcgatgcggttcccggtgtcg

SEQ ID NO: 198071 - DNA, 25 bp, E. coli
tggttacagccagaggtcgagatga

SEQ ID NO: 198072 - DNA, 25 bp, E. coli
gaatcgctataacacggctacgcaa

SEQ ID NO: 198073 - DNA, 25 bp, E. coli
gaatcgctataagacggctacgcaa

SEQ ID NO: 198074 - DNA, 25 bp, E. coli
cgagcgcctgccgattgaacgtatt

SEQ ID NO: 198075 - DNA, 25 bp, E. coli
cgagcgcctgcccattgaacgtatt

SEQ ID NO: 198076 - DNA, 25 bp, E. coli
gatttgccgaacaaagccttgctga

SEQ ID NO: 198077 - DNA, 25 bp, E. coli
gatttgccgaactaagccttgctga

SEQ ID NO: 198078 - DNA, 25 bp, E. coli
ggatatgctggaactgttaacccgc

SEQ ID NO: 198079 - DNA, 25 bp, E. coli
ggatatgctggatctgttaacccgc

SEQ ID NO: 198080 - DNA, 25 bp, E. coli
tggaagtgacagaaagccgacgtat

SEQ ID NO: 198081 - DNA, 25 bp, E. coli
tggcattaccgcgtctgcatcagga

SEQ ID NO: 198082 - DNA, 25 bp, E. coli
tggttacagccacaggtcgagatga

SEQ ID NO: 198083 - DNA, 25 bp, E. coli
tggaagtgacagtaagccgacgtat

SEQ ID NO: 198084 - DNA, 25 bp, E. coli
tggcattaccgcctctgcatcagga

SEQ ID NO: 198085 - DNA, 25 bp, E. coli
gagaaattctgcagctgacgctggt

SEQ ID NO: 198086 - DNA, 25 bp, E. coli
gagaaattctgctgctgacgctggt

SEQ ID NO: 198087 - DNA, 25 bp, E. coli
caaaaacgagcattaaagaactatc

SEQ ID NO: 198088 - DNA, 25 bp, E. coli
caaaaacgagcaataaagaactatc

SEQ ID NO: 198089 - DNA, 25 bp, E. coli
catgttacggaaccgcaactgttta

SEQ ID NO: 198090 - DNA, 25 bp, E. coli
catgttacggaagcgcaactgttta

SEQ ID NO: 198091 - DNA, 25 bp, E. coli
tatgtatcgatgctgaaagacttgg

SEQ ID NO: 198092 - DNA, 25 bp, E. coli
tatgaatcgagactaatttttccgc

SEQ ID NO: 198093 - DNA, 25 bp, E. coli
tatgaatcgagagtaatttttccgc

SEQ ID NO: 198094 - DNA, 25 bp, E. coli
tatgtatcgatggtgaaagacttgg

SEQ ID NO: 198095 - DNA, 25 bp, E. coli
tccgccggctggaataacaaaaacg

SEQ ID NO: 198096 - DNA, 25 bp, E. coli
tccgccggctggtataacaaaaacg

SEQ ID NO: 198097 - DNA, 25 bp, E. coli
ccggctggaatatcaaaaacgagca

SEQ ID NO: 198098 - DNA, 25 bp, E. coli
ccggctggaataacaaaaacgagca

SEQ ID NO: 198099 - DNA, 25 bp, E. coli
gcaataaagaacaatcaaatgacca

SEQ ID NO: 198100 - DNA, 25 bp, E. coli
gaagcgcaactgattaatttgaaac

SEQ ID NO: 198101 - DNA, 25 bp, E. coli
gcaataaagaactatcaaatgacca

SEQ ID NO: 198102 - DNA, 25 bp, E. coli
gaagcgcaactgtttaatttgaaac

SEQ ID NO: 198103 - DNA, 25 bp, E. coli
gaaacaaaaaacttatgtatcgatg

SEQ ID NO: 198104 - DNA, 25 bp, E. coli
gaaacaaaaaacatatgtatcgatg

SEQ ID NO: 198105 - DNA, 25 bp, E. coli
gaaagacttggtgagtcgattccag

SEQ ID NO: 198106 - DNA, 25 bp, E. coli
gaaagacttggtcagtcgattccag

SEQ ID NO: 198107 - DNA, 25 bp, E. coli
tcaaatgaccatgttacggaagcgc

SEQ ID NO: 198108 - DNA, 25 bp, E. coli
tcaaatgaccatcttacggaagcgc

SEQ ID NO: 198109 - DNA, 25 bp, E. coli
catttcctctgaaaagaaactaact

SEQ ID NO: 198110 - DNA, 25 bp, E. coli
catttcctctgataagaaactaact

SEQ ID NO: 198111 - DNA, 25 bp, E. coli
aaataaaaatatccggcaggtatgc

SEQ ID NO: 198112 - DNA, 25 bp, E. coli
aaataaaaatatgcggcaggtatgc

SEQ ID NO: 198113 - DNA, 25 bp, E. coli
tgtctatttcatatcctctgaaaag

SEQ ID NO: 198114 - DNA, 25 bp, E. coli
tgtttttaatgaaggatatgctcgg

SEQ ID NO: 198115 - DNA, 25 bp, E. coli
tgtttttaatgatggatatgctcgg

SEQ ID NO: 198116 - DNA, 25 bp, E. coli
tgtctatttcatttcctctgaaaag

SEQ ID NO: 198117 - DNA, 25 bp, E. coli
tcctctgaaaagtaactaactattc

SEQ ID NO: 198118 - DNA, 25 bp, E. coli
tcctctgaaaagaaactaactattc

SEQ ID NO: 198119 - DNA, 25 bp, E. coli
gctcggagttggagatgcaattaat

SEQ ID NO: 198120 - DNA, 25 bp, E. coli
gctcggagttggtgatgcaattaat

SEQ ID NO: 198121 - DNA, 25 bp, E. coli
cggagttggagatgcaattaatatt

SEQ ID NO: 198122 - DNA, 25 bp, E. coli
cggagttggagaagcaattaatatt

SEQ ID NO: 198123 - DNA, 25 bp, E. coli
gatatgctcggagttggagatgcaa

SEQ ID NO: 198124 - DNA, 25 bp, E. coli
gatatgctcggacttggagatgcaa

SEQ ID NO: 198125 - DNA, 25 bp, E. coli
ggagatgcaattaatattaatacaa

SEQ ID NO: 198126 - DNA, 25 bp, E. coli
ggagatgcaatttatattaatacaa

SEQ ID NO: 198127 - DNA, 25 bp, E. coli
taatgatggatatgctcggagttgg

SEQ ID NO: 198128 - DNA, 25 bp, E. coli
taatacaaataaaaatatccggcag

SEQ ID NO: 198129 - DNA, 25 bp, E. coli
taatgatggataagctcggagttgg

SEQ ID NO: 198130 - DNA, 25 bp, E. coli
taatacaaataataatatccggcag

SEQ ID NO: 198131 - DNA, 25 bp, E. coli
ttgtgcgcgccgcaaaggtcatgca

SEQ ID NO: 198132 - DNA, 25 bp, E. coli
ttgtgcgcgccggaaaggtcatgca

SEQ ID NO: 198133 - DNA, 25 bp, E. coli
cctgtacgccagatgaagccgggat

SEQ ID NO: 198134 - DNA, 25 bp, E. coli
cctgtacgccagttgaagccgggat

SEQ ID NO: 198135 - DNA, 25 bp, E. coli
gaaagtattctttgcgaacaaggac

SEQ ID NO: 198136 - DNA, 25 bp, E. coli
gaacaaggacatcaactgctggcta

SEQ ID NO: 198137 - DNA, 25 bp, E. coli
gaaagtattcttagcgaacaaggac

SEQ ID NO: 198138 - DNA, 25 bp, E. coli
gaacaaggacatgaactgctggcta

SEQ ID NO: 198139 - DNA, 25 bp, E. coli
ccgggatctcccttgacgttattcg

SEQ ID NO: 198140 - DNA, 25 bp, E. coli
ccgggatctcccatgacgttattcg

SEQ ID NO: 198141 - DNA, 25 bp, E. coli
gattcttggcgtgtgcctcggtcat

SEQ ID NO: 198142 - DNA, 25 bp, E. coli
gataactacgatacttttacctgga

SEQ ID NO: 198143 - DNA, 25 bp, E. coli
gattcttggcgtctgcctcggtcat

SEQ ID NO: 198144 - DNA, 25 bp, E. coli
gatatcgacgcccttaaaccacaaa

SEQ ID NO: 198145 - DNA, 25 bp, E. coli
gatatcgacgccgttaaaccacaaa

SEQ ID NO: 198146 - DNA, 25 bp, E. coli
ggtcatcaggcattggcgcaggcat

SEQ ID NO: 198147 - DNA, 25 bp, E. coli
ggaacctctaccagtacttttgtga

SEQ ID NO: 198148 - DNA, 25 bp, E. coli
ggtcatcaggcaatggcgcaggcat

SEQ ID NO: 198149 - DNA, 25 bp, E. coli
ggtcatgcacggcaaaacctcgccg

SEQ ID NO: 198150 - DNA, 25 bp, E. coli
ggtcatgcacgggaaaacctcgccg

SEQ ID NO: 198151 - DNA, 25 bp, E. coli
ggaacctctacctgtacttttgtga

SEQ ID NO: 198152 - DNA, 25 bp, E. coli
gataactacgattcttttacctgga

SEQ ID NO: 198153 - DNA, 25 bp, E. coli
aacgattggcgttactgagcggctc

SEQ ID NO: 198154 - DNA, 25 bp, E. coli
aagatggtgttaactcccgggagca

SEQ ID NO: 198155 - DNA, 25 bp, E. coli
aagatggtgttatctcccgggagca

SEQ ID NO: 198156 - DNA, 25 bp, E. coli
taacagctctgaccaacgatgcggc

SEQ ID NO: 198157 - DNA, 25 bp, E. coli
tatgccccttactgaagaacctgag

SEQ ID NO: 198158 - DNA, 25 bp, E. coli
taaaacgttcgaactggtcgcagag

SEQ ID NO: 198159 - DNA, 25 bp, E. coli
taaaacgttcgatctggtcgcagag

SEQ ID NO: 198160 - DNA, 25 bp, E. coli
tatgccccttacagaagaacctgag

SEQ ID NO: 198161 - DNA, 25 bp, E. coli
taacagctctgagcaacgatgcggc

SEQ ID NO: 198162 - DNA, 25 bp, E. coli
aacgattggcgtaactgagcggctc

SEQ ID NO: 198163 - DNA, 25 bp, E. coli
tatctacactatcgtcagacccggc

SEQ ID NO: 198164 - DNA, 25 bp, E. coli
tatctacactatggtcagacccggc

SEQ ID NO: 198165 - DNA, 25 bp, E. coli
tttacactcggctctgatggtcagg

SEQ ID NO: 198166 - DNA, 25 bp, E. coli
tttacactcggcactgatggtcagg

SEQ ID NO: 198167 - DNA, 25 bp, E. coli
gaaaatcaagtttctccctcgtgga

SEQ ID NO: 198168 - DNA, 25 bp, E. coli
gaaaatcaagttactccctcgtgga

SEQ ID NO: 198169 - DNA, 25 bp, E. coli
gactctggtcaggaatcggcggaaa

SEQ ID NO: 198170 - DNA, 25 bp, E. coli
gactctggtcagcaatcggcggaaa

SEQ ID NO: 198171 - DNA, 25 bp, E. coli
gttcatgactggtagagacgctctg

SEQ ID NO: 198172 - DNA, 25 bp, E. coli
gttcatgactggaagagacgctctg

SEQ ID NO: 198173 - DNA, 25 bp, E. coli
gacccggctggtatgattacaacaa

SEQ ID NO: 198174 - DNA, 25 bp, E. coli
gacccggctggtttgattacaacaa

SEQ ID NO: 198175 - DNA, 25 bp, E. coli
caactatgcgtttatgattgcgtcg

SEQ ID NO: 198176 - DNA, 25 bp, E. coli
caactatgcgttaatgattgcgtcg

SEQ ID NO: 198177 - DNA, 25 bp, E. coli
aaagcagttctcatttcaggtgtta

SEQ ID NO: 198178 - DNA, 25 bp, E. coli
aaagcagttctcttttcaggtgtta

SEQ ID NO: 198179 - DNA, 25 bp, E. coli
tacgaagtcgttactgttatgcaaa

SEQ ID NO: 198180 - DNA, 25 bp, E. coli
tacgaagtcgtttctgttatgcaaa

SEQ ID NO: 198181 - DNA, 25 bp, E. coli
tatacacacgttcctgaagaaagct

SEQ ID NO: 198182 - DNA, 25 bp, E. coli
tatacacacgttgctgaagaaagct

SEQ ID NO: 198183 - DNA, 25 bp, E. coli
tgcaaaccatttttgccgaaaggct

SEQ ID NO: 198184 - DNA, 25 bp, E. coli
tgagtctctccatttaagtacgaag

SEQ ID NO: 198185 - DNA, 25 bp, E. coli
tgcaaaccatttatgccgaaaggct

SEQ ID NO: 198186 - DNA, 25 bp, E. coli
tgagtctctccaattaagtacgaag

SEQ ID NO: 198187 - DNA, 25 bp, E. coli
gaagaacagacgttatacgaagtag

SEQ ID NO: 198188 - DNA, 25 bp, E. coli
gaagaacagacgatatacgaagtag

SEQ ID NO: 198189 - DNA, 25 bp, E. coli
ccgaaaggctcatgttaaggaatgt

SEQ ID NO: 198190 - DNA, 25 bp, E. coli
ccgaaaggctcaagttaaggaatgt

SEQ ID NO: 198191 - DNA, 25 bp, E. coli
gataacttggcggactatacacacg

SEQ ID NO: 198192 - DNA, 25 bp, E. coli
gataacttggcgcactatacacacg

SEQ ID NO: 198193 - DNA, 25 bp, E. coli
gattgcgtcggtatgaagaacagac

SEQ ID NO: 198194 - DNA, 25 bp, E. coli
gattgcgtcggtttgaagaacagac

SEQ ID NO: 198195 - DNA, 25 bp, E. coli
gatggctggatgtctaaaataaaca

SEQ ID NO: 198196 - DNA, 25 bp, E. coli
gatggctggatgactaaaataaaca

SEQ ID NO: 198197 - DNA, 25 bp, E. coli
aaggcgtggttgttctgcacggctt

SEQ ID NO: 198198 - DNA, 25 bp, E. coli
aaggcgtggttgatctgcacggctt

SEQ ID NO: 198199 - DNA, 25 bp, E. coli
aggcgtggttgaactgcacggcttt

SEQ ID NO: 198200 - DNA, 25 bp, E. coli
atctgcacggctatgccaccaacgg

SEQ ID NO: 198201 - DNA, 25 bp, E. coli
aggcgtggttgatctgcacggcttt

SEQ ID NO: 198202 - DNA, 25 bp, E. coli
atctgcacggctttgccaccaacgg

SEQ ID NO: 198203 - DNA, 25 bp, E. coli
tgatctgcacggctttgccaccaac

SEQ ID NO: 198204 - DNA, 25 bp, E. coli
tgatctgcacgggtttgccaccaac

SEQ ID NO: 198205 - DNA, 25 bp, E. coli
tctgcacggctttgccaccaacggt

SEQ ID NO: 198206 - DNA, 25 bp, E. coli
tctgcacggcttagccaccaacggt

SEQ ID NO: 198207 - DNA, 25 bp, E. coli
gcgtggttgatcagcacggctttgc

SEQ ID NO: 198208 - DNA, 25 bp, E. coli
gcgtggttgatctgcacggctttgc

SEQ ID NO: 198209 - DNA, 25 bp, E. coli
cgtggttgatctgcacggctttgcc

SEQ ID NO: 198210 - DNA, 25 bp, E. coli
cgtggttgatctccacggctttgcc

SEQ ID NO: 198211 - DNA, 25 bp, E. coli
gatctgcacggcattgccaccaacg

SEQ ID NO: 198212 - DNA, 25 bp, E. coli
gtggttgatctgcacggctttgcca

SEQ ID NO: 198213 - DNA, 25 bp, E. coli
gtggttgatctggacggctttgcca

SEQ ID NO: 198214 - DNA, 25 bp, E. coli
ggttgatctgcagggctttgccacc

SEQ ID NO: 198215 - DNA, 25 bp, E. coli
ggttgatctgcacggctttgccacc

SEQ ID NO: 198216 - DNA, 25 bp, E. coli
tggttgatctgctcggctttgccac

SEQ ID NO: 198217 - DNA, 25 bp, E. coli
tggttgatctgcacggctttgccac

SEQ ID NO: 198218 - DNA, 25 bp, E. coli
gatctgcacggctttgccaccaacg

SEQ ID NO: 198219 - DNA, 25 bp, E. coli
cacatcgttcgcattatcggtctac

SEQ ID NO: 198220 - DNA, 25 bp, E. coli
cacatcgttcgctttatcggtctac

SEQ ID NO: 198221 - DNA, 25 bp, E. coli
tactaaacgcatgttctttgcgcgg

SEQ ID NO: 198222 - DNA, 25 bp, E. coli
tactaaacgcatcttctttgcgcgg

SEQ ID NO: 198223 - DNA, 25 bp, E. coli
acgagtgagcggcatccagcattaa

SEQ ID NO: 198224 - DNA, 25 bp, E. coli
acgagtgagcgggatccagcattaa

SEQ ID NO: 198225 - DNA, 25 bp, E. coli
aaacgcatcttcattgcgcggtaga

SEQ ID NO: 198226 - DNA, 25 bp, E. coli
aaacgcatcttctttgcgcggtaga

SEQ ID NO: 198227 - DNA, 25 bp, E. coli
tatcggtctactactactaaacgca

SEQ ID NO: 198228 - DNA, 25 bp, E. coli
tatcggtctacttctactaaacgca

SEQ ID NO: 198229 - DNA, 25 bp, E. coli
ttctttgcgcggtagacgagtgagc

SEQ ID NO: 198230 - DNA, 25 bp, E. coli
ttctttgcgcggaagacgagtgagc

SEQ ID NO: 198231 - DNA, 25 bp, E. coli
tgactcacatcgatcgctttatcgg

SEQ ID NO: 198232 - DNA, 25 bp, E. coli
tgactcacatcgttcgctttatcgg

SEQ ID NO: 198233 - DNA, 25 bp, E. coli
cgttcgctttatgggtctactacta

SEQ ID NO: 198234 - DNA, 25 bp, E. coli
cgcatcttctttgcgcggtagacga

SEQ ID NO: 198235 - DNA, 25 bp, E. coli
cgcatcttctttccgcggtagacga

SEQ ID NO: 198236 - DNA, 25 bp, E. coli
cgttcgctttatcggtctactacta

SEQ ID NO: 198237 - DNA, 25 bp, E. coli
gtagacgagtgagcggcatccagca

SEQ ID NO: 198238 - DNA, 25 bp, E. coli
ggtctactactactaaacgcatctt

SEQ ID NO: 198239 - DNA, 25 bp, E. coli
ggtctactactagtaaacgcatctt

SEQ ID NO: 198240 - DNA, 25 bp, E. coli
gtagacgagtgaccggcatccagca

SEQ ID NO: 198241 - DNA, 25 bp, E. coli
aatgattatggtgcgcgtttgccgc

SEQ ID NO: 198242 - DNA, 25 bp, E. coli
aatgattatggtccgcgtttgccgc

SEQ ID NO: 198243 - DNA, 25 bp, E. coli
cagaaaaatggctatccggcagcgg

SEQ ID NO: 198244 - DNA, 25 bp, E. coli
cagggtaacaggattagctcgccac

SEQ ID NO: 198245 - DNA, 25 bp, E. coli
cagaaaaatggcaatccggcagcgg

SEQ ID NO: 198246 - DNA, 25 bp, E. coli
cagggtaacaggtttagctcgccac

SEQ ID NO: 198247 - DNA, 25 bp, E. coli
taacgacccgaatatgccgtatctg

SEQ ID NO: 198248 - DNA, 25 bp, E. coli
tgataaatcaatgagcgtcacgctg

SEQ ID NO: 198249 - DNA, 25 bp, E. coli
tgataaatcaatcagcgtcacgctg

SEQ ID NO: 198250 - DNA, 25 bp, E. coli
gccgtatctggcacaaagctggatg

SEQ ID NO: 198251 - DNA, 25 bp, E. coli
gccgtatctggctcaaagctggatg

SEQ ID NO: 198252 - DNA, 25 bp, E. coli
cgtcagcatgaaaaacccgtggcag

SEQ ID NO: 198253 - DNA, 25 bp, E. coli
cctcagtggtcacgagtttaccgtc

SEQ ID NO: 198254 - DNA, 25 bp, E. coli
cctcagtggtcaggagtttaccgtc

SEQ ID NO: 198255 - DNA, 25 bp, E. coli
cgtcagcatgaataacccgtggcag

SEQ ID NO: 198256 - DNA, 25 bp, E. coli
ggatatcaacaagctgcctgccgac

SEQ ID NO: 198257 - DNA, 25 bp, E. coli
ggatatcaacaacctgcctgccgac

SEQ ID NO: 198258 - DNA, 25 bp, E. coli
taaaagtcaaaaaggatagcgtccc

SEQ ID NO: 198259 - DNA, 25 bp, E. coli
taacgacccgaaaatgccgtatctg

SEQ ID NO: 198260 - DNA, 25 bp, E. coli
taaaagtcaaaatggatagcgtccc

SEQ ID NO: 198261 - DNA, 25 bp, E. coli
taaggtgacctttaccctcagtggt

SEQ ID NO: 198262 - DNA, 25 bp, E. coli
taaggtgaccttaaccctcagtggt

SEQ ID NO: 198263 - DNA, 25 bp, E. coli
aactggaggcttaacgtcatgtcgg

SEQ ID NO: 198264 - DNA, 25 bp, E. coli
cagaggccatacttttttgcaggca

SEQ ID NO: 198265 - DNA, 25 bp, E. coli
cagaggccatacatttttgcaggca

SEQ ID NO: 198266 - DNA, 25 bp, E. coli
aactggaggctttacgtcatgtcgg

SEQ ID NO: 198267 - DNA, 25 bp, E. coli
tatggacagtttaagcgtggaaccg

SEQ ID NO: 198268 - DNA, 25 bp, E. coli
tatggacagttttagcgtggaaccg

SEQ ID NO: 198269 - DNA, 25 bp, E. coli
tatatggaacagagccgtgcaaccc

SEQ ID NO: 198270 - DNA, 25 bp, E. coli
tatatggaacagtgccgtgcaaccc

SEQ ID NO: 198271 - DNA, 25 bp, E. coli
tgtacgcgccaatacgtcagtagtg

SEQ ID NO: 198272 - DNA, 25 bp, E. coli
tgtacgcgccaaaacgtcagtagtg

SEQ ID NO: 198273 - DNA, 25 bp, E. coli
tcgccttagtgctagagggcatcgc

SEQ ID NO: 198274 - DNA, 25 bp, E. coli
tcgccttagtgcaagagggcatcgc

SEQ ID NO: 198275 - DNA, 25 bp, E. coli
tcactgaacttatccgacgcaacgc

SEQ ID NO: 198276 - DNA, 25 bp, E. coli
tcactgaacttaaccgacgcaacgc

SEQ ID NO: 198277 - DNA, 25 bp, E. coli
gaacagcttgttctgagaggccgca

SEQ ID NO: 198278 - DNA, 25 bp, E. coli
gaacagcttgttgtgagaggccgca

SEQ ID NO: 198279 - DNA, 25 bp, E. coli
ggagatacagctaaacagaggccat

SEQ ID NO: 198280 - DNA, 25 bp, E. coli
ggagatacagcttaacagaggccat

SEQ ID NO: 198281 - DNA, 25 bp, E. coli
gagggcatcgccttctcgcagaaaa

SEQ ID NO: 198282 - DNA, 25 bp, E. coli
gagaggccgcacaatgagacttcat

SEQ ID NO: 198283 - DNA, 25 bp, E. coli
gagggcatcgccatctcgcagaaaa

SEQ ID NO: 198284 - DNA, 25 bp, E. coli
gagaggccgcactatgagacttcat

SEQ ID NO: 198285 - DNA, 25 bp, E. coli
catctgtcttcgctttcatttttgg

SEQ ID NO: 198286 - DNA, 25 bp, E. coli
catctgtcttcggtttcatttttgg

SEQ ID NO: 198287 - DNA, 25 bp, E. coli
agtcaggcgccagagccgttgaaaa

SEQ ID NO: 198288 - DNA, 25 bp, E. coli
agtcaggcgccacagccgttgaaaa

SEQ ID NO: 198289 - DNA, 25 bp, E. coli
tgtcgcgagtcaatcatctgtcttc

SEQ ID NO: 198290 - DNA, 25 bp, E. coli
tgtcgcgagtcattcatctgtcttc

SEQ ID NO: 198291 - DNA, 25 bp, E. coli
tcaggcgccacagccgttgaaaaag

SEQ ID NO: 198292 - DNA, 25 bp, E. coli
tcaggcgccacacccgttgaaaaag

SEQ ID NO: 198293 - DNA, 25 bp, E. coli
gtcttcgctttcatttttggcggtt

SEQ ID NO: 198294 - DNA, 25 bp, E. coli
gtcttcgctttcttttttggcggtt

SEQ ID NO: 198295 - DNA, 25 bp, E. coli
ctgtcttcgctttcatttttggcgg

SEQ ID NO: 198296 - DNA, 25 bp, E. coli
ctgtcttcgcttacatttttggcgg

SEQ ID NO: 198297 - DNA, 25 bp, E. coli
gtcaatcatctgacttcgctttcat

SEQ ID NO: 198298 - DNA, 25 bp, E. coli
ggtgtagcagtctggcgccacagcc

SEQ ID NO: 198299 - DNA, 25 bp, E. coli
gtcgcgagtcaaacatctgtcttcg

SEQ ID NO: 198300 - DNA, 25 bp, E. coli
gtcgcgagtcaatcatctgtcttcg

SEQ ID NO: 198301 - DNA, 25 bp, E. coli
gtcaatcatctgtcttcgctttcat

SEQ ID NO: 198302 - DNA, 25 bp, E. coli
ggtgtagcagtcaggcgccacagcc

SEQ ID NO: 198303 - DNA, 25 bp, E. coli
ggcgccacagccgttgaaaaagggc

SEQ ID NO: 198304 - DNA, 25 bp, E. coli
ggcgccacagcccttgaaaaagggc

SEQ ID NO: 198305 - DNA, 25 bp, E. coli
gagtcaatcatctgtcttcgctttc

SEQ ID NO: 198306 - DNA, 25 bp, E. coli
gagtcaatcatcagtcttcgctttc

SEQ ID NO: 198307 - DNA, 25 bp, E. coli
aaacaacgatgccttaagcccggcg

SEQ ID NO: 198308 - DNA, 25 bp, E. coli
aaacaacgatgcgttaagcccggcg

SEQ ID NO: 198309 - DNA, 25 bp, E. coli
tatgtccttctaggtgaaagcggtg

SEQ ID NO: 198310 - DNA, 25 bp, E. coli
tatgtccttctacgtgaaagcggtg

SEQ ID NO: 198311 - DNA, 25 bp, E. coli
tgggtatgcacggtatcaaagatcg

SEQ ID NO: 198312 - DNA, 25 bp, E. coli
tgggtatgcacgctatcaaagatcg

SEQ ID NO: 198313 - DNA, 25 bp, E. coli
tcgcaacctggcttaaaaaacccgg

SEQ ID NO: 198314 - DNA, 25 bp, E. coli
tcgcaacctggcataaaaaacccgg

SEQ ID NO: 198315 - DNA, 25 bp, E. coli
tcagatccttggacgcctgcgtgaa

SEQ ID NO: 198316 - DNA, 25 bp, E. coli
tctgaagagaaagcgtccactccgg

SEQ ID NO: 198317 - DNA, 25 bp, E. coli
tctgaagagaaaccgtccactccgg

SEQ ID NO: 198318 - DNA, 25 bp, E. coli
tcagatccttggtcgcctgcgtgaa

SEQ ID NO: 198319 - DNA, 25 bp, E. coli
gaatccgtgggcttcctggtaacga

SEQ ID NO: 198320 - DNA, 25 bp, E. coli
gaatccgtgggcatcctggtaacga

SEQ ID NO: 198321 - DNA, 25 bp, E. coli
tcaaagagttgctggaagatccgac

SEQ ID NO: 198322 - DNA, 25 bp, E. coli
tcaaagagttgcaggaagatccgac

SEQ ID NO: 198323 - DNA, 25 bp, E. coli
gagatcctgccgttgatgtacctgg

SEQ ID NO: 198324 - DNA, 25 bp, E. coli
gatgtcgataccgtcggcatggcag

SEQ ID NO: 198325 - DNA, 25 bp, E. coli
gatgtcgataccctcggcatggcag

SEQ ID NO: 198326 - DNA, 25 bp, E. coli
gacctgcctgaatccgtagccgatg

SEQ ID NO: 198327 - DNA, 25 bp, E. coli
gacctgcctgaaaccgtagccgatg

SEQ ID NO: 198328 - DNA, 25 bp, E. coli
gagatcctgccgatgatgtacctgg

SEQ ID NO: 198329 - DNA, 25 bp, E. coli
caattttaccgcgaagtgggcgtct

SEQ ID NO: 198330 - DNA, 25 bp, E. coli
caattttaccgccaagtgggcgtct

SEQ ID NO: 198331 - DNA, 25 bp, E. coli
taaaaaccagcgagtagaggctgcc

SEQ ID NO: 198332 - DNA, 25 bp, E. coli
taaaaaccagcgtgtagaggctgcc

SEQ ID NO: 198333 - DNA, 25 bp, E. coli
tagaggctgcctaccgtaaagagct

SEQ ID NO: 198334 - DNA, 25 bp, E. coli
tagaggctgccttccgtaaagagct

SEQ ID NO: 198335 - DNA, 25 bp, E. coli
tattacatggcgaactggcaacaac

SEQ ID NO: 198336 - DNA, 25 bp, E. coli
tattacatggcgtactggcaacaac

SEQ ID NO: 198337 - DNA, 25 bp, E. coli
ttatggtgaagacgatgccacgcgc

SEQ ID NO: 198338 - DNA, 25 bp, E. coli
ttccgtatggtctggtgattgccgc

SEQ ID NO: 198339 - DNA, 25 bp, E. coli
ttccgtatggtcaggtgattgccgc

SEQ ID NO: 198340 - DNA, 25 bp, E. coli
ttatggtgaagaggatgccacgcgc

SEQ ID NO: 198341 - DNA, 25 bp, E. coli
tgtgcaggaagacaccatgcgtttt

SEQ ID NO: 198342 - DNA, 25 bp, E. coli
tgtgcaggaagagaccatgcgtttt

SEQ ID NO: 198343 - DNA, 25 bp, E. coli
tgatgtctatcttcaaacgtctgcg

SEQ ID NO: 198344 - DNA, 25 bp, E. coli
tgatgtctatctacaaacgtctgcg

SEQ ID NO: 198345 - DNA, 25 bp, E. coli
tcaggttcgcggtgctttccagtac

SEQ ID NO: 198346 - DNA, 25 bp, E. coli
tcaggttcgcggagctttccagtac

SEQ ID NO: 198347 - DNA, 25 bp, E. coli
ggcaacaactgcgtcatatcgaagg

SEQ ID NO: 198348 - DNA, 25 bp, E. coli
ggcaacaactgcctcatatcgaagg

SEQ ID NO: 198349 - DNA, 25 bp, E. coli
ggaagtaacccataccttgagctaa

SEQ ID NO: 198350 - DNA, 25 bp, E. coli
ggaagtaacccaaaccttgagctaa

SEQ ID NO: 198351 - DNA, 25 bp, E. coli
caactgacgaaaaaatgacaaatcc

SEQ ID NO: 198352 - DNA, 25 bp, E. coli
caccattattctttatgggtataaa

SEQ ID NO: 198353 - DNA, 25 bp, E. coli
caccattattctatatgggtataaa

SEQ ID NO: 198354 - DNA, 25 bp, E. coli
caactgacgaaataatgacaaatcc

SEQ ID NO: 198355 - DNA, 25 bp, E. coli
catcctggcgatcatagttatcacc

SEQ ID NO: 198356 - DNA, 25 bp, E. coli
catcctggcgatgatagttatcacc

SEQ ID NO: 198357 - DNA, 25 bp, E. coli
tacccgttatcgataaacgatgcaa

SEQ ID NO: 198358 - DNA, 25 bp, E. coli
aaacatcccctttcaatcctgaagg

SEQ ID NO: 198359 - DNA, 25 bp, E. coli
aaacatccccttacaatcctgaagg

SEQ ID NO: 198360 - DNA, 25 bp, E. coli
tacccgttatcgttaaacgatgcaa

SEQ ID NO: 198361 - DNA, 25 bp, E. coli
tgggtataaaactatcggcgcagca

SEQ ID NO: 198362 - DNA, 25 bp, E. coli
tgggtataaaacaatcggcgcagca

SEQ ID NO: 198363 - DNA, 25 bp, E. coli
tgacaaatccttatgctggttaacc

SEQ ID NO: 198364 - DNA, 25 bp, E. coli
tgacaaatccttttgctggttaacc

SEQ ID NO: 198365 - DNA, 25 bp, E. coli
gcgcagcatccttcccgttatcgat

SEQ ID NO: 198366 - DNA, 25 bp, E. coli
gctggttaacctgtgtactgtccta

SEQ ID NO: 198367 - DNA, 25 bp, E. coli
gcgcagcatcctacccgttatcgat

SEQ ID NO: 198368 - DNA, 25 bp, E. coli
gctggttaacctctgtactgtccta

SEQ ID NO: 198369 - DNA, 25 bp, E. coli
gataaacgatgctaaacatcccctt

SEQ ID NO: 198370 - DNA, 25 bp, E. coli
gataaacgatgcaaaacatcccctt

SEQ ID NO: 198371 - DNA, 25 bp, E. coli
tactgtcctacagttaatctttaaa

SEQ ID NO: 198372 - DNA, 25 bp, E. coli
tactgtcctacacttaatctttaaa

SEQ ID NO: 198373 - DNA, 25 bp, E. coli
tacacctataaaagagagagccgtt

SEQ ID NO: 198374 - DNA, 25 bp, E. coli
tacacctataaatgagagagccgtt

SEQ ID NO: 198375 - DNA, 25 bp, E. coli
aactttacccggaggtgcatatcgg

SEQ ID NO: 198376 - DNA, 25 bp, E. coli
aactttacccggtggtgcatatcgg

SEQ ID NO: 198377 - DNA, 25 bp, E. coli
agagccgttatcctctgtttgtgga

SEQ ID NO: 198378 - DNA, 25 bp, E. coli
agagccgttatcgtctgtttgtgga

SEQ ID NO: 198379 - DNA, 25 bp, E. coli
aaacgccattaacctgatgttctgg

SEQ ID NO: 198380 - DNA, 25 bp, E. coli
aaacgccattaagctgatgttctgg

SEQ ID NO: 198381 - DNA, 25 bp, E. coli
tgatctcagccagcgcgaaaatgac

SEQ ID NO: 198382 - DNA, 25 bp, E. coli
tgatctcagccaccgcgaaaatgac

SEQ ID NO: 198383 - DNA, 25 bp, E. coli
tgaaagctggcggatgatgaccacc

SEQ ID NO: 198384 - DNA, 25 bp, E. coli
tgaaagctggcgcatgatgaccacc

SEQ ID NO: 198385 - DNA, 25 bp, E. coli
tgctgtcagataaagtctcccgtga

SEQ ID NO: 198386 - DNA, 25 bp, E. coli
tgctgtcagatatagtctcccgtga

SEQ ID NO: 198387 - DNA, 25 bp, E. coli
gccagtgtgccgctctccgttatcg

SEQ ID NO: 198388 - DNA, 25 bp, E. coli
gccagtgtgccggtctccgttatcg

SEQ ID NO: 198389 - DNA, 25 bp, E. coli
gtgatattattgtcacgcccgggcg

SEQ ID NO: 198390 - DNA, 25 bp, E. coli
gtgatattattgacacgcccgggcg

SEQ ID NO: 198391 - DNA, 25 bp, E. coli
tggccagtgcacgtctgctgtcaga

SEQ ID NO: 198392 - DNA, 25 bp, E. coli
tggccagtgcacctctgctgtcaga

SEQ ID NO: 198393 - DNA, 25 bp, E. coli
gatgaccaccgaaatggccagtgtg

SEQ ID NO: 198394 - DNA, 25 bp, E. coli
gatgaccaccgatatggccagtgtg

SEQ ID NO: 198395 - DNA, 25 bp, E. coli
aatgctcgatggttttgacaccgcg

SEQ ID NO: 198396 - DNA, 25 bp, E. coli
aatgctcgatggatttgacaccgcg

SEQ ID NO: 198397 - DNA, 25 bp, E. coli
tatccaacacaatgtcgagccacgg

SEQ ID NO: 198398 - DNA, 25 bp, E. coli
tatccaacacaaagtcgagccacgg

SEQ ID NO: 198399 - DNA, 25 bp, E. coli
ttctcaccggatctgcaaacgctgg

SEQ ID NO: 198400 - DNA, 25 bp, E. coli
ttctcaccggatgtgcaaacgctgg

SEQ ID NO: 198401 - DNA, 25 bp, E. coli
ttatcgatgctggtccggtcggcaa

SEQ ID NO: 198402 - DNA, 25 bp, E. coli
ttatcgatgctgctccggtcggcaa

SEQ ID NO: 198403 - DNA, 25 bp, E. coli
tggtcaaatgctatcggccgctgcg

SEQ ID NO: 198404 - DNA, 25 bp, E. coli
tggtcaaatgctttcggccgctgcg

SEQ ID NO: 198405 - DNA, 25 bp, E. coli
tgattaccgtggttcgccagtcgac

SEQ ID NO: 198406 - DNA, 25 bp, E. coli
tgattaccgtggatcgccagtcgac

SEQ ID NO: 198407 - DNA, 25 bp, E. coli
tgctctcaagctcgatgccgacgct

SEQ ID NO: 198408 - DNA, 25 bp, E. coli
tgctctcaagctggatgccgacgct

SEQ ID NO: 198409 - DNA, 25 bp, E. coli
gcgattttcggctctggcattggca

SEQ ID NO: 198410 - DNA, 25 bp, E. coli
gcgattttcggcactggcattggca

SEQ ID NO: 198411 - DNA, 25 bp, E. coli
gataagttcaatgctttccgcgtgc

SEQ ID NO: 198412 - DNA, 25 bp, E. coli
gataagttcaatcctttccgcgtgc

SEQ ID NO: 198413 - DNA, 25 bp, E. coli
ggtgattgcgaataccgtcagcgcc

SEQ ID NO: 198414 - DNA, 25 bp, E. coli
ggtgattgcgaaaaccgtcagcgcc

SEQ ID NO: 198415 - DNA, 25 bp, E. coli
tgtggcccgttgtccgatcgctttg

SEQ ID NO: 198416 - DNA, 25 bp, E. coli
tgtggcccgttgaccgatcgctttg

SEQ ID NO: 198417 - DNA, 25 bp, E. coli
aatgggcatttcgattctccgtggg

SEQ ID NO: 198418 - DNA, 25 bp, E. coli
aatgggcatttccattctccgtggg

SEQ ID NO: 198419 - DNA, 25 bp, E. coli
tattcccattaatagtgataccctg

SEQ ID NO: 198420 - DNA, 25 bp, E. coli
tattcccattaaaagtgataccctg

SEQ ID NO: 198421 - DNA, 25 bp, E. coli
tgtcacaaactgtgaataatactca

SEQ ID NO: 198422 - DNA, 25 bp, E. coli
tgtctcgcgtcaatctgaacaaagc

SEQ ID NO: 198423 - DNA, 25 bp, E. coli
tgtctcgcgtcattctgaacaaagc

SEQ ID NO: 198424 - DNA, 25 bp, E. coli
tgtcacaaactgagaataatactca

SEQ ID NO: 198425 - DNA, 25 bp, E. coli
tcccattaatagagataccctggta

SEQ ID NO: 198426 - DNA, 25 bp, E. coli
tcccattaatagtgataccctggta

SEQ ID NO: 198427 - DNA, 25 bp, E. coli
tctgaacaaagcaatcctccagaat

SEQ ID NO: 198428 - DNA, 25 bp, E. coli
tctgaacaaagctatcctccagaat

SEQ ID NO: 198429 - DNA, 25 bp, E. coli
gcgtcaatctgatcaaagcaatcct

SEQ ID NO: 198430 - DNA, 25 bp, E. coli
gcgtcaatctgaacaaagcaatcct

SEQ ID NO: 198431 - DNA, 25 bp, E. coli
ctcatgaagtagctatgaagattac

SEQ ID NO: 198432 - DNA, 25 bp, E. coli
ctgagaataatagtcatgaagtagc

SEQ ID NO: 198433 - DNA, 25 bp, E. coli
ctcatgaagtaggtatgaagattac

SEQ ID NO: 198434 - DNA, 25 bp, E. coli
ctgagaataatactcatgaagtagc

SEQ ID NO: 198435 - DNA, 25 bp, E. coli
gatctgtctcgcctcaatctgaaca

SEQ ID NO: 198436 - DNA, 25 bp, E. coli
gatctgtctcgcgtcaatctgaaca

SEQ ID NO: 198437 - DNA, 25 bp, E. coli
ggaggagaatatacccattaatagt

SEQ ID NO: 198438 - DNA, 25 bp, E. coli
ggaggagaatattcccattaatagt

SEQ ID NO: 198439 - DNA, 25 bp, E. coli
aaagacggctttgttgccacaaatg

SEQ ID NO: 198440 - DNA, 25 bp, E. coli
aaagacggctttcttgccacaaatg

SEQ ID NO: 198441 - DNA, 25 bp, E. coli
ttcttcagcgtgcataaagacggct

SEQ ID NO: 198442 - DNA, 25 bp, E. coli
ttcttcagcgtggataaagacggct

SEQ ID NO: 198443 - DNA, 25 bp, E. coli
tgtgttcaacgacaacaaaaccttg

SEQ ID NO: 198444 - DNA, 25 bp, E. coli
tgtgttcaacgagaacaaaaccttg

SEQ ID NO: 198445 - DNA, 25 bp, E. coli
tccggttctgttgctgacacgctag

SEQ ID NO: 198446 - DNA, 25 bp, E. coli
tccggttctgttcctgacacgctag

SEQ ID NO: 198447 - DNA, 25 bp, E. coli
tcttcaagctgtggattgtcgggac

SEQ ID NO: 198448 - DNA, 25 bp, E. coli
tcttcaagctgtcgattgtcgggac

SEQ ID NO: 198449 - DNA, 25 bp, E. coli
gctagtaagcagacgcaactcggca

SEQ ID NO: 198450 - DNA, 25 bp, E. coli
gccacaaatggcagcacgttaacca

SEQ ID NO: 198451 - DNA, 25 bp, E. coli
gctagtaagcagtcgcaactcggca

SEQ ID NO: 198452 - DNA, 25 bp, E. coli
gccacaaatggctgcacgttaacca

SEQ ID NO: 198453 - DNA, 25 bp, E. coli
gcggaaccgccatcaggtcaatgca

SEQ ID NO: 198454 - DNA, 25 bp, E. coli
gcggaaccgccaacaggtcaatgca

SEQ ID NO: 198455 - DNA, 25 bp, E. coli
ggtcaatgcagcaaacattctccgg

SEQ ID NO: 198456 - DNA, 25 bp, E. coli
ggtcaatgcagctaacattctccgg

SEQ ID NO: 198457 - DNA, 25 bp, E. coli
ggcgtttactgcgacaaccatcaaa

SEQ ID NO: 198458 - DNA, 25 bp, E. coli
ggcgtttactgccacaaccatcaaa

SEQ ID NO: 198459 - DNA, 25 bp, E. coli
taaccattcagtggaatggcgcggc

SEQ ID NO: 198460 - DNA, 25 bp, E. coli
taaccattcagtcgaatggcgcggc

SEQ ID NO: 198461 - DNA, 25 bp, E. coli
gatgtcaacgttgagggtacccgca

SEQ ID NO: 198462 - DNA, 25 bp, E. coli
gatgtcaacgttcagggtacccgca

SEQ ID NO: 198463 - DNA, 25 bp, E. coli
cactgttgtactactggcagcggaa

SEQ ID NO: 198464 - DNA, 25 bp, E. coli
cactgttgtacttctggcagcggaa

SEQ ID NO: 198465 - DNA, 25 bp, E. coli
taactacgttgaaaagccagacctg

SEQ ID NO: 198466 - DNA, 25 bp, E. coli
taactacgttgataagccagacctg

SEQ ID NO: 198467 - DNA, 25 bp, E. coli
tacgggcaaaaaatacgctgtcagc

SEQ ID NO: 198468 - DNA, 25 bp, E. coli
actacggcaaaaccaagtggcaggc

SEQ ID NO: 198469 - DNA, 25 bp, E. coli
actacggcaaaagcaagtggcaggc

SEQ ID NO: 198470 - DNA, 25 bp, E. coli
tacgggcaaaaattacgctgtcagc

SEQ ID NO: 198471 - DNA, 25 bp, E. coli
tatacgctgtcgcaaggtctggatc

SEQ ID NO: 198472 - DNA, 25 bp, E. coli
tatacgctgtcggaaggtctggatc

SEQ ID NO: 198473 - DNA, 25 bp, E. coli
ttatcttcggtgtacgcaaccgcgg

SEQ ID NO: 198474 - DNA, 25 bp, E. coli
ttatcttcggtgaacgcaaccgcgg

SEQ ID NO: 198475 - DNA, 25 bp, E. coli
gctctgtgcgcgtgaaaaaattctg

SEQ ID NO: 198476 - DNA, 25 bp, E. coli
gctctgtgcgcgagaaaaaattctg

SEQ ID NO: 198477 - DNA, 25 bp, E. coli
gatatcctgagctaaattacgggca

SEQ ID NO: 198478 - DNA, 25 bp, E. coli
gatatcctgagcaaaattacgggca

SEQ ID NO: 198479 - DNA, 25 bp, E. coli
taacttgctgaaacagatcgctggc

SEQ ID NO: 198480 - DNA, 25 bp, E. coli
taacttgctgaatcagatcgctggc

SEQ ID NO: 198481 - DNA, 25 bp, E. coli
gatgttcgtgatcaacaggcactcg

SEQ ID NO: 198482 - DNA, 25 bp, E. coli
gatgttcgtgatgaacaggcactcg

SEQ ID NO: 198483 - DNA, 25 bp, E. coli
cacagtagtcgatgtttttagcagc

SEQ ID NO: 198484 - DNA, 25 bp, E. coli
cacagtagtcgaagtttttagcagc

SEQ ID NO: 198485 - DNA, 25 bp, E. coli
tttttgccacaagacgaagcggcgc

SEQ ID NO: 198486 - DNA, 25 bp, E. coli
tttttgccacaacacgaagcggcgc

SEQ ID NO: 198487 - DNA, 25 bp, E. coli
tgaaaattcccctcgctgagatgat

SEQ ID NO: 198488 - DNA, 25 bp, E. coli
tgaaaattccccacgctgagatgat

SEQ ID NO: 198489 - DNA, 25 bp, E. coli
gcggcgctttttgctataacttaga

SEQ ID NO: 198490 - DNA, 25 bp, E. coli
gcggcgctttttcctataacttaga

SEQ ID NO: 198491 - DNA, 25 bp, E. coli
gacttagcccctttttcggcattga

SEQ ID NO: 198492 - DNA, 25 bp, E. coli
gacttagcccctatttcggcattga

SEQ ID NO: 198493 - DNA, 25 bp, E. coli
gaaagtaatatattcatctcaggaa

SEQ ID NO: 198494 - DNA, 25 bp, E. coli
gaaagtaatataatcatctcaggaa

SEQ ID NO: 198495 - DNA, 25 bp, E. coli
cccacgctgagaagatttactgttc

SEQ ID NO: 198496 - DNA, 25 bp, E. coli
cccacgctgagatgatttactgttc

SEQ ID NO: 198497 - DNA, 25 bp, E. coli
cggtaagcacaatacgcgtgaaaat

SEQ ID NO: 198498 - DNA, 25 bp, E. coli
cggtaagcacaaaacgcgtgaaaat

SEQ ID NO: 198499 - DNA, 25 bp, E. coli
cattgactatgtggtctgaaaaggg

SEQ ID NO: 198500 - DNA, 25 bp, E. coli
cattgactatgtcgtctgaaaaggg

SEQ ID NO: 198501 - DNA, 25 bp, E. coli
gtactgatgattgacttagcccctt

SEQ ID NO: 198502 - DNA, 25 bp, E. coli
gtactgatgattcacttagcccctt

SEQ ID NO: 198503 - DNA, 25 bp, E. coli
taagcatattttttatcgaagggat

SEQ ID NO: 198504 - DNA, 25 bp, E. coli
taagcatattttatatcgaagggat

SEQ ID NO: 198505 - DNA, 25 bp, E. coli
attgcccgcaaaatgctgctcgata

SEQ ID NO: 198506 - DNA, 25 bp, E. coli
attgcccgcaaattgctgctcgata

SEQ ID NO: 198507 - DNA, 25 bp, E. coli
taggtttcaaaaatggcactgatgg

SEQ ID NO: 198508 - DNA, 25 bp, E. coli
taggtttcaaaattggcactgatgg

SEQ ID NO: 198509 - DNA, 25 bp, E. coli
tttcaaaaatggcactgatggtacg

SEQ ID NO: 198510 - DNA, 25 bp, E. coli
tattgcccgcaatttgctgctcgat

SEQ ID NO: 198511 - DNA, 25 bp, E. coli
tttcaaaaatgggactgatggtacg

SEQ ID NO: 198512 - DNA, 25 bp, E. coli
tattgcccgcaaattgctgctcgat

SEQ ID NO: 198513 - DNA, 25 bp, E. coli
tgaattcctggatatgatcacccca

SEQ ID NO: 198514 - DNA, 25 bp, E. coli
tgaattcctggaaatgatcacccca

SEQ ID NO: 198515 - DNA, 25 bp, E. coli
tgcccgcaaattcctgctcgatatt

SEQ ID NO: 198516 - DNA, 25 bp, E. coli
tgcccgcaaattgctgctcgatatt

SEQ ID NO: 198517 - DNA, 25 bp, E. coli
gcgtattgcccggaaattgctgctc

SEQ ID NO: 198518 - DNA, 25 bp, E. coli
gcgtattgcccgcaaattgctgctc

SEQ ID NO: 198519 - DNA, 25 bp, E. coli
cgtattgcccgcaaattgctgctcg

SEQ ID NO: 198520 - DNA, 25 bp, E. coli
cgtattgcccgctaattgctgctcg

SEQ ID NO: 198521 - DNA, 25 bp, E. coli
gtattgcccgcaaattgctgctcga

SEQ ID NO: 198522 - DNA, 25 bp, E. coli
gtattgcccgcatattgctgctcga

SEQ ID NO: 198523 - DNA, 25 bp, E. coli
ggtaggtttcaaaaatggcactgat

SEQ ID NO: 198524 - DNA, 25 bp, E. coli
ggtttcaaaaatggcactgatggta

SEQ ID NO: 198525 - DNA, 25 bp, E. coli
ggtaggtttcaataatggcactgat

SEQ ID NO: 198526 - DNA, 25 bp, E. coli
ggtttcaaaaatcgcactgatggta

SEQ ID NO: 198527 - DNA, 25 bp, E. coli
catgatgaatcacaagagtcgcgta

SEQ ID NO: 198528 - DNA, 25 bp, E. coli
catgatgaatcagaagagtcgcgta

SEQ ID NO: 198529 - DNA, 25 bp, E. coli
taaactgaccgaacatctgctggag

SEQ ID NO: 198530 - DNA, 25 bp, E. coli
taaactgaccgatcatctgctggag

SEQ ID NO: 198531 - DNA, 25 bp, E. coli
aaatccctggaattatcgctgtagc

SEQ ID NO: 198532 - DNA, 25 bp, E. coli
aaatccctggaaatatcgctgtagc

SEQ ID NO: 198533 - DNA, 25 bp, E. coli
tattactgcgactaccagagctgga

SEQ ID NO: 198534 - DNA, 25 bp, E. coli
tatattcccaacagaactgctggcg

SEQ ID NO: 198535 - DNA, 25 bp, E. coli
tttgcagccacgaagagattgcgct

SEQ ID NO: 198536 - DNA, 25 bp, E. coli
tattactgcgacaaccagagctgga

SEQ ID NO: 198537 - DNA, 25 bp, E. coli
tttgcagccacgtagagattgcgct

SEQ ID NO: 198538 - DNA, 25 bp, E. coli
tatattcccaactgaactgctggcg

SEQ ID NO: 198539 - DNA, 25 bp, E. coli
tgttatcacaatcccggatgccgca

SEQ ID NO: 198540 - DNA, 25 bp, E. coli
tgttatcacaatgccggatgccgca

SEQ ID NO: 198541 - DNA, 25 bp, E. coli
tggtcacagtcaaacagtcgccgta

SEQ ID NO: 198542 - DNA, 25 bp, E. coli
tggtcacagtcatacagtcgccgta

SEQ ID NO: 198543 - DNA, 25 bp, E. coli
cgctaactttgctggtgtcggaacc

SEQ ID NO: 198544 - DNA, 25 bp, E. coli
cgctaactttgcaggtgtcggaacc

SEQ ID NO: 198545 - DNA, 25 bp, E. coli
ggtgcgcatatggaaaaccgcctgc

SEQ ID NO: 198546 - DNA, 25 bp, E. coli
ggtgcgcatatgcaaaaccgcctgc

SEQ ID NO: 198547 - DNA, 25 bp, E. coli
gatgacgcttctacaaggcaacccg

SEQ ID NO: 198548 - DNA, 25 bp, E. coli
gatgacgcttcttcaaggcaacccg

SEQ ID NO: 198549 - DNA, 25 bp, E. coli
acccgcggtagctggaatgatggaa

SEQ ID NO: 198550 - DNA, 25 bp, E. coli
acccgcggtagcaggaatgatggaa

SEQ ID NO: 198551 - DNA, 25 bp, E. coli
tattttgctgatcttcggcgtcggt

SEQ ID NO: 198552 - DNA, 25 bp, E. coli
tattttgctgatgttcggcgtcggt

SEQ ID NO: 198553 - DNA, 25 bp, E. coli
ttggtcactccctgcgcacggcgtt

SEQ ID NO: 198554 - DNA, 25 bp, E. coli
ttggtaaatcggacgcggccctgtt

SEQ ID NO: 198555 - DNA, 25 bp, E. coli
ttggtcactcccagcgcacggcgtt

SEQ ID NO: 198556 - DNA, 25 bp, E. coli
ttggtaaatcggtcgcggccctgtt

SEQ ID NO: 198557 - DNA, 25 bp, E. coli
tctgtttggtaattcggtcgcggcc

SEQ ID NO: 198558 - DNA, 25 bp, E. coli
tctgtttggtaaatcggtcgcggcc

SEQ ID NO: 198559 - DNA, 25 bp, E. coli
ccttgtgcgtttgtttggtcactcc

SEQ ID NO: 198560 - DNA, 25 bp, E. coli
ccttgtgcgtttctttggtcactcc

SEQ ID NO: 198561 - DNA, 25 bp, E. coli
gcggccctgttccttgtgcgtttgt

SEQ ID NO: 198562 - DNA, 25 bp, E. coli
gctgaactgggccttattttgctga

SEQ ID NO: 198563 - DNA, 25 bp, E. coli
gcggccctgttcgttgtgcgtttgt

SEQ ID NO: 198564 - DNA, 25 bp, E. coli
gctgaactgggcgttattttgctga

SEQ ID NO: 198565 - DNA, 25 bp, E. coli
ctgatgttcggcctcggtttgcatt

SEQ ID NO: 198566 - DNA, 25 bp, E. coli
ctgatgttcggcgtcggtttgcatt

SEQ ID NO: 198567 - DNA, 25 bp, E. coli
tggtgatggtcctgacgctggtatt

SEQ ID NO: 198568 - DNA, 25 bp, E. coli
tggtgatggtccagacgctggtatt

SEQ ID NO: 198569 - DNA, 25 bp, E. coli
gacgctggtattcctacccgcggta

SEQ ID NO: 198570 - DNA, 25 bp, E. coli
gacgctggtattgctacccgcggta

SEQ ID NO: 198571 - DNA, 25 bp, E. coli
catgctggtggcattaatatcatta

SEQ ID NO: 198572 - DNA, 25 bp, E. coli
catgcaggccagtactgtttctgac

SEQ ID NO: 198573 - DNA, 25 bp, E. coli
catgcaggccagaactgtttctgac

SEQ ID NO: 198574 - DNA, 25 bp, E. coli
catgctggtggctttaatatcatta

SEQ ID NO: 198575 - DNA, 25 bp, E. coli
ataatattcatcatgctggtggcat

SEQ ID NO: 198576 - DNA, 25 bp, E. coli
ataatattcatcttgctggtggcat

SEQ ID NO: 198577 - DNA, 25 bp, E. coli
cactttacagctttattttttggcg

SEQ ID NO: 198578 - DNA, 25 bp, E. coli
cactttacagctatattttttggcg

SEQ ID NO: 198579 - DNA, 25 bp, E. coli
tcatagtgcagcgtcactttacagc

SEQ ID NO: 198580 - DNA, 25 bp, E. coli
tcatagtgcagcctcactttacagc

SEQ ID NO: 198581 - DNA, 25 bp, E. coli
ccggcgcgcatattattcatcatgc

SEQ ID NO: 198582 - DNA, 25 bp, E. coli
gctatattttttggcggctttcgcc

SEQ ID NO: 198583 - DNA, 25 bp, E. coli
gctatattttttcgcggctttcgcc

SEQ ID NO: 198584 - DNA, 25 bp, E. coli
gcagcgtatttcgaccgtttttccg

SEQ ID NO: 198585 - DNA, 25 bp, E. coli
gcagcgtatttccaccgtttttccg

SEQ ID NO: 198586 - DNA, 25 bp, E. coli
cgccggacgtgcatgcaggccagta

SEQ ID NO: 198587 - DNA, 25 bp, E. coli
cgccggacgtgcttgcaggccagta

SEQ ID NO: 198588 - DNA, 25 bp, E. coli
ccggcgcgcataatattcatcatgc

SEQ ID NO: 198589 - DNA, 25 bp, E. coli
ggctttcgccagtcaggccgccgga

SEQ ID NO: 198590 - DNA, 25 bp, E. coli
ggctttcgccagacaggccgccgga

SEQ ID NO: 198591 - DNA, 25 bp, E. coli
gacgtgcatgcaggccagtactgtt

SEQ ID NO: 198592 - DNA, 25 bp, E. coli
gacgtgcatgcacgccagtactgtt

SEQ ID NO: 198593 - DNA, 25 bp, E. coli
caggctcaccatcgaagactggcaa

SEQ ID NO: 198594 - DNA, 25 bp, E. coli
caggctcaccatggaagactggcaa

SEQ ID NO: 198595 - DNA, 25 bp, E. coli
tactttgccaaaccacgggatctgg

SEQ ID NO: 198596 - DNA, 25 bp, E. coli
tactttgccaaagcacgggatctgg

SEQ ID NO: 198597 - DNA, 25 bp, E. coli
tacactacgctgtgatgccattggg

SEQ ID NO: 198598 - DNA, 25 bp, E. coli
tacactacgctgagatgccattggg

SEQ ID NO: 198599 - DNA, 25 bp, E. coli
tcacccagggaaaaaccggaatgcg

SEQ ID NO: 198600 - DNA, 25 bp, E. coli
tcacggactcggtacagacaaaggt

SEQ ID NO: 198601 - DNA, 25 bp, E. coli
tctgaaaatacacgacacgcgactg

SEQ ID NO: 198602 - DNA, 25 bp, E. coli
tcacggactcggaacagacaaaggt

SEQ ID NO: 198603 - DNA, 25 bp, E. coli
tctgaaaatacaggacacgcgactg

SEQ ID NO: 198604 - DNA, 25 bp, E. coli
gaatggctgcatacctggtttcccg

SEQ ID NO: 198605 - DNA, 25 bp, E. coli
gaatggctgcattcctggtttcccg

SEQ ID NO: 198606 - DNA, 25 bp, E. coli
gaagccgatgagtaaagacaacctg

SEQ ID NO: 198607 - DNA, 25 bp, E. coli
gaagccgatgagaaaagacaacctg

SEQ ID NO: 198608 - DNA, 25 bp, E. coli
cgattgttactggtcagcgccgtga

SEQ ID NO: 198609 - DNA, 25 bp, E. coli
cgattgttactgctcagcgccgtga

SEQ ID NO: 198610 - DNA, 25 bp, E. coli
tcacccagggaataaccggaatgcg

SEQ ID NO: 198611 - DNA, 25 bp, E. coli
taacgatactcgtggtcaggaatgg

SEQ ID NO: 198612 - DNA, 25 bp, E. coli
taacgatactcgaggtcaggaatgg

SEQ ID NO: 198613 - DNA, 25 bp, E. coli
gatccctaaagttaccagagccagg

SEQ ID NO: 198614 - DNA, 25 bp, E. coli
gatccctaaagtaaccagagccagg

SEQ ID NO: 198615 - DNA, 25 bp, E. coli
aacgagactttagaggcagcagcgg

SEQ ID NO: 198616 - DNA, 25 bp, E. coli
aacgagactttacaggcagcagcgg

SEQ ID NO: 198617 - DNA, 25 bp, E. coli
ttatgatcgacaacacctgggcagc

SEQ ID NO: 198618 - DNA, 25 bp, E. coli
tttattcagcatcgcctactcgtgg

SEQ ID NO: 198619 - DNA, 25 bp, E. coli
ttatgatcgacatcacctgggcagc

SEQ ID NO: 198620 - DNA, 25 bp, E. coli
tttattcagcatggcctactcgtgg

SEQ ID NO: 198621 - DNA, 25 bp, E. coli
tctgattgccgatctggacgccggt

SEQ ID NO: 198622 - DNA, 25 bp, E. coli
tctgatgggccagatggtcgatgcc

SEQ ID NO: 198623 - DNA, 25 bp, E. coli
tctgattgccgaactggacgccggt

SEQ ID NO: 198624 - DNA, 25 bp, E. coli
tctgatgggccacatggtcgatgcc

SEQ ID NO: 198625 - DNA, 25 bp, E. coli
gcaaaatcctcaccaaactgggcgt

SEQ ID NO: 198626 - DNA, 25 bp, E. coli
gcaaaatcctcagcaaactgggcgt

SEQ ID NO: 198627 - DNA, 25 bp, E. coli
gatatcgttaagcatctgcagccaa

SEQ ID NO: 198628 - DNA, 25 bp, E. coli
gattttagcgggaccttgattcgcc

SEQ ID NO: 198629 - DNA, 25 bp, E. coli
gataccgcctatataaccagccgtg

SEQ ID NO: 198630 - DNA, 25 bp, E. coli
gatatcgttaaggatctgcagccaa

SEQ ID NO: 198631 - DNA, 25 bp, E. coli
gttgatgaccaagaccgcctatgaa

SEQ ID NO: 198632 - DNA, 25 bp, E. coli
gttgatgaccaacaccgcctatgaa

SEQ ID NO: 198633 - DNA, 25 bp, E. coli
gattttagcgggtccttgattcgcc

SEQ ID NO: 198634 - DNA, 25 bp, E. coli
gataccgcctatttaaccagccgtg

SEQ ID NO: 198635 - DNA, 25 bp, E. coli
taaggcgctggattttggcatcgat

SEQ ID NO: 198636 - DNA, 25 bp, E. coli
taaggcgctggaatttggcatcgat

SEQ ID NO: 198637 - DNA, 25 bp, E. coli
caaccgcagtctggatgtgctggaa

SEQ ID NO: 198638 - DNA, 25 bp, E. coli
caaaattgaggctctggcggatggc

SEQ ID NO: 198639 - DNA, 25 bp, E. coli
caaaattgaggcactggcggatggc

SEQ ID NO: 198640 - DNA, 25 bp, E. coli
caaccgcagtctcgatgtgctggaa

SEQ ID NO: 198641 - DNA, 25 bp, E. coli
aaaccgatacggtcaatctggcgac

SEQ ID NO: 198642 - DNA, 25 bp, E. coli
aaaagtgccggtcctggtgaccgaa

SEQ ID NO: 198643 - DNA, 25 bp, E. coli
aaaagtgccggtgctggtgaccgaa

SEQ ID NO: 198644 - DNA, 25 bp, E. coli
aaaccgatacggacaatctggcgac

SEQ ID NO: 198645 - DNA, 25 bp, E. coli
tattaatgaactgccctataacgcg

SEQ ID NO: 198646 - DNA, 25 bp, E. coli
tattaatgaactcccctataacgcg

SEQ ID NO: 198647 - DNA, 25 bp, E. coli
tgaaactcgtcggtagctacaccag

SEQ ID NO: 198648 - DNA, 25 bp, E. coli
tgaaactcgtcgctagctacaccag

SEQ ID NO: 198649 - DNA, 25 bp, E. coli
tcgaaaacctgtatagccgcgaaag

SEQ ID NO: 198650 - DNA, 25 bp, E. coli
tcgaaaacctgtttagccgcgaaag

SEQ ID NO: 198651 - DNA, 25 bp, E. coli
gcggcgcagcagtctgaagatgaat

SEQ ID NO: 198652 - DNA, 25 bp, E. coli
gcggcgcagcagactgaagatgaat

SEQ ID NO: 198653 - DNA, 25 bp, E. coli
gaaagttttgctcgcaccgaaccgc

SEQ ID NO: 198654 - DNA, 25 bp, E. coli
gaaagttttgctggcaccgaaccgc

SEQ ID NO: 198655 - DNA, 25 bp, E. coli
cgccattgcctgagccgtcggatat

SEQ ID NO: 198656 - DNA, 25 bp, E. coli
cgccattgcctgtgccgtcggatat

SEQ ID NO: 198657 - DNA, 25 bp, E. coli
ggatatctcaatttccgccgcgttg

SEQ ID NO: 198658 - DNA, 25 bp, E. coli
ggatatctcaatatccgccgcgttg

SEQ ID NO: 198659 - DNA, 25 bp, E. coli
aagccgaaggcagtcaacatattag

SEQ ID NO: 198660 - DNA, 25 bp, E. coli
aagccgaaggcactcaacatattag

SEQ ID NO: 198661 - DNA, 25 bp, E. coli
cagtaaaattatctggcggcgttaa

SEQ ID NO: 198662 - DNA, 25 bp, E. coli
cagtaaaattatgtggcggcgttaa

SEQ ID NO: 198663 - DNA, 25 bp, E. coli
acatattagctaccagttcagcggg

SEQ ID NO: 198664 - DNA, 25 bp, E. coli
acatattagctagcagttcagcggg

SEQ ID NO: 198665 - DNA, 25 bp, E. coli
tatcgcctgcgcagcggaatgaaaa

SEQ ID NO: 198666 - DNA, 25 bp, E. coli
tatcgcctgcgctgcggaatgaaaa

SEQ ID NO: 198667 - DNA, 25 bp, E. coli
tgattaacggcgatcaaggcacgat

SEQ ID NO: 198668 - DNA, 25 bp, E. coli
tgattaacggcgttcaaggcacgat

SEQ ID NO: 198669 - DNA, 25 bp, E. coli
tgaaaaccgcgatcggcaacgtggt

SEQ ID NO: 198670 - DNA, 25 bp, E. coli
tgaaaaccgcgaacggcaacgtggt

SEQ ID NO: 198671 - DNA, 25 bp, E. coli
gatattcctgctcacaccggtgtta

SEQ ID NO: 198672 - DNA, 25 bp, E. coli
gatattcctgctgacaccggtgtta

SEQ ID NO: 198673 - DNA, 25 bp, E. coli
taatgccttcggtcgataccctgaa

SEQ ID NO: 198674 - DNA, 25 bp, E. coli
taatcgtgccgtcgaatgtaaagcc

SEQ ID NO: 198675 - DNA, 25 bp, E. coli
taatcgtgccgtggaatgtaaagcc

SEQ ID NO: 198676 - DNA, 25 bp, E. coli
taatgccttcggacgataccctgaa

SEQ ID NO: 198677 - DNA, 25 bp, E. coli
gaccggctgttcgacgatgtcgtca

SEQ ID NO: 198678 - DNA, 25 bp, E. coli
gacctttacagcaaagcatttggca

SEQ ID NO: 198679 - DNA, 25 bp, E. coli
gaccggctgttccacgatgtcgtca

SEQ ID NO: 198680 - DNA, 25 bp, E. coli
gacctttacagctaagcatttggca

SEQ ID NO: 198681 - DNA, 25 bp, E. coli
catggttgaccgcatcgttccggcg

SEQ ID NO: 198682 - DNA, 25 bp, E. coli
catggttgaccggatcgttccggcg

SEQ ID NO: 198683 - DNA, 25 bp, E. coli
tacaggaaattggtgaccagctggg

SEQ ID NO: 198684 - DNA, 25 bp, E. coli
tacaggaaattgctgaccagctggg

SEQ ID NO: 198685 - DNA, 25 bp, E. coli
accgcgtgctgatcgaaaacctgaa

SEQ ID NO: 198686 - DNA, 25 bp, E. coli
accgcgtgctgaacgaaaacctgaa

SEQ ID NO: 198687 - DNA, 25 bp, E. coli
aaaaaggctactccgctgatgcggc

SEQ ID NO: 198688 - DNA, 25 bp, E. coli
aaaaaggctactgcgctgatgcggc

SEQ ID NO: 198689 - DNA, 25 bp, E. coli
tatcggttcgatcaaagaagcgctg

SEQ ID NO: 198690 - DNA, 25 bp, E. coli
tatcggttcgatgaaagaagcgctg

SEQ ID NO: 198691 - DNA, 25 bp, E. coli
tgttgacagcaaactgccggttgcc

SEQ ID NO: 198692 - DNA, 25 bp, E. coli
tgttgacagcaatctgccggttgcc

SEQ ID NO: 198693 - DNA, 25 bp, E. coli
tgatgtcctgcgttaacgtgcgtga

SEQ ID NO: 198694 - DNA, 25 bp, E. coli
tgatgtcctgcgataacgtgcgtga

SEQ ID NO: 198695 - DNA, 25 bp, E. coli
tctgcgaagttatcctgatgccagg

SEQ ID NO: 198696 - DNA, 25 bp, E. coli
tctgcgaagttaacctgatgccagg

SEQ ID NO: 198697 - DNA, 25 bp, E. coli
gaaggtattctctacgcgatggcgc

SEQ ID NO: 198698 - DNA, 25 bp, E. coli
gaaggtattctcaacgcgatggcgc

SEQ ID NO: 198699 - DNA, 25 bp, E. coli
ggcgacgccagaaaccttacaggaa

SEQ ID NO: 198700 - DNA, 25 bp, E. coli
ggcgacgccagataccttacaggaa

SEQ ID NO: 198701 - DNA, 25 bp, E. coli
tcaagcacgatcaggaaaacccgac

SEQ ID NO: 198702 - DNA, 25 bp, E. coli
tcaagcacgatctggaaaacccgac

SEQ ID NO: 198703 - DNA, 25 bp, E. coli
caattcggaaaggattacggcgacg

SEQ ID NO: 198704 - DNA, 25 bp, E. coli
caattcggaaagcattacggcgacg

SEQ ID NO: 198705 - DNA, 25 bp, E. coli
taaaccactgtacttcccgaggcat

SEQ ID NO: 198706 - DNA, 25 bp, E. coli
taaaccactgtagttcccgaggcat

SEQ ID NO: 198707 - DNA, 25 bp, E. coli
aacaagcgtgaaaggagcgatgaca

SEQ ID NO: 198708 - DNA, 25 bp, E. coli
aacaagcgtgaatggagcgatgaca

SEQ ID NO: 198709 - DNA, 25 bp, E. coli
aaagcctcggctcaggttgtcctgc

SEQ ID NO: 198710 - DNA, 25 bp, E. coli
aaagcctcggctgaggttgtcctgc

SEQ ID NO: 198711 - DNA, 25 bp, E. coli
ttatcggtgtctttgcccctacagg

SEQ ID NO: 198712 - DNA, 25 bp, E. coli
ttttcgctgtgcaagaaagggcgca

SEQ ID NO: 198713 - DNA, 25 bp, E. coli
ttttcgctgtgctagaaagggcgca

SEQ ID NO: 198714 - DNA, 25 bp, E. coli
ttatcggtgtctatgcccctacagg

SEQ ID NO: 198715 - DNA, 25 bp, E. coli
tccgcaggcgagacaaccagtctgt

SEQ ID NO: 198716 - DNA, 25 bp, E. coli
tccgcaggcgagtcaaccagtctgt

SEQ ID NO: 198717 - DNA, 25 bp, E. coli
tcaggaggccctagctatgtatacg

SEQ ID NO: 198718 - DNA, 25 bp, E. coli
tcaggaggcccttgctatgtatacg

SEQ ID NO: 198719 - DNA, 25 bp, E. coli
gtttatcaattgtcggcaaccctcg

SEQ ID NO: 198720 - DNA, 25 bp, E. coli
gtttatcaattgacggcaaccctcg

SEQ ID NO: 198721 - DNA, 25 bp, E. coli
tcaatgttaattcagcagaggcgaa

SEQ ID NO: 198722 - DNA, 25 bp, E. coli
taagtacccaaagattgaacgcgga

SEQ ID NO: 198723 - DNA, 25 bp, E. coli
taagtacccaaacattgaacgcgga

SEQ ID NO: 198724 - DNA, 25 bp, E. coli
tcaatgttaattgagcagaggcgaa

SEQ ID NO: 198725 - DNA, 25 bp, E. coli
caaaccattgagacagtacgcaacg

SEQ ID NO: 198726 - DNA, 25 bp, E. coli
caaaccattgagtcagtacgcaacg

SEQ ID NO: 198727 - DNA, 25 bp, E. coli
caggccaaaagccaacgaatttcag

SEQ ID NO: 198728 - DNA, 25 bp, E. coli
caggccaaaagcgaacgaatttcag

SEQ ID NO: 198729 - DNA, 25 bp, E. coli
actaactggcaagtttgcagcctgg

SEQ ID NO: 198730 - DNA, 25 bp, E. coli
actaactggcaactttgcagcctgg

SEQ ID NO: 198731 - DNA, 25 bp, E. coli
tatcaccagcagcaagagcaaggtg

SEQ ID NO: 198732 - DNA, 25 bp, E. coli
tatcaccagcaggaagagcaaggtg

SEQ ID NO: 198733 - DNA, 25 bp, E. coli
tgtgaagttgctgtcagcgacgcgc

SEQ ID NO: 198734 - DNA, 25 bp, E. coli
tgtgaagttgctctcagcgacgcgc

SEQ ID NO: 198735 - DNA, 25 bp, E. coli
tcagtacgcaacgtagagggcgtgc

SEQ ID NO: 198736 - DNA, 25 bp, E. coli
tcagtacgcaacctagagggcgtgc

SEQ ID NO: 198737 - DNA, 25 bp, E. coli
gcgaaacgctgatccaaaccattga

SEQ ID NO: 198738 - DNA, 25 bp, E. coli
gcgaaacgctgaaccaaaccattga

SEQ ID NO: 198739 - DNA, 25 bp, E. coli
gaagagcaaggtgaggaaacaccat

SEQ ID NO: 198740 - DNA, 25 bp, E. coli
gaatttcagacaacagcacccaact

SEQ ID NO: 198741 - DNA, 25 bp, E. coli
gaagagcaaggtcaggaaacaccat

SEQ ID NO: 198742 - DNA, 25 bp, E. coli
gaatttcagacatcagcacccaact

SEQ ID NO: 198743 - DNA, 25 bp, E. coli
tggtggaagcagaagacagcgaaac

SEQ ID NO: 198744 - DNA, 25 bp, E. coli
tggcggtgtcgctggtttatcacca

SEQ ID NO: 198745 - DNA, 25 bp, E. coli
tggtggaagcagtagacagcgaaac

SEQ ID NO: 198746 - DNA, 25 bp, E. coli
tggcggtgtcgcaggtttatcacca

SEQ ID NO: 198747 - DNA, 25 bp, E. coli
tactgtgcaatttttcattgattgc

SEQ ID NO: 198748 - DNA, 25 bp, E. coli
tactgtgcaattattcattgattgc

SEQ ID NO: 198749 - DNA, 25 bp, E. coli
tattgataactatttgcatttgcaa

SEQ ID NO: 198750 - DNA, 25 bp, E. coli
tattgataactaattgcatttgcaa

SEQ ID NO: 198751 - DNA, 25 bp, E. coli
tgcaatagcgtaatggcgcgccgtg

SEQ ID NO: 198752 - DNA, 25 bp, E. coli
tgcaatagcgtattggcgcgccgtg

SEQ ID NO: 198753 - DNA, 25 bp, E. coli
ccataaccccatctttactgtgcaa

SEQ ID NO: 198754 - DNA, 25 bp, E. coli
ccataaccccatgtttactgtgcaa

SEQ ID NO: 198755 - DNA, 25 bp, E. coli
gcatttgcaataccgtaatggcgcg

SEQ ID NO: 198756 - DNA, 25 bp, E. coli
gcatttgcaatagcgtaatggcgcg

SEQ ID NO: 198757 - DNA, 25 bp, E. coli
gaagcgcggacaataattaaccaac

SEQ ID NO: 198758 - DNA, 25 bp, E. coli
gaagcgcggacattaattaaccaac

SEQ ID NO: 198759 - DNA, 25 bp, E. coli
cgcggacattaaataaccaactgca

SEQ ID NO: 198760 - DNA, 25 bp, E. coli
cccatgtttactctgcaatttttca

SEQ ID NO: 198761 - DNA, 25 bp, E. coli
cgcggacattaattaaccaactgca

SEQ ID NO: 198762 - DNA, 25 bp, E. coli
cccatgtttactgtgcaatttttca

SEQ ID NO: 198763 - DNA, 25 bp, E. coli
cattaattaaccaactgcactgcgt

SEQ ID NO: 198764 - DNA, 25 bp, E. coli
cattgattgcagtaatatattgata

SEQ ID NO: 198765 - DNA, 25 bp, E. coli
cattaattaacctactgcactgcgt

SEQ ID NO: 198766 - DNA, 25 bp, E. coli
cattgattgcagaaatatattgata

SEQ ID NO: 198767 - DNA, 25 bp, E. coli
gtgggaagcgcggacattaattaac

SEQ ID NO: 198768 - DNA, 25 bp, E. coli
gtgggaagcgcgcacattaattaac

SEQ ID NO: 198769 - DNA, 25 bp, E. coli
cacctgacggtgtcgcagataagtt

SEQ ID NO: 198770 - DNA, 25 bp, E. coli
caacttattgttcgcgcgtatgaca

SEQ ID NO: 198771 - DNA, 25 bp, E. coli
cacctgacggtgacgcagataagtt

SEQ ID NO: 198772 - DNA, 25 bp, E. coli
caacttattgttggcgcgtatgaca

SEQ ID NO: 198773 - DNA, 25 bp, E. coli
aaagggattgaaagcccggcagaat

SEQ ID NO: 198774 - DNA, 25 bp, E. coli
aaagggattgaatgcccggcagaat

SEQ ID NO: 198775 - DNA, 25 bp, E. coli
tatgctattccagatccagggatgg

SEQ ID NO: 198776 - DNA, 25 bp, E. coli
tatgctattccacatccagggatgg

SEQ ID NO: 198777 - DNA, 25 bp, E. coli
ttaagagtgaaaaagaccagctggc

SEQ ID NO: 198778 - DNA, 25 bp, E. coli
ttaagagtgaaatagaccagctggc

SEQ ID NO: 198779 - DNA, 25 bp, E. coli
tgacagaaataaacgcgactacgcc

SEQ ID NO: 198780 - DNA, 25 bp, E. coli
tgatgataaaaaggcctggcaggac

SEQ ID NO: 198781 - DNA, 25 bp, E. coli
tgacagaaataatcgcgactacgcc

SEQ ID NO: 198782 - DNA, 25 bp, E. coli
tgatgataaaaacgcctggcaggac

SEQ ID NO: 198783 - DNA, 25 bp, E. coli
cgctaatggcgccttccgctgatga

SEQ ID NO: 198784 - DNA, 25 bp, E. coli
cgctaaacagatttgaccggagtat

SEQ ID NO: 198785 - DNA, 25 bp, E. coli
cgctaaacagatatgaccggagtat

SEQ ID NO: 198786 - DNA, 25 bp, E. coli
cgctaatggcgcgttccgctgatga

SEQ ID NO: 198787 - DNA, 25 bp, E. coli
taatcgcaggtataacgcctgccgc

SEQ ID NO: 198788 - DNA, 25 bp, E. coli
taatcgcaggtaaaacgcctgccgc

SEQ ID NO: 198789 - DNA, 25 bp, E. coli
gagaaatttgatcgcgtgacgctac

SEQ ID NO: 198790 - DNA, 25 bp, E. coli
gagaaatttgatggcgtgacgctac

SEQ ID NO: 198791 - DNA, 25 bp, E. coli
aatatgtaattttcagcatttgcat

SEQ ID NO: 198792 - DNA, 25 bp, E. coli
aatatgtaatttacagcatttgcat

SEQ ID NO: 198793 - DNA, 25 bp, E. coli
cagcatttgcataaaatttaaaagc

SEQ ID NO: 198794 - DNA, 25 bp, E. coli
cagcatttgcattaaatttaaaagc

SEQ ID NO: 198795 - DNA, 25 bp, E. coli
aaatatgtaattatcagcatttgca

SEQ ID NO: 198796 - DNA, 25 bp, E. coli
aaatatgtaattttcagcatttgca

SEQ ID NO: 198797 - DNA, 25 bp, E. coli
tatgtaattttctgcatttgcatta

SEQ ID NO: 198798 - DNA, 25 bp, E. coli
tatgtaattttcagcatttgcatta

SEQ ID NO: 198799 - DNA, 25 bp, E. coli
tgtaattttcagcatttgcattaaa

SEQ ID NO: 198800 - DNA, 25 bp, E. coli
tgtaattttcaggatttgcattaaa

SEQ ID NO: 198801 - DNA, 25 bp, E. coli
tcagcatttgcattaaatttaaaag

SEQ ID NO: 198802 - DNA, 25 bp, E. coli
gcatttgcattatatttaaaagcat

SEQ ID NO: 198803 - DNA, 25 bp, E. coli
gcattaaatttataagcataacact

SEQ ID NO: 198804 - DNA, 25 bp, E. coli
gcatttgcattaaatttaaaagcat

SEQ ID NO: 198805 - DNA, 25 bp, E. coli
gcattaaatttaaaagcataacact

SEQ ID NO: 198806 - DNA, 25 bp, E. coli
gaatacaaaataagtaattttcagc

SEQ ID NO: 198807 - DNA, 25 bp, E. coli
gaatacaaaatatgtaattttcagc

SEQ ID NO: 198808 - DNA, 25 bp, E. coli
cattaaatttaaaagcataacacta

SEQ ID NO: 198809 - DNA, 25 bp, E. coli
cattaaatttaatagcataacacta

SEQ ID NO: 198810 - DNA, 25 bp, E. coli
gtaattttcagcatttgcattaaat

SEQ ID NO: 198811 - DNA, 25 bp, E. coli
gtaattttcagcttttgcattaaat

SEQ ID NO: 198812 - DNA, 25 bp, E. coli
tcagcatttgcaataaatttaaaag

SEQ ID NO: 198813 - DNA, 25 bp, E. coli
caatatcagtgtaccgttaaatccg

SEQ ID NO: 198814 - DNA, 25 bp, E. coli
caatatcagtgttccgttaaatccg

SEQ ID NO: 198815 - DNA, 25 bp, E. coli
catgagcggataccacagaatttcc

SEQ ID NO: 198816 - DNA, 25 bp, E. coli
catgagcggatagcacagaatttcc

SEQ ID NO: 198817 - DNA, 25 bp, E. coli
agaatttcccatgactttctgctat

SEQ ID NO: 198818 - DNA, 25 bp, E. coli
agaatttcccatcactttctgctat

SEQ ID NO: 198819 - DNA, 25 bp, E. coli
aaagaacctttttacattatgagcg

SEQ ID NO: 198820 - DNA, 25 bp, E. coli
aaagaaccttttaacattatgagcg

SEQ ID NO: 198821 - DNA, 25 bp, E. coli
tatgagcgtcaaaatcagtgtaccg

SEQ ID NO: 198822 - DNA, 25 bp, E. coli
tatgagcgtcaatatcagtgtaccg

SEQ ID NO: 198823 - DNA, 25 bp, E. coli
tattattggccattgaaagaacctt

SEQ ID NO: 198824 - DNA, 25 bp, E. coli
tattattggccaatgaaagaacctt

SEQ ID NO: 198825 - DNA, 25 bp, E. coli
tcgggtttgagttacgccgcgcgaa

SEQ ID NO: 198826 - DNA, 25 bp, E. coli
tcgggtttgagtaacgccgcgcgaa

SEQ ID NO: 198827 - DNA, 25 bp, E. coli
ccgatgattcggctttgagtaacgc

SEQ ID NO: 198828 - DNA, 25 bp, E. coli
ccgatgattcgggtttgagtaacgc

SEQ ID NO: 198829 - DNA, 25 bp, E. coli
gtaccgttaaatccgatgattcggg

SEQ ID NO: 198830 - DNA, 25 bp, E. coli
gtaccgttaaatgcgatgattcggg

SEQ ID NO: 198831 - DNA, 25 bp, E. coli
ggataccacagattttcccatgact

SEQ ID NO: 198832 - DNA, 25 bp, E. coli
ggataccacagaatttcccatgact

SEQ ID NO: 198833 - DNA, 25 bp, E. coli
taacgccgcgcgtaacatgagcgga

SEQ ID NO: 198834 - DNA, 25 bp, E. coli
taacgccgcgcgaaacatgagcgga

SEQ ID NO: 198835 - DNA, 25 bp, E. coli
cacactgatgcgcaaaaggctgagc

SEQ ID NO: 198836 - DNA, 25 bp, E. coli
cacactgatgcggaaaaggctgagc

SEQ ID NO: 198837 - DNA, 25 bp, E. coli
aatgaagtgggcgacttacatcccg

SEQ ID NO: 198838 - DNA, 25 bp, E. coli
aaacagccgttcttgttgccgtgga

SEQ ID NO: 198839 - DNA, 25 bp, E. coli
aatgaagtgggccacttacatcccg

SEQ ID NO: 198840 - DNA, 25 bp, E. coli
aaacagccgttcatgttgccgtgga

SEQ ID NO: 198841 - DNA, 25 bp, E. coli
tagcagaactggaagccgaactcgt

SEQ ID NO: 198842 - DNA, 25 bp, E. coli
tagcagaactggtagccgaactcgt

SEQ ID NO: 198843 - DNA, 25 bp, E. coli
tgagcaatggctacaggcgtgcgac

SEQ ID NO: 198844 - DNA, 25 bp, E. coli
tgagcaatggcttcaggcgtgcgac

SEQ ID NO: 198845 - DNA, 25 bp, E. coli
tcctggtgcgtcgtggaaaccgtca

SEQ ID NO: 198846 - DNA, 25 bp, E. coli
tcctggtgcgtcctggaaaccgtca

SEQ ID NO: 198847 - DNA, 25 bp, E. coli
gaatgccggatagcaaaacagccgt

SEQ ID NO: 198848 - DNA, 25 bp, E. coli
gaatgccggataccaaaacagccgt

SEQ ID NO: 198849 - DNA, 25 bp, E. coli
gaagcatcagagaagcgcatagcag

SEQ ID NO: 198850 - DNA, 25 bp, E. coli
gaagcatcagagtagcgcatagcag

SEQ ID NO: 198851 - DNA, 25 bp, E. coli
gaatgcgctgtctggcaactctccg

SEQ ID NO: 198852 - DNA, 25 bp, E. coli
gaatgcgctgtcaggcaactctccg

SEQ ID NO: 198853 - DNA, 25 bp, E. coli
taagctggaacgcttgcagaatgcg

SEQ ID NO: 198854 - DNA, 25 bp, E. coli
tacaagttgccacacacgcagtttg

SEQ ID NO: 198855 - DNA, 25 bp, E. coli
tacaagttgccagacacgcagtttg

SEQ ID NO: 198856 - DNA, 25 bp, E. coli
taagctggaacggttgcagaatgcg

SEQ ID NO: 198857 - DNA, 25 bp, E. coli
caaaacctggagttacatgctcgtc

SEQ ID NO: 198858 - DNA, 25 bp, E. coli
caaaacctggagatacatgctcgtc

SEQ ID NO: 198859 - DNA, 25 bp, E. coli
caactggcgggcctgagccagcatt

SEQ ID NO: 198860 - DNA, 25 bp, E. coli
caactggcgggcgtgagccagcatt

SEQ ID NO: 198861 - DNA, 25 bp, E. coli
catgctcgtctgattcatatcccgg

SEQ ID NO: 198862 - DNA, 25 bp, E. coli
catgctcgtctgtttcatatcccgg

SEQ ID NO: 198863 - DNA, 25 bp, E. coli
tcgtctgtttcaaatcccggaagcg

SEQ ID NO: 198864 - DNA, 25 bp, E. coli
ttggaccggatggtgtcggtaaatc

SEQ ID NO: 198865 - DNA, 25 bp, E. coli
ttggaccggatgctgtcggtaaatc

SEQ ID NO: 198866 - DNA, 25 bp, E. coli
tcgtctgtttcatatcccggaagcg

SEQ ID NO: 198867 - DNA, 25 bp, E. coli
gcgtcattgagctgggcggcgtgat

SEQ ID NO: 198868 - DNA, 25 bp, E. coli
gcgtcattgagcagggcggcgtgat

SEQ ID NO: 198869 - DNA, 25 bp, E. coli
cgtcgaagatgttttgccggagtca

SEQ ID NO: 198870 - DNA, 25 bp, E. coli
cgtcgaagatgtattgccggagtca

SEQ ID NO: 198871 - DNA, 25 bp, E. coli
ggtaaatcgagcttgttgtcgctga

SEQ ID NO: 198872 - DNA, 25 bp, E. coli
ggtaaatcgagcatgttgtcgctga

SEQ ID NO: 198873 - DNA, 25 bp, E. coli
tcaacgacgtcgaagatgtattgcc

SEQ ID NO: 198874 - DNA, 25 bp, E. coli
tcaacgacgtcgtagatgtattgcc

SEQ ID NO: 198875 - DNA, 25 bp, E. coli
gatggtgtcggttaatcgagcttgt

SEQ ID NO: 198876 - DNA, 25 bp, E. coli
gatggtgtcggtaaatcgagcttgt

SEQ ID NO: 198877 - DNA, 25 bp, E. coli
gagatgttaatcgttgatgaaccga

SEQ ID NO: 198878 - DNA, 25 bp, E. coli
gagatgttaatccttgatgaaccga

SEQ ID NO: 198879 - DNA, 25 bp, E. coli
aataggcagagcgaccgatctggtg

SEQ ID NO: 198880 - DNA, 25 bp, E. coli
aataggcagagccaccgatctggtg

SEQ ID NO: 198881 - DNA, 25 bp, E. coli
cacaagccgttcaggagttagcaca

SEQ ID NO: 198882 - DNA, 25 bp, E. coli
cacaagccgttctggagttagcaca

SEQ ID NO: 198883 - DNA, 25 bp, E. coli
aaacgccgcgaggagtttgaacgca

SEQ ID NO: 198884 - DNA, 25 bp, E. coli
aaacgccgcgagcagtttgaacgca

SEQ ID NO: 198885 - DNA, 25 bp, E. coli
tatccggatctccaaatcgtggtgc

SEQ ID NO: 198886 - DNA, 25 bp, E. coli
tatccggatctcgaaatcgtggtgc

SEQ ID NO: 198887 - DNA, 25 bp, E. coli
tattcgtgccgaactgacaaagcgt

SEQ ID NO: 198888 - DNA, 25 bp, E. coli
tattcgtgccgatctgacaaagcgt

SEQ ID NO: 198889 - DNA, 25 bp, E. coli
ttattgcaggaagagtgtgagccgc

SEQ ID NO: 198890 - DNA, 25 bp, E. coli
ttattgcaggaacagtgtgagccgc

SEQ ID NO: 198891 - DNA, 25 bp, E. coli
gcttttgcgccacacatatccggat

SEQ ID NO: 198892 - DNA, 25 bp, E. coli
gcttttgcgccagacatatccggat

SEQ ID NO: 198893 - DNA, 25 bp, E. coli
gaaaactgattatgtctcgctgcca

SEQ ID NO: 198894 - DNA, 25 bp, E. coli
gaaaactgattaagtctcgctgcca

SEQ ID NO: 198895 - DNA, 25 bp, E. coli
gacaaatacaacctaccgtgccgct

SEQ ID NO: 198896 - DNA, 25 bp, E. coli
gacaaatacaacgtaccgtgccgct

SEQ ID NO: 198897 - DNA, 25 bp, E. coli
gatttcctgaaaacggcccagcttt

SEQ ID NO: 198898 - DNA, 25 bp, E. coli
gatttcctgaaatcggcccagcttt

SEQ ID NO: 198899 - DNA, 25 bp, E. coli
ggccggtttaatgcgcgctctgaaa

SEQ ID NO: 198900 - DNA, 25 bp, E. coli
ggccggtttaatccgcgctctgaaa

SEQ ID NO: 198901 - DNA, 25 bp, E. coli
tacggcatcaccatatttcaagcat

SEQ ID NO: 198902 - DNA, 25 bp, E. coli
aaacctgctgtaccgattgtaacct

SEQ ID NO: 198903 - DNA, 25 bp, E. coli
aaacctgctgtagcgattgtaacct

SEQ ID NO: 198904 - DNA, 25 bp, E. coli
tacggcatcaccttatttcaagcat

SEQ ID NO: 198905 - DNA, 25 bp, E. coli
tgttacgctaactccgaaagaggct

SEQ ID NO: 198906 - DNA, 25 bp, E. coli
tgttacgctaacaccgaaagaggct

SEQ ID NO: 198907 - DNA, 25 bp, E. coli
tccctgtgttatcggtacggcatca

SEQ ID NO: 198908 - DNA, 25 bp, E. coli
tccctgtgttatgggtacggcatca

SEQ ID NO: 198909 - DNA, 25 bp, E. coli
tccgtctcctggataaaattgaaaa

SEQ ID NO: 198910 - DNA, 25 bp, E. coli
tccgtctcctggttaaaattgaaaa

SEQ ID NO: 198911 - DNA, 25 bp, E. coli
gcacggttccatgcaaaattcatga

SEQ ID NO: 198912 - DNA, 25 bp, E. coli
gcacggttccatccaaaattcatga

SEQ ID NO: 198913 - DNA, 25 bp, E. coli
gaaagaggcttttcgcacggttcca

SEQ ID NO: 198914 - DNA, 25 bp, E. coli
gaaagaggctttacgcacggttcca

SEQ ID NO: 198915 - DNA, 25 bp, E. coli
gacggattatcagctagtccctgtg

SEQ ID NO: 198916 - DNA, 25 bp, E. coli
cgattgtaaccttatggacggatta

SEQ ID NO: 198917 - DNA, 25 bp, E. coli
cgaatttagcgccttatgctgcgta

SEQ ID NO: 198918 - DNA, 25 bp, E. coli
cgattgtaacctaatggacggatta

SEQ ID NO: 198919 - DNA, 25 bp, E. coli
cgaatttagcgcgttatgctgcgta

SEQ ID NO: 198920 - DNA, 25 bp, E. coli
tgacgggcctttgtgcgaatttagc

SEQ ID NO: 198921 - DNA, 25 bp, E. coli
tgacgggcctttctgcgaatttagc

SEQ ID NO: 198922 - DNA, 25 bp, E. coli
gacggattatcacctagtccctgtg

SEQ ID NO: 198923 - DNA, 25 bp, E. coli
tacgccttcagtttatgatccacaa

SEQ ID NO: 198924 - DNA, 25 bp, E. coli
tacgccttcagtatatgatccacaa

SEQ ID NO: 198925 - DNA, 25 bp, E. coli
tgaacacttctccattcagatggca

SEQ ID NO: 198926 - DNA, 25 bp, E. coli
tgaacacttctcgattcagatggca

SEQ ID NO: 198927 - DNA, 25 bp, E. coli
tcgctgtttcctaatgatccacaac

SEQ ID NO: 198928 - DNA, 25 bp, E. coli
tcgatttgctgcagacgtcacgcat

SEQ ID NO: 198929 - DNA, 25 bp, E. coli
tcgctgtttccttatgatccacaac

SEQ ID NO: 198930 - DNA, 25 bp, E. coli
tcgatttgctgctgacgtcacgcat

SEQ ID NO: 198931 - DNA, 25 bp, E. coli
tcattgatggacaacttgatctgtg

SEQ ID NO: 198932 - DNA, 25 bp, E. coli
tcattgatggactacttgatctgtg

SEQ ID NO: 198933 - DNA, 25 bp, E. coli
gcaataagcgaaacgacgccccatg

SEQ ID NO: 198934 - DNA, 25 bp, E. coli
gcaataagcgaatcgacgccccatg

SEQ ID NO: 198935 - DNA, 25 bp, E. coli
gaacatgtcgtcctcattgatggac

SEQ ID NO: 198936 - DNA, 25 bp, E. coli
gaacatgtcgtcgtcattgatggac

SEQ ID NO: 198937 - DNA, 25 bp, E. coli
gggtaatcgaacatgtcgtcgtcat

SEQ ID NO: 198938 - DNA, 25 bp, E. coli
gggagcaaaccgtacattttcattc

SEQ ID NO: 198939 - DNA, 25 bp, E. coli
gggagcaaaccgaacattttcattc

SEQ ID NO: 198940 - DNA, 25 bp, E. coli
gggtaatcgaacttgtcgtcgtcat

SEQ ID NO: 198941 - DNA, 25 bp, E. coli
ggaaggcgttcgatttgctgcagac

SEQ ID NO: 198942 - DNA, 25 bp, E. coli
ggaaggcgttcgttttgctgcagac

SEQ ID NO: 198943 - DNA, 25 bp, E. coli
gatccacaactcagctttgaacact

SEQ ID NO: 198944 - DNA, 25 bp, E. coli
gatccacaactctgctttgaacact

SEQ ID NO: 198945 - DNA, 25 bp, E. coli
aagaattttcagctcagactcttct

SEQ ID NO: 198946 - DNA, 25 bp, E. coli
caatgagtaaaaaatcgacagcggg

SEQ ID NO: 198947 - DNA, 25 bp, E. coli
caatgagtaaaatatcgacagcggg

SEQ ID NO: 198948 - DNA, 25 bp, E. coli
aagaattttcaggtcagactcttct

SEQ ID NO: 198949 - DNA, 25 bp, E. coli
caaacattgtcttaacgtaatactt

SEQ ID NO: 198950 - DNA, 25 bp, E. coli
caaagttgaacattaagtgtggtca

SEQ ID NO: 198951 - DNA, 25 bp, E. coli
caaacattgtctaaacgtaatactt

SEQ ID NO: 198952 - DNA, 25 bp, E. coli
caaagttgaacaataagtgtggtca

SEQ ID NO: 198953 - DNA, 25 bp, E. coli
tactcttgccaatacataagaattt

SEQ ID NO: 198954 - DNA, 25 bp, E. coli
tactcttgccaaaacataagaattt

SEQ ID NO: 198955 - DNA, 25 bp, E. coli
tatgccccaatgtgtaaaaaatcga

SEQ ID NO: 198956 - DNA, 25 bp, E. coli
tatgccccaatgagtaaaaaatcga

SEQ ID NO: 198957 - DNA, 25 bp, E. coli
ttgactcctttttcaaagttgaaca

SEQ ID NO: 198958 - DNA, 25 bp, E. coli
ttgactccttttacaaagttgaaca

SEQ ID NO: 198959 - DNA, 25 bp, E. coli
ggtcagactcttgttaagagacgct

SEQ ID NO: 198960 - DNA, 25 bp, E. coli
ggtcagactcttcttaagagacgct

SEQ ID NO: 198961 - DNA, 25 bp, E. coli
gtgtggtcaacattatctactcttg

SEQ ID NO: 198962 - DNA, 25 bp, E. coli
gtgtggtcaacaatatctactcttg

SEQ ID NO: 198963 - DNA, 25 bp, E. coli
taatacttatttttatgccccaatg

SEQ ID NO: 198964 - DNA, 25 bp, E. coli
taagagacgctaaaacaaacattgt

SEQ ID NO: 198965 - DNA, 25 bp, E. coli
taagagacgctataacaaacattgt

SEQ ID NO: 198966 - DNA, 25 bp, E. coli
taatacttatttatatgccccaatg

SEQ ID NO: 198967 - DNA, 25 bp, E. coli
aatcgtcgaagcgaccttctgaccg

SEQ ID NO: 198968 - DNA, 25 bp, E. coli
aatcgtcgaagccaccttctgaccg

SEQ ID NO: 198969 - DNA, 25 bp, E. coli
catatggacatttcccgaaagcgat

SEQ ID NO: 198970 - DNA, 25 bp, E. coli
catatggacattacccgaaagcgat

SEQ ID NO: 198971 - DNA, 25 bp, E. coli
ttctgaccgctctgttccagatgct

SEQ ID NO: 198972 - DNA, 25 bp, E. coli
ttctgaccgctcagttccagatgct

SEQ ID NO: 198973 - DNA, 25 bp, E. coli
tgcattgcatatggacattacccga

SEQ ID NO: 198974 - DNA, 25 bp, E. coli
tgcattgcatatcgacattacccga

SEQ ID NO: 198975 - DNA, 25 bp, E. coli
tcacggttaaccaacgaaatcgtcg

SEQ ID NO: 198976 - DNA, 25 bp, E. coli
tcacggttaacctacgaaatcgtcg

SEQ ID NO: 198977 - DNA, 25 bp, E. coli
gctcagttccagatgctccgtaacg

SEQ ID NO: 198978 - DNA, 25 bp, E. coli
gctcagttccagttgctccgtaacg

SEQ ID NO: 198979 - DNA, 25 bp, E. coli
gaagccaccttctgaccgctcagtt

SEQ ID NO: 198980 - DNA, 25 bp, E. coli
gaagccaccttcagaccgctcagtt

SEQ ID NO: 198981 - DNA, 25 bp, E. coli
cgttttgccggagcatatgcattgc

SEQ ID NO: 198982 - DNA, 25 bp, E. coli
ccgctggcgggacattaaaaagcag

SEQ ID NO: 198983 - DNA, 25 bp, E. coli
ccgctggcgggagattaaaaagcag

SEQ ID NO: 198984 - DNA, 25 bp, E. coli
cgttttgccggaccatatgcattgc

SEQ ID NO: 198985 - DNA, 25 bp, E. coli
gtattacatcaatgggggaacctgg

SEQ ID NO: 198986 - DNA, 25 bp, E. coli
gtattacatcaaagggggaacctgg

SEQ ID NO: 198987 - DNA, 25 bp, E. coli
gagattaaaaaggagttcacccatg

SEQ ID NO: 198988 - DNA, 25 bp, E. coli
gagattaaaaagcagttcacccatg

SEQ ID NO: 198989 - DNA, 25 bp, E. coli
catttattattggagggaccccagg

SEQ ID NO: 198990 - DNA, 25 bp, E. coli
catttattattgcagggaccccagg

SEQ ID NO: 198991 - DNA, 25 bp, E. coli
taaacagtgatgttaaacgctcccg

SEQ ID NO: 198992 - DNA, 25 bp, E. coli
taaacagtgatgataaacgctcccg

SEQ ID NO: 198993 - DNA, 25 bp, E. coli
taacataaaaacatgggaccccttg

SEQ ID NO: 198994 - DNA, 25 bp, E. coli
taacataaaaacttgggaccccttg

SEQ ID NO: 198995 - DNA, 25 bp, E. coli
tcaggcgccgaagaaaaagatattc

SEQ ID NO: 198996 - DNA, 25 bp, E. coli
ttggctacagctaaaactccccttg

SEQ ID NO: 198997 - DNA, 25 bp, E. coli
tcaggcgccgaacaaaaagatattc

SEQ ID NO: 198998 - DNA, 25 bp, E. coli
ttggctacagcttaaactccccttg

SEQ ID NO: 198999 - DNA, 25 bp, E. coli
gaaatggaacgcttatcccgacacc

SEQ ID NO: 199000 - DNA, 25 bp, E. coli
gaaatggaacgcatatcccgacacc

SEQ ID NO: 199001 - DNA, 25 bp, E. coli
ccaaacttaggagagcgagacgtaa

SEQ ID NO: 199002 - DNA, 25 bp, E. coli
ccaaacttaggacagcgagacgtaa

SEQ ID NO: 199003 - DNA, 25 bp, E. coli
cgtttttacgcatatcaggcgccga

SEQ ID NO: 199004 - DNA, 25 bp, E. coli
cgtttttacgcaaatcaggcgccga

SEQ ID NO: 199005 - DNA, 25 bp, E. coli
ggagcggagccctatactatgccat

SEQ ID NO: 199006 - DNA, 25 bp, E. coli
ggagcggagcccaatactatgccat

SEQ ID NO: 199007 - DNA, 25 bp, E. coli
taaaatccgttcgtgtatggttggc

SEQ ID NO: 199008 - DNA, 25 bp, E. coli
taaaatccgttcctgtatggttggc

SEQ ID NO: 199009 - DNA, 25 bp, E. coli
taattgttcttctggcgcagccacg

SEQ ID NO: 199010 - DNA, 25 bp, E. coli
taattgttcttcaggcgcagccacg

SEQ ID NO: 199011 - DNA, 25 bp, E. coli
tatggataatctcgtgctacccgcg

SEQ ID NO: 199012 - DNA, 25 bp, E. coli
tatgcctcgcttggtcagtgcagga

SEQ ID NO: 199013 - DNA, 25 bp, E. coli
tatggataatctggtgctacccgcg

SEQ ID NO: 199014 - DNA, 25 bp, E. coli
tatgcctcgcttcgtcagtgcagga

SEQ ID NO: 199015 - DNA, 25 bp, E. coli
tttctgatggtagggcaataactgc

SEQ ID NO: 199016 - DNA, 25 bp, E. coli
tattcggtagaagagattgccacca

SEQ ID NO: 199017 - DNA, 25 bp, E. coli
tattcggtagaacagattgccacca

SEQ ID NO: 199018 - DNA, 25 bp, E. coli
tttctgatggtacggcaataactgc

SEQ ID NO: 199019 - DNA, 25 bp, E. coli
tgtaccgtaaaattcagatcccgtg

SEQ ID NO: 199020 - DNA, 25 bp, E. coli
tgtaccgtaaaaatcagatcccgtg

SEQ ID NO: 199021 - DNA, 25 bp, E. coli
tgttcggcctgagtatcgacccgga

SEQ ID NO: 199022 - DNA, 25 bp, E. coli
tgttcggcctgactatcgacccgga

SEQ ID NO: 199023 - DNA, 25 bp, E. coli
cgtttgtcgaaattgagagccgtgc

SEQ ID NO: 199024 - DNA, 25 bp, E. coli
cgtttgtcgaaaatgagagccgtgc

SEQ ID NO: 199025 - DNA, 25 bp, E. coli
cgtcgggagaactgtcgctatgcct

SEQ ID NO: 199026 - DNA, 25 bp, E. coli
cgtcgggagaacagtcgctatgcct

SEQ ID NO: 199027 - DNA, 25 bp, E. coli
ggttgccccgcttcaacaagagatg

SEQ ID NO: 199028 - DNA, 25 bp, E. coli
ggttgccccgctacaacaagagatg

SEQ ID NO: 199029 - DNA, 25 bp, E. coli
taactgcggaggaattaggacacgc

SEQ ID NO: 199030 - DNA, 25 bp, E. coli
taactgcggaggtattaggacacgc

SEQ ID NO: 199031 - DNA, 25 bp, E. coli
gagatgaaactgcatccaacgccga

SEQ ID NO: 199032 - DNA, 25 bp, E. coli
gagatgaaactggatccaacgccga

SEQ ID NO: 199033 - DNA, 25 bp, E. coli
aatatgtgattaacgtcgctaccgc

SEQ ID NO: 199034 - DNA, 25 bp, E. coli
aatatgtgattatcgtcgctaccgc

SEQ ID NO: 199035 - DNA, 25 bp, E. coli
caattattgccgttgtcgcggcggt

SEQ ID NO: 199036 - DNA, 25 bp, E. coli
caattattgccgatgtcgcggcggt

SEQ ID NO: 199037 - DNA, 25 bp, E. coli
caaagtgtttctcgtgctcgatgcg

SEQ ID NO: 199038 - DNA, 25 bp, E. coli
caaagtgtttctggtgctcgatgcg

SEQ ID NO: 199039 - DNA, 25 bp, E. coli
tgtacatcgcgcagcaacactatgt

SEQ ID NO: 199040 - DNA, 25 bp, E. coli
tgtacatcgcgctgcaacactatgt

SEQ ID NO: 199041 - DNA, 25 bp, E. coli
gcgcgatattctgctgggccactat

SEQ ID NO: 199042 - DNA, 25 bp, E. coli
gccactatccgcacggctgggtcaa

SEQ ID NO: 199043 - DNA, 25 bp, E. coli
gccactatccgctcggctgggtcaa

SEQ ID NO: 199044 - DNA, 25 bp, E. coli
gcgcgatattctcctgggccactat

SEQ ID NO: 199045 - DNA, 25 bp, E. coli
gctgggtcaaacacccggaatatgt

SEQ ID NO: 199046 - DNA, 25 bp, E. coli
gcattactgccgaagccatgacggg

SEQ ID NO: 199047 - DNA, 25 bp, E. coli
gcattactgccgtagccatgacggg

SEQ ID NO: 199048 - DNA, 25 bp, E. coli
gctgggtcaaactcccggaatatgt

SEQ ID NO: 199049 - DNA, 25 bp, E. coli
gactggtggtcttttctatcatcgg

SEQ ID NO: 199050 - DNA, 25 bp, E. coli
gactggtggtctattctatcatcgg

SEQ ID NO: 199051 - DNA, 25 bp, E. coli
cggtcttttactacagccacgaagg

SEQ ID NO: 199052 - DNA, 25 bp, E. coli
cggtcttttacttcagccacgaagg

SEQ ID NO: 199053 - DNA, 25 bp, E. coli
taaccaccggcgagtttggcggcgt

SEQ ID NO: 199054 - DNA, 25 bp, E. coli
taaccaccggcgtgtttggcggcgt

SEQ ID NO: 199055 - DNA, 25 bp, E. coli
tacacagccggaaaatcagcttgcg

SEQ ID NO: 199056 - DNA, 25 bp, E. coli
tacacagccggataatcagcttgcg

SEQ ID NO: 199057 - DNA, 25 bp, E. coli
aaagccactggtatcatgaaacgca

SEQ ID NO: 199058 - DNA, 25 bp, E. coli
aaagccactggtttcatgaaacgca

SEQ ID NO: 199059 - DNA, 25 bp, E. coli
ttatgtaactactattcggcgcgac

SEQ ID NO: 199060 - DNA, 25 bp, E. coli
ttatgtaactacaattcggcgcgac

SEQ ID NO: 199061 - DNA, 25 bp, E. coli
ttttattggctttcaggcgcggaca

SEQ ID NO: 199062 - DNA, 25 bp, E. coli
ttatgaacgcttctcgacggccctg

SEQ ID NO: 199063 - DNA, 25 bp, E. coli
ttatgaacgcttgtcgacggccctg

SEQ ID NO: 199064 - DNA, 25 bp, E. coli
ttaatctgctggaatggagcgggct

SEQ ID NO: 199065 - DNA, 25 bp, E. coli
ttttattggcttacaggcgcggaca

SEQ ID NO: 199066 - DNA, 25 bp, E. coli
ttaatctgctggtatggagcgggct

SEQ ID NO: 199067 - DNA, 25 bp, E. coli
tgatgaatcattacgctggcgaagc

SEQ ID NO: 199068 - DNA, 25 bp, E. coli
tgatgaatcatttcgctggcgaagc

SEQ ID NO: 199069 - DNA, 25 bp, E. coli
tgttgagcgcgcaaccgttcaggcg

SEQ ID NO: 199070 - DNA, 25 bp, E. coli
tgttgagcgcgctaccgttcaggcg

SEQ ID NO: 199071 - DNA, 25 bp, E. coli
cggttgctcaggattgcggcgtcca

SEQ ID NO: 199072 - DNA, 25 bp, E. coli
cggttgctcaggtttgcggcgtcca

SEQ ID NO: 199073 - DNA, 25 bp, E. coli
taatcatcggttcgcacaaatcacg

SEQ ID NO: 199074 - DNA, 25 bp, E. coli
taatcatcggttggcacaaatcacg

SEQ ID NO: 199075 - DNA, 25 bp, E. coli
gagatacaaaacaacgccgacgcgt

SEQ ID NO: 199076 - DNA, 25 bp, E. coli
gagatacaaaactacgccgacgcgt

SEQ ID NO: 199077 - DNA, 25 bp, E. coli
cagagtcgtttgtcatcaggctgga

SEQ ID NO: 199078 - DNA, 25 bp, E. coli
cagggatttctggtatccgcccgga

SEQ ID NO: 199079 - DNA, 25 bp, E. coli
cagagtcgtttgacatcaggctgga

SEQ ID NO: 199080 - DNA, 25 bp, E. coli
cagggatttctgctatccgcccgga

SEQ ID NO: 199081 - DNA, 25 bp, E. coli
acatgtcgtcttcaaaacccgggcg

SEQ ID NO: 199082 - DNA, 25 bp, E. coli
acatgtcgtcttgaaaacccgggcg

SEQ ID NO: 199083 - DNA, 25 bp, E. coli
taggcattgcactgctggacaccga

SEQ ID NO: 199084 - DNA, 25 bp, E. coli
taggcattgcacagctggacaccga

SEQ ID NO: 199085 - DNA, 25 bp, E. coli
tgtctgccggactggcaatagcctc

SEQ ID NO: 199086 - DNA, 25 bp, E. coli
tgtctgccggacaggcaatagcctc

SEQ ID NO: 199087 - DNA, 25 bp, E. coli
tgatgataaaaagcacaggcgctct

SEQ ID NO: 199088 - DNA, 25 bp, E. coli
tgatgataaaaaccacaggcgctct

SEQ ID NO: 199089 - DNA, 25 bp, E. coli
tcaggctggaaaactgccatgcaac

SEQ ID NO: 199090 - DNA, 25 bp, E. coli
tcaggctggaaatctgccatgcaac

SEQ ID NO: 199091 - DNA, 25 bp, E. coli
gccatctgaaggtaaccggagtgaa

SEQ ID NO: 199092 - DNA, 25 bp, E. coli
gccatctgaaggaaaccggagtgaa

SEQ ID NO: 199093 - DNA, 25 bp, E. coli
gtaatctgcttgtcagaccctgcca

SEQ ID NO: 199094 - DNA, 25 bp, E. coli
gtaatctgcttgacagaccctgcca

SEQ ID NO: 199095 - DNA, 25 bp, E. coli
ggcaaaattgtgtccctgaccttta

SEQ ID NO: 199096 - DNA, 25 bp, E. coli
ggcaaaattgtgaccctgaccttta

SEQ ID NO: 199097 - DNA, 25 bp, E. coli
gaccctgccatgtgtccggtgacag

SEQ ID NO: 199098 - DNA, 25 bp, E. coli
gaccctgccatgagtccggtgacag

SEQ ID NO: 199099 - DNA, 25 bp, E. coli
caaattggctttgtctatgcggcaa

SEQ ID NO: 199100 - DNA, 25 bp, E. coli
caaattggctttctctatgcggcaa

SEQ ID NO: 199101 - DNA, 25 bp, E. coli
cagtggaaaactggcgcatagcgta

SEQ ID NO: 199102 - DNA, 25 bp, E. coli
cagtggaaaactcgcgcatagcgta

SEQ ID NO: 199103 - DNA, 25 bp, E. coli
tagttcgttgctgcaatatacaatg

SEQ ID NO: 199104 - DNA, 25 bp, E. coli
tagcgtacggccaggtctgttgatg

SEQ ID NO: 199105 - DNA, 25 bp, E. coli
tagttcgttgctccaatatacaatg

SEQ ID NO: 199106 - DNA, 25 bp, E. coli
tagcgtacggcctggtctgttgatg

SEQ ID NO: 199107 - DNA, 25 bp, E. coli
tgttgatgttgctctccacattggg

SEQ ID NO: 199108 - DNA, 25 bp, E. coli
tgttgatgttgcactccacattggg

SEQ ID NO: 199109 - DNA, 25 bp, E. coli
ccaggtctgttgttgttgctctcca

SEQ ID NO: 199110 - DNA, 25 bp, E. coli
ccaggtctgttgatgttgctctcca

SEQ ID NO: 199111 - DNA, 25 bp, E. coli
gaaaactggcgcatagcgtacggcc

SEQ ID NO: 199112 - DNA, 25 bp, E. coli
gaaaactggcgcttagcgtacggcc

SEQ ID NO: 199113 - DNA, 25 bp, E. coli
ctgagtgcggttagttcgttgctgc

SEQ ID NO: 199114 - DNA, 25 bp, E. coli
ctgagtgcggtttgttcgttgctgc

SEQ ID NO: 199115 - DNA, 25 bp, E. coli
tgtcggcggcgcaaattggctttct

SEQ ID NO: 199116 - DNA, 25 bp, E. coli
tggcgcatagcgtacggccaggtct

SEQ ID NO: 199117 - DNA, 25 bp, E. coli
tgtcggcggcgctaattggctttct

SEQ ID NO: 199118 - DNA, 25 bp, E. coli
tggcgcatagcgaacggccaggtct

SEQ ID NO: 199119 - DNA, 25 bp, E. coli
tggcgcgttaacgagtggaaaactg

SEQ ID NO: 199120 - DNA, 25 bp, E. coli
tggcgcgttaaccagtggaaaactg

SEQ ID NO: 199121 - DNA, 25 bp, E. coli
aattatcttgagtgcctgacgcagg

SEQ ID NO: 199122 - DNA, 25 bp, E. coli
aattatcttgagagcctgacgcagg

SEQ ID NO: 199123 - DNA, 25 bp, E. coli
tactgacgatgctgggtagcgccat

SEQ ID NO: 199124 - DNA, 25 bp, E. coli
tactgacgatgcagggtagcgccat

SEQ ID NO: 199125 - DNA, 25 bp, E. coli
tattatgaaagctgcctgaacccgc

SEQ ID NO: 199126 - DNA, 25 bp, E. coli
tattatgaaagcagcctgaacccgc

SEQ ID NO: 199127 - DNA, 25 bp, E. coli
tttatcacgcatgaaacggcgcgag

SEQ ID NO: 199128 - DNA, 25 bp, E. coli
tttatcacgcatcaaacggcgcgag

SEQ ID NO: 199129 - DNA, 25 bp, E. coli
tgataaaagtgccatccagacggcg

SEQ ID NO: 199130 - DNA, 25 bp, E. coli
tgattgtcagcgtcgaaggcagcga

SEQ ID NO: 199131 - DNA, 25 bp, E. coli
tgataaaagtgcgatccagacggcg

SEQ ID NO: 199132 - DNA, 25 bp, E. coli
tgattgtcagcgacgaaggcagcga

SEQ ID NO: 199133 - DNA, 25 bp, E. coli
tctgaactggtctacaaagcgacgg

SEQ ID NO: 199134 - DNA, 25 bp, E. coli
tctgaactggtcaacaaagcgacgg

SEQ ID NO: 199135 - DNA, 25 bp, E. coli
gaaattcattgtctgcgcggtacac

SEQ ID NO: 199136 - DNA, 25 bp, E. coli
gaaattcattgtgtgcgcggtacac

SEQ ID NO: 199137 - DNA, 25 bp, E. coli
cgtaaaacaactcgctgacgctggc

SEQ ID NO: 199138 - DNA, 25 bp, E. coli
cgtaaaacaactggctgacgctggc

SEQ ID NO: 199139 - DNA, 25 bp, E. coli
gattcataccgaatcgctgccgctg

SEQ ID NO: 199140 - DNA, 25 bp, E. coli
gattcataccgattcgctgccgctg

SEQ ID NO: 199141 - DNA, 25 bp, E. coli
gatcccgctggaaatgccgctgaaa

SEQ ID NO: 199142 - DNA, 25 bp, E. coli
gatcccgctggatatgccgctgaaa

SEQ ID NO: 199143 - DNA, 25 bp, E. coli
caacctgatgctgaaacctgaactg

SEQ ID NO: 199144 - DNA, 25 bp, E. coli
caacctgatgctcaaacctgaactg

SEQ ID NO: 199145 - DNA, 25 bp, E. coli
taaagcggcggtctctaacgatgcc

SEQ ID NO: 199146 - DNA, 25 bp, E. coli
tgtcctcaatgaagccgacggcgca

SEQ ID NO: 199147 - DNA, 25 bp, E. coli
tgtcctcaatgatgccgacggcgca

SEQ ID NO: 199148 - DNA, 25 bp, E. coli
tgaacggtgcgctggctttagctaa

SEQ ID NO: 199149 - DNA, 25 bp, E. coli
tgaacggtgcgcaggctttagctaa

SEQ ID NO: 199150 - DNA, 25 bp, E. coli
ttggcgacgccgagaagatccttcc

SEQ ID NO: 199151 - DNA, 25 bp, E. coli
ttggcgacgccgtgaagatccttcc

SEQ ID NO: 199152 - DNA, 25 bp, E. coli
tccagcacatggatggcgctaacgc

SEQ ID NO: 199153 - DNA, 25 bp, E. coli
tccagcacatggttggcgctaacgc

SEQ ID NO: 199154 - DNA, 25 bp, E. coli
gctcggcgctaatcatgtctggaaa

SEQ ID NO: 199155 - DNA, 25 bp, E. coli
gctcggcgctaaacatgtctggaaa

SEQ ID NO: 199156 - DNA, 25 bp, E. coli
gaacacgttttctcaagtctgggta

SEQ ID NO: 199157 - DNA, 25 bp, E. coli
gaaaaatggatggagcacgaacgct

SEQ ID NO: 199158 - DNA, 25 bp, E. coli
gaacacgttttcacaagtctgggta

SEQ ID NO: 199159 - DNA, 25 bp, E. coli
gaaaaatggatgcagcacgaacgct

SEQ ID NO: 199160 - DNA, 25 bp, E. coli
cgtcggtcgcggtattggcagcaaa

SEQ ID NO: 199161 - DNA, 25 bp, E. coli
cgtcggtcgcggaattggcagcaaa

SEQ ID NO: 199162 - DNA, 25 bp, E. coli
taaagcggcggtgtctaacgatgcc

SEQ ID NO: 199163 - DNA, 25 bp, E. coli
gatcttccagtaggcggattacggc

SEQ ID NO: 199164 - DNA, 25 bp, E. coli
gatcttccagtacgcggattacggc

SEQ ID NO: 199165 - DNA, 25 bp, E. coli
cagcgagccttttgttatcaggaag

SEQ ID NO: 199166 - DNA, 25 bp, E. coli
cagcgagcctttagttatcaggaag

SEQ ID NO: 199167 - DNA, 25 bp, E. coli
cattctatgatcctcgccgcacaag

SEQ ID NO: 199168 - DNA, 25 bp, E. coli
catgtggagttaaccgaccacgccg

SEQ ID NO: 199169 - DNA, 25 bp, E. coli
cattctatgatcgtcgccgcacaag

SEQ ID NO: 199170 - DNA, 25 bp, E. coli
catgtggagttatccgaccacgccg

SEQ ID NO: 199171 - DNA, 25 bp, E. coli
ccaaaagtcatttacggcgaggagc

SEQ ID NO: 199172 - DNA, 25 bp, E. coli
cctttgatggcgtcacggttcatgt

SEQ ID NO: 199173 - DNA, 25 bp, E. coli
ccaaaagtcattaacggcgaggagc

SEQ ID NO: 199174 - DNA, 25 bp, E. coli
cctttgatggcgacacggttcatgt

SEQ ID NO: 199175 - DNA, 25 bp, E. coli
gcttttattgaagatcgcgccgaag

SEQ ID NO: 199176 - DNA, 25 bp, E. coli
gcttttattgaacatcgcgccgaag

SEQ ID NO: 199177 - DNA, 25 bp, E. coli
cgtctaagtgaagaacagcgagcct

SEQ ID NO: 199178 - DNA, 25 bp, E. coli
cgtctaagtgaacaacagcgagcct

SEQ ID NO: 199179 - DNA, 25 bp, E. coli
gatttacgaccacaatgctattgcg

SEQ ID NO: 199180 - DNA, 25 bp, E. coli
gatttacgaccagaatgctattgcg

SEQ ID NO: 199181 - DNA, 25 bp, E. coli
gattcattacagttcgcaggtggcg

SEQ ID NO: 199182 - DNA, 25 bp, E. coli
gattcattacagatcgcaggtggcg

SEQ ID NO: 199183 - DNA, 25 bp, E. coli
ggttcatgtccgaggtccaaaagtc

SEQ ID NO: 199184 - DNA, 25 bp, E. coli
ggttcatgtccgtggtccaaaagtc

SEQ ID NO: 199185 - DNA, 25 bp, E. coli
gaccacgccgtccttgaagcctttg

SEQ ID NO: 199186 - DNA, 25 bp, E. coli
gaccacgccgtcgttgaagcctttg

SEQ ID NO: 199187 - DNA, 25 bp, E. coli
tatacggattcctcgccttgattat

SEQ ID NO: 199188 - DNA, 25 bp, E. coli
tatacggattccacgccttgattat

SEQ ID NO: 199189 - DNA, 25 bp, E. coli
aacacgctggattcgcgtaccattc

SEQ ID NO: 199190 - DNA, 25 bp, E. coli
aacacgctggatacgcgtaccattc

SEQ ID NO: 199191 - DNA, 25 bp, E. coli
ttttgcgcgacgttggcagcgagtt

SEQ ID NO: 199192 - DNA, 25 bp, E. coli
ttggcagcgagtatgttactttcta

SEQ ID NO: 199193 - DNA, 25 bp, E. coli
ttggcagcgagtttgttactttcta

SEQ ID NO: 199194 - DNA, 25 bp, E. coli
ttttgcgcgacgatggcagcgagtt

SEQ ID NO: 199195 - DNA, 25 bp, E. coli
tgggtatatacggattccacgcctt

SEQ ID NO: 199196 - DNA, 25 bp, E. coli
tgggtatatacgcattccacgcctt

SEQ ID NO: 199197 - DNA, 25 bp, E. coli
gctggatacgcgtaccattcgcgga

SEQ ID NO: 199198 - DNA, 25 bp, E. coli
gcgacgttggcagcgagtttgttac

SEQ ID NO: 199199 - DNA, 25 bp, E. coli
gctggatacgcgaaccattcgcgga

SEQ ID NO: 199200 - DNA, 25 bp, E. coli
gcgacgttggcaccgagtttgttac

SEQ ID NO: 199201 - DNA, 25 bp, E. coli
cgttggcagcgagtttgttactttc

SEQ ID NO: 199202 - DNA, 25 bp, E. coli
cgttggcagcgactttgttactttc

SEQ ID NO: 199203 - DNA, 25 bp, E. coli
gatacgcgtacctttcgcggacttg

SEQ ID NO: 199204 - DNA, 25 bp, E. coli
gatacgcgtaccattcgcggacttg

SEQ ID NO: 199205 - DNA, 25 bp, E. coli
ggtatatacggattccacgccttga

SEQ ID NO: 199206 - DNA, 25 bp, E. coli
ggtatatacggaatccacgccttga

SEQ ID NO: 199207 - DNA, 25 bp, E. coli
tggatacgcgtagcattcgcggact

SEQ ID NO: 199208 - DNA, 25 bp, E. coli
tggatacgcgtaccattcgcggact

SEQ ID NO: 199209 - DNA, 25 bp, E. coli
aaccagcgcgaaggaaatgcaaaat

SEQ ID NO: 199210 - DNA, 25 bp, E. coli
aaccagcgcgaacgaaatgcaaaat

SEQ ID NO: 199211 - DNA, 25 bp, E. coli
taaaccagcgcgaaggaaatgcaaa

SEQ ID NO: 199212 - DNA, 25 bp, E. coli
taaaccagcgcgtaggaaatgcaaa

SEQ ID NO: 199213 - DNA, 25 bp, E. coli
atcagtggtggtcctgcccggaaca

SEQ ID NO: 199214 - DNA, 25 bp, E. coli
atcagtggtggtgctgcccggaaca

SEQ ID NO: 199215 - DNA, 25 bp, E. coli
aaggaatggtttcacccggcattct

SEQ ID NO: 199216 - DNA, 25 bp, E. coli
aaggaatggtttgacccggcattct

SEQ ID NO: 199217 - DNA, 25 bp, E. coli
tttcacccggcaatctcaaatcagt

SEQ ID NO: 199218 - DNA, 25 bp, E. coli
tttcacccggcattctcaaatcagt

SEQ ID NO: 199219 - DNA, 25 bp, E. coli
tcagcagaaacttaaagacctgcga

SEQ ID NO: 199220 - DNA, 25 bp, E. coli
gcgaagtatcagcagaaacttaaag

SEQ ID NO: 199221 - DNA, 25 bp, E. coli
gcgaagtatcaggagaaacttaaag

SEQ ID NO: 199222 - DNA, 25 bp, E. coli
gtatcagcagaaacttaaagacctg

SEQ ID NO: 199223 - DNA, 25 bp, E. coli
ggtgctgcccggaacacggaactca

SEQ ID NO: 199224 - DNA, 25 bp, E. coli
gtatcagcagaatcttaaagacctg

SEQ ID NO: 199225 - DNA, 25 bp, E. coli
ggtttcacccggcattctcaaatca

SEQ ID NO: 199226 - DNA, 25 bp, E. coli
ggtgctgcccggtacacggaactca

SEQ ID NO: 199227 - DNA, 25 bp, E. coli
ggtttcacccgggattctcaaatca

SEQ ID NO: 199228 - DNA, 25 bp, E. coli
ggaatggtttcacccggcattctca

SEQ ID NO: 199229 - DNA, 25 bp, E. coli
ggaatggtttcagccggcattctca

SEQ ID NO: 199230 - DNA, 25 bp, E. coli
tcagcagaaactaaaagacctgcga

SEQ ID NO: 199231 - DNA, 25 bp, E. coli
cacatttgcggccaactgccgatca

SEQ ID NO: 199232 - DNA, 25 bp, E. coli
cacatttgcggcgaactgccgatca

SEQ ID NO: 199233 - DNA, 25 bp, E. coli
cattaagttcgtccagtgattcctg

SEQ ID NO: 199234 - DNA, 25 bp, E. coli
ttttgcagattcagccacatttgcg

SEQ ID NO: 199235 - DNA, 25 bp, E. coli
tttgcggcgaacagccgatcaccac

SEQ ID NO: 199236 - DNA, 25 bp, E. coli
tttctggcgtcatagctgcttttcc

SEQ ID NO: 199237 - DNA, 25 bp, E. coli
tttgcggcgaactgccgatcaccac

SEQ ID NO: 199238 - DNA, 25 bp, E. coli
tttctggcgtcaaagctgcttttcc

SEQ ID NO: 199239 - DNA, 25 bp, E. coli
ttttgcagattctgccacatttgcg

SEQ ID NO: 199240 - DNA, 25 bp, E. coli
tcgcgcaggctgtcattaagttcgt

SEQ ID NO: 199241 - DNA, 25 bp, E. coli
tcgcgcaggctgacattaagttcgt

SEQ ID NO: 199242 - DNA, 25 bp, E. coli
gccatttctggcgtcaaagctgctt

SEQ ID NO: 199243 - DNA, 25 bp, E. coli
gccatttctggcctcaaagctgctt

SEQ ID NO: 199244 - DNA, 25 bp, E. coli
gcagattcagccacatttgcggcga

SEQ ID NO: 199245 - DNA, 25 bp, E. coli
gcaatttccattgctctggcaaact

SEQ ID NO: 199246 - DNA, 25 bp, E. coli
gcaatttccattcctctggcaaact

SEQ ID NO: 199247 - DNA, 25 bp, E. coli
gcagattcagcctcatttgcggcga

SEQ ID NO: 199248 - DNA, 25 bp, E. coli
cattgctctggcaaactcgcgcagg

SEQ ID NO: 199249 - DNA, 25 bp, E. coli
cattgctctggctaactcgcgcagg

SEQ ID NO: 199250 - DNA, 25 bp, E. coli
cattaagttcgtgcagtgattcctg

SEQ ID NO: 199251 - DNA, 25 bp, E. coli
ggcaaactcgcgcaggctgacatta

SEQ ID NO: 199252 - DNA, 25 bp, E. coli
ggcaaactcgcggaggctgacatta

SEQ ID NO: 199253 - DNA, 25 bp, E. coli
tttgcaaccaacgacaaacggccgg

SEQ ID NO: 199254 - DNA, 25 bp, E. coli
tttgcaaccaaccacaaacggccgg

SEQ ID NO: 199255 - DNA, 25 bp, E. coli
tgtctttgcaaccaacgacaaacgg

SEQ ID NO: 199256 - DNA, 25 bp, E. coli
tgtctttgcaacgaacgacaaacgg

SEQ ID NO: 199257 - DNA, 25 bp, E. coli
gcgaccgaaagctgggtgaaaacac

SEQ ID NO: 199258 - DNA, 25 bp, E. coli
gcgaccgaaagcagggtgaaaacac

SEQ ID NO: 199259 - DNA, 25 bp, E. coli
gcaaccaacgactaacggccggact

SEQ ID NO: 199260 - DNA, 25 bp, E. coli
gcaaccaacgacaaacggccggact

SEQ ID NO: 199261 - DNA, 25 bp, E. coli
gaaagacgataaccagatcgaccta

SEQ ID NO: 199262 - DNA, 25 bp, E. coli
gaaagacgataagcagatcgaccta

SEQ ID NO: 199263 - DNA, 25 bp, E. coli
gacgataagcagatcgacctattgg

SEQ ID NO: 199264 - DNA, 25 bp, E. coli
cgataagcagatggacctattggtg

SEQ ID NO: 199265 - DNA, 25 bp, E. coli
cgataagcagatcgacctattggtg

SEQ ID NO: 199266 - DNA, 25 bp, E. coli
cgttgctgaatactgttggttttat

SEQ ID NO: 199267 - DNA, 25 bp, E. coli
cgttgctgaatagtgttggttttat

SEQ ID NO: 199268 - DNA, 25 bp, E. coli
gttttatcggcggacagacgggctt

SEQ ID NO: 199269 - DNA, 25 bp, E. coli
gttttatcggcgcacagacgggctt

SEQ ID NO: 199270 - DNA, 25 bp, E. coli
ggaaacgttgctgaatactgttggt

SEQ ID NO: 199271 - DNA, 25 bp, E. coli
ggaaacgttgctcaatactgttggt

SEQ ID NO: 199272 - DNA, 25 bp, E. coli
gaccgaaagctgcgtgaaaacaccg

SEQ ID NO: 199273 - DNA, 25 bp, E. coli
gacgataagcagttcgacctattgg

SEQ ID NO: 199274 - DNA, 25 bp, E. coli
gaccgaaagctgggtgaaaacaccg

SEQ ID NO: 199275 - DNA, 25 bp, E. coli
cacatggctggcatatcactgcgct

SEQ ID NO: 199276 - DNA, 25 bp, E. coli
cacatggctggcttatcactgcgct

SEQ ID NO: 199277 - DNA, 25 bp, E. coli
catcaaggcgcggttacacatggct

SEQ ID NO: 199278 - DNA, 25 bp, E. coli
catcaaggcgcgcttacacatggct

SEQ ID NO: 199279 - DNA, 25 bp, E. coli
tacagcagggatacgctgaaaagcg

SEQ ID NO: 199280 - DNA, 25 bp, E. coli
tacagcagggattcgctgaaaagcg

SEQ ID NO: 199281 - DNA, 25 bp, E. coli
aaagcgtattacgtactccttgccg

SEQ ID NO: 199282 - DNA, 25 bp, E. coli
aaagcgtattacctactccttgccg

SEQ ID NO: 199283 - DNA, 25 bp, E. coli
ttaagagctatatgagaaaggcgtc

SEQ ID NO: 199284 - DNA, 25 bp, E. coli
ttaagagctataagagaaaggcgtc

SEQ ID NO: 199285 - DNA, 25 bp, E. coli
tgccgaccgtatgagcaaataattg

SEQ ID NO: 199286 - DNA, 25 bp, E. coli
tgccgaccgtatcagcaaataattg

SEQ ID NO: 199287 - DNA, 25 bp, E. coli
gcctgaagaaatgtggcccagtaga

SEQ ID NO: 199288 - DNA, 25 bp, E. coli
gcctgaagaaatctggcccagtaga

SEQ ID NO: 199289 - DNA, 25 bp, E. coli
gcaaataattgcagatgctcttggg

SEQ ID NO: 199290 - DNA, 25 bp, E. coli
gaagtttcagatcacgattggccgc

SEQ ID NO: 199291 - DNA, 25 bp, E. coli
gcaaataattgctgatgctcttggg

SEQ ID NO: 199292 - DNA, 25 bp, E. coli
gaagtttcagatgacgattggccgc

SEQ ID NO: 199293 - DNA, 25 bp, E. coli
cccagtagataccaggttaagagct

SEQ ID NO: 199294 - DNA, 25 bp, E. coli
cccagtagatacgaggttaagagct

SEQ ID NO: 199295 - DNA, 25 bp, E. coli
gattggccgcctcaaatcatcaagg

SEQ ID NO: 199296 - DNA, 25 bp, E. coli
gattggccgcctgaaatcatcaagg

SEQ ID NO: 199297 - DNA, 25 bp, E. coli
caaatgtgccgcgtattacactgcg

SEQ ID NO: 199298 - DNA, 25 bp, E. coli
caaatgtgccgcctattacactgcg

SEQ ID NO: 199299 - DNA, 25 bp, E. coli
catgaactgaagcaagtgggcgatc

SEQ ID NO: 199300 - DNA, 25 bp, E. coli
catgaactgaaggaagtgggcgatc

SEQ ID NO: 199301 - DNA, 25 bp, E. coli
taaatattgccaggcgctggtggag

SEQ ID NO: 199302 - DNA, 25 bp, E. coli
taaatattgccacgcgctggtggag

SEQ ID NO: 199303 - DNA, 25 bp, E. coli
acgcgctggcgcatgactggtcaga

SEQ ID NO: 199304 - DNA, 25 bp, E. coli
acgcgctggcgcttgactggtcaga

SEQ ID NO: 199305 - DNA, 25 bp, E. coli
tattacactgcgcaagacaacgcgc

SEQ ID NO: 199306 - DNA, 25 bp, E. coli
tattacactgcggaagacaacgcgc

SEQ ID NO: 199307 - DNA, 25 bp, E. coli
tgactggtcagaacgtcttgcggag

SEQ ID NO: 199308 - DNA, 25 bp, E. coli
tgactggtcagatcgtcttgcggag

SEQ ID NO: 199309 - DNA, 25 bp, E. coli
tgatggtgataacgccaaatgtgcc

SEQ ID NO: 199310 - DNA, 25 bp, E. coli
tgatggtgataaggccaaatgtgcc

SEQ ID NO: 199311 - DNA, 25 bp, E. coli
tcttgcggagctaaaaggtgctgcc

SEQ ID NO: 199312 - DNA, 25 bp, E. coli
tcttgcggagcttaaaggtgctgcc

SEQ ID NO: 199313 - DNA, 25 bp, E. coli
gcggaacaaaccagcccatgaactg

SEQ ID NO: 199314 - DNA, 25 bp, E. coli
gctggtggagctccggaacaaacca

SEQ ID NO: 199315 - DNA, 25 bp, E. coli
gctggtggagctgcggaacaaacca

SEQ ID NO: 199316 - DNA, 25 bp, E. coli
gcggaacaaacctgcccatgaactg

SEQ ID NO: 199317 - DNA, 25 bp, E. coli
tggcgcacgccggacaacattttct

SEQ ID NO: 199318 - DNA, 25 bp, E. coli
tggcgcacgccgcacaacattttct

SEQ ID NO: 199319 - DNA, 25 bp, E. coli
caataaccaccaggaaaaggagacg

SEQ ID NO: 199320 - DNA, 25 bp, E. coli
caataaccaccacgaaaaggagacg

SEQ ID NO: 199321 - DNA, 25 bp, E. coli
caataattattcatgaacatcatca

SEQ ID NO: 199322 - DNA, 25 bp, E. coli
caataattattcttgaacatcatca

SEQ ID NO: 199323 - DNA, 25 bp, E. coli
caaaggcaaactatggctgcatcgt

SEQ ID NO: 199324 - DNA, 25 bp, E. coli
caaaggcaaactttggctgcatcgt

SEQ ID NO: 199325 - DNA, 25 bp, E. coli
cagctaattccaattttctgcaaaa

SEQ ID NO: 199326 - DNA, 25 bp, E. coli
cagctaattccatttttctgcaaaa

SEQ ID NO: 199327 - DNA, 25 bp, E. coli
cataagcctttcgtctgttaaaccg

SEQ ID NO: 199328 - DNA, 25 bp, E. coli
cataagcctttcctctgttaaaccg

SEQ ID NO: 199329 - DNA, 25 bp, E. coli
accgccttctgttttccgatccgtg

SEQ ID NO: 199330 - DNA, 25 bp, E. coli
accgccttctgtattccgatccgtg

SEQ ID NO: 199331 - DNA, 25 bp, E. coli
tttcctctgttaaaccgccttctgt

SEQ ID NO: 199332 - DNA, 25 bp, E. coli
tttcctctgttataccgccttctgt

SEQ ID NO: 199333 - DNA, 25 bp, E. coli
tcgttttacagtggccataagcctt

SEQ ID NO: 199334 - DNA, 25 bp, E. coli
tcgttttacagtcgccataagcctt

SEQ ID NO: 199335 - DNA, 25 bp, E. coli
gctgcatcgttttacagtcgccata

SEQ ID NO: 199336 - DNA, 25 bp, E. coli
gctgcatcgtttaacagtcgccata

SEQ ID NO: 199337 - DNA, 25 bp, E. coli
gaaattgtcatatactattacctgt

SEQ ID NO: 199338 - DNA, 25 bp, E. coli
gaaattgtcataaactattacctgt

SEQ ID NO: 199339 - DNA, 25 bp, E. coli
ggccaaaaatggacaataaccacca

SEQ ID NO: 199340 - DNA, 25 bp, E. coli
ggccaaaaatggtcaataaccacca

SEQ ID NO: 199341 - DNA, 25 bp, E. coli
catcctgcgctggtgaacgcgttaa

SEQ ID NO: 199342 - DNA, 25 bp, E. coli
catcctgcgctgctgaacgcgttaa

SEQ ID NO: 199343 - DNA, 25 bp, E. coli
cagttacggcgttgggccattgcca

SEQ ID NO: 199344 - DNA, 25 bp, E. coli
cagttacggcgtagggccattgcca

SEQ ID NO: 199345 - DNA, 25 bp, E. coli
aaacccagggcgtaactctgtggca

SEQ ID NO: 199346 - DNA, 25 bp, E. coli
aaacccagggcgaaactctgtggca

SEQ ID NO: 199347 - DNA, 25 bp, E. coli
tggtgtttatgatctccggcacgga

SEQ ID NO: 199348 - DNA, 25 bp, E. coli
tgacggcagcgaggccagagttttt

SEQ ID NO: 199349 - DNA, 25 bp, E. coli
tgcagaagatcgatcagcagtacga

SEQ ID NO: 199350 - DNA, 25 bp, E. coli
tgacggcagcgacgccagagttttt

SEQ ID NO: 199351 - DNA, 25 bp, E. coli
tgcagaagatcgttcagcagtacga

SEQ ID NO: 199352 - DNA, 25 bp, E. coli
tgaacaaacagctattacacgcgcg

SEQ ID NO: 199353 - DNA, 25 bp, E. coli
tgaacaaacagcaattacacgcgcg

SEQ ID NO: 199354 - DNA, 25 bp, E. coli
gcacggaagctaacgaaaccgcctt

SEQ ID NO: 199355 - DNA, 25 bp, E. coli
gcacggaagctatcgaaaccgcctt

SEQ ID NO: 199356 - DNA, 25 bp, E. coli
tcacggttccacctacggcggtaat

SEQ ID NO: 199357 - DNA, 25 bp, E. coli
tcacggttccacgtacggcggtaat

SEQ ID NO: 199358 - DNA, 25 bp, E. coli
ggtaaaaggtcagggcagccgaatc

SEQ ID NO: 199359 - DNA, 25 bp, E. coli
ggtaaaaggtcacggcagccgaatc

SEQ ID NO: 199360 - DNA, 25 bp, E. coli
tggtgtttatgaactccggcacgga

SEQ ID NO: 199361 - DNA, 25 bp, E. coli
taatcctctggcctgtgcagtagcg

SEQ ID NO: 199362 - DNA, 25 bp, E. coli
taatcctctggcgtgtgcagtagcg

SEQ ID NO: 199363 - DNA, 25 bp, E. coli
tacgaaatcgtttttatggtccatc

SEQ ID NO: 199364 - DNA, 25 bp, E. coli
tacgaaatcgttattatggtccatc

SEQ ID NO: 199365 - DNA, 25 bp, E. coli
aggttccgggcatgatcgagcgcta

SEQ ID NO: 199366 - DNA, 25 bp, E. coli
aggttccgggcaagatcgagcgcta

SEQ ID NO: 199367 - DNA, 25 bp, E. coli
aagatccaccgtctggaagactggg

SEQ ID NO: 199368 - DNA, 25 bp, E. coli
aagatccaccgtgtggaagactggg

SEQ ID NO: 199369 - DNA, 25 bp, E. coli
tatggtccatcctgaccagagcgaa

SEQ ID NO: 199370 - DNA, 25 bp, E. coli
tatggtccatccagaccagagcgaa

SEQ ID NO: 199371 - DNA, 25 bp, E. coli
tgaccagagcgaacaggttccgggc

SEQ ID NO: 199372 - DNA, 25 bp, E. coli
tgaccagagcgatcaggttccgggc

SEQ ID NO: 199373 - DNA, 25 bp, E. coli
tcactggtgcagtaggcaagatcca

SEQ ID NO: 199374 - DNA, 25 bp, E. coli
tcactggtgcagaaggcaagatcca

SEQ ID NO: 199375 - DNA, 25 bp, E. coli
gctggcttacccgatcaacaaactg

SEQ ID NO: 199376 - DNA, 25 bp, E. coli
gcgctacactgcagccatcactggt

SEQ ID NO: 199377 - DNA, 25 bp, E. coli
gctggcttaccccatcaacaaactg

SEQ ID NO: 199378 - DNA, 25 bp, E. coli
gcgctacactgctgccatcactggt

SEQ ID NO: 199379 - DNA, 25 bp, E. coli
gcagcatggttatgcgtaccaagca

SEQ ID NO: 199380 - DNA, 25 bp, E. coli
gcagcatggttaagcgtaccaagca

SEQ ID NO: 199381 - DNA, 25 bp, E. coli
gatcgatgagctggaaactaccttc

SEQ ID NO: 199382 - DNA, 25 bp, E. coli
gatcgatgagctcgaaactaccttc

SEQ ID NO: 199383 - DNA, 25 bp, E. coli
tcaacgatgccgttatccgcagcat

SEQ ID NO: 199384 - DNA, 25 bp, E. coli
tcaacgatgccgatatccgcagcat

SEQ ID NO: 199385 - DNA, 25 bp, E. coli
caaatctggtgagaacgctcggaca

SEQ ID NO: 199386 - DNA, 25 bp, E. coli
caaatctggtgacaacgctcggaca

SEQ ID NO: 199387 - DNA, 25 bp, E. coli
cagaatctgttgttccggtggcgca

SEQ ID NO: 199388 - DNA, 25 bp, E. coli
cagaatctgttgatccggtggcgca

SEQ ID NO: 199389 - DNA, 25 bp, E. coli
taaaactggcgggaaagtggacgac

SEQ ID NO: 199390 - DNA, 25 bp, E. coli
taaaactggcggcaaagtggacgac

SEQ ID NO: 199391 - DNA, 25 bp, E. coli
tattgctgatgcagacccgatggag

SEQ ID NO: 199392 - DNA, 25 bp, E. coli
tattgctgatgctgacccgatggag

SEQ ID NO: 199393 - DNA, 25 bp, E. coli
ttaaaaacagtgtcatgccgcgtcg

SEQ ID NO: 199394 - DNA, 25 bp, E. coli
ttaaaaacagtgacatgccgcgtcg

SEQ ID NO: 199395 - DNA, 25 bp, E. coli
tgataccctggctatgatagcgctg

SEQ ID NO: 199396 - DNA, 25 bp, E. coli
tgataccctggcaatgatagcgctg

SEQ ID NO: 199397 - DNA, 25 bp, E. coli
tctactgacaggcaagctaccgtgc

SEQ ID NO: 199398 - DNA, 25 bp, E. coli
tctactgacagggaagctaccgtgc

SEQ ID NO: 199399 - DNA, 25 bp, E. coli
gcctgatggcaataacgcggttact

SEQ ID NO: 199400 - DNA, 25 bp, E. coli
gcctgatggcaaaaacgcggttact

SEQ ID NO: 199401 - DNA, 25 bp, E. coli
gatataccggaagagcaggtgccct

SEQ ID NO: 199402 - DNA, 25 bp, E. coli
gatataccggaacagcaggtgccct

SEQ ID NO: 199403 - DNA, 25 bp, E. coli
taatctggtgactcgaggcacagcg

SEQ ID NO: 199404 - DNA, 25 bp, E. coli
taatctggtgacacgaggcacagcg

SEQ ID NO: 199405 - DNA, 25 bp, E. coli
gatgcgatgattgagagcccggtaa

SEQ ID NO: 199406 - DNA, 25 bp, E. coli
gatgcgatgattcagagcccggtaa

SEQ ID NO: 199407 - DNA, 25 bp, E. coli
cacgtctggagtcgacctggcgact

SEQ ID NO: 199408 - DNA, 25 bp, E. coli
cacgtctggagtggacctggcgact

SEQ ID NO: 199409 - DNA, 25 bp, E. coli
caaagtaaatggaatgacgttccac

SEQ ID NO: 199410 - DNA, 25 bp, E. coli
caaagtaaatggtatgacgttccac

SEQ ID NO: 199411 - DNA, 25 bp, E. coli
taaatggtatgacgttccacctgac

SEQ ID NO: 199412 - DNA, 25 bp, E. coli
taaatggtatgaggttccacctgac

SEQ ID NO: 199413 - DNA, 25 bp, E. coli
atgtcacgtctgcagtggacctggc

SEQ ID NO: 199414 - DNA, 25 bp, E. coli
atgtcacgtctggagtggacctggc

SEQ ID NO: 199415 - DNA, 25 bp, E. coli
aacttcacaagatccggcgctggca

SEQ ID NO: 199416 - DNA, 25 bp, E. coli
aacttcacaagaaccggcgctggca

SEQ ID NO: 199417 - DNA, 25 bp, E. coli
aaaaaatgacgcagcagcgcggggc

SEQ ID NO: 199418 - DNA, 25 bp, E. coli
aaaaaatgacgctgcagcgcggggc

SEQ ID NO: 199419 - DNA, 25 bp, E. coli
tgacgttccaccagaccggccgttt

SEQ ID NO: 199420 - DNA, 25 bp, E. coli
tgacgttccacctgaccggccgttt

SEQ ID NO: 199421 - DNA, 25 bp, E. coli
tgcagtccatggtcgggttgaaatc

SEQ ID NO: 199422 - DNA, 25 bp, E. coli
tgcagtccatggacgggttgaaatc

SEQ ID NO: 199423 - DNA, 25 bp, E. coli
gttgcagtccatcgtcgggttgaaa

SEQ ID NO: 199424 - DNA, 25 bp, E. coli
gttgcagtccatggtcgggttgaaa

SEQ ID NO: 199425 - DNA, 25 bp, E. coli
tggtatgacgttgcacctgaccggc

SEQ ID NO: 199426 - DNA, 25 bp, E. coli
tggtatgacgttccacctgaccggc

SEQ ID NO: 199427 - DNA, 25 bp, E. coli
tggagtggacctcgcgactggtcat

SEQ ID NO: 199428 - DNA, 25 bp, E. coli
tggagtggacctggcgactggtcat

SEQ ID NO: 199429 - DNA, 25 bp, E. coli
aatcaaattactcacgaagtgcgcg

SEQ ID NO: 199430 - DNA, 25 bp, E. coli
aatcaaattactgacgaagtgcgcg

SEQ ID NO: 199431 - DNA, 25 bp, E. coli
caccaagtctgaagagtgaagcaca

SEQ ID NO: 199432 - DNA, 25 bp, E. coli
caccaagtctgatgagtgaagcaca

SEQ ID NO: 199433 - DNA, 25 bp, E. coli
cagactgtgtctggcgaatcaaatt

SEQ ID NO: 199434 - DNA, 25 bp, E. coli
cagactgtgtctcgcgaatcaaatt

SEQ ID NO: 199435 - DNA, 25 bp, E. coli
taaatacatcccagcaagttggcta

SEQ ID NO: 199436 - DNA, 25 bp, E. coli
taaatacatccctgcaagttggcta

SEQ ID NO: 199437 - DNA, 25 bp, E. coli
taccgattctgcaagctattcagtc

SEQ ID NO: 199438 - DNA, 25 bp, E. coli
taccgattctgctagctattcagtc

SEQ ID NO: 199439 - DNA, 25 bp, E. coli
tgttaacacctctgacaataccgat

SEQ ID NO: 199440 - DNA, 25 bp, E. coli
tgttaacacctcagacaataccgat

SEQ ID NO: 199441 - DNA, 25 bp, E. coli
tgcggcatgagcctttgacctttcc

SEQ ID NO: 199442 - DNA, 25 bp, E. coli
tgcggcatgagcgtttgacctttcc

SEQ ID NO: 199443 - DNA, 25 bp, E. coli
gcaagttggctatttctgaacgagt

SEQ ID NO: 199444 - DNA, 25 bp, E. coli
gcaagttggctaattctgaacgagt

SEQ ID NO: 199445 - DNA, 25 bp, E. coli
cgcgttgttttctggcaaatgcggc

SEQ ID NO: 199446 - DNA, 25 bp, E. coli
cgcgttgttttcaggcaaatgcggc

SEQ ID NO: 199447 - DNA, 25 bp, E. coli
ggtaacaatgaattcgccagactgt

SEQ ID NO: 199448 - DNA, 25 bp, E. coli
ggtaacaatgaaatcgccagactgt

SEQ ID NO: 199449 - DNA, 25 bp, E. coli
gagtgaagcacaacaagcaatttct

SEQ ID NO: 199450 - DNA, 25 bp, E. coli
gagtgaagcacatcaagcaatttct

SEQ ID NO: 199451 - DNA, 25 bp, E. coli
cagatattgttctcgattacgcagg

SEQ ID NO: 199452 - DNA, 25 bp, E. coli
cagatattgttcacgattacgcagg

SEQ ID NO: 199453 - DNA, 25 bp, E. coli
tactgagcggcgataacgcattgca

SEQ ID NO: 199454 - DNA, 25 bp, E. coli
tactgagcggcgttaacgcattgca

SEQ ID NO: 199455 - DNA, 25 bp, E. coli
ttataatgagccgatgaccatgcgc

SEQ ID NO: 199456 - DNA, 25 bp, E. coli
ttataatgagcccatgaccatgcgc

SEQ ID NO: 199457 - DNA, 25 bp, E. coli
tgttaaagcgcgtgttcctcagcct

SEQ ID NO: 199458 - DNA, 25 bp, E. coli
tgttagtcctgatcggcttgctgct

SEQ ID NO: 199459 - DNA, 25 bp, E. coli
tgttatgccgtaccgtcaccgaaag

SEQ ID NO: 199460 - DNA, 25 bp, E. coli
tgttaaagcgcgagttcctcagcct

SEQ ID NO: 199461 - DNA, 25 bp, E. coli
tgttatgccgtagcgtcaccgaaag

SEQ ID NO: 199462 - DNA, 25 bp, E. coli
tgttagtcctgaacggcttgctgct

SEQ ID NO: 199463 - DNA, 25 bp, E. coli
tgaaccgcgttttttagggccgctg

SEQ ID NO: 199464 - DNA, 25 bp, E. coli
tgaaccgcgtttattagggccgctg

SEQ ID NO: 199465 - DNA, 25 bp, E. coli
tctacgacgaatagcaggatctccc

SEQ ID NO: 199466 - DNA, 25 bp, E. coli
tctacgacgaattgcaggatctccc

SEQ ID NO: 199467 - DNA, 25 bp, E. coli
gctgttgactgtgctcggcctcgat

SEQ ID NO: 199468 - DNA, 25 bp, E. coli
gctgttgactgtcctcggcctcgat

SEQ ID NO: 199469 - DNA, 25 bp, E. coli
gcaggctttcgttcgctggattcca

SEQ ID NO: 199470 - DNA, 25 bp, E. coli
gcaggctttcgtacgctggattcca

SEQ ID NO: 199471 - DNA, 25 bp, E. coli
gattaatgcctaaaacagcggtaag

SEQ ID NO: 199472 - DNA, 25 bp, E. coli
gattaatgcctataacagcggtaag

SEQ ID NO: 199473 - DNA, 25 bp, E. coli
cagttaccggatttgcagcaaacgc

SEQ ID NO: 199474 - DNA, 25 bp, E. coli
cagttaccggatatgcagcaaacgc

SEQ ID NO: 199475 - DNA, 25 bp, E. coli
tattagaagccaacctggcgctgcc

SEQ ID NO: 199476 - DNA, 25 bp, E. coli
tattctgccgtctgttagcgccgca

SEQ ID NO: 199477 - DNA, 25 bp, E. coli
tattctgccgtcagttagcgccgca

SEQ ID NO: 199478 - DNA, 25 bp, E. coli
tattagaagccatcctggcgctgcc

SEQ ID NO: 199479 - DNA, 25 bp, E. coli
tcatgaccgctgacgatatggtcgt

SEQ ID NO: 199480 - DNA, 25 bp, E. coli
tctgcgtaagcatggcgcgaaggca

SEQ ID NO: 199481 - DNA, 25 bp, E. coli
tcatgaccgctgtcgatatggtcgt

SEQ ID NO: 199482 - DNA, 25 bp, E. coli
tctgcgtaagcaaggcgcgaaggca

SEQ ID NO: 199483 - DNA, 25 bp, E. coli
gctgctggataaacactatctgcgt

SEQ ID NO: 199484 - DNA, 25 bp, E. coli
gctgctggataatcactatctgcgt

SEQ ID NO: 199485 - DNA, 25 bp, E. coli
cgcgaaggcatattacgggcagtaa

SEQ ID NO: 199486 - DNA, 25 bp, E. coli
cgcgaaggcataatacgggcagtaa

SEQ ID NO: 199487 - DNA, 25 bp, E. coli
cccgcaaaatgagcgacgcagaaat

SEQ ID NO: 199488 - DNA, 25 bp, E. coli
cccgcaaaatgaccgacgcagaaat

SEQ ID NO: 199489 - DNA, 25 bp, E. coli
ggtgcataacgcgatcgtgctggaa

SEQ ID NO: 199490 - DNA, 25 bp, E. coli
ggtgcataacgccatcgtgctggaa

SEQ ID NO: 199491 - DNA, 25 bp, E. coli
tggcgctgccaatacacaacctggt

SEQ ID NO: 199492 - DNA, 25 bp, E. coli
tggcgctgccaaaacacaacctggt

SEQ ID NO: 199493 - DNA, 25 bp, E. coli
tatgagtgggaaaccggtaacgtca

SEQ ID NO: 199494 - DNA, 25 bp, E. coli
tatgagtgggaatccggtaacgtca

SEQ ID NO: 199495 - DNA, 25 bp, E. coli
tactttccagcgacgtacagcctaa

SEQ ID NO: 199496 - DNA, 25 bp, E. coli
tactttccagcgtcgtacagcctaa

SEQ ID NO: 199497 - DNA, 25 bp, E. coli
cagcgtcgtacagcctaacttctgg

SEQ ID NO: 199498 - DNA, 25 bp, E. coli
cagcgtcgtacaccctaacttctgg

SEQ ID NO: 199499 - DNA, 25 bp, E. coli
actttccagcgtcgtacagcctaac

SEQ ID NO: 199500 - DNA, 25 bp, E. coli
actttccagcgtggtacagcctaac

SEQ ID NO: 199501 - DNA, 25 bp, E. coli
tttccagcgtcgtacagcctaactt

SEQ ID NO: 199502 - DNA, 25 bp, E. coli
tattttactttcgagcgtcgtacag

SEQ ID NO: 199503 - DNA, 25 bp, E. coli
tattttactttccagcgtcgtacag

SEQ ID NO: 199504 - DNA, 25 bp, E. coli
ttgattattttactttccagcgtcg

SEQ ID NO: 199505 - DNA, 25 bp, E. coli
tttccagcgtcgaacagcctaactt

SEQ ID NO: 199506 - DNA, 25 bp, E. coli
ttgattattttagtttccagcgtcg

SEQ ID NO: 199507 - DNA, 25 bp, E. coli
ttttactttccaccgtcgtacagcc

SEQ ID NO: 199508 - DNA, 25 bp, E. coli
ttttactttccagcgtcgtacagcc

SEQ ID NO: 199509 - DNA, 25 bp, E. coli
tccagcgtcgtagagcctaacttct

SEQ ID NO: 199510 - DNA, 25 bp, E. coli
tccagcgtcgtacagcctaacttct

SEQ ID NO: 199511 - DNA, 25 bp, E. coli
gcgtcgtacagcctaacttctggtg

SEQ ID NO: 199512 - DNA, 25 bp, E. coli
gcgtcgtacagcgtaacttctggtg

SEQ ID NO: 199513 - DNA, 25 bp, E. coli
cgtcgtacagcctaacttctggtgg

SEQ ID NO: 199514 - DNA, 25 bp, E. coli
cgtcgtacagccaaacttctggtgg

SEQ ID NO: 199515 - DNA, 25 bp, E. coli
gattattttactatccagcgtcgta

SEQ ID NO: 199516 - DNA, 25 bp, E. coli
gattattttactttccagcgtcgta

SEQ ID NO: 199517 - DNA, 25 bp, E. coli
actgtacctgaacaaaatattgatg

SEQ ID NO: 199518 - DNA, 25 bp, E. coli
actgtacctgaagaaaatattgatg

SEQ ID NO: 199519 - DNA, 25 bp, E. coli
tatcgcttaaatcttctcttgaaga

SEQ ID NO: 199520 - DNA, 25 bp, E. coli
tatcgcttaaatgttctcttgaaga

SEQ ID NO: 199521 - DNA, 25 bp, E. coli
tattctttttacttcccgccaaatg

SEQ ID NO: 199522 - DNA, 25 bp, E. coli
tattctttttacatcccgccaaatg

SEQ ID NO: 199523 - DNA, 25 bp, E. coli
tgcttgagataacctcgctggtaga

SEQ ID NO: 199524 - DNA, 25 bp, E. coli
tgcttgagataagctcgctggtaga

SEQ ID NO: 199525 - DNA, 25 bp, E. coli
cctcgctggtagttaacgcattgga

SEQ ID NO: 199526 - DNA, 25 bp, E. coli
cctcgctggtagataacgcattgga

SEQ ID NO: 199527 - DNA, 25 bp, E. coli
gacggcgctgcaaactgtacctgaa

SEQ ID NO: 199528 - DNA, 25 bp, E. coli
gcaatccagatgaatttaatacctt

SEQ ID NO: 199529 - DNA, 25 bp, E. coli
gacggcgctgcatactgtacctgaa

SEQ ID NO: 199530 - DNA, 25 bp, E. coli
gcaatccagatgtatttaatacctt

SEQ ID NO: 199531 - DNA, 25 bp, E. coli
gaaattacagaacaatattcacact

SEQ ID NO: 199532 - DNA, 25 bp, E. coli
gaaattacagaagaatattcacact

SEQ ID NO: 199533 - DNA, 25 bp, E. coli
cgcattggatctggctgaaattaca

SEQ ID NO: 199534 - DNA, 25 bp, E. coli
cgcattggatctcgctgaaattaca

SEQ ID NO: 199535 - DNA, 25 bp, E. coli
ctcttgaagatatcctgcttgagat

SEQ ID NO: 199536 - DNA, 25 bp, E. coli
ctcttgaagataacctgcttgagat

SEQ ID NO: 199537 - DNA, 25 bp, E. coli
gtagtatcagcattccagatgaatt

SEQ ID NO: 199538 - DNA, 25 bp, E. coli
gtagtatcagcaatccagatgaatt

SEQ ID NO: 199539 - DNA, 25 bp, E. coli
cacgctatattgtccatgccagagt

SEQ ID NO: 199540 - DNA, 25 bp, E. coli
caaagataaacataccgaagcggct

SEQ ID NO: 199541 - DNA, 25 bp, E. coli
caaagataaacaaaccgaagcggct

SEQ ID NO: 199542 - DNA, 25 bp, E. coli
cacgctatattgaccatgccagagt

SEQ ID NO: 199543 - DNA, 25 bp, E. coli
taccggtgtaatgggctttgccgcc

SEQ ID NO: 199544 - DNA, 25 bp, E. coli
taccggtgtaatcggctttgccgcc

SEQ ID NO: 199545 - DNA, 25 bp, E. coli
tgattcctacgcagccaattcggcg

SEQ ID NO: 199546 - DNA, 25 bp, E. coli
tgattcctacgctgccaattcggcg

SEQ ID NO: 199547 - DNA, 25 bp, E. coli
cctggatgtgctcaacggcaagcaa

SEQ ID NO: 199548 - DNA, 25 bp, E. coli
cctggatgtgctgaacggcaagcaa

SEQ ID NO: 199549 - DNA, 25 bp, E. coli
cctttccggcagttaacaatggcta

SEQ ID NO: 199550 - DNA, 25 bp, E. coli
cctttccggcagataacaatggcta

SEQ ID NO: 199551 - DNA, 25 bp, E. coli
gaagcggcttttcagttcgccaacg

SEQ ID NO: 199552 - DNA, 25 bp, E. coli
gaagcggcttttgagttcgccaacg

SEQ ID NO: 199553 - DNA, 25 bp, E. coli
cgactaatgttcgttccggctacga

SEQ ID NO: 199554 - DNA, 25 bp, E. coli
cgactaatgttccttccggctacga

SEQ ID NO: 199555 - DNA, 25 bp, E. coli
cgttggtggcataaatcgtgctgct

SEQ ID NO: 199556 - DNA, 25 bp, E. coli
cgttggtggcattaatcgtgctgct

SEQ ID NO: 199557 - DNA, 25 bp, E. coli
gatgtgcactcatcggttcagggcg

SEQ ID NO: 199558 - DNA, 25 bp, E. coli
gagatcgttgctacggttgatggcc

SEQ ID NO: 199559 - DNA, 25 bp, E. coli
gagatcgttgcttcggttgatggcc

SEQ ID NO: 199560 - DNA, 25 bp, E. coli
gatgtgcactcaacggttcagggcg

SEQ ID NO: 199561 - DNA, 25 bp, E. coli
aactcaacgatgtcgaggttttgca

SEQ ID NO: 199562 - DNA, 25 bp, E. coli
aactcaacgatgacgaggttttgca

SEQ ID NO: 199563 - DNA, 25 bp, E. coli
tatgaagaaattgatgccactggct

SEQ ID NO: 199564 - DNA, 25 bp, E. coli
tatgaagaaattcatgccactggct

SEQ ID NO: 199565 - DNA, 25 bp, E. coli
tttcgccgcagctcccgtatgaaga

SEQ ID NO: 199566 - DNA, 25 bp, E. coli
tttcgccgcagcacccgtatgaaga

SEQ ID NO: 199567 - DNA, 25 bp, E. coli
tgtggaaaaccgcatgcagttactg

SEQ ID NO: 199568 - DNA, 25 bp, E. coli
tgtggaaaaccggatgcagttactg

SEQ ID NO: 199569 - DNA, 25 bp, E. coli
tgacgggacgtataacaccggaacg

SEQ ID NO: 199570 - DNA, 25 bp, E. coli
tgacgggacgtaaaacaccggaacg

SEQ ID NO: 199571 - DNA, 25 bp, E. coli
tcgttaacgcagatggacaagccaa

SEQ ID NO: 199572 - DNA, 25 bp, E. coli
tcgttaacgcagttggacaagccaa

SEQ ID NO: 199573 - DNA, 25 bp, E. coli
ccataaagcggtgatcgattacagc

SEQ ID NO: 199574 - DNA, 25 bp, E. coli
ccagttgggcaagaatatttcgccg

SEQ ID NO: 199575 - DNA, 25 bp, E. coli
ccagttgggcaacaatatttcgccg

SEQ ID NO: 199576 - DNA, 25 bp, E. coli
ccataaagcggtcatcgattacagc

SEQ ID NO: 199577 - DNA, 25 bp, E. coli
gctttcacggtgagatccagcacat

SEQ ID NO: 199578 - DNA, 25 bp, E. coli
gctttcacggtgtgatccagcacat

SEQ ID NO: 199579 - DNA, 25 bp, E. coli
cgtgcacccggataatgatgcggct

SEQ ID NO: 199580 - DNA, 25 bp, E. coli
cgtgcacccggaaaatgatgcggct

SEQ ID NO: 199581 - DNA, 25 bp, E. coli
gtattgatcaaatacggcactgtcg

SEQ ID NO: 199582 - DNA, 25 bp, E. coli
gtattgatcaaaaacggcactgtcg

SEQ ID NO: 199583 - DNA, 25 bp, E. coli
aagttaaggttgtcatatctcgcgg

SEQ ID NO: 199584 - DNA, 25 bp, E. coli
aagttaaggttgacatatctcgcgg

SEQ ID NO: 199585 - DNA, 25 bp, E. coli
caaaaatagaacctgtcacactggg

SEQ ID NO: 199586 - DNA, 25 bp, E. coli
caaaaatagaacgtgtcacactggg

SEQ ID NO: 199587 - DNA, 25 bp, E. coli
taaaccgatgccctgaatatctccg

SEQ ID NO: 199588 - DNA, 25 bp, E. coli
taaaccgatgccgtgaatatctccg

SEQ ID NO: 199589 - DNA, 25 bp, E. coli
aaaaagtaacgcgagtgacgcagtg

SEQ ID NO: 199590 - DNA, 25 bp, E. coli
aaaaagtaacgccagtgacgcagtg

SEQ ID NO: 199591 - DNA, 25 bp, E. coli
tatctccgcaagcatggaaccagtg

SEQ ID NO: 199592 - DNA, 25 bp, E. coli
tagaaattcggtttaccacagggct

SEQ ID NO: 199593 - DNA, 25 bp, E. coli
tagaaattcggtataccacagggct

SEQ ID NO: 199594 - DNA, 25 bp, E. coli
tatttcatgatggagtgacgggcgc

SEQ ID NO: 199595 - DNA, 25 bp, E. coli
tatttcatgatgcagtgacgggcgc

SEQ ID NO: 199596 - DNA, 25 bp, E. coli
tatctccgcaaggatggaaccagtg

SEQ ID NO: 199597 - DNA, 25 bp, E. coli
tgatgcgtttcattctccgtgggag

SEQ ID NO: 199598 - DNA, 25 bp, E. coli
tgatgcgtttcaatctccgtgggag

SEQ ID NO: 199599 - DNA, 25 bp, E. coli
tcctgacaacaaagatggtacgcgt

SEQ ID NO: 199600 - DNA, 25 bp, E. coli
tcctgacaacaatgatggtacgcgt

SEQ ID NO: 199601 - DNA, 25 bp, E. coli
tcatcacaacagtcacgagcggtaa

SEQ ID NO: 199602 - DNA, 25 bp, E. coli
tcatcacaacagacacgagcggtaa

SEQ ID NO: 199603 - DNA, 25 bp, E. coli
ggatggacaaattcaaccgctgagt

SEQ ID NO: 199604 - DNA, 25 bp, E. coli
ggatggacaaatacaaccgctgagt

SEQ ID NO: 199605 - DNA, 25 bp, E. coli
aataaagagaagcaacaggagcgtc

SEQ ID NO: 199606 - DNA, 25 bp, E. coli
aataaagagaaggaacaggagcgtc

SEQ ID NO: 199607 - DNA, 25 bp, E. coli
tgatgatgatactgtccctaagacc

SEQ ID NO: 199608 - DNA, 25 bp, E. coli
tgatgatgatacagtccctaagacc

SEQ ID NO: 199609 - DNA, 25 bp, E. coli
tcaagttcctatcgttgaagaagcc

SEQ ID NO: 199610 - DNA, 25 bp, E. coli
tcaagttcctatggttgaagaagcc

SEQ ID NO: 199611 - DNA, 25 bp, E. coli
tcttaaagactggagagagccaacg

SEQ ID NO: 199612 - DNA, 25 bp, E. coli
tcttaaagactgcagagagccaacg

SEQ ID NO: 199613 - DNA, 25 bp, E. coli
gctttacgcaaatcagaacgctcaa

SEQ ID NO: 199614 - DNA, 25 bp, E. coli
gctttacgcaaaacagaacgctcaa

SEQ ID NO: 199615 - DNA, 25 bp, E. coli
gaaccgcaatttctttactcgtgga

SEQ ID NO: 199616 - DNA, 25 bp, E. coli
gaagcctatcaaccatttaagcgag

SEQ ID NO: 199617 - DNA, 25 bp, E. coli
gaagcctatcaagcatttaagcgag

SEQ ID NO: 199618 - DNA, 25 bp, E. coli
gaaccgcaatttgtttactcgtgga

SEQ ID NO: 199619 - DNA, 25 bp, E. coli
gaaagaaaatgacactctgccagct

SEQ ID NO: 199620 - DNA, 25 bp, E. coli
gaaagaaaatgagactctgccagct

SEQ ID NO: 199621 - DNA, 25 bp, E. coli
gacgctgaactaatacgcacatgca

SEQ ID NO: 199622 - DNA, 25 bp, E. coli
gaaacttgtggctacagaccgagta

SEQ ID NO: 199623 - DNA, 25 bp, E. coli
gacgctgaactattacgcacatgca

SEQ ID NO: 199624 - DNA, 25 bp, E. coli
gaaacttgtggcaacagaccgagta

SEQ ID NO: 199625 - DNA, 25 bp, E. coli
ccgagtaccagcaggaaagcgtgat

SEQ ID NO: 199626 - DNA, 25 bp, E. coli
ccgagtaccagctggaaagcgtgat

SEQ ID NO: 199627 - DNA, 25 bp, E. coli
catattgacctgtcggcagcagtcc

SEQ ID NO: 199628 - DNA, 25 bp, E. coli
catcaacggtaagacttaagtaaca

SEQ ID NO: 199629 - DNA, 25 bp, E. coli
cagtccgccaggtcagcgtcgtaat

SEQ ID NO: 199630 - DNA, 25 bp, E. coli
catcaacggtaacacttaagtaaca

SEQ ID NO: 199631 - DNA, 25 bp, E. coli
catattgacctgacggcagcagtcc

SEQ ID NO: 199632 - DNA, 25 bp, E. coli
cagtccgccaggacagcgtcgtaat

SEQ ID NO: 199633 - DNA, 25 bp, E. coli
acctgacggcagcagtccgccaggt

SEQ ID NO: 199634 - DNA, 25 bp, E. coli
acctgacggcaggagtccgccaggt

SEQ ID NO: 199635 - DNA, 25 bp, E. coli
tattgcaggtgagatttgcgcggca

SEQ ID NO: 199636 - DNA, 25 bp, E. coli
tattgcaggtgacatttgcgcggca

SEQ ID NO: 199637 - DNA, 25 bp, E. coli
tatagggttattagaaatgaaggga

SEQ ID NO: 199638 - DNA, 25 bp, E. coli
tatagggttatttgaaatgaaggga

SEQ ID NO: 199639 - DNA, 25 bp, E. coli
tgaagggatttttagcatattgacc

SEQ ID NO: 199640 - DNA, 25 bp, E. coli
tgaagggattttaagcatattgacc

SEQ ID NO: 199641 - DNA, 25 bp, E. coli
tgttaatgcctttcttttagtcgct

SEQ ID NO: 199642 - DNA, 25 bp, E. coli
tgttaatgccttacttttagtcgct

SEQ ID NO: 199643 - DNA, 25 bp, E. coli
gcgcggcatcaacggtaacacttaa

SEQ ID NO: 199644 - DNA, 25 bp, E. coli
gcgcggcatcaagggtaacacttaa

SEQ ID NO: 199645 - DNA, 25 bp, E. coli
cttttagtcgctatattgcaggtga

SEQ ID NO: 199646 - DNA, 25 bp, E. coli
cttttagtcgctttattgcaggtga

SEQ ID NO: 199647 - DNA, 25 bp, E. coli
gatttgcgcggcatcaacggtaaca

SEQ ID NO: 199648 - DNA, 25 bp, E. coli
gatttgcgcggcttcaacggtaaca

SEQ ID NO: 199649 - DNA, 25 bp, E. coli
caaagaccgcattctggaattggcg

SEQ ID NO: 199650 - DNA, 25 bp, E. coli
caaagaccgcatactggaattggcg

SEQ ID NO: 199651 - DNA, 25 bp, E. coli
tagtgcgtcacggagagtgctccgt

SEQ ID NO: 199652 - DNA, 25 bp, E. coli
tagtgcgtcacgcagagtgctccgt

SEQ ID NO: 199653 - DNA, 25 bp, E. coli
tattccgcagaaataccggcaatgg

SEQ ID NO: 199654 - DNA, 25 bp, E. coli
tattccgcagaattaccggcaatgg

SEQ ID NO: 199655 - DNA, 25 bp, E. coli
tttaaactgccatccgacagagtgc

SEQ ID NO: 199656 - DNA, 25 bp, E. coli
tttaaactgccaaccgacagagtgc

SEQ ID NO: 199657 - DNA, 25 bp, E. coli
gcggaagccaaaacgcaactggaag

SEQ ID NO: 199658 - DNA, 25 bp, E. coli
gcggaagccaaatcgcaactggaag

SEQ ID NO: 199659 - DNA, 25 bp, E. coli
gcagaggttcatatcctgacggtaa

SEQ ID NO: 199660 - DNA, 25 bp, E. coli
gcagaggttcatttcctgacggtaa

SEQ ID NO: 199661 - DNA, 25 bp, E. coli
ccgacagagtgcatgtccatgttga

SEQ ID NO: 199662 - DNA, 25 bp, E. coli
cgattcagaattaactcaacgcgtg

SEQ ID NO: 199663 - DNA, 25 bp, E. coli
cgattcagaatttactcaacgcgtg

SEQ ID NO: 199664 - DNA, 25 bp, E. coli
ccgacagagtgcttgtccatgttga

SEQ ID NO: 199665 - DNA, 25 bp, E. coli
ggatatcaccacatatctgctcggt

SEQ ID NO: 199666 - DNA, 25 bp, E. coli
ggatatcaccacttatctgctcggt

SEQ ID NO: 199667 - DNA, 25 bp, E. coli
ggaattggcgaagaagatccccgct

SEQ ID NO: 199668 - DNA, 25 bp, E. coli
ggaattggcgaacaagatccccgct

SEQ ID NO: 199669 - DNA, 25 bp, E. coli
gatcatcattgcttcccatcgaccg

SEQ ID NO: 199670 - DNA, 25 bp, E. coli
gatcatcattgcatcccatcgaccg

SEQ ID NO: 199671 - DNA, 25 bp, E. coli
aagcttcaggcagcggcattttctc

SEQ ID NO: 199672 - DNA, 25 bp, E. coli
aagcttcaggcaccggcattttctc

SEQ ID NO: 199673 - DNA, 25 bp, E. coli
taacgttgcgaaccttcaggcagcg

SEQ ID NO: 199674 - DNA, 25 bp, E. coli
acgttgcgaagcttcaggcagcggc

SEQ ID NO: 199675 - DNA, 25 bp, E. coli
acgttgcgaagcatcaggcagcggc

SEQ ID NO: 199676 - DNA, 25 bp, E. coli
ttaacgttgcgatgcttcaggcagc

SEQ ID NO: 199677 - DNA, 25 bp, E. coli
ttgcgaagcttcaggcagcggcatt

SEQ ID NO: 199678 - DNA, 25 bp, E. coli
ttgcgaagcttctggcagcggcatt

SEQ ID NO: 199679 - DNA, 25 bp, E. coli
ttaacgttgcgaagcttcaggcagc

SEQ ID NO: 199680 - DNA, 25 bp, E. coli
tgcgaagcttcaggcagcggcattt

SEQ ID NO: 199681 - DNA, 25 bp, E. coli
tgcgaagcttcacgcagcggcattt

SEQ ID NO: 199682 - DNA, 25 bp, E. coli
gcgaagcttcaggcagcggcatttt

SEQ ID NO: 199683 - DNA, 25 bp, E. coli
gcgaagcttcagccagcggcatttt

SEQ ID NO: 199684 - DNA, 25 bp, E. coli
gcttcaggcagcggcattttctcaa

SEQ ID NO: 199685 - DNA, 25 bp, E. coli
gcttcaggcagccgcattttctcaa

SEQ ID NO: 199686 - DNA, 25 bp, E. coli
gaagcttcaggctgcggcattttct

SEQ ID NO: 199687 - DNA, 25 bp, E. coli
gaagcttcaggcagcggcattttct

SEQ ID NO: 199688 - DNA, 25 bp, E. coli
cgaagcttcagggagcggcattttc

SEQ ID NO: 199689 - DNA, 25 bp, E. coli
cgaagcttcaggcagcggcattttc

SEQ ID NO: 199690 - DNA, 25 bp, E. coli
cgttgcgaagcttcaggcagcggca

SEQ ID NO: 199691 - DNA, 25 bp, E. coli
cgttgcgaagctacaggcagcggca

SEQ ID NO: 199692 - DNA, 25 bp, E. coli
taacgttgcgaagcttcaggcagcg

SEQ ID NO: 199693 - DNA, 25 bp, E. coli
aaacacgcgtttcatcattcctcgg

SEQ ID NO: 199694 - DNA, 25 bp, E. coli
aaacacgcgtttgatcattcctcgg

SEQ ID NO: 199695 - DNA, 25 bp, E. coli
aagaagaagggcagaaaacacgcgt

SEQ ID NO: 199696 - DNA, 25 bp, E. coli
aagaagaagggctgaaaacacgcgt

SEQ ID NO: 199697 - DNA, 25 bp, E. coli
tcctcggcgctatcgtgcagattat

SEQ ID NO: 199698 - DNA, 25 bp, E. coli
tcctcggcgctaacgtgcagattat

SEQ ID NO: 199699 - DNA, 25 bp, E. coli
tccttcggtaaatatgctggcgctc

SEQ ID NO: 199700 - DNA, 25 bp, E. coli
tccttcggtaaaaatgctggcgctc

SEQ ID NO: 199701 - DNA, 25 bp, E. coli
tctggaaagccagcaaggaaatcca

SEQ ID NO: 199702 - DNA, 25 bp, E. coli
tctctattgcggttgaaagcctcaa

SEQ ID NO: 199703 - DNA, 25 bp, E. coli
tctggaaagccaccaaggaaatcca

SEQ ID NO: 199704 - DNA, 25 bp, E. coli
tctctattgcggatgaaagcctcaa

SEQ ID NO: 199705 - DNA, 25 bp, E. coli
gaaagtttcgacttccacgtaccga

SEQ ID NO: 199706 - DNA, 25 bp, E. coli
gaaagtttcgacatccacgtaccga

SEQ ID NO: 199707 - DNA, 25 bp, E. coli
gaaaggttacatgtacttcgcgatg

SEQ ID NO: 199708 - DNA, 25 bp, E. coli
gaaaggttacatctacttcgcgatg

SEQ ID NO: 199709 - DNA, 25 bp, E. coli
cgccgcgcgctcgattggtgatttt

SEQ ID NO: 199710 - DNA, 25 bp, E. coli
cgccgcgcgctccattggtgatttt

SEQ ID NO: 199711 - DNA, 25 bp, E. coli
ctaacgcctggcttgcgctcggtac

SEQ ID NO: 199712 - DNA, 25 bp, E. coli
ctaacgcctggcatgcgctcggtac

SEQ ID NO: 199713 - DNA, 25 bp, E. coli
gtgggctttaccctgattctggaaa

SEQ ID NO: 199714 - DNA, 25 bp, E. coli
gtgggctttaccgtgattctggaaa

SEQ ID NO: 199715 - DNA, 25 bp, E. coli
tacatgctgaaactgaaccacctgg

SEQ ID NO: 199716 - DNA, 25 bp, E. coli
taaagagctgctcaaacttggcgac

SEQ ID NO: 199717 - DNA, 25 bp, E. coli
taaagagctgctgaaacttggcgac

SEQ ID NO: 199718 - DNA, 25 bp, E. coli
tacatgctgaaagtgaaccacctgg

SEQ ID NO: 199719 - DNA, 25 bp, E. coli
tatccgggtgaagcaggtatcgaca

SEQ ID NO: 199720 - DNA, 25 bp, E. coli
tatgtccaatcgaaacccctgaagg

SEQ ID NO: 199721 - DNA, 25 bp, E. coli
tatccgggtgaaccaggtatcgaca

SEQ ID NO: 199722 - DNA, 25 bp, E. coli
tatgtccaatcgtaacccctgaagg

SEQ ID NO: 199723 - DNA, 25 bp, E. coli
tatcgagcaagatcctgaagggcag

SEQ ID NO: 199724 - DNA, 25 bp, E. coli
tatcgagcaagaacctgaagggcag

SEQ ID NO: 199725 - DNA, 25 bp, E. coli
tttatggaccagtacaacccgctgt

SEQ ID NO: 199726 - DNA, 25 bp, E. coli
tttatggaccagaacaacccgctgt

SEQ ID NO: 199727 - DNA, 25 bp, E. coli
gaagctgcgctcaccaaactggatg

SEQ ID NO: 199728 - DNA, 25 bp, E. coli
gaagaactgcagttcctcgaagcgg

SEQ ID NO: 199729 - DNA, 25 bp, E. coli
gaagctgcgctctccaaactggatg

SEQ ID NO: 199730 - DNA, 25 bp, E. coli
gaagaactgcagatcctcgaagcgg

SEQ ID NO: 199731 - DNA, 25 bp, E. coli
gaaagagttcttcggttccagccag

SEQ ID NO: 199732 - DNA, 25 bp, E. coli
gaaagagttcttgggttccagccag

SEQ ID NO: 199733 - DNA, 25 bp, E. coli
gaagtcccggttcagtacatcgcag

SEQ ID NO: 199734 - DNA, 25 bp, E. coli
gaagtcccggttgagtacatcgcag

SEQ ID NO: 199735 - DNA, 25 bp, E. coli
gtagacatcgtactgaacccgctgg

SEQ ID NO: 199736 - DNA, 25 bp, E. coli
gtagacatcgtagtgaacccgctgg

SEQ ID NO: 199737 - DNA, 25 bp, E. coli
caatactgactgctgttcgtgctga

SEQ ID NO: 199738 - DNA, 25 bp, E. coli
caatactgactggtgttcgtgctga

SEQ ID NO: 199739 - DNA, 25 bp, E. coli
cacagcgtcaccagaagggttttat

SEQ ID NO: 199740 - DNA, 25 bp, E. coli
cacagcgtcacctgaagggttttat

SEQ ID NO: 199741 - DNA, 25 bp, E. coli
catcttacggcccatgtggctcgca

SEQ ID NO: 199742 - DNA, 25 bp, E. coli
catcttacggccgatgtggctcgca

SEQ ID NO: 199743 - DNA, 25 bp, E. coli
catgcgggtctgagagccttttggc

SEQ ID NO: 199744 - DNA, 25 bp, E. coli
catgcgggtctgtgagccttttggc

SEQ ID NO: 199745 - DNA, 25 bp, E. coli
ttggcccggaacagcgtaagggact

SEQ ID NO: 199746 - DNA, 25 bp, E. coli
ttggcccggaactgcgtaagggact

SEQ ID NO: 199747 - DNA, 25 bp, E. coli
tatataacgccagaacccgagctat

SEQ ID NO: 199748 - DNA, 25 bp, E. coli
tatataacgccacaacccgagctat

SEQ ID NO: 199749 - DNA, 25 bp, E. coli
tgccctgcgtaaccgtatcacgaag

SEQ ID NO: 199750 - DNA, 25 bp, E. coli
tgccctgcgtaagcgtatcacgaag

SEQ ID NO: 199751 - DNA, 25 bp, E. coli
gccaccagatgaggctattacagat

SEQ ID NO: 199752 - DNA, 25 bp, E. coli
gccaccagatgacgctattacagat

SEQ ID NO: 199753 - DNA, 25 bp, E. coli
gaaaagactctagtgtgctgctcca

SEQ ID NO: 199754 - DNA, 25 bp, E. coli
gaaaagactctactgtgctgctcca

SEQ ID NO: 199755 - DNA, 25 bp, E. coli
ggtgtctctcagattcagccggaat

SEQ ID NO: 199756 - DNA, 25 bp, E. coli
ggtgtctctcagtttcagccggaat

SEQ ID NO: 199757 - DNA, 25 bp, E. coli
gatgataaacccaggaccacagcgt

SEQ ID NO: 199758 - DNA, 25 bp, E. coli
gatgataaaccctggaccacagcgt

SEQ ID NO: 199759 - DNA, 25 bp, E. coli
cagactacggatggttgcaggcccg

SEQ ID NO: 199760 - DNA, 25 bp, E. coli
cattacgctggtagccgattcccca

SEQ ID NO: 199761 - DNA, 25 bp, E. coli
caggcagtgtggtcaagcagactac

SEQ ID NO: 199762 - DNA, 25 bp, E. coli
cagactacggatcgttgcaggcccg

SEQ ID NO: 199763 - DNA, 25 bp, E. coli
cattacgctggttgccgattcccca

SEQ ID NO: 199764 - DNA, 25 bp, E. coli
caggcagtgtggacaagcagactac

SEQ ID NO: 199765 - DNA, 25 bp, E. coli
tacgcatcatgaagagaaagcggcg

SEQ ID NO: 199766 - DNA, 25 bp, E. coli
tacgcatcatgatgagaaagcggcg

SEQ ID NO: 199767 - DNA, 25 bp, E. coli
ttgctgctctcttcccagccgggtg

SEQ ID NO: 199768 - DNA, 25 bp, E. coli
ttgctgctctctacccagccgggtg

SEQ ID NO: 199769 - DNA, 25 bp, E. coli
tgattactacccgaactgccaggca

SEQ ID NO: 199770 - DNA, 25 bp, E. coli
tgattactaccccaactgccaggca

SEQ ID NO: 199771 - DNA, 25 bp, E. coli
tcctttggacacaacttcgacccga

SEQ ID NO: 199772 - DNA, 25 bp, E. coli
tcctttggacactacttcgacccga

SEQ ID NO: 199773 - DNA, 25 bp, E. coli
tcgtgacgaggcaaacattacgctg

SEQ ID NO: 199774 - DNA, 25 bp, E. coli
tcgtgacgaggctaacattacgctg

SEQ ID NO: 199775 - DNA, 25 bp, E. coli
gacccgaaattgataggctatgcct

SEQ ID NO: 199776 - DNA, 25 bp, E. coli
gacccgaaattgttaggctatgcct

SEQ ID NO: 199777 - DNA, 25 bp, E. coli
cccactgcgcgcattgctgatagat

SEQ ID NO: 199778 - DNA, 25 bp, E. coli
cgaaggcaatcaagttcaggccagc

SEQ ID NO: 199779 - DNA, 25 bp, E. coli
cgaaggcaatcatgttcaggccagc

SEQ ID NO: 199780 - DNA, 25 bp, E. coli
cccactgcgcgctttgctgatagat

SEQ ID NO: 199781 - DNA, 25 bp, E. coli
catgactacccgtgctttagcagca

SEQ ID NO: 199782 - DNA, 25 bp, E. coli
catgactacccgagctttagcagca

SEQ ID NO: 199783 - DNA, 25 bp, E. coli
acccgtgctttagcagcatactctg

SEQ ID NO: 199784 - DNA, 25 bp, E. coli
acccgtgctttaccagcatactctg

SEQ ID NO: 199785 - DNA, 25 bp, E. coli
tgttgtttttcaccactttatttcg

SEQ ID NO: 199786 - DNA, 25 bp, E. coli
tgttgtttttcagcactttatttcg

SEQ ID NO: 199787 - DNA, 25 bp, E. coli
tcgttttatgcatgactacccgtgc

SEQ ID NO: 199788 - DNA, 25 bp, E. coli
tcgttttatgcaagactacccgtgc

SEQ ID NO: 199789 - DNA, 25 bp, E. coli
ccagggttctctccttaatagcgga

SEQ ID NO: 199790 - DNA, 25 bp, E. coli
ccagggttctctgcttaatagcgga

SEQ ID NO: 199791 - DNA, 25 bp, E. coli
gcatactctgcttaaacatacccga

SEQ ID NO: 199792 - DNA, 25 bp, E. coli
gcatactctgctaaaacatacccga

SEQ ID NO: 199793 - DNA, 25 bp, E. coli
gacagtttattatcaatctgcgtgg

SEQ ID NO: 199794 - DNA, 25 bp, E. coli
gacagtttattaacaatctgcgtgg

SEQ ID NO: 199795 - DNA, 25 bp, E. coli
gatattggaatacctattttgacag

SEQ ID NO: 199796 - DNA, 25 bp, E. coli
gatattggaatagctattttgacag

SEQ ID NO: 199797 - DNA, 25 bp, E. coli
gattattacagacgcccaaaaaaca

SEQ ID NO: 199798 - DNA, 25 bp, E. coli
gattattacagaggcccaaaaaaca

SEQ ID NO: 199799 - DNA, 25 bp, E. coli
ggactctcatccagggttctctgct

SEQ ID NO: 199800 - DNA, 25 bp, E. coli
ggactctcatcctgggttctctgct

SEQ ID NO: 199801 - DNA, 25 bp, E. coli
ggaaattgattattacagaggccca

SEQ ID NO: 199802 - DNA, 25 bp, E. coli
ggaaattgattaatacagaggccca

SEQ ID NO: 199803 - DNA, 25 bp, E. coli
tacgggttccatccattgattatcc

SEQ ID NO: 199804 - DNA, 25 bp, E. coli
tacgggttccatgcattgattatcc

SEQ ID NO: 199805 - DNA, 25 bp, E. coli
ttcgttaggtatttacgggttccat

SEQ ID NO: 199806 - DNA, 25 bp, E. coli
ttcgttaggtatatacgggttccat

SEQ ID NO: 199807 - DNA, 25 bp, E. coli
aacacgctgtatacgcgtactattt

SEQ ID NO: 199808 - DNA, 25 bp, E. coli
aacacgctgtattcgcgtactattt

SEQ ID NO: 199809 - DNA, 25 bp, E. coli
tttgcgcgaccctggcagtgagttt

SEQ ID NO: 199810 - DNA, 25 bp, E. coli
tttgcgcgacccaggcagtgagttt

SEQ ID NO: 199811 - DNA, 25 bp, E. coli
tatacgcgtactttttgcggacttg

SEQ ID NO: 199812 - DNA, 25 bp, E. coli
tatacgcgtactatttgcggacttg

SEQ ID NO: 199813 - DNA, 25 bp, E. coli
tgcattgattatccatgcactgcgc

SEQ ID NO: 199814 - DNA, 25 bp, E. coli
tgcattgattatgcatgcactgcgc

SEQ ID NO: 199815 - DNA, 25 bp, E. coli
cctggcagtgagattattactttct

SEQ ID NO: 199816 - DNA, 25 bp, E. coli
cctggcagtgagtttattactttct

SEQ ID NO: 199817 - DNA, 25 bp, E. coli
gctgtatacgcgtactatttgcgga

SEQ ID NO: 199818 - DNA, 25 bp, E. coli
gctgtatacgcgaactatttgcgga

SEQ ID NO: 199819 - DNA, 25 bp, E. coli
cgaccctggcagtgagtttattact

SEQ ID NO: 199820 - DNA, 25 bp, E. coli
cgaccctggcagagagtttattact

SEQ ID NO: 199821 - DNA, 25 bp, E. coli
gatcttttgcgccaccctggcagtg

SEQ ID NO: 199822 - DNA, 25 bp, E. coli
ggtatatacgggttccatgcattga

SEQ ID NO: 199823 - DNA, 25 bp, E. coli
ggtatatacgggatccatgcattga

SEQ ID NO: 199824 - DNA, 25 bp, E. coli
gatcttttgcgcgaccctggcagtg

SEQ ID NO: 199825 - DNA, 25 bp, E. coli
cactttaggaagtaattatgagtta

SEQ ID NO: 199826 - DNA, 25 bp, E. coli
cactttaggaagaaattatgagtta

SEQ ID NO: 199827 - DNA, 25 bp, E. coli
tattgggcaaattaataccttaaag

SEQ ID NO: 199828 - DNA, 25 bp, E. coli
taaatctcaataaatgtattgggca

SEQ ID NO: 199829 - DNA, 25 bp, E. coli
tattgggcaaataaataccttaaag

SEQ ID NO: 199830 - DNA, 25 bp, E. coli
taaatctcaatatatgtattgggca

SEQ ID NO: 199831 - DNA, 25 bp, E. coli
tatggcatgctattttatcaatggc

SEQ ID NO: 199832 - DNA, 25 bp, E. coli
taccttaaaggatggtatgtcgatt

SEQ ID NO: 199833 - DNA, 25 bp, E. coli
tatggcatgctaatttatcaatggc

SEQ ID NO: 199834 - DNA, 25 bp, E. coli
taccttaaaggaaggtatgtcgatt

SEQ ID NO: 199835 - DNA, 25 bp, E. coli
tatttactccagcaaattgtaggcg

SEQ ID NO: 199836 - DNA, 25 bp, E. coli
tatttactccaggaaattgtaggcg

SEQ ID NO: 199837 - DNA, 25 bp, E. coli
tccaggaaattgtaggcgtatatat

SEQ ID NO: 199838 - DNA, 25 bp, E. coli
tccatctcagaataagggcactatc

SEQ ID NO: 199839 - DNA, 25 bp, E. coli
tccaggaaattgaaggcgtatatat

SEQ ID NO: 199840 - DNA, 25 bp, E. coli
tccatctcagaaaaagggcactatc

SEQ ID NO: 199841 - DNA, 25 bp, E. coli
gaatgacaccctttttccatctcag

SEQ ID NO: 199842 - DNA, 25 bp, E. coli
gaatgacaccctatttccatctcag

SEQ ID NO: 199843 - DNA, 25 bp, E. coli
gaaaagtccttttatggcatgctat

SEQ ID NO: 199844 - DNA, 25 bp, E. coli
gaaaagtcctttaatggcatgctat

SEQ ID NO: 199845 - DNA, 25 bp, E. coli
ggtatgtcgattatgaatgacaccc

SEQ ID NO: 199846 - DNA, 25 bp, E. coli
ggtatgtcgattttgaatgacaccc

SEQ ID NO: 199847 - DNA, 25 bp, E. coli
aattgccaatctaacagcgtcttgc

SEQ ID NO: 199848 - DNA, 25 bp, E. coli
aattgccaatcttacagcgtcttgc

SEQ ID NO: 199849 - DNA, 25 bp, E. coli
catcaagtaagccaaataattcatc

SEQ ID NO: 199850 - DNA, 25 bp, E. coli
catcaagtaagcgaaataattcatc

SEQ ID NO: 199851 - DNA, 25 bp, E. coli
tactctggcagatgaaatccttttc

SEQ ID NO: 199852 - DNA, 25 bp, E. coli
taaatgctccgaaatctctacggat

SEQ ID NO: 199853 - DNA, 25 bp, E. coli
taaatgctccgatatctctacggat

SEQ ID NO: 199854 - DNA, 25 bp, E. coli
tactctggcagaagaaatccttttc

SEQ ID NO: 199855 - DNA, 25 bp, E. coli
acttgcctttcttttctggtatgta

SEQ ID NO: 199856 - DNA, 25 bp, E. coli
acttgcctttctattctggtatgta

SEQ ID NO: 199857 - DNA, 25 bp, E. coli
aaacattatcttggcattttttgca

SEQ ID NO: 199858 - DNA, 25 bp, E. coli
aaacattatcttcgcattttttgca

SEQ ID NO: 199859 - DNA, 25 bp, E. coli
tatttgcccgagtataaatgctccg

SEQ ID NO: 199860 - DNA, 25 bp, E. coli
tatttgcccgagaataaatgctccg

SEQ ID NO: 199861 - DNA, 25 bp, E. coli
tataaaccatacactttacttgcct

SEQ ID NO: 199862 - DNA, 25 bp, E. coli
tataaaccatactctttacttgcct

SEQ ID NO: 199863 - DNA, 25 bp, E. coli
gccgttgactcgtttgccgtagctc

SEQ ID NO: 199864 - DNA, 25 bp, E. coli
gccgttgactcgattgccgtagctc

SEQ ID NO: 199865 - DNA, 25 bp, E. coli
cgattgccgtaggtcgaacgcaagc

SEQ ID NO: 199866 - DNA, 25 bp, E. coli
cgattgccgtagctcgaacgcaagc

SEQ ID NO: 199867 - DNA, 25 bp, E. coli
ggcagatgaaatgcttttcaaggaa

SEQ ID NO: 199868 - DNA, 25 bp, E. coli
ggcagatgaaatccttttcaaggaa

SEQ ID NO: 199869 - DNA, 25 bp, E. coli
ttaaccgcactaggcttattgatgc

SEQ ID NO: 199870 - DNA, 25 bp, E. coli
ttgatgcccggcccagtgaagcgat

SEQ ID NO: 199871 - DNA, 25 bp, E. coli
ttgatgcccggcgcagtgaagcgat

SEQ ID NO: 199872 - DNA, 25 bp, E. coli
ttaaccgcactacgcttattgatgc

SEQ ID NO: 199873 - DNA, 25 bp, E. coli
tgctgccggacgttaaactctacca

SEQ ID NO: 199874 - DNA, 25 bp, E. coli
tgctgccggacgataaactctacca

SEQ ID NO: 199875 - DNA, 25 bp, E. coli
ccggtgaaaaatttcgagcgcatga

SEQ ID NO: 199876 - DNA, 25 bp, E. coli
ccggtgaaaaatatcgagcgcatga

SEQ ID NO: 199877 - DNA, 25 bp, E. coli
gctggttaaccgcactacgcttatt

SEQ ID NO: 199878 - DNA, 25 bp, E. coli
gctggttaaccggactacgcttatt

SEQ ID NO: 199879 - DNA, 25 bp, E. coli
gaaaaatatcgagcgcatgatcaac

SEQ ID NO: 199880 - DNA, 25 bp, E. coli
gaaaaatatcgaccgcatgatcaac

SEQ ID NO: 199881 - DNA, 25 bp, E. coli
ctaccaggcattacgtcaggatttg

SEQ ID NO: 199882 - DNA, 25 bp, E. coli
ctaccaggcatttcgtcaggatttg

SEQ ID NO: 199883 - DNA, 25 bp, E. coli
ggacgataaactctaccaggcatta

SEQ ID NO: 199884 - DNA, 25 bp, E. coli
ggacgataaactgtaccaggcatta

SEQ ID NO: 199885 - DNA, 25 bp, E. coli
ggcgtgctgccggacgataaactct

SEQ ID NO: 199886 - DNA, 25 bp, E. coli
ggctcaacttcagtgtaacaacagc

SEQ ID NO: 199887 - DNA, 25 bp, E. coli
ggcgtgctgccgcacgataaactct

SEQ ID NO: 199888 - DNA, 25 bp, E. coli
ggctcaacttcactgtaacaacagc

SEQ ID NO: 199889 - DNA, 25 bp, E. coli
tcaacttcagtgaaacaacagcggt

SEQ ID NO: 199890 - DNA, 25 bp, E. coli
tcaacttcagtgtaacaacagcggt

SEQ ID NO: 199891 - DNA, 25 bp, E. coli
cagttacgtaatcccgatgcgttaa

SEQ ID NO: 199892 - DNA, 25 bp, E. coli
cagttacgtaatgccgatgcgttaa

SEQ ID NO: 199893 - DNA, 25 bp, E. coli
atgcgttaacccagcaggcacctgc

SEQ ID NO: 199894 - DNA, 25 bp, E. coli
atgaccagaacgaacgcacgccgat

SEQ ID NO: 199895 - DNA, 25 bp, E. coli
atgcgttaaccctgcaggcacctgc

SEQ ID NO: 199896 - DNA, 25 bp, E. coli
atgaccagaacgtacgcacgccgat

SEQ ID NO: 199897 - DNA, 25 bp, E. coli
cagagtgcggaagagttacgtaatg

SEQ ID NO: 199898 - DNA, 25 bp, E. coli
cagagtgcggaacagttacgtaatg

SEQ ID NO: 199899 - DNA, 25 bp, E. coli
tgacgctggaataaagcggttgccc

SEQ ID NO: 199900 - DNA, 25 bp, E. coli
tgacgctggaattaagcggttgccc

SEQ ID NO: 199901 - DNA, 25 bp, E. coli
cgaacgcacgcccattggcggcaaa

SEQ ID NO: 199902 - DNA, 25 bp, E. coli
cgaacgcacgccgattggcggcaaa

SEQ ID NO: 199903 - DNA, 25 bp, E. coli
cgcacgccgattggcggcaaaatcg

SEQ ID NO: 199904 - DNA, 25 bp, E. coli
cgcacgccgattcgcggcaaaatcg

SEQ ID NO: 199905 - DNA, 25 bp, E. coli
gattggcggcaatatcgttttccag

SEQ ID NO: 199906 - DNA, 25 bp, E. coli
gattggcggcaaaatcgttttccag

SEQ ID NO: 199907 - DNA, 25 bp, E. coli
ggaacagttacgtaatgccgatgcg

SEQ ID NO: 199908 - DNA, 25 bp, E. coli
ggcaaaatcgttttccagcgttggc

SEQ ID NO: 199909 - DNA, 25 bp, E. coli
ggcaaaatcgttatccagcgttggc

SEQ ID NO: 199910 - DNA, 25 bp, E. coli
tggaattaagcggttgcccgataga

SEQ ID NO: 199911 - DNA, 25 bp, E. coli
tggaattaagcgcttgcccgataga

SEQ ID NO: 199912 - DNA, 25 bp, E. coli
ggaacagttacgaaatgccgatgcg

SEQ ID NO: 199913 - DNA, 25 bp, E. coli
agtatacccgaagatgacctgtgcc

SEQ ID NO: 199914 - DNA, 25 bp, E. coli
agtatacccgaacatgacctgtgcc

SEQ ID NO: 199915 - DNA, 25 bp, E. coli
aaatggcgcttgtccgcgtaattcc

SEQ ID NO: 199916 - DNA, 25 bp, E. coli
aaatggcgcttgaccgcgtaattcc

SEQ ID NO: 199917 - DNA, 25 bp, E. coli
tttaaaaaatgacacaaatggcgct

SEQ ID NO: 199918 - DNA, 25 bp, E. coli
tttaaaaaatgagacaaatggcgct

SEQ ID NO: 199919 - DNA, 25 bp, E. coli
ttttgacgcaaaacaagcgcttgtc

SEQ ID NO: 199920 - DNA, 25 bp, E. coli
ttttgacgcaaatcaagcgcttgtc

SEQ ID NO: 199921 - DNA, 25 bp, E. coli
taaccaagacgggaaagcagtatac

SEQ ID NO: 199922 - DNA, 25 bp, E. coli
tcgccagcgcacaattgaaatcagg

SEQ ID NO: 199923 - DNA, 25 bp, E. coli
tcgccagcgcactattgaaatcagg

SEQ ID NO: 199924 - DNA, 25 bp, E. coli
taaccaagacggcaaagcagtatac

SEQ ID NO: 199925 - DNA, 25 bp, E. coli
cctgagaagttaggttgaaaagacg

SEQ ID NO: 199926 - DNA, 25 bp, E. coli
cctgagaagttacgttgaaaagacg

SEQ ID NO: 199927 - DNA, 25 bp, E. coli
gaaatcaggagtgagaaaatagccc

SEQ ID NO: 199928 - DNA, 25 bp, E. coli
gaaatcaggagtcagaaaatagccc

SEQ ID NO: 199929 - DNA, 25 bp, E. coli
gaaaagacgatgcaataaccaagac

SEQ ID NO: 199930 - DNA, 25 bp, E. coli
gaaaagacgatggaataaccaagac

SEQ ID NO: 199931 - DNA, 25 bp, E. coli
ggagtgagaaaatagcccctttggg

SEQ ID NO: 199932 - DNA, 25 bp, E. coli
ggagtgagaaaaaagcccctttggg

SEQ ID NO: 199933 - DNA, 25 bp, E. coli
gacctgtgccacaaactttcattat

SEQ ID NO: 199934 - DNA, 25 bp, E. coli
gacctgtgccactaactttcattat

SEQ ID NO: 199935 - DNA, 25 bp, E. coli
caatgattgaatttgcaggcgtcgg

SEQ ID NO: 199936 - DNA, 25 bp, E. coli
caatgattgaatatgcaggcgtcgg

SEQ ID NO: 199937 - DNA, 25 bp, E. coli
tactgcattactaataacggcgcgc

SEQ ID NO: 199938 - DNA, 25 bp, E. coli
tactgcattacttataacggcgcgc

SEQ ID NO: 199939 - DNA, 25 bp, E. coli
taaaaatgcgatagccgcagctcgc

SEQ ID NO: 199940 - DNA, 25 bp, E. coli
taaaaatgcgattgccgcagctcgc

SEQ ID NO: 199941 - DNA, 25 bp, E. coli
tattaaaccggatgaaatcatggcg

SEQ ID NO: 199942 - DNA, 25 bp, E. coli
tattaaaccggaagaaatcatggcg

SEQ ID NO: 199943 - DNA, 25 bp, E. coli
tctgcgaagcggtgaaaatggaccc

SEQ ID NO: 199944 - DNA, 25 bp, E. coli
tctgcgaagcggagaaaatggaccc

SEQ ID NO: 199945 - DNA, 25 bp, E. coli
gcccgtggcgtgtatgtcgtgctaa

SEQ ID NO: 199946 - DNA, 25 bp, E. coli
gcccgtggcgtgaatgtcgtgctaa

SEQ ID NO: 199947 - DNA, 25 bp, E. coli
gctatcgatatggatggcacccttc

SEQ ID NO: 199948 - DNA, 25 bp, E. coli
gctatcgatatgcatggcacccttc

SEQ ID NO: 199949 - DNA, 25 bp, E. coli
gaaaagtgcgccgtacttcctcgaa

SEQ ID NO: 199950 - DNA, 25 bp, E. coli
gaaaagtgcgccctacttcctcgaa

SEQ ID NO: 199951 - DNA, 25 bp, E. coli
ctgcatatggaacagccgggcgact

SEQ ID NO: 199952 - DNA, 25 bp, E. coli
ctgcatatggaagagccgggcgact

SEQ ID NO: 199953 - DNA, 25 bp, E. coli
gatatcagctacaacacggtgcatg

SEQ ID NO: 199954 - DNA, 25 bp, E. coli
gatatcagctactacacggtgcatg

SEQ ID NO: 199955 - DNA, 25 bp, E. coli
ggaaaaactctcacgcgaagtcggt

SEQ ID NO: 199956 - DNA, 25 bp, E. coli
ggaaaaactctctcgcgaagtcggt

SEQ ID NO: 199957 - DNA, 25 bp, E. coli
attgaccccttgtcgctaaacgcgg

SEQ ID NO: 199958 - DNA, 25 bp, E. coli
attgaccccttgacgctaaacgcgg

SEQ ID NO: 199959 - DNA, 25 bp, E. coli
aaagagcctggtctgcaacatacgg

SEQ ID NO: 199960 - DNA, 25 bp, E. coli
aacatacggcagtaacggtggcgca

SEQ ID NO: 199961 - DNA, 25 bp, E. coli
aacatacggcagaaacggtggcgca

SEQ ID NO: 199962 - DNA, 25 bp, E. coli
aaagagcctggtgtgcaacatacgg

SEQ ID NO: 199963 - DNA, 25 bp, E. coli
tatcccggcgacgtggtgtttacca

SEQ ID NO: 199964 - DNA, 25 bp, E. coli
tatcccggcgacctggtgtttacca

SEQ ID NO: 199965 - DNA, 25 bp, E. coli
tatcttgaatattgcgccagccgcc

SEQ ID NO: 199966 - DNA, 25 bp, E. coli
tatcttgaatatagcgccagccgcc

SEQ ID NO: 199967 - DNA, 25 bp, E. coli
ttgttcacggcatagttggcagacc

SEQ ID NO: 199968 - DNA, 25 bp, E. coli
ttgttcacggcaaagttggcagacc

SEQ ID NO: 199969 - DNA, 25 bp, E. coli
tgatgatcgagcgttttaagccggg

SEQ ID NO: 199970 - DNA, 25 bp, E. coli
tgatcgttgaggtcgaaacgccgct

SEQ ID NO: 199971 - DNA, 25 bp, E. coli
tgatcgttgaggacgaaacgccgct

SEQ ID NO: 199972 - DNA, 25 bp, E. coli
tgaactggtgcacgcgcattatccc

SEQ ID NO: 199973 - DNA, 25 bp, E. coli
tgaactggtgcaggcgcattatccc

SEQ ID NO: 199974 - DNA, 25 bp, E. coli
tgatgatcgagccttttaagccggg

SEQ ID NO: 199975 - DNA, 25 bp, E. coli
gaaagtattgatagcgccagccaga

SEQ ID NO: 199976 - DNA, 25 bp, E. coli
gaaagtattgattgcgccagccaga

SEQ ID NO: 199977 - DNA, 25 bp, E. coli
ggtgtttaccacagcagccagcgat

SEQ ID NO: 199978 - DNA, 25 bp, E. coli
ggtgtttaccactgcagccagcgat

SEQ ID NO: 199979 - DNA, 25 bp, E. coli
cagtcatttgcccaagggcttgatt

SEQ ID NO: 199980 - DNA, 25 bp, E. coli
cagtcatttgccgaagggcttgatt

SEQ ID NO: 199981 - DNA, 25 bp, E. coli
tacagctggacttgttcacgaaact

SEQ ID NO: 199982 - DNA, 25 bp, E. coli
tacacctctggtatcactgcgtggg

SEQ ID NO: 199983 - DNA, 25 bp, E. coli
tacacctctggtttcactgcgtggg

SEQ ID NO: 199984 - DNA, 25 bp, E. coli
tacagctggactagttcacgaaact

SEQ ID NO: 199985 - DNA, 25 bp, E. coli
ttgttcacgaaagtggtcgctacct

SEQ ID NO: 199986 - DNA, 25 bp, E. coli
ttgttcacgaaactggtcgctacct

SEQ ID NO: 199987 - DNA, 25 bp, E. coli
tgggaatacgtgtcagcgatcagct

SEQ ID NO: 199988 - DNA, 25 bp, E. coli
tgggaatacgtgacagcgatcagct

SEQ ID NO: 199989 - DNA, 25 bp, E. coli
tgtcagcgatcacctggaaaggctg

SEQ ID NO: 199990 - DNA, 25 bp, E. coli
tgtcagcgatcagctggaaaggctg

SEQ ID NO: 199991 - DNA, 25 bp, E. coli
gcgatcagccgcgttaccgtttagt

SEQ ID NO: 199992 - DNA, 25 bp, E. coli
gcgttaccgttttgttgaactgcac

SEQ ID NO: 199993 - DNA, 25 bp, E. coli
gcgttaccgtttagttgaactgcac

SEQ ID NO: 199994 - DNA, 25 bp, E. coli
gcgatcagccgccttaccgtttagt

SEQ ID NO: 199995 - DNA, 25 bp, E. coli
ccgaagggcttgatttgaaaggtga

SEQ ID NO: 199996 - DNA, 25 bp, E. coli
ccgaagggcttgttttgaaaggtga

SEQ ID NO: 199997 - DNA, 25 bp, E. coli
tggtatcggctacagctggacttgt

SEQ ID NO: 199998 - DNA, 25 bp, E. coli
tggtatcggctagagctggacttgt

SEQ ID NO: 199999 - DNA, 25 bp, E. coli
tcactgcgtgggaatacgtgtcagc

SEQ ID NO: 200000 - DNA, 25 bp, E. coli
tcactgcgtgggtatacgtgtcagc

SEQ ID NO: 200001 - DNA, 25 bp, E. coli
caagcacagctatagagtcaactgg

SEQ ID NO: 200002 - DNA, 25 bp, E. coli
aatcttccctctgctgaaaatcggc

SEQ ID NO: 200003 - DNA, 25 bp, E. coli
caagcacagctaaagagtcaactgg

SEQ ID NO: 200004 - DNA, 25 bp, E. coli
aatcttccctctcctgaaaatcggc

SEQ ID NO: 200005 - DNA, 25 bp, E. coli
aacaatggttcggtggctttagcgg

SEQ ID NO: 200006 - DNA, 25 bp, E. coli
aacaatggttcgctggctttagcgg

SEQ ID NO: 200007 - DNA, 25 bp, E. coli
tgttatccattgtcgccacagagaa

SEQ ID NO: 200008 - DNA, 25 bp, E. coli
tgttatccattgacgccacagagaa

SEQ ID NO: 200009 - DNA, 25 bp, E. coli
tgcccggtggcaacaattacttttc

SEQ ID NO: 200010 - DNA, 25 bp, E. coli
tgcccggtggcatcaattacttttc

SEQ ID NO: 200011 - DNA, 25 bp, E. coli
gctttagcgggtggagtgttatcca

SEQ ID NO: 200012 - DNA, 25 bp, E. coli
gctttagcgggtcgagtgttatcca

SEQ ID NO: 200013 - DNA, 25 bp, E. coli
gacattaatttgaccctgaagggtg

SEQ ID NO: 200014 - DNA, 25 bp, E. coli
gacattaatttgtccctgaagggtg

SEQ ID NO: 200015 - DNA, 25 bp, E. coli
cgatgccaaagagtttgcccggtgg

SEQ ID NO: 200016 - DNA, 25 bp, E. coli
cgatgccaaagactttgcccggtgg

SEQ ID NO: 200017 - DNA, 25 bp, E. coli
ggtgaaaaacctctcgatgccaaag

SEQ ID NO: 200018 - DNA, 25 bp, E. coli
ggtgaaaaacctgtcgatgccaaag

SEQ ID NO: 200019 - DNA, 25 bp, E. coli
gggtgtatcgcccaataacctggga

SEQ ID NO: 200020 - DNA, 25 bp, E. coli
gggtgtatcgccgaataacctggga

SEQ ID NO: 200021 - DNA, 25 bp, E. coli
taacctgggataactgaagttagcc

SEQ ID NO: 200022 - DNA, 25 bp, E. coli
taacctgggatatctgaagttagcc

SEQ ID NO: 200023 - DNA, 25 bp, E. coli
caatgcagcagctgtgatactggcg

SEQ ID NO: 200024 - DNA, 25 bp, E. coli
caatgcagcagcagtgatactggcg

SEQ ID NO: 200025 - DNA, 25 bp, E. coli
ttgattgcccaccaaaccctgtttg

SEQ ID NO: 200026 - DNA, 25 bp, E. coli
ttgattgcccacgaaaccctgtttg

SEQ ID NO: 200027 - DNA, 25 bp, E. coli
tataacgcagcgactggtgcaggcg

SEQ ID NO: 200028 - DNA, 25 bp, E. coli
tataacgcagcgtctggtgcaggcg

SEQ ID NO: 200029 - DNA, 25 bp, E. coli
ttgaccgacacctgcgcgaaacagg

SEQ ID NO: 200030 - DNA, 25 bp, E. coli
ttgaccgacaccagcgcgaaacagg

SEQ ID NO: 200031 - DNA, 25 bp, E. coli
tggtgcaggcgcatcagctcgttga

SEQ ID NO: 200032 - DNA, 25 bp, E. coli
tgaggtggtcaatcgcgccctgtat

SEQ ID NO: 200033 - DNA, 25 bp, E. coli
tgaggtggtcaaacgcgccctgtat

SEQ ID NO: 200034 - DNA, 25 bp, E. coli
tcccagccaggctgataagactata

SEQ ID NO: 200035 - DNA, 25 bp, E. coli
tcccagccaggcagataagactata

SEQ ID NO: 200036 - DNA, 25 bp, E. coli
gcgaaacaggcgtggcattcacctc

SEQ ID NO: 200037 - DNA, 25 bp, E. coli
gctcgtgactggctgaagctgaaaa

SEQ ID NO: 200038 - DNA, 25 bp, E. coli
gctcgtgactgggtgaagctgaaaa

SEQ ID NO: 200039 - DNA, 25 bp, E. coli
gcgaaacaggcgaggcattcacctc

SEQ ID NO: 200040 - DNA, 25 bp, E. coli
ggtaaaacgcgccttaacgctgctt

SEQ ID NO: 200041 - DNA, 25 bp, E. coli
ggtaaaacgcgcgttaacgctgctt

SEQ ID NO: 200042 - DNA, 25 bp, E. coli
tggtgcaggcgcttcagctcgttga

SEQ ID NO: 200043 - DNA, 25 bp, E. coli
taccgaggtacaaccccgtgaggtg

SEQ ID NO: 200044 - DNA, 25 bp, E. coli
taccgaggtacatccccgtgaggtg

SEQ ID NO: 200045 - DNA, 25 bp, E. coli
catgtaaatcagatacgccgtgatc

SEQ ID NO: 200046 - DNA, 25 bp, E. coli
catgtccctgaattcatcctgctga

SEQ ID NO: 200047 - DNA, 25 bp, E. coli
catcctgctgaactcccatgacggt

SEQ ID NO: 200048 - DNA, 25 bp, E. coli
catcgacacggacattaagctcaat

SEQ ID NO: 200049 - DNA, 25 bp, E. coli
catgtaaatcagttacgccgtgatc

SEQ ID NO: 200050 - DNA, 25 bp, E. coli
catcgacacggagattaagctcaat

SEQ ID NO: 200051 - DNA, 25 bp, E. coli
catgtccctgaaatcatcctgctga

SEQ ID NO: 200052 - DNA, 25 bp, E. coli
catcctgctgaagtcccatgacggt

SEQ ID NO: 200053 - DNA, 25 bp, E. coli
ttaactcgtgaacaactgatgcagg

SEQ ID NO: 200054 - DNA, 25 bp, E. coli
ttaactcgtgaagaactgatgcagg

SEQ ID NO: 200055 - DNA, 25 bp, E. coli
gaagcgagaactttacctggatccc

SEQ ID NO: 200056 - DNA, 25 bp, E. coli
gaagataagcactcatccagaagcg

SEQ ID NO: 200057 - DNA, 25 bp, E. coli
gaagcgagaactatacctggatccc

SEQ ID NO: 200058 - DNA, 25 bp, E. coli
gaagataagcacacatccagaagcg

SEQ ID NO: 200059 - DNA, 25 bp, E. coli
gaagaactgatggaggtcgtcccca

SEQ ID NO: 200060 - DNA, 25 bp, E. coli
gaagaactgatgcaggtcgtcccca

SEQ ID NO: 200061 - DNA, 25 bp, E. coli
cgccgtgatcgtcccttaactcgtg

SEQ ID NO: 200062 - DNA, 25 bp, E. coli
cgccgtgatcgtgccttaactcgtg

SEQ ID NO: 200063 - DNA, 25 bp, E. coli
ggatccccaccatcacagtgctgga

SEQ ID NO: 200064 - DNA, 25 bp, E. coli
ggatccccaccaacacagtgctgga

SEQ ID NO: 200065 - DNA, 25 bp, E. coli
gatgcaggtcgtgcccagcgtattc

SEQ ID NO: 200066 - DNA, 25 bp, E. coli
gatgcaggtcgtccccagcgtattc

SEQ ID NO: 200067 - DNA, 25 bp, E. coli
tattagagcggcttttttcttactt

SEQ ID NO: 200068 - DNA, 25 bp, E. coli
tattagagcggcatttttcttactt

SEQ ID NO: 200069 - DNA, 25 bp, E. coli
tgatgcgctttcctcaatgccagaa

SEQ ID NO: 200070 - DNA, 25 bp, E. coli
tgatgcgctttcgtcaatgccagaa

SEQ ID NO: 200071 - DNA, 25 bp, E. coli
ccggcgttcctgatgatgcggctga

SEQ ID NO: 200072 - DNA, 25 bp, E. coli
ccagaacttatttgagcggcttttt

SEQ ID NO: 200073 - DNA, 25 bp, E. coli
ccagaacttattagagcggcttttt

SEQ ID NO: 200074 - DNA, 25 bp, E. coli
ccggcgttcctgttgatgcggctga

SEQ ID NO: 200075 - DNA, 25 bp, E. coli
gcgctttcgtcattgccagaactta

SEQ ID NO: 200076 - DNA, 25 bp, E. coli
gcgctttcgtcaatgccagaactta

SEQ ID NO: 200077 - DNA, 25 bp, E. coli
gaattttccggccttcctgatgatg

SEQ ID NO: 200078 - DNA, 25 bp, E. coli
gaattttccggcgttcctgatgatg

SEQ ID NO: 200079 - DNA, 25 bp, E. coli
cgttcctgatgaagcggctgatgcg

SEQ ID NO: 200080 - DNA, 25 bp, E. coli
cgttcctgatgatgcggctgatgcg

SEQ ID NO: 200081 - DNA, 25 bp, E. coli
gggttatgcgtgttgatcgttttaa

SEQ ID NO: 200082 - DNA, 25 bp, E. coli
gggttatgcgtgatgatcgttttaa

SEQ ID NO: 200083 - DNA, 25 bp, E. coli
tcaatgccagaagttattagagcgg

SEQ ID NO: 200084 - DNA, 25 bp, E. coli
tcaatgccagaacttattagagcgg

SEQ ID NO: 200085 - DNA, 25 bp, E. coli
gatgcggctgatgcgctttcgtcaa

SEQ ID NO: 200086 - DNA, 25 bp, E. coli
gatgcggctgatccgctttcgtcaa

SEQ ID NO: 200087 - DNA, 25 bp, E. coli
gatcgttttaataccctgaaacagg

SEQ ID NO: 200088 - DNA, 25 bp, E. coli
gatcgttttaattccctgaaacagg

SEQ ID NO: 200089 - DNA, 25 bp, E. coli
cactggtggcgtacctctgtggaag

SEQ ID NO: 200090 - DNA, 25 bp, E. coli
cactggtggcgttcctctgtggaag

SEQ ID NO: 200091 - DNA, 25 bp, E. coli
tacccgcctgacagattcgacgatt

SEQ ID NO: 200092 - DNA, 25 bp, E. coli
tacccgcctgactgattcgacgatt

SEQ ID NO: 200093 - DNA, 25 bp, E. coli
ttccgctgatgttcaacgcactggc

SEQ ID NO: 200094 - DNA, 25 bp, E. coli
ttccgctgatgtacaacgcactggc

SEQ ID NO: 200095 - DNA, 25 bp, E. coli
tgggaacacgtctaatctggcacct

SEQ ID NO: 200096 - DNA, 25 bp, E. coli
tgggaacacgtcaaatctggcacct

SEQ ID NO: 200097 - DNA, 25 bp, E. coli
tgcataacgttagtgtcccgaccga

SEQ ID NO: 200098 - DNA, 25 bp, E. coli
tgcataacgttactgtcccgaccga

SEQ ID NO: 200099 - DNA, 25 bp, E. coli
tgctcgaagtttcactggcctaccg

SEQ ID NO: 200100 - DNA, 25 bp, E. coli
tgctcgaagtttgactggcctaccg

SEQ ID NO: 200101 - DNA, 25 bp, E. coli
ccagggaaatattactgcaggtgca

SEQ ID NO: 200102 - DNA, 25 bp, E. coli
ccagggaaatataactgcaggtgca

SEQ ID NO: 200103 - DNA, 25 bp, E. coli
ggtcagcgtgctgacaagcctttca

SEQ ID NO: 200104 - DNA, 25 bp, E. coli
ggtcagcgtgctcacaagcctttca

SEQ ID NO: 200105 - DNA, 25 bp, E. coli
ggagcattatttcactacccgcctg

SEQ ID NO: 200106 - DNA, 25 bp, E. coli
ggcgaaacgcgagttcacccagttg

SEQ ID NO: 200107 - DNA, 25 bp, E. coli
ggcgaaacgcgacttcacccagttg

SEQ ID NO: 200108 - DNA, 25 bp, E. coli
tggcctaccgcataattgaatggga

SEQ ID NO: 200109 - DNA, 25 bp, E. coli
ggagcattatttgactacccgcctg

SEQ ID NO: 200110 - DNA, 25 bp, E. coli
tggcctaccgcaaaattgaatggga

SEQ ID NO: 200111 - DNA, 25 bp, E. coli
tacccctgggtctgaagataccatg

SEQ ID NO: 200112 - DNA, 25 bp, E. coli
tagggaccgtgcagaatccgtatgc

SEQ ID NO: 200113 - DNA, 25 bp, E. coli
tacccctgggtcagaagataccatg

SEQ ID NO: 200114 - DNA, 25 bp, E. coli
tagggaccgtgctgaatccgtatgc

SEQ ID NO: 200115 - DNA, 25 bp, E. coli
tttgacacttccagcatagggaccg

SEQ ID NO: 200116 - DNA, 25 bp, E. coli
tttgacacttcctgcatagggaccg

SEQ ID NO: 200117 - DNA, 25 bp, E. coli
tttaagtgatcatgagtacgctcgc

SEQ ID NO: 200118 - DNA, 25 bp, E. coli
tttaagtgatcaagagtacgctcgc

SEQ ID NO: 200119 - DNA, 25 bp, E. coli
tcctgtaaatcccatgcgcctggcg

SEQ ID NO: 200120 - DNA, 25 bp, E. coli
tcctgtaaatccgatgcgcctggcg

SEQ ID NO: 200121 - DNA, 25 bp, E. coli
gcctggcggcgtgtgagataacact

SEQ ID NO: 200122 - DNA, 25 bp, E. coli
gcctggcggcgtctgagataacact

SEQ ID NO: 200123 - DNA, 25 bp, E. coli
cgtacggtagagtataagcctgcaa

SEQ ID NO: 200124 - DNA, 25 bp, E. coli
cgtacggtagagaataagcctgcaa

SEQ ID NO: 200125 - DNA, 25 bp, E. coli
gatactactgataacggcgcacggt

SEQ ID NO: 200126 - DNA, 25 bp, E. coli
gatactactgattacggcgcacggt

SEQ ID NO: 200127 - DNA, 25 bp, E. coli
tggtccgctcgaaactcttaacagg

SEQ ID NO: 200128 - DNA, 25 bp, E. coli
tggtccgctcgatactcttaacagg

SEQ ID NO: 200129 - DNA, 25 bp, E. coli
tcaaagcacttatgcgcgtctggcg

SEQ ID NO: 200130 - DNA, 25 bp, E. coli
tcaaagcacttaagcgcgtctggcg

SEQ ID NO: 200131 - DNA, 25 bp, E. coli
gatgaacaacaagctaaacgccagg

SEQ ID NO: 200132 - DNA, 25 bp, E. coli
gatgaacaacaacctaaacgccagg

SEQ ID NO: 200133 - DNA, 25 bp, E. coli
gttttaacctcgcacgcgaagcgca

SEQ ID NO: 200134 - DNA, 25 bp, E. coli
atcaaaacgctgaccggcaagcagg

SEQ ID NO: 200135 - DNA, 25 bp, E. coli
gttttaacctcggacgcgaagcgca

SEQ ID NO: 200136 - DNA, 25 bp, E. coli
atcaaaacgctgtccggcaagcagg

SEQ ID NO: 200137 - DNA, 25 bp, E. coli
aaaaagttagtacccacagcaccgc

SEQ ID NO: 200138 - DNA, 25 bp, E. coli
aaaaagttagtagccacagcaccgc

SEQ ID NO: 200139 - DNA, 25 bp, E. coli
aacatggtggttcgcgacattatcg

SEQ ID NO: 200140 - DNA, 25 bp, E. coli
aacatggtggttggcgacattatcg

SEQ ID NO: 200141 - DNA, 25 bp, E. coli
tccggaacagagcatcaaaatgggc

SEQ ID NO: 200142 - DNA, 25 bp, E. coli
tccggaacagaggatcaaaatgggc

SEQ ID NO: 200143 - DNA, 25 bp, E. coli
gccgatgtgattttcgaaaccagcg

SEQ ID NO: 200144 - DNA, 25 bp, E. coli
gccgatgtgattatcgaaaccagcg

SEQ ID NO: 200145 - DNA, 25 bp, E. coli
gcgaagcgcattacaataacgccaa

SEQ ID NO: 200146 - DNA, 25 bp, E. coli
gcgaagcgcatttcaataacgccaa

SEQ ID NO: 200147 - DNA, 25 bp, E. coli
gctgcgctggttcagtatgaagatc

SEQ ID NO: 200148 - DNA, 25 bp, E. coli
gctgcgctggttgagtatgaagatc

SEQ ID NO: 200149 - DNA, 25 bp, E. coli
gacattatcgagagcggcagcgacg

SEQ ID NO: 200150 - DNA, 25 bp, E. coli
gacattatcgagtgcggcagcgacg

SEQ ID NO: 200151 - DNA, 25 bp, E. coli
cgccgcgcggcattgagtttggcaa

SEQ ID NO: 200152 - DNA, 25 bp, E. coli
cgccgcgcggcaatgagtttggcaa

SEQ ID NO: 200153 - DNA, 25 bp, E. coli
gtgaataactacaagctgcgcaaaa

SEQ ID NO: 200154 - DNA, 25 bp, E. coli
gtgaataactactagctgcgcaaaa

SEQ ID NO: 200155 - DNA, 25 bp, E. coli
cagatgctgaaacgtggtaacgccc

SEQ ID NO: 200156 - DNA, 25 bp, E. coli
cagatgctgaaaggtggtaacgccc

SEQ ID NO: 200157 - DNA, 25 bp, E. coli
taaaagcggcgtttgacgatgcgat

SEQ ID NO: 200158 - DNA, 25 bp, E. coli
taaaagcggcgtatgacgatgcgat

SEQ ID NO: 200159 - DNA, 25 bp, E. coli
aaacctggcggcaactctgagggaa

SEQ ID NO: 200160 - DNA, 25 bp, E. coli
aaacctggcggctactctgagggaa

SEQ ID NO: 200161 - DNA, 25 bp, E. coli
taccattaaagaagccgaacgcggc

SEQ ID NO: 200162 - DNA, 25 bp, E. coli
taccattaaagatgccgaacgcggc

SEQ ID NO: 200163 - DNA, 25 bp, E. coli
tatctgtatagcgtgaccagcccgg

SEQ ID NO: 200164 - DNA, 25 bp, E. coli
tataccaacgaagttcagccgcgtg

SEQ ID NO: 200165 - DNA, 25 bp, E. coli
tatctgtatagcctgaccagcccgg

SEQ ID NO: 200166 - DNA, 25 bp, E. coli
tataccaacgaacttcagccgcgtg

SEQ ID NO: 200167 - DNA, 25 bp, E. coli
tgattcgtagcgatactcagcgcga

SEQ ID NO: 200168 - DNA, 25 bp, E. coli
tgattcgtagcgttactcagcgcga

SEQ ID NO: 200169 - DNA, 25 bp, E. coli
gaagagcgataagggtgccagcaat

SEQ ID NO: 200170 - DNA, 25 bp, E. coli
gaagagcgataacggtgccagcaat

SEQ ID NO: 200171 - DNA, 25 bp, E. coli
cgattgtcattaactgggcggccag

SEQ ID NO: 200172 - DNA, 25 bp, E. coli
cgattgtcattatctgggcggccag

SEQ ID NO: 200173 - DNA, 25 bp, E. coli
cattcgtgaagcagaagcgtatacc

SEQ ID NO: 200174 - DNA, 25 bp, E. coli
cattcgtgaagctgaagcgtatacc

SEQ ID NO: 200175 - DNA, 25 bp, E. coli
tcaaaccggtgaacgtggaagccgt

SEQ ID NO: 200176 - DNA, 25 bp, E. coli
tcaaaccggtgatcgtggaagccgt

SEQ ID NO: 200177 - DNA, 25 bp, E. coli
caaaagatttttgtagacctgaaga

SEQ ID NO: 200178 - DNA, 25 bp, E. coli
cacgctttgctgttttgccgaggag

SEQ ID NO: 200179 - DNA, 25 bp, E. coli
caaaagatttttctagacctgaaga

SEQ ID NO: 200180 - DNA, 25 bp, E. coli
cacgctttgctgatttgccgaggag

SEQ ID NO: 200181 - DNA, 25 bp, E. coli
taaacttacacaaaggagttctctt

SEQ ID NO: 200182 - DNA, 25 bp, E. coli
taaacttacacataggagttctctt

SEQ ID NO: 200183 - DNA, 25 bp, E. coli
aaagattgtatgaatatttgcacgc

SEQ ID NO: 200184 - DNA, 25 bp, E. coli
aaagattgtatgtatatttgcacgc

SEQ ID NO: 200185 - DNA, 25 bp, E. coli
tattgcaagtacagtttttcacgct

SEQ ID NO: 200186 - DNA, 25 bp, E. coli
tattgcaagtactgtttttcacgct

SEQ ID NO: 200187 - DNA, 25 bp, E. coli
tgtgaatagcaacaaaacgacatct

SEQ ID NO: 200188 - DNA, 25 bp, E. coli
tgtgaatagcaagaaaacgacatct

SEQ ID NO: 200189 - DNA, 25 bp, E. coli
tgccgaggaggtaaaagatgattat

SEQ ID NO: 200190 - DNA, 25 bp, E. coli
tgccgaggaggttaaagatgattat

SEQ ID NO: 200191 - DNA, 25 bp, E. coli
cgacatctttacctattgagttaga

SEQ ID NO: 200192 - DNA, 25 bp, E. coli
cgacatctttacgtattgagttaga

SEQ ID NO: 200193 - DNA, 25 bp, E. coli
ctcccgaaggagttgattatatgaa

SEQ ID NO: 200194 - DNA, 25 bp, E. coli
ctcccgaaggagatgattatatgaa

SEQ ID NO: 200195 - DNA, 25 bp, E. coli
gacctgaagaagaagtatcaagttc

SEQ ID NO: 200196 - DNA, 25 bp, E. coli
gatgattattctcattacaggacct

SEQ ID NO: 200197 - DNA, 25 bp, E. coli
gatgattattctgattacaggacct

SEQ ID NO: 200198 - DNA, 25 bp, E. coli
gacctgaagaagtagtatcaagttc

SEQ ID NO: 200199 - DNA, 25 bp, E. coli
catatttcaatgattagtagtcctt

SEQ ID NO: 200200 - DNA, 25 bp, E. coli
catatttcaatgtttagtagtcctt

SEQ ID NO: 200201 - DNA, 25 bp, E. coli
taaataacagttactaatcattctc

SEQ ID NO: 200202 - DNA, 25 bp, E. coli
taaataacagtttctaatcattctc

SEQ ID NO: 200203 - DNA, 25 bp, E. coli
gattagtagtccataaataacagtt

SEQ ID NO: 200204 - DNA, 25 bp, E. coli
cactgtaaattaagaattaatcctc

SEQ ID NO: 200205 - DNA, 25 bp, E. coli
cactgtaaattatgaattaatcctc

SEQ ID NO: 200206 - DNA, 25 bp, E. coli
gattagtagtccttaaataacagtt

SEQ ID NO: 200207 - DNA, 25 bp, E. coli
cacaaaaatgaaagagtacaattga

SEQ ID NO: 200208 - DNA, 25 bp, E. coli
acattcgtctttaatgcactgtaaa

SEQ ID NO: 200209 - DNA, 25 bp, E. coli
acattcgtcttttatgcactgtaaa

SEQ ID NO: 200210 - DNA, 25 bp, E. coli
cacaaaaatgaatgagtacaattga

SEQ ID NO: 200211 - DNA, 25 bp, E. coli
taccttatcgcgtaatcccattcag

SEQ ID NO: 200212 - DNA, 25 bp, E. coli
tagtgctttctaataccttatcgcg

SEQ ID NO: 200213 - DNA, 25 bp, E. coli
taccttatcgcgaaatcccattcag

SEQ ID NO: 200214 - DNA, 25 bp, E. coli
tagtgctttctattaccttatcgcg

SEQ ID NO: 200215 - DNA, 25 bp, E. coli
gcgtaatcccatacagaaaaccatc

SEQ ID NO: 200216 - DNA, 25 bp, E. coli
gcgtaatcccattcagaaaaccatc

SEQ ID NO: 200217 - DNA, 25 bp, E. coli
gaattaatcctcaaatttatagtgc

SEQ ID NO: 200218 - DNA, 25 bp, E. coli
gaattaatcctctaatttatagtgc

SEQ ID NO: 200219 - DNA, 25 bp, E. coli
gaaaaccatcactaaaatgaatgag

SEQ ID NO: 200220 - DNA, 25 bp, E. coli
gaaaaccatcacaaaaatgaatgag

SEQ ID NO: 200221 - DNA, 25 bp, E. coli
cattcttcccgcaaaagttgccgta

SEQ ID NO: 200222 - DNA, 25 bp, E. coli
cattcttcccgctaaagttgccgta

SEQ ID NO: 200223 - DNA, 25 bp, E. coli
taccaaatgtcctgaaaagagctaa

SEQ ID NO: 200224 - DNA, 25 bp, E. coli
taccaaatgtccagaaaagagctaa

SEQ ID NO: 200225 - DNA, 25 bp, E. coli
taccacgacgtataacgaaacgcgt

SEQ ID NO: 200226 - DNA, 25 bp, E. coli
ataaacggaacggacaagccttcgg

SEQ ID NO: 200227 - DNA, 25 bp, E. coli
ataaacggaacgcacaagccttcgg

SEQ ID NO: 200228 - DNA, 25 bp, E. coli
aaaaaatgtcttctgcctgtggcaa

SEQ ID NO: 200229 - DNA, 25 bp, E. coli
aaaaaatgtcttgtgcctgtggcaa

SEQ ID NO: 200230 - DNA, 25 bp, E. coli
taccacgacgtaaaacgaaacgcgt

SEQ ID NO: 200231 - DNA, 25 bp, E. coli
tttagccgttgtaattaccacgacg

SEQ ID NO: 200232 - DNA, 25 bp, E. coli
tttagccgttgttattaccacgacg

SEQ ID NO: 200233 - DNA, 25 bp, E. coli
ttatcggccacatcgtcgggtctgg

SEQ ID NO: 200234 - DNA, 25 bp, E. coli
ttatcggccacaacgtcgggtctgg

SEQ ID NO: 200235 - DNA, 25 bp, E. coli
gggtctggcagcaattccggaacga

SEQ ID NO: 200236 - DNA, 25 bp, E. coli
gggtctggcagctattccggaacga

SEQ ID NO: 200237 - DNA, 25 bp, E. coli
tggcaggatgcctgtcaaatgctga

SEQ ID NO: 200238 - DNA, 25 bp, E. coli
tgccagtttacgacaggtttagccg

SEQ ID NO: 200239 - DNA, 25 bp, E. coli
tgccagtttacgtcaggtttagccg

SEQ ID NO: 200240 - DNA, 25 bp, E. coli
tggcaggatgccagtcaaatgctga

SEQ ID NO: 200241 - DNA, 25 bp, E. coli
taaggaaggcacgaaagtgtatacc

SEQ ID NO: 200242 - DNA, 25 bp, E. coli
taaggaaggcaccaaagtgtatacc

SEQ ID NO: 200243 - DNA, 25 bp, E. coli
gggtcgctaacgcaattactgaaga

SEQ ID NO: 200244 - DNA, 25 bp, E. coli
gggtcgctaacggaattactgaaga

SEQ ID NO: 200245 - DNA, 25 bp, E. coli
aaaattcagaaagtgatccctgcgg

SEQ ID NO: 200246 - DNA, 25 bp, E. coli
aatgcgcaaagggaaaaaattcaga

SEQ ID NO: 200247 - DNA, 25 bp, E. coli
aatgcgcaaaggcaaaaaattcaga

SEQ ID NO: 200248 - DNA, 25 bp, E. coli
aaaattcagaaactgatccctgcgg

SEQ ID NO: 200249 - DNA, 25 bp, E. coli
tagcgattctgtcgtagtgcattga

SEQ ID NO: 200250 - DNA, 25 bp, E. coli
tagcgattctgtggtagtgcattga

SEQ ID NO: 200251 - DNA, 25 bp, E. coli
tgatccctgcggatctggcaattct

SEQ ID NO: 200252 - DNA, 25 bp, E. coli
tgatccctgcggttctggcaattct

SEQ ID NO: 200253 - DNA, 25 bp, E. coli
tccaggccgttttccgtaaagcaca

SEQ ID NO: 200254 - DNA, 25 bp, E. coli
tccaggccgtttaccgtaaagcaca

SEQ ID NO: 200255 - DNA, 25 bp, E. coli
gaaaggtgaaaccaatgcgcaaagg

SEQ ID NO: 200256 - DNA, 25 bp, E. coli
gaaaggtgaaacgaatgcgcaaagg

SEQ ID NO: 200257 - DNA, 25 bp, E. coli
cggcggcggttctcctagcgattct

SEQ ID NO: 200258 - DNA, 25 bp, E. coli
cggcggcggttcacctagcgattct

SEQ ID NO: 200259 - DNA, 25 bp, E. coli
ggatgcactgagaacggcaattgat

SEQ ID NO: 200260 - DNA, 25 bp, E. coli
ggatgcactgagtacggcaattgat

SEQ ID NO: 200261 - DNA, 25 bp, E. coli
ggttctggcaatacttcctcgcgag

SEQ ID NO: 200262 - DNA, 25 bp, E. coli
ggttctggcaattcttcctcgcgag

SEQ ID NO: 200263 - DNA, 25 bp, E. coli
tggcggcacaggttgcactgagtac

SEQ ID NO: 200264 - DNA, 25 bp, E. coli
tggcggcacaggatgcactgagtac

SEQ ID NO: 200265 - DNA, 25 bp, E. coli
cacaggaatatatccgtacccagtg

SEQ ID NO: 200266 - DNA, 25 bp, E. coli
cacaggaatataaccgtacccagtg

SEQ ID NO: 200267 - DNA, 25 bp, E. coli
acggctgatggcaatgcagaagcaa

SEQ ID NO: 200268 - DNA, 25 bp, E. coli
acggctgatggctatgcagaagcaa

SEQ ID NO: 200269 - DNA, 25 bp, E. coli
actggaaggagctcaggaatatatc

SEQ ID NO: 200270 - DNA, 25 bp, E. coli
actggaaggagcacaggaatatatc

SEQ ID NO: 200271 - DNA, 25 bp, E. coli
tatccgtacccagtgtataccgtga

SEQ ID NO: 200272 - DNA, 25 bp, E. coli
tatccgtacccactgtataccgtga

SEQ ID NO: 200273 - DNA, 25 bp, E. coli
tatatccgtaccgagtgtataccgt

SEQ ID NO: 200274 - DNA, 25 bp, E. coli
tatatccgtacccagtgtataccgt

SEQ ID NO: 200275 - DNA, 25 bp, E. coli
gaatatatccgttcccagtgtatac

SEQ ID NO: 200276 - DNA, 25 bp, E. coli
gcaactggaaggtgcacaggaatat

SEQ ID NO: 200277 - DNA, 25 bp, E. coli
gaaggagcacagcaatatatccgta

SEQ ID NO: 200278 - DNA, 25 bp, E. coli
gaaggagcacaggaatatatccgta

SEQ ID NO: 200279 - DNA, 25 bp, E. coli
gcaactggaaggagcacaggaatat

SEQ ID NO: 200280 - DNA, 25 bp, E. coli
gaagcaactggaaggagcacaggaa

SEQ ID NO: 200281 - DNA, 25 bp, E. coli
gaatatatccgtacccagtgtatac

SEQ ID NO: 200282 - DNA, 25 bp, E. coli
gaagcaactggatggagcacaggaa

SEQ ID NO: 200283 - DNA, 25 bp, E. coli
ctgatggcaatggagaagcaactgg

SEQ ID NO: 200284 - DNA, 25 bp, E. coli
ctgatggcaatgcagaagcaactgg

SEQ ID NO: 200285 - DNA, 25 bp, E. coli
gagcacaggaatttatccgtaccca

SEQ ID NO: 200286 - DNA, 25 bp, E. coli
gagcacaggaatatatccgtaccca

SEQ ID NO: 200287 - DNA, 25 bp, E. coli
aatgcttcattaacatccttcgtgg

SEQ ID NO: 200288 - DNA, 25 bp, E. coli
aatgcttcattatcatccttcgtgg

SEQ ID NO: 200289 - DNA, 25 bp, E. coli
caaagtcgattgatcatacaggcaa

SEQ ID NO: 200290 - DNA, 25 bp, E. coli
caaagtcgattgttcatacaggcaa

SEQ ID NO: 200291 - DNA, 25 bp, E. coli
catacaccgcagtgatgttacattg

SEQ ID NO: 200292 - DNA, 25 bp, E. coli
catacaccgcagagatgttacattg

SEQ ID NO: 200293 - DNA, 25 bp, E. coli
tacagctatagtatgttatgcactc

SEQ ID NO: 200294 - DNA, 25 bp, E. coli
tacagctatagtttgttatgcactc

SEQ ID NO: 200295 - DNA, 25 bp, E. coli
ttcgtccgaaactctacaaagtcga

SEQ ID NO: 200296 - DNA, 25 bp, E. coli
ttcgtccgaaacactacaaagtcga

SEQ ID NO: 200297 - DNA, 25 bp, E. coli
tccaggcataacctttactacaggg

SEQ ID NO: 200298 - DNA, 25 bp, E. coli
tccaggcataacgtttactacaggg

SEQ ID NO: 200299 - DNA, 25 bp, E. coli
ccttcgtggctgtgtagtggatgta

SEQ ID NO: 200300 - DNA, 25 bp, E. coli
ccttcgtggctgagtagtggatgta

SEQ ID NO: 200301 - DNA, 25 bp, E. coli
gaatattctgcggaccttcgtccga

SEQ ID NO: 200302 - DNA, 25 bp, E. coli
gaatattctgcgcaccttcgtccga

SEQ ID NO: 200303 - DNA, 25 bp, E. coli
gttatgcactcattctatccaggca

SEQ ID NO: 200304 - DNA, 25 bp, E. coli
gttatgcactcaatctatccaggca

SEQ ID NO: 200305 - DNA, 25 bp, E. coli
ggtgtattagtttttgccgcattaa

SEQ ID NO: 200306 - DNA, 25 bp, E. coli
ggtgtattagttattgccgcattaa

SEQ ID NO: 200307 - DNA, 25 bp, E. coli
taatactgcgaaaattctgcggacc

SEQ ID NO: 200308 - DNA, 25 bp, E. coli
taatactgcgaatattctgcggacc

SEQ ID NO: 200309 - DNA, 25 bp, E. coli
aaccgtggcttaggctgattttgca

SEQ ID NO: 200310 - DNA, 25 bp, E. coli
aaaacggtggtggtcttatgcaatc

SEQ ID NO: 200311 - DNA, 25 bp, E. coli
aaaacggtggtgctcttatgcaatc

SEQ ID NO: 200312 - DNA, 25 bp, E. coli
aaccgtggcttacgctgattttgca

SEQ ID NO: 200313 - DNA, 25 bp, E. coli
tttgcacgtctgcaaatgcgcgtcg

SEQ ID NO: 200314 - DNA, 25 bp, E. coli
tttgcacgtctggaaatgcgcgtcg

SEQ ID NO: 200315 - DNA, 25 bp, E. coli
tgttaacgccggagcggatgatgcc

SEQ ID NO: 200316 - DNA, 25 bp, E. coli
tggtgccgtacttcagcgaagaaga

SEQ ID NO: 200317 - DNA, 25 bp, E. coli
tggtgccgtactacagcgaagaaga

SEQ ID NO: 200318 - DNA, 25 bp, E. coli
tgttaacgccggtgcggatgatgcc

SEQ ID NO: 200319 - DNA, 25 bp, E. coli
tgcggaaaccgatgacggcagtgaa

SEQ ID NO: 200320 - DNA, 25 bp, E. coli
tcggaaagattgaggaagtgaaacg

SEQ ID NO: 200321 - DNA, 25 bp, E. coli
tcggaaagattgtggaagtgaaacg

SEQ ID NO: 200322 - DNA, 25 bp, E. coli
tgcggaaaccgaagacggcagtgaa

SEQ ID NO: 200323 - DNA, 25 bp, E. coli
gcaatctgcaaatagcgaaaatgcg

SEQ ID NO: 200324 - DNA, 25 bp, E. coli
gaagtgaaacgcgatgaaaacgccg

SEQ ID NO: 200325 - DNA, 25 bp, E. coli
gcaaaccgtgacgagcctggtgccg

SEQ ID NO: 200326 - DNA, 25 bp, E. coli
gcaatctgcaaaaagcgaaaatgcg

SEQ ID NO: 200327 - DNA, 25 bp, E. coli
gaagtgaaacgccatgaaaacgccg

SEQ ID NO: 200328 - DNA, 25 bp, E. coli
gcaaaccgtgaccagcctggtgccg

SEQ ID NO: 200329 - DNA, 25 bp, E. coli
gaaaacgccgacaagctgtacatcg

SEQ ID NO: 200330 - DNA, 25 bp, E. coli
gaaaacgccgactagctgtacatcg

SEQ ID NO: 200331 - DNA, 25 bp, E. coli
aagttaataagaccctgacgccggg

SEQ ID NO: 200332 - DNA, 25 bp, E. coli
aagttaataagagcctgacgccggg

SEQ ID NO: 200333 - DNA, 25 bp, E. coli
taaaagatacgcagcgcgaagtgcg

SEQ ID NO: 200334 - DNA, 25 bp, E. coli
taaaagatacgctgcgcgaagtgcg

SEQ ID NO: 200335 - DNA, 25 bp, E. coli
tattctcggcatgggcgacgtactg

SEQ ID NO: 200336 - DNA, 25 bp, E. coli
tattctcggcatcggcgacgtactg

SEQ ID NO: 200337 - DNA, 25 bp, E. coli
ttgaccaaagtggacggcgatgccc

SEQ ID NO: 200338 - DNA, 25 bp, E. coli
ttgaccaaagtgcacggcgatgccc

SEQ ID NO: 200339 - DNA, 25 bp, E. coli
tgcaaggtgccggtaaaacaaccag

SEQ ID NO: 200340 - DNA, 25 bp, E. coli
tgcaaggtgccgctaaaacaaccag

SEQ ID NO: 200341 - DNA, 25 bp, E. coli
tcgatgacgatgaaagagcgcgcta

SEQ ID NO: 200342 - DNA, 25 bp, E. coli
tgcgcaatatcagtggccgtggacg

SEQ ID NO: 200343 - DNA, 25 bp, E. coli
tgcgcaatatcactggccgtggacg

SEQ ID NO: 200344 - DNA, 25 bp, E. coli
tcgatgacgatgtaagagcgcgcta

SEQ ID NO: 200345 - DNA, 25 bp, E. coli
tcggtaagttcctgcgcgagaagca

SEQ ID NO: 200346 - DNA, 25 bp, E. coli
tcggtaagttccagcgcgagaagca

SEQ ID NO: 200347 - DNA, 25 bp, E. coli
gaaacagttcgacgacatgcagcgc

SEQ ID NO: 200348 - DNA, 25 bp, E. coli
gaaacagttcgaggacatgcagcgc

SEQ ID NO: 200349 - DNA, 25 bp, E. coli
taaccgatcgtttgtcgcgcacgct

SEQ ID NO: 200350 - DNA, 25 bp, E. coli
taaccgatcgttagtcgcgcacgct

SEQ ID NO: 200351 - DNA, 25 bp, E. coli
gatcccggataaggtcaagtcacag

SEQ ID NO: 200352 - DNA, 25 bp, E. coli
gatcccggataacgtcaagtcacag

SEQ ID NO: 200353 - DNA, 25 bp, E. coli
aagcgtcgcccggagtatgacgagc

SEQ ID NO: 200354 - DNA, 25 bp, E. coli
aagcgtcgcccgcagtatgacgagc

SEQ ID NO: 200355 - DNA, 25 bp, E. coli
caaaaagttaaagcggcgagtgctg

SEQ ID NO: 200356 - DNA, 25 bp, E. coli
caaaaagttaaaccggcgagtgctg

SEQ ID NO: 200357 - DNA, 25 bp, E. coli
taaaccggcgagagctggaaaaact

SEQ ID NO: 200358 - DNA, 25 bp, E. coli
taaaccggcgagtgctggaaaaact

SEQ ID NO: 200359 - DNA, 25 bp, E. coli
tgacggctttacactcgacgatccc

SEQ ID NO: 200360 - DNA, 25 bp, E. coli
tgacggctttactctcgacgatccc

SEQ ID NO: 200361 - DNA, 25 bp, E. coli
cgttgcgttttatgaagagcacttc

SEQ ID NO: 200362 - DNA, 25 bp, E. coli
cgttgcgttttaagaagagcacttc

SEQ ID NO: 200363 - DNA, 25 bp, E. coli
ccgtggttccggtgcagggtcactg

SEQ ID NO: 200364 - DNA, 25 bp, E. coli
ccgtggttccggagcagggtcactg

SEQ ID NO: 200365 - DNA, 25 bp, E. coli
gatcgcactggtcgcgctattccgt

SEQ ID NO: 200366 - DNA, 25 bp, E. coli
gtatgacgagcgtctggatactgaa

SEQ ID NO: 200367 - DNA, 25 bp, E. coli
gtatgacgagcgactggatactgaa

SEQ ID NO: 200368 - DNA, 25 bp, E. coli
ggcgctattccgacccggtccgttg

SEQ ID NO: 200369 - DNA, 25 bp, E. coli
ggcgctattccgtcccggtccgttg

SEQ ID NO: 200370 - DNA, 25 bp, E. coli
gatcgcactggtggcgctattccgt

SEQ ID NO: 200371 - DNA, 25 bp, E. coli
gatccgcgacgttggtcgtgtactg

SEQ ID NO: 200372 - DNA, 25 bp, E. coli
gagtgcgttgcgttttatgaagagc

SEQ ID NO: 200373 - DNA, 25 bp, E. coli
gagtgcgttgcgatttatgaagagc

SEQ ID NO: 200374 - DNA, 25 bp, E. coli
gatccgcgacgtaggtcgtgtactg

SEQ ID NO: 200375 - DNA, 25 bp, E. coli
cagataaattcccacaatattaaaa

SEQ ID NO: 200376 - DNA, 25 bp, E. coli
cagataaattccgacaatattaaaa

SEQ ID NO: 200377 - DNA, 25 bp, E. coli
tacggcccggtagttaatcagataa

SEQ ID NO: 200378 - DNA, 25 bp, E. coli
taccagtaattcaccttatatctca

SEQ ID NO: 200379 - DNA, 25 bp, E. coli
tacggcccggtacttaatcagataa

SEQ ID NO: 200380 - DNA, 25 bp, E. coli
taccagtaattctccttatatctca

SEQ ID NO: 200381 - DNA, 25 bp, E. coli
accttatatctcttttcgacttcga

SEQ ID NO: 200382 - DNA, 25 bp, E. coli
accttatatctcatttcgacttcga

SEQ ID NO: 200383 - DNA, 25 bp, E. coli
aatcaccattctattttaaaaacag

SEQ ID NO: 200384 - DNA, 25 bp, E. coli
aatcaccattcttttttaaaaacag

SEQ ID NO: 200385 - DNA, 25 bp, E. coli
ttaacgataatttaaaggattctgt

SEQ ID NO: 200386 - DNA, 25 bp, E. coli
ttaacgataattaaaaggattctgt

SEQ ID NO: 200387 - DNA, 25 bp, E. coli
tcatttataaatgacgccgtttaaa

SEQ ID NO: 200388 - DNA, 25 bp, E. coli
tcatttataaatcacgccgtttaaa

SEQ ID NO: 200389 - DNA, 25 bp, E. coli
tcgacttcgatctcatatcgataaa

SEQ ID NO: 200390 - DNA, 25 bp, E. coli
tcgacttcgatcacatatcgataaa

SEQ ID NO: 200391 - DNA, 25 bp, E. coli
tctcattgtttttaatcaccattct

SEQ ID NO: 200392 - DNA, 25 bp, E. coli
tctcattgttttaaatcaccattct

SEQ ID NO: 200393 - DNA, 25 bp, E. coli
ggtagttaatcagataaattccgac

SEQ ID NO: 200394 - DNA, 25 bp, E. coli
ggtagttaatcacataaattccgac

SEQ ID NO: 200395 - DNA, 25 bp, E. coli
taaatttcaaattccagtaattcac

SEQ ID NO: 200396 - DNA, 25 bp, E. coli
taaatttcaaataccagtaattcac

SEQ ID NO: 200397 - DNA, 25 bp, E. coli
accgctggtcttaggtgagaagtgg

SEQ ID NO: 200398 - DNA, 25 bp, E. coli
accgctggtctttggtgagaagtgg

SEQ ID NO: 200399 - DNA, 25 bp, E. coli
taccgctggtctttggtgagaagtg

SEQ ID NO: 200400 - DNA, 25 bp, E. coli
taccgctggtctatggtgagaagtg

SEQ ID NO: 200401 - DNA, 25 bp, E. coli
tttgtaccgctgctctttggtgaga

SEQ ID NO: 200402 - DNA, 25 bp, E. coli
tttgtaccgctggtctttggtgaga

SEQ ID NO: 200403 - DNA, 25 bp, E. coli
ttgtaccgctggactttggtgagaa

SEQ ID NO: 200404 - DNA, 25 bp, E. coli
ttgtaccgctggtctttggtgagaa

SEQ ID NO: 200405 - DNA, 25 bp, E. coli
tctttggtgagatgtggaacagcat

SEQ ID NO: 200406 - DNA, 25 bp, E. coli
tctttggtgagaagtggaacagcat

SEQ ID NO: 200407 - DNA, 25 bp, E. coli
ccgctggtctttggtgagaagtgga

SEQ ID NO: 200408 - DNA, 25 bp, E. coli
ccgctggtctttcgtgagaagtgga

SEQ ID NO: 200409 - DNA, 25 bp, E. coli
ctttggtgagaagtggaacagcatt

SEQ ID NO: 200410 - DNA, 25 bp, E. coli
ctggtctttggtgagaagtggaaca

SEQ ID NO: 200411 - DNA, 25 bp, E. coli
ctttgtaccgctggtctttggtgag

SEQ ID NO: 200412 - DNA, 25 bp, E. coli
ctttggtgagaactggaacagcatt

SEQ ID NO: 200413 - DNA, 25 bp, E. coli
ctttgtaccgctcgtctttggtgag

SEQ ID NO: 200414 - DNA, 25 bp, E. coli
ctggtctttggtcagaagtggaaca

SEQ ID NO: 200415 - DNA, 25 bp, E. coli
gtaccgctggtcattggtgagaagt

SEQ ID NO: 200416 - DNA, 25 bp, E. coli
gtaccgctggtctttggtgagaagt

SEQ ID NO: 200417 - DNA, 25 bp, E. coli
gtctttggtgagtagtggaacagca

SEQ ID NO: 200418 - DNA, 25 bp, E. coli
gtctttggtgagaagtggaacagca

SEQ ID NO: 200419 - DNA, 25 bp, E. coli
aataccatgagctttccggacgcgc

SEQ ID NO: 200420 - DNA, 25 bp, E. coli
aataccatgagcattccggacgcgc

SEQ ID NO: 200421 - DNA, 25 bp, E. coli
caaagctgctggctattcctggaaa

SEQ ID NO: 200422 - DNA, 25 bp, E. coli
caaagctgctgggtattcctggaaa

SEQ ID NO: 200423 - DNA, 25 bp, E. coli
aacgaagcggcaatccgtcaggaag

SEQ ID NO: 200424 - DNA, 25 bp, E. coli
aacgaagcggcattccgtcaggaag

SEQ ID NO: 200425 - DNA, 25 bp, E. coli
tacgcgctgcatcgatcaacgaagc

SEQ ID NO: 200426 - DNA, 25 bp, E. coli
tacgcgctgcatggatcaacgaagc

SEQ ID NO: 200427 - DNA, 25 bp, E. coli
tatcgtcgccgtgattacctggtgc

SEQ ID NO: 200428 - DNA, 25 bp, E. coli
tatcagctccgtcatgctggtgatg

SEQ ID NO: 200429 - DNA, 25 bp, E. coli
tatcagctccgtgatgctggtgatg

SEQ ID NO: 200430 - DNA, 25 bp, E. coli
tatcgtcgccgtcattacctggtgc

SEQ ID NO: 200431 - DNA, 25 bp, E. coli
ttcctggaaaggtttacgcgctgca

SEQ ID NO: 200432 - DNA, 25 bp, E. coli
ttcctggaaaggattacgcgctgca

SEQ ID NO: 200433 - DNA, 25 bp, E. coli
tgcatggatcaaggaagcggcattc

SEQ ID NO: 200434 - DNA, 25 bp, E. coli
tgcatggatcaacgaagcggcattc

SEQ ID NO: 200435 - DNA, 25 bp, E. coli
gattacccgcgtgctgcttatcagc

SEQ ID NO: 200436 - DNA, 25 bp, E. coli
gattacccgcgtcctgcttatcagc

SEQ ID NO: 200437 - DNA, 25 bp, E. coli
tggctggatgtggacgcgattaccc

SEQ ID NO: 200438 - DNA, 25 bp, E. coli
tggctggatgtgcacgcgattaccc

SEQ ID NO: 200439 - DNA, 25 bp, E. coli
gaccgaattggctctgaataccatg

SEQ ID NO: 200440 - DNA, 25 bp, E. coli
gaccgaattggcactgaataccatg

SEQ ID NO: 200441 - DNA, 25 bp, E. coli
actcgtatgacattgtattttatta

SEQ ID NO: 200442 - DNA, 25 bp, E. coli
atgtgttttccgcatgtatcgtggg

SEQ ID NO: 200443 - DNA, 25 bp, E. coli
actcgtatgacaatgtattttatta

SEQ ID NO: 200444 - DNA, 25 bp, E. coli
atgtgttttccggatgtatcgtggg

SEQ ID NO: 200445 - DNA, 25 bp, E. coli
agcaaaactgctggcatcaacaggg

SEQ ID NO: 200446 - DNA, 25 bp, E. coli
agcaaaactgctcgcatcaacaggg

SEQ ID NO: 200447 - DNA, 25 bp, E. coli
tgactcgtatgagaatgtattttat

SEQ ID NO: 200448 - DNA, 25 bp, E. coli
tgactcgtatgacaatgtattttat

SEQ ID NO: 200449 - DNA, 25 bp, E. coli
ccagttgttacgggaaggtatcagg

SEQ ID NO: 200450 - DNA, 25 bp, E. coli
ccagttgttacgcgaaggtatcagg

SEQ ID NO: 200451 - DNA, 25 bp, E. coli
gcgactaaaagaagcaaaactgctg

SEQ ID NO: 200452 - DNA, 25 bp, E. coli
gcgactaaaagatgcaaaactgctg

SEQ ID NO: 200453 - DNA, 25 bp, E. coli
gactcgtatgactatgtattttatt

SEQ ID NO: 200454 - DNA, 25 bp, E. coli
gactaaaagaagcaaaactgctggc

SEQ ID NO: 200455 - DNA, 25 bp, E. coli
gactaaaagaaggaaaactgctggc

SEQ ID NO: 200456 - DNA, 25 bp, E. coli
gactcgtatgacaatgtattttatt

SEQ ID NO: 200457 - DNA, 25 bp, E. coli
ctcgtatgacaaagtattttattag

SEQ ID NO: 200458 - DNA, 25 bp, E. coli
cattgatgtgttttccggatgtatc

SEQ ID NO: 200459 - DNA, 25 bp, E. coli
ctaaaagaagcaaaactgctggcat

SEQ ID NO: 200460 - DNA, 25 bp, E. coli
cattgatgtgttatccggatgtatc

SEQ ID NO: 200461 - DNA, 25 bp, E. coli
ctaaaagaagcataactgctggcat

SEQ ID NO: 200462 - DNA, 25 bp, E. coli
ctcgtatgacaatgtattttattag

SEQ ID NO: 200463 - DNA, 25 bp, E. coli
aatcagagaggagcgtcgtaaggcg

SEQ ID NO: 200464 - DNA, 25 bp, E. coli
aatcagagaggaccgtcgtaaggcg

SEQ ID NO: 200465 - DNA, 25 bp, E. coli
cagagaggaccgtcgtaaggcggcg

SEQ ID NO: 200466 - DNA, 25 bp, E. coli
cagagaggaccgacgtaaggcggcg

SEQ ID NO: 200467 - DNA, 25 bp, E. coli
atcagagaggacggtcgtaaggcgg

SEQ ID NO: 200468 - DNA, 25 bp, E. coli
agagaggaccgtcgtaaggcggcgc

SEQ ID NO: 200469 - DNA, 25 bp, E. coli
agagaggaccgtggtaaggcggcgc

SEQ ID NO: 200470 - DNA, 25 bp, E. coli
atcagagaggaccgtcgtaaggcgg

SEQ ID NO: 200471 - DNA, 25 bp, E. coli
actaacctgtatatcaaaatcagag

SEQ ID NO: 200472 - DNA, 25 bp, E. coli
aaatcagagaggtccgtcgtaaggc

SEQ ID NO: 200473 - DNA, 25 bp, E. coli
aaatcagagaggaccgtcgtaaggc

SEQ ID NO: 200474 - DNA, 25 bp, E. coli
actaacctgtatttcaaaatcagag

SEQ ID NO: 200475 - DNA, 25 bp, E. coli
tcagagaggaccgtcgtaaggcggc

SEQ ID NO: 200476 - DNA, 25 bp, E. coli
tcagagaggaccctcgtaaggcggc

SEQ ID NO: 200477 - DNA, 25 bp, E. coli
cctgctgacgtaactgactaacctg

SEQ ID NO: 200478 - DNA, 25 bp, E. coli
cctgctgacgtatctgactaacctg

SEQ ID NO: 200479 - DNA, 25 bp, E. coli
gactaacctgtaattcaaaatcaga

SEQ ID NO: 200480 - DNA, 25 bp, E. coli
gactaacctgtatttcaaaatcaga

SEQ ID NO: 200481 - DNA, 25 bp, E. coli
ctaacctgtatttcaaaatcagaga

SEQ ID NO: 200482 - DNA, 25 bp, E. coli
ctaacctgtattacaaaatcagaga

SEQ ID NO: 200483 - DNA, 25 bp, E. coli
gagaggaccgtcctaaggcggcgcg

SEQ ID NO: 200484 - DNA, 25 bp, E. coli
gagaggaccgtcgtaaggcggcgcg

SEQ ID NO: 200485 - DNA, 25 bp, E. coli
aattagtgacttatcctgcgagcgc

SEQ ID NO: 200486 - DNA, 25 bp, E. coli
caaggtgcgtcaaggtaccgcatta

SEQ ID NO: 200487 - DNA, 25 bp, E. coli
caaggtgcgtcatggtaccgcatta

SEQ ID NO: 200488 - DNA, 25 bp, E. coli
aattagtgacttttcctgcgagcgc

SEQ ID NO: 200489 - DNA, 25 bp, E. coli
taaaggccgatgtacaaggtgcgtc

SEQ ID NO: 200490 - DNA, 25 bp, E. coli
taaaggccgatgaacaaggtgcgtc

SEQ ID NO: 200491 - DNA, 25 bp, E. coli
tattaccatgtacgaagaccagcag

SEQ ID NO: 200492 - DNA, 25 bp, E. coli
tattaccatgtaggaagaccagcag

SEQ ID NO: 200493 - DNA, 25 bp, E. coli
gccacggcacagactgcagaattcg

SEQ ID NO: 200494 - DNA, 25 bp, E. coli
gccacggcacagtctgcagaattcg

SEQ ID NO: 200495 - DNA, 25 bp, E. coli
gctgacgatgaaacaattacttgcc

SEQ ID NO: 200496 - DNA, 25 bp, E. coli
gctgacgatgaatcaattacttgcc

SEQ ID NO: 200497 - DNA, 25 bp, E. coli
gaattcgccagtgctgactgcgtga

SEQ ID NO: 200498 - DNA, 25 bp, E. coli
gaattcgccagtcctgactgcgtga

SEQ ID NO: 200499 - DNA, 25 bp, E. coli
cgtgacgggcctgaatgaaataggt

SEQ ID NO: 200500 - DNA, 25 bp, E. coli
cgtgacgggcctcaatgaaataggt

SEQ ID NO: 200501 - DNA, 25 bp, E. coli
gatccgcaggacctggaacgtatcg

SEQ ID NO: 200502 - DNA, 25 bp, E. coli
taactggcgcgtacaggcgatactg

SEQ ID NO: 200503 - DNA, 25 bp, E. coli
taactggcgcgttcaggcgatactg

SEQ ID NO: 200504 - DNA, 25 bp, E. coli
gatctcagttaggaatatttcaggg

SEQ ID NO: 200505 - DNA, 25 bp, E. coli
gatctcagttagcaatatttcaggg

SEQ ID NO: 200506 - DNA, 25 bp, E. coli
gatccgcaggacgtggaacgtatcg

SEQ ID NO: 200507 - DNA, 25 bp, E. coli
caaggcgcgttgctcatgctgatgt

SEQ ID NO: 200508 - DNA, 25 bp, E. coli
caaggcgcgttggtcatgctgatgt

SEQ ID NO: 200509 - DNA, 25 bp, E. coli
tacgtgattattcgctggcttccgg

SEQ ID NO: 200510 - DNA, 25 bp, E. coli
tacgtgattattggctggcttccgg

SEQ ID NO: 200511 - DNA, 25 bp, E. coli
tacttattatttggcggtacagcgg

SEQ ID NO: 200512 - DNA, 25 bp, E. coli
tacttattatttcgcggtacagcgg

SEQ ID NO: 200513 - DNA, 25 bp, E. coli
taccggcgcatattccctgacaatg

SEQ ID NO: 200514 - DNA, 25 bp, E. coli
taccggcgcataatccctgacaatg

SEQ ID NO: 200515 - DNA, 25 bp, E. coli
tttgaacggttttggctggcaaggc

SEQ ID NO: 200516 - DNA, 25 bp, E. coli
tttgaacggtttaggctggcaaggc

SEQ ID NO: 200517 - DNA, 25 bp, E. coli
tcttgggatcaactcactggtctat

SEQ ID NO: 200518 - DNA, 25 bp, E. coli
tcttgggatcaagtcactggtctat

SEQ ID NO: 200519 - DNA, 25 bp, E. coli
gccgggagagacaaagaaattcgct

SEQ ID NO: 200520 - DNA, 25 bp, E. coli
gccgggagagactaagaaattcgct

SEQ ID NO: 200521 - DNA, 25 bp, E. coli
gcaaaccggctttttgaccaccctg

SEQ ID NO: 200522 - DNA, 25 bp, E. coli
gcaaaccggcttattgaccaccctg

SEQ ID NO: 200523 - DNA, 25 bp, E. coli
ctatagcgaagctcaggcgggttca

SEQ ID NO: 200524 - DNA, 25 bp, E. coli
ctatagcgaagcacaggcgggttca

SEQ ID NO: 200525 - DNA, 25 bp, E. coli
ggttccggcgcatcaatgatactgg

SEQ ID NO: 200526 - DNA, 25 bp, E. coli
ggttccggcgcaacaatgatactgg

SEQ ID NO: 200527 - DNA, 25 bp, E. coli
ggccgccgctgaagggtaaaataca

SEQ ID NO: 200528 - DNA, 25 bp, E. coli
ggccgccgctgatgggtaaaataca

SEQ ID NO: 200529 - DNA, 25 bp, E. coli
catttcatgagcttctccagttact

SEQ ID NO: 200530 - DNA, 25 bp, E. coli
catttcatgagcatctccagttact

SEQ ID NO: 200531 - DNA, 25 bp, E. coli
atttcatgagcaactccagttactg

SEQ ID NO: 200532 - DNA, 25 bp, E. coli
atttcatgagcatctccagttactg

SEQ ID NO: 200533 - DNA, 25 bp, E. coli
tttcatgagcatctccagttactga

SEQ ID NO: 200534 - DNA, 25 bp, E. coli
tttgcgccatttcatgagcatctcc

SEQ ID NO: 200535 - DNA, 25 bp, E. coli
tttgcgccatttgatgagcatctcc

SEQ ID NO: 200536 - DNA, 25 bp, E. coli
ttgcgccatttcatgagcatctcca

SEQ ID NO: 200537 - DNA, 25 bp, E. coli
tttcatgagcatgtccagttactga

SEQ ID NO: 200538 - DNA, 25 bp, E. coli
ttgcgccatttcttgagcatctcca

SEQ ID NO: 200539 - DNA, 25 bp, E. coli
tgcgccatttcatgagcatctccag

SEQ ID NO: 200540 - DNA, 25 bp, E. coli
tgcgccatttcaagagcatctccag

SEQ ID NO: 200541 - DNA, 25 bp, E. coli
gccatttcatgaccatctccagtta

SEQ ID NO: 200542 - DNA, 25 bp, E. coli
ccatttcatgagcatctccagttac

SEQ ID NO: 200543 - DNA, 25 bp, E. coli
ccatttcatgaggatctccagttac

SEQ ID NO: 200544 - DNA, 25 bp, E. coli
gccatttcatgagcatctccagtta

SEQ ID NO: 200545 - DNA, 25 bp, E. coli
gcgccatttcatgagcatctccagt

SEQ ID NO: 200546 - DNA, 25 bp, E. coli
gcgccatttcatcagcatctccagt

SEQ ID NO: 200547 - DNA, 25 bp, E. coli
cgccatttcatgtgcatctccagtt

SEQ ID NO: 200548 - DNA, 25 bp, E. coli
cgccatttcatgagcatctccagtt

SEQ ID NO: 200549 - DNA, 25 bp, E. coli
cagcgccattgaaacgcaatctggt

SEQ ID NO: 200550 - DNA, 25 bp, E. coli
cactgtgacgagtttgatgatgagc

SEQ ID NO: 200551 - DNA, 25 bp, E. coli
cactgtgacgagattgatgatgagc

SEQ ID NO: 200552 - DNA, 25 bp, E. coli
cagcgccattgatacgcaatctggt

SEQ ID NO: 200553 - DNA, 25 bp, E. coli
catcgatgttcactgtgacgagatt

SEQ ID NO: 200554 - DNA, 25 bp, E. coli
catcgatgttcagtgtgacgagatt

SEQ ID NO: 200555 - DNA, 25 bp, E. coli
atctggtgtgatccccgtaactgaa

SEQ ID NO: 200556 - DNA, 25 bp, E. coli
atctggtgtgatgcccgtaactgaa

SEQ ID NO: 200557 - DNA, 25 bp, E. coli
tatacttcgcgcctgtttcgtttgc

SEQ ID NO: 200558 - DNA, 25 bp, E. coli
tacccatgtcgatgtctccgacgca

SEQ ID NO: 200559 - DNA, 25 bp, E. coli
tacccatgtcgaagtctccgacgca

SEQ ID NO: 200560 - DNA, 25 bp, E. coli
tatacttcgcgcgtgtttcgtttgc

SEQ ID NO: 200561 - DNA, 25 bp, E. coli
ttgaaagcgatgctggaagtgaaac

SEQ ID NO: 200562 - DNA, 25 bp, E. coli
ttgaaagcgatggtggaagtgaaac

SEQ ID NO: 200563 - DNA, 25 bp, E. coli
tgtctccgacgcaacgctgactgcg

SEQ ID NO: 200564 - DNA, 25 bp, E. coli
tgtctccgacgctacgctgactgcg

SEQ ID NO: 200565 - DNA, 25 bp, E. coli
gctgactgcgttcaaagcgatgctg

SEQ ID NO: 200566 - DNA, 25 bp, E. coli
gctgactgcgttgaaagcgatgctg

SEQ ID NO: 200567 - DNA, 25 bp, E. coli
gatacgcaatctcgtgtgatgcccg

SEQ ID NO: 200568 - DNA, 25 bp, E. coli
gatacgcaatctggtgtgatgcccg

SEQ ID NO: 200569 - DNA, 25 bp, E. coli
gatgagcaatcacgctttgtcgaaa

SEQ ID NO: 200570 - DNA, 25 bp, E. coli
gatgagcaatcaggctttgtcgaaa

SEQ ID NO: 200571 - DNA, 25 bp, E. coli
catttccgtcaattttggcggcggc

SEQ ID NO: 200572 - DNA, 25 bp, E. coli
catttccgtcaaatttggcggcggc

SEQ ID NO: 200573 - DNA, 25 bp, E. coli
tacgatgagtacatgacggcggcga

SEQ ID NO: 200574 - DNA, 25 bp, E. coli
attctggaaatcaccccggaacgcg

SEQ ID NO: 200575 - DNA, 25 bp, E. coli
attctggaaatctccccggaacgcg

SEQ ID NO: 200576 - DNA, 25 bp, E. coli
tacgatgagtacttgacggcggcga

SEQ ID NO: 200577 - DNA, 25 bp, E. coli
tgaccgtgttcgtatggatgagcca

SEQ ID NO: 200578 - DNA, 25 bp, E. coli
tgaccgtgttcgaatggatgagcca

SEQ ID NO: 200579 - DNA, 25 bp, E. coli
cctttatgaagatcctcggcggcga

SEQ ID NO: 200580 - DNA, 25 bp, E. coli
cctttatgaagaacctcggcggcga

SEQ ID NO: 200581 - DNA, 25 bp, E. coli
gacaccattcgcaggctggaacagg

SEQ ID NO: 200582 - DNA, 25 bp, E. coli
gaaaacgctggtcggcgatctgcaa

SEQ ID NO: 200583 - DNA, 25 bp, E. coli
gacaccattcgctggctggaacagg

SEQ ID NO: 200584 - DNA, 25 bp, E. coli
gaaaacgctggtgggcgatctgcaa

SEQ ID NO: 200585 - DNA, 25 bp, E. coli
cgcgcgcgcgccagattgataaaat

SEQ ID NO: 200586 - DNA, 25 bp, E. coli
cgcgcgcgcgcctgattgataaaat

SEQ ID NO: 200587 - DNA, 25 bp, E. coli
cattctgatcatcgacgaaccgacc

SEQ ID NO: 200588 - DNA, 25 bp, E. coli
cattctgatcatggacgaaccgacc

SEQ ID NO: 200589 - DNA, 25 bp, E. coli
tacggcgaaatggacggttactctg

SEQ ID NO: 200590 - DNA, 25 bp, E. coli
taacgtcaccatccagttcggcagt

SEQ ID NO: 200591 - DNA, 25 bp, E. coli
tacggcgaaatgcacggttactctg

SEQ ID NO: 200592 - DNA, 25 bp, E. coli
taacgtcaccatgcagttcggcagt

SEQ ID NO: 200593 - DNA, 25 bp, E. coli
agcgatgccattcacgcggtgtata

SEQ ID NO: 200594 - DNA, 25 bp, E. coli
agcgatgccattgacgcggtgtata

SEQ ID NO: 200595 - DNA, 25 bp, E. coli
aaagcgatgccaatgacgcggtgta

SEQ ID NO: 200596 - DNA, 25 bp, E. coli
aactggatcactcgccagttcgtcg

SEQ ID NO: 200597 - DNA, 25 bp, E. coli
aaagcgatgccattgacgcggtgta

SEQ ID NO: 200598 - DNA, 25 bp, E. coli
aactggatcactggccagttcgtcg

SEQ ID NO: 200599 - DNA, 25 bp, E. coli
tcgaggccgcccatgagagcggtaa

SEQ ID NO: 200600 - DNA, 25 bp, E. coli
tcgaggccgcccttgagagcggtaa

SEQ ID NO: 200601 - DNA, 25 bp, E. coli
ccatgagagcggtaaatacaagtta

SEQ ID NO: 200602 - DNA, 25 bp, E. coli
ccatgagagcggaaaatacaagtta

SEQ ID NO: 200603 - DNA, 25 bp, E. coli
gaaagcgatgccattgacgcggtgt

SEQ ID NO: 200604 - DNA, 25 bp, E. coli
gaaagcgatgcctttgacgcggtgt

SEQ ID NO: 200605 - DNA, 25 bp, E. coli
cccatgagagcgctaaatacaagtt

SEQ ID NO: 200606 - DNA, 25 bp, E. coli
cgatgccattgaggcggtgtatatt

SEQ ID NO: 200607 - DNA, 25 bp, E. coli
ccgcccatgagaccggtaaatacaa

SEQ ID NO: 200608 - DNA, 25 bp, E. coli
cgatgccattgacgcggtgtatatt

SEQ ID NO: 200609 - DNA, 25 bp, E. coli
ccgcccatgagagcggtaaatacaa

SEQ ID NO: 200610 - DNA, 25 bp, E. coli
cgaggccgcccaagagagcggtaaa

SEQ ID NO: 200611 - DNA, 25 bp, E. coli
cgaggccgcccatgagagcggtaaa

SEQ ID NO: 200612 - DNA, 25 bp, E. coli
cccatgagagcggtaaatacaagtt

SEQ ID NO: 200613 - DNA, 25 bp, E. coli
ggccgcccatgacagcggtaaatac

SEQ ID NO: 200614 - DNA, 25 bp, E. coli
ggccgcccatgagagcggtaaatac

SEQ ID NO: 200615 - DNA, 25 bp, E. coli
caaacaggcgaacctgaagatagcc

SEQ ID NO: 200616 - DNA, 25 bp, E. coli
caaacaggcgaagctgaagatagcc

SEQ ID NO: 200617 - DNA, 25 bp, E. coli
tgacatggcacatacaggcgaagct

SEQ ID NO: 200618 - DNA, 25 bp, E. coli
tgacatggcacaaacaggcgaagct

SEQ ID NO: 200619 - DNA, 25 bp, E. coli
tctgacgacgggaaaccggagcaaa

SEQ ID NO: 200620 - DNA, 25 bp, E. coli
tctgacgacgggtaaccggagcaaa

SEQ ID NO: 200621 - DNA, 25 bp, E. coli
ccggagcaaatcagtgaaagcgaca

SEQ ID NO: 200622 - DNA, 25 bp, E. coli
ccagtgctgtgtcgatggataagct

SEQ ID NO: 200623 - DNA, 25 bp, E. coli
ccggagcaaatctgtgaaagcgaca

SEQ ID NO: 200624 - DNA, 25 bp, E. coli
ccagtgctgtgtggatggataagct

SEQ ID NO: 200625 - DNA, 25 bp, E. coli
gaagatagccctcacgagcgtgaac

SEQ ID NO: 200626 - DNA, 25 bp, E. coli
gaagatagccctgacgagcgtgaac

SEQ ID NO: 200627 - DNA, 25 bp, E. coli
gaagttcctcgggtacagtgtgaca

SEQ ID NO: 200628 - DNA, 25 bp, E. coli
gaagttcctcggctacagtgtgaca

SEQ ID NO: 200629 - DNA, 25 bp, E. coli
gaacaggctgaaggagaaagtccac

SEQ ID NO: 200630 - DNA, 25 bp, E. coli
gacaatcaatgctctgacaccagtg

SEQ ID NO: 200631 - DNA, 25 bp, E. coli
gacaatcaatgcactgacaccagtg

SEQ ID NO: 200632 - DNA, 25 bp, E. coli
gaacaggctgaacgagaaagtccac

SEQ ID NO: 200633 - DNA, 25 bp, E. coli
ggataagctacttcaggctgacgga

SEQ ID NO: 200634 - DNA, 25 bp, E. coli
ggataagctactacaggctgacgga

SEQ ID NO: 200635 - DNA, 25 bp, E. coli
gatggctggatctaacggaaactgc

SEQ ID NO: 200636 - DNA, 25 bp, E. coli
gatggctggatcaaacggaaactgc

SEQ ID NO: 200637 - DNA, 25 bp, E. coli
cactgttaataggttccggtcgtca

SEQ ID NO: 200638 - DNA, 25 bp, E. coli
cactgttaatagcttccggtcgtca

SEQ ID NO: 200639 - DNA, 25 bp, E. coli
tactgatgatcgcaaaaatgtgcct

SEQ ID NO: 200640 - DNA, 25 bp, E. coli
tactgatgatcggaaaaatgtgcct

SEQ ID NO: 200641 - DNA, 25 bp, E. coli
taccggcgggctgcaatttacttac

SEQ ID NO: 200642 - DNA, 25 bp, E. coli
taccggcgggctccaatttacttac

SEQ ID NO: 200643 - DNA, 25 bp, E. coli
tgcccatgtggagcgaatcagtcac

SEQ ID NO: 200644 - DNA, 25 bp, E. coli
tgcccatgtggaccgaatcagtcac

SEQ ID NO: 200645 - DNA, 25 bp, E. coli
ccaactggcggtggatgcactgtta

SEQ ID NO: 200646 - DNA, 25 bp, E. coli
ccaactggcggtcgatgcactgtta

SEQ ID NO: 200647 - DNA, 25 bp, E. coli
cattggttcatgacgcacagcagca

SEQ ID NO: 200648 - DNA, 25 bp, E. coli
cggccaggcggactttatcaataat

SEQ ID NO: 200649 - DNA, 25 bp, E. coli
cggccaggcggagtttatcaataat

SEQ ID NO: 200650 - DNA, 25 bp, E. coli
cattggttcatgtcgcacagcagca

SEQ ID NO: 200651 - DNA, 25 bp, E. coli
ggctaccgcttccttacatccagaa

SEQ ID NO: 200652 - DNA, 25 bp, E. coli
ggaaaaacattacccgtcacgctgg

SEQ ID NO: 200653 - DNA, 25 bp, E. coli
ggctaccgcttcgttacatccagaa

SEQ ID NO: 200654 - DNA, 25 bp, E. coli
ggaaaaacattagccgtcacgctgg

SEQ ID NO: 200655 - DNA, 25 bp, E. coli
taatcatagcctgcgtgttcatcgg

SEQ ID NO: 200656 - DNA, 25 bp, E. coli
tcaaatgcaatgtatggcgggacct

SEQ ID NO: 200657 - DNA, 25 bp, E. coli
tcaaatgcaatgaatggcgggacct

SEQ ID NO: 200658 - DNA, 25 bp, E. coli
taatcatagcctccgtgttcatcgg

SEQ ID NO: 200659 - DNA, 25 bp, E. coli
caattcattgaatgtggctgcgcca

SEQ ID NO: 200660 - DNA, 25 bp, E. coli
caattcattgaaagtggctgcgcca

SEQ ID NO: 200661 - DNA, 25 bp, E. coli
ttaatcaggtggaaaccggccaggc

SEQ ID NO: 200662 - DNA, 25 bp, E. coli
ttaatcaggtggtaaccggccaggc

SEQ ID NO: 200663 - DNA, 25 bp, E. coli
tcggaaaacccgatactggcgctgc

SEQ ID NO: 200664 - DNA, 25 bp, E. coli
tcggaaaacccgttactggcgctgc

SEQ ID NO: 200665 - DNA, 25 bp, E. coli
tcaggccaatcttgaatcagcggaa

SEQ ID NO: 200666 - DNA, 25 bp, E. coli
tcaggccaatctagaatcagcggaa

SEQ ID NO: 200667 - DNA, 25 bp, E. coli
gaatataccgaaagtacgtctgcgg

SEQ ID NO: 200668 - DNA, 25 bp, E. coli
gaatataccgaatgtacgtctgcgg

SEQ ID NO: 200669 - DNA, 25 bp, E. coli
gaagattccgtattaactcagcagg

SEQ ID NO: 200670 - DNA, 25 bp, E. coli
gaagattccgtaataactcagcagg

SEQ ID NO: 200671 - DNA, 25 bp, E. coli
gaacgtagtgcctgttgatccaacc

SEQ ID NO: 200672 - DNA, 25 bp, E. coli
gaacgtagtgccagttgatccaacc

SEQ ID NO: 200673 - DNA, 25 bp, E. coli
gttgcacaggcaaaatcaccgcatg

SEQ ID NO: 200674 - DNA, 25 bp, E. coli
gattgaaaatacgagctccggtgcc

SEQ ID NO: 200675 - DNA, 25 bp, E. coli
gattgaaaataccagctccggtgcc

SEQ ID NO: 200676 - DNA, 25 bp, E. coli
gttgcacaggcataatcaccgcatg

SEQ ID NO: 200677 - DNA, 25 bp, E. coli
ggtgggaaaagccaaactgctctcg

SEQ ID NO: 200678 - DNA, 25 bp, E. coli
ggtgggaaaagcgaaactgctctcg

SEQ ID NO: 200679 - DNA, 25 bp, E. coli
taattacgctcgctaaagcgcacca

SEQ ID NO: 200680 - DNA, 25 bp, E. coli
taattacgctcggtaaagcgcacca

SEQ ID NO: 200681 - DNA, 25 bp, E. coli
caatggccgcatgatttaaaaagaa

SEQ ID NO: 200682 - DNA, 25 bp, E. coli
caatggccgcatcatttaaaaagaa

SEQ ID NO: 200683 - DNA, 25 bp, E. coli
tactcgtagctggtaccttgaaacg

SEQ ID NO: 200684 - DNA, 25 bp, E. coli
tactcgtagctgctaccttgaaacg

SEQ ID NO: 200685 - DNA, 25 bp, E. coli
tgtcaggtatctgtatctcgtccag

SEQ ID NO: 200686 - DNA, 25 bp, E. coli
tgtcaggtatctctatctcgtccag

SEQ ID NO: 200687 - DNA, 25 bp, E. coli
tctcgtccagttcctttactcgtag

SEQ ID NO: 200688 - DNA, 25 bp, E. coli
tctcgtccagttgctttactcgtag

SEQ ID NO: 200689 - DNA, 25 bp, E. coli
tccagaaaagagacgctgaaaagcg

SEQ ID NO: 200690 - DNA, 25 bp, E. coli
tccagaaaagagtcgctgaaaagcg

SEQ ID NO: 200691 - DNA, 25 bp, E. coli
ccttgaaacgatcgtgccggtacgc

SEQ ID NO: 200692 - DNA, 25 bp, E. coli
ccttgaaacgatggtgccggtacgc

SEQ ID NO: 200693 - DNA, 25 bp, E. coli
cgactgatggcttcgttctgcgtaa

SEQ ID NO: 200694 - DNA, 25 bp, E. coli
cgactgatggctacgttctgcgtaa

SEQ ID NO: 200695 - DNA, 25 bp, E. coli
gataaaccatccagctcctgtcagt

SEQ ID NO: 200696 - DNA, 25 bp, E. coli
gataaaccatcctgctcctgtcagt

SEQ ID NO: 200697 - DNA, 25 bp, E. coli
gtgccggtacgcgttagttataaat

SEQ ID NO: 200698 - DNA, 25 bp, E. coli
gtgccggtacgccttagttataaat

SEQ ID NO: 200699 - DNA, 25 bp, E. coli
tgtgtcaactccagttccggtacga

SEQ ID NO: 200700 - DNA, 25 bp, E. coli
tgtgtcaactcctgttccggtacga

SEQ ID NO: 200701 - DNA, 25 bp, E. coli
taattactgagaacgcaatggccgc

SEQ ID NO: 200702 - DNA, 25 bp, E. coli
taattactgagatcgcaatggccgc

SEQ ID NO: 200703 - DNA, 25 bp, E. coli
caattagtccatatcagcccggcag

SEQ ID NO: 200704 - DNA, 25 bp, E. coli
caattagtccatttcagcccggcag

SEQ ID NO: 200705 - DNA, 25 bp, E. coli
caaagtctgaaaggtgcgtggcgca

SEQ ID NO: 200706 - DNA, 25 bp, E. coli
caaagtctgaaacgtgcgtggcgca

SEQ ID NO: 200707 - DNA, 25 bp, E. coli
caggtcgcgcatccatttggtgtca

SEQ ID NO: 200708 - DNA, 25 bp, E. coli
caggtcgcgcatgcatttggtgtca

SEQ ID NO: 200709 - DNA, 25 bp, E. coli
actttttgaacaggcactggcgggc

SEQ ID NO: 200710 - DNA, 25 bp, E. coli
actttttgaacacgcactggcgggc

SEQ ID NO: 200711 - DNA, 25 bp, E. coli
tatgaacccattaatggcacccggc

SEQ ID NO: 200712 - DNA, 25 bp, E. coli
tatgaacccatttatggcacccggc

SEQ ID NO: 200713 - DNA, 25 bp, E. coli
tttgacgccgtaaaagcgctggccc

SEQ ID NO: 200714 - DNA, 25 bp, E. coli
ttaaccgtgatgacaccggagcgcc

SEQ ID NO: 200715 - DNA, 25 bp, E. coli
ttaaccgtgatgtcaccggagcgcc

SEQ ID NO: 200716 - DNA, 25 bp, E. coli
tttgacgccgtataagcgctggccc

SEQ ID NO: 200717 - DNA, 25 bp, E. coli
tctatgaacagatgaccgaatgcgc

SEQ ID NO: 200718 - DNA, 25 bp, E. coli
tctatgaacagaagaccgaatgcgc

SEQ ID NO: 200719 - DNA, 25 bp, E. coli
gaatttaatgttgaagccgcctgcc

SEQ ID NO: 200720 - DNA, 25 bp, E. coli
gaatttaatgttcaagccgcctgcc

SEQ ID NO: 200721 - DNA, 25 bp, E. coli
gaacaaccacgttctctggcggcgg

SEQ ID NO: 200722 - DNA, 25 bp, E. coli
gaacaaccacgtactctggcggcgg

SEQ ID NO: 200723 - DNA, 25 bp, E. coli
gatctgctggtcgaaaacctcggcg

SEQ ID NO: 200724 - DNA, 25 bp, E. coli
gatctgctggtccaaaacctcggcg

SEQ ID NO: 200725 - DNA, 25 bp, E. coli
tatgcgttacgctcatctggcaccg

SEQ ID NO: 200726 - DNA, 25 bp, E. coli
tatcgagataaacgcctgacaggtg

SEQ ID NO: 200727 - DNA, 25 bp, E. coli
tttagcgaactatcccgcctgggcg

SEQ ID NO: 200728 - DNA, 25 bp, E. coli
tatgcgttacgcacatctggcaccg

SEQ ID NO: 200729 - DNA, 25 bp, E. coli
tttagcgaactaacccgcctgggcg

SEQ ID NO: 200730 - DNA, 25 bp, E. coli
tatcgagataaaggcctgacaggtg

SEQ ID NO: 200731 - DNA, 25 bp, E. coli
tgggcgtcgtgtgcgtaaacaattc

SEQ ID NO: 200732 - DNA, 25 bp, E. coli
tgggcgtcgtgtccgtaaacaattc

SEQ ID NO: 200733 - DNA, 25 bp, E. coli
tcgcagaaaaagagatggcatggct

SEQ ID NO: 200734 - DNA, 25 bp, E. coli
tcgcagaaaaagtgatggcatggct

SEQ ID NO: 200735 - DNA, 25 bp, E. coli
gctttgcgaatgttaccccgccgga

SEQ ID NO: 200736 - DNA, 25 bp, E. coli
gctttgcgaatgataccccgccgga

SEQ ID NO: 200737 - DNA, 25 bp, E. coli
gtaaatcactgactgctgggcagca

SEQ ID NO: 200738 - DNA, 25 bp, E. coli
ggatcacctggaaactgcattacgg

SEQ ID NO: 200739 - DNA, 25 bp, E. coli
ggtcgtatccgaacccactggagaa

SEQ ID NO: 200740 - DNA, 25 bp, E. coli
gtaaatcactgagtgctgggcagca

SEQ ID NO: 200741 - DNA, 25 bp, E. coli
ggatcacctggatactgcattacgg

SEQ ID NO: 200742 - DNA, 25 bp, E. coli
ggtcgtatccgatcccactggagaa

SEQ ID NO: 200743 - DNA, 25 bp, E. coli
tggaagaaaccgtagcaaagccctg

SEQ ID NO: 200744 - DNA, 25 bp, E. coli
tggaagaaaccgaagcaaagccctg

SEQ ID NO: 200745 - DNA, 25 bp, E. coli
ggcttttgagcgacacacgatggaa

SEQ ID NO: 200746 - DNA, 25 bp, E. coli
ggcttttgagcgtcacacgatggaa

SEQ ID NO: 200747 - DNA, 25 bp, E. coli
aggatattgctcatactgttgggaa

SEQ ID NO: 200748 - DNA, 25 bp, E. coli
aggatattgctcttactgttgggaa

SEQ ID NO: 200749 - DNA, 25 bp, E. coli
aaaaagcaacgtgtggtgagtggtc

SEQ ID NO: 200750 - DNA, 25 bp, E. coli
aaaaagcaacgtctggtgagtggtc

SEQ ID NO: 200751 - DNA, 25 bp, E. coli
tttgcagaattgaaggagcgcatcc

SEQ ID NO: 200752 - DNA, 25 bp, E. coli
tttgcagaattgtaggagcgcatcc

SEQ ID NO: 200753 - DNA, 25 bp, E. coli
tccaaatggaactgcaggccaatgc

SEQ ID NO: 200754 - DNA, 25 bp, E. coli
tccaaatggaacagcaggccaatgc

SEQ ID NO: 200755 - DNA, 25 bp, E. coli
gccaatgctgaattcatcgccgcag

SEQ ID NO: 200756 - DNA, 25 bp, E. coli
ccaatccggctagtgtgctggcact

SEQ ID NO: 200757 - DNA, 25 bp, E. coli
ccaatccggctactgtgctggcact

SEQ ID NO: 200758 - DNA, 25 bp, E. coli
gccaatgctgaaatcatcgccgcag

SEQ ID NO: 200759 - DNA, 25 bp, E. coli
gaactggagaaatgcgaagagcaac

SEQ ID NO: 200760 - DNA, 25 bp, E. coli
gagcgcatccagaaagcggtttcga

SEQ ID NO: 200761 - DNA, 25 bp, E. coli
gagcgcatccagtaagcggtttcga

SEQ ID NO: 200762 - DNA, 25 bp, E. coli
gaactggagaaaagcgaagagcaac

SEQ ID NO: 200763 - DNA, 25 bp, E. coli
cgtgaagttgctggatatattccca

SEQ ID NO: 200764 - DNA, 25 bp, E. coli
ctcgaatatggacagagccgatttg

SEQ ID NO: 200765 - DNA, 25 bp, E. coli
ctcgaatatggagagagccgatttg

SEQ ID NO: 200766 - DNA, 25 bp, E. coli
cgtgaagttgctcgatatattccca

SEQ ID NO: 200767 - DNA, 25 bp, E. coli
gattatgcgctaattcatcgtgaag

SEQ ID NO: 200768 - DNA, 25 bp, E. coli
gattatgcgctatttcatcgtgaag

SEQ ID NO: 200769 - DNA, 25 bp, E. coli
caacaacagagtttcagggcgagat

SEQ ID NO: 200770 - DNA, 25 bp, E. coli
caacaacagagtatcagggcgagat

SEQ ID NO: 200771 - DNA, 25 bp, E. coli
catttcacgcaaaaaatggcgcgcc

SEQ ID NO: 200772 - DNA, 25 bp, E. coli
tactgccgacgctaaatgaagattc

SEQ ID NO: 200773 - DNA, 25 bp, E. coli
tactgccgacgcaaaatgaagattc

SEQ ID NO: 200774 - DNA, 25 bp, E. coli
tacaccgggtgctttgttgctggcg

SEQ ID NO: 200775 - DNA, 25 bp, E. coli
tacaccgggtgcattgttgctggcg

SEQ ID NO: 200776 - DNA, 25 bp, E. coli
tattgtggcgaagagcgacagtacg

SEQ ID NO: 200777 - DNA, 25 bp, E. coli
tattgtggcgaacagcgacagtacg

SEQ ID NO: 200778 - DNA, 25 bp, E. coli
tctttagtgaggaaaactgccagct

SEQ ID NO: 200779 - DNA, 25 bp, E. coli
tctttagtgaggtaaactgccagct

SEQ ID NO: 200780 - DNA, 25 bp, E. coli
gctggtcaaaatcaactgcgctgcc

SEQ ID NO: 200781 - DNA, 25 bp, E. coli
gctggtcaaaatgaactgcgctgcc

SEQ ID NO: 200782 - DNA, 25 bp, E. coli
gaacgatcccggtgaatgtcagagt

SEQ ID NO: 200783 - DNA, 25 bp, E. coli
gaacgatcccggagaatgtcagagt

SEQ ID NO: 200784 - DNA, 25 bp, E. coli
gagctacgcttttttcgcacccacg

SEQ ID NO: 200785 - DNA, 25 bp, E. coli
gagctacgctttattcgcacccacg

SEQ ID NO: 200786 - DNA, 25 bp, E. coli
cgtttgctggagtaagatcgcgatc

SEQ ID NO: 200787 - DNA, 25 bp, E. coli
cgtttgctggagaaagatcgcgatc

SEQ ID NO: 200788 - DNA, 25 bp, E. coli
catttcacgcaataaatggcgcgcc

SEQ ID NO: 200789 - DNA, 25 bp, E. coli
gatctgatcgctcacgtcgctcgtg

SEQ ID NO: 200790 - DNA, 25 bp, E. coli
gatctgatcgctgacgtcgctcgtg

SEQ ID NO: 200791 - DNA, 25 bp, E. coli
catgattggtatcttagccgagcgc

SEQ ID NO: 200792 - DNA, 25 bp, E. coli
catgattggtatgttagccgagcgc

SEQ ID NO: 200793 - DNA, 25 bp, E. coli
tacgatctgggtagttctctgggcg

SEQ ID NO: 200794 - DNA, 25 bp, E. coli
tacgatctgggttgttctctgggcg

SEQ ID NO: 200795 - DNA, 25 bp, E. coli
actccccggcgaagattgaacgctg

SEQ ID NO: 200796 - DNA, 25 bp, E. coli
actccccggcgatgattgaacgctg

SEQ ID NO: 200797 - DNA, 25 bp, E. coli
tattgacgcctataaagcccctacg

SEQ ID NO: 200798 - DNA, 25 bp, E. coli
tattgacgcctaaaaagcccctacg

SEQ ID NO: 200799 - DNA, 25 bp, E. coli
gactgggcgactcgacctttgatga

SEQ ID NO: 200800 - DNA, 25 bp, E. coli
gactgggcgactggacctttgatga

SEQ ID NO: 200801 - DNA, 25 bp, E. coli
cggtgcgtcgcaacattcatcatga

SEQ ID NO: 200802 - DNA, 25 bp, E. coli
cggtgcgtcgcatcattcatcatga

SEQ ID NO: 200803 - DNA, 25 bp, E. coli
gatatcgccattcaaaacgcatcga

SEQ ID NO: 200804 - DNA, 25 bp, E. coli
gatatcgccattgaaaacgcatcga

SEQ ID NO: 200805 - DNA, 25 bp, E. coli
ggttacagcgaactggagatcagcc

SEQ ID NO: 200806 - DNA, 25 bp, E. coli
ggttacagcgaagtggagatcagcc

SEQ ID NO: 200807 - DNA, 25 bp, E. coli
tggaaacccataaagcacgcctgca

SEQ ID NO: 200808 - DNA, 25 bp, E. coli
tggaaacccatatagcacgcctgca

SEQ ID NO: 200809 - DNA, 25 bp, E. coli
gatgctgaccgaatccgtggaaacc

SEQ ID NO: 200810 - DNA, 25 bp, E. coli
gatgaacgggtagctgaagtcttcc

SEQ ID NO: 200811 - DNA, 25 bp, E. coli
gatgaacgggtacctgaagtcttcc

SEQ ID NO: 200812 - DNA, 25 bp, E. coli
gatgctgaccgattccgtggaaacc

SEQ ID NO: 200813 - DNA, 25 bp, E. coli
aatgttccaggatggcacagaagcc

SEQ ID NO: 200814 - DNA, 25 bp, E. coli
aatgttccaggaaggcacagaagcc

SEQ ID NO: 200815 - DNA, 25 bp, E. coli
catagcggaagaactcgaggcgaaa

SEQ ID NO: 200816 - DNA, 25 bp, E. coli
catagcggaagatctcgaggcgaaa

SEQ ID NO: 200817 - DNA, 25 bp, E. coli
acgatgcgacgggtggaatgttcca

SEQ ID NO: 200818 - DNA, 25 bp, E. coli
acgatgcgacggctggaatgttcca

SEQ ID NO: 200819 - DNA, 25 bp, E. coli
tatggcgtaattacccagacagcta

SEQ ID NO: 200820 - DNA, 25 bp, E. coli
tatggcgtaatttcccagacagcta

SEQ ID NO: 200821 - DNA, 25 bp, E. coli
tggtgtaagcgaagaaatatggcgt

SEQ ID NO: 200822 - DNA, 25 bp, E. coli
tgagaaaggcagtcgatcgcactta

SEQ ID NO: 200823 - DNA, 25 bp, E. coli
tggtgtaagcgatgaaatatggcgt

SEQ ID NO: 200824 - DNA, 25 bp, E. coli
tgagaaaggcagacgatcgcactta

SEQ ID NO: 200825 - DNA, 25 bp, E. coli
tcatgctgctggaggagacagacaa

SEQ ID NO: 200826 - DNA, 25 bp, E. coli
tcatgctgctggtggagacagacaa

SEQ ID NO: 200827 - DNA, 25 bp, E. coli
gacagacaaggatcggcatcaggtt

SEQ ID NO: 200828 - DNA, 25 bp, E. coli
gacagacaaggaacggcatcaggtt

SEQ ID NO: 200829 - DNA, 25 bp, E. coli
cgcacttatgctgaaatgggtatag

SEQ ID NO: 200830 - DNA, 25 bp, E. coli
cgcacttatgctcaaatgggtatag

SEQ ID NO: 200831 - DNA, 25 bp, E. coli
cggagccgccggttaacttcggaga

SEQ ID NO: 200832 - DNA, 25 bp, E. coli
cggagccgccggataacttcggaga

SEQ ID NO: 200833 - DNA, 25 bp, E. coli
taacttcggagacctgagaaaggca

SEQ ID NO: 200834 - DNA, 25 bp, E. coli
taacttcggagagctgagaaaggca

SEQ ID NO: 200835 - DNA, 25 bp, E. coli
aattgattgatatctaacctactga

SEQ ID NO: 200836 - DNA, 25 bp, E. coli
aattgattgataactaacctactga

SEQ ID NO: 200837 - DNA, 25 bp, E. coli
cagcgttaaagggacggaatgacac

SEQ ID NO: 200838 - DNA, 25 bp, E. coli
cacggaatgacacgcaaaatacaaa

SEQ ID NO: 200839 - DNA, 25 bp, E. coli
cagcgttaaaggcacggaatgacac

SEQ ID NO: 200840 - DNA, 25 bp, E. coli
cacggaatgacaggcaaaatacaaa

SEQ ID NO: 200841 - DNA, 25 bp, E. coli
ataaaatcgaagagaattgaccgcc

SEQ ID NO: 200842 - DNA, 25 bp, E. coli
ataaaatcgaagtgaattgaccgcc

SEQ ID NO: 200843 - DNA, 25 bp, E. coli
tataagtgacgtagtttcgtcgatg

SEQ ID NO: 200844 - DNA, 25 bp, E. coli
tataagtgacgttgtttcgtcgatg

SEQ ID NO: 200845 - DNA, 25 bp, E. coli
ttatactcgctaagcatctcgccag

SEQ ID NO: 200846 - DNA, 25 bp, E. coli
ttatactcgctatgcatctcgccag

SEQ ID NO: 200847 - DNA, 25 bp, E. coli
tgaccgccttgtacaaataaattga

SEQ ID NO: 200848 - DNA, 25 bp, E. coli
tgaccgccttgttcaaataaattga

SEQ ID NO: 200849 - DNA, 25 bp, E. coli
tcgtcgatgtgaagagtatcacgtt

SEQ ID NO: 200850 - DNA, 25 bp, E. coli
tcgtcgatgtgatgagtatcacgtt

SEQ ID NO: 200851 - DNA, 25 bp, E. coli
gcgtggcagtcagagcagcgttaaa

SEQ ID NO: 200852 - DNA, 25 bp, E. coli
gcgtggcagtcacagcagcgttaaa

SEQ ID NO: 200853 - DNA, 25 bp, E. coli
gaacttgttttaaaccgcgtggcag

SEQ ID NO: 200854 - DNA, 25 bp, E. coli
gaacttgttttataccgcgtggcag

SEQ ID NO: 200855 - DNA, 25 bp, E. coli
cgcaggtgatttttgtataagtgac

SEQ ID NO: 200856 - DNA, 25 bp, E. coli
cgcaggtgatttatgtataagtgac

SEQ ID NO: 200857 - DNA, 25 bp, E. coli
atcatgtacatgaccgatgccgcgc

SEQ ID NO: 200858 - DNA, 25 bp, E. coli
atcatgtacatgtccgatgccgcgc

SEQ ID NO: 200859 - DNA, 25 bp, E. coli
aaagagtaagaacaaccgcgctgcg

SEQ ID NO: 200860 - DNA, 25 bp, E. coli
aaagagtaagaagaaccgcgctgcg

SEQ ID NO: 200861 - DNA, 25 bp, E. coli
tatgtggaatgcgtacagatggacc

SEQ ID NO: 200862 - DNA, 25 bp, E. coli
tatgtggaatgcctacagatggacc

SEQ ID NO: 200863 - DNA, 25 bp, E. coli
tgtgaacaacctgcgcaatgcgatg

SEQ ID NO: 200864 - DNA, 25 bp, E. coli
tgtgaacaacctccgcaatgcgatg

SEQ ID NO: 200865 - DNA, 25 bp, E. coli
tctgaacatcaagaacgtgagccgg

SEQ ID NO: 200866 - DNA, 25 bp, E. coli
tctgaacatcaacaacgtgagccgg

SEQ ID NO: 200867 - DNA, 25 bp, E. coli
tctggaccgccgagaattactggac

SEQ ID NO: 200868 - DNA, 25 bp, E. coli
tctggaccgccgtgaattactggac

SEQ ID NO: 200869 - DNA, 25 bp, E. coli
ctggcaaaatatacccgacgcgggt

SEQ ID NO: 200870 - DNA, 25 bp, E. coli
cattaacggtagtcatgcaggcttc

SEQ ID NO: 200871 - DNA, 25 bp, E. coli
cattaacggtagacatgcaggcttc

SEQ ID NO: 200872 - DNA, 25 bp, E. coli
ctggcaaaatattcccgacgcgggt

SEQ ID NO: 200873 - DNA, 25 bp, E. coli
gattcagatcatcccgctgtcagag

SEQ ID NO: 200874 - DNA, 25 bp, E. coli
gattcagatcatgccgctgtcagag

SEQ ID NO: 200875 - DNA, 25 bp, E. coli
taatcaggagatctacggcctgccc

SEQ ID NO: 200876 - DNA, 25 bp, E. coli
taatcaggagatgtacggcctgccc

SEQ ID NO: 200877 - DNA, 25 bp, E. coli
gatggaccgttggtatgagccgccc

SEQ ID NO: 200878 - DNA, 25 bp, E. coli
gatggaccgttgctatgagccgccc

SEQ ID NO: 200879 - DNA, 25 bp, E. coli
taaattcattgagaggactcgtggg

SEQ ID NO: 200880 - DNA, 25 bp, E. coli
taacagcagtcgtaagaacactggg

SEQ ID NO: 200881 - DNA, 25 bp, E. coli
taaattcattgacaggactcgtggg

SEQ ID NO: 200882 - DNA, 25 bp, E. coli
taacagcagtcgaaagaacactggg

SEQ ID NO: 200883 - DNA, 25 bp, E. coli
taccgagccaaaaacagaggatccg

SEQ ID NO: 200884 - DNA, 25 bp, E. coli
taccgagccaaatacagaggatccg

SEQ ID NO: 200885 - DNA, 25 bp, E. coli
tgaaaatgcttggtcagcccggtac

SEQ ID NO: 200886 - DNA, 25 bp, E. coli
tgaaaatgcttgctcagcccggtac

SEQ ID NO: 200887 - DNA, 25 bp, E. coli
tgcacatgggatgttcggtctagcg

SEQ ID NO: 200888 - DNA, 25 bp, E. coli
tgcacatgggatcttcggtctagcg

SEQ ID NO: 200889 - DNA, 25 bp, E. coli
tctggacatgaatatactgagcgtg

SEQ ID NO: 200890 - DNA, 25 bp, E. coli
tctggacatgaaaatactgagcgtg

SEQ ID NO: 200891 - DNA, 25 bp, E. coli
gcccggtactccagaatatgcgaaa

SEQ ID NO: 200892 - DNA, 25 bp, E. coli
gcccggtactcctgaatatgcgaaa

SEQ ID NO: 200893 - DNA, 25 bp, E. coli
gatacgaaagggaactggtcaaccg

SEQ ID NO: 200894 - DNA, 25 bp, E. coli
gatacgaaagggtactggtcaaccg

SEQ ID NO: 200895 - DNA, 25 bp, E. coli
gcatggctagcaaacgaaacaggaa

SEQ ID NO: 200896 - DNA, 25 bp, E. coli
gaagctacggtgatccatcaaatca

SEQ ID NO: 200897 - DNA, 25 bp, E. coli
gaagctacggtgttccatcaaatca

SEQ ID NO: 200898 - DNA, 25 bp, E. coli
gcatggctagcatacgaaacaggaa

SEQ ID NO: 200899 - DNA, 25 bp, E. coli
cgtaagtagtaattggaagcagcca

SEQ ID NO: 200900 - DNA, 25 bp, E. coli
cgtaagtagtaaatggaagcagcca

SEQ ID NO: 200901 - DNA, 25 bp, E. coli
tattcgacagggattaggcatcgcc

SEQ ID NO: 200902 - DNA, 25 bp, E. coli
tattcgacagggtttaggcatcgcc

SEQ ID NO: 200903 - DNA, 25 bp, E. coli
tcgacagggattaggcatcgcctta

SEQ ID NO: 200904 - DNA, 25 bp, E. coli
tcgttgctggctaaagaaaagccgg

SEQ ID NO: 200905 - DNA, 25 bp, E. coli
tcgttgctggcttaagaaaagccgg

SEQ ID NO: 200906 - DNA, 25 bp, E. coli
tcgacagggatttggcatcgcctta

SEQ ID NO: 200907 - DNA, 25 bp, E. coli
tctatcgacagaattcgttgctggc

SEQ ID NO: 200908 - DNA, 25 bp, E. coli
tctatcgacagatttcgttgctggc

SEQ ID NO: 200909 - DNA, 25 bp, E. coli
gccggtagaagggagtccactgttt

SEQ ID NO: 200910 - DNA, 25 bp, E. coli
gccggtagaaggcagtccactgttt

SEQ ID NO: 200911 - DNA, 25 bp, E. coli
gacagatttcgttgctggctaaaga

SEQ ID NO: 200912 - DNA, 25 bp, E. coli
gaattgtgttcccttcctctcgaac

SEQ ID NO: 200913 - DNA, 25 bp, E. coli
gaattgtgttccgttcctctcgaac

SEQ ID NO: 200914 - DNA, 25 bp, E. coli
gacagatttcgtagctggctaaaga

SEQ ID NO: 200915 - DNA, 25 bp, E. coli
gaaaagccggtacaaggcagtccac

SEQ ID NO: 200916 - DNA, 25 bp, E. coli
gaaaagccggtagaaggcagtccac

SEQ ID NO: 200917 - DNA, 25 bp, E. coli
gtccactgtttttactacaaatgtg

SEQ ID NO: 200918 - DNA, 25 bp, E. coli
gtccactgttttaactacaaatgtg

SEQ ID NO: 200919 - DNA, 25 bp, E. coli
ggcagtccactgattttactacaaa

SEQ ID NO: 200920 - DNA, 25 bp, E. coli
ggcagtccactgtttttactacaaa

SEQ ID NO: 200921 - DNA, 25 bp, E. coli
tgtgttccgttcgtctcgaaccaac

SEQ ID NO: 200922 - DNA, 25 bp, E. coli
tgtgttccgttcctctcgaaccaac

SEQ ID NO: 200923 - DNA, 25 bp, E. coli
caaggttacctgttgcgacgagggc

SEQ ID NO: 200924 - DNA, 25 bp, E. coli
caaggttacctgatgcgacgagggc

SEQ ID NO: 200925 - DNA, 25 bp, E. coli
caggcattgatgctcgactgtcgga

SEQ ID NO: 200926 - DNA, 25 bp, E. coli
caggcattgatggtcgactgtcgga

SEQ ID NO: 200927 - DNA, 25 bp, E. coli
catgaatggtgcattggtcatacca

SEQ ID NO: 200928 - DNA, 25 bp, E. coli
catgaatggtgctttggtcatacca

SEQ ID NO: 200929 - DNA, 25 bp, E. coli
taacaacaggtttcagcaatgaaaa

SEQ ID NO: 200930 - DNA, 25 bp, E. coli
taacaacaggttacagcaatgaaaa

SEQ ID NO: 200931 - DNA, 25 bp, E. coli
aacatagctcttaattaacaacagg

SEQ ID NO: 200932 - DNA, 25 bp, E. coli
aacatagctctttattaacaacagg

SEQ ID NO: 200933 - DNA, 25 bp, E. coli
tttgttgctgaaaagataggcgact

SEQ ID NO: 200934 - DNA, 25 bp, E. coli
tttgttgctgaatagataggcgact

SEQ ID NO: 200935 - DNA, 25 bp, E. coli
tgaaaatgttctacgctattgagaa

SEQ ID NO: 200936 - DNA, 25 bp, E. coli
tgaaaatgttcttcgctattgagaa

SEQ ID NO: 200937 - DNA, 25 bp, E. coli
gcgcatcaggtagcggcaaggttac

SEQ ID NO: 200938 - DNA, 25 bp, E. coli
gcgcatcaggtaccggcaaggttac

SEQ ID NO: 200939 - DNA, 25 bp, E. coli
ccacagaattcgcagcgcatcaggt

SEQ ID NO: 200940 - DNA, 25 bp, E. coli
ccacagaattcggagcgcatcaggt

SEQ ID NO: 200941 - DNA, 25 bp, E. coli
cgggtgagatcaaaaaacagagttt

SEQ ID NO: 200942 - DNA, 25 bp, E. coli
cgggtgagatcataaaacagagttt

SEQ ID NO: 200943 - DNA, 25 bp, E. coli
gataggcgacttaaccgggtgagat

SEQ ID NO: 200944 - DNA, 25 bp, E. coli
gataggcgactttaccgggtgagat

SEQ ID NO: 200945 - DNA, 25 bp, E. coli
cataccgccagatctgttgggtgga

SEQ ID NO: 200946 - DNA, 25 bp, E. coli
cataccgccagaactgttgggtgga

SEQ ID NO: 200947 - DNA, 25 bp, E. coli
taaatcagtttaacaaagactcatg

SEQ ID NO: 200948 - DNA, 25 bp, E. coli
taaatcagtttatcaaagactcatg

SEQ ID NO: 200949 - DNA, 25 bp, E. coli
acttcaaacgagtatctcctttagg

SEQ ID NO: 200950 - DNA, 25 bp, E. coli
acttcaaacgagaatctcctttagg

SEQ ID NO: 200951 - DNA, 25 bp, E. coli
gaatacggcctgttgcttcgcactg

SEQ ID NO: 200952 - DNA, 25 bp, E. coli
gaatacggcctgatgcttcgcactg

SEQ ID NO: 200953 - DNA, 25 bp, E. coli
gacaaattgaaggataccgccagaa

SEQ ID NO: 200954 - DNA, 25 bp, E. coli
gacaaattgaagcataccgccagaa

SEQ ID NO: 200955 - DNA, 25 bp, E. coli
cggcctgatgctacgcactggtctg

SEQ ID NO: 200956 - DNA, 25 bp, E. coli
ctttaatgaagagtggatggttgaa

SEQ ID NO: 200957 - DNA, 25 bp, E. coli
ctttaatgaagactggatggttgaa

SEQ ID NO: 200958 - DNA, 25 bp, E. coli
cggcctgatgcttcgcactggtctg

SEQ ID NO: 200959 - DNA, 25 bp, E. coli
ggcttccacttctaacgagtatctc

SEQ ID NO: 200960 - DNA, 25 bp, E. coli
gggccagacaaattgaagcataccg

SEQ ID NO: 200961 - DNA, 25 bp, E. coli
ggcttccacttcaaacgagtatctc

SEQ ID NO: 200962 - DNA, 25 bp, E. coli
gggccagacaaaatgaagcataccg

SEQ ID NO: 200963 - DNA, 25 bp, E. coli
tggatggttgaaaacggcctgatgc

SEQ ID NO: 200964 - DNA, 25 bp, E. coli
tggatggttgaatacggcctgatgc

SEQ ID NO: 200965 - DNA, 25 bp, E. coli
tggcacaagtaatctttaatgaaga

SEQ ID NO: 200966 - DNA, 25 bp, E. coli
tggcacaagtaaactttaatgaaga

SEQ ID NO: 200967 - DNA, 25 bp, E. coli
tatcgaaagtcagtttcaggttgcc

SEQ ID NO: 200968 - DNA, 25 bp, E. coli
tatgggacatgatttttgacagcga

SEQ ID NO: 200969 - DNA, 25 bp, E. coli
tatgggacatgaattttgacagcga

SEQ ID NO: 200970 - DNA, 25 bp, E. coli
tatcgaaagtcactttcaggttgcc

SEQ ID NO: 200971 - DNA, 25 bp, E. coli
ttgtcgaagatgtaaagaaaaccgg

SEQ ID NO: 200972 - DNA, 25 bp, E. coli
ttgtcgaagatgaaaagaaaaccgg

SEQ ID NO: 200973 - DNA, 25 bp, E. coli
tgatggtcgatctcgtcagccgcaa

SEQ ID NO: 200974 - DNA, 25 bp, E. coli
tgaacggctgggatatcgtgcgcat

SEQ ID NO: 200975 - DNA, 25 bp, E. coli
tgatggtcgatcacgtcagccgcaa

SEQ ID NO: 200976 - DNA, 25 bp, E. coli
tgaacggctgggttatcgtgcgcat

SEQ ID NO: 200977 - DNA, 25 bp, E. coli
tcgatttggccgacaacgggctgaa

SEQ ID NO: 200978 - DNA, 25 bp, E. coli
tcgatttggccgtcaacgggctgaa

SEQ ID NO: 200979 - DNA, 25 bp, E. coli
gcggcaaaatcgacaacgactttga

SEQ ID NO: 200980 - DNA, 25 bp, E. coli
gcttggcaccatagaacatcgcgtc

SEQ ID NO: 200981 - DNA, 25 bp, E. coli
gcggcaaaatcgtcaacgactttga

SEQ ID NO: 200982 - DNA, 25 bp, E. coli
gcttggcaccattgaacatcgcgtc

SEQ ID NO: 200983 - DNA, 25 bp, E. coli
gaatggctaccatctggcgatgacc

SEQ ID NO: 200984 - DNA, 25 bp, E. coli
gaatggctaccaactggcgatgacc

SEQ ID NO: 200985 - DNA, 25 bp, E. coli
cgcttatcgcctggcaggtatggga

SEQ ID NO: 200986 - DNA, 25 bp, E. coli
cgcttatcgcctcgcaggtatggga

SEQ ID NO: 200987 - DNA, 25 bp, E. coli
gatgccgattctcttgcttaccgcg

SEQ ID NO: 200988 - DNA, 25 bp, E. coli
gatgccgattctgttgcttaccgcg

SEQ ID NO: 200989 - DNA, 25 bp, E. coli
cagaacgccagaacgggctcttgat

SEQ ID NO: 200990 - DNA, 25 bp, E. coli
cagaacgccagatcgggctcttgat

SEQ ID NO: 200991 - DNA, 25 bp, E. coli
cagttcggacagcatgcttttcagc

SEQ ID NO: 200992 - DNA, 25 bp, E. coli
cagttcggacaggatgcttttcagc

SEQ ID NO: 200993 - DNA, 25 bp, E. coli
taccggaaccagttacttcagcacg

SEQ ID NO: 200994 - DNA, 25 bp, E. coli
aactttttgactgtggtcctgcgga

SEQ ID NO: 200995 - DNA, 25 bp, E. coli
aactttttgactctggtcctgcgga

SEQ ID NO: 200996 - DNA, 25 bp, E. coli
taccggaaccagatacttcagcacg

SEQ ID NO: 200997 - DNA, 25 bp, E. coli
ttctgagcacgactaccctgacgag

SEQ ID NO: 200998 - DNA, 25 bp, E. coli
ttctgagcacgagtaccctgacgag

SEQ ID NO: 200999 - DNA, 25 bp, E. coli
tcctgcggacgagcagcaaaggtca

SEQ ID NO: 201000 - DNA, 25 bp, E. coli
tcctgcggacgaccagcaaaggtca

SEQ ID NO: 201001 - DNA, 25 bp, E. coli
tcttgatagaacgagaacgcgcacg

SEQ ID NO: 201002 - DNA, 25 bp, E. coli
tcttgatagaaccagaacgcgcacg

SEQ ID NO: 201003 - DNA, 25 bp, E. coli
gcgccgcggtacttcttcttgttaa

SEQ ID NO: 201004 - DNA, 25 bp, E. coli
gcgccgcggtacatcttcttgttaa

SEQ ID NO: 201005 - DNA, 25 bp, E. coli
gctgcataagcaacaacaacctggt

SEQ ID NO: 201006 - DNA, 25 bp, E. coli
gctgcataagcatcaacaacctggt

SEQ ID NO: 201007 - DNA, 25 bp, E. coli
gacgatcctgacgtaccagttcgga

SEQ ID NO: 201008 - DNA, 25 bp, E. coli
gacgatcctgacctaccagttcgga

SEQ ID NO: 201009 - DNA, 25 bp, E. coli
gaaccagcgcttcgttgaaatcacg

SEQ ID NO: 201010 - DNA, 25 bp, E. coli
gaaccagcgcttggttgaaatcacg

SEQ ID NO: 201011 - DNA, 25 bp, E. coli
taccagcactatgcgttacggtgag

SEQ ID NO: 201012 - DNA, 25 bp, E. coli
tatgaggcgctgaaaagtccatcgc

SEQ ID NO: 201013 - DNA, 25 bp, E. coli
taccagcactatccgttacggtgag

SEQ ID NO: 201014 - DNA, 25 bp, E. coli
tatgaggcgctgtaaagtccatcgc

SEQ ID NO: 201015 - DNA, 25 bp, E. coli
tatctcacggtaagtattggcgtcg

SEQ ID NO: 201016 - DNA, 25 bp, E. coli
tatcgctcgaagaaagatgggcgca

SEQ ID NO: 201017 - DNA, 25 bp, E. coli
tattgccacgatcgcgatatgccca

SEQ ID NO: 201018 - DNA, 25 bp, E. coli
tattgccacgatggcgatatgccca

SEQ ID NO: 201019 - DNA, 25 bp, E. coli
tattgcctcggttgtcattggcgga

SEQ ID NO: 201020 - DNA, 25 bp, E. coli
tatacgccgcaggtaacatgtctgt

SEQ ID NO: 201021 - DNA, 25 bp, E. coli
tatacgccgcagctaacatgtctgt

SEQ ID NO: 201022 - DNA, 25 bp, E. coli
tattgcctcggtagtcattggcgga

SEQ ID NO: 201023 - DNA, 25 bp, E. coli
tatctcacggtatgtattggcgtcg

SEQ ID NO: 201024 - DNA, 25 bp, E. coli
tatcgctcgaagtaagatgggcgca

SEQ ID NO: 201025 - DNA, 25 bp, E. coli
tgattgatatctcggtcggttcgcc

SEQ ID NO: 201026 - DNA, 25 bp, E. coli
tgattgatatctgggtcggttcgcc

SEQ ID NO: 201027 - DNA, 25 bp, E. coli
tgagcaattctctacgggcgtgttg

SEQ ID NO: 201028 - DNA, 25 bp, E. coli
tgagcaattctcaacgggcgtgttg

SEQ ID NO: 201029 - DNA, 25 bp, E. coli
tctggtgtgcagagcgctatacgcc

SEQ ID NO: 201030 - DNA, 25 bp, E. coli
tctggtgtgcagtgcgctatacgcc

SEQ ID NO: 201031 - DNA, 25 bp, E. coli
taatgaagcaagatgcgctgcgagc

SEQ ID NO: 201032 - DNA, 25 bp, E. coli
taatgaagcaagttgcgctgcgagc

SEQ ID NO: 201033 - DNA, 25 bp, E. coli
caacggtatttcttgcgagggacgg

SEQ ID NO: 201034 - DNA, 25 bp, E. coli
caacggtatttcatgcgagggacgg

SEQ ID NO: 201035 - DNA, 25 bp, E. coli
tacttcgatcaaactacccagcagg

SEQ ID NO: 201036 - DNA, 25 bp, E. coli
tacttcgatcaatctacccagcagg

SEQ ID NO: 201037 - DNA, 25 bp, E. coli
tacccagcaggagattttgcgccgc

SEQ ID NO: 201038 - DNA, 25 bp, E. coli
tacccagcaggacattttgcgccgc

SEQ ID NO: 201039 - DNA, 25 bp, E. coli
tattgttacagaagaccgagcgcct

SEQ ID NO: 201040 - DNA, 25 bp, E. coli
tattgttacagatgaccgagcgcct

SEQ ID NO: 201041 - DNA, 25 bp, E. coli
tgcgggtcactcagaaaactttagc

SEQ ID NO: 201042 - DNA, 25 bp, E. coli
tgcgggtcactctgaaaactttagc

SEQ ID NO: 201043 - DNA, 25 bp, E. coli
tctggctgaccataaacgcgacatg

SEQ ID NO: 201044 - DNA, 25 bp, E. coli
tctggctgaccaaaaacgcgacatg

SEQ ID NO: 201045 - DNA, 25 bp, E. coli
gcccggacgctggaaagtgtttgcc

SEQ ID NO: 201046 - DNA, 25 bp, E. coli
gcccggacgctgcaaagtgtttgcc

SEQ ID NO: 201047 - DNA, 25 bp, E. coli
gctgaccacgaaactgacggcattt

SEQ ID NO: 201048 - DNA, 25 bp, E. coli
gctgaccacgaatctgacggcattt

SEQ ID NO: 201049 - DNA, 25 bp, E. coli
gaagagttgaaatacctgacgccgc

SEQ ID NO: 201050 - DNA, 25 bp, E. coli
gaagagttgaaaaacctgacgccgc

SEQ ID NO: 201051 - DNA, 25 bp, E. coli
tggcgaaacagtacaccgtgccggg

SEQ ID NO: 201052 - DNA, 25 bp, E. coli
tggcgaaacagttcaccgtgccggg

SEQ ID NO: 201053 - DNA, 25 bp, E. coli
taaacccgacggattgctgtttgcg

SEQ ID NO: 201054 - DNA, 25 bp, E. coli
taaacccgacggtttgctgtttgcg

SEQ ID NO: 201055 - DNA, 25 bp, E. coli
aattacgcctaatgtgcaggatgcg

SEQ ID NO: 201056 - DNA, 25 bp, E. coli
aattacgcctaaagtgcaggatgcg

SEQ ID NO: 201057 - DNA, 25 bp, E. coli
cacagtaagctcagacgatgtcatc

SEQ ID NO: 201058 - DNA, 25 bp, E. coli
cacagtaagctctgacgatgtcatc

SEQ ID NO: 201059 - DNA, 25 bp, E. coli
caccgacatagacttgcttgcacag

SEQ ID NO: 201060 - DNA, 25 bp, E. coli
caccgacatagagttgcttgcacag

SEQ ID NO: 201061 - DNA, 25 bp, E. coli
tacgcctaattccaccgacatagag

SEQ ID NO: 201062 - DNA, 25 bp, E. coli
tacaaagtgaaattgaggatgcctg

SEQ ID NO: 201063 - DNA, 25 bp, E. coli
tacaaagtgaaaatgaggatgcctg

SEQ ID NO: 201064 - DNA, 25 bp, E. coli
tacgcctaattcgaccgacatagag

SEQ ID NO: 201065 - DNA, 25 bp, E. coli
gcgtaatattcgctgttatcggtgt

SEQ ID NO: 201066 - DNA, 25 bp, E. coli
gcgtaatattcggtgttatcggtgt

SEQ ID NO: 201067 - DNA, 25 bp, E. coli
gctaaacaagatagtcgaatggtgg

SEQ ID NO: 201068 - DNA, 25 bp, E. coli
gctaaacaagattgtcgaatggtgg

SEQ ID NO: 201069 - DNA, 25 bp, E. coli
gcaggatgcgtctttttacgcctaa

SEQ ID NO: 201070 - DNA, 25 bp, E. coli
gcaggatgcgtcattttacgcctaa

SEQ ID NO: 201071 - DNA, 25 bp, E. coli
cgatgtcatcagctttacaaagtga

SEQ ID NO: 201072 - DNA, 25 bp, E. coli
cgatgtcatcaggtttacaaagtga

SEQ ID NO: 201073 - DNA, 25 bp, E. coli
ggaaaagtcactggaattacgccta

SEQ ID NO: 201074 - DNA, 25 bp, E. coli
ggatgcctgaatagcaaaaaagcgc

SEQ ID NO: 201075 - DNA, 25 bp, E. coli
ggatgcctgaattgcaaaaaagcgc

SEQ ID NO: 201076 - DNA, 25 bp, E. coli
ggaaaagtcactcgaattacgccta

SEQ ID NO: 201077 - DNA, 25 bp, E. coli
cagagcttttcggtgcattaatgca

SEQ ID NO: 201078 - DNA, 25 bp, E. coli
cagagcttttcgctgcattaatgca

SEQ ID NO: 201079 - DNA, 25 bp, E. coli
cataataacgcgtgtttatggcagg

SEQ ID NO: 201080 - DNA, 25 bp, E. coli
catttgcgcggtatgttgcgcaacc

SEQ ID NO: 201081 - DNA, 25 bp, E. coli
cataataacgcgagtttatggcagg

SEQ ID NO: 201082 - DNA, 25 bp, E. coli
tttttaacgcttttgatcagtatca

SEQ ID NO: 201083 - DNA, 25 bp, E. coli
tttttaacgcttatgatcagtatca

SEQ ID NO: 201084 - DNA, 25 bp, E. coli
tttaacaacagaccttttcgctgca

SEQ ID NO: 201085 - DNA, 25 bp, E. coli
tttaacaacagagcttttcgctgca

SEQ ID NO: 201086 - DNA, 25 bp, E. coli
tgatcagtatcaattgcgcggtatg

SEQ ID NO: 201087 - DNA, 25 bp, E. coli
tgatcagtatcatttgcgcggtatg

SEQ ID NO: 201088 - DNA, 25 bp, E. coli
tgcgcaacccttaaacaacagagct

SEQ ID NO: 201089 - DNA, 25 bp, E. coli
tgcgcaaccctttaacaacagagct

SEQ ID NO: 201090 - DNA, 25 bp, E. coli
gcgcggtatgttgcgcaacccttta

SEQ ID NO: 201091 - DNA, 25 bp, E. coli
gcgcggtatgttccgcaacccttta

SEQ ID NO: 201092 - DNA, 25 bp, E. coli
gctgcattaatggataataacgcga

SEQ ID NO: 201093 - DNA, 25 bp, E. coli
gctgcattaatgcataataacgcga

SEQ ID NO: 201094 - DNA, 25 bp, E. coli
catttgcgcggtttgttgcgcaacc

SEQ ID NO: 201095 - DNA, 25 bp, E. coli
gtgttgcgttggtttgtagattttt

SEQ ID NO: 201096 - DNA, 25 bp, E. coli
gtgttgcgttggattgtagattttt

SEQ ID NO: 201097 - DNA, 25 bp, E. coli
taacgcgagtttatggcaggattaa

SEQ ID NO: 201098 - DNA, 25 bp, E. coli
taacgcgagtttttggcaggattaa

SEQ ID NO: 201099 - DNA, 25 bp, E. coli
catcctgatgactggtgaactggca

SEQ ID NO: 201100 - DNA, 25 bp, E. coli
cagacaatgatgtggatcgacacgg

SEQ ID NO: 201101 - DNA, 25 bp, E. coli
cagacaatgatgaggatcgacacgg

SEQ ID NO: 201102 - DNA, 25 bp, E. coli
catcctgatgacaggtgaactggca

SEQ ID NO: 201103 - DNA, 25 bp, E. coli
ttgaactgacgcagaccgaatgggt

SEQ ID NO: 201104 - DNA, 25 bp, E. coli
ttgaactgacgctgaccgaatgggt

SEQ ID NO: 201105 - DNA, 25 bp, E. coli
tggtgactaaactggcgctcgactg

SEQ ID NO: 201106 - DNA, 25 bp, E. coli
tggtgactaaacaggcgctcgactg

SEQ ID NO: 201107 - DNA, 25 bp, E. coli
tgaagttctgcgtcgagctgcgcga

SEQ ID NO: 201108 - DNA, 25 bp, E. coli
tgaagttctgcgacgagctgcgcga

SEQ ID NO: 201109 - DNA, 25 bp, E. coli
tccgcgcgaagatacaagatctgac

SEQ ID NO: 201110 - DNA, 25 bp, E. coli
tccgcgcgaagaaacaagatctgac

SEQ ID NO: 201111 - DNA, 25 bp, E. coli
cgctgaaagacgaagtgctgcactc

SEQ ID NO: 201112 - DNA, 25 bp, E. coli
cgctgaaagacgtagtgctgcactc

SEQ ID NO: 201113 - DNA, 25 bp, E. coli
cattgaagccggaaaagtggtgact

SEQ ID NO: 201114 - DNA, 25 bp, E. coli
cattgaagccggtaaagtggtgact

SEQ ID NO: 201115 - DNA, 25 bp, E. coli
tggaaaaacagctagcctcgatggc

SEQ ID NO: 201116 - DNA, 25 bp, E. coli
tggaaaaacagcaagcctcgatggc

SEQ ID NO: 201117 - DNA, 25 bp, E. coli
taatggtttaccgtcttagccgcga

SEQ ID NO: 201118 - DNA, 25 bp, E. coli
taatggtttaccctcttagccgcga

SEQ ID NO: 201119 - DNA, 25 bp, E. coli
gatgaagccgagctgaaatcgttgc

SEQ ID NO: 201120 - DNA, 25 bp, E. coli
gatgaagccgaggtgaaatcgttgc

SEQ ID NO: 201121 - DNA, 25 bp, E. coli
agaatacagctaacgcgctggtgct

SEQ ID NO: 201122 - DNA, 25 bp, E. coli
agaatacagctatcgcgctggtgct

SEQ ID NO: 201123 - DNA, 25 bp, E. coli
aaaatcggccagtttacgatgggtc

SEQ ID NO: 201124 - DNA, 25 bp, E. coli
aaaatcggccagattacgatgggtc

SEQ ID NO: 201125 - DNA, 25 bp, E. coli
tagccgtaccgttgatggttgcacg

SEQ ID NO: 201126 - DNA, 25 bp, E. coli
tagccgtaccgtagatggttgcacg

SEQ ID NO: 201127 - DNA, 25 bp, E. coli
tcattgaagaatacagctatcgcgc

SEQ ID NO: 201128 - DNA, 25 bp, E. coli
tcattgaagaattcagctatcgcgc

SEQ ID NO: 201129 - DNA, 25 bp, E. coli
gcgacgtttgcccaccttcattgaa

SEQ ID NO: 201130 - DNA, 25 bp, E. coli
gccaagatagccctaccgttgatgg

SEQ ID NO: 201131 - DNA, 25 bp, E. coli
gccgtaccgttgatggttgcacgct

SEQ ID NO: 201132 - DNA, 25 bp, E. coli
gccgtaccgttgttggttgcacgct

SEQ ID NO: 201133 - DNA, 25 bp, E. coli
gccaagatagccgtaccgttgatgg

SEQ ID NO: 201134 - DNA, 25 bp, E. coli
gcgacgtttgccgaccttcattgaa

SEQ ID NO: 201135 - DNA, 25 bp, E. coli
gaaattgccaagttagccgtaccgt

SEQ ID NO: 201136 - DNA, 25 bp, E. coli
gaaattgccaagatagccgtaccgt

SEQ ID NO: 201137 - DNA, 25 bp, E. coli
cgtaaaatcggccagattacgatgg

SEQ ID NO: 201138 - DNA, 25 bp, E. coli
cgtaaaatcggcgagattacgatgg

SEQ ID NO: 201139 - DNA, 25 bp, E. coli
ggccagattacgttgggtctggtca

SEQ ID NO: 201140 - DNA, 25 bp, E. coli
ggccagattacgatgggtctggtca

SEQ ID NO: 201141 - DNA, 25 bp, E. coli
gacgtttgcccagcttcattgaaga

SEQ ID NO: 201142 - DNA, 25 bp, E. coli
gacgtttgcccaccttcattgaaga

SEQ ID NO: 201143 - DNA, 25 bp, E. coli
cacagatcccggaagataaaggtaa

SEQ ID NO: 201144 - DNA, 25 bp, E. coli
cacagatcccggtagataaaggtaa

SEQ ID NO: 201145 - DNA, 25 bp, E. coli
cagttgcctctaactggtacgcaga

SEQ ID NO: 201146 - DNA, 25 bp, E. coli
cagtgatatcgggtgccagttgcct

SEQ ID NO: 201147 - DNA, 25 bp, E. coli
cagtgatatcggctgccagttgcct

SEQ ID NO: 201148 - DNA, 25 bp, E. coli
cagttgcctctatctggtacgcaga

SEQ ID NO: 201149 - DNA, 25 bp, E. coli
cattttgaacgcgtactggatggcg

SEQ ID NO: 201150 - DNA, 25 bp, E. coli
tgacgaagattttaaagcgctgccg

SEQ ID NO: 201151 - DNA, 25 bp, E. coli
tgacgaagatttaaaagcgctgccg

SEQ ID NO: 201152 - DNA, 25 bp, E. coli
tgcctgcgggatgtacactcaaatg

SEQ ID NO: 201153 - DNA, 25 bp, E. coli
tgcctgcgggatctacactcaaatg

SEQ ID NO: 201154 - DNA, 25 bp, E. coli
tctttactgtcaaaatcgctggcga

SEQ ID NO: 201155 - DNA, 25 bp, E. coli
tcggctgccgatgtcaaaaaactct

SEQ ID NO: 201156 - DNA, 25 bp, E. coli
tctttactgtcataatcgctggcga

SEQ ID NO: 201157 - DNA, 25 bp, E. coli
tcggctgccgatctcaaaaaactct

SEQ ID NO: 201158 - DNA, 25 bp, E. coli
gcgctgccggaaaaaggcggttatt

SEQ ID NO: 201159 - DNA, 25 bp, E. coli
gcgctgccggaataaggcggttatt

SEQ ID NO: 201160 - DNA, 25 bp, E. coli
gacaccttcggtcatttgctgggcg

SEQ ID NO: 201161 - DNA, 25 bp, E. coli
gaaatcgttcatatccaggtgggaa

SEQ ID NO: 201162 - DNA, 25 bp, E. coli
gacaccttcggtgatttgctgggcg

SEQ ID NO: 201163 - DNA, 25 bp, E. coli
gaaatcgttcatttccaggtgggaa

SEQ ID NO: 201164 - DNA, 25 bp, E. coli
cattttgaacgcctactggatggcg

SEQ ID NO: 201165 - DNA, 25 bp, E. coli
aactctttgattataatggtgccga

SEQ ID NO: 201166 - DNA, 25 bp, E. coli
caaggttacaatcgcacaaatacgg

SEQ ID NO: 201167 - DNA, 25 bp, E. coli
caagttatagcattaaacccgttga

SEQ ID NO: 201168 - DNA, 25 bp, E. coli
caagttatagcaataaacccgttga

SEQ ID NO: 201169 - DNA, 25 bp, E. coli
caaggttacaatggcacaaatacgg

SEQ ID NO: 201170 - DNA, 25 bp, E. coli
cacaggaggaaaggtggtgtattta

SEQ ID NO: 201171 - DNA, 25 bp, E. coli
cacaaatacggcacaggaggaaacg

SEQ ID NO: 201172 - DNA, 25 bp, E. coli
cacaaatacggctcaggaggaaacg

SEQ ID NO: 201173 - DNA, 25 bp, E. coli
cacaggaggaaacgtggtgtattta

SEQ ID NO: 201174 - DNA, 25 bp, E. coli
cagtattttgatcaattgccaaggt

SEQ ID NO: 201175 - DNA, 25 bp, E. coli
cagtattttgatgaattgccaaggt

SEQ ID NO: 201176 - DNA, 25 bp, E. coli
aactctttgattttaatggtgccga

SEQ ID NO: 201177 - DNA, 25 bp, E. coli
tggtgccgataaaaggagtcgaacc

SEQ ID NO: 201178 - DNA, 25 bp, E. coli
tgtctgcacctgcactgcctgatgt

SEQ ID NO: 201179 - DNA, 25 bp, E. coli
tgtctgcacctggactgcctgatgt

SEQ ID NO: 201180 - DNA, 25 bp, E. coli
tggtgccgataataggagtcgaacc

SEQ ID NO: 201181 - DNA, 25 bp, E. coli
gcctgatgtcagaacagtattttga

SEQ ID NO: 201182 - DNA, 25 bp, E. coli
gcctgatgtcagtacagtattttga

SEQ ID NO: 201183 - DNA, 25 bp, E. coli
gcatttttaactacttgagcaatca

SEQ ID NO: 201184 - DNA, 25 bp, E. coli
gcatttttaacttcttgagcaatca

SEQ ID NO: 201185 - DNA, 25 bp, E. coli
gagtcgaacctacgaccttcgcatt

SEQ ID NO: 201186 - DNA, 25 bp, E. coli
gagtcgaacctaggaccttcgcatt

SEQ ID NO: 201187 - DNA, 25 bp, E. coli
catgctgaagatccgccggcttgta

SEQ ID NO: 201188 - DNA, 25 bp, E. coli
catgctgaagatgcgccggcttgta

SEQ ID NO: 201189 - DNA, 25 bp, E. coli
ttattctcgacgaaccattgcaggg

SEQ ID NO: 201190 - DNA, 25 bp, E. coli
ttattctcgacgtaccattgcaggg

SEQ ID NO: 201191 - DNA, 25 bp, E. coli
ccggacggtggcgtctatcattatg

SEQ ID NO: 201192 - DNA, 25 bp, E. coli
ccggacggtggcctctatcattatg

SEQ ID NO: 201193 - DNA, 25 bp, E. coli
cctctatcattaagcgctgacaaaa

SEQ ID NO: 201194 - DNA, 25 bp, E. coli
cctctatcattatgcgctgacaaaa

SEQ ID NO: 201195 - DNA, 25 bp, E. coli
gcaccatgctgatgatgcgccggct

SEQ ID NO: 201196 - DNA, 25 bp, E. coli
gcaccatgctgaagatgcgccggct

SEQ ID NO: 201197 - DNA, 25 bp, E. coli
cgaaccattgcaggggcttgatccg

SEQ ID NO: 201198 - DNA, 25 bp, E. coli
cgaaccattgcacgggcttgatccg

SEQ ID NO: 201199 - DNA, 25 bp, E. coli
cgtgccggacggaggcctctatcat

SEQ ID NO: 201200 - DNA, 25 bp, E. coli
cgtgccggacggtggcctctatcat

SEQ ID NO: 201201 - DNA, 25 bp, E. coli
gttgcttattctggacgaaccattg

SEQ ID NO: 201202 - DNA, 25 bp, E. coli
gttgcttattctcgacgaaccattg

SEQ ID NO: 201203 - DNA, 25 bp, E. coli
ggtggcctctatcattatgcgctga

SEQ ID NO: 201204 - DNA, 25 bp, E. coli
ggtggcctctatgattatgcgctga

SEQ ID NO: 201205 - DNA, 25 bp, E. coli
ggcctctatcataatgcgctgacaa

SEQ ID NO: 201206 - DNA, 25 bp, E. coli
ggcctctatcattatgcgctgacaa

SEQ ID NO: 201207 - DNA, 25 bp, E. coli
gacggtggcctcaatcattatgcgc

SEQ ID NO: 201208 - DNA, 25 bp, E. coli
gacggtggcctctatcattatgcgc

SEQ ID NO: 201209 - DNA, 25 bp, E. coli
caatgtaatgttgtgcgacgctcac

SEQ ID NO: 201210 - DNA, 25 bp, E. coli
caatgtacaccgacatgtggagtga

SEQ ID NO: 201211 - DNA, 25 bp, E. coli
caatgtacaccgtcatgtggagtga

SEQ ID NO: 201212 - DNA, 25 bp, E. coli
caatgtaatgttctgcgacgctcac

SEQ ID NO: 201213 - DNA, 25 bp, E. coli
cactggcggaaggaacgcgtaaact

SEQ ID NO: 201214 - DNA, 25 bp, E. coli
cactggcggaagcaacgcgtaaact

SEQ ID NO: 201215 - DNA, 25 bp, E. coli
caggagaaactggatcagccgatta

SEQ ID NO: 201216 - DNA, 25 bp, E. coli
caggagaaactgcatcagccgatta

SEQ ID NO: 201217 - DNA, 25 bp, E. coli
aaaaagaacttcaggcctggcagga

SEQ ID NO: 201218 - DNA, 25 bp, E. coli
aaaaagaacttctggcctggcagga

SEQ ID NO: 201219 - DNA, 25 bp, E. coli
tacccttacgctgaagagatgctcg

SEQ ID NO: 201220 - DNA, 25 bp, E. coli
tacccttacgctcaagagatgctcg

SEQ ID NO: 201221 - DNA, 25 bp, E. coli
tattgccaacgaaccggatacccgt

SEQ ID NO: 201222 - DNA, 25 bp, E. coli
tattgccaacgatccggatacccgt

SEQ ID NO: 201223 - DNA, 25 bp, E. coli
gcatattgcgcgttggcggtaacaa

SEQ ID NO: 201224 - DNA, 25 bp, E. coli
gcattggtttcgtagcgggcaacaa

SEQ ID NO: 201225 - DNA, 25 bp, E. coli
gcgtgacaaaaaccacccaagcgtg

SEQ ID NO: 201226 - DNA, 25 bp, E. coli
gcattggtttcgaagcgggcaacaa

SEQ ID NO: 201227 - DNA, 25 bp, E. coli
gcgtgacaaaaagcacccaagcgtg

SEQ ID NO: 201228 - DNA, 25 bp, E. coli
gcatattgcgcgatggcggtaacaa

SEQ ID NO: 201229 - DNA, 25 bp, E. coli
gatctctttgatgtgctgtgcctga

SEQ ID NO: 201230 - DNA, 25 bp, E. coli
gatctctttgatctgctgtgcctga

SEQ ID NO: 201231 - DNA, 25 bp, E. coli
caacagcaatggtgaggcggcatca

SEQ ID NO: 201232 - DNA, 25 bp, E. coli
caacagcaatggagaggcggcatca

SEQ ID NO: 201233 - DNA, 25 bp, E. coli
cagaatatatcttcagggatcgcat

SEQ ID NO: 201234 - DNA, 25 bp, E. coli
catttgtaatgtccctccctggcag

SEQ ID NO: 201235 - DNA, 25 bp, E. coli
cagaatatatctacagggatcgcat

SEQ ID NO: 201236 - DNA, 25 bp, E. coli
catttgtaatgtgcctccctggcag

SEQ ID NO: 201237 - DNA, 25 bp, E. coli
taaaaaagcgacacacattgttccg

SEQ ID NO: 201238 - DNA, 25 bp, E. coli
taaaaaagcgactcacattgttccg

SEQ ID NO: 201239 - DNA, 25 bp, E. coli
tattatcacttactggcggctcata

SEQ ID NO: 201240 - DNA, 25 bp, E. coli
tattatcacttagtggcggctcata

SEQ ID NO: 201241 - DNA, 25 bp, E. coli
tattaacagcacaatcgagccttcc

SEQ ID NO: 201242 - DNA, 25 bp, E. coli
tattaacagcactatcgagccttcc

SEQ ID NO: 201243 - DNA, 25 bp, E. coli
tgagctggttaaagctgtgcacaca

SEQ ID NO: 201244 - DNA, 25 bp, E. coli
tgagctggttaatgctgtgcacaca

SEQ ID NO: 201245 - DNA, 25 bp, E. coli
gcatcgctggtcttacgcgaacacg

SEQ ID NO: 201246 - DNA, 25 bp, E. coli
gcatcgctggtcatacgcgaacacg

SEQ ID NO: 201247 - DNA, 25 bp, E. coli
gcatcaagagcagggatccgtcatt

SEQ ID NO: 201248 - DNA, 25 bp, E. coli
gcatcaagagcacggatccgtcatt

SEQ ID NO: 201249 - DNA, 25 bp, E. coli
ctggcagtttcaaccggaacccgga

SEQ ID NO: 201250 - DNA, 25 bp, E. coli
ctggcagtttcatccggaacccgga

SEQ ID NO: 201251 - DNA, 25 bp, E. coli
taagctgacttcgacggcagggagt

SEQ ID NO: 201252 - DNA, 25 bp, E. coli
taagctgacttccacggcagggagt

SEQ ID NO: 201253 - DNA, 25 bp, E. coli
aatgcggcgctggtgaacgatgcca

SEQ ID NO: 201254 - DNA, 25 bp, E. coli
aatgcggcgctgctgaacgatgcca

SEQ ID NO: 201255 - DNA, 25 bp, E. coli
cagatccagcatatggttggcggca

SEQ ID NO: 201256 - DNA, 25 bp, E. coli
cagatccagcatttggttggcggca

SEQ ID NO: 201257 - DNA, 25 bp, E. coli
catttgcgccgaacaccggatgtat

SEQ ID NO: 201258 - DNA, 25 bp, E. coli
catttgcgccgatcaccggatgtat

SEQ ID NO: 201259 - DNA, 25 bp, E. coli
tatgctgaactgtttggcggcgctc

SEQ ID NO: 201260 - DNA, 25 bp, E. coli
tatgctgaactgattggcggcgctc

SEQ ID NO: 201261 - DNA, 25 bp, E. coli
ttaagtgtgcaagtgaatgcggcgc

SEQ ID NO: 201262 - DNA, 25 bp, E. coli
ttaagtgtgcaactgaatgcggcgc

SEQ ID NO: 201263 - DNA, 25 bp, E. coli
tgttcacgtccatttgccgaaggcg

SEQ ID NO: 201264 - DNA, 25 bp, E. coli
tgttcacgtccaattgccgaaggcg

SEQ ID NO: 201265 - DNA, 25 bp, E. coli
tgaaattctctgtcgcgaacgccgt

SEQ ID NO: 201266 - DNA, 25 bp, E. coli
tgaaattctctgacgcgaacgccgt

SEQ ID NO: 201267 - DNA, 25 bp, E. coli
tcatcagtgcccgacagaaacggta

SEQ ID NO: 201268 - DNA, 25 bp, E. coli
tctggtgggcgaaatctacaaagtc

SEQ ID NO: 201269 - DNA, 25 bp, E. coli
tcatcagtgccccacagaaacggta

SEQ ID NO: 201270 - DNA, 25 bp, E. coli
tctggtgggcgatatctacaaagtc

SEQ ID NO: 201271 - DNA, 25 bp, E. coli
gctgaaagataaacaccccgctatg

SEQ ID NO: 201272 - DNA, 25 bp, E. coli
gctgaaagataatcaccccgctatg

SEQ ID NO: 201273 - DNA, 25 bp, E. coli
gacctgagcaaagcaaaacgtgtgg

SEQ ID NO: 201274 - DNA, 25 bp, E. coli
gacctgagcaaaccaaaacgtgtgg

SEQ ID NO: 201275 - DNA, 25 bp, E. coli
catcgatatggaaatgtccggctcg

SEQ ID NO: 201276 - DNA, 25 bp, E. coli
cagtgatgaacttgcttgatgtccc

SEQ ID NO: 201277 - DNA, 25 bp, E. coli
cagtgatgaactagcttgatgtccc

SEQ ID NO: 201278 - DNA, 25 bp, E. coli
catcgatatggatatgtccggctcg

SEQ ID NO: 201279 - DNA, 25 bp, E. coli
tagtttcatctggacaagaagcggg

SEQ ID NO: 201280 - DNA, 25 bp, E. coli
tatgaaacatcagaaaccgactcgc

SEQ ID NO: 201281 - DNA, 25 bp, E. coli
tagtttcatctgcacaagaagcggg

SEQ ID NO: 201282 - DNA, 25 bp, E. coli
tatgaaacatcacaaaccgactcgc

SEQ ID NO: 201283 - DNA, 25 bp, E. coli
tattgcaggagacaaccaaaggcga

SEQ ID NO: 201284 - DNA, 25 bp, E. coli
tattgcaggagagaaccaaaggcga

SEQ ID NO: 201285 - DNA, 25 bp, E. coli
ttaagtccggagttccagcaggcgc

SEQ ID NO: 201286 - DNA, 25 bp, E. coli
ttaagtccggagatccagcaggcgc

SEQ ID NO: 201287 - DNA, 25 bp, E. coli
tgttcccggacaccactctcggtaa

SEQ ID NO: 201288 - DNA, 25 bp, E. coli
tgttcccggacagcactctcggtaa

SEQ ID NO: 201289 - DNA, 25 bp, E. coli
gaagttcctttcactgacgcaccac

SEQ ID NO: 201290 - DNA, 25 bp, E. coli
gaagttcctttctctgacgcaccac

SEQ ID NO: 201291 - DNA, 25 bp, E. coli
cattattcattgctggcctggctgc

SEQ ID NO: 201292 - DNA, 25 bp, E. coli
cattattcattggtggcctggctgc

SEQ ID NO: 201293 - DNA, 25 bp, E. coli
taactttgccgggttatcaccagtg

SEQ ID NO: 201294 - DNA, 25 bp, E. coli
taactttgccggcttatcaccagtg

SEQ ID NO: 201295 - DNA, 25 bp, E. coli
gatgatctgaaaccctcacttgaag

SEQ ID NO: 201296 - DNA, 25 bp, E. coli
gatgatctgaaagcctcacttgaag

SEQ ID NO: 201297 - DNA, 25 bp, E. coli
catcgttatcgaaggcggcctggtc

SEQ ID NO: 201298 - DNA, 25 bp, E. coli
catcgttatcgatggcggcctggtc

SEQ ID NO: 201299 - DNA, 25 bp, E. coli
tacgccgtctgggtaaatgtgaaga

SEQ ID NO: 201300 - DNA, 25 bp, E. coli
tacgccgtctggctaaatgtgaaga

SEQ ID NO: 201301 - DNA, 25 bp, E. coli
tgaaaaaagtatgccgcgcagtggt

SEQ ID NO: 201302 - DNA, 25 bp, E. coli
tgaaaaaagtatcccgcgcagtggt

SEQ ID NO: 201303 - DNA, 25 bp, E. coli
tctgacgaaagaggcgctgatgctg

SEQ ID NO: 201304 - DNA, 25 bp, E. coli
tctgacgaaagacgcgctgatgctg

SEQ ID NO: 201305 - DNA, 25 bp, E. coli
ccaagcgtcggtgaggcgaattaca

SEQ ID NO: 201306 - DNA, 25 bp, E. coli
ccaagcgtcggtcaggcgaattaca

SEQ ID NO: 201307 - DNA, 25 bp, E. coli
gaagaagtggcgtacaccatcgtct

SEQ ID NO: 201308 - DNA, 25 bp, E. coli
gaagaagtggcgaacaccatcgtct

SEQ ID NO: 201309 - DNA, 25 bp, E. coli
cgatgagttatgaggatttcaccca

SEQ ID NO: 201310 - DNA, 25 bp, E. coli
cgatgagttatgtggatttcaccca

SEQ ID NO: 201311 - DNA, 25 bp, E. coli
cattgtgcgaacagatagagcgcca

SEQ ID NO: 201312 - DNA, 25 bp, E. coli
cggtcgcaccgggaatgattgaatc

SEQ ID NO: 201313 - DNA, 25 bp, E. coli
cggtcgcaccggcaatgattgaatc

SEQ ID NO: 201314 - DNA, 25 bp, E. coli
cattgtgcgaactgatagagcgcca

SEQ ID NO: 201315 - DNA, 25 bp, E. coli
taacgcgggcatcgttaaagacagc

SEQ ID NO: 201316 - DNA, 25 bp, E. coli
taacgttgcctctattgcagcgctg

SEQ ID NO: 201317 - DNA, 25 bp, E. coli
taacgcgggcatggttaaagacagc

SEQ ID NO: 201318 - DNA, 25 bp, E. coli
taacgttgcctcaattgcagcgctg

SEQ ID NO: 201319 - DNA, 25 bp, E. coli
aattagtagcgcaggcaaattcgcg

SEQ ID NO: 201320 - DNA, 25 bp, E. coli
aattagtagcgctggcaaattcgcg

SEQ ID NO: 201321 - DNA, 25 bp, E. coli
cagaggctggatttcgccatcagga

SEQ ID NO: 201322 - DNA, 25 bp, E. coli
cagaggctggatatcgccatcagga

SEQ ID NO: 201323 - DNA, 25 bp, E. coli
cagttccaggttaagattcagaggc

SEQ ID NO: 201324 - DNA, 25 bp, E. coli
cagttccaggtttagattcagaggc

SEQ ID NO: 201325 - DNA, 25 bp, E. coli
tagcgatgaaatcgcagataacctc

SEQ ID NO: 201326 - DNA, 25 bp, E. coli
tagcgatgaaatggcagataacctc

SEQ ID NO: 201327 - DNA, 25 bp, E. coli
tttttattggccgaccgctgtacgg

SEQ ID NO: 201328 - DNA, 25 bp, E. coli
ttttgcaggaaaatggaggccagat

SEQ ID NO: 201329 - DNA, 25 bp, E. coli
ttttgcaggaaattggaggccagat

SEQ ID NO: 201330 - DNA, 25 bp, E. coli
tttttattggcccaccgctgtacgg

SEQ ID NO: 201331 - DNA, 25 bp, E. coli
tcgcgaataaagcagcagaagctgg

SEQ ID NO: 201332 - DNA, 25 bp, E. coli
tcgcgaataaaggagcagaagctgg

SEQ ID NO: 201333 - DNA, 25 bp, E. coli
tcttgatccggctggcccattggtt

SEQ ID NO: 201334 - DNA, 25 bp, E. coli
tcttgatccggcaggcccattggtt

SEQ ID NO: 201335 - DNA, 25 bp, E. coli
gctggctgttggtttcgcgcataca

SEQ ID NO: 201336 - DNA, 25 bp, E. coli
gctggctgttggattcgcgcataca

SEQ ID NO: 201337 - DNA, 25 bp, E. coli
ggagtcagcggtccactatgtgatt

SEQ ID NO: 201338 - DNA, 25 bp, E. coli
ggagtcagcggtgcactatgtgatt

SEQ ID NO: 201339 - DNA, 25 bp, E. coli
ggctcaggcctttcgtgtaattgga

SEQ ID NO: 201340 - DNA, 25 bp, E. coli
ggctcaggccttacgtgtaattgga

SEQ ID NO: 201341 - DNA, 25 bp, E. coli
aaccggagagcacgagatgaagcaa

SEQ ID NO: 201342 - DNA, 25 bp, E. coli
aaccggagagcaggagatgaagcaa

SEQ ID NO: 201343 - DNA, 25 bp, E. coli
agagcaggagatcaagcaaaccttt

SEQ ID NO: 201344 - DNA, 25 bp, E. coli
agagcaggagatgaagcaaaccttt

SEQ ID NO: 201345 - DNA, 25 bp, E. coli
aaaatggaaccggagagcaggagat

SEQ ID NO: 201346 - DNA, 25 bp, E. coli
aaaatggaaccgcagagcaggagat

SEQ ID NO: 201347 - DNA, 25 bp, E. coli
tgctgcggcggctgaaaaatggaac

SEQ ID NO: 201348 - DNA, 25 bp, E. coli
tgctgcggcggcagaaaaatggaac

SEQ ID NO: 201349 - DNA, 25 bp, E. coli
ccggagagcaggagatgaagcaaac

SEQ ID NO: 201350 - DNA, 25 bp, E. coli
ccggagagcaggtgatgaagcaaac

SEQ ID NO: 201351 - DNA, 25 bp, E. coli
gctgaaaaatggtaccggagagcag

SEQ ID NO: 201352 - DNA, 25 bp, E. coli
gctgcggcggctcaaaaatggaacc

SEQ ID NO: 201353 - DNA, 25 bp, E. coli
gctgcggcggctgaaaaatggaacc

SEQ ID NO: 201354 - DNA, 25 bp, E. coli
gctgaaaaatggaaccggagagcag

SEQ ID NO: 201355 - DNA, 25 bp, E. coli
ctgcggcggctgaaaaatggaaccg

SEQ ID NO: 201356 - DNA, 25 bp, E. coli
cggagagcaggagatgaagcaaacc

SEQ ID NO: 201357 - DNA, 25 bp, E. coli
ctgcggcggctgtaaaatggaaccg

SEQ ID NO: 201358 - DNA, 25 bp, E. coli
ctgaaaaatggaaccggagagcagg

SEQ ID NO: 201359 - DNA, 25 bp, E. coli
cggagagcaggacatgaagcaaacc

SEQ ID NO: 201360 - DNA, 25 bp, E. coli
ctgaaaaatggatccggagagcagg

SEQ ID NO: 201361 - DNA, 25 bp, E. coli
gagagcaggagatgaagcaaacctt

SEQ ID NO: 201362 - DNA, 25 bp, E. coli
gagagcaggagaagaagcaaacctt

SEQ ID NO: 201363 - DNA, 25 bp, E. coli
taaattactctaccaggcaaagctg

SEQ ID NO: 201364 - DNA, 25 bp, E. coli
taaattactctagcaggcaaagctg

SEQ ID NO: 201365 - DNA, 25 bp, E. coli
tttgaaatagcagcgaggcaacccg

SEQ ID NO: 201366 - DNA, 25 bp, E. coli
tttgaaatagcaccgaggcaacccg

SEQ ID NO: 201367 - DNA, 25 bp, E. coli
ttcgtgctgatccacaaaaccggga

SEQ ID NO: 201368 - DNA, 25 bp, E. coli
ttcgtgctgatcgacaaaaccggga

SEQ ID NO: 201369 - DNA, 25 bp, E. coli
tgtgaatcgctgcatcagtgctgcc

SEQ ID NO: 201370 - DNA, 25 bp, E. coli
tgtgaatcgctggatcagtgctgcc

SEQ ID NO: 201371 - DNA, 25 bp, E. coli
tctgtacggtatttctgaagcggca

SEQ ID NO: 201372 - DNA, 25 bp, E. coli
tctgtacggtatatctgaagcggca

SEQ ID NO: 201373 - DNA, 25 bp, E. coli
cctgcattatgctcgaaccgggaac

SEQ ID NO: 201374 - DNA, 25 bp, E. coli
cctgcattatgcacgaaccgggaac

SEQ ID NO: 201375 - DNA, 25 bp, E. coli
gaattacgttttcgtgagccaccgc

SEQ ID NO: 201376 - DNA, 25 bp, E. coli
gaattacgttttggtgagccaccgc

SEQ ID NO: 201377 - DNA, 25 bp, E. coli
ccctgaacctgatacgctgggtgat

SEQ ID NO: 201378 - DNA, 25 bp, E. coli
ccctgaacctgaaacgctgggtgat

SEQ ID NO: 201379 - DNA, 25 bp, E. coli
gatttattcatactggcaaaccgct

SEQ ID NO: 201380 - DNA, 25 bp, E. coli
gatttattcatagtggcaaaccgct

SEQ ID NO: 201381 - DNA, 25 bp, E. coli
taacggaagatcaacgcctgaaggt

SEQ ID NO: 201382 - DNA, 25 bp, E. coli
taacggaagatctacgcctgaaggt

SEQ ID NO: 201383 - DNA, 25 bp, E. coli
tcaaatcgacgtactggacggcgct

SEQ ID NO: 201384 - DNA, 25 bp, E. coli
tcaaatcgacgttctggacggcgct

SEQ ID NO: 201385 - DNA, 25 bp, E. coli
cagacgctggtcagttattccgaca

SEQ ID NO: 201386 - DNA, 25 bp, E. coli
cagacgctggtctgttattccgaca

SEQ ID NO: 201387 - DNA, 25 bp, E. coli
cagaaggtcgtctgatggccagcct

SEQ ID NO: 201388 - DNA, 25 bp, E. coli
cagaaggtcgtcagatggccagcct

SEQ ID NO: 201389 - DNA, 25 bp, E. coli
aaagccagcgaggagtattcctacg

SEQ ID NO: 201390 - DNA, 25 bp, E. coli
aaagccagcgagcagtattcctacg

SEQ ID NO: 201391 - DNA, 25 bp, E. coli
tatctacggtgacaaagcggctgcc

SEQ ID NO: 201392 - DNA, 25 bp, E. coli
tatctacggtgagaaagcggctgcc

SEQ ID NO: 201393 - DNA, 25 bp, E. coli
tgtttccggagatgacgtgactcag

SEQ ID NO: 201394 - DNA, 25 bp, E. coli
tgtttccggagaagacgtgactcag

SEQ ID NO: 201395 - DNA, 25 bp, E. coli
tgaaatatcagagacgaccgaaggt

SEQ ID NO: 201396 - DNA, 25 bp, E. coli
tgaaatatcagacacgaccgaaggt

SEQ ID NO: 201397 - DNA, 25 bp, E. coli
tgagaaagagcacctgaaagccagc

SEQ ID NO: 201398 - DNA, 25 bp, E. coli
tgagaaagagcagctgaaagccagc

SEQ ID NO: 201399 - DNA, 25 bp, E. coli
tcgaccggtaaggatatggagcgcc

SEQ ID NO: 201400 - DNA, 25 bp, E. coli
tcgaccggtaagcatatggagcgcc

SEQ ID NO: 201401 - DNA, 25 bp, E. coli
tctgagtgccgttcttgccgcaagg

SEQ ID NO: 201402 - DNA, 25 bp, E. coli
tctgagtgccgtacttgccgcaagg

SEQ ID NO: 201403 - DNA, 25 bp, E. coli
gaacattaatgtccaccgggagcgc

SEQ ID NO: 201404 - DNA, 25 bp, E. coli
gaacattaatgtgcaccgggagcgc

SEQ ID NO: 201405 - DNA, 25 bp, E. coli
ggtgtctcctgccatcaacgataag

SEQ ID NO: 201406 - DNA, 25 bp, E. coli
ggtgtctcctgcgatcaacgataag

SEQ ID NO: 201407 - DNA, 25 bp, E. coli
cagctggttgcggacatgatcaaaa

SEQ ID NO: 201408 - DNA, 25 bp, E. coli
cagctggttgcgcacatgatcaaaa

SEQ ID NO: 201409 - DNA, 25 bp, E. coli
tattacctttgcgatcgcgggcgtg

SEQ ID NO: 201410 - DNA, 25 bp, E. coli
tattacctttgccatcgcgggcgtg

SEQ ID NO: 201411 - DNA, 25 bp, E. coli
tgatcaacttgcaggtaacggcggc

SEQ ID NO: 201412 - DNA, 25 bp, E. coli
tgatcaacttgctggtaacggcggc

SEQ ID NO: 201413 - DNA, 25 bp, E. coli
tgacgctgttctacggtggctggca

SEQ ID NO: 201414 - DNA, 25 bp, E. coli
tgacgctgttcttcggtggctggca

SEQ ID NO: 201415 - DNA, 25 bp, E. coli
tgcgggctggtctagtaacaacaaa

SEQ ID NO: 201416 - DNA, 25 bp, E. coli
tgcgggctggtcaagtaacaacaaa

SEQ ID NO: 201417 - DNA, 25 bp, E. coli
gcgcagaccctgagctacgaagtgt

SEQ ID NO: 201418 - DNA, 25 bp, E. coli
gcgcagaccctgtgctacgaagtgt

SEQ ID NO: 201419 - DNA, 25 bp, E. coli
cattcatgagctatggcgaacgtcg

SEQ ID NO: 201420 - DNA, 25 bp, E. coli
cattcatgagctttggcgaacgtcg

SEQ ID NO: 201421 - DNA, 25 bp, E. coli
ggatcgcgtcatctttaccctggca

SEQ ID NO: 201422 - DNA, 25 bp, E. coli
ggatcgcgtcatgtttaccctggca

SEQ ID NO: 201423 - DNA, 25 bp, E. coli
ggcgcaggccggatcattcaacatg

SEQ ID NO: 201424 - DNA, 25 bp, E. coli
ggcgcaggccggttcattcaacatg

SEQ ID NO: 201425 - DNA, 25 bp, E. coli
taacggcggctgtcattctctggca

SEQ ID NO: 201426 - DNA, 25 bp, E. coli
taacggcggctgacattctctggca

SEQ ID NO: 201427 - DNA, 25 bp, E. coli
gatgattgccttaacctcgctgctg

SEQ ID NO: 201428 - DNA, 25 bp, E. coli
gatgattgcctttacctcgctgctg

SEQ ID NO: 201429 - DNA, 25 bp, E. coli
cacgtttacggaggactgggagcat

SEQ ID NO: 201430 - DNA, 25 bp, E. coli
cacgtttacggacgactgggagcat

SEQ ID NO: 201431 - DNA, 25 bp, E. coli
agcaatttttgaggctcccggacga

SEQ ID NO: 201432 - DNA, 25 bp, E. coli
agcaatttttgacgctcccggacga

SEQ ID NO: 201433 - DNA, 25 bp, E. coli
tatgtgaagtccgtaatacccgacg

SEQ ID NO: 201434 - DNA, 25 bp, E. coli
tagcatttctggagacacaacggcg

SEQ ID NO: 201435 - DNA, 25 bp, E. coli
tatgtgaagtccctaatacccgacg

SEQ ID NO: 201436 - DNA, 25 bp, E. coli
tagcatttctggtgacacaacggcg

SEQ ID NO: 201437 - DNA, 25 bp, E. coli
tatttcaacgatgccctgcgtagcg

SEQ ID NO: 201438 - DNA, 25 bp, E. coli
tatttcaacgatcccctgcgtagcg

SEQ ID NO: 201439 - DNA, 25 bp, E. coli
tgatggaaaatcaacggcgcgatcc

SEQ ID NO: 201440 - DNA, 25 bp, E. coli
tgaagagagcaagctgatccaggcc

SEQ ID NO: 201441 - DNA, 25 bp, E. coli
tgatggaaaatctacggcgcgatcc

SEQ ID NO: 201442 - DNA, 25 bp, E. coli
tgaagagagcaacctgatccaggcc

SEQ ID NO: 201443 - DNA, 25 bp, E. coli
ctatcacgatgtcgaaaggcgcagg

SEQ ID NO: 201444 - DNA, 25 bp, E. coli
ctatcacgatgtggaaaggcgcagg

SEQ ID NO: 201445 - DNA, 25 bp, E. coli
gattaccaacaaatacgcgagcggc

SEQ ID NO: 201446 - DNA, 25 bp, E. coli
gattaccaacaattacgcgagcggc

SEQ ID NO: 201447 - DNA, 25 bp, E. coli
gggaaaattgacaaccaggcgctga

SEQ ID NO: 201448 - DNA, 25 bp, E. coli
gggaaaattgactaccaggcgctga

SEQ ID NO: 201449 - DNA, 25 bp, E. coli
ggcatacgttgttcctcagggcgag

SEQ ID NO: 201450 - DNA, 25 bp, E. coli
ggcatacgttgtacctcagggcgag

SEQ ID NO: 201451 - DNA, 25 bp, E. coli
caacctgctgttgttcatgaccgaa

SEQ ID NO: 201452 - DNA, 25 bp, E. coli
caatcgggccatagaacggaatacc

SEQ ID NO: 201453 - DNA, 25 bp, E. coli
caatcgggccattgaacggaatacc

SEQ ID NO: 201454 - DNA, 25 bp, E. coli
caacctgctgttcttcatgaccgaa

SEQ ID NO: 201455 - DNA, 25 bp, E. coli
catcatgccggtttccagagtcacg

SEQ ID NO: 201456 - DNA, 25 bp, E. coli
catcatgccggtatccagagtcacg

SEQ ID NO: 201457 - DNA, 25 bp, E. coli
tttgaagtccatttcgcccaggtga

SEQ ID NO: 201458 - DNA, 25 bp, E. coli
tttgaagtccatatcgcccaggtga

SEQ ID NO: 201459 - DNA, 25 bp, E. coli
ttcatcaagaacgtgcgcgtcacga

SEQ ID NO: 201460 - DNA, 25 bp, E. coli
tttaatgctcagacggatacggccc

SEQ ID NO: 201461 - DNA, 25 bp, E. coli
tttaatgctcagtcggatacggccc

SEQ ID NO: 201462 - DNA, 25 bp, E. coli
ttcatcaagaacctgcgcgtcacga

SEQ ID NO: 201463 - DNA, 25 bp, E. coli
tgcagacgcgcagctttagcctggt

SEQ ID NO: 201464 - DNA, 25 bp, E. coli
tgcagacgcgcacctttagcctggt

SEQ ID NO: 201465 - DNA, 25 bp, E. coli
tccagggtttcgacttcagcaagca

SEQ ID NO: 201466 - DNA, 25 bp, E. coli
tccagggtttcgtcttcagcaagca

SEQ ID NO: 201467 - DNA, 25 bp, E. coli
gaaggtatcggttcgttcgcccatc

SEQ ID NO: 201468 - DNA, 25 bp, E. coli
gaaggtatcggtacgttcgcccatc

SEQ ID NO: 201469 - DNA, 25 bp, E. coli
cgatttgagagatgtggaccagacc

SEQ ID NO: 201470 - DNA, 25 bp, E. coli
cgatttgagagaagtggaccagacc

SEQ ID NO: 201471 - DNA, 25 bp, E. coli
gaccaatttcacgacgcttcggaga

SEQ ID NO: 201472 - DNA, 25 bp, E. coli
gaccaatttcaccacgcttcggaga

SEQ ID NO: 201473 - DNA, 25 bp, E. coli
aagattgaaggctagctggccgcca

SEQ ID NO: 201474 - DNA, 25 bp, E. coli
aagattgaaggcaagctggccgcca

SEQ ID NO: 201475 - DNA, 25 bp, E. coli
tacgccctggacagcgaagagaacg

SEQ ID NO: 201476 - DNA, 25 bp, E. coli
aggccaccgagcataagatcaccga

SEQ ID NO: 201477 - DNA, 25 bp, E. coli
aggccaccgagcttaagatcaccga

SEQ ID NO: 201478 - DNA, 25 bp, E. coli
tatcgcctcggcatgaagctggtcg

SEQ ID NO: 201479 - DNA, 25 bp, E. coli
tacgccctggactgcgaagagaacg

SEQ ID NO: 201480 - DNA, 25 bp, E. coli
tatcgcctcggcttgaagctggtcg

SEQ ID NO: 201481 - DNA, 25 bp, E. coli
tattcggcagaacgcaaaaggctgg

SEQ ID NO: 201482 - DNA, 25 bp, E. coli
tattcggcagaaggcaaaaggctgg

SEQ ID NO: 201483 - DNA, 25 bp, E. coli
tgctaaaaaccctgcagcttcacgg

SEQ ID NO: 201484 - DNA, 25 bp, E. coli
tgctaaaaacccagcagcttcacgg

SEQ ID NO: 201485 - DNA, 25 bp, E. coli
tcgcgtctcgcgtagccttaatgag

SEQ ID NO: 201486 - DNA, 25 bp, E. coli
tcgcgtctcgcgaagccttaatgag

SEQ ID NO: 201487 - DNA, 25 bp, E. coli
tcgtgggctccatcgatattcggca

SEQ ID NO: 201488 - DNA, 25 bp, E. coli
tcgtgggctccaacgatattcggca

SEQ ID NO: 201489 - DNA, 25 bp, E. coli
gaacgtgcgttggagatcctcgacc

SEQ ID NO: 201490 - DNA, 25 bp, E. coli
gaacgtgcgttgcagatcctcgacc

SEQ ID NO: 201491 - DNA, 25 bp, E. coli
gacgacgcggaggtggctaatttcc

SEQ ID NO: 201492 - DNA, 25 bp, E. coli
gacgacgcggagctggctaatttcc

SEQ ID NO: 201493 - DNA, 25 bp, E. coli
ggctatatcgatcagaacccggaga

SEQ ID NO: 201494 - DNA, 25 bp, E. coli
ggctatatcgatgagaacccggaga

SEQ ID NO: 201495 - DNA, 25 bp, E. coli
caagtacttcgggaagcgacacggt

SEQ ID NO: 201496 - DNA, 25 bp, E. coli
caattggcgaagaaatgcagcaccg

SEQ ID NO: 201497 - DNA, 25 bp, E. coli
aatacatcttgcaggtgacacagcc

SEQ ID NO: 201498 - DNA, 25 bp, E. coli
aatacatcttgctggtgacacagcc

SEQ ID NO: 201499 - DNA, 25 bp, E. coli
caagtacttcggcaagcgacacggt

SEQ ID NO: 201500 - DNA, 25 bp, E. coli
aaggttcgcccgatgtacagcctga

SEQ ID NO: 201501 - DNA, 25 bp, E. coli
caattggcgaagtaatgcagcaccg

SEQ ID NO: 201502 - DNA, 25 bp, E. coli
aaggttcgcccgttgtacagcctga

SEQ ID NO: 201503 - DNA, 25 bp, E. coli
caactggatggcagagcaactgagc

SEQ ID NO: 201504 - DNA, 25 bp, E. coli
caactggatggctgagcaactgagc

SEQ ID NO: 201505 - DNA, 25 bp, E. coli
tatcgatgagcagggcaaggttcgc

SEQ ID NO: 201506 - DNA, 25 bp, E. coli
tatcgatgagcacggcaaggttcgc

SEQ ID NO: 201507 - DNA, 25 bp, E. coli
tggtgcaagccaaaaacggagaggt

SEQ ID NO: 201508 - DNA, 25 bp, E. coli
tggtgcaagccataaacggagaggt

SEQ ID NO: 201509 - DNA, 25 bp, E. coli
tcgacttccgagtaatggtgcaagc

SEQ ID NO: 201510 - DNA, 25 bp, E. coli
tcaggaaaatcgagcaggttaaggc

SEQ ID NO: 201511 - DNA, 25 bp, E. coli
tgcggcaatcaaggagagctatatc

SEQ ID NO: 201512 - DNA, 25 bp, E. coli
tcaggaaaatcgtgcaggttaaggc

SEQ ID NO: 201513 - DNA, 25 bp, E. coli
tgcggcaatcaacgagagctatatc

SEQ ID NO: 201514 - DNA, 25 bp, E. coli
tcgacttccgagaaatggtgcaagc

SEQ ID NO: 201515 - DNA, 25 bp, E. coli
tcaaagctgaaaggtacgatcggca

SEQ ID NO: 201516 - DNA, 25 bp, E. coli
tcaaagctgaaacgtacgatcggca

SEQ ID NO: 201517 - DNA, 25 bp, E. coli
caaaacctcatgtatgctacgcaga

SEQ ID NO: 201518 - DNA, 25 bp, E. coli
caaaacctcatgaatgctacgcaga

SEQ ID NO: 201519 - DNA, 25 bp, E. coli
tacacaggaaagacatcgcgaccgg

SEQ ID NO: 201520 - DNA, 25 bp, E. coli
taaacaattggttacgtttacacag

SEQ ID NO: 201521 - DNA, 25 bp, E. coli
taaacaattggtaacgtttacacag

SEQ ID NO: 201522 - DNA, 25 bp, E. coli
tacgcagaagttatcaagtacctcg

SEQ ID NO: 201523 - DNA, 25 bp, E. coli
tacacaggaaagtcatcgcgaccgg

SEQ ID NO: 201524 - DNA, 25 bp, E. coli
actgtttcggatttctgacactgcg

SEQ ID NO: 201525 - DNA, 25 bp, E. coli
actgtttcggatatctgacactgcg

SEQ ID NO: 201526 - DNA, 25 bp, E. coli
tatcgccaggcgagactgtttcgga

SEQ ID NO: 201527 - DNA, 25 bp, E. coli
tacgcagaagttttcaagtacctcg

SEQ ID NO: 201528 - DNA, 25 bp, E. coli
tatcgccaggcgtgactgtttcgga

SEQ ID NO: 201529 - DNA, 25 bp, E. coli
tcgcgaccggcaataagagggatat

SEQ ID NO: 201530 - DNA, 25 bp, E. coli
tcgcgaccggcattaagagggatat

SEQ ID NO: 201531 - DNA, 25 bp, E. coli
tctgacactgcgatgatatcgcccg

SEQ ID NO: 201532 - DNA, 25 bp, E. coli
tctgacactgcgttgatatcgcccg

SEQ ID NO: 201533 - DNA, 25 bp, E. coli
ccgccgacaagagggttatcgccag

SEQ ID NO: 201534 - DNA, 25 bp, E. coli
ccgccgacaagacggttatcgccag

SEQ ID NO: 201535 - DNA, 25 bp, E. coli
gtacctcgtagcgtatatacttctt

SEQ ID NO: 201536 - DNA, 25 bp, E. coli
gatatcacgacggaacgtcagcgca

SEQ ID NO: 201537 - DNA, 25 bp, E. coli
gtacctcgtagcctatatacttctt

SEQ ID NO: 201538 - DNA, 25 bp, E. coli
gatatcacgacgcaacgtcagcgca

SEQ ID NO: 201539 - DNA, 25 bp, E. coli
cagaatttccagtataatagccgcc

SEQ ID NO: 201540 - DNA, 25 bp, E. coli
catccgccggcacctaagttaaggg

SEQ ID NO: 201541 - DNA, 25 bp, E. coli
caggctcttacgctgcggcagaatt

SEQ ID NO: 201542 - DNA, 25 bp, E. coli
caggctcttacggtgcggcagaatt

SEQ ID NO: 201543 - DNA, 25 bp, E. coli
cagaatttccagaataatagccgcc

SEQ ID NO: 201544 - DNA, 25 bp, E. coli
catccgccggcagctaagttaaggg

SEQ ID NO: 201545 - DNA, 25 bp, E. coli
taaagtggtaaccaggcgttccagc

SEQ ID NO: 201546 - DNA, 25 bp, E. coli
taaagtggtaacgaggcgttccagc

SEQ ID NO: 201547 - DNA, 25 bp, E. coli
gagttcgggcaagacctttatagca

SEQ ID NO: 201548 - DNA, 25 bp, E. coli
gagttcgggcaacacctttatagca

SEQ ID NO: 201549 - DNA, 25 bp, E. coli
ttatagcaaactcgcgtagagtctg

SEQ ID NO: 201550 - DNA, 25 bp, E. coli
ttatagcaaactggcgtagagtctg

SEQ ID NO: 201551 - DNA, 25 bp, E. coli
ccgatggcggaaggacaaattttgt

SEQ ID NO: 201552 - DNA, 25 bp, E. coli
ccgatggcggaacgacaaattttgt

SEQ ID NO: 201553 - DNA, 25 bp, E. coli
cttaatgcgatttgccgatggcgga

SEQ ID NO: 201554 - DNA, 25 bp, E. coli
cttaatgcgattagccgatggcgga

SEQ ID NO: 201555 - DNA, 25 bp, E. coli
gttgtgacatacagctaacgctgcg

SEQ ID NO: 201556 - DNA, 25 bp, E. coli
gatttcaggccccatataaagtggt

SEQ ID NO: 201557 - DNA, 25 bp, E. coli
gatttcaggcccgatataaagtggt

SEQ ID NO: 201558 - DNA, 25 bp, E. coli
gttgtgacatactgctaacgctgcg

SEQ ID NO: 201559 - DNA, 25 bp, E. coli
taacgctgcgacatggtcacctgcg

SEQ ID NO: 201560 - DNA, 25 bp, E. coli
taacgctgcgacttggtcacctgcg

SEQ ID NO: 201561 - DNA, 25 bp, E. coli
caaggacgacgggttaagtgatagc

SEQ ID NO: 201562 - DNA, 25 bp, E. coli
caaggacgacggcttaagtgatagc

SEQ ID NO: 201563 - DNA, 25 bp, E. coli
tactgggatcggttatccctcacca

SEQ ID NO: 201564 - DNA, 25 bp, E. coli
tactgattcacgtactgggatcgga

SEQ ID NO: 201565 - DNA, 25 bp, E. coli
tactgattcacgaactgggatcgga

SEQ ID NO: 201566 - DNA, 25 bp, E. coli
tactgggatcggatatccctcacca

SEQ ID NO: 201567 - DNA, 25 bp, E. coli
tatccctcaccataaccgaaccgtt

SEQ ID NO: 201568 - DNA, 25 bp, E. coli
tatccctcaccaaaaccgaaccgtt

SEQ ID NO: 201569 - DNA, 25 bp, E. coli
tgactgtactgattcacgtactggg

SEQ ID NO: 201570 - DNA, 25 bp, E. coli
tgactgtactgaatcacgtactggg

SEQ ID NO: 201571 - DNA, 25 bp, E. coli
gcgctggccgcgtcgagcgagcacg

SEQ ID NO: 201572 - DNA, 25 bp, E. coli
gcgctggccgcgacgagcgagcacg

SEQ ID NO: 201573 - DNA, 25 bp, E. coli
cggtcatcgcgatagcaaaagctaa

SEQ ID NO: 201574 - DNA, 25 bp, E. coli
cggtcatcgcgaaagcaaaagctaa

SEQ ID NO: 201575 - DNA, 25 bp, E. coli
gattcacgtactgggatcggatatc

SEQ ID NO: 201576 - DNA, 25 bp, E. coli
gattcacgtactcggatcggatatc

SEQ ID NO: 201577 - DNA, 25 bp, E. coli
gacgacggcttaagtgatagctgtc

SEQ ID NO: 201578 - DNA, 25 bp, E. coli
gagcacgcgcgcgagtttatggttg

SEQ ID NO: 201579 - DNA, 25 bp, E. coli
gagcacgcgcgccagtttatggttg

SEQ ID NO: 201580 - DNA, 25 bp, E. coli
gatcggatatccctcaccataaccg

SEQ ID NO: 201581 - DNA, 25 bp, E. coli
gatcggatatccgtcaccataaccg

SEQ ID NO: 201582 - DNA, 25 bp, E. coli
gacgacggcttatgtgatagctgtc

SEQ ID NO: 201583 - DNA, 25 bp, E. coli
aatgcgccgctgacaaaaaatgact

SEQ ID NO: 201584 - DNA, 25 bp, E. coli
caatgcgccgctctcaaaaaatgac

SEQ ID NO: 201585 - DNA, 25 bp, E. coli
caagcctctcatactcttgtcattt

SEQ ID NO: 201586 - DNA, 25 bp, E. coli
caatgcgccgctgtcaaaaaatgac

SEQ ID NO: 201587 - DNA, 25 bp, E. coli
caagcctctcattctcttgtcattt

SEQ ID NO: 201588 - DNA, 25 bp, E. coli
aatgcgccgctgtcaaaaaatgact

SEQ ID NO: 201589 - DNA, 25 bp, E. coli
cacaatgcgccggtgtcaaaaaatg

SEQ ID NO: 201590 - DNA, 25 bp, E. coli
cacaatgcgccgctgtcaaaaaatg

SEQ ID NO: 201591 - DNA, 25 bp, E. coli
atttaggcacaatgcgccgctgtca

SEQ ID NO: 201592 - DNA, 25 bp, E. coli
atttaggcacaaagcgccgctgtca

SEQ ID NO: 201593 - DNA, 25 bp, E. coli
agcctctcattcacttgtcatttcc

SEQ ID NO: 201594 - DNA, 25 bp, E. coli
agcctctcattctcttgtcatttcc

SEQ ID NO: 201595 - DNA, 25 bp, E. coli
tttaggcacaatccgccgctgtcaa

SEQ ID NO: 201596 - DNA, 25 bp, E. coli
tttaggcacaatgcgccgctgtcaa

SEQ ID NO: 201597 - DNA, 25 bp, E. coli
tcttgtcatttcccccccatttagg

SEQ ID NO: 201598 - DNA, 25 bp, E. coli
tcttgtcatttcgcccccatttagg

SEQ ID NO: 201599 - DNA, 25 bp, E. coli
tgcgccgctgtcaaaaaatgactaa

SEQ ID NO: 201600 - DNA, 25 bp, E. coli
tgcgccgctgtctaaaaatgactaa

SEQ ID NO: 201601 - DNA, 25 bp, E. coli
cccatttaggcagaatgcgccgctg

SEQ ID NO: 201602 - DNA, 25 bp, E. coli
cccatttaggcacaatgcgccgctg

SEQ ID NO: 201603 - DNA, 25 bp, E. coli
catttaggcacaatgcgccgctgtc

SEQ ID NO: 201604 - DNA, 25 bp, E. coli
catttaggcacattgcgccgctgtc

SEQ ID NO: 201605 - DNA, 25 bp, E. coli
catcagggatcaacgcggatgcagc

SEQ ID NO: 201606 - DNA, 25 bp, E. coli
catcagggatcatcgcggatgcagc

SEQ ID NO: 201607 - DNA, 25 bp, E. coli
tatctacctgcatgtgcctgcggcg

SEQ ID NO: 201608 - DNA, 25 bp, E. coli
tatcagcagggatatagctaccgca

SEQ ID NO: 201609 - DNA, 25 bp, E. coli
tatctacctgcaagtgcctgcggcg

SEQ ID NO: 201610 - DNA, 25 bp, E. coli
tatcagcagggaaatagctaccgca

SEQ ID NO: 201611 - DNA, 25 bp, E. coli
tttataccgtgggtggcaattgcca

SEQ ID NO: 201612 - DNA, 25 bp, E. coli
tttataccgtggctggcaattgcca

SEQ ID NO: 201613 - DNA, 25 bp, E. coli
tgaaaatggccatcctggcggtggc

SEQ ID NO: 201614 - DNA, 25 bp, E. coli
tgaactgatactcaaaagaggccgt

SEQ ID NO: 201615 - DNA, 25 bp, E. coli
tgaaaatggccaacctggcggtggc

SEQ ID NO: 201616 - DNA, 25 bp, E. coli
tgaactgatactgaaaagaggccgt

SEQ ID NO: 201617 - DNA, 25 bp, E. coli
tcccaccacggcagtatcaaatctg

SEQ ID NO: 201618 - DNA, 25 bp, E. coli
tcccaccacggctgtatcaaatctg

SEQ ID NO: 201619 - DNA, 25 bp, E. coli
ccgtccgtgggtgagtgaactgata

SEQ ID NO: 201620 - DNA, 25 bp, E. coli
ccgtccgtgggtcagtgaactgata

SEQ ID NO: 201621 - DNA, 25 bp, E. coli
tcaaatctgtgggtggtttataccg

SEQ ID NO: 201622 - DNA, 25 bp, E. coli
tcaaatctgtggctggtttataccg

SEQ ID NO: 201623 - DNA, 25 bp, E. coli
gatgcagcaaagtatcgatccggcg

SEQ ID NO: 201624 - DNA, 25 bp, E. coli
gatgcagcaaagaatcgatccggcg

SEQ ID NO: 201625 - DNA, 25 bp, E. coli
gatgcacgtctgacttctgaactgg

SEQ ID NO: 201626 - DNA, 25 bp, E. coli
gatgcacgtctgtcttctgaactgg

SEQ ID NO: 201627 - DNA, 25 bp, E. coli
aattaccctggaaatgagcgtgacg

SEQ ID NO: 201628 - DNA, 25 bp, E. coli
aattaccctggatatgagcgtgacg

SEQ ID NO: 201629 - DNA, 25 bp, E. coli
agatacggcgcgatgatacgcgtcg

SEQ ID NO: 201630 - DNA, 25 bp, E. coli
agatacggcgcgttgatacgcgtcg

SEQ ID NO: 201631 - DNA, 25 bp, E. coli
tagcaaatagtgctcgaaattaccc

SEQ ID NO: 201632 - DNA, 25 bp, E. coli
tagcaaatagtggtcgaaattaccc

SEQ ID NO: 201633 - DNA, 25 bp, E. coli
tttaaaatgaagttacggcgcgatg

SEQ ID NO: 201634 - DNA, 25 bp, E. coli
tttaaaatgaagatacggcgcgatg

SEQ ID NO: 201635 - DNA, 25 bp, E. coli
tgattcaccagggaaaaagaaaccc

SEQ ID NO: 201636 - DNA, 25 bp, E. coli
tgattcaccaggcaaaaagaaaccc

SEQ ID NO: 201637 - DNA, 25 bp, E. coli
gcgtcgggttgtctctctgttgata

SEQ ID NO: 201638 - DNA, 25 bp, E. coli
gcgtcgggttgtgtctctgttgata

SEQ ID NO: 201639 - DNA, 25 bp, E. coli
ctgttgatacagtgatactagatgt

SEQ ID NO: 201640 - DNA, 25 bp, E. coli
ctgttgatacagagatactagatgt

SEQ ID NO: 201641 - DNA, 25 bp, E. coli
gattcaaccacacaatatatagcaa

SEQ ID NO: 201642 - DNA, 25 bp, E. coli
gattcaaccacagaatatatagcaa

SEQ ID NO: 201643 - DNA, 25 bp, E. coli
gggatttttgtgattcaccaggcaa

SEQ ID NO: 201644 - DNA, 25 bp, E. coli
ggtcaaagacgcgtatttattatca

SEQ ID NO: 201645 - DNA, 25 bp, E. coli
gggatttttgtgtttcaccaggcaa

SEQ ID NO: 201646 - DNA, 25 bp, E. coli
ggtcaaagacgcctatttattatca

SEQ ID NO: 201647 - DNA, 25 bp, E. coli
gatgtagttgaaaaaagattcaacc

SEQ ID NO: 201648 - DNA, 25 bp, E. coli
gatgtagttgaataaagattcaacc

SEQ ID NO: 201649 - DNA, 25 bp, E. coli
tactcaacgtgctggcggataacgg

SEQ ID NO: 201650 - DNA, 25 bp, E. coli
tactcaacgtgcaggcggataacgg

SEQ ID NO: 201651 - DNA, 25 bp, E. coli
aagatcctgctaggttcaaaactgg

SEQ ID NO: 201652 - DNA, 25 bp, E. coli
aagatcctgctacgttcaaaactgg

SEQ ID NO: 201653 - DNA, 25 bp, E. coli
tatcgccgcgatagttgccacgctg

SEQ ID NO: 201654 - DNA, 25 bp, E. coli
tatcgccgcgattgttgccacgctg

SEQ ID NO: 201655 - DNA, 25 bp, E. coli
taggcatcggctggagtgcaacgct

SEQ ID NO: 201656 - DNA, 25 bp, E. coli
taggcatcggctcgagtgcaacgct

SEQ ID NO: 201657 - DNA, 25 bp, E. coli
tatctggtggtttatggcctgcgca

SEQ ID NO: 201658 - DNA, 25 bp, E. coli
tttttcgtcctgcaaccgctcggca

SEQ ID NO: 201659 - DNA, 25 bp, E. coli
tttttcgtcctggaaccgctcggca

SEQ ID NO: 201660 - DNA, 25 bp, E. coli
tatctggtggttaatggcctgcgca

SEQ ID NO: 201661 - DNA, 25 bp, E. coli
tgtcgtcgctaatcgcggtcatgcg

SEQ ID NO: 201662 - DNA, 25 bp, E. coli
tgtcgtcgctaaacgcggtcatgcg

SEQ ID NO: 201663 - DNA, 25 bp, E. coli
tcagtaaaggcagtacgctggcgtt

SEQ ID NO: 201664 - DNA, 25 bp, E. coli
tcagtaaaggcactacgctggcgtt

SEQ ID NO: 201665 - DNA, 25 bp, E. coli
gaatatctttctcgcgtactcaacg

SEQ ID NO: 201666 - DNA, 25 bp, E. coli
gaatatcgtctgcaacgcgacggct

SEQ ID NO: 201667 - DNA, 25 bp, E. coli
gaatatcgtctggaacgcgacggct

SEQ ID NO: 201668 - DNA, 25 bp, E. coli
gaatatctttctggcgtactcaacg

SEQ ID NO: 201669 - DNA, 25 bp, E. coli
ggattatcatgagcctgcctgtgct

SEQ ID NO: 201670 - DNA, 25 bp, E. coli
ggattatcatgaccctgcctgtgct

SEQ ID NO: 201671 - DNA, 25 bp, E. coli
acattatccggcagcgggaacgtcc

SEQ ID NO: 201672 - DNA, 25 bp, E. coli
agaccatcagcacgcagtcagacga

SEQ ID NO: 201673 - DNA, 25 bp, E. coli
agaccatcagcaggcagtcagacga

SEQ ID NO: 201674 - DNA, 25 bp, E. coli
acattatccggctgcgggaacgtcc

SEQ ID NO: 201675 - DNA, 25 bp, E. coli
aacaccggatcgaggagctgaaacg

SEQ ID NO: 201676 - DNA, 25 bp, E. coli
aacaccggatcgtggagctgaaacg

SEQ ID NO: 201677 - DNA, 25 bp, E. coli
taccgtcagtggttgtccgcgagtg

SEQ ID NO: 201678 - DNA, 25 bp, E. coli
taccgtcagtggatgtccgcgagtg

SEQ ID NO: 201679 - DNA, 25 bp, E. coli
tgaaaccaataagcgggagcaggcg

SEQ ID NO: 201680 - DNA, 25 bp, E. coli
tgaaaccaataaccgggagcaggcg

SEQ ID NO: 201681 - DNA, 25 bp, E. coli
tgctgagacaacgacaacaccggat

SEQ ID NO: 201682 - DNA, 25 bp, E. coli
tgctgagacaaccacaacaccggat

SEQ ID NO: 201683 - DNA, 25 bp, E. coli
tcaccggaggtggagcttaccgtca

SEQ ID NO: 201684 - DNA, 25 bp, E. coli
tcaccggaggtgcagcttaccgtca

SEQ ID NO: 201685 - DNA, 25 bp, E. coli
tcagacgagctgcagagcaaaagcc

SEQ ID NO: 201686 - DNA, 25 bp, E. coli
gctgatactcctatgcctgctgaca

SEQ ID NO: 201687 - DNA, 25 bp, E. coli
gctgatactcctttgcctgctgaca

SEQ ID NO: 201688 - DNA, 25 bp, E. coli
gaacgaggatttacgccgctgggct

SEQ ID NO: 201689 - DNA, 25 bp, E. coli
gaacgaggattttcgccgctgggct

SEQ ID NO: 201690 - DNA, 25 bp, E. coli
tcagacgagctggagagcaaaagcc

SEQ ID NO: 201691 - DNA, 25 bp, E. coli
gagcaacagccagcttattagcctg

SEQ ID NO: 201692 - DNA, 25 bp, E. coli
gagcaacagccaccttattagcctg

SEQ ID NO: 201693 - DNA, 25 bp, E. coli
aagtccgtcagctgtttgcagtgca

SEQ ID NO: 201694 - DNA, 25 bp, E. coli
aagtccgtcagcagtttgcagtgca

SEQ ID NO: 201695 - DNA, 25 bp, E. coli
cacaggttttgtcatgggtgccata

SEQ ID NO: 201696 - DNA, 25 bp, E. coli
cacaggttttgtgatgggtgccata

SEQ ID NO: 201697 - DNA, 25 bp, E. coli
cagggacgctggctaatctggctct

SEQ ID NO: 201698 - DNA, 25 bp, E. coli
cagggacgctgggtaatctggctct

SEQ ID NO: 201699 - DNA, 25 bp, E. coli
ttgctgcaaatcatgccctggccgg

SEQ ID NO: 201700 - DNA, 25 bp, E. coli
ttgctgcaaatcttgccctggccgg

SEQ ID NO: 201701 - DNA, 25 bp, E. coli
tgcttacctggtcgcgctgaaatac

SEQ ID NO: 201702 - DNA, 25 bp, E. coli
tgcttacctggtggcgctgaaatac

SEQ ID NO: 201703 - DNA, 25 bp, E. coli
tttccgcaacctggcattatggcag

SEQ ID NO: 201704 - DNA, 25 bp, E. coli
tttccgcaacctcgcattatggcag

SEQ ID NO: 201705 - DNA, 25 bp, E. coli
gcgagctatcgttgccagggacgct

SEQ ID NO: 201706 - DNA, 25 bp, E. coli
gcgagctatcgtagccagggacgct

SEQ ID NO: 201707 - DNA, 25 bp, E. coli
gataacctgattgttttccggccaa

SEQ ID NO: 201708 - DNA, 25 bp, E. coli
gataacctgattcttttccggccaa

SEQ ID NO: 201709 - DNA, 25 bp, E. coli
gatcagcggctccacgcttggcgta

SEQ ID NO: 201710 - DNA, 25 bp, E. coli
ggtgccatactgcatctgatcagcg

SEQ ID NO: 201711 - DNA, 25 bp, E. coli
ggtgccatactggatctgatcagcg

SEQ ID NO: 201712 - DNA, 25 bp, E. coli
taacgtctctttcagaccggaagtg

SEQ ID NO: 201713 - DNA, 25 bp, E. coli
taacgtctctttgagaccggaagtg

SEQ ID NO: 201714 - DNA, 25 bp, E. coli
gatcagcggctcgacgcttggcgta

SEQ ID NO: 201715 - DNA, 25 bp, E. coli
caaatattgcagctgaagctcgggc

SEQ ID NO: 201716 - DNA, 25 bp, E. coli
caaatattgcaggtgaagctcgggc

SEQ ID NO: 201717 - DNA, 25 bp, E. coli
catttttaatgacccgggaagcagc

SEQ ID NO: 201718 - DNA, 25 bp, E. coli
catttttaatgagccgggaagcagc

SEQ ID NO: 201719 - DNA, 25 bp, E. coli
cagtacgtgtaactgagccaaaccc

SEQ ID NO: 201720 - DNA, 25 bp, E. coli
cagtacgtgtaagtgagccaaaccc

SEQ ID NO: 201721 - DNA, 25 bp, E. coli
tactattggcgatgtcacggccgat

SEQ ID NO: 201722 - DNA, 25 bp, E. coli
tactattggcgaagtcacggccgat

SEQ ID NO: 201723 - DNA, 25 bp, E. coli
aactaattcagctggagtaccctgg

SEQ ID NO: 201724 - DNA, 25 bp, E. coli
aactaattcagcaggagtaccctgg

SEQ ID NO: 201725 - DNA, 25 bp, E. coli
tatgtttccgatccagtttcagcgg

SEQ ID NO: 201726 - DNA, 25 bp, E. coli
tatgtttccgatgcagtttcagcgg

SEQ ID NO: 201727 - DNA, 25 bp, E. coli
tagaacaattcgctgggccacaggg

SEQ ID NO: 201728 - DNA, 25 bp, E. coli
tagaacaattcggtgggccacaggg

SEQ ID NO: 201729 - DNA, 25 bp, E. coli
tgagcttgctgaaggagaaccacaa

SEQ ID NO: 201730 - DNA, 25 bp, E. coli
tgagcttgctgatggagaaccacaa

SEQ ID NO: 201731 - DNA, 25 bp, E. coli
ccacagggtgaggttgcagcagcat

SEQ ID NO: 201732 - DNA, 25 bp, E. coli
ccacagggtgagcttgcagcagcat

SEQ ID NO: 201733 - DNA, 25 bp, E. coli
cggaggaggcccagcattaactaat

SEQ ID NO: 201734 - DNA, 25 bp, E. coli
cggaggaggccctgcattaactaat

SEQ ID NO: 201735 - DNA, 25 bp, E. coli
tcaatcctgtcagtggcgctgagct

SEQ ID NO: 201736 - DNA, 25 bp, E. coli
tcaatcctgtcactggcgctgagct

SEQ ID NO: 201737 - DNA, 25 bp, E. coli
ctttttggccgctgccgtggactga

SEQ ID NO: 201738 - DNA, 25 bp, E. coli
ctttttggccgcagccgtggactga

SEQ ID NO: 201739 - DNA, 25 bp, E. coli
aaaaacaggctacattgctggctgg

SEQ ID NO: 201740 - DNA, 25 bp, E. coli
aaaaacaggctagattgctggctgg

SEQ ID NO: 201741 - DNA, 25 bp, E. coli
tatggccgacggatattgccttagc

SEQ ID NO: 201742 - DNA, 25 bp, E. coli
tatggccgacggttattgccttagc

SEQ ID NO: 201743 - DNA, 25 bp, E. coli
ttttcagtgtaatgggtggcatcgg

SEQ ID NO: 201744 - DNA, 25 bp, E. coli
ttttcagtgtaaagggtggcatcgg

SEQ ID NO: 201745 - DNA, 25 bp, E. coli
tgacatttgtctggcttcccctgaa

SEQ ID NO: 201746 - DNA, 25 bp, E. coli
tgacatttgtctcgcttcccctgaa

SEQ ID NO: 201747 - DNA, 25 bp, E. coli
tcggcccgattagtgcccagcttgg

SEQ ID NO: 201748 - DNA, 25 bp, E. coli
tcggcccgattactgcccagcttgg

SEQ ID NO: 201749 - DNA, 25 bp, E. coli
gcagaacgcctcctgaattaaaaaa

SEQ ID NO: 201750 - DNA, 25 bp, E. coli
gcagaacgcctcgtgaattaaaaaa

SEQ ID NO: 201751 - DNA, 25 bp, E. coli
cgtggactgattatgtcggcccgat

SEQ ID NO: 201752 - DNA, 25 bp, E. coli
cgtggactgattttgtcggcccgat

SEQ ID NO: 201753 - DNA, 25 bp, E. coli
ggcatcggttgggaattctcccgca

SEQ ID NO: 201754 - DNA, 25 bp, E. coli
ggcatcggttggcaattctcccgca

SEQ ID NO: 201755 - DNA, 25 bp, E. coli
taatattctcctttccgctcctggt

SEQ ID NO: 201756 - DNA, 25 bp, E. coli
taagtttggcgattttagctctggg

SEQ ID NO: 201757 - DNA, 25 bp, E. coli
taatattctcctatccgctcctggt

SEQ ID NO: 201758 - DNA, 25 bp, E. coli
taagtttggcgaatttagctctggg

SEQ ID NO: 201759 - DNA, 25 bp, E. coli
aagcgatatcgcgaccgttgtacag

SEQ ID NO: 201760 - DNA, 25 bp, E. coli
aagcgatatcgccaccgttgtacag

SEQ ID NO: 201761 - DNA, 25 bp, E. coli
caaacacatcctatcgatctggtct

SEQ ID NO: 201762 - DNA, 25 bp, E. coli
caaacacatcctttcgatctggtct

SEQ ID NO: 201763 - DNA, 25 bp, E. coli
cgaccgcgtagtgacggacggaatt

SEQ ID NO: 201764 - DNA, 25 bp, E. coli
cgaccgcgtagtcacggacggaatt

SEQ ID NO: 201765 - DNA, 25 bp, E. coli
tagtgacggacgcaattgatcgcct

SEQ ID NO: 201766 - DNA, 25 bp, E. coli
tagtgacggacggaattgatcgcct

SEQ ID NO: 201767 - DNA, 25 bp, E. coli
tatctcgtcaggaactggatgccca

SEQ ID NO: 201768 - DNA, 25 bp, E. coli
tatctcgtcaggtactggatgccca

SEQ ID NO: 201769 - DNA, 25 bp, E. coli
ccagtggcgacagcaccgggattgt

SEQ ID NO: 201770 - DNA, 25 bp, E. coli
ccagtggcgacaccaccgggattgt

SEQ ID NO: 201771 - DNA, 25 bp, E. coli
cgccgcactgcatatgggcaacgaa

SEQ ID NO: 201772 - DNA, 25 bp, E. coli
cgccgcactgcaaatgggcaacgaa

SEQ ID NO: 201773 - DNA, 25 bp, E. coli
cgggattgtggtcatcacccaaaca

SEQ ID NO: 201774 - DNA, 25 bp, E. coli
cgttgtacaggctcaaaaagccgga

SEQ ID NO: 201775 - DNA, 25 bp, E. coli
cgggattgtggtgatcacccaaaca

SEQ ID NO: 201776 - DNA, 25 bp, E. coli
cgttgtacaggcacaaaaagccgga

SEQ ID NO: 201777 - DNA, 25 bp, E. coli
gatctggtcttttctttgccggaaa

SEQ ID NO: 201778 - DNA, 25 bp, E. coli
ggatgatgcgcttttccctaatcag

SEQ ID NO: 201779 - DNA, 25 bp, E. coli
ggatgatgcgctattccctaatcag

SEQ ID NO: 201780 - DNA, 25 bp, E. coli
gatctggtctttactttgccggaaa

SEQ ID NO: 201781 - DNA, 25 bp, E. coli
tatcaggaaggtccatttagttcgc

SEQ ID NO: 201782 - DNA, 25 bp, E. coli
tatcaggaaggtgcatttagttcgc

SEQ ID NO: 201783 - DNA, 25 bp, E. coli
ttgatgggcgcttcaccggaaatcg

SEQ ID NO: 201784 - DNA, 25 bp, E. coli
ttgatgggcgctacaccggaaatcg

SEQ ID NO: 201785 - DNA, 25 bp, E. coli
ttggcggcagtaatggcggtattcc

SEQ ID NO: 201786 - DNA, 25 bp, E. coli
ttggcggcagtattggcggtattcc

SEQ ID NO: 201787 - DNA, 25 bp, E. coli
tgattgtcttttatgccgcccgcaa

SEQ ID NO: 201788 - DNA, 25 bp, E. coli
tgattgtcttttttgccgcccgcaa

SEQ ID NO: 201789 - DNA, 25 bp, E. coli
gctgcgccgagctggattatcagga

SEQ ID NO: 201790 - DNA, 25 bp, E. coli
gctgcgccgagcaggattatcagga

SEQ ID NO: 201791 - DNA, 25 bp, E. coli
gaatatctggtggtcattaccgctg

SEQ ID NO: 201792 - DNA, 25 bp, E. coli
gaatatctggtgctcattaccgctg

SEQ ID NO: 201793 - DNA, 25 bp, E. coli
gaaatcagtcacgacgcctattgca

SEQ ID NO: 201794 - DNA, 25 bp, E. coli
gaaatcagtcaccacgcctattgca

SEQ ID NO: 201795 - DNA, 25 bp, E. coli
cgcgcgcgctggaaatcgatcatca

SEQ ID NO: 201796 - DNA, 25 bp, E. coli
cgcgcgcgctggtaatcgatcatca

SEQ ID NO: 201797 - DNA, 25 bp, E. coli
cgtgattttcgtgggcatcctcggc

SEQ ID NO: 201798 - DNA, 25 bp, E. coli
ctaaacgatctggtgcaaccggcgg

SEQ ID NO: 201799 - DNA, 25 bp, E. coli
ctaaacgatctgctgcaaccggcgg

SEQ ID NO: 201800 - DNA, 25 bp, E. coli
cgtgattttcgtcggcatcctcggc

SEQ ID NO: 201801 - DNA, 25 bp, E. coli
ggtattccggcaatcagcgcagttt

SEQ ID NO: 201802 - DNA, 25 bp, E. coli
ggtattccggcattcagcgcagttt

SEQ ID NO: 201803 - DNA, 25 bp, E. coli
aatatctggtcgttctcgtcgcagt

SEQ ID NO: 201804 - DNA, 25 bp, E. coli
aatatctggtcgatctcgtcgcagt

SEQ ID NO: 201805 - DNA, 25 bp, E. coli
caaaacgcctttgtagtaatacctg

SEQ ID NO: 201806 - DNA, 25 bp, E. coli
caaaacgcctttctagtaatacctg

SEQ ID NO: 201807 - DNA, 25 bp, E. coli
caggactccacataacgcctttgta

SEQ ID NO: 201808 - DNA, 25 bp, E. coli
caggactccacaaaacgcctttgta

SEQ ID NO: 201809 - DNA, 25 bp, E. coli
accaggtgtttggtgttgttcaatg

SEQ ID NO: 201810 - DNA, 25 bp, E. coli
accaggtgtttgctgttgttcaatg

SEQ ID NO: 201811 - DNA, 25 bp, E. coli
tagccaggactccacaaaacgcctt

SEQ ID NO: 201812 - DNA, 25 bp, E. coli
tagccaggactcgacaaaacgcctt

SEQ ID NO: 201813 - DNA, 25 bp, E. coli
tgcaatatctggacgatctcgtcgc

SEQ ID NO: 201814 - DNA, 25 bp, E. coli
tgcaatatctggtcgatctcgtcgc

SEQ ID NO: 201815 - DNA, 25 bp, E. coli
cctccgcagctactggcaaaatagc

SEQ ID NO: 201816 - DNA, 25 bp, E. coli
cctccgcagctagtggcaaaatagc

SEQ ID NO: 201817 - DNA, 25 bp, E. coli
gcagctactggctaaatagccagga

SEQ ID NO: 201818 - DNA, 25 bp, E. coli
gcacctccgcaggtactggcaaaat

SEQ ID NO: 201819 - DNA, 25 bp, E. coli
gcagctactggcaaaatagccagga

SEQ ID NO: 201820 - DNA, 25 bp, E. coli
gcacctccgcagctactggcaaaat

SEQ ID NO: 201821 - DNA, 25 bp, E. coli
cggatattggcgcacctccgcagct

SEQ ID NO: 201822 - DNA, 25 bp, E. coli
cggatattggcggacctccgcagct

SEQ ID NO: 201823 - DNA, 25 bp, E. coli
ggcaaaatagcctggactccacaaa

SEQ ID NO: 201824 - DNA, 25 bp, E. coli
ggcaaaatagccaggactccacaaa

SEQ ID NO: 201825 - DNA, 25 bp, E. coli
aagaggcgctgaacgagttcgaacg

SEQ ID NO: 201826 - DNA, 25 bp, E. coli
aagaggcgctgatcgagttcgaacg

SEQ ID NO: 201827 - DNA, 25 bp, E. coli
aaattacaacaacccgaacagcgcg

SEQ ID NO: 201828 - DNA, 25 bp, E. coli
aaaaggcgctgaccgagctggaaca

SEQ ID NO: 201829 - DNA, 25 bp, E. coli
aaaaggcgctgagcgagctggaaca

SEQ ID NO: 201830 - DNA, 25 bp, E. coli
aaattacaacaagccgaacagcgcg

SEQ ID NO: 201831 - DNA, 25 bp, E. coli
gccgaacagcgcgtacaaattctgc

SEQ ID NO: 201832 - DNA, 25 bp, E. coli
gccgaacagcgcctacaaattctgc

SEQ ID NO: 201833 - DNA, 25 bp, E. coli
gcgtacaaattctgctgtctgacaa

SEQ ID NO: 201834 - DNA, 25 bp, E. coli
gcgtacaaattcagctgtctgacaa

SEQ ID NO: 201835 - DNA, 25 bp, E. coli
gcgagctggaacagattgtaacccg

SEQ ID NO: 201836 - DNA, 25 bp, E. coli
gcgagctggaactgattgtaacccg

SEQ ID NO: 201837 - DNA, 25 bp, E. coli
cccgccagctttcaaaaggcgctga

SEQ ID NO: 201838 - DNA, 25 bp, E. coli
cccgccagctttgaaaaggcgctga

SEQ ID NO: 201839 - DNA, 25 bp, E. coli
ctgaacgagttccaacgcggcgtgc

SEQ ID NO: 201840 - DNA, 25 bp, E. coli
ctgaacgagttcgaacgcggcgtgc

SEQ ID NO: 201841 - DNA, 25 bp, E. coli
gggcaggccaaaatacaacaagccg

SEQ ID NO: 201842 - DNA, 25 bp, E. coli
gggcaggccaaattacaacaagccg

SEQ ID NO: 201843 - DNA, 25 bp, E. coli
ggaacagattgtaacccgtctggaa

SEQ ID NO: 201844 - DNA, 25 bp, E. coli
ggaacagattgttacccgtctggaa

SEQ ID NO: 201845 - DNA, 25 bp, E. coli
taacccgtctggtaagtggcgacct

SEQ ID NO: 201846 - DNA, 25 bp, E. coli
taacccgtctggaaagtggcgacct

SEQ ID NO: 201847 - DNA, 25 bp, E. coli
caaatggcggagattcacggtgaaa

SEQ ID NO: 201848 - DNA, 25 bp, E. coli
caaatggcggagtttcacggtgaaa

SEQ ID NO: 201849 - DNA, 25 bp, E. coli
tactctctgcgttggatagccggaa

SEQ ID NO: 201850 - DNA, 25 bp, E. coli
tactctctgcgtaggatagccggaa

SEQ ID NO: 201851 - DNA, 25 bp, E. coli
actcagggcgtattgtggacaggac

SEQ ID NO: 201852 - DNA, 25 bp, E. coli
actcagggcgtaatgtggacaggac

SEQ ID NO: 201853 - DNA, 25 bp, E. coli
tgtttttcagcattaccccacggcg

SEQ ID NO: 201854 - DNA, 25 bp, E. coli
tgtcaggcgaaattcagcaagcgtt

SEQ ID NO: 201855 - DNA, 25 bp, E. coli
tgtcaggcgaaaatcagcaagcgtt

SEQ ID NO: 201856 - DNA, 25 bp, E. coli
tgtttttcagcaataccccacggcg

SEQ ID NO: 201857 - DNA, 25 bp, E. coli
tcgagtgcgcagacaaaaataagcc

SEQ ID NO: 201858 - DNA, 25 bp, E. coli
tcctggctgatgctcaaagggcgct

SEQ ID NO: 201859 - DNA, 25 bp, E. coli
tcgagtgcgcagtcaaaaataagcc

SEQ ID NO: 201860 - DNA, 25 bp, E. coli
tcctggctgatggtcaaagggcgct

SEQ ID NO: 201861 - DNA, 25 bp, E. coli
gattatttgcgcaggcagacacccg

SEQ ID NO: 201862 - DNA, 25 bp, E. coli
gattatttgcgctggcagacacccg

SEQ ID NO: 201863 - DNA, 25 bp, E. coli
tcacgctacaagatgcagtcaccgg

SEQ ID NO: 201864 - DNA, 25 bp, E. coli
taagtctgggcggtatagcaacact

SEQ ID NO: 201865 - DNA, 25 bp, E. coli
tcacgctacaagttgcagtcaccgg

SEQ ID NO: 201866 - DNA, 25 bp, E. coli
taagtctgggcgctatagcaacact

SEQ ID NO: 201867 - DNA, 25 bp, E. coli
gatgtattacttttcgccgcgttag

SEQ ID NO: 201868 - DNA, 25 bp, E. coli
gatgtattacttatcgccgcgttag

SEQ ID NO: 201869 - DNA, 25 bp, E. coli
acagttaattgtaatcgcggggcgg

SEQ ID NO: 201870 - DNA, 25 bp, E. coli
acagttaattgttatcgcggggcgg

SEQ ID NO: 201871 - DNA, 25 bp, E. coli
tatgcgattacatcgaaatggtcga

SEQ ID NO: 201872 - DNA, 25 bp, E. coli
tatgcgattacaacgaaatggtcga

SEQ ID NO: 201873 - DNA, 25 bp, E. coli
tattacagttaaatgtaatcgcggg

SEQ ID NO: 201874 - DNA, 25 bp, E. coli
tattacagttaattgtaatcgcggg

SEQ ID NO: 201875 - DNA, 25 bp, E. coli
ttacaacgaaatggtcgatgaaata

SEQ ID NO: 201876 - DNA, 25 bp, E. coli
ttgtgatgagcacggatatgtcacg

SEQ ID NO: 201877 - DNA, 25 bp, E. coli
ttgtgatgagcagggatatgtcacg

SEQ ID NO: 201878 - DNA, 25 bp, E. coli
ttacaacgaaatcgtcgatgaaata

SEQ ID NO: 201879 - DNA, 25 bp, E. coli
tgatgagcacggatatgtcacgaag

SEQ ID NO: 201880 - DNA, 25 bp, E. coli
tgcgattacaaccaaatggtcgatg

SEQ ID NO: 201881 - DNA, 25 bp, E. coli
tgagcacggatatgtcacgaagtcg

SEQ ID NO: 201882 - DNA, 25 bp, E. coli
tgatgagcacggttatgtcacgaag

SEQ ID NO: 201883 - DNA, 25 bp, E. coli
tgagcacggataagtcacgaagtcg

SEQ ID NO: 201884 - DNA, 25 bp, E. coli
tgcgattacaacgaaatggtcgatg

SEQ ID NO: 201885 - DNA, 25 bp, E. coli
gcacggatatgtcacgaagtcgtaa

SEQ ID NO: 201886 - DNA, 25 bp, E. coli
gcacggatatgtgacgaagtcgtaa

SEQ ID NO: 201887 - DNA, 25 bp, E. coli
cgattacaacgaaatggtcgatgaa

SEQ ID NO: 201888 - DNA, 25 bp, E. coli
cgattacaacgatatggtcgatgaa

SEQ ID NO: 201889 - DNA, 25 bp, E. coli
ggtttgtgatgagcacggatatgtc

SEQ ID NO: 201890 - DNA, 25 bp, E. coli
ggtttgtgatgaccacggatatgtc

SEQ ID NO: 201891 - DNA, 25 bp, E. coli
tgttattaagaggaaccaggaacct

SEQ ID NO: 201892 - DNA, 25 bp, E. coli
tgttattaagagcaaccaggaacct

SEQ ID NO: 201893 - DNA, 25 bp, E. coli
tgagcaagtgagaaaagagcaaaac

SEQ ID NO: 201894 - DNA, 25 bp, E. coli
tgagcaagtgagtaaagagcaaaac

SEQ ID NO: 201895 - DNA, 25 bp, E. coli
tcataacaaacggagttactacgcc

SEQ ID NO: 201896 - DNA, 25 bp, E. coli
tccggtgggttagtgatgttaatca

SEQ ID NO: 201897 - DNA, 25 bp, E. coli
tcataacaaacgcagttactacgcc

SEQ ID NO: 201898 - DNA, 25 bp, E. coli
tccggtgggttactgatgttaatca

SEQ ID NO: 201899 - DNA, 25 bp, E. coli
gctaaaataaaagaggccgcattgc

SEQ ID NO: 201900 - DNA, 25 bp, E. coli
gctaaaataaaacaggccgcattgc

SEQ ID NO: 201901 - DNA, 25 bp, E. coli
gaattaaaacatcaccgtattgcac

SEQ ID NO: 201902 - DNA, 25 bp, E. coli
gaatactgttcaacactggcaggcg

SEQ ID NO: 201903 - DNA, 25 bp, E. coli
gaattaaaacatgaccgtattgcac

SEQ ID NO: 201904 - DNA, 25 bp, E. coli
gaatactgttcatcactggcaggcg

SEQ ID NO: 201905 - DNA, 25 bp, E. coli
gaaaatctacatatcgggaatactg

SEQ ID NO: 201906 - DNA, 25 bp, E. coli
gaaaatctacatttcgggaatactg

SEQ ID NO: 201907 - DNA, 25 bp, E. coli
cattacatttataatctggctacgg

SEQ ID NO: 201908 - DNA, 25 bp, E. coli
cattacatttattatctggctacgg

SEQ ID NO: 201909 - DNA, 25 bp, E. coli
ctggctacggattacatcagaatta

SEQ ID NO: 201910 - DNA, 25 bp, E. coli
ctggctacggataacatcagaatta

SEQ ID NO: 201911 - DNA, 25 bp, E. coli
gttactacgccaatgataatacgct

SEQ ID NO: 201912 - DNA, 25 bp, E. coli
gttactacgccattgataatacgct

SEQ ID NO: 201913 - DNA, 25 bp, E. coli
caaggagagccgaggcctgcatttc

SEQ ID NO: 201914 - DNA, 25 bp, E. coli
caaggagagccgtggcctgcatttc

SEQ ID NO: 201915 - DNA, 25 bp, E. coli
taccttatgccctcggcgtcagtac

SEQ ID NO: 201916 - DNA, 25 bp, E. coli
taccttatgcccacggcgtcagtac

SEQ ID NO: 201917 - DNA, 25 bp, E. coli
agccgtggcctgcatttcacgctgg

SEQ ID NO: 201918 - DNA, 25 bp, E. coli
agccgtggcctggatttcacgctgg

SEQ ID NO: 201919 - DNA, 25 bp, E. coli
aaaacccgtgcccattgtgcctgct

SEQ ID NO: 201920 - DNA, 25 bp, E. coli
aaaacccgtgccgattgtgcctgct

SEQ ID NO: 201921 - DNA, 25 bp, E. coli
ttcgctgtgcgaagatgcgcaagga

SEQ ID NO: 201922 - DNA, 25 bp, E. coli
ttcgctgtgcgatgatgcgcaagga

SEQ ID NO: 201923 - DNA, 25 bp, E. coli
tgcttcaaaagtttatcagtacacc

SEQ ID NO: 201924 - DNA, 25 bp, E. coli
tgcttcaaaagtatatcagtacacc

SEQ ID NO: 201925 - DNA, 25 bp, E. coli
gaaaaaacccgtcccgattgtgcct

SEQ ID NO: 201926 - DNA, 25 bp, E. coli
gacgtataccttttgcccacggcgt

SEQ ID NO: 201927 - DNA, 25 bp, E. coli
gaaaaaacccgtgccgattgtgcct

SEQ ID NO: 201928 - DNA, 25 bp, E. coli
gacgtataccttatgcccacggcgt

SEQ ID NO: 201929 - DNA, 25 bp, E. coli
ggatagatctcaggaaaaaacccgt

SEQ ID NO: 201930 - DNA, 25 bp, E. coli
ggatagatctcacgaaaaaacccgt

SEQ ID NO: 201931 - DNA, 25 bp, E. coli
ggcaaccggcggagcttcaaaagtt

SEQ ID NO: 201932 - DNA, 25 bp, E. coli
ggcagaagatatcagcagacgtata

SEQ ID NO: 201933 - DNA, 25 bp, E. coli
ggcaaccggcggtgcttcaaaagtt

SEQ ID NO: 201934 - DNA, 25 bp, E. coli
ggcagaagatatgagcagacgtata

SEQ ID NO: 201935 - DNA, 25 bp, E. coli
tattacagcattggtgatgttgctg

SEQ ID NO: 201936 - DNA, 25 bp, E. coli
tattacagcattcgtgatgttgctg

SEQ ID NO: 201937 - DNA, 25 bp, E. coli
ttgctgaacgttccgggattaatcc

SEQ ID NO: 201938 - DNA, 25 bp, E. coli
ttgctgaacgttgcgggattaatcc

SEQ ID NO: 201939 - DNA, 25 bp, E. coli
tgatgttgctgatcgttgcgggatt

SEQ ID NO: 201940 - DNA, 25 bp, E. coli
tgatgttgctgaacgttgcgggatt

SEQ ID NO: 201941 - DNA, 25 bp, E. coli
gaacgttgcgggattaatcctgtca

SEQ ID NO: 201942 - DNA, 25 bp, E. coli
gaacgttgcgggtttaatcctgtca

SEQ ID NO: 201943 - DNA, 25 bp, E. coli
cgttgcgggattaatcctgtcactc

SEQ ID NO: 201944 - DNA, 25 bp, E. coli
cgttgcgggatttatcctgtcactc

SEQ ID NO: 201945 - DNA, 25 bp, E. coli
ctggcaacgccgctacggtttgtta

SEQ ID NO: 201946 - DNA, 25 bp, E. coli
ctggcaacgccggtacggtttgtta

SEQ ID NO: 201947 - DNA, 25 bp, E. coli
gattaatcctgtgactctccgggcc

SEQ ID NO: 201948 - DNA, 25 bp, E. coli
gattaatcctgtcactctccgggcc

SEQ ID NO: 201949 - DNA, 25 bp, E. coli
gtggcttattactgcattggtgatg

SEQ ID NO: 201950 - DNA, 25 bp, E. coli
gggattaatcctgtcactctccggg

SEQ ID NO: 201951 - DNA, 25 bp, E. coli
gggattaatcctctcactctccggg

SEQ ID NO: 201952 - DNA, 25 bp, E. coli
gtggcttattacagcattggtgatg

SEQ ID NO: 201953 - DNA, 25 bp, E. coli
tggcaacgccgctacggtttgttaa

SEQ ID NO: 201954 - DNA, 25 bp, E. coli
tggcaacgccgcaacggtttgttaa

SEQ ID NO: 201955 - DNA, 25 bp, E. coli
taatcctgtcacactccgggcctgg

SEQ ID NO: 201956 - DNA, 25 bp, E. coli
taatcctgtcactctccgggcctgg

SEQ ID NO: 201957 - DNA, 25 bp, E. coli
aatgcctgggcatatcctgatggtg

SEQ ID NO: 201958 - DNA, 25 bp, E. coli
aatgcctgggcaaatcctgatggtg

SEQ ID NO: 201959 - DNA, 25 bp, E. coli
catatcctgatggtgagaaagttcc

SEQ ID NO: 201960 - DNA, 25 bp, E. coli
catatcctgatgctgagaaagttcc

SEQ ID NO: 201961 - DNA, 25 bp, E. coli
atgcctgggcatttcctgatggtga

SEQ ID NO: 201962 - DNA, 25 bp, E. coli
atatcctgatggtgagaaagttcct

SEQ ID NO: 201963 - DNA, 25 bp, E. coli
atgcctgggcatatcctgatggtga

SEQ ID NO: 201964 - DNA, 25 bp, E. coli
atatcctgatggagagaaagttcct

SEQ ID NO: 201965 - DNA, 25 bp, E. coli
tgggcatatcctcatggtgagaaag

SEQ ID NO: 201966 - DNA, 25 bp, E. coli
tgcctgggcatatcctgatggtgag

SEQ ID NO: 201967 - DNA, 25 bp, E. coli
tgcctgggcataacctgatggtgag

SEQ ID NO: 201968 - DNA, 25 bp, E. coli
cctgggcatatcctgatggtgagaa

SEQ ID NO: 201969 - DNA, 25 bp, E. coli
cctgggcatatcgtgatggtgagaa

SEQ ID NO: 201970 - DNA, 25 bp, E. coli
gcatatcctgatggtgagaaagttc

SEQ ID NO: 201971 - DNA, 25 bp, E. coli
gcatatcctgatcgtgagaaagttc

SEQ ID NO: 201972 - DNA, 25 bp, E. coli
ctgggcatatccagatggtgagaaa

SEQ ID NO: 201973 - DNA, 25 bp, E. coli
ctgggcatatcctgatggtgagaaa

SEQ ID NO: 201974 - DNA, 25 bp, E. coli
gggcatatcctgatggtgagaaagt

SEQ ID NO: 201975 - DNA, 25 bp, E. coli
gggcatatcctgttggtgagaaagt

SEQ ID NO: 201976 - DNA, 25 bp, E. coli
ggcatatcctgaaggtgagaaagtt

SEQ ID NO: 201977 - DNA, 25 bp, E. coli
ggcatatcctgatggtgagaaagtt

SEQ ID NO: 201978 - DNA, 25 bp, E. coli
tgggcatatcctgatggtgagaaag

SEQ ID NO: 201979 - DNA, 25 bp, E. coli
atgttaagcgcgtcaccgccgtgtg

SEQ ID NO: 201980 - DNA, 25 bp, E. coli
atgttaagcgcgacaccgccgtgtg

SEQ ID NO: 201981 - DNA, 25 bp, E. coli
acatatcgtctataaacccgcccag

SEQ ID NO: 201982 - DNA, 25 bp, E. coli
acatatcgtctaaaaacccgcccag

SEQ ID NO: 201983 - DNA, 25 bp, E. coli
tttgaaattgtctgccacggaacgg

SEQ ID NO: 201984 - DNA, 25 bp, E. coli
tttgaaattgtcagccacggaacgg

SEQ ID NO: 201985 - DNA, 25 bp, E. coli
tgcgtgtcgataccggcgattcgct

SEQ ID NO: 201986 - DNA, 25 bp, E. coli
tgcgtgtcgatagcggcgattcgct

SEQ ID NO: 201987 - DNA, 25 bp, E. coli
tctcctgcgttgaggagagcgccgt

SEQ ID NO: 201988 - DNA, 25 bp, E. coli
tcatcagcacgatgcgcagtgtccg

SEQ ID NO: 201989 - DNA, 25 bp, E. coli
tctcctgcgttgtggagagcgccgt

SEQ ID NO: 201990 - DNA, 25 bp, E. coli
tcatcagcacgaagcgcagtgtccg

SEQ ID NO: 201991 - DNA, 25 bp, E. coli
gcaagggtgcgatttacatatcgtc

SEQ ID NO: 201992 - DNA, 25 bp, E. coli
gcaagggtgcgaattacatatcgtc

SEQ ID NO: 201993 - DNA, 25 bp, E. coli
cggagcagcacgatgttaagcgcgt

SEQ ID NO: 201994 - DNA, 25 bp, E. coli
cgtcaaaagtattgaagttgaataa

SEQ ID NO: 201995 - DNA, 25 bp, E. coli
cggagcagcacgttgttaagcgcgt

SEQ ID NO: 201996 - DNA, 25 bp, E. coli
cgtcaaaagtatagaagttgaataa

SEQ ID NO: 201997 - DNA, 25 bp, E. coli
tcaccgccgtgtggctggaaattgg

SEQ ID NO: 201998 - DNA, 25 bp, E. coli
tcaccgccgtgtcgctggaaattgg

SEQ ID NO: 201999 - DNA, 25 bp, E. coli
gaggagagcgccgtccgttttagtt

SEQ ID NO: 202000 - DNA, 25 bp, E. coli
gaggagagcgccctccgttttagtt

SEQ ID NO: 202001 - DNA, 25 bp, E. coli
caagaatggcgggaaactcaccgtc

SEQ ID NO: 202002 - DNA, 25 bp, E. coli
aagaatggcggctaactcaccgtcg

SEQ ID NO: 202003 - DNA, 25 bp, E. coli
aagaatggcggcaaactcaccgtcg

SEQ ID NO: 202004 - DNA, 25 bp, E. coli
caagaatggcggcaaactcaccgtc

SEQ ID NO: 202005 - DNA, 25 bp, E. coli
caaactcaccgtcgctgtagcaaaa

SEQ ID NO: 202006 - DNA, 25 bp, E. coli
caaactcaccgtggctgtagcaaaa

SEQ ID NO: 202007 - DNA, 25 bp, E. coli
catgctgtaacagcaaatttccagt

SEQ ID NO: 202008 - DNA, 25 bp, E. coli
catgctgtaacaccaaatttccagt

SEQ ID NO: 202009 - DNA, 25 bp, E. coli
agcaaaaatcaccaccgcgtgggcg

SEQ ID NO: 202010 - DNA, 25 bp, E. coli
agcaaaaatcacgaccgcgtgggcg

SEQ ID NO: 202011 - DNA, 25 bp, E. coli
tgtagcaaaaatcaccaccgcgtgg

SEQ ID NO: 202012 - DNA, 25 bp, E. coli
tgtagcaaaaatgaccaccgcgtgg

SEQ ID NO: 202013 - DNA, 25 bp, E. coli
gtcgctgtagcaaaaatcaccaccg

SEQ ID NO: 202014 - DNA, 25 bp, E. coli
gtcgctgtagcataaatcaccaccg

SEQ ID NO: 202015 - DNA, 25 bp, E. coli
tggcggcaaactgaccgtcgctgta

SEQ ID NO: 202016 - DNA, 25 bp, E. coli
tggcggcaaactcaccgtcgctgta

SEQ ID NO: 202017 - DNA, 25 bp, E. coli
ggcaaactcaccgtcgctgtagcaa

SEQ ID NO: 202018 - DNA, 25 bp, E. coli
ggcaaactcaccctcgctgtagcaa

SEQ ID NO: 202019 - DNA, 25 bp, E. coli
tcaccgtcgctgtagcaaaaatcac

SEQ ID NO: 202020 - DNA, 25 bp, E. coli
taacagcaaattaccagtaatgcca

SEQ ID NO: 202021 - DNA, 25 bp, E. coli
tcaccgtcgctgaagcaaaaatcac

SEQ ID NO: 202022 - DNA, 25 bp, E. coli
taacagcaaatttccagtaatgcca

SEQ ID NO: 202023 - DNA, 25 bp, E. coli
cagttctgacggtaagcattggagg

SEQ ID NO: 202024 - DNA, 25 bp, E. coli
cagttctgacggaaagcattggagg

SEQ ID NO: 202025 - DNA, 25 bp, E. coli
atctcagttctgacggaaagcattg

SEQ ID NO: 202026 - DNA, 25 bp, E. coli
agttctgacggaaagcattggaggt

SEQ ID NO: 202027 - DNA, 25 bp, E. coli
atctcagttctgtcggaaagcattg

SEQ ID NO: 202028 - DNA, 25 bp, E. coli
agttctgacggatagcattggaggt

SEQ ID NO: 202029 - DNA, 25 bp, E. coli
atgtctgatatcacagcctcccgtc

SEQ ID NO: 202030 - DNA, 25 bp, E. coli
atgtctgatatctcagcctcccgtc

SEQ ID NO: 202031 - DNA, 25 bp, E. coli
tgtctgatatcacagcctcccgtcc

SEQ ID NO: 202032 - DNA, 25 bp, E. coli
tgtctgatatcagagcctcccgtcc

SEQ ID NO: 202033 - DNA, 25 bp, E. coli
tctcagttctgagggaaagcattgg

SEQ ID NO: 202034 - DNA, 25 bp, E. coli
tctcagttctgacggaaagcattgg

SEQ ID NO: 202035 - DNA, 25 bp, E. coli
tcagttctgacgcaaagcattggag

SEQ ID NO: 202036 - DNA, 25 bp, E. coli
tctgatatcacagcctcccgtccgg

SEQ ID NO: 202037 - DNA, 25 bp, E. coli
tcagttctgacggaaagcattggag

SEQ ID NO: 202038 - DNA, 25 bp, E. coli
tctgatatcacaccctcccgtccgg

SEQ ID NO: 202039 - DNA, 25 bp, E. coli
ctcagttctgaccgaaagcattgga

SEQ ID NO: 202040 - DNA, 25 bp, E. coli
ctcagttctgacggaaagcattgga

SEQ ID NO: 202041 - DNA, 25 bp, E. coli
gtctgatatcacagcctcccgtccg

SEQ ID NO: 202042 - DNA, 25 bp, E. coli
gtctgatatcactgcctcccgtccg

SEQ ID NO: 202043 - DNA, 25 bp, E. coli
atttccgctggtgctggtaatgggc

SEQ ID NO: 202044 - DNA, 25 bp, E. coli
atttccgctggtcctggtaatgggc

SEQ ID NO: 202045 - DNA, 25 bp, E. coli
atggtacgctgacctcatggtggac

SEQ ID NO: 202046 - DNA, 25 bp, E. coli
atggtacgctgagctcatggtggac

SEQ ID NO: 202047 - DNA, 25 bp, E. coli
aactttgatggttcgctgagctcat

SEQ ID NO: 202048 - DNA, 25 bp, E. coli
actttgatggtaggctgagctcatg

SEQ ID NO: 202049 - DNA, 25 bp, E. coli
actttgatggtacgctgagctcatg

SEQ ID NO: 202050 - DNA, 25 bp, E. coli
aactttgatggtacgctgagctcat

SEQ ID NO: 202051 - DNA, 25 bp, E. coli
ttgatggtacgcagagctcatggtg

SEQ ID NO: 202052 - DNA, 25 bp, E. coli
ttgatggtacgctgagctcatggtg

SEQ ID NO: 202053 - DNA, 25 bp, E. coli
tctctaccggacaggcgacactggc

SEQ ID NO: 202054 - DNA, 25 bp, E. coli
tctctaccggactggcgacactggc

SEQ ID NO: 202055 - DNA, 25 bp, E. coli
gcatttccgctggtgctggtaatgg

SEQ ID NO: 202056 - DNA, 25 bp, E. coli
gcatttccgctgctgctggtaatgg

SEQ ID NO: 202057 - DNA, 25 bp, E. coli
gctctctaccggtctggcgacactg

SEQ ID NO: 202058 - DNA, 25 bp, E. coli
gctctctaccggactggcgacactg

SEQ ID NO: 202059 - DNA, 25 bp, E. coli
ctggcatttccgctggtgctggtaa

SEQ ID NO: 202060 - DNA, 25 bp, E. coli
ctggcatttccggtggtgctggtaa

SEQ ID NO: 202061 - DNA, 25 bp, E. coli
gtacgctgagctgatggtggacgaa

SEQ ID NO: 202062 - DNA, 25 bp, E. coli
gtacgctgagctcatggtggacgaa

SEQ ID NO: 202063 - DNA, 25 bp, E. coli
tggcatttccgcaggtgctggtaat

SEQ ID NO: 202064 - DNA, 25 bp, E. coli
tggcatttccgctggtgctggtaat

SEQ ID NO: 202065 - DNA, 25 bp, E. coli
cactggcgcgcagagtgtgaattgc

SEQ ID NO: 202066 - DNA, 25 bp, E. coli
cactggcgcgcacagtgtgaattgc

SEQ ID NO: 202067 - DNA, 25 bp, E. coli
agcccaagaacgtcataccctgact

SEQ ID NO: 202068 - DNA, 25 bp, E. coli
agcccaagaacgacataccctgact

SEQ ID NO: 202069 - DNA, 25 bp, E. coli
aacacagtaatcgtcgggttgatga

SEQ ID NO: 202070 - DNA, 25 bp, E. coli
aacacagtaatcctcgggttgatga

SEQ ID NO: 202071 - DNA, 25 bp, E. coli
tatttttgaacagagtaatcgtcgg

SEQ ID NO: 202072 - DNA, 25 bp, E. coli
tatttttgaacacagtaatcgtcgg

SEQ ID NO: 202073 - DNA, 25 bp, E. coli
ttgcgtgaacaagtggatggtttcc

SEQ ID NO: 202074 - DNA, 25 bp, E. coli
ttgcgtgaacaactggatggtttcc

SEQ ID NO: 202075 - DNA, 25 bp, E. coli
tctgaacagtctattgtcgccgttg

SEQ ID NO: 202076 - DNA, 25 bp, E. coli
tctgaacagtcttttgtcgccgttg

SEQ ID NO: 202077 - DNA, 25 bp, E. coli
tcttttgtcgccgttgcgtgaacaa

SEQ ID NO: 202078 - DNA, 25 bp, E. coli
tcttttgtcgcccttgcgtgaacaa

SEQ ID NO: 202079 - DNA, 25 bp, E. coli
ccaggacagcttaggtaaagaagcc

SEQ ID NO: 202080 - DNA, 25 bp, E. coli
ccaggacagctttggtaaagaagcc

SEQ ID NO: 202081 - DNA, 25 bp, E. coli
gcaaaatcgccacagtctgaacagt

SEQ ID NO: 202082 - DNA, 25 bp, E. coli
gcaaaatcgccagagtctgaacagt

SEQ ID NO: 202083 - DNA, 25 bp, E. coli
gtcataccctgactcacgaaatccg

SEQ ID NO: 202084 - DNA, 25 bp, E. coli
gtgtgaattgctcaataacgaagtg

SEQ ID NO: 202085 - DNA, 25 bp, E. coli
gtcataccctgagtcacgaaatccg

SEQ ID NO: 202086 - DNA, 25 bp, E. coli
gtgtgaattgctgaataacgaagtg

SEQ ID NO: 202087 - DNA, 25 bp, E. coli
aagccgcactgctaggtactcgcga

SEQ ID NO: 202088 - DNA, 25 bp, E. coli
aagccgcactgcaaggtactcgcga

SEQ ID NO: 202089 - DNA, 25 bp, E. coli
tactggtttcgtggtggatgacgcc

SEQ ID NO: 202090 - DNA, 25 bp, E. coli
tactggtttcgtcgtggatgacgcc

SEQ ID NO: 202091 - DNA, 25 bp, E. coli
ataacggcgcggtgatgaatctggt

SEQ ID NO: 202092 - DNA, 25 bp, E. coli
ataacggcgcggagatgaatctggt

SEQ ID NO: 202093 - DNA, 25 bp, E. coli
ttaccggagttgcaggaaaccattc

SEQ ID NO: 202094 - DNA, 25 bp, E. coli
ttaccggagttggaggaaaccattc

SEQ ID NO: 202095 - DNA, 25 bp, E. coli
tgaactccgatctgcaggataacgg

SEQ ID NO: 202096 - DNA, 25 bp, E. coli
tgaactccgatcagcaggataacgg

SEQ ID NO: 202097 - DNA, 25 bp, E. coli
tcgctggaagaagtcgagcaaacgc

SEQ ID NO: 202098 - DNA, 25 bp, E. coli
tcgctggaagaactcgagcaaacgc

SEQ ID NO: 202099 - DNA, 25 bp, E. coli
gaatgaaaccgtagcaagccgcact

SEQ ID NO: 202100 - DNA, 25 bp, E. coli
gaatgaaaccgttgcaagccgcact

SEQ ID NO: 202101 - DNA, 25 bp, E. coli
cattccggcggccattgatctgcaa

SEQ ID NO: 202102 - DNA, 25 bp, E. coli
cattccggcggcgattgatctgcaa

SEQ ID NO: 202103 - DNA, 25 bp, E. coli
ggcgaatgccccactatcggtgaat

SEQ ID NO: 202104 - DNA, 25 bp, E. coli
ggcgaatgcccctctatcggtgaat

SEQ ID NO: 202105 - DNA, 25 bp, E. coli
tggcacggctggcaatcgacgtaca

SEQ ID NO: 202106 - DNA, 25 bp, E. coli
tggcacggctgggaatcgacgtaca

SEQ ID NO: 202107 - DNA, 25 bp, E. coli
gagagttacgtacatccgctgacga

SEQ ID NO: 202108 - DNA, 25 bp, E. coli
gagagttacgtagatccgctgacga

SEQ ID NO: 202109 - DNA, 25 bp, E. coli
aaccctggcatctccgttaagcaag

SEQ ID NO: 202110 - DNA, 25 bp, E. coli
taaagccgatctctctactacgctg

SEQ ID NO: 202111 - DNA, 25 bp, E. coli
taaagccgatctgtctactacgctg

SEQ ID NO: 202112 - DNA, 25 bp, E. coli
agaaaaccctgggatcaccgttaag

SEQ ID NO: 202113 - DNA, 25 bp, E. coli
agaaaaccctggcatcaccgttaag

SEQ ID NO: 202114 - DNA, 25 bp, E. coli
accgaatcagctaatcggtgaactg

SEQ ID NO: 202115 - DNA, 25 bp, E. coli
aggtgctgcgctcccggtgaataaa

SEQ ID NO: 202116 - DNA, 25 bp, E. coli
aggtgctgcgctgccggtgaataaa

SEQ ID NO: 202117 - DNA, 25 bp, E. coli
accgaatcagcttatcggtgaactg

SEQ ID NO: 202118 - DNA, 25 bp, E. coli
aaccctggcatcaccgttaagcaag

SEQ ID NO: 202119 - DNA, 25 bp, E. coli
tgcctataacactaaagtcattact

SEQ ID NO: 202120 - DNA, 25 bp, E. coli
tgcctataacacaaaagtcattact

SEQ ID NO: 202121 - DNA, 25 bp, E. coli
gcgctgggtgaactaccgaatcagc

SEQ ID NO: 202122 - DNA, 25 bp, E. coli
gcgctgggtgaagtaccgaatcagc

SEQ ID NO: 202123 - DNA, 25 bp, E. coli
gtgggtaaagccgatctctctacta

SEQ ID NO: 202124 - DNA, 25 bp, E. coli
ggtgaactaccgaatcagctaatcg

SEQ ID NO: 202125 - DNA, 25 bp, E. coli
gtgggtaaagcccatctctctacta

SEQ ID NO: 202126 - DNA, 25 bp, E. coli
ggtgaactaccgtatcagctaatcg

SEQ ID NO: 202127 - DNA, 25 bp, E. coli
tggcatcaccgttaagcaagtgccc

SEQ ID NO: 202128 - DNA, 25 bp, E. coli
tggcatcaccgtaaagcaagtgccc

SEQ ID NO: 202129 - DNA, 25 bp, E. coli
gatctctctactacgctgcaagcga

SEQ ID NO: 202130 - DNA, 25 bp, E. coli
gatctctctacttcgctgcaagcga

SEQ ID NO: 202131 - DNA, 25 bp, E. coli
aattcctcgatatgatcactcctca

SEQ ID NO: 202132 - DNA, 25 bp, E. coli
aattcctcgataagatcactcctca

SEQ ID NO: 202133 - DNA, 25 bp, E. coli
cactcctcagtaactcgctgacctg

SEQ ID NO: 202134 - DNA, 25 bp, E. coli
cactcctcagtatctcgctgacctg

SEQ ID NO: 202135 - DNA, 25 bp, E. coli
cattatcggtgtcatggtggaaagt

SEQ ID NO: 202136 - DNA, 25 bp, E. coli
cattatcggtgtgatggtggaaagt

SEQ ID NO: 202137 - DNA, 25 bp, E. coli
tatgatcactccacagtatctcgct

SEQ ID NO: 202138 - DNA, 25 bp, E. coli
tatgatcactcctcagtatctcgct

SEQ ID NO: 202139 - DNA, 25 bp, E. coli
tatcggtgtgatcgtggaaagtcat

SEQ ID NO: 202140 - DNA, 25 bp, E. coli
tatcggtgtgatggtggaaagtcat

SEQ ID NO: 202141 - DNA, 25 bp, E. coli
ttttaaaaatggcacagacggtacg

SEQ ID NO: 202142 - DNA, 25 bp, E. coli
ttttaaaaatgggacagacggtacg

SEQ ID NO: 202143 - DNA, 25 bp, E. coli
tgatcactcctctgtatctcgctga

SEQ ID NO: 202144 - DNA, 25 bp, E. coli
tgatcactcctcagtatctcgctga

SEQ ID NO: 202145 - DNA, 25 bp, E. coli
tgaattcctcgaaatgatcactcct

SEQ ID NO: 202146 - DNA, 25 bp, E. coli
tgaattcctcgatatgatcactcct

SEQ ID NO: 202147 - DNA, 25 bp, E. coli
tcctcgatatgaacactcctcagta

SEQ ID NO: 202148 - DNA, 25 bp, E. coli
tcctcgatatgatcactcctcagta

SEQ ID NO: 202149 - DNA, 25 bp, E. coli
tcggtgtgatggtggaaagtcatct

SEQ ID NO: 202150 - DNA, 25 bp, E. coli
tcggtgtgatggaggaaagtcatct

SEQ ID NO: 202151 - DNA, 25 bp, E. coli
gatatgatcactgctcagtatctcg

SEQ ID NO: 202152 - DNA, 25 bp, E. coli
gatatgatcactcctcagtatctcg

SEQ ID NO: 202153 - DNA, 25 bp, E. coli
caagggaaacgtaattgccatagcg

SEQ ID NO: 202154 - DNA, 25 bp, E. coli
caagggaaacgttattgccatagcg

SEQ ID NO: 202155 - DNA, 25 bp, E. coli
cacggtaatgagacggcacctgtgg

SEQ ID NO: 202156 - DNA, 25 bp, E. coli
tccgttatcgggtggtttcgcaaat

SEQ ID NO: 202157 - DNA, 25 bp, E. coli
tccgttatcgggaggtttcgcaaat

SEQ ID NO: 202158 - DNA, 25 bp, E. coli
cacggtaatgagtcggcacctgtgg

SEQ ID NO: 202159 - DNA, 25 bp, E. coli
tacgtttacccaattcagcgccaga

SEQ ID NO: 202160 - DNA, 25 bp, E. coli
tacgtttacccatttcagcgccaga

SEQ ID NO: 202161 - DNA, 25 bp, E. coli
tatgaccagggctaagaatctgtgc

SEQ ID NO: 202162 - DNA, 25 bp, E. coli
tatgaccagggcaaagaatctgtgc

SEQ ID NO: 202163 - DNA, 25 bp, E. coli
tgccctttgggctaaacgatcttcg

SEQ ID NO: 202164 - DNA, 25 bp, E. coli
tgccctttgggcaaaacgatcttcg

SEQ ID NO: 202165 - DNA, 25 bp, E. coli
tcgccgtccttccaaatgcatatgg

SEQ ID NO: 202166 - DNA, 25 bp, E. coli
tcgccgtccttcgaaatgcatatgg

SEQ ID NO: 202167 - DNA, 25 bp, E. coli
tcggtatcgtgagaacaccgccgct

SEQ ID NO: 202168 - DNA, 25 bp, E. coli
tcggtatcgtgacaacaccgccgct

SEQ ID NO: 202169 - DNA, 25 bp, E. coli
cgatggtgtgctggaactgacgcca

SEQ ID NO: 202170 - DNA, 25 bp, E. coli
cgatggtgtgctcgaactgacgcca

SEQ ID NO: 202171 - DNA, 25 bp, E. coli
gggaatcctcctccgctgaagcaag

SEQ ID NO: 202172 - DNA, 25 bp, E. coli
gggaatcctcctgcgctgaagcaag

SEQ ID NO: 202173 - DNA, 25 bp, E. coli
tcaccgagcgagtaatcaacggcgt

SEQ ID NO: 202174 - DNA, 25 bp, E. coli
tcaccgagcgagaaatcaacggcgt

SEQ ID NO: 202175 - DNA, 25 bp, E. coli
caacttactccacaaaaatcagacc

SEQ ID NO: 202176 - DNA, 25 bp, E. coli
caacttactccagaaaaatcagacc

SEQ ID NO: 202177 - DNA, 25 bp, E. coli
caaaaatcagacgagaacgccaatt

SEQ ID NO: 202178 - DNA, 25 bp, E. coli
caacaaaacagttttagttgattgt

SEQ ID NO: 202179 - DNA, 25 bp, E. coli
caaaaatcagaccagaacgccaatt

SEQ ID NO: 202180 - DNA, 25 bp, E. coli
caacaaaacagtattagttgattgt

SEQ ID NO: 202181 - DNA, 25 bp, E. coli
tacaagcaaaaatcaacaaaacagt

SEQ ID NO: 202182 - DNA, 25 bp, E. coli
tacaagcaaaaaacaacaaaacagt

SEQ ID NO: 202183 - DNA, 25 bp, E. coli
atcagaccagaacgccaattacaag

SEQ ID NO: 202184 - DNA, 25 bp, E. coli
atcagaccagaaggccaattacaag

SEQ ID NO: 202185 - DNA, 25 bp, E. coli
tagttgattgttttctctgacttca

SEQ ID NO: 202186 - DNA, 25 bp, E. coli
tagttgattgttatctctgacttca

SEQ ID NO: 202187 - DNA, 25 bp, E. coli
tgttatctctgagttcatactcctg

SEQ ID NO: 202188 - DNA, 25 bp, E. coli
tgttatctctgacttcatactcctg

SEQ ID NO: 202189 - DNA, 25 bp, E. coli
tccacaaaaatctgaccagaacgcc

SEQ ID NO: 202190 - DNA, 25 bp, E. coli
tccacaaaaatcagaccagaacgcc

SEQ ID NO: 202191 - DNA, 25 bp, E. coli
gaacgccaattacaagcaaaaatca

SEQ ID NO: 202192 - DNA, 25 bp, E. coli
gaacgccaattagaagcaaaaatca

SEQ ID NO: 202193 - DNA, 25 bp, E. coli
gacttcatactcctgctcctgtcag

SEQ ID NO: 202194 - DNA, 25 bp, E. coli
gacttcatactcgtgctcctgtcag

SEQ ID NO: 202195 - DNA, 25 bp, E. coli
gaccagaacgcctattacaagcaaa

SEQ ID NO: 202196 - DNA, 25 bp, E. coli
gaccagaacgccaattacaagcaaa

SEQ ID NO: 202197 - DNA, 25 bp, E. coli
catttcgtgaggtatgccgacattt

SEQ ID NO: 202198 - DNA, 25 bp, E. coli
catttcgtgaggaatgccgacattt

SEQ ID NO: 202199 - DNA, 25 bp, E. coli
ccccgttattttctgctatgtttat

SEQ ID NO: 202200 - DNA, 25 bp, E. coli
ccccgttattttgtgctatgtttat

SEQ ID NO: 202201 - DNA, 25 bp, E. coli
taaattgtccgggatttcgtgagga

SEQ ID NO: 202202 - DNA, 25 bp, E. coli
taaattgtccggcatttcgtgagga

SEQ ID NO: 202203 - DNA, 25 bp, E. coli
cccgtaaattgtgcggcatttcgtg

SEQ ID NO: 202204 - DNA, 25 bp, E. coli
cccgtaaattgtccggcatttcgtg

SEQ ID NO: 202205 - DNA, 25 bp, E. coli
ttgtccggcatttcgtgaggaatgc

SEQ ID NO: 202206 - DNA, 25 bp, E. coli
ttgtccggcattacgtgaggaatgc

SEQ ID NO: 202207 - DNA, 25 bp, E. coli
tgaggaatgccgtcatttatgctcg

SEQ ID NO: 202208 - DNA, 25 bp, E. coli
tgtttattgaataatgcgctttgct

SEQ ID NO: 202209 - DNA, 25 bp, E. coli
tgaggaatgccgacatttatgctcg

SEQ ID NO: 202210 - DNA, 25 bp, E. coli
tgtttattgaattatgcgctttgct

SEQ ID NO: 202211 - DNA, 25 bp, E. coli
tgctatgtttatagaataatgcgct

SEQ ID NO: 202212 - DNA, 25 bp, E. coli
tgctatgtttattgaataatgcgct

SEQ ID NO: 202213 - DNA, 25 bp, E. coli
tgccgacatttatgctcgccgacca

SEQ ID NO: 202214 - DNA, 25 bp, E. coli
tgccgacatttaagctcgccgacca

SEQ ID NO: 202215 - DNA, 25 bp, E. coli
gccttgatcaacgaataaaccccgt

SEQ ID NO: 202216 - DNA, 25 bp, E. coli
gccttgatcaaccaataaaccccgt

SEQ ID NO: 202217 - DNA, 25 bp, E. coli
gaatgccgacatatatgctcgccga

SEQ ID NO: 202218 - DNA, 25 bp, E. coli
gaatgccgacatttatgctcgccga

SEQ ID NO: 202219 - DNA, 25 bp, E. coli
acttaaagcgcgttcttacgccgcg

SEQ ID NO: 202220 - DNA, 25 bp, E. coli
acttaaagcgcgatcttacgccgcg

SEQ ID NO: 202221 - DNA, 25 bp, E. coli
tacgccgcgcttcaaaaaatgggtg

SEQ ID NO: 202222 - DNA, 25 bp, E. coli
tacgccgcgcttgaaaaaatgggtg

SEQ ID NO: 202223 - DNA, 25 bp, E. coli
tatcgctgacaatgaacgcttgccg

SEQ ID NO: 202224 - DNA, 25 bp, E. coli
tatcgctgacaaagaacgcttgccg

SEQ ID NO: 202225 - DNA, 25 bp, E. coli
tgggtgtaactccttctgaagcgct

SEQ ID NO: 202226 - DNA, 25 bp, E. coli
tgggtgtaactcgttctgaagcgct

SEQ ID NO: 202227 - DNA, 25 bp, E. coli
tgaagcgcttcgactcatgctcgag

SEQ ID NO: 202228 - DNA, 25 bp, E. coli
tgaagcgcttcgtctcatgctcgag

SEQ ID NO: 202229 - DNA, 25 bp, E. coli
tgccgttcaaacagacactcctgag

SEQ ID NO: 202230 - DNA, 25 bp, E. coli
tgccgttcaaactgacactcctgag

SEQ ID NO: 202231 - DNA, 25 bp, E. coli
gaaagaacggctacgtaatcctaag

SEQ ID NO: 202232 - DNA, 25 bp, E. coli
gaaagaacggcttcgtaatcctaag

SEQ ID NO: 202233 - DNA, 25 bp, E. coli
cttgtggagatagtgaaagaacggc

SEQ ID NO: 202234 - DNA, 25 bp, E. coli
cttgtggagatactgaaagaacggc

SEQ ID NO: 202235 - DNA, 25 bp, E. coli
gtattgacgatgtacttaaagcgcg

SEQ ID NO: 202236 - DNA, 25 bp, E. coli
gtattgacgatgaacttaaagcgcg

SEQ ID NO: 202237 - DNA, 25 bp, E. coli
ggtagcattaacgtgcgtattgacg

SEQ ID NO: 202238 - DNA, 25 bp, E. coli
ggtagcattaacctgcgtattgacg

SEQ ID NO: 202239 - DNA, 25 bp, E. coli
taatcctaagcctgtacgtgtgacg

SEQ ID NO: 202240 - DNA, 25 bp, E. coli
taatcctaagccagtacgtgtgacg

SEQ ID NO: 202241 - DNA, 25 bp, E. coli
aaggtgatttgctttttctgtatgc

SEQ ID NO: 202242 - DNA, 25 bp, E. coli
aaggtgatttgcattttctgtatgc

SEQ ID NO: 202243 - DNA, 25 bp, E. coli
taaatccgattattctgaaaatatg

SEQ ID NO: 202244 - DNA, 25 bp, E. coli
taaatccgattaatctgaaaatatg

SEQ ID NO: 202245 - DNA, 25 bp, E. coli
tgtccacgctttaatatgtaaaggt

SEQ ID NO: 202246 - DNA, 25 bp, E. coli
tgtccacgcttttatatgtaaaggt

SEQ ID NO: 202247 - DNA, 25 bp, E. coli
tcaaaccaaacggaattaaggagtt

SEQ ID NO: 202248 - DNA, 25 bp, E. coli
tcaaaccaaacgcaattaaggagtt

SEQ ID NO: 202249 - DNA, 25 bp, E. coli
tgccttataacaattggcaatattc

SEQ ID NO: 202250 - DNA, 25 bp, E. coli
tgccttataacatttggcaatattc

SEQ ID NO: 202251 - DNA, 25 bp, E. coli
tctgtatatttgacagctagttggc

SEQ ID NO: 202252 - DNA, 25 bp, E. coli
tctgtatatttgtcagctagttggc

SEQ ID NO: 202253 - DNA, 25 bp, E. coli
tctgtatgctcgtccaatataataa

SEQ ID NO: 202254 - DNA, 25 bp, E. coli
tctgtatgctcgaccaatataataa

SEQ ID NO: 202255 - DNA, 25 bp, E. coli
gctagttggctgtttttaaatgcct

SEQ ID NO: 202256 - DNA, 25 bp, E. coli
gctagttggctgattttaaatgcct

SEQ ID NO: 202257 - DNA, 25 bp, E. coli
gacttaataagtcaaaccaaacgca

SEQ ID NO: 202258 - DNA, 25 bp, E. coli
gacttaataagtgaaaccaaacgca

SEQ ID NO: 202259 - DNA, 25 bp, E. coli
tggcaatattctaatttggcaatta

SEQ ID NO: 202260 - DNA, 25 bp, E. coli
tggcaatattcttatttggcaatta

SEQ ID NO: 202261 - DNA, 25 bp, E. coli
taactttagtgacttaaattctctg

SEQ ID NO: 202262 - DNA, 25 bp, E. coli
taactttagtgagttaaattctctg

SEQ ID NO: 202263 - DNA, 25 bp, E. coli
aattatctgaaattaaattggattt

SEQ ID NO: 202264 - DNA, 25 bp, E. coli
aattatctgaaaataaattggattt

SEQ ID NO: 202265 - DNA, 25 bp, E. coli
taaattggattttctatttaaggct

SEQ ID NO: 202266 - DNA, 25 bp, E. coli
taaattggatttactatttaaggct

SEQ ID NO: 202267 - DNA, 25 bp, E. coli
atctgaaattaaattggattttcta

SEQ ID NO: 202268 - DNA, 25 bp, E. coli
ttatctgaaatttaattggattttc

SEQ ID NO: 202269 - DNA, 25 bp, E. coli
ctgaaattaaattggattttctatt

SEQ ID NO: 202270 - DNA, 25 bp, E. coli
ttatctgaaattaaattggattttc

SEQ ID NO: 202271 - DNA, 25 bp, E. coli
ctgaaattaaataggattttctatt

SEQ ID NO: 202272 - DNA, 25 bp, E. coli
atctgaaattaatttggattttcta

SEQ ID NO: 202273 - DNA, 25 bp, E. coli
ttaattatctgaaattaaattggat

SEQ ID NO: 202274 - DNA, 25 bp, E. coli
ttaattatctgatattaaattggat

SEQ ID NO: 202275 - DNA, 25 bp, E. coli
tatctgaaattaaattggattttct

SEQ ID NO: 202276 - DNA, 25 bp, E. coli
tatctgaaattatattggattttct

SEQ ID NO: 202277 - DNA, 25 bp, E. coli
tattaattatctgaaattaaattgg

SEQ ID NO: 202278 - DNA, 25 bp, E. coli
tctgaaattaaattggattttctat

SEQ ID NO: 202279 - DNA, 25 bp, E. coli
tctgaaattaaaatggattttctat

SEQ ID NO: 202280 - DNA, 25 bp, E. coli
tattaattatctcaaattaaattgg

SEQ ID NO: 202281 - DNA, 25 bp, E. coli
taattatctgaaattaaattggatt

SEQ ID NO: 202282 - DNA, 25 bp, E. coli
taattatctgaatttaaattggatt

SEQ ID NO: 202283 - DNA, 25 bp, E. coli
aatgcggcacgaatcggcagctccc

SEQ ID NO: 202284 - DNA, 25 bp, E. coli
aatgcggcacgattcggcagctccc

SEQ ID NO: 202285 - DNA, 25 bp, E. coli
accttaatgcggcacgaatcggcag

SEQ ID NO: 202286 - DNA, 25 bp, E. coli
accttaatgcgggacgaatcggcag

SEQ ID NO: 202287 - DNA, 25 bp, E. coli
atgcggcacgaaacggcagctcccg

SEQ ID NO: 202288 - DNA, 25 bp, E. coli
atgcggcacgaatcggcagctcccg

SEQ ID NO: 202289 - DNA, 25 bp, E. coli
acgaatcggcaggtcccgcgcgatt

SEQ ID NO: 202290 - DNA, 25 bp, E. coli
acgaatcggcagctcccgcgcgatt

SEQ ID NO: 202291 - DNA, 25 bp, E. coli
ttaatgcggcacgaatcggcagctc

SEQ ID NO: 202292 - DNA, 25 bp, E. coli
ttaatgcggcaccaatcggcagctc

SEQ ID NO: 202293 - DNA, 25 bp, E. coli
tgcggcacgaatgggcagctcccgc

SEQ ID NO: 202294 - DNA, 25 bp, E. coli
tgcggcacgaatcggcagctcccgc

SEQ ID NO: 202295 - DNA, 25 bp, E. coli
ccttaatgcggcacgaatcggcagc

SEQ ID NO: 202296 - DNA, 25 bp, E. coli
ccttaatgcggctcgaatcggcagc

SEQ ID NO: 202297 - DNA, 25 bp, E. coli
cttaatgcggcaggaatcggcagct

SEQ ID NO: 202298 - DNA, 25 bp, E. coli
cttaatgcggcacgaatcggcagct

SEQ ID NO: 202299 - DNA, 25 bp, E. coli
gataaccttaatgcggcacgaatcg

SEQ ID NO: 202300 - DNA, 25 bp, E. coli
gataaccttaatccggcacgaatcg

SEQ ID NO: 202301 - DNA, 25 bp, E. coli
ggataaccttaaagcggcacgaatc

SEQ ID NO: 202302 - DNA, 25 bp, E. coli
ggataaccttaatgcggcacgaatc

SEQ ID NO: 202303 - DNA, 25 bp, E. coli
taatgcggcacgtatcggcagctcc

SEQ ID NO: 202304 - DNA, 25 bp, E. coli
taatgcggcacgaatcggcagctcc

SEQ ID NO: 202305 - DNA, 25 bp, E. coli
aatgaaaaccatccctgacgtcccg

SEQ ID NO: 202306 - DNA, 25 bp, E. coli
aatgaaaaccatgcctgacgtcccg

SEQ ID NO: 202307 - DNA, 25 bp, E. coli
aatggtacttctagcaggcgctgcc

SEQ ID NO: 202308 - DNA, 25 bp, E. coli
aatggtacttcttgcaggcgctgcc

SEQ ID NO: 202309 - DNA, 25 bp, E. coli
cagctgcactggaagacaaaacggg

SEQ ID NO: 202310 - DNA, 25 bp, E. coli
cagctgcactggtagacaaaacggg

SEQ ID NO: 202311 - DNA, 25 bp, E. coli
tatcaataaacctggcggaggcggt

SEQ ID NO: 202312 - DNA, 25 bp, E. coli
tatcaataaaccaggcggaggcggt

SEQ ID NO: 202313 - DNA, 25 bp, E. coli
tgaatggcggcaagctgaagacact

SEQ ID NO: 202314 - DNA, 25 bp, E. coli
tgaatggcggcatgctgaagacact

SEQ ID NO: 202315 - DNA, 25 bp, E. coli
gaatcccggaaaagtacgcattggt

SEQ ID NO: 202316 - DNA, 25 bp, E. coli
gaatcccggaaatgtacgcattggt

SEQ ID NO: 202317 - DNA, 25 bp, E. coli
gaagcggtttccgtaagcccaggag

SEQ ID NO: 202318 - DNA, 25 bp, E. coli
gaagcggtttccctaagcccaggag

SEQ ID NO: 202319 - DNA, 25 bp, E. coli
gaaaggcgttgatctctccatcggc

SEQ ID NO: 202320 - DNA, 25 bp, E. coli
gaaaggcgttgaactctccatcggc

SEQ ID NO: 202321 - DNA, 25 bp, E. coli
cattggtaactctggcaccggagct

SEQ ID NO: 202322 - DNA, 25 bp, E. coli
cattggtaactcaggcaccggagct

SEQ ID NO: 202323 - DNA, 25 bp, E. coli
gttagtcgttccgtacgctgccgga

SEQ ID NO: 202324 - DNA, 25 bp, E. coli
gttagtcgttccctacgctgccgga

SEQ ID NO: 202325 - DNA, 25 bp, E. coli
gattgtgtcgcaaaaaacgccgcag

SEQ ID NO: 202326 - DNA, 25 bp, E. coli
gattgtgtcgcataaaacgccgcag

SEQ ID NO: 202327 - DNA, 25 bp, E. coli
aatcctcgacattttgtttctgcca

SEQ ID NO: 202328 - DNA, 25 bp, E. coli
aatcctcgacatattgtttctgcca

SEQ ID NO: 202329 - DNA, 25 bp, E. coli
cattttgtttctgccattcaatcga

SEQ ID NO: 202330 - DNA, 25 bp, E. coli
cattttgtttctcccattcaatcga

SEQ ID NO: 202331 - DNA, 25 bp, E. coli
ttttgcaaccgcgatcaaatcctcg

SEQ ID NO: 202332 - DNA, 25 bp, E. coli
ttttgcaaccgccatcaaatcctcg

SEQ ID NO: 202333 - DNA, 25 bp, E. coli
tccgctgttgccgtgtttcagggca

SEQ ID NO: 202334 - DNA, 25 bp, E. coli
tccgctgttgccctgtttcagggca

SEQ ID NO: 202335 - DNA, 25 bp, E. coli
tctgccattcaaacgaaacgctgcg

SEQ ID NO: 202336 - DNA, 25 bp, E. coli
tctgccattcaatcgaaacgctgcg

SEQ ID NO: 202337 - DNA, 25 bp, E. coli
gcaaccgcgatcaaatcctcgacat

SEQ ID NO: 202338 - DNA, 25 bp, E. coli
gcaaccgcgatctaatcctcgacat

SEQ ID NO: 202339 - DNA, 25 bp, E. coli
gaaacgctgcgattcaaccgctata

SEQ ID NO: 202340 - DNA, 25 bp, E. coli
gaaacgctgcgaatcaaccgctata

SEQ ID NO: 202341 - DNA, 25 bp, E. coli
ccgctatacctgctatcttcaactt

SEQ ID NO: 202342 - DNA, 25 bp, E. coli
ccgctatacctggtatcttcaactt

SEQ ID NO: 202343 - DNA, 25 bp, E. coli
gtttcagggcaaatttgcaaccgcg

SEQ ID NO: 202344 - DNA, 25 bp, E. coli
gattcaaccgctatacctgctatct

SEQ ID NO: 202345 - DNA, 25 bp, E. coli
gtttcagggcaattttgcaaccgcg

SEQ ID NO: 202346 - DNA, 25 bp, E. coli
gattcaaccgctttacctgctatct

SEQ ID NO: 202347 - DNA, 25 bp, E. coli
gggcaattttgcaaccgcgatcaaa

SEQ ID NO: 202348 - DNA, 25 bp, E. coli
gggcaattttgctaccgcgatcaaa

SEQ ID NO: 202349 - DNA, 25 bp, E. coli
tacacaaatgtagaagatgattatt

SEQ ID NO: 202350 - DNA, 25 bp, E. coli
tacataaactatttggcaataccag

SEQ ID NO: 202351 - DNA, 25 bp, E. coli
tacacaaatgtacaagatgattatt

SEQ ID NO: 202352 - DNA, 25 bp, E. coli
tacataaactatatggcaataccag

SEQ ID NO: 202353 - DNA, 25 bp, E. coli
tatttatacaaacatgaatctcttg

SEQ ID NO: 202354 - DNA, 25 bp, E. coli
tatttatacaaagatgaatctcttg

SEQ ID NO: 202355 - DNA, 25 bp, E. coli
ttttttccgcacctagcggtggata

SEQ ID NO: 202356 - DNA, 25 bp, E. coli
ttttttccgcacgtagcggtggata

SEQ ID NO: 202357 - DNA, 25 bp, E. coli
tcattgttgtttaatgcgtaattac

SEQ ID NO: 202358 - DNA, 25 bp, E. coli
tcattgttgttttatgcgtaattac

SEQ ID NO: 202359 - DNA, 25 bp, E. coli
gaatctcttgtatgtaaacattaca

SEQ ID NO: 202360 - DNA, 25 bp, E. coli
gaatctcttgtaagtaaacattaca

SEQ ID NO: 202361 - DNA, 25 bp, E. coli
cgcacgtagcggaggatatatcaat

SEQ ID NO: 202362 - DNA, 25 bp, E. coli
cgcacgtagcggtggatatatcaat

SEQ ID NO: 202363 - DNA, 25 bp, E. coli
gatatatcaatatacacaaatgtag

SEQ ID NO: 202364 - DNA, 25 bp, E. coli
gatatatcaataaacacaaatgtag

SEQ ID NO: 202365 - DNA, 25 bp, E. coli
tggcaataccagtaaatgatggagt

SEQ ID NO: 202366 - DNA, 25 bp, E. coli
ggctatctcaagaaatctatcaaag

SEQ ID NO: 202367 - DNA, 25 bp, E. coli
ggctatctcaagtaatctatcaaag

SEQ ID NO: 202368 - DNA, 25 bp, E. coli
tggcaataccagaaaatgatggagt

SEQ ID NO: 202369 - DNA, 25 bp, E. coli
gatggagtttttacatggctcccag

SEQ ID NO: 202370 - DNA, 25 bp, E. coli
gatggagttttttcatggctcccag

SEQ ID NO: 202371 - DNA, 25 bp, E. coli
cagcctgcgcccgtttatcagagaa

SEQ ID NO: 202372 - DNA, 25 bp, E. coli
cacggttgtcttcagcagttgcgcc

SEQ ID NO: 202373 - DNA, 25 bp, E. coli
cacggttgtcttgagcagttgcgcc

SEQ ID NO: 202374 - DNA, 25 bp, E. coli
cagcctgcgcccctttatcagagaa

SEQ ID NO: 202375 - DNA, 25 bp, E. coli
catcgcgtggattttggcaacctgc

SEQ ID NO: 202376 - DNA, 25 bp, E. coli
catcgcgtggatattggcaacctgc

SEQ ID NO: 202377 - DNA, 25 bp, E. coli
tttgcatcaggtcttgtggagccgc

SEQ ID NO: 202378 - DNA, 25 bp, E. coli
tttgcatcaggtgttgtggagccgc

SEQ ID NO: 202379 - DNA, 25 bp, E. coli
tgcagttactggtacaacattgggt

SEQ ID NO: 202380 - DNA, 25 bp, E. coli
tgcagttactggaacaacattgggt

SEQ ID NO: 202381 - DNA, 25 bp, E. coli
gcgactggtttattgcgctggcaga

SEQ ID NO: 202382 - DNA, 25 bp, E. coli
gcgactggtttaatgcgctggcaga

SEQ ID NO: 202383 - DNA, 25 bp, E. coli
gaattgcgggtcttcaatggcgaca

SEQ ID NO: 202384 - DNA, 25 bp, E. coli
gaattgcgggtcatcaatggcgaca

SEQ ID NO: 202385 - DNA, 25 bp, E. coli
cgaaaacggcgcaggaaaaatgtca

SEQ ID NO: 202386 - DNA, 25 bp, E. coli
cattgtcgttttgatccgtggcgag

SEQ ID NO: 202387 - DNA, 25 bp, E. coli
cgaaaacggcgctggaaaaatgtca

SEQ ID NO: 202388 - DNA, 25 bp, E. coli
cattgtcgttttcatccgtggcgag

SEQ ID NO: 202389 - DNA, 25 bp, E. coli
tcaacagaaacaagcgaaaacggcg

SEQ ID NO: 202390 - DNA, 25 bp, E. coli
tcaacagaaacatgcgaaaacggcg

SEQ ID NO: 202391 - DNA, 25 bp, E. coli
gacgttatcgatggtgggccgcaaa

SEQ ID NO: 202392 - DNA, 25 bp, E. coli
gacgttatcgatcgtgggccgcaaa

SEQ ID NO: 202393 - DNA, 25 bp, E. coli
catcaaaagtcggatcgtctggtca

SEQ ID NO: 202394 - DNA, 25 bp, E. coli
catcctgatgatggtgaaagacgca

SEQ ID NO: 202395 - DNA, 25 bp, E. coli
catcaaaagtcgcatcgtctggtca

SEQ ID NO: 202396 - DNA, 25 bp, E. coli
catcctgatgatcgtgaaagacgca

SEQ ID NO: 202397 - DNA, 25 bp, E. coli
tgagaacaggatctgaaccgacccg

SEQ ID NO: 202398 - DNA, 25 bp, E. coli
tgcaggcgaaaatacactacggctc

SEQ ID NO: 202399 - DNA, 25 bp, E. coli
tgagaacaggatgtgaaccgacccg

SEQ ID NO: 202400 - DNA, 25 bp, E. coli
tgcaggcgaaaaaacactacggctc

SEQ ID NO: 202401 - DNA, 25 bp, E. coli
tctggtagaagccaaaaccggatcg

SEQ ID NO: 202402 - DNA, 25 bp, E. coli
tctggtagaagcgaaaaccggatcg

SEQ ID NO: 202403 - DNA, 25 bp, E. coli
cattactctgcggaagaactggcga

SEQ ID NO: 202404 - DNA, 25 bp, E. coli
cattactctgcgcaagaactggcga

SEQ ID NO: 202405 - DNA, 25 bp, E. coli
ggttaagcgaagatgaccccgatct

SEQ ID NO: 202406 - DNA, 25 bp, E. coli
ggttaagcgaagttgaccccgatct

SEQ ID NO: 202407 - DNA, 25 bp, E. coli
ggcaacctgtcaaaacgaagccggt

SEQ ID NO: 202408 - DNA, 25 bp, E. coli
ggcaacctgtcataacgaagccggt

SEQ ID NO: 202409 - DNA, 25 bp, E. coli
tcaacagcgagttcatcaaaatggg

SEQ ID NO: 202410 - DNA, 25 bp, E. coli
tcaacagcgagtacatcaaaatggg

SEQ ID NO: 202411 - DNA, 25 bp, E. coli
gatggtctgatccaagcctggaaag

SEQ ID NO: 202412 - DNA, 25 bp, E. coli
gatggtctgatcgaagcctggaaag

SEQ ID NO: 202413 - DNA, 25 bp, E. coli
gatgaatatgaaaaccacccgacgc

SEQ ID NO: 202414 - DNA, 25 bp, E. coli
gatgaatatgaataccacccgacgc

SEQ ID NO: 202415 - DNA, 25 bp, E. coli
caagcttatctttcttaaaaagaga

SEQ ID NO: 202416 - DNA, 25 bp, E. coli
caagcttatcttacttaaaaagaga

SEQ ID NO: 202417 - DNA, 25 bp, E. coli
cagttacagccgcaaaattttatgg

SEQ ID NO: 202418 - DNA, 25 bp, E. coli
cagttacagccggaaaattttatgg

SEQ ID NO: 202419 - DNA, 25 bp, E. coli
cagccgcaaaattttatggctgatt

SEQ ID NO: 202420 - DNA, 25 bp, E. coli
cagccgcaaaatattatggctgatt

SEQ ID NO: 202421 - DNA, 25 bp, E. coli
cctcaagcttatgtttcttaaaaag

SEQ ID NO: 202422 - DNA, 25 bp, E. coli
cctcaagcttatctttcttaaaaag

SEQ ID NO: 202423 - DNA, 25 bp, E. coli
agggcagttacagccgcaaaatttt

SEQ ID NO: 202424 - DNA, 25 bp, E. coli
agggcagttacacccgcaaaatttt

SEQ ID NO: 202425 - DNA, 25 bp, E. coli
tatagccagagacgagttcagtttg

SEQ ID NO: 202426 - DNA, 25 bp, E. coli
tatagccagagaggagttcagtttg

SEQ ID NO: 202427 - DNA, 25 bp, E. coli
tgatttcaccttgccctcaagctta

SEQ ID NO: 202428 - DNA, 25 bp, E. coli
tgatttcaccttcccctcaagctta

SEQ ID NO: 202429 - DNA, 25 bp, E. coli
tcagtttgtgatttttacagggcag

SEQ ID NO: 202430 - DNA, 25 bp, E. coli
tcagtttgtgatatttacagggcag

SEQ ID NO: 202431 - DNA, 25 bp, E. coli
gccagagacgagatcagtttgtgat

SEQ ID NO: 202432 - DNA, 25 bp, E. coli
gccagagacgagttcagtttgtgat

SEQ ID NO: 202433 - DNA, 25 bp, E. coli
gtgtatagccagagacgagttcagt

SEQ ID NO: 202434 - DNA, 25 bp, E. coli
tgtgatttttactgggcagttacag

SEQ ID NO: 202435 - DNA, 25 bp, E. coli
tgtgatttttacagggcagttacag

SEQ ID NO: 202436 - DNA, 25 bp, E. coli
gtgtatagccagtgacgagttcagt

SEQ ID NO: 202437 - DNA, 25 bp, E. coli
caacaaaaaggctgacagtttcctg

SEQ ID NO: 202438 - DNA, 25 bp, E. coli
caacaaaaaggcagacagtttcctg

SEQ ID NO: 202439 - DNA, 25 bp, E. coli
tatgctttgctctgtaccggtgcct

SEQ ID NO: 202440 - DNA, 25 bp, E. coli
tatgctttgctcagtaccggtgcct

SEQ ID NO: 202441 - DNA, 25 bp, E. coli
tgtgggtatgctttgctcagtaccg

SEQ ID NO: 202442 - DNA, 25 bp, E. coli
tgtgggtatgctatgctcagtaccg

SEQ ID NO: 202443 - DNA, 25 bp, E. coli
tgcggcactggagaaagcacacaac

SEQ ID NO: 202444 - DNA, 25 bp, E. coli
tgcggcactggacaaagcacacaac

SEQ ID NO: 202445 - DNA, 25 bp, E. coli
tctgccgcagttatcaggcggaagg

SEQ ID NO: 202446 - DNA, 25 bp, E. coli
tctgccgcagttttcaggcggaagg

SEQ ID NO: 202447 - DNA, 25 bp, E. coli
gccatgagaatttctctccttgtta

SEQ ID NO: 202448 - DNA, 25 bp, E. coli
gccatgagaattactctccttgtta

SEQ ID NO: 202449 - DNA, 25 bp, E. coli
gcaggaatagccatgagaattactc

SEQ ID NO: 202450 - DNA, 25 bp, E. coli
gcaggaatagccttgagaattactc

SEQ ID NO: 202451 - DNA, 25 bp, E. coli
gacagtttcctgtctgccgcagtta

SEQ ID NO: 202452 - DNA, 25 bp, E. coli
gacagtttcctgactgccgcagtta

SEQ ID NO: 202453 - DNA, 25 bp, E. coli
ctttgctcagtagcggtgcctgcgg

SEQ ID NO: 202454 - DNA, 25 bp, E. coli
ctttgctcagtaccggtgcctgcgg

SEQ ID NO: 202455 - DNA, 25 bp, E. coli
ggtgcctgcggctctggacaaagca

SEQ ID NO: 202456 - DNA, 25 bp, E. coli
ggtgcctgcggcactggacaaagca

SEQ ID NO: 202457 - DNA, 25 bp, E. coli
tggacaaagcacacaacaaaaaggc

SEQ ID NO: 202458 - DNA, 25 bp, E. coli
tggacaaagcactcaacaaaaaggc

SEQ ID NO: 202459 - DNA, 25 bp, E. coli
catgcgttaagctagatggatctcc

SEQ ID NO: 202460 - DNA, 25 bp, E. coli
catgcgttaagcaagatggatctcc

SEQ ID NO: 202461 - DNA, 25 bp, E. coli
tatcgctccggattaggtaaatgcc

SEQ ID NO: 202462 - DNA, 25 bp, E. coli
taccaccgggctcttatgtcacctg

SEQ ID NO: 202463 - DNA, 25 bp, E. coli
tatcgctccggaataggtaaatgcc

SEQ ID NO: 202464 - DNA, 25 bp, E. coli
taccaccgggctgttatgtcacctg

SEQ ID NO: 202465 - DNA, 25 bp, E. coli
ttgacgcaactgatggataccaccg

SEQ ID NO: 202466 - DNA, 25 bp, E. coli
ttgacgcaactgttggataccaccg

SEQ ID NO: 202467 - DNA, 25 bp, E. coli
tgcttaatgaacacaggcgtcagcg

SEQ ID NO: 202468 - DNA, 25 bp, E. coli
tgcttaatgaactcaggcgtcagcg

SEQ ID NO: 202469 - DNA, 25 bp, E. coli
gccaataacgaggttaccgctgcga

SEQ ID NO: 202470 - DNA, 25 bp, E. coli
gccaataacgagcttaccgctgcga

SEQ ID NO: 202471 - DNA, 25 bp, E. coli
gctggagctatgtcaacggcgaaga

SEQ ID NO: 202472 - DNA, 25 bp, E. coli
gctggagctatgacaacggcgaaga

SEQ ID NO: 202473 - DNA, 25 bp, E. coli
gaataccgtgattatctggcgggca

SEQ ID NO: 202474 - DNA, 25 bp, E. coli
gaataccgtgataatctggcgggca

SEQ ID NO: 202475 - DNA, 25 bp, E. coli
ggagtcatcagccactatcagcgtg

SEQ ID NO: 202476 - DNA, 25 bp, E. coli
ggattattgataacggcagcgctta

SEQ ID NO: 202477 - DNA, 25 bp, E. coli
ggattattgatatcggcagcgctta

SEQ ID NO: 202478 - DNA, 25 bp, E. coli
ggaatcaagcaaagttcccgccctg

SEQ ID NO: 202479 - DNA, 25 bp, E. coli
ggaatcaagcaatgttcccgccctg

SEQ ID NO: 202480 - DNA, 25 bp, E. coli
ggagtcatcagcgactatcagcgtg

SEQ ID NO: 202481 - DNA, 25 bp, E. coli
aaggtcgtgagcagcaacagcaggt

SEQ ID NO: 202482 - DNA, 25 bp, E. coli
aaggtcgtgagctgcaacagcaggt

SEQ ID NO: 202483 - DNA, 25 bp, E. coli
taaaggtcgtgacctgcaacagcag

SEQ ID NO: 202484 - DNA, 25 bp, E. coli
taaaggtcgtgagctgcaacagcag

SEQ ID NO: 202485 - DNA, 25 bp, E. coli
atatcgccctgggacctgacggctt

SEQ ID NO: 202486 - DNA, 25 bp, E. coli
atcgccctggcacctgacggcttaa

SEQ ID NO: 202487 - DNA, 25 bp, E. coli
atcgccctggcagctgacggcttaa

SEQ ID NO: 202488 - DNA, 25 bp, E. coli
aggtcgtgagctgcaacagcaggtt

SEQ ID NO: 202489 - DNA, 25 bp, E. coli
atatcgccctggcacctgacggctt

SEQ ID NO: 202490 - DNA, 25 bp, E. coli
aggtcgtgagctccaacagcaggtt

SEQ ID NO: 202491 - DNA, 25 bp, E. coli
tccgttggaggtaatccgggaaatg

SEQ ID NO: 202492 - DNA, 25 bp, E. coli
tccgttggaggttatccgggaaatg

SEQ ID NO: 202493 - DNA, 25 bp, E. coli
cgttggaggttatccgggaaatgat

SEQ ID NO: 202494 - DNA, 25 bp, E. coli
cgttggaggttaaccgggaaatgat

SEQ ID NO: 202495 - DNA, 25 bp, E. coli
gttatccgggaaatgatgataaagg

SEQ ID NO: 202496 - DNA, 25 bp, E. coli
gttatccgggaattgatgataaagg

SEQ ID NO: 202497 - DNA, 25 bp, E. coli
gggtatatcgccctggcacctgacg

SEQ ID NO: 202498 - DNA, 25 bp, E. coli
ggtatatcgccctggcacctgacgg

SEQ ID NO: 202499 - DNA, 25 bp, E. coli
gggtatatcgccgtggcacctgacg

SEQ ID NO: 202500 - DNA, 25 bp, E. coli
ggtatatcgcccaggcacctgacgg

SEQ ID NO: 202501 - DNA, 25 bp, E. coli
gaggttatccggcaaatgatgataa

SEQ ID NO: 202502 - DNA, 25 bp, E. coli
gaggttatccgggaaatgatgataa

SEQ ID NO: 202503 - DNA, 25 bp, E. coli
caatttatacattgcgccgctcagg

SEQ ID NO: 202504 - DNA, 25 bp, E. coli
caatttatacatagcgccgctcagg

SEQ ID NO: 202505 - DNA, 25 bp, E. coli
taacatttacgggaccaccaaaggg

SEQ ID NO: 202506 - DNA, 25 bp, E. coli
tgttgatgcataacatggtcgccgg

SEQ ID NO: 202507 - DNA, 25 bp, E. coli
tgttgatgcatatcatggtcgccgg

SEQ ID NO: 202508 - DNA, 25 bp, E. coli
ccaaagggcagcatcgacaggctat

SEQ ID NO: 202509 - DNA, 25 bp, E. coli
ccaaagggcagcttcgacaggctat

SEQ ID NO: 202510 - DNA, 25 bp, E. coli
gcttcgcatttggaaacgcccgttg

SEQ ID NO: 202511 - DNA, 25 bp, E. coli
gcttcgcatttgcaaacgcccgttg

SEQ ID NO: 202512 - DNA, 25 bp, E. coli
gcagaccgcaatcaaaatggccgag

SEQ ID NO: 202513 - DNA, 25 bp, E. coli
gcagaccgcaatgaaaatggccgag

SEQ ID NO: 202514 - DNA, 25 bp, E. coli
gaaacgcgttatagccgtcaggaac

SEQ ID NO: 202515 - DNA, 25 bp, E. coli
gaaacgcgttattgccgtcaggaac

SEQ ID NO: 202516 - DNA, 25 bp, E. coli
cgcgcaaaccgctgagcaaggataa

SEQ ID NO: 202517 - DNA, 25 bp, E. coli
cgcgcaaaccgcagagcaaggataa

SEQ ID NO: 202518 - DNA, 25 bp, E. coli
gatctcgatcgcctgctggcggaaa

SEQ ID NO: 202519 - DNA, 25 bp, E. coli
gttatattcatgacaccgcgcgcaa

SEQ ID NO: 202520 - DNA, 25 bp, E. coli
gatattgttccatgcggtgctcgag

SEQ ID NO: 202521 - DNA, 25 bp, E. coli
gttatattcatgtcaccgcgcgcaa

SEQ ID NO: 202522 - DNA, 25 bp, E. coli
gatattgttccaagcggtgctcgag

SEQ ID NO: 202523 - DNA, 25 bp, E. coli
taacatttacggcaccaccaaaggg

SEQ ID NO: 202524 - DNA, 25 bp, E. coli
gatctcgatcgcgtgctggcggaaa

SEQ ID NO: 202525 - DNA, 25 bp, E. coli
caacgcggcgagacttaacttctac

SEQ ID NO: 202526 - DNA, 25 bp, E. coli
caacgcggcgagtcttaacttctac

SEQ ID NO: 202527 - DNA, 25 bp, E. coli
cagcgcgctgtatacgatagattca

SEQ ID NO: 202528 - DNA, 25 bp, E. coli
cagcgcgctgtaaacgatagattca

SEQ ID NO: 202529 - DNA, 25 bp, E. coli
catggatttatctccgcgtttacga

SEQ ID NO: 202530 - DNA, 25 bp, E. coli
catcagaaagttcgttcgccaggcg

SEQ ID NO: 202531 - DNA, 25 bp, E. coli
catggatttatcaccgcgtttacga

SEQ ID NO: 202532 - DNA, 25 bp, E. coli
catcagaaagttggttcgccaggcg

SEQ ID NO: 202533 - DNA, 25 bp, E. coli
agatttaccagagcgctgagccagg

SEQ ID NO: 202534 - DNA, 25 bp, E. coli
accaacggtagtgtgcgaacgcctt

SEQ ID NO: 202535 - DNA, 25 bp, E. coli
accaacggtagtctgcgaacgcctt

SEQ ID NO: 202536 - DNA, 25 bp, E. coli
agatttaccagaccgctgagccagg

SEQ ID NO: 202537 - DNA, 25 bp, E. coli
tgataagtagaaccaccaacgcggc

SEQ ID NO: 202538 - DNA, 25 bp, E. coli
tgataagtagaagcaccaacgcggc

SEQ ID NO: 202539 - DNA, 25 bp, E. coli
gcattacgacgaaccggacggactt

SEQ ID NO: 202540 - DNA, 25 bp, E. coli
gcattacgacgatccggacggactt

SEQ ID NO: 202541 - DNA, 25 bp, E. coli
ggcgcacgttttcgagagctacttc

SEQ ID NO: 202542 - DNA, 25 bp, E. coli
ggcgcacgttttggagagctacttc

SEQ ID NO: 202543 - DNA, 25 bp, E. coli
tcaacgatccaaggcattgccagag

SEQ ID NO: 202544 - DNA, 25 bp, E. coli
tcaacgatccaacgcattgccagag

SEQ ID NO: 202545 - DNA, 25 bp, E. coli
taacttctacagtcgggcgcacgtt

SEQ ID NO: 202546 - DNA, 25 bp, E. coli
taacttctacagacgggcgcacgtt

SEQ ID NO: 202547 - DNA, 25 bp, E. coli
cacgggcggaatcggcgcttactct

SEQ ID NO: 202548 - DNA, 25 bp, E. coli
cacgggcggaatgggcgcttactct

SEQ ID NO: 202549 - DNA, 25 bp, E. coli
cataacattccttcggcggaatatc

SEQ ID NO: 202550 - DNA, 25 bp, E. coli
caggcgccgcactgctggaaggctc

SEQ ID NO: 202551 - DNA, 25 bp, E. coli
caggcgccgcacagctggaaggctc

SEQ ID NO: 202552 - DNA, 25 bp, E. coli
cataacattcctacggcggaatatc

SEQ ID NO: 202553 - DNA, 25 bp, E. coli
agcgctggaaccgacgctgcaaaac

SEQ ID NO: 202554 - DNA, 25 bp, E. coli
agcgctggaacccacgctgcaaaac

SEQ ID NO: 202555 - DNA, 25 bp, E. coli
acccacgctgcataacgtcgctatc

SEQ ID NO: 202556 - DNA, 25 bp, E. coli
acccacgctgcaaaacgtcgctatc

SEQ ID NO: 202557 - DNA, 25 bp, E. coli
tgcgccggtagtgacagatgacgtt

SEQ ID NO: 202558 - DNA, 25 bp, E. coli
tgcgccggtagtcacagatgacgtt

SEQ ID NO: 202559 - DNA, 25 bp, E. coli
tctcctgcgccggtagtgacagatg

SEQ ID NO: 202560 - DNA, 25 bp, E. coli
tctcctgcgccgctagtgacagatg

SEQ ID NO: 202561 - DNA, 25 bp, E. coli
gccgcacagctgcaaggctcgaaag

SEQ ID NO: 202562 - DNA, 25 bp, E. coli
gccgcacagctggaaggctcgaaag

SEQ ID NO: 202563 - DNA, 25 bp, E. coli
gctggaaggctcgaaagcgtttact

SEQ ID NO: 202564 - DNA, 25 bp, E. coli
gctggaaggctccaaagcgtttact

SEQ ID NO: 202565 - DNA, 25 bp, E. coli
gcacagctggaaggctcgaaagcgt

SEQ ID NO: 202566 - DNA, 25 bp, E. coli
gcacagctggaacgctcgaaagcgt

SEQ ID NO: 202567 - DNA, 25 bp, E. coli
ggcaaactagacgagaaaacgtcag

SEQ ID NO: 202568 - DNA, 25 bp, E. coli
ggcaaactagaccagaaaacgtcag

SEQ ID NO: 202569 - DNA, 25 bp, E. coli
caagcgcgacagtgaaagaatgcat

SEQ ID NO: 202570 - DNA, 25 bp, E. coli
caagcgcgacagagaaagaatgcat

SEQ ID NO: 202571 - DNA, 25 bp, E. coli
tattttgtgtccagcaactgcgcgc

SEQ ID NO: 202572 - DNA, 25 bp, E. coli
tttctgctatgacgtttgacccgcg

SEQ ID NO: 202573 - DNA, 25 bp, E. coli
tattttgtgtcctgcaactgcgcgc

SEQ ID NO: 202574 - DNA, 25 bp, E. coli
tttctgctatgaggtttgacccgcg

SEQ ID NO: 202575 - DNA, 25 bp, E. coli
ttcctgctgatgtacccgtgtgccc

SEQ ID NO: 202576 - DNA, 25 bp, E. coli
ttcctgctgatgaacccgtgtgccc

SEQ ID NO: 202577 - DNA, 25 bp, E. coli
tgtggcacaacgataaccgtggcgt

SEQ ID NO: 202578 - DNA, 25 bp, E. coli
tgtgacatgctggtggcgttaccgc

SEQ ID NO: 202579 - DNA, 25 bp, E. coli
tgtgacatgctgctggcgttaccgc

SEQ ID NO: 202580 - DNA, 25 bp, E. coli
tgtggcacaacgttaaccgtggcgt

SEQ ID NO: 202581 - DNA, 25 bp, E. coli
tgaatcgcgcggaattaccggtccg

SEQ ID NO: 202582 - DNA, 25 bp, E. coli
tgaatcgcgcggtattaccggtccg

SEQ ID NO: 202583 - DNA, 25 bp, E. coli
ccttgagcatggacagaaagcggca

SEQ ID NO: 202584 - DNA, 25 bp, E. coli
ccttgagcatggtcagaaagcggca

SEQ ID NO: 202585 - DNA, 25 bp, E. coli
ccggcgtgcttttttctgaggacta

SEQ ID NO: 202586 - DNA, 25 bp, E. coli
ccggcgtgctttattctgaggacta

SEQ ID NO: 202587 - DNA, 25 bp, E. coli
ggtgccaacgtttaagatgatcgcc

SEQ ID NO: 202588 - DNA, 25 bp, E. coli
ggtgccaacgttaaagatgatcgcc

SEQ ID NO: 202589 - DNA, 25 bp, E. coli
ggcacgggtgctatttcaactcaaa

SEQ ID NO: 202590 - DNA, 25 bp, E. coli
ggcacgggtgctttttcaactcaaa

SEQ ID NO: 202591 - DNA, 25 bp, E. coli
aactctttatgtcgtctgggtgaca

SEQ ID NO: 202592 - DNA, 25 bp, E. coli
caaatgcgcatcaaataaaaaataa

SEQ ID NO: 202593 - DNA, 25 bp, E. coli
caaatgcgcatctaataaaaaataa

SEQ ID NO: 202594 - DNA, 25 bp, E. coli
aactctttatgtggtctgggtgaca

SEQ ID NO: 202595 - DNA, 25 bp, E. coli
ttttttccccgtgatggcgacggca

SEQ ID NO: 202596 - DNA, 25 bp, E. coli
ttttttccccgtcatggcgacggca

SEQ ID NO: 202597 - DNA, 25 bp, E. coli
tcatggcgacgggacaaaatgtggt

SEQ ID NO: 202598 - DNA, 25 bp, E. coli
tcatggcgacggcacaaaatgtggt

SEQ ID NO: 202599 - DNA, 25 bp, E. coli
gcctgaccgccgcagtttgtttatt

SEQ ID NO: 202600 - DNA, 25 bp, E. coli
gccggagtttgtttatttacacaat

SEQ ID NO: 202601 - DNA, 25 bp, E. coli
gcctgaccgccggagtttgtttatt

SEQ ID NO: 202602 - DNA, 25 bp, E. coli
gccggagtttgtatatttacacaat

SEQ ID NO: 202603 - DNA, 25 bp, E. coli
gacggcacaaaatgtggtacatgct

SEQ ID NO: 202604 - DNA, 25 bp, E. coli
gatcaaaactctttatgtggtctgg

SEQ ID NO: 202605 - DNA, 25 bp, E. coli
gatcaaaactctatatgtggtctgg

SEQ ID NO: 202606 - DNA, 25 bp, E. coli
gggtgacaaaattcgccgcctgacc

SEQ ID NO: 202607 - DNA, 25 bp, E. coli
gggtgacaaaatacgccgcctgacc

SEQ ID NO: 202608 - DNA, 25 bp, E. coli
gtctgggtgacataatacgccgcct

SEQ ID NO: 202609 - DNA, 25 bp, E. coli
gtctgggtgacaaaatacgccgcct

SEQ ID NO: 202610 - DNA, 25 bp, E. coli
tggcttcgacaaatgcgcatcaaat

SEQ ID NO: 202611 - DNA, 25 bp, E. coli
tggcttcgacaattgcgcatcaaat

SEQ ID NO: 202612 - DNA, 25 bp, E. coli
gacggcacaaaaagtggtacatgct

SEQ ID NO: 202613 - DNA, 25 bp, E. coli
aactggcgctgcatgaacaaagaat

SEQ ID NO: 202614 - DNA, 25 bp, E. coli
aagcagccagatgcagagactctcc

SEQ ID NO: 202615 - DNA, 25 bp, E. coli
aagcagccagatccagagactctcc

SEQ ID NO: 202616 - DNA, 25 bp, E. coli
caaaaagcagcctgatccagagact

SEQ ID NO: 202617 - DNA, 25 bp, E. coli
caaaaagcagccagatccagagact

SEQ ID NO: 202618 - DNA, 25 bp, E. coli
agctgacgcgccacgaccttgtaag

SEQ ID NO: 202619 - DNA, 25 bp, E. coli
agctgacgcgcctcgaccttgtaag

SEQ ID NO: 202620 - DNA, 25 bp, E. coli
aactggcgctgcttgaacaaagaat

SEQ ID NO: 202621 - DNA, 25 bp, E. coli
gcctcgaccttgtaagccgtgaaga

SEQ ID NO: 202622 - DNA, 25 bp, E. coli
gcctcgaccttgaaagccgtgaaga

SEQ ID NO: 202623 - DNA, 25 bp, E. coli
gaatcagcgaacaggaaaatcgcag

SEQ ID NO: 202624 - DNA, 25 bp, E. coli
gaatcagcgaactggaaaatcgcag

SEQ ID NO: 202625 - DNA, 25 bp, E. coli
gcagtactgagatcaaaaagcagcc

SEQ ID NO: 202626 - DNA, 25 bp, E. coli
gcagtactgagaacaaaaagcagcc

SEQ ID NO: 202627 - DNA, 25 bp, E. coli
cttgaacaaagaatcagcgaactgg

SEQ ID NO: 202628 - DNA, 25 bp, E. coli
cttgaacaaagattcagcgaactgg

SEQ ID NO: 202629 - DNA, 25 bp, E. coli
tggaaaatcgcactactgagatcaa

SEQ ID NO: 202630 - DNA, 25 bp, E. coli
tggaaaatcgcagtactgagatcaa

SEQ ID NO: 202631 - DNA, 25 bp, E. coli
taagccgtgaagagttcgacgtcca

SEQ ID NO: 202632 - DNA, 25 bp, E. coli
taagccgtgaagtgttcgacgtcca

SEQ ID NO: 202633 - DNA, 25 bp, E. coli
gagttcgacgtcgaaacgcaagtcc

SEQ ID NO: 202634 - DNA, 25 bp, E. coli
gagttcgacgtccaaacgcaagtcc

SEQ ID NO: 202635 - DNA, 25 bp, E. coli
caatggtcgtaaagctctgcgtcag

SEQ ID NO: 202636 - DNA, 25 bp, E. coli
caatggtcgtaatgctctgcgtcag

SEQ ID NO: 202637 - DNA, 25 bp, E. coli
cagctccaaacgaacctgggatcag

SEQ ID NO: 202638 - DNA, 25 bp, E. coli
cactggcctgatgggtactggcgac

SEQ ID NO: 202639 - DNA, 25 bp, E. coli
cactggcctgatcggtactggcgac

SEQ ID NO: 202640 - DNA, 25 bp, E. coli
cagctccaaacgtacctgggatcag

SEQ ID NO: 202641 - DNA, 25 bp, E. coli
aaattccaggacatcggttctttcg

SEQ ID NO: 202642 - DNA, 25 bp, E. coli
aaaacctgggtgacgttgctggtcg

SEQ ID NO: 202643 - DNA, 25 bp, E. coli
aaaacctgggtgtcgttgctggtcg

SEQ ID NO: 202644 - DNA, 25 bp, E. coli
aaattccaggacttcggttctttcg

SEQ ID NO: 202645 - DNA, 25 bp, E. coli
tcatggcatcacgaacaatggtcgt

SEQ ID NO: 202646 - DNA, 25 bp, E. coli
tcatggcatcaccaacaatggtcgt

SEQ ID NO: 202647 - DNA, 25 bp, E. coli
gctccggaaagccaaaacaactcct

SEQ ID NO: 202648 - DNA, 25 bp, E. coli
gctccggaaagcgaaaacaactcct

SEQ ID NO: 202649 - DNA, 25 bp, E. coli
gcgtccgtctgttgcatacctgcag

SEQ ID NO: 202650 - DNA, 25 bp, E. coli
gcgtccgtctgtagcatacctgcag

SEQ ID NO: 202651 - DNA, 25 bp, E. coli
gcagcgtaagcgctgaaaatgatcc

SEQ ID NO: 202652 - DNA, 25 bp, E. coli
gcagcgtaagcggtgaaaatgatcc

SEQ ID NO: 202653 - DNA, 25 bp, E. coli
ctgggatcagaagaacactggcctg

SEQ ID NO: 202654 - DNA, 25 bp, E. coli
ctgggatcagaacaacactggcctg

SEQ ID NO: 202655 - DNA, 25 bp, E. coli
gatccggatttctctggtcatggca

SEQ ID NO: 202656 - DNA, 25 bp, E. coli
gatccggatttcactggtcatggca

SEQ ID NO: 202657 - DNA, 25 bp, E. coli
aagccatccatataaggctgacagc

SEQ ID NO: 202658 - DNA, 25 bp, E. coli
aagccatccataaaaggctgacagc

SEQ ID NO: 202659 - DNA, 25 bp, E. coli
cataaaaggctgtcagccatgctga

SEQ ID NO: 202660 - DNA, 25 bp, E. coli
cataaaaggctgacagccatgctga

SEQ ID NO: 202661 - DNA, 25 bp, E. coli
ataaaaggctgagagccatgctgat

SEQ ID NO: 202662 - DNA, 25 bp, E. coli
agccatccataaaaggctgacagcc

SEQ ID NO: 202663 - DNA, 25 bp, E. coli
ataaaaggctgacagccatgctgat

SEQ ID NO: 202664 - DNA, 25 bp, E. coli
agccatccataataggctgacagcc

SEQ ID NO: 202665 - DNA, 25 bp, E. coli
ttgcccgcacactatgctgcgcccg

SEQ ID NO: 202666 - DNA, 25 bp, E. coli
ttgcccgcacacaatgctgcgcccg

SEQ ID NO: 202667 - DNA, 25 bp, E. coli
tccataaaaggcagacagccatgct

SEQ ID NO: 202668 - DNA, 25 bp, E. coli
tccataaaaggctgacagccatgct

SEQ ID NO: 202669 - DNA, 25 bp, E. coli
ccatccataaaacgctgacagccat

SEQ ID NO: 202670 - DNA, 25 bp, E. coli
ccatccataaaaggctgacagccat

SEQ ID NO: 202671 - DNA, 25 bp, E. coli
gccatccataaaaggctgacagcca

SEQ ID NO: 202672 - DNA, 25 bp, E. coli
ccataaaaggctgacagccatgctg

SEQ ID NO: 202673 - DNA, 25 bp, E. coli
ccataaaaggctcacagccatgctg

SEQ ID NO: 202674 - DNA, 25 bp, E. coli
gccatccataaatggctgacagcca

SEQ ID NO: 202675 - DNA, 25 bp, E. coli
ccgcacactatggtgcgcccgttcc

SEQ ID NO: 202676 - DNA, 25 bp, E. coli
ccgcacactatgctgcgcccgttcc

SEQ ID NO: 202677 - DNA, 25 bp, E. coli
gacgttgcccgcacactatgctgcg

SEQ ID NO: 202678 - DNA, 25 bp, E. coli
gacgttgcccgctcactatgctgcg

SEQ ID NO: 202679 - DNA, 25 bp, E. coli
cacggcattccagctctttaatcta

SEQ ID NO: 202680 - DNA, 25 bp, E. coli
cacggcattccacctctttaatcta

SEQ ID NO: 202681 - DNA, 25 bp, E. coli
ttttcaccctgaaagcggcgcgtac

SEQ ID NO: 202682 - DNA, 25 bp, E. coli
ttcttttcacccagaaagcggcgcg

SEQ ID NO: 202683 - DNA, 25 bp, E. coli
ttcttttcaccctgaaagcggcgcg

SEQ ID NO: 202684 - DNA, 25 bp, E. coli
ttcaccctgaaagcggcgcgtactg

SEQ ID NO: 202685 - DNA, 25 bp, E. coli
ttcaccctgaaaccggcgcgtactg

SEQ ID NO: 202686 - DNA, 25 bp, E. coli
ttttcaccctgatagcggcgcgtac

SEQ ID NO: 202687 - DNA, 25 bp, E. coli
tccgttcttttctccctgaaagcgg

SEQ ID NO: 202688 - DNA, 25 bp, E. coli
tccgttcttttcaccctgaaagcgg

SEQ ID NO: 202689 - DNA, 25 bp, E. coli
tgaaagcggcgcgtactggcaacac

SEQ ID NO: 202690 - DNA, 25 bp, E. coli
tgaaagcggcgcctactggcaacac

SEQ ID NO: 202691 - DNA, 25 bp, E. coli
tcttttcaccctgaaagcggcgcgt

SEQ ID NO: 202692 - DNA, 25 bp, E. coli
tcttttcaccctcaaagcggcgcgt

SEQ ID NO: 202693 - DNA, 25 bp, E. coli
gcccgctgctgagggttccgttctt

SEQ ID NO: 202694 - DNA, 25 bp, E. coli
gcccgctgctgacggttccgttctt

SEQ ID NO: 202695 - DNA, 25 bp, E. coli
gctgctgacggtaccgttcttttca

SEQ ID NO: 202696 - DNA, 25 bp, E. coli
gctgctgacggttccgttcttttca

SEQ ID NO: 202697 - DNA, 25 bp, E. coli
gaaagcggcgcgtactggcaacacg

SEQ ID NO: 202698 - DNA, 25 bp, E. coli
gaaagcggcgcgaactggcaacacg

SEQ ID NO: 202699 - DNA, 25 bp, E. coli
tgacggttccgttcttttcaccctg

SEQ ID NO: 202700 - DNA, 25 bp, E. coli
tgacggttccgtacttttcaccctg

SEQ ID NO: 202701 - DNA, 25 bp, E. coli
caacttttgtcgaattttctcgcgc

SEQ ID NO: 202702 - DNA, 25 bp, E. coli
caacttttgtcgtattttctcgcgc

SEQ ID NO: 202703 - DNA, 25 bp, E. coli
tgcagaagcagtaagatagaagatg

SEQ ID NO: 202704 - DNA, 25 bp, E. coli
tgcagaagcagttagatagaagatg

SEQ ID NO: 202705 - DNA, 25 bp, E. coli
tctcgcgctttctggaaaatcctta

SEQ ID NO: 202706 - DNA, 25 bp, E. coli
tctcgcgctttcaggaaaatcctta

SEQ ID NO: 202707 - DNA, 25 bp, E. coli
tccttaaaaatgagaccgattggtc

SEQ ID NO: 202708 - DNA, 25 bp, E. coli
tccggtaataatcaaaaaccatagc

SEQ ID NO: 202709 - DNA, 25 bp, E. coli
tccttaaaaatgtgaccgattggtc

SEQ ID NO: 202710 - DNA, 25 bp, E. coli
tccggtaataatgaaaaaccatagc

SEQ ID NO: 202711 - DNA, 25 bp, E. coli
ccatagccttaatgaataacgatta

SEQ ID NO: 202712 - DNA, 25 bp, E. coli
ccatagccttaaagaataacgatta

SEQ ID NO: 202713 - DNA, 25 bp, E. coli
gctgtaccgcctcctacaagcaaga

SEQ ID NO: 202714 - DNA, 25 bp, E. coli
gctgtaccgcctgctacaagcaaga

SEQ ID NO: 202715 - DNA, 25 bp, E. coli
gaagatgagtgtgtaattccctgaa

SEQ ID NO: 202716 - DNA, 25 bp, E. coli
gaataacgattactggcaacttttg

SEQ ID NO: 202717 - DNA, 25 bp, E. coli
gaataacgattagtggcaacttttg

SEQ ID NO: 202718 - DNA, 25 bp, E. coli
gaagatgagtgtctaattccctgaa

SEQ ID NO: 202719 - DNA, 25 bp, E. coli
cgattggtcagacgctgcagaagca

SEQ ID NO: 202720 - DNA, 25 bp, E. coli
cgattggtcagaggctgcagaagca

SEQ ID NO: 202721 - DNA, 25 bp, E. coli
tgtctaattcccagaatacaggagt

SEQ ID NO: 202722 - DNA, 25 bp, E. coli
tgtctaattccctgaatacaggagt

SEQ ID NO: 202723 - DNA, 25 bp, E. coli
tctgatgatacccatgaaaacgagg

SEQ ID NO: 202724 - DNA, 25 bp, E. coli
tctgatgataccgatgaaaacgagg

SEQ ID NO: 202725 - DNA, 25 bp, E. coli
ccggaagagatgaagaatgagctgc

SEQ ID NO: 202726 - DNA, 25 bp, E. coli
ccggaagagatgtagaatgagctgc

SEQ ID NO: 202727 - DNA, 25 bp, E. coli
gcattctgagtctctaccccgggta

SEQ ID NO: 202728 - DNA, 25 bp, E. coli
gcattctgagtcactaccccgggta

SEQ ID NO: 202729 - DNA, 25 bp, E. coli
gcaggcatcattactacggcaaaac

SEQ ID NO: 202730 - DNA, 25 bp, E. coli
gcaggcatcatttctacggcaaaac

SEQ ID NO: 202731 - DNA, 25 bp, E. coli
gaaaaaacgaaagtcatccagagcc

SEQ ID NO: 202732 - DNA, 25 bp, E. coli
gaaaaaacgaaactcatccagagcc

SEQ ID NO: 202733 - DNA, 25 bp, E. coli
gaaaacgaggcatacatgacgccgg

SEQ ID NO: 202734 - DNA, 25 bp, E. coli
gaaaacgaggcaaacatgacgccgg

SEQ ID NO: 202735 - DNA, 25 bp, E. coli
cgcaggaaggagtaaagcatgaccc

SEQ ID NO: 202736 - DNA, 25 bp, E. coli
cgcaggaaggagaaaagcatgaccc

SEQ ID NO: 202737 - DNA, 25 bp, E. coli
cattacctggctggtcatgcaggca

SEQ ID NO: 202738 - DNA, 25 bp, E. coli
cattacctggctcgtcatgcaggca

SEQ ID NO: 202739 - DNA, 25 bp, E. coli
gataaaaggctagcgcaaatctggt

SEQ ID NO: 202740 - DNA, 25 bp, E. coli
gataaaaggctaccgcaaatctggt

SEQ ID NO: 202741 - DNA, 25 bp, E. coli
tggattgcagactcaagcgtagcta

SEQ ID NO: 202742 - DNA, 25 bp, E. coli
tggattgcagacacaagcgtagcta

SEQ ID NO: 202743 - DNA, 25 bp, E. coli
taatgaggccttaatcaggcgcagg

SEQ ID NO: 202744 - DNA, 25 bp, E. coli
taatgaggcctttatcaggcgcagg

SEQ ID NO: 202745 - DNA, 25 bp, E. coli
caccctgaccagtgttgaggaaacc

SEQ ID NO: 202746 - DNA, 25 bp, E. coli
caaagacgatcaaggtgcgcttgtc

SEQ ID NO: 202747 - DNA, 25 bp, E. coli
caaagacgatcatggtgcgcttgtc

SEQ ID NO: 202748 - DNA, 25 bp, E. coli
caccctgaccagagttgaggaaacc

SEQ ID NO: 202749 - DNA, 25 bp, E. coli
tggtgtttatgcaggacggctatcc

SEQ ID NO: 202750 - DNA, 25 bp, E. coli
tgtttatgcaggacggctatccgca

SEQ ID NO: 202751 - DNA, 25 bp, E. coli
tgtttatgcaggtcggctatccgca

SEQ ID NO: 202752 - DNA, 25 bp, E. coli
tgtcaccctgaccagtgttgaggaa

SEQ ID NO: 202753 - DNA, 25 bp, E. coli
tggtgtttatgctggacggctatcc

SEQ ID NO: 202754 - DNA, 25 bp, E. coli
tgtcaccctgacgagtgttgaggaa

SEQ ID NO: 202755 - DNA, 25 bp, E. coli
tgcaggacggctttccgcatccctg

SEQ ID NO: 202756 - DNA, 25 bp, E. coli
tgaccagtgttgtggaaacccgggt

SEQ ID NO: 202757 - DNA, 25 bp, E. coli
tgaccagtgttgaggaaacccgggt

SEQ ID NO: 202758 - DNA, 25 bp, E. coli
tgcaggacggctatccgcatccctg

SEQ ID NO: 202759 - DNA, 25 bp, E. coli
gacgatcatggtgcgcttgtcaccc

SEQ ID NO: 202760 - DNA, 25 bp, E. coli
gacgatcatggtccgcttgtcaccc

SEQ ID NO: 202761 - DNA, 25 bp, E. coli
cgcttgtcacccagaccagtgttga

SEQ ID NO: 202762 - DNA, 25 bp, E. coli
cgcttgtcaccctgaccagtgttga

SEQ ID NO: 202763 - DNA, 25 bp, E. coli
gatcatggtgcggttgtcaccctga

SEQ ID NO: 202764 - DNA, 25 bp, E. coli
ggtgcgcttgtctccctgaccagtg

SEQ ID NO: 202765 - DNA, 25 bp, E. coli
ggtgcgcttgtcaccctgaccagtg

SEQ ID NO: 202766 - DNA, 25 bp, E. coli
gatcatggtgcgcttgtcaccctga

SEQ ID NO: 202767 - DNA, 25 bp, E. coli
taaaggtcggctcaaaaatgacgcg

SEQ ID NO: 202768 - DNA, 25 bp, E. coli
taaaggtcggctgaaaaatgacgcg

SEQ ID NO: 202769 - DNA, 25 bp, E. coli
agcctcctgtctgggtcagccgaat

SEQ ID NO: 202770 - DNA, 25 bp, E. coli
agcctcctgtctcggtcagccgaat

SEQ ID NO: 202771 - DNA, 25 bp, E. coli
tattcagcctcctgtctgggtcagc

SEQ ID NO: 202772 - DNA, 25 bp, E. coli
tattcagcctccagtctgggtcagc

SEQ ID NO: 202773 - DNA, 25 bp, E. coli
tgctccttacggattattcagcctc

SEQ ID NO: 202774 - DNA, 25 bp, E. coli
tgctccttacggtttattcagcctc

SEQ ID NO: 202775 - DNA, 25 bp, E. coli
tcgtaatgacgcttcgaattgctcc

SEQ ID NO: 202776 - DNA, 25 bp, E. coli
tcgtaatgacgcatcgaattgctcc

SEQ ID NO: 202777 - DNA, 25 bp, E. coli
tcggctgaaaaatgacgcgttatag

SEQ ID NO: 202778 - DNA, 25 bp, E. coli
tcggctgaaaaaagacgcgttatag

SEQ ID NO: 202779 - DNA, 25 bp, E. coli
gcatcgaattgctccttacggatta

SEQ ID NO: 202780 - DNA, 25 bp, E. coli
gcatcgaattgcaccttacggatta

SEQ ID NO: 202781 - DNA, 25 bp, E. coli
gcaaggaacgtgttaaaggtcggct

SEQ ID NO: 202782 - DNA, 25 bp, E. coli
gcaaggaacgtgataaaggtcggct

SEQ ID NO: 202783 - DNA, 25 bp, E. coli
gacgcatcgaattgctccttacgga

SEQ ID NO: 202784 - DNA, 25 bp, E. coli
gacgcatcgaatagctccttacgga

SEQ ID NO: 202785 - DNA, 25 bp, E. coli
ctgtctgggtcacccgaatcccggg

SEQ ID NO: 202786 - DNA, 25 bp, E. coli
ctgtctgggtcagccgaatcccggg

SEQ ID NO: 202787 - DNA, 25 bp, E. coli
ggattattcagcctcctgtctgggt

SEQ ID NO: 202788 - DNA, 25 bp, E. coli
ggattattcagcgtcctgtctgggt

SEQ ID NO: 202789 - DNA, 25 bp, E. coli
caacgggagccagagattattgtct

SEQ ID NO: 202790 - DNA, 25 bp, E. coli
caacgggagccacagattattgtct

SEQ ID NO: 202791 - DNA, 25 bp, E. coli
cacccgttacgttttgatgagcgtg

SEQ ID NO: 202792 - DNA, 25 bp, E. coli
cacccgttacgtattgatgagcgtg

SEQ ID NO: 202793 - DNA, 25 bp, E. coli
catgggatgcgtattagtgaactgc

SEQ ID NO: 202794 - DNA, 25 bp, E. coli
catgggatgcgttttagtgaactgc

SEQ ID NO: 202795 - DNA, 25 bp, E. coli
taaatattcgcccactgaagaacgg

SEQ ID NO: 202796 - DNA, 25 bp, E. coli
taccggtaaagaagttcaggccatg

SEQ ID NO: 202797 - DNA, 25 bp, E. coli
taaatattcgccgactgaagaacgg

SEQ ID NO: 202798 - DNA, 25 bp, E. coli
taccggtaaagatgttcaggccatg

SEQ ID NO: 202799 - DNA, 25 bp, E. coli
tattctgttggcttatcggcatggg

SEQ ID NO: 202800 - DNA, 25 bp, E. coli
tatctcgggcatggaaatattcgcc

SEQ ID NO: 202801 - DNA, 25 bp, E. coli
tattgaagctggaaccgtaacgcag

SEQ ID NO: 202802 - DNA, 25 bp, E. coli
tatctcgggcatcgaaatattcgcc

SEQ ID NO: 202803 - DNA, 25 bp, E. coli
tattgaagctggtaccgtaacgcag

SEQ ID NO: 202804 - DNA, 25 bp, E. coli
tattctgttggcatatcggcatggg

SEQ ID NO: 202805 - DNA, 25 bp, E. coli
tgctgctcgtttagccggattatgg

SEQ ID NO: 202806 - DNA, 25 bp, E. coli
tgctgctcgttttgccggattatgg

SEQ ID NO: 202807 - DNA, 25 bp, E. coli
gccagcaggcctttcgcattattcg

SEQ ID NO: 202808 - DNA, 25 bp, E. coli
gccagcaggcctatcgcattattcg

SEQ ID NO: 202809 - DNA, 25 bp, E. coli
gaacgtgctaacaggaaaggcgctg

SEQ ID NO: 202810 - DNA, 25 bp, E. coli
gaacgtgctaactggaaaggcgctg

SEQ ID NO: 202811 - DNA, 25 bp, E. coli
cactctccggtgcagagacacagcg

SEQ ID NO: 202812 - DNA, 25 bp, E. coli
cactctccggtggagagacacagcg

SEQ ID NO: 202813 - DNA, 25 bp, E. coli
agtgccagccgttgcgccatcgtca

SEQ ID NO: 202814 - DNA, 25 bp, E. coli
agtgccagccgtagcgccatcgtca

SEQ ID NO: 202815 - DNA, 25 bp, E. coli
ttaatgaacaatgcgccaccatcca

SEQ ID NO: 202816 - DNA, 25 bp, E. coli
ttaatgaacaatccgccaccatcca

SEQ ID NO: 202817 - DNA, 25 bp, E. coli
tgatgaagcctttagccgcctgacg

SEQ ID NO: 202818 - DNA, 25 bp, E. coli
tgatgaagccttaagccgcctgacg

SEQ ID NO: 202819 - DNA, 25 bp, E. coli
tccggctgtacctttagcgtggaag

SEQ ID NO: 202820 - DNA, 25 bp, E. coli
tccggctgtaccattagcgtggaag

SEQ ID NO: 202821 - DNA, 25 bp, E. coli
gccagaaaatctgtgtcttgctgaa

SEQ ID NO: 202822 - DNA, 25 bp, E. coli
gccagcaagcgtggcaattgcaaaa

SEQ ID NO: 202823 - DNA, 25 bp, E. coli
gccagaaaatctctgtcttgctgaa

SEQ ID NO: 202824 - DNA, 25 bp, E. coli
gccagcaagcgtcgcaattgcaaaa

SEQ ID NO: 202825 - DNA, 25 bp, E. coli
gctcgtccagcattcgccctatttg

SEQ ID NO: 202826 - DNA, 25 bp, E. coli
gctcgtccagcaatcgccctatttg

SEQ ID NO: 202827 - DNA, 25 bp, E. coli
gaagaagttgccattgggccagaaa

SEQ ID NO: 202828 - DNA, 25 bp, E. coli
gaagaagttgcctttgggccagaaa

SEQ ID NO: 202829 - DNA, 25 bp, E. coli
gttgcagcgctttcaacactgggcg

SEQ ID NO: 202830 - DNA, 25 bp, E. coli
gttgcagcgcttacaacactgggcg

SEQ ID NO: 202831 - DNA, 25 bp, E. coli
tggcgggctggtttccggactttct

SEQ ID NO: 202832 - DNA, 25 bp, E. coli
tggcgggctggtatccggactttct

SEQ ID NO: 202833 - DNA, 25 bp, E. coli
aaccacctgggctctgtacaggaag

SEQ ID NO: 202834 - DNA, 25 bp, E. coli
aaccacctgggcactgtacaggaag

SEQ ID NO: 202835 - DNA, 25 bp, E. coli
caaaacctgtgtcgcgaaactggaa

SEQ ID NO: 202836 - DNA, 25 bp, E. coli
caaaacctgtgtggcgaaactggaa

SEQ ID NO: 202837 - DNA, 25 bp, E. coli
tacaggacccggtagtgaattcgcg

SEQ ID NO: 202838 - DNA, 25 bp, E. coli
tacaggacccggaagtgaattcgcg

SEQ ID NO: 202839 - DNA, 25 bp, E. coli
tgtacaggaagatggcaatttgcgc

SEQ ID NO: 202840 - DNA, 25 bp, E. coli
tgtacaggaagaaggcaatttgcgc

SEQ ID NO: 202841 - DNA, 25 bp, E. coli
gccgcgtaaaaaacgtctgttcaat

SEQ ID NO: 202842 - DNA, 25 bp, E. coli
cctataaagatgtagacgcagtggc

SEQ ID NO: 202843 - DNA, 25 bp, E. coli
gccgcgtaaaaatcgtctgttcaat

SEQ ID NO: 202844 - DNA, 25 bp, E. coli
cctataaagatgaagacgcagtggc

SEQ ID NO: 202845 - DNA, 25 bp, E. coli
gaatctttaatgtccgggccgcgta

SEQ ID NO: 202846 - DNA, 25 bp, E. coli
gaatctttaatgaccgggccgcgta

SEQ ID NO: 202847 - DNA, 25 bp, E. coli
gaagtttttcgccagaaccacctgg

SEQ ID NO: 202848 - DNA, 25 bp, E. coli
gaagtttttcgcgagaaccacctgg

SEQ ID NO: 202849 - DNA, 25 bp, E. coli
cgttcatgaagacaaggttgacgag

SEQ ID NO: 202850 - DNA, 25 bp, E. coli
cgttcatgaagagaaggttgacgag

SEQ ID NO: 202851 - DNA, 25 bp, E. coli
tgcgcttcgatgacttacaggaccc

SEQ ID NO: 202852 - DNA, 25 bp, E. coli
tgcgcttcgatgtcttacaggaccc

SEQ ID NO: 202853 - DNA, 25 bp, E. coli
gacgcagtggcgttccataaaacca

SEQ ID NO: 202854 - DNA, 25 bp, E. coli
gacgcagtggcgatccataaaacca

SEQ ID NO: 202855 - DNA, 25 bp, E. coli
aagttcctgcaggtgaaatagcccg

SEQ ID NO: 202856 - DNA, 25 bp, E. coli
aagttcctgcagctgaaatagcccg

SEQ ID NO: 202857 - DNA, 25 bp, E. coli
cagctgaaatagcccggacttattt

SEQ ID NO: 202858 - DNA, 25 bp, E. coli
cagctgaaataggccggacttattt

SEQ ID NO: 202859 - DNA, 25 bp, E. coli
ctgaaatagccccgacttatttcga

SEQ ID NO: 202860 - DNA, 25 bp, E. coli
ctgaaatagcccggacttatttcga

SEQ ID NO: 202861 - DNA, 25 bp, E. coli
agttcctgcagcagaaatagcccgg

SEQ ID NO: 202862 - DNA, 25 bp, E. coli
agttcctgcagctgaaatagcccgg

SEQ ID NO: 202863 - DNA, 25 bp, E. coli
ttcctgcagctgtaatagcccggac

SEQ ID NO: 202864 - DNA, 25 bp, E. coli
ttcctgcagctgaaatagcccggac

SEQ ID NO: 202865 - DNA, 25 bp, E. coli
tgcagctgaaattgcccggacttat

SEQ ID NO: 202866 - DNA, 25 bp, E. coli
tgcagctgaaatagcccggacttat

SEQ ID NO: 202867 - DNA, 25 bp, E. coli
tcctgcagctgaaatagcccggact

SEQ ID NO: 202868 - DNA, 25 bp, E. coli
tcctgcagctgatatagcccggact

SEQ ID NO: 202869 - DNA, 25 bp, E. coli
cctgcagctgaattagcccggactt

SEQ ID NO: 202870 - DNA, 25 bp, E. coli
cctgcagctgaaatagcccggactt

SEQ ID NO: 202871 - DNA, 25 bp, E. coli
gcagctgaaataccccggacttatt

SEQ ID NO: 202872 - DNA, 25 bp, E. coli
gcagctgaaatagcccggacttatt

SEQ ID NO: 202873 - DNA, 25 bp, E. coli
ctgcagctgaaaaagcccggactta

SEQ ID NO: 202874 - DNA, 25 bp, E. coli
ctgcagctgaaatagcccggactta

SEQ ID NO: 202875 - DNA, 25 bp, E. coli
gttcctgcagctgaaatagcccgga

SEQ ID NO: 202876 - DNA, 25 bp, E. coli
gttcctgcagctcaaatagcccgga

SEQ ID NO: 202877 - DNA, 25 bp, E. coli
caaaatgcattatacggttctggcg

SEQ ID NO: 202878 - DNA, 25 bp, E. coli
caaaatgcattaaacggttctggcg

SEQ ID NO: 202879 - DNA, 25 bp, E. coli
taactcaaaggataaaacgaccagc

SEQ ID NO: 202880 - DNA, 25 bp, E. coli
taactcaaaggaaaaaacgaccagc

SEQ ID NO: 202881 - DNA, 25 bp, E. coli
tatgcggagcttattaactcaaagg

SEQ ID NO: 202882 - DNA, 25 bp, E. coli
tatgcggagctttttaactcaaagg

SEQ ID NO: 202883 - DNA, 25 bp, E. coli
tgtttgtaagctaatcgatctggcg

SEQ ID NO: 202884 - DNA, 25 bp, E. coli
tgttgtgtccttccatatctatgcg

SEQ ID NO: 202885 - DNA, 25 bp, E. coli
tgtttgtaagcttatcgatctggcg

SEQ ID NO: 202886 - DNA, 25 bp, E. coli
tgttgtgtccttgcatatctatgcg

SEQ ID NO: 202887 - DNA, 25 bp, E. coli
gaacgctgctggaaaactgtctgaa

SEQ ID NO: 202888 - DNA, 25 bp, E. coli
gaacgctgctggtaaactgtctgaa

SEQ ID NO: 202889 - DNA, 25 bp, E. coli
gaaacatcttctgaaaaaagcatgg

SEQ ID NO: 202890 - DNA, 25 bp, E. coli
gaaacatcttctcaaaaaagcatgg

SEQ ID NO: 202891 - DNA, 25 bp, E. coli
cgaccagcaataagattataacgca

SEQ ID NO: 202892 - DNA, 25 bp, E. coli
cgaccagcaatatgattataacgca

SEQ ID NO: 202893 - DNA, 25 bp, E. coli
ctggcgatgaggaatgctgagaaac

SEQ ID NO: 202894 - DNA, 25 bp, E. coli
ctggcgatgaggtatgctgagaaac

SEQ ID NO: 202895 - DNA, 25 bp, E. coli
ggttaagcaggcattagccaaaatg

SEQ ID NO: 202896 - DNA, 25 bp, E. coli
ggttctggcggattcaatatgttga

SEQ ID NO: 202897 - DNA, 25 bp, E. coli
ggttaagcaggctttagccaaaatg

SEQ ID NO: 202898 - DNA, 25 bp, E. coli
ggttctggcggaatcaatatgttga

SEQ ID NO: 202899 - DNA, 25 bp, E. coli
catctggaactaggcgggaaatacc

SEQ ID NO: 202900 - DNA, 25 bp, E. coli
catctggaactacgcgggaaatacc

SEQ ID NO: 202901 - DNA, 25 bp, E. coli
taaaacagcgaatacgccgcagtgg

SEQ ID NO: 202902 - DNA, 25 bp, E. coli
taaaacagcgaaaacgccgcagtgg

SEQ ID NO: 202903 - DNA, 25 bp, E. coli
aaagcatttcgtcacgaccccgagg

SEQ ID NO: 202904 - DNA, 25 bp, E. coli
aaagcatttcgtgacgaccccgagg

SEQ ID NO: 202905 - DNA, 25 bp, E. coli
tattattcctaaggactacgccggt

SEQ ID NO: 202906 - DNA, 25 bp, E. coli
tattattcctaacgactacgccggt

SEQ ID NO: 202907 - DNA, 25 bp, E. coli
tgaaattggcactgcaaaacccgct

SEQ ID NO: 202908 - DNA, 25 bp, E. coli
tgaaattggcacagcaaaacccgct

SEQ ID NO: 202909 - DNA, 25 bp, E. coli
tgaattacccaatgaaacgcgtggg

SEQ ID NO: 202910 - DNA, 25 bp, E. coli
tgaattacccaaagaaacgcgtggg

SEQ ID NO: 202911 - DNA, 25 bp, E. coli
tcctgagtgaagacgcgaaacgtct

SEQ ID NO: 202912 - DNA, 25 bp, E. coli
tcctgagtgaagtcgcgaaacgtct

SEQ ID NO: 202913 - DNA, 25 bp, E. coli
cgtcaactgtggaagccgctgtgca

SEQ ID NO: 202914 - DNA, 25 bp, E. coli
cgtcaactgtggtagccgctgtgca

SEQ ID NO: 202915 - DNA, 25 bp, E. coli
tcaaacgcctgaagaactgctacgg

SEQ ID NO: 202916 - DNA, 25 bp, E. coli
tcaaacgcctgatgaactgctacgg

SEQ ID NO: 202917 - DNA, 25 bp, E. coli
gatggcaacagctccacggatattg

SEQ ID NO: 202918 - DNA, 25 bp, E. coli
gaccgtatcatctaactggcgcgtg

SEQ ID NO: 202919 - DNA, 25 bp, E. coli
gaccgtatcatcaaactggcgcgtg

SEQ ID NO: 202920 - DNA, 25 bp, E. coli
gatggcaacagcaccacggatattg

SEQ ID NO: 202921 - DNA, 25 bp, E. coli
caaggctatttatggtgcggatgtc

SEQ ID NO: 202922 - DNA, 25 bp, E. coli
caatcctgtgattggatgtcactga

SEQ ID NO: 202923 - DNA, 25 bp, E. coli
aacgatgttataatttttgcaaggc

SEQ ID NO: 202924 - DNA, 25 bp, E. coli
caatcctgtgataggatgtcactga

SEQ ID NO: 202925 - DNA, 25 bp, E. coli
caaggctatttaaggtgcggatgtc

SEQ ID NO: 202926 - DNA, 25 bp, E. coli
cataaacggcagattgaaaacaacg

SEQ ID NO: 202927 - DNA, 25 bp, E. coli
cataaacggcagtttgaaaacaacg

SEQ ID NO: 202928 - DNA, 25 bp, E. coli
ttcaaacgggatctttttatctgcg

SEQ ID NO: 202929 - DNA, 25 bp, E. coli
ttcaaacgggatgtttttatctgcg

SEQ ID NO: 202930 - DNA, 25 bp, E. coli
aacggtcaatccgataaacggcaga

SEQ ID NO: 202931 - DNA, 25 bp, E. coli
aacgatgttatattttttgcaaggc

SEQ ID NO: 202932 - DNA, 25 bp, E. coli
aacggtcaatcccataaacggcaga

SEQ ID NO: 202933 - DNA, 25 bp, E. coli
tgaactccgtgtgaaaagaaaacgg

SEQ ID NO: 202934 - DNA, 25 bp, E. coli
tgaactccgtgtcaaaagaaaacgg

SEQ ID NO: 202935 - DNA, 25 bp, E. coli
tgaggcacaaagagaaaaccctgcc

SEQ ID NO: 202936 - DNA, 25 bp, E. coli
tgaggcacaaagtgaaaaccctgcc

SEQ ID NO: 202937 - DNA, 25 bp, E. coli
taatgctcgtgaatagtcttataaa

SEQ ID NO: 202938 - DNA, 25 bp, E. coli
taattatggtaatgatgaggcacaa

SEQ ID NO: 202939 - DNA, 25 bp, E. coli
taatgctcgtgattagtcttataaa

SEQ ID NO: 202940 - DNA, 25 bp, E. coli
taattatggtaaagatgaggcacaa

SEQ ID NO: 202941 - DNA, 25 bp, E. coli
gatgttaatcacactgaccttacag

SEQ ID NO: 202942 - DNA, 25 bp, E. coli
gatgttaatcactctgaccttacag

SEQ ID NO: 202943 - DNA, 25 bp, E. coli
aatcctggcgcatctaacgtgttac

SEQ ID NO: 202944 - DNA, 25 bp, E. coli
aatcctggcgcaactaacgtgttac

SEQ ID NO: 202945 - DNA, 25 bp, E. coli
actaacgtgttacgtataggtggca

SEQ ID NO: 202946 - DNA, 25 bp, E. coli
actaacgtgttaggtataggtggca

SEQ ID NO: 202947 - DNA, 25 bp, E. coli
tccggtaatcctcgcgcaactaacg

SEQ ID NO: 202948 - DNA, 25 bp, E. coli
tccggtaatcctggcgcaactaacg

SEQ ID NO: 202949 - DNA, 25 bp, E. coli
tcctggcgcaacaaacgtgttacgt

SEQ ID NO: 202950 - DNA, 25 bp, E. coli
tcctggcgcaactaacgtgttacgt

SEQ ID NO: 202951 - DNA, 25 bp, E. coli
gctccggtaatcgtggcgcaactaa

SEQ ID NO: 202952 - DNA, 25 bp, E. coli
gctccggtaatcctggcgcaactaa

SEQ ID NO: 202953 - DNA, 25 bp, E. coli
gcaactaacgtgttacgtataggtg

SEQ ID NO: 202954 - DNA, 25 bp, E. coli
gcaactaacgtgatacgtataggtg

SEQ ID NO: 202955 - DNA, 25 bp, E. coli
cgtgttacgtataggtggcaaagga

SEQ ID NO: 202956 - DNA, 25 bp, E. coli
cgtgttacgtattggtggcaaagga

SEQ ID NO: 202957 - DNA, 25 bp, E. coli
ctggcgcaactaacgtgttacgtat

SEQ ID NO: 202958 - DNA, 25 bp, E. coli
ctggcgcaactatcgtgttacgtat

SEQ ID NO: 202959 - DNA, 25 bp, E. coli
gtaatcctggcggaactaacgtgtt

SEQ ID NO: 202960 - DNA, 25 bp, E. coli
gtaatcctggcgcaactaacgtgtt

SEQ ID NO: 202961 - DNA, 25 bp, E. coli
ggcgcaactaacgtgttacgtatag

SEQ ID NO: 202962 - DNA, 25 bp, E. coli
ggcgcaactaacctgttacgtatag

SEQ ID NO: 202963 - DNA, 25 bp, E. coli
taacgtgttacgaataggtggcaaa

SEQ ID NO: 202964 - DNA, 25 bp, E. coli
taacgtgttacgtataggtggcaaa

SEQ ID NO: 202965 - DNA, 25 bp, E. coli
ccccatcgtcaagactgctacctcg

SEQ ID NO: 202966 - DNA, 25 bp, E. coli
ccccatcgtcaacactgctacctcg

SEQ ID NO: 202967 - DNA, 25 bp, E. coli
taaaaatcgacctccgtcgcacgct

SEQ ID NO: 202968 - DNA, 25 bp, E. coli
taaaaatcgaccaccgtcgcacgct

SEQ ID NO: 202969 - DNA, 25 bp, E. coli
atcgaccaccgtggcacgctaccga

SEQ ID NO: 202970 - DNA, 25 bp, E. coli
atcgaccaccgtcgcacgctaccga

SEQ ID NO: 202971 - DNA, 25 bp, E. coli
aaaaatcgaccaccgtcgcacgcta

SEQ ID NO: 202972 - DNA, 25 bp, E. coli
aaaaatcgaccagcgtcgcacgcta

SEQ ID NO: 202973 - DNA, 25 bp, E. coli
aaatcgaccaccgtcgcacgctacc

SEQ ID NO: 202974 - DNA, 25 bp, E. coli
aaatcgaccaccctcgcacgctacc

SEQ ID NO: 202975 - DNA, 25 bp, E. coli
ttaaaaatcgaccaccgtcgcacgc

SEQ ID NO: 202976 - DNA, 25 bp, E. coli
ttaaaaatcgacgaccgtcgcacgc

SEQ ID NO: 202977 - DNA, 25 bp, E. coli
gcgttaaaaatccaccaccgtcgca

SEQ ID NO: 202978 - DNA, 25 bp, E. coli
gcgttaaaaatcgaccaccgtcgca

SEQ ID NO: 202979 - DNA, 25 bp, E. coli
cgaccaccgtcggacgctaccgaaa

SEQ ID NO: 202980 - DNA, 25 bp, E. coli
cgaccaccgtcgcacgctaccgaaa

SEQ ID NO: 202981 - DNA, 25 bp, E. coli
gttaaaaatcgaccaccgtcgcacg

SEQ ID NO: 202982 - DNA, 25 bp, E. coli
gttaaaaatcgagcaccgtcgcacg

SEQ ID NO: 202983 - DNA, 25 bp, E. coli
ggaggccaacaaagaatgacaccag

SEQ ID NO: 202984 - DNA, 25 bp, E. coli
ggaggccaacaatgaatgacaccag

SEQ ID NO: 202985 - DNA, 25 bp, E. coli
gaggccaacaatgaatgacaccagc

SEQ ID NO: 202986 - DNA, 25 bp, E. coli
gaggccaacaatcaatgacaccagc

SEQ ID NO: 202987 - DNA, 25 bp, E. coli
aataaagtgtgtgggcaacagcccc

SEQ ID NO: 202988 - DNA, 25 bp, E. coli
aataaagtgtgtcggcaacagcccc

SEQ ID NO: 202989 - DNA, 25 bp, E. coli
cacaacgtggcggacattattaccc

SEQ ID NO: 202990 - DNA, 25 bp, E. coli
cacaacgtggcgcacattattaccc

SEQ ID NO: 202991 - DNA, 25 bp, E. coli
cattattaccctcccggagtctaca

SEQ ID NO: 202992 - DNA, 25 bp, E. coli
cattattaccctgccggagtctaca

SEQ ID NO: 202993 - DNA, 25 bp, E. coli
cacgtaacgttcacaaataaagtgt

SEQ ID NO: 202994 - DNA, 25 bp, E. coli
cacgtaacgttctcaaataaagtgt

SEQ ID NO: 202995 - DNA, 25 bp, E. coli
ttctcagaagtgtgaattaacgcac

SEQ ID NO: 202996 - DNA, 25 bp, E. coli
ttctcagaagtgagaattaacgcac

SEQ ID NO: 202997 - DNA, 25 bp, E. coli
gcaataccatgcgtgtctgctatgc

SEQ ID NO: 202998 - DNA, 25 bp, E. coli
gcaataccatgcctgtctgctatgc

SEQ ID NO: 202999 - DNA, 25 bp, E. coli
ggtaataatcctttaacactgatgt

SEQ ID NO: 203000 - DNA, 25 bp, E. coli
ggtaataatcctataacactgatgt

SEQ ID NO: 203001 - DNA, 25 bp, E. coli
gatgttacctgcataatccagcaat

SEQ ID NO: 203002 - DNA, 25 bp, E. coli
gagcaagtccaatctctcaccatta

SEQ ID NO: 203003 - DNA, 25 bp, E. coli
gatgcgtttagccaaatttctcaga

SEQ ID NO: 203004 - DNA, 25 bp, E. coli
gagcaagtccaaactctcaccatta

SEQ ID NO: 203005 - DNA, 25 bp, E. coli
gagtctacagacattgagcaagtcc

SEQ ID NO: 203006 - DNA, 25 bp, E. coli
gagtctacagactttgagcaagtcc

SEQ ID NO: 203007 - DNA, 25 bp, E. coli
gatgttacctgcttaatccagcaat

SEQ ID NO: 203008 - DNA, 25 bp, E. coli
gatgcgtttagcgaaatttctcaga

SEQ ID NO: 203009 - DNA, 25 bp, E. coli
caaacgctcagcatgtcaggcaaca

SEQ ID NO: 203010 - DNA, 25 bp, E. coli
caaacgctcagcttgtcaggcaaca

SEQ ID NO: 203011 - DNA, 25 bp, E. coli
cagtcaactgccagaattgtgaggc

SEQ ID NO: 203012 - DNA, 25 bp, E. coli
cagtcaactgcctgaattgtgaggc

SEQ ID NO: 203013 - DNA, 25 bp, E. coli
taaaaagcccgcaaaagagagtcag

SEQ ID NO: 203014 - DNA, 25 bp, E. coli
taaaaagcccgctaaagagagtcag

SEQ ID NO: 203015 - DNA, 25 bp, E. coli
aaacatctgtcaatatgccccgccg

SEQ ID NO: 203016 - DNA, 25 bp, E. coli
aaacatctgtcattatgccccgccg

SEQ ID NO: 203017 - DNA, 25 bp, E. coli
tatacagcatgatgccgggtgcctc

SEQ ID NO: 203018 - DNA, 25 bp, E. coli
tatacagcatgaagccgggtgcctc

SEQ ID NO: 203019 - DNA, 25 bp, E. coli
tggtgcgttgtagtggattcgaacc

SEQ ID NO: 203020 - DNA, 25 bp, E. coli
tgaccagacagattccgcaacttgc

SEQ ID NO: 203021 - DNA, 25 bp, E. coli
tgaccagacagaatccgcaacttgc

SEQ ID NO: 203022 - DNA, 25 bp, E. coli
tcccggtgaattctgcaatgaccag

SEQ ID NO: 203023 - DNA, 25 bp, E. coli
tcccggtgaattgtgcaatgaccag

SEQ ID NO: 203024 - DNA, 25 bp, E. coli
gcatttaacattacactgtccggtg

SEQ ID NO: 203025 - DNA, 25 bp, E. coli
gcatttaacatttcactgtccggtg

SEQ ID NO: 203026 - DNA, 25 bp, E. coli
gaaggcaattgcactgtccggctga

SEQ ID NO: 203027 - DNA, 25 bp, E. coli
gaaccagtgaccgattgcttagaag

SEQ ID NO: 203028 - DNA, 25 bp, E. coli
gaaggcaattgctctgtccggctga

SEQ ID NO: 203029 - DNA, 25 bp, E. coli
gaaccagtgacccattgcttagaag

SEQ ID NO: 203030 - DNA, 25 bp, E. coli
tggtgcgttgtactggattcgaacc

SEQ ID NO: 203031 - DNA, 25 bp, E. coli
aatgctggttggttcacgacggata

SEQ ID NO: 203032 - DNA, 25 bp, E. coli
aatgctggttggatcacgacggata

SEQ ID NO: 203033 - DNA, 25 bp, E. coli
cagcacccgtgaagagggcggagac

SEQ ID NO: 203034 - DNA, 25 bp, E. coli
cacgtatttttcgtcactggataac

SEQ ID NO: 203035 - DNA, 25 bp, E. coli
cagcacccgtgatgagggcggagac

SEQ ID NO: 203036 - DNA, 25 bp, E. coli
cacgtatttttcctcactggataac

SEQ ID NO: 203037 - DNA, 25 bp, E. coli
ttcacgacggatatcccaggacatc

SEQ ID NO: 203038 - DNA, 25 bp, E. coli
tttttcgtcactcgataacatgatt

SEQ ID NO: 203039 - DNA, 25 bp, E. coli
tttttcgtcactggataacatgatt

SEQ ID NO: 203040 - DNA, 25 bp, E. coli
ttcacgacggatttcccaggacatc

SEQ ID NO: 203041 - DNA, 25 bp, E. coli
gctggttggttctcgacggatatcc

SEQ ID NO: 203042 - DNA, 25 bp, E. coli
gctggttggttcacgacggatatcc

SEQ ID NO: 203043 - DNA, 25 bp, E. coli
gaaatgctggttcgttcacgacgga

SEQ ID NO: 203044 - DNA, 25 bp, E. coli
gaacacgtatttatcgtcactggat

SEQ ID NO: 203045 - DNA, 25 bp, E. coli
gaacacgtatttttcgtcactggat

SEQ ID NO: 203046 - DNA, 25 bp, E. coli
gaaatgctggttggttcacgacgga

SEQ ID NO: 203047 - DNA, 25 bp, E. coli
ggttggttcacgtcggatatcccag

SEQ ID NO: 203048 - DNA, 25 bp, E. coli
ggttggttcacgacggatatcccag

SEQ ID NO: 203049 - DNA, 25 bp, E. coli
tggttcacgacgcatatcccaggac

SEQ ID NO: 203050 - DNA, 25 bp, E. coli
tggttcacgacggatatcccaggac

SEQ ID NO: 203051 - DNA, 25 bp, E. coli
tgatgagggcggagacgggaaagtg

SEQ ID NO: 203052 - DNA, 25 bp, E. coli
tgatgagggcggtgacgggaaagtg

SEQ ID NO: 203053 - DNA, 25 bp, E. coli
caagttgggttgttgaaggtaccat

SEQ ID NO: 203054 - DNA, 25 bp, E. coli
caagttgggttgatgaaggtaccat

SEQ ID NO: 203055 - DNA, 25 bp, E. coli
cacatgggcgcagtgtaataataat

SEQ ID NO: 203056 - DNA, 25 bp, E. coli
cacatgggcgcactgtaataataat

SEQ ID NO: 203057 - DNA, 25 bp, E. coli
taggcaaaaatgttgggagaattct

SEQ ID NO: 203058 - DNA, 25 bp, E. coli
taggcaaaaatgatgggagaattct

SEQ ID NO: 203059 - DNA, 25 bp, E. coli
ttttacatacaacacatgggcgcag

SEQ ID NO: 203060 - DNA, 25 bp, E. coli
ttttacatacaagacatgggcgcag

SEQ ID NO: 203061 - DNA, 25 bp, E. coli
tcactgagttaacaacaagttgggt

SEQ ID NO: 203062 - DNA, 25 bp, E. coli
tcactgagttaagaacaagttgggt

SEQ ID NO: 203063 - DNA, 25 bp, E. coli
gaatcgttatggtcaggatgccgca

SEQ ID NO: 203064 - DNA, 25 bp, E. coli
gaaggtaccattcactcagaccaaa

SEQ ID NO: 203065 - DNA, 25 bp, E. coli
gaatcgttatggacaggatgccgca

SEQ ID NO: 203066 - DNA, 25 bp, E. coli
gaaggtaccattgactcagaccaaa

SEQ ID NO: 203067 - DNA, 25 bp, E. coli
gaaaaaccataccaaatcactgagt

SEQ ID NO: 203068 - DNA, 25 bp, E. coli
gaaaaaccatacgaaatcactgagt

SEQ ID NO: 203069 - DNA, 25 bp, E. coli
tcactcagaccatattgctggtggg

SEQ ID NO: 203070 - DNA, 25 bp, E. coli
tcactcagaccaaattgctggtggg

SEQ ID NO: 203071 - DNA, 25 bp, E. coli
taatgcgcaagtttgaaagtgaagg

SEQ ID NO: 203072 - DNA, 25 bp, E. coli
taatgcgcaagtatgaaagtgaagg

SEQ ID NO: 203073 - DNA, 25 bp, E. coli
gagaattctgaaatttggccacgga

SEQ ID NO: 203074 - DNA, 25 bp, E. coli
gagaattctgaattttggccacgga

SEQ ID NO: 203075 - DNA, 25 bp, E. coli
cagcgtcagggatgaagagagccat

SEQ ID NO: 203076 - DNA, 25 bp, E. coli
cagcgtcagggaagaagagagccat

SEQ ID NO: 203077 - DNA, 25 bp, E. coli
aacatataaaagactggcagcgccc

SEQ ID NO: 203078 - DNA, 25 bp, E. coli
aacatataaaagtctggcagcgccc

SEQ ID NO: 203079 - DNA, 25 bp, E. coli
tatgtgccgctgtatgaagcatccc

SEQ ID NO: 203080 - DNA, 25 bp, E. coli
tagtacccgagcgaaaagataagga

SEQ ID NO: 203081 - DNA, 25 bp, E. coli
tagtacccgagccaaaagataagga

SEQ ID NO: 203082 - DNA, 25 bp, E. coli
tatgtgccgctgaatgaagcatccc

SEQ ID NO: 203083 - DNA, 25 bp, E. coli
tatggtgacgcgtgaaaatcccacg

SEQ ID NO: 203084 - DNA, 25 bp, E. coli
tatggtgacgcgagaaaatcccacg

SEQ ID NO: 203085 - DNA, 25 bp, E. coli
tctgattaaaggatccgcgacggtt

SEQ ID NO: 203086 - DNA, 25 bp, E. coli
tctgattaaaggttccgcgacggtt

SEQ ID NO: 203087 - DNA, 25 bp, E. coli
gaagttgccgactatcaaaacacgc

SEQ ID NO: 203088 - DNA, 25 bp, E. coli
gaagttgccgacaatcaaaacacgc

SEQ ID NO: 203089 - DNA, 25 bp, E. coli
cgggaagggtacaataacagcgtca

SEQ ID NO: 203090 - DNA, 25 bp, E. coli
cgggaagggtactataacagcgtca

SEQ ID NO: 203091 - DNA, 25 bp, E. coli
gataaggatcgaacctcgctggcct

SEQ ID NO: 203092 - DNA, 25 bp, E. coli
gataaggatcgatcctcgctggcct

SEQ ID NO: 203093 - DNA, 25 bp, E. coli
ggttatgcaagacaccccaatgctg

SEQ ID NO: 203094 - DNA, 25 bp, E. coli
ggttatgcaagagaccccaatgctg

SEQ ID NO: 203095 - DNA, 25 bp, E. coli
tactattaggcacggcgttactggc

SEQ ID NO: 203096 - DNA, 25 bp, E. coli
tactattaggcagggcgttactggc

SEQ ID NO: 203097 - DNA, 25 bp, E. coli
aacagccgtattggtaggcggtgac

SEQ ID NO: 203098 - DNA, 25 bp, E. coli
aacagccgtattcgtaggcggtgac

SEQ ID NO: 203099 - DNA, 25 bp, E. coli
tagcggcaatccctcttaaggtgac

SEQ ID NO: 203100 - DNA, 25 bp, E. coli
tagcggcaatccgtcttaaggtgac

SEQ ID NO: 203101 - DNA, 25 bp, E. coli
tatcgttgcagagcagtatttaggc

SEQ ID NO: 203102 - DNA, 25 bp, E. coli
tatagcgacattctgcaagccggtg

SEQ ID NO: 203103 - DNA, 25 bp, E. coli
tatagcgacattgtgcaagccggtg

SEQ ID NO: 203104 - DNA, 25 bp, E. coli
tatcgttgcagaccagtatttaggc

SEQ ID NO: 203105 - DNA, 25 bp, E. coli
tgataactgtgaaaaaacagccgta

SEQ ID NO: 203106 - DNA, 25 bp, E. coli
tgataactgtgataaaacagccgta

SEQ ID NO: 203107 - DNA, 25 bp, E. coli
gccggtggctttcgtgattatttac

SEQ ID NO: 203108 - DNA, 25 bp, E. coli
gccggtggctttggtgattatttac

SEQ ID NO: 203109 - DNA, 25 bp, E. coli
gaaggaggacgccatgaaactttta

SEQ ID NO: 203110 - DNA, 25 bp, E. coli
gaaggaggacgcgatgaaactttta

SEQ ID NO: 203111 - DNA, 25 bp, E. coli
gaaacttttaatcgcaatcatcctg

SEQ ID NO: 203112 - DNA, 25 bp, E. coli
gaaacttttaatggcaatcatcctg

SEQ ID NO: 203113 - DNA, 25 bp, E. coli
cgacagatttgaggatatagcggca

SEQ ID NO: 203114 - DNA, 25 bp, E. coli
cgacagatttgacgatatagcggca

SEQ ID NO: 203115 - DNA, 25 bp, E. coli
gataacgcaagaattgaatcagtcg

SEQ ID NO: 203116 - DNA, 25 bp, E. coli
gataacgcaagatttgaatcagtcg

SEQ ID NO: 203117 - DNA, 25 bp, E. coli
ggatctggctggtcgtatcgttgca

SEQ ID NO: 203118 - DNA, 25 bp, E. coli
ggatctggctggacgtatcgttgca

SEQ ID NO: 203119 - DNA, 25 bp, E. coli
caatggatcattgcacgtcagggtc

SEQ ID NO: 203120 - DNA, 25 bp, E. coli
caatggatcattccacgtcagggtc

SEQ ID NO: 203121 - DNA, 25 bp, E. coli
tgagcgcctgaaccaacattctctg

SEQ ID NO: 203122 - DNA, 25 bp, E. coli
tgcttatggcattccgtacatcggt

SEQ ID NO: 203123 - DNA, 25 bp, E. coli
tgcttatggcataccgtacatcggt

SEQ ID NO: 203124 - DNA, 25 bp, E. coli
tgagcgcctgaagcaacattctctg

SEQ ID NO: 203125 - DNA, 25 bp, E. coli
gcaacattctctcgcaaacaaactg

SEQ ID NO: 203126 - DNA, 25 bp, E. coli
gcacgtcagggtgagagtgaaccac

SEQ ID NO: 203127 - DNA, 25 bp, E. coli
gcacgtcagggtcagagtgaaccac

SEQ ID NO: 203128 - DNA, 25 bp, E. coli
gcaacattctctggcaaacaaactg

SEQ ID NO: 203129 - DNA, 25 bp, E. coli
gactggacgaaatacctgaaacaca

SEQ ID NO: 203130 - DNA, 25 bp, E. coli
gactggacgaaaaacctgaaacaca

SEQ ID NO: 203131 - DNA, 25 bp, E. coli
gaaaaagatctggagcaatggatca

SEQ ID NO: 203132 - DNA, 25 bp, E. coli
gaaaaagatctgcagcaatggatca

SEQ ID NO: 203133 - DNA, 25 bp, E. coli
ctgtctgaatgtgagcgcctgaagc

SEQ ID NO: 203134 - DNA, 25 bp, E. coli
ctgtctgaatgtcagcgcctgaagc

SEQ ID NO: 203135 - DNA, 25 bp, E. coli
gtacatcggttgatgccgctcacag

SEQ ID NO: 203136 - DNA, 25 bp, E. coli
gtacatcggttgttgccgctcacag

SEQ ID NO: 203137 - DNA, 25 bp, E. coli
tggcggcacggagttacgtctcaaa

SEQ ID NO: 203138 - DNA, 25 bp, E. coli
tggcggcacggacttacgtctcaaa

SEQ ID NO: 203139 - DNA, 25 bp, E. coli
gagtgaaccactcacaaatctgatg

SEQ ID NO: 203140 - DNA, 25 bp, E. coli
gagtgaaccactgacaaatctgatg

SEQ ID NO: 203141 - DNA, 25 bp, E. coli
aaccgcgcgcgctgtatttgtacgt

SEQ ID NO: 203142 - DNA, 25 bp, E. coli
aaccgcgcgcgcagtatttgtacgt

SEQ ID NO: 203143 - DNA, 25 bp, E. coli
cacgaccaagctggacgaatccgtt

SEQ ID NO: 203144 - DNA, 25 bp, E. coli
cacgaccaagctcgacgaatccgtt

SEQ ID NO: 203145 - DNA, 25 bp, E. coli
cagagacgacatgcctgaagcaacc

SEQ ID NO: 203146 - DNA, 25 bp, E. coli
cagagacgacatccctgaagcaacc

SEQ ID NO: 203147 - DNA, 25 bp, E. coli
tactggcgtatcaccgagcgttggg

SEQ ID NO: 203148 - DNA, 25 bp, E. coli
tacgtgccgtatcgcgatcagagcg

SEQ ID NO: 203149 - DNA, 25 bp, E. coli
tactggcgtatctccgagcgttggg

SEQ ID NO: 203150 - DNA, 25 bp, E. coli
tacgtgccgtatggcgatcagagcg

SEQ ID NO: 203151 - DNA, 25 bp, E. coli
tgaagcaacccgagttcacctggaa

SEQ ID NO: 203152 - DNA, 25 bp, E. coli
tgaagcaacccgtgttcacctggaa

SEQ ID NO: 203153 - DNA, 25 bp, E. coli
gctccgggttattcccaaacgctgg

SEQ ID NO: 203154 - DNA, 25 bp, E. coli
gctccgggttatacccaaacgctgg

SEQ ID NO: 203155 - DNA, 25 bp, E. coli
gacggcaaaatggtctttgaacgcg

SEQ ID NO: 203156 - DNA, 25 bp, E. coli
gacggcaaaatgctctttgaacgcg

SEQ ID NO: 203157 - DNA, 25 bp, E. coli
cgaatccgttaagcgcgtaatgccg

SEQ ID NO: 203158 - DNA, 25 bp, E. coli
cgaatccgttaaccgcgtaatgccg

SEQ ID NO: 203159 - DNA, 25 bp, E. coli
ctttgaacgcgaaatggaaatgctg

SEQ ID NO: 203160 - DNA, 25 bp, E. coli
ctttgaacgcgatatggaaatgctg

SEQ ID NO: 203161 - DNA, 25 bp, E. coli
gtaatgccgcaattcaaagttgacg

SEQ ID NO: 203162 - DNA, 25 bp, E. coli
gtaatgccgcaaatcaaagttgacg

SEQ ID NO: 203163 - DNA, 25 bp, E. coli
tatacatgcctgcaacacgggaaga

SEQ ID NO: 203164 - DNA, 25 bp, E. coli
tatacatgcctggaacacgggaaga

SEQ ID NO: 203165 - DNA, 25 bp, E. coli
ttatgaacgttgagtcgcttcgccg

SEQ ID NO: 203166 - DNA, 25 bp, E. coli
ttatgaacgttgtgtcgcttcgccg

SEQ ID NO: 203167 - DNA, 25 bp, E. coli
tgggttacagaaggagcaaagcgct

SEQ ID NO: 203168 - DNA, 25 bp, E. coli
tgggttacagaacgagcaaagcgct

SEQ ID NO: 203169 - DNA, 25 bp, E. coli
tgtcgacgggtttgtgctgcctaaa

SEQ ID NO: 203170 - DNA, 25 bp, E. coli
tgtcgacgggttagtgctgcctaaa

SEQ ID NO: 203171 - DNA, 25 bp, E. coli
cctgggtaaaaatgactggcctctg

SEQ ID NO: 203172 - DNA, 25 bp, E. coli
cctgggtaaaaaagactggcctctg

SEQ ID NO: 203173 - DNA, 25 bp, E. coli
tggctacccgtctggaggaacatcc

SEQ ID NO: 203174 - DNA, 25 bp, E. coli
tggctacccgtcaggaggaacatcc

SEQ ID NO: 203175 - DNA, 25 bp, E. coli
gaagatattgctcatgccgtcctgc

SEQ ID NO: 203176 - DNA, 25 bp, E. coli
gaagatattgctgatgccgtcctgc

SEQ ID NO: 203177 - DNA, 25 bp, E. coli
cattcacccgggacagatagaggtc

SEQ ID NO: 203178 - DNA, 25 bp, E. coli
cattcacccgggtcagatagaggtc

SEQ ID NO: 203179 - DNA, 25 bp, E. coli
gatagaggtcatacaaaacgcgctg

SEQ ID NO: 203180 - DNA, 25 bp, E. coli
gatagaggtcattcaaaacgcgctg

SEQ ID NO: 203181 - DNA, 25 bp, E. coli
tggctcttgatatggcacacgggct

SEQ ID NO: 203182 - DNA, 25 bp, E. coli
tggctcttgataaggcacacgggct

SEQ ID NO: 203183 - DNA, 25 bp, E. coli
tacccaggccgtctttaagtcgcag

SEQ ID NO: 203184 - DNA, 25 bp, E. coli
tacccaggccgtgtttaagtcgcag

SEQ ID NO: 203185 - DNA, 25 bp, E. coli
aataagtgatcggttacactacgcg

SEQ ID NO: 203186 - DNA, 25 bp, E. coli
aataagtgatcgcttacactacgcg

SEQ ID NO: 203187 - DNA, 25 bp, E. coli
tacactacgcgaggaaatacttttt

SEQ ID NO: 203188 - DNA, 25 bp, E. coli
ttcggtgtatgttgtagctgggtca

SEQ ID NO: 203189 - DNA, 25 bp, E. coli
ttcggtgtatgtagtagctgggtca

SEQ ID NO: 203190 - DNA, 25 bp, E. coli
tgctccttaatataagcgtaatggg

SEQ ID NO: 203191 - DNA, 25 bp, E. coli
tgtacattaacaccagaaagcacca

SEQ ID NO: 203192 - DNA, 25 bp, E. coli
tgctccttaataaaagcgtaatggg

SEQ ID NO: 203193 - DNA, 25 bp, E. coli
tgtacattaacagcagaaagcacca

SEQ ID NO: 203194 - DNA, 25 bp, E. coli
tcgctggctatgactaatcaattag

SEQ ID NO: 203195 - DNA, 25 bp, E. coli
tcgctggctatgtctaatcaattag

SEQ ID NO: 203196 - DNA, 25 bp, E. coli
gccatctgcattttcgcatagcgta

SEQ ID NO: 203197 - DNA, 25 bp, E. coli
gccatctgcattatcgcatagcgta

SEQ ID NO: 203198 - DNA, 25 bp, E. coli
gctgaaataatcacgcgcaggactg

SEQ ID NO: 203199 - DNA, 25 bp, E. coli
gctgaaataatctcgcgcaggactg

SEQ ID NO: 203200 - DNA, 25 bp, E. coli
gaaagcagtggatctcattgccatc

SEQ ID NO: 203201 - DNA, 25 bp, E. coli
gaaagcagtggaactcattgccatc

SEQ ID NO: 203202 - DNA, 25 bp, E. coli
cgcgcaggactgaaaatagattaaa

SEQ ID NO: 203203 - DNA, 25 bp, E. coli
cgctataagcgtagagaattcggtg

SEQ ID NO: 203204 - DNA, 25 bp, E. coli
cgctataagcgttgagaattcggtg

SEQ ID NO: 203205 - DNA, 25 bp, E. coli
cgcgcaggactgtaaatagattaaa

SEQ ID NO: 203206 - DNA, 25 bp, E. coli
tacactacgcgacgaaatacttttt

SEQ ID NO: 203207 - DNA, 25 bp, E. coli
catgcccgcaggctgatgtaacccg

SEQ ID NO: 203208 - DNA, 25 bp, E. coli
catgcccgcagggtgatgtaacccg

SEQ ID NO: 203209 - DNA, 25 bp, E. coli
tacgtaagcactcccggtcgaaggt

SEQ ID NO: 203210 - DNA, 25 bp, E. coli
tttgacatgtatgcgaaacaccggg

SEQ ID NO: 203211 - DNA, 25 bp, E. coli
tttgacatgtatccgaaacaccggg

SEQ ID NO: 203212 - DNA, 25 bp, E. coli
tgaacccgttaaaccgcctctgtgg

SEQ ID NO: 203213 - DNA, 25 bp, E. coli
tgaacccgttaatccgcctctgtgg

SEQ ID NO: 203214 - DNA, 25 bp, E. coli
cctctgtgggttcaaaacgtcacca

SEQ ID NO: 203215 - DNA, 25 bp, E. coli
cctacgtgatctgacaggccgtgca

SEQ ID NO: 203216 - DNA, 25 bp, E. coli
cctacgtgatctcacaggccgtgca

SEQ ID NO: 203217 - DNA, 25 bp, E. coli
cctctgtgggttgaaaacgtcacca

SEQ ID NO: 203218 - DNA, 25 bp, E. coli
cattacatggcgaagggaagcagtt

SEQ ID NO: 203219 - DNA, 25 bp, E. coli
cattacatggcgtagggaagcagtt

SEQ ID NO: 203220 - DNA, 25 bp, E. coli
gattgaggcgagatcactaagccga

SEQ ID NO: 203221 - DNA, 25 bp, E. coli
gattgaggcgagttcactaagccga

SEQ ID NO: 203222 - DNA, 25 bp, E. coli
tggagaacctgagcggcagtgacct

SEQ ID NO: 203223 - DNA, 25 bp, E. coli
tggagaacctgaccggcagtgacct

SEQ ID NO: 203224 - DNA, 25 bp, E. coli
taactgacctaaggaggtgaagacc

SEQ ID NO: 203225 - DNA, 25 bp, E. coli
taactgacctaacgaggtgaagacc

SEQ ID NO: 203226 - DNA, 25 bp, E. coli
tacgtaagcactgccggtcgaaggt

SEQ ID NO: 203227 - DNA, 25 bp, E. coli
gagcttccgtagtagtccgcgatgg

SEQ ID NO: 203228 - DNA, 25 bp, E. coli
gagcttccgtagaagtccgcgatgg

SEQ ID NO: 203229 - DNA, 25 bp, E. coli
catgccacaccggatgagttagcgc

SEQ ID NO: 203230 - DNA, 25 bp, E. coli
catgccacaccgcatgagttagcgc

SEQ ID NO: 203231 - DNA, 25 bp, E. coli
atgtcagaagccctggtaaacccgc

SEQ ID NO: 203232 - DNA, 25 bp, E. coli
atgtcagaagccgtggtaaacccgc

SEQ ID NO: 203233 - DNA, 25 bp, E. coli
tatcagccagaagaacaagaggcac

SEQ ID NO: 203234 - DNA, 25 bp, E. coli
tatcagccagaacaacaagaggcac

SEQ ID NO: 203235 - DNA, 25 bp, E. coli
tgatccggcgttattgcagccagag

SEQ ID NO: 203236 - DNA, 25 bp, E. coli
tgatccggcgtttttgcagccagag

SEQ ID NO: 203237 - DNA, 25 bp, E. coli
cgctgacggcagaaaatcaatatcg

SEQ ID NO: 203238 - DNA, 25 bp, E. coli
cgctgacggcagtaaatcaatatcg

SEQ ID NO: 203239 - DNA, 25 bp, E. coli
cttacggctggcagatgaaacgtga

SEQ ID NO: 203240 - DNA, 25 bp, E. coli
cgtaaaattctccacagcgaagcca

SEQ ID NO: 203241 - DNA, 25 bp, E. coli
cgtaaaattctcgacagcgaagcca

SEQ ID NO: 203242 - DNA, 25 bp, E. coli
cttacggctggctgatgaaacgtga

SEQ ID NO: 203243 - DNA, 25 bp, E. coli
gattgataaagaactcgccgctgcg

SEQ ID NO: 203244 - DNA, 25 bp, E. coli
gattgataaagatctcgccgctgcg

SEQ ID NO: 203245 - DNA, 25 bp, E. coli
ggcgtctccgcaaccgcgtaaaatt

SEQ ID NO: 203246 - DNA, 25 bp, E. coli
ggcgtctccgcatccgcgtaaaatt

SEQ ID NO: 203247 - DNA, 25 bp, E. coli
gagttagcgccaattgccaaagccg

SEQ ID NO: 203248 - DNA, 25 bp, E. coli
gaggtagaaccgtatccgctggatg

SEQ ID NO: 203249 - DNA, 25 bp, E. coli
gaggtagaaccgaatccgctggatg

SEQ ID NO: 203250 - DNA, 25 bp, E. coli
gagttagcgccatttgccaaagccg

SEQ ID NO: 203251 - DNA, 25 bp, E. coli
aattggtgcatccagcgcgattgag

SEQ ID NO: 203252 - DNA, 25 bp, E. coli
aattggtgcatcgagcgcgattgag

SEQ ID NO: 203253 - DNA, 25 bp, E. coli
atcgagcgcgatagaggccctgcat

SEQ ID NO: 203254 - DNA, 25 bp, E. coli
attcgccccagtcctcattttggca

SEQ ID NO: 203255 - DNA, 25 bp, E. coli
attcgccccagtgctcattttggca

SEQ ID NO: 203256 - DNA, 25 bp, E. coli
atcgagcgcgattgaggccctgcat

SEQ ID NO: 203257 - DNA, 25 bp, E. coli
ttgaggccctgcttcgccaggtcgt

SEQ ID NO: 203258 - DNA, 25 bp, E. coli
ttgaggccctgcatcgccaggtcgt

SEQ ID NO: 203259 - DNA, 25 bp, E. coli
tgcatcgagcgccattgaggccctg

SEQ ID NO: 203260 - DNA, 25 bp, E. coli
tgcatcgagcgcgattgaggccctg

SEQ ID NO: 203261 - DNA, 25 bp, E. coli
tgcatcgccaggacgtcagcggtct

SEQ ID NO: 203262 - DNA, 25 bp, E. coli
tgcatcgccaggtcgtcagcggtct

SEQ ID NO: 203263 - DNA, 25 bp, E. coli
tcgccaggtcgtcagcggtctgaat

SEQ ID NO: 203264 - DNA, 25 bp, E. coli
tcgccaggtcgtgagcggtctgaat

SEQ ID NO: 203265 - DNA, 25 bp, E. coli
gccccagtcctcattttggcacggt

SEQ ID NO: 203266 - DNA, 25 bp, E. coli
gccccagtcctctttttggcacggt

SEQ ID NO: 203267 - DNA, 25 bp, E. coli
ccagtcctcattatggcacggtgga

SEQ ID NO: 203268 - DNA, 25 bp, E. coli
ccagtcctcattttggcacggtgga

SEQ ID NO: 203269 - DNA, 25 bp, E. coli
cgagcgcgattgaggccctgcatcg

SEQ ID NO: 203270 - DNA, 25 bp, E. coli
cgattgaggcccagcatcgccaggt

SEQ ID NO: 203271 - DNA, 25 bp, E. coli
cgattgaggccctgcatcgccaggt

SEQ ID NO: 203272 - DNA, 25 bp, E. coli
cgagcgcgattgtggccctgcatcg

SEQ ID NO: 203273 - DNA, 25 bp, E. coli
caattaccggagagcttgtacgcgc

SEQ ID NO: 203274 - DNA, 25 bp, E. coli
caattaccggagtgcttgtacgcgc

SEQ ID NO: 203275 - DNA, 25 bp, E. coli
tattgctgaagcaacccgggctgta

SEQ ID NO: 203276 - DNA, 25 bp, E. coli
tattgctgaagctacccgggctgta

SEQ ID NO: 203277 - DNA, 25 bp, E. coli
tgtacgcgcactcaaagatcgcccg

SEQ ID NO: 203278 - DNA, 25 bp, E. coli
tgtacgcgcactgaaagatcgcccg

SEQ ID NO: 203279 - DNA, 25 bp, E. coli
tcctctgaaggattacacgggtgca

SEQ ID NO: 203280 - DNA, 25 bp, E. coli
tcctctgaaggaatacacgggtgca

SEQ ID NO: 203281 - DNA, 25 bp, E. coli
tctcagtgaattcgaatgcagccgg

SEQ ID NO: 203282 - DNA, 25 bp, E. coli
tctcagtgaattggaatgcagccgg

SEQ ID NO: 203283 - DNA, 25 bp, E. coli
tattacgtcgggaaccggaccatgt

SEQ ID NO: 203284 - DNA, 25 bp, E. coli
tattacgtcgggtaccggaccatgt

SEQ ID NO: 203285 - DNA, 25 bp, E. coli
tcttatggcagacaagtcgcgacgt

SEQ ID NO: 203286 - DNA, 25 bp, E. coli
tcttatggcagagaagtcgcgacgt

SEQ ID NO: 203287 - DNA, 25 bp, E. coli
cgttctattgaccacccggacgttg

SEQ ID NO: 203288 - DNA, 25 bp, E. coli
cgttctattgacgacccggacgttg

SEQ ID NO: 203289 - DNA, 25 bp, E. coli
tggaatacggaatcagcccgggtct

SEQ ID NO: 203290 - DNA, 25 bp, E. coli
tggaatacggaaacagcccgggtct

SEQ ID NO: 203291 - DNA, 25 bp, E. coli
gatcgtggaattgacggtgcagccc

SEQ ID NO: 203292 - DNA, 25 bp, E. coli
gatcgtggaattcacggtgcagccc

SEQ ID NO: 203293 - DNA, 25 bp, E. coli
ggtgcagccctcgacgtcattgaag

SEQ ID NO: 203294 - DNA, 25 bp, E. coli
ggtgcagccctccacgtcattgaag

SEQ ID NO: 203295 - DNA, 25 bp, E. coli
aattcagcacctatgtcaccgtcag

SEQ ID NO: 203296 - DNA, 25 bp, E. coli
aattcagcacctttgtcaccgtcag

SEQ ID NO: 203297 - DNA, 25 bp, E. coli
ttaagattgcgctgccgcttatcgc

SEQ ID NO: 203298 - DNA, 25 bp, E. coli
ttaagattgcgcagccgcttatcgc

SEQ ID NO: 203299 - DNA, 25 bp, E. coli
tgcagttccgctttgttgaaagcaa

SEQ ID NO: 203300 - DNA, 25 bp, E. coli
tgatgttcctcgtcatcgtgctgac

SEQ ID NO: 203301 - DNA, 25 bp, E. coli
tgatgttcctcgacatcgtgctgac

SEQ ID NO: 203302 - DNA, 25 bp, E. coli
tgcagttccgctatgttgaaagcaa

SEQ ID NO: 203303 - DNA, 25 bp, E. coli
tctggacgacgaaaaaattcagcac

SEQ ID NO: 203304 - DNA, 25 bp, E. coli
tctggacgacgataaaattcagcac

SEQ ID NO: 203305 - DNA, 25 bp, E. coli
gccgttgccgccctattgtggatct

SEQ ID NO: 203306 - DNA, 25 bp, E. coli
gccgttgccgccgtattgtggatct

SEQ ID NO: 203307 - DNA, 25 bp, E. coli
gcgtcgatccgtttggtttctccag

SEQ ID NO: 203308 - DNA, 25 bp, E. coli
gcgtcgatccgtatggtttctccag

SEQ ID NO: 203309 - DNA, 25 bp, E. coli
gaacctggtgtaagccttcttcgac

SEQ ID NO: 203310 - DNA, 25 bp, E. coli
gaacctggtgtatgccttcttcgac

SEQ ID NO: 203311 - DNA, 25 bp, E. coli
cgttcgttgatcgaagccgcagcca

SEQ ID NO: 203312 - DNA, 25 bp, E. coli
cgttcgttgatccaagccgcagcca

SEQ ID NO: 203313 - DNA, 25 bp, E. coli
tggaaccacgcgcaaaacagcggtc

SEQ ID NO: 203314 - DNA, 25 bp, E. coli
tggaaccacgcggaaaacagcggtc

SEQ ID NO: 203315 - DNA, 25 bp, E. coli
gagttcggctaccactggaaccacg

SEQ ID NO: 203316 - DNA, 25 bp, E. coli
gagttcggctacgactggaaccacg

SEQ ID NO: 203317 - DNA, 25 bp, E. coli
caatctctggtttgttttcagatga

SEQ ID NO: 203318 - DNA, 25 bp, E. coli
caatctctggttagttttcagatga

SEQ ID NO: 203319 - DNA, 25 bp, E. coli
caaagtgttgcacgaaaaggtaggc

SEQ ID NO: 203320 - DNA, 25 bp, E. coli
caaagtgttgcaggaaaaggtaggc

SEQ ID NO: 203321 - DNA, 25 bp, E. coli
ctcataaattcaaagtgttgcagga

SEQ ID NO: 203322 - DNA, 25 bp, E. coli
agcgcatcaggctatctctggtttg

SEQ ID NO: 203323 - DNA, 25 bp, E. coli
agcgcatcaggcaatctctggtttg

SEQ ID NO: 203324 - DNA, 25 bp, E. coli
ttttcagatgaatacgccggagtga

SEQ ID NO: 203325 - DNA, 25 bp, E. coli
ttttcagatgaaaacgccggagtga

SEQ ID NO: 203326 - DNA, 25 bp, E. coli
tgttgcaggaaaaggtaggcctgat

SEQ ID NO: 203327 - DNA, 25 bp, E. coli
tgaaaacgccggagtgaaaattctc

SEQ ID NO: 203328 - DNA, 25 bp, E. coli
tgaaaacgccggtgtgaaaattctc

SEQ ID NO: 203329 - DNA, 25 bp, E. coli
tgttgcaggaaatggtaggcctgat

SEQ ID NO: 203330 - DNA, 25 bp, E. coli
tccagcctacaataactcataaatt

SEQ ID NO: 203331 - DNA, 25 bp, E. coli
tccagcctacaaaaactcataaatt

SEQ ID NO: 203332 - DNA, 25 bp, E. coli
tctccggcgtttgagattgttgaca

SEQ ID NO: 203333 - DNA, 25 bp, E. coli
tctccggcgtttcagattgttgaca

SEQ ID NO: 203334 - DNA, 25 bp, E. coli
gagtgaaaattctccggcgttttgg

SEQ ID NO: 203335 - DNA, 25 bp, E. coli
gagagaaaaatctccggcgtttcag

SEQ ID NO: 203336 - DNA, 25 bp, E. coli
gagtgaaaattcaccggcgttttgg

SEQ ID NO: 203337 - DNA, 25 bp, E. coli
gagagaaaaatcaccggcgtttcag

SEQ ID NO: 203338 - DNA, 25 bp, E. coli
ctcataaattcatagtgttgcagga

SEQ ID NO: 203339 - DNA, 25 bp, E. coli
ctttcctggaagatagccgaacgcg

SEQ ID NO: 203340 - DNA, 25 bp, E. coli
ctttcctggaagttagccgaacgcg

SEQ ID NO: 203341 - DNA, 25 bp, E. coli
aacaatatccgtataaccgctgccg

SEQ ID NO: 203342 - DNA, 25 bp, E. coli
aacaatatccgtttaaccgctgccg

SEQ ID NO: 203343 - DNA, 25 bp, E. coli
tagccgaacgcgtcactttggtcga

SEQ ID NO: 203344 - DNA, 25 bp, E. coli
tagccgaacgcgacactttggtcga

SEQ ID NO: 203345 - DNA, 25 bp, E. coli
ttttcacccgccacagaaacaatat

SEQ ID NO: 203346 - DNA, 25 bp, E. coli
ttttcacccgcctcagaaacaatat

SEQ ID NO: 203347 - DNA, 25 bp, E. coli
tgccttatgcagaaacgctcatgag

SEQ ID NO: 203348 - DNA, 25 bp, E. coli
tgccttatgcagtaacgctcatgag

SEQ ID NO: 203349 - DNA, 25 bp, E. coli
tcctggaagttagccgaacgcgtca

SEQ ID NO: 203350 - DNA, 25 bp, E. coli
tcctggaagttacccgaacgcgtca

SEQ ID NO: 203351 - DNA, 25 bp, E. coli
gaatcagacaacaggaaaatcaact

SEQ ID NO: 203352 - DNA, 25 bp, E. coli
gaatcagacaactggaaaatcaact

SEQ ID NO: 203353 - DNA, 25 bp, E. coli
gaaacgctcatgagcacctggcagg

SEQ ID NO: 203354 - DNA, 25 bp, E. coli
gaaacgctcatgtgcacctggcagg

SEQ ID NO: 203355 - DNA, 25 bp, E. coli
cggctgaatcgctctatctgaccca

SEQ ID NO: 203356 - DNA, 25 bp, E. coli
cgtcactttggtggagcggctgaat

SEQ ID NO: 203357 - DNA, 25 bp, E. coli
cgtcactttggtcgagcggctgaat

SEQ ID NO: 203358 - DNA, 25 bp, E. coli
cggctgaatcgcactatctgaccca

SEQ ID NO: 203359 - DNA, 25 bp, E. coli
gtgagctttcgattcagacaactgg

SEQ ID NO: 203360 - DNA, 25 bp, E. coli
gtgagctttcgaatcagacaactgg

SEQ ID NO: 203361 - DNA, 25 bp, E. coli
aagcaactggctatccgggcaacac

SEQ ID NO: 203362 - DNA, 25 bp, E. coli
aagcaactggctttccgggcaacac

SEQ ID NO: 203363 - DNA, 25 bp, E. coli
caacgaattgagtgctgccggtcag

SEQ ID NO: 203364 - DNA, 25 bp, E. coli
caacgaattgagagctgccggtcag

SEQ ID NO: 203365 - DNA, 25 bp, E. coli
cagagtgtacgcattgtggacgagc

SEQ ID NO: 203366 - DNA, 25 bp, E. coli
cagagtgtacgctttgtggacgagc

SEQ ID NO: 203367 - DNA, 25 bp, E. coli
tactgatggcgggttgtagctccag

SEQ ID NO: 203368 - DNA, 25 bp, E. coli
tactgatggcggcttgtagctccag

SEQ ID NO: 203369 - DNA, 25 bp, E. coli
tgttgtccagttatgtcccgacgga

SEQ ID NO: 203370 - DNA, 25 bp, E. coli
tgttgtccagttttgtcccgacgga

SEQ ID NO: 203371 - DNA, 25 bp, E. coli
tgcgacaggtaaccaaagcaactgg

SEQ ID NO: 203372 - DNA, 25 bp, E. coli
tgcgacaggtaagcaaagcaactgg

SEQ ID NO: 203373 - DNA, 25 bp, E. coli
ccagctgattggaactgcgacaggt

SEQ ID NO: 203374 - DNA, 25 bp, E. coli
ccagctgattggtactgcgacaggt

SEQ ID NO: 203375 - DNA, 25 bp, E. coli
gcccgtcgcagggaatgttgtccag

SEQ ID NO: 203376 - DNA, 25 bp, E. coli
gcccgtcgcaggcaatgttgtccag

SEQ ID NO: 203377 - DNA, 25 bp, E. coli
gcagcaaacgatgtgcgcaaccagg

SEQ ID NO: 203378 - DNA, 25 bp, E. coli
gcagcaaacgatctgcgcaaccagg

SEQ ID NO: 203379 - DNA, 25 bp, E. coli
ctgcaatgggcgctaacgtgattta

SEQ ID NO: 203380 - DNA, 25 bp, E. coli
ctgcaatgggcggtaacgtgattta

SEQ ID NO: 203381 - DNA, 25 bp, E. coli
gtcccgacggatagccagattatcg

SEQ ID NO: 203382 - DNA, 25 bp, E. coli
gtcccgacggattgccagattatcg

SEQ ID NO: 203383 - DNA, 25 bp, E. coli
cacaacgccggctgattctggaaga

SEQ ID NO: 203384 - DNA, 25 bp, E. coli
cacaacgccggcagattctggaaga

SEQ ID NO: 203385 - DNA, 25 bp, E. coli
taaagcacgactggctcagcaagaa

SEQ ID NO: 203386 - DNA, 25 bp, E. coli
taaagcacgactcgctcagcaagaa

SEQ ID NO: 203387 - DNA, 25 bp, E. coli
ttggcgttacgtgccggtgcacaac

SEQ ID NO: 203388 - DNA, 25 bp, E. coli
ttggcgttacgtcccggtgcacaac

SEQ ID NO: 203389 - DNA, 25 bp, E. coli
tgcacaacgttttcatgctcagccg

SEQ ID NO: 203390 - DNA, 25 bp, E. coli
tgcacaacgtttacatgctcagccg

SEQ ID NO: 203391 - DNA, 25 bp, E. coli
gctggatgccagtaacagaacgcta

SEQ ID NO: 203392 - DNA, 25 bp, E. coli
gctggatgccagaaacagaacgcta

SEQ ID NO: 203393 - DNA, 25 bp, E. coli
gaaacagaacgctactcgaatgcgt

SEQ ID NO: 203394 - DNA, 25 bp, E. coli
gaaacagaacgcaactcgaatgcgt

SEQ ID NO: 203395 - DNA, 25 bp, E. coli
cgcgtgctggccaatggcgaagcaa

SEQ ID NO: 203396 - DNA, 25 bp, E. coli
cgcgtgctggcctatggcgaagcaa

SEQ ID NO: 203397 - DNA, 25 bp, E. coli
ctggcgttgccggaactgaacgtcg

SEQ ID NO: 203398 - DNA, 25 bp, E. coli
ctggcgttgccgcaactgaacgtcg

SEQ ID NO: 203399 - DNA, 25 bp, E. coli
ctgcataccgtagaggatttgctct

SEQ ID NO: 203400 - DNA, 25 bp, E. coli
cattctcactatccgctttttcaac

SEQ ID NO: 203401 - DNA, 25 bp, E. coli
ctgcataccgtacaggatttgctct

SEQ ID NO: 203402 - DNA, 25 bp, E. coli
cattctcactatgcgctttttcaac

SEQ ID NO: 203403 - DNA, 25 bp, E. coli
gatttgctcttagaccttcctctgc

SEQ ID NO: 203404 - DNA, 25 bp, E. coli
gatttgctcttacaccttcctctgc

SEQ ID NO: 203405 - DNA, 25 bp, E. coli
cacaatgcgagattaagcggatata

SEQ ID NO: 203406 - DNA, 25 bp, E. coli
cacaatgcgagaataagcggatata

SEQ ID NO: 203407 - DNA, 25 bp, E. coli
taaaagtcttacatgcaatagttgc

SEQ ID NO: 203408 - DNA, 25 bp, E. coli
taaaagtcttacttgcaatagttgc

SEQ ID NO: 203409 - DNA, 25 bp, E. coli
aaataatgccagtagagtcaccgcg

SEQ ID NO: 203410 - DNA, 25 bp, E. coli
aaataatgccagaagagtcaccgcg

SEQ ID NO: 203411 - DNA, 25 bp, E. coli
tatggatatccgtagcatctacgcg

SEQ ID NO: 203412 - DNA, 25 bp, E. coli
tatggatatccgaagcatctacgcg

SEQ ID NO: 203413 - DNA, 25 bp, E. coli
tgcaatcgttaggtaattactggcg

SEQ ID NO: 203414 - DNA, 25 bp, E. coli
tatacggatagggaggttcttaaca

SEQ ID NO: 203415 - DNA, 25 bp, E. coli
tatacggataggcaggttcttaaca

SEQ ID NO: 203416 - DNA, 25 bp, E. coli
tgcaatcgttagctaattactggcg

SEQ ID NO: 203417 - DNA, 25 bp, E. coli
tctacgcgtacaagcaacgaatcga

SEQ ID NO: 203418 - DNA, 25 bp, E. coli
tctacgcgtacatgcaacgaatcga

SEQ ID NO: 203419 - DNA, 25 bp, E. coli
gactatcttgcatgtactgacatgg

SEQ ID NO: 203420 - DNA, 25 bp, E. coli
gactatcttgcaagtactgacatgg

SEQ ID NO: 203421 - DNA, 25 bp, E. coli
ggattgttttagtcagcgaccgcaa

SEQ ID NO: 203422 - DNA, 25 bp, E. coli
ggattgttttagacagcgaccgcaa

SEQ ID NO: 203423 - DNA, 25 bp, E. coli
taatcgtggtgtcgtagaaggtatc

SEQ ID NO: 203424 - DNA, 25 bp, E. coli
taatcgtggtgtggtagaaggtatc

SEQ ID NO: 203425 - DNA, 25 bp, E. coli
gatgttgccaatgaaaagatcagac

SEQ ID NO: 203426 - DNA, 25 bp, E. coli
gatgttgccaatcaaaagatcagac

SEQ ID NO: 203427 - DNA, 25 bp, E. coli
caactgtggcgcgatttggataacc

SEQ ID NO: 203428 - DNA, 25 bp, E. coli
cacgggttgcacgatctactggaga

SEQ ID NO: 203429 - DNA, 25 bp, E. coli
cacgggttgcaccatctactggaga

SEQ ID NO: 203430 - DNA, 25 bp, E. coli
caactgtggcgccatttggataacc

SEQ ID NO: 203431 - DNA, 25 bp, E. coli
catacttttgatccgcaggcgagcg

SEQ ID NO: 203432 - DNA, 25 bp, E. coli
catggtgctgctcaaacgggctaca

SEQ ID NO: 203433 - DNA, 25 bp, E. coli
catggtgctgctgaaacgggctaca

SEQ ID NO: 203434 - DNA, 25 bp, E. coli
catacttttgatgcgcaggcgagcg

SEQ ID NO: 203435 - DNA, 25 bp, E. coli
tacagtatttcacagacaccgcagg

SEQ ID NO: 203436 - DNA, 25 bp, E. coli
tacagtatttcagagacaccgcagg

SEQ ID NO: 203437 - DNA, 25 bp, E. coli
tatgagaaaccgaaggaaaccgctg

SEQ ID NO: 203438 - DNA, 25 bp, E. coli
tatgagaaaccgtaggaaaccgctg

SEQ ID NO: 203439 - DNA, 25 bp, E. coli
gaattcgcggccttcaaacgtgtgt

SEQ ID NO: 203440 - DNA, 25 bp, E. coli
gcacatctggtgctacaagcgccgt

SEQ ID NO: 203441 - DNA, 25 bp, E. coli
gaattcgcggccatcaaacgtgtgt

SEQ ID NO: 203442 - DNA, 25 bp, E. coli
gcacatctggtggtacaagcgccgt

SEQ ID NO: 203443 - DNA, 25 bp, E. coli
gaacaattgtttcaaccggcgctaa

SEQ ID NO: 203444 - DNA, 25 bp, E. coli
gaaatcatggatgcacagcagcgcg

SEQ ID NO: 203445 - DNA, 25 bp, E. coli
gaaatcatggatccacagcagcgcg

SEQ ID NO: 203446 - DNA, 25 bp, E. coli
gaacaattgtttgaaccggcgctaa

SEQ ID NO: 203447 - DNA, 25 bp, E. coli
taatcagtctattgccgatcgggcg

SEQ ID NO: 203448 - DNA, 25 bp, E. coli
taatcagtctatagccgatcgggcg

SEQ ID NO: 203449 - DNA, 25 bp, E. coli
aacgtgtggatgttatgctcggcgc

SEQ ID NO: 203450 - DNA, 25 bp, E. coli
aagcgccaattcatgcccggatgca

SEQ ID NO: 203451 - DNA, 25 bp, E. coli
aagcgccaattcttgcccggatgca

SEQ ID NO: 203452 - DNA, 25 bp, E. coli
acccggatgatctgcaacgtgtgga

SEQ ID NO: 203453 - DNA, 25 bp, E. coli
acccggatgatcagcaacgtgtgga

SEQ ID NO: 203454 - DNA, 25 bp, E. coli
aaagtctccgccgatgaaggcgatc

SEQ ID NO: 203455 - DNA, 25 bp, E. coli
aaagtctccgcccatgaaggcgatc

SEQ ID NO: 203456 - DNA, 25 bp, E. coli
aacgtgtggatgatatgctcggcgc

SEQ ID NO: 203457 - DNA, 25 bp, E. coli
tgttgcagcaagaaccgttattcag

SEQ ID NO: 203458 - DNA, 25 bp, E. coli
tgttgcagcaagtaccgttattcag

SEQ ID NO: 203459 - DNA, 25 bp, E. coli
ccatcctggcgggtgtaaagtctcc

SEQ ID NO: 203460 - DNA, 25 bp, E. coli
ccatcctggcggctgtaaagtctcc

SEQ ID NO: 203461 - DNA, 25 bp, E. coli
gaacccagccttcagcagcaactgg

SEQ ID NO: 203462 - DNA, 25 bp, E. coli
gcagcaactggtgagcgaatttcaa

SEQ ID NO: 203463 - DNA, 25 bp, E. coli
gcagcaactggtcagcgaatttcaa

SEQ ID NO: 203464 - DNA, 25 bp, E. coli
gaacccagccttgagcagcaactgg

SEQ ID NO: 203465 - DNA, 25 bp, E. coli
gcaactggcgcaactgcaaatgcag

SEQ ID NO: 203466 - DNA, 25 bp, E. coli
gcaactggcgcatctgcaaatgcag

SEQ ID NO: 203467 - DNA, 25 bp, E. coli
ggataactcggctctgatcaaacag

SEQ ID NO: 203468 - DNA, 25 bp, E. coli
ggataactcggcactgatcaaacag

SEQ ID NO: 203469 - DNA, 25 bp, E. coli
ggtcagacgccaacggtggataact

SEQ ID NO: 203470 - DNA, 25 bp, E. coli
ggtcagacgccatcggtggataact

SEQ ID NO: 203471 - DNA, 25 bp, E. coli
cagcgaactgcaccgtatggaaacc

SEQ ID NO: 203472 - DNA, 25 bp, E. coli
cagcgaactgcagcgtatggaaacc

SEQ ID NO: 203473 - DNA, 25 bp, E. coli
caggcttttgagcaggatcgcgcac

SEQ ID NO: 203474 - DNA, 25 bp, E. coli
caggtctcggttaagcactggcaac

SEQ ID NO: 203475 - DNA, 25 bp, E. coli
caggcttttgaggaggatcgcgcac

SEQ ID NO: 203476 - DNA, 25 bp, E. coli
caggtctcggtttagcactggcaac

SEQ ID NO: 203477 - DNA, 25 bp, E. coli
aaagctgcagtccatgaaagcgggc

SEQ ID NO: 203478 - DNA, 25 bp, E. coli
aaagctgcagtcgatgaaagcgggc

SEQ ID NO: 203479 - DNA, 25 bp, E. coli
tatggaaaccgaactgcaggctaaa

SEQ ID NO: 203480 - DNA, 25 bp, E. coli
tatggaaaccgatctgcaggctaaa

SEQ ID NO: 203481 - DNA, 25 bp, E. coli
tgtaaaagacatcactgccgacgta

SEQ ID NO: 203482 - DNA, 25 bp, E. coli
tgtaaaagacatgactgccgacgta

SEQ ID NO: 203483 - DNA, 25 bp, E. coli
gacttttgctcacaaagcgcaggct

SEQ ID NO: 203484 - DNA, 25 bp, E. coli
gaaaaagacgtgttggctcagcgcc

SEQ ID NO: 203485 - DNA, 25 bp, E. coli
gaaaaagacgtgatggctcagcgcc

SEQ ID NO: 203486 - DNA, 25 bp, E. coli
gacttttgctcagaaagcgcaggct

SEQ ID NO: 203487 - DNA, 25 bp, E. coli
ctcaggcggctgtcaaaattgcaat

SEQ ID NO: 203488 - DNA, 25 bp, E. coli
ctcaggcggctgacaaaattgcaat

SEQ ID NO: 203489 - DNA, 25 bp, E. coli
gatctggttgttgatgcaaacgccg

SEQ ID NO: 203490 - DNA, 25 bp, E. coli
gatctggttgttcatgcaaacgccg

SEQ ID NO: 203491 - DNA, 25 bp, E. coli
ggttactcgtatgcagactgctgtg

SEQ ID NO: 203492 - DNA, 25 bp, E. coli
ggttactcgtatccagactgctgtg

SEQ ID NO: 203493 - DNA, 25 bp, E. coli
aattcggtgtagaaatctatgctgc

SEQ ID NO: 203494 - DNA, 25 bp, E. coli
caaggtgaaccccatccagaattaa

SEQ ID NO: 203495 - DNA, 25 bp, E. coli
aattcggtgtagtaatctatgctgc

SEQ ID NO: 203496 - DNA, 25 bp, E. coli
aagcaattgatatagccaaaggcgg

SEQ ID NO: 203497 - DNA, 25 bp, E. coli
caaggtgaacccgatccagaattaa

SEQ ID NO: 203498 - DNA, 25 bp, E. coli
aagcaattgataaagccaaaggcgg

SEQ ID NO: 203499 - DNA, 25 bp, E. coli
taaaaaaggcgggaatatcggagcg

SEQ ID NO: 203500 - DNA, 25 bp, E. coli
tactgaccttcaaaaaggaatcgcg

SEQ ID NO: 203501 - DNA, 25 bp, E. coli
tactgaccttcataaaggaatcgcg

SEQ ID NO: 203502 - DNA, 25 bp, E. coli
taaaaaaggcggcaatatcggagcg

SEQ ID NO: 203503 - DNA, 25 bp, E. coli
tatcggagcggcaggttctgtcagc

SEQ ID NO: 203504 - DNA, 25 bp, E. coli
tatcggagcggctggttctgtcagc

SEQ ID NO: 203505 - DNA, 25 bp, E. coli
tgcccttgaagaagacgacgatgta

SEQ ID NO: 203506 - DNA, 25 bp, E. coli
tgcccttgaagatgacgacgatgta

SEQ ID NO: 203507 - DNA, 25 bp, E. coli
tcgttattgaacgtgcaaagcaggc

SEQ ID NO: 203508 - DNA, 25 bp, E. coli
tcgttattgaacctgcaaagcaggc

SEQ ID NO: 203509 - DNA, 25 bp, E. coli
gcaggcacaagtaccaaagcacgtt

SEQ ID NO: 203510 - DNA, 25 bp, E. coli
gcaggcacaagttccaaagcacgtt

SEQ ID NO: 203511 - DNA, 25 bp, E. coli
gaaggctttggtgctaatggctcaa

SEQ ID NO: 203512 - DNA, 25 bp, E. coli
gaaggctttggtcctaatggctcaa

SEQ ID NO: 203513 - DNA, 25 bp, E. coli
cgtacgattgctaacgttcgcacaa

SEQ ID NO: 203514 - DNA, 25 bp, E. coli
cgtacgattgcttacgttcgcacaa

SEQ ID NO: 203515 - DNA, 25 bp, E. coli
cattacccgtgcgtttgatgacgat

SEQ ID NO: 203516 - DNA, 25 bp, E. coli
cattacccgtgcctttgatgacgat

SEQ ID NO: 203517 - DNA, 25 bp, E. coli
agaggcagaactcgcagacgacatg

SEQ ID NO: 203518 - DNA, 25 bp, E. coli
agaggcagaactggcagacgacatg

SEQ ID NO: 203519 - DNA, 25 bp, E. coli
tacccgtgcgtttgatgacgatgtt

SEQ ID NO: 203520 - DNA, 25 bp, E. coli
tacccgtgcgttagatgacgatgtt

SEQ ID NO: 203521 - DNA, 25 bp, E. coli
ttgatgacgatgatgagtttcagga

SEQ ID NO: 203522 - DNA, 25 bp, E. coli
ttgatgacgatgttgagtttcagga

SEQ ID NO: 203523 - DNA, 25 bp, E. coli
tcgcccgtgaagtgaaagaggcaga

SEQ ID NO: 203524 - DNA, 25 bp, E. coli
tcgcccgtgaagagaaagaggcaga

SEQ ID NO: 203525 - DNA, 25 bp, E. coli
gcatggcagaactcatccggtacat

SEQ ID NO: 203526 - DNA, 25 bp, E. coli
gcatggcagaacacatccggtacat

SEQ ID NO: 203527 - DNA, 25 bp, E. coli
cgtttgatgacgttgttgagtttca

SEQ ID NO: 203528 - DNA, 25 bp, E. coli
cgcatggcagaacacatccggtaca

SEQ ID NO: 203529 - DNA, 25 bp, E. coli
cccgtgcgtttgttgacgatgttga

SEQ ID NO: 203530 - DNA, 25 bp, E. coli
cccgtgaagagatagaggcagaact

SEQ ID NO: 203531 - DNA, 25 bp, E. coli
cccgtgaagagaaagaggcagaact

SEQ ID NO: 203532 - DNA, 25 bp, E. coli
cgcatggcagaagacatccggtaca

SEQ ID NO: 203533 - DNA, 25 bp, E. coli
cgtttgatgacgatgttgagtttca

SEQ ID NO: 203534 - DNA, 25 bp, E. coli
cccgtgcgtttgatgacgatgttga

SEQ ID NO: 203535 - DNA, 25 bp, E. coli
cgtgcgtttgatgacgatgttgagt

SEQ ID NO: 203536 - DNA, 25 bp, E. coli
cgtgcgtttgatcacgatgttgagt

SEQ ID NO: 203537 - DNA, 25 bp, E. coli
aatacgatccctgccatcgatcctg

SEQ ID NO: 203538 - DNA, 25 bp, E. coli
aatccgcaggatcgcgttaatgttc

SEQ ID NO: 203539 - DNA, 25 bp, E. coli
aatacgatccctcccatcgatcctg

SEQ ID NO: 203540 - DNA, 25 bp, E. coli
cagccaaatccggaggatggcgtta

SEQ ID NO: 203541 - DNA, 25 bp, E. coli
cagccaaatccgcaggatggcgtta

SEQ ID NO: 203542 - DNA, 25 bp, E. coli
aatccgcaggatggcgttaatgttc

SEQ ID NO: 203543 - DNA, 25 bp, E. coli
tgccatcgatcctgccgctatgtcg

SEQ ID NO: 203544 - DNA, 25 bp, E. coli
tgccatcgatccagccgctatgtcg

SEQ ID NO: 203545 - DNA, 25 bp, E. coli
ccaaatccgcagcatggcgttaatg

SEQ ID NO: 203546 - DNA, 25 bp, E. coli
ccaaatccgcaggatggcgttaatg

SEQ ID NO: 203547 - DNA, 25 bp, E. coli
gaatcagccaaaaccgcaggatggc

SEQ ID NO: 203548 - DNA, 25 bp, E. coli
gaatggctggcgagatgttaggcgc

SEQ ID NO: 203549 - DNA, 25 bp, E. coli
gaatggctggcgtgatgttaggcgc

SEQ ID NO: 203550 - DNA, 25 bp, E. coli
gaatcagccaaatccgcaggatggc

SEQ ID NO: 203551 - DNA, 25 bp, E. coli
cgttaatgttctggcaaaagtgggt

SEQ ID NO: 203552 - DNA, 25 bp, E. coli
cgttaatgttctcgcaaaagtgggt

SEQ ID NO: 203553 - DNA, 25 bp, E. coli
ctgggaaggctgcaggcgcttggcg

SEQ ID NO: 203554 - DNA, 25 bp, E. coli
ctgggaaggctggaggcgcttggcg

SEQ ID NO: 203555 - DNA, 25 bp, E. coli
ggctggcgtgatcttaggcgctgct

SEQ ID NO: 203556 - DNA, 25 bp, E. coli
ggctggaggcgcttggcgtacaact

SEQ ID NO: 203557 - DNA, 25 bp, E. coli
ggctggcgtgatgttaggcgctgct

SEQ ID NO: 203558 - DNA, 25 bp, E. coli
ggctggaggcgcatggcgtacaact

SEQ ID NO: 203559 - DNA, 25 bp, E. coli
cagacgcctggttgacggtatgtcg

SEQ ID NO: 203560 - DNA, 25 bp, E. coli
cagacgcctggtagacggtatgtcg

SEQ ID NO: 203561 - DNA, 25 bp, E. coli
aacagttgcagcctctgaccgcagc

SEQ ID NO: 203562 - DNA, 25 bp, E. coli
aacagttgcagcgtctgaccgcagc

SEQ ID NO: 203563 - DNA, 25 bp, E. coli
tacctttggcgccatgtcggtgtgc

SEQ ID NO: 203564 - DNA, 25 bp, E. coli
tacctttggcgcgatgtcggtgtgc

SEQ ID NO: 203565 - DNA, 25 bp, E. coli
tgtgaacatgcacaaatcgcgccgg

SEQ ID NO: 203566 - DNA, 25 bp, E. coli
tgtgaacatgcagaaatcgcgccgg

SEQ ID NO: 203567 - DNA, 25 bp, E. coli
tgaaaatggcgtagcagtactggca

SEQ ID NO: 203568 - DNA, 25 bp, E. coli
tgaaaatggcgttgcagtactggca

SEQ ID NO: 203569 - DNA, 25 bp, E. coli
gcttaatgcggccatgaagtcgcaa

SEQ ID NO: 203570 - DNA, 25 bp, E. coli
gcttaatgcggcgatgaagtcgcaa

SEQ ID NO: 203571 - DNA, 25 bp, E. coli
gaaggtatcttggtgattgccgacg

SEQ ID NO: 203572 - DNA, 25 bp, E. coli
gaaggtatcttgctgattgccgacg

SEQ ID NO: 203573 - DNA, 25 bp, E. coli
ccgcaatggttatcatggcgatacc

SEQ ID NO: 203574 - DNA, 25 bp, E. coli
ccgcaatggttaacatggcgatacc

SEQ ID NO: 203575 - DNA, 25 bp, E. coli
gtaaagccttaaccggcggcacaat

SEQ ID NO: 203576 - DNA, 25 bp, E. coli
gtaaagccttaagcggcggcacaat

SEQ ID NO: 203577 - DNA, 25 bp, E. coli
gatgcgcatgtaccatccggaatgg

SEQ ID NO: 203578 - DNA, 25 bp, E. coli
gatgtttggcggtatcacccatgcg

SEQ ID NO: 203579 - DNA, 25 bp, E. coli
gatgtttggcggaatcacccatgcg

SEQ ID NO: 203580 - DNA, 25 bp, E. coli
gatgcgcatgtagcatccggaatgg

SEQ ID NO: 203581 - DNA, 25 bp, E. coli
aatgctcggcgtgaaatctgtcgga

SEQ ID NO: 203582 - DNA, 25 bp, E. coli
caaaaaacaggtatggcacgggcca

SEQ ID NO: 203583 - DNA, 25 bp, E. coli
caaaaaacaggtttggcacgggcca

SEQ ID NO: 203584 - DNA, 25 bp, E. coli
aatgctcggcgtcaaatctgtcgga

SEQ ID NO: 203585 - DNA, 25 bp, E. coli
ctttcccaaaaaccgaatgctcggc

SEQ ID NO: 203586 - DNA, 25 bp, E. coli
ctttcccaaaaagcgaatgctcggc

SEQ ID NO: 203587 - DNA, 25 bp, E. coli
aaatctgtcggatggattgaggccg

SEQ ID NO: 203588 - DNA, 25 bp, E. coli
aaatctgtcggaaggattgaggccg

SEQ ID NO: 203589 - DNA, 25 bp, E. coli
taccagcggttaaccaaaaaacagg

SEQ ID NO: 203590 - DNA, 25 bp, E. coli
taccagcggttatccaaaaaacagg

SEQ ID NO: 203591 - DNA, 25 bp, E. coli
tgaacaatcgatgggccgttagaat

SEQ ID NO: 203592 - DNA, 25 bp, E. coli
tgaacaatcgatcggccgttagaat

SEQ ID NO: 203593 - DNA, 25 bp, E. coli
gatacgatgccagctttcccaaaaa

SEQ ID NO: 203594 - DNA, 25 bp, E. coli
gatacgatgccacctttcccaaaaa

SEQ ID NO: 203595 - DNA, 25 bp, E. coli
gttagaatactagggttaccagcgg

SEQ ID NO: 203596 - DNA, 25 bp, E. coli
gttagaatactacggttaccagcgg

SEQ ID NO: 203597 - DNA, 25 bp, E. coli
ggttgaaccccaaatcaccacgata

SEQ ID NO: 203598 - DNA, 25 bp, E. coli
ggcacgggccaccatctatgactgg

SEQ ID NO: 203599 - DNA, 25 bp, E. coli
ggttgaaccccatatcaccacgata

SEQ ID NO: 203600 - DNA, 25 bp, E. coli
ggcacgggccacgatctatgactgg

SEQ ID NO: 203601 - DNA, 25 bp, E. coli
gatgagtggttaacacaacgctgta

SEQ ID NO: 203602 - DNA, 25 bp, E. coli
gatgagtggttatcacaacgctgta

SEQ ID NO: 203603 - DNA, 25 bp, E. coli
caccgcggctatgacgccgtggaac

SEQ ID NO: 203604 - DNA, 25 bp, E. coli
caccgcggctatcacgccgtggaac

SEQ ID NO: 203605 - DNA, 25 bp, E. coli
agccgattggcgtcaccgcggctat

SEQ ID NO: 203606 - DNA, 25 bp, E. coli
agccgattggcgacaccgcggctat

SEQ ID NO: 203607 - DNA, 25 bp, E. coli
tcaccgcggctaacacgccgtggaa

SEQ ID NO: 203608 - DNA, 25 bp, E. coli
tcaccgcggctatcacgccgtggaa

SEQ ID NO: 203609 - DNA, 25 bp, E. coli
ccgattggcgtcaccgcggctatca

SEQ ID NO: 203610 - DNA, 25 bp, E. coli
ccgattggcgtctccgcggctatca

SEQ ID NO: 203611 - DNA, 25 bp, E. coli
gccgattggcgtgaccgcggctatc

SEQ ID NO: 203612 - DNA, 25 bp, E. coli
gccgattggcgtcaccgcggctatc

SEQ ID NO: 203613 - DNA, 25 bp, E. coli
cgattggcgtcaccgcggctatcac

SEQ ID NO: 203614 - DNA, 25 bp, E. coli
cgattggcgtcagcgcggctatcac

SEQ ID NO: 203615 - DNA, 25 bp, E. coli
cgtctgcgccaagcgcctgtatgtg

SEQ ID NO: 203616 - DNA, 25 bp, E. coli
ctgcgccaaccggctgtatgtgcag

SEQ ID NO: 203617 - DNA, 25 bp, E. coli
ctgcgccaaccgcctgtatgtgcag

SEQ ID NO: 203618 - DNA, 25 bp, E. coli
cgtctgcgccaaccgcctgtatgtg

SEQ ID NO: 203619 - DNA, 25 bp, E. coli
gattggcgtcacggcggctatcacg

SEQ ID NO: 203620 - DNA, 25 bp, E. coli
gattggcgtcaccgcggctatcacg

SEQ ID NO: 203621 - DNA, 25 bp, E. coli
gtctgcgccaaccgcctgtatgtgc

SEQ ID NO: 203622 - DNA, 25 bp, E. coli
gtcaccgcggctatcacgccgtgga

SEQ ID NO: 203623 - DNA, 25 bp, E. coli
gtctgcgccaacggcctgtatgtgc

SEQ ID NO: 203624 - DNA, 25 bp, E. coli
gtcaccgcggctttcacgccgtgga

SEQ ID NO: 203625 - DNA, 25 bp, E. coli
tagctataaaccacacgcattcgcg

SEQ ID NO: 203626 - DNA, 25 bp, E. coli
tagctataaacctcacgcattcgcg

SEQ ID NO: 203627 - DNA, 25 bp, E. coli
tatcaacatgatggctggcttccgg

SEQ ID NO: 203628 - DNA, 25 bp, E. coli
tatcaacatgatcgctggcttccgg

SEQ ID NO: 203629 - DNA, 25 bp, E. coli
tataaagagatcgaacgctacggca

SEQ ID NO: 203630 - DNA, 25 bp, E. coli
tataaagagatccaacgctacggca

SEQ ID NO: 203631 - DNA, 25 bp, E. coli
tgctggatgaagtgcgacaaacgcc

SEQ ID NO: 203632 - DNA, 25 bp, E. coli
tgctggatgaagagcgacaaacgcc

SEQ ID NO: 203633 - DNA, 25 bp, E. coli
tctgctggaagtcgaacggctacac

SEQ ID NO: 203634 - DNA, 25 bp, E. coli
tctgctggaagtggaacggctacac

SEQ ID NO: 203635 - DNA, 25 bp, E. coli
ccaaaaattgttgcgctggcgctgc

SEQ ID NO: 203636 - DNA, 25 bp, E. coli
ccaaaaattgttccgctggcgctgc

SEQ ID NO: 203637 - DNA, 25 bp, E. coli
gaatatggaacatcgcactcagggc

SEQ ID NO: 203638 - DNA, 25 bp, E. coli
gaagatatgcatgcgctgcgcaaag

SEQ ID NO: 203639 - DNA, 25 bp, E. coli
gaagtgaccttcttatcggaccgcg

SEQ ID NO: 203640 - DNA, 25 bp, E. coli
gaatatggaacaacgcactcagggc

SEQ ID NO: 203641 - DNA, 25 bp, E. coli
gaagtgaccttcatatcggaccgcg

SEQ ID NO: 203642 - DNA, 25 bp, E. coli
gaagatatgcatccgctgcgcaaag

SEQ ID NO: 203643 - DNA, 25 bp, E. coli
cgcggatgggcttcaacgaagtgac

SEQ ID NO: 203644 - DNA, 25 bp, E. coli
cgcggatgggctacaacgaagtgac

SEQ ID NO: 203645 - DNA, 25 bp, E. coli
gatggattatcgactgcgccctgaa

SEQ ID NO: 203646 - DNA, 25 bp, E. coli
gatggattatcgtctgcgccctgaa

SEQ ID NO: 203647 - DNA, 25 bp, E. coli
cacaggaggctgtgatggcaacaaa

SEQ ID NO: 203648 - DNA, 25 bp, E. coli
cacagacgatggtgagcagttgcac

SEQ ID NO: 203649 - DNA, 25 bp, E. coli
cacaggaggctgagatggcaacaaa

SEQ ID NO: 203650 - DNA, 25 bp, E. coli
cacagacgatggagagcagttgcac

SEQ ID NO: 203651 - DNA, 25 bp, E. coli
tacagcacggaagggctgagcatgc

SEQ ID NO: 203652 - DNA, 25 bp, E. coli
tacagcacggaacggctgagcatgc

SEQ ID NO: 203653 - DNA, 25 bp, E. coli
aaagcggtccgtgtgcggaaatgcc

SEQ ID NO: 203654 - DNA, 25 bp, E. coli
aagaggagcttgctgtttccccgga

SEQ ID NO: 203655 - DNA, 25 bp, E. coli
aagaggagcttggtgtttccccgga

SEQ ID NO: 203656 - DNA, 25 bp, E. coli
aaagcggtccgtctgcggaaatgcc

SEQ ID NO: 203657 - DNA, 25 bp, E. coli
tgttatggtgccatcaccactggcg

SEQ ID NO: 203658 - DNA, 25 bp, E. coli
tgttatggtgccttcaccactggcg

SEQ ID NO: 203659 - DNA, 25 bp, E. coli
tgctgcggatattgctcaacgtgtg

SEQ ID NO: 203660 - DNA, 25 bp, E. coli
tgctgcggatatagctcaacgtgtg

SEQ ID NO: 203661 - DNA, 25 bp, E. coli
gctacggatgatgttaaagcggtcc

SEQ ID NO: 203662 - DNA, 25 bp, E. coli
gctacggatgatcttaaagcggtcc

SEQ ID NO: 203663 - DNA, 25 bp, E. coli
gaatcgtcttcgtcaactggctggc

SEQ ID NO: 203664 - DNA, 25 bp, E. coli
gaatcgtcttcgacaactggctggc

SEQ ID NO: 203665 - DNA, 25 bp, E. coli
cattatgcactctgatgagagcggg

SEQ ID NO: 203666 - DNA, 25 bp, E. coli
cattatgcactcagatgagagcggg

SEQ ID NO: 203667 - DNA, 25 bp, E. coli
tggcgacagccatgatacagcacgg

SEQ ID NO: 203668 - DNA, 25 bp, E. coli
tggcgacagccaagatacagcacgg

SEQ ID NO: 203669 - DNA, 25 bp, E. coli
taaagcagatagatccgcgaagcgc

SEQ ID NO: 203670 - DNA, 25 bp, E. coli
taaagcagatagttccgcgaagcgc

SEQ ID NO: 203671 - DNA, 25 bp, E. coli
aaattactgccgctgttgcaagacg

SEQ ID NO: 203672 - DNA, 25 bp, E. coli
aaatattccgcttctctgacgtggg

SEQ ID NO: 203673 - DNA, 25 bp, E. coli
aaatattccgctactctgacgtggg

SEQ ID NO: 203674 - DNA, 25 bp, E. coli
aaattactgccggtgttgcaagacg

SEQ ID NO: 203675 - DNA, 25 bp, E. coli
tatctaaccggaatgcaccaccaga

SEQ ID NO: 203676 - DNA, 25 bp, E. coli
tatctaaccggattgcaccaccaga

SEQ ID NO: 203677 - DNA, 25 bp, E. coli
tgcattgactatctcgctggcggaa

SEQ ID NO: 203678 - DNA, 25 bp, E. coli
tgaaacagggaatgaggatcagccg

SEQ ID NO: 203679 - DNA, 25 bp, E. coli
tgcaatttcagcgtcctgcctggga

SEQ ID NO: 203680 - DNA, 25 bp, E. coli
tgcaatttcagcctcctgcctggga

SEQ ID NO: 203681 - DNA, 25 bp, E. coli
tgaaacagggaaagaggatcagccg

SEQ ID NO: 203682 - DNA, 25 bp, E. coli
tgcattgactatgtcgctggcggaa

SEQ ID NO: 203683 - DNA, 25 bp, E. coli
gaaaaacgatattaaccactggcag

SEQ ID NO: 203684 - DNA, 25 bp, E. coli
gaaaaacgatataaaccactggcag

SEQ ID NO: 203685 - DNA, 25 bp, E. coli
gggcctcttttatcctcagcgaaca

SEQ ID NO: 203686 - DNA, 25 bp, E. coli
gggcctcttttaacctcagcgaaca

SEQ ID NO: 203687 - DNA, 25 bp, E. coli
tggcaggagtgcttcattagcgacc

SEQ ID NO: 203688 - DNA, 25 bp, E. coli
tggcaggagtgcatcattagcgacc

SEQ ID NO: 203689 - DNA, 25 bp, E. coli
tcacgacacgtagcgcaaaaagcca

SEQ ID NO: 203690 - DNA, 25 bp, E. coli
tcacgacacgtaccgcaaaaagcca

SEQ ID NO: 203691 - DNA, 25 bp, E. coli
catcaatgtctcatctggcaaaaca

SEQ ID NO: 203692 - DNA, 25 bp, E. coli
catcaatgtctcttctggcaaaaca

SEQ ID NO: 203693 - DNA, 25 bp, E. coli
aggtgattccctcccaccagcaatg

SEQ ID NO: 203694 - DNA, 25 bp, E. coli
aggtgattccctgccaccagcaatg

SEQ ID NO: 203695 - DNA, 25 bp, E. coli
aaaatcgacaatgttcctctggaac

SEQ ID NO: 203696 - DNA, 25 bp, E. coli
aaaaatcacccaatcaggtgattcc

SEQ ID NO: 203697 - DNA, 25 bp, E. coli
aaaaatcacccattcaggtgattcc

SEQ ID NO: 203698 - DNA, 25 bp, E. coli
aaaatcgacaatcttcctctggaac

SEQ ID NO: 203699 - DNA, 25 bp, E. coli
tgtctcatctgggaaaacacacagc

SEQ ID NO: 203700 - DNA, 25 bp, E. coli
tgggcatctcccttcaatgtctcat

SEQ ID NO: 203701 - DNA, 25 bp, E. coli
tgtctcatctggcaaaacacacagc

SEQ ID NO: 203702 - DNA, 25 bp, E. coli
tgggcatctcccatcaatgtctcat

SEQ ID NO: 203703 - DNA, 25 bp, E. coli
tgcgcgaaaaatcgacaatgttcct

SEQ ID NO: 203704 - DNA, 25 bp, E. coli
tgcgcgaaaaatggacaatgttcct

SEQ ID NO: 203705 - DNA, 25 bp, E. coli
tctggcaaaacagacagcccaaaaa

SEQ ID NO: 203706 - DNA, 25 bp, E. coli
tctggcaaaacacacagcccaaaaa

SEQ ID NO: 203707 - DNA, 25 bp, E. coli
cctgccaccagcaatgcgcgaaaaa

SEQ ID NO: 203708 - DNA, 25 bp, E. coli
ccagcaatgcgcgaaaaatcgacaa

SEQ ID NO: 203709 - DNA, 25 bp, E. coli
ccagcaatgcgccaaaaatcgacaa

SEQ ID NO: 203710 - DNA, 25 bp, E. coli
cctgccaccagctatgcgcgaaaaa

SEQ ID NO: 203711 - DNA, 25 bp, E. coli
gacaatgttcctctggaacaaatga

SEQ ID NO: 203712 - DNA, 25 bp, E. coli
gacaatgttcctgtggaacaaatga

SEQ ID NO: 203713 - DNA, 25 bp, E. coli
caatcgatcaagtgcaggtggagct

SEQ ID NO: 203714 - DNA, 25 bp, E. coli
caatcgatcaagagcaggtggagct

SEQ ID NO: 203715 - DNA, 25 bp, E. coli
catgtcgtcgacagcataaggagcc

SEQ ID NO: 203716 - DNA, 25 bp, E. coli
catgtcgtcgactgcataaggagcc

SEQ ID NO: 203717 - DNA, 25 bp, E. coli
attgccgggcttcagacgatcacca

SEQ ID NO: 203718 - DNA, 25 bp, E. coli
attgccgggcttgagacgatcacca

SEQ ID NO: 203719 - DNA, 25 bp, E. coli
tgcaaatgcgtatcgaaatctcccg

SEQ ID NO: 203720 - DNA, 25 bp, E. coli
tgacgctggccgtcaaaatcgtggt

SEQ ID NO: 203721 - DNA, 25 bp, E. coli
tgcaaatgcgtaacgaaatctcccg

SEQ ID NO: 203722 - DNA, 25 bp, E. coli
tgacgctggccgacaaaatcgtggt

SEQ ID NO: 203723 - DNA, 25 bp, E. coli
tgctggatcgcaaaccgaaagcgct

SEQ ID NO: 203724 - DNA, 25 bp, E. coli
tgctggatcgcataccgaaagcgct

SEQ ID NO: 203725 - DNA, 25 bp, E. coli
gcctgggccgcacaatgatttacgt

SEQ ID NO: 203726 - DNA, 25 bp, E. coli
gcctgggccgcagaatgatttacgt

SEQ ID NO: 203727 - DNA, 25 bp, E. coli
ctgcaaaatgtatcgaaagcctggg

SEQ ID NO: 203728 - DNA, 25 bp, E. coli
ctgcaaaatgtaacgaaagcctggg

SEQ ID NO: 203729 - DNA, 25 bp, E. coli
gatatcgctgacgtcatccttgagg

SEQ ID NO: 203730 - DNA, 25 bp, E. coli
gatatcgctgacctcatccttgagg

SEQ ID NO: 203731 - DNA, 25 bp, E. coli
gatgccaaatcgacagcaagtctgg

SEQ ID NO: 203732 - DNA, 25 bp, E. coli
tggtgtaccgccagaacgacgtggt

SEQ ID NO: 203733 - DNA, 25 bp, E. coli
tggtgtaccgcctgaacgacgtggt

SEQ ID NO: 203734 - DNA, 25 bp, E. coli
gatgccaaatcgtcagcaagtctgg

SEQ ID NO: 203735 - DNA, 25 bp, E. coli
cagtatgtgcactacggcggtacag

SEQ ID NO: 203736 - DNA, 25 bp, E. coli
cagtatgtgcacaacggcggtacag

SEQ ID NO: 203737 - DNA, 25 bp, E. coli
aaccccggtggatgtgtctcagaca

SEQ ID NO: 203738 - DNA, 25 bp, E. coli
aaaacggtcgccagattgtgagagc

SEQ ID NO: 203739 - DNA, 25 bp, E. coli
aaccccggtggaagtgtctcagaca

SEQ ID NO: 203740 - DNA, 25 bp, E. coli
aaaacggtcgcctgattgtgagagc

SEQ ID NO: 203741 - DNA, 25 bp, E. coli
taccactgtggtatatgccggcggc

SEQ ID NO: 203742 - DNA, 25 bp, E. coli
taccactgtggtttatgccggcggc

SEQ ID NO: 203743 - DNA, 25 bp, E. coli
tgaaggaacggctaataccactgtg

SEQ ID NO: 203744 - DNA, 25 bp, E. coli
tgaaggaacggcaaataccactgtg

SEQ ID NO: 203745 - DNA, 25 bp, E. coli
ccaccgttaatctgaagggcagact

SEQ ID NO: 203746 - DNA, 25 bp, E. coli
ccaccgttaatcagaagggcagact

SEQ ID NO: 203747 - DNA, 25 bp, E. coli
gaacggcggaacactggcaaatcat

SEQ ID NO: 203748 - DNA, 25 bp, E. coli
gaacggcggaactctggcaaatcat

SEQ ID NO: 203749 - DNA, 25 bp, E. coli
gttcgtaccggcaaccctgaaagtg

SEQ ID NO: 203750 - DNA, 25 bp, E. coli
cattaatgataagggctggcaggtc

SEQ ID NO: 203751 - DNA, 25 bp, E. coli
cattaatgataacggctggcaggtc

SEQ ID NO: 203752 - DNA, 25 bp, E. coli
gttcgtaccggctaccctgaaagtg

SEQ ID NO: 203753 - DNA, 25 bp, E. coli
tggtcttcagagagtgaaccccggt

SEQ ID NO: 203754 - DNA, 25 bp, E. coli
tggtcttcagagtgtgaaccccggt

SEQ ID NO: 203755 - DNA, 25 bp, E. coli
tcaagcccggtagagtggcaacgga

SEQ ID NO: 203756 - DNA, 25 bp, E. coli
tcaagcccggtacagtggcaacgga

SEQ ID NO: 203757 - DNA, 25 bp, E. coli
caatgcctgcgctacgttgaaagag

SEQ ID NO: 203758 - DNA, 25 bp, E. coli
aagaaattgctagcgctctggctgg

SEQ ID NO: 203759 - DNA, 25 bp, E. coli
aatgactgtcatggcctccggtagc

SEQ ID NO: 203760 - DNA, 25 bp, E. coli
aatgactgtcatcgcctccggtagc

SEQ ID NO: 203761 - DNA, 25 bp, E. coli
aagaaattgctaccgctctggctgg

SEQ ID NO: 203762 - DNA, 25 bp, E. coli
caatgcctgcgcaacgttgaaagag

SEQ ID NO: 203763 - DNA, 25 bp, E. coli
caccagttgttagcgggcgtacata

SEQ ID NO: 203764 - DNA, 25 bp, E. coli
caccagttgttaccgggcgtacata

SEQ ID NO: 203765 - DNA, 25 bp, E. coli
ttacgggaaagatgacgatagcgca

SEQ ID NO: 203766 - DNA, 25 bp, E. coli
ttacgggaaagaagacgatagcgca

SEQ ID NO: 203767 - DNA, 25 bp, E. coli
tgtatgacgtcgtgaccaatgccgc

SEQ ID NO: 203768 - DNA, 25 bp, E. coli
tgtatgacgtcgagaccaatgccgc

SEQ ID NO: 203769 - DNA, 25 bp, E. coli
tgaatatgttcagcagcgccagtaa

SEQ ID NO: 203770 - DNA, 25 bp, E. coli
tgaatatgttcaccagcgccagtaa

SEQ ID NO: 203771 - DNA, 25 bp, E. coli
gcacaacatctgaaacccggtacgg

SEQ ID NO: 203772 - DNA, 25 bp, E. coli
gcacaacatctgtaacccggtacgg

SEQ ID NO: 203773 - DNA, 25 bp, E. coli
cgtacatattgctgccggagccgaa

SEQ ID NO: 203774 - DNA, 25 bp, E. coli
cgtacatattgcagccggagccgaa

SEQ ID NO: 203775 - DNA, 25 bp, E. coli
ggatgttcgaaatccggatgcgtca

SEQ ID NO: 203776 - DNA, 25 bp, E. coli
ggatgttcgaaaaccggatgcgtca

SEQ ID NO: 203777 - DNA, 25 bp, E. coli
tggcatcactcttccgggagcgaaa

SEQ ID NO: 203778 - DNA, 25 bp, E. coli
tggcatcactctaccgggagcgaaa

SEQ ID NO: 203779 - DNA, 25 bp, E. coli
cagggaagctcggtgagctaatgca

SEQ ID NO: 203780 - DNA, 25 bp, E. coli
cagggaagctcgctgagctaatgca

SEQ ID NO: 203781 - DNA, 25 bp, E. coli
tacaaagggcgtcgcttaatcgacc

SEQ ID NO: 203782 - DNA, 25 bp, E. coli
tacaaagggcgtggcttaatcgacc

SEQ ID NO: 203783 - DNA, 25 bp, E. coli
tgaaatagccaatacgataatgccg

SEQ ID NO: 203784 - DNA, 25 bp, E. coli
tgaaatagccaaaacgataatgccg

SEQ ID NO: 203785 - DNA, 25 bp, E. coli
tgacgcaactggtccagcccctgaa

SEQ ID NO: 203786 - DNA, 25 bp, E. coli
tgacgcaactggaccagcccctgaa

SEQ ID NO: 203787 - DNA, 25 bp, E. coli
tcgacctgccggaggagtatctgct

SEQ ID NO: 203788 - DNA, 25 bp, E. coli
tcgacctgccggtggagtatctgct

SEQ ID NO: 203789 - DNA, 25 bp, E. coli
ccaatacgataaagccgtttggcaa

SEQ ID NO: 203790 - DNA, 25 bp, E. coli
ccaatacgataatgccgtttggcaa

SEQ ID NO: 203791 - DNA, 25 bp, E. coli
cgcttaatcgacctgccggaggagt

SEQ ID NO: 203792 - DNA, 25 bp, E. coli
cgcttaatcgacgtgccggaggagt

SEQ ID NO: 203793 - DNA, 25 bp, E. coli
ggtttgcccgcaaagatgagttccc

SEQ ID NO: 203794 - DNA, 25 bp, E. coli
ggtttgcccgcatagatgagttccc

SEQ ID NO: 203795 - DNA, 25 bp, E. coli
gagtatctgctgtggtttgcccgca

SEQ ID NO: 203796 - DNA, 25 bp, E. coli
gagcagctgattcaaatagccaata

SEQ ID NO: 203797 - DNA, 25 bp, E. coli
gagtatctgctgaggtttgcccgca

SEQ ID NO: 203798 - DNA, 25 bp, E. coli
gagctaatgcaaatcacgctgctga

SEQ ID NO: 203799 - DNA, 25 bp, E. coli
gagcagctgattgaaatagccaata

SEQ ID NO: 203800 - DNA, 25 bp, E. coli
gagctaatgcaattcacgctgctga

SEQ ID NO: 203801 - DNA, 25 bp, E. coli
caggatcggcgcaaactgttaatgc

SEQ ID NO: 203802 - DNA, 25 bp, E. coli
catcagcatgtcagcgaacgtcgca

SEQ ID NO: 203803 - DNA, 25 bp, E. coli
catcagcatgtctgcgaacgtcgca

SEQ ID NO: 203804 - DNA, 25 bp, E. coli
caggatcggcgctaactgttaatgc

SEQ ID NO: 203805 - DNA, 25 bp, E. coli
tatattgagattcgtgccagcgcgc

SEQ ID NO: 203806 - DNA, 25 bp, E. coli
tatattgagattggtgccagcgcgc

SEQ ID NO: 203807 - DNA, 25 bp, E. coli
ttaaacggcggtatcagcagcgcac

SEQ ID NO: 203808 - DNA, 25 bp, E. coli
ttaaacggcggtttcagcagcgcac

SEQ ID NO: 203809 - DNA, 25 bp, E. coli
tggtatcaaacagtcgcctggtggg

SEQ ID NO: 203810 - DNA, 25 bp, E. coli
tgcaaccggctattgctggcaagct

SEQ ID NO: 203811 - DNA, 25 bp, E. coli
tgcaaccggctaatgctggcaagct

SEQ ID NO: 203812 - DNA, 25 bp, E. coli
gctggcgctcgatcactctgtgcaa

SEQ ID NO: 203813 - DNA, 25 bp, E. coli
gctggcgctcgaacactctgtgcaa

SEQ ID NO: 203814 - DNA, 25 bp, E. coli
gaatcggttttatcatcgccgggct

SEQ ID NO: 203815 - DNA, 25 bp, E. coli
gaatcggttttaacatcgccgggct

SEQ ID NO: 203816 - DNA, 25 bp, E. coli
gaatgagctttagcgtggctgccct

SEQ ID NO: 203817 - DNA, 25 bp, E. coli
gaatgagctttaccgtggctgccct

SEQ ID NO: 203818 - DNA, 25 bp, E. coli
ccgcagctgtggctcaaagaggcat

SEQ ID NO: 203819 - DNA, 25 bp, E. coli
ccgcagctgtgggtcaaagaggcat

SEQ ID NO: 203820 - DNA, 25 bp, E. coli
gttagttcaacaaagcgaaacctgg

SEQ ID NO: 203821 - DNA, 25 bp, E. coli
gttagttcaacatagcgaaacctgg

SEQ ID NO: 203822 - DNA, 25 bp, E. coli
tggtatcaaacactcgcctggtggg

SEQ ID NO: 203823 - DNA, 25 bp, E. coli
taaagagcaatttgatctcagcgcc

SEQ ID NO: 203824 - DNA, 25 bp, E. coli
taaagggcgtcgtatgccattggcg

SEQ ID NO: 203825 - DNA, 25 bp, E. coli
taaagagcaattagatctcagcgcc

SEQ ID NO: 203826 - DNA, 25 bp, E. coli
taaaggttcccctcatcaggaaggt

SEQ ID NO: 203827 - DNA, 25 bp, E. coli
taaaggttccccacatcaggaaggt

SEQ ID NO: 203828 - DNA, 25 bp, E. coli
taaagggcgtcgaatgccattggcg

SEQ ID NO: 203829 - DNA, 25 bp, E. coli
tacttgccggttggttgtcagacaa

SEQ ID NO: 203830 - DNA, 25 bp, E. coli
tacttgccggttcgttgtcagacaa

SEQ ID NO: 203831 - DNA, 25 bp, E. coli
tattttttgaatcggccgcgatccc

SEQ ID NO: 203832 - DNA, 25 bp, E. coli
tattttttgaatgggccgcgatccc

SEQ ID NO: 203833 - DNA, 25 bp, E. coli
tatatcttcggtgcatctctgggca

SEQ ID NO: 203834 - DNA, 25 bp, E. coli
tatatcttcggtccatctctgggca

SEQ ID NO: 203835 - DNA, 25 bp, E. coli
tgaacttgaacgtcacagagccgca

SEQ ID NO: 203836 - DNA, 25 bp, E. coli
tgaacttgaacgacacagagccgca

SEQ ID NO: 203837 - DNA, 25 bp, E. coli
ggaaggtctaccctctctggaagag

SEQ ID NO: 203838 - DNA, 25 bp, E. coli
ggaaggtctaccgtctctggaagag

SEQ ID NO: 203839 - DNA, 25 bp, E. coli
taacgttggcctcggattcagcacc

SEQ ID NO: 203840 - DNA, 25 bp, E. coli
taacgttggcctgggattcagcacc

SEQ ID NO: 203841 - DNA, 25 bp, E. coli
tcagactatggacatcgtgcccagc

SEQ ID NO: 203842 - DNA, 25 bp, E. coli
tcagactatggagatcgtgcccagc

SEQ ID NO: 203843 - DNA, 25 bp, E. coli
gagttatatcgtaccggcctgcgtg

SEQ ID NO: 203844 - DNA, 25 bp, E. coli
gagttatatcgttccggcctgcgtg

SEQ ID NO: 203845 - DNA, 25 bp, E. coli
cagcgtcaagcgcaatcgtgtcaat

SEQ ID NO: 203846 - DNA, 25 bp, E. coli
cagcgtcaagcggaatcgtgtcaat

SEQ ID NO: 203847 - DNA, 25 bp, E. coli
tacaaaaacctttcgcagcgtcaag

SEQ ID NO: 203848 - DNA, 25 bp, E. coli
tacaaaaaccttacgcagcgtcaag

SEQ ID NO: 203849 - DNA, 25 bp, E. coli
taggtgcagccaattcgtcgagatc

SEQ ID NO: 203850 - DNA, 25 bp, E. coli
taggtgcagccatttcgtcgagatc

SEQ ID NO: 203851 - DNA, 25 bp, E. coli
ttttcatcacgaattaggtgcagcc

SEQ ID NO: 203852 - DNA, 25 bp, E. coli
ttttcatcacgatttaggtgcagcc

SEQ ID NO: 203853 - DNA, 25 bp, E. coli
tgttagtgaataaaaggttgcctgt

SEQ ID NO: 203854 - DNA, 25 bp, E. coli
tgttagtgaatataaggttgcctgt

SEQ ID NO: 203855 - DNA, 25 bp, E. coli
tgactcgcctcactcttcctttggg

SEQ ID NO: 203856 - DNA, 25 bp, E. coli
tgactcgcctcagtcttcctttggg

SEQ ID NO: 203857 - DNA, 25 bp, E. coli
gcctaagcattaggcgactgactcg

SEQ ID NO: 203858 - DNA, 25 bp, E. coli
tcctttgggcttcagaccacatggg

SEQ ID NO: 203859 - DNA, 25 bp, E. coli
gcctaagcattacgcgactgactcg

SEQ ID NO: 203860 - DNA, 25 bp, E. coli
gaatcagtcacgaaatgtgagcacg

SEQ ID NO: 203861 - DNA, 25 bp, E. coli
gaatcagtcacgtaatgtgagcacg

SEQ ID NO: 203862 - DNA, 25 bp, E. coli
gacaaatcaatcctgtgcctaagca

SEQ ID NO: 203863 - DNA, 25 bp, E. coli
gacaaatcaatcgtgtgcctaagca

SEQ ID NO: 203864 - DNA, 25 bp, E. coli
tcctttgggcttgagaccacatggg

SEQ ID NO: 203865 - DNA, 25 bp, E. coli
cgtcgagatcaactttaggacaaaa

SEQ ID NO: 203866 - DNA, 25 bp, E. coli
cgtcgagatcaagtttaggacaaaa

SEQ ID NO: 203867 - DNA, 25 bp, E. coli
catcgcttagcgctgatcagttaac

SEQ ID NO: 203868 - DNA, 25 bp, E. coli
catcgcttagcggtgatcagttaac

SEQ ID NO: 203869 - DNA, 25 bp, E. coli
agacatgcctgtcagcgatgccagc

SEQ ID NO: 203870 - DNA, 25 bp, E. coli
agacatgcctgtgagcgatgccagc

SEQ ID NO: 203871 - DNA, 25 bp, E. coli
actatgttgcagctggacgcgccct

SEQ ID NO: 203872 - DNA, 25 bp, E. coli
actatgttgcaggtggacgcgccct

SEQ ID NO: 203873 - DNA, 25 bp, E. coli
tagctgctgcactatcgcaactggc

SEQ ID NO: 203874 - DNA, 25 bp, E. coli
tagctgctgcacaatcgcaactggc

SEQ ID NO: 203875 - DNA, 25 bp, E. coli
ttagcgatggcgttagcgtagctgc

SEQ ID NO: 203876 - DNA, 25 bp, E. coli
ttagcgatggcgatagcgtagctgc

SEQ ID NO: 203877 - DNA, 25 bp, E. coli
tcgcctgcgagataacggtaaagag

SEQ ID NO: 203878 - DNA, 25 bp, E. coli
tcgcctgcgagaaaacggtaaagag

SEQ ID NO: 203879 - DNA, 25 bp, E. coli
gaaactgcctgcgattgataacgcc

SEQ ID NO: 203880 - DNA, 25 bp, E. coli
gaaactgcctgccattgataacgcc

SEQ ID NO: 203881 - DNA, 25 bp, E. coli
cgctatggttgcttccggtgtgacc

SEQ ID NO: 203882 - DNA, 25 bp, E. coli
cgctatggttgcatccggtgtgacc

SEQ ID NO: 203883 - DNA, 25 bp, E. coli
cattaatgcggaaacgccgggcaac

SEQ ID NO: 203884 - DNA, 25 bp, E. coli
cattaatgcggatacgccgggcaac

SEQ ID NO: 203885 - DNA, 25 bp, E. coli
taacccggatgtgattgctgcccgt

SEQ ID NO: 203886 - DNA, 25 bp, E. coli
taacccggatgtcattgctgcccgt

SEQ ID NO: 203887 - DNA, 25 bp, E. coli
gatgccagcgttcaggcactgaaaa

SEQ ID NO: 203888 - DNA, 25 bp, E. coli
gatgccagcgttgaggcactgaaaa

SEQ ID NO: 203889 - DNA, 25 bp, E. coli
gaacctttatggcatcgagccgaac

SEQ ID NO: 203890 - DNA, 25 bp, E. coli
cagcaagccgcatccgcaagtatat

SEQ ID NO: 203891 - DNA, 25 bp, E. coli
cagcaagccgcaaccgcaagtatat

SEQ ID NO: 203892 - DNA, 25 bp, E. coli
cgagctgccggagaccttaggttta

SEQ ID NO: 203893 - DNA, 25 bp, E. coli
cgagctgccggacaccttaggttta

SEQ ID NO: 203894 - DNA, 25 bp, E. coli
gaacctttatgggatcgagccgaac

SEQ ID NO: 203895 - DNA, 25 bp, E. coli
tttcactggttgaagagacacgtcc

SEQ ID NO: 203896 - DNA, 25 bp, E. coli
ttacgcgacagtttcgatgccctcg

SEQ ID NO: 203897 - DNA, 25 bp, E. coli
tttcactggttgtagagacacgtcc

SEQ ID NO: 203898 - DNA, 25 bp, E. coli
ttacgcgacagtatcgatgccctcg

SEQ ID NO: 203899 - DNA, 25 bp, E. coli
tggtcgatctttcgtacgcccggca

SEQ ID NO: 203900 - DNA, 25 bp, E. coli
tggtcgatctttggtacgcccggca

SEQ ID NO: 203901 - DNA, 25 bp, E. coli
tgacagaactcaccgcaaaagacct

SEQ ID NO: 203902 - DNA, 25 bp, E. coli
tgacagaactcagcgcaaaagacct

SEQ ID NO: 203903 - DNA, 25 bp, E. coli
ccgaactggatgagatggcaagcct

SEQ ID NO: 203904 - DNA, 25 bp, E. coli
gcaagtatatctggactgcgcagca

SEQ ID NO: 203905 - DNA, 25 bp, E. coli
gcaagtatatctcgactgcgcagca

SEQ ID NO: 203906 - DNA, 25 bp, E. coli
ccgaactggatgtgatggcaagcct

SEQ ID NO: 203907 - DNA, 25 bp, E. coli
ggatatctcccgtcgtaacgagctg

SEQ ID NO: 203908 - DNA, 25 bp, E. coli
ggatatctcccgacgtaacgagctg

SEQ ID NO: 203909 - DNA, 25 bp, E. coli
tgggccaagccgtcaggaagtagta

SEQ ID NO: 203910 - DNA, 25 bp, E. coli
tgggccaagccgacaggaagtagta

SEQ ID NO: 203911 - DNA, 25 bp, E. coli
caaatgatcaggttgttgcagcatt

SEQ ID NO: 203912 - DNA, 25 bp, E. coli
caaatgatcaggatgttgcagcatt

SEQ ID NO: 203913 - DNA, 25 bp, E. coli
aaagtgcaaatgttcaggttgttgc

SEQ ID NO: 203914 - DNA, 25 bp, E. coli
aaactgcatcagagaaagcattgcg

SEQ ID NO: 203915 - DNA, 25 bp, E. coli
aaactgcatcagtgaaagcattgcg

SEQ ID NO: 203916 - DNA, 25 bp, E. coli
aaagtgcaaatgatcaggttgttgc

SEQ ID NO: 203917 - DNA, 25 bp, E. coli
tgcatcagagaaagcattgcgtggg

SEQ ID NO: 203918 - DNA, 25 bp, E. coli
tgcatcagagaatgcattgcgtggg

SEQ ID NO: 203919 - DNA, 25 bp, E. coli
tccaggaataatgcctggcccaaaa

SEQ ID NO: 203920 - DNA, 25 bp, E. coli
tccaggaataatccctggcccaaaa

SEQ ID NO: 203921 - DNA, 25 bp, E. coli
tcttccaggaataatccctggccca

SEQ ID NO: 203922 - DNA, 25 bp, E. coli
tcaggttgttgcagcattttgcgtg

SEQ ID NO: 203923 - DNA, 25 bp, E. coli
tcaggttgttgctgcattttgcgtg

SEQ ID NO: 203924 - DNA, 25 bp, E. coli
tcttccaggaattatccctggccca

SEQ ID NO: 203925 - DNA, 25 bp, E. coli
gctaaaaagtgctaatgatcaggtt

SEQ ID NO: 203926 - DNA, 25 bp, E. coli
gctaaaaagtgcaaatgatcaggtt

SEQ ID NO: 203927 - DNA, 25 bp, E. coli
cattgcgtggggactggcgctcatc

SEQ ID NO: 203928 - DNA, 25 bp, E. coli
cattgcgtggggtctggcgctcatc

SEQ ID NO: 203929 - DNA, 25 bp, E. coli
ggcaaaactgcaacagagaaagcat

SEQ ID NO: 203930 - DNA, 25 bp, E. coli
ggcaaaactgcatcagagaaagcat

SEQ ID NO: 203931 - DNA, 25 bp, E. coli
gatcaggttgttgcagcattttgcg

SEQ ID NO: 203932 - DNA, 25 bp, E. coli
gatcaggttgttccagcattttgcg

SEQ ID NO: 203933 - DNA, 25 bp, E. coli
caagaaggtattcccgaagatggct

SEQ ID NO: 203934 - DNA, 25 bp, E. coli
caagaaggtattgccgaagatggct

SEQ ID NO: 203935 - DNA, 25 bp, E. coli
aagaggtttacctcatccatatgca

SEQ ID NO: 203936 - DNA, 25 bp, E. coli
aagaggtttaccacatccatatgca

SEQ ID NO: 203937 - DNA, 25 bp, E. coli
caggatgatctggtaacggcgtttc

SEQ ID NO: 203938 - DNA, 25 bp, E. coli
caggatgatctgctaacggcgtttc

SEQ ID NO: 203939 - DNA, 25 bp, E. coli
aagcgccaacgcatattctgatcat

SEQ ID NO: 203940 - DNA, 25 bp, E. coli
aagcgccaacgcttattctgatcat

SEQ ID NO: 203941 - DNA, 25 bp, E. coli
ttattcgtcgtgtgatcccctccga

SEQ ID NO: 203942 - DNA, 25 bp, E. coli
ttattcgtcgtgagatcccctccga

SEQ ID NO: 203943 - DNA, 25 bp, E. coli
tccgatatcgtcaaccaggatgatc

SEQ ID NO: 203944 - DNA, 25 bp, E. coli
tccgatatcgtctaccaggatgatc

SEQ ID NO: 203945 - DNA, 25 bp, E. coli
ccgtagcggcaaaaattgctgagca

SEQ ID NO: 203946 - DNA, 25 bp, E. coli
ccgtagcggcaataattgctgagca

SEQ ID NO: 203947 - DNA, 25 bp, E. coli
gaagatggctatcgtctgatcatga

SEQ ID NO: 203948 - DNA, 25 bp, E. coli
gaagatggctatggtctgatcatga

SEQ ID NO: 203949 - DNA, 25 bp, E. coli
cgctgggaccaatgctggcgcataa

SEQ ID NO: 203950 - DNA, 25 bp, E. coli
cgctgggaccaaagctggcgcataa

SEQ ID NO: 203951 - DNA, 25 bp, E. coli
ccgccatggcggtcaagaggtttac

SEQ ID NO: 203952 - DNA, 25 bp, E. coli
ccgccatggcggacaagaggtttac

SEQ ID NO: 203953 - DNA, 25 bp, E. coli
ggacgcatgatcaccgtagcggcaa

SEQ ID NO: 203954 - DNA, 25 bp, E. coli
ggacgcatgatctccgtagcggcaa

SEQ ID NO: 203955 - DNA, 25 bp, E. coli
catcacctgacgcagaaatacgtcg

SEQ ID NO: 203956 - DNA, 25 bp, E. coli
catcacctgacggagaaatacgtcg

SEQ ID NO: 203957 - DNA, 25 bp, E. coli
tacgacagtcgcgtaaacataatct

SEQ ID NO: 203958 - DNA, 25 bp, E. coli
tacgacagtcgcctaaacataatct

SEQ ID NO: 203959 - DNA, 25 bp, E. coli
aaagtttttacagaagaagagcgag

SEQ ID NO: 203960 - DNA, 25 bp, E. coli
aaagtttttacacaagaagagcgag

SEQ ID NO: 203961 - DNA, 25 bp, E. coli
aactcgtacgccagagtgggcgtga

SEQ ID NO: 203962 - DNA, 25 bp, E. coli
aactcgtacgcctgagtgggcgtga

SEQ ID NO: 203963 - DNA, 25 bp, E. coli
tgttgaactcgttcgccagagtggg

SEQ ID NO: 203964 - DNA, 25 bp, E. coli
tgttgaactcgtacgccagagtggg

SEQ ID NO: 203965 - DNA, 25 bp, E. coli
gcctaaacataaactgtcgcgagtg

SEQ ID NO: 203966 - DNA, 25 bp, E. coli
cctgctgtggttgatccggacctta

SEQ ID NO: 203967 - DNA, 25 bp, E. coli
cctgctgtggttcatccggacctta

SEQ ID NO: 203968 - DNA, 25 bp, E. coli
gcctaaacataatctgtcgcgagtg

SEQ ID NO: 203969 - DNA, 25 bp, E. coli
gcaggttgttgatctcgtacgccag

SEQ ID NO: 203970 - DNA, 25 bp, E. coli
gcaggttgttgaactcgtacgccag

SEQ ID NO: 203971 - DNA, 25 bp, E. coli
gaaacctgctgtggttgatccggac

SEQ ID NO: 203972 - DNA, 25 bp, E. coli
gaaatacgtcgcaacgacagtcgcc

SEQ ID NO: 203973 - DNA, 25 bp, E. coli
gaaacctgctgtcgttgatccggac

SEQ ID NO: 203974 - DNA, 25 bp, E. coli
gaaatacgtcgctacgacagtcgcc

SEQ ID NO: 203975 - DNA, 25 bp, E. coli
tccggctacgggatattcccctctg

SEQ ID NO: 203976 - DNA, 25 bp, E. coli
tccggctacgggttattcccctctg

SEQ ID NO: 203977 - DNA, 25 bp, E. coli
caacatttcaaatgacaggattggg

SEQ ID NO: 203978 - DNA, 25 bp, E. coli
caacatttcaaaagacaggattggg

SEQ ID NO: 203979 - DNA, 25 bp, E. coli
catgtgtcacgcttttaccaggcaa

SEQ ID NO: 203980 - DNA, 25 bp, E. coli
catgtgtcacgcatttaccaggcaa

SEQ ID NO: 203981 - DNA, 25 bp, E. coli
cattaaatttggtgacatgtgtcac

SEQ ID NO: 203982 - DNA, 25 bp, E. coli
catccaagaatttcctttgcgtgat

SEQ ID NO: 203983 - DNA, 25 bp, E. coli
catccaagaattacctttgcgtgat

SEQ ID NO: 203984 - DNA, 25 bp, E. coli
tttgatatgttgaaaggcggatgca

SEQ ID NO: 203985 - DNA, 25 bp, E. coli
tttgatatgttgtaaggcggatgca

SEQ ID NO: 203986 - DNA, 25 bp, E. coli
gctctaaataaaacctctaaaccag

SEQ ID NO: 203987 - DNA, 25 bp, E. coli
gctctaaataaatcctctaaaccag

SEQ ID NO: 203988 - DNA, 25 bp, E. coli
gcttttaccagggaattgtcgattg

SEQ ID NO: 203989 - DNA, 25 bp, E. coli
gcttttaccaggcaattgtcgattg

SEQ ID NO: 203990 - DNA, 25 bp, E. coli
ctaaaccagcattttcatccaagaa

SEQ ID NO: 203991 - DNA, 25 bp, E. coli
ctaaaccagcatattcatccaagaa

SEQ ID NO: 203992 - DNA, 25 bp, E. coli
cattaaatttggagacatgtgtcac

SEQ ID NO: 203993 - DNA, 25 bp, E. coli
gatatttcctcatcatcgcgacgca

SEQ ID NO: 203994 - DNA, 25 bp, E. coli
gatatttcctcaacatcgcgacgca

SEQ ID NO: 203995 - DNA, 25 bp, E. coli
gatgcaaatccggacacaacatttc

SEQ ID NO: 203996 - DNA, 25 bp, E. coli
gacgcaaacgttgatattgccgcaa

SEQ ID NO: 203997 - DNA, 25 bp, E. coli
gatgcaaatccgcacacaacatttc

SEQ ID NO: 203998 - DNA, 25 bp, E. coli
gacgcaaacgttcatattgccgcaa

SEQ ID NO: 203999 - DNA, 25 bp, E. coli
aacgggcttttggtcacatttcaaa

SEQ ID NO: 204000 - DNA, 25 bp, E. coli
aacgggcttttgctcacatttcaaa

SEQ ID NO: 204001 - DNA, 25 bp, E. coli
aaaacgggcttttgctcacatttca

SEQ ID NO: 204002 - DNA, 25 bp, E. coli
aaaacgggctttagctcacatttca

SEQ ID NO: 204003 - DNA, 25 bp, E. coli
tgctcacatttcaaatggttataaa

SEQ ID NO: 204004 - DNA, 25 bp, E. coli
tgctcacatttctaatggttataaa

SEQ ID NO: 204005 - DNA, 25 bp, E. coli
cctgtagcaggatcaaaagagtggc

SEQ ID NO: 204006 - DNA, 25 bp, E. coli
cctgtagcaggaacaaaagagtggc

SEQ ID NO: 204007 - DNA, 25 bp, E. coli
gaagcgtggcaaaaacgggcttttg

SEQ ID NO: 204008 - DNA, 25 bp, E. coli
gcaaaaacgggcatttgctcacatt

SEQ ID NO: 204009 - DNA, 25 bp, E. coli
gaagcgtggcaataacgggcttttg

SEQ ID NO: 204010 - DNA, 25 bp, E. coli
gcaaaaacgggcttttgctcacatt

SEQ ID NO: 204011 - DNA, 25 bp, E. coli
gtcaaagatgcataccccgatcggg

SEQ ID NO: 204012 - DNA, 25 bp, E. coli
gtcaaagatgcaaaccccgatcggg

SEQ ID NO: 204013 - DNA, 25 bp, E. coli
gggcttttgctctcatttcaaatgg

SEQ ID NO: 204014 - DNA, 25 bp, E. coli
gggtaaaacctgaagcaggatcaaa

SEQ ID NO: 204015 - DNA, 25 bp, E. coli
gtgtcaaagatgcataccccgatcg

SEQ ID NO: 204016 - DNA, 25 bp, E. coli
gtgtcaaagatggataccccgatcg

SEQ ID NO: 204017 - DNA, 25 bp, E. coli
gggtaaaacctgtagcaggatcaaa

SEQ ID NO: 204018 - DNA, 25 bp, E. coli
gggcttttgctcacatttcaaatgg

SEQ ID NO: 204019 - DNA, 25 bp, E. coli
gatcaaaagagtcgcgggaagcgtg

SEQ ID NO: 204020 - DNA, 25 bp, E. coli
gatcaaaagagtggcgggaagcgtg

SEQ ID NO: 204021 - DNA, 25 bp, E. coli
cagattatgtgaagactcgtgctta

SEQ ID NO: 204022 - DNA, 25 bp, E. coli
cagattatgtgatgactcgtgctta

SEQ ID NO: 204023 - DNA, 25 bp, E. coli
tactacaggtagtctgcatgaaact

SEQ ID NO: 204024 - DNA, 25 bp, E. coli
tactacaggtagactgcatgaaact

SEQ ID NO: 204025 - DNA, 25 bp, E. coli
tattatgccgttcaagaaatcgccg

SEQ ID NO: 204026 - DNA, 25 bp, E. coli
tattatgccgttgaagaaatcgccg

SEQ ID NO: 204027 - DNA, 25 bp, E. coli
tgcacttgcaagtgggtcattttca

SEQ ID NO: 204028 - DNA, 25 bp, E. coli
tgcacttgcaagagggtcattttca

SEQ ID NO: 204029 - DNA, 25 bp, E. coli
tcctgagttatccacaaagttatgc

SEQ ID NO: 204030 - DNA, 25 bp, E. coli
tctgacctaaggtgcgcgaaagcca

SEQ ID NO: 204031 - DNA, 25 bp, E. coli
tctgacctaaggagcgcgaaagcca

SEQ ID NO: 204032 - DNA, 25 bp, E. coli
tcctgagttatcgacaaagttatgc

SEQ ID NO: 204033 - DNA, 25 bp, E. coli
tctaagcagcttcccgtactacagg

SEQ ID NO: 204034 - DNA, 25 bp, E. coli
tctaagcagcttgccgtactacagg

SEQ ID NO: 204035 - DNA, 25 bp, E. coli
ccatcattttctttaagacggcgta

SEQ ID NO: 204036 - DNA, 25 bp, E. coli
ccatcattttctataagacggcgta

SEQ ID NO: 204037 - DNA, 25 bp, E. coli
gaaagccactttttccttcctgagt

SEQ ID NO: 204038 - DNA, 25 bp, E. coli
gaaagccactttatccttcctgagt

SEQ ID NO: 204039 - DNA, 25 bp, E. coli
gttcaacccggtccaatggctattt

SEQ ID NO: 204040 - DNA, 25 bp, E. coli
gttcaacccggtgcaatggctattt

SEQ ID NO: 204041 - DNA, 25 bp, E. coli
gggtcattttcacactatcttgcag

SEQ ID NO: 204042 - DNA, 25 bp, E. coli
gggtcattttcagactatcttgcag

SEQ ID NO: 204043 - DNA, 25 bp, E. coli
caagagatgcctgttcagtgactgc

SEQ ID NO: 204044 - DNA, 25 bp, E. coli
aattcccacattcgccgcatgaggc

SEQ ID NO: 204045 - DNA, 25 bp, E. coli
caagagatgcctcttcagtgactgc

SEQ ID NO: 204046 - DNA, 25 bp, E. coli
aattcccacattggccgcatgaggc

SEQ ID NO: 204047 - DNA, 25 bp, E. coli
taaactccgctgacaatcatgagca

SEQ ID NO: 204048 - DNA, 25 bp, E. coli
tactctgtggcgtgataaaactccg

SEQ ID NO: 204049 - DNA, 25 bp, E. coli
taaattgcagtcaatcgaagacgcg

SEQ ID NO: 204050 - DNA, 25 bp, E. coli
tactctgtggcgagataaaactccg

SEQ ID NO: 204051 - DNA, 25 bp, E. coli
taaattgcagtctatcgaagacgcg

SEQ ID NO: 204052 - DNA, 25 bp, E. coli
taaactccgctgtcaatcatgagca

SEQ ID NO: 204053 - DNA, 25 bp, E. coli
tatttctgatacagcgtaaactccg

SEQ ID NO: 204054 - DNA, 25 bp, E. coli
tatttctgatactgcgtaaactccg

SEQ ID NO: 204055 - DNA, 25 bp, E. coli
tgggcgggcaggaatgtaattttac

SEQ ID NO: 204056 - DNA, 25 bp, E. coli
tgggcgggcaggtatgtaattttac

SEQ ID NO: 204057 - DNA, 25 bp, E. coli
gaatagtggatatctgtctccagcc

SEQ ID NO: 204058 - DNA, 25 bp, E. coli
gaagacgcgatcacgctcgcaattt

SEQ ID NO: 204059 - DNA, 25 bp, E. coli
gaatagtggataactgtctccagcc

SEQ ID NO: 204060 - DNA, 25 bp, E. coli
gaagacgcgatctcgctcgcaattt

SEQ ID NO: 204061 - DNA, 25 bp, E. coli
cgcatgaggcggaagtaaaattttt

SEQ ID NO: 204062 - DNA, 25 bp, E. coli
cgcatgaggcggtagtaaaattttt

SEQ ID NO: 204063 - DNA, 25 bp, E. coli
cgtcgtacttaattatgccaacaaa

SEQ ID NO: 204064 - DNA, 25 bp, E. coli
cgtcgtacttaaatatgccaacaaa

SEQ ID NO: 204065 - DNA, 25 bp, E. coli
aatattcaggcgcaaaagcccgatt

SEQ ID NO: 204066 - DNA, 25 bp, E. coli
aatattcaggcggaaaagcccgatt

SEQ ID NO: 204067 - DNA, 25 bp, E. coli
caagacagaagaagatatctctcaa

SEQ ID NO: 204068 - DNA, 25 bp, E. coli
caagacagaagatgatatctctcaa

SEQ ID NO: 204069 - DNA, 25 bp, E. coli
aaaagcccgattttctgttcttctg

SEQ ID NO: 204070 - DNA, 25 bp, E. coli
aagcccgattttgtgttcttctgtt

SEQ ID NO: 204071 - DNA, 25 bp, E. coli
aaaagcccgattatctgttcttctg

SEQ ID NO: 204072 - DNA, 25 bp, E. coli
aagcccgattttctgttcttctgtt

SEQ ID NO: 204073 - DNA, 25 bp, E. coli
tattcaggcgcataagcccgatttt

SEQ ID NO: 204074 - DNA, 25 bp, E. coli
tattcaggcgcaaaagcccgatttt

SEQ ID NO: 204075 - DNA, 25 bp, E. coli
ttttctccgcaaaattcaggcgcaa

SEQ ID NO: 204076 - DNA, 25 bp, E. coli
ttttctccgcaatattcaggcgcaa

SEQ ID NO: 204077 - DNA, 25 bp, E. coli
tccgcaatattctggcgcaaaagcc

SEQ ID NO: 204078 - DNA, 25 bp, E. coli
tccgcaatattcaggcgcaaaagcc

SEQ ID NO: 204079 - DNA, 25 bp, E. coli
tctccgcaatatacaggcgcaaaag

SEQ ID NO: 204080 - DNA, 25 bp, E. coli
tcaggcgcaaaaccccgattttctg

SEQ ID NO: 204081 - DNA, 25 bp, E. coli
tctccgcaatattcaggcgcaaaag

SEQ ID NO: 204082 - DNA, 25 bp, E. coli
tcaggcgcaaaagcccgattttctg

SEQ ID NO: 204083 - DNA, 25 bp, E. coli
gcgcaaaagcccgattttctgttct

SEQ ID NO: 204084 - DNA, 25 bp, E. coli
gcgcaaaagccccattttctgttct

SEQ ID NO: 204085 - DNA, 25 bp, E. coli
gctttttctccggaatattcaggcg

SEQ ID NO: 204086 - DNA, 25 bp, E. coli
gctttttctccgcaatattcaggcg

SEQ ID NO: 204087 - DNA, 25 bp, E. coli
catcgcacagcaataatgagtcgta

SEQ ID NO: 204088 - DNA, 25 bp, E. coli
catcgcacagcattaatgagtcgta

SEQ ID NO: 204089 - DNA, 25 bp, E. coli
tatctgtttcctaattttgccgagg

SEQ ID NO: 204090 - DNA, 25 bp, E. coli
tatctgtttccttattttgccgagg

SEQ ID NO: 204091 - DNA, 25 bp, E. coli
tttcctaattttgccgaggcaaaat

SEQ ID NO: 204092 - DNA, 25 bp, E. coli
tttcctaattttcccgaggcaaaat

SEQ ID NO: 204093 - DNA, 25 bp, E. coli
tgtttcctaattatgccgaggcaaa

SEQ ID NO: 204094 - DNA, 25 bp, E. coli
tgtttcctaattttgccgaggcaaa

SEQ ID NO: 204095 - DNA, 25 bp, E. coli
tctgtttcctaaatttgccgaggca

SEQ ID NO: 204096 - DNA, 25 bp, E. coli
tctgtttcctaattttgccgaggca

SEQ ID NO: 204097 - DNA, 25 bp, E. coli
gccatcgcacaggattaatgagtcg

SEQ ID NO: 204098 - DNA, 25 bp, E. coli
gccatcgcacagcattaatgagtcg

SEQ ID NO: 204099 - DNA, 25 bp, E. coli
gcattgagttatgtcgattatctgt

SEQ ID NO: 204100 - DNA, 25 bp, E. coli
gcattgagttatctcgattatctgt

SEQ ID NO: 204101 - DNA, 25 bp, E. coli
cgcacagcattattgagtcgtattg

SEQ ID NO: 204102 - DNA, 25 bp, E. coli
cgcacagcattaatgagtcgtattg

SEQ ID NO: 204103 - DNA, 25 bp, E. coli
gattatctgtttcctaattttgccg

SEQ ID NO: 204104 - DNA, 25 bp, E. coli
gattatctgtttgctaattttgccg

SEQ ID NO: 204105 - DNA, 25 bp, E. coli
gggccatcgcacagcattaatgagt

SEQ ID NO: 204106 - DNA, 25 bp, E. coli
gggccatcgcactgcattaatgagt

SEQ ID NO: 204107 - DNA, 25 bp, E. coli
ggccatcgcacagcattaatgagtc

SEQ ID NO: 204108 - DNA, 25 bp, E. coli
ggccatcgcacaccattaatgagtc

SEQ ID NO: 204109 - DNA, 25 bp, E. coli
aaggcggcaagcgagtgaactccag

SEQ ID NO: 204110 - DNA, 25 bp, E. coli
aaggcggcaagccagtgaactccag

SEQ ID NO: 204111 - DNA, 25 bp, E. coli
catcagaattaagggcagaatcggc

SEQ ID NO: 204112 - DNA, 25 bp, E. coli
catcattatgcacgtgagtttcgcg

SEQ ID NO: 204113 - DNA, 25 bp, E. coli
catcagaattaacggcagaatcggc

SEQ ID NO: 204114 - DNA, 25 bp, E. coli
catcattatgcaggtgagtttcgcg

SEQ ID NO: 204115 - DNA, 25 bp, E. coli
tactctatggatttcgtgttgcagg

SEQ ID NO: 204116 - DNA, 25 bp, E. coli
tactctatggatatcgtgttgcagg

SEQ ID NO: 204117 - DNA, 25 bp, E. coli
tgcggtctgtgatgtaggtcgatac

SEQ ID NO: 204118 - DNA, 25 bp, E. coli
tgcggtctgtgaagtaggtcgatac

SEQ ID NO: 204119 - DNA, 25 bp, E. coli
tcgacgatttgacgcacaaaaaagg

SEQ ID NO: 204120 - DNA, 25 bp, E. coli
tcgacgatttgaggcacaaaaaagg

SEQ ID NO: 204121 - DNA, 25 bp, E. coli
gcgtgttgcctgagttgttgtacca

SEQ ID NO: 204122 - DNA, 25 bp, E. coli
gctgcaatagcggactgaaaggtga

SEQ ID NO: 204123 - DNA, 25 bp, E. coli
gctgcaatagcgcactgaaaggtga

SEQ ID NO: 204124 - DNA, 25 bp, E. coli
gcgtgttgcctgtgttgttgtacca

SEQ ID NO: 204125 - DNA, 25 bp, E. coli
gaatcggcctgtaaaaaaccgctga

SEQ ID NO: 204126 - DNA, 25 bp, E. coli
gaatcggcctgttaaaaaccgctga

SEQ ID NO: 204127 - DNA, 25 bp, E. coli
gaactccaggagcttacaatagtaa

SEQ ID NO: 204128 - DNA, 25 bp, E. coli
gaactccaggaggttacaatagtaa

SEQ ID NO: 204129 - DNA, 25 bp, E. coli
gatacactattctttcaggctgctg

SEQ ID NO: 204130 - DNA, 25 bp, E. coli
gatacactattcattcaggctgctg

SEQ ID NO: 204131 - DNA, 25 bp, E. coli
tttactgcatcttcaaccgtcttgg

SEQ ID NO: 204132 - DNA, 25 bp, E. coli
ttcaaccgtcttggcgggaatgtgc

SEQ ID NO: 204133 - DNA, 25 bp, E. coli
ttcaaccgtcttcgcgggaatgtgc

SEQ ID NO: 204134 - DNA, 25 bp, E. coli
tttactgcatctacaaccgtcttgg

SEQ ID NO: 204135 - DNA, 25 bp, E. coli
tcttcggattacctccggtacgtgg

SEQ ID NO: 204136 - DNA, 25 bp, E. coli
tcttcggattacgtccggtacgtgg

SEQ ID NO: 204137 - DNA, 25 bp, E. coli
gctgggtggcaactctttctatcaa

SEQ ID NO: 204138 - DNA, 25 bp, E. coli
gctgggtggcaagtctttctatcaa

SEQ ID NO: 204139 - DNA, 25 bp, E. coli
gaaactgccgaaaccgcggatttca

SEQ ID NO: 204140 - DNA, 25 bp, E. coli
gaaactgccgaatccgcggatttca

SEQ ID NO: 204141 - DNA, 25 bp, E. coli
cgcggtagtgcatagagaaactgcc

SEQ ID NO: 204142 - DNA, 25 bp, E. coli
ccctgcgcaagagtcgaggccatat

SEQ ID NO: 204143 - DNA, 25 bp, E. coli
cgcggtagtgcaaagagaaactgcc

SEQ ID NO: 204144 - DNA, 25 bp, E. coli
ccctgcgcaagactcgaggccatat

SEQ ID NO: 204145 - DNA, 25 bp, E. coli
cggatttcaataggctcgccctgcg

SEQ ID NO: 204146 - DNA, 25 bp, E. coli
cggatttcaatacgctcgccctgcg

SEQ ID NO: 204147 - DNA, 25 bp, E. coli
gttctactttatcgccagtcttcgg

SEQ ID NO: 204148 - DNA, 25 bp, E. coli
gttctactttatggccagtcttcgg

SEQ ID NO: 204149 - DNA, 25 bp, E. coli
taaccgtaaataatggcgcgatcgc

SEQ ID NO: 204150 - DNA, 25 bp, E. coli
taaccgtaaatattggcgcgatcgc

SEQ ID NO: 204151 - DNA, 25 bp, E. coli
gagtcgaggccatatgctccagcat

SEQ ID NO: 204152 - DNA, 25 bp, E. coli
gagtcgaggccaaatgctccagcat

SEQ ID NO: 204153 - DNA, 25 bp, E. coli
aaccagtcgccggtttcaattagct

SEQ ID NO: 204154 - DNA, 25 bp, E. coli
aaggcatcaagtacggccagcgtgg

SEQ ID NO: 204155 - DNA, 25 bp, E. coli
aaggcatcaagttcggccagcgtgg

SEQ ID NO: 204156 - DNA, 25 bp, E. coli
ttagctttaatcgatcgacgggtcg

SEQ ID NO: 204157 - DNA, 25 bp, E. coli
ttagctttaatccatcgacgggtcg

SEQ ID NO: 204158 - DNA, 25 bp, E. coli
tacttatccctgactaaccagtcgc

SEQ ID NO: 204159 - DNA, 25 bp, E. coli
tacttatccctgtctaaccagtcgc

SEQ ID NO: 204160 - DNA, 25 bp, E. coli
aaccagtcgccgctttcaattagct

SEQ ID NO: 204161 - DNA, 25 bp, E. coli
tagtggcccaggctatacaactggt

SEQ ID NO: 204162 - DNA, 25 bp, E. coli
tagtggcccagggtatacaactggt

SEQ ID NO: 204163 - DNA, 25 bp, E. coli
tgcactcccgtagggcgtctgaatc

SEQ ID NO: 204164 - DNA, 25 bp, E. coli
tgcactcccgtacggcgtctgaatc

SEQ ID NO: 204165 - DNA, 25 bp, E. coli
tcgttgataaacgtacatccatgca

SEQ ID NO: 204166 - DNA, 25 bp, E. coli
tcgttgataaacctacatccatgca

SEQ ID NO: 204167 - DNA, 25 bp, E. coli
ccagcgtggcgtagtcaatacgata

SEQ ID NO: 204168 - DNA, 25 bp, E. coli
ccagcgtggcgttgtcaatacgata

SEQ ID NO: 204169 - DNA, 25 bp, E. coli
cccctggtgcgctaggcatcaagtt

SEQ ID NO: 204170 - DNA, 25 bp, E. coli
cccctggtgcgcaaggcatcaagtt

SEQ ID NO: 204171 - DNA, 25 bp, E. coli
cgtctgaatcaactggcgcgcgtat

SEQ ID NO: 204172 - DNA, 25 bp, E. coli
cgtctgaatcaagtggcgcgcgtat

SEQ ID NO: 204173 - DNA, 25 bp, E. coli
ggaactgcgcctcgatagtggccca

SEQ ID NO: 204174 - DNA, 25 bp, E. coli
ggaactgcgcctggatagtggccca

SEQ ID NO: 204175 - DNA, 25 bp, E. coli
cagcaggagctgcagatcaacgatc

SEQ ID NO: 204176 - DNA, 25 bp, E. coli
cagcaggagctggagatcaacgatc

SEQ ID NO: 204177 - DNA, 25 bp, E. coli
caaattaaaactccgcggcacgacc

SEQ ID NO: 204178 - DNA, 25 bp, E. coli
cagcggttacgatgcggtggatatc

SEQ ID NO: 204179 - DNA, 25 bp, E. coli
caaattaaaactgcgcggcacgacc

SEQ ID NO: 204180 - DNA, 25 bp, E. coli
cagcggttacgaagcggtggatatc

SEQ ID NO: 204181 - DNA, 25 bp, E. coli
tattcgtgaggtggcctttgcggaa

SEQ ID NO: 204182 - DNA, 25 bp, E. coli
tattcgtgaggtcgcctttgcggaa

SEQ ID NO: 204183 - DNA, 25 bp, E. coli
tattttaattgtcggcaaacccacg

SEQ ID NO: 204184 - DNA, 25 bp, E. coli
tattttaattgtgggcaaacccacg

SEQ ID NO: 204185 - DNA, 25 bp, E. coli
ttatcgactttcacgaacccggcag

SEQ ID NO: 204186 - DNA, 25 bp, E. coli
ttatcgactttctcgaacccggcag

SEQ ID NO: 204187 - DNA, 25 bp, E. coli
tggtgtatgaaatagcccgcgatgg

SEQ ID NO: 204188 - DNA, 25 bp, E. coli
gaagactatccgaaggcactgtttg

SEQ ID NO: 204189 - DNA, 25 bp, E. coli
gaagactatccgtaggcactgtttg

SEQ ID NO: 204190 - DNA, 25 bp, E. coli
gattccattgctatcggcgtactgc

SEQ ID NO: 204191 - DNA, 25 bp, E. coli
gattccattgctttcggcgtactgc

SEQ ID NO: 204192 - DNA, 25 bp, E. coli
tggtgtatgaaaaagcccgcgatgg

SEQ ID NO: 204193 - DNA, 25 bp, E. coli
ggctatctacagctaccagcaggag

SEQ ID NO: 204194 - DNA, 25 bp, E. coli
ggctatctacaggtaccagcaggag

SEQ ID NO: 204195 - DNA, 25 bp, E. coli
gagatcgccgaaaagctggagtaca

SEQ ID NO: 204196 - DNA, 25 bp, E. coli
gagatcgccgaatagctggagtaca

SEQ ID NO: 204197 - DNA, 25 bp, E. coli
cagcgtaactcgatattgtttgcga

SEQ ID NO: 204198 - DNA, 25 bp, E. coli
cagcgtaactcgttattgtttgcga

SEQ ID NO: 204199 - DNA, 25 bp, E. coli
catagagtagttaacatgaagcgga

SEQ ID NO: 204200 - DNA, 25 bp, E. coli
catagagtagtttacatgaagcgga

SEQ ID NO: 204201 - DNA, 25 bp, E. coli
taacatgaagcggagtagaacggaa

SEQ ID NO: 204202 - DNA, 25 bp, E. coli
taacatgaagcgcagtagaacggaa

SEQ ID NO: 204203 - DNA, 25 bp, E. coli
aaaacgcgggaatagcactggtcag

SEQ ID NO: 204204 - DNA, 25 bp, E. coli
aaaacgcgggaaaagcactggtcag

SEQ ID NO: 204205 - DNA, 25 bp, E. coli
ttcatctggcaattaaaaacgcggg

SEQ ID NO: 204206 - DNA, 25 bp, E. coli
ttcatctggcaaataaaaacgcggg

SEQ ID NO: 204207 - DNA, 25 bp, E. coli
tccacagcatcacgaagtgcattct

SEQ ID NO: 204208 - DNA, 25 bp, E. coli
tccacagcatcaggaagtgcattct

SEQ ID NO: 204209 - DNA, 25 bp, E. coli
tcaggctagccgtcgtaaatcgcgt

SEQ ID NO: 204210 - DNA, 25 bp, E. coli
tcaggctagccgacgtaaatcgcgt

SEQ ID NO: 204211 - DNA, 25 bp, E. coli
gccgaaatatgcgtatccacagcat

SEQ ID NO: 204212 - DNA, 25 bp, E. coli
gccgaaatatgcctatccacagcat

SEQ ID NO: 204213 - DNA, 25 bp, E. coli
ctggcgcatgcaccgtcaggctagc

SEQ ID NO: 204214 - DNA, 25 bp, E. coli
ctggcgcatgcagcgtcaggctagc

SEQ ID NO: 204215 - DNA, 25 bp, E. coli
ggaagtgcattctaaacaaacagcg

SEQ ID NO: 204216 - DNA, 25 bp, E. coli
ggaagtgcattcaaaacaaacagcg

SEQ ID NO: 204217 - DNA, 25 bp, E. coli
gagtttacgcatatggattcatctg

SEQ ID NO: 204218 - DNA, 25 bp, E. coli
gagtttacgcatttggattcatctg

SEQ ID NO: 204219 - DNA, 25 bp, E. coli
aatagccaggtagtttccttctgtg

SEQ ID NO: 204220 - DNA, 25 bp, E. coli
aatagccaggtactttccttctgtg

SEQ ID NO: 204221 - DNA, 25 bp, E. coli
cagaattaacgatataatagccagg

SEQ ID NO: 204222 - DNA, 25 bp, E. coli
cagaattaacgaaataatagccagg

SEQ ID NO: 204223 - DNA, 25 bp, E. coli
aggtactttcctactgtgctctcag

SEQ ID NO: 204224 - DNA, 25 bp, E. coli
aggtactttccttctgtgctctcag

SEQ ID NO: 204225 - DNA, 25 bp, E. coli
tttccttctgtggtctcagcctgct

SEQ ID NO: 204226 - DNA, 25 bp, E. coli
tttccttctgtgctctcagcctgct

SEQ ID NO: 204227 - DNA, 25 bp, E. coli
gcgcaatgaagaggagatgttcatc

SEQ ID NO: 204228 - DNA, 25 bp, E. coli
gctctcagcctgctcccgagtgtga

SEQ ID NO: 204229 - DNA, 25 bp, E. coli
gcgcaatgaagacgagatgttcatc

SEQ ID NO: 204230 - DNA, 25 bp, E. coli
gctctcagcctggtcccgagtgtga

SEQ ID NO: 204231 - DNA, 25 bp, E. coli
gcacacatcactttcaaaaggctgg

SEQ ID NO: 204232 - DNA, 25 bp, E. coli
gcacacatcactatcaaaaggctgg

SEQ ID NO: 204233 - DNA, 25 bp, E. coli
ctggaactgattcacagaattaacg

SEQ ID NO: 204234 - DNA, 25 bp, E. coli
ctggaactgattgacagaattaacg

SEQ ID NO: 204235 - DNA, 25 bp, E. coli
gggatctgcacacatcactttcaaa

SEQ ID NO: 204236 - DNA, 25 bp, E. coli
gggatctgcacagatcactttcaaa

SEQ ID NO: 204237 - DNA, 25 bp, E. coli
tcactttcaaaaggctggaactgat

SEQ ID NO: 204238 - DNA, 25 bp, E. coli
tcactttcaaaacgctggaactgat

SEQ ID NO: 204239 - DNA, 25 bp, E. coli
taagaagggatcagcacacatcact

SEQ ID NO: 204240 - DNA, 25 bp, E. coli
taagaagggatctgcacacatcact

SEQ ID NO: 204241 - DNA, 25 bp, E. coli
caagattgttccattctaagctgcc

SEQ ID NO: 204242 - DNA, 25 bp, E. coli
caagattgttcctttctaagctgcc

SEQ ID NO: 204243 - DNA, 25 bp, E. coli
caaaacaatttggtgaggtgtccga

SEQ ID NO: 204244 - DNA, 25 bp, E. coli
caaaacaatttgctgaggtgtccga

SEQ ID NO: 204245 - DNA, 25 bp, E. coli
aaagtgtgtatagggcaacgtatcg

SEQ ID NO: 204246 - DNA, 25 bp, E. coli
aaagtgtgtatacggcaacgtatcg

SEQ ID NO: 204247 - DNA, 25 bp, E. coli
aaaccatctcatattcctgctgtca

SEQ ID NO: 204248 - DNA, 25 bp, E. coli
aaaccatctcattttcctgctgtca

SEQ ID NO: 204249 - DNA, 25 bp, E. coli
tttatccttaccttttccagcagca

SEQ ID NO: 204250 - DNA, 25 bp, E. coli
tttatccttaccatttccagcagca

SEQ ID NO: 204251 - DNA, 25 bp, E. coli
tgtacggcagtgtacgccaactttc

SEQ ID NO: 204252 - DNA, 25 bp, E. coli
tgtacggcagtgaacgccaactttc

SEQ ID NO: 204253 - DNA, 25 bp, E. coli
tgaacgccaactatcacagcctttg

SEQ ID NO: 204254 - DNA, 25 bp, E. coli
tgaacgccaactttcacagcctttg

SEQ ID NO: 204255 - DNA, 25 bp, E. coli
tccgagtggctgaaggagcacgcct

SEQ ID NO: 204256 - DNA, 25 bp, E. coli
tccgagtggctgtaggagcacgcct

SEQ ID NO: 204257 - DNA, 25 bp, E. coli
cctggaaagtgtctatacggcaacg

SEQ ID NO: 204258 - DNA, 25 bp, E. coli
cctggaaagtgtgtatacggcaacg

SEQ ID NO: 204259 - DNA, 25 bp, E. coli
ggagcacgcctggaaagtgtgtata

SEQ ID NO: 204260 - DNA, 25 bp, E. coli
ggagcacgcctgcaaagtgtgtata

SEQ ID NO: 204261 - DNA, 25 bp, E. coli
tcacagcctttgcaagattgttcct

SEQ ID NO: 204262 - DNA, 25 bp, E. coli
tcacagcctttggaagattgttcct

SEQ ID NO: 204263 - DNA, 25 bp, E. coli
aagccattgatgatcccggtgaaaa

SEQ ID NO: 204264 - DNA, 25 bp, E. coli
agtaatgtgacccaaatgatgcgca

SEQ ID NO: 204265 - DNA, 25 bp, E. coli
agtaatgtgaccgaaatgatgcgca

SEQ ID NO: 204266 - DNA, 25 bp, E. coli
aagccattgatgttcccggtgaaaa

SEQ ID NO: 204267 - DNA, 25 bp, E. coli
tttatgaagagtgtcggcgctaccc

SEQ ID NO: 204268 - DNA, 25 bp, E. coli
tttatgaagagtctcggcgctaccc

SEQ ID NO: 204269 - DNA, 25 bp, E. coli
tcctgcgcgatcaggaaaaagaaca

SEQ ID NO: 204270 - DNA, 25 bp, E. coli
tcctgcgcgatctggaaaaagaaca

SEQ ID NO: 204271 - DNA, 25 bp, E. coli
tcgcgcccaggcacagagtaatgtg

SEQ ID NO: 204272 - DNA, 25 bp, E. coli
tcgcgcccaggctcagagtaatgtg

SEQ ID NO: 204273 - DNA, 25 bp, E. coli
tctgaacagagtgtgaacggcaccg

SEQ ID NO: 204274 - DNA, 25 bp, E. coli
tctgaacagagtctgaacggcaccg

SEQ ID NO: 204275 - DNA, 25 bp, E. coli
gaagaactgttcgaaaaaacgatgg

SEQ ID NO: 204276 - DNA, 25 bp, E. coli
gcaaaccattcttgatgaagtgcgc

SEQ ID NO: 204277 - DNA, 25 bp, E. coli
gaagaactgttccaaaaaacgatgg

SEQ ID NO: 204278 - DNA, 25 bp, E. coli
gcaaaccattctagatgaagtgcgc

SEQ ID NO: 204279 - DNA, 25 bp, E. coli
gaaccgcgagttatacgcatccaat

SEQ ID NO: 204280 - DNA, 25 bp, E. coli
gaaccgcgagttttacgcatccaat

SEQ ID NO: 204281 - DNA, 25 bp, E. coli
cgatggaagaatacgagcaacgttc

SEQ ID NO: 204282 - DNA, 25 bp, E. coli
cgatggaagaattcgagcaacgttc

SEQ ID NO: 204283 - DNA, 25 bp, E. coli
ccggtgaaaaacagaactctctgga

SEQ ID NO: 204284 - DNA, 25 bp, E. coli
ccggtgaaaaactgaactctctgga

SEQ ID NO: 204285 - DNA, 25 bp, E. coli
caactcacctaaaacgacgctgatc

SEQ ID NO: 204286 - DNA, 25 bp, E. coli
caactcacctaatacgacgctgatc

SEQ ID NO: 204287 - DNA, 25 bp, E. coli
cacctaaaacgaggctgatccagcg

SEQ ID NO: 204288 - DNA, 25 bp, E. coli
cacctaaaacgacgctgatccagcg

SEQ ID NO: 204289 - DNA, 25 bp, E. coli
taacaactcaccaaaaacgacgctg

SEQ ID NO: 204290 - DNA, 25 bp, E. coli
taaaacgacgctcatccagcgtgaa

SEQ ID NO: 204291 - DNA, 25 bp, E. coli
taaaacgacgctgatccagcgtgaa

SEQ ID NO: 204292 - DNA, 25 bp, E. coli
aaacgacgctgatccagcgtgaata

SEQ ID NO: 204293 - DNA, 25 bp, E. coli
aaacgacgctgaaccagcgtgaata

SEQ ID NO: 204294 - DNA, 25 bp, E. coli
tattaacaactcacctaaaacgacg

SEQ ID NO: 204295 - DNA, 25 bp, E. coli
tattaacaactctcctaaaacgacg

SEQ ID NO: 204296 - DNA, 25 bp, E. coli
tcatttaagcaagggtttcttcttc

SEQ ID NO: 204297 - DNA, 25 bp, E. coli
tcatttaagcaacggtttcttcttc

SEQ ID NO: 204298 - DNA, 25 bp, E. coli
cctaaaacgacgctgatccagcgtg

SEQ ID NO: 204299 - DNA, 25 bp, E. coli
cctaaaacgacggtgatccagcgtg

SEQ ID NO: 204300 - DNA, 25 bp, E. coli
tttaagcaagggattcttcttcatt

SEQ ID NO: 204301 - DNA, 25 bp, E. coli
tttaagcaagggtttcttcttcatt

SEQ ID NO: 204302 - DNA, 25 bp, E. coli
tcacctaaaacgacgctgatccagc

SEQ ID NO: 204303 - DNA, 25 bp, E. coli
taacaactcacctaaaacgacgctg

SEQ ID NO: 204304 - DNA, 25 bp, E. coli
tcacctaaaacgtcgctgatccagc

SEQ ID NO: 204305 - DNA, 25 bp, E. coli
gacgctgatccagcgtgaatactgg

SEQ ID NO: 204306 - DNA, 25 bp, E. coli
gacgctgatccaccgtgaatactgg

SEQ ID NO: 204307 - DNA, 25 bp, E. coli
aaagtatccgatcgaattacccagg

SEQ ID NO: 204308 - DNA, 25 bp, E. coli
aaagtatccgatggaattacccagg

SEQ ID NO: 204309 - DNA, 25 bp, E. coli
tatatggtatttccaaaagtatccg

SEQ ID NO: 204310 - DNA, 25 bp, E. coli
tatatggtatttgcaaaagtatccg

SEQ ID NO: 204311 - DNA, 25 bp, E. coli
tatcttcgtcataatggccttgcca

SEQ ID NO: 204312 - DNA, 25 bp, E. coli
tatcttcgtcattatggccttgcca

SEQ ID NO: 204313 - DNA, 25 bp, E. coli
ttgacttaacagttcttcacttggg

SEQ ID NO: 204314 - DNA, 25 bp, E. coli
ttctgcaaagaattagagctcgatt

SEQ ID NO: 204315 - DNA, 25 bp, E. coli
ttctgcaaagaaatagagctcgatt

SEQ ID NO: 204316 - DNA, 25 bp, E. coli
ttgacttaacagatcttcacttggg

SEQ ID NO: 204317 - DNA, 25 bp, E. coli
tgaactccacaatagtaaacttgac

SEQ ID NO: 204318 - DNA, 25 bp, E. coli
tgaactccacaaaagtaaacttgac

SEQ ID NO: 204319 - DNA, 25 bp, E. coli
ccatcctggattcaggtgctttatc

SEQ ID NO: 204320 - DNA, 25 bp, E. coli
ccatcctggattgaggtgctttatc

SEQ ID NO: 204321 - DNA, 25 bp, E. coli
gaattacccaggtctccgtagataa

SEQ ID NO: 204322 - DNA, 25 bp, E. coli
gaattacccaggactccgtagataa

SEQ ID NO: 204323 - DNA, 25 bp, E. coli
gactcatctccgtcaaaggctatga

SEQ ID NO: 204324 - DNA, 25 bp, E. coli
gactcatctccgacaaaggctatga

SEQ ID NO: 204325 - DNA, 25 bp, E. coli
gatatcgcgtgttgactcatctccg

SEQ ID NO: 204326 - DNA, 25 bp, E. coli
gatatcgcgtgtagactcatctccg

SEQ ID NO: 204327 - DNA, 25 bp, E. coli
ggccttgccacattacaaattccca

SEQ ID NO: 204328 - DNA, 25 bp, E. coli
ggccttgccacaatacaaattccca

SEQ ID NO: 204329 - DNA, 25 bp, E. coli
cagcgagtgataaagtacagatacc

SEQ ID NO: 204330 - DNA, 25 bp, E. coli
cagcgagtgatatagtacagatacc

SEQ ID NO: 204331 - DNA, 25 bp, E. coli
taaatgcaagactgttgtgtacgga

SEQ ID NO: 204332 - DNA, 25 bp, E. coli
taaatgcaagacagttgtgtacgga

SEQ ID NO: 204333 - DNA, 25 bp, E. coli
actctttacaggaaccattgtcgta

SEQ ID NO: 204334 - DNA, 25 bp, E. coli
actctttacaggtaccattgtcgta

SEQ ID NO: 204335 - DNA, 25 bp, E. coli
tagtaagacaatgcttaacctctgg

SEQ ID NO: 204336 - DNA, 25 bp, E. coli
tagtaagacaatccttaacctctgg

SEQ ID NO: 204337 - DNA, 25 bp, E. coli
gctcctcgtggtaatgtcctgacta

SEQ ID NO: 204338 - DNA, 25 bp, E. coli
gctaagcatcaatgaaaacagcatg

SEQ ID NO: 204339 - DNA, 25 bp, E. coli
gctcctcgtggttatgtcctgacta

SEQ ID NO: 204340 - DNA, 25 bp, E. coli
gctaagcatcaaagaaaacagcatg

SEQ ID NO: 204341 - DNA, 25 bp, E. coli
cgcgctaaaaaagctgtaacttcag

SEQ ID NO: 204342 - DNA, 25 bp, E. coli
cattgtcgtacatgatggcccaacc

SEQ ID NO: 204343 - DNA, 25 bp, E. coli
cattgtcgtacaagatggcccaacc

SEQ ID NO: 204344 - DNA, 25 bp, E. coli
cgcgctaaaaaacctgtaacttcag

SEQ ID NO: 204345 - DNA, 25 bp, E. coli
gataccgcattcatgctcctcgtgg

SEQ ID NO: 204346 - DNA, 25 bp, E. coli
gataccgcattcttgctcctcgtgg

SEQ ID NO: 204347 - DNA, 25 bp, E. coli
taacctctggcattttttgctaagc

SEQ ID NO: 204348 - DNA, 25 bp, E. coli
taatcagtagctgaaagcagtcagc

SEQ ID NO: 204349 - DNA, 25 bp, E. coli
taatcagtagctcaaagcagtcagc

SEQ ID NO: 204350 - DNA, 25 bp, E. coli
taacctctggcaatttttgctaagc

SEQ ID NO: 204351 - DNA, 25 bp, E. coli
gtaatctgacacaggtaggtttttg

SEQ ID NO: 204352 - DNA, 25 bp, E. coli
gtaatctgacactggtaggtttttg

SEQ ID NO: 204353 - DNA, 25 bp, E. coli
tatgcggcgtggagcaacttaatga

SEQ ID NO: 204354 - DNA, 25 bp, E. coli
tatgcggcgtggtgcaacttaatga

SEQ ID NO: 204355 - DNA, 25 bp, E. coli
tgacatcggaaaaccggtgcagccg

SEQ ID NO: 204356 - DNA, 25 bp, E. coli
tgacatcggaaatccggtgcagccg

SEQ ID NO: 204357 - DNA, 25 bp, E. coli
tctgacactggtaggtttttgtaaa

SEQ ID NO: 204358 - DNA, 25 bp, E. coli
tctgacactggttggtttttgtaaa

SEQ ID NO: 204359 - DNA, 25 bp, E. coli
gcgctgtaatctcacactggtaggt

SEQ ID NO: 204360 - DNA, 25 bp, E. coli
gcggcgtggagcaacttaatgacat

SEQ ID NO: 204361 - DNA, 25 bp, E. coli
gcgctgtaatctgacactggtaggt

SEQ ID NO: 204362 - DNA, 25 bp, E. coli
gctgtaatctgagactggtaggttt

SEQ ID NO: 204363 - DNA, 25 bp, E. coli
gcggcgtggagctacttaatgacat

SEQ ID NO: 204364 - DNA, 25 bp, E. coli
gcgtatgcggcgaggagcaacttaa

SEQ ID NO: 204365 - DNA, 25 bp, E. coli
gctgtaatctgacactggtaggttt

SEQ ID NO: 204366 - DNA, 25 bp, E. coli
gcgtatgcggcgtggagcaacttaa

SEQ ID NO: 204367 - DNA, 25 bp, E. coli
cgtggagcaacttaatgacatcgga

SEQ ID NO: 204368 - DNA, 25 bp, E. coli
cgtatgcggcgtcgagcaacttaat

SEQ ID NO: 204369 - DNA, 25 bp, E. coli
cgtggagcaactaaatgacatcgga

SEQ ID NO: 204370 - DNA, 25 bp, E. coli
cgtatgcggcgtggagcaacttaat

SEQ ID NO: 204371 - DNA, 25 bp, E. coli
ggcgtggagcaacttaatgacatcg

SEQ ID NO: 204372 - DNA, 25 bp, E. coli
ggcgtggagcaagttaatgacatcg

SEQ ID NO: 204373 - DNA, 25 bp, E. coli
catgctatttctgccgaggtgacct

SEQ ID NO: 204374 - DNA, 25 bp, E. coli
catgctatttctcccgaggtgacct

SEQ ID NO: 204375 - DNA, 25 bp, E. coli
caggtcataaacaaccacgatttcg

SEQ ID NO: 204376 - DNA, 25 bp, E. coli
caggtcataaactaccacgatttcg

SEQ ID NO: 204377 - DNA, 25 bp, E. coli
aaagacccgcatgctatttctgccg

SEQ ID NO: 204378 - DNA, 25 bp, E. coli
aaagataagcgcgagaaagacccgc

SEQ ID NO: 204379 - DNA, 25 bp, E. coli
aaagataagcgccagaaagacccgc

SEQ ID NO: 204380 - DNA, 25 bp, E. coli
aaagacccgcatcctatttctgccg

SEQ ID NO: 204381 - DNA, 25 bp, E. coli
tatttctgccgacgtgacctatacg

SEQ ID NO: 204382 - DNA, 25 bp, E. coli
tatttctgccgaggtgacctatacg

SEQ ID NO: 204383 - DNA, 25 bp, E. coli
tataaaacaggtgataaacaaccac

SEQ ID NO: 204384 - DNA, 25 bp, E. coli
tataaaacaggtcataaacaaccac

SEQ ID NO: 204385 - DNA, 25 bp, E. coli
tgtcacctttacgccagtaatggcg

SEQ ID NO: 204386 - DNA, 25 bp, E. coli
tgtcacctttaccccagtaatggcg

SEQ ID NO: 204387 - DNA, 25 bp, E. coli
gcgccagaaagacccgcatgctatt

SEQ ID NO: 204388 - DNA, 25 bp, E. coli
gcgccagaaagagccgcatgctatt

SEQ ID NO: 204389 - DNA, 25 bp, E. coli
cgaggtgacctatacgccagtgcct

SEQ ID NO: 204390 - DNA, 25 bp, E. coli
cgaggtgacctaaacgccagtgcct

SEQ ID NO: 204391 - DNA, 25 bp, E. coli
cgataaagatttctcgctgaaggat

SEQ ID NO: 204392 - DNA, 25 bp, E. coli
cgataaagatttgtcgctgaaggat

SEQ ID NO: 204393 - DNA, 25 bp, E. coli
gatttctcgctgtaggattcttcgc

SEQ ID NO: 204394 - DNA, 25 bp, E. coli
gatttctcgctgaaggattcttcgc

SEQ ID NO: 204395 - DNA, 25 bp, E. coli
catgcggagtatagaagaaggcgtc

SEQ ID NO: 204396 - DNA, 25 bp, E. coli
catgcggagtattgaagaaggcgtc

SEQ ID NO: 204397 - DNA, 25 bp, E. coli
tatgcctcggcactgtatgtccctg

SEQ ID NO: 204398 - DNA, 25 bp, E. coli
tatgcctcggcagtgtatgtccctg

SEQ ID NO: 204399 - DNA, 25 bp, E. coli
tatatgtacgttagctatgcctcgg

SEQ ID NO: 204400 - DNA, 25 bp, E. coli
tatatgtacgtttgctatgcctcgg

SEQ ID NO: 204401 - DNA, 25 bp, E. coli
tatcaggaagcccagaaagtcatgc

SEQ ID NO: 204402 - DNA, 25 bp, E. coli
tattaatcctgattgcggtgctcgg

SEQ ID NO: 204403 - DNA, 25 bp, E. coli
tattaatcctgaatgcggtgctcgg

SEQ ID NO: 204404 - DNA, 25 bp, E. coli
tatcaggaagccgagaaagtcatgc

SEQ ID NO: 204405 - DNA, 25 bp, E. coli
gctggtttcaccgaatatatgcccg

SEQ ID NO: 204406 - DNA, 25 bp, E. coli
gctggtttcacccaatatatgcccg

SEQ ID NO: 204407 - DNA, 25 bp, E. coli
gaactggcgggtacaactgcttatc

SEQ ID NO: 204408 - DNA, 25 bp, E. coli
gaactggcgggttcaactgcttatc

SEQ ID NO: 204409 - DNA, 25 bp, E. coli
gactcacgccgcagattagtgcaga

SEQ ID NO: 204410 - DNA, 25 bp, E. coli
gacaaaaccggtcgcagaaatgcgt

SEQ ID NO: 204411 - DNA, 25 bp, E. coli
gactcacgccgctgattagtgcaga

SEQ ID NO: 204412 - DNA, 25 bp, E. coli
gacaaaaccggtggcagaaatgcgt

SEQ ID NO: 204413 - DNA, 25 bp, E. coli
gatcctcgcgcacctgaaagcgttg

SEQ ID NO: 204414 - DNA, 25 bp, E. coli
tggcctggcgcttctttcctgaatc

SEQ ID NO: 204415 - DNA, 25 bp, E. coli
tggcctggcgctactttcctgaatc

SEQ ID NO: 204416 - DNA, 25 bp, E. coli
gatcctcgcgcagctgaaagcgttg

SEQ ID NO: 204417 - DNA, 25 bp, E. coli
agaactatacgttcatccccaccat

SEQ ID NO: 204418 - DNA, 25 bp, E. coli
agccagaactattcgtacatcccca

SEQ ID NO: 204419 - DNA, 25 bp, E. coli
agaactatacgtacatccccaccat

SEQ ID NO: 204420 - DNA, 25 bp, E. coli
cgtcccgaagccagaactatacgta

SEQ ID NO: 204421 - DNA, 25 bp, E. coli
agccagaactatacgtacatcccca

SEQ ID NO: 204422 - DNA, 25 bp, E. coli
cgtcccgaagcctgaactatacgta

SEQ ID NO: 204423 - DNA, 25 bp, E. coli
acacacgtcccgaagccagaactat

SEQ ID NO: 204424 - DNA, 25 bp, E. coli
acacacgtcccgtagccagaactat

SEQ ID NO: 204425 - DNA, 25 bp, E. coli
cacacgtcccgaagccagaactata

SEQ ID NO: 204426 - DNA, 25 bp, E. coli
cacacgtcccgatgccagaactata

SEQ ID NO: 204427 - DNA, 25 bp, E. coli
tacgtacatccccaccatcaccgta

SEQ ID NO: 204428 - DNA, 25 bp, E. coli
tacgtacatcccgaccatcaccgta

SEQ ID NO: 204429 - DNA, 25 bp, E. coli
tcccgaagccagaactatacgtaca

SEQ ID NO: 204430 - DNA, 25 bp, E. coli
tcccgaagccagtactatacgtaca

SEQ ID NO: 204431 - DNA, 25 bp, E. coli
gaagccagaactatacgtacatccc

SEQ ID NO: 204432 - DNA, 25 bp, E. coli
gaagccagaactttacgtacatccc

SEQ ID NO: 204433 - DNA, 25 bp, E. coli
cccgaagccagatctatacgtacat

SEQ ID NO: 204434 - DNA, 25 bp, E. coli
ccgaagccagaactatacgtacatc

SEQ ID NO: 204435 - DNA, 25 bp, E. coli
cgaagccagaactatacgtacatcc

SEQ ID NO: 204436 - DNA, 25 bp, E. coli
cccgaagccagaactatacgtacat

SEQ ID NO: 204437 - DNA, 25 bp, E. coli
cgaagccagaacaatacgtacatcc

SEQ ID NO: 204438 - DNA, 25 bp, E. coli
ccgaagccagaagtatacgtacatc

SEQ ID NO: 204439 - DNA, 25 bp, E. coli
aagccatggcggtcagggtagtaat

SEQ ID NO: 204440 - DNA, 25 bp, E. coli
aagccatggcggacagggtagtaat

SEQ ID NO: 204441 - DNA, 25 bp, E. coli
caaaggtcacaatggctgggaggct

SEQ ID NO: 204442 - DNA, 25 bp, E. coli
caaaggtcacaaaggctgggaggct

SEQ ID NO: 204443 - DNA, 25 bp, E. coli
ttatcaggccggcatcgccggacgc

SEQ ID NO: 204444 - DNA, 25 bp, E. coli
ttatcaggccgggatcgccggacgc

SEQ ID NO: 204445 - DNA, 25 bp, E. coli
tgggaggctggcgagaagccatggc

SEQ ID NO: 204446 - DNA, 25 bp, E. coli
tgggaggctggccagaagccatggc

SEQ ID NO: 204447 - DNA, 25 bp, E. coli
tgaatcaaaggtgacaatggctggg

SEQ ID NO: 204448 - DNA, 25 bp, E. coli
tgaatcaaaggtcacaatggctggg

SEQ ID NO: 204449 - DNA, 25 bp, E. coli
tcgccggacgctgaaaagaaatgtg

SEQ ID NO: 204450 - DNA, 25 bp, E. coli
tcgccggacgctcaaaagaaatgtg

SEQ ID NO: 204451 - DNA, 25 bp, E. coli
cctatcagacgctgaatcaaaggtc

SEQ ID NO: 204452 - DNA, 25 bp, E. coli
cctatcagacgcagaatcaaaggtc

SEQ ID NO: 204453 - DNA, 25 bp, E. coli
gaaatgtgtccctatcagacgctga

SEQ ID NO: 204454 - DNA, 25 bp, E. coli
gaacgggcacatgaacgtggttatc

SEQ ID NO: 204455 - DNA, 25 bp, E. coli
gaacgggcacatcaacgtggttatc

SEQ ID NO: 204456 - DNA, 25 bp, E. coli
gacgctcaaaagaaatgtgtcccta

SEQ ID NO: 204457 - DNA, 25 bp, E. coli
gaaatgtgtcccaatcagacgctga

SEQ ID NO: 204458 - DNA, 25 bp, E. coli
tcaacgtggttatcaggccggcatc

SEQ ID NO: 204459 - DNA, 25 bp, E. coli
tcaacgtggttaacaggccggcatc

SEQ ID NO: 204460 - DNA, 25 bp, E. coli
gacgctcaaaagtaatgtgtcccta

SEQ ID NO: 204461 - DNA, 25 bp, E. coli
tacatgtcacaagaaaaccgcttcg

SEQ ID NO: 204462 - DNA, 25 bp, E. coli
tacatgtcacaacaaaaccgcttcg

SEQ ID NO: 204463 - DNA, 25 bp, E. coli
tatgataaatgcacactggagtggc

SEQ ID NO: 204464 - DNA, 25 bp, E. coli
tatgataaatgctcactggagtggc

SEQ ID NO: 204465 - DNA, 25 bp, E. coli
tatggctacggtaatggctccgcga

SEQ ID NO: 204466 - DNA, 25 bp, E. coli
tatggctacggttatggctccgcga

SEQ ID NO: 204467 - DNA, 25 bp, E. coli
tttactttacgatcatgggcatggc

SEQ ID NO: 204468 - DNA, 25 bp, E. coli
tttactttacgaacatgggcatggc

SEQ ID NO: 204469 - DNA, 25 bp, E. coli
ttaagtactcaacccagggcagtgc

SEQ ID NO: 204470 - DNA, 25 bp, E. coli
ttaagtactcaagccagggcagtgc

SEQ ID NO: 204471 - DNA, 25 bp, E. coli
tgaattactacatcaagcaggccag

SEQ ID NO: 204472 - DNA, 25 bp, E. coli
tgaattactacaacaagcaggccag

SEQ ID NO: 204473 - DNA, 25 bp, E. coli
tgaaatagccaaagaactcgccagt

SEQ ID NO: 204474 - DNA, 25 bp, E. coli
tgaaatagccaatgaactcgccagt

SEQ ID NO: 204475 - DNA, 25 bp, E. coli
gcaatcaatttgtctggcgagcata

SEQ ID NO: 204476 - DNA, 25 bp, E. coli
gcaatcaatttgactggcgagcata

SEQ ID NO: 204477 - DNA, 25 bp, E. coli
ggctccgcgacctataacgatttcg

SEQ ID NO: 204478 - DNA, 25 bp, E. coli
ggctccgcgaccaataacgatttcg

SEQ ID NO: 204479 - DNA, 25 bp, E. coli
gacgtatttagcgatcgcgaagcca

SEQ ID NO: 204480 - DNA, 25 bp, E. coli
gacgtatttagccatcgcgaagcca

SEQ ID NO: 204481 - DNA, 25 bp, E. coli
gagcatttactgaaacagggtccca

SEQ ID NO: 204482 - DNA, 25 bp, E. coli
gagcatttactgtaacagggtccca

SEQ ID NO: 204483 - DNA, 25 bp, E. coli
caatgttggttcatcgatgcgggtg

SEQ ID NO: 204484 - DNA, 25 bp, E. coli
caatgttggttcttcgatgcgggtg

SEQ ID NO: 204485 - DNA, 25 bp, E. coli
caaagggcacaattacccgcttgga

SEQ ID NO: 204486 - DNA, 25 bp, E. coli
caaagggcacaaatacccgcttgga

SEQ ID NO: 204487 - DNA, 25 bp, E. coli
tcgccgctgctcttcgagtggtagc

SEQ ID NO: 204488 - DNA, 25 bp, E. coli
tcgccgctgctcatcgagtggtagc

SEQ ID NO: 204489 - DNA, 25 bp, E. coli
tctactcttgcgatcaaaggcccgt

SEQ ID NO: 204490 - DNA, 25 bp, E. coli
tctactcttgcgttcaaaggcccgt

SEQ ID NO: 204491 - DNA, 25 bp, E. coli
gcgtccactggatatcattatgcgg

SEQ ID NO: 204492 - DNA, 25 bp, E. coli
gcgtccactggaaatcattatgcgg

SEQ ID NO: 204493 - DNA, 25 bp, E. coli
gaaatccagctccacgatgcgcgtc

SEQ ID NO: 204494 - DNA, 25 bp, E. coli
gaaatccagctcgacgatgcgcgtc

SEQ ID NO: 204495 - DNA, 25 bp, E. coli
cggtatcaaccaaggcaaagggcac

SEQ ID NO: 204496 - DNA, 25 bp, E. coli
cggtatcaaccatggcaaagggcac

SEQ ID NO: 204497 - DNA, 25 bp, E. coli
cattatgcggtcgttcgttggcctg

SEQ ID NO: 204498 - DNA, 25 bp, E. coli
cattatgcggtccttcgttggcctg

SEQ ID NO: 204499 - DNA, 25 bp, E. coli
ggtgacgacgaaatcccgaaactct

SEQ ID NO: 204500 - DNA, 25 bp, E. coli
ggtgacgacgaattcccgaaactct

SEQ ID NO: 204501 - DNA, 25 bp, E. coli
ggattcctcggctaatcgtggctaa

SEQ ID NO: 204502 - DNA, 25 bp, E. coli
ggattcctcggcaaatcgtggctaa

SEQ ID NO: 204503 - DNA, 25 bp, E. coli
tggcctgtggctcctcgtcgagcaa

SEQ ID NO: 204504 - DNA, 25 bp, E. coli
tggcctgtggctgctcgtcgagcaa

SEQ ID NO: 204505 - DNA, 25 bp, E. coli
tagcaactgggttattccttagcaa

SEQ ID NO: 204506 - DNA, 25 bp, E. coli
tagcaactgggtaattccttagcaa

SEQ ID NO: 204507 - DNA, 25 bp, E. coli
atatgatgcttggtcgtaccaggcc

SEQ ID NO: 204508 - DNA, 25 bp, E. coli
accgtgatctgtagagcgggtgaca

SEQ ID NO: 204509 - DNA, 25 bp, E. coli
accgtgatctgttgagcgggtgaca

SEQ ID NO: 204510 - DNA, 25 bp, E. coli
atatgatgcttgctcgtaccaggcc

SEQ ID NO: 204511 - DNA, 25 bp, E. coli
aaaaacgaacgaaaaccgtgatctg

SEQ ID NO: 204512 - DNA, 25 bp, E. coli
aaaaacgaacgataaccgtgatctg

SEQ ID NO: 204513 - DNA, 25 bp, E. coli
tatacaatgattacggtgtccagta

SEQ ID NO: 204514 - DNA, 25 bp, E. coli
tatacaatgatttcggtgtccagta

SEQ ID NO: 204515 - DNA, 25 bp, E. coli
tttttaccgttggatcatgtcgccc

SEQ ID NO: 204516 - DNA, 25 bp, E. coli
tttttaccgttgcatcatgtcgccc

SEQ ID NO: 204517 - DNA, 25 bp, E. coli
tgtgcctaattaagcaagcggttaa

SEQ ID NO: 204518 - DNA, 25 bp, E. coli
tgtgcctaattatgcaagcggttaa

SEQ ID NO: 204519 - DNA, 25 bp, E. coli
tcgattgtttcaggcagtgttgtgc

SEQ ID NO: 204520 - DNA, 25 bp, E. coli
tcgattgtttcacgcagtgttgtgc

SEQ ID NO: 204521 - DNA, 25 bp, E. coli
tcatgtcgcccaatatgatgcttgc

SEQ ID NO: 204522 - DNA, 25 bp, E. coli
tcatgtcgcccattatgatgcttgc

SEQ ID NO: 204523 - DNA, 25 bp, E. coli
ccaggcccctgcaatttcaacaggg

SEQ ID NO: 204524 - DNA, 25 bp, E. coli
ccaggcccctgctatttcaacaggg

SEQ ID NO: 204525 - DNA, 25 bp, E. coli
gacagtgcgcattgcgttgtgctaa

SEQ ID NO: 204526 - DNA, 25 bp, E. coli
gacagtgcgcatagcgttgtgctaa

SEQ ID NO: 204527 - DNA, 25 bp, E. coli
atgcacgtattacccgcctgcctgg

SEQ ID NO: 204528 - DNA, 25 bp, E. coli
atgcacgtattagccgcctgcctgg

SEQ ID NO: 204529 - DNA, 25 bp, E. coli
tagccgccagcgcatgtacctggta

SEQ ID NO: 204530 - DNA, 25 bp, E. coli
tagccgccagcggatgtacctggta

SEQ ID NO: 204531 - DNA, 25 bp, E. coli
tgattccttaatgattgttttaccc

SEQ ID NO: 204532 - DNA, 25 bp, E. coli
tgattccttaatcattgttttaccc

SEQ ID NO: 204533 - DNA, 25 bp, E. coli
tgcaactcggcgagtcgagaaattc

SEQ ID NO: 204534 - DNA, 25 bp, E. coli
tgcaactcggcgtgtcgagaaattc

SEQ ID NO: 204535 - DNA, 25 bp, E. coli
tcggcgtgtcgacaaattcactgcg

SEQ ID NO: 204536 - DNA, 25 bp, E. coli
tcggcgtgtcgagaaattcactgcg

SEQ ID NO: 204537 - DNA, 25 bp, E. coli
gccgaagcttcagataacattgtgt

SEQ ID NO: 204538 - DNA, 25 bp, E. coli
gccgccagcggatgtacctggtacc

SEQ ID NO: 204539 - DNA, 25 bp, E. coli
gccgaagcttcacataacattgtgt

SEQ ID NO: 204540 - DNA, 25 bp, E. coli
gccgccagcggaagtacctggtacc

SEQ ID NO: 204541 - DNA, 25 bp, E. coli
gcttcacataacattgtgttgctgc

SEQ ID NO: 204542 - DNA, 25 bp, E. coli
gcttcacataactttgtgttgctgc

SEQ ID NO: 204543 - DNA, 25 bp, E. coli
cgaaactggtaagcgaaggtgtgct

SEQ ID NO: 204544 - DNA, 25 bp, E. coli
cgaaactggtaaccgaaggtgtgct

SEQ ID NO: 204545 - DNA, 25 bp, E. coli
cgtgtcgagaaaatcactgcgcgag

SEQ ID NO: 204546 - DNA, 25 bp, E. coli
cgtgtcgagaaattcactgcgcgag

SEQ ID NO: 204547 - DNA, 25 bp, E. coli
gtattacccgcctgcctggtgacca

SEQ ID NO: 204548 - DNA, 25 bp, E. coli
gtattacccgccagcctggtgacca

SEQ ID NO: 204549 - DNA, 25 bp, E. coli
catcatgctgatcataatgaatttg

SEQ ID NO: 204550 - DNA, 25 bp, E. coli
catcatgctgatgataatgaatttg

SEQ ID NO: 204551 - DNA, 25 bp, E. coli
taccatcgtgcctggcgcttattgc

SEQ ID NO: 204552 - DNA, 25 bp, E. coli
taccatcgtgccaggcgcttattgc

SEQ ID NO: 204553 - DNA, 25 bp, E. coli
tattgacgccggtgatgctgtatca

SEQ ID NO: 204554 - DNA, 25 bp, E. coli
tattgacgccggagatgctgtatca

SEQ ID NO: 204555 - DNA, 25 bp, E. coli
ttttgctaccatcgtgcctggcgct

SEQ ID NO: 204556 - DNA, 25 bp, E. coli
ttttgctaccatggtgcctggcgct

SEQ ID NO: 204557 - DNA, 25 bp, E. coli
tgatgataatgaatttgaatcaggg

SEQ ID NO: 204558 - DNA, 25 bp, E. coli
tgatgataatgattttgaatcaggg

SEQ ID NO: 204559 - DNA, 25 bp, E. coli
tgctaccatcgtgcctggcgcttat

SEQ ID NO: 204560 - DNA, 25 bp, E. coli
tgctaccatcgtccctggcgcttat

SEQ ID NO: 204561 - DNA, 25 bp, E. coli
tcgtgcctggcggttattgctggca

SEQ ID NO: 204562 - DNA, 25 bp, E. coli
tcgtgcctggcgcttattgctggca

SEQ ID NO: 204563 - DNA, 25 bp, E. coli
gcctggcgcttattgctggcatcat

SEQ ID NO: 204564 - DNA, 25 bp, E. coli
gcctggcgcttaatgctggcatcat

SEQ ID NO: 204565 - DNA, 25 bp, E. coli
gcgcttattgctcgcatcatgctga

SEQ ID NO: 204566 - DNA, 25 bp, E. coli
gcgcttattgctggcatcatgctga

SEQ ID NO: 204567 - DNA, 25 bp, E. coli
cggtgatgctgtttcacaaacagtt

SEQ ID NO: 204568 - DNA, 25 bp, E. coli
cggtgatgctgtatcacaaacagtt

SEQ ID NO: 204569 - DNA, 25 bp, E. coli
gacgccggtgatgctgtatcacaaa

SEQ ID NO: 204570 - DNA, 25 bp, E. coli
gacgccggtgatcctgtatcacaaa

SEQ ID NO: 204571 - DNA, 25 bp, E. coli
cagcagagacacattccggcggtga

SEQ ID NO: 204572 - DNA, 25 bp, E. coli
cagcagagacactttccggcggtga

SEQ ID NO: 204573 - DNA, 25 bp, E. coli
tacgctcgcgttggtgagccgcgct

SEQ ID NO: 204574 - DNA, 25 bp, E. coli
tacagtatgcgccagctggaacctc

SEQ ID NO: 204575 - DNA, 25 bp, E. coli
tacagtatgcgcgagctggaacctc

SEQ ID NO: 204576 - DNA, 25 bp, E. coli
attcttaaggagtttggcgatcgcc

SEQ ID NO: 204577 - DNA, 25 bp, E. coli
attcttaaggagattggcgatcgcc

SEQ ID NO: 204578 - DNA, 25 bp, E. coli
tacgctcgcgttcgtgagccgcgct

SEQ ID NO: 204579 - DNA, 25 bp, E. coli
tatttgcgtctgctgtacgctcgcg

SEQ ID NO: 204580 - DNA, 25 bp, E. coli
tatttgcgtctggtgtacgctcgcg

SEQ ID NO: 204581 - DNA, 25 bp, E. coli
ttatcgctggctcgcggtgcgatcc

SEQ ID NO: 204582 - DNA, 25 bp, E. coli
ttatcgctggctggcggtgcgatcc

SEQ ID NO: 204583 - DNA, 25 bp, E. coli
tgcctgcccgatatgcggttacagt

SEQ ID NO: 204584 - DNA, 25 bp, E. coli
tgcctgcccgatttgcggttacagt

SEQ ID NO: 204585 - DNA, 25 bp, E. coli
gctgacgggtgcacgcggtaataac

SEQ ID NO: 204586 - DNA, 25 bp, E. coli
gctgacgggtgctcgcggtaataac

SEQ ID NO: 204587 - DNA, 25 bp, E. coli
gagcctgcccgacctgtgacggtct

SEQ ID NO: 204588 - DNA, 25 bp, E. coli
gagcctgcccgagctgtgacggtct

SEQ ID NO: 204589 - DNA, 25 bp, E. coli
gacactttcccggtcagcagagaca

SEQ ID NO: 204590 - DNA, 25 bp, E. coli
gacactttcccgctcagcagagaca

SEQ ID NO: 204591 - DNA, 25 bp, E. coli
gagctggaacctggcctgttttcat

SEQ ID NO: 204592 - DNA, 25 bp, E. coli
gagctggaacctcgcctgttttcat

SEQ ID NO: 204593 - DNA, 25 bp, E. coli
caatgcatcgcgactgatcgatttc

SEQ ID NO: 204594 - DNA, 25 bp, E. coli
caatgcatcgcgtctgatcgatttc

SEQ ID NO: 204595 - DNA, 25 bp, E. coli
actaacacaaatatcatacgcttcg

SEQ ID NO: 204596 - DNA, 25 bp, E. coli
actaacacaaatttcatacgcttcg

SEQ ID NO: 204597 - DNA, 25 bp, E. coli
aaatttcatacggttcgttcagtcg

SEQ ID NO: 204598 - DNA, 25 bp, E. coli
aaatttcatacgcttcgttcagtcg

SEQ ID NO: 204599 - DNA, 25 bp, E. coli
tcgaaaaatttcatggtcacagcaa

SEQ ID NO: 204600 - DNA, 25 bp, E. coli
tcgaaaaatttcttggtcacagcaa

SEQ ID NO: 204601 - DNA, 25 bp, E. coli
gaagagatgattagtctcatctgat

SEQ ID NO: 204602 - DNA, 25 bp, E. coli
gaagagatgatttgtctcatctgat

SEQ ID NO: 204603 - DNA, 25 bp, E. coli
gaaaatacgcgatatcccagcggcg

SEQ ID NO: 204604 - DNA, 25 bp, E. coli
gaaaatacgcgaaatcccagcggcg

SEQ ID NO: 204605 - DNA, 25 bp, E. coli
cgcgatatcccaccggcggtattat

SEQ ID NO: 204606 - DNA, 25 bp, E. coli
cgcttcgttcagtcgaaaaatttca

SEQ ID NO: 204607 - DNA, 25 bp, E. coli
cgcttcgttcagacgaaaaatttca

SEQ ID NO: 204608 - DNA, 25 bp, E. coli
cgcgatatcccagcggcggtattat

SEQ ID NO: 204609 - DNA, 25 bp, E. coli
gattagtctcatgtgattgttttta

SEQ ID NO: 204610 - DNA, 25 bp, E. coli
gatcgatttcagtcgtaccactgac

SEQ ID NO: 204611 - DNA, 25 bp, E. coli
gattgtttttattgaactaacacaa

SEQ ID NO: 204612 - DNA, 25 bp, E. coli
gattagtctcatctgattgttttta

SEQ ID NO: 204613 - DNA, 25 bp, E. coli
gattgtttttatagaactaacacaa

SEQ ID NO: 204614 - DNA, 25 bp, E. coli
gatcgatttcagacgtaccactgac

SEQ ID NO: 204615 - DNA, 25 bp, E. coli
aagccgcataaggattcagggatcc

SEQ ID NO: 204616 - DNA, 25 bp, E. coli
tacaccgggcgaacatgaatggaag

SEQ ID NO: 204617 - DNA, 25 bp, E. coli
tacaccgggcgatcatgaatggaag

SEQ ID NO: 204618 - DNA, 25 bp, E. coli
aagccgcataagcattcagggatcc

SEQ ID NO: 204619 - DNA, 25 bp, E. coli
ttaatacgcgtatagatagggatcg

SEQ ID NO: 204620 - DNA, 25 bp, E. coli
ttaatacgcgtaaagatagggatcg

SEQ ID NO: 204621 - DNA, 25 bp, E. coli
tgatcgacgccaatgtcatcgggta

SEQ ID NO: 204622 - DNA, 25 bp, E. coli
tgttgggtaaactacagtacaccgg

SEQ ID NO: 204623 - DNA, 25 bp, E. coli
tgttgggtaaacaacagtacaccgg

SEQ ID NO: 204624 - DNA, 25 bp, E. coli
tgatcgacgccattgtcatcgggta

SEQ ID NO: 204625 - DNA, 25 bp, E. coli
tcgtaatggtaaagcgaagccgcat

SEQ ID NO: 204626 - DNA, 25 bp, E. coli
tcgtaatggtaatgcgaagccgcat

SEQ ID NO: 204627 - DNA, 25 bp, E. coli
tcagggatcccatcacttacaggta

SEQ ID NO: 204628 - DNA, 25 bp, E. coli
tcagggatcccaacacttacaggta

SEQ ID NO: 204629 - DNA, 25 bp, E. coli
gaatggaagcggctctatactacgc

SEQ ID NO: 204630 - DNA, 25 bp, E. coli
gaatggaagcgggtctatactacgc

SEQ ID NO: 204631 - DNA, 25 bp, E. coli
ggtaaatggcgtcacccttcaatgg

SEQ ID NO: 204632 - DNA, 25 bp, E. coli
ggtaaatggcgtgacccttcaatgg

SEQ ID NO: 204633 - DNA, 25 bp, E. coli
tggttcccggacagttatccacaaa

SEQ ID NO: 204634 - DNA, 25 bp, E. coli
tggttcccggactgttatccacaaa

SEQ ID NO: 204635 - DNA, 25 bp, E. coli
gatgatccggaacgaatcgtctggt

SEQ ID NO: 204636 - DNA, 25 bp, E. coli
gatgatccggaaggaatcgtctggt

SEQ ID NO: 204637 - DNA, 25 bp, E. coli
caactgaatttgtcagcgggcgcag

SEQ ID NO: 204638 - DNA, 25 bp, E. coli
caaatggattatgtccgaagccgga

SEQ ID NO: 204639 - DNA, 25 bp, E. coli
caactgaatttgacagcgggcgcag

SEQ ID NO: 204640 - DNA, 25 bp, E. coli
caaatggattatctccgaagccgga

SEQ ID NO: 204641 - DNA, 25 bp, E. coli
taaagcacgtcaacagtcacgcgat

SEQ ID NO: 204642 - DNA, 25 bp, E. coli
tacccaggaacaagtgaaaaaagcg

SEQ ID NO: 204643 - DNA, 25 bp, E. coli
taaaaactacaatcgctgggtccgc

SEQ ID NO: 204644 - DNA, 25 bp, E. coli
taaaaactacaaacgctgggtccgc

SEQ ID NO: 204645 - DNA, 25 bp, E. coli
taaagcacgtcatcagtcacgcgat

SEQ ID NO: 204646 - DNA, 25 bp, E. coli
tacccaggaacatgtgaaaaaagcg

SEQ ID NO: 204647 - DNA, 25 bp, E. coli
tgctttagcaggatgcgcgcgtact

SEQ ID NO: 204648 - DNA, 25 bp, E. coli
tgctttagcaggttgcgcgcgtact

SEQ ID NO: 204649 - DNA, 25 bp, E. coli
gcgtactgcgccaattgatcaggtt

SEQ ID NO: 204650 - DNA, 25 bp, E. coli
gcgtactgcgcctattgatcaggtt

SEQ ID NO: 204651 - DNA, 25 bp, E. coli
gaacctacaagcctcaggcggacaa

SEQ ID NO: 204652 - DNA, 25 bp, E. coli
gaacctacaagcgtcaggcggacaa

SEQ ID NO: 204653 - DNA, 25 bp, E. coli
gattctgaaagctggcgttgaacgc

SEQ ID NO: 204654 - DNA, 25 bp, E. coli
gattctgaaagcaggcgttgaacgc

SEQ ID NO: 204655 - DNA, 25 bp, E. coli
ggaaatacgcattaactacacggca

SEQ ID NO: 204656 - DNA, 25 bp, E. coli
tgggtccgcaatctcgacaaagata

SEQ ID NO: 204657 - DNA, 25 bp, E. coli
ggaaatacgcataaactacacggca

SEQ ID NO: 204658 - DNA, 25 bp, E. coli
tgggtccgcaatgtcgacaaagata

SEQ ID NO: 204659 - DNA, 25 bp, E. coli
caactgatgcagtatatcgtgctcg

SEQ ID NO: 204660 - DNA, 25 bp, E. coli
cagcgcgcagttattgtgaatctca

SEQ ID NO: 204661 - DNA, 25 bp, E. coli
cagcgcgcagtttttgtgaatctca

SEQ ID NO: 204662 - DNA, 25 bp, E. coli
caactgatgcagaatatcgtgctcg

SEQ ID NO: 204663 - DNA, 25 bp, E. coli
taaaggaccaaaccagatgaaggcg

SEQ ID NO: 204664 - DNA, 25 bp, E. coli
taaaggaccaaagcagatgaaggcg

SEQ ID NO: 204665 - DNA, 25 bp, E. coli
aaaagtattgtgtttctggcggcgc

SEQ ID NO: 204666 - DNA, 25 bp, E. coli
aaaagtattgtgattctggcggcgc

SEQ ID NO: 204667 - DNA, 25 bp, E. coli
tattattgtgatcatcggttacgcc

SEQ ID NO: 204668 - DNA, 25 bp, E. coli
tattattgtgatgatcggttacgcc

SEQ ID NO: 204669 - DNA, 25 bp, E. coli
tatttccgcaattcatcatgccgca

SEQ ID NO: 204670 - DNA, 25 bp, E. coli
tatttccgcaatacatcatgccgca

SEQ ID NO: 204671 - DNA, 25 bp, E. coli
tgaaggcgctgattaagattttcgg

SEQ ID NO: 204672 - DNA, 25 bp, E. coli
tgaaggcgctgaataagattttcgg

SEQ ID NO: 204673 - DNA, 25 bp, E. coli
gattgctctatggattaaaggacca

SEQ ID NO: 204674 - DNA, 25 bp, E. coli
gattgctctatgcattaaaggacca

SEQ ID NO: 204675 - DNA, 25 bp, E. coli
gttacgccacccatgctcaacggat

SEQ ID NO: 204676 - DNA, 25 bp, E. coli
gttacgccacccttgctcaacggat

SEQ ID NO: 204677 - DNA, 25 bp, E. coli
gtgaatctcacctatcccaaaagta

SEQ ID NO: 204678 - DNA, 25 bp, E. coli
gtcgacatttgttccagcgcgcagt

SEQ ID NO: 204679 - DNA, 25 bp, E. coli
gtgaatctcaccaatcccaaaagta

SEQ ID NO: 204680 - DNA, 25 bp, E. coli
gtcgacatttgtaccagcgcgcagt

SEQ ID NO: 204681 - DNA, 25 bp, E. coli
caacaatgcgtatcggtgctcaaca

SEQ ID NO: 204682 - DNA, 25 bp, E. coli
caacaatgcgtaacggtgctcaaca

SEQ ID NO: 204683 - DNA, 25 bp, E. coli
caggagcgataaatccaacaatgcg

SEQ ID NO: 204684 - DNA, 25 bp, E. coli
caggagcgataattccaacaatgcg

SEQ ID NO: 204685 - DNA, 25 bp, E. coli
aggtcatcttggacctggcccagga

SEQ ID NO: 204686 - DNA, 25 bp, E. coli
aggtcatcttggtcctggcccagga

SEQ ID NO: 204687 - DNA, 25 bp, E. coli
tatgaacgttgtaggcaaccgccag

SEQ ID NO: 204688 - DNA, 25 bp, E. coli
tatgaacgttgttggcaaccgccag

SEQ ID NO: 204689 - DNA, 25 bp, E. coli
ttgctggtccgaatctgccaggtca

SEQ ID NO: 204690 - DNA, 25 bp, E. coli
ttgctggtccgattctgccaggtca

SEQ ID NO: 204691 - DNA, 25 bp, E. coli
tcctggcccaggagcgataattcca

SEQ ID NO: 204692 - DNA, 25 bp, E. coli
tcctggcccaggtgcgataattcca

SEQ ID NO: 204693 - DNA, 25 bp, E. coli
gcgtatcggtgctcaacaaagttat

SEQ ID NO: 204694 - DNA, 25 bp, E. coli
gcgtatcggtgcacaacaaagttat

SEQ ID NO: 204695 - DNA, 25 bp, E. coli
gaacgttgttgggaaccgccagttt

SEQ ID NO: 204696 - DNA, 25 bp, E. coli
gaacgttgttggcaaccgccagttt

SEQ ID NO: 204697 - DNA, 25 bp, E. coli
gattctgccaggtcatcttggtcct

SEQ ID NO: 204698 - DNA, 25 bp, E. coli
gattctgccaggacatcttggtcct

SEQ ID NO: 204699 - DNA, 25 bp, E. coli
ggtgctcaacaatgttatgaacgtt

SEQ ID NO: 204700 - DNA, 25 bp, E. coli
ggtgctcaacaaagttatgaacgtt

SEQ ID NO: 204701 - DNA, 25 bp, E. coli
taattccaacaatgcgtatcggtgc

SEQ ID NO: 204702 - DNA, 25 bp, E. coli
taattccaacaaagcgtatcggtgc

SEQ ID NO: 204703 - DNA, 25 bp, E. coli
catatgtcagaaccagattgggcgg

SEQ ID NO: 204704 - DNA, 25 bp, E. coli
catatgtcagaagcagattgggcgg

SEQ ID NO: 204705 - DNA, 25 bp, E. coli
tgactggattgcgaacccggatctg

SEQ ID NO: 204706 - DNA, 25 bp, E. coli
tgactggattgccaacccggatctg

SEQ ID NO: 204707 - DNA, 25 bp, E. coli
tctgcgcagtattgaaccgggtgac

SEQ ID NO: 204708 - DNA, 25 bp, E. coli
tctgcgcagtatagaaccgggtgac

SEQ ID NO: 204709 - DNA, 25 bp, E. coli
gcccgaatgaagaagccgatgcact

SEQ ID NO: 204710 - DNA, 25 bp, E. coli
gcccgaatgaagtagccgatgcact

SEQ ID NO: 204711 - DNA, 25 bp, E. coli
gctgaaacgctgatcggcaaagggt

SEQ ID NO: 204712 - DNA, 25 bp, E. coli
gctgaaacgctgttcggcaaagggt

SEQ ID NO: 204713 - DNA, 25 bp, E. coli
gaatactatcgccaacgtgccagtg

SEQ ID NO: 204714 - DNA, 25 bp, E. coli
gaatactatcgcgaacgtgccagtg

SEQ ID NO: 204715 - DNA, 25 bp, E. coli
gaagccacgcaattttctgcccagg

SEQ ID NO: 204716 - DNA, 25 bp, E. coli
gaagccacgcaaatttctgcccagg

SEQ ID NO: 204717 - DNA, 25 bp, E. coli
gaacacgtacttgtctgcgcgatga

SEQ ID NO: 204718 - DNA, 25 bp, E. coli
gaacacgtacttctctgcgcgatga

SEQ ID NO: 204719 - DNA, 25 bp, E. coli
cggcgcaggtgcatacacagtagaa

SEQ ID NO: 204720 - DNA, 25 bp, E. coli
cggcgcaggtgcttacacagtagaa

SEQ ID NO: 204721 - DNA, 25 bp, E. coli
gtatttttatgggaccgctgacgcg

SEQ ID NO: 204722 - DNA, 25 bp, E. coli
gattgaacaactcggtaaacgcggc

SEQ ID NO: 204723 - DNA, 25 bp, E. coli
gtatttttatggcaccgctgacgcg

SEQ ID NO: 204724 - DNA, 25 bp, E. coli
gattgaacaactgggtaaacgcggc

SEQ ID NO: 204725 - DNA, 25 bp, E. coli
aagtgctgaggctgaaacagattag

SEQ ID NO: 204726 - DNA, 25 bp, E. coli
aagtgctgaggcagaaacagattag

SEQ ID NO: 204727 - DNA, 25 bp, E. coli
caggatgaagtgctgaggctgaaac

SEQ ID NO: 204728 - DNA, 25 bp, E. coli
caggatgaagtggtgaggctgaaac

SEQ ID NO: 204729 - DNA, 25 bp, E. coli
atgaagtgctgacgctgaaacagat

SEQ ID NO: 204730 - DNA, 25 bp, E. coli
agtgctgaggctgaaacagattagc

SEQ ID NO: 204731 - DNA, 25 bp, E. coli
aggatgaagtgctgaggctgaaaca

SEQ ID NO: 204732 - DNA, 25 bp, E. coli
aggatgaagtgcagaggctgaaaca

SEQ ID NO: 204733 - DNA, 25 bp, E. coli
atgaagtgctgaggctgaaacagat

SEQ ID NO: 204734 - DNA, 25 bp, E. coli
agtgctgaggctcaaacagattagc

SEQ ID NO: 204735 - DNA, 25 bp, E. coli
accaggatgaagtgctgaggctgaa

SEQ ID NO: 204736 - DNA, 25 bp, E. coli
accaggatgaagagctgaggctgaa

SEQ ID NO: 204737 - DNA, 25 bp, E. coli
tgaagtgctgagcctgaaacagatt

SEQ ID NO: 204738 - DNA, 25 bp, E. coli
tgaagtgctgaggctgaaacagatt

SEQ ID NO: 204739 - DNA, 25 bp, E. coli
ccaggatgaagtgctgaggctgaaa

SEQ ID NO: 204740 - DNA, 25 bp, E. coli
ccaggatgaagtcctgaggctgaaa

SEQ ID NO: 204741 - DNA, 25 bp, E. coli
gaagtgctgagggtgaaacagatta

SEQ ID NO: 204742 - DNA, 25 bp, E. coli
gaagtgctgaggctgaaacagatta

SEQ ID NO: 204743 - DNA, 25 bp, E. coli
gtgctgaggctgaaacagattagcg

SEQ ID NO: 204744 - DNA, 25 bp, E. coli
gtgctgaggctgtaacagattagcg

SEQ ID NO: 204745 - DNA, 25 bp, E. coli
gatgaagtgctgaggctgaaacaga

SEQ ID NO: 204746 - DNA, 25 bp, E. coli
gatgaagtgctgtggctgaaacaga

SEQ ID NO: 204747 - DNA, 25 bp, E. coli
caattgtcagtctagcagagccgta

SEQ ID NO: 204748 - DNA, 25 bp, E. coli
aataccttgtcgctggtggcaccgg

SEQ ID NO: 204749 - DNA, 25 bp, E. coli
caattgtcagtcaagcagagccgta

SEQ ID NO: 204750 - DNA, 25 bp, E. coli
aataccttgtcggtggtggcaccgg

SEQ ID NO: 204751 - DNA, 25 bp, E. coli
cataccgtcgtcaggttgagagcca

SEQ ID NO: 204752 - DNA, 25 bp, E. coli
cataccgtcgtctggttgagagcca

SEQ ID NO: 204753 - DNA, 25 bp, E. coli
aaagatcagatgaccggcgagttcc

SEQ ID NO: 204754 - DNA, 25 bp, E. coli
aaagatcagatgtccggcgagttcc

SEQ ID NO: 204755 - DNA, 25 bp, E. coli
tggtattccagctacgtaacgggcg

SEQ ID NO: 204756 - DNA, 25 bp, E. coli
tgatgaacatgcatgacccgacggc

SEQ ID NO: 204757 - DNA, 25 bp, E. coli
tgatgaggcccaaaacgtcgcagaa

SEQ ID NO: 204758 - DNA, 25 bp, E. coli
tgatgaggcccataacgtcgcagaa

SEQ ID NO: 204759 - DNA, 25 bp, E. coli
tgatgaacatgcttgacccgacggc

SEQ ID NO: 204760 - DNA, 25 bp, E. coli
tgaacagcaacgactcggaaagcgc

SEQ ID NO: 204761 - DNA, 25 bp, E. coli
tgaacagcaacgtctcggaaagcgc

SEQ ID NO: 204762 - DNA, 25 bp, E. coli
tctctggcaaatcaacccggtagtg

SEQ ID NO: 204763 - DNA, 25 bp, E. coli
tctctggcaaatgaacccggtagtg

SEQ ID NO: 204764 - DNA, 25 bp, E. coli
tggtattccagcaacgtaacgggcg

SEQ ID NO: 204765 - DNA, 25 bp, E. coli
taattgctgttatcaccggagcgga

SEQ ID NO: 204766 - DNA, 25 bp, E. coli
taattgctgttaacaccggagcgga

SEQ ID NO: 204767 - DNA, 25 bp, E. coli
gatgatgacgatgaacaggcccagt

SEQ ID NO: 204768 - DNA, 25 bp, E. coli
gatgatgacgatcaacaggcccagt

SEQ ID NO: 204769 - DNA, 25 bp, E. coli
cactatgtggtgctcggttttcgct

SEQ ID NO: 204770 - DNA, 25 bp, E. coli
cactatgtggtggtcggttttcgct

SEQ ID NO: 204771 - DNA, 25 bp, E. coli
cagttttacggtctctggcagcact

SEQ ID NO: 204772 - DNA, 25 bp, E. coli
cagttttacggtgtctggcagcact

SEQ ID NO: 204773 - DNA, 25 bp, E. coli
tactgccggatgtgcagcatgacga

SEQ ID NO: 204774 - DNA, 25 bp, E. coli
tactgccggatgagcagcatgacga

SEQ ID NO: 204775 - DNA, 25 bp, E. coli
agaaagacgaaacgctggaagccgc

SEQ ID NO: 204776 - DNA, 25 bp, E. coli
agaaagacgaaaggctggaagccgc

SEQ ID NO: 204777 - DNA, 25 bp, E. coli
tttttacgtcaggaagactttgcca

SEQ ID NO: 204778 - DNA, 25 bp, E. coli
tttttacgtcagcaagactttgcca

SEQ ID NO: 204779 - DNA, 25 bp, E. coli
ttgtcgagaacagtcgcggcgagtt

SEQ ID NO: 204780 - DNA, 25 bp, E. coli
ttgtcgagaacactcgcggcgagtt

SEQ ID NO: 204781 - DNA, 25 bp, E. coli
tctgcttggcaatagaaccaaccgc

SEQ ID NO: 204782 - DNA, 25 bp, E. coli
tctgcttggcaaaagaaccaaccgc

SEQ ID NO: 204783 - DNA, 25 bp, E. coli
gcatgacgattagcgctggctgacg

SEQ ID NO: 204784 - DNA, 25 bp, E. coli
gcatgacgattaccgctggctgacg

SEQ ID NO: 204785 - DNA, 25 bp, E. coli
gactttgccacgctagtgcgctcca

SEQ ID NO: 204786 - DNA, 25 bp, E. coli
gactttgccacggtagtgcgctcca

SEQ ID NO: 204787 - DNA, 25 bp, E. coli
cgcggcgagtttgtgcttggcaaaa

SEQ ID NO: 204788 - DNA, 25 bp, E. coli
cgcggcgagtttctgcttggcaaaa

SEQ ID NO: 204789 - DNA, 25 bp, E. coli
ctggcagcacttttatgacgataac

SEQ ID NO: 204790 - DNA, 25 bp, E. coli
ctggcagcacttatatgacgataac

SEQ ID NO: 204791 - DNA, 25 bp, E. coli
caaagcctcaatataaccgtcgtgg

SEQ ID NO: 204792 - DNA, 25 bp, E. coli
caaatcttcgcacaaacgggtgaac

SEQ ID NO: 204793 - DNA, 25 bp, E. coli
caaagcctcaatttaaccgtcgtgg

SEQ ID NO: 204794 - DNA, 25 bp, E. coli
caaatcttcgcagaaacgggtgaac

SEQ ID NO: 204795 - DNA, 25 bp, E. coli
tatccgtgaacttgtcggcgctgca

SEQ ID NO: 204796 - DNA, 25 bp, E. coli
tatccgtgaactagtcggcgctgca

SEQ ID NO: 204797 - DNA, 25 bp, E. coli
tattcgcaagaaaggcggtaacggc

SEQ ID NO: 204798 - DNA, 25 bp, E. coli
tattcgcaagaatggcggtaacggc

SEQ ID NO: 204799 - DNA, 25 bp, E. coli
tcagttagcagattggcgtagccag

SEQ ID NO: 204800 - DNA, 25 bp, E. coli
tcagttagcagaatggcgtagccag

SEQ ID NO: 204801 - DNA, 25 bp, E. coli
gcttagtcagtcttccggtaacgga

SEQ ID NO: 204802 - DNA, 25 bp, E. coli
gcttagtcagtcatccggtaacgga

SEQ ID NO: 204803 - DNA, 25 bp, E. coli
gaagccattacctgcattgggcaaa

SEQ ID NO: 204804 - DNA, 25 bp, E. coli
gaagccattaccagcattgggcaaa

SEQ ID NO: 204805 - DNA, 25 bp, E. coli
cgtttggttttaggcgcagcgctga

SEQ ID NO: 204806 - DNA, 25 bp, E. coli
cgtttggttttacgcgcagcgctga

SEQ ID NO: 204807 - DNA, 25 bp, E. coli
cggaaggcgtcgtaaccaaagagca

SEQ ID NO: 204808 - DNA, 25 bp, E. coli
cggaaggcgtcgaaaccaaagagca

SEQ ID NO: 204809 - DNA, 25 bp, E. coli
tggcagttcttctgcccggcgatga

SEQ ID NO: 204810 - DNA, 25 bp, E. coli
tggcagttcttcagcccggcgatga

SEQ ID NO: 204811 - DNA, 25 bp, E. coli
tcagatcctgcgagatatgggcgtg

SEQ ID NO: 204812 - DNA, 25 bp, E. coli
tcagatcctgcgtgatatgggcgtg

SEQ ID NO: 204813 - DNA, 25 bp, E. coli
tatcagtactaatagcgcgacggcg

SEQ ID NO: 204814 - DNA, 25 bp, E. coli
tatcagtactaaaagcgcgacggcg

SEQ ID NO: 204815 - DNA, 25 bp, E. coli
tgatgcaggagaaagaacacacgtt

SEQ ID NO: 204816 - DNA, 25 bp, E. coli
tgcaacttctgtcatgacggtctgg

SEQ ID NO: 204817 - DNA, 25 bp, E. coli
tgatgcaggagatagaacacacgtt

SEQ ID NO: 204818 - DNA, 25 bp, E. coli
tgcaacttctgtgatgacggtctgg

SEQ ID NO: 204819 - DNA, 25 bp, E. coli
tccggtatatcacgaagcactgggt

SEQ ID NO: 204820 - DNA, 25 bp, E. coli
tccggtatatcaggaagcactgggt

SEQ ID NO: 204821 - DNA, 25 bp, E. coli
tcaggcaaatgctgagtaaaccgct

SEQ ID NO: 204822 - DNA, 25 bp, E. coli
tcagggtaaacaaccggagcaacac

SEQ ID NO: 204823 - DNA, 25 bp, E. coli
tcagggtaaacatccggagcaacac

SEQ ID NO: 204824 - DNA, 25 bp, E. coli
tcaggcaaatgcagagtaaaccgct

SEQ ID NO: 204825 - DNA, 25 bp, E. coli
gccattgagcaccaaatacgcgggt

SEQ ID NO: 204826 - DNA, 25 bp, E. coli
gccattgagcacgaaatacgcgggt

SEQ ID NO: 204827 - DNA, 25 bp, E. coli
gcactgaaactattcggcgaactgt

SEQ ID NO: 204828 - DNA, 25 bp, E. coli
gcactgaaactaatcggcgaactgt

SEQ ID NO: 204829 - DNA, 25 bp, E. coli
cgttatcgaaaatatgccgtctgag

SEQ ID NO: 204830 - DNA, 25 bp, E. coli
cgacggcggaagtagcactgaaact

SEQ ID NO: 204831 - DNA, 25 bp, E. coli
cgacggcggaagaagcactgaaact

SEQ ID NO: 204832 - DNA, 25 bp, E. coli
cgttatcgaaaaaatgccgtctgag

SEQ ID NO: 204833 - DNA, 25 bp, E. coli
cgtctgagagatccgttccggtata

SEQ ID NO: 204834 - DNA, 25 bp, E. coli
cgtctgagagatgcgttccggtata

SEQ ID NO: 204835 - DNA, 25 bp, E. coli
taaaggccgtgacagatttcgctgc

SEQ ID NO: 204836 - DNA, 25 bp, E. coli
taaaggccgtgagagatttcgctgc

SEQ ID NO: 204837 - DNA, 25 bp, E. coli
tacttatcaagcacgtaagccgggt

SEQ ID NO: 204838 - DNA, 25 bp, E. coli
tacttatcaagctcgtaagccgggt

SEQ ID NO: 204839 - DNA, 25 bp, E. coli
acagatttcgctcccgtgactgcca

SEQ ID NO: 204840 - DNA, 25 bp, E. coli
acagatttcgctgccgtgactgcca

SEQ ID NO: 204841 - DNA, 25 bp, E. coli
tgaaatggccttaaatggtgccggg

SEQ ID NO: 204842 - DNA, 25 bp, E. coli
tgaaatggcctttaatggtgccggg

SEQ ID NO: 204843 - DNA, 25 bp, E. coli
tcattgtccccgttgtcagtcagct

SEQ ID NO: 204844 - DNA, 25 bp, E. coli
tcattgtccccgatgtcagtcagct

SEQ ID NO: 204845 - DNA, 25 bp, E. coli
gccaccgtgtgtatcagctcactta

SEQ ID NO: 204846 - DNA, 25 bp, E. coli
gccaccgtgtgtttcagctcactta

SEQ ID NO: 204847 - DNA, 25 bp, E. coli
gaaagagatgatgactgaaatggcc

SEQ ID NO: 204848 - DNA, 25 bp, E. coli
gaaagagatgatcactgaaatggcc

SEQ ID NO: 204849 - DNA, 25 bp, E. coli
ccatggtcagaaccctaaaggccgt

SEQ ID NO: 204850 - DNA, 25 bp, E. coli
ccatggtcagaagcctaaaggccgt

SEQ ID NO: 204851 - DNA, 25 bp, E. coli
gataccgccaggacactgaaaattg

SEQ ID NO: 204852 - DNA, 25 bp, E. coli
gataccgccaggtcactgaaaattg

SEQ ID NO: 204853 - DNA, 25 bp, E. coli
gtcagtcagctctggtttaccgcca

SEQ ID NO: 204854 - DNA, 25 bp, E. coli
gtcagtcagctcaggtttaccgcca

SEQ ID NO: 204855 - DNA, 25 bp, E. coli
ggtattaacaccatcatccggactt

SEQ ID NO: 204856 - DNA, 25 bp, E. coli
ggtattaacaccttcatccggactt

SEQ ID NO: 204857 - DNA, 25 bp, E. coli
caaacagattgctatgggcgtagac

SEQ ID NO: 204858 - DNA, 25 bp, E. coli
caaacagattgcaatgggcgtagac

SEQ ID NO: 204859 - DNA, 25 bp, E. coli
caaagtgctgctcgttgggcagtca

SEQ ID NO: 204860 - DNA, 25 bp, E. coli
caaagtgctgctggttgggcagtca

SEQ ID NO: 204861 - DNA, 25 bp, E. coli
atggtaccctggaagtgcgcgtgaa

SEQ ID NO: 204862 - DNA, 25 bp, E. coli
atggtaccctggtagtgcgcgtgaa

SEQ ID NO: 204863 - DNA, 25 bp, E. coli
tagacggtgccaacgaagtgtataa

SEQ ID NO: 204864 - DNA, 25 bp, E. coli
tagacggtgccatcgaagtgtataa

SEQ ID NO: 204865 - DNA, 25 bp, E. coli
tataacgagattcgtcagggccagc

SEQ ID NO: 204866 - DNA, 25 bp, E. coli
tataacgagattggtcagggccagc

SEQ ID NO: 204867 - DNA, 25 bp, E. coli
tgctgtgggtacgaaagccgcaact

SEQ ID NO: 204868 - DNA, 25 bp, E. coli
tgctgtgggtaccaaagccgcaact

SEQ ID NO: 204869 - DNA, 25 bp, E. coli
tgaacagcgcattgtcgaaagacga

SEQ ID NO: 204870 - DNA, 25 bp, E. coli
tgaacagcgcatagtcgaaagacga

SEQ ID NO: 204871 - DNA, 25 bp, E. coli
tgactgaacgtgaagcgaaagcggc

SEQ ID NO: 204872 - DNA, 25 bp, E. coli
tgactgaacgtgtagcgaaagcggc

SEQ ID NO: 204873 - DNA, 25 bp, E. coli
gcattaatgtaacggcctatcaggg

SEQ ID NO: 204874 - DNA, 25 bp, E. coli
gcattaatgtaagggcctatcaggg

SEQ ID NO: 204875 - DNA, 25 bp, E. coli
gcaaggttgtgttgccgctgccgta

SEQ ID NO: 204876 - DNA, 25 bp, E. coli
gcaaggttgtgtagccgctgccgta

SEQ ID NO: 204877 - DNA, 25 bp, E. coli
gacctggtgaaaacgtccaacgtga

SEQ ID NO: 204878 - DNA, 25 bp, E. coli
gacctggtgaaatcgtccaacgtga

SEQ ID NO: 204879 - DNA, 25 bp, E. coli
caaaatgtggcgcaaccgagaaaca

SEQ ID NO: 204880 - DNA, 25 bp, E. coli
caaaatgtggcggaaccgagaaaca

SEQ ID NO: 204881 - DNA, 25 bp, E. coli
tatcgtcagccattttgcgcgcgcg

SEQ ID NO: 204882 - DNA, 25 bp, E. coli
tatcgtcagccaatttgcgcgcgcg

SEQ ID NO: 204883 - DNA, 25 bp, E. coli
ttttgatgccagtgatctgccgacg

SEQ ID NO: 204884 - DNA, 25 bp, E. coli
ttttgatgccagagatctgccgacg

SEQ ID NO: 204885 - DNA, 25 bp, E. coli
tgcgcccgggcatcattctttatgg

SEQ ID NO: 204886 - DNA, 25 bp, E. coli
tgcgcccgggcaacattctttatgg

SEQ ID NO: 204887 - DNA, 25 bp, E. coli
tcgaagaagctcagcgactgcgtgc

SEQ ID NO: 204888 - DNA, 25 bp, E. coli
tgcgcgcgcggaagaaccaaaatgt

SEQ ID NO: 204889 - DNA, 25 bp, E. coli
tgcgcgcgcggatgaaccaaaatgt

SEQ ID NO: 204890 - DNA, 25 bp, E. coli
tcgaagaagctctgcgactgcgtgc

SEQ ID NO: 204891 - DNA, 25 bp, E. coli
gcctgacccagtccaaaaacgttcg

SEQ ID NO: 204892 - DNA, 25 bp, E. coli
gcctgacccagtgcaaaaacgttcg

SEQ ID NO: 204893 - DNA, 25 bp, E. coli
cgtgcataacgaagaacagctggct

SEQ ID NO: 204894 - DNA, 25 bp, E. coli
cgtgcataacgatgaacagctggct

SEQ ID NO: 204895 - DNA, 25 bp, E. coli
gtatgcaccgtcagggcgtaaggcc

SEQ ID NO: 204896 - DNA, 25 bp, E. coli
gtatgcaccgtctgggcgtaaggcc

SEQ ID NO: 204897 - DNA, 25 bp, E. coli
tcaacgttccattgccgcgtcgggt

SEQ ID NO: 204898 - DNA, 25 bp, E. coli
tcaacgttccatagccgcgtcgggt

SEQ ID NO: 204899 - DNA, 25 bp, E. coli
gagccggttaccgtctggatgaaac

SEQ ID NO: 204900 - DNA, 25 bp, E. coli
gagccggttaccctctggatgaaac

SEQ ID NO: 204901 - DNA, 25 bp, E. coli
catgaagagtatgcgctggcacgta

SEQ ID NO: 204902 - DNA, 25 bp, E. coli
catgaagagtatccgctggcacgta

SEQ ID NO: 204903 - DNA, 25 bp, E. coli
tagccagctggatggaacaacgttg

SEQ ID NO: 204904 - DNA, 25 bp, E. coli
taccagcaggtacgccgcgattttc

SEQ ID NO: 204905 - DNA, 25 bp, E. coli
taccagcaggtaggccgcgattttc

SEQ ID NO: 204906 - DNA, 25 bp, E. coli
tagccagctggaaggaacaacgttg

SEQ ID NO: 204907 - DNA, 25 bp, E. coli
tgagtccgcaggacgatgtccgttt

SEQ ID NO: 204908 - DNA, 25 bp, E. coli
tgagtccgcaggtcgatgtccgttt

SEQ ID NO: 204909 - DNA, 25 bp, E. coli
gcgagattatcgtcccgtacaacgg

SEQ ID NO: 204910 - DNA, 25 bp, E. coli
gcgagattatcgacccgtacaacgg

SEQ ID NO: 204911 - DNA, 25 bp, E. coli
gcactgcgcgttatattcccggaaa

SEQ ID NO: 204912 - DNA, 25 bp, E. coli
gcactgcgcgttttattcccggaaa

SEQ ID NO: 204913 - DNA, 25 bp, E. coli
gcagtacgccacaggagatgctcga

SEQ ID NO: 204914 - DNA, 25 bp, E. coli
gcagtacgccactggagatgctcga

SEQ ID NO: 204915 - DNA, 25 bp, E. coli
cgtacaacggtcagggcgatctgca

SEQ ID NO: 204916 - DNA, 25 bp, E. coli
cgtacaacggtctgggcgatctgca

SEQ ID NO: 204917 - DNA, 25 bp, E. coli
tggaacaactatcccagcgtctgcg

SEQ ID NO: 204918 - DNA, 25 bp, E. coli
tggaacaactatgccagcgtctgcg

SEQ ID NO: 204919 - DNA, 25 bp, E. coli
gacccatgcgggagaactggaacac

SEQ ID NO: 204920 - DNA, 25 bp, E. coli
gacccatgcgggtgaactggaacac

SEQ ID NO: 204921 - DNA, 25 bp, E. coli
gatgcattgttagggctaccggtca

SEQ ID NO: 204922 - DNA, 25 bp, E. coli
gatgcattgttacggctaccggtca

SEQ ID NO: 204923 - DNA, 25 bp, E. coli
ggtttttgtcgggtatggatttgat

SEQ ID NO: 204924 - DNA, 25 bp, E. coli
atggatttgatgattgctgcgcaaa

SEQ ID NO: 204925 - DNA, 25 bp, E. coli
atggatttgatgtttgctgcgcaaa

SEQ ID NO: 204926 - DNA, 25 bp, E. coli
ggtttttgtcggctatggatttgat

SEQ ID NO: 204927 - DNA, 25 bp, E. coli
tatggatttgatcattgctgcgcaa

SEQ ID NO: 204928 - DNA, 25 bp, E. coli
tatggatttgatgattgctgcgcaa

SEQ ID NO: 204929 - DNA, 25 bp, E. coli
ttttgcacggtttttgtcgggtatg

SEQ ID NO: 204930 - DNA, 25 bp, E. coli
ttttgcacggttattgtcgggtatg

SEQ ID NO: 204931 - DNA, 25 bp, E. coli
tgttattttgcagggtttttgtcgg

SEQ ID NO: 204932 - DNA, 25 bp, E. coli
tgtcgggtatggatttgatgattgc

SEQ ID NO: 204933 - DNA, 25 bp, E. coli
tgttattttgcacggtttttgtcgg

SEQ ID NO: 204934 - DNA, 25 bp, E. coli
tgtcgggtatggttttgatgattgc

SEQ ID NO: 204935 - DNA, 25 bp, E. coli
ttgcacggttttagtcgggtatgga

SEQ ID NO: 204936 - DNA, 25 bp, E. coli
ttgcacggtttttgtcgggtatgga

SEQ ID NO: 204937 - DNA, 25 bp, E. coli
gcacggtttttgacgggtatggatt

SEQ ID NO: 204938 - DNA, 25 bp, E. coli
gcacggtttttgtcgggtatggatt

SEQ ID NO: 204939 - DNA, 25 bp, E. coli
cgggtatggattagatgattgctgc

SEQ ID NO: 204940 - DNA, 25 bp, E. coli
cgggtatggatttgatgattgctgc

SEQ ID NO: 204941 - DNA, 25 bp, E. coli
ggatttgatgattgctgcgcaaatg

SEQ ID NO: 204942 - DNA, 25 bp, E. coli
ggtatggatttgttgattgctgcgc

SEQ ID NO: 204943 - DNA, 25 bp, E. coli
ggatttgatgatagctgcgcaaatg

SEQ ID NO: 204944 - DNA, 25 bp, E. coli
ggtatggatttgatgattgctgcgc

SEQ ID NO: 204945 - DNA, 25 bp, E. coli
caatttaaatacatgcgagcgcgct

SEQ ID NO: 204946 - DNA, 25 bp, E. coli
caatttaaatacttgcgagcgcgct

SEQ ID NO: 204947 - DNA, 25 bp, E. coli
taaacacgacgagatggtggcggat

SEQ ID NO: 204948 - DNA, 25 bp, E. coli
taaacacgacgacatggtggcggat

SEQ ID NO: 204949 - DNA, 25 bp, E. coli
taaagaggcgtttcagatatcccgc

SEQ ID NO: 204950 - DNA, 25 bp, E. coli
taaagaggcgttacagatatcccgc

SEQ ID NO: 204951 - DNA, 25 bp, E. coli
aaaccgccagtcgtatgatgcaccg

SEQ ID NO: 204952 - DNA, 25 bp, E. coli
aaaccgccagtcctatgatgcaccg

SEQ ID NO: 204953 - DNA, 25 bp, E. coli
tatttaaagaaggatcaggccggat

SEQ ID NO: 204954 - DNA, 25 bp, E. coli
tatttaaagaagcatcaggccggat

SEQ ID NO: 204955 - DNA, 25 bp, E. coli
tatttcccgcttcaggcgagcgagc

SEQ ID NO: 204956 - DNA, 25 bp, E. coli
tatttcccgcttgaggcgagcgagc

SEQ ID NO: 204957 - DNA, 25 bp, E. coli
tcaggacggctttcgtaacggtaag

SEQ ID NO: 204958 - DNA, 25 bp, E. coli
tcaggacggcttacgtaacggtaag

SEQ ID NO: 204959 - DNA, 25 bp, E. coli
gcgaaaaatcatcagccagcaggtt

SEQ ID NO: 204960 - DNA, 25 bp, E. coli
gcgaaaaatcatgagccagcaggtt

SEQ ID NO: 204961 - DNA, 25 bp, E. coli
gatttatttaaggtctccggtctgg

SEQ ID NO: 204962 - DNA, 25 bp, E. coli
gatttatttaagctctccggtctgg

SEQ ID NO: 204963 - DNA, 25 bp, E. coli
tggcctgatgggtgataaacacgac

SEQ ID NO: 204964 - DNA, 25 bp, E. coli
tggcctgatgggagataaacacgac

SEQ ID NO: 204965 - DNA, 25 bp, E. coli
gatgcacaggttagtttgccgccga

SEQ ID NO: 204966 - DNA, 25 bp, E. coli
gatgcacaggtttgtttgccgccga

SEQ ID NO: 204967 - DNA, 25 bp, E. coli
aatgttttgcgtcctgcaatcgccc

SEQ ID NO: 204968 - DNA, 25 bp, E. coli
aatgttttgcgtgctgcaatcgccc

SEQ ID NO: 204969 - DNA, 25 bp, E. coli
tatataacgccacagcttgtgccat

SEQ ID NO: 204970 - DNA, 25 bp, E. coli
tatataacgccagagcttgtgccat

SEQ ID NO: 204971 - DNA, 25 bp, E. coli
tgagtgatacgcatttaaccgaaaa

SEQ ID NO: 204972 - DNA, 25 bp, E. coli
tgagtgatacgcttttaaccgaaaa

SEQ ID NO: 204973 - DNA, 25 bp, E. coli
tgcaatcgcccgcattgagtggatt

SEQ ID NO: 204974 - DNA, 25 bp, E. coli
tgcaatcgcccggattgagtggatt

SEQ ID NO: 204975 - DNA, 25 bp, E. coli
tccctttttccggtatgccatgacg

SEQ ID NO: 204976 - DNA, 25 bp, E. coli
tccctttttccgctatgccatgacg

SEQ ID NO: 204977 - DNA, 25 bp, E. coli
tgcgtaaacgtaaatcaaaaccagc

SEQ ID NO: 204978 - DNA, 25 bp, E. coli
tgcgtaaacgtatatcaaaaccagc

SEQ ID NO: 204979 - DNA, 25 bp, E. coli
tctgttcattgagtgggaggcccag

SEQ ID NO: 204980 - DNA, 25 bp, E. coli
tctgttcattgactgggaggcccag

SEQ ID NO: 204981 - DNA, 25 bp, E. coli
ccatcttgtggctgaggtggcccgc

SEQ ID NO: 204982 - DNA, 25 bp, E. coli
ccatcttgtggcagaggtggcccgc

SEQ ID NO: 204983 - DNA, 25 bp, E. coli
ggaagaggccattacggatatgaca

SEQ ID NO: 204984 - DNA, 25 bp, E. coli
ggaagaggccataacggatatgaca

SEQ ID NO: 204985 - DNA, 25 bp, E. coli
tccttaccggagaaaatgttttgcg

SEQ ID NO: 204986 - DNA, 25 bp, E. coli
tccttaccggagtaaatgttttgcg

SEQ ID NO: 204987 - DNA, 25 bp, E. coli
gaggcccagtatcggtgcaccattg

SEQ ID NO: 204988 - DNA, 25 bp, E. coli
gaggcccagtatgggtgcaccattg

SEQ ID NO: 204989 - DNA, 25 bp, E. coli
caatgcctgatatcccattaatgat

SEQ ID NO: 204990 - DNA, 25 bp, E. coli
caatgcctgataacccattaatgat

SEQ ID NO: 204991 - DNA, 25 bp, E. coli
tataccggattagccctttatgtct

SEQ ID NO: 204992 - DNA, 25 bp, E. coli
tataccggattacccctttatgtct

SEQ ID NO: 204993 - DNA, 25 bp, E. coli
ttcaaaatccttgatgccatcagct

SEQ ID NO: 204994 - DNA, 25 bp, E. coli
ttcaaaatccttcatgccatcagct

SEQ ID NO: 204995 - DNA, 25 bp, E. coli
tgatggcggcagtcactggcttttt

SEQ ID NO: 204996 - DNA, 25 bp, E. coli
tgatggcggcagacactggcttttt

SEQ ID NO: 204997 - DNA, 25 bp, E. coli
tcccctgttatagcggattagccct

SEQ ID NO: 204998 - DNA, 25 bp, E. coli
tcccctgttataccggattagccct

SEQ ID NO: 204999 - DNA, 25 bp, E. coli
gacactggctttatctcccctgtta

SEQ ID NO: 205000 - DNA, 25 bp, E. coli
gacactggctttttctcccctgtta

SEQ ID NO: 205001 - DNA, 25 bp, E. coli
cccattaatgatcgtttctggtgat

SEQ ID NO: 205002 - DNA, 25 bp, E. coli
cccattaatgatggtttctggtgat

SEQ ID NO: 205003 - DNA, 25 bp, E. coli
gataaaaaatctttaacaatgcctg

SEQ ID NO: 205004 - DNA, 25 bp, E. coli
gataaaaaatctataacaatgcctg

SEQ ID NO: 205005 - DNA, 25 bp, E. coli
ggtttcaaaaaagatgcgtagtctt

SEQ ID NO: 205006 - DNA, 25 bp, E. coli
ggtttcaaaaaacatgcgtagtctt

SEQ ID NO: 205007 - DNA, 25 bp, E. coli
gatgcgtagtctatcaaaatccttg

SEQ ID NO: 205008 - DNA, 25 bp, E. coli
gatgccatcagcagtagataaaaaa

SEQ ID NO: 205009 - DNA, 25 bp, E. coli
gatgccatcagctgtagataaaaaa

SEQ ID NO: 205010 - DNA, 25 bp, E. coli
gatgcgtagtctttcaaaatccttg

SEQ ID NO: 205011 - DNA, 25 bp, E. coli
tataaaatccgcttcccgaacggca

SEQ ID NO: 205012 - DNA, 25 bp, E. coli
tataaaatccgcatcccgaacggca

SEQ ID NO: 205013 - DNA, 25 bp, E. coli
taacagcggcaagcggcatgaccgt

SEQ ID NO: 205014 - DNA, 25 bp, E. coli
atcgcagcacggtaacagcggcaac

SEQ ID NO: 205015 - DNA, 25 bp, E. coli
atcgcagcacggaaacagcggcaac

SEQ ID NO: 205016 - DNA, 25 bp, E. coli
ttaaagacctgaggcccggcgaact

SEQ ID NO: 205017 - DNA, 25 bp, E. coli
ttaaagacctgacgcccggcgaact

SEQ ID NO: 205018 - DNA, 25 bp, E. coli
tgaccgctgagtgctatgacgacag

SEQ ID NO: 205019 - DNA, 25 bp, E. coli
tgaccgctgagtcctatgacgacag

SEQ ID NO: 205020 - DNA, 25 bp, E. coli
gcgctgctggcgtggtttaatgaag

SEQ ID NO: 205021 - DNA, 25 bp, E. coli
gcgctgctggcgaggtttaatgaag

SEQ ID NO: 205022 - DNA, 25 bp, E. coli
gcgaactgaccgctgagtcctatga

SEQ ID NO: 205023 - DNA, 25 bp, E. coli
gcgaactgaccggtgagtcctatga

SEQ ID NO: 205024 - DNA, 25 bp, E. coli
gaagatcgcagctcggtaacagcgg

SEQ ID NO: 205025 - DNA, 25 bp, E. coli
gaagatcgcagcacggtaacagcgg

SEQ ID NO: 205026 - DNA, 25 bp, E. coli
cttcacgctggcctggatgcccgga

SEQ ID NO: 205027 - DNA, 25 bp, E. coli
cttcacgctggcgtggatgcccgga

SEQ ID NO: 205028 - DNA, 25 bp, E. coli
ggcagaagatcgcagcacggtaaca

SEQ ID NO: 205029 - DNA, 25 bp, E. coli
ggcagaagatcggagcacggtaaca

SEQ ID NO: 205030 - DNA, 25 bp, E. coli
taacagcggcaaccggcatgaccgt

SEQ ID NO: 205031 - DNA, 25 bp, E. coli
gagataccagctacacgctggcgtg

SEQ ID NO: 205032 - DNA, 25 bp, E. coli
gagataccagcttcacgctggcgtg

SEQ ID NO: 205033 - DNA, 25 bp, E. coli
cagccagacgctgtatatggataac

SEQ ID NO: 205034 - DNA, 25 bp, E. coli
cagccagacgctctatatggataac

SEQ ID NO: 205035 - DNA, 25 bp, E. coli
cattattttcggtagctgcgcagca

SEQ ID NO: 205036 - DNA, 25 bp, E. coli
tacagtagcggaaattggctggcga

SEQ ID NO: 205037 - DNA, 25 bp, E. coli
tacagtagcggatattggctggcga

SEQ ID NO: 205038 - DNA, 25 bp, E. coli
tatggcgaacatatcggcatgagcc

SEQ ID NO: 205039 - DNA, 25 bp, E. coli
tatggcgaacatttcggcatgagcc

SEQ ID NO: 205040 - DNA, 25 bp, E. coli
tattggcgactgcatccgttcaccg

SEQ ID NO: 205041 - DNA, 25 bp, E. coli
tattggcgactggatccgttcaccg

SEQ ID NO: 205042 - DNA, 25 bp, E. coli
tttatctgtacgtccctgattgcgg

SEQ ID NO: 205043 - DNA, 25 bp, E. coli
tttatctgtacgaccctgattgcgg

SEQ ID NO: 205044 - DNA, 25 bp, E. coli
tgctttaccaaatccacggtatggg

SEQ ID NO: 205045 - DNA, 25 bp, E. coli
tgagatgctgaaaaatcacccggcc

SEQ ID NO: 205046 - DNA, 25 bp, E. coli
tgagatgctgaataatcacccggcc

SEQ ID NO: 205047 - DNA, 25 bp, E. coli
tgctttaccaaaaccacggtatggg

SEQ ID NO: 205048 - DNA, 25 bp, E. coli
tccattgtacgtaccgaactcgctg

SEQ ID NO: 205049 - DNA, 25 bp, E. coli
tccattgtacgttccgaactcgctg

SEQ ID NO: 205050 - DNA, 25 bp, E. coli
cattattttcggaagctgcgcagca

SEQ ID NO: 205051 - DNA, 25 bp, E. coli
cgttcaccggacagaaatatcgaag

SEQ ID NO: 205052 - DNA, 25 bp, E. coli
cgttcaccggactgaaatatcgaag

SEQ ID NO: 205053 - DNA, 25 bp, E. coli
gatattgtacagacacacggcgcgg

SEQ ID NO: 205054 - DNA, 25 bp, E. coli
gatattgtacagtcacacggcgcgg

SEQ ID NO: 205055 - DNA, 25 bp, E. coli
aaggctacgagcagagccacttccg

SEQ ID NO: 205056 - DNA, 25 bp, E. coli
aaggctacgagctgagccacttccg

SEQ ID NO: 205057 - DNA, 25 bp, E. coli
tacgagcagagccacttccgcttca

SEQ ID NO: 205058 - DNA, 25 bp, E. coli
tacgagcagagcgacttccgcttca

SEQ ID NO: 205059 - DNA, 25 bp, E. coli
aacatgcgctaccatctggcgctgc

SEQ ID NO: 205060 - DNA, 25 bp, E. coli
aacatgcgctacgatctggcgctgc

SEQ ID NO: 205061 - DNA, 25 bp, E. coli
tgtcaactggatgggcgaaattcag

SEQ ID NO: 205062 - DNA, 25 bp, E. coli
tgtcaactggatcggcgaaattcag

SEQ ID NO: 205063 - DNA, 25 bp, E. coli
tgcgcgaaggcttcgagcagagcca

SEQ ID NO: 205064 - DNA, 25 bp, E. coli
tgcgcgaaggctacgagcagagcca

SEQ ID NO: 205065 - DNA, 25 bp, E. coli
tcatgtcaactgcatcggcgaaatt

SEQ ID NO: 205066 - DNA, 25 bp, E. coli
tctgcatcatgtgaactggatcggc

SEQ ID NO: 205067 - DNA, 25 bp, E. coli
tcatgtcaactggatcggcgaaatt

SEQ ID NO: 205068 - DNA, 25 bp, E. coli
tctgcatcatgtcaactggatcggc

SEQ ID NO: 205069 - DNA, 25 bp, E. coli
cctgcatttgcagtttcatctgcat

SEQ ID NO: 205070 - DNA, 25 bp, E. coli
cctgcatttgcactttcatctgcat

SEQ ID NO: 205071 - DNA, 25 bp, E. coli
cgcgcggtctgatcgtcggcagtaa

SEQ ID NO: 205072 - DNA, 25 bp, E. coli
cgcgcggtctgaacgtcggcagtaa

SEQ ID NO: 205073 - DNA, 25 bp, E. coli
gtttcatctgcatcatgtcaactgg

SEQ ID NO: 205074 - DNA, 25 bp, E. coli
gtttcatctgcaacatgtcaactgg

SEQ ID NO: 205075 - DNA, 25 bp, E. coli
ggcagaagaagaagcccgccaggcc

SEQ ID NO: 205076 - DNA, 25 bp, E. coli
ggcagaagaagatgcccgccaggcc

SEQ ID NO: 205077 - DNA, 25 bp, E. coli
catcagagtgattgcgcaaactgtt

SEQ ID NO: 205078 - DNA, 25 bp, E. coli
catcagagtgatagcgcaaactgtt

SEQ ID NO: 205079 - DNA, 25 bp, E. coli
acgagccactcgaaagacttatgta

SEQ ID NO: 205080 - DNA, 25 bp, E. coli
acgagccactcgtaagacttatgta

SEQ ID NO: 205081 - DNA, 25 bp, E. coli
tattcattactaccagagcaacgag

SEQ ID NO: 205082 - DNA, 25 bp, E. coli
tattctggaacagcaggagtagacg

SEQ ID NO: 205083 - DNA, 25 bp, E. coli
tattctggaacaccaggagtagacg

SEQ ID NO: 205084 - DNA, 25 bp, E. coli
tattcattactagcagagcaacgag

SEQ ID NO: 205085 - DNA, 25 bp, E. coli
tgcttatactgaaataccttggctc

SEQ ID NO: 205086 - DNA, 25 bp, E. coli
tgcttatactgatataccttggctc

SEQ ID NO: 205087 - DNA, 25 bp, E. coli
gaaactttttgctaacgagccactc

SEQ ID NO: 205088 - DNA, 25 bp, E. coli
gaaactttttgcaaacgagccactc

SEQ ID NO: 205089 - DNA, 25 bp, E. coli
cgtggtcgccatatccttctcaaga

SEQ ID NO: 205090 - DNA, 25 bp, E. coli
cgtggtcgccatttccttctcaaga

SEQ ID NO: 205091 - DNA, 25 bp, E. coli
gataccgaaagactttactgtcgca

SEQ ID NO: 205092 - DNA, 25 bp, E. coli
gattgcgagcacttattcaaaagca

SEQ ID NO: 205093 - DNA, 25 bp, E. coli
gataccgaaagagtttactgtcgca

SEQ ID NO: 205094 - DNA, 25 bp, E. coli
gattgcgagcacatattcaaaagca

SEQ ID NO: 205095 - DNA, 25 bp, E. coli
gtctcactctctcgctgataccgaa

SEQ ID NO: 205096 - DNA, 25 bp, E. coli
gtctcactctctggctgataccgaa

SEQ ID NO: 205097 - DNA, 25 bp, E. coli
ggaagggcatcaatcaacatcagag

SEQ ID NO: 205098 - DNA, 25 bp, E. coli
ggaagggcatcattcaacatcagag

SEQ ID NO: 205099 - DNA, 25 bp, E. coli
caatattttgtctgcgcaaacggtt

SEQ ID NO: 205100 - DNA, 25 bp, E. coli
caatattttgtcagcgcaaacggtt

SEQ ID NO: 205101 - DNA, 25 bp, E. coli
cagcgcaaacggtttatttgaatta

SEQ ID NO: 205102 - DNA, 25 bp, E. coli
cagcgcaaacggattatttgaatta

SEQ ID NO: 205103 - DNA, 25 bp, E. coli
caaattgtccggcattatactcatc

SEQ ID NO: 205104 - DNA, 25 bp, E. coli
caaattgtccgggattatactcatc

SEQ ID NO: 205105 - DNA, 25 bp, E. coli
catttgatgcaatattttgtcagcg

SEQ ID NO: 205106 - DNA, 25 bp, E. coli
catttgatgcaaaattttgtcagcg

SEQ ID NO: 205107 - DNA, 25 bp, E. coli
accatacatcctcccggcaaattgt

SEQ ID NO: 205108 - DNA, 25 bp, E. coli
accatacatcctgccggcaaattgt

SEQ ID NO: 205109 - DNA, 25 bp, E. coli
tgtccggcattatactcatcgtcag

SEQ ID NO: 205110 - DNA, 25 bp, E. coli
tgtccggcattaaactcatcgtcag

SEQ ID NO: 205111 - DNA, 25 bp, E. coli
tgaaccatacatcctcccggcaaat

SEQ ID NO: 205112 - DNA, 25 bp, E. coli
tgcaatattttgacagcgcaaacgg

SEQ ID NO: 205113 - DNA, 25 bp, E. coli
tgaaccatacatgctcccggcaaat

SEQ ID NO: 205114 - DNA, 25 bp, E. coli
tgcaatattttgtcagcgcaaacgg

SEQ ID NO: 205115 - DNA, 25 bp, E. coli
ccggcattatactcatcgtcagaag

SEQ ID NO: 205116 - DNA, 25 bp, E. coli
ccggcattatacacatcgtcagaag

SEQ ID NO: 205117 - DNA, 25 bp, E. coli
gcattatactcatcgtcagaagcgg

SEQ ID NO: 205118 - DNA, 25 bp, E. coli
gcattatactcaacgtcagaagcgg

SEQ ID NO: 205119 - DNA, 25 bp, E. coli
tttgtcagcgcaaacggtttatttg

SEQ ID NO: 205120 - DNA, 25 bp, E. coli
tttgtcagcgcatacggtttatttg

SEQ ID NO: 205121 - DNA, 25 bp, E. coli
caggatgtggtcgattgtgaagtaa

SEQ ID NO: 205122 - DNA, 25 bp, E. coli
caggatgtggtccattgtgaagtaa

SEQ ID NO: 205123 - DNA, 25 bp, E. coli
atcctgcaaaaagggcgtcaggatg

SEQ ID NO: 205124 - DNA, 25 bp, E. coli
atcctgcaaaaacggcgtcaggatg

SEQ ID NO: 205125 - DNA, 25 bp, E. coli
tcgcgacctgaatgacgcagcggtt

SEQ ID NO: 205126 - DNA, 25 bp, E. coli
tcgcgacctgaaagacgcagcggtt

SEQ ID NO: 205127 - DNA, 25 bp, E. coli
gcctgtttacgctcattaatctgca

SEQ ID NO: 205128 - DNA, 25 bp, E. coli
gcctgtttacgcacattaatctgca

SEQ ID NO: 205129 - DNA, 25 bp, E. coli
gcaactcaggcgttaaagcaccaag

SEQ ID NO: 205130 - DNA, 25 bp, E. coli
gcaactcaggcgataaagcaccaag

SEQ ID NO: 205131 - DNA, 25 bp, E. coli
ccgcgaagaggctccacgcctgttt

SEQ ID NO: 205132 - DNA, 25 bp, E. coli
ccgcgaagaggcaccacgcctgttt

SEQ ID NO: 205133 - DNA, 25 bp, E. coli
ctggaaaaagcgctgaatattactc

SEQ ID NO: 205134 - DNA, 25 bp, E. coli
ctggaaaaagcggtgaatattactc

SEQ ID NO: 205135 - DNA, 25 bp, E. coli
gtaaaattgaccactgaacgccgcg

SEQ ID NO: 205136 - DNA, 25 bp, E. coli
gattttaatggacggcaactcaggc

SEQ ID NO: 205137 - DNA, 25 bp, E. coli
gtaaaattgacctctgaacgccgcg

SEQ ID NO: 205138 - DNA, 25 bp, E. coli
gattttaatggagggcaactcaggc

SEQ ID NO: 205139 - DNA, 25 bp, E. coli
ggttgcagtgccatcgatgtggttt

SEQ ID NO: 205140 - DNA, 25 bp, E. coli
ggttgcagtgccttcgatgtggttt

SEQ ID NO: 205141 - DNA, 25 bp, E. coli
tcactcgtatgaagtggttgccgcg

SEQ ID NO: 205142 - DNA, 25 bp, E. coli
tcactcgtatgatgtggttgccgcg

SEQ ID NO: 205143 - DNA, 25 bp, E. coli
cacgaattgagtccggtcaaccgac

SEQ ID NO: 205144 - DNA, 25 bp, E. coli
cacgaattgagtgcggtcaaccgac

SEQ ID NO: 205145 - DNA, 25 bp, E. coli
atcccgaccagcgatcgggaaatgg

SEQ ID NO: 205146 - DNA, 25 bp, E. coli
atcccgaccagccatcgggaaatgg

SEQ ID NO: 205147 - DNA, 25 bp, E. coli
ttttgttatccccaccagccatcgg

SEQ ID NO: 205148 - DNA, 25 bp, E. coli
ttttgttatcccgaccagccatcgg

SEQ ID NO: 205149 - DNA, 25 bp, E. coli
tgcctcaatcccagctgcgtggcga

SEQ ID NO: 205150 - DNA, 25 bp, E. coli
tgcctcaatccctgctgcgtggcga

SEQ ID NO: 205151 - DNA, 25 bp, E. coli
tcctacgcagatgcgggcggtttgc

SEQ ID NO: 205152 - DNA, 25 bp, E. coli
tcctacgcagatccgggcggtttgc

SEQ ID NO: 205153 - DNA, 25 bp, E. coli
tcgtgccatcgacgaagtaggcctg

SEQ ID NO: 205154 - DNA, 25 bp, E. coli
tcagtcctacgcagatgcgggcggt

SEQ ID NO: 205155 - DNA, 25 bp, E. coli
tcagtcctacgctgatgcgggcggt

SEQ ID NO: 205156 - DNA, 25 bp, E. coli
tcgtgccatcgaggaagtaggcctg

SEQ ID NO: 205157 - DNA, 25 bp, E. coli
gcgttactgatactcgtgccatcga

SEQ ID NO: 205158 - DNA, 25 bp, E. coli
gcgttactgatagtcgtgccatcga

SEQ ID NO: 205159 - DNA, 25 bp, E. coli
gaagatcgttttcttatcccgacca

SEQ ID NO: 205160 - DNA, 25 bp, E. coli
gaagatcgttttgttatcccgacca

SEQ ID NO: 205161 - DNA, 25 bp, E. coli
cgtggaaggcgttactgatactcgt

SEQ ID NO: 205162 - DNA, 25 bp, E. coli
cgtggaaggcgtaactgatactcgt

SEQ ID NO: 205163 - DNA, 25 bp, E. coli
gagtccggtcaaccgaccgtgtgct

SEQ ID NO: 205164 - DNA, 25 bp, E. coli
gagtccggtcaagcgaccgtgtgct

SEQ ID NO: 205165 - DNA, 25 bp, E. coli
cacagcacatcacgcatggtgacat

SEQ ID NO: 205166 - DNA, 25 bp, E. coli
cacagcacatcaggcatggtgacat

SEQ ID NO: 205167 - DNA, 25 bp, E. coli
catggtgacatgattgtcgggtacg

SEQ ID NO: 205168 - DNA, 25 bp, E. coli
catggtgacatgtttgtcgggtacg

SEQ ID NO: 205169 - DNA, 25 bp, E. coli
tagggcttttgcgacagcacatcag

SEQ ID NO: 205170 - DNA, 25 bp, E. coli
tagggcttttgccacagcacatcag

SEQ ID NO: 205171 - DNA, 25 bp, E. coli
ttttgccacagcacatcaggcatgg

SEQ ID NO: 205172 - DNA, 25 bp, E. coli
ttttgccacagctcatcaggcatgg

SEQ ID NO: 205173 - DNA, 25 bp, E. coli
ttgccacagcacttcaggcatggtg

SEQ ID NO: 205174 - DNA, 25 bp, E. coli
tttagggcttttcccacagcacatc

SEQ ID NO: 205175 - DNA, 25 bp, E. coli
tttagggcttttgccacagcacatc

SEQ ID NO: 205176 - DNA, 25 bp, E. coli
ttgccacagcacatcaggcatggtg

SEQ ID NO: 205177 - DNA, 25 bp, E. coli
tcaggcatggtgtcatgtttgtcgg

SEQ ID NO: 205178 - DNA, 25 bp, E. coli
tcaggcatggtgacatgtttgtcgg

SEQ ID NO: 205179 - DNA, 25 bp, E. coli
gcacatcaggcatggtgacatgttt

SEQ ID NO: 205180 - DNA, 25 bp, E. coli
gcacatcaggcaaggtgacatgttt

SEQ ID NO: 205181 - DNA, 25 bp, E. coli
gacatgtttgtcgggtacggcgtaa

SEQ ID NO: 205182 - DNA, 25 bp, E. coli
gacatgtttgtccggtacggcgtaa

SEQ ID NO: 205183 - DNA, 25 bp, E. coli
ggcttttgccactgcacatcaggca

SEQ ID NO: 205184 - DNA, 25 bp, E. coli
ggcttttgccacagcacatcaggca

SEQ ID NO: 205185 - DNA, 25 bp, E. coli
taaacgccttatccaaccttgaaga

SEQ ID NO: 205186 - DNA, 25 bp, E. coli
taaacgccttatgcaaccttgaaga

SEQ ID NO: 205187 - DNA, 25 bp, E. coli
caatggtgggttattgctctttggg

SEQ ID NO: 205188 - DNA, 25 bp, E. coli
caatcgttagtattgccatgttcgc

SEQ ID NO: 205189 - DNA, 25 bp, E. coli
caatggtgggtttttgctctttggg

SEQ ID NO: 205190 - DNA, 25 bp, E. coli
caatcgttagtaatgccatgttcgc

SEQ ID NO: 205191 - DNA, 25 bp, E. coli
tgtacttaataaacaagaactcttc

SEQ ID NO: 205192 - DNA, 25 bp, E. coli
tgtacttaataatcaagaactcttc

SEQ ID NO: 205193 - DNA, 25 bp, E. coli
tcttaccaattaagcctcaaaatgt

SEQ ID NO: 205194 - DNA, 25 bp, E. coli
tcttaccaattatgcctcaaaatgt

SEQ ID NO: 205195 - DNA, 25 bp, E. coli
tcttatcatacagagaaaactggat

SEQ ID NO: 205196 - DNA, 25 bp, E. coli
tcttatcatacacagaaaactggat

SEQ ID NO: 205197 - DNA, 25 bp, E. coli
gctaataagcatcaagtctctctcg

SEQ ID NO: 205198 - DNA, 25 bp, E. coli
gctaataagcatgaagtctctctcg

SEQ ID NO: 205199 - DNA, 25 bp, E. coli
gcaaaatacgtgattctctctgtac

SEQ ID NO: 205200 - DNA, 25 bp, E. coli
gcaaaatacgtgtttctctctgtac

SEQ ID NO: 205201 - DNA, 25 bp, E. coli
gaaaactggatactaaattctctta

SEQ ID NO: 205202 - DNA, 25 bp, E. coli
gaaaactggatagtaaattctctta

SEQ ID NO: 205203 - DNA, 25 bp, E. coli
gtctctctcgtagaacaaaatttca

SEQ ID NO: 205204 - DNA, 25 bp, E. coli
gtctctctcgtacaacaaaatttca

SEQ ID NO: 205205 - DNA, 25 bp, E. coli
taatgggatattccttgtattctca

SEQ ID NO: 205206 - DNA, 25 bp, E. coli
taatgggatattgcttgtattctca

SEQ ID NO: 205207 - DNA, 25 bp, E. coli
gatacaaagaaatgaagaaacttgc

SEQ ID NO: 205208 - DNA, 25 bp, E. coli
gatacaaagaaaagaagaaacttgc

SEQ ID NO: 205209 - DNA, 25 bp, E. coli
caaaggacttcggtggttgccgcga

SEQ ID NO: 205210 - DNA, 25 bp, E. coli
caaaggacttcgctggttgccgcga

SEQ ID NO: 205211 - DNA, 25 bp, E. coli
ggcaaagtcccgcacagttccgcga

SEQ ID NO: 205212 - DNA, 25 bp, E. coli
ggcaaagtcccggacagttccgcga

SEQ ID NO: 205213 - DNA, 25 bp, E. coli
tatcgcggttctttcctgattgaga

SEQ ID NO: 205214 - DNA, 25 bp, E. coli
tatcgcggttctatcctgattgaga

SEQ ID NO: 205215 - DNA, 25 bp, E. coli
tgaaagacacccagccagtcaccgg

SEQ ID NO: 205216 - DNA, 25 bp, E. coli
tgaaagacaccctgccagtcaccgg

SEQ ID NO: 205217 - DNA, 25 bp, E. coli
tcgaaacaggtgatgggatcccgtc

SEQ ID NO: 205218 - DNA, 25 bp, E. coli
tcgaaacaggtgttgggatcccgtc

SEQ ID NO: 205219 - DNA, 25 bp, E. coli
ccagctggcaggatatgacgtctat

SEQ ID NO: 205220 - DNA, 25 bp, E. coli
ccagctggcaggttatgacgtctat

SEQ ID NO: 205221 - DNA, 25 bp, E. coli
gctgcataaactgaactatcgcggt

SEQ ID NO: 205222 - DNA, 25 bp, E. coli
gctttccctttgctagccgtgacga

SEQ ID NO: 205223 - DNA, 25 bp, E. coli
gctgcataaactcaactatcgcggt

SEQ ID NO: 205224 - DNA, 25 bp, E. coli
gctttccctttggtagccgtgacga

SEQ ID NO: 205225 - DNA, 25 bp, E. coli
ggtgcgcgtgcgtaatcatcagtta

SEQ ID NO: 205226 - DNA, 25 bp, E. coli
gggatcccgtcgatgtgcctgtccg

SEQ ID NO: 205227 - DNA, 25 bp, E. coli
gggatcccgtcgttgtgcctgtccg

SEQ ID NO: 205228 - DNA, 25 bp, E. coli
ggtgcgcgtgcgaaatcatcagtta

SEQ ID NO: 205229 - DNA, 25 bp, E. coli
ggcattcgcaccttccagctggcag

SEQ ID NO: 205230 - DNA, 25 bp, E. coli
ggcattcgcaccatccagctggcag

SEQ ID NO: 205231 - DNA, 25 bp, E. coli
cagtactgctgactatgctgccgta

SEQ ID NO: 205232 - DNA, 25 bp, E. coli
cagtactgctgagtatgctgccgta

SEQ ID NO: 205233 - DNA, 25 bp, E. coli
aactatcctcggaaactgggctgcg

SEQ ID NO: 205234 - DNA, 25 bp, E. coli
actctgatgaactctgccggtggta

SEQ ID NO: 205235 - DNA, 25 bp, E. coli
actctgatgaacactgccggtggta

SEQ ID NO: 205236 - DNA, 25 bp, E. coli
aactatcctcggtaactgggctgcg

SEQ ID NO: 205237 - DNA, 25 bp, E. coli
tacctgcgaacctagcaagtatcgg

SEQ ID NO: 205238 - DNA, 25 bp, E. coli
tacctgcgaaccaagcaagtatcgg

SEQ ID NO: 205239 - DNA, 25 bp, E. coli
tattaaatgatcgtgttccggcggg

SEQ ID NO: 205240 - DNA, 25 bp, E. coli
tattccgaaaaaaggtctgctgctg

SEQ ID NO: 205241 - DNA, 25 bp, E. coli
tattccgaaaaatggtctgctgctg

SEQ ID NO: 205242 - DNA, 25 bp, E. coli
tattaaatgatcctgttccggcggg

SEQ ID NO: 205243 - DNA, 25 bp, E. coli
tgagttctgccaagaagatcgggct

SEQ ID NO: 205244 - DNA, 25 bp, E. coli
tgagttctgccatgaagatcgggct

SEQ ID NO: 205245 - DNA, 25 bp, E. coli
cctttgtaaataagctcggcggtac

SEQ ID NO: 205246 - DNA, 25 bp, E. coli
cctttgtaaatatgctcggcggtac

SEQ ID NO: 205247 - DNA, 25 bp, E. coli
gctgcgactcagctgctttccggta

SEQ ID NO: 205248 - DNA, 25 bp, E. coli
gctgcgactcaggtgctttccggta

SEQ ID NO: 205249 - DNA, 25 bp, E. coli
gattatcctgatcttctacgctcgc

SEQ ID NO: 205250 - DNA, 25 bp, E. coli
gattatcctgatgttctacgctcgc

SEQ ID NO: 205251 - DNA, 25 bp, E. coli
ggaatactgcggataccactgatgg

SEQ ID NO: 205252 - DNA, 25 bp, E. coli
ggaatactgcggttaccactgatgg

SEQ ID NO: 205253 - DNA, 25 bp, E. coli
cagccgttgcgtaatcttggtcacg

SEQ ID NO: 205254 - DNA, 25 bp, E. coli
cagccgttgcgttatcttggtcacg

SEQ ID NO: 205255 - DNA, 25 bp, E. coli
atcagccgttgccttatcttggtca

SEQ ID NO: 205256 - DNA, 25 bp, E. coli
agccgttgcgttatcttggtcacga

SEQ ID NO: 205257 - DNA, 25 bp, E. coli
agccgttgcgttttcttggtcacga

SEQ ID NO: 205258 - DNA, 25 bp, E. coli
atcagccgttgcgttatcttggtca

SEQ ID NO: 205259 - DNA, 25 bp, E. coli
ttatcttggtcacgatcatctggtg

SEQ ID NO: 205260 - DNA, 25 bp, E. coli
ttatcttggtcaggatcatctggtg

SEQ ID NO: 205261 - DNA, 25 bp, E. coli
tcatcagccgttgcgttatcttggt

SEQ ID NO: 205262 - DNA, 25 bp, E. coli
tcatcagccgttccgttatcttggt

SEQ ID NO: 205263 - DNA, 25 bp, E. coli
tgcgttatcttgctcacgatcatct

SEQ ID NO: 205264 - DNA, 25 bp, E. coli
tgcgttatcttggtcacgatcatct

SEQ ID NO: 205265 - DNA, 25 bp, E. coli
tctcatcagccgatgcgttatcttg

SEQ ID NO: 205266 - DNA, 25 bp, E. coli
tcagccgttgcgttatcttggtcac

SEQ ID NO: 205267 - DNA, 25 bp, E. coli
tctcatcagccgttgcgttatcttg

SEQ ID NO: 205268 - DNA, 25 bp, E. coli
tcagccgttgcgatatcttggtcac

SEQ ID NO: 205269 - DNA, 25 bp, E. coli
cgttgcgttatcttggtcacgatca

SEQ ID NO: 205270 - DNA, 25 bp, E. coli
cgttgcgttatcatggtcacgatca

SEQ ID NO: 205271 - DNA, 25 bp, E. coli
gccgttgcgttatcttggtcacgat

SEQ ID NO: 205272 - DNA, 25 bp, E. coli
gccgttgcgttaacttggtcacgat

SEQ ID NO: 205273 - DNA, 25 bp, E. coli
gttatcttggtcacgatcatctggt

SEQ ID NO: 205274 - DNA, 25 bp, E. coli
gttatcttggtctcgatcatctggt

SEQ ID NO: 205275 - DNA, 25 bp, E. coli
ctgactgagcatcgcactcgctact

SEQ ID NO: 205276 - DNA, 25 bp, E. coli
ctgactgagcatggcactcgctact

SEQ ID NO: 205277 - DNA, 25 bp, E. coli
aaaccctgactgtgcatggcactcg

SEQ ID NO: 205278 - DNA, 25 bp, E. coli
aaaccctgactgagcatggcactcg

SEQ ID NO: 205279 - DNA, 25 bp, E. coli
ttgccgaaaccctgactgagcatgg

SEQ ID NO: 205280 - DNA, 25 bp, E. coli
ttgccgaaacccagactgagcatgg

SEQ ID NO: 205281 - DNA, 25 bp, E. coli
tgattgccgaaaccctgactgagca

SEQ ID NO: 205282 - DNA, 25 bp, E. coli
tgattgccgaaagcctgactgagca

SEQ ID NO: 205283 - DNA, 25 bp, E. coli
tgccgaaaccctcactgagcatggc

SEQ ID NO: 205284 - DNA, 25 bp, E. coli
tgccgaaaccctgactgagcatggc

SEQ ID NO: 205285 - DNA, 25 bp, E. coli
gactgagcatggcactcgctactgc

SEQ ID NO: 205286 - DNA, 25 bp, E. coli
gactgagcatgggactcgctactgc

SEQ ID NO: 205287 - DNA, 25 bp, E. coli
ccctgactgagcatggcactcgcta

SEQ ID NO: 205288 - DNA, 25 bp, E. coli
ccctgactgagcttggcactcgcta

SEQ ID NO: 205289 - DNA, 25 bp, E. coli
cgaaaccctgacagagcatggcact

SEQ ID NO: 205290 - DNA, 25 bp, E. coli
cgtgattgccgataccctgactgag

SEQ ID NO: 205291 - DNA, 25 bp, E. coli
cgtgattgccgaaaccctgactgag

SEQ ID NO: 205292 - DNA, 25 bp, E. coli
cgaaaccctgactgagcatggcact

SEQ ID NO: 205293 - DNA, 25 bp, E. coli
gtgattgccgaatccctgactgagc

SEQ ID NO: 205294 - DNA, 25 bp, E. coli
gtgattgccgaaaccctgactgagc

SEQ ID NO: 205295 - DNA, 25 bp, E. coli
ggcgtgattgccgaaaccctgactg

SEQ ID NO: 205296 - DNA, 25 bp, E. coli
ggcgtgattgcccaaaccctgactg

SEQ ID NO: 205297 - DNA, 25 bp, E. coli
tttccattgcatttatgctgatcac

SEQ ID NO: 205298 - DNA, 25 bp, E. coli
tttccattgcatatatgctgatcac

SEQ ID NO: 205299 - DNA, 25 bp, E. coli
tggtcatccttaatgcaaaacccag

SEQ ID NO: 205300 - DNA, 25 bp, E. coli
tgcttgtgacgaaaaatttgcttaa

SEQ ID NO: 205301 - DNA, 25 bp, E. coli
tgggagaagtgcatgtgacgataaa

SEQ ID NO: 205302 - DNA, 25 bp, E. coli
tgcttgtgacgataaatttgcttaa

SEQ ID NO: 205303 - DNA, 25 bp, E. coli
tggtcatccttattgcaaaacccag

SEQ ID NO: 205304 - DNA, 25 bp, E. coli
tgggagaagtgcttgtgacgataaa

SEQ ID NO: 205305 - DNA, 25 bp, E. coli
gccattagtagcatgaacaatagta

SEQ ID NO: 205306 - DNA, 25 bp, E. coli
gccattagtagcttgaacaatagta

SEQ ID NO: 205307 - DNA, 25 bp, E. coli
gcatgaacaatactaataatctgga

SEQ ID NO: 205308 - DNA, 25 bp, E. coli
gcatgaacaatagtaataatctgga

SEQ ID NO: 205309 - DNA, 25 bp, E. coli
cgatcaatctggataatcgattaag

SEQ ID NO: 205310 - DNA, 25 bp, E. coli
cgatcaatctggttaatcgattaag

SEQ ID NO: 205311 - DNA, 25 bp, E. coli
ctcctggtcatccttattgcaaaac

SEQ ID NO: 205312 - DNA, 25 bp, E. coli
ctcctggtcatcgttattgcaaaac

SEQ ID NO: 205313 - DNA, 25 bp, E. coli
ggattgccattagtagcatgaacaa

SEQ ID NO: 205314 - DNA, 25 bp, E. coli
ggattgccattactagcatgaacaa

SEQ ID NO: 205315 - DNA, 25 bp, E. coli
ggctggcgatcattctggttaatcg

SEQ ID NO: 205316 - DNA, 25 bp, E. coli
ggctggcgatcaatctggttaatcg

SEQ ID NO: 205317 - DNA, 25 bp, E. coli
taatctggattatttcactctctat

SEQ ID NO: 205318 - DNA, 25 bp, E. coli
taatctggattaattcactctctat

SEQ ID NO: 205319 - DNA, 25 bp, E. coli
caaaaaatagacaaaatgagcgggt

SEQ ID NO: 205320 - DNA, 25 bp, E. coli
caaaaaatagactaaatgagcgggt

SEQ ID NO: 205321 - DNA, 25 bp, E. coli
tatagaaatagatgcacgtagcggg

SEQ ID NO: 205322 - DNA, 25 bp, E. coli
tataaattttcttaagtcacggaat

SEQ ID NO: 205323 - DNA, 25 bp, E. coli
tataaattttctaaagtcacggaat

SEQ ID NO: 205324 - DNA, 25 bp, E. coli
tatagaaatagaagcacgtagcggg

SEQ ID NO: 205325 - DNA, 25 bp, E. coli
tagacaaaatgagcgggtttataga

SEQ ID NO: 205326 - DNA, 25 bp, E. coli
tagacaaaatgaccgggtttataga

SEQ ID NO: 205327 - DNA, 25 bp, E. coli
tctgatatttcatgtttgtgcaaaa

SEQ ID NO: 205328 - DNA, 25 bp, E. coli
tcttaagtcacggaattgtctgata

SEQ ID NO: 205329 - DNA, 25 bp, E. coli
tcacggaattgtgtgatatttcatg

SEQ ID NO: 205330 - DNA, 25 bp, E. coli
tcttaagtcacgcaattgtctgata

SEQ ID NO: 205331 - DNA, 25 bp, E. coli
tcacggaattgtctgatatttcatg

SEQ ID NO: 205332 - DNA, 25 bp, E. coli
tctgatatttcaagtttgtgcaaaa

SEQ ID NO: 205333 - DNA, 25 bp, E. coli
gcgggtttatagaaatagatgcacg

SEQ ID NO: 205334 - DNA, 25 bp, E. coli
gcgggtttatagtaatagatgcacg

SEQ ID NO: 205335 - DNA, 25 bp, E. coli
gaagagaggaaaaggccggacgacg

SEQ ID NO: 205336 - DNA, 25 bp, E. coli
gaagagaggaaatggccggacgacg

SEQ ID NO: 205337 - DNA, 25 bp, E. coli
gacgacgatagtgccgtccggcatg

SEQ ID NO: 205338 - DNA, 25 bp, E. coli
gacgacgatagtcccgtccggcatg

SEQ ID NO: 205339 - DNA, 25 bp, E. coli
cgatagtgccgtgcggcatgagcaa

SEQ ID NO: 205340 - DNA, 25 bp, E. coli
cgatagtgccgtccggcatgagcaa

SEQ ID NO: 205341 - DNA, 25 bp, E. coli
caaacgaaaggtccggcatagagtg

SEQ ID NO: 205342 - DNA, 25 bp, E. coli
caaacgaaaggtgcggcatagagtg

SEQ ID NO: 205343 - DNA, 25 bp, E. coli
catagagtgccagaaaggcaggcgt

SEQ ID NO: 205344 - DNA, 25 bp, E. coli
catagagtgccacaaaggcaggcgt

SEQ ID NO: 205345 - DNA, 25 bp, E. coli
tactgcgggctagtgccctatactc

SEQ ID NO: 205346 - DNA, 25 bp, E. coli
tactgcgggctactgccctatactc

SEQ ID NO: 205347 - DNA, 25 bp, E. coli
tattcgacgccacaaataatgcagg

SEQ ID NO: 205348 - DNA, 25 bp, E. coli
tattcgacgccagaaataatgcagg

SEQ ID NO: 205349 - DNA, 25 bp, E. coli
tgatgctgaaatgacgtcggtgacg

SEQ ID NO: 205350 - DNA, 25 bp, E. coli
tgatgctgaaatcacgtcggtgacg

SEQ ID NO: 205351 - DNA, 25 bp, E. coli
tcggtgacgatcgatactgcgggct

SEQ ID NO: 205352 - DNA, 25 bp, E. coli
tcggtgacgatccatactgcgggct

SEQ ID NO: 205353 - DNA, 25 bp, E. coli
gcgttaaaaggcgtgatgctgaaat

SEQ ID NO: 205354 - DNA, 25 bp, E. coli
gcgttaaaaggcctgatgctgaaat

SEQ ID NO: 205355 - DNA, 25 bp, E. coli
gacaagctcctgcttaaggaatagc

SEQ ID NO: 205356 - DNA, 25 bp, E. coli
gacaagctcctggttaaggaatagc

SEQ ID NO: 205357 - DNA, 25 bp, E. coli
gacaaaatgcaatcgaaaggtgcgg

SEQ ID NO: 205358 - DNA, 25 bp, E. coli
gacaaaatgcaaacgaaaggtgcgg

SEQ ID NO: 205359 - DNA, 25 bp, E. coli
taaggaatagctattcgacgccaga

SEQ ID NO: 205360 - DNA, 25 bp, E. coli
taatgcaggcgttacgacaaaatgc

SEQ ID NO: 205361 - DNA, 25 bp, E. coli
taaggaatagcttttcgacgccaga

SEQ ID NO: 205362 - DNA, 25 bp, E. coli
taatgcaggcgtaacgacaaaatgc

SEQ ID NO: 205363 - DNA, 25 bp, E. coli
aatacgggttttgttgattcagacg

SEQ ID NO: 205364 - DNA, 25 bp, E. coli
aatacgggttttcttgattcagacg

SEQ ID NO: 205365 - DNA, 25 bp, E. coli
cagcaaccagatcaaaagccattga

SEQ ID NO: 205366 - DNA, 25 bp, E. coli
cagcaaccagatgaaaagccattga

SEQ ID NO: 205367 - DNA, 25 bp, E. coli
cagaaaatcagacgcggtcgttcac

SEQ ID NO: 205368 - DNA, 25 bp, E. coli
cagaaaatcagaggcggtcgttcac

SEQ ID NO: 205369 - DNA, 25 bp, E. coli
taaatcagaaaaacagacgcggtcg

SEQ ID NO: 205370 - DNA, 25 bp, E. coli
tactttgatacatgaaaatacgggt

SEQ ID NO: 205371 - DNA, 25 bp, E. coli
taaatcagaaaatcagacgcggtcg

SEQ ID NO: 205372 - DNA, 25 bp, E. coli
tactttgatacaagaaaatacgggt

SEQ ID NO: 205373 - DNA, 25 bp, E. coli
ttcacgcgattagaccgcattgcgg

SEQ ID NO: 205374 - DNA, 25 bp, E. coli
ttcacgcgattacaccgcattgcgg

SEQ ID NO: 205375 - DNA, 25 bp, E. coli
tgccgctatagccaaataaatcaga

SEQ ID NO: 205376 - DNA, 25 bp, E. coli
tgccgctatagcgaaataaatcaga

SEQ ID NO: 205377 - DNA, 25 bp, E. coli
tcttgattcagacgcgcagcggtgt

SEQ ID NO: 205378 - DNA, 25 bp, E. coli
tcttgattcagaggcgcagcggtgt

SEQ ID NO: 205379 - DNA, 25 bp, E. coli
cggtgtgcgtttctttgccgctata

SEQ ID NO: 205380 - DNA, 25 bp, E. coli
cggtgtgcgtttgtttgccgctata

SEQ ID NO: 205381 - DNA, 25 bp, E. coli
ggtcgttcacttcttcagcaaccag

SEQ ID NO: 205382 - DNA, 25 bp, E. coli
gggttgaccgtaaaattcacgcgat

SEQ ID NO: 205383 - DNA, 25 bp, E. coli
gggttgaccgtataattcacgcgat

SEQ ID NO: 205384 - DNA, 25 bp, E. coli
ggtcgttcacttgttcagcaaccag

SEQ ID NO: 205385 - DNA, 25 bp, E. coli
caagaaccggtagcgattgtgcctg

SEQ ID NO: 205386 - DNA, 25 bp, E. coli
caagaaccggtaccgattgtgcctg

SEQ ID NO: 205387 - DNA, 25 bp, E. coli
agagtcgggggtagcatttcacgct

SEQ ID NO: 205388 - DNA, 25 bp, E. coli
agagtcgggggttgcatttcacgct

SEQ ID NO: 205389 - DNA, 25 bp, E. coli
agaaccggtacccattgtgcctgct

SEQ ID NO: 205390 - DNA, 25 bp, E. coli
agaaccggtaccgattgtgcctgct

SEQ ID NO: 205391 - DNA, 25 bp, E. coli
tgatctcacacatgaaccggtaccg

SEQ ID NO: 205392 - DNA, 25 bp, E. coli
tgatctcacacaagaaccggtaccg

SEQ ID NO: 205393 - DNA, 25 bp, E. coli
tgcaatgatgcgtaaagagagtcgg

SEQ ID NO: 205394 - DNA, 25 bp, E. coli
tgcaatgatgcgaaaagagagtcgg

SEQ ID NO: 205395 - DNA, 25 bp, E. coli
tgccttatgcccacgacatcagtac

SEQ ID NO: 205396 - DNA, 25 bp, E. coli
tgccttatgccctcgacatcagtac

SEQ ID NO: 205397 - DNA, 25 bp, E. coli
tctcacacaagatccggtaccgatt

SEQ ID NO: 205398 - DNA, 25 bp, E. coli
tctcacacaagaaccggtaccgatt

SEQ ID NO: 205399 - DNA, 25 bp, E. coli
gacgtatgccttatgcccacgacat

SEQ ID NO: 205400 - DNA, 25 bp, E. coli
gacgtatgccttttgcccacgacat

SEQ ID NO: 205401 - DNA, 25 bp, E. coli
cggaagatatcagcagacgtatgcc

SEQ ID NO: 205402 - DNA, 25 bp, E. coli
cggaagatatcaccagacgtatgcc

SEQ ID NO: 205403 - DNA, 25 bp, E. coli
gttcgctgtgcattgatgcgtaaag

SEQ ID NO: 205404 - DNA, 25 bp, E. coli
gttcgctgtgcaatgatgcgtaaag

SEQ ID NO: 205405 - DNA, 25 bp, E. coli
gggattgatctcacacaagaaccgg

SEQ ID NO: 205406 - DNA, 25 bp, E. coli
gggattgatctctcacaagaaccgg

SEQ ID NO: 205407 - DNA, 25 bp, E. coli
aaaggccgcggtcctttacaaagca

SEQ ID NO: 205408 - DNA, 25 bp, E. coli
aaaggccgcggtgctttacaaagca

SEQ ID NO: 205409 - DNA, 25 bp, E. coli
tattaccgcgcactgtaggaccaat

SEQ ID NO: 205410 - DNA, 25 bp, E. coli
ttcgcccctggagaaagcctcgtgt

SEQ ID NO: 205411 - DNA, 25 bp, E. coli
ttcgcccctggacaaagcctcgtgt

SEQ ID NO: 205412 - DNA, 25 bp, E. coli
tattaccgcgcagtgtaggaccaat

SEQ ID NO: 205413 - DNA, 25 bp, E. coli
gccagcggcaaagcgaattaatcaa

SEQ ID NO: 205414 - DNA, 25 bp, E. coli
ccattttgaaattagctggcgttga

SEQ ID NO: 205415 - DNA, 25 bp, E. coli
ccattttgaaataagctggcgttga

SEQ ID NO: 205416 - DNA, 25 bp, E. coli
gccagcggcaaaccgaattaatcaa

SEQ ID NO: 205417 - DNA, 25 bp, E. coli
gctttacaaagctgcagcaattgca

SEQ ID NO: 205418 - DNA, 25 bp, E. coli
gctttacaaagcagcagcaattgca

SEQ ID NO: 205419 - DNA, 25 bp, E. coli
gcaattgcagtataattccgcacca

SEQ ID NO: 205420 - DNA, 25 bp, E. coli
gcaattgcagtaaaattccgcacca

SEQ ID NO: 205421 - DNA, 25 bp, E. coli
gaaagcctcgtgaatactcctcacc

SEQ ID NO: 205422 - DNA, 25 bp, E. coli
gaaagcctcgtgtatactcctcacc

SEQ ID NO: 205423 - DNA, 25 bp, E. coli
cgaattaatcaatggtgagaggcac

SEQ ID NO: 205424 - DNA, 25 bp, E. coli
cgaattaatcaaaggtgagaggcac

SEQ ID NO: 205425 - DNA, 25 bp, E. coli
ggaccaatgcggcttgatgtaaaac

SEQ ID NO: 205426 - DNA, 25 bp, E. coli
ggaccaatgcgggttgatgtaaaac

SEQ ID NO: 205427 - DNA, 25 bp, E. coli
gatgtaaaacttagttcgcccctgg

SEQ ID NO: 205428 - DNA, 25 bp, E. coli
gatgtaaaactttgttcgcccctgg

SEQ ID NO: 205429 - DNA, 25 bp, E. coli
aatgttaggctaggattccatggca

SEQ ID NO: 205430 - DNA, 25 bp, E. coli
aatgttaggctacgattccatggca

SEQ ID NO: 205431 - DNA, 25 bp, E. coli
taactcataatcgttggcctgctgg

SEQ ID NO: 205432 - DNA, 25 bp, E. coli
taactcataatccttggcctgctgg

SEQ ID NO: 205433 - DNA, 25 bp, E. coli
tactagttgctgaagaagcccgaga

SEQ ID NO: 205434 - DNA, 25 bp, E. coli
tactagttgctgtagaagcccgaga

SEQ ID NO: 205435 - DNA, 25 bp, E. coli
tccatggcaagactaaacacttcgg

SEQ ID NO: 205436 - DNA, 25 bp, E. coli
tccatggcaagagtaaacacttcgg

SEQ ID NO: 205437 - DNA, 25 bp, E. coli
tccgaaagaataccaaatcaggttg

SEQ ID NO: 205438 - DNA, 25 bp, E. coli
tccgaaagaatagcaaatcaggttg

SEQ ID NO: 205439 - DNA, 25 bp, E. coli
gaattaggaccgacaataggccaga

SEQ ID NO: 205440 - DNA, 25 bp, E. coli
gaattaggaccgtcaataggccaga

SEQ ID NO: 205441 - DNA, 25 bp, E. coli
gaaaatttaagagaatgcctgccaa

SEQ ID NO: 205442 - DNA, 25 bp, E. coli
gaaaatttaagacaatgcctgccaa

SEQ ID NO: 205443 - DNA, 25 bp, E. coli
cccactcagggaaggatagcattaa

SEQ ID NO: 205444 - DNA, 25 bp, E. coli
cccactcagggatggatagcattaa

SEQ ID NO: 205445 - DNA, 25 bp, E. coli
gatttttccggctacgaaaggagca

SEQ ID NO: 205446 - DNA, 25 bp, E. coli
gatttttccggcaacgaaaggagca

SEQ ID NO: 205447 - DNA, 25 bp, E. coli
gggttacttggctcaaacgacagaa

SEQ ID NO: 205448 - DNA, 25 bp, E. coli
gggttacttggcacaaacgacagaa

SEQ ID NO: 205449 - DNA, 25 bp, E. coli
gatgatctggagatagcggtactag

SEQ ID NO: 205450 - DNA, 25 bp, E. coli
gatgatctggagttagcggtactag

SEQ ID NO: 205451 - DNA, 25 bp, E. coli
atttgccagggcttctgataaagaa

SEQ ID NO: 205452 - DNA, 25 bp, E. coli
atttgccagggcatctgataaagaa

SEQ ID NO: 205453 - DNA, 25 bp, E. coli
ttctgaaaatgggagcagccgcacc

SEQ ID NO: 205454 - DNA, 25 bp, E. coli
ttctgaaaatggcagcagccgcacc

SEQ ID NO: 205455 - DNA, 25 bp, E. coli
tgtcagctgtttctgaaaatggcag

SEQ ID NO: 205456 - DNA, 25 bp, E. coli
tgacaagaacccgtaatttattatt

SEQ ID NO: 205457 - DNA, 25 bp, E. coli
tgtcagctgtttgtgaaaatggcag

SEQ ID NO: 205458 - DNA, 25 bp, E. coli
tgtttctgaaaaaggcagcagccgc

SEQ ID NO: 205459 - DNA, 25 bp, E. coli
tgacaagaacccctaatttattatt

SEQ ID NO: 205460 - DNA, 25 bp, E. coli
tgtttctgaaaatggcagcagccgc

SEQ ID NO: 205461 - DNA, 25 bp, E. coli
tctgatatgaccactgaaattgctc

SEQ ID NO: 205462 - DNA, 25 bp, E. coli
tctgatatgacctctgaaattgctc

SEQ ID NO: 205463 - DNA, 25 bp, E. coli
tctgataaagaattgactattggcg

SEQ ID NO: 205464 - DNA, 25 bp, E. coli
tctgataaagaaatgactattggcg

SEQ ID NO: 205465 - DNA, 25 bp, E. coli
gccattattttgtcagctgtttctg

SEQ ID NO: 205466 - DNA, 25 bp, E. coli
gccattattttgacagctgtttctg

SEQ ID NO: 205467 - DNA, 25 bp, E. coli
ccagggcttctgttaaagaaatgac

SEQ ID NO: 205468 - DNA, 25 bp, E. coli
ccagggcttctgataaagaaatgac

SEQ ID NO: 205469 - DNA, 25 bp, E. coli
cgatgccattatattgtcagctgtt

SEQ ID NO: 205470 - DNA, 25 bp, E. coli
cgatgccattattttgtcagctgtt

SEQ ID NO: 205471 - DNA, 25 bp, E. coli
gttttcggttctgatatgaccactg

SEQ ID NO: 205472 - DNA, 25 bp, E. coli
gttttcggttctcatatgaccactg

SEQ ID NO: 205473 - DNA, 25 bp, E. coli
tactaataaagctgcgcgcgagatg

SEQ ID NO: 205474 - DNA, 25 bp, E. coli
tactaataaagcagcgcgcgagatg

SEQ ID NO: 205475 - DNA, 25 bp, E. coli
tgatctccactttccatacgttggg

SEQ ID NO: 205476 - DNA, 25 bp, E. coli
tgatctccacttaccatacgttggg

SEQ ID NO: 205477 - DNA, 25 bp, E. coli
tgggtgacgatgtccagtcgatcta

SEQ ID NO: 205478 - DNA, 25 bp, E. coli
tgacgatgaccagtcgatctactcc

SEQ ID NO: 205479 - DNA, 25 bp, E. coli
tgacgatgaccactcgatctactcc

SEQ ID NO: 205480 - DNA, 25 bp, E. coli
gctgctgagtcaggattttccggcg

SEQ ID NO: 205481 - DNA, 25 bp, E. coli
gctgctgagtcacgattttccggcg

SEQ ID NO: 205482 - DNA, 25 bp, E. coli
cttgggatgaaagcgaacttctcgt

SEQ ID NO: 205483 - DNA, 25 bp, E. coli
cgcgctttaccgaggtgggtgacga

SEQ ID NO: 205484 - DNA, 25 bp, E. coli
cttgggatgaaaccgaacttctcgt

SEQ ID NO: 205485 - DNA, 25 bp, E. coli
ctgagtcaggatattccggcgctga

SEQ ID NO: 205486 - DNA, 25 bp, E. coli
cggttatcaggcccggcacattgcg

SEQ ID NO: 205487 - DNA, 25 bp, E. coli
cgcgctttaccgtggtgggtgacga

SEQ ID NO: 205488 - DNA, 25 bp, E. coli
cggttatcaggcgcggcacattgcg

SEQ ID NO: 205489 - DNA, 25 bp, E. coli
ctgagtcaggattttccggcgctga

SEQ ID NO: 205490 - DNA, 25 bp, E. coli
gggctgatgatctccactttccata

SEQ ID NO: 205491 - DNA, 25 bp, E. coli
gggctgatgatcaccactttccata

SEQ ID NO: 205492 - DNA, 25 bp, E. coli
ggcggtgacctttactaataaagca

SEQ ID NO: 205493 - DNA, 25 bp, E. coli
ggcggtgaccttaactaataaagca

SEQ ID NO: 205494 - DNA, 25 bp, E. coli
tgggtgacgatgaccagtcgatcta

SEQ ID NO: 205495 - DNA, 25 bp, E. coli
cactgaaactgtcggcgttaccggg

SEQ ID NO: 205496 - DNA, 25 bp, E. coli
cactgaaactgtgggcgttaccggg

SEQ ID NO: 205497 - DNA, 25 bp, E. coli
catatctggcagtggagggcactga

SEQ ID NO: 205498 - DNA, 25 bp, E. coli
catatctggcagaggagggcactga

SEQ ID NO: 205499 - DNA, 25 bp, E. coli
actgttgatgttttccgcggctggc

SEQ ID NO: 205500 - DNA, 25 bp, E. coli
actgttgatgttatccgcggctggc

SEQ ID NO: 205501 - DNA, 25 bp, E. coli
ttctggatgtattccggcaacggcg

SEQ ID NO: 205502 - DNA, 25 bp, E. coli
ttctggatgtataccggcaacggcg

SEQ ID NO: 205503 - DNA, 25 bp, E. coli
tgtcaatgtgggagcaaccaccacg

SEQ ID NO: 205504 - DNA, 25 bp, E. coli
tgtcaatgtgggtgcaaccaccacg

SEQ ID NO: 205505 - DNA, 25 bp, E. coli
tgacggagccagtgacaaagcgatc

SEQ ID NO: 205506 - DNA, 25 bp, E. coli
tgacggagccagagacaaagcgatc

SEQ ID NO: 205507 - DNA, 25 bp, E. coli
tccactggcaaacacgaaaggtgcg

SEQ ID NO: 205508 - DNA, 25 bp, E. coli
tccactggcaaagacgaaaggtgcg

SEQ ID NO: 205509 - DNA, 25 bp, E. coli
gaacggacttgtggccacggtgaaa

SEQ ID NO: 205510 - DNA, 25 bp, E. coli
gaacggacttgtcgccacggtgaaa

SEQ ID NO: 205511 - DNA, 25 bp, E. coli
gatctgcaacctcgcgaaatgaccg

SEQ ID NO: 205512 - DNA, 25 bp, E. coli
tcaaaagacgtgatgacccgcacag

SEQ ID NO: 205513 - DNA, 25 bp, E. coli
tcaaaagacgtgttgacccgcacag

SEQ ID NO: 205514 - DNA, 25 bp, E. coli
gatgcagactggaaaacgacaaccc

SEQ ID NO: 205515 - DNA, 25 bp, E. coli
gatctgcaacctggcgaaatgaccg

SEQ ID NO: 205516 - DNA, 25 bp, E. coli
gatgcagactggtaaacgacaaccc

SEQ ID NO: 205517 - DNA, 25 bp, E. coli
catgtgttgcactttatcccaggaa

SEQ ID NO: 205518 - DNA, 25 bp, E. coli
catgtgttgcacattatcccaggaa

SEQ ID NO: 205519 - DNA, 25 bp, E. coli
tactacagggagaagggagatgctt

SEQ ID NO: 205520 - DNA, 25 bp, E. coli
tactacagggagtagggagatgctt

SEQ ID NO: 205521 - DNA, 25 bp, E. coli
taaaccgtggctattgcaatacaat

SEQ ID NO: 205522 - DNA, 25 bp, E. coli
tatcccaggaaccttggaggcctaa

SEQ ID NO: 205523 - DNA, 25 bp, E. coli
tatcccaggaacgttggaggcctaa

SEQ ID NO: 205524 - DNA, 25 bp, E. coli
taaaccgtggcttttgcaatacaat

SEQ ID NO: 205525 - DNA, 25 bp, E. coli
aacaacagaggactaaaccgtggct

SEQ ID NO: 205526 - DNA, 25 bp, E. coli
aacaacagaggagtaaaccgtggct

SEQ ID NO: 205527 - DNA, 25 bp, E. coli
tattgagaaaatcagatgacgcctt

SEQ ID NO: 205528 - DNA, 25 bp, E. coli
tattgagaaaatgagatgacgcctt

SEQ ID NO: 205529 - DNA, 25 bp, E. coli
tcttcatatcaaacacagtgcatgt

SEQ ID NO: 205530 - DNA, 25 bp, E. coli
tcttcatatcaatcacagtgcatgt

SEQ ID NO: 205531 - DNA, 25 bp, E. coli
gcaatacaattcttacgcctgtagg

SEQ ID NO: 205532 - DNA, 25 bp, E. coli
gcaatacaattcatacgcctgtagg

SEQ ID NO: 205533 - DNA, 25 bp, E. coli
cgcctgtaggataagtaagaagact

SEQ ID NO: 205534 - DNA, 25 bp, E. coli
cgcctgtaggattagtaagaagact

SEQ ID NO: 205535 - DNA, 25 bp, E. coli
taagaagacttatagtgccaacttg

SEQ ID NO: 205536 - DNA, 25 bp, E. coli
taagaagacttaaagtgccaacttg

SEQ ID NO: 205537 - DNA, 25 bp, E. coli
gagatgcttcattgcaaagggaata

SEQ ID NO: 205538 - DNA, 25 bp, E. coli
gagatgcttcatagcaaagggaata

SEQ ID NO: 205539 - DNA, 25 bp, E. coli
tacgtatcggctctgcaacgacatt

SEQ ID NO: 205540 - DNA, 25 bp, E. coli
tacgtatcggctgtgcaacgacatt

SEQ ID NO: 205541 - DNA, 25 bp, E. coli
tataactcaacgacatctcccggcg

SEQ ID NO: 205542 - DNA, 25 bp, E. coli
tattcataatctcgcggagctgcgg

SEQ ID NO: 205543 - DNA, 25 bp, E. coli
tattcataatctggcggagctgcgg

SEQ ID NO: 205544 - DNA, 25 bp, E. coli
tataactcaacgtcatctcccggcg

SEQ ID NO: 205545 - DNA, 25 bp, E. coli
tgttgatattcataatctggcggag

SEQ ID NO: 205546 - DNA, 25 bp, E. coli
tgttgatattcaaaatctggcggag

SEQ ID NO: 205547 - DNA, 25 bp, E. coli
tccattgctggagcgcagatccgta

SEQ ID NO: 205548 - DNA, 25 bp, E. coli
tccattgctggaccgcagatccgta

SEQ ID NO: 205549 - DNA, 25 bp, E. coli
tcggctctgcaaggacatttaccca

SEQ ID NO: 205550 - DNA, 25 bp, E. coli
tcggctctgcaacgacatttaccca

SEQ ID NO: 205551 - DNA, 25 bp, E. coli
gaagatggctcgctacgtatcggct

SEQ ID NO: 205552 - DNA, 25 bp, E. coli
gaagatggctcggtacgtatcggct

SEQ ID NO: 205553 - DNA, 25 bp, E. coli
cgtcgctacctagggtggaaatatt

SEQ ID NO: 205554 - DNA, 25 bp, E. coli
cgtcgctacctacggtggaaatatt

SEQ ID NO: 205555 - DNA, 25 bp, E. coli
tggaccgcagatccgtaacgtcgct

SEQ ID NO: 205556 - DNA, 25 bp, E. coli
tggaccgcagatgcgtaacgtcgct

SEQ ID NO: 205557 - DNA, 25 bp, E. coli
ggctcgctacgtttcggctctgcaa

SEQ ID NO: 205558 - DNA, 25 bp, E. coli
ggctcgctacgtatcggctctgcaa

SEQ ID NO: 205559 - DNA, 25 bp, E. coli
taacgtcgctacgtacggtggaaat

SEQ ID NO: 205560 - DNA, 25 bp, E. coli
taacgtcgctacctacggtggaaat

SEQ ID NO: 205561 - DNA, 25 bp, E. coli
taaaggctttggaggactgtatgga
